United States Patent 7,888,497 (BIOINFORMATICALLY DETECTABLE GROUP OF NOVEL REGULATORY OLIGONUCLEOTIDES AND USES THEREOF) - sequence listing, part 88

SEQ ID NO: 3716620 - DNA, 21 bp, Homo sapiens
aggccacaccatctcctttca

SEQ ID NO: 3716621 - DNA, 13 bp, Homo sapiens
aggccacctgccc

SEQ ID NO: 3716622 - DNA, 16 bp, Homo sapiens
aggccacctgccccct

SEQ ID NO: 3716623 - DNA, 18 bp, Homo sapiens
aggccagcaaggtggagt

SEQ ID NO: 3716624 - DNA, 20 bp, Homo sapiens
aggccagcaaggtggagtgg

SEQ ID NO: 3716625 - DNA, 16 bp, Homo sapiens
aggccagccccaccca

SEQ ID NO: 3716626 - DNA, 17 bp, Homo sapiens
aggccagctggcagcag

SEQ ID NO: 3716627 - DNA, 18 bp, Homo sapiens
aggccagctggcagcaga

SEQ ID NO: 3716628 - DNA, 12 bp, Homo sapiens
aggccaggctcc

SEQ ID NO: 3716629 - DNA, 22 bp, Homo sapiens
aggccaggctccttcctgtctt

SEQ ID NO: 3716630 - DNA, 16 bp, Homo sapiens
aggccaggggcttttg

SEQ ID NO: 3716631 - DNA, 19 bp, Homo sapiens
aggccatgattcgcccaaa

SEQ ID NO: 3716632 - DNA, 21 bp, Homo sapiens
aggccatgattcgcccaaagc

SEQ ID NO: 3716633 - DNA, 14 bp, Homo sapiens
aggccatgggcctc

SEQ ID NO: 3716634 - DNA, 16 bp, Homo sapiens
aggccatgggcctcct

SEQ ID NO: 3716635 - DNA, 23 bp, Homo sapiens
agtaagatttacccagaatgtca

SEQ ID NO: 3716636 - DNA, 20 bp, Homo sapiens
agtaagccgtgattttcatt

SEQ ID NO: 3716637 - DNA, 14 bp, Homo sapiens
agtaagctgctttt

SEQ ID NO: 3716638 - DNA, 13 bp, Homo sapiens
agtaataaaacat

SEQ ID NO: 3716639 - DNA, 15 bp, Homo sapiens
agtaataaaacatct

SEQ ID NO: 3716640 - DNA, 17 bp, Homo sapiens
agtaataaactgtgttt

SEQ ID NO: 3716641 - DNA, 12 bp, Homo sapiens
agtaatgaattt

SEQ ID NO: 3716642 - DNA, 22 bp, Homo sapiens
agtaatgaatttttatgatatt

SEQ ID NO: 3716643 - DNA, 22 bp, Homo sapiens
agtaattggtccgatctttgac

SEQ ID NO: 3716644 - DNA, 13 bp, Homo sapiens
agtaatttattgt

SEQ ID NO: 3716645 - DNA, 23 bp, Homo sapiens
agtaatttattgtttttccttgt

SEQ ID NO: 3716646 - DNA, 15 bp, Homo sapiens
agtaatttgaggaca

SEQ ID NO: 3716647 - DNA, 14 bp, Homo sapiens
agtacaggcagcac

SEQ ID NO: 3716648 - DNA, 17 bp, Homo sapiens
agtacaggcagcacaga

SEQ ID NO: 3716649 - DNA, 18 bp, Homo sapiens
agtacaggcagcacagag

SEQ ID NO: 3716650 - DNA, 12 bp, Homo sapiens
agtacccacctg

SEQ ID NO: 3716651 - DNA, 17 bp, Homo sapiens
agtacccacctgagctt

SEQ ID NO: 3716652 - DNA, 17 bp, Homo sapiens
agtacctccaagcaagt

SEQ ID NO: 3716653 - DNA, 16 bp, Homo sapiens
agtacctttgctcttg

SEQ ID NO: 3716654 - DNA, 18 bp, Homo sapiens
agtacctttgctcttgca

SEQ ID NO: 3716655 - DNA, 21 bp, Homo sapiens
agtacctttgctcttgcagag

SEQ ID NO: 3716656 - DNA, 22 bp, Homo sapiens
agtactatatctgttttactgc

SEQ ID NO: 3716657 - DNA, 14 bp, Homo sapiens
agtactatgtatca

SEQ ID NO: 3716658 - DNA, 16 bp, Homo sapiens
agtactcctgcaaaat

SEQ ID NO: 3716659 - DNA, 16 bp, Homo sapiens
agtactgtgtacagaa

SEQ ID NO: 3716660 - DNA, 17 bp, Homo sapiens
agtacttctccaccctg

SEQ ID NO: 3716661 - DNA, 21 bp, Homo sapiens
agtacttctccaccctgctct

SEQ ID NO: 3716662 - DNA, 22 bp, Homo sapiens
agtacttctccaccctgctctc

SEQ ID NO: 3716663 - DNA, 17 bp, Homo sapiens
agtagaagtcttagatg

SEQ ID NO: 3716664 - DNA, 21 bp, Homo sapiens
agtagaagtcttagatgtata

SEQ ID NO: 3716665 - DNA, 14 bp, Homo sapiens
agtagaattgattt

SEQ ID NO: 3716666 - DNA, 13 bp, Homo sapiens
agtagacccctgg

SEQ ID NO: 3716667 - DNA, 11 bp, Homo sapiens
agtagagacag

SEQ ID NO: 3716668 - DNA, 12 bp, Homo sapiens
agtagagacagg

SEQ ID NO: 3716669 - DNA, 19 bp, Homo sapiens
agtagagatggggaaagaa

SEQ ID NO: 3716670 - DNA, 14 bp, Homo sapiens
agtagagtcatctc

SEQ ID NO: 3716671 - DNA, 17 bp, Homo sapiens
agtagagtcatctccat

SEQ ID NO: 3716672 - DNA, 20 bp, Homo sapiens
agtagcagtagatgcatgta

SEQ ID NO: 3716673 - DNA, 23 bp, Homo sapiens
agtagcatgagagaattgtatca

SEQ ID NO: 3716674 - DNA, 22 bp, Homo sapiens
agtagccccaacccaaacctgg

SEQ ID NO: 3716675 - DNA, 15 bp, Homo sapiens
agtagccgagagcct

SEQ ID NO: 3716676 - DNA, 17 bp, Homo sapiens
agtagccgagagcctgc

SEQ ID NO: 3716677 - DNA, 18 bp, Homo sapiens
agtagccgagagcctgct

SEQ ID NO: 3716678 - DNA, 14 bp, Homo sapiens
agtagctgggacta

SEQ ID NO: 3716679 - DNA, 20 bp, Homo sapiens
agtagctttccacatttgtc

SEQ ID NO: 3716680 - DNA, 13 bp, Homo sapiens
agtaggtgcttga

SEQ ID NO: 3716681 - DNA, 14 bp, Homo sapiens
agtagtcatttcat

SEQ ID NO: 3716682 - DNA, 15 bp, Homo sapiens
agtatacaagataag

SEQ ID NO: 3716683 - DNA, 15 bp, Homo sapiens
agtatattaaaaatg

SEQ ID NO: 3716684 - DNA, 17 bp, Homo sapiens
agtatatttatataatt

SEQ ID NO: 3716685 - DNA, 18 bp, Homo sapiens
agtatatttatataatta

SEQ ID NO: 3716686 - DNA, 20 bp, Homo sapiens
agtatatttatataattatg

SEQ ID NO: 3716687 - DNA, 13 bp, Homo sapiens
agtatattttctt

SEQ ID NO: 3716688 - DNA, 18 bp, Homo sapiens
agtatattttcttttcct

SEQ ID NO: 3716689 - DNA, 16 bp, Homo sapiens
agtatctaacatgtat

SEQ ID NO: 3716690 - DNA, 18 bp, Homo sapiens
agtatctcctcgcaagct

SEQ ID NO: 3716691 - DNA, 15 bp, Homo sapiens
agtatggtggctggg

SEQ ID NO: 3716692 - DNA, 14 bp, Homo sapiens
agtatgttcaaagt

SEQ ID NO: 3716693 - DNA, 20 bp, Homo sapiens
agtattaaaggggggagggg

SEQ ID NO: 3716694 - DNA, 20 bp, Homo sapiens
agtattataggccaaactgg

SEQ ID NO: 3716695 - DNA, 14 bp, Homo sapiens
agtattccacctta

SEQ ID NO: 3716696 - DNA, 23 bp, Homo sapiens
agtattccaccttaaattaaaca

SEQ ID NO: 3716697 - DNA, 12 bp, Homo sapiens
agtattctgcct

SEQ ID NO: 3716698 - DNA, 16 bp, Homo sapiens
agtatttgcatattct

SEQ ID NO: 3716699 - DNA, 21 bp, Homo sapiens
agtatttttatatttaaatgt

SEQ ID NO: 3716700 - DNA, 17 bp, Homo sapiens
agtcaaaaggtgcctgt

SEQ ID NO: 3716701 - DNA, 21 bp, Homo sapiens
agtcaaagtaaaacttgctgc

SEQ ID NO: 3716702 - DNA, 14 bp, Homo sapiens
agtcaacagtgaaa

SEQ ID NO: 3716703 - DNA, 16 bp, Homo sapiens
agtcaagtgaaaaagg

SEQ ID NO: 3716704 - DNA, 13 bp, Homo sapiens
agtcacaaaggaa

SEQ ID NO: 3716705 - DNA, 23 bp, Homo sapiens
agtcacacagtattacttctgct

SEQ ID NO: 3716706 - DNA, 23 bp, Homo sapiens
agtcacacagtgagtcgaggaca

SEQ ID NO: 3716707 - DNA, 14 bp, Homo sapiens
agtcaccaagccca

SEQ ID NO: 3716708 - DNA, 15 bp, Homo sapiens
agtcaccaagcccag

SEQ ID NO: 3716709 - DNA, 13 bp, Homo sapiens
agtcaccaggaat

SEQ ID NO: 3716710 - DNA, 19 bp, Homo sapiens
agtcaccaggaatgttaaa

SEQ ID NO: 3716711 - DNA, 14 bp, Homo sapiens
agtcaccttttaaa

SEQ ID NO: 3716712 - DNA, 19 bp, Homo sapiens
agtcaccttttaaatcctg

SEQ ID NO: 3716713 - DNA, 13 bp, Homo sapiens
agtcactgcacag

SEQ ID NO: 3716714 - DNA, 23 bp, Homo sapiens
agtcagactggatagtccgtctc

SEQ ID NO: 3716715 - DNA, 23 bp, Homo sapiens
agtcagatgcccagagggcccag

SEQ ID NO: 3716716 - DNA, 22 bp, Homo sapiens
agtcagctttgccttccacgct

SEQ ID NO: 3716717 - DNA, 19 bp, Homo sapiens
agtcagggacccctgccct

SEQ ID NO: 3716718 - DNA, 14 bp, Homo sapiens
agtcatctcaacca

SEQ ID NO: 3716719 - DNA, 18 bp, Homo sapiens
agtcatctccatcagctg

SEQ ID NO: 3716720 - DNA, 20 bp, Homo sapiens
agtcatctccatcagctgta

SEQ ID NO: 3716721 - DNA, 14 bp, Homo sapiens
agtcatgagctgag

SEQ ID NO: 3716722 - DNA, 15 bp, Homo sapiens
agtcatgatctccct

SEQ ID NO: 3716723 - DNA, 17 bp, Homo sapiens
agtcatgatctccctgc

SEQ ID NO: 3716724 - DNA, 13 bp, Homo sapiens
agtcatgtgcatt

SEQ ID NO: 3716725 - DNA, 22 bp, Homo sapiens
agtcattatgagaggcaatgat

SEQ ID NO: 3716726 - DNA, 23 bp, Homo sapiens
agtccaacgtggggcagcacaga

SEQ ID NO: 3716727 - DNA, 17 bp, Homo sapiens
agtccaatgtcttttta

SEQ ID NO: 3716728 - DNA, 18 bp, Homo sapiens
agtccaggccccaaaacc

SEQ ID NO: 3716729 - DNA, 22 bp, Homo sapiens
agtccaggtcgggctcagctct

SEQ ID NO: 3716730 - DNA, 14 bp, Homo sapiens
agtcccaaggaaag

SEQ ID NO: 3716731 - DNA, 15 bp, Homo sapiens
agtcccaccttggct

SEQ ID NO: 3716732 - DNA, 16 bp, Homo sapiens
agtcccaccttggctg

SEQ ID NO: 3716733 - DNA, 20 bp, Homo sapiens
agtcccaccttggctgcagg

SEQ ID NO: 3716734 - DNA, 18 bp, Homo sapiens
agtcccagctactcagga

SEQ ID NO: 3716735 - DNA, 19 bp, Homo sapiens
agtcccagctactcaggag

SEQ ID NO: 3716736 - DNA, 13 bp, Homo sapiens
agtccccaggccc

SEQ ID NO: 3716737 - DNA, 16 bp, Homo sapiens
agtccccctgccccag

SEQ ID NO: 3716738 - DNA, 15 bp, Homo sapiens
agtcccgtcaggacg

SEQ ID NO: 3716739 - DNA, 14 bp, Homo sapiens
agtccctgggggaa

SEQ ID NO: 3716740 - DNA, 20 bp, Homo sapiens
agtccctgggggaagccctg

SEQ ID NO: 3716741 - DNA, 14 bp, Homo sapiens
agtcccttccaggc

SEQ ID NO: 3716742 - DNA, 23 bp, Homo sapiens
agtccgaaagggacttggaagct

SEQ ID NO: 3716743 - DNA, 15 bp, Homo sapiens
agtcctcactcccag

SEQ ID NO: 3716744 - DNA, 13 bp, Homo sapiens
agtcctgcctggc

SEQ ID NO: 3716745 - DNA, 15 bp, Homo sapiens
agtcctgcctggcca

SEQ ID NO: 3716746 - DNA, 21 bp, Homo sapiens
agtcctgcctggccaggcaga

SEQ ID NO: 3716747 - DNA, 19 bp, Homo sapiens
agtcctggctacatcccag

SEQ ID NO: 3716748 - DNA, 13 bp, Homo sapiens
ataaaattatgcc

SEQ ID NO: 3716749 - DNA, 24 bp, Homo sapiens
ataaacacatagattcacctgtaa

SEQ ID NO: 3716750 - DNA, 22 bp, Homo sapiens
ataaacagtggaatataaggaa

SEQ ID NO: 3716751 - DNA, 12 bp, Homo sapiens
ataaagacacct

SEQ ID NO: 3716752 - DNA, 21 bp, Homo sapiens
ataaagagaaaattgaattta

SEQ ID NO: 3716753 - DNA, 20 bp, Homo sapiens
ataaagattatataaagacc

SEQ ID NO: 3716754 - DNA, 20 bp, Homo sapiens
ataaaggttattttctcctg

SEQ ID NO: 3716755 - DNA, 17 bp, Homo sapiens
ataaagtgttttcagag

SEQ ID NO: 3716756 - DNA, 18 bp, Homo sapiens
ataaagtgttttcagagc

SEQ ID NO: 3716757 - DNA, 22 bp, Homo sapiens
ataaagttgaagctaagattta

SEQ ID NO: 3716758 - DNA, 16 bp, Homo sapiens
ataaataaatgcaata

SEQ ID NO: 3716759 - DNA, 15 bp, Homo sapiens
ataaatagctatatc

SEQ ID NO: 3716760 - DNA, 21 bp, Homo sapiens
ataaatagctatatccatgta

SEQ ID NO: 3716761 - DNA, 14 bp, Homo sapiens
ataaatatttatgt

SEQ ID NO: 3716762 - DNA, 14 bp, Homo sapiens
ataaatcaatgtca

SEQ ID NO: 3716763 - DNA, 11 bp, Homo sapiens
ataaatgaatg

SEQ ID NO: 3716764 - DNA, 17 bp, Homo sapiens
ataaatgcaatatgtat

SEQ ID NO: 3716765 - DNA, 22 bp, Homo sapiens
ataaatgcaatatgtattaata

SEQ ID NO: 3716766 - DNA, 15 bp, Homo sapiens
ataaatgtacattaa

SEQ ID NO: 3716767 - DNA, 13 bp, Homo sapiens
ataaatgtatcat

SEQ ID NO: 3716768 - DNA, 21 bp, Homo sapiens
ataaatgtatcatagaaatgt

SEQ ID NO: 3716769 - DNA, 22 bp, Homo sapiens
ataaatgtattcaaataccaat

SEQ ID NO: 3716770 - DNA, 21 bp, Homo sapiens
ataaatgtcattaaaataaat

SEQ ID NO: 3716771 - DNA, 19 bp, Homo sapiens
ataaattaaatatatgtat

SEQ ID NO: 3716772 - DNA, 13 bp, Homo sapiens
ataaattcagata

SEQ ID NO: 3716773 - DNA, 15 bp, Homo sapiens
ataaattccactgga

SEQ ID NO: 3716774 - DNA, 21 bp, Homo sapiens
ataaattctataggaacatat

SEQ ID NO: 3716775 - DNA, 19 bp, Homo sapiens
ataaattgcatgctgcttt

SEQ ID NO: 3716776 - DNA, 16 bp, Homo sapiens
ataaattgctccttga

SEQ ID NO: 3716777 - DNA, 19 bp, Homo sapiens
ataacaagatctttcagga

SEQ ID NO: 3716778 - DNA, 16 bp, Homo sapiens
ataacaatgtgctctc

SEQ ID NO: 3716779 - DNA, 11 bp, Homo sapiens
ataacacacat

SEQ ID NO: 3716780 - DNA, 16 bp, Homo sapiens
ataacagtaaatgtgc

SEQ ID NO: 3716781 - DNA, 19 bp, Homo sapiens
ataacagtcttactgcagg

SEQ ID NO: 3716782 - DNA, 23 bp, Homo sapiens
ataacagtgccattgtctttata

SEQ ID NO: 3716783 - DNA, 15 bp, Homo sapiens
ataacataacaaata

SEQ ID NO: 3716784 - DNA, 20 bp, Homo sapiens
ataacatgtaattaagtact

SEQ ID NO: 3716785 - DNA, 14 bp, Homo sapiens
ataaccaatgttta

SEQ ID NO: 3716786 - DNA, 15 bp, Homo sapiens
ataactactgtgttc

SEQ ID NO: 3716787 - DNA, 16 bp, Homo sapiens
ataactactgtgttcc

SEQ ID NO: 3716788 - DNA, 17 bp, Homo sapiens
ataactcatcataaaat

SEQ ID NO: 3716789 - DNA, 22 bp, Homo sapiens
ataactctgtggcattattgca

SEQ ID NO: 3716790 - DNA, 12 bp, Homo sapiens
ataactgacaaa

SEQ ID NO: 3716791 - DNA, 12 bp, Homo sapiens
ataacttaaaat

SEQ ID NO: 3716792 - DNA, 16 bp, Homo sapiens
ataacttaaaatattt

SEQ ID NO: 3716793 - DNA, 14 bp, Homo sapiens
ataagattcatatt

SEQ ID NO: 3716794 - DNA, 23 bp, Homo sapiens
ataagcaaagggagcactgggtt

SEQ ID NO: 3716795 - DNA, 15 bp, Homo sapiens
ataagcaagagagat

SEQ ID NO: 3716796 - DNA, 17 bp, Homo sapiens
ataagcaagagagatgt

SEQ ID NO: 3716797 - DNA, 16 bp, Homo sapiens
ataagcatcaaactct

SEQ ID NO: 3716798 - DNA, 17 bp, Homo sapiens
ataagcatcaaactctt

SEQ ID NO: 3716799 - DNA, 13 bp, Homo sapiens
ataagctaaagag

SEQ ID NO: 3716800 - DNA, 23 bp, Homo sapiens
ataagcttccaggctgcatagaa

SEQ ID NO: 3716801 - DNA, 20 bp, Homo sapiens
ataaggatcagaacagcaga

SEQ ID NO: 3716802 - DNA, 17 bp, Homo sapiens
ataaggccttaatatgt

SEQ ID NO: 3716803 - DNA, 18 bp, Homo sapiens
ataaggccttaatatgtt

SEQ ID NO: 3716804 - DNA, 22 bp, Homo sapiens
ataagttaactattttattttc

SEQ ID NO: 3716805 - DNA, 12 bp, Homo sapiens
ataataaacttt

SEQ ID NO: 3716806 - DNA, 12 bp, Homo sapiens
ataataaagtat

SEQ ID NO: 3716807 - DNA, 15 bp, Homo sapiens
ataataaattgcatg

SEQ ID NO: 3716808 - DNA, 15 bp, Homo sapiens
ataataagctaaaga

SEQ ID NO: 3716809 - DNA, 12 bp, Homo sapiens
ataataatacaa

SEQ ID NO: 3716810 - DNA, 19 bp, Homo sapiens
ataatacagtatctcaggg

SEQ ID NO: 3716811 - DNA, 13 bp, Homo sapiens
ataatagaagaac

SEQ ID NO: 3716812 - DNA, 14 bp, Homo sapiens
ataatatttttaat

SEQ ID NO: 3716813 - DNA, 13 bp, Homo sapiens
ataatcagcctct

SEQ ID NO: 3716814 - DNA, 15 bp, Homo sapiens
ataatcagcctctta

SEQ ID NO: 3716815 - DNA, 22 bp, Homo sapiens
ataatcggcccacagctcccac

SEQ ID NO: 3716816 - DNA, 19 bp, Homo sapiens
ataatctggactcctctgt

SEQ ID NO: 3716817 - DNA, 20 bp, Homo sapiens
ataatcttgtttctgaaaag

SEQ ID NO: 3716818 - DNA, 13 bp, Homo sapiens
ataatctttgggt

SEQ ID NO: 3716819 - DNA, 15 bp, Homo sapiens
ataatgaatgaaaca

SEQ ID NO: 3716820 - DNA, 22 bp, Homo sapiens
ataatgtataaagaacaaggta

SEQ ID NO: 3716821 - DNA, 10 bp, Homo sapiens
ataatgtctt

SEQ ID NO: 3716822 - DNA, 16 bp, Homo sapiens
ataatgtcttgttaat

SEQ ID NO: 3716823 - DNA, 17 bp, Homo sapiens
ataatgtcttgttaata

SEQ ID NO: 3716824 - DNA, 20 bp, Homo sapiens
ataatgtcttgttaatattc

SEQ ID NO: 3716825 - DNA, 12 bp, Homo sapiens
ataatgttaaca

SEQ ID NO: 3716826 - DNA, 17 bp, Homo sapiens
ataattatccagagttt

SEQ ID NO: 3716827 - DNA, 16 bp, Homo sapiens
ataattatcggaagca

SEQ ID NO: 3716828 - DNA, 20 bp, Homo sapiens
ataattatcggaagcagtgc

SEQ ID NO: 3716829 - DNA, 21 bp, Homo sapiens
ataattatcggaagcagtgcc

SEQ ID NO: 3716830 - DNA, 18 bp, Homo sapiens
ataattatgacagttata

SEQ ID NO: 3716831 - DNA, 18 bp, Homo sapiens
ataattatgttattgaaa

SEQ ID NO: 3716832 - DNA, 22 bp, Homo sapiens
ataattatgttattgaaaaaaa

SEQ ID NO: 3716833 - DNA, 19 bp, Homo sapiens
ataattcttgtatattatg

SEQ ID NO: 3716834 - DNA, 15 bp, Homo sapiens
ataatttaatgcatg

SEQ ID NO: 3716835 - DNA, 18 bp, Homo sapiens
ataatttcccaattagga

SEQ ID NO: 3716836 - DNA, 22 bp, Homo sapiens
ataatttgtacatatgtaaaat

SEQ ID NO: 3716837 - DNA, 13 bp, Homo sapiens
ataattttaagat

SEQ ID NO: 3716838 - DNA, 13 bp, Homo sapiens
ataattttatgaa

SEQ ID NO: 3716839 - DNA, 23 bp, Homo sapiens
ataattttcttcatgcaatgaca

SEQ ID NO: 3716840 - DNA, 19 bp, Homo sapiens
ataatttttaaagtatata

SEQ ID NO: 3716841 - DNA, 21 bp, Homo sapiens
ataatttttaaagtatatatt

SEQ ID NO: 3716842 - DNA, 19 bp, Homo sapiens
atacaaacatatttgttaa

SEQ ID NO: 3716843 - DNA, 16 bp, Homo sapiens
atacaacttaaataat

SEQ ID NO: 3716844 - DNA, 15 bp, Homo sapiens
atacaagataagctt

SEQ ID NO: 3716845 - DNA, 18 bp, Homo sapiens
atacaagataagcttcca

SEQ ID NO: 3716846 - DNA, 20 bp, Homo sapiens
atacaataaactattggaaa

SEQ ID NO: 3716847 - DNA, 15 bp, Homo sapiens
atacaatatcatcca

SEQ ID NO: 3716848 - DNA, 14 bp, Homo sapiens
atacacacacaaag

SEQ ID NO: 3716849 - DNA, 19 bp, Homo sapiens
atacaccagagataatatg

SEQ ID NO: 3716850 - DNA, 13 bp, Homo sapiens
atacacttacact

SEQ ID NO: 3716851 - DNA, 17 bp, Homo sapiens
atacagatgacaatggg

SEQ ID NO: 3716852 - DNA, 18 bp, Homo sapiens
atacagccaaagataatc

SEQ ID NO: 3716853 - DNA, 19 bp, Homo sapiens
atacaggaaaagctgctga

SEQ ID NO: 3716854 - DNA, 16 bp, Homo sapiens
atacaggggaatattt

SEQ ID NO: 3716855 - DNA, 10 bp, Homo sapiens
atacagtagt

SEQ ID NO: 3716856 - DNA, 17 bp, Homo sapiens
atacagtagtgagaaga

SEQ ID NO: 3716857 - DNA, 20 bp, Homo sapiens
atacagtagtgagaagaata

SEQ ID NO: 3716858 - DNA, 15 bp, Homo sapiens
atacagttttcctaa

SEQ ID NO: 3716859 - DNA, 21 bp, Homo sapiens
atacagttttcctaaatgtat

SEQ ID NO: 3716860 - DNA, 13 bp, Homo sapiens
atacatacacata

SEQ ID NO: 3716861 - DNA, 14 bp, Homo sapiens
atacatggataaca

SEQ ID NO: 3716862 - DNA, 14 bp, Homo sapiens
atccctgttcattg

SEQ ID NO: 3716863 - DNA, 12 bp, Homo sapiens
atcctaatgaat

SEQ ID NO: 3716864 - DNA, 13 bp, Homo sapiens
atcctaatgaatg

SEQ ID NO: 3716865 - DNA, 14 bp, Homo sapiens
atcctaccaacctc

SEQ ID NO: 3716866 - DNA, 16 bp, Homo sapiens
atcctatctctccaac

SEQ ID NO: 3716867 - DNA, 15 bp, Homo sapiens
atcctcactgggtgg

SEQ ID NO: 3716868 - DNA, 19 bp, Homo sapiens
atcctcccacctcagcctc

SEQ ID NO: 3716869 - DNA, 20 bp, Homo sapiens
atcctcccacctcagcctcc

SEQ ID NO: 3716870 - DNA, 11 bp, Homo sapiens
atcctcccctt

SEQ ID NO: 3716871 - DNA, 14 bp, Homo sapiens
atcctcgctcccgg

SEQ ID NO: 3716872 - DNA, 16 bp, Homo sapiens
atcctcgctcccggga

SEQ ID NO: 3716873 - DNA, 10 bp, Homo sapiens
atcctctggc

SEQ ID NO: 3716874 - DNA, 14 bp, Homo sapiens
atcctctggctggc

SEQ ID NO: 3716875 - DNA, 24 bp, Homo sapiens
atcctgagccatcggtgaaactaa

SEQ ID NO: 3716876 - DNA, 17 bp, Homo sapiens
atcctggcacccggccc

SEQ ID NO: 3716877 - DNA, 19 bp, Homo sapiens
atcctggcacccggcccct

SEQ ID NO: 3716878 - DNA, 19 bp, Homo sapiens
atcctggctctgtggcttg

SEQ ID NO: 3716879 - DNA, 16 bp, Homo sapiens
atcctggctttgccca

SEQ ID NO: 3716880 - DNA, 20 bp, Homo sapiens
atcctggggcattaaaaaaa

SEQ ID NO: 3716881 - DNA, 22 bp, Homo sapiens
atcctgggtggtctgcaggcag

SEQ ID NO: 3716882 - DNA, 18 bp, Homo sapiens
atcctgtcctcagcttct

SEQ ID NO: 3716883 - DNA, 15 bp, Homo sapiens
atcctgtgtggttta

SEQ ID NO: 3716884 - DNA, 20 bp, Homo sapiens
atcctgtgtggtttagtgta

SEQ ID NO: 3716885 - DNA, 12 bp, Homo sapiens
atccttttctcc

SEQ ID NO: 3716886 - DNA, 15 bp, Homo sapiens
atccttttctgcaga

SEQ ID NO: 3716887 - DNA, 15 bp, Homo sapiens
atcctttttctttat

SEQ ID NO: 3716888 - DNA, 23 bp, Homo sapiens
atcgatgggggagtctgaagcag

SEQ ID NO: 3716889 - DNA, 21 bp, Homo sapiens
atcgatgggggatgcttcatg

SEQ ID NO: 3716890 - DNA, 23 bp, Homo sapiens
atcgatgggggatgcttcatgtg

SEQ ID NO: 3716891 - DNA, 17 bp, Homo sapiens
atcgctccaccttgcag

SEQ ID NO: 3716892 - DNA, 18 bp, Homo sapiens
atcggaagcagtgccttc

SEQ ID NO: 3716893 - DNA, 20 bp, Homo sapiens
atcggaggcttgtcagagct

SEQ ID NO: 3716894 - DNA, 21 bp, Homo sapiens
atcggatctggggctctggga

SEQ ID NO: 3716895 - DNA, 15 bp, Homo sapiens
atcgggaacagtgtt

SEQ ID NO: 3716896 - DNA, 16 bp, Homo sapiens
atcgggagcagtgtct

SEQ ID NO: 3716897 - DNA, 14 bp, Homo sapiens
atcggtcctgtctc

SEQ ID NO: 3716898 - DNA, 22 bp, Homo sapiens
atcgttagtatctaacatgtat

SEQ ID NO: 3716899 - DNA, 21 bp, Homo sapiens
atcgttatgtgtgtatatgta

SEQ ID NO: 3716900 - DNA, 16 bp, Homo sapiens
atcgttctttctagct

SEQ ID NO: 3716901 - DNA, 16 bp, Homo sapiens
atctaaactttaatat

SEQ ID NO: 3716902 - DNA, 17 bp, Homo sapiens
atctaagcctttccata

SEQ ID NO: 3716903 - DNA, 18 bp, Homo sapiens
atctaagcctttccataa

SEQ ID NO: 3716904 - DNA, 18 bp, Homo sapiens
atctaatatgtaacaagc

SEQ ID NO: 3716905 - DNA, 20 bp, Homo sapiens
atctaatatgtaacaagcca

SEQ ID NO: 3716906 - DNA, 16 bp, Homo sapiens
atctaattattttgca

SEQ ID NO: 3716907 - DNA, 16 bp, Homo sapiens
atctagaagaaatgaa

SEQ ID NO: 3716908 - DNA, 14 bp, Homo sapiens
atctagcaaatgtt

SEQ ID NO: 3716909 - DNA, 18 bp, Homo sapiens
atctagcaaatgttatgc

SEQ ID NO: 3716910 - DNA, 13 bp, Homo sapiens
atctagtgcagct

SEQ ID NO: 3716911 - DNA, 17 bp, Homo sapiens
atctagtgcagctgatt

SEQ ID NO: 3716912 - DNA, 19 bp, Homo sapiens
atctagtgcagctgatttt

SEQ ID NO: 3716913 - DNA, 17 bp, Homo sapiens
atctattgggattttct

SEQ ID NO: 3716914 - DNA, 19 bp, Homo sapiens
atctattgggttcattatt

SEQ ID NO: 3716915 - DNA, 12 bp, Homo sapiens
atctattgtaag

SEQ ID NO: 3716916 - DNA, 15 bp, Homo sapiens
atctattgtaagata

SEQ ID NO: 3716917 - DNA, 17 bp, Homo sapiens
atctattgtaagataaa

SEQ ID NO: 3716918 - DNA, 15 bp, Homo sapiens
atctatttctgagaa

SEQ ID NO: 3716919 - DNA, 12 bp, Homo sapiens
atctatttgtat

SEQ ID NO: 3716920 - DNA, 22 bp, Homo sapiens
atctatttgtatatatacataa

SEQ ID NO: 3716921 - DNA, 14 bp, Homo sapiens
atctcaaataacta

SEQ ID NO: 3716922 - DNA, 21 bp, Homo sapiens
atctcaaataactaaaaggta

SEQ ID NO: 3716923 - DNA, 22 bp, Homo sapiens
atctcaataaagtgctttaaaa

SEQ ID NO: 3716924 - DNA, 15 bp, Homo sapiens
atctcacagcacact

SEQ ID NO: 3716925 - DNA, 22 bp, Homo sapiens
atctcaccccatcccacaccct

SEQ ID NO: 3716926 - DNA, 23 bp, Homo sapiens
atctcaccccatcccacaccctg

SEQ ID NO: 3716927 - DNA, 11 bp, Homo sapiens
atctcagccca

SEQ ID NO: 3716928 - DNA, 23 bp, Homo sapiens
atctcagggaagcccagctccag

SEQ ID NO: 3716929 - DNA, 21 bp, Homo sapiens
atctccagggagcaagacaga

SEQ ID NO: 3716930 - DNA, 12 bp, Homo sapiens
atctccctgccg

SEQ ID NO: 3716931 - DNA, 13 bp, Homo sapiens
atctcctattttt

SEQ ID NO: 3716932 - DNA, 18 bp, Homo sapiens
atctcctatttttttaaa

SEQ ID NO: 3716933 - DNA, 22 bp, Homo sapiens
atctcctatttttttaaaatca

SEQ ID NO: 3716934 - DNA, 13 bp, Homo sapiens
atctcctcactga

SEQ ID NO: 3716935 - DNA, 20 bp, Homo sapiens
atctcctcgcaagctgggta

SEQ ID NO: 3716936 - DNA, 20 bp, Homo sapiens
atctcctgaggatcagaaag

SEQ ID NO: 3716937 - DNA, 21 bp, Homo sapiens
atctcctgaggatcagaaagt

SEQ ID NO: 3716938 - DNA, 18 bp, Homo sapiens
atctcctgtgcatgggtg

SEQ ID NO: 3716939 - DNA, 20 bp, Homo sapiens
atctctactaccacaaggaa

SEQ ID NO: 3716940 - DNA, 21 bp, Homo sapiens
atctctagaattttaagtgct

SEQ ID NO: 3716941 - DNA, 15 bp, Homo sapiens
atctctccctcccct

SEQ ID NO: 3716942 - DNA, 22 bp, Homo sapiens
atctctctactcctacctcagc

SEQ ID NO: 3716943 - DNA, 17 bp, Homo sapiens
atctctgaacttcagct

SEQ ID NO: 3716944 - DNA, 16 bp, Homo sapiens
atctctgctttggaaa

SEQ ID NO: 3716945 - DNA, 17 bp, Homo sapiens
atctctgtctaccatct

SEQ ID NO: 3716946 - DNA, 15 bp, Homo sapiens
atctctgtgtgcaca

SEQ ID NO: 3716947 - DNA, 16 bp, Homo sapiens
atctcttattttacaa

SEQ ID NO: 3716948 - DNA, 19 bp, Homo sapiens
atctcttattttacaataa

SEQ ID NO: 3716949 - DNA, 21 bp, Homo sapiens
atctgaagagctattatataa

SEQ ID NO: 3716950 - DNA, 13 bp, Homo sapiens
atctgactgcacg

SEQ ID NO: 3716951 - DNA, 18 bp, Homo sapiens
atctgatgcaagcaagaa

SEQ ID NO: 3716952 - DNA, 15 bp, Homo sapiens
atctgcacccccctg

SEQ ID NO: 3716953 - DNA, 21 bp, Homo sapiens
atctgcaccctcgatgaagcc

SEQ ID NO: 3716954 - DNA, 15 bp, Homo sapiens
atctgcatttagcac

SEQ ID NO: 3716955 - DNA, 16 bp, Homo sapiens
atctgcatttagcaca

SEQ ID NO: 3716956 - DNA, 23 bp, Homo sapiens
atctgcattttcaccccaccctt

SEQ ID NO: 3716957 - DNA, 23 bp, Homo sapiens
atctgcattttctgggttctggg

SEQ ID NO: 3716958 - DNA, 13 bp, Homo sapiens
atctgctatgctt

SEQ ID NO: 3716959 - DNA, 16 bp, Homo sapiens
atctgggaactcccaa

SEQ ID NO: 3716960 - DNA, 17 bp, Homo sapiens
atctgtacttcttcgat

SEQ ID NO: 3716961 - DNA, 14 bp, Homo sapiens
atctgtatatacaa

SEQ ID NO: 3716962 - DNA, 12 bp, Homo sapiens
atctgtcatttg

SEQ ID NO: 3716963 - DNA, 23 bp, Homo sapiens
atctgtccaaaggaggctggcag

SEQ ID NO: 3716964 - DNA, 14 bp, Homo sapiens
atctgtctggaggg

SEQ ID NO: 3716965 - DNA, 14 bp, Homo sapiens
atctgtgcaataaa

SEQ ID NO: 3716966 - DNA, 20 bp, Homo sapiens
atctgtgcaataaaataaca

SEQ ID NO: 3716967 - DNA, 13 bp, Homo sapiens
atctgtgccccat

SEQ ID NO: 3716968 - DNA, 21 bp, Homo sapiens
atctgtgtttttgaaatatta

SEQ ID NO: 3716969 - DNA, 21 bp, Homo sapiens
atctgttgtgtacgtggagag

SEQ ID NO: 3716970 - DNA, 21 bp, Homo sapiens
atctgtttaaagtagattaga

SEQ ID NO: 3716971 - DNA, 14 bp, Homo sapiens
atctgttttactgc

SEQ ID NO: 3716972 - DNA, 18 bp, Homo sapiens
atctgtttttaaaaatca

SEQ ID NO: 3716973 - DNA, 19 bp, Homo sapiens
atcttaaagtgtgtttcta

SEQ ID NO: 3716974 - DNA, 12 bp, Homo sapiens
atcttaactctt

SEQ ID NO: 3716975 - DNA, 14 bp, Homo sapiens
attaatattttaat

SEQ ID NO: 3716976 - DNA, 14 bp, Homo sapiens
attaattaaatgca

SEQ ID NO: 3716977 - DNA, 12 bp, Homo sapiens
attacagagagg

SEQ ID NO: 3716978 - DNA, 19 bp, Homo sapiens
attacagagaggagaaaca

SEQ ID NO: 3716979 - DNA, 19 bp, Homo sapiens
attacagatgggcaaatta

SEQ ID NO: 3716980 - DNA, 15 bp, Homo sapiens
attacagctggagaa

SEQ ID NO: 3716981 - DNA, 16 bp, Homo sapiens
attacaggtgtgaacc

SEQ ID NO: 3716982 - DNA, 21 bp, Homo sapiens
attacatatttgcatatgtat

SEQ ID NO: 3716983 - DNA, 17 bp, Homo sapiens
attacatccttgtggca

SEQ ID NO: 3716984 - DNA, 15 bp, Homo sapiens
attacatctttcaca

SEQ ID NO: 3716985 - DNA, 22 bp, Homo sapiens
attacatctttcacattggcta

SEQ ID NO: 3716986 - DNA, 19 bp, Homo sapiens
attacatgtaaaacattat

SEQ ID NO: 3716987 - DNA, 22 bp, Homo sapiens
attacattccttgataatgttg

SEQ ID NO: 3716988 - DNA, 12 bp, Homo sapiens
attaccactgaa

SEQ ID NO: 3716989 - DNA, 22 bp, Homo sapiens
attaccactgaagatagaagaa

SEQ ID NO: 3716990 - DNA, 21 bp, Homo sapiens
attaccagtaaagtgtaacat

SEQ ID NO: 3716991 - DNA, 22 bp, Homo sapiens
attaccccctcattgtttatta

SEQ ID NO: 3716992 - DNA, 16 bp, Homo sapiens
attacccttctttcca

SEQ ID NO: 3716993 - DNA, 21 bp, Homo sapiens
attacctagtagtcatttcat

SEQ ID NO: 3716994 - DNA, 19 bp, Homo sapiens
attactcttgtaagatttt

SEQ ID NO: 3716995 - DNA, 15 bp, Homo sapiens
attactgtcaataaa

SEQ ID NO: 3716996 - DNA, 15 bp, Homo sapiens
attacttatttttga

SEQ ID NO: 3716997 - DNA, 16 bp, Homo sapiens
attacttatttttgac

SEQ ID NO: 3716998 - DNA, 14 bp, Homo sapiens
attacttctgctac

SEQ ID NO: 3716999 - DNA, 15 bp, Homo sapiens
attagaaataaagca

SEQ ID NO: 3717000 - DNA, 19 bp, Homo sapiens
attagactttagaaataaa

SEQ ID NO: 3717001 - DNA, 20 bp, Homo sapiens
attagactttagaaataaat

SEQ ID NO: 3717002 - DNA, 21 bp, Homo sapiens
attagagggaggagaatgagc

SEQ ID NO: 3717003 - DNA, 21 bp, Homo sapiens
attagattatattgagacaaa

SEQ ID NO: 3717004 - DNA, 17 bp, Homo sapiens
attagcagtttgctttg

SEQ ID NO: 3717005 - DNA, 19 bp, Homo sapiens
attagcatttgtcaacaaa

SEQ ID NO: 3717006 - DNA, 18 bp, Homo sapiens
attagccgggcatggtgg

SEQ ID NO: 3717007 - DNA, 20 bp, Homo sapiens
attagctttactgtttgtta

SEQ ID NO: 3717008 - DNA, 22 bp, Homo sapiens
attaggggttgctaagaagcga

SEQ ID NO: 3717009 - DNA, 19 bp, Homo sapiens
attaggttaactatgtaca

SEQ ID NO: 3717010 - DNA, 20 bp, Homo sapiens
attagttgtgtactctggcc

SEQ ID NO: 3717011 - DNA, 21 bp, Homo sapiens
attataactgaaggagaaggt

SEQ ID NO: 3717012 - DNA, 15 bp, Homo sapiens
attataacttaaaat

SEQ ID NO: 3717013 - DNA, 17 bp, Homo sapiens
attataaggactgcatg

SEQ ID NO: 3717014 - DNA, 17 bp, Homo sapiens
attatactaagaaaaga

SEQ ID NO: 3717015 - DNA, 19 bp, Homo sapiens
attatactaagaaaagata

SEQ ID NO: 3717016 - DNA, 14 bp, Homo sapiens
attatagtgtagaa

SEQ ID NO: 3717017 - DNA, 14 bp, Homo sapiens
attatattgagaca

SEQ ID NO: 3717018 - DNA, 17 bp, Homo sapiens
attatattgagacaaaa

SEQ ID NO: 3717019 - DNA, 14 bp, Homo sapiens
attatcaagctaat

SEQ ID NO: 3717020 - DNA, 17 bp, Homo sapiens
attatcggaagcagtgc

SEQ ID NO: 3717021 - DNA, 19 bp, Homo sapiens
attatcggaagcagtgcct

SEQ ID NO: 3717022 - DNA, 21 bp, Homo sapiens
attatcggaagcagtgccttc

SEQ ID NO: 3717023 - DNA, 16 bp, Homo sapiens
attatcgggagcagtg

SEQ ID NO: 3717024 - DNA, 20 bp, Homo sapiens
attatcgggagcagtgtctt

SEQ ID NO: 3717025 - DNA, 21 bp, Homo sapiens
attatgactgttttttaaact

SEQ ID NO: 3717026 - DNA, 14 bp, Homo sapiens
attatgcaaattcc

SEQ ID NO: 3717027 - DNA, 21 bp, Homo sapiens
attatgcaggggcaaacacct

SEQ ID NO: 3717028 - DNA, 21 bp, Homo sapiens
attattacttatttttgacag

SEQ ID NO: 3717029 - DNA, 21 bp, Homo sapiens
attattagtaagaaaacatca

SEQ ID NO: 3717030 - DNA, 20 bp, Homo sapiens
attattcaccatgtaaaaca

SEQ ID NO: 3717031 - DNA, 22 bp, Homo sapiens
attattccctgtacaatattta

SEQ ID NO: 3717032 - DNA, 12 bp, Homo sapiens
attattgcatta

SEQ ID NO: 3717033 - DNA, 14 bp, Homo sapiens
attattttaaatta

SEQ ID NO: 3717034 - DNA, 14 bp, Homo sapiens
attcaaaaatgtac

SEQ ID NO: 3717035 - DNA, 16 bp, Homo sapiens
attcaaaaatgtacaa

SEQ ID NO: 3717036 - DNA, 16 bp, Homo sapiens
attcaagaaagccagt

SEQ ID NO: 3717037 - DNA, 23 bp, Homo sapiens
attcaagaaagccagtcttaaca

SEQ ID NO: 3717038 - DNA, 17 bp, Homo sapiens
attcaaggtaaaattct

SEQ ID NO: 3717039 - DNA, 19 bp, Homo sapiens
attcaaggtaaaattctaa

SEQ ID NO: 3717040 - DNA, 13 bp, Homo sapiens
attcaataagcat

SEQ ID NO: 3717041 - DNA, 22 bp, Homo sapiens
attcaatgtttatgcaaggaag

SEQ ID NO: 3717042 - DNA, 14 bp, Homo sapiens
attcaattcctctg

SEQ ID NO: 3717043 - DNA, 22 bp, Homo sapiens
attcaattttctttaaccagtc

SEQ ID NO: 3717044 - DNA, 16 bp, Homo sapiens
attcacaagctgcctc

SEQ ID NO: 3717045 - DNA, 13 bp, Homo sapiens
attcacaatagaa

SEQ ID NO: 3717046 - DNA, 14 bp, Homo sapiens
attcacccagacag

SEQ ID NO: 3717047 - DNA, 16 bp, Homo sapiens
attcacctgtaaaact

SEQ ID NO: 3717048 - DNA, 18 bp, Homo sapiens
attcacctgtaaaacttt

SEQ ID NO: 3717049 - DNA, 14 bp, Homo sapiens
attcagctctgcaa

SEQ ID NO: 3717050 - DNA, 18 bp, Homo sapiens
attcagctctgcaagaat

SEQ ID NO: 3717051 - DNA, 18 bp, Homo sapiens
attcaggaacctggacca

SEQ ID NO: 3717052 - DNA, 19 bp, Homo sapiens
attcagtaataactctacc

SEQ ID NO: 3717053 - DNA, 21 bp, Homo sapiens
attcagtgagggtcttcttac

SEQ ID NO: 3717054 - DNA, 17 bp, Homo sapiens
attcagtgctgtggcct

SEQ ID NO: 3717055 - DNA, 14 bp, Homo sapiens
attcagtgcttctt

SEQ ID NO: 3717056 - DNA, 15 bp, Homo sapiens
attcagttaagaaaa

SEQ ID NO: 3717057 - DNA, 18 bp, Homo sapiens
attcagttaagaaaaaaa

SEQ ID NO: 3717058 - DNA, 14 bp, Homo sapiens
attcatatttactt

SEQ ID NO: 3717059 - DNA, 19 bp, Homo sapiens
attcatatttacttcttat

SEQ ID NO: 3717060 - DNA, 20 bp, Homo sapiens
attcatatttacttcttata

SEQ ID NO: 3717061 - DNA, 12 bp, Homo sapiens
attcatgtttct

SEQ ID NO: 3717062 - DNA, 15 bp, Homo sapiens
attcatgtttcttaa

SEQ ID NO: 3717063 - DNA, 16 bp, Homo sapiens
attcattgtataaaaa

SEQ ID NO: 3717064 - DNA, 20 bp, Homo sapiens
attcattgtggttattttta

SEQ ID NO: 3717065 - DNA, 16 bp, Homo sapiens
attccacctgcaatca

SEQ ID NO: 3717066 - DNA, 16 bp, Homo sapiens
attccaccttaaatta

SEQ ID NO: 3717067 - DNA, 17 bp, Homo sapiens
attccaccttaaattaa

SEQ ID NO: 3717068 - DNA, 19 bp, Homo sapiens
attccaccttaaattaaac

SEQ ID NO: 3717069 - DNA, 23 bp, Homo sapiens
attccaccttaaattaaacaatt

SEQ ID NO: 3717070 - DNA, 18 bp, Homo sapiens
attccagagacatcagca

SEQ ID NO: 3717071 - DNA, 21 bp, Homo sapiens
attccagagagtggctcctcc

SEQ ID NO: 3717072 - DNA, 12 bp, Homo sapiens
attccaggctcc

SEQ ID NO: 3717073 - DNA, 20 bp, Homo sapiens
attccataattccatatgct

SEQ ID NO: 3717074 - DNA, 19 bp, Homo sapiens
attccatagtatattaaaa

SEQ ID NO: 3717075 - DNA, 16 bp, Homo sapiens
attccatgaatgtatc

SEQ ID NO: 3717076 - DNA, 16 bp, Homo sapiens
attccatgtgcccagt

SEQ ID NO: 3717077 - DNA, 14 bp, Homo sapiens
attcccaagctctg

SEQ ID NO: 3717078 - DNA, 15 bp, Homo sapiens
attcccaagctctgc

SEQ ID NO: 3717079 - DNA, 16 bp, Homo sapiens
attcccaagctctgct

SEQ ID NO: 3717080 - DNA, 17 bp, Homo sapiens
attcccaagctctgctc

SEQ ID NO: 3717081 - DNA, 19 bp, Homo sapiens
attcccaagctctgctcct

SEQ ID NO: 3717082 - DNA, 12 bp, Homo sapiens
attcccagagac

SEQ ID NO: 3717083 - DNA, 16 bp, Homo sapiens
attcccagagacagga

SEQ ID NO: 3717084 - DNA, 12 bp, Homo sapiens
attcccagccca

SEQ ID NO: 3717085 - DNA, 23 bp, Homo sapiens
attcccattttgcaaaatttcca

SEQ ID NO: 3717086 - DNA, 14 bp, Homo sapiens
attccccagcctct

SEQ ID NO: 3717087 - DNA, 20 bp, Homo sapiens
attccccagcctctcttcct

SEQ ID NO: 3717088 - DNA, 21 bp, Homo sapiens
attttcttgatgactggaatt

SEQ ID NO: 3717089 - DNA, 16 bp, Homo sapiens
attttctttctgtaac

SEQ ID NO: 3717090 - DNA, 15 bp, Homo sapiens
attttctttgaaatt

SEQ ID NO: 3717091 - DNA, 23 bp, Homo sapiens
attttctttgtgtagctttgctc

SEQ ID NO: 3717092 - DNA, 16 bp, Homo sapiens
attttcttttgtaaat

SEQ ID NO: 3717093 - DNA, 17 bp, Homo sapiens
attttcttttgtaaatg

SEQ ID NO: 3717094 - DNA, 19 bp, Homo sapiens
attttcttttgtaaatgtt

SEQ ID NO: 3717095 - DNA, 19 bp, Homo sapiens
attttgaaaactacatttt

SEQ ID NO: 3717096 - DNA, 15 bp, Homo sapiens
attttgaagctaatt

SEQ ID NO: 3717097 - DNA, 20 bp, Homo sapiens
attttgaataaataaatgta

SEQ ID NO: 3717098 - DNA, 18 bp, Homo sapiens
attttgcaaaatttccag

SEQ ID NO: 3717099 - DNA, 19 bp, Homo sapiens
attttgcaaaatttccagt

SEQ ID NO: 3717100 - DNA, 12 bp, Homo sapiens
attttgcataaa

SEQ ID NO: 3717101 - DNA, 16 bp, Homo sapiens
attttgcatttgaata

SEQ ID NO: 3717102 - DNA, 18 bp, Homo sapiens
attttggtccaagttgtg

SEQ ID NO: 3717103 - DNA, 10 bp, Homo sapiens
attttgtaaa

SEQ ID NO: 3717104 - DNA, 19 bp, Homo sapiens
attttgtaaactcaaaata

SEQ ID NO: 3717105 - DNA, 13 bp, Homo sapiens
attttgtaaaggt

SEQ ID NO: 3717106 - DNA, 12 bp, Homo sapiens
attttgtaattt

SEQ ID NO: 3717107 - DNA, 16 bp, Homo sapiens
attttgtaattttctt

SEQ ID NO: 3717108 - DNA, 23 bp, Homo sapiens
attttgtcatataagattcatat

SEQ ID NO: 3717109 - DNA, 19 bp, Homo sapiens
attttgtgcccccatgtaa

SEQ ID NO: 3717110 - DNA, 14 bp, Homo sapiens
attttgtttttaaa

SEQ ID NO: 3717111 - DNA, 17 bp, Homo sapiens
atttttaaagtatatat

SEQ ID NO: 3717112 - DNA, 21 bp, Homo sapiens
atttttaagcaaaatattatt

SEQ ID NO: 3717113 - DNA, 14 bp, Homo sapiens
atttttacagaatt

SEQ ID NO: 3717114 - DNA, 22 bp, Homo sapiens
atttttacagaattgcttgttt

SEQ ID NO: 3717115 - DNA, 20 bp, Homo sapiens
atttttagatggttacactg

SEQ ID NO: 3717116 - DNA, 13 bp, Homo sapiens
atttttatacagt

SEQ ID NO: 3717117 - DNA, 16 bp, Homo sapiens
atttttatacagtagt

SEQ ID NO: 3717118 - DNA, 14 bp, Homo sapiens
atttttatatagct

SEQ ID NO: 3717119 - DNA, 14 bp, Homo sapiens
atttttatatttaa

SEQ ID NO: 3717120 - DNA, 16 bp, Homo sapiens
atttttattaaattat

SEQ ID NO: 3717121 - DNA, 14 bp, Homo sapiens
atttttattatgca

SEQ ID NO: 3717122 - DNA, 20 bp, Homo sapiens
atttttattatgcataactg

SEQ ID NO: 3717123 - DNA, 14 bp, Homo sapiens
atttttatttatat

SEQ ID NO: 3717124 - DNA, 14 bp, Homo sapiens
atttttcagatgct

SEQ ID NO: 3717125 - DNA, 11 bp, Homo sapiens
atttttcttcc

SEQ ID NO: 3717126 - DNA, 14 bp, Homo sapiens
atttttgaaaaggc

SEQ ID NO: 3717127 - DNA, 15 bp, Homo sapiens
atttttggattgaca

SEQ ID NO: 3717128 - DNA, 19 bp, Homo sapiens
atttttggattgacagtaa

SEQ ID NO: 3717129 - DNA, 22 bp, Homo sapiens
atttttgtttcttccaaagcac

SEQ ID NO: 3717130 - DNA, 13 bp, Homo sapiens
atttttgtttgtt

SEQ ID NO: 3717131 - DNA, 14 bp, Homo sapiens
atttttgtttgttt

SEQ ID NO: 3717132 - DNA, 15 bp, Homo sapiens
attttttaaaaagca

SEQ ID NO: 3717133 - DNA, 15 bp, Homo sapiens
attttttaataaccc

SEQ ID NO: 3717134 - DNA, 15 bp, Homo sapiens
attttttaattatta

SEQ ID NO: 3717135 - DNA, 20 bp, Homo sapiens
attttttaattattatttat

SEQ ID NO: 3717136 - DNA, 19 bp, Homo sapiens
attttttacagctgcctgc

SEQ ID NO: 3717137 - DNA, 13 bp, Homo sapiens
attttttatacag

SEQ ID NO: 3717138 - DNA, 22 bp, Homo sapiens
atttttttaaaatcactaacat

SEQ ID NO: 3717139 - DNA, 13 bp, Homo sapiens
atttttttaagtc

SEQ ID NO: 3717140 - DNA, 15 bp, Homo sapiens
atttttttaagtctt

SEQ ID NO: 3717141 - DNA, 16 bp, Homo sapiens
atttttttgagacaga

SEQ ID NO: 3717142 - DNA, 23 bp, Homo sapiens
atttttttttagaacagaaaaca

SEQ ID NO: 3717143 - DNA, 18 bp, Homo sapiens
caaaaaacaatatttatt

SEQ ID NO: 3717144 - DNA, 22 bp, Homo sapiens
caaaaaacaatatttattgtat

SEQ ID NO: 3717145 - DNA, 14 bp, Homo sapiens
caaaaacagcctca

SEQ ID NO: 3717146 - DNA, 15 bp, Homo sapiens
caaaaacagcctcac

SEQ ID NO: 3717147 - DNA, 13 bp, Homo sapiens
caaaaagcttccc

SEQ ID NO: 3717148 - DNA, 14 bp, Homo sapiens
caaaaatactctaa

SEQ ID NO: 3717149 - DNA, 19 bp, Homo sapiens
caaaaatgaaagcatgtct

SEQ ID NO: 3717150 - DNA, 19 bp, Homo sapiens
caaaaatgtacaaaataaa

SEQ ID NO: 3717151 - DNA, 22 bp, Homo sapiens
caaaaatgtacaaaataaagtt

SEQ ID NO: 3717152 - DNA, 17 bp, Homo sapiens
caaaaattagccgggcg

SEQ ID NO: 3717153 - DNA, 20 bp, Homo sapiens
caaaaattatctatttgtat

SEQ ID NO: 3717154 - DNA, 21 bp, Homo sapiens
caaaaattatctatttgtata

SEQ ID NO: 3717155 - DNA, 17 bp, Homo sapiens
caaaaattcacaagctg

SEQ ID NO: 3717156 - DNA, 13 bp, Homo sapiens
caaaaatttgaac

SEQ ID NO: 3717157 - DNA, 20 bp, Homo sapiens
caaaaatttggaattctgtt

SEQ ID NO: 3717158 - DNA, 18 bp, Homo sapiens
caaaaatttttggattga

SEQ ID NO: 3717159 - DNA, 21 bp, Homo sapiens
caaaaatttttggattgacag

SEQ ID NO: 3717160 - DNA, 22 bp, Homo sapiens
caaaaatttttggattgacagt

SEQ ID NO: 3717161 - DNA, 16 bp, Homo sapiens
caaaacacttgtaatt

SEQ ID NO: 3717162 - DNA, 22 bp, Homo sapiens
caaaacatgctacctgatccca

SEQ ID NO: 3717163 - DNA, 16 bp, Homo sapiens
caaaaccacagccctg

SEQ ID NO: 3717164 - DNA, 15 bp, Homo sapiens
caaaaccattgcttc

SEQ ID NO: 3717165 - DNA, 23 bp, Homo sapiens
caaaacgcatggagtgtgtattg

SEQ ID NO: 3717166 - DNA, 19 bp, Homo sapiens
caaaagaacaagaatttct

SEQ ID NO: 3717167 - DNA, 21 bp, Homo sapiens
caaaagatgtatccttccaat

SEQ ID NO: 3717168 - DNA, 15 bp, Homo sapiens
caaaagggacatgaa

SEQ ID NO: 3717169 - DNA, 22 bp, Homo sapiens
caaaagggtttaaactgattca

SEQ ID NO: 3717170 - DNA, 13 bp, Homo sapiens
caaaaggtgcctg

SEQ ID NO: 3717171 - DNA, 15 bp, Homo sapiens
caaaaggtgcctgtg

SEQ ID NO: 3717172 - DNA, 20 bp, Homo sapiens
caaaaggttaataaagtaat

SEQ ID NO: 3717173 - DNA, 19 bp, Homo sapiens
caaaataaagttacattgc

SEQ ID NO: 3717174 - DNA, 15 bp, Homo sapiens
caaaataatgtcttg

SEQ ID NO: 3717175 - DNA, 20 bp, Homo sapiens
caaaataatgtcttgttaat

SEQ ID NO: 3717176 - DNA, 21 bp, Homo sapiens
caaaataatgtcttgttaata

SEQ ID NO: 3717177 - DNA, 14 bp, Homo sapiens
caaaatatgttctt

SEQ ID NO: 3717178 - DNA, 19 bp, Homo sapiens
caaaatatgttgatgaaaa

SEQ ID NO: 3717179 - DNA, 16 bp, Homo sapiens
caaaatatttgtacat

SEQ ID NO: 3717180 - DNA, 17 bp, Homo sapiens
caaaatatttgtacata

SEQ ID NO: 3717181 - DNA, 21 bp, Homo sapiens
caaaatctgtccaaaggaggc

SEQ ID NO: 3717182 - DNA, 18 bp, Homo sapiens
caaaatggaattcattct

SEQ ID NO: 3717183 - DNA, 22 bp, Homo sapiens
caaaatgtctgtagctcctcaa

SEQ ID NO: 3717184 - DNA, 16 bp, Homo sapiens
caaaattatttcagaa

SEQ ID NO: 3717185 - DNA, 23 bp, Homo sapiens
caaaattgggaaaggagtagaaa

SEQ ID NO: 3717186 - DNA, 19 bp, Homo sapiens
caaaatttccagtaccttt

SEQ ID NO: 3717187 - DNA, 14 bp, Homo sapiens
caaaatttgaaatt

SEQ ID NO: 3717188 - DNA, 23 bp, Homo sapiens
caaaattttatagctcagtttat

SEQ ID NO: 3717189 - DNA, 13 bp, Homo sapiens
caaacaaagccag

SEQ ID NO: 3717190 - DNA, 14 bp, Homo sapiens
caaacaaagccaga

SEQ ID NO: 3717191 - DNA, 16 bp, Homo sapiens
caaacaaagccagaag

SEQ ID NO: 3717192 - DNA, 15 bp, Homo sapiens
caaacacctcccagg

SEQ ID NO: 3717193 - DNA, 22 bp, Homo sapiens
caaacacctgctgatgtggcaa

SEQ ID NO: 3717194 - DNA, 13 bp, Homo sapiens
caaacagccacac

SEQ ID NO: 3717195 - DNA, 16 bp, Homo sapiens
caaacagctcaggctg

SEQ ID NO: 3717196 - DNA, 18 bp, Homo sapiens
caaacatcagacctgtct

SEQ ID NO: 3717197 - DNA, 18 bp, Homo sapiens
caaacatgtggttaatgc

SEQ ID NO: 3717198 - DNA, 14 bp, Homo sapiens
caaacatttcaaag

SEQ ID NO: 3717199 - DNA, 13 bp, Homo sapiens
caaacccatgagg

SEQ ID NO: 3717200 - DNA, 18 bp, Homo sapiens
caaacctccaaaagccct

SEQ ID NO: 3717201 - DNA, 23 bp, Homo sapiens
caatgctggctgttggctggggg

SEQ ID NO: 3717202 - DNA, 21 bp, Homo sapiens
caatgctttgcccctgagaca

SEQ ID NO: 3717203 - DNA, 14 bp, Homo sapiens
caatggaagatttg

SEQ ID NO: 3717204 - DNA, 20 bp, Homo sapiens
caatggagactgtctcaaga

SEQ ID NO: 3717205 - DNA, 23 bp, Homo sapiens
caatggagtagacccctggctgg

SEQ ID NO: 3717206 - DNA, 13 bp, Homo sapiens
caatggcagcctt

SEQ ID NO: 3717207 - DNA, 16 bp, Homo sapiens
caatggcagccttggc

SEQ ID NO: 3717208 - DNA, 21 bp, Homo sapiens
caatgggagcctcataaagat

SEQ ID NO: 3717209 - DNA, 18 bp, Homo sapiens
caatggtttgcaaggaag

SEQ ID NO: 3717210 - DNA, 20 bp, Homo sapiens
caatggtttgcaaggaagcc

SEQ ID NO: 3717211 - DNA, 13 bp, Homo sapiens
caatgtgccccca

SEQ ID NO: 3717212 - DNA, 13 bp, Homo sapiens
caatgtgctctcg

SEQ ID NO: 3717213 - DNA, 21 bp, Homo sapiens
caatgtggcctaaaaatgcaa

SEQ ID NO: 3717214 - DNA, 15 bp, Homo sapiens
caatgttcattgtaa

SEQ ID NO: 3717215 - DNA, 18 bp, Homo sapiens
caatgttcattgtaatgt

SEQ ID NO: 3717216 - DNA, 23 bp, Homo sapiens
caatgttcattgtaatgttactg

SEQ ID NO: 3717217 - DNA, 14 bp, Homo sapiens
caatgttctctctt

SEQ ID NO: 3717218 - DNA, 16 bp, Homo sapiens
caatgtttaaaaaagt

SEQ ID NO: 3717219 - DNA, 18 bp, Homo sapiens
caatgtttaaaaaagttt

SEQ ID NO: 3717220 - DNA, 20 bp, Homo sapiens
caatgtttaaaaaagtttaa

SEQ ID NO: 3717221 - DNA, 21 bp, Homo sapiens
caatgtttaaaaaagtttaaa

SEQ ID NO: 3717222 - DNA, 20 bp, Homo sapiens
caatgtttatgcaaggaagg

SEQ ID NO: 3717223 - DNA, 17 bp, Homo sapiens
caatgtttcttctaggt

SEQ ID NO: 3717224 - DNA, 20 bp, Homo sapiens
caattaggaagtgtaacagc

SEQ ID NO: 3717225 - DNA, 22 bp, Homo sapiens
caattaggaagtgtaacagctg

SEQ ID NO: 3717226 - DNA, 23 bp, Homo sapiens
caattaggaagtgtaacagctga

SEQ ID NO: 3717227 - DNA, 16 bp, Homo sapiens
caattagggcctagcc

SEQ ID NO: 3717228 - DNA, 14 bp, Homo sapiens
caattcaacccttt

SEQ ID NO: 3717229 - DNA, 21 bp, Homo sapiens
caattcagtgctgtacttgat

SEQ ID NO: 3717230 - DNA, 20 bp, Homo sapiens
caattcatatttatgaatct

SEQ ID NO: 3717231 - DNA, 15 bp, Homo sapiens
caattcctagataaa

SEQ ID NO: 3717232 - DNA, 15 bp, Homo sapiens
caattcctctgggaa

SEQ ID NO: 3717233 - DNA, 21 bp, Homo sapiens
caattgaacttaaataaatgt

SEQ ID NO: 3717234 - DNA, 21 bp, Homo sapiens
caattgaattaaattaggaat

SEQ ID NO: 3717235 - DNA, 19 bp, Homo sapiens
caattgactgtcactgttc

SEQ ID NO: 3717236 - DNA, 14 bp, Homo sapiens
caattgctgcatct

SEQ ID NO: 3717237 - DNA, 18 bp, Homo sapiens
caattgctgcatcttagt

SEQ ID NO: 3717238 - DNA, 20 bp, Homo sapiens
caattgcttactcattaaaa

SEQ ID NO: 3717239 - DNA, 19 bp, Homo sapiens
caattgtaaaactgaggca

SEQ ID NO: 3717240 - DNA, 13 bp, Homo sapiens
caatttaaagcaa

SEQ ID NO: 3717241 - DNA, 23 bp, Homo sapiens
caatttgtaaaaacagcattgct

SEQ ID NO: 3717242 - DNA, 16 bp, Homo sapiens
caatttgtataaaatg

SEQ ID NO: 3717243 - DNA, 17 bp, Homo sapiens
caatttgtcattttgaa

SEQ ID NO: 3717244 - DNA, 19 bp, Homo sapiens
caattttctggaatacatg

SEQ ID NO: 3717245 - DNA, 20 bp, Homo sapiens
caattttctggaatacatga

SEQ ID NO: 3717246 - DNA, 18 bp, Homo sapiens
caattttgcatgctcgat

SEQ ID NO: 3717247 - DNA, 22 bp, Homo sapiens
cacaaaaaaaatttaaaaaaat

SEQ ID NO: 3717248 - DNA, 22 bp, Homo sapiens
cacaaaaaaagttgaaggcctt

SEQ ID NO: 3717249 - DNA, 14 bp, Homo sapiens
cacaaaagcctctc

SEQ ID NO: 3717250 - DNA, 16 bp, Homo sapiens
cacaaaagtttctctt

SEQ ID NO: 3717251 - DNA, 14 bp, Homo sapiens
cacaaacaaacaag

SEQ ID NO: 3717252 - DNA, 19 bp, Homo sapiens
cacaaagcggggggagggt

SEQ ID NO: 3717253 - DNA, 13 bp, Homo sapiens
cacaaaggagagc

SEQ ID NO: 3717254 - DNA, 21 bp, Homo sapiens
cacaaatatttattttctttc

SEQ ID NO: 3717255 - DNA, 16 bp, Homo sapiens
cacaacacacacactc

SEQ ID NO: 3717256 - DNA, 20 bp, Homo sapiens
cacaacccatctacccctgg

SEQ ID NO: 3717257 - DNA, 21 bp, Homo sapiens
cacaagagcccagcagggcct

SEQ ID NO: 3717258 - DNA, 14 bp, Homo sapiens
cacaagattcccag

SEQ ID NO: 3717259 - DNA, 16 bp, Homo sapiens
cacaagattcccagag

SEQ ID NO: 3717260 - DNA, 19 bp, Homo sapiens
cacaagattcccagagaca

SEQ ID NO: 3717261 - DNA, 15 bp, Homo sapiens
cacaagctgcctccc

SEQ ID NO: 3717262 - DNA, 22 bp, Homo sapiens
cacaagctgcctccctgtccac

SEQ ID NO: 3717263 - DNA, 20 bp, Homo sapiens
cacaaggaaaatagtttagg

SEQ ID NO: 3717264 - DNA, 14 bp, Homo sapiens
cacaaggctgacca

SEQ ID NO: 3717265 - DNA, 22 bp, Homo sapiens
cacaatgcagtgcctttcttct

SEQ ID NO: 3717266 - DNA, 12 bp, Homo sapiens
cacaatgtcttg

SEQ ID NO: 3717267 - DNA, 21 bp, Homo sapiens
cacacaaaatgtacccagtat

SEQ ID NO: 3717268 - DNA, 18 bp, Homo sapiens
cacacaaaggtataattt

SEQ ID NO: 3717269 - DNA, 21 bp, Homo sapiens
cacacaaattatcttaaaact

SEQ ID NO: 3717270 - DNA, 16 bp, Homo sapiens
cacacacacacacagg

SEQ ID NO: 3717271 - DNA, 13 bp, Homo sapiens
cacacacacacag

SEQ ID NO: 3717272 - DNA, 14 bp, Homo sapiens
cacacacacacagg

SEQ ID NO: 3717273 - DNA, 16 bp, Homo sapiens
cacacacacacaggag

SEQ ID NO: 3717274 - DNA, 14 bp, Homo sapiens
cacacacacaggag

SEQ ID NO: 3717275 - DNA, 14 bp, Homo sapiens
cacacacagaggaa

SEQ ID NO: 3717276 - DNA, 11 bp, Homo sapiens
cacacacagct

SEQ ID NO: 3717277 - DNA, 14 bp, Homo sapiens
cacacaccagagcc

SEQ ID NO: 3717278 - DNA, 16 bp, Homo sapiens
cacacaccagagccca

SEQ ID NO: 3717279 - DNA, 13 bp, Homo sapiens
cacacaccccaat

SEQ ID NO: 3717280 - DNA, 19 bp, Homo sapiens
cacacacctgtagtcccag

SEQ ID NO: 3717281 - DNA, 20 bp, Homo sapiens
cacacacctgtagtcccagc

SEQ ID NO: 3717282 - DNA, 12 bp, Homo sapiens
cacacacgttat

SEQ ID NO: 3717283 - DNA, 14 bp, Homo sapiens
cacacactttggct

SEQ ID NO: 3717284 - DNA, 14 bp, Homo sapiens
cacacagagtggtc

SEQ ID NO: 3717285 - DNA, 12 bp, Homo sapiens
cacacagctctg

SEQ ID NO: 3717286 - DNA, 22 bp, Homo sapiens
cacacagcttttagtacccacc

SEQ ID NO: 3717287 - DNA, 13 bp, Homo sapiens
cacacaggcaact

SEQ ID NO: 3717288 - DNA, 16 bp, Homo sapiens
cacacaggcaactgag

SEQ ID NO: 3717289 - DNA, 19 bp, Homo sapiens
cacacaggcaactgaggca

SEQ ID NO: 3717290 - DNA, 20 bp, Homo sapiens
cacacagtattacttctgct

SEQ ID NO: 3717291 - DNA, 21 bp, Homo sapiens
cacacatataaacatcacaca

SEQ ID NO: 3717292 - DNA, 15 bp, Homo sapiens
cacaccagagcccac

SEQ ID NO: 3717293 - DNA, 13 bp, Homo sapiens
cacaccaggctgt

SEQ ID NO: 3717294 - DNA, 17 bp, Homo sapiens
cacaccaggctgtgggc

SEQ ID NO: 3717295 - DNA, 20 bp, Homo sapiens
cacaccaggctgtgggcctc

SEQ ID NO: 3717296 - DNA, 21 bp, Homo sapiens
cacaccaggcttgcctgcagg

SEQ ID NO: 3717297 - DNA, 20 bp, Homo sapiens
cacacccagcccacttctgc

SEQ ID NO: 3717298 - DNA, 17 bp, Homo sapiens
cacaccctctcccagga

SEQ ID NO: 3717299 - DNA, 13 bp, Homo sapiens
cacacctcagttc

SEQ ID NO: 3717300 - DNA, 14 bp, Homo sapiens
cacacgcacacaca

SEQ ID NO: 3717301 - DNA, 20 bp, Homo sapiens
cacacggaggcatctgcacc

SEQ ID NO: 3717302 - DNA, 21 bp, Homo sapiens
cacacggaggcatctgcaccc

SEQ ID NO: 3717303 - DNA, 18 bp, Homo sapiens
cacactagcctctccagg

SEQ ID NO: 3717304 - DNA, 17 bp, Homo sapiens
cacactgaggcagggaa

SEQ ID NO: 3717305 - DNA, 17 bp, Homo sapiens
cacactgcaagagcctt

SEQ ID NO: 3717306 - DNA, 19 bp, Homo sapiens
cacactgcaagagccttgg

SEQ ID NO: 3717307 - DNA, 18 bp, Homo sapiens
cacacttcaggctcttct

SEQ ID NO: 3717308 - DNA, 19 bp, Homo sapiens
cacacttccaccagcctgc

SEQ ID NO: 3717309 - DNA, 15 bp, Homo sapiens
cacacttctgtgaga

SEQ ID NO: 3717310 - DNA, 10 bp, Homo sapiens
cacacttgtc

SEQ ID NO: 3717311 - DNA, 13 bp, Homo sapiens
cacacttgtgtgt

SEQ ID NO: 3717312 - DNA, 19 bp, Homo sapiens
cacacttgtgtgtgggctg

SEQ ID NO: 3717313 - DNA, 21 bp, Homo sapiens
cacacttgtgtgtgggctgtg

SEQ ID NO: 3717314 - DNA, 13 bp, Homo sapiens
cacttctgaccac

SEQ ID NO: 3717315 - DNA, 22 bp, Homo sapiens
cacttctgtgagacccccacac

SEQ ID NO: 3717316 - DNA, 23 bp, Homo sapiens
cacttcttcttggtcttatttat

SEQ ID NO: 3717317 - DNA, 19 bp, Homo sapiens
cacttgatgacccccaacc

SEQ ID NO: 3717318 - DNA, 12 bp, Homo sapiens
cacttgcatttc

SEQ ID NO: 3717319 - DNA, 19 bp, Homo sapiens
cacttggttgggtcctcac

SEQ ID NO: 3717320 - DNA, 20 bp, Homo sapiens
cacttggttgggtcctcaca

SEQ ID NO: 3717321 - DNA, 21 bp, Homo sapiens
cacttggttgggtcctcacat

SEQ ID NO: 3717322 - DNA, 20 bp, Homo sapiens
cacttgtaattttgtatctt

SEQ ID NO: 3717323 - DNA, 17 bp, Homo sapiens
cacttgtacaaaataaa

SEQ ID NO: 3717324 - DNA, 15 bp, Homo sapiens
cacttgtgtgtgggc

SEQ ID NO: 3717325 - DNA, 19 bp, Homo sapiens
cacttgtgtgtgggctgtg

SEQ ID NO: 3717326 - DNA, 22 bp, Homo sapiens
cacttgtgtgtgggctgtgagt

SEQ ID NO: 3717327 - DNA, 17 bp, Homo sapiens
cacttgttccagctctt

SEQ ID NO: 3717328 - DNA, 15 bp, Homo sapiens
cactttatttacttc

SEQ ID NO: 3717329 - DNA, 14 bp, Homo sapiens
cactttcaggaaca

SEQ ID NO: 3717330 - DNA, 16 bp, Homo sapiens
cactttcattgccagt

SEQ ID NO: 3717331 - DNA, 20 bp, Homo sapiens
cactttcattgccagtgtct

SEQ ID NO: 3717332 - DNA, 21 bp, Homo sapiens
cactttcattgccagtgtctt

SEQ ID NO: 3717333 - DNA, 22 bp, Homo sapiens
cactttcattgccagtgtcttt

SEQ ID NO: 3717334 - DNA, 23 bp, Homo sapiens
cactttcattgccagtgtctttc

SEQ ID NO: 3717335 - DNA, 14 bp, Homo sapiens
cactttgcacagct

SEQ ID NO: 3717336 - DNA, 19 bp, Homo sapiens
cactttgggaggccaagga

SEQ ID NO: 3717337 - DNA, 16 bp, Homo sapiens
cacttttcctccctca

SEQ ID NO: 3717338 - DNA, 12 bp, Homo sapiens
cacttttctcca

SEQ ID NO: 3717339 - DNA, 16 bp, Homo sapiens
cagaaaaactctggga

SEQ ID NO: 3717340 - DNA, 21 bp, Homo sapiens
cagaaaaataacttcaagcaa

SEQ ID NO: 3717341 - DNA, 11 bp, Homo sapiens
cagaaaacaac

SEQ ID NO: 3717342 - DNA, 12 bp, Homo sapiens
cagaaaacagaa

SEQ ID NO: 3717343 - DNA, 20 bp, Homo sapiens
cagaaaacagaaaaaaaaca

SEQ ID NO: 3717344 - DNA, 23 bp, Homo sapiens
cagaaacagatttggtgaatttg

SEQ ID NO: 3717345 - DNA, 18 bp, Homo sapiens
cagaaacaggtgcatctg

SEQ ID NO: 3717346 - DNA, 22 bp, Homo sapiens
cagaaacaggtgcatctgggga

SEQ ID NO: 3717347 - DNA, 19 bp, Homo sapiens
cagaaacatcagttactct

SEQ ID NO: 3717348 - DNA, 24 bp, Homo sapiens
cagaaagaagtggggacagagcag

SEQ ID NO: 3717349 - DNA, 21 bp, Homo sapiens
cagaaagatggatgtgctttg

SEQ ID NO: 3717350 - DNA, 16 bp, Homo sapiens
cagaaagcagaggctg

SEQ ID NO: 3717351 - DNA, 19 bp, Homo sapiens
cagaaagccccaagcaatt

SEQ ID NO: 3717352 - DNA, 20 bp, Homo sapiens
cagaaagtaatttcttctca

SEQ ID NO: 3717353 - DNA, 22 bp, Homo sapiens
cagaaagtaatttcttctcaaa

SEQ ID NO: 3717354 - DNA, 22 bp, Homo sapiens
cagaaataccaaaattatttca

SEQ ID NO: 3717355 - DNA, 16 bp, Homo sapiens
cagaaatcagaggaga

SEQ ID NO: 3717356 - DNA, 22 bp, Homo sapiens
cagaaatttaattcatgtttct

SEQ ID NO: 3717357 - DNA, 23 bp, Homo sapiens
cagaaatttaattcatgtttctt

SEQ ID NO: 3717358 - DNA, 19 bp, Homo sapiens
cagaacagttaagcagccg

SEQ ID NO: 3717359 - DNA, 22 bp, Homo sapiens
cagaacagttaagcagccgcca

SEQ ID NO: 3717360 - DNA, 14 bp, Homo sapiens
cagaacctcttccc

SEQ ID NO: 3717361 - DNA, 15 bp, Homo sapiens
cagaacctcttcccc

SEQ ID NO: 3717362 - DNA, 13 bp, Homo sapiens
cagaactgagctc

SEQ ID NO: 3717363 - DNA, 15 bp, Homo sapiens
cagaactgagctcct

SEQ ID NO: 3717364 - DNA, 15 bp, Homo sapiens
cagaagaaggcagca

SEQ ID NO: 3717365 - DNA, 18 bp, Homo sapiens
cagaagaatatgacagct

SEQ ID NO: 3717366 - DNA, 20 bp, Homo sapiens
cagaagagatgggcttgttt

SEQ ID NO: 3717367 - DNA, 16 bp, Homo sapiens
cagaagcctattgtaa

SEQ ID NO: 3717368 - DNA, 18 bp, Homo sapiens
cagaagcctattgtaaat

SEQ ID NO: 3717369 - DNA, 22 bp, Homo sapiens
cagaagcctattgtaaatacaa

SEQ ID NO: 3717370 - DNA, 14 bp, Homo sapiens
cagaagcctctggc

SEQ ID NO: 3717371 - DNA, 19 bp, Homo sapiens
cagaagcctgaggctggga

SEQ ID NO: 3717372 - DNA, 15 bp, Homo sapiens
cagaagctctcgatg

SEQ ID NO: 3717373 - DNA, 13 bp, Homo sapiens
cagaaggaggagg

SEQ ID NO: 3717374 - DNA, 13 bp, Homo sapiens
cagaagggaaaca

SEQ ID NO: 3717375 - DNA, 14 bp, Homo sapiens
cagaagggaaacag

SEQ ID NO: 3717376 - DNA, 14 bp, Homo sapiens
cagaagggggccat

SEQ ID NO: 3717377 - DNA, 16 bp, Homo sapiens
cagaagggggccatga

SEQ ID NO: 3717378 - DNA, 15 bp, Homo sapiens
cagaagggggtctct

SEQ ID NO: 3717379 - DNA, 22 bp, Homo sapiens
cagaagtcactcaattgttttt

SEQ ID NO: 3717380 - DNA, 17 bp, Homo sapiens
cagaagtcatgaagccc

SEQ ID NO: 3717381 - DNA, 23 bp, Homo sapiens
cagaagtttgagatcagcctggg

SEQ ID NO: 3717382 - DNA, 22 bp, Homo sapiens
cagaataaagttctgagtgttt

SEQ ID NO: 3717383 - DNA, 14 bp, Homo sapiens
cagaataatgaatg

SEQ ID NO: 3717384 - DNA, 20 bp, Homo sapiens
cagaatactagccagagctc

SEQ ID NO: 3717385 - DNA, 18 bp, Homo sapiens
cagaatctgaatgtaatt

SEQ ID NO: 3717386 - DNA, 12 bp, Homo sapiens
cagaatgtcaga

SEQ ID NO: 3717387 - DNA, 22 bp, Homo sapiens
cagaatgtcagattcctttccc

SEQ ID NO: 3717388 - DNA, 23 bp, Homo sapiens
cagaattcccagctgtctgtgtc

SEQ ID NO: 3717389 - DNA, 15 bp, Homo sapiens
cagaattccttttct

SEQ ID NO: 3717390 - DNA, 13 bp, Homo sapiens
cagaattctgcta

SEQ ID NO: 3717391 - DNA, 20 bp, Homo sapiens
cagacaaaaacagcctcaca

SEQ ID NO: 3717392 - DNA, 21 bp, Homo sapiens
cagacaaaaacagcctcacag

SEQ ID NO: 3717393 - DNA, 22 bp, Homo sapiens
cagacaaaaacagcctcacaga

SEQ ID NO: 3717394 - DNA, 13 bp, Homo sapiens
cagacaacagaag

SEQ ID NO: 3717395 - DNA, 17 bp, Homo sapiens
cagacaacagaagtcat

SEQ ID NO: 3717396 - DNA, 14 bp, Homo sapiens
cagacacaggcccg

SEQ ID NO: 3717397 - DNA, 21 bp, Homo sapiens
cagacacaggcccggctccag

SEQ ID NO: 3717398 - DNA, 15 bp, Homo sapiens
cagacagacacacac

SEQ ID NO: 3717399 - DNA, 16 bp, Homo sapiens
cagacagacacacaca

SEQ ID NO: 3717400 - DNA, 13 bp, Homo sapiens
cagacagcagctc

SEQ ID NO: 3717401 - DNA, 18 bp, Homo sapiens
cagacagcagctcaggca

SEQ ID NO: 3717402 - DNA, 19 bp, Homo sapiens
cagacagcagctcaggcac

SEQ ID NO: 3717403 - DNA, 15 bp, Homo sapiens
cagacaggaaaggga

SEQ ID NO: 3717404 - DNA, 20 bp, Homo sapiens
cagacaggaaagggaaggcc

SEQ ID NO: 3717405 - DNA, 21 bp, Homo sapiens
cagacaggcaagcacctcctg

SEQ ID NO: 3717406 - DNA, 21 bp, Homo sapiens
cagacaggccatgtgagccac

SEQ ID NO: 3717407 - DNA, 22 bp, Homo sapiens
cagacatgtggtgggacaggga

SEQ ID NO: 3717408 - DNA, 21 bp, Homo sapiens
cagacattctgccaggccccc

SEQ ID NO: 3717409 - DNA, 14 bp, Homo sapiens
cagaccacaaaact

SEQ ID NO: 3717410 - DNA, 20 bp, Homo sapiens
cagaccacaaaacttttcta

SEQ ID NO: 3717411 - DNA, 12 bp, Homo sapiens
cagaccagagct

SEQ ID NO: 3717412 - DNA, 15 bp, Homo sapiens
cagaccagagctctg

SEQ ID NO: 3717413 - DNA, 16 bp, Homo sapiens
cagaccccagcggctg

SEQ ID NO: 3717414 - DNA, 14 bp, Homo sapiens
cagacccccacccc

SEQ ID NO: 3717415 - DNA, 15 bp, Homo sapiens
cagacccccacccct

SEQ ID NO: 3717416 - DNA, 17 bp, Homo sapiens
cagacccccaccccttc

SEQ ID NO: 3717417 - DNA, 18 bp, Homo sapiens
cagacccccagcaaccct

SEQ ID NO: 3717418 - DNA, 13 bp, Homo sapiens
cagacccctctgg

SEQ ID NO: 3717419 - DNA, 17 bp, Homo sapiens
cagacccctctggccag

SEQ ID NO: 3717420 - DNA, 20 bp, Homo sapiens
cagacccctctggccaggat

SEQ ID NO: 3717421 - DNA, 22 bp, Homo sapiens
cagacccctctggccaggatgg

SEQ ID NO: 3717422 - DNA, 14 bp, Homo sapiens
cagacccctggctt

SEQ ID NO: 3717423 - DNA, 15 bp, Homo sapiens
cagacccctggcttt

SEQ ID NO: 3717424 - DNA, 18 bp, Homo sapiens
cagacccctggcttttca

SEQ ID NO: 3717425 - DNA, 23 bp, Homo sapiens
cagacccctggcttttcactgct

SEQ ID NO: 3717426 - DNA, 15 bp, Homo sapiens
cagctagcaaaagaa

SEQ ID NO: 3717427 - DNA, 21 bp, Homo sapiens
cagctagcaaaagaagtaaca

SEQ ID NO: 3717428 - DNA, 21 bp, Homo sapiens
cagctatgggagccccagggt

SEQ ID NO: 3717429 - DNA, 13 bp, Homo sapiens
cagctatttttat

SEQ ID NO: 3717430 - DNA, 19 bp, Homo sapiens
cagctcaaaggcacagtga

SEQ ID NO: 3717431 - DNA, 13 bp, Homo sapiens
cagctcaagtctt

SEQ ID NO: 3717432 - DNA, 16 bp, Homo sapiens
cagctcaccagcccca

SEQ ID NO: 3717433 - DNA, 21 bp, Homo sapiens
cagctcaggcacacttcttct

SEQ ID NO: 3717434 - DNA, 18 bp, Homo sapiens
cagctcagtcccatcaga

SEQ ID NO: 3717435 - DNA, 15 bp, Homo sapiens
cagctccagctcacc

SEQ ID NO: 3717436 - DNA, 14 bp, Homo sapiens
cagctccagggcca

SEQ ID NO: 3717437 - DNA, 21 bp, Homo sapiens
cagctcccaaggctctgagca

SEQ ID NO: 3717438 - DNA, 12 bp, Homo sapiens
cagctcccaccc

SEQ ID NO: 3717439 - DNA, 22 bp, Homo sapiens
cagctcccaccccacccccttc

SEQ ID NO: 3717440 - DNA, 15 bp, Homo sapiens
cagctccctaggaga

SEQ ID NO: 3717441 - DNA, 20 bp, Homo sapiens
cagctccctaggagaccaag

SEQ ID NO: 3717442 - DNA, 16 bp, Homo sapiens
cagctccctctgcctg

SEQ ID NO: 3717443 - DNA, 16 bp, Homo sapiens
cagctccttctgtcct

SEQ ID NO: 3717444 - DNA, 20 bp, Homo sapiens
cagctctagacaaccctgca

SEQ ID NO: 3717445 - DNA, 16 bp, Homo sapiens
cagctctccccttctc

SEQ ID NO: 3717446 - DNA, 17 bp, Homo sapiens
cagctctccctctggcc

SEQ ID NO: 3717447 - DNA, 19 bp, Homo sapiens
cagctctccctctggccct

SEQ ID NO: 3717448 - DNA, 15 bp, Homo sapiens
cagctctgcaagaat

SEQ ID NO: 3717449 - DNA, 22 bp, Homo sapiens
cagctctgcttgccgaaactgg

SEQ ID NO: 3717450 - DNA, 20 bp, Homo sapiens
cagctctggctcacagactg

SEQ ID NO: 3717451 - DNA, 12 bp, Homo sapiens
cagctctggctt

SEQ ID NO: 3717452 - DNA, 14 bp, Homo sapiens
cagctctgtcctgg

SEQ ID NO: 3717453 - DNA, 17 bp, Homo sapiens
cagctctgtcctgggag

SEQ ID NO: 3717454 - DNA, 18 bp, Homo sapiens
cagctctgtcctgggagt

SEQ ID NO: 3717455 - DNA, 13 bp, Homo sapiens
cagctcttctcca

SEQ ID NO: 3717456 - DNA, 18 bp, Homo sapiens
cagctcttctccaggctg

SEQ ID NO: 3717457 - DNA, 22 bp, Homo sapiens
cagctctttgaaatagtctgtg

SEQ ID NO: 3717458 - DNA, 15 bp, Homo sapiens
cagctgaaatactga

SEQ ID NO: 3717459 - DNA, 13 bp, Homo sapiens
cagctgactgtgg

SEQ ID NO: 3717460 - DNA, 19 bp, Homo sapiens
cagctgagggtgagtgggt

SEQ ID NO: 3717461 - DNA, 19 bp, Homo sapiens
cagctgaggtctcttgagg

SEQ ID NO: 3717462 - DNA, 16 bp, Homo sapiens
cagctgcacctgccag

SEQ ID NO: 3717463 - DNA, 17 bp, Homo sapiens
cagctgcacctgccagc

SEQ ID NO: 3717464 - DNA, 21 bp, Homo sapiens
cagctgcacctgccagcctgg

SEQ ID NO: 3717465 - DNA, 22 bp, Homo sapiens
cagctgcacctgccagcctggc

SEQ ID NO: 3717466 - DNA, 17 bp, Homo sapiens
cagctgcatctactcag

SEQ ID NO: 3717467 - DNA, 13 bp, Homo sapiens
cagctgcccctcc

SEQ ID NO: 3717468 - DNA, 16 bp, Homo sapiens
cagctgcccctccctg

SEQ ID NO: 3717469 - DNA, 19 bp, Homo sapiens
cagctgccgaccagagccc

SEQ ID NO: 3717470 - DNA, 22 bp, Homo sapiens
cagctgcctggaagagcagccc

SEQ ID NO: 3717471 - DNA, 21 bp, Homo sapiens
cagctgcggtccacccaggag

SEQ ID NO: 3717472 - DNA, 23 bp, Homo sapiens
cagctgcggtccacccaggagcc

SEQ ID NO: 3717473 - DNA, 16 bp, Homo sapiens
cagctgctcccctccc

SEQ ID NO: 3717474 - DNA, 12 bp, Homo sapiens
cagctgctctgc

SEQ ID NO: 3717475 - DNA, 18 bp, Homo sapiens
cagctgctctgcccagag

SEQ ID NO: 3717476 - DNA, 18 bp, Homo sapiens
cagctggcagcagagtgt

SEQ ID NO: 3717477 - DNA, 20 bp, Homo sapiens
cagctgggatctgactgcac

SEQ ID NO: 3717478 - DNA, 20 bp, Homo sapiens
cagctggtgggaagcgtctg

SEQ ID NO: 3717479 - DNA, 22 bp, Homo sapiens
cagctggtgggaagcgtctgtc

SEQ ID NO: 3717480 - DNA, 19 bp, Homo sapiens
cagctgtaagaagagactg

SEQ ID NO: 3717481 - DNA, 22 bp, Homo sapiens
cagctgtaagaagagactggga

SEQ ID NO: 3717482 - DNA, 13 bp, Homo sapiens
cagctgtccctgt

SEQ ID NO: 3717483 - DNA, 17 bp, Homo sapiens
cagcttcagccaggagc

SEQ ID NO: 3717484 - DNA, 18 bp, Homo sapiens
cagcttcatgcctttgta

SEQ ID NO: 3717485 - DNA, 21 bp, Homo sapiens
cagcttcatttcctgtgtctt

SEQ ID NO: 3717486 - DNA, 22 bp, Homo sapiens
cagcttcccctctctcctcctg

SEQ ID NO: 3717487 - DNA, 23 bp, Homo sapiens
cagcttcccctctctcctcctgc

SEQ ID NO: 3717488 - DNA, 15 bp, Homo sapiens
cagcttgagggttgg

SEQ ID NO: 3717489 - DNA, 22 bp, Homo sapiens
cagcttgcgttagaatgaggag

SEQ ID NO: 3717490 - DNA, 23 bp, Homo sapiens
cagcttgctcttcagtgggagaa

SEQ ID NO: 3717491 - DNA, 14 bp, Homo sapiens
cagcttgctgccct

SEQ ID NO: 3717492 - DNA, 17 bp, Homo sapiens
cagcttgctgccctagg

SEQ ID NO: 3717493 - DNA, 18 bp, Homo sapiens
cagcttgtaaatagctca

SEQ ID NO: 3717494 - DNA, 15 bp, Homo sapiens
cagctttgccttcca

SEQ ID NO: 3717495 - DNA, 18 bp, Homo sapiens
cagctttgccttccacgc

SEQ ID NO: 3717496 - DNA, 19 bp, Homo sapiens
cagcttttagtacccacct

SEQ ID NO: 3717497 - DNA, 22 bp, Homo sapiens
cagcttttagtacccacctgag

SEQ ID NO: 3717498 - DNA, 14 bp, Homo sapiens
caggaaaaaaactt

SEQ ID NO: 3717499 - DNA, 18 bp, Homo sapiens
caggaaaaaaacttttat

SEQ ID NO: 3717500 - DNA, 14 bp, Homo sapiens
caggaaaaaggaca

SEQ ID NO: 3717501 - DNA, 19 bp, Homo sapiens
caggaaaactgacagagga

SEQ ID NO: 3717502 - DNA, 16 bp, Homo sapiens
caggaaaagctgctga

SEQ ID NO: 3717503 - DNA, 20 bp, Homo sapiens
caggaaaagctgctgacagt

SEQ ID NO: 3717504 - DNA, 15 bp, Homo sapiens
caggaaatatatatg

SEQ ID NO: 3717505 - DNA, 17 bp, Homo sapiens
caggaaatatatatgtg

SEQ ID NO: 3717506 - DNA, 13 bp, Homo sapiens
caggaacagaagg

SEQ ID NO: 3717507 - DNA, 14 bp, Homo sapiens
caggaacagaagga

SEQ ID NO: 3717508 - DNA, 19 bp, Homo sapiens
caggaacctggaccaaagc

SEQ ID NO: 3717509 - DNA, 21 bp, Homo sapiens
caggaacctggaccaaagctg

SEQ ID NO: 3717510 - DNA, 19 bp, Homo sapiens
caggaactagactgcctgg

SEQ ID NO: 3717511 - DNA, 13 bp, Homo sapiens
caggaactgggcc

SEQ ID NO: 3717512 - DNA, 22 bp, Homo sapiens
caggaagctgtgagagcagttt

SEQ ID NO: 3717513 - DNA, 16 bp, Homo sapiens
caggaaggagagcctg

SEQ ID NO: 3717514 - DNA, 19 bp, Homo sapiens
caggaaggctgagaggaga

SEQ ID NO: 3717515 - DNA, 22 bp, Homo sapiens
caggaagggcctacagcccatt

SEQ ID NO: 3717516 - DNA, 15 bp, Homo sapiens
caggaaggggctgga

SEQ ID NO: 3717517 - DNA, 23 bp, Homo sapiens
caggaaggggctggactggctgt

SEQ ID NO: 3717518 - DNA, 16 bp, Homo sapiens
caggaagtcttcaggg

SEQ ID NO: 3717519 - DNA, 12 bp, Homo sapiens
caggaataaggc

SEQ ID NO: 3717520 - DNA, 17 bp, Homo sapiens
caggaatggaaagcgga

SEQ ID NO: 3717521 - DNA, 16 bp, Homo sapiens
caggacaacgaggaag

SEQ ID NO: 3717522 - DNA, 19 bp, Homo sapiens
caggacaacgaggaagccc

SEQ ID NO: 3717523 - DNA, 23 bp, Homo sapiens
caggacagcatggtgcatgccgc

SEQ ID NO: 3717524 - DNA, 12 bp, Homo sapiens
caggacaggccc

SEQ ID NO: 3717525 - DNA, 20 bp, Homo sapiens
caggacagtgcttcagcctg

SEQ ID NO: 3717526 - DNA, 15 bp, Homo sapiens
caggaccgccaaaga

SEQ ID NO: 3717527 - DNA, 21 bp, Homo sapiens
caggacctcagagtccaggcc

SEQ ID NO: 3717528 - DNA, 22 bp, Homo sapiens
caggacctcagagtccaggccc

SEQ ID NO: 3717529 - DNA, 12 bp, Homo sapiens
caggactccagc

SEQ ID NO: 3717530 - DNA, 13 bp, Homo sapiens
caggactccagcc

SEQ ID NO: 3717531 - DNA, 21 bp, Homo sapiens
caggactccctcctcacctct

SEQ ID NO: 3717532 - DNA, 12 bp, Homo sapiens
caggactctgcc

SEQ ID NO: 3717533 - DNA, 16 bp, Homo sapiens
caggactctgcctcct

SEQ ID NO: 3717534 - DNA, 19 bp, Homo sapiens
caggactgaattgtcccca

SEQ ID NO: 3717535 - DNA, 21 bp, Homo sapiens
caggactgaattgtccccagt

SEQ ID NO: 3717536 - DNA, 23 bp, Homo sapiens
caggacttggtctgatttcagga

SEQ ID NO: 3717537 - DNA, 17 bp, Homo sapiens
caggagaaccactacat

SEQ ID NO: 3717538 - DNA, 19 bp, Homo sapiens
cagtgtgatcccaagtgcc

SEQ ID NO: 3717539 - DNA, 21 bp, Homo sapiens
cagtgtgggaatgcggcaaga

SEQ ID NO: 3717540 - DNA, 23 bp, Homo sapiens
cagtgtgggaatgcggcaagaag

SEQ ID NO: 3717541 - DNA, 17 bp, Homo sapiens
cagtgtgtttgtgattg

SEQ ID NO: 3717542 - DNA, 14 bp, Homo sapiens
cagtgttaaaaaat

SEQ ID NO: 3717543 - DNA, 19 bp, Homo sapiens
cagtgttgtttgtaaataa

SEQ ID NO: 3717544 - DNA, 20 bp, Homo sapiens
cagtgttgtttgtaaataag

SEQ ID NO: 3717545 - DNA, 14 bp, Homo sapiens
cagtgtttcccata

SEQ ID NO: 3717546 - DNA, 18 bp, Homo sapiens
cagtgtttcccataattt

SEQ ID NO: 3717547 - DNA, 20 bp, Homo sapiens
cagtgtttcccataattttc

SEQ ID NO: 3717548 - DNA, 21 bp, Homo sapiens
cagtgtttcccataattttct

SEQ ID NO: 3717549 - DNA, 15 bp, Homo sapiens
cagtgttttctggga

SEQ ID NO: 3717550 - DNA, 22 bp, Homo sapiens
cagttaagaaaaaaataatttt

SEQ ID NO: 3717551 - DNA, 14 bp, Homo sapiens
cagttactcagccc

SEQ ID NO: 3717552 - DNA, 18 bp, Homo sapiens
cagttactcagccctggg

SEQ ID NO: 3717553 - DNA, 18 bp, Homo sapiens
cagttagagatgcctccc

SEQ ID NO: 3717554 - DNA, 19 bp, Homo sapiens
cagttagggttgagttact

SEQ ID NO: 3717555 - DNA, 21 bp, Homo sapiens
cagttataagtagcaggccaa

SEQ ID NO: 3717556 - DNA, 13 bp, Homo sapiens
cagttcagcacca

SEQ ID NO: 3717557 - DNA, 20 bp, Homo sapiens
cagttcaggagtcccaagga

SEQ ID NO: 3717558 - DNA, 16 bp, Homo sapiens
cagttcccttggcctc

SEQ ID NO: 3717559 - DNA, 18 bp, Homo sapiens
cagttcccttggcctcag

SEQ ID NO: 3717560 - DNA, 14 bp, Homo sapiens
cagttcctcgccct

SEQ ID NO: 3717561 - DNA, 17 bp, Homo sapiens
cagttcctcgccctggg

SEQ ID NO: 3717562 - DNA, 14 bp, Homo sapiens
cagttcctgcagca

SEQ ID NO: 3717563 - DNA, 16 bp, Homo sapiens
cagttcctgcagcaga

SEQ ID NO: 3717564 - DNA, 19 bp, Homo sapiens
cagttcctgcagcagagcc

SEQ ID NO: 3717565 - DNA, 11 bp, Homo sapiens
cagttctgcaa

SEQ ID NO: 3717566 - DNA, 13 bp, Homo sapiens
cagttctgcaaat

SEQ ID NO: 3717567 - DNA, 20 bp, Homo sapiens
cagttctgggtgctccctac

SEQ ID NO: 3717568 - DNA, 18 bp, Homo sapiens
cagttgaaaaacagctga

SEQ ID NO: 3717569 - DNA, 13 bp, Homo sapiens
cagttgcacttgg

SEQ ID NO: 3717570 - DNA, 22 bp, Homo sapiens
cagttgcatttttatggagttc

SEQ ID NO: 3717571 - DNA, 16 bp, Homo sapiens
cagttgggtggatgcc

SEQ ID NO: 3717572 - DNA, 15 bp, Homo sapiens
cagtttcaggtgttt

SEQ ID NO: 3717573 - DNA, 15 bp, Homo sapiens
cagtttgagacagga

SEQ ID NO: 3717574 - DNA, 15 bp, Homo sapiens
cagtttgataactag

SEQ ID NO: 3717575 - DNA, 20 bp, Homo sapiens
cagtttgataactagggaag

SEQ ID NO: 3717576 - DNA, 23 bp, Homo sapiens
cagtttgcagaaaagcacctgcc

SEQ ID NO: 3717577 - DNA, 21 bp, Homo sapiens
cagtttgctttgtatgcactt

SEQ ID NO: 3717578 - DNA, 13 bp, Homo sapiens
cagtttgtcagac

SEQ ID NO: 3717579 - DNA, 14 bp, Homo sapiens
cagttttccatgaa

SEQ ID NO: 3717580 - DNA, 14 bp, Homo sapiens
cataaaaagttaaa

SEQ ID NO: 3717581 - DNA, 22 bp, Homo sapiens
cataaaaagttaaaaaaaataa

SEQ ID NO: 3717582 - DNA, 21 bp, Homo sapiens
cataaaggataaacttttaga

SEQ ID NO: 3717583 - DNA, 23 bp, Homo sapiens
cataaaggataaacttttagaaa

SEQ ID NO: 3717584 - DNA, 20 bp, Homo sapiens
cataaaggtggtatgtgtgt

SEQ ID NO: 3717585 - DNA, 22 bp, Homo sapiens
cataaaggtggtatgtgtgtgt

SEQ ID NO: 3717586 - DNA, 15 bp, Homo sapiens
cataaagtcagtgcc

SEQ ID NO: 3717587 - DNA, 16 bp, Homo sapiens
cataaattgtactgtt

SEQ ID NO: 3717588 - DNA, 17 bp, Homo sapiens
cataacagaatgcacca

SEQ ID NO: 3717589 - DNA, 22 bp, Homo sapiens
cataacagggtaaattattcag

SEQ ID NO: 3717590 - DNA, 14 bp, Homo sapiens
cataacagtgccat

SEQ ID NO: 3717591 - DNA, 15 bp, Homo sapiens
cataaccactgcttc

SEQ ID NO: 3717592 - DNA, 13 bp, Homo sapiens
cataactgacaaa

SEQ ID NO: 3717593 - DNA, 20 bp, Homo sapiens
cataactgacaaatcaagtt

SEQ ID NO: 3717594 - DNA, 21 bp, Homo sapiens
cataactgacaaatcaagttt

SEQ ID NO: 3717595 - DNA, 19 bp, Homo sapiens
cataagaaaactaagaaat

SEQ ID NO: 3717596 - DNA, 23 bp, Homo sapiens
cataatctggactcctctgtcca

SEQ ID NO: 3717597 - DNA, 14 bp, Homo sapiens
cataattatgacag

SEQ ID NO: 3717598 - DNA, 17 bp, Homo sapiens
cataattatgacagtta

SEQ ID NO: 3717599 - DNA, 16 bp, Homo sapiens
cataattcttgtatat

SEQ ID NO: 3717600 - DNA, 20 bp, Homo sapiens
catactgagggaccaactgg

SEQ ID NO: 3717601 - DNA, 15 bp, Homo sapiens
catactttttcaaga

SEQ ID NO: 3717602 - DNA, 21 bp, Homo sapiens
catagactttatgcaataaat

SEQ ID NO: 3717603 - DNA, 21 bp, Homo sapiens
catagaggtgagggaagcctg

SEQ ID NO: 3717604 - DNA, 17 bp, Homo sapiens
catagattcacctgtaa

SEQ ID NO: 3717605 - DNA, 18 bp, Homo sapiens
catagattcacctgtaaa

SEQ ID NO: 3717606 - DNA, 23 bp, Homo sapiens
catagattcacctgtaaaacttt

SEQ ID NO: 3717607 - DNA, 17 bp, Homo sapiens
catagatttctgatttt

SEQ ID NO: 3717608 - DNA, 18 bp, Homo sapiens
catagcagattttaattt

SEQ ID NO: 3717609 - DNA, 15 bp, Homo sapiens
catagccaggaaact

SEQ ID NO: 3717610 - DNA, 18 bp, Homo sapiens
catagcctaatccctggg

SEQ ID NO: 3717611 - DNA, 13 bp, Homo sapiens
catagcttccatg

SEQ ID NO: 3717612 - DNA, 14 bp, Homo sapiens
cataggcctgggtg

SEQ ID NO: 3717613 - DNA, 15 bp, Homo sapiens
cataggcctgggtgc

SEQ ID NO: 3717614 - DNA, 15 bp, Homo sapiens
catagggtctcttca

SEQ ID NO: 3717615 - DNA, 16 bp, Homo sapiens
catagtaccaatcatt

SEQ ID NO: 3717616 - DNA, 17 bp, Homo sapiens
catagtatattaaaaat

SEQ ID NO: 3717617 - DNA, 15 bp, Homo sapiens
catagtatggtggct

SEQ ID NO: 3717618 - DNA, 17 bp, Homo sapiens
catagtatggtggctgg

SEQ ID NO: 3717619 - DNA, 18 bp, Homo sapiens
catagtatggtggctggg

SEQ ID NO: 3717620 - DNA, 13 bp, Homo sapiens
catagtcccagct

SEQ ID NO: 3717621 - DNA, 18 bp, Homo sapiens
catagtgaccggctgctt

SEQ ID NO: 3717622 - DNA, 21 bp, Homo sapiens
catagtgagacccctgtctcc

SEQ ID NO: 3717623 - DNA, 18 bp, Homo sapiens
catagtgatggttcccct

SEQ ID NO: 3717624 - DNA, 22 bp, Homo sapiens
catagtgatggttcccctgttc

SEQ ID NO: 3717625 - DNA, 19 bp, Homo sapiens
catagttcccatgttaaat

SEQ ID NO: 3717626 - DNA, 20 bp, Homo sapiens
catataaacatcacacacac

SEQ ID NO: 3717627 - DNA, 17 bp, Homo sapiens
catataatatatgtttt

SEQ ID NO: 3717628 - DNA, 22 bp, Homo sapiens
catatatacacacacaaagaga

SEQ ID NO: 3717629 - DNA, 23 bp, Homo sapiens
catatatatgttttaagaggcag

SEQ ID NO: 3717630 - DNA, 17 bp, Homo sapiens
catatatgaggacttgt

SEQ ID NO: 3717631 - DNA, 21 bp, Homo sapiens
catatatggggggccaacacc

SEQ ID NO: 3717632 - DNA, 22 bp, Homo sapiens
catatatggggggccaacacca

SEQ ID NO: 3717633 - DNA, 17 bp, Homo sapiens
catatattttttagaaa

SEQ ID NO: 3717634 - DNA, 11 bp, Homo sapiens
catatctaacc

SEQ ID NO: 3717635 - DNA, 17 bp, Homo sapiens
catatctatcagagtat

SEQ ID NO: 3717636 - DNA, 18 bp, Homo sapiens
catatgaaaatacaactt

SEQ ID NO: 3717637 - DNA, 17 bp, Homo sapiens
catatgaaatttaatat

SEQ ID NO: 3717638 - DNA, 22 bp, Homo sapiens
catatgcttcaaactaacacat

SEQ ID NO: 3717639 - DNA, 21 bp, Homo sapiens
catatgtaccatgtacatgaa

SEQ ID NO: 3717640 - DNA, 14 bp, Homo sapiens
catattaggaaaat

SEQ ID NO: 3717641 - DNA, 22 bp, Homo sapiens
catattcctgcagcctggaggc

SEQ ID NO: 3717642 - DNA, 11 bp, Homo sapiens
catatttaagg

SEQ ID NO: 3717643 - DNA, 19 bp, Homo sapiens
catatttgttaaatattta

SEQ ID NO: 3717644 - DNA, 17 bp, Homo sapiens
catcaaactcttagtta

SEQ ID NO: 3717645 - DNA, 16 bp, Homo sapiens
catcaaagtggcaaaa

SEQ ID NO: 3717646 - DNA, 14 bp, Homo sapiens
catcaacatcttgg

SEQ ID NO: 3717647 - DNA, 18 bp, Homo sapiens
catcaagcacagaaggag

SEQ ID NO: 3717648 - DNA, 23 bp, Homo sapiens
catcaagcacagaaggaggagga

SEQ ID NO: 3717649 - DNA, 22 bp, Homo sapiens
catcacaggacacggggcagtg

SEQ ID NO: 3717650 - DNA, 15 bp, Homo sapiens
catttcatctatttc

SEQ ID NO: 3717651 - DNA, 20 bp, Homo sapiens
catttcatctatttctgaga

SEQ ID NO: 3717652 - DNA, 18 bp, Homo sapiens
catttcattcctaacaca

SEQ ID NO: 3717653 - DNA, 21 bp, Homo sapiens
catttcattcctaacacagca

SEQ ID NO: 3717654 - DNA, 16 bp, Homo sapiens
catttccccagacctg

SEQ ID NO: 3717655 - DNA, 20 bp, Homo sapiens
catttccccagacctgagct

SEQ ID NO: 3717656 - DNA, 21 bp, Homo sapiens
catttcgcccctcatttatcc

SEQ ID NO: 3717657 - DNA, 20 bp, Homo sapiens
catttctagcgcatggcctg

SEQ ID NO: 3717658 - DNA, 17 bp, Homo sapiens
catttctctctccagtc

SEQ ID NO: 3717659 - DNA, 12 bp, Homo sapiens
catttcttgggc

SEQ ID NO: 3717660 - DNA, 14 bp, Homo sapiens
catttcttgggccc

SEQ ID NO: 3717661 - DNA, 16 bp, Homo sapiens
catttcttgggccctc

SEQ ID NO: 3717662 - DNA, 14 bp, Homo sapiens
catttgagcagggc

SEQ ID NO: 3717663 - DNA, 14 bp, Homo sapiens
catttgatgctaaa

SEQ ID NO: 3717664 - DNA, 15 bp, Homo sapiens
catttgattctgtgt

SEQ ID NO: 3717665 - DNA, 21 bp, Homo sapiens
catttgcgaatggttccattc

SEQ ID NO: 3717666 - DNA, 16 bp, Homo sapiens
catttgctttttcacc

SEQ ID NO: 3717667 - DNA, 20 bp, Homo sapiens
catttggtcaagattttgaa

SEQ ID NO: 3717668 - DNA, 12 bp, Homo sapiens
catttgtaataa

SEQ ID NO: 3717669 - DNA, 14 bp, Homo sapiens
catttgtaataaag

SEQ ID NO: 3717670 - DNA, 16 bp, Homo sapiens
catttgtaataaagta

SEQ ID NO: 3717671 - DNA, 17 bp, Homo sapiens
catttgtaataaagtat

SEQ ID NO: 3717672 - DNA, 14 bp, Homo sapiens
catttgtgaaatga

SEQ ID NO: 3717673 - DNA, 11 bp, Homo sapiens
catttgtgagg

SEQ ID NO: 3717674 - DNA, 15 bp, Homo sapiens
catttgttattctta

SEQ ID NO: 3717675 - DNA, 18 bp, Homo sapiens
cattttaaagttaaacat

SEQ ID NO: 3717676 - DNA, 16 bp, Homo sapiens
cattttactgtacaga

SEQ ID NO: 3717677 - DNA, 14 bp, Homo sapiens
cattttccccccac

SEQ ID NO: 3717678 - DNA, 15 bp, Homo sapiens
cattttccccccact

SEQ ID NO: 3717679 - DNA, 22 bp, Homo sapiens
cattttccccccactctcccca

SEQ ID NO: 3717680 - DNA, 13 bp, Homo sapiens
cattttgaagcta

SEQ ID NO: 3717681 - DNA, 15 bp, Homo sapiens
cattttgaagctaat

SEQ ID NO: 3717682 - DNA, 22 bp, Homo sapiens
cattttgaagctaattatttta

SEQ ID NO: 3717683 - DNA, 15 bp, Homo sapiens
cattttgcaaaattt

SEQ ID NO: 3717684 - DNA, 22 bp, Homo sapiens
cattttgcagcagtgagtctct

SEQ ID NO: 3717685 - DNA, 21 bp, Homo sapiens
cattttgctaaatgtgaatga

SEQ ID NO: 3717686 - DNA, 24 bp, Homo sapiens
cattttgctaaatgtgaatgatga

SEQ ID NO: 3717687 - DNA, 22 bp, Homo sapiens
cattttggggtacccactgctc

SEQ ID NO: 3717688 - DNA, 17 bp, Homo sapiens
catttttagtagagaca

SEQ ID NO: 3717689 - DNA, 15 bp, Homo sapiens
cattttttaaaacaa

SEQ ID NO: 3717690 - DNA, 22 bp, Homo sapiens
ccaaaaaattctacaacacaca

SEQ ID NO: 3717691 - DNA, 12 bp, Homo sapiens
ccaaaacaaaca

SEQ ID NO: 3717692 - DNA, 22 bp, Homo sapiens
ccaaaagtcaaaaggtgcctgt

SEQ ID NO: 3717693 - DNA, 14 bp, Homo sapiens
ccaaaataatgtct

SEQ ID NO: 3717694 - DNA, 16 bp, Homo sapiens
ccaaacagccacactg

SEQ ID NO: 3717695 - DNA, 13 bp, Homo sapiens
ccaaacatcagac

SEQ ID NO: 3717696 - DNA, 15 bp, Homo sapiens
ccaaaccccggggct

SEQ ID NO: 3717697 - DNA, 14 bp, Homo sapiens
ccaaagagctgcct

SEQ ID NO: 3717698 - DNA, 13 bp, Homo sapiens
ccaaagccaccag

SEQ ID NO: 3717699 - DNA, 21 bp, Homo sapiens
ccaaagggtgaagctatttat

SEQ ID NO: 3717700 - DNA, 13 bp, Homo sapiens
ccaaatctgccta

SEQ ID NO: 3717701 - DNA, 17 bp, Homo sapiens
ccaacaagggcagtgga

SEQ ID NO: 3717702 - DNA, 21 bp, Homo sapiens
ccaacatcccattgccctggt

SEQ ID NO: 3717703 - DNA, 22 bp, Homo sapiens
ccaacatggagaaaccctgtct

SEQ ID NO: 3717704 - DNA, 18 bp, Homo sapiens
ccaacccaaacctggaga

SEQ ID NO: 3717705 - DNA, 16 bp, Homo sapiens
ccaacccccaccccac

SEQ ID NO: 3717706 - DNA, 19 bp, Homo sapiens
ccaacccccaccccacact

SEQ ID NO: 3717707 - DNA, 20 bp, Homo sapiens
ccaacccccaccccacactt

SEQ ID NO: 3717708 - DNA, 12 bp, Homo sapiens
ccaacccctgtg

SEQ ID NO: 3717709 - DNA, 14 bp, Homo sapiens
ccaaccctcagagc

SEQ ID NO: 3717710 - DNA, 11 bp, Homo sapiens
ccaacctcagc

SEQ ID NO: 3717711 - DNA, 16 bp, Homo sapiens
ccaacctgaccaacat

SEQ ID NO: 3717712 - DNA, 22 bp, Homo sapiens
ccaacctgaccaacatggagaa

SEQ ID NO: 3717713 - DNA, 14 bp, Homo sapiens
ccaacgaaaagcac

SEQ ID NO: 3717714 - DNA, 19 bp, Homo sapiens
ccaacgaaaagcacatcca

SEQ ID NO: 3717715 - DNA, 20 bp, Homo sapiens
ccaacgtggggcagcacaga

SEQ ID NO: 3717716 - DNA, 14 bp, Homo sapiens
ccaactcacctgag

SEQ ID NO: 3717717 - DNA, 22 bp, Homo sapiens
ccaactgagaaaacgaaactgc

SEQ ID NO: 3717718 - DNA, 16 bp, Homo sapiens
ccaactggccctcttc

SEQ ID NO: 3717719 - DNA, 18 bp, Homo sapiens
ccaagaactgaaaacata

SEQ ID NO: 3717720 - DNA, 21 bp, Homo sapiens
ccaagaactgaaaacataaaa

SEQ ID NO: 3717721 - DNA, 14 bp, Homo sapiens
ccaagaactgcatg

SEQ ID NO: 3717722 - DNA, 14 bp, Homo sapiens
ccaagaaggctggg

SEQ ID NO: 3717723 - DNA, 24 bp, Homo sapiens
ccaagacagatgccccagagctgt

SEQ ID NO: 3717724 - DNA, 15 bp, Homo sapiens
ccaagacctgactca

SEQ ID NO: 3717725 - DNA, 16 bp, Homo sapiens
ccaagactccagccct

SEQ ID NO: 3717726 - DNA, 12 bp, Homo sapiens
ccaagagagaaa

SEQ ID NO: 3717727 - DNA, 13 bp, Homo sapiens
ccaagagagaaag

SEQ ID NO: 3717728 - DNA, 15 bp, Homo sapiens
ccaagagagaaagaa

SEQ ID NO: 3717729 - DNA, 14 bp, Homo sapiens
ccaagagatgaaga

SEQ ID NO: 3717730 - DNA, 17 bp, Homo sapiens
ccaagatgcttttcaaa

SEQ ID NO: 3717731 - DNA, 20 bp, Homo sapiens
ccaagcaaaggtgaagagac

SEQ ID NO: 3717732 - DNA, 12 bp, Homo sapiens
ccaagcagccaa

SEQ ID NO: 3717733 - DNA, 13 bp, Homo sapiens
ccaagcaggaagc

SEQ ID NO: 3717734 - DNA, 14 bp, Homo sapiens
ccaagcaggaagct

SEQ ID NO: 3717735 - DNA, 17 bp, Homo sapiens
ccaagcaggaagctcag

SEQ ID NO: 3717736 - DNA, 21 bp, Homo sapiens
ccaagcatagagaagagtctg

SEQ ID NO: 3717737 - DNA, 14 bp, Homo sapiens
ccaagccccatcct

SEQ ID NO: 3717738 - DNA, 17 bp, Homo sapiens
ccaagccgtggcttccc

SEQ ID NO: 3717739 - DNA, 18 bp, Homo sapiens
ccaagctcacagttcctc

SEQ ID NO: 3717740 - DNA, 22 bp, Homo sapiens
ccaagctcacagttcctcgccc

SEQ ID NO: 3717741 - DNA, 14 bp, Homo sapiens
ccaagctccttggg

SEQ ID NO: 3717742 - DNA, 22 bp, Homo sapiens
ccaagctggagtgcagtggtgc

SEQ ID NO: 3717743 - DNA, 12 bp, Homo sapiens
ccaagctggtcc

SEQ ID NO: 3717744 - DNA, 20 bp, Homo sapiens
ccaagctggtcccactcagt

SEQ ID NO: 3717745 - DNA, 23 bp, Homo sapiens
ccaagcttgtccaacccgaggcc

SEQ ID NO: 3717746 - DNA, 22 bp, Homo sapiens
ccaaggacccctcaccttgcaa

SEQ ID NO: 3717747 - DNA, 15 bp, Homo sapiens
ccaaggagaaacaga

SEQ ID NO: 3717748 - DNA, 21 bp, Homo sapiens
ccaaggagaaacagagacagg

SEQ ID NO: 3717749 - DNA, 12 bp, Homo sapiens
ccaaggagacca

SEQ ID NO: 3717750 - DNA, 23 bp, Homo sapiens
ccaaggagatgaagcaaacacat

SEQ ID NO: 3717751 - DNA, 15 bp, Homo sapiens
ccaaggagctgagaa

SEQ ID NO: 3717752 - DNA, 15 bp, Homo sapiens
ccaaggccagagtgg

SEQ ID NO: 3717753 - DNA, 18 bp, Homo sapiens
ccaaggccagagtggcct

SEQ ID NO: 3717754 - DNA, 20 bp, Homo sapiens
ccaagggttcagagactcag

SEQ ID NO: 3717755 - DNA, 13 bp, Homo sapiens
ccaaggtgggagg

SEQ ID NO: 3717756 - DNA, 17 bp, Homo sapiens
ccaaggtgggctgagcc

SEQ ID NO: 3717757 - DNA, 18 bp, Homo sapiens
ccaaggtgggctgagccc

SEQ ID NO: 3717758 - DNA, 20 bp, Homo sapiens
ccaaggtgggctgagccctg

SEQ ID NO: 3717759 - DNA, 17 bp, Homo sapiens
ccaagtaaatagcaaca

SEQ ID NO: 3717760 - DNA, 20 bp, Homo sapiens
ccaagtcaagtgaaaaagga

SEQ ID NO: 3717761 - DNA, 22 bp, Homo sapiens
ccaagtccaggtcgggctcagc

SEQ ID NO: 3717762 - DNA, 12 bp, Homo sapiens
ccaagtcccacc

SEQ ID NO: 3717763 - DNA, 12 bp, Homo sapiens
ccaagtgtgtgt

SEQ ID NO: 3717764 - DNA, 20 bp, Homo sapiens
ccagggctcagcctggtggg

SEQ ID NO: 3717765 - DNA, 20 bp, Homo sapiens
ccaggggaaaatcagcctgc

SEQ ID NO: 3717766 - DNA, 18 bp, Homo sapiens
ccaggggaccacacctcc

SEQ ID NO: 3717767 - DNA, 18 bp, Homo sapiens
ccaggggatgagtggagg

SEQ ID NO: 3717768 - DNA, 16 bp, Homo sapiens
ccaggggatgggaggt

SEQ ID NO: 3717769 - DNA, 14 bp, Homo sapiens
ccaggggtcccagc

SEQ ID NO: 3717770 - DNA, 14 bp, Homo sapiens
ccagggtcttccct

SEQ ID NO: 3717771 - DNA, 23 bp, Homo sapiens
ccagggtcttccctacctcaggc

SEQ ID NO: 3717772 - DNA, 14 bp, Homo sapiens
ccaggtagaacaca

SEQ ID NO: 3717773 - DNA, 16 bp, Homo sapiens
ccaggtggccactcca

SEQ ID NO: 3717774 - DNA, 16 bp, Homo sapiens
ccaggtggctgaccca

SEQ ID NO: 3717775 - DNA, 17 bp, Homo sapiens
ccaggtggctgacccag

SEQ ID NO: 3717776 - DNA, 14 bp, Homo sapiens
ccaggttcagcttg

SEQ ID NO: 3717777 - DNA, 22 bp, Homo sapiens
ccaggttctggttagctcagcc

SEQ ID NO: 3717778 - DNA, 16 bp, Homo sapiens
ccaggttgaaagacct

SEQ ID NO: 3717779 - DNA, 24 bp, Homo sapiens
ccagtaaagtgtaacatatgcaaa

SEQ ID NO: 3717780 - DNA, 18 bp, Homo sapiens
ccagtacctccaagcaag

SEQ ID NO: 3717781 - DNA, 16 bp, Homo sapiens
ccagtacctttgtcac

SEQ ID NO: 3717782 - DNA, 17 bp, Homo sapiens
ccagtacctttgtcaca

SEQ ID NO: 3717783 - DNA, 16 bp, Homo sapiens
ccagtacgtgctaaca

SEQ ID NO: 3717784 - DNA, 14 bp, Homo sapiens
ccagtactggagct

SEQ ID NO: 3717785 - DNA, 19 bp, Homo sapiens
ccagtcaggtagttgcaat

SEQ ID NO: 3717786 - DNA, 22 bp, Homo sapiens
ccagtccctgggggaagccctg

SEQ ID NO: 3717787 - DNA, 16 bp, Homo sapiens
ccagtcctgcctggcc

SEQ ID NO: 3717788 - DNA, 14 bp, Homo sapiens
ccagtcctgctctc

SEQ ID NO: 3717789 - DNA, 19 bp, Homo sapiens
ccagtctcccaggccccct

SEQ ID NO: 3717790 - DNA, 22 bp, Homo sapiens
ccagtctcccaggccccctgca

SEQ ID NO: 3717791 - DNA, 17 bp, Homo sapiens
ccagtctgaagtttcat

SEQ ID NO: 3717792 - DNA, 21 bp, Homo sapiens
ccagtctgaagtttcatttat

SEQ ID NO: 3717793 - DNA, 14 bp, Homo sapiens
ccagtgaaaactag

SEQ ID NO: 3717794 - DNA, 15 bp, Homo sapiens
ccagtgaaaactaga

SEQ ID NO: 3717795 - DNA, 16 bp, Homo sapiens
ccagtgacacttcaga

SEQ ID NO: 3717796 - DNA, 19 bp, Homo sapiens
ccagtgacacttcagagag

SEQ ID NO: 3717797 - DNA, 23 bp, Homo sapiens
ccagtgacacttcagagagctgg

SEQ ID NO: 3717798 - DNA, 17 bp, Homo sapiens
ccagtgacccctgacct

SEQ ID NO: 3717799 - DNA, 18 bp, Homo sapiens
ccagtgacctgaggaagc

SEQ ID NO: 3717800 - DNA, 21 bp, Homo sapiens
ccagtgatgctaaaggttgta

SEQ ID NO: 3717801 - DNA, 14 bp, Homo sapiens
ccagtgcaacactg

SEQ ID NO: 3717802 - DNA, 23 bp, Homo sapiens
ccagtgcccacaggatcagtctg

SEQ ID NO: 3717803 - DNA, 21 bp, Homo sapiens
ccagtgccttacctcctgccc

SEQ ID NO: 3717804 - DNA, 22 bp, Homo sapiens
ccagtggaacagcgggagacct

SEQ ID NO: 3717805 - DNA, 17 bp, Homo sapiens
ccagtggcctcaaccct

SEQ ID NO: 3717806 - DNA, 14 bp, Homo sapiens
ccagtgtgacaagg

SEQ ID NO: 3717807 - DNA, 22 bp, Homo sapiens
ccagtgtgggaatgcggcaaga

SEQ ID NO: 3717808 - DNA, 16 bp, Homo sapiens
ccagtgtgtggctttc

SEQ ID NO: 3717809 - DNA, 23 bp, Homo sapiens
ccagtgtgtggctttcagagcct

SEQ ID NO: 3717810 - DNA, 17 bp, Homo sapiens
ccagtgttgtttgtaaa

SEQ ID NO: 3717811 - DNA, 21 bp, Homo sapiens
ccagtgttgtttgtaaataag

SEQ ID NO: 3717812 - DNA, 22 bp, Homo sapiens
ccagttagcctctgcaggatgt

SEQ ID NO: 3717813 - DNA, 20 bp, Homo sapiens
ccagttattttccgccctca

SEQ ID NO: 3717814 - DNA, 14 bp, Homo sapiens
ccagttcaggagtc

SEQ ID NO: 3717815 - DNA, 21 bp, Homo sapiens
ccagttcctttcaatggtttg

SEQ ID NO: 3717816 - DNA, 23 bp, Homo sapiens
ccagttgggtggatgcctggtgg

SEQ ID NO: 3717817 - DNA, 13 bp, Homo sapiens
ccagtttgcagaa

SEQ ID NO: 3717818 - DNA, 17 bp, Homo sapiens
ccataagcctccattta

SEQ ID NO: 3717819 - DNA, 17 bp, Homo sapiens
ccataattttcttcatg

SEQ ID NO: 3717820 - DNA, 18 bp, Homo sapiens
ccatactctgtctcccta

SEQ ID NO: 3717821 - DNA, 21 bp, Homo sapiens
ccatagcaagattgcttaaaa

SEQ ID NO: 3717822 - DNA, 22 bp, Homo sapiens
ccatagtatattaaaaatggta

SEQ ID NO: 3717823 - DNA, 12 bp, Homo sapiens
ccatatgctgtt

SEQ ID NO: 3717824 - DNA, 19 bp, Homo sapiens
ccatattctgttggccagt

SEQ ID NO: 3717825 - DNA, 23 bp, Homo sapiens
ccatattctgttggccagtgtga

SEQ ID NO: 3717826 - DNA, 16 bp, Homo sapiens
ccatcaaagtggcaaa

SEQ ID NO: 3717827 - DNA, 13 bp, Homo sapiens
ccatcaacctctg

SEQ ID NO: 3717828 - DNA, 16 bp, Homo sapiens
ccatcacgcctgtgca

SEQ ID NO: 3717829 - DNA, 18 bp, Homo sapiens
ccatcactggagcaccag

SEQ ID NO: 3717830 - DNA, 12 bp, Homo sapiens
ccatcagaggcc

SEQ ID NO: 3717831 - DNA, 24 bp, Homo sapiens
ccatcagctgtaagaagagactgg

SEQ ID NO: 3717832 - DNA, 13 bp, Homo sapiens
ccatcatgtctgg

SEQ ID NO: 3717833 - DNA, 22 bp, Homo sapiens
ccatccactctaccctcccacc

SEQ ID NO: 3717834 - DNA, 21 bp, Homo sapiens
ccatccagggatgccatctgt

SEQ ID NO: 3717835 - DNA, 12 bp, Homo sapiens
ccatcccacacc

SEQ ID NO: 3717836 - DNA, 15 bp, Homo sapiens
ccatcccatcccatc

SEQ ID NO: 3717837 - DNA, 13 bp, Homo sapiens
ccatcccatcccg

SEQ ID NO: 3717838 - DNA, 17 bp, Homo sapiens
ccatcccctatggacca

SEQ ID NO: 3717839 - DNA, 21 bp, Homo sapiens
ccatcctaatcatccaatgct

SEQ ID NO: 3717840 - DNA, 14 bp, Homo sapiens
ccatcctccccttc

SEQ ID NO: 3717841 - DNA, 17 bp, Homo sapiens
ccatcctccccttccct

SEQ ID NO: 3717842 - DNA, 18 bp, Homo sapiens
ccatcctccccttccctg

SEQ ID NO: 3717843 - DNA, 21 bp, Homo sapiens
ccatcctccccttccctgcaa

SEQ ID NO: 3717844 - DNA, 16 bp, Homo sapiens
ccatcgctgtcatctc

SEQ ID NO: 3717845 - DNA, 18 bp, Homo sapiens
ccatcggtcctgtctccc

SEQ ID NO: 3717846 - DNA, 14 bp, Homo sapiens
ccatctacccctgg

SEQ ID NO: 3717847 - DNA, 18 bp, Homo sapiens
ccatctacccctggatga

SEQ ID NO: 3717848 - DNA, 13 bp, Homo sapiens
ccatctaccctcc

SEQ ID NO: 3717849 - DNA, 24 bp, Homo sapiens
ccatctccctcgaacccacactgc

SEQ ID NO: 3717850 - DNA, 17 bp, Homo sapiens
ccatctcctttcaggga

SEQ ID NO: 3717851 - DNA, 22 bp, Homo sapiens
ccatctcgccacccctccttcc

SEQ ID NO: 3717852 - DNA, 14 bp, Homo sapiens
ccatctctccctcc

SEQ ID NO: 3717853 - DNA, 19 bp, Homo sapiens
ccatctgcacccccctggg

SEQ ID NO: 3717854 - DNA, 19 bp, Homo sapiens
ccatcttgcccgctcaggc

SEQ ID NO: 3717855 - DNA, 19 bp, Homo sapiens
ccatgaaaacgttttattg

SEQ ID NO: 3717856 - DNA, 23 bp, Homo sapiens
ccatgaaaacgttttattgtgtt

SEQ ID NO: 3717857 - DNA, 18 bp, Homo sapiens
ccatgaactggaggccag

SEQ ID NO: 3717858 - DNA, 19 bp, Homo sapiens
ccatgaagacaggacagtg

SEQ ID NO: 3717859 - DNA, 18 bp, Homo sapiens
ccatgacttgagaaacaa

SEQ ID NO: 3717860 - DNA, 13 bp, Homo sapiens
ccatgagctccag

SEQ ID NO: 3717861 - DNA, 16 bp, Homo sapiens
ccatgagctccagacc

SEQ ID NO: 3717862 - DNA, 18 bp, Homo sapiens
ccatgagctccagacccc

SEQ ID NO: 3717863 - DNA, 20 bp, Homo sapiens
ccatgaggagttgctgtttg

SEQ ID NO: 3717864 - DNA, 13 bp, Homo sapiens
ccatgcaaggtgc

SEQ ID NO: 3717865 - DNA, 20 bp, Homo sapiens
ccatgcaaggtgcccacatg

SEQ ID NO: 3717866 - DNA, 21 bp, Homo sapiens
ccatgcaccctcatacacaga

SEQ ID NO: 3717867 - DNA, 13 bp, Homo sapiens
ccatgcctgtcca

SEQ ID NO: 3717868 - DNA, 14 bp, Homo sapiens
ccatgcctgtccag

SEQ ID NO: 3717869 - DNA, 19 bp, Homo sapiens
ccatgcctgtccagcctgg

SEQ ID NO: 3717870 - DNA, 13 bp, Homo sapiens
ccatgctcctggc

SEQ ID NO: 3717871 - DNA, 17 bp, Homo sapiens
ccatggagacaagaagg

SEQ ID NO: 3717872 - DNA, 21 bp, Homo sapiens
ccatggcgtgtccctctcgga

SEQ ID NO: 3717873 - DNA, 17 bp, Homo sapiens
ccatgggcctcctgtgt

SEQ ID NO: 3717874 - DNA, 14 bp, Homo sapiens
ccatggtgcctctg

SEQ ID NO: 3717875 - DNA, 16 bp, Homo sapiens
ccatggtgcctctgga

SEQ ID NO: 3717876 - DNA, 16 bp, Homo sapiens
cccctcccaccacagc

SEQ ID NO: 3717877 - DNA, 12 bp, Homo sapiens
cccctcccaggg

SEQ ID NO: 3717878 - DNA, 21 bp, Homo sapiens
cccctcccccaacccccaccc

SEQ ID NO: 3717879 - DNA, 19 bp, Homo sapiens
cccctcccctaatgcctgc

SEQ ID NO: 3717880 - DNA, 15 bp, Homo sapiens
cccctccctggctcc

SEQ ID NO: 3717881 - DNA, 15 bp, Homo sapiens
cccctcccttcaacc

SEQ ID NO: 3717882 - DNA, 11 bp, Homo sapiens
cccctcctctg

SEQ ID NO: 3717883 - DNA, 14 bp, Homo sapiens
cccctcctctgcca

SEQ ID NO: 3717884 - DNA, 12 bp, Homo sapiens
cccctccttctc

SEQ ID NO: 3717885 - DNA, 15 bp, Homo sapiens
cccctccttgcctcc

SEQ ID NO: 3717886 - DNA, 17 bp, Homo sapiens
cccctctcccagttgtc

SEQ ID NO: 3717887 - DNA, 12 bp, Homo sapiens
cccctctctcct

SEQ ID NO: 3717888 - DNA, 12 bp, Homo sapiens
cccctctgctgg

SEQ ID NO: 3717889 - DNA, 13 bp, Homo sapiens
cccctctggccag

SEQ ID NO: 3717890 - DNA, 16 bp, Homo sapiens
cccctctggccaggat

SEQ ID NO: 3717891 - DNA, 22 bp, Homo sapiens
cccctgcactggagtccagtct

SEQ ID NO: 3717892 - DNA, 24 bp, Homo sapiens
cccctgcatctatcgagtttgcaa

SEQ ID NO: 3717893 - DNA, 14 bp, Homo sapiens
cccctgccaccctg

SEQ ID NO: 3717894 - DNA, 22 bp, Homo sapiens
cccctgccccgtcaccatctca

SEQ ID NO: 3717895 - DNA, 23 bp, Homo sapiens
cccctgccccttctacactctcc

SEQ ID NO: 3717896 - DNA, 17 bp, Homo sapiens
cccctgcccggctgcgg

SEQ ID NO: 3717897 - DNA, 13 bp, Homo sapiens
cccctgccctgct

SEQ ID NO: 3717898 - DNA, 15 bp, Homo sapiens
cccctgccctgctgc

SEQ ID NO: 3717899 - DNA, 13 bp, Homo sapiens
cccctgccctggg

SEQ ID NO: 3717900 - DNA, 14 bp, Homo sapiens
cccctgctgcctcc

SEQ ID NO: 3717901 - DNA, 20 bp, Homo sapiens
cccctgctgcctccccaacc

SEQ ID NO: 3717902 - DNA, 20 bp, Homo sapiens
cccctggcttttcactgctg

SEQ ID NO: 3717903 - DNA, 23 bp, Homo sapiens
cccctggcttttcactgctggct

SEQ ID NO: 3717904 - DNA, 13 bp, Homo sapiens
cccctgggctctg

SEQ ID NO: 3717905 - DNA, 21 bp, Homo sapiens
cccctgggctctgccccagct

SEQ ID NO: 3717906 - DNA, 19 bp, Homo sapiens
cccctggtggacagtcctg

SEQ ID NO: 3717907 - DNA, 23 bp, Homo sapiens
cccctggtggacagtcctgggag

SEQ ID NO: 3717908 - DNA, 14 bp, Homo sapiens
cccctgtactccag

SEQ ID NO: 3717909 - DNA, 13 bp, Homo sapiens
ccccttcagtgcc

SEQ ID NO: 3717910 - DNA, 14 bp, Homo sapiens
ccccttcagtgccc

SEQ ID NO: 3717911 - DNA, 13 bp, Homo sapiens
ccccttccccact

SEQ ID NO: 3717912 - DNA, 14 bp, Homo sapiens
ccccttccctgcaa

SEQ ID NO: 3717913 - DNA, 19 bp, Homo sapiens
ccccttctacactctcctg

SEQ ID NO: 3717914 - DNA, 17 bp, Homo sapiens
ccccttgcccagggctc

SEQ ID NO: 3717915 - DNA, 18 bp, Homo sapiens
cccctttttactcccctt

SEQ ID NO: 3717916 - DNA, 19 bp, Homo sapiens
cccctttttactccccttg

SEQ ID NO: 3717917 - DNA, 17 bp, Homo sapiens
cccgaatagctgggact

SEQ ID NO: 3717918 - DNA, 23 bp, Homo sapiens
cccgagctgggggccatgagctc

SEQ ID NO: 3717919 - DNA, 12 bp, Homo sapiens
cccgagctggtg

SEQ ID NO: 3717920 - DNA, 14 bp, Homo sapiens
cccgagctggtgca

SEQ ID NO: 3717921 - DNA, 22 bp, Homo sapiens
cccgagctggtgcattacagag

SEQ ID NO: 3717922 - DNA, 19 bp, Homo sapiens
cccgaggctgcccactatg

SEQ ID NO: 3717923 - DNA, 21 bp, Homo sapiens
cccgagtagctgggactacag

SEQ ID NO: 3717924 - DNA, 22 bp, Homo sapiens
cccgcaatgtgcccccagacgc

SEQ ID NO: 3717925 - DNA, 16 bp, Homo sapiens
cccgcacccccaccct

SEQ ID NO: 3717926 - DNA, 17 bp, Homo sapiens
cccgcacccccaccctt

SEQ ID NO: 3717927 - DNA, 19 bp, Homo sapiens
cccgcaccccccaagctgt

SEQ ID NO: 3717928 - DNA, 16 bp, Homo sapiens
cccgcatgcagcagct

SEQ ID NO: 3717929 - DNA, 19 bp, Homo sapiens
cccgcatgcagcagcttgc

SEQ ID NO: 3717930 - DNA, 22 bp, Homo sapiens
cccgcatgcagcagcttgctgc

SEQ ID NO: 3717931 - DNA, 15 bp, Homo sapiens
cccgcattccaggct

SEQ ID NO: 3717932 - DNA, 17 bp, Homo sapiens
cccgcctggcagaactg

SEQ ID NO: 3717933 - DNA, 12 bp, Homo sapiens
cccgctcagccc

SEQ ID NO: 3717934 - DNA, 23 bp, Homo sapiens
cccgctcagccctccctgcccct

SEQ ID NO: 3717935 - DNA, 15 bp, Homo sapiens
cccgctcttttccta

SEQ ID NO: 3717936 - DNA, 22 bp, Homo sapiens
cccgctggctgggggcctcact

SEQ ID NO: 3717937 - DNA, 15 bp, Homo sapiens
cccgcttgtccagcg

SEQ ID NO: 3717938 - DNA, 18 bp, Homo sapiens
cccgcttgtccagcgcct

SEQ ID NO: 3717939 - DNA, 19 bp, Homo sapiens
cccggagattggacggcct

SEQ ID NO: 3717940 - DNA, 21 bp, Homo sapiens
cccggagctaacactggcccc

SEQ ID NO: 3717941 - DNA, 15 bp, Homo sapiens
cccggctccaggctc

SEQ ID NO: 3717942 - DNA, 22 bp, Homo sapiens
cccgggtttggcgggccaagga

SEQ ID NO: 3717943 - DNA, 18 bp, Homo sapiens
cccgtcatgttcctcaaa

SEQ ID NO: 3717944 - DNA, 15 bp, Homo sapiens
cccgtcttcagccta

SEQ ID NO: 3717945 - DNA, 17 bp, Homo sapiens
cccgtcttcagcctagc

SEQ ID NO: 3717946 - DNA, 18 bp, Homo sapiens
cccgtcttcagcctagcc

SEQ ID NO: 3717947 - DNA, 16 bp, Homo sapiens
cccgtgcaaaacatgc

SEQ ID NO: 3717948 - DNA, 19 bp, Homo sapiens
cccgttttatgatttactc

SEQ ID NO: 3717949 - DNA, 17 bp, Homo sapiens
ccctaacctcttttctg

SEQ ID NO: 3717950 - DNA, 20 bp, Homo sapiens
ccctacagttgaaaaacagc

SEQ ID NO: 3717951 - DNA, 17 bp, Homo sapiens
ccctaccacctccccag

SEQ ID NO: 3717952 - DNA, 18 bp, Homo sapiens
ccctacttcttttgctct

SEQ ID NO: 3717953 - DNA, 19 bp, Homo sapiens
ccctacttcttttgctctt

SEQ ID NO: 3717954 - DNA, 19 bp, Homo sapiens
ccctagagggttcctgtag

SEQ ID NO: 3717955 - DNA, 17 bp, Homo sapiens
ccctagggctgggtgta

SEQ ID NO: 3717956 - DNA, 22 bp, Homo sapiens
ccctaggtcagcttgctgccct

SEQ ID NO: 3717957 - DNA, 23 bp, Homo sapiens
ccctatatgtagtataaagaaaa

SEQ ID NO: 3717958 - DNA, 14 bp, Homo sapiens
ccctatccacccag

SEQ ID NO: 3717959 - DNA, 17 bp, Homo sapiens
ccctattggtaaagaat

SEQ ID NO: 3717960 - DNA, 13 bp, Homo sapiens
ccctcacccctgc

SEQ ID NO: 3717961 - DNA, 17 bp, Homo sapiens
ccctcacctgggcacct

SEQ ID NO: 3717962 - DNA, 18 bp, Homo sapiens
ccctcaccttgcaacaca

SEQ ID NO: 3717963 - DNA, 13 bp, Homo sapiens
ccctcagagccac

SEQ ID NO: 3717964 - DNA, 12 bp, Homo sapiens
ccctcagcccct

SEQ ID NO: 3717965 - DNA, 21 bp, Homo sapiens
ccctcagcccctcttgccccc

SEQ ID NO: 3717966 - DNA, 23 bp, Homo sapiens
ccctcagcccctcttgcccccca

SEQ ID NO: 3717967 - DNA, 21 bp, Homo sapiens
ccctcaggaccctcgctggcc

SEQ ID NO: 3717968 - DNA, 18 bp, Homo sapiens
ccctcaggcataggcctg

SEQ ID NO: 3717969 - DNA, 23 bp, Homo sapiens
ccctcaggcataggcctgggtgc

SEQ ID NO: 3717970 - DNA, 14 bp, Homo sapiens
ccctcatgccaacc

SEQ ID NO: 3717971 - DNA, 12 bp, Homo sapiens
ccctccactcct

SEQ ID NO: 3717972 - DNA, 17 bp, Homo sapiens
ccctccactccttcctg

SEQ ID NO: 3717973 - DNA, 17 bp, Homo sapiens
ccctccatgtgggctag

SEQ ID NO: 3717974 - DNA, 13 bp, Homo sapiens
ccctcccagctct

SEQ ID NO: 3717975 - DNA, 15 bp, Homo sapiens
ccctcccagctctga

SEQ ID NO: 3717976 - DNA, 13 bp, Homo sapiens
ccctccccagggg

SEQ ID NO: 3717977 - DNA, 16 bp, Homo sapiens
ccctcccccaaccccc

SEQ ID NO: 3717978 - DNA, 16 bp, Homo sapiens
ccctccccgcaccccc

SEQ ID NO: 3717979 - DNA, 13 bp, Homo sapiens
ccctccctacctc

SEQ ID NO: 3717980 - DNA, 14 bp, Homo sapiens
ccctccctacctca

SEQ ID NO: 3717981 - DNA, 13 bp, Homo sapiens
ccctccctcagcc

SEQ ID NO: 3717982 - DNA, 16 bp, Homo sapiens
ccctccctcagcccct

SEQ ID NO: 3717983 - DNA, 13 bp, Homo sapiens
ccctccctctttc

SEQ ID NO: 3717984 - DNA, 14 bp, Homo sapiens
ccctccctgcccct

SEQ ID NO: 3717985 - DNA, 17 bp, Homo sapiens
ccctccctggcctgttc

SEQ ID NO: 3717986 - DNA, 16 bp, Homo sapiens
ccctccctggctccca

SEQ ID NO: 3717987 - DNA, 13 bp, Homo sapiens
ccctccctgtcct

SEQ ID NO: 3717988 - DNA, 16 bp, Homo sapiens
ccctccgccaggcgag

SEQ ID NO: 3717989 - DNA, 18 bp, Homo sapiens
ccctccgccaggcgagat

SEQ ID NO: 3717990 - DNA, 15 bp, Homo sapiens
cctctccccagcaag

SEQ ID NO: 3717991 - DNA, 20 bp, Homo sapiens
cctctccccagcaagtgaga

SEQ ID NO: 3717992 - DNA, 13 bp, Homo sapiens
cctctccctgttg

SEQ ID NO: 3717993 - DNA, 19 bp, Homo sapiens
cctctcggtggccagcagg

SEQ ID NO: 3717994 - DNA, 16 bp, Homo sapiens
cctctctaacctcctt

SEQ ID NO: 3717995 - DNA, 17 bp, Homo sapiens
cctctctaacctccttt

SEQ ID NO: 3717996 - DNA, 19 bp, Homo sapiens
cctctctcttctgctccac

SEQ ID NO: 3717997 - DNA, 21 bp, Homo sapiens
cctctctcttctgctccaccc

SEQ ID NO: 3717998 - DNA, 23 bp, Homo sapiens
cctctctgatcttgtgctcagca

SEQ ID NO: 3717999 - DNA, 16 bp, Homo sapiens
cctctcttcctatccc

SEQ ID NO: 3718000 - DNA, 23 bp, Homo sapiens
cctctcttcctatcccatcccat

SEQ ID NO: 3718001 - DNA, 18 bp, Homo sapiens
cctctcttggtttccttc

SEQ ID NO: 3718002 - DNA, 23 bp, Homo sapiens
cctctgaaaaccaatgttctctc

SEQ ID NO: 3718003 - DNA, 16 bp, Homo sapiens
cctctgacacacagct

SEQ ID NO: 3718004 - DNA, 21 bp, Homo sapiens
cctctgacacacagctctgtc

SEQ ID NO: 3718005 - DNA, 14 bp, Homo sapiens
cctctgactcccaa

SEQ ID NO: 3718006 - DNA, 21 bp, Homo sapiens
cctctgactcccaaagagctg

SEQ ID NO: 3718007 - DNA, 22 bp, Homo sapiens
cctctgactcccaaagagctgc

SEQ ID NO: 3718008 - DNA, 12 bp, Homo sapiens
cctctgccacct

SEQ ID NO: 3718009 - DNA, 13 bp, Homo sapiens
cctctgccacctc

SEQ ID NO: 3718010 - DNA, 16 bp, Homo sapiens
cctctgccacctcccc

SEQ ID NO: 3718011 - DNA, 12 bp, Homo sapiens
cctctgcctcaa

SEQ ID NO: 3718012 - DNA, 13 bp, Homo sapiens
cctctgcctcaat

SEQ ID NO: 3718013 - DNA, 21 bp, Homo sapiens
cctctgcctctgacacacagc

SEQ ID NO: 3718014 - DNA, 23 bp, Homo sapiens
cctctgcctctgacacacagctc

SEQ ID NO: 3718015 - DNA, 11 bp, Homo sapiens
cctctgcctga

SEQ ID NO: 3718016 - DNA, 20 bp, Homo sapiens
cctctgcctgaagtcacaca

SEQ ID NO: 3718017 - DNA, 17 bp, Homo sapiens
cctctgcctgtccctct

SEQ ID NO: 3718018 - DNA, 19 bp, Homo sapiens
cctctgctggccgggcaca

SEQ ID NO: 3718019 - DNA, 14 bp, Homo sapiens
cctctggactggct

SEQ ID NO: 3718020 - DNA, 15 bp, Homo sapiens
cctctggactggcta

SEQ ID NO: 3718021 - DNA, 17 bp, Homo sapiens
cctctggactggctaga

SEQ ID NO: 3718022 - DNA, 18 bp, Homo sapiens
cctctggactggctagag

SEQ ID NO: 3718023 - DNA, 18 bp, Homo sapiens
cctctggaggcctctggg

SEQ ID NO: 3718024 - DNA, 19 bp, Homo sapiens
cctctggaggcctctgggc

SEQ ID NO: 3718025 - DNA, 12 bp, Homo sapiens
cctctggctaga

SEQ ID NO: 3718026 - DNA, 24 bp, Homo sapiens
cctctggctagaggccagccccac

SEQ ID NO: 3718027 - DNA, 22 bp, Homo sapiens
cctctggctggctaactggaag

SEQ ID NO: 3718028 - DNA, 10 bp, Homo sapiens
cctctgggct

SEQ ID NO: 3718029 - DNA, 23 bp, Homo sapiens
cctctgtatttgaatcagcctac

SEQ ID NO: 3718030 - DNA, 14 bp, Homo sapiens
cctctgtccagggc

SEQ ID NO: 3718031 - DNA, 18 bp, Homo sapiens
cctcttaaaaaataaaaa

SEQ ID NO: 3718032 - DNA, 17 bp, Homo sapiens
cctcttaaagctgcctg

SEQ ID NO: 3718033 - DNA, 22 bp, Homo sapiens
cctcttaaagctgcctgtagtt

SEQ ID NO: 3718034 - DNA, 17 bp, Homo sapiens
cctcttaaataaacctt

SEQ ID NO: 3718035 - DNA, 18 bp, Homo sapiens
cctcttatgtacctcttt

SEQ ID NO: 3718036 - DNA, 12 bp, Homo sapiens
cctcttccccac

SEQ ID NO: 3718037 - DNA, 22 bp, Homo sapiens
cctcttccccagaaaggagact

SEQ ID NO: 3718038 - DNA, 20 bp, Homo sapiens
cctcttccggagatgtagca

SEQ ID NO: 3718039 - DNA, 16 bp, Homo sapiens
cctcttcctccctcat

SEQ ID NO: 3718040 - DNA, 17 bp, Homo sapiens
cctcttctattttgtaa

SEQ ID NO: 3718041 - DNA, 14 bp, Homo sapiens
cctcttcttacttg

SEQ ID NO: 3718042 - DNA, 15 bp, Homo sapiens
cctcttcttcttcag

SEQ ID NO: 3718043 - DNA, 12 bp, Homo sapiens
cctcttgccccc

SEQ ID NO: 3718044 - DNA, 16 bp, Homo sapiens
cctcttgccccccacc

SEQ ID NO: 3718045 - DNA, 17 bp, Homo sapiens
cctcttgcggtcccttc

SEQ ID NO: 3718046 - DNA, 17 bp, Homo sapiens
cctctttcagaaaacag

SEQ ID NO: 3718047 - DNA, 21 bp, Homo sapiens
cctctttcagaaaacagaaaa

SEQ ID NO: 3718048 - DNA, 23 bp, Homo sapiens
cctctttcagaaaacagaaaaaa

SEQ ID NO: 3718049 - DNA, 19 bp, Homo sapiens
cctctttccctcccttcct

SEQ ID NO: 3718050 - DNA, 17 bp, Homo sapiens
cctcttttagtcatttt

SEQ ID NO: 3718051 - DNA, 20 bp, Homo sapiens
cctctttttccatcataatt

SEQ ID NO: 3718052 - DNA, 21 bp, Homo sapiens
cctgaaaatgtttttctgcca

SEQ ID NO: 3718053 - DNA, 14 bp, Homo sapiens
cctgaaagccctga

SEQ ID NO: 3718054 - DNA, 19 bp, Homo sapiens
cctgaacacttattgcttt

SEQ ID NO: 3718055 - DNA, 14 bp, Homo sapiens
cctgaagaacagta

SEQ ID NO: 3718056 - DNA, 17 bp, Homo sapiens
cctgaagtcacacagtg

SEQ ID NO: 3718057 - DNA, 20 bp, Homo sapiens
cctgaagtcacacagtgagt

SEQ ID NO: 3718058 - DNA, 14 bp, Homo sapiens
cctgaccctgcaga

SEQ ID NO: 3718059 - DNA, 20 bp, Homo sapiens
cctgacggcgcccccagtgt

SEQ ID NO: 3718060 - DNA, 13 bp, Homo sapiens
cctgactctctgt

SEQ ID NO: 3718061 - DNA, 15 bp, Homo sapiens
cctgactctctgtga

SEQ ID NO: 3718062 - DNA, 16 bp, Homo sapiens
cctgactctctgtgac

SEQ ID NO: 3718063 - DNA, 15 bp, Homo sapiens
cctgagacaaatgga

SEQ ID NO: 3718064 - DNA, 19 bp, Homo sapiens
cctgagatggccctctggt

SEQ ID NO: 3718065 - DNA, 21 bp, Homo sapiens
cctgagcaacagagtgagacc

SEQ ID NO: 3718066 - DNA, 19 bp, Homo sapiens
cctgagcacctcccagccc

SEQ ID NO: 3718067 - DNA, 15 bp, Homo sapiens
cctgagctcggtgga

SEQ ID NO: 3718068 - DNA, 16 bp, Homo sapiens
cctgagctcggtggac

SEQ ID NO: 3718069 - DNA, 19 bp, Homo sapiens
cctgagctcggtggaccca

SEQ ID NO: 3718070 - DNA, 20 bp, Homo sapiens
cctgagctcggtggacccag

SEQ ID NO: 3718071 - DNA, 17 bp, Homo sapiens
cctgagcttggccagaa

SEQ ID NO: 3718072 - DNA, 15 bp, Homo sapiens
cctgagctttggaca

SEQ ID NO: 3718073 - DNA, 18 bp, Homo sapiens
cctgagctttggacacac

SEQ ID NO: 3718074 - DNA, 23 bp, Homo sapiens
cctgagctttggacgcacacagc

SEQ ID NO: 3718075 - DNA, 23 bp, Homo sapiens
cctgaggaagcgtgaaggccgag

SEQ ID NO: 3718076 - DNA, 17 bp, Homo sapiens
cctgaggatcagaaagt

SEQ ID NO: 3718077 - DNA, 21 bp, Homo sapiens
cctgaggctgagactgcggga

SEQ ID NO: 3718078 - DNA, 19 bp, Homo sapiens
cctgaggctggactccaga

SEQ ID NO: 3718079 - DNA, 18 bp, Homo sapiens
cctgaggggcatctgccc

SEQ ID NO: 3718080 - DNA, 23 bp, Homo sapiens
cctgaggggcatctgcccctccc

SEQ ID NO: 3718081 - DNA, 15 bp, Homo sapiens
cctgagtcaccagga

SEQ ID NO: 3718082 - DNA, 15 bp, Homo sapiens
cctgagtcacccatg

SEQ ID NO: 3718083 - DNA, 18 bp, Homo sapiens
cctgatcccactcctagg

SEQ ID NO: 3718084 - DNA, 19 bp, Homo sapiens
cctgatcccactcctagga

SEQ ID NO: 3718085 - DNA, 19 bp, Homo sapiens
cctgatgacccaggctgcc

SEQ ID NO: 3718086 - DNA, 21 bp, Homo sapiens
cctgatgacccaggctgcctg

SEQ ID NO: 3718087 - DNA, 14 bp, Homo sapiens
cctgatgctccctc

SEQ ID NO: 3718088 - DNA, 19 bp, Homo sapiens
cctgatgctccctcccctg

SEQ ID NO: 3718089 - DNA, 20 bp, Homo sapiens
cctgattgtgtatattcata

SEQ ID NO: 3718090 - DNA, 14 bp, Homo sapiens
cctgcaaaatttta

SEQ ID NO: 3718091 - DNA, 22 bp, Homo sapiens
cctgcacaaagcccttccatgt

SEQ ID NO: 3718092 - DNA, 12 bp, Homo sapiens
cctgcaccagga

SEQ ID NO: 3718093 - DNA, 17 bp, Homo sapiens
cctgcaccaggagacag

SEQ ID NO: 3718094 - DNA, 17 bp, Homo sapiens
cctgcacctccccccac

SEQ ID NO: 3718095 - DNA, 21 bp, Homo sapiens
cctgcactaatttgatgttta

SEQ ID NO: 3718096 - DNA, 20 bp, Homo sapiens
cctgcactgacccacagcct

SEQ ID NO: 3718097 - DNA, 20 bp, Homo sapiens
cctgcactggagtccagtct

SEQ ID NO: 3718098 - DNA, 18 bp, Homo sapiens
cctgcacttgcagactct

SEQ ID NO: 3718099 - DNA, 14 bp, Homo sapiens
cctgcagcagagcc

SEQ ID NO: 3718100 - DNA, 21 bp, Homo sapiens
cctgcagcagagcctggaaga

SEQ ID NO: 3718101 - DNA, 13 bp, Homo sapiens
cctgcagcctgga

SEQ ID NO: 3718102 - DNA, 20 bp, Homo sapiens
cctgcagtactttacctcct

SEQ ID NO: 3718103 - DNA, 17 bp, Homo sapiens
cgatgtggccctggcct

SEQ ID NO: 3718104 - DNA, 22 bp, Homo sapiens
cgatgtggccctggcctgctgg

SEQ ID NO: 3718105 - DNA, 14 bp, Homo sapiens
cgatttgtcccagg

SEQ ID NO: 3718106 - DNA, 18 bp, Homo sapiens
cgcaatgtgcccccagac

SEQ ID NO: 3718107 - DNA, 10 bp, Homo sapiens
cgcacacaca

SEQ ID NO: 3718108 - DNA, 15 bp, Homo sapiens
cgcacacacacacac

SEQ ID NO: 3718109 - DNA, 13 bp, Homo sapiens
cgcacccccaccc

SEQ ID NO: 3718110 - DNA, 17 bp, Homo sapiens
cgcaccccccaagctgt

SEQ ID NO: 3718111 - DNA, 10 bp, Homo sapiens
cgcagccctg

SEQ ID NO: 3718112 - DNA, 13 bp, Homo sapiens
cgcaggaagctgc

SEQ ID NO: 3718113 - DNA, 13 bp, Homo sapiens
cgcatcagacaga

SEQ ID NO: 3718114 - DNA, 21 bp, Homo sapiens
cgcatcttctccatctggcag

SEQ ID NO: 3718115 - DNA, 22 bp, Homo sapiens
cgcatggagtgtgtattgttcc

SEQ ID NO: 3718116 - DNA, 13 bp, Homo sapiens
cgccaaggctggg

SEQ ID NO: 3718117 - DNA, 17 bp, Homo sapiens
cgccacccctccttcct

SEQ ID NO: 3718118 - DNA, 21 bp, Homo sapiens
cgccactacactccagcctga

SEQ ID NO: 3718119 - DNA, 22 bp, Homo sapiens
cgccactacactccagcctgag

SEQ ID NO: 3718120 - DNA, 13 bp, Homo sapiens
cgccactgcactc

SEQ ID NO: 3718121 - DNA, 22 bp, Homo sapiens
cgccaggggaaaatcagcctgc

SEQ ID NO: 3718122 - DNA, 14 bp, Homo sapiens
cgccagtctcccag

SEQ ID NO: 3718123 - DNA, 23 bp, Homo sapiens
cgcccagctgcacctgccagcct

SEQ ID NO: 3718124 - DNA, 15 bp, Homo sapiens
cgcccaggagacatc

SEQ ID NO: 3718125 - DNA, 19 bp, Homo sapiens
cgcccagtctggaatgcag

SEQ ID NO: 3718126 - DNA, 21 bp, Homo sapiens
cgcccagtctggaatgcagtg

SEQ ID NO: 3718127 - DNA, 23 bp, Homo sapiens
cgcccagttgggtggatgcctgg

SEQ ID NO: 3718128 - DNA, 13 bp, Homo sapiens
cgcccatgtgtga

SEQ ID NO: 3718129 - DNA, 12 bp, Homo sapiens
cgccccagcctc

SEQ ID NO: 3718130 - DNA, 14 bp, Homo sapiens
cgccccagcctctg

SEQ ID NO: 3718131 - DNA, 23 bp, Homo sapiens
cgcccccgggtttggcgggccaa

SEQ ID NO: 3718132 - DNA, 13 bp, Homo sapiens
cgccccgccccac

SEQ ID NO: 3718133 - DNA, 17 bp, Homo sapiens
cgcccgaggtggctgcc

SEQ ID NO: 3718134 - DNA, 15 bp, Homo sapiens
cgccctaggcctggc

SEQ ID NO: 3718135 - DNA, 20 bp, Homo sapiens
cgccctcattacggctcctc

SEQ ID NO: 3718136 - DNA, 13 bp, Homo sapiens
cgccctcttcccc

SEQ ID NO: 3718137 - DNA, 15 bp, Homo sapiens
cgcctcccagcctgg

SEQ ID NO: 3718138 - DNA, 13 bp, Homo sapiens
cgcctctgcattc

SEQ ID NO: 3718139 - DNA, 11 bp, Homo sapiens
cgcctggcaga

SEQ ID NO: 3718140 - DNA, 18 bp, Homo sapiens
cgcctgtaatcccagcag

SEQ ID NO: 3718141 - DNA, 20 bp, Homo sapiens
cgcctgtagtcctagccact

SEQ ID NO: 3718142 - DNA, 23 bp, Homo sapiens
cgccttaggtacttattccagat

SEQ ID NO: 3718143 - DNA, 19 bp, Homo sapiens
cgcggtggctcacgcctgt

SEQ ID NO: 3718144 - DNA, 16 bp, Homo sapiens
cgcgtgcacacaccag

SEQ ID NO: 3718145 - DNA, 21 bp, Homo sapiens
cgctaatcccgattcaccctg

SEQ ID NO: 3718146 - DNA, 21 bp, Homo sapiens
cgctcagccctccctgcccct

SEQ ID NO: 3718147 - DNA, 17 bp, Homo sapiens
cgctcctgtctgccagc

SEQ ID NO: 3718148 - DNA, 17 bp, Homo sapiens
cgctgcctaagtggctg

SEQ ID NO: 3718149 - DNA, 18 bp, Homo sapiens
cgctggagtgcagtgagc

SEQ ID NO: 3718150 - DNA, 12 bp, Homo sapiens
cgctggccccca

SEQ ID NO: 3718151 - DNA, 16 bp, Homo sapiens
cgctgtctccagaccc

SEQ ID NO: 3718152 - DNA, 12 bp, Homo sapiens
cgcttctgactg

SEQ ID NO: 3718153 - DNA, 20 bp, Homo sapiens
cgcttgtccagcgcctagtg

SEQ ID NO: 3718154 - DNA, 17 bp, Homo sapiens
cgctttctacactgtat

SEQ ID NO: 3718155 - DNA, 19 bp, Homo sapiens
cgcttttgctggtcactgc

SEQ ID NO: 3718156 - DNA, 13 bp, Homo sapiens
cggaaagcagctc

SEQ ID NO: 3718157 - DNA, 15 bp, Homo sapiens
cggaacaagcctaaa

SEQ ID NO: 3718158 - DNA, 13 bp, Homo sapiens
cggaagagccttg

SEQ ID NO: 3718159 - DNA, 18 bp, Homo sapiens
cggaaggacctatgtttg

SEQ ID NO: 3718160 - DNA, 19 bp, Homo sapiens
cggaaggacctatgtttgc

SEQ ID NO: 3718161 - DNA, 17 bp, Homo sapiens
cggaatagttggctagg

SEQ ID NO: 3718162 - DNA, 17 bp, Homo sapiens
cggaatcctgtcctcag

SEQ ID NO: 3718163 - DNA, 13 bp, Homo sapiens
cggacaagtttta

SEQ ID NO: 3718164 - DNA, 21 bp, Homo sapiens
cggacagccacggccaggcca

SEQ ID NO: 3718165 - DNA, 12 bp, Homo sapiens
cggacgggctgt

SEQ ID NO: 3718166 - DNA, 23 bp, Homo sapiens
cggagagcgcctgcccctcccag

SEQ ID NO: 3718167 - DNA, 22 bp, Homo sapiens
cggagcctcatccgaggcaggg

SEQ ID NO: 3718168 - DNA, 18 bp, Homo sapiens
cggaggcttgtcagagct

SEQ ID NO: 3718169 - DNA, 23 bp, Homo sapiens
cggaggcttgtcagagctgggag

SEQ ID NO: 3718170 - DNA, 17 bp, Homo sapiens
cggagggattcccctaa

SEQ ID NO: 3718171 - DNA, 13 bp, Homo sapiens
cggaggttgcagg

SEQ ID NO: 3718172 - DNA, 20 bp, Homo sapiens
cggagtcccaccttggctgc

SEQ ID NO: 3718173 - DNA, 23 bp, Homo sapiens
cggagtcccaccttggctgcagg

SEQ ID NO: 3718174 - DNA, 16 bp, Homo sapiens
cggagttcctaacagg

SEQ ID NO: 3718175 - DNA, 22 bp, Homo sapiens
cggcaggacaacgaggaagccc

SEQ ID NO: 3718176 - DNA, 20 bp, Homo sapiens
cggcagttctgggtgctccc

SEQ ID NO: 3718177 - DNA, 23 bp, Homo sapiens
cggcattggttccctttgctcca

SEQ ID NO: 3718178 - DNA, 12 bp, Homo sapiens
cggccaggccag

SEQ ID NO: 3718179 - DNA, 17 bp, Homo sapiens
cggcccaggatggcttt

SEQ ID NO: 3718180 - DNA, 18 bp, Homo sapiens
cggcccctgctggttcag

SEQ ID NO: 3718181 - DNA, 16 bp, Homo sapiens
cggccgcattccctga

SEQ ID NO: 3718182 - DNA, 18 bp, Homo sapiens
cggccgcattccctgagt

SEQ ID NO: 3718183 - DNA, 19 bp, Homo sapiens
cggccgtcttcactcgccc

SEQ ID NO: 3718184 - DNA, 17 bp, Homo sapiens
cggcctgatgctccctc

SEQ ID NO: 3718185 - DNA, 19 bp, Homo sapiens
cggccttcaactgaaaaga

SEQ ID NO: 3718186 - DNA, 15 bp, Homo sapiens
cggcctttggcttca

SEQ ID NO: 3718187 - DNA, 17 bp, Homo sapiens
cggcgcccccagtgtgc

SEQ ID NO: 3718188 - DNA, 13 bp, Homo sapiens
cggcgcggtggct

SEQ ID NO: 3718189 - DNA, 17 bp, Homo sapiens
cggctcactgcagcctc

SEQ ID NO: 3718190 - DNA, 14 bp, Homo sapiens
cggctccaggctcc

SEQ ID NO: 3718191 - DNA, 16 bp, Homo sapiens
cggctccaggctcctt

SEQ ID NO: 3718192 - DNA, 12 bp, Homo sapiens
cggctcctggac

SEQ ID NO: 3718193 - DNA, 15 bp, Homo sapiens
cggctggtgcagggc

SEQ ID NO: 3718194 - DNA, 13 bp, Homo sapiens
cgggaacagtgtt

SEQ ID NO: 3718195 - DNA, 16 bp, Homo sapiens
cgggaagccaccctcc

SEQ ID NO: 3718196 - DNA, 12 bp, Homo sapiens
cgggaagcggag

SEQ ID NO: 3718197 - DNA, 14 bp, Homo sapiens
cgggaaggagggtt

SEQ ID NO: 3718198 - DNA, 16 bp, Homo sapiens
cgggagacctgtgcta

SEQ ID NO: 3718199 - DNA, 14 bp, Homo sapiens
cgggagcagtgtct

SEQ ID NO: 3718200 - DNA, 15 bp, Homo sapiens
cgggagcagtgtctt

SEQ ID NO: 3718201 - DNA, 16 bp, Homo sapiens
cgggaggtcgaggcag

SEQ ID NO: 3718202 - DNA, 18 bp, Homo sapiens
cgggatggtcctggggct

SEQ ID NO: 3718203 - DNA, 14 bp, Homo sapiens
cgggcacaataaat

SEQ ID NO: 3718204 - DNA, 12 bp, Homo sapiens
cgggccaaggac

SEQ ID NO: 3718205 - DNA, 12 bp, Homo sapiens
cgggccacagag

SEQ ID NO: 3718206 - DNA, 17 bp, Homo sapiens
cgggccacagagaaagt

SEQ ID NO: 3718207 - DNA, 16 bp, Homo sapiens
cgggcctggagaacta

SEQ ID NO: 3718208 - DNA, 20 bp, Homo sapiens
cgggcctggagaactagaga

SEQ ID NO: 3718209 - DNA, 15 bp, Homo sapiens
cgggctctctgctgt

SEQ ID NO: 3718210 - DNA, 20 bp, Homo sapiens
cgggctgggagctctgcaga

SEQ ID NO: 3718211 - DNA, 15 bp, Homo sapiens
cggggacagctcctt

SEQ ID NO: 3718212 - DNA, 14 bp, Homo sapiens
cggggcagctgcca

SEQ ID NO: 3718213 - DNA, 16 bp, Homo sapiens
cggggcatgctggggc

SEQ ID NO: 3718214 - DNA, 17 bp, Homo sapiens
cggggcatgctggggca

SEQ ID NO: 3718215 - DNA, 13 bp, Homo sapiens
cggggccagaggc

SEQ ID NO: 3718216 - DNA, 19 bp, Homo sapiens
cggggctccccttcgcgta

SEQ ID NO: 3718217 - DNA, 20 bp, Homo sapiens
ctatggattttctaaggaag

SEQ ID NO: 3718218 - DNA, 17 bp, Homo sapiens
ctatgggagccccaggg

SEQ ID NO: 3718219 - DNA, 16 bp, Homo sapiens
ctatggggacattcca

SEQ ID NO: 3718220 - DNA, 15 bp, Homo sapiens
ctatggggatggtcc

SEQ ID NO: 3718221 - DNA, 16 bp, Homo sapiens
ctatggtaaagatatt

SEQ ID NO: 3718222 - DNA, 15 bp, Homo sapiens
ctatgtacaatattt

SEQ ID NO: 3718223 - DNA, 16 bp, Homo sapiens
ctatgtacaatatttt

SEQ ID NO: 3718224 - DNA, 13 bp, Homo sapiens
ctatgtatcaatg

SEQ ID NO: 3718225 - DNA, 16 bp, Homo sapiens
ctatgtcccttgctgt

SEQ ID NO: 3718226 - DNA, 14 bp, Homo sapiens
ctatgttgcccagg

SEQ ID NO: 3718227 - DNA, 15 bp, Homo sapiens
ctatgttgcccaggc

SEQ ID NO: 3718228 - DNA, 17 bp, Homo sapiens
ctatgttgcccaggcag

SEQ ID NO: 3718229 - DNA, 11 bp, Homo sapiens
ctatgtttgct

SEQ ID NO: 3718230 - DNA, 20 bp, Homo sapiens
ctattaagcagtaaaaactg

SEQ ID NO: 3718231 - DNA, 20 bp, Homo sapiens
ctattaccactgaagataga

SEQ ID NO: 3718232 - DNA, 17 bp, Homo sapiens
ctattataatttaatgc

SEQ ID NO: 3718233 - DNA, 21 bp, Homo sapiens
ctattataatttaatgcatgt

SEQ ID NO: 3718234 - DNA, 20 bp, Homo sapiens
ctattattttcactgtagaa

SEQ ID NO: 3718235 - DNA, 22 bp, Homo sapiens
ctattattttcactgtagaatg

SEQ ID NO: 3718236 - DNA, 23 bp, Homo sapiens
ctattcagtaataactctaccct

SEQ ID NO: 3718237 - DNA, 16 bp, Homo sapiens
ctattctctcctcaga

SEQ ID NO: 3718238 - DNA, 16 bp, Homo sapiens
ctattgacaagtcatt

SEQ ID NO: 3718239 - DNA, 22 bp, Homo sapiens
ctattgacatcagcatcaccta

SEQ ID NO: 3718240 - DNA, 17 bp, Homo sapiens
ctattgcagctgggaga

SEQ ID NO: 3718241 - DNA, 23 bp, Homo sapiens
ctattgggttcattattggaatt

SEQ ID NO: 3718242 - DNA, 16 bp, Homo sapiens
ctattgtaagataaaa

SEQ ID NO: 3718243 - DNA, 14 bp, Homo sapiens
ctatttaaattctt

SEQ ID NO: 3718244 - DNA, 13 bp, Homo sapiens
ctatttagcatga

SEQ ID NO: 3718245 - DNA, 16 bp, Homo sapiens
ctatttatctgtgttt

SEQ ID NO: 3718246 - DNA, 19 bp, Homo sapiens
ctatttatctgtgtttttg

SEQ ID NO: 3718247 - DNA, 14 bp, Homo sapiens
ctatttatttactg

SEQ ID NO: 3718248 - DNA, 19 bp, Homo sapiens
ctatttcaaaaatttggaa

SEQ ID NO: 3718249 - DNA, 18 bp, Homo sapiens
ctatttgcttatttaata

SEQ ID NO: 3718250 - DNA, 21 bp, Homo sapiens
ctattttactgtcttaattaa

SEQ ID NO: 3718251 - DNA, 16 bp, Homo sapiens
ctattttcagaatctg

SEQ ID NO: 3718252 - DNA, 23 bp, Homo sapiens
ctattttcagaatctgaatgtaa

SEQ ID NO: 3718253 - DNA, 19 bp, Homo sapiens
ctattttgtaaactcaaaa

SEQ ID NO: 3718254 - DNA, 17 bp, Homo sapiens
ctatttttttaaaatca

SEQ ID NO: 3718255 - DNA, 13 bp, Homo sapiens
ctcaaaaggaaac

SEQ ID NO: 3718256 - DNA, 14 bp, Homo sapiens
ctcaaaaggaaacc

SEQ ID NO: 3718257 - DNA, 20 bp, Homo sapiens
ctcaaacctccaaaagccct

SEQ ID NO: 3718258 - DNA, 17 bp, Homo sapiens
ctcaaactgccttggct

SEQ ID NO: 3718259 - DNA, 20 bp, Homo sapiens
ctcaacatgttactgaccag

SEQ ID NO: 3718260 - DNA, 15 bp, Homo sapiens
ctcaaccatcccctc

SEQ ID NO: 3718261 - DNA, 20 bp, Homo sapiens
ctcaaccatcccctccgtgg

SEQ ID NO: 3718262 - DNA, 18 bp, Homo sapiens
ctcaaccccaccacttct

SEQ ID NO: 3718263 - DNA, 16 bp, Homo sapiens
ctcaaccctccctcag

SEQ ID NO: 3718264 - DNA, 22 bp, Homo sapiens
ctcaaccctccctcagcccctc

SEQ ID NO: 3718265 - DNA, 17 bp, Homo sapiens
ctcaacctgtaaattat

SEQ ID NO: 3718266 - DNA, 17 bp, Homo sapiens
ctcaactcacctaatgt

SEQ ID NO: 3718267 - DNA, 16 bp, Homo sapiens
ctcaagaggctgaggc

SEQ ID NO: 3718268 - DNA, 16 bp, Homo sapiens
ctcaagccaagcagcc

SEQ ID NO: 3718269 - DNA, 18 bp, Homo sapiens
ctcaagccaagcagccaa

SEQ ID NO: 3718270 - DNA, 21 bp, Homo sapiens
ctcaagccaagcagccaagct

SEQ ID NO: 3718271 - DNA, 23 bp, Homo sapiens
ctcaaggacaaagtctccagccc

SEQ ID NO: 3718272 - DNA, 18 bp, Homo sapiens
ctcaaggacttgaaagca

SEQ ID NO: 3718273 - DNA, 20 bp, Homo sapiens
ctcaaggacttgaaagcatc

SEQ ID NO: 3718274 - DNA, 14 bp, Homo sapiens
ctcaagtcctcttt

SEQ ID NO: 3718275 - DNA, 18 bp, Homo sapiens
ctcaagtcttccctgatc

SEQ ID NO: 3718276 - DNA, 20 bp, Homo sapiens
ctcaagtgattctcctgcct

SEQ ID NO: 3718277 - DNA, 18 bp, Homo sapiens
ctcaagttcaaggaccaa

SEQ ID NO: 3718278 - DNA, 13 bp, Homo sapiens
ctcaataaaatca

SEQ ID NO: 3718279 - DNA, 22 bp, Homo sapiens
ctcaataaaatcatgtacattt

SEQ ID NO: 3718280 - DNA, 18 bp, Homo sapiens
ctcaatattcctgaatga

SEQ ID NO: 3718281 - DNA, 18 bp, Homo sapiens
ctcaatattttccatgaa

SEQ ID NO: 3718282 - DNA, 18 bp, Homo sapiens
ctcaatcccagctactca

SEQ ID NO: 3718283 - DNA, 20 bp, Homo sapiens
ctcaatgtgaatcagaccct

SEQ ID NO: 3718284 - DNA, 17 bp, Homo sapiens
ctcacaacagctgcctg

SEQ ID NO: 3718285 - DNA, 23 bp, Homo sapiens
ctcacaccaggcttgcctgcagg

SEQ ID NO: 3718286 - DNA, 17 bp, Homo sapiens
ctcacagaacccttgga

SEQ ID NO: 3718287 - DNA, 23 bp, Homo sapiens
ctcacagactggagacaatgcag

SEQ ID NO: 3718288 - DNA, 16 bp, Homo sapiens
ctcacagagacacagg

SEQ ID NO: 3718289 - DNA, 16 bp, Homo sapiens
ctcacagctgtaataa

SEQ ID NO: 3718290 - DNA, 20 bp, Homo sapiens
ctcacagtctctttaatctt

SEQ ID NO: 3718291 - DNA, 19 bp, Homo sapiens
ctcacagtgggagccaggg

SEQ ID NO: 3718292 - DNA, 21 bp, Homo sapiens
ctcacagtgttgcccaggctg

SEQ ID NO: 3718293 - DNA, 16 bp, Homo sapiens
ctcacagttcctcgcc

SEQ ID NO: 3718294 - DNA, 13 bp, Homo sapiens
ctcacatgctgga

SEQ ID NO: 3718295 - DNA, 15 bp, Homo sapiens
ctcacatgctggaca

SEQ ID NO: 3718296 - DNA, 22 bp, Homo sapiens
ctcacatgctggacaggtctgg

SEQ ID NO: 3718297 - DNA, 23 bp, Homo sapiens
ctcacatgctggacaggtctggg

SEQ ID NO: 3718298 - DNA, 19 bp, Homo sapiens
ctcacatttattctgctca

SEQ ID NO: 3718299 - DNA, 18 bp, Homo sapiens
ctcaccagccccagtgcc

SEQ ID NO: 3718300 - DNA, 19 bp, Homo sapiens
ctcaccagccccagtgccc

SEQ ID NO: 3718301 - DNA, 19 bp, Homo sapiens
ctcaccccatcccacaccc

SEQ ID NO: 3718302 - DNA, 22 bp, Homo sapiens
ctcaccccatcccacaccctgg

SEQ ID NO: 3718303 - DNA, 21 bp, Homo sapiens
ctcacccccaaggggcagtct

SEQ ID NO: 3718304 - DNA, 15 bp, Homo sapiens
ctcaccccgtctggg

SEQ ID NO: 3718305 - DNA, 21 bp, Homo sapiens
ctcaccgtggctaagagtgtc

SEQ ID NO: 3718306 - DNA, 12 bp, Homo sapiens
ctcacctctgcc

SEQ ID NO: 3718307 - DNA, 13 bp, Homo sapiens
ctcacctctgcct

SEQ ID NO: 3718308 - DNA, 19 bp, Homo sapiens
ctcacctctgcctcaatgt

SEQ ID NO: 3718309 - DNA, 21 bp, Homo sapiens
ctcacctgggcacctggggag

SEQ ID NO: 3718310 - DNA, 11 bp, Homo sapiens
ctcacctgggg

SEQ ID NO: 3718311 - DNA, 22 bp, Homo sapiens
ctcaccttgaacaccacgcttg

SEQ ID NO: 3718312 - DNA, 18 bp, Homo sapiens
ctcaccttgcaacacaca

SEQ ID NO: 3718313 - DNA, 19 bp, Homo sapiens
ctcaccttgcaacacacag

SEQ ID NO: 3718314 - DNA, 21 bp, Homo sapiens
ctcaccttgcaacacacagac

SEQ ID NO: 3718315 - DNA, 20 bp, Homo sapiens
ctcacgcctgtaatcccagc

SEQ ID NO: 3718316 - DNA, 22 bp, Homo sapiens
ctcacgcctgtaatcccagcag

SEQ ID NO: 3718317 - DNA, 23 bp, Homo sapiens
ctcactatgttgcccaggcaggt

SEQ ID NO: 3718318 - DNA, 17 bp, Homo sapiens
ctcactccaccacccaa

SEQ ID NO: 3718319 - DNA, 17 bp, Homo sapiens
ctcactcccttctcctt

SEQ ID NO: 3718320 - DNA, 16 bp, Homo sapiens
ctcactcctacctggt

SEQ ID NO: 3718321 - DNA, 12 bp, Homo sapiens
ctcactctgtcg

SEQ ID NO: 3718322 - DNA, 13 bp, Homo sapiens
ctcactgcagcct

SEQ ID NO: 3718323 - DNA, 16 bp, Homo sapiens
ctcactgcagcctcga

SEQ ID NO: 3718324 - DNA, 13 bp, Homo sapiens
ctcactggcagcc

SEQ ID NO: 3718325 - DNA, 17 bp, Homo sapiens
ctcactggggtcctggg

SEQ ID NO: 3718326 - DNA, 13 bp, Homo sapiens
ctcactgggtggg

SEQ ID NO: 3718327 - DNA, 16 bp, Homo sapiens
ctcactgttgcccagg

SEQ ID NO: 3718328 - DNA, 21 bp, Homo sapiens
ctcacttatcccaagagaatg

SEQ ID NO: 3718329 - DNA, 15 bp, Homo sapiens
ctcgtcctccccctg

SEQ ID NO: 3718330 - DNA, 16 bp, Homo sapiens
ctcgtcctccccctgc

SEQ ID NO: 3718331 - DNA, 20 bp, Homo sapiens
ctcgtcggggggacagctcc

SEQ ID NO: 3718332 - DNA, 15 bp, Homo sapiens
ctcgtgctttaagtg

SEQ ID NO: 3718333 - DNA, 22 bp, Homo sapiens
ctctaaatgaggggcctcaggt

SEQ ID NO: 3718334 - DNA, 14 bp, Homo sapiens
ctctaacaggggct

SEQ ID NO: 3718335 - DNA, 14 bp, Homo sapiens
ctctaacctccttt

SEQ ID NO: 3718336 - DNA, 23 bp, Homo sapiens
ctctaatagcgaggctctaacca

SEQ ID NO: 3718337 - DNA, 18 bp, Homo sapiens
ctctaatgctcacgctcc

SEQ ID NO: 3718338 - DNA, 20 bp, Homo sapiens
ctctaattcccattttgcaa

SEQ ID NO: 3718339 - DNA, 12 bp, Homo sapiens
ctctaattctaa

SEQ ID NO: 3718340 - DNA, 18 bp, Homo sapiens
ctctaattgaattttcaa

SEQ ID NO: 3718341 - DNA, 16 bp, Homo sapiens
ctctacagaggccatg

SEQ ID NO: 3718342 - DNA, 19 bp, Homo sapiens
ctctacagaggccatgggc

SEQ ID NO: 3718343 - DNA, 21 bp, Homo sapiens
ctctacagctaatcagcattc

SEQ ID NO: 3718344 - DNA, 20 bp, Homo sapiens
ctctaccatcccctgtagag

SEQ ID NO: 3718345 - DNA, 20 bp, Homo sapiens
ctctacccagcccatcttgc

SEQ ID NO: 3718346 - DNA, 19 bp, Homo sapiens
ctctacccatattacagat

SEQ ID NO: 3718347 - DNA, 17 bp, Homo sapiens
ctctaccctcccacccc

SEQ ID NO: 3718348 - DNA, 18 bp, Homo sapiens
ctctactaaaaatacaaa

SEQ ID NO: 3718349 - DNA, 22 bp, Homo sapiens
ctctactaaaaatacaaaaatt

SEQ ID NO: 3718350 - DNA, 19 bp, Homo sapiens
ctctactaccacaaggaaa

SEQ ID NO: 3718351 - DNA, 23 bp, Homo sapiens
ctctagacaaccctgcaaaggac

SEQ ID NO: 3718352 - DNA, 21 bp, Homo sapiens
ctctagccggagtgacagagt

SEQ ID NO: 3718353 - DNA, 18 bp, Homo sapiens
ctctagggaaggccacct

SEQ ID NO: 3718354 - DNA, 20 bp, Homo sapiens
ctctagggaaggccacctgc

SEQ ID NO: 3718355 - DNA, 13 bp, Homo sapiens
ctctagtgccctc

SEQ ID NO: 3718356 - DNA, 14 bp, Homo sapiens
ctctagtgccctcc

SEQ ID NO: 3718357 - DNA, 21 bp, Homo sapiens
ctctagtgccctccacagccg

SEQ ID NO: 3718358 - DNA, 17 bp, Homo sapiens
ctctataattgccactg

SEQ ID NO: 3718359 - DNA, 22 bp, Homo sapiens
ctctatatttagattgttaaaa

SEQ ID NO: 3718360 - DNA, 19 bp, Homo sapiens
ctctatggtaaagatatta

SEQ ID NO: 3718361 - DNA, 22 bp, Homo sapiens
ctctattaccactgaagataga

SEQ ID NO: 3718362 - DNA, 10 bp, Homo sapiens
ctctatttaa

SEQ ID NO: 3718363 - DNA, 12 bp, Homo sapiens
ctctatttaaat

SEQ ID NO: 3718364 - DNA, 15 bp, Homo sapiens
ctctatttaaattct

SEQ ID NO: 3718365 - DNA, 16 bp, Homo sapiens
ctctatttaaattctt

SEQ ID NO: 3718366 - DNA, 17 bp, Homo sapiens
ctctatttaaattcttt

SEQ ID NO: 3718367 - DNA, 18 bp, Homo sapiens
ctctatttaaattctttt

SEQ ID NO: 3718368 - DNA, 14 bp, Homo sapiens
ctctatttagcatg

SEQ ID NO: 3718369 - DNA, 16 bp, Homo sapiens
ctctcagaaggtattc

SEQ ID NO: 3718370 - DNA, 23 bp, Homo sapiens
ctctcagccaacgagtaatttat

SEQ ID NO: 3718371 - DNA, 14 bp, Homo sapiens
ctctcaggatcaag

SEQ ID NO: 3718372 - DNA, 21 bp, Homo sapiens
ctctcaggcatgcctgtgtga

SEQ ID NO: 3718373 - DNA, 16 bp, Homo sapiens
ctctccaacctggaca

SEQ ID NO: 3718374 - DNA, 10 bp, Homo sapiens
ctctccacct

SEQ ID NO: 3718375 - DNA, 13 bp, Homo sapiens
ctctccacctcag

SEQ ID NO: 3718376 - DNA, 14 bp, Homo sapiens
ctctccacctcagc

SEQ ID NO: 3718377 - DNA, 17 bp, Homo sapiens
ctctccacctcagcctt

SEQ ID NO: 3718378 - DNA, 12 bp, Homo sapiens
ctctccactgcc

SEQ ID NO: 3718379 - DNA, 12 bp, Homo sapiens
ctctcccaggac

SEQ ID NO: 3718380 - DNA, 14 bp, Homo sapiens
ctctcccatcactt

SEQ ID NO: 3718381 - DNA, 18 bp, Homo sapiens
ctctcccatcacttccct

SEQ ID NO: 3718382 - DNA, 20 bp, Homo sapiens
ctctcccatcacttccctac

SEQ ID NO: 3718383 - DNA, 20 bp, Homo sapiens
ctctccccaatatcctcgct

SEQ ID NO: 3718384 - DNA, 13 bp, Homo sapiens
ctctccccagcaa

SEQ ID NO: 3718385 - DNA, 24 bp, Homo sapiens
ctctccccagcaagtgagagctgg

SEQ ID NO: 3718386 - DNA, 16 bp, Homo sapiens
ctctcccctgccctgc

SEQ ID NO: 3718387 - DNA, 18 bp, Homo sapiens
ctctccctctggccctgc

SEQ ID NO: 3718388 - DNA, 22 bp, Homo sapiens
ctctccctctggccctgccttc

SEQ ID NO: 3718389 - DNA, 13 bp, Homo sapiens
ctctccctggccc

SEQ ID NO: 3718390 - DNA, 12 bp, Homo sapiens
ctctccctgttg

SEQ ID NO: 3718391 - DNA, 21 bp, Homo sapiens
ctctccgaccagacaccttga

SEQ ID NO: 3718392 - DNA, 15 bp, Homo sapiens
ctctccggtctctct

SEQ ID NO: 3718393 - DNA, 15 bp, Homo sapiens
ctctcctcctgccca

SEQ ID NO: 3718394 - DNA, 22 bp, Homo sapiens
ctctcctcttgccactgcctct

SEQ ID NO: 3718395 - DNA, 15 bp, Homo sapiens
ctctcctgggcccct

SEQ ID NO: 3718396 - DNA, 17 bp, Homo sapiens
ctctcctgggcccctcc

SEQ ID NO: 3718397 - DNA, 19 bp, Homo sapiens
ctctcctgggcccctccct

SEQ ID NO: 3718398 - DNA, 18 bp, Homo sapiens
ctctcggaaggctggctg

SEQ ID NO: 3718399 - DNA, 19 bp, Homo sapiens
ctctcggaaggctggctgg

SEQ ID NO: 3718400 - DNA, 22 bp, Homo sapiens
ctctcggaaggctggctgggca

SEQ ID NO: 3718401 - DNA, 19 bp, Homo sapiens
ctctcggagtatctgggaa

SEQ ID NO: 3718402 - DNA, 15 bp, Homo sapiens
ctctctaacctcctt

SEQ ID NO: 3718403 - DNA, 18 bp, Homo sapiens
ctctctaacctcctttac

SEQ ID NO: 3718404 - DNA, 22 bp, Homo sapiens
ctctctacccagcccatcttgc

SEQ ID NO: 3718405 - DNA, 14 bp, Homo sapiens
ctctctccacccta

SEQ ID NO: 3718406 - DNA, 20 bp, Homo sapiens
ctctctccagtcttccacct

SEQ ID NO: 3718407 - DNA, 14 bp, Homo sapiens
ctctctccatcaga

SEQ ID NO: 3718408 - DNA, 17 bp, Homo sapiens
ctctctcctcctgccca

SEQ ID NO: 3718409 - DNA, 12 bp, Homo sapiens
ctctctcttctg

SEQ ID NO: 3718410 - DNA, 21 bp, Homo sapiens
ctctctgcagccagcccagcc

SEQ ID NO: 3718411 - DNA, 14 bp, Homo sapiens
ctctctgcctgtga

SEQ ID NO: 3718412 - DNA, 21 bp, Homo sapiens
ctctctgtaataaactcattt

SEQ ID NO: 3718413 - DNA, 19 bp, Homo sapiens
ctctcttacccttctgtgc

SEQ ID NO: 3718414 - DNA, 23 bp, Homo sapiens
ctctcttatagaatatttattac

SEQ ID NO: 3718415 - DNA, 15 bp, Homo sapiens
ctctcttcctatccc

SEQ ID NO: 3718416 - DNA, 19 bp, Homo sapiens
ctctcttcctatcccatcc

SEQ ID NO: 3718417 - DNA, 15 bp, Homo sapiens
ctctcttctgctcca

SEQ ID NO: 3718418 - DNA, 23 bp, Homo sapiens
ctctgaagagtgggtttcacaag

SEQ ID NO: 3718419 - DNA, 19 bp, Homo sapiens
ctctgaaggacccttcaga

SEQ ID NO: 3718420 - DNA, 19 bp, Homo sapiens
ctctgaagggcatcatgca

SEQ ID NO: 3718421 - DNA, 23 bp, Homo sapiens
ctctgaagggcatcatgcatctt

SEQ ID NO: 3718422 - DNA, 12 bp, Homo sapiens
ctctgaattcca

SEQ ID NO: 3718423 - DNA, 18 bp, Homo sapiens
ctctgaattccaagtaga

SEQ ID NO: 3718424 - DNA, 15 bp, Homo sapiens
ctctgacacacagct

SEQ ID NO: 3718425 - DNA, 16 bp, Homo sapiens
ctctgacacacagctc

SEQ ID NO: 3718426 - DNA, 19 bp, Homo sapiens
ctctgaccgaaacagcgct

SEQ ID NO: 3718427 - DNA, 14 bp, Homo sapiens
ctctgacctgcagg

SEQ ID NO: 3718428 - DNA, 21 bp, Homo sapiens
ctctgactcccaaagagctgc

SEQ ID NO: 3718429 - DNA, 22 bp, Homo sapiens
ctctgactcccaaagagctgcc

SEQ ID NO: 3718430 - DNA, 16 bp, Homo sapiens
ctctgagcaaatgtgg

SEQ ID NO: 3718431 - DNA, 22 bp, Homo sapiens
ctctgagcccctgggactgctg

SEQ ID NO: 3718432 - DNA, 17 bp, Homo sapiens
ctctgaggactgcacca

SEQ ID NO: 3718433 - DNA, 21 bp, Homo sapiens
ctctgagtttaccatttgtaa

SEQ ID NO: 3718434 - DNA, 19 bp, Homo sapiens
ctctgatattccatgaatg

SEQ ID NO: 3718435 - DNA, 17 bp, Homo sapiens
ctctgatcttgtgctca

SEQ ID NO: 3718436 - DNA, 15 bp, Homo sapiens
ctctgattttcaaag

SEQ ID NO: 3718437 - DNA, 19 bp, Homo sapiens
ctctgattttcaaagcttt

SEQ ID NO: 3718438 - DNA, 20 bp, Homo sapiens
ctctgattttcaaagctttt

SEQ ID NO: 3718439 - DNA, 22 bp, Homo sapiens
ctctgcaagaattgaagcagga

SEQ ID NO: 3718440 - DNA, 14 bp, Homo sapiens
ctctgcacaagctg

SEQ ID NO: 3718441 - DNA, 21 bp, Homo sapiens
ctctgcacaagctgcaccctc

SEQ ID NO: 3718442 - DNA, 11 bp, Homo sapiens
ctgcagcctgg

SEQ ID NO: 3718443 - DNA, 20 bp, Homo sapiens
ctgcagcctggaggccgggt

SEQ ID NO: 3718444 - DNA, 14 bp, Homo sapiens
ctgcagctgggctg

SEQ ID NO: 3718445 - DNA, 11 bp, Homo sapiens
ctgcaggcccc

SEQ ID NO: 3718446 - DNA, 17 bp, Homo sapiens
ctgcagggactgccagt

SEQ ID NO: 3718447 - DNA, 17 bp, Homo sapiens
ctgcagggggtgtgtct

SEQ ID NO: 3718448 - DNA, 20 bp, Homo sapiens
ctgcagggggtgtgtctgct

SEQ ID NO: 3718449 - DNA, 22 bp, Homo sapiens
ctgcagtcatcttgaccaagca

SEQ ID NO: 3718450 - DNA, 15 bp, Homo sapiens
ctgcagtgagctgtg

SEQ ID NO: 3718451 - DNA, 20 bp, Homo sapiens
ctgcatagaaggaggagagg

SEQ ID NO: 3718452 - DNA, 13 bp, Homo sapiens
ctgcatcatctgt

SEQ ID NO: 3718453 - DNA, 16 bp, Homo sapiens
ctgcatcgtttcatct

SEQ ID NO: 3718454 - DNA, 14 bp, Homo sapiens
ctgcatctactcag

SEQ ID NO: 3718455 - DNA, 12 bp, Homo sapiens
ctgcatggacct

SEQ ID NO: 3718456 - DNA, 18 bp, Homo sapiens
ctgcatggacctaacatt

SEQ ID NO: 3718457 - DNA, 19 bp, Homo sapiens
ctgcatggacctaacattc

SEQ ID NO: 3718458 - DNA, 22 bp, Homo sapiens
ctgcatggacctaacattcgat

SEQ ID NO: 3718459 - DNA, 19 bp, Homo sapiens
ctgcatggtaatttatagt

SEQ ID NO: 3718460 - DNA, 15 bp, Homo sapiens
ctgcattagaaatta

SEQ ID NO: 3718461 - DNA, 20 bp, Homo sapiens
ctgcattcacccagacagct

SEQ ID NO: 3718462 - DNA, 21 bp, Homo sapiens
ctgcattcacccagacagctc

SEQ ID NO: 3718463 - DNA, 20 bp, Homo sapiens
ctgcattcaggatcaaaccc

SEQ ID NO: 3718464 - DNA, 19 bp, Homo sapiens
ctgcattctgccgtgtgcc

SEQ ID NO: 3718465 - DNA, 23 bp, Homo sapiens
ctgcattgcctgcggtcaaggcc

SEQ ID NO: 3718466 - DNA, 13 bp, Homo sapiens
ctgcattggcttt

SEQ ID NO: 3718467 - DNA, 14 bp, Homo sapiens
ctgcatttagcaca

SEQ ID NO: 3718468 - DNA, 23 bp, Homo sapiens
ctgcatttagcacaaaaaaaatt

SEQ ID NO: 3718469 - DNA, 13 bp, Homo sapiens
ctgcatttgtgaa

SEQ ID NO: 3718470 - DNA, 15 bp, Homo sapiens
ctgcatttgtgaaat

SEQ ID NO: 3718471 - DNA, 18 bp, Homo sapiens
ctgcattttcaccccacc

SEQ ID NO: 3718472 - DNA, 21 bp, Homo sapiens
ctgcattttctgggttctggg

SEQ ID NO: 3718473 - DNA, 18 bp, Homo sapiens
ctgcatttttagaccatt

SEQ ID NO: 3718474 - DNA, 22 bp, Homo sapiens
ctgccaaggccagagtggcctg

SEQ ID NO: 3718475 - DNA, 12 bp, Homo sapiens
ctgccacacagg

SEQ ID NO: 3718476 - DNA, 24 bp, Homo sapiens
ctgccacacgtctgaccctctcca

SEQ ID NO: 3718477 - DNA, 13 bp, Homo sapiens
ctgccacacttca

SEQ ID NO: 3718478 - DNA, 15 bp, Homo sapiens
ctgccaccctgggga

SEQ ID NO: 3718479 - DNA, 20 bp, Homo sapiens
ctgccaccctggggagaaag

SEQ ID NO: 3718480 - DNA, 15 bp, Homo sapiens
ctgccacctgctgct

SEQ ID NO: 3718481 - DNA, 14 bp, Homo sapiens
ctgccacctggggc

SEQ ID NO: 3718482 - DNA, 16 bp, Homo sapiens
ctgccacctggggcag

SEQ ID NO: 3718483 - DNA, 23 bp, Homo sapiens
ctgccactttggtacatggccag

SEQ ID NO: 3718484 - DNA, 22 bp, Homo sapiens
ctgccagacggcacccacccag

SEQ ID NO: 3718485 - DNA, 20 bp, Homo sapiens
ctgccagagaagcatcggag

SEQ ID NO: 3718486 - DNA, 16 bp, Homo sapiens
ctgccagcacccccac

SEQ ID NO: 3718487 - DNA, 15 bp, Homo sapiens
ctgccagccagcagc

SEQ ID NO: 3718488 - DNA, 23 bp, Homo sapiens
ctgccagccagcagccagctctc

SEQ ID NO: 3718489 - DNA, 23 bp, Homo sapiens
ctgccagcctggcttctggagcc

SEQ ID NO: 3718490 - DNA, 17 bp, Homo sapiens
ctgccagtccccctgcc

SEQ ID NO: 3718491 - DNA, 12 bp, Homo sapiens
ctgccagtgcct

SEQ ID NO: 3718492 - DNA, 13 bp, Homo sapiens
ctgccagtgcctt

SEQ ID NO: 3718493 - DNA, 17 bp, Homo sapiens
ctgccagtgccttacct

SEQ ID NO: 3718494 - DNA, 18 bp, Homo sapiens
ctgccagtgccttacctc

SEQ ID NO: 3718495 - DNA, 22 bp, Homo sapiens
ctgccagtgccttacctcctgc

SEQ ID NO: 3718496 - DNA, 21 bp, Homo sapiens
ctgccatattctgttggccag

SEQ ID NO: 3718497 - DNA, 17 bp, Homo sapiens
ctgccatccagggatgc

SEQ ID NO: 3718498 - DNA, 16 bp, Homo sapiens
ctgccatccaggttca

SEQ ID NO: 3718499 - DNA, 23 bp, Homo sapiens
ctgccatgaactggaggccagga

SEQ ID NO: 3718500 - DNA, 15 bp, Homo sapiens
ctgccatgccagctt

SEQ ID NO: 3718501 - DNA, 17 bp, Homo sapiens
ctgccatggaggcacac

SEQ ID NO: 3718502 - DNA, 16 bp, Homo sapiens
ctgccatttctgagat

SEQ ID NO: 3718503 - DNA, 17 bp, Homo sapiens
ctgcccaacctgctctc

SEQ ID NO: 3718504 - DNA, 12 bp, Homo sapiens
ctgcccacccgt

SEQ ID NO: 3718505 - DNA, 21 bp, Homo sapiens
ctgcccagaattcccagctgt

SEQ ID NO: 3718506 - DNA, 13 bp, Homo sapiens
ctgcccagagctg

SEQ ID NO: 3718507 - DNA, 17 bp, Homo sapiens
ctgcccagcctccaagc

SEQ ID NO: 3718508 - DNA, 17 bp, Homo sapiens
ctgcccaggagagccag

SEQ ID NO: 3718509 - DNA, 21 bp, Homo sapiens
ctgcccaggagagccagccct

SEQ ID NO: 3718510 - DNA, 22 bp, Homo sapiens
ctgcccaggagagccagccctc

SEQ ID NO: 3718511 - DNA, 14 bp, Homo sapiens
ctgcccaggcccct

SEQ ID NO: 3718512 - DNA, 20 bp, Homo sapiens
ctgcccaggcccctgccacc

SEQ ID NO: 3718513 - DNA, 12 bp, Homo sapiens
ctgcccagtgtt

SEQ ID NO: 3718514 - DNA, 22 bp, Homo sapiens
ctgcccagtgttgtttgtaaat

SEQ ID NO: 3718515 - DNA, 15 bp, Homo sapiens
ctgccccaaacaaat

SEQ ID NO: 3718516 - DNA, 14 bp, Homo sapiens
ctgccccaactcct

SEQ ID NO: 3718517 - DNA, 20 bp, Homo sapiens
ctgccccaactcctggaagc

SEQ ID NO: 3718518 - DNA, 15 bp, Homo sapiens
ctgccccagctctgg

SEQ ID NO: 3718519 - DNA, 14 bp, Homo sapiens
ctgcccccacacct

SEQ ID NO: 3718520 - DNA, 20 bp, Homo sapiens
ctgcccccacacctggccct

SEQ ID NO: 3718521 - DNA, 17 bp, Homo sapiens
ctgcccccgctcatggg

SEQ ID NO: 3718522 - DNA, 19 bp, Homo sapiens
ctgcccccttctcccacac

SEQ ID NO: 3718523 - DNA, 20 bp, Homo sapiens
ctgcccccttctcccacact

SEQ ID NO: 3718524 - DNA, 22 bp, Homo sapiens
ctgcccccttctcccacactgc

SEQ ID NO: 3718525 - DNA, 23 bp, Homo sapiens
ctgcccccttctcccacactgct

SEQ ID NO: 3718526 - DNA, 16 bp, Homo sapiens
ctgccccgcccagctg

SEQ ID NO: 3718527 - DNA, 22 bp, Homo sapiens
ctgccccgtctcatgaggggcc

SEQ ID NO: 3718528 - DNA, 15 bp, Homo sapiens
ctgcccctcccagaa

SEQ ID NO: 3718529 - DNA, 14 bp, Homo sapiens
ctgcccctccccca

SEQ ID NO: 3718530 - DNA, 16 bp, Homo sapiens
ctgcccctccctgcca

SEQ ID NO: 3718531 - DNA, 11 bp, Homo sapiens
ctgcccctgcc

SEQ ID NO: 3718532 - DNA, 14 bp, Homo sapiens
ctgcccctgccccg

SEQ ID NO: 3718533 - DNA, 11 bp, Homo sapiens
ctgcccctggc

SEQ ID NO: 3718534 - DNA, 19 bp, Homo sapiens
ctgccccttctacactctc

SEQ ID NO: 3718535 - DNA, 21 bp, Homo sapiens
ctgccccttctacactctcct

SEQ ID NO: 3718536 - DNA, 16 bp, Homo sapiens
ctgcccgagctggtgc

SEQ ID NO: 3718537 - DNA, 13 bp, Homo sapiens
ctgcccggggcag

SEQ ID NO: 3718538 - DNA, 15 bp, Homo sapiens
ctgcccgtcttcagc

SEQ ID NO: 3718539 - DNA, 18 bp, Homo sapiens
ctgcccgtcttcagccta

SEQ ID NO: 3718540 - DNA, 21 bp, Homo sapiens
ctgccctagagcacactgtag

SEQ ID NO: 3718541 - DNA, 22 bp, Homo sapiens
ctgccctagctccacaccctct

SEQ ID NO: 3718542 - DNA, 12 bp, Homo sapiens
ctgccctaggct

SEQ ID NO: 3718543 - DNA, 18 bp, Homo sapiens
ctgccctaggctccgtca

SEQ ID NO: 3718544 - DNA, 14 bp, Homo sapiens
ctgccctccatccc

SEQ ID NO: 3718545 - DNA, 19 bp, Homo sapiens
ctgccctctgttcagtaac

SEQ ID NO: 3718546 - DNA, 11 bp, Homo sapiens
ctgccctgctg

SEQ ID NO: 3718547 - DNA, 21 bp, Homo sapiens
ctgccctgctgccgcctccca

SEQ ID NO: 3718548 - DNA, 19 bp, Homo sapiens
ctgccctgggatgtccaca

SEQ ID NO: 3718549 - DNA, 21 bp, Homo sapiens
ctgccctggtccagggaagct

SEQ ID NO: 3718550 - DNA, 21 bp, Homo sapiens
ctgccctggtgctgccacact

SEQ ID NO: 3718551 - DNA, 21 bp, Homo sapiens
ctgccctgtaccccagcactt

SEQ ID NO: 3718552 - DNA, 15 bp, Homo sapiens
ctgcccttgtcccac

SEQ ID NO: 3718553 - DNA, 22 bp, Homo sapiens
ctgccgaccgaggctggagctg

SEQ ID NO: 3718554 - DNA, 23 bp, Homo sapiens
ctgccgaccgaggctggagctgg

SEQ ID NO: 3718555 - DNA, 12 bp, Homo sapiens
ctgggtgcccac

SEQ ID NO: 3718556 - DNA, 13 bp, Homo sapiens
ctgggtgcccaca

SEQ ID NO: 3718557 - DNA, 14 bp, Homo sapiens
ctgggtgcccacag

SEQ ID NO: 3718558 - DNA, 15 bp, Homo sapiens
ctgggtgctccctac

SEQ ID NO: 3718559 - DNA, 18 bp, Homo sapiens
ctgggtggcaccagcagc

SEQ ID NO: 3718560 - DNA, 20 bp, Homo sapiens
ctgggtggcaccagcagcct

SEQ ID NO: 3718561 - DNA, 18 bp, Homo sapiens
ctgggtggggctgctcct

SEQ ID NO: 3718562 - DNA, 20 bp, Homo sapiens
ctgggtggggctgctcctcc

SEQ ID NO: 3718563 - DNA, 21 bp, Homo sapiens
ctgggtggggctgctcctcca

SEQ ID NO: 3718564 - DNA, 21 bp, Homo sapiens
ctgggtggggtgaggaccact

SEQ ID NO: 3718565 - DNA, 18 bp, Homo sapiens
ctgggttggaaaacagta

SEQ ID NO: 3718566 - DNA, 22 bp, Homo sapiens
ctggtaggaatagcatgtcact

SEQ ID NO: 3718567 - DNA, 19 bp, Homo sapiens
ctggtatgggtttctccca

SEQ ID NO: 3718568 - DNA, 19 bp, Homo sapiens
ctggtcaacttgagcatgt

SEQ ID NO: 3718569 - DNA, 20 bp, Homo sapiens
ctggtcacaggactctgcct

SEQ ID NO: 3718570 - DNA, 17 bp, Homo sapiens
ctggtccagggaagctg

SEQ ID NO: 3718571 - DNA, 19 bp, Homo sapiens
ctggtccatgatggagtca

SEQ ID NO: 3718572 - DNA, 14 bp, Homo sapiens
ctggtcccactcag

SEQ ID NO: 3718573 - DNA, 18 bp, Homo sapiens
ctggtcccactcagtcca

SEQ ID NO: 3718574 - DNA, 15 bp, Homo sapiens
ctggtccctgggagg

SEQ ID NO: 3718575 - DNA, 17 bp, Homo sapiens
ctggtcccttgcagcta

SEQ ID NO: 3718576 - DNA, 19 bp, Homo sapiens
ctggtccttccaggccccc

SEQ ID NO: 3718577 - DNA, 20 bp, Homo sapiens
ctggtcttgtggaattggga

SEQ ID NO: 3718578 - DNA, 16 bp, Homo sapiens
ctggtgagcagactgg

SEQ ID NO: 3718579 - DNA, 19 bp, Homo sapiens
ctggtgaggaagctccagt

SEQ ID NO: 3718580 - DNA, 17 bp, Homo sapiens
ctggtgcagggcctcca

SEQ ID NO: 3718581 - DNA, 20 bp, Homo sapiens
ctggtgcagggcctccattc

SEQ ID NO: 3718582 - DNA, 14 bp, Homo sapiens
ctggtgcattacag

SEQ ID NO: 3718583 - DNA, 12 bp, Homo sapiens
ctggtgctgcca

SEQ ID NO: 3718584 - DNA, 14 bp, Homo sapiens
ctggtggcagctgc

SEQ ID NO: 3718585 - DNA, 21 bp, Homo sapiens
ctggtggcccgacagcctggc

SEQ ID NO: 3718586 - DNA, 14 bp, Homo sapiens
ctggtggcctctgc

SEQ ID NO: 3718587 - DNA, 22 bp, Homo sapiens
ctggtgggcaccaagagccaat

SEQ ID NO: 3718588 - DNA, 17 bp, Homo sapiens
ctggtgggcctcctctg

SEQ ID NO: 3718589 - DNA, 13 bp, Homo sapiens
ctggttagcagag

SEQ ID NO: 3718590 - DNA, 14 bp, Homo sapiens
ctggttagctcagc

SEQ ID NO: 3718591 - DNA, 15 bp, Homo sapiens
ctggttagctcagcc

SEQ ID NO: 3718592 - DNA, 21 bp, Homo sapiens
ctggttagctcagccccagcc

SEQ ID NO: 3718593 - DNA, 23 bp, Homo sapiens
ctggttagctcagccccagccca

SEQ ID NO: 3718594 - DNA, 22 bp, Homo sapiens
ctggttaggttaggacttgccc

SEQ ID NO: 3718595 - DNA, 20 bp, Homo sapiens
ctggttcttgtgttggctgt

SEQ ID NO: 3718596 - DNA, 14 bp, Homo sapiens
ctggttgtcatttt

SEQ ID NO: 3718597 - DNA, 20 bp, Homo sapiens
ctgtaaaactttattttata

SEQ ID NO: 3718598 - DNA, 20 bp, Homo sapiens
ctgtaaattattttaaatta

SEQ ID NO: 3718599 - DNA, 22 bp, Homo sapiens
ctgtaaattattttaaattata

SEQ ID NO: 3718600 - DNA, 19 bp, Homo sapiens
ctgtaatcatataataaat

SEQ ID NO: 3718601 - DNA, 13 bp, Homo sapiens
ctgtaatcccagc

SEQ ID NO: 3718602 - DNA, 20 bp, Homo sapiens
ctgtaatcccagcactttgg

SEQ ID NO: 3718603 - DNA, 22 bp, Homo sapiens
ctgtacaaaagggacatgaaat

SEQ ID NO: 3718604 - DNA, 13 bp, Homo sapiens
ctgtacaaagtag

SEQ ID NO: 3718605 - DNA, 17 bp, Homo sapiens
ctgtacaatatttaaaa

SEQ ID NO: 3718606 - DNA, 20 bp, Homo sapiens
ctgtacacactttatttact

SEQ ID NO: 3718607 - DNA, 19 bp, Homo sapiens
ctgtacactgaatatttat

SEQ ID NO: 3718608 - DNA, 20 bp, Homo sapiens
ctgtacatatttgagactag

SEQ ID NO: 3718609 - DNA, 18 bp, Homo sapiens
ctgtacgtctgacaggca

SEQ ID NO: 3718610 - DNA, 20 bp, Homo sapiens
ctgtacgtctgacaggcaat

SEQ ID NO: 3718611 - DNA, 22 bp, Homo sapiens
ctgtactagtctgtgtgggact

SEQ ID NO: 3718612 - DNA, 13 bp, Homo sapiens
ctgtactcaggag

SEQ ID NO: 3718613 - DNA, 15 bp, Homo sapiens
ctgtactcctcccag

SEQ ID NO: 3718614 - DNA, 16 bp, Homo sapiens
ctgtactcctcccagg

SEQ ID NO: 3718615 - DNA, 13 bp, Homo sapiens
ctgtacttaataa

SEQ ID NO: 3718616 - DNA, 22 bp, Homo sapiens
ctgtagacctagggaggacctt

SEQ ID NO: 3718617 - DNA, 15 bp, Homo sapiens
ctgtagagtgggagc

SEQ ID NO: 3718618 - DNA, 16 bp, Homo sapiens
ctgtagatgctgggcc

SEQ ID NO: 3718619 - DNA, 17 bp, Homo sapiens
ctgtagcattacagtgg

SEQ ID NO: 3718620 - DNA, 18 bp, Homo sapiens
ctgtagtaaactatttat

SEQ ID NO: 3718621 - DNA, 18 bp, Homo sapiens
ctgtagtactccttaaga

SEQ ID NO: 3718622 - DNA, 23 bp, Homo sapiens
ctgtagtactccttaagaacaca

SEQ ID NO: 3718623 - DNA, 15 bp, Homo sapiens
ctgtagtcccagcta

SEQ ID NO: 3718624 - DNA, 18 bp, Homo sapiens
ctgtagtcccagctactc

SEQ ID NO: 3718625 - DNA, 23 bp, Homo sapiens
ctgtagtcccagctactcaggag

SEQ ID NO: 3718626 - DNA, 22 bp, Homo sapiens
ctgtagtcctagccactcagga

SEQ ID NO: 3718627 - DNA, 14 bp, Homo sapiens
ctgtagtctcagga

SEQ ID NO: 3718628 - DNA, 15 bp, Homo sapiens
ctgtagtctcaggac

SEQ ID NO: 3718629 - DNA, 15 bp, Homo sapiens
ctgtagttaggaaat

SEQ ID NO: 3718630 - DNA, 15 bp, Homo sapiens
ctgtatagtactggc

SEQ ID NO: 3718631 - DNA, 19 bp, Homo sapiens
ctgtatatacaataacata

SEQ ID NO: 3718632 - DNA, 19 bp, Homo sapiens
ctgtatcaacccagaaaca

SEQ ID NO: 3718633 - DNA, 22 bp, Homo sapiens
ctgtatcccatgagcctcagca

SEQ ID NO: 3718634 - DNA, 14 bp, Homo sapiens
ctgtatctgtgtag

SEQ ID NO: 3718635 - DNA, 18 bp, Homo sapiens
ctgtatttatgtgtgagg

SEQ ID NO: 3718636 - DNA, 23 bp, Homo sapiens
ctgtatttatgtgtgaggagctg

SEQ ID NO: 3718637 - DNA, 18 bp, Homo sapiens
ctgtatttgaatcagcct

SEQ ID NO: 3718638 - DNA, 22 bp, Homo sapiens
ctgtcaaacaaagccagaagct

SEQ ID NO: 3718639 - DNA, 22 bp, Homo sapiens
ctgtcaagttaacaaggaatgc

SEQ ID NO: 3718640 - DNA, 13 bp, Homo sapiens
ctgtcaataaaca

SEQ ID NO: 3718641 - DNA, 19 bp, Homo sapiens
ctgtcacgcagccaccagg

SEQ ID NO: 3718642 - DNA, 22 bp, Homo sapiens
ctgtcagatgggaagacatgaa

SEQ ID NO: 3718643 - DNA, 17 bp, Homo sapiens
ctgtcatttgagcaggg

SEQ ID NO: 3718644 - DNA, 23 bp, Homo sapiens
ctgtcatttgagcagggctcagc

SEQ ID NO: 3718645 - DNA, 18 bp, Homo sapiens
ctgtccaaaggaggctgg

SEQ ID NO: 3718646 - DNA, 19 bp, Homo sapiens
ctgtccaaaggaggctggc

SEQ ID NO: 3718647 - DNA, 16 bp, Homo sapiens
ctgtccaacctaaccc

SEQ ID NO: 3718648 - DNA, 18 bp, Homo sapiens
ctgtccagagagagaagt

SEQ ID NO: 3718649 - DNA, 17 bp, Homo sapiens
ctgtccagcctgggcag

SEQ ID NO: 3718650 - DNA, 18 bp, Homo sapiens
ctgtccagcctgggcagc

SEQ ID NO: 3718651 - DNA, 19 bp, Homo sapiens
ctgtccaggcactgctgcc

SEQ ID NO: 3718652 - DNA, 21 bp, Homo sapiens
ctgtccaggcactgctgccca

SEQ ID NO: 3718653 - DNA, 19 bp, Homo sapiens
ctgtccagggccctgagct

SEQ ID NO: 3718654 - DNA, 22 bp, Homo sapiens
ctgtcccagtgccgagaaggaa

SEQ ID NO: 3718655 - DNA, 15 bp, Homo sapiens
ctgtccctctcaggc

SEQ ID NO: 3718656 - DNA, 16 bp, Homo sapiens
ctgtccctggccatct

SEQ ID NO: 3718657 - DNA, 17 bp, Homo sapiens
ctgtccctggccatctc

SEQ ID NO: 3718658 - DNA, 18 bp, Homo sapiens
ctgtcctgacctgtctca

SEQ ID NO: 3718659 - DNA, 13 bp, Homo sapiens
ctgtcctgggagt

SEQ ID NO: 3718660 - DNA, 14 bp, Homo sapiens
ctgtcctgggagtg

SEQ ID NO: 3718661 - DNA, 12 bp, Homo sapiens
ctgtccttaccc

SEQ ID NO: 3718662 - DNA, 16 bp, Homo sapiens
ctgtccttgcacactc

SEQ ID NO: 3718663 - DNA, 16 bp, Homo sapiens
ctgtcgtgccagtcct

SEQ ID NO: 3718664 - DNA, 14 bp, Homo sapiens
ctgtctaccatctc

SEQ ID NO: 3718665 - DNA, 23 bp, Homo sapiens
ctgtctcaaaaaaacacaaaagt

SEQ ID NO: 3718666 - DNA, 22 bp, Homo sapiens
ctgtctcaagagggcactggtg

SEQ ID NO: 3718667 - DNA, 18 bp, Homo sapiens
cttctacactctcctggg

SEQ ID NO: 3718668 - DNA, 15 bp, Homo sapiens
cttctactgcttcta

SEQ ID NO: 3718669 - DNA, 13 bp, Homo sapiens
cttctacttctgc

SEQ ID NO: 3718670 - DNA, 21 bp, Homo sapiens
cttctacttctgcccttgcca

SEQ ID NO: 3718671 - DNA, 17 bp, Homo sapiens
cttctagaaccaggcaa

SEQ ID NO: 3718672 - DNA, 13 bp, Homo sapiens
cttctattttatt

SEQ ID NO: 3718673 - DNA, 15 bp, Homo sapiens
cttctattttgtaaa

SEQ ID NO: 3718674 - DNA, 16 bp, Homo sapiens
cttctattttgtaaac

SEQ ID NO: 3718675 - DNA, 13 bp, Homo sapiens
cttctcaggctct

SEQ ID NO: 3718676 - DNA, 20 bp, Homo sapiens
cttctcaggctctgccctgc

SEQ ID NO: 3718677 - DNA, 21 bp, Homo sapiens
cttctcaggctctgccctgcc

SEQ ID NO: 3718678 - DNA, 22 bp, Homo sapiens
cttctcatagcattaactaatc

SEQ ID NO: 3718679 - DNA, 16 bp, Homo sapiens
cttctccaccctgctc

SEQ ID NO: 3718680 - DNA, 14 bp, Homo sapiens
cttctccactggat

SEQ ID NO: 3718681 - DNA, 15 bp, Homo sapiens
cttctccactggatg

SEQ ID NO: 3718682 - DNA, 17 bp, Homo sapiens
cttctccagacaaacca

SEQ ID NO: 3718683 - DNA, 23 bp, Homo sapiens
cttctccagacaaaccagaagca

SEQ ID NO: 3718684 - DNA, 17 bp, Homo sapiens
cttctccatctggcagg

SEQ ID NO: 3718685 - DNA, 14 bp, Homo sapiens
cttctcccacactg

SEQ ID NO: 3718686 - DNA, 20 bp, Homo sapiens
cttctccttgataacagcta

SEQ ID NO: 3718687 - DNA, 17 bp, Homo sapiens
cttctcctttcacaacc

SEQ ID NO: 3718688 - DNA, 15 bp, Homo sapiens
cttctctacagactt

SEQ ID NO: 3718689 - DNA, 14 bp, Homo sapiens
cttctctcacctcc

SEQ ID NO: 3718690 - DNA, 15 bp, Homo sapiens
cttctctcacctcct

SEQ ID NO: 3718691 - DNA, 13 bp, Homo sapiens
cttctctgcccat

SEQ ID NO: 3718692 - DNA, 13 bp, Homo sapiens
cttctctgctcca

SEQ ID NO: 3718693 - DNA, 22 bp, Homo sapiens
cttctctgctccaccacatcct

SEQ ID NO: 3718694 - DNA, 21 bp, Homo sapiens
cttctctgtgaacgatttaga

SEQ ID NO: 3718695 - DNA, 22 bp, Homo sapiens
cttctctgtgaacgatttagaa

SEQ ID NO: 3718696 - DNA, 12 bp, Homo sapiens
cttctcttaatt

SEQ ID NO: 3718697 - DNA, 15 bp, Homo sapiens
cttctcttaatttaa

SEQ ID NO: 3718698 - DNA, 20 bp, Homo sapiens
cttctctttaactcaggact

SEQ ID NO: 3718699 - DNA, 22 bp, Homo sapiens
cttctctttaactcaggactcc

SEQ ID NO: 3718700 - DNA, 15 bp, Homo sapiens
cttctgaccacactt

SEQ ID NO: 3718701 - DNA, 17 bp, Homo sapiens
cttctgaccacacttcc

SEQ ID NO: 3718702 - DNA, 18 bp, Homo sapiens
cttctgaccacacttcct

SEQ ID NO: 3718703 - DNA, 13 bp, Homo sapiens
cttctgactgctg

SEQ ID NO: 3718704 - DNA, 22 bp, Homo sapiens
cttctgcccatcctgtctgttc

SEQ ID NO: 3718705 - DNA, 12 bp, Homo sapiens
cttctgcctgca

SEQ ID NO: 3718706 - DNA, 12 bp, Homo sapiens
cttctgctccac

SEQ ID NO: 3718707 - DNA, 21 bp, Homo sapiens
cttctgctccacccttggcct

SEQ ID NO: 3718708 - DNA, 13 bp, Homo sapiens
cttctggagccct

SEQ ID NO: 3718709 - DNA, 14 bp, Homo sapiens
cttctgtacgtctg

SEQ ID NO: 3718710 - DNA, 15 bp, Homo sapiens
cttctgtacgtctga

SEQ ID NO: 3718711 - DNA, 21 bp, Homo sapiens
cttctgtagtactccttaaga

SEQ ID NO: 3718712 - DNA, 16 bp, Homo sapiens
cttctgtcatctacct

SEQ ID NO: 3718713 - DNA, 19 bp, Homo sapiens
cttctgtcctactctgtgt

SEQ ID NO: 3718714 - DNA, 20 bp, Homo sapiens
cttctgtgagacccccacac

SEQ ID NO: 3718715 - DNA, 12 bp, Homo sapiens
cttctgtgccca

SEQ ID NO: 3718716 - DNA, 15 bp, Homo sapiens
cttctgtgcccagct

SEQ ID NO: 3718717 - DNA, 22 bp, Homo sapiens
cttctgtggctcacagaaccct

SEQ ID NO: 3718718 - DNA, 22 bp, Homo sapiens
cttcttattctcactccaccac

SEQ ID NO: 3718719 - DNA, 17 bp, Homo sapiens
cttcttcagccacctct

SEQ ID NO: 3718720 - DNA, 17 bp, Homo sapiens
cttcttcggggaactcc

SEQ ID NO: 3718721 - DNA, 20 bp, Homo sapiens
cttcttcggggaactcctgg

SEQ ID NO: 3718722 - DNA, 14 bp, Homo sapiens
cttcttcttcagaa

SEQ ID NO: 3718723 - DNA, 14 bp, Homo sapiens
cttcttggctttgt

SEQ ID NO: 3718724 - DNA, 13 bp, Homo sapiens
cttcttgttcccc

SEQ ID NO: 3718725 - DNA, 23 bp, Homo sapiens
cttcttttaagatgtgtcttcaa

SEQ ID NO: 3718726 - DNA, 23 bp, Homo sapiens
cttctttttattttcttttgtaa

SEQ ID NO: 3718727 - DNA, 16 bp, Homo sapiens
cttcttttttttcatt

SEQ ID NO: 3718728 - DNA, 17 bp, Homo sapiens
cttgaaagaaaggggca

SEQ ID NO: 3718729 - DNA, 15 bp, Homo sapiens
cttgaacactggggg

SEQ ID NO: 3718730 - DNA, 15 bp, Homo sapiens
cttgaacccaggagg

SEQ ID NO: 3718731 - DNA, 18 bp, Homo sapiens
cttgaactcctggcctca

SEQ ID NO: 3718732 - DNA, 18 bp, Homo sapiens
cttgaactgggtacttgt

SEQ ID NO: 3718733 - DNA, 20 bp, Homo sapiens
cttgaagatcgttagtatct

SEQ ID NO: 3718734 - DNA, 21 bp, Homo sapiens
cttgaagccactgaagctggg

SEQ ID NO: 3718735 - DNA, 16 bp, Homo sapiens
cttgacagaacactgt

SEQ ID NO: 3718736 - DNA, 19 bp, Homo sapiens
cttgaccaagcaggaagct

SEQ ID NO: 3718737 - DNA, 20 bp, Homo sapiens
cttgaccagcagatcccagc

SEQ ID NO: 3718738 - DNA, 23 bp, Homo sapiens
cttgaccagcagatcccagctca

SEQ ID NO: 3718739 - DNA, 12 bp, Homo sapiens
cttgagaaacct

SEQ ID NO: 3718740 - DNA, 11 bp, Homo sapiens
cttgagaactt

SEQ ID NO: 3718741 - DNA, 16 bp, Homo sapiens
cttgagcatgttactg

SEQ ID NO: 3718742 - DNA, 13 bp, Homo sapiens
cttgagccagtaa

SEQ ID NO: 3718743 - DNA, 15 bp, Homo sapiens
cttgagcccaggagt

SEQ ID NO: 3718744 - DNA, 16 bp, Homo sapiens
cttgagctgagatgga

SEQ ID NO: 3718745 - DNA, 20 bp, Homo sapiens
cttgagggttgggctggtgt

SEQ ID NO: 3718746 - DNA, 21 bp, Homo sapiens
cttgagggttgggctggtgtc

SEQ ID NO: 3718747 - DNA, 14 bp, Homo sapiens
cttgaggtcttttg

SEQ ID NO: 3718748 - DNA, 16 bp, Homo sapiens
cttgagtgctcagtag

SEQ ID NO: 3718749 - DNA, 21 bp, Homo sapiens
cttgagttgattcagctctgc

SEQ ID NO: 3718750 - DNA, 21 bp, Homo sapiens
cttgataatgttgtggtttgt

SEQ ID NO: 3718751 - DNA, 16 bp, Homo sapiens
cttgatgactggaatt

SEQ ID NO: 3718752 - DNA, 20 bp, Homo sapiens
cttgatgactggaattttta

SEQ ID NO: 3718753 - DNA, 22 bp, Homo sapiens
cttgatgagtgtaacaagaaag

SEQ ID NO: 3718754 - DNA, 16 bp, Homo sapiens
cttgatggtcagacac

SEQ ID NO: 3718755 - DNA, 16 bp, Homo sapiens
cttgatggtttatgtt

SEQ ID NO: 3718756 - DNA, 18 bp, Homo sapiens
cttgatgtgttatctctt

SEQ ID NO: 3718757 - DNA, 18 bp, Homo sapiens
cttgattcacaatgaaat

SEQ ID NO: 3718758 - DNA, 14 bp, Homo sapiens
cttgcaacacacag

SEQ ID NO: 3718759 - DNA, 14 bp, Homo sapiens
cttgcaatggcagc

SEQ ID NO: 3718760 - DNA, 17 bp, Homo sapiens
cttgcaatggcagcctt

SEQ ID NO: 3718761 - DNA, 23 bp, Homo sapiens
cttgcacactcccctgcactgga

SEQ ID NO: 3718762 - DNA, 19 bp, Homo sapiens
cttgcacgcccatgtgtga

SEQ ID NO: 3718763 - DNA, 13 bp, Homo sapiens
cttgcagagaagc

SEQ ID NO: 3718764 - DNA, 20 bp, Homo sapiens
cttgcataataagctaaaga

SEQ ID NO: 3718765 - DNA, 17 bp, Homo sapiens
cttgccactgcactcca

SEQ ID NO: 3718766 - DNA, 22 bp, Homo sapiens
cttgcccagagatgcctccacc

SEQ ID NO: 3718767 - DNA, 14 bp, Homo sapiens
cttgcccagggctc

SEQ ID NO: 3718768 - DNA, 16 bp, Homo sapiens
cttgcccagggctcag

SEQ ID NO: 3718769 - DNA, 19 bp, Homo sapiens
cttgcccagggctcagcct

SEQ ID NO: 3718770 - DNA, 19 bp, Homo sapiens
cttgccccccaccccagcc

SEQ ID NO: 3718771 - DNA, 15 bp, Homo sapiens
cttgccctagatgag

SEQ ID NO: 3718772 - DNA, 15 bp, Homo sapiens
cttgccgaaactgga

SEQ ID NO: 3718773 - DNA, 17 bp, Homo sapiens
cttgccgaaactggaag

SEQ ID NO: 3718774 - DNA, 14 bp, Homo sapiens
cttgcctagggcct

SEQ ID NO: 3718775 - DNA, 18 bp, Homo sapiens
cttgcctagggcctggtc

SEQ ID NO: 3718776 - DNA, 20 bp, Homo sapiens
cttgctagctatgtgacctt

SEQ ID NO: 3718777 - DNA, 16 bp, Homo sapiens
cttgctctatctcaca

SEQ ID NO: 3718778 - DNA, 22 bp, Homo sapiens
cttgctctgctgacagacacag

SEQ ID NO: 3718779 - DNA, 19 bp, Homo sapiens
cttgctgctattttactgt

SEQ ID NO: 3718780 - DNA, 17 bp, Homo sapiens
ctttttaagcttattta

SEQ ID NO: 3718781 - DNA, 15 bp, Homo sapiens
ctttttaataaaaag

SEQ ID NO: 3718782 - DNA, 19 bp, Homo sapiens
ctttttattgatgtgcaaa

SEQ ID NO: 3718783 - DNA, 18 bp, Homo sapiens
ctttttattttttaatta

SEQ ID NO: 3718784 - DNA, 15 bp, Homo sapiens
ctttttcaagattga

SEQ ID NO: 3718785 - DNA, 21 bp, Homo sapiens
ctttttcaagattgatcattt

SEQ ID NO: 3718786 - DNA, 13 bp, Homo sapiens
ctttttccagagg

SEQ ID NO: 3718787 - DNA, 13 bp, Homo sapiens
ctttttcttcctc

SEQ ID NO: 3718788 - DNA, 15 bp, Homo sapiens
cttttttcactacat

SEQ ID NO: 3718789 - DNA, 20 bp, Homo sapiens
cttttttgaaataataaatc

SEQ ID NO: 3718790 - DNA, 19 bp, Homo sapiens
gaaaaaaaagtttcagaga

SEQ ID NO: 3718791 - DNA, 20 bp, Homo sapiens
gaaaaaaaataacacagaga

SEQ ID NO: 3718792 - DNA, 14 bp, Homo sapiens
gaaaaaaactttta

SEQ ID NO: 3718793 - DNA, 20 bp, Homo sapiens
gaaaaaaagtttgccagaag

SEQ ID NO: 3718794 - DNA, 23 bp, Homo sapiens
gaaaaaaataattttatgaactg

SEQ ID NO: 3718795 - DNA, 21 bp, Homo sapiens
gaaaaaagaagtgtccgagaa

SEQ ID NO: 3718796 - DNA, 17 bp, Homo sapiens
gaaaaaatacattttat

SEQ ID NO: 3718797 - DNA, 19 bp, Homo sapiens
gaaaaaatattttcctgcc

SEQ ID NO: 3718798 - DNA, 15 bp, Homo sapiens
gaaaaacaataagag

SEQ ID NO: 3718799 - DNA, 18 bp, Homo sapiens
gaaaaacatctgaaagcc

SEQ ID NO: 3718800 - DNA, 16 bp, Homo sapiens
gaaaaagaaaaaatat

SEQ ID NO: 3718801 - DNA, 12 bp, Homo sapiens
gaaaaaggagga

SEQ ID NO: 3718802 - DNA, 18 bp, Homo sapiens
gaaaaagtatcatggaaa

SEQ ID NO: 3718803 - DNA, 10 bp, Homo sapiens
gaaaaatatg

SEQ ID NO: 3718804 - DNA, 13 bp, Homo sapiens
gaaaaatatttaa

SEQ ID NO: 3718805 - DNA, 14 bp, Homo sapiens
gaaaaatatttaag

SEQ ID NO: 3718806 - DNA, 18 bp, Homo sapiens
gaaaaatccagaaagaaa

SEQ ID NO: 3718807 - DNA, 20 bp, Homo sapiens
gaaaaatgcccttaaatcat

SEQ ID NO: 3718808 - DNA, 16 bp, Homo sapiens
gaaaaatttaagcatt

SEQ ID NO: 3718809 - DNA, 18 bp, Homo sapiens
gaaaaatttaagcattgt

SEQ ID NO: 3718810 - DNA, 14 bp, Homo sapiens
gaaaacaacaaaaa

SEQ ID NO: 3718811 - DNA, 23 bp, Homo sapiens
gaaaacaggaaaaaaacttttat

SEQ ID NO: 3718812 - DNA, 12 bp, Homo sapiens
gaaaacataaaa

SEQ ID NO: 3718813 - DNA, 21 bp, Homo sapiens
gaaaaccaagccgtggcttcc

SEQ ID NO: 3718814 - DNA, 12 bp, Homo sapiens
gaaaacccagag

SEQ ID NO: 3718815 - DNA, 22 bp, Homo sapiens
gaaaacccagagaggaatcaga

SEQ ID NO: 3718816 - DNA, 19 bp, Homo sapiens
gaaaacgttttattgtgtt

SEQ ID NO: 3718817 - DNA, 17 bp, Homo sapiens
gaaaacgttttgtttga

SEQ ID NO: 3718818 - DNA, 18 bp, Homo sapiens
gaaaactacattttaaca

SEQ ID NO: 3718819 - DNA, 19 bp, Homo sapiens
gaaaactacattttaacat

SEQ ID NO: 3718820 - DNA, 20 bp, Homo sapiens
gaaaactacattttaacatg

SEQ ID NO: 3718821 - DNA, 23 bp, Homo sapiens
gaaaagaaaaatgagcctggcaa

SEQ ID NO: 3718822 - DNA, 16 bp, Homo sapiens
gaaaagatacgacttt

SEQ ID NO: 3718823 - DNA, 19 bp, Homo sapiens
gaaaagatacgactttatt

SEQ ID NO: 3718824 - DNA, 22 bp, Homo sapiens
gaaaagatacgactttattttc

SEQ ID NO: 3718825 - DNA, 15 bp, Homo sapiens
gaaaagccatgttta

SEQ ID NO: 3718826 - DNA, 17 bp, Homo sapiens
gaaaagccatgtttaag

SEQ ID NO: 3718827 - DNA, 19 bp, Homo sapiens
gaaaagccatgtttaagat

SEQ ID NO: 3718828 - DNA, 19 bp, Homo sapiens
gaaaaggaggccattctga

SEQ ID NO: 3718829 - DNA, 11 bp, Homo sapiens
gaaaaggcagg

SEQ ID NO: 3718830 - DNA, 20 bp, Homo sapiens
gaaaaggttcttactgcttg

SEQ ID NO: 3718831 - DNA, 18 bp, Homo sapiens
gaaaagtggcaagaccaa

SEQ ID NO: 3718832 - DNA, 12 bp, Homo sapiens
gaaaataaaatt

SEQ ID NO: 3718833 - DNA, 23 bp, Homo sapiens
gaaaataaatcaatgctataact

SEQ ID NO: 3718834 - DNA, 18 bp, Homo sapiens
gaaaatagtttaggagaa

SEQ ID NO: 3718835 - DNA, 18 bp, Homo sapiens
gaaaatgcaacaacatgt

SEQ ID NO: 3718836 - DNA, 20 bp, Homo sapiens
gaaaatgcaacaacatgtat

SEQ ID NO: 3718837 - DNA, 23 bp, Homo sapiens
gaaaatgctgtattagtcacaga

SEQ ID NO: 3718838 - DNA, 20 bp, Homo sapiens
gaaaatgtaagtaaatgtct

SEQ ID NO: 3718839 - DNA, 13 bp, Homo sapiens
gaaaattaacact

SEQ ID NO: 3718840 - DNA, 18 bp, Homo sapiens
gaaaattaggatttcatg

SEQ ID NO: 3718841 - DNA, 22 bp, Homo sapiens
gaaaattaggatttcatgattt

SEQ ID NO: 3718842 - DNA, 18 bp, Homo sapiens
gaaaattccagaaaggat

SEQ ID NO: 3718843 - DNA, 16 bp, Homo sapiens
gaaaattgaatttaac

SEQ ID NO: 3718844 - DNA, 17 bp, Homo sapiens
gaaaattgaatttaaca

SEQ ID NO: 3718845 - DNA, 22 bp, Homo sapiens
gaaaattgaatttaacaatgcg

SEQ ID NO: 3718846 - DNA, 19 bp, Homo sapiens
gaaacaaaaacactaaaaa

SEQ ID NO: 3718847 - DNA, 23 bp, Homo sapiens
gaaacaaaaacactaaaaataaa

SEQ ID NO: 3718848 - DNA, 19 bp, Homo sapiens
gaaacaaagtggaaggaaa

SEQ ID NO: 3718849 - DNA, 20 bp, Homo sapiens
gaaacaaagtggaaggaaag

SEQ ID NO: 3718850 - DNA, 14 bp, Homo sapiens
gaaacacaatattt

SEQ ID NO: 3718851 - DNA, 17 bp, Homo sapiens
gaaacacaccaggctgt

SEQ ID NO: 3718852 - DNA, 17 bp, Homo sapiens
gaaacactgactcctgt

SEQ ID NO: 3718853 - DNA, 17 bp, Homo sapiens
gaaacagagacaggccc

SEQ ID NO: 3718854 - DNA, 14 bp, Homo sapiens
gaaacagatttggt

SEQ ID NO: 3718855 - DNA, 23 bp, Homo sapiens
gaaacatcagttactctgaaggg

SEQ ID NO: 3718856 - DNA, 17 bp, Homo sapiens
gaaacatctcaataaag

SEQ ID NO: 3718857 - DNA, 20 bp, Homo sapiens
gaaacatgactcgtatatgt

SEQ ID NO: 3718858 - DNA, 23 bp, Homo sapiens
gaaaccaatcaagataaaggaca

SEQ ID NO: 3718859 - DNA, 17 bp, Homo sapiens
gaaaccgtcctcttttt

SEQ ID NO: 3718860 - DNA, 17 bp, Homo sapiens
gaaacctacagaatact

SEQ ID NO: 3718861 - DNA, 15 bp, Homo sapiens
gaaacgtgccctctg

SEQ ID NO: 3718862 - DNA, 17 bp, Homo sapiens
gaaactcaccatgtaaa

SEQ ID NO: 3718863 - DNA, 22 bp, Homo sapiens
gaaactcacctgctggcccctc

SEQ ID NO: 3718864 - DNA, 15 bp, Homo sapiens
gaaacttacacacaa

SEQ ID NO: 3718865 - DNA, 22 bp, Homo sapiens
gaaacttcaagcaccagggaag

SEQ ID NO: 3718866 - DNA, 20 bp, Homo sapiens
gaaacttgttagaaatgcaa

SEQ ID NO: 3718867 - DNA, 11 bp, Homo sapiens
gaaacttttct

SEQ ID NO: 3718868 - DNA, 21 bp, Homo sapiens
gaaacttttcttaaaaagtta

SEQ ID NO: 3718869 - DNA, 17 bp, Homo sapiens
gaaagaaaatatgcatc

SEQ ID NO: 3718870 - DNA, 21 bp, Homo sapiens
gaaagaaacccgacagaggga

SEQ ID NO: 3718871 - DNA, 15 bp, Homo sapiens
gaaagaaagaaggaa

SEQ ID NO: 3718872 - DNA, 21 bp, Homo sapiens
gaaagacggattgcattagaa

SEQ ID NO: 3718873 - DNA, 23 bp, Homo sapiens
gaaagagataccaagatgccatc

SEQ ID NO: 3718874 - DNA, 18 bp, Homo sapiens
gaaagagttaagaatgtc

SEQ ID NO: 3718875 - DNA, 23 bp, Homo sapiens
gaaagatggctgtgcctctgcct

SEQ ID NO: 3718876 - DNA, 19 bp, Homo sapiens
gaaagcagaggctggcctc

SEQ ID NO: 3718877 - DNA, 18 bp, Homo sapiens
gaaagcatcacctcaggc

SEQ ID NO: 3718878 - DNA, 15 bp, Homo sapiens
gaaagcatccatgtg

SEQ ID NO: 3718879 - DNA, 22 bp, Homo sapiens
gaaagcatgtggcatgttcatc

SEQ ID NO: 3718880 - DNA, 22 bp, Homo sapiens
gaaagctgattactgtcaataa

SEQ ID NO: 3718881 - DNA, 23 bp, Homo sapiens
gaaagctgattactgtcaataaa

SEQ ID NO: 3718882 - DNA, 16 bp, Homo sapiens
gaaaggatatttaaga

SEQ ID NO: 3718883 - DNA, 21 bp, Homo sapiens
gaaaggatatttaagaaaata

SEQ ID NO: 3718884 - DNA, 12 bp, Homo sapiens
gaaaggccagct

SEQ ID NO: 3718885 - DNA, 14 bp, Homo sapiens
gaaaggctcagtct

SEQ ID NO: 3718886 - DNA, 22 bp, Homo sapiens
gaaagggacttggaagctccgc

SEQ ID NO: 3718887 - DNA, 22 bp, Homo sapiens
gaaagggagctatcaggaacag

SEQ ID NO: 3718888 - DNA, 20 bp, Homo sapiens
gaaagggattttcagccctc

SEQ ID NO: 3718889 - DNA, 18 bp, Homo sapiens
gaaaggttaccctgtaac

SEQ ID NO: 3718890 - DNA, 14 bp, Homo sapiens
gaaagtaatttctt

SEQ ID NO: 3718891 - DNA, 17 bp, Homo sapiens
gaaagtcatgaacacat

SEQ ID NO: 3718892 - DNA, 23 bp, Homo sapiens
gacacaaacaaacaagctaggtg

SEQ ID NO: 3718893 - DNA, 14 bp, Homo sapiens
gacacacacagctt

SEQ ID NO: 3718894 - DNA, 13 bp, Homo sapiens
gacacacagctct

SEQ ID NO: 3718895 - DNA, 15 bp, Homo sapiens
gacacacgcacacac

SEQ ID NO: 3718896 - DNA, 21 bp, Homo sapiens
gacacagctcttctccaggct

SEQ ID NO: 3718897 - DNA, 22 bp, Homo sapiens
gacacagctcttctccaggctg

SEQ ID NO: 3718898 - DNA, 21 bp, Homo sapiens
gacacaggatagataactctt

SEQ ID NO: 3718899 - DNA, 12 bp, Homo sapiens
gacacaggcccg

SEQ ID NO: 3718900 - DNA, 15 bp, Homo sapiens
gacacaggcccggct

SEQ ID NO: 3718901 - DNA, 17 bp, Homo sapiens
gacacaggcccggctcc

SEQ ID NO: 3718902 - DNA, 21 bp, Homo sapiens
gacacaggcccggctccaggc

SEQ ID NO: 3718903 - DNA, 17 bp, Homo sapiens
gacacctactgagtggc

SEQ ID NO: 3718904 - DNA, 13 bp, Homo sapiens
gacacctcagagc

SEQ ID NO: 3718905 - DNA, 16 bp, Homo sapiens
gacacctgcacctccc

SEQ ID NO: 3718906 - DNA, 19 bp, Homo sapiens
gacacctgcacctcccccc

SEQ ID NO: 3718907 - DNA, 22 bp, Homo sapiens
gacacctgcacctccccccact

SEQ ID NO: 3718908 - DNA, 15 bp, Homo sapiens
gacaccttgacaggg

SEQ ID NO: 3718909 - DNA, 15 bp, Homo sapiens
gacacttcagagagc

SEQ ID NO: 3718910 - DNA, 14 bp, Homo sapiens
gacagaacactgtc

SEQ ID NO: 3718911 - DNA, 13 bp, Homo sapiens
gacagaagaaggc

SEQ ID NO: 3718912 - DNA, 16 bp, Homo sapiens
gacagacacaggcccg

SEQ ID NO: 3718913 - DNA, 22 bp, Homo sapiens
gacagacacaggcccggctcca

SEQ ID NO: 3718914 - DNA, 15 bp, Homo sapiens
gacagacttgagaac

SEQ ID NO: 3718915 - DNA, 21 bp, Homo sapiens
gacagagccccaccctcagat

SEQ ID NO: 3718916 - DNA, 12 bp, Homo sapiens
gacagaggcagc

SEQ ID NO: 3718917 - DNA, 20 bp, Homo sapiens
gacagagggaaacacagcag

SEQ ID NO: 3718918 - DNA, 19 bp, Homo sapiens
gacagagtgagactctgtc

SEQ ID NO: 3718919 - DNA, 23 bp, Homo sapiens
gacagatcatagatttctgattt

SEQ ID NO: 3718920 - DNA, 19 bp, Homo sapiens
gacagatctctgctttgga

SEQ ID NO: 3718921 - DNA, 19 bp, Homo sapiens
gacagatgccccagagctg

SEQ ID NO: 3718922 - DNA, 20 bp, Homo sapiens
gacagatgccccagagctgt

SEQ ID NO: 3718923 - DNA, 18 bp, Homo sapiens
gacagcagctcaggcaca

SEQ ID NO: 3718924 - DNA, 21 bp, Homo sapiens
gacagcatggtgcatgccgct

SEQ ID NO: 3718925 - DNA, 22 bp, Homo sapiens
gacagcatggtgcatgccgctg

SEQ ID NO: 3718926 - DNA, 17 bp, Homo sapiens
gacagcccactgagaag

SEQ ID NO: 3718927 - DNA, 16 bp, Homo sapiens
gacagcctcccacccc

SEQ ID NO: 3718928 - DNA, 12 bp, Homo sapiens
gacagcctggca

SEQ ID NO: 3718929 - DNA, 15 bp, Homo sapiens
gacagctccttctgt

SEQ ID NO: 3718930 - DNA, 16 bp, Homo sapiens
gacagctgtccctgtc

SEQ ID NO: 3718931 - DNA, 18 bp, Homo sapiens
gacagctgtccctgtcac

SEQ ID NO: 3718932 - DNA, 19 bp, Homo sapiens
gacagctgtccctgtcacc

SEQ ID NO: 3718933 - DNA, 22 bp, Homo sapiens
gacagctgtccctgtcaccaag

SEQ ID NO: 3718934 - DNA, 15 bp, Homo sapiens
gacagctgtgctgta

SEQ ID NO: 3718935 - DNA, 22 bp, Homo sapiens
gacagcttctcatcctgcaggc

SEQ ID NO: 3718936 - DNA, 13 bp, Homo sapiens
gacaggacctgac

SEQ ID NO: 3718937 - DNA, 18 bp, Homo sapiens
gacaggagacctggcact

SEQ ID NO: 3718938 - DNA, 18 bp, Homo sapiens
gacaggatgtttgctcag

SEQ ID NO: 3718939 - DNA, 20 bp, Homo sapiens
gacaggcaagcacctcctgc

SEQ ID NO: 3718940 - DNA, 18 bp, Homo sapiens
gacaggcatgttctctga

SEQ ID NO: 3718941 - DNA, 18 bp, Homo sapiens
gacaggccatgtgagcca

SEQ ID NO: 3718942 - DNA, 13 bp, Homo sapiens
gacagggacccac

SEQ ID NO: 3718943 - DNA, 23 bp, Homo sapiens
gacagggcacaccgggcactcag

SEQ ID NO: 3718944 - DNA, 24 bp, Homo sapiens
gacagggcacaccgggcactcaga

SEQ ID NO: 3718945 - DNA, 14 bp, Homo sapiens
gacagggcatggcc

SEQ ID NO: 3718946 - DNA, 13 bp, Homo sapiens
gacagggtcctgc

SEQ ID NO: 3718947 - DNA, 14 bp, Homo sapiens
gacaggtctgggag

SEQ ID NO: 3718948 - DNA, 16 bp, Homo sapiens
gacagtcaaggagtgg

SEQ ID NO: 3718949 - DNA, 14 bp, Homo sapiens
gacagtcctgggag

SEQ ID NO: 3718950 - DNA, 13 bp, Homo sapiens
gacagtgcctggg

SEQ ID NO: 3718951 - DNA, 21 bp, Homo sapiens
gacagtgcctgggaatgtatt

SEQ ID NO: 3718952 - DNA, 16 bp, Homo sapiens
gacagtgcttcagcct

SEQ ID NO: 3718953 - DNA, 20 bp, Homo sapiens
gacagtggattgcatttctt

SEQ ID NO: 3718954 - DNA, 16 bp, Homo sapiens
gacataatttcactga

SEQ ID NO: 3718955 - DNA, 13 bp, Homo sapiens
gacatattcattt

SEQ ID NO: 3718956 - DNA, 13 bp, Homo sapiens
gacatcagcatca

SEQ ID NO: 3718957 - DNA, 18 bp, Homo sapiens
gacatcagcatcacctag

SEQ ID NO: 3718958 - DNA, 20 bp, Homo sapiens
gacatcttcaaagcttgaag

SEQ ID NO: 3718959 - DNA, 21 bp, Homo sapiens
gacatcttcaaagcttgaaga

SEQ ID NO: 3718960 - DNA, 14 bp, Homo sapiens
gacatgaatatgat

SEQ ID NO: 3718961 - DNA, 14 bp, Homo sapiens
gacatgatcttctt

SEQ ID NO: 3718962 - DNA, 21 bp, Homo sapiens
gacatgatggagcgcacctgc

SEQ ID NO: 3718963 - DNA, 17 bp, Homo sapiens
gacatggacccggagct

SEQ ID NO: 3718964 - DNA, 13 bp, Homo sapiens
gacatgtggaaag

SEQ ID NO: 3718965 - DNA, 17 bp, Homo sapiens
gacattaacagttttcc

SEQ ID NO: 3718966 - DNA, 22 bp, Homo sapiens
gacattaacagttttccatgaa

SEQ ID NO: 3718967 - DNA, 23 bp, Homo sapiens
gacattaacagttttccatgaaa

SEQ ID NO: 3718968 - DNA, 17 bp, Homo sapiens
gacattgcggacagcca

SEQ ID NO: 3718969 - DNA, 19 bp, Homo sapiens
gacattgtagagcttctgg

SEQ ID NO: 3718970 - DNA, 17 bp, Homo sapiens
gaccaaaaaaataaggt

SEQ ID NO: 3718971 - DNA, 22 bp, Homo sapiens
gaccaacatggagaaaccctgt

SEQ ID NO: 3718972 - DNA, 14 bp, Homo sapiens
gaccaagagagaaa

SEQ ID NO: 3718973 - DNA, 16 bp, Homo sapiens
gaccaagagagaaaga

SEQ ID NO: 3718974 - DNA, 14 bp, Homo sapiens
gaccaagttataaa

SEQ ID NO: 3718975 - DNA, 12 bp, Homo sapiens
gaccacacctcc

SEQ ID NO: 3718976 - DNA, 20 bp, Homo sapiens
gaccacacttcctgtccaga

SEQ ID NO: 3718977 - DNA, 21 bp, Homo sapiens
gaccacagggttcaaaatgtc

SEQ ID NO: 3718978 - DNA, 16 bp, Homo sapiens
gaccagaagccaaaga

SEQ ID NO: 3718979 - DNA, 22 bp, Homo sapiens
gaccagacaccttgacagggca

SEQ ID NO: 3718980 - DNA, 24 bp, Homo sapiens
gaccagacaccttgacagggcaca

SEQ ID NO: 3718981 - DNA, 16 bp, Homo sapiens
gaccagcagatcccag

SEQ ID NO: 3718982 - DNA, 22 bp, Homo sapiens
gaccagcctggccaacatggta

SEQ ID NO: 3718983 - DNA, 16 bp, Homo sapiens
gaccaggacaggacca

SEQ ID NO: 3718984 - DNA, 16 bp, Homo sapiens
gaccaggactccctcc

SEQ ID NO: 3718985 - DNA, 21 bp, Homo sapiens
gaccaggactccctcctcacc

SEQ ID NO: 3718986 - DNA, 23 bp, Homo sapiens
gaccatccactctaccctcccac

SEQ ID NO: 3718987 - DNA, 21 bp, Homo sapiens
gaccatttataatgttagtag

SEQ ID NO: 3718988 - DNA, 15 bp, Homo sapiens
gaccatttcaggggt

SEQ ID NO: 3718989 - DNA, 13 bp, Homo sapiens
gacccaaggagga

SEQ ID NO: 3718990 - DNA, 14 bp, Homo sapiens
gacccacagcctct

SEQ ID NO: 3718991 - DNA, 23 bp, Homo sapiens
gacccacttcacacacaggcaac

SEQ ID NO: 3718992 - DNA, 22 bp, Homo sapiens
gacccagccccttgagaaacct

SEQ ID NO: 3718993 - DNA, 16 bp, Homo sapiens
gacccaggctgcctga

SEQ ID NO: 3718994 - DNA, 18 bp, Homo sapiens
gacccaggctgcctgagc

SEQ ID NO: 3718995 - DNA, 15 bp, Homo sapiens
gacccagtccctggg

SEQ ID NO: 3718996 - DNA, 12 bp, Homo sapiens
gacccccacccc

SEQ ID NO: 3718997 - DNA, 13 bp, Homo sapiens
gacccccacccct

SEQ ID NO: 3718998 - DNA, 15 bp, Homo sapiens
gacccccaccccttc

SEQ ID NO: 3718999 - DNA, 19 bp, Homo sapiens
gacccccaccccttcccca

SEQ ID NO: 3719000 - DNA, 18 bp, Homo sapiens
gacccccactctcattcc

SEQ ID NO: 3719001 - DNA, 20 bp, Homo sapiens
gacccccagcaaccctccta

SEQ ID NO: 3719002 - DNA, 18 bp, Homo sapiens
gacccccctcaggaccct

SEQ ID NO: 3719003 - DNA, 14 bp, Homo sapiens
gacccctcaccttg

SEQ ID NO: 3719004 - DNA, 14 bp, Homo sapiens
gacccctccatgtg

SEQ ID NO: 3719005 - DNA, 18 bp, Homo sapiens
gaggacatgatggagcgc

SEQ ID NO: 3719006 - DNA, 13 bp, Homo sapiens
gaggaccactcct

SEQ ID NO: 3719007 - DNA, 15 bp, Homo sapiens
gaggaccttatctgt

SEQ ID NO: 3719008 - DNA, 19 bp, Homo sapiens
gaggaccttatctgtgcgt

SEQ ID NO: 3719009 - DNA, 14 bp, Homo sapiens
gaggacttgtgtct

SEQ ID NO: 3719010 - DNA, 16 bp, Homo sapiens
gaggacttttctttgt

SEQ ID NO: 3719011 - DNA, 23 bp, Homo sapiens
gaggacttttctttgtggcttcc

SEQ ID NO: 3719012 - DNA, 13 bp, Homo sapiens
gaggagagacggt

SEQ ID NO: 3719013 - DNA, 15 bp, Homo sapiens
gaggagcttggggga

SEQ ID NO: 3719014 - DNA, 20 bp, Homo sapiens
gaggaggtggcagccctgta

SEQ ID NO: 3719015 - DNA, 15 bp, Homo sapiens
gaggatggagagagg

SEQ ID NO: 3719016 - DNA, 20 bp, Homo sapiens
gaggatgttctgggacacag

SEQ ID NO: 3719017 - DNA, 20 bp, Homo sapiens
gaggattgcttgagctcagg

SEQ ID NO: 3719018 - DNA, 20 bp, Homo sapiens
gaggatttaagggatggaaa

SEQ ID NO: 3719019 - DNA, 20 bp, Homo sapiens
gaggcacacagctgcagaga

SEQ ID NO: 3719020 - DNA, 24 bp, Homo sapiens
gaggcacacagctgcagagacaga

SEQ ID NO: 3719021 - DNA, 18 bp, Homo sapiens
gaggcagaaagcagaggc

SEQ ID NO: 3719022 - DNA, 21 bp, Homo sapiens
gaggcagaaagcagaggctgg

SEQ ID NO: 3719023 - DNA, 23 bp, Homo sapiens
gaggcagaagaattgaacccagg

SEQ ID NO: 3719024 - DNA, 19 bp, Homo sapiens
gaggcagacagcagctcag

SEQ ID NO: 3719025 - DNA, 20 bp, Homo sapiens
gaggcagacagcagctcagg

SEQ ID NO: 3719026 - DNA, 22 bp, Homo sapiens
gaggcagacagcagctcaggca

SEQ ID NO: 3719027 - DNA, 22 bp, Homo sapiens
gaggcagacttccctgaatgta

SEQ ID NO: 3719028 - DNA, 14 bp, Homo sapiens
gaggcagagtgccc

SEQ ID NO: 3719029 - DNA, 9 bp, Homo sapiens
gaggcaggg

SEQ ID NO: 3719030 - DNA, 22 bp, Homo sapiens
gaggcagggaagtccccaggcc

SEQ ID NO: 3719031 - DNA, 20 bp, Homo sapiens
gaggcagggccttgcccaga

SEQ ID NO: 3719032 - DNA, 13 bp, Homo sapiens
gaggcagggtcag

SEQ ID NO: 3719033 - DNA, 14 bp, Homo sapiens
gaggcagggtctca

SEQ ID NO: 3719034 - DNA, 18 bp, Homo sapiens
gaggcagggtctcactct

SEQ ID NO: 3719035 - DNA, 18 bp, Homo sapiens
gaggcaggtgacagtgag

SEQ ID NO: 3719036 - DNA, 14 bp, Homo sapiens
gaggccagccccac

SEQ ID NO: 3719037 - DNA, 12 bp, Homo sapiens
gaggccagcctg

SEQ ID NO: 3719038 - DNA, 14 bp, Homo sapiens
gaggccagcctggc

SEQ ID NO: 3719039 - DNA, 20 bp, Homo sapiens
gaggccatgattcgcccaaa

SEQ ID NO: 3719040 - DNA, 14 bp, Homo sapiens
gaggccccactggg

SEQ ID NO: 3719041 - DNA, 14 bp, Homo sapiens
gaggccttctctga

SEQ ID NO: 3719042 - DNA, 18 bp, Homo sapiens
gaggccttctctgaagga

SEQ ID NO: 3719043 - DNA, 19 bp, Homo sapiens
gaggccttctctgaaggac

SEQ ID NO: 3719044 - DNA, 12 bp, Homo sapiens
gaggcgggtgga

SEQ ID NO: 3719045 - DNA, 20 bp, Homo sapiens
gaggctctaaccacacagcc

SEQ ID NO: 3719046 - DNA, 20 bp, Homo sapiens
gaggctgaaagaggccaatg

SEQ ID NO: 3719047 - DNA, 18 bp, Homo sapiens
gaggctgaggcagaagaa

SEQ ID NO: 3719048 - DNA, 12 bp, Homo sapiens
gaggctgaggcg

SEQ ID NO: 3719049 - DNA, 20 bp, Homo sapiens
gaggctggactccagatctg

SEQ ID NO: 3719050 - DNA, 15 bp, Homo sapiens
gaggctggagctggc

SEQ ID NO: 3719051 - DNA, 16 bp, Homo sapiens
gaggctggaggcaggg

SEQ ID NO: 3719052 - DNA, 19 bp, Homo sapiens
gaggctggaggcagggcct

SEQ ID NO: 3719053 - DNA, 12 bp, Homo sapiens
gaggctggcagg

SEQ ID NO: 3719054 - DNA, 13 bp, Homo sapiens
gaggctggcaggt

SEQ ID NO: 3719055 - DNA, 15 bp, Homo sapiens
gaggctgggccaagc

SEQ ID NO: 3719056 - DNA, 21 bp, Homo sapiens
gaggctgggccaagccaggga

SEQ ID NO: 3719057 - DNA, 16 bp, Homo sapiens
gaggcttcttcagatc

SEQ ID NO: 3719058 - DNA, 19 bp, Homo sapiens
gaggcttgtcagagctggg

SEQ ID NO: 3719059 - DNA, 15 bp, Homo sapiens
gagggaacagacagg

SEQ ID NO: 3719060 - DNA, 19 bp, Homo sapiens
gagggaacagacaggagaa

SEQ ID NO: 3719061 - DNA, 18 bp, Homo sapiens
gagggaccaactgggccc

SEQ ID NO: 3719062 - DNA, 19 bp, Homo sapiens
gagggaccaactgggccca

SEQ ID NO: 3719063 - DNA, 14 bp, Homo sapiens
gagggagaagcatg

SEQ ID NO: 3719064 - DNA, 13 bp, Homo sapiens
gagggaggaatcg

SEQ ID NO: 3719065 - DNA, 15 bp, Homo sapiens
gagggagggcaatag

SEQ ID NO: 3719066 - DNA, 14 bp, Homo sapiens
gagggagtgacaga

SEQ ID NO: 3719067 - DNA, 22 bp, Homo sapiens
gagggagtgacagaggcagccc

SEQ ID NO: 3719068 - DNA, 22 bp, Homo sapiens
gagggatgaggtgctgggaggg

SEQ ID NO: 3719069 - DNA, 15 bp, Homo sapiens
gagggcagaggctgg

SEQ ID NO: 3719070 - DNA, 16 bp, Homo sapiens
gagggcccaggcaggc

SEQ ID NO: 3719071 - DNA, 20 bp, Homo sapiens
gagggcgtgactcacccaag

SEQ ID NO: 3719072 - DNA, 21 bp, Homo sapiens
gagggctgcccggctgcccac

SEQ ID NO: 3719073 - DNA, 13 bp, Homo sapiens
gagggctgccctg

SEQ ID NO: 3719074 - DNA, 21 bp, Homo sapiens
gaggggaggatcactggagcc

SEQ ID NO: 3719075 - DNA, 20 bp, Homo sapiens
gaggggcaacgaagaaaaaa

SEQ ID NO: 3719076 - DNA, 18 bp, Homo sapiens
gaggggcagaacagccgc

SEQ ID NO: 3719077 - DNA, 17 bp, Homo sapiens
gaggggcatctgcccct

SEQ ID NO: 3719078 - DNA, 13 bp, Homo sapiens
gaggggcccgagc

SEQ ID NO: 3719079 - DNA, 13 bp, Homo sapiens
gaggggcctggca

SEQ ID NO: 3719080 - DNA, 14 bp, Homo sapiens
gaggggcctggcag

SEQ ID NO: 3719081 - DNA, 12 bp, Homo sapiens
gaggggctcctg

SEQ ID NO: 3719082 - DNA, 14 bp, Homo sapiens
gagggggagggggt

SEQ ID NO: 3719083 - DNA, 14 bp, Homo sapiens
gaggggtgctctgc

SEQ ID NO: 3719084 - DNA, 13 bp, Homo sapiens
gagggtcagagag

SEQ ID NO: 3719085 - DNA, 15 bp, Homo sapiens
gagggtcaggaagga

SEQ ID NO: 3719086 - DNA, 21 bp, Homo sapiens
gagggtcctggctcctgaggg

SEQ ID NO: 3719087 - DNA, 14 bp, Homo sapiens
gagggtctgaggaa

SEQ ID NO: 3719088 - DNA, 12 bp, Homo sapiens
gagggtggaata

SEQ ID NO: 3719089 - DNA, 19 bp, Homo sapiens
gagggtgggagagcccagc

SEQ ID NO: 3719090 - DNA, 14 bp, Homo sapiens
gagggttgggctgg

SEQ ID NO: 3719091 - DNA, 17 bp, Homo sapiens
gagggttggggaggggc

SEQ ID NO: 3719092 - DNA, 18 bp, Homo sapiens
gagggttgttctcctaga

SEQ ID NO: 3719093 - DNA, 21 bp, Homo sapiens
gaggtaggtggatcacctgag

SEQ ID NO: 3719094 - DNA, 19 bp, Homo sapiens
gaggtatttatctttactt

SEQ ID NO: 3719095 - DNA, 22 bp, Homo sapiens
gaggtcaacagagaaggcagga

SEQ ID NO: 3719096 - DNA, 20 bp, Homo sapiens
gaggtcaagcccaggaggac

SEQ ID NO: 3719097 - DNA, 24 bp, Homo sapiens
gaggtcaagcccaggaggactgcc

SEQ ID NO: 3719098 - DNA, 12 bp, Homo sapiens
gaggtcagagcc

SEQ ID NO: 3719099 - DNA, 17 bp, Homo sapiens
gaggtcagagcctgcag

SEQ ID NO: 3719100 - DNA, 12 bp, Homo sapiens
gaggtcccaggc

SEQ ID NO: 3719101 - DNA, 13 bp, Homo sapiens
gaggtcctggggg

SEQ ID NO: 3719102 - DNA, 21 bp, Homo sapiens
gaggtcctgggggcctgacct

SEQ ID NO: 3719103 - DNA, 22 bp, Homo sapiens
gaggtcgaccccaaagcccctt

SEQ ID NO: 3719104 - DNA, 19 bp, Homo sapiens
gaggtctgctcggccgtct

SEQ ID NO: 3719105 - DNA, 15 bp, Homo sapiens
gaggtgaaagggagc

SEQ ID NO: 3719106 - DNA, 23 bp, Homo sapiens
gaggtgaccccaggtttctatgt

SEQ ID NO: 3719107 - DNA, 18 bp, Homo sapiens
gaggtgcagagtgcccag

SEQ ID NO: 3719108 - DNA, 15 bp, Homo sapiens
gaggtggaagccctc

SEQ ID NO: 3719109 - DNA, 20 bp, Homo sapiens
gaggtggaagccctccttcc

SEQ ID NO: 3719110 - DNA, 19 bp, Homo sapiens
gaggtggaggctgcagtga

SEQ ID NO: 3719111 - DNA, 15 bp, Homo sapiens
gaggtggcagccctg

SEQ ID NO: 3719112 - DNA, 20 bp, Homo sapiens
gaggtggctctggaatgaca

SEQ ID NO: 3719113 - DNA, 11 bp, Homo sapiens
gaggtgggagg

SEQ ID NO: 3719114 - DNA, 16 bp, Homo sapiens
gaggtggtctgaatgt

SEQ ID NO: 3719115 - DNA, 15 bp, Homo sapiens
gaggttaaggctgag

SEQ ID NO: 3719116 - DNA, 22 bp, Homo sapiens
gaggttaggagttcgagaccag

SEQ ID NO: 3719117 - DNA, 22 bp, Homo sapiens
gaggttataggtcactcctggg

SEQ ID NO: 3719118 - DNA, 21 bp, Homo sapiens
gatcccgcctcttcttcttca

SEQ ID NO: 3719119 - DNA, 17 bp, Homo sapiens
gatcctcccacctcagc

SEQ ID NO: 3719120 - DNA, 18 bp, Homo sapiens
gatcctcccacctcagcc

SEQ ID NO: 3719121 - DNA, 20 bp, Homo sapiens
gatcctcccacctcagcctc

SEQ ID NO: 3719122 - DNA, 20 bp, Homo sapiens
gatcctgtctttaaggaaaa

SEQ ID NO: 3719123 - DNA, 13 bp, Homo sapiens
gatcgcagtttgc

SEQ ID NO: 3719124 - DNA, 18 bp, Homo sapiens
gatcgcagtttgcctggt

SEQ ID NO: 3719125 - DNA, 22 bp, Homo sapiens
gatcggaggcttgtcagagctg

SEQ ID NO: 3719126 - DNA, 15 bp, Homo sapiens
gatcgtgctaaattt

SEQ ID NO: 3719127 - DNA, 21 bp, Homo sapiens
gatctcagggaagcccagctc

SEQ ID NO: 3719128 - DNA, 17 bp, Homo sapiens
gatctcattcagtatta

SEQ ID NO: 3719129 - DNA, 14 bp, Homo sapiens
gatctccaaagctt

SEQ ID NO: 3719130 - DNA, 14 bp, Homo sapiens
gatctccctgccgc

SEQ ID NO: 3719131 - DNA, 15 bp, Homo sapiens
gatctccctgccgcc

SEQ ID NO: 3719132 - DNA, 16 bp, Homo sapiens
gatctcttgagcctgg

SEQ ID NO: 3719133 - DNA, 19 bp, Homo sapiens
gatctgaacagaaatacca

SEQ ID NO: 3719134 - DNA, 22 bp, Homo sapiens
gatctgggaccctttccttcct

SEQ ID NO: 3719135 - DNA, 20 bp, Homo sapiens
gatctgggttcactgcaacc

SEQ ID NO: 3719136 - DNA, 23 bp, Homo sapiens
gatctgtatatttttttctaaga

SEQ ID NO: 3719137 - DNA, 20 bp, Homo sapiens
gatcttgctctatctcacag

SEQ ID NO: 3719138 - DNA, 13 bp, Homo sapiens
gatcttgtgctca

SEQ ID NO: 3719139 - DNA, 17 bp, Homo sapiens
gatctttgcagacaggc

SEQ ID NO: 3719140 - DNA, 16 bp, Homo sapiens
gatgaagcaaacacat

SEQ ID NO: 3719141 - DNA, 19 bp, Homo sapiens
gatgaatgaggtcccaggc

SEQ ID NO: 3719142 - DNA, 21 bp, Homo sapiens
gatgacccaggctgcctgagc

SEQ ID NO: 3719143 - DNA, 12 bp, Homo sapiens
gatgacccctcc

SEQ ID NO: 3719144 - DNA, 15 bp, Homo sapiens
gatgactagaggcag

SEQ ID NO: 3719145 - DNA, 18 bp, Homo sapiens
gatgagaattcagctgcc

SEQ ID NO: 3719146 - DNA, 18 bp, Homo sapiens
gatgagcatttagggcaa

SEQ ID NO: 3719147 - DNA, 21 bp, Homo sapiens
gatgagcatttagggcaagga

SEQ ID NO: 3719148 - DNA, 14 bp, Homo sapiens
gatgaggggaggaa

SEQ ID NO: 3719149 - DNA, 14 bp, Homo sapiens
gatgaggtgctggg

SEQ ID NO: 3719150 - DNA, 19 bp, Homo sapiens
gatgaggtgctgggaggga

SEQ ID NO: 3719151 - DNA, 18 bp, Homo sapiens
gatgagtgtaacaagaaa

SEQ ID NO: 3719152 - DNA, 21 bp, Homo sapiens
gatgagtgtaacaagaaagga

SEQ ID NO: 3719153 - DNA, 13 bp, Homo sapiens
gatgatcctaggc

SEQ ID NO: 3719154 - DNA, 14 bp, Homo sapiens
gatgatcctaggca

SEQ ID NO: 3719155 - DNA, 20 bp, Homo sapiens
gatgatctttgcagacaggc

SEQ ID NO: 3719156 - DNA, 21 bp, Homo sapiens
gatgatctttgcagacaggca

SEQ ID NO: 3719157 - DNA, 23 bp, Homo sapiens
gatgatgacgacgacaacgatga

SEQ ID NO: 3719158 - DNA, 14 bp, Homo sapiens
gatgatgctgccag

SEQ ID NO: 3719159 - DNA, 14 bp, Homo sapiens
gatgcaaggaccag

SEQ ID NO: 3719160 - DNA, 17 bp, Homo sapiens
gatgcaaggaccaggac

SEQ ID NO: 3719161 - DNA, 18 bp, Homo sapiens
gatgcaatgtgctactga

SEQ ID NO: 3719162 - DNA, 15 bp, Homo sapiens
gatgcaccagccctt

SEQ ID NO: 3719163 - DNA, 23 bp, Homo sapiens
gatgcaccagcccttagcaggga

SEQ ID NO: 3719164 - DNA, 14 bp, Homo sapiens
gatgcagtgcttcc

SEQ ID NO: 3719165 - DNA, 17 bp, Homo sapiens
gatgcccactgaggaat

SEQ ID NO: 3719166 - DNA, 12 bp, Homo sapiens
gatgcctccacc

SEQ ID NO: 3719167 - DNA, 17 bp, Homo sapiens
gatgcctccaccgctgc

SEQ ID NO: 3719168 - DNA, 20 bp, Homo sapiens
gatgcctccaccgctgccta

SEQ ID NO: 3719169 - DNA, 14 bp, Homo sapiens
gatgcctgaacttg

SEQ ID NO: 3719170 - DNA, 14 bp, Homo sapiens
gatgcctggtggca

SEQ ID NO: 3719171 - DNA, 18 bp, Homo sapiens
gatgcctggtggcagctg

SEQ ID NO: 3719172 - DNA, 16 bp, Homo sapiens
gatgctccagccaacc

SEQ ID NO: 3719173 - DNA, 13 bp, Homo sapiens
gatgctccctccc

SEQ ID NO: 3719174 - DNA, 20 bp, Homo sapiens
gatgctgaaacaggagagaa

SEQ ID NO: 3719175 - DNA, 17 bp, Homo sapiens
gatgctgactgtactcc

SEQ ID NO: 3719176 - DNA, 20 bp, Homo sapiens
gatgctgactgtactcctcc

SEQ ID NO: 3719177 - DNA, 16 bp, Homo sapiens
gatgctgcctgagtca

SEQ ID NO: 3719178 - DNA, 18 bp, Homo sapiens
gatgctggatgctccttc

SEQ ID NO: 3719179 - DNA, 23 bp, Homo sapiens
gatgcttctcactgccatgccag

SEQ ID NO: 3719180 - DNA, 18 bp, Homo sapiens
gatgcttgtaacaagaaa

SEQ ID NO: 3719181 - DNA, 21 bp, Homo sapiens
gatgcttgtaacaagaaaaca

SEQ ID NO: 3719182 - DNA, 15 bp, Homo sapiens
gatggaaacaaagtg

SEQ ID NO: 3719183 - DNA, 20 bp, Homo sapiens
gatggaacccttttggcccc

SEQ ID NO: 3719184 - DNA, 22 bp, Homo sapiens
gatggaacccttttggcccccg

SEQ ID NO: 3719185 - DNA, 15 bp, Homo sapiens
gatggagagagggga

SEQ ID NO: 3719186 - DNA, 12 bp, Homo sapiens
gatggaggagga

SEQ ID NO: 3719187 - DNA, 21 bp, Homo sapiens
gatggaggggtggtcctgact

SEQ ID NO: 3719188 - DNA, 22 bp, Homo sapiens
gatggccgggcgcggtggctca

SEQ ID NO: 3719189 - DNA, 17 bp, Homo sapiens
gatggctgtgcctctgc

SEQ ID NO: 3719190 - DNA, 18 bp, Homo sapiens
gatggctgtgcctctgcc

SEQ ID NO: 3719191 - DNA, 19 bp, Homo sapiens
gatggctgtgcctctgcct

SEQ ID NO: 3719192 - DNA, 21 bp, Homo sapiens
gatggctttgaatgcggccca

SEQ ID NO: 3719193 - DNA, 14 bp, Homo sapiens
gatgggactgggag

SEQ ID NO: 3719194 - DNA, 20 bp, Homo sapiens
gatgggcaacccccagcctg

SEQ ID NO: 3719195 - DNA, 21 bp, Homo sapiens
gatgggcaacccccagcctgc

SEQ ID NO: 3719196 - DNA, 14 bp, Homo sapiens
gatggggaaggagg

SEQ ID NO: 3719197 - DNA, 15 bp, Homo sapiens
gatggggccacagcc

SEQ ID NO: 3719198 - DNA, 22 bp, Homo sapiens
gatggggtggggtggagaactc

SEQ ID NO: 3719199 - DNA, 21 bp, Homo sapiens
gatggtcctggggctctgtgc

SEQ ID NO: 3719200 - DNA, 23 bp, Homo sapiens
gatggttacactgttagaacact

SEQ ID NO: 3719201 - DNA, 21 bp, Homo sapiens
gatggttcccctgttcactct

SEQ ID NO: 3719202 - DNA, 23 bp, Homo sapiens
gatgtaaataaccccattctttg

SEQ ID NO: 3719203 - DNA, 17 bp, Homo sapiens
gatgtacagttgggaaa

SEQ ID NO: 3719204 - DNA, 23 bp, Homo sapiens
gatgtacagttgggaaaatatgt

SEQ ID NO: 3719205 - DNA, 19 bp, Homo sapiens
gatgtaccatgaaacaaag

SEQ ID NO: 3719206 - DNA, 19 bp, Homo sapiens
gatgtagggtaaggtgcct

SEQ ID NO: 3719207 - DNA, 20 bp, Homo sapiens
gatgtagggtaaggtgcctt

SEQ ID NO: 3719208 - DNA, 19 bp, Homo sapiens
gatgtcatcccattgtctt

SEQ ID NO: 3719209 - DNA, 21 bp, Homo sapiens
gatgtcatcccattgtcttct

SEQ ID NO: 3719210 - DNA, 20 bp, Homo sapiens
gatgtccacagatgcctcca

SEQ ID NO: 3719211 - DNA, 14 bp, Homo sapiens
gatgtctaatagtt

SEQ ID NO: 3719212 - DNA, 16 bp, Homo sapiens
gatgtcttatttttag

SEQ ID NO: 3719213 - DNA, 22 bp, Homo sapiens
gatgtgcaaaaatttttggatt

SEQ ID NO: 3719214 - DNA, 23 bp, Homo sapiens
gatgtgcatttttgtgaaatgaa

SEQ ID NO: 3719215 - DNA, 12 bp, Homo sapiens
gatgtggagcac

SEQ ID NO: 3719216 - DNA, 13 bp, Homo sapiens
gatgtggccctgg

SEQ ID NO: 3719217 - DNA, 20 bp, Homo sapiens
gatgtggccctggcctgctg

SEQ ID NO: 3719218 - DNA, 14 bp, Homo sapiens
gatgttaaccagaa

SEQ ID NO: 3719219 - DNA, 14 bp, Homo sapiens
gatgttctgggaca

SEQ ID NO: 3719220 - DNA, 16 bp, Homo sapiens
gatgttctgggacaca

SEQ ID NO: 3719221 - DNA, 23 bp, Homo sapiens
gatgtttacaggtggacacacaa

SEQ ID NO: 3719222 - DNA, 22 bp, Homo sapiens
gattaagagatgggtttgacaa

SEQ ID NO: 3719223 - DNA, 18 bp, Homo sapiens
gattaaggtctctctttg

SEQ ID NO: 3719224 - DNA, 23 bp, Homo sapiens
gattacaagcgtgagccactgca

SEQ ID NO: 3719225 - DNA, 20 bp, Homo sapiens
gattacaggtgtgaaccacc

SEQ ID NO: 3719226 - DNA, 14 bp, Homo sapiens
gattacatgcatgt

SEQ ID NO: 3719227 - DNA, 17 bp, Homo sapiens
gattactgtcaataaac

SEQ ID NO: 3719228 - DNA, 15 bp, Homo sapiens
gattagtaaagaaat

SEQ ID NO: 3719229 - DNA, 20 bp, Homo sapiens
gattatagattggagccacc

SEQ ID NO: 3719230 - DNA, 20 bp, Homo sapiens
gcatcatctgtagatactag

SEQ ID NO: 3719231 - DNA, 22 bp, Homo sapiens
gcatcattatttgcagagacag

SEQ ID NO: 3719232 - DNA, 16 bp, Homo sapiens
gcatcccaggggacca

SEQ ID NO: 3719233 - DNA, 20 bp, Homo sapiens
gcatcccagtggcctcaacc

SEQ ID NO: 3719234 - DNA, 14 bp, Homo sapiens
gcatcctggcaccc

SEQ ID NO: 3719235 - DNA, 18 bp, Homo sapiens
gcatcctgtctggcattt

SEQ ID NO: 3719236 - DNA, 16 bp, Homo sapiens
gcatctaaactttaat

SEQ ID NO: 3719237 - DNA, 20 bp, Homo sapiens
gcatctatcgagtttgcaat

SEQ ID NO: 3719238 - DNA, 13 bp, Homo sapiens
gcatctcagccca

SEQ ID NO: 3719239 - DNA, 15 bp, Homo sapiens
gcatctcagcccaca

SEQ ID NO: 3719240 - DNA, 16 bp, Homo sapiens
gcatctcctgtgcatg

SEQ ID NO: 3719241 - DNA, 16 bp, Homo sapiens
gcatctgacacaaaaa

SEQ ID NO: 3719242 - DNA, 18 bp, Homo sapiens
gcatctgcccctccccca

SEQ ID NO: 3719243 - DNA, 17 bp, Homo sapiens
gcatcttctcactccct

SEQ ID NO: 3719244 - DNA, 13 bp, Homo sapiens
gcatcttctccat

SEQ ID NO: 3719245 - DNA, 14 bp, Homo sapiens
gcatcttctccatc

SEQ ID NO: 3719246 - DNA, 15 bp, Homo sapiens
gcatgacaagcccca

SEQ ID NO: 3719247 - DNA, 18 bp, Homo sapiens
gcatgacaagccccaggc

SEQ ID NO: 3719248 - DNA, 22 bp, Homo sapiens
gcatgacctgtgaccagcactg

SEQ ID NO: 3719249 - DNA, 14 bp, Homo sapiens
gcatgcagaaaggg

SEQ ID NO: 3719250 - DNA, 15 bp, Homo sapiens
gcatgcattttgcag

SEQ ID NO: 3719251 - DNA, 13 bp, Homo sapiens
gcatgcctgtgtg

SEQ ID NO: 3719252 - DNA, 15 bp, Homo sapiens
gcatgcctgtgtgac

SEQ ID NO: 3719253 - DNA, 14 bp, Homo sapiens
gcatgctctctgca

SEQ ID NO: 3719254 - DNA, 15 bp, Homo sapiens
gcatgctctctgcag

SEQ ID NO: 3719255 - DNA, 16 bp, Homo sapiens
gcatgctggggcaagt

SEQ ID NO: 3719256 - DNA, 17 bp, Homo sapiens
gcatggagtgtgtattg

SEQ ID NO: 3719257 - DNA, 18 bp, Homo sapiens
gcatggagtgtgtattgt

SEQ ID NO: 3719258 - DNA, 20 bp, Homo sapiens
gcatggagtgtgtattgttc

SEQ ID NO: 3719259 - DNA, 24 bp, Homo sapiens
gcatggagtgtgtattgttcccag

SEQ ID NO: 3719260 - DNA, 20 bp, Homo sapiens
gcatggcaaggactgcaggg

SEQ ID NO: 3719261 - DNA, 21 bp, Homo sapiens
gcatggcacctgtcgcccagt

SEQ ID NO: 3719262 - DNA, 18 bp, Homo sapiens
gcatggcagcaggcctgt

SEQ ID NO: 3719263 - DNA, 14 bp, Homo sapiens
gcatggccaggtgg

SEQ ID NO: 3719264 - DNA, 22 bp, Homo sapiens
gcatggcgtagagggtgctgcc

SEQ ID NO: 3719265 - DNA, 23 bp, Homo sapiens
gcatggcgtagagggtgctgccc

SEQ ID NO: 3719266 - DNA, 13 bp, Homo sapiens
gcatggctccagt

SEQ ID NO: 3719267 - DNA, 22 bp, Homo sapiens
gcatggctccagtctgctgccc

SEQ ID NO: 3719268 - DNA, 23 bp, Homo sapiens
gcatggggataaaggagaaggca

SEQ ID NO: 3719269 - DNA, 15 bp, Homo sapiens
gcatgtaggagaatc

SEQ ID NO: 3719270 - DNA, 19 bp, Homo sapiens
gcatgtgtgcgagtgtgtg

SEQ ID NO: 3719271 - DNA, 16 bp, Homo sapiens
gcatgtgtgtgctcag

SEQ ID NO: 3719272 - DNA, 20 bp, Homo sapiens
gcatgtgtttggttctgggg

SEQ ID NO: 3719273 - DNA, 18 bp, Homo sapiens
gcatgttgagccaggcct

SEQ ID NO: 3719274 - DNA, 14 bp, Homo sapiens
gcattacagagagg

SEQ ID NO: 3719275 - DNA, 19 bp, Homo sapiens
gcattacagagaggagaaa

SEQ ID NO: 3719276 - DNA, 17 bp, Homo sapiens
gcattactcttgtaaga

SEQ ID NO: 3719277 - DNA, 19 bp, Homo sapiens
gcattactcttgtaagatt

SEQ ID NO: 3719278 - DNA, 21 bp, Homo sapiens
gcattactcttgtaagatttt

SEQ ID NO: 3719279 - DNA, 24 bp, Homo sapiens
gcattactcttgtaagattttgaa

SEQ ID NO: 3719280 - DNA, 16 bp, Homo sapiens
gcattagaaatagaca

SEQ ID NO: 3719281 - DNA, 14 bp, Homo sapiens
gcattattgcatta

SEQ ID NO: 3719282 - DNA, 13 bp, Homo sapiens
gcattccaggctc

SEQ ID NO: 3719283 - DNA, 12 bp, Homo sapiens
gcattccccact

SEQ ID NO: 3719284 - DNA, 13 bp, Homo sapiens
gcattccctgagt

SEQ ID NO: 3719285 - DNA, 16 bp, Homo sapiens
gcattcctacaaagat

SEQ ID NO: 3719286 - DNA, 13 bp, Homo sapiens
gcattctagtact

SEQ ID NO: 3719287 - DNA, 15 bp, Homo sapiens
gcattctcactccta

SEQ ID NO: 3719288 - DNA, 18 bp, Homo sapiens
gcattctcactcctacct

SEQ ID NO: 3719289 - DNA, 22 bp, Homo sapiens
gcattcttagcctgtggcagta

SEQ ID NO: 3719290 - DNA, 22 bp, Homo sapiens
gcattgagaactgcatatgttt

SEQ ID NO: 3719291 - DNA, 17 bp, Homo sapiens
gcattgatggggaagga

SEQ ID NO: 3719292 - DNA, 12 bp, Homo sapiens
gcattgctttcc

SEQ ID NO: 3719293 - DNA, 20 bp, Homo sapiens
gcattgctttctgaaattag

SEQ ID NO: 3719294 - DNA, 15 bp, Homo sapiens
gcattgttgaggtgg

SEQ ID NO: 3719295 - DNA, 17 bp, Homo sapiens
gcattgtttgcttattg

SEQ ID NO: 3719296 - DNA, 20 bp, Homo sapiens
gcattgtttgcttattgttc

SEQ ID NO: 3719297 - DNA, 21 bp, Homo sapiens
gcattgtttgcttattgttcc

SEQ ID NO: 3719298 - DNA, 17 bp, Homo sapiens
gcatttactttgaattt

SEQ ID NO: 3719299 - DNA, 19 bp, Homo sapiens
gcatttatggtcaacactt

SEQ ID NO: 3719300 - DNA, 13 bp, Homo sapiens
gcatttgctgaat

SEQ ID NO: 3719301 - DNA, 14 bp, Homo sapiens
gcatttgctgaata

SEQ ID NO: 3719302 - DNA, 17 bp, Homo sapiens
gcatttgctgaatacag

SEQ ID NO: 3719303 - DNA, 13 bp, Homo sapiens
gcatttgtcaatg

SEQ ID NO: 3719304 - DNA, 13 bp, Homo sapiens
gcatttgtgatca

SEQ ID NO: 3719305 - DNA, 17 bp, Homo sapiens
gcattttactgtacaga

SEQ ID NO: 3719306 - DNA, 13 bp, Homo sapiens
gcattttctgaaa

SEQ ID NO: 3719307 - DNA, 17 bp, Homo sapiens
gcattttctgaaactaa

SEQ ID NO: 3719308 - DNA, 21 bp, Homo sapiens
gcattttctgaaactaatgaa

SEQ ID NO: 3719309 - DNA, 23 bp, Homo sapiens
gcattttctgaaactaatgaaag

SEQ ID NO: 3719310 - DNA, 22 bp, Homo sapiens
gcattttgctaaatgtgaatga

SEQ ID NO: 3719311 - DNA, 18 bp, Homo sapiens
gcatttttgtgaaatgaa

SEQ ID NO: 3719312 - DNA, 21 bp, Homo sapiens
gcatttttgtgaaatgaaaac

SEQ ID NO: 3719313 - DNA, 22 bp, Homo sapiens
gccaaacccatgaggcaatgtc

SEQ ID NO: 3719314 - DNA, 19 bp, Homo sapiens
gccaaagacttagtatatt

SEQ ID NO: 3719315 - DNA, 20 bp, Homo sapiens
gccaaagccaaagctaggcc

SEQ ID NO: 3719316 - DNA, 22 bp, Homo sapiens
gccaaagctaggcctggccaga

SEQ ID NO: 3719317 - DNA, 16 bp, Homo sapiens
gccaaatatattctct

SEQ ID NO: 3719318 - DNA, 14 bp, Homo sapiens
gccaacccctgtgg

SEQ ID NO: 3719319 - DNA, 23 bp, Homo sapiens
gccaacgacaaagccaaactctg

SEQ ID NO: 3719320 - DNA, 18 bp, Homo sapiens
gccaagatgcttttcaaa

SEQ ID NO: 3719321 - DNA, 17 bp, Homo sapiens
gccaagctccttgggag

SEQ ID NO: 3719322 - DNA, 17 bp, Homo sapiens
gccaaggactgccgacc

SEQ ID NO: 3719323 - DNA, 18 bp, Homo sapiens
gccaaggtgggctgagcc

SEQ ID NO: 3719324 - DNA, 20 bp, Homo sapiens
gccaagtgcaggctggcacc

SEQ ID NO: 3719325 - DNA, 21 bp, Homo sapiens
gccaagttcctctagtgccct

SEQ ID NO: 3719326 - DNA, 15 bp, Homo sapiens
gccaagtttatatac

SEQ ID NO: 3719327 - DNA, 12 bp, Homo sapiens
gccaatgaggtc

SEQ ID NO: 3719328 - DNA, 19 bp, Homo sapiens
gccaatgaggtctgaaatg

SEQ ID NO: 3719329 - DNA, 22 bp, Homo sapiens
gccaatgaggtctgaaatggag

SEQ ID NO: 3719330 - DNA, 19 bp, Homo sapiens
gccaatggagactgtctca

SEQ ID NO: 3719331 - DNA, 19 bp, Homo sapiens
gccaattgaataggatcaa

SEQ ID NO: 3719332 - DNA, 19 bp, Homo sapiens
gccacaccatctcctttca

SEQ ID NO: 3719333 - DNA, 21 bp, Homo sapiens
gccacacgtctgaccctctcc

SEQ ID NO: 3719334 - DNA, 20 bp, Homo sapiens
gccacacttcaggctcttct

SEQ ID NO: 3719335 - DNA, 23 bp, Homo sapiens
gccacacttcaggctcttctcct

SEQ ID NO: 3719336 - DNA, 20 bp, Homo sapiens
gccacagagaaagtacttct

SEQ ID NO: 3719337 - DNA, 16 bp, Homo sapiens
gccacagcagcctctg

SEQ ID NO: 3719338 - DNA, 20 bp, Homo sapiens
gccacagcagcctctgaagt

SEQ ID NO: 3719339 - DNA, 14 bp, Homo sapiens
gccacagccagaac

SEQ ID NO: 3719340 - DNA, 11 bp, Homo sapiens
gccacagctct

SEQ ID NO: 3719341 - DNA, 18 bp, Homo sapiens
gccaccaactggccctct

SEQ ID NO: 3719342 - DNA, 14 bp, Homo sapiens
gccaccatggccag

SEQ ID NO: 3719343 - DNA, 13 bp, Homo sapiens
gccggccctgggg

SEQ ID NO: 3719344 - DNA, 20 bp, Homo sapiens
gccggccctggggctaggct

SEQ ID NO: 3719345 - DNA, 16 bp, Homo sapiens
gccgggtgctcagggc

SEQ ID NO: 3719346 - DNA, 20 bp, Homo sapiens
gccgtcttcactcgcccccg

SEQ ID NO: 3719347 - DNA, 15 bp, Homo sapiens
gccgtgatgcctccc

SEQ ID NO: 3719348 - DNA, 15 bp, Homo sapiens
gccgtgccttcagct

SEQ ID NO: 3719349 - DNA, 17 bp, Homo sapiens
gccgtgccttcagctct

SEQ ID NO: 3719350 - DNA, 19 bp, Homo sapiens
gccgtgccttcagctctac

SEQ ID NO: 3719351 - DNA, 12 bp, Homo sapiens
gccgtggcttcc

SEQ ID NO: 3719352 - DNA, 21 bp, Homo sapiens
gccgtggcttcccgctcagcc

SEQ ID NO: 3719353 - DNA, 23 bp, Homo sapiens
gccgtggtgatttagcaggaagc

SEQ ID NO: 3719354 - DNA, 14 bp, Homo sapiens
gccgttactctcca

SEQ ID NO: 3719355 - DNA, 18 bp, Homo sapiens
gccgttactctccaacct

SEQ ID NO: 3719356 - DNA, 17 bp, Homo sapiens
gcctaaaaatgcaactt

SEQ ID NO: 3719357 - DNA, 14 bp, Homo sapiens
gcctaatccctggg

SEQ ID NO: 3719358 - DNA, 23 bp, Homo sapiens
gcctaatccctgggcattgcttt

SEQ ID NO: 3719359 - DNA, 19 bp, Homo sapiens
gcctactagggacctgggg

SEQ ID NO: 3719360 - DNA, 12 bp, Homo sapiens
gcctactcacga

SEQ ID NO: 3719361 - DNA, 17 bp, Homo sapiens
gcctagatccacacaca

SEQ ID NO: 3719362 - DNA, 18 bp, Homo sapiens
gcctagccgacctcagcc

SEQ ID NO: 3719363 - DNA, 22 bp, Homo sapiens
gcctaggggtcagggaccaagg

SEQ ID NO: 3719364 - DNA, 15 bp, Homo sapiens
gcctagtcagccaca

SEQ ID NO: 3719365 - DNA, 19 bp, Homo sapiens
gcctagtcagccacatggg

SEQ ID NO: 3719366 - DNA, 13 bp, Homo sapiens
gcctatagtccca

SEQ ID NO: 3719367 - DNA, 15 bp, Homo sapiens
gcctatgatcccagc

SEQ ID NO: 3719368 - DNA, 18 bp, Homo sapiens
gcctattgtaaatacaag

SEQ ID NO: 3719369 - DNA, 14 bp, Homo sapiens
gcctcaaccctccc

SEQ ID NO: 3719370 - DNA, 17 bp, Homo sapiens
gcctcaaccctccctca

SEQ ID NO: 3719371 - DNA, 22 bp, Homo sapiens
gcctcaaccctccctcagcccc

SEQ ID NO: 3719372 - DNA, 20 bp, Homo sapiens
gcctcaagtgattctcctgc

SEQ ID NO: 3719373 - DNA, 22 bp, Homo sapiens
gcctcaagtgattctcctgcct

SEQ ID NO: 3719374 - DNA, 23 bp, Homo sapiens
gcctcagaattgatcattttccc

SEQ ID NO: 3719375 - DNA, 18 bp, Homo sapiens
gcctcagcatcctggcac

SEQ ID NO: 3719376 - DNA, 23 bp, Homo sapiens
gcctcagcctcccaaagtgctgg

SEQ ID NO: 3719377 - DNA, 21 bp, Homo sapiens
gcctcagggcagcctgcctgg

SEQ ID NO: 3719378 - DNA, 17 bp, Homo sapiens
gcctcatccgaggcagg

SEQ ID NO: 3719379 - DNA, 22 bp, Homo sapiens
gcctcatccgaggcagggtcag

SEQ ID NO: 3719380 - DNA, 17 bp, Homo sapiens
gcctccaaatgccaact

SEQ ID NO: 3719381 - DNA, 18 bp, Homo sapiens
gcctccaccccccagaac

SEQ ID NO: 3719382 - DNA, 18 bp, Homo sapiens
gcctccaccgctgcctaa

SEQ ID NO: 3719383 - DNA, 21 bp, Homo sapiens
gcctccagccctctcactgtg

SEQ ID NO: 3719384 - DNA, 12 bp, Homo sapiens
gcctccagctca

SEQ ID NO: 3719385 - DNA, 14 bp, Homo sapiens
gcctccatggtgcc

SEQ ID NO: 3719386 - DNA, 17 bp, Homo sapiens
gcctccatggtgcctct

SEQ ID NO: 3719387 - DNA, 18 bp, Homo sapiens
gcctccattcctggagcc

SEQ ID NO: 3719388 - DNA, 21 bp, Homo sapiens
gcctccattcctggagcccga

SEQ ID NO: 3719389 - DNA, 17 bp, Homo sapiens
gcctccattctgaccat

SEQ ID NO: 3719390 - DNA, 18 bp, Homo sapiens
gcctcccaaagtgctggg

SEQ ID NO: 3719391 - DNA, 12 bp, Homo sapiens
gcctcccacccc

SEQ ID NO: 3719392 - DNA, 10 bp, Homo sapiens
gcctcccagc

SEQ ID NO: 3719393 - DNA, 14 bp, Homo sapiens
gcctcccagcctgg

SEQ ID NO: 3719394 - DNA, 12 bp, Homo sapiens
gcctccccacct

SEQ ID NO: 3719395 - DNA, 20 bp, Homo sapiens
gcctcccgaatagctgggac

SEQ ID NO: 3719396 - DNA, 21 bp, Homo sapiens
gcctcccgagtagctgggact

SEQ ID NO: 3719397 - DNA, 23 bp, Homo sapiens
gcctcccgagtagctgggactac

SEQ ID NO: 3719398 - DNA, 18 bp, Homo sapiens
gcctccctcccctgccct

SEQ ID NO: 3719399 - DNA, 21 bp, Homo sapiens
gcctccctctctcttctgctc

SEQ ID NO: 3719400 - DNA, 20 bp, Homo sapiens
gcctccctctgacctgcagg

SEQ ID NO: 3719401 - DNA, 11 bp, Homo sapiens
gcctccctgaa

SEQ ID NO: 3719402 - DNA, 20 bp, Homo sapiens
gcctcctctaacaggggctg

SEQ ID NO: 3719403 - DNA, 22 bp, Homo sapiens
gcctcctctaacaggggctggt

SEQ ID NO: 3719404 - DNA, 23 bp, Homo sapiens
gcctcctctctcagtttttatat

SEQ ID NO: 3719405 - DNA, 13 bp, Homo sapiens
gcctcctgtgtaa

SEQ ID NO: 3719406 - DNA, 18 bp, Homo sapiens
gcctcctgtgtagctggg

SEQ ID NO: 3719407 - DNA, 20 bp, Homo sapiens
gcctccttccttgctgtcct

SEQ ID NO: 3719408 - DNA, 19 bp, Homo sapiens
gcctcgaactcctgggctc

SEQ ID NO: 3719409 - DNA, 17 bp, Homo sapiens
gcctcgaactggctgca

SEQ ID NO: 3719410 - DNA, 20 bp, Homo sapiens
gcctcgaactggctgcaaag

SEQ ID NO: 3719411 - DNA, 14 bp, Homo sapiens
gcctcggagcctca

SEQ ID NO: 3719412 - DNA, 15 bp, Homo sapiens
gcctcggagcctcat

SEQ ID NO: 3719413 - DNA, 17 bp, Homo sapiens
gcctcggagcctcatcc

SEQ ID NO: 3719414 - DNA, 23 bp, Homo sapiens
gcctcggagcctcatccgaggca

SEQ ID NO: 3719415 - DNA, 17 bp, Homo sapiens
gcctctcttcctatccc

SEQ ID NO: 3719416 - DNA, 22 bp, Homo sapiens
gcctctcttcctatcccatccc

SEQ ID NO: 3719417 - DNA, 15 bp, Homo sapiens
gcctctgcattcagg

SEQ ID NO: 3719418 - DNA, 13 bp, Homo sapiens
gcctctgcctctg

SEQ ID NO: 3719419 - DNA, 12 bp, Homo sapiens
gcctctgcctgt

SEQ ID NO: 3719420 - DNA, 13 bp, Homo sapiens
gcctctgcctgtc

SEQ ID NO: 3719421 - DNA, 16 bp, Homo sapiens
gcctctgcctgtgcac

SEQ ID NO: 3719422 - DNA, 20 bp, Homo sapiens
gcctctggaggcctctgggc

SEQ ID NO: 3719423 - DNA, 21 bp, Homo sapiens
gcctctggaggcctctgggcc

SEQ ID NO: 3719424 - DNA, 21 bp, Homo sapiens
gcctctggctagaggccagcc

SEQ ID NO: 3719425 - DNA, 12 bp, Homo sapiens
gcctctgggact

SEQ ID NO: 3719426 - DNA, 13 bp, Homo sapiens
gcctctgggcctc

SEQ ID NO: 3719427 - DNA, 19 bp, Homo sapiens
gcctcttaaagctgcctgt

SEQ ID NO: 3719428 - DNA, 23 bp, Homo sapiens
gcctcttaaagctgcctgtagtt

SEQ ID NO: 3719429 - DNA, 19 bp, Homo sapiens
gcctcttaaataaaccttt

SEQ ID NO: 3719430 - DNA, 20 bp, Homo sapiens
gcctcttcttcttcagaaga

SEQ ID NO: 3719431 - DNA, 20 bp, Homo sapiens
gcctcttgcggtcccttctt

SEQ ID NO: 3719432 - DNA, 15 bp, Homo sapiens
gcctgaagtcacaca

SEQ ID NO: 3719433 - DNA, 16 bp, Homo sapiens
gcctgaagtcacacag

SEQ ID NO: 3719434 - DNA, 17 bp, Homo sapiens
gcctgaagtcacacagt

SEQ ID NO: 3719435 - DNA, 18 bp, Homo sapiens
gcctgaagtcacacagtg

SEQ ID NO: 3719436 - DNA, 20 bp, Homo sapiens
gcctgacctccccctccttc

SEQ ID NO: 3719437 - DNA, 13 bp, Homo sapiens
gcctgagagtatt

SEQ ID NO: 3719438 - DNA, 21 bp, Homo sapiens
gcctgagagtatttaggcaga

SEQ ID NO: 3719439 - DNA, 17 bp, Homo sapiens
gcctgagcacctcccag

SEQ ID NO: 3719440 - DNA, 19 bp, Homo sapiens
gcctgagcacctcccagcc

SEQ ID NO: 3719441 - DNA, 13 bp, Homo sapiens
gcctgaggctgag

SEQ ID NO: 3719442 - DNA, 23 bp, Homo sapiens
gcctgagggcgaggggagggtgg

SEQ ID NO: 3719443 - DNA, 13 bp, Homo sapiens
gcctgcaccagga

SEQ ID NO: 3719444 - DNA, 15 bp, Homo sapiens
gcctgcaccaggaga

SEQ ID NO: 3719445 - DNA, 16 bp, Homo sapiens
gcctgcaccaggagac

SEQ ID NO: 3719446 - DNA, 21 bp, Homo sapiens
gcctgcaccaggagacagaca

SEQ ID NO: 3719447 - DNA, 10 bp, Homo sapiens
gcctgcagcc

SEQ ID NO: 3719448 - DNA, 11 bp, Homo sapiens
gcctgcccagg

SEQ ID NO: 3719449 - DNA, 16 bp, Homo sapiens
gcctgcccctcccaga

SEQ ID NO: 3719450 - DNA, 21 bp, Homo sapiens
gcctgcctagcactcacatgc

SEQ ID NO: 3719451 - DNA, 17 bp, Homo sapiens
gcctgcggcctgctgga

SEQ ID NO: 3719452 - DNA, 19 bp, Homo sapiens
gcctgcggtcaaggccagc

SEQ ID NO: 3719453 - DNA, 16 bp, Homo sapiens
gcctgcgtggctgacc

SEQ ID NO: 3719454 - DNA, 17 bp, Homo sapiens
gcctgcgtggctgaccc

SEQ ID NO: 3719455 - DNA, 22 bp, Homo sapiens
gcctgcgtggctgacccccctc

SEQ ID NO: 3719456 - DNA, 15 bp, Homo sapiens
gctctgcccagagct

SEQ ID NO: 3719457 - DNA, 18 bp, Homo sapiens
gctctgccccagctctgg

SEQ ID NO: 3719458 - DNA, 13 bp, Homo sapiens
gctctgccctgcc

SEQ ID NO: 3719459 - DNA, 13 bp, Homo sapiens
gctctgcctgtgg

SEQ ID NO: 3719460 - DNA, 13 bp, Homo sapiens
gctctgctcctct

SEQ ID NO: 3719461 - DNA, 18 bp, Homo sapiens
gctctgctgacagacaca

SEQ ID NO: 3719462 - DNA, 22 bp, Homo sapiens
gctctggctcacagactggaga

SEQ ID NO: 3719463 - DNA, 21 bp, Homo sapiens
gctctgggatagctgacccag

SEQ ID NO: 3719464 - DNA, 19 bp, Homo sapiens
gctctggtgacaccagcct

SEQ ID NO: 3719465 - DNA, 20 bp, Homo sapiens
gctctggtgacaccagcctt

SEQ ID NO: 3719466 - DNA, 15 bp, Homo sapiens
gctctgtcctgggag

SEQ ID NO: 3719467 - DNA, 14 bp, Homo sapiens
gctctgtgcaggga

SEQ ID NO: 3719468 - DNA, 15 bp, Homo sapiens
gctcttgcagagaag

SEQ ID NO: 3719469 - DNA, 17 bp, Homo sapiens
gctgaaacaggagagaa

SEQ ID NO: 3719470 - DNA, 18 bp, Homo sapiens
gctgaagaattatttttt

SEQ ID NO: 3719471 - DNA, 15 bp, Homo sapiens
gctgaagagtgagga

SEQ ID NO: 3719472 - DNA, 22 bp, Homo sapiens
gctgaagcttattaatgctaag

SEQ ID NO: 3719473 - DNA, 17 bp, Homo sapiens
gctgaatggttttcaaa

SEQ ID NO: 3719474 - DNA, 17 bp, Homo sapiens
gctgacagacacaggcc

SEQ ID NO: 3719475 - DNA, 13 bp, Homo sapiens
gctgaccaagaga

SEQ ID NO: 3719476 - DNA, 20 bp, Homo sapiens
gctgaccaagagagaaagaa

SEQ ID NO: 3719477 - DNA, 19 bp, Homo sapiens
gctgacccagtccctgggg

SEQ ID NO: 3719478 - DNA, 16 bp, Homo sapiens
gctgacctccacagct

SEQ ID NO: 3719479 - DNA, 20 bp, Homo sapiens
gctgaccttgaactcctggg

SEQ ID NO: 3719480 - DNA, 14 bp, Homo sapiens
gctgacgaggctgg

SEQ ID NO: 3719481 - DNA, 18 bp, Homo sapiens
gctgacgaggctgggcca

SEQ ID NO: 3719482 - DNA, 23 bp, Homo sapiens
gctgactagaagggccagtcctg

SEQ ID NO: 3719483 - DNA, 18 bp, Homo sapiens
gctgactgatgttgaggg

SEQ ID NO: 3719484 - DNA, 20 bp, Homo sapiens
gctgactgtggccccctccg

SEQ ID NO: 3719485 - DNA, 15 bp, Homo sapiens
gctgagaatagaagg

SEQ ID NO: 3719486 - DNA, 16 bp, Homo sapiens
gctgagaatagaagga

SEQ ID NO: 3719487 - DNA, 17 bp, Homo sapiens
gctgagaatagaaggaa

SEQ ID NO: 3719488 - DNA, 14 bp, Homo sapiens
gctgagactgcggg

SEQ ID NO: 3719489 - DNA, 20 bp, Homo sapiens
gctgagactggatactgccc

SEQ ID NO: 3719490 - DNA, 22 bp, Homo sapiens
gctgagagacccaaggaggaaa

SEQ ID NO: 3719491 - DNA, 12 bp, Homo sapiens
gctgagccctgg

SEQ ID NO: 3719492 - DNA, 12 bp, Homo sapiens
gctgaggaaagg

SEQ ID NO: 3719493 - DNA, 19 bp, Homo sapiens
gctgaggatttcaagcctg

SEQ ID NO: 3719494 - DNA, 15 bp, Homo sapiens
gctgaggcaggagga

SEQ ID NO: 3719495 - DNA, 16 bp, Homo sapiens
gctgagggaccagcca

SEQ ID NO: 3719496 - DNA, 22 bp, Homo sapiens
gctgaggggaggatcactggag

SEQ ID NO: 3719497 - DNA, 11 bp, Homo sapiens
gctgaggggca

SEQ ID NO: 3719498 - DNA, 23 bp, Homo sapiens
gctgaggggcaacgaagaaaaaa

SEQ ID NO: 3719499 - DNA, 14 bp, Homo sapiens
gctgaggtgggagg

SEQ ID NO: 3719500 - DNA, 23 bp, Homo sapiens
gctgagtgggggatcacagcctc

SEQ ID NO: 3719501 - DNA, 20 bp, Homo sapiens
gctgatatatgtgtttttca

SEQ ID NO: 3719502 - DNA, 16 bp, Homo sapiens
gctgatcgtgctaaat

SEQ ID NO: 3719503 - DNA, 22 bp, Homo sapiens
gctgatctcagggaagcccagc

SEQ ID NO: 3719504 - DNA, 21 bp, Homo sapiens
gctgattactgtcaataaaca

SEQ ID NO: 3719505 - DNA, 19 bp, Homo sapiens
gctgcaccctcaggcaggt

SEQ ID NO: 3719506 - DNA, 19 bp, Homo sapiens
gctgcacctgccagcctgg

SEQ ID NO: 3719507 - DNA, 16 bp, Homo sapiens
gctgcatccgtgagca

SEQ ID NO: 3719508 - DNA, 15 bp, Homo sapiens
gctgccaaattttgg

SEQ ID NO: 3719509 - DNA, 15 bp, Homo sapiens
gctgccaagccccat

SEQ ID NO: 3719510 - DNA, 17 bp, Homo sapiens
gctgccaaggccagagt

SEQ ID NO: 3719511 - DNA, 17 bp, Homo sapiens
gctgccacacttcaggc

SEQ ID NO: 3719512 - DNA, 23 bp, Homo sapiens
gctgccacacttcaggctcttct

SEQ ID NO: 3719513 - DNA, 12 bp, Homo sapiens
gctgccagagaa

SEQ ID NO: 3719514 - DNA, 14 bp, Homo sapiens
gctgccagcacaga

SEQ ID NO: 3719515 - DNA, 21 bp, Homo sapiens
gctgccatccaggttcagctt

SEQ ID NO: 3719516 - DNA, 17 bp, Homo sapiens
gctgcccacacacccca

SEQ ID NO: 3719517 - DNA, 14 bp, Homo sapiens
gctgccccagctga

SEQ ID NO: 3719518 - DNA, 21 bp, Homo sapiens
gctgccccagctgactgtggc

SEQ ID NO: 3719519 - DNA, 20 bp, Homo sapiens
gctgccccatgaagccacag

SEQ ID NO: 3719520 - DNA, 21 bp, Homo sapiens
gctgccccatgaagccacagc

SEQ ID NO: 3719521 - DNA, 21 bp, Homo sapiens
gctgcccccgctcatgggccc

SEQ ID NO: 3719522 - DNA, 19 bp, Homo sapiens
gctgcccgtcttcagccta

SEQ ID NO: 3719523 - DNA, 19 bp, Homo sapiens
gctgccctccatcccgaca

SEQ ID NO: 3719524 - DNA, 12 bp, Homo sapiens
gctgccctggtg

SEQ ID NO: 3719525 - DNA, 13 bp, Homo sapiens
gctgccctggtgc

SEQ ID NO: 3719526 - DNA, 19 bp, Homo sapiens
gctgccctggtgctgccac

SEQ ID NO: 3719527 - DNA, 17 bp, Homo sapiens
gctgcctaagtggctgc

SEQ ID NO: 3719528 - DNA, 12 bp, Homo sapiens
gctgcctcactt

SEQ ID NO: 3719529 - DNA, 13 bp, Homo sapiens
gctgcctccccaa

SEQ ID NO: 3719530 - DNA, 12 bp, Homo sapiens
gctgcctccctg

SEQ ID NO: 3719531 - DNA, 15 bp, Homo sapiens
gctgcctgagcacct

SEQ ID NO: 3719532 - DNA, 16 bp, Homo sapiens
gctgcctgtagttagg

SEQ ID NO: 3719533 - DNA, 19 bp, Homo sapiens
gctgcctgtagttaggaaa

SEQ ID NO: 3719534 - DNA, 20 bp, Homo sapiens
gctgcctgtagttaggaaat

SEQ ID NO: 3719535 - DNA, 12 bp, Homo sapiens
gctgcctgttca

SEQ ID NO: 3719536 - DNA, 17 bp, Homo sapiens
gctgcctgttcagctcc

SEQ ID NO: 3719537 - DNA, 22 bp, Homo sapiens
gctgcctgttcagctccagctc

SEQ ID NO: 3719538 - DNA, 15 bp, Homo sapiens
gctgccttagaacct

SEQ ID NO: 3719539 - DNA, 20 bp, Homo sapiens
gctgctaatcttcagggcac

SEQ ID NO: 3719540 - DNA, 11 bp, Homo sapiens
gctgctcctcc

SEQ ID NO: 3719541 - DNA, 14 bp, Homo sapiens
gctgctcctccagg

SEQ ID NO: 3719542 - DNA, 13 bp, Homo sapiens
gctgctctgccca

SEQ ID NO: 3719543 - DNA, 18 bp, Homo sapiens
gctgctctgcccagagct

SEQ ID NO: 3719544 - DNA, 19 bp, Homo sapiens
gctgctctgcccagagctg

SEQ ID NO: 3719545 - DNA, 20 bp, Homo sapiens
gctgctctgcccagagctgg

SEQ ID NO: 3719546 - DNA, 12 bp, Homo sapiens
gctgctggagga

SEQ ID NO: 3719547 - DNA, 12 bp, Homo sapiens
gctgcttccctc

SEQ ID NO: 3719548 - DNA, 14 bp, Homo sapiens
gctgcttccctctg

SEQ ID NO: 3719549 - DNA, 21 bp, Homo sapiens
gctgcttccctctgcctgtcc

SEQ ID NO: 3719550 - DNA, 21 bp, Homo sapiens
gctgcttcttaaccccagtaa

SEQ ID NO: 3719551 - DNA, 18 bp, Homo sapiens
gctggaccttgaactggg

SEQ ID NO: 3719552 - DNA, 22 bp, Homo sapiens
gctggactccagatctgcaccg

SEQ ID NO: 3719553 - DNA, 13 bp, Homo sapiens
gctggactggctg

SEQ ID NO: 3719554 - DNA, 12 bp, Homo sapiens
gctggagctggc

SEQ ID NO: 3719555 - DNA, 22 bp, Homo sapiens
gctggagctggcgtctgtcttc

SEQ ID NO: 3719556 - DNA, 14 bp, Homo sapiens
gctggagtgcagtg

SEQ ID NO: 3719557 - DNA, 20 bp, Homo sapiens
gctggagtgcggtggtgtga

SEQ ID NO: 3719558 - DNA, 14 bp, Homo sapiens
gctggataaaatga

SEQ ID NO: 3719559 - DNA, 19 bp, Homo sapiens
gctggatctcccagggcta

SEQ ID NO: 3719560 - DNA, 20 bp, Homo sapiens
gctggatctcccagggctac

SEQ ID NO: 3719561 - DNA, 19 bp, Homo sapiens
gctggcaaagacagaagcc

SEQ ID NO: 3719562 - DNA, 18 bp, Homo sapiens
gctggcaccgccttctct

SEQ ID NO: 3719563 - DNA, 13 bp, Homo sapiens
gctggcagcagag

SEQ ID NO: 3719564 - DNA, 19 bp, Homo sapiens
gctggcccccactggctgt

SEQ ID NO: 3719565 - DNA, 12 bp, Homo sapiens
gctggcccctca

SEQ ID NO: 3719566 - DNA, 19 bp, Homo sapiens
gctggcccctcacctgggc

SEQ ID NO: 3719567 - DNA, 20 bp, Homo sapiens
gctggcccctcacctgggca

SEQ ID NO: 3719568 - DNA, 15 bp, Homo sapiens
gctggccgagggtcc

SEQ ID NO: 3719569 - DNA, 12 bp, Homo sapiens
gcttgagcccag

SEQ ID NO: 3719570 - DNA, 23 bp, Homo sapiens
gcttgcaagtatgttttagcatg

SEQ ID NO: 3719571 - DNA, 23 bp, Homo sapiens
gcttgcataataagctaaagagg

SEQ ID NO: 3719572 - DNA, 16 bp, Homo sapiens
gcttgccgaaactgga

SEQ ID NO: 3719573 - DNA, 18 bp, Homo sapiens
gcttgccgaaactggaag

SEQ ID NO: 3719574 - DNA, 22 bp, Homo sapiens
gcttgcctagggcctggtccat

SEQ ID NO: 3719575 - DNA, 13 bp, Homo sapiens
gcttgcctgcagg

SEQ ID NO: 3719576 - DNA, 14 bp, Homo sapiens
gcttgcctgcaggc

SEQ ID NO: 3719577 - DNA, 22 bp, Homo sapiens
gcttgctagctatgtgaccttg

SEQ ID NO: 3719578 - DNA, 13 bp, Homo sapiens
gcttggcagctga

SEQ ID NO: 3719579 - DNA, 13 bp, Homo sapiens
gcttggccagaag

SEQ ID NO: 3719580 - DNA, 23 bp, Homo sapiens
gcttgggtgtaacaggtctcctc

SEQ ID NO: 3719581 - DNA, 17 bp, Homo sapiens
gcttgtaaatagctcag

SEQ ID NO: 3719582 - DNA, 15 bp, Homo sapiens
gcttgtaacaagaaa

SEQ ID NO: 3719583 - DNA, 15 bp, Homo sapiens
gcttgtcagagctgg

SEQ ID NO: 3719584 - DNA, 18 bp, Homo sapiens
gcttgtcagagctgggag

SEQ ID NO: 3719585 - DNA, 18 bp, Homo sapiens
gcttgtcattaccagacg

SEQ ID NO: 3719586 - DNA, 15 bp, Homo sapiens
gcttgtccagcgcct

SEQ ID NO: 3719587 - DNA, 19 bp, Homo sapiens
gcttgtcccctcctcactc

SEQ ID NO: 3719588 - DNA, 17 bp, Homo sapiens
gcttgtgatctgggaac

SEQ ID NO: 3719589 - DNA, 15 bp, Homo sapiens
gctttacaaaaagac

SEQ ID NO: 3719590 - DNA, 18 bp, Homo sapiens
gctttacttagcttatca

SEQ ID NO: 3719591 - DNA, 13 bp, Homo sapiens
gctttatttttta

SEQ ID NO: 3719592 - DNA, 22 bp, Homo sapiens
gctttcccccacttttctctct

SEQ ID NO: 3719593 - DNA, 23 bp, Homo sapiens
gctttcctggagagtctcactcc

SEQ ID NO: 3719594 - DNA, 19 bp, Homo sapiens
gctttctacccagcgagcc

SEQ ID NO: 3719595 - DNA, 13 bp, Homo sapiens
gctttctggagag

SEQ ID NO: 3719596 - DNA, 13 bp, Homo sapiens
gctttcttgctgg

SEQ ID NO: 3719597 - DNA, 15 bp, Homo sapiens
gctttgactgagcag

SEQ ID NO: 3719598 - DNA, 20 bp, Homo sapiens
gctttgattccatctccttg

SEQ ID NO: 3719599 - DNA, 21 bp, Homo sapiens
gctttgcttatggtaataaaa

SEQ ID NO: 3719600 - DNA, 14 bp, Homo sapiens
gctttggaagccat

SEQ ID NO: 3719601 - DNA, 15 bp, Homo sapiens
gctttgggctgccct

SEQ ID NO: 3719602 - DNA, 22 bp, Homo sapiens
gcttttagtacccacctgagct

SEQ ID NO: 3719603 - DNA, 19 bp, Homo sapiens
gcttttccctaagccaagg

SEQ ID NO: 3719604 - DNA, 14 bp, Homo sapiens
gcttttccttgggg

SEQ ID NO: 3719605 - DNA, 20 bp, Homo sapiens
gcttttccttggggcaggca

SEQ ID NO: 3719606 - DNA, 15 bp, Homo sapiens
gcttttgctggtcac

SEQ ID NO: 3719607 - DNA, 15 bp, Homo sapiens
gctttttaatattga

SEQ ID NO: 3719608 - DNA, 14 bp, Homo sapiens
ggaaaaaaactttt

SEQ ID NO: 3719609 - DNA, 14 bp, Homo sapiens
ggaaaaaaatgact

SEQ ID NO: 3719610 - DNA, 23 bp, Homo sapiens
ggaaaaaggacaggcagaaagag

SEQ ID NO: 3719611 - DNA, 21 bp, Homo sapiens
ggaaaaagtatcatggaaata

SEQ ID NO: 3719612 - DNA, 13 bp, Homo sapiens
ggaaaaatagcct

SEQ ID NO: 3719613 - DNA, 23 bp, Homo sapiens
ggaaaaatggatccccagtgaaa

SEQ ID NO: 3719614 - DNA, 21 bp, Homo sapiens
ggaaaaccaagccgtggcttc

SEQ ID NO: 3719615 - DNA, 22 bp, Homo sapiens
ggaaaagagcgcatcaggcctg

SEQ ID NO: 3719616 - DNA, 19 bp, Homo sapiens
ggaaaatcagcctgctcca

SEQ ID NO: 3719617 - DNA, 15 bp, Homo sapiens
ggaaacaggaccaca

SEQ ID NO: 3719618 - DNA, 14 bp, Homo sapiens
ggaaacagtcattt

SEQ ID NO: 3719619 - DNA, 14 bp, Homo sapiens
ggaaactaaaactt

SEQ ID NO: 3719620 - DNA, 17 bp, Homo sapiens
ggaaactgttgccagag

SEQ ID NO: 3719621 - DNA, 16 bp, Homo sapiens
ggaaagaaagaaggaa

SEQ ID NO: 3719622 - DNA, 22 bp, Homo sapiens
ggaaagcagctcaaaggcacag

SEQ ID NO: 3719623 - DNA, 16 bp, Homo sapiens
ggaaaggatattttct

SEQ ID NO: 3719624 - DNA, 18 bp, Homo sapiens
ggaaaggccagctggcag

SEQ ID NO: 3719625 - DNA, 20 bp, Homo sapiens
ggaaaggctctgaaagccag

SEQ ID NO: 3719626 - DNA, 14 bp, Homo sapiens
ggaaagtgaatttg

SEQ ID NO: 3719627 - DNA, 22 bp, Homo sapiens
ggaaataaaaaagtctctattt

SEQ ID NO: 3719628 - DNA, 22 bp, Homo sapiens
ggaaataaaacctttcaaattt

SEQ ID NO: 3719629 - DNA, 16 bp, Homo sapiens
ggaaatatcagttact

SEQ ID NO: 3719630 - DNA, 14 bp, Homo sapiens
ggaaatattatgca

SEQ ID NO: 3719631 - DNA, 17 bp, Homo sapiens
ggaaatgcctaagaaga

SEQ ID NO: 3719632 - DNA, 17 bp, Homo sapiens
ggaaattggaagagcac

SEQ ID NO: 3719633 - DNA, 17 bp, Homo sapiens
ggaacagacaggagaaa

SEQ ID NO: 3719634 - DNA, 19 bp, Homo sapiens
ggaacagcgggagacctgt

SEQ ID NO: 3719635 - DNA, 23 bp, Homo sapiens
ggaacagtgtttcccataatttt

SEQ ID NO: 3719636 - DNA, 19 bp, Homo sapiens
ggaaccagagccatggact

SEQ ID NO: 3719637 - DNA, 15 bp, Homo sapiens
ggaaccgcaggaagc

SEQ ID NO: 3719638 - DNA, 18 bp, Homo sapiens
ggaacctggaccaaagct

SEQ ID NO: 3719639 - DNA, 21 bp, Homo sapiens
ggaactagagggatacactga

SEQ ID NO: 3719640 - DNA, 15 bp, Homo sapiens
ggaactcccaagaac

SEQ ID NO: 3719641 - DNA, 21 bp, Homo sapiens
ggaacttgagcgtgaatctgt

SEQ ID NO: 3719642 - DNA, 14 bp, Homo sapiens
ggaagacaatgtga

SEQ ID NO: 3719643 - DNA, 22 bp, Homo sapiens
ggaagacaatgtgaaaagaaaa

SEQ ID NO: 3719644 - DNA, 13 bp, Homo sapiens
ggaagagaaacag

SEQ ID NO: 3719645 - DNA, 14 bp, Homo sapiens
ggaagagcaggcac

SEQ ID NO: 3719646 - DNA, 18 bp, Homo sapiens
ggaagattttaaattcac

SEQ ID NO: 3719647 - DNA, 16 bp, Homo sapiens
ggaagcacagaaaact

SEQ ID NO: 3719648 - DNA, 19 bp, Homo sapiens
ggaagcacagaaaactaga

SEQ ID NO: 3719649 - DNA, 21 bp, Homo sapiens
ggaagcagtgccttccataat

SEQ ID NO: 3719650 - DNA, 20 bp, Homo sapiens
ggaagcatattgttattata

SEQ ID NO: 3719651 - DNA, 20 bp, Homo sapiens
ggaagcatgtaggagaatcc

SEQ ID NO: 3719652 - DNA, 16 bp, Homo sapiens
ggaagccctccttcca

SEQ ID NO: 3719653 - DNA, 17 bp, Homo sapiens
ggaagccctccttccac

SEQ ID NO: 3719654 - DNA, 11 bp, Homo sapiens
ggaagccctgg

SEQ ID NO: 3719655 - DNA, 15 bp, Homo sapiens
ggaagccctggattt

SEQ ID NO: 3719656 - DNA, 20 bp, Homo sapiens
ggaagcggaggttgcaggga

SEQ ID NO: 3719657 - DNA, 22 bp, Homo sapiens
ggaagcgtgaaggccgagaagc

SEQ ID NO: 3719658 - DNA, 13 bp, Homo sapiens
ggaagctgctccg

SEQ ID NO: 3719659 - DNA, 18 bp, Homo sapiens
ggaagctggccgagggtc

SEQ ID NO: 3719660 - DNA, 17 bp, Homo sapiens
ggaagctgtgtccttgc

SEQ ID NO: 3719661 - DNA, 21 bp, Homo sapiens
ggaagctgtgtccttgcacct

SEQ ID NO: 3719662 - DNA, 19 bp, Homo sapiens
ggaagcttcttaaatgaga

SEQ ID NO: 3719663 - DNA, 19 bp, Homo sapiens
ggaaggacctatgtttgct

SEQ ID NO: 3719664 - DNA, 21 bp, Homo sapiens
ggaaggagactcacctctgcc

SEQ ID NO: 3719665 - DNA, 22 bp, Homo sapiens
ggaaggagactcacctctgcct

SEQ ID NO: 3719666 - DNA, 16 bp, Homo sapiens
ggaaggagagcctgct

SEQ ID NO: 3719667 - DNA, 13 bp, Homo sapiens
ggaaggagggagg

SEQ ID NO: 3719668 - DNA, 20 bp, Homo sapiens
ggaaggagggttagggaggg

SEQ ID NO: 3719669 - DNA, 14 bp, Homo sapiens
ggaaggccacctgc

SEQ ID NO: 3719670 - DNA, 17 bp, Homo sapiens
ggaaggccacctgcagg

SEQ ID NO: 3719671 - DNA, 12 bp, Homo sapiens
ggaagggcagga

SEQ ID NO: 3719672 - DNA, 21 bp, Homo sapiens
ggaagggcaggaaggagagcc

SEQ ID NO: 3719673 - DNA, 18 bp, Homo sapiens
ggaaggggcccgtgggag

SEQ ID NO: 3719674 - DNA, 21 bp, Homo sapiens
ggaaggggcccgtgggagtca

SEQ ID NO: 3719675 - DNA, 17 bp, Homo sapiens
ggaagtctaggagctgg

SEQ ID NO: 3719676 - DNA, 21 bp, Homo sapiens
ggaagtgagggtcagagagga

SEQ ID NO: 3719677 - DNA, 13 bp, Homo sapiens
ggaatattttatt

SEQ ID NO: 3719678 - DNA, 16 bp, Homo sapiens
ggaatcaacagggcag

SEQ ID NO: 3719679 - DNA, 23 bp, Homo sapiens
ggaatcagacttcacactgcaag

SEQ ID NO: 3719680 - DNA, 12 bp, Homo sapiens
ggaatgcagtgg

SEQ ID NO: 3719681 - DNA, 23 bp, Homo sapiens
ggaatgctcccccatcctcccct

SEQ ID NO: 3719682 - DNA, 22 bp, Homo sapiens
ggccatcggtcctgtctcccct

SEQ ID NO: 3719683 - DNA, 21 bp, Homo sapiens
ggccatctctgaacttcagct

SEQ ID NO: 3719684 - DNA, 15 bp, Homo sapiens
ggccatgaactttgt

SEQ ID NO: 3719685 - DNA, 21 bp, Homo sapiens
ggccatgattcgcccaaagcc

SEQ ID NO: 3719686 - DNA, 13 bp, Homo sapiens
ggccatggcagaa

SEQ ID NO: 3719687 - DNA, 15 bp, Homo sapiens
ggccatgtgagccac

SEQ ID NO: 3719688 - DNA, 21 bp, Homo sapiens
ggcccaaattatcaagctaat

SEQ ID NO: 3719689 - DNA, 19 bp, Homo sapiens
ggcccaagagatgaagagt

SEQ ID NO: 3719690 - DNA, 19 bp, Homo sapiens
ggcccacagctcccacccc

SEQ ID NO: 3719691 - DNA, 22 bp, Homo sapiens
ggcccacctaccttcaaagctg

SEQ ID NO: 3719692 - DNA, 16 bp, Homo sapiens
ggcccagaggcacagc

SEQ ID NO: 3719693 - DNA, 16 bp, Homo sapiens
ggccccaaaaccacag

SEQ ID NO: 3719694 - DNA, 12 bp, Homo sapiens
ggccccagagac

SEQ ID NO: 3719695 - DNA, 13 bp, Homo sapiens
ggccccagagact

SEQ ID NO: 3719696 - DNA, 21 bp, Homo sapiens
ggccccagcactaaagcagtg

SEQ ID NO: 3719697 - DNA, 16 bp, Homo sapiens
ggcccccactggctgt

SEQ ID NO: 3719698 - DNA, 15 bp, Homo sapiens
ggcccccgagctggg

SEQ ID NO: 3719699 - DNA, 13 bp, Homo sapiens
ggccccctgcatc

SEQ ID NO: 3719700 - DNA, 19 bp, Homo sapiens
ggccccgcttgtccagcgc

SEQ ID NO: 3719701 - DNA, 21 bp, Homo sapiens
ggccccgcttgtccagcgcct

SEQ ID NO: 3719702 - DNA, 12 bp, Homo sapiens
ggcccctgccac

SEQ ID NO: 3719703 - DNA, 16 bp, Homo sapiens
ggcccctgccaccctg

SEQ ID NO: 3719704 - DNA, 16 bp, Homo sapiens
ggcccctgcccggctg

SEQ ID NO: 3719705 - DNA, 14 bp, Homo sapiens
ggcccctgctggtt

SEQ ID NO: 3719706 - DNA, 23 bp, Homo sapiens
ggcccctgctggttcagggttgg

SEQ ID NO: 3719707 - DNA, 20 bp, Homo sapiens
ggccccttcacttctgacca

SEQ ID NO: 3719708 - DNA, 22 bp, Homo sapiens
ggccccttcacttctgaccaca

SEQ ID NO: 3719709 - DNA, 15 bp, Homo sapiens
ggcccgacagcctgg

SEQ ID NO: 3719710 - DNA, 15 bp, Homo sapiens
ggcccgcctggcaga

SEQ ID NO: 3719711 - DNA, 19 bp, Homo sapiens
ggcccgcctggcagaactg

SEQ ID NO: 3719712 - DNA, 23 bp, Homo sapiens
ggcccggcgcggtggctcacgcc

SEQ ID NO: 3719713 - DNA, 13 bp, Homo sapiens
ggcccggggctgg

SEQ ID NO: 3719714 - DNA, 20 bp, Homo sapiens
ggccctcacccctgccctgg

SEQ ID NO: 3719715 - DNA, 21 bp, Homo sapiens
ggccctcacccctgccctggg

SEQ ID NO: 3719716 - DNA, 19 bp, Homo sapiens
ggccctgagctcggtggac

SEQ ID NO: 3719717 - DNA, 11 bp, Homo sapiens
ggccctggggc

SEQ ID NO: 3719718 - DNA, 14 bp, Homo sapiens
ggccctggggcctg

SEQ ID NO: 3719719 - DNA, 15 bp, Homo sapiens
ggccctggtccttcc

SEQ ID NO: 3719720 - DNA, 13 bp, Homo sapiens
ggcccttcctctc

SEQ ID NO: 3719721 - DNA, 15 bp, Homo sapiens
ggcccttcctctcca

SEQ ID NO: 3719722 - DNA, 18 bp, Homo sapiens
ggcccttcctctccactg

SEQ ID NO: 3719723 - DNA, 21 bp, Homo sapiens
ggcccttgcagttcagcacca

SEQ ID NO: 3719724 - DNA, 18 bp, Homo sapiens
ggccgagggtcctggctc

SEQ ID NO: 3719725 - DNA, 14 bp, Homo sapiens
ggccgggcacagct

SEQ ID NO: 3719726 - DNA, 15 bp, Homo sapiens
ggccgggcacagctg

SEQ ID NO: 3719727 - DNA, 16 bp, Homo sapiens
ggcctcaaccctccct

SEQ ID NO: 3719728 - DNA, 19 bp, Homo sapiens
ggcctcaaccctccctcag

SEQ ID NO: 3719729 - DNA, 21 bp, Homo sapiens
ggcctcaaccctccctcagcc

SEQ ID NO: 3719730 - DNA, 14 bp, Homo sapiens
ggcctcaagtgatt

SEQ ID NO: 3719731 - DNA, 15 bp, Homo sapiens
ggcctcagctgcctc

SEQ ID NO: 3719732 - DNA, 11 bp, Homo sapiens
ggcctcagggc

SEQ ID NO: 3719733 - DNA, 20 bp, Homo sapiens
ggcctccagccctctcactg

SEQ ID NO: 3719734 - DNA, 17 bp, Homo sapiens
ggcctccattcctggag

SEQ ID NO: 3719735 - DNA, 21 bp, Homo sapiens
ggcctccattcctggagcccg

SEQ ID NO: 3719736 - DNA, 15 bp, Homo sapiens
ggcctccctctctct

SEQ ID NO: 3719737 - DNA, 15 bp, Homo sapiens
ggcctcctctaacag

SEQ ID NO: 3719738 - DNA, 14 bp, Homo sapiens
ggcctcctgtgtgt

SEQ ID NO: 3719739 - DNA, 13 bp, Homo sapiens
ggcctcggagcct

SEQ ID NO: 3719740 - DNA, 15 bp, Homo sapiens
ggcctcggagcctca

SEQ ID NO: 3719741 - DNA, 22 bp, Homo sapiens
ggcctcggagcctcatccgagg

SEQ ID NO: 3719742 - DNA, 20 bp, Homo sapiens
ggcctcggtgtggagaagcg

SEQ ID NO: 3719743 - DNA, 19 bp, Homo sapiens
ggcctcttccgtgacgtca

SEQ ID NO: 3719744 - DNA, 19 bp, Homo sapiens
ggcctcttgggtcccccac

SEQ ID NO: 3719745 - DNA, 16 bp, Homo sapiens
ggcctgacctccccct

SEQ ID NO: 3719746 - DNA, 19 bp, Homo sapiens
ggcctgacctccccctcct

SEQ ID NO: 3719747 - DNA, 20 bp, Homo sapiens
ggcctgacctccccctcctt

SEQ ID NO: 3719748 - DNA, 17 bp, Homo sapiens
ggcctgaggagcagcag

SEQ ID NO: 3719749 - DNA, 17 bp, Homo sapiens
ggcctgatgctccctcc

SEQ ID NO: 3719750 - DNA, 22 bp, Homo sapiens
ggcctgatgctccctcccctgc

SEQ ID NO: 3719751 - DNA, 13 bp, Homo sapiens
ggcctgcactaat

SEQ ID NO: 3719752 - DNA, 21 bp, Homo sapiens
ggcctggccagatgcaccagc

SEQ ID NO: 3719753 - DNA, 16 bp, Homo sapiens
ggcctggccaggagct

SEQ ID NO: 3719754 - DNA, 14 bp, Homo sapiens
ggcctggctccgct

SEQ ID NO: 3719755 - DNA, 21 bp, Homo sapiens
ggcctggtccatgatggagtc

SEQ ID NO: 3719756 - DNA, 19 bp, Homo sapiens
ggcctgtacaaaagggaca

SEQ ID NO: 3719757 - DNA, 11 bp, Homo sapiens
ggcctgttgcc

SEQ ID NO: 3719758 - DNA, 16 bp, Homo sapiens
ggccttctctgaagga

SEQ ID NO: 3719759 - DNA, 13 bp, Homo sapiens
ggccttgcccaga

SEQ ID NO: 3719760 - DNA, 14 bp, Homo sapiens
ggccttgcccagag

SEQ ID NO: 3719761 - DNA, 15 bp, Homo sapiens
ggccttgcccagaga

SEQ ID NO: 3719762 - DNA, 23 bp, Homo sapiens
ggcctttgcttatgaatatttat

SEQ ID NO: 3719763 - DNA, 14 bp, Homo sapiens
ggcgcaagcctgta

SEQ ID NO: 3719764 - DNA, 22 bp, Homo sapiens
ggcgcaagcctgtaatcccagc

SEQ ID NO: 3719765 - DNA, 16 bp, Homo sapiens
ggcgggagcatctctt

SEQ ID NO: 3719766 - DNA, 15 bp, Homo sapiens
ggcgtctgtcttcaa

SEQ ID NO: 3719767 - DNA, 19 bp, Homo sapiens
ggcgtgcagtggtgcgatc

SEQ ID NO: 3719768 - DNA, 16 bp, Homo sapiens
ggcgtggagccaggga

SEQ ID NO: 3719769 - DNA, 19 bp, Homo sapiens
ggcgtggagccagggagcg

SEQ ID NO: 3719770 - DNA, 17 bp, Homo sapiens
ggctactcagcagccct

SEQ ID NO: 3719771 - DNA, 18 bp, Homo sapiens
ggctactcagcagccctc

SEQ ID NO: 3719772 - DNA, 16 bp, Homo sapiens
ggctagaggccagccc

SEQ ID NO: 3719773 - DNA, 18 bp, Homo sapiens
ggctagaggccagcccca

SEQ ID NO: 3719774 - DNA, 15 bp, Homo sapiens
ggctagatcatgaag

SEQ ID NO: 3719775 - DNA, 22 bp, Homo sapiens
ggctaggacccctccatgtggg

SEQ ID NO: 3719776 - DNA, 13 bp, Homo sapiens
ggctagtcagaga

SEQ ID NO: 3719777 - DNA, 19 bp, Homo sapiens
ggctatagctacaggaagc

SEQ ID NO: 3719778 - DNA, 13 bp, Homo sapiens
ggctattcacaac

SEQ ID NO: 3719779 - DNA, 19 bp, Homo sapiens
ggctattccataattccat

SEQ ID NO: 3719780 - DNA, 19 bp, Homo sapiens
ggctcagcaaaagatgctt

SEQ ID NO: 3719781 - DNA, 12 bp, Homo sapiens
ggctcagcctgg

SEQ ID NO: 3719782 - DNA, 14 bp, Homo sapiens
ggctcagctctggc

SEQ ID NO: 3719783 - DNA, 18 bp, Homo sapiens
ggctcagctctggctcac

SEQ ID NO: 3719784 - DNA, 14 bp, Homo sapiens
ggctcagtctcagg

SEQ ID NO: 3719785 - DNA, 17 bp, Homo sapiens
ggctcagtctcaggagc

SEQ ID NO: 3719786 - DNA, 11 bp, Homo sapiens
ggctccaggct

SEQ ID NO: 3719787 - DNA, 15 bp, Homo sapiens
ggctccaggctcctt

SEQ ID NO: 3719788 - DNA, 22 bp, Homo sapiens
ggctccagtctgctgccctcca

SEQ ID NO: 3719789 - DNA, 24 bp, Homo sapiens
ggctccagtctgctgccctccatc

SEQ ID NO: 3719790 - DNA, 18 bp, Homo sapiens
ggctcccacaggcccttc

SEQ ID NO: 3719791 - DNA, 20 bp, Homo sapiens
ggctcccacaggcccttcct

SEQ ID NO: 3719792 - DNA, 13 bp, Homo sapiens
ggctcccttcctc

SEQ ID NO: 3719793 - DNA, 22 bp, Homo sapiens
ggctccgtcagtatcaggcctg

SEQ ID NO: 3719794 - DNA, 12 bp, Homo sapiens
ggctcctggact

SEQ ID NO: 3719795 - DNA, 16 bp, Homo sapiens
ggctctccacctcagc

SEQ ID NO: 3719796 - DNA, 11 bp, Homo sapiens
ggtccagggaa

SEQ ID NO: 3719797 - DNA, 21 bp, Homo sapiens
ggtccagggaagctggccgag

SEQ ID NO: 3719798 - DNA, 14 bp, Homo sapiens
ggtcccactcagtc

SEQ ID NO: 3719799 - DNA, 14 bp, Homo sapiens
ggtcccagccaccc

SEQ ID NO: 3719800 - DNA, 23 bp, Homo sapiens
ggtccctgggaggaaatttgaat

SEQ ID NO: 3719801 - DNA, 21 bp, Homo sapiens
ggtcccttgagacctcagcca

SEQ ID NO: 3719802 - DNA, 23 bp, Homo sapiens
ggtcccttgcagctagttttcta

SEQ ID NO: 3719803 - DNA, 15 bp, Homo sapiens
ggtcctggctcctga

SEQ ID NO: 3719804 - DNA, 15 bp, Homo sapiens
ggtcctgggggcctg

SEQ ID NO: 3719805 - DNA, 13 bp, Homo sapiens
ggtcctgtctccc

SEQ ID NO: 3719806 - DNA, 21 bp, Homo sapiens
ggtcctgtctcccctctgctg

SEQ ID NO: 3719807 - DNA, 21 bp, Homo sapiens
ggtccttcaagttagctcagg

SEQ ID NO: 3719808 - DNA, 16 bp, Homo sapiens
ggtccttccaggcccc

SEQ ID NO: 3719809 - DNA, 21 bp, Homo sapiens
ggtcctttgggaaaggagaag

SEQ ID NO: 3719810 - DNA, 20 bp, Homo sapiens
ggtcgaccccaaagcccctt

SEQ ID NO: 3719811 - DNA, 12 bp, Homo sapiens
ggtcgcccagga

SEQ ID NO: 3719812 - DNA, 14 bp, Homo sapiens
ggtcgcccaggaga

SEQ ID NO: 3719813 - DNA, 23 bp, Homo sapiens
ggtctcaaactcctgggctcagg

SEQ ID NO: 3719814 - DNA, 22 bp, Homo sapiens
ggtctcactatgttgcccaggc

SEQ ID NO: 3719815 - DNA, 22 bp, Homo sapiens
ggtctcccgggaagccaccctc

SEQ ID NO: 3719816 - DNA, 20 bp, Homo sapiens
ggtctcgctttgttgcccag

SEQ ID NO: 3719817 - DNA, 21 bp, Homo sapiens
ggtctcgctttgttgcccagg

SEQ ID NO: 3719818 - DNA, 13 bp, Homo sapiens
ggtctctctttgg

SEQ ID NO: 3719819 - DNA, 13 bp, Homo sapiens
ggtctgaaatgga

SEQ ID NO: 3719820 - DNA, 15 bp, Homo sapiens
ggtctgaaggactgg

SEQ ID NO: 3719821 - DNA, 21 bp, Homo sapiens
ggtctgaatgttctgacatta

SEQ ID NO: 3719822 - DNA, 13 bp, Homo sapiens
ggtctgcaggcag

SEQ ID NO: 3719823 - DNA, 23 bp, Homo sapiens
ggtctgcaggcagggctgactct

SEQ ID NO: 3719824 - DNA, 22 bp, Homo sapiens
ggtctggagaagcagtgagccg

SEQ ID NO: 3719825 - DNA, 22 bp, Homo sapiens
ggtcttccctacctcaggcagg

SEQ ID NO: 3719826 - DNA, 22 bp, Homo sapiens
ggtcttcttacatgcatttgag

SEQ ID NO: 3719827 - DNA, 19 bp, Homo sapiens
ggtgaaagaaatcatgtta

SEQ ID NO: 3719828 - DNA, 14 bp, Homo sapiens
ggtgacctctgcct

SEQ ID NO: 3719829 - DNA, 21 bp, Homo sapiens
ggtgacctctgcctgaagtca

SEQ ID NO: 3719830 - DNA, 15 bp, Homo sapiens
ggtgaggaccactcc

SEQ ID NO: 3719831 - DNA, 23 bp, Homo sapiens
ggtgagtggggagacacctcaga

SEQ ID NO: 3719832 - DNA, 20 bp, Homo sapiens
ggtgatttagcaggaagctg

SEQ ID NO: 3719833 - DNA, 15 bp, Homo sapiens
ggtgcagcagtgagg

SEQ ID NO: 3719834 - DNA, 19 bp, Homo sapiens
ggtgcattacagagaggag

SEQ ID NO: 3719835 - DNA, 22 bp, Homo sapiens
ggtgccccccttgccagacatg

SEQ ID NO: 3719836 - DNA, 17 bp, Homo sapiens
ggtgcccttggaggcca

SEQ ID NO: 3719837 - DNA, 22 bp, Homo sapiens
ggtgcccttggaggccagccag

SEQ ID NO: 3719838 - DNA, 19 bp, Homo sapiens
ggtgcctgggtggggctgc

SEQ ID NO: 3719839 - DNA, 17 bp, Homo sapiens
ggtgcctgtgaggcagg

SEQ ID NO: 3719840 - DNA, 19 bp, Homo sapiens
ggtgcctgtgaggcagggg

SEQ ID NO: 3719841 - DNA, 23 bp, Homo sapiens
ggtgccttcttattctcactcca

SEQ ID NO: 3719842 - DNA, 17 bp, Homo sapiens
ggtgcctttcctgttca

SEQ ID NO: 3719843 - DNA, 19 bp, Homo sapiens
ggtgcctttcctgttcagc

SEQ ID NO: 3719844 - DNA, 17 bp, Homo sapiens
ggtgctaattaataaag

SEQ ID NO: 3719845 - DNA, 22 bp, Homo sapiens
ggtgctgttgtcattgctttac

SEQ ID NO: 3719846 - DNA, 15 bp, Homo sapiens
ggtggacagtcctgg

SEQ ID NO: 3719847 - DNA, 16 bp, Homo sapiens
ggtggacagtcctggg

SEQ ID NO: 3719848 - DNA, 18 bp, Homo sapiens
ggtggaggagagcctggt

SEQ ID NO: 3719849 - DNA, 21 bp, Homo sapiens
ggtggatgcctggtggcagct

SEQ ID NO: 3719850 - DNA, 18 bp, Homo sapiens
ggtggcagccctgtaggg

SEQ ID NO: 3719851 - DNA, 12 bp, Homo sapiens
ggtggcagctgc

SEQ ID NO: 3719852 - DNA, 13 bp, Homo sapiens
ggtggcagctgcg

SEQ ID NO: 3719853 - DNA, 21 bp, Homo sapiens
ggtggcagtgcagcaaccaga

SEQ ID NO: 3719854 - DNA, 20 bp, Homo sapiens
ggtggccactccagacccct

SEQ ID NO: 3719855 - DNA, 21 bp, Homo sapiens
ggtggccactccagacccctg

SEQ ID NO: 3719856 - DNA, 16 bp, Homo sapiens
ggtggcccgacagcct

SEQ ID NO: 3719857 - DNA, 16 bp, Homo sapiens
ggtggctagtcagaga

SEQ ID NO: 3719858 - DNA, 15 bp, Homo sapiens
ggtggctgacccagt

SEQ ID NO: 3719859 - DNA, 18 bp, Homo sapiens
ggtggctgggttggaggg

SEQ ID NO: 3719860 - DNA, 17 bp, Homo sapiens
ggtgggatggaggagaa

SEQ ID NO: 3719861 - DNA, 20 bp, Homo sapiens
ggtgggccagcccctcccac

SEQ ID NO: 3719862 - DNA, 17 bp, Homo sapiens
ggtggggctgctcctcc

SEQ ID NO: 3719863 - DNA, 18 bp, Homo sapiens
ggtggggctgctcctcca

SEQ ID NO: 3719864 - DNA, 22 bp, Homo sapiens
ggtggggctgctcctccagggc

SEQ ID NO: 3719865 - DNA, 13 bp, Homo sapiens
ggtgggggcctcg

SEQ ID NO: 3719866 - DNA, 15 bp, Homo sapiens
ggtggtctgaatgtt

SEQ ID NO: 3719867 - DNA, 18 bp, Homo sapiens
ggtggtctgaatgttctg

SEQ ID NO: 3719868 - DNA, 21 bp, Homo sapiens
ggtggttatggagagggtgtc

SEQ ID NO: 3719869 - DNA, 16 bp, Homo sapiens
ggtgtaacctgagatg

SEQ ID NO: 3719870 - DNA, 23 bp, Homo sapiens
ggtgtatttattttcctccccag

SEQ ID NO: 3719871 - DNA, 20 bp, Homo sapiens
ggtgtgaaagtcagatgccc

SEQ ID NO: 3719872 - DNA, 18 bp, Homo sapiens
ggtgtgagtcaccaagcc

SEQ ID NO: 3719873 - DNA, 13 bp, Homo sapiens
ggtgtgctctgat

SEQ ID NO: 3719874 - DNA, 14 bp, Homo sapiens
ggtgtggagaagcg

SEQ ID NO: 3719875 - DNA, 14 bp, Homo sapiens
ggtgtgtgtagcca

SEQ ID NO: 3719876 - DNA, 14 bp, Homo sapiens
ggtgtgtttttggg

SEQ ID NO: 3719877 - DNA, 13 bp, Homo sapiens
ggtgtttatacag

SEQ ID NO: 3719878 - DNA, 11 bp, Homo sapiens
ggttaaaactg

SEQ ID NO: 3719879 - DNA, 13 bp, Homo sapiens
ggttaaaactgtc

SEQ ID NO: 3719880 - DNA, 14 bp, Homo sapiens
ggttacaaactgca

SEQ ID NO: 3719881 - DNA, 21 bp, Homo sapiens
ggttacccagttagctctcaa

SEQ ID NO: 3719882 - DNA, 20 bp, Homo sapiens
ggttaggagttcgagaccag

SEQ ID NO: 3719883 - DNA, 15 bp, Homo sapiens
ggttagggaggggta

SEQ ID NO: 3719884 - DNA, 23 bp, Homo sapiens
ggttatacatgacactgaaatgc

SEQ ID NO: 3719885 - DNA, 13 bp, Homo sapiens
ggttatggagagg

SEQ ID NO: 3719886 - DNA, 22 bp, Homo sapiens
ggttatgtgtatgtgccattta

SEQ ID NO: 3719887 - DNA, 12 bp, Homo sapiens
ggttatttttat

SEQ ID NO: 3719888 - DNA, 22 bp, Homo sapiens
ggttcaagcgattcttctgctt

SEQ ID NO: 3719889 - DNA, 12 bp, Homo sapiens
ggttcaccagcc

SEQ ID NO: 3719890 - DNA, 13 bp, Homo sapiens
ggttcaccagcct

SEQ ID NO: 3719891 - DNA, 22 bp, Homo sapiens
ggttcacgcctgtaatcccagc

SEQ ID NO: 3719892 - DNA, 15 bp, Homo sapiens
ggttcactaaagcag

SEQ ID NO: 3719893 - DNA, 17 bp, Homo sapiens
ggttcagcccctcctct

SEQ ID NO: 3719894 - DNA, 19 bp, Homo sapiens
ggttcagcccctcctctgc

SEQ ID NO: 3719895 - DNA, 12 bp, Homo sapiens
ggttcagcttgt

SEQ ID NO: 3719896 - DNA, 22 bp, Homo sapiens
ggttcatcagtgttaaaaaatt

SEQ ID NO: 3719897 - DNA, 19 bp, Homo sapiens
ggttcattattggaattaa

SEQ ID NO: 3719898 - DNA, 23 bp, Homo sapiens
ggttcgtggaaagggtgctgctt

SEQ ID NO: 3719899 - DNA, 23 bp, Homo sapiens
ggttctcacagtgggagccaggg

SEQ ID NO: 3719900 - DNA, 18 bp, Homo sapiens
ggttctggttagctcagc

SEQ ID NO: 3719901 - DNA, 20 bp, Homo sapiens
ggttctggttagctcagccc

SEQ ID NO: 3719902 - DNA, 16 bp, Homo sapiens
ggttcttagtgtcact

SEQ ID NO: 3719903 - DNA, 13 bp, Homo sapiens
ggttcttcccttt

SEQ ID NO: 3719904 - DNA, 14 bp, Homo sapiens
ggttctttcttcct

SEQ ID NO: 3719905 - DNA, 16 bp, Homo sapiens
ggttctttcttcctct

SEQ ID NO: 3719906 - DNA, 18 bp, Homo sapiens
ggttctttcttcctctgc

SEQ ID NO: 3719907 - DNA, 13 bp, Homo sapiens
ggttgagaaatga

SEQ ID NO: 3719908 - DNA, 22 bp, Homo sapiens
gtcctccccctgccagtgcctt

SEQ ID NO: 3719909 - DNA, 20 bp, Homo sapiens
gtcctctttcagaaaacaga

SEQ ID NO: 3719910 - DNA, 16 bp, Homo sapiens
gtcctgacggcgcccc

SEQ ID NO: 3719911 - DNA, 15 bp, Homo sapiens
gtcctgcctcagcct

SEQ ID NO: 3719912 - DNA, 19 bp, Homo sapiens
gtcctggctacatcccagc

SEQ ID NO: 3719913 - DNA, 22 bp, Homo sapiens
gtcctggctacatcccagcctg

SEQ ID NO: 3719914 - DNA, 15 bp, Homo sapiens
gtcctgggagtgagc

SEQ ID NO: 3719915 - DNA, 15 bp, Homo sapiens
gtcctggggctctgt

SEQ ID NO: 3719916 - DNA, 17 bp, Homo sapiens
gtcctgggggcctgacc

SEQ ID NO: 3719917 - DNA, 18 bp, Homo sapiens
gtcctgtcggagccctgt

SEQ ID NO: 3719918 - DNA, 18 bp, Homo sapiens
gtcctgtctcccctctgc

SEQ ID NO: 3719919 - DNA, 20 bp, Homo sapiens
gtccttaatgatccgttcca

SEQ ID NO: 3719920 - DNA, 22 bp, Homo sapiens
gtccttccaggcccccaccact

SEQ ID NO: 3719921 - DNA, 21 bp, Homo sapiens
gtccttccctctccccaagac

SEQ ID NO: 3719922 - DNA, 17 bp, Homo sapiens
gtccttctctcacctcc

SEQ ID NO: 3719923 - DNA, 19 bp, Homo sapiens
gtccttctctcacctccta

SEQ ID NO: 3719924 - DNA, 12 bp, Homo sapiens
gtccttgcacac

SEQ ID NO: 3719925 - DNA, 22 bp, Homo sapiens
gtccttgcacactcccctgcac

SEQ ID NO: 3719926 - DNA, 15 bp, Homo sapiens
gtccttgcacctgca

SEQ ID NO: 3719927 - DNA, 16 bp, Homo sapiens
gtccttgcacctgcat

SEQ ID NO: 3719928 - DNA, 15 bp, Homo sapiens
gtcctttccagtggc

SEQ ID NO: 3719929 - DNA, 23 bp, Homo sapiens
gtcctttccagtggcctggctcc

SEQ ID NO: 3719930 - DNA, 14 bp, Homo sapiens
gtcctttccctcca

SEQ ID NO: 3719931 - DNA, 17 bp, Homo sapiens
gtccttttgtaccatgg

SEQ ID NO: 3719932 - DNA, 12 bp, Homo sapiens
gtcgcccaggag

SEQ ID NO: 3719933 - DNA, 18 bp, Homo sapiens
gtcgggagttcgagacca

SEQ ID NO: 3719934 - DNA, 21 bp, Homo sapiens
gtcgggctcagctctggctca

SEQ ID NO: 3719935 - DNA, 18 bp, Homo sapiens
gtcgggggctgaggggca

SEQ ID NO: 3719936 - DNA, 17 bp, Homo sapiens
gtcggggggacagctcc

SEQ ID NO: 3719937 - DNA, 15 bp, Homo sapiens
gtcgtggcagataat

SEQ ID NO: 3719938 - DNA, 16 bp, Homo sapiens
gtctaaccaaatgcat

SEQ ID NO: 3719939 - DNA, 18 bp, Homo sapiens
gtctaacttttgtgtgaa

SEQ ID NO: 3719940 - DNA, 13 bp, Homo sapiens
gtctaccatctcc

SEQ ID NO: 3719941 - DNA, 14 bp, Homo sapiens
gtctaccatctccc

SEQ ID NO: 3719942 - DNA, 19 bp, Homo sapiens
gtctagcagagcaggggca

SEQ ID NO: 3719943 - DNA, 14 bp, Homo sapiens
gtctatgggactca

SEQ ID NO: 3719944 - DNA, 19 bp, Homo sapiens
gtctcaaaaaaagaaaaag

SEQ ID NO: 3719945 - DNA, 16 bp, Homo sapiens
gtctcaaactcctggg

SEQ ID NO: 3719946 - DNA, 20 bp, Homo sapiens
gtctcaagagggcactggtg

SEQ ID NO: 3719947 - DNA, 23 bp, Homo sapiens
gtctcacagtgttgcccaggctg

SEQ ID NO: 3719948 - DNA, 20 bp, Homo sapiens
gtctcactatgttgcccagg

SEQ ID NO: 3719949 - DNA, 23 bp, Homo sapiens
gtctcactatgttgcccaggcag

SEQ ID NO: 3719950 - DNA, 16 bp, Homo sapiens
gtctcactctgtcgcc

SEQ ID NO: 3719951 - DNA, 18 bp, Homo sapiens
gtctcactctgtcgccca

SEQ ID NO: 3719952 - DNA, 16 bp, Homo sapiens
gtctcagaatctttcc

SEQ ID NO: 3719953 - DNA, 13 bp, Homo sapiens
gtctcagcctccc

SEQ ID NO: 3719954 - DNA, 16 bp, Homo sapiens
gtctcaggagcatggg

SEQ ID NO: 3719955 - DNA, 14 bp, Homo sapiens
gtctcatccccagg

SEQ ID NO: 3719956 - DNA, 21 bp, Homo sapiens
gtctccagtatccactttgca

SEQ ID NO: 3719957 - DNA, 13 bp, Homo sapiens
gtctccatgtttg

SEQ ID NO: 3719958 - DNA, 17 bp, Homo sapiens
gtctcccaggccccctg

SEQ ID NO: 3719959 - DNA, 18 bp, Homo sapiens
gtctcccatcttaactct

SEQ ID NO: 3719960 - DNA, 18 bp, Homo sapiens
gtctccccatgtgcctgc

SEQ ID NO: 3719961 - DNA, 15 bp, Homo sapiens
gtctcccctctgctg

SEQ ID NO: 3719962 - DNA, 16 bp, Homo sapiens
gtctcccctctgctgg

SEQ ID NO: 3719963 - DNA, 17 bp, Homo sapiens
gtctcccctctgctggc

SEQ ID NO: 3719964 - DNA, 14 bp, Homo sapiens
gtctccctctcctg

SEQ ID NO: 3719965 - DNA, 22 bp, Homo sapiens
gtctccctctcctgcctactca

SEQ ID NO: 3719966 - DNA, 22 bp, Homo sapiens
gtctcctcttaaaaaataaaaa

SEQ ID NO: 3719967 - DNA, 14 bp, Homo sapiens
gtctcctgccccca

SEQ ID NO: 3719968 - DNA, 17 bp, Homo sapiens
gtctcgctttgttgccc

SEQ ID NO: 3719969 - DNA, 23 bp, Homo sapiens
gtctcgggtggctagtcagagag

SEQ ID NO: 3719970 - DNA, 23 bp, Homo sapiens
gtctctatgccagctcagtccca

SEQ ID NO: 3719971 - DNA, 16 bp, Homo sapiens
gtctctctttggactc

SEQ ID NO: 3719972 - DNA, 21 bp, Homo sapiens
gtctctctttggactctcccc

SEQ ID NO: 3719973 - DNA, 11 bp, Homo sapiens
gtctctgccat

SEQ ID NO: 3719974 - DNA, 21 bp, Homo sapiens
gtctctgccatgaactggagg

SEQ ID NO: 3719975 - DNA, 17 bp, Homo sapiens
gtctcttaaaaaaataa

SEQ ID NO: 3719976 - DNA, 14 bp, Homo sapiens
gtctcttctccact

SEQ ID NO: 3719977 - DNA, 23 bp, Homo sapiens
gtctcttgagggagcttagccaa

SEQ ID NO: 3719978 - DNA, 12 bp, Homo sapiens
gtctcttgcttg

SEQ ID NO: 3719979 - DNA, 18 bp, Homo sapiens
gtctctttaatcttcagt

SEQ ID NO: 3719980 - DNA, 20 bp, Homo sapiens
gtctctttaatgtcacaggc

SEQ ID NO: 3719981 - DNA, 16 bp, Homo sapiens
gtctgaagtcactgca

SEQ ID NO: 3719982 - DNA, 17 bp, Homo sapiens
gtctgaagtcactgcac

SEQ ID NO: 3719983 - DNA, 14 bp, Homo sapiens
gtctgaatgttctg

SEQ ID NO: 3719984 - DNA, 18 bp, Homo sapiens
gtctgaatgttctgacat

SEQ ID NO: 3719985 - DNA, 12 bp, Homo sapiens
gtctgacaggca

SEQ ID NO: 3719986 - DNA, 13 bp, Homo sapiens
gtctgacaggcaa

SEQ ID NO: 3719987 - DNA, 14 bp, Homo sapiens
gtctgacaggcaat

SEQ ID NO: 3719988 - DNA, 18 bp, Homo sapiens
gtctgacaggcaatgctg

SEQ ID NO: 3719989 - DNA, 14 bp, Homo sapiens
gtctgaccctctcc

SEQ ID NO: 3719990 - DNA, 18 bp, Homo sapiens
gtctgaggaatccagacc

SEQ ID NO: 3719991 - DNA, 19 bp, Homo sapiens
gtctgaggaatccagaccc

SEQ ID NO: 3719992 - DNA, 18 bp, Homo sapiens
gtctgattcccaagctct

SEQ ID NO: 3719993 - DNA, 15 bp, Homo sapiens
gtctgcattttctga

SEQ ID NO: 3719994 - DNA, 14 bp, Homo sapiens
gtctgccagccagc

SEQ ID NO: 3719995 - DNA, 16 bp, Homo sapiens
gtctgccagccagcag

SEQ ID NO: 3719996 - DNA, 17 bp, Homo sapiens
gtctgctgaataataaa

SEQ ID NO: 3719997 - DNA, 13 bp, Homo sapiens
gtctgctgccctc

SEQ ID NO: 3719998 - DNA, 16 bp, Homo sapiens
gtctgctgccctccat

SEQ ID NO: 3719999 - DNA, 19 bp, Homo sapiens
gtctgctgccctccatccc

SEQ ID NO: 3720000 - DNA, 16 bp, Homo sapiens
gtctgcttctgcacct

SEQ ID NO: 3720001 - DNA, 23 bp, Homo sapiens
gtctgcttctgcaccttatctta

SEQ ID NO: 3720002 - DNA, 15 bp, Homo sapiens
gtctggaatgcagtg

SEQ ID NO: 3720003 - DNA, 16 bp, Homo sapiens
gtctggaatgcagtgg

SEQ ID NO: 3720004 - DNA, 18 bp, Homo sapiens
gtctggaatgcagtggta

SEQ ID NO: 3720005 - DNA, 21 bp, Homo sapiens
gtctggagaataattctttga

SEQ ID NO: 3720006 - DNA, 10 bp, Homo sapiens
gtctggaggg

SEQ ID NO: 3720007 - DNA, 14 bp, Homo sapiens
gtctggcccttcct

SEQ ID NO: 3720008 - DNA, 15 bp, Homo sapiens
gtctggcttcacaga

SEQ ID NO: 3720009 - DNA, 14 bp, Homo sapiens
gtctgggggtcagg

SEQ ID NO: 3720010 - DNA, 16 bp, Homo sapiens
gtctggggttcagccc

SEQ ID NO: 3720011 - DNA, 13 bp, Homo sapiens
gtctggtttctag

SEQ ID NO: 3720012 - DNA, 18 bp, Homo sapiens
gtctgtaatgacaaataa

SEQ ID NO: 3720013 - DNA, 19 bp, Homo sapiens
gtctgtatttatgtgtgag

SEQ ID NO: 3720014 - DNA, 15 bp, Homo sapiens
gtctgtcccaccagc

SEQ ID NO: 3720015 - DNA, 15 bp, Homo sapiens
gtctgtcttcacagc

SEQ ID NO: 3720016 - DNA, 21 bp, Homo sapiens
gtctgtgaattggaccatcct

SEQ ID NO: 3720017 - DNA, 16 bp, Homo sapiens
gtctgttaacttaata

SEQ ID NO: 3720018 - DNA, 17 bp, Homo sapiens
gtctgttcacttttcct

SEQ ID NO: 3720019 - DNA, 15 bp, Homo sapiens
gtcttaattaagtaa

SEQ ID NO: 3720020 - DNA, 20 bp, Homo sapiens
gtcttaattaagtaaactaa

SEQ ID NO: 3720021 - DNA, 23 bp, Homo sapiens
gttaacaaggaatgcctgtgcca

SEQ ID NO: 3720022 - DNA, 23 bp, Homo sapiens
gttaacattgaccaagaactgca

SEQ ID NO: 3720023 - DNA, 18 bp, Homo sapiens
gttaagaaaaaaataatt

SEQ ID NO: 3720024 - DNA, 15 bp, Homo sapiens
gttaagaatgtcgat

SEQ ID NO: 3720025 - DNA, 19 bp, Homo sapiens
gttaagcagccgccacatc

SEQ ID NO: 3720026 - DNA, 16 bp, Homo sapiens
gttaatattctttcaa

SEQ ID NO: 3720027 - DNA, 16 bp, Homo sapiens
gttaatcttgctttct

SEQ ID NO: 3720028 - DNA, 21 bp, Homo sapiens
gttaatcttgctttctttgtt

SEQ ID NO: 3720029 - DNA, 16 bp, Homo sapiens
gttaatgaaaatgtca

SEQ ID NO: 3720030 - DNA, 17 bp, Homo sapiens
gttaatgaaaatgtcag

SEQ ID NO: 3720031 - DNA, 9 bp, Homo sapiens
gttacaaac

SEQ ID NO: 3720032 - DNA, 16 bp, Homo sapiens
gttacaaactgcaata

SEQ ID NO: 3720033 - DNA, 19 bp, Homo sapiens
gttacaaactgcaatagag

SEQ ID NO: 3720034 - DNA, 14 bp, Homo sapiens
gttacactgttaga

SEQ ID NO: 3720035 - DNA, 19 bp, Homo sapiens
gttacactgttagaacact

SEQ ID NO: 3720036 - DNA, 20 bp, Homo sapiens
gttacactgttagaacacta

SEQ ID NO: 3720037 - DNA, 22 bp, Homo sapiens
gttacactgttagaacactatt

SEQ ID NO: 3720038 - DNA, 19 bp, Homo sapiens
gttacataagataaatgtg

SEQ ID NO: 3720039 - DNA, 23 bp, Homo sapiens
gttacattgctggtcttgtaaga

SEQ ID NO: 3720040 - DNA, 23 bp, Homo sapiens
gttactaattggcctctttaaga

SEQ ID NO: 3720041 - DNA, 16 bp, Homo sapiens
gttactatcctggctt

SEQ ID NO: 3720042 - DNA, 14 bp, Homo sapiens
gttactcagccctg

SEQ ID NO: 3720043 - DNA, 18 bp, Homo sapiens
gttactcagccctgggcc

SEQ ID NO: 3720044 - DNA, 14 bp, Homo sapiens
gttactctccaacc

SEQ ID NO: 3720045 - DNA, 19 bp, Homo sapiens
gttactgatcatgcattgt

SEQ ID NO: 3720046 - DNA, 22 bp, Homo sapiens
gttactggatttgttgttcttt

SEQ ID NO: 3720047 - DNA, 16 bp, Homo sapiens
gttactgttatagagg

SEQ ID NO: 3720048 - DNA, 15 bp, Homo sapiens
gttagaaatgcaaat

SEQ ID NO: 3720049 - DNA, 19 bp, Homo sapiens
gttagaaatgcagaatcct

SEQ ID NO: 3720050 - DNA, 20 bp, Homo sapiens
gttagaacactattttcaga

SEQ ID NO: 3720051 - DNA, 21 bp, Homo sapiens
gttagaacactattttcagaa

SEQ ID NO: 3720052 - DNA, 20 bp, Homo sapiens
gttagctcaggaggcttgga

SEQ ID NO: 3720053 - DNA, 13 bp, Homo sapiens
gttaggctgggcc

SEQ ID NO: 3720054 - DNA, 18 bp, Homo sapiens
gttaggctgggcccagag

SEQ ID NO: 3720055 - DNA, 11 bp, Homo sapiens
gttagggaggg

SEQ ID NO: 3720056 - DNA, 22 bp, Homo sapiens
gttatagagggtctaagattca

SEQ ID NO: 3720057 - DNA, 15 bp, Homo sapiens
gttatagtgaattat

SEQ ID NO: 3720058 - DNA, 13 bp, Homo sapiens
gttatataaagag

SEQ ID NO: 3720059 - DNA, 16 bp, Homo sapiens
gttatataaagagaaa

SEQ ID NO: 3720060 - DNA, 22 bp, Homo sapiens
gttatataaagagaaaattgaa

SEQ ID NO: 3720061 - DNA, 20 bp, Homo sapiens
gttatattttactactgtgg

SEQ ID NO: 3720062 - DNA, 13 bp, Homo sapiens
gttatgcatcatt

SEQ ID NO: 3720063 - DNA, 21 bp, Homo sapiens
gttattacatccttgtggcac

SEQ ID NO: 3720064 - DNA, 14 bp, Homo sapiens
gttattgaaaaaaa

SEQ ID NO: 3720065 - DNA, 13 bp, Homo sapiens
gttatttaaagaa

SEQ ID NO: 3720066 - DNA, 23 bp, Homo sapiens
gttattttctttgaaattgttta

SEQ ID NO: 3720067 - DNA, 16 bp, Homo sapiens
gttattttttaattat

SEQ ID NO: 3720068 - DNA, 14 bp, Homo sapiens
gttcaaaaagtcta

SEQ ID NO: 3720069 - DNA, 19 bp, Homo sapiens
gttcaagcgattcttctgc

SEQ ID NO: 3720070 - DNA, 12 bp, Homo sapiens
gttcacccctcc

SEQ ID NO: 3720071 - DNA, 14 bp, Homo sapiens
gttcacccctccac

SEQ ID NO: 3720072 - DNA, 18 bp, Homo sapiens
gttcacgtaagatacaag

SEQ ID NO: 3720073 - DNA, 21 bp, Homo sapiens
gttcactactacacccagcta

SEQ ID NO: 3720074 - DNA, 16 bp, Homo sapiens
gttcagcattcttagc

SEQ ID NO: 3720075 - DNA, 14 bp, Homo sapiens
gttcagcccctcct

SEQ ID NO: 3720076 - DNA, 15 bp, Homo sapiens
gttcagcccctcctc

SEQ ID NO: 3720077 - DNA, 19 bp, Homo sapiens
gttcagcccctcctctgcc

SEQ ID NO: 3720078 - DNA, 20 bp, Homo sapiens
gttcagcccctcctctgcca

SEQ ID NO: 3720079 - DNA, 23 bp, Homo sapiens
gttcagcccctcctctgccacct

SEQ ID NO: 3720080 - DNA, 13 bp, Homo sapiens
gttcagctccagc

SEQ ID NO: 3720081 - DNA, 16 bp, Homo sapiens
gttcagctccagctca

SEQ ID NO: 3720082 - DNA, 15 bp, Homo sapiens
gttcaggagtcccaa

SEQ ID NO: 3720083 - DNA, 18 bp, Homo sapiens
gttcaggagtcccaagga

SEQ ID NO: 3720084 - DNA, 21 bp, Homo sapiens
gttcaggagtcccaaggaaag

SEQ ID NO: 3720085 - DNA, 19 bp, Homo sapiens
gttcagggttggcccctgc

SEQ ID NO: 3720086 - DNA, 21 bp, Homo sapiens
gttcagggttggcccctgccc

SEQ ID NO: 3720087 - DNA, 19 bp, Homo sapiens
gttcataacagtgccattg

SEQ ID NO: 3720088 - DNA, 20 bp, Homo sapiens
gttcataacagtgccattgt

SEQ ID NO: 3720089 - DNA, 22 bp, Homo sapiens
gttcataacagtgccattgtct

SEQ ID NO: 3720090 - DNA, 24 bp, Homo sapiens
gttcataacagtgccattgtcttt

SEQ ID NO: 3720091 - DNA, 18 bp, Homo sapiens
gttcatagggtctcttca

SEQ ID NO: 3720092 - DNA, 19 bp, Homo sapiens
gttcatgagaatctatatt

SEQ ID NO: 3720093 - DNA, 16 bp, Homo sapiens
gttcattaaagcatga

SEQ ID NO: 3720094 - DNA, 20 bp, Homo sapiens
gttcattaaagcatgaatgg

SEQ ID NO: 3720095 - DNA, 20 bp, Homo sapiens
gttcatttcaaatacatctt

SEQ ID NO: 3720096 - DNA, 13 bp, Homo sapiens
gttccaagacatt

SEQ ID NO: 3720097 - DNA, 15 bp, Homo sapiens
gttccaagacattgt

SEQ ID NO: 3720098 - DNA, 19 bp, Homo sapiens
gttccaagacattgtcaat

SEQ ID NO: 3720099 - DNA, 23 bp, Homo sapiens
gttccaatcctggctctgtggct

SEQ ID NO: 3720100 - DNA, 14 bp, Homo sapiens
gttccagctctttg

SEQ ID NO: 3720101 - DNA, 19 bp, Homo sapiens
gttcccaccaggctgctca

SEQ ID NO: 3720102 - DNA, 14 bp, Homo sapiens
gttcccacttggag

SEQ ID NO: 3720103 - DNA, 21 bp, Homo sapiens
gttcccagtgacacttcagag

SEQ ID NO: 3720104 - DNA, 20 bp, Homo sapiens
gttcccccagccctgtggaa

SEQ ID NO: 3720105 - DNA, 17 bp, Homo sapiens
gttcccctttgcttcat

SEQ ID NO: 3720106 - DNA, 20 bp, Homo sapiens
gttccctacttcctgtgact

SEQ ID NO: 3720107 - DNA, 17 bp, Homo sapiens
gttccctgaaaacccag

SEQ ID NO: 3720108 - DNA, 18 bp, Homo sapiens
gttccctgaaaacccaga

SEQ ID NO: 3720109 - DNA, 13 bp, Homo sapiens
gttcccttggcct

SEQ ID NO: 3720110 - DNA, 19 bp, Homo sapiens
gttcccttggcctcagaat

SEQ ID NO: 3720111 - DNA, 22 bp, Homo sapiens
gttccctttccttccatcccta

SEQ ID NO: 3720112 - DNA, 15 bp, Homo sapiens
gttcctcgccctggg

SEQ ID NO: 3720113 - DNA, 19 bp, Homo sapiens
gttcctgatgacccaggct

SEQ ID NO: 3720114 - DNA, 18 bp, Homo sapiens
gttcctgcagcagagcct

SEQ ID NO: 3720115 - DNA, 21 bp, Homo sapiens
gttcctggcaatagtgtgttc

SEQ ID NO: 3720116 - DNA, 15 bp, Homo sapiens
gttcctggctcagcc

SEQ ID NO: 3720117 - DNA, 23 bp, Homo sapiens
gttccttgatctgtatatacaat

SEQ ID NO: 3720118 - DNA, 17 bp, Homo sapiens
gttcgagaccagcctgg

SEQ ID NO: 3720119 - DNA, 18 bp, Homo sapiens
gttcgagaccagcctggc

SEQ ID NO: 3720120 - DNA, 17 bp, Homo sapiens
gttcgtggaaagggtgc

SEQ ID NO: 3720121 - DNA, 23 bp, Homo sapiens
gttcgttcttgttctgttttgtt

SEQ ID NO: 3720122 - DNA, 17 bp, Homo sapiens
gttctatttctatccca

SEQ ID NO: 3720123 - DNA, 18 bp, Homo sapiens
gttctatttctatcccaa

SEQ ID NO: 3720124 - DNA, 23 bp, Homo sapiens
gttctctctatggtaaagatatt

SEQ ID NO: 3720125 - DNA, 13 bp, Homo sapiens
gttctgaaatatt

SEQ ID NO: 3720126 - DNA, 21 bp, Homo sapiens
gttctgaaatattttaccact

SEQ ID NO: 3720127 - DNA, 17 bp, Homo sapiens
gttctgacattaacagt

SEQ ID NO: 3720128 - DNA, 22 bp, Homo sapiens
gttctgagattattttaatcta

SEQ ID NO: 3720129 - DNA, 14 bp, Homo sapiens
gttctgattagaaa

SEQ ID NO: 3720130 - DNA, 18 bp, Homo sapiens
gttctgattagaaatgac

SEQ ID NO: 3720131 - DNA, 20 bp, Homo sapiens
gttctgattagaaatgacca

SEQ ID NO: 3720132 - DNA, 14 bp, Homo sapiens
gttctgcaaataga

SEQ ID NO: 3720133 - DNA, 24 bp, Homo sapiens
taaacaatttattttattttagca

SEQ ID NO: 3720134 - DNA, 18 bp, Homo sapiens
taaacagtgcctgctgaa

SEQ ID NO: 3720135 - DNA, 17 bp, Homo sapiens
taaacatccttcaagaa

SEQ ID NO: 3720136 - DNA, 18 bp, Homo sapiens
taaacattagttctattt

SEQ ID NO: 3720137 - DNA, 20 bp, Homo sapiens
taaaccccacctttattcct

SEQ ID NO: 3720138 - DNA, 17 bp, Homo sapiens
taaacgtgatgatcagc

SEQ ID NO: 3720139 - DNA, 15 bp, Homo sapiens
taaacgtttcagtaa

SEQ ID NO: 3720140 - DNA, 16 bp, Homo sapiens
taaactcaaaatattt

SEQ ID NO: 3720141 - DNA, 21 bp, Homo sapiens
taaactcaaaatatttgtaca

SEQ ID NO: 3720142 - DNA, 13 bp, Homo sapiens
taaactgccctgt

SEQ ID NO: 3720143 - DNA, 19 bp, Homo sapiens
taaactgtactagtctgtg

SEQ ID NO: 3720144 - DNA, 17 bp, Homo sapiens
taaactgtcctctttca

SEQ ID NO: 3720145 - DNA, 18 bp, Homo sapiens
taaactgtcctctttcag

SEQ ID NO: 3720146 - DNA, 20 bp, Homo sapiens
taaactgtgtggactgtgat

SEQ ID NO: 3720147 - DNA, 22 bp, Homo sapiens
taaacttagtgcggacaagttt

SEQ ID NO: 3720148 - DNA, 22 bp, Homo sapiens
taaacttggtttttaaaaaact

SEQ ID NO: 3720149 - DNA, 12 bp, Homo sapiens
taaactttaata

SEQ ID NO: 3720150 - DNA, 15 bp, Homo sapiens
taaactttaatatgt

SEQ ID NO: 3720151 - DNA, 16 bp, Homo sapiens
taaactttcaatatct

SEQ ID NO: 3720152 - DNA, 15 bp, Homo sapiens
taaagaataatatgc

SEQ ID NO: 3720153 - DNA, 17 bp, Homo sapiens
taaagaatcattattta

SEQ ID NO: 3720154 - DNA, 20 bp, Homo sapiens
taaagacaaagacaaattct

SEQ ID NO: 3720155 - DNA, 15 bp, Homo sapiens
taaagacagaggcag

SEQ ID NO: 3720156 - DNA, 21 bp, Homo sapiens
taaagaccctaaatctgagga

SEQ ID NO: 3720157 - DNA, 17 bp, Homo sapiens
taaagacgatttgtcag

SEQ ID NO: 3720158 - DNA, 12 bp, Homo sapiens
taaagagaaact

SEQ ID NO: 3720159 - DNA, 14 bp, Homo sapiens
taaagagaaacttt

SEQ ID NO: 3720160 - DNA, 19 bp, Homo sapiens
taaagagaaactttgtgct

SEQ ID NO: 3720161 - DNA, 12 bp, Homo sapiens
taaagagagaat

SEQ ID NO: 3720162 - DNA, 20 bp, Homo sapiens
taaagagttgtgttgttctt

SEQ ID NO: 3720163 - DNA, 21 bp, Homo sapiens
taaagagttgtgttgttcttt

SEQ ID NO: 3720164 - DNA, 21 bp, Homo sapiens
taaagatgcaaggaccaggac

SEQ ID NO: 3720165 - DNA, 14 bp, Homo sapiens
taaagatttcttga

SEQ ID NO: 3720166 - DNA, 19 bp, Homo sapiens
taaagcagtcacttttcct

SEQ ID NO: 3720167 - DNA, 13 bp, Homo sapiens
taaagcagtggac

SEQ ID NO: 3720168 - DNA, 19 bp, Homo sapiens
taaagcagtggacaccagg

SEQ ID NO: 3720169 - DNA, 15 bp, Homo sapiens
taaagcatctaaact

SEQ ID NO: 3720170 - DNA, 22 bp, Homo sapiens
taaagcatgaatggtatggaac

SEQ ID NO: 3720171 - DNA, 21 bp, Homo sapiens
taaagcctgctttttaagtgt

SEQ ID NO: 3720172 - DNA, 14 bp, Homo sapiens
taaagctgaaaact

SEQ ID NO: 3720173 - DNA, 21 bp, Homo sapiens
taaagctgcctgtagttagga

SEQ ID NO: 3720174 - DNA, 23 bp, Homo sapiens
taaagctgcctgtagttaggaaa

SEQ ID NO: 3720175 - DNA, 19 bp, Homo sapiens
taaagcttgcaacaaaatt

SEQ ID NO: 3720176 - DNA, 17 bp, Homo sapiens
taaaggagaaggcatga

SEQ ID NO: 3720177 - DNA, 21 bp, Homo sapiens
taaagggaaaggattcatgtg

SEQ ID NO: 3720178 - DNA, 19 bp, Homo sapiens
taaagtatatatagaatct

SEQ ID NO: 3720179 - DNA, 17 bp, Homo sapiens
taaagtatatatttatt

SEQ ID NO: 3720180 - DNA, 19 bp, Homo sapiens
taaagtcttgctgtggtct

SEQ ID NO: 3720181 - DNA, 13 bp, Homo sapiens
taaagtgtaacat

SEQ ID NO: 3720182 - DNA, 16 bp, Homo sapiens
taaagttactttgtca

SEQ ID NO: 3720183 - DNA, 20 bp, Homo sapiens
taaataaaagaaatgcacaa

SEQ ID NO: 3720184 - DNA, 20 bp, Homo sapiens
taaataaaagcagcatctgc

SEQ ID NO: 3720185 - DNA, 17 bp, Homo sapiens
taaataaaagtgatcaa

SEQ ID NO: 3720186 - DNA, 14 bp, Homo sapiens
taaataaaataacc

SEQ ID NO: 3720187 - DNA, 20 bp, Homo sapiens
taaataaacacatagattca

SEQ ID NO: 3720188 - DNA, 13 bp, Homo sapiens
taaataaaccctt

SEQ ID NO: 3720189 - DNA, 18 bp, Homo sapiens
taaataaccccattcttt

SEQ ID NO: 3720190 - DNA, 17 bp, Homo sapiens
taaatagaccattaatc

SEQ ID NO: 3720191 - DNA, 22 bp, Homo sapiens
taaatagctatatccatgtact

SEQ ID NO: 3720192 - DNA, 15 bp, Homo sapiens
taaatatatgtatgt

SEQ ID NO: 3720193 - DNA, 22 bp, Homo sapiens
taaatatatttaagataattat

SEQ ID NO: 3720194 - DNA, 17 bp, Homo sapiens
taaatatcttctgattt

SEQ ID NO: 3720195 - DNA, 21 bp, Homo sapiens
taaatatgttagcaaagagtt

SEQ ID NO: 3720196 - DNA, 17 bp, Homo sapiens
taaatatttacatatga

SEQ ID NO: 3720197 - DNA, 13 bp, Homo sapiens
taaatatttcctt

SEQ ID NO: 3720198 - DNA, 14 bp, Homo sapiens
taaatcaatgtcac

SEQ ID NO: 3720199 - DNA, 11 bp, Homo sapiens
taaatcagtgg

SEQ ID NO: 3720200 - DNA, 23 bp, Homo sapiens
taaatcccattcataactttcat

SEQ ID NO: 3720201 - DNA, 17 bp, Homo sapiens
taaatcctgttgaaaag

SEQ ID NO: 3720202 - DNA, 17 bp, Homo sapiens
taaatcctttactgtta

SEQ ID NO: 3720203 - DNA, 16 bp, Homo sapiens
taaatctcctattttt

SEQ ID NO: 3720204 - DNA, 18 bp, Homo sapiens
taaatgaaaatcgtgaca

SEQ ID NO: 3720205 - DNA, 23 bp, Homo sapiens
taaatgaagtttatacagtacag

SEQ ID NO: 3720206 - DNA, 13 bp, Homo sapiens
taaatgaatgttt

SEQ ID NO: 3720207 - DNA, 10 bp, Homo sapiens
taaatgcata

SEQ ID NO: 3720208 - DNA, 20 bp, Homo sapiens
taaatgcatatcctgagcca

SEQ ID NO: 3720209 - DNA, 14 bp, Homo sapiens
taaatgcattatag

SEQ ID NO: 3720210 - DNA, 17 bp, Homo sapiens
taaatgctttatgcaaa

SEQ ID NO: 3720211 - DNA, 17 bp, Homo sapiens
taaatggggctcacaaa

SEQ ID NO: 3720212 - DNA, 16 bp, Homo sapiens
taaatgggtagagaaa

SEQ ID NO: 3720213 - DNA, 17 bp, Homo sapiens
taaatgtacctgatgta

SEQ ID NO: 3720214 - DNA, 20 bp, Homo sapiens
taaatgttgaaagatcaaaa

SEQ ID NO: 3720215 - DNA, 14 bp, Homo sapiens
taaattaaacaatt

SEQ ID NO: 3720216 - DNA, 14 bp, Homo sapiens
taaattaaatatat

SEQ ID NO: 3720217 - DNA, 21 bp, Homo sapiens
taaattaaatatatgtatgta

SEQ ID NO: 3720218 - DNA, 14 bp, Homo sapiens
taaattaggaataa

SEQ ID NO: 3720219 - DNA, 17 bp, Homo sapiens
taaattataacttaaaa

SEQ ID NO: 3720220 - DNA, 17 bp, Homo sapiens
taaattatagtgtagaa

SEQ ID NO: 3720221 - DNA, 17 bp, Homo sapiens
taaattattcagttaag

SEQ ID NO: 3720222 - DNA, 21 bp, Homo sapiens
taaattattcagttaagaaaa

SEQ ID NO: 3720223 - DNA, 20 bp, Homo sapiens
taaattcagatatatttttc

SEQ ID NO: 3720224 - DNA, 15 bp, Homo sapiens
taaattgcatgctgc

SEQ ID NO: 3720225 - DNA, 18 bp, Homo sapiens
taaattgcatgctgcttt

SEQ ID NO: 3720226 - DNA, 19 bp, Homo sapiens
taaattgcatgctgcttta

SEQ ID NO: 3720227 - DNA, 20 bp, Homo sapiens
taaattgcatgctgctttaa

SEQ ID NO: 3720228 - DNA, 15 bp, Homo sapiens
taaattttcttcagt

SEQ ID NO: 3720229 - DNA, 18 bp, Homo sapiens
taaattttcttcagttgg

SEQ ID NO: 3720230 - DNA, 14 bp, Homo sapiens
taaatttttcctta

SEQ ID NO: 3720231 - DNA, 12 bp, Homo sapiens
taacaaattatg

SEQ ID NO: 3720232 - DNA, 22 bp, Homo sapiens
taacaactatgatttggaaaat

SEQ ID NO: 3720233 - DNA, 18 bp, Homo sapiens
taacaagaaactcacccc

SEQ ID NO: 3720234 - DNA, 15 bp, Homo sapiens
taacaagaaaggaga

SEQ ID NO: 3720235 - DNA, 17 bp, Homo sapiens
taacaagaaaggagagt

SEQ ID NO: 3720236 - DNA, 17 bp, Homo sapiens
taacaagatctttcagg

SEQ ID NO: 3720237 - DNA, 19 bp, Homo sapiens
taacaataactactgtgtt

SEQ ID NO: 3720238 - DNA, 24 bp, Homo sapiens
taacaatggaagatttgcccattt

SEQ ID NO: 3720239 - DNA, 20 bp, Homo sapiens
taacacacataaaggataaa

SEQ ID NO: 3720240 - DNA, 22 bp, Homo sapiens
taacacattatcgggagcagtg

SEQ ID NO: 3720241 - DNA, 18 bp, Homo sapiens
taacaccatgattaacca

SEQ ID NO: 3720242 - DNA, 18 bp, Homo sapiens
taacactagtctgtgtgc

SEQ ID NO: 3720243 - DNA, 15 bp, Homo sapiens
taacactgttaagag

SEQ ID NO: 3720244 - DNA, 22 bp, Homo sapiens
taacagcattcttgtcacaata

SEQ ID NO: 3720245 - DNA, 12 bp, Homo sapiens
taacagctgtgg

SEQ ID NO: 3720246 - DNA, 15 bp, Homo sapiens
taccattttctggtt

SEQ ID NO: 3720247 - DNA, 23 bp, Homo sapiens
taccattttggggtacccactgc

SEQ ID NO: 3720248 - DNA, 23 bp, Homo sapiens
tacccacctgagctttggacaca

SEQ ID NO: 3720249 - DNA, 11 bp, Homo sapiens
tacccactgct

SEQ ID NO: 3720250 - DNA, 14 bp, Homo sapiens
tacccactgctctg

SEQ ID NO: 3720251 - DNA, 15 bp, Homo sapiens
tacccagcccatctt

SEQ ID NO: 3720252 - DNA, 22 bp, Homo sapiens
tacccagcccatcttgcctcca

SEQ ID NO: 3720253 - DNA, 16 bp, Homo sapiens
tacccagcgagccctg

SEQ ID NO: 3720254 - DNA, 18 bp, Homo sapiens
tacccatcggtgtccatt

SEQ ID NO: 3720255 - DNA, 16 bp, Homo sapiens
taccccctaagagcca

SEQ ID NO: 3720256 - DNA, 15 bp, Homo sapiens
taccctcccaccccc

SEQ ID NO: 3720257 - DNA, 14 bp, Homo sapiens
tacccttctttcca

SEQ ID NO: 3720258 - DNA, 18 bp, Homo sapiens
taccgagtctcttctcca

SEQ ID NO: 3720259 - DNA, 22 bp, Homo sapiens
tacctaaaaggaaatctcaccc

SEQ ID NO: 3720260 - DNA, 13 bp, Homo sapiens
tacctagatttac

SEQ ID NO: 3720261 - DNA, 17 bp, Homo sapiens
tacctcaacctatggta

SEQ ID NO: 3720262 - DNA, 22 bp, Homo sapiens
tacctcaacctgtaaattattt

SEQ ID NO: 3720263 - DNA, 15 bp, Homo sapiens
tacctcactggggtc

SEQ ID NO: 3720264 - DNA, 12 bp, Homo sapiens
tacctcagccta

SEQ ID NO: 3720265 - DNA, 13 bp, Homo sapiens
tacctcccacctt

SEQ ID NO: 3720266 - DNA, 17 bp, Homo sapiens
tacctctcttatagaat

SEQ ID NO: 3720267 - DNA, 15 bp, Homo sapiens
tacctctgatacctc

SEQ ID NO: 3720268 - DNA, 17 bp, Homo sapiens
tacctctgatacctcaa

SEQ ID NO: 3720269 - DNA, 23 bp, Homo sapiens
tacctcttttagtcattttgctt

SEQ ID NO: 3720270 - DNA, 19 bp, Homo sapiens
tacctgaacacttattgct

SEQ ID NO: 3720271 - DNA, 18 bp, Homo sapiens
tacctgctgccccagctg

SEQ ID NO: 3720272 - DNA, 15 bp, Homo sapiens
tacctgtattcccag

SEQ ID NO: 3720273 - DNA, 20 bp, Homo sapiens
tacctgtgcgttactaattg

SEQ ID NO: 3720274 - DNA, 14 bp, Homo sapiens
taccttcaataaag

SEQ ID NO: 3720275 - DNA, 14 bp, Homo sapiens
tacctttatggttt

SEQ ID NO: 3720276 - DNA, 16 bp, Homo sapiens
tacctttgctcttgca

SEQ ID NO: 3720277 - DNA, 14 bp, Homo sapiens
tacgactttatttt

SEQ ID NO: 3720278 - DNA, 15 bp, Homo sapiens
tacgctctcctttct

SEQ ID NO: 3720279 - DNA, 18 bp, Homo sapiens
tacgtcaaacatgaagtg

SEQ ID NO: 3720280 - DNA, 15 bp, Homo sapiens
tacgtctgacaggca

SEQ ID NO: 3720281 - DNA, 23 bp, Homo sapiens
tactaattaacatataatatatg

SEQ ID NO: 3720282 - DNA, 18 bp, Homo sapiens
tactacagttcttttgtt

SEQ ID NO: 3720283 - DNA, 23 bp, Homo sapiens
tactacagttgttttttgaaaac

SEQ ID NO: 3720284 - DNA, 17 bp, Homo sapiens
tactaccacaaggaaaa

SEQ ID NO: 3720285 - DNA, 17 bp, Homo sapiens
tactactcctgtaggaa

SEQ ID NO: 3720286 - DNA, 22 bp, Homo sapiens
tactactgtggaaaaatattta

SEQ ID NO: 3720287 - DNA, 14 bp, Homo sapiens
tactagatgtcttt

SEQ ID NO: 3720288 - DNA, 19 bp, Homo sapiens
tactagatgtctttaggca

SEQ ID NO: 3720289 - DNA, 17 bp, Homo sapiens
tactagtctgtgtggga

SEQ ID NO: 3720290 - DNA, 20 bp, Homo sapiens
tactatcatgtcaaacgtga

SEQ ID NO: 3720291 - DNA, 13 bp, Homo sapiens
tactatcctggct

SEQ ID NO: 3720292 - DNA, 15 bp, Homo sapiens
tactatggagtacca

SEQ ID NO: 3720293 - DNA, 13 bp, Homo sapiens
tactatgtatcaa

SEQ ID NO: 3720294 - DNA, 14 bp, Homo sapiens
tactattttacttc

SEQ ID NO: 3720295 - DNA, 19 bp, Homo sapiens
tactcaagaggctgaggca

SEQ ID NO: 3720296 - DNA, 20 bp, Homo sapiens
tactcactcaagttcaagga

SEQ ID NO: 3720297 - DNA, 17 bp, Homo sapiens
tactcagaagcctgagg

SEQ ID NO: 3720298 - DNA, 19 bp, Homo sapiens
tactcagaagcctgaggct

SEQ ID NO: 3720299 - DNA, 17 bp, Homo sapiens
tactcagcagccctcct

SEQ ID NO: 3720300 - DNA, 20 bp, Homo sapiens
tactcagcagccctcctcac

SEQ ID NO: 3720301 - DNA, 14 bp, Homo sapiens
tactcagccctggg

SEQ ID NO: 3720302 - DNA, 15 bp, Homo sapiens
tactcagccctgggc

SEQ ID NO: 3720303 - DNA, 15 bp, Homo sapiens
tactcaggaggctga

SEQ ID NO: 3720304 - DNA, 15 bp, Homo sapiens
tactccccttgagct

SEQ ID NO: 3720305 - DNA, 22 bp, Homo sapiens
tactccctcaaagcacacgtca

SEQ ID NO: 3720306 - DNA, 16 bp, Homo sapiens
tactcctgcaaaattt

SEQ ID NO: 3720307 - DNA, 13 bp, Homo sapiens
tactctgtctccc

SEQ ID NO: 3720308 - DNA, 21 bp, Homo sapiens
tactctgtgtcaggtggggca

SEQ ID NO: 3720309 - DNA, 17 bp, Homo sapiens
tactctttgagatagaa

SEQ ID NO: 3720310 - DNA, 14 bp, Homo sapiens
tactctttttgttt

SEQ ID NO: 3720311 - DNA, 23 bp, Homo sapiens
tactgacactttgccagaaagca

SEQ ID NO: 3720312 - DNA, 19 bp, Homo sapiens
tactgagccttgtaattct

SEQ ID NO: 3720313 - DNA, 14 bp, Homo sapiens
tactgagcttctct

SEQ ID NO: 3720314 - DNA, 23 bp, Homo sapiens
tactgagggaccaactgggccca

SEQ ID NO: 3720315 - DNA, 15 bp, Homo sapiens
tactgaggtgctatg

SEQ ID NO: 3720316 - DNA, 18 bp, Homo sapiens
tactgatcatgcattgtt

SEQ ID NO: 3720317 - DNA, 16 bp, Homo sapiens
tactgatggtgcattt

SEQ ID NO: 3720318 - DNA, 14 bp, Homo sapiens
tactgattgtttca

SEQ ID NO: 3720319 - DNA, 22 bp, Homo sapiens
tactgcccggggcagctgccag

SEQ ID NO: 3720320 - DNA, 22 bp, Homo sapiens
tactgcttctaccaactggaag

SEQ ID NO: 3720321 - DNA, 14 bp, Homo sapiens
tactgtacttaata

SEQ ID NO: 3720322 - DNA, 15 bp, Homo sapiens
tactgtcaataaaca

SEQ ID NO: 3720323 - DNA, 16 bp, Homo sapiens
tactgtcaataaacag

SEQ ID NO: 3720324 - DNA, 19 bp, Homo sapiens
tactgtcttaattaagtaa

SEQ ID NO: 3720325 - DNA, 20 bp, Homo sapiens
tactgtggaaaaatatttaa

SEQ ID NO: 3720326 - DNA, 12 bp, Homo sapiens
tactgtgttcct

SEQ ID NO: 3720327 - DNA, 18 bp, Homo sapiens
tacttaaatgaaagcatg

SEQ ID NO: 3720328 - DNA, 13 bp, Homo sapiens
tacttaataaatt

SEQ ID NO: 3720329 - DNA, 20 bp, Homo sapiens
tacttagcttatcaatttgt

SEQ ID NO: 3720330 - DNA, 15 bp, Homo sapiens
tacttattcattgtg

SEQ ID NO: 3720331 - DNA, 17 bp, Homo sapiens
tacttatttttgacagt

SEQ ID NO: 3720332 - DNA, 23 bp, Homo sapiens
tacttcaagttaaagtgaataac

SEQ ID NO: 3720333 - DNA, 19 bp, Homo sapiens
tacttcctatcaagccagt

SEQ ID NO: 3720334 - DNA, 18 bp, Homo sapiens
tacttctccaccctgctc

SEQ ID NO: 3720335 - DNA, 20 bp, Homo sapiens
tacttctccaccctgctctc

SEQ ID NO: 3720336 - DNA, 14 bp, Homo sapiens
tacttcttatacat

SEQ ID NO: 3720337 - DNA, 16 bp, Homo sapiens
tacttgagcccaggag

SEQ ID NO: 3720338 - DNA, 23 bp, Homo sapiens
tacttgatgagtgtaacaagaaa

SEQ ID NO: 3720339 - DNA, 13 bp, Homo sapiens
tacttgtggacac

SEQ ID NO: 3720340 - DNA, 22 bp, Homo sapiens
tactttgtaagtgagagagaca

SEQ ID NO: 3720341 - DNA, 19 bp, Homo sapiens
tactttgtttttaaatgat

SEQ ID NO: 3720342 - DNA, 21 bp, Homo sapiens
tacttttaaacagtgagcctg

SEQ ID NO: 3720343 - DNA, 13 bp, Homo sapiens
tacttttccttcc

SEQ ID NO: 3720344 - DNA, 18 bp, Homo sapiens
tacttttggaatctagaa

SEQ ID NO: 3720345 - DNA, 18 bp, Homo sapiens
tacttttttcttatttaa

SEQ ID NO: 3720346 - DNA, 17 bp, Homo sapiens
tagaaaacaggaaaaaa

SEQ ID NO: 3720347 - DNA, 22 bp, Homo sapiens
tagaaaacaggaaaaaaacttt

SEQ ID NO: 3720348 - DNA, 23 bp, Homo sapiens
tagaaaacaggaaaaaaactttt

SEQ ID NO: 3720349 - DNA, 18 bp, Homo sapiens
tagaaaagaactggaaac

SEQ ID NO: 3720350 - DNA, 22 bp, Homo sapiens
tagaaaatttaaaacattactc

SEQ ID NO: 3720351 - DNA, 23 bp, Homo sapiens
tagaaacttatcttacaaagtgt

SEQ ID NO: 3720352 - DNA, 16 bp, Homo sapiens
tagaaataatatgcat

SEQ ID NO: 3720353 - DNA, 15 bp, Homo sapiens
tagaaatataattga

SEQ ID NO: 3720354 - DNA, 21 bp, Homo sapiens
tagaaatatctgaaaatgtat

SEQ ID NO: 3720355 - DNA, 23 bp, Homo sapiens
tagaaatatctgaaaatgtatgt

SEQ ID NO: 3720356 - DNA, 17 bp, Homo sapiens
tagaaattttacaatag

SEQ ID NO: 3720357 - DNA, 19 bp, Homo sapiens
tagaaatttttcagatgct

SEQ ID NO: 3720358 - DNA, 22 bp, Homo sapiens
tagaaatttttcagatgcttct

SEQ ID NO: 3720359 - DNA, 16 bp, Homo sapiens
tcaaaataaattgaaa

SEQ ID NO: 3720360 - DNA, 16 bp, Homo sapiens
tcaaacaaagccagaa

SEQ ID NO: 3720361 - DNA, 16 bp, Homo sapiens
tcaaacatctggaaaa

SEQ ID NO: 3720362 - DNA, 22 bp, Homo sapiens
tcaaacatgaagtgtgtttcct

SEQ ID NO: 3720363 - DNA, 23 bp, Homo sapiens
tcaaaccccgaccacctgcccaa

SEQ ID NO: 3720364 - DNA, 14 bp, Homo sapiens
tcaaactcttaaaa

SEQ ID NO: 3720365 - DNA, 15 bp, Homo sapiens
tcaaactgatacaga

SEQ ID NO: 3720366 - DNA, 17 bp, Homo sapiens
tcaaactgtagaaatga

SEQ ID NO: 3720367 - DNA, 14 bp, Homo sapiens
tcaaacttccagtc

SEQ ID NO: 3720368 - DNA, 18 bp, Homo sapiens
tcaaataactaaaaggta

SEQ ID NO: 3720369 - DNA, 20 bp, Homo sapiens
tcaaatttgtagggtttcta

SEQ ID NO: 3720370 - DNA, 14 bp, Homo sapiens
tcaacaactactac

SEQ ID NO: 3720371 - DNA, 17 bp, Homo sapiens
tcaacagagaaggcagg

SEQ ID NO: 3720372 - DNA, 19 bp, Homo sapiens
tcaacagagaaggcaggaa

SEQ ID NO: 3720373 - DNA, 14 bp, Homo sapiens
tcaacagggcagca

SEQ ID NO: 3720374 - DNA, 14 bp, Homo sapiens
tcaacatcaatgtt

SEQ ID NO: 3720375 - DNA, 18 bp, Homo sapiens
tcaacatcaatgttcatt

SEQ ID NO: 3720376 - DNA, 19 bp, Homo sapiens
tcaacatcaatgttcattg

SEQ ID NO: 3720377 - DNA, 14 bp, Homo sapiens
tcaacccagaaaca

SEQ ID NO: 3720378 - DNA, 20 bp, Homo sapiens
tcaaccccaccacttctttt

SEQ ID NO: 3720379 - DNA, 19 bp, Homo sapiens
tcaaccccttcgctcctgt

SEQ ID NO: 3720380 - DNA, 23 bp, Homo sapiens
tcaaccctaaaaagcagagcttt

SEQ ID NO: 3720381 - DNA, 15 bp, Homo sapiens
tcaaccctccctcag

SEQ ID NO: 3720382 - DNA, 17 bp, Homo sapiens
tcaaccctccctcagcc

SEQ ID NO: 3720383 - DNA, 17 bp, Homo sapiens
tcaacctgtaaattatt

SEQ ID NO: 3720384 - DNA, 22 bp, Homo sapiens
tcaactgaaagtgtttccttca

SEQ ID NO: 3720385 - DNA, 22 bp, Homo sapiens
tcaactgtctcctacctctgct

SEQ ID NO: 3720386 - DNA, 14 bp, Homo sapiens
tcaactttatgcag

SEQ ID NO: 3720387 - DNA, 18 bp, Homo sapiens
tcaagaaactgaggaatt

SEQ ID NO: 3720388 - DNA, 18 bp, Homo sapiens
tcaagaaagccagtctta

SEQ ID NO: 3720389 - DNA, 23 bp, Homo sapiens
tcaagaagaagatggattggtgt

SEQ ID NO: 3720390 - DNA, 15 bp, Homo sapiens
tcaagaccagcctgg

SEQ ID NO: 3720391 - DNA, 16 bp, Homo sapiens
tcaagacccctgtctt

SEQ ID NO: 3720392 - DNA, 17 bp, Homo sapiens
tcaagatgtcagactgg

SEQ ID NO: 3720393 - DNA, 13 bp, Homo sapiens
tcaagattttgaa

SEQ ID NO: 3720394 - DNA, 19 bp, Homo sapiens
tcaagcaatcctcctgagt

SEQ ID NO: 3720395 - DNA, 19 bp, Homo sapiens
tcaagcagtctacccacct

SEQ ID NO: 3720396 - DNA, 20 bp, Homo sapiens
tcaagcagtctacccacctc

SEQ ID NO: 3720397 - DNA, 18 bp, Homo sapiens
tcaagcatctcctgagga

SEQ ID NO: 3720398 - DNA, 22 bp, Homo sapiens
tcaagcatctcctgaggatcag

SEQ ID NO: 3720399 - DNA, 14 bp, Homo sapiens
tcaagccaagcagc

SEQ ID NO: 3720400 - DNA, 13 bp, Homo sapiens
tcaagccctgcag

SEQ ID NO: 3720401 - DNA, 17 bp, Homo sapiens
tcaagccgcatcccaga

SEQ ID NO: 3720402 - DNA, 16 bp, Homo sapiens
tcaagcgattcttctg

SEQ ID NO: 3720403 - DNA, 18 bp, Homo sapiens
tcaagcgattcttctgct

SEQ ID NO: 3720404 - DNA, 13 bp, Homo sapiens
tcaagctaataaa

SEQ ID NO: 3720405 - DNA, 18 bp, Homo sapiens
tcaaggacttgaaagcat

SEQ ID NO: 3720406 - DNA, 16 bp, Homo sapiens
tcaagggggactgtct

SEQ ID NO: 3720407 - DNA, 16 bp, Homo sapiens
tcaaggtgctgttgtc

SEQ ID NO: 3720408 - DNA, 23 bp, Homo sapiens
tcaagtaagaagacatgaaccaa

SEQ ID NO: 3720409 - DNA, 15 bp, Homo sapiens
tcaagtaattgtgaa

SEQ ID NO: 3720410 - DNA, 16 bp, Homo sapiens
tcaagtattggcaaag

SEQ ID NO: 3720411 - DNA, 15 bp, Homo sapiens
tcaagtcacctcctt

SEQ ID NO: 3720412 - DNA, 14 bp, Homo sapiens
tcaagtctctgctg

SEQ ID NO: 3720413 - DNA, 17 bp, Homo sapiens
tcaagtctctgctggcc

SEQ ID NO: 3720414 - DNA, 17 bp, Homo sapiens
tcaagtctgtgcctgga

SEQ ID NO: 3720415 - DNA, 21 bp, Homo sapiens
tcaagtctgtgcctggagctc

SEQ ID NO: 3720416 - DNA, 12 bp, Homo sapiens
tcaagtcttccc

SEQ ID NO: 3720417 - DNA, 17 bp, Homo sapiens
tcaagtgattctcctgc

SEQ ID NO: 3720418 - DNA, 21 bp, Homo sapiens
tcaagtgcatgctctctgcag

SEQ ID NO: 3720419 - DNA, 14 bp, Homo sapiens
tcaagttaaagtga

SEQ ID NO: 3720420 - DNA, 21 bp, Homo sapiens
tcaagttattgacaaactctc

SEQ ID NO: 3720421 - DNA, 21 bp, Homo sapiens
tcaagttgggagcctgaaata

SEQ ID NO: 3720422 - DNA, 18 bp, Homo sapiens
tcaagtttccaagcaaat

SEQ ID NO: 3720423 - DNA, 19 bp, Homo sapiens
tcaagtttccaagcaaatg

SEQ ID NO: 3720424 - DNA, 13 bp, Homo sapiens
tcaataaaatcat

SEQ ID NO: 3720425 - DNA, 12 bp, Homo sapiens
tcaataaacagc

SEQ ID NO: 3720426 - DNA, 12 bp, Homo sapiens
tcaataaagtat

SEQ ID NO: 3720427 - DNA, 13 bp, Homo sapiens
tcaataaagtatc

SEQ ID NO: 3720428 - DNA, 14 bp, Homo sapiens
tcaataacgaagtt

SEQ ID NO: 3720429 - DNA, 22 bp, Homo sapiens
tcaatatgaaggaaatgaacca

SEQ ID NO: 3720430 - DNA, 10 bp, Homo sapiens
tcaatattta

SEQ ID NO: 3720431 - DNA, 16 bp, Homo sapiens
tcaatattttccatga

SEQ ID NO: 3720432 - DNA, 15 bp, Homo sapiens
tcaatcccctcattc

SEQ ID NO: 3720433 - DNA, 20 bp, Homo sapiens
tcaatcccctcattcaggaa

SEQ ID NO: 3720434 - DNA, 22 bp, Homo sapiens
tcaatcccctcattcaggaaaa

SEQ ID NO: 3720435 - DNA, 14 bp, Homo sapiens
tcaatcctctaagc

SEQ ID NO: 3720436 - DNA, 17 bp, Homo sapiens
tcaatggtttgcaagga

SEQ ID NO: 3720437 - DNA, 18 bp, Homo sapiens
tcaatggtttgcaaggaa

SEQ ID NO: 3720438 - DNA, 22 bp, Homo sapiens
tcaatgtttatgcaaggaagga

SEQ ID NO: 3720439 - DNA, 13 bp, Homo sapiens
tcaattaaatgta

SEQ ID NO: 3720440 - DNA, 16 bp, Homo sapiens
tcaattaaatgtaggt

SEQ ID NO: 3720441 - DNA, 13 bp, Homo sapiens
tcaattaccacac

SEQ ID NO: 3720442 - DNA, 16 bp, Homo sapiens
tcaattcatatttatg

SEQ ID NO: 3720443 - DNA, 16 bp, Homo sapiens
tcaatttattgcacaa

SEQ ID NO: 3720444 - DNA, 18 bp, Homo sapiens
tcaatttgtcattttgaa

SEQ ID NO: 3720445 - DNA, 14 bp, Homo sapiens
tcaattttctttaa

SEQ ID NO: 3720446 - DNA, 14 bp, Homo sapiens
tcacaaaattttat

SEQ ID NO: 3720447 - DNA, 12 bp, Homo sapiens
tcacaaaggaat

SEQ ID NO: 3720448 - DNA, 13 bp, Homo sapiens
tcacaacccatct

SEQ ID NO: 3720449 - DNA, 13 bp, Homo sapiens
tcacaagctgcct

SEQ ID NO: 3720450 - DNA, 22 bp, Homo sapiens
tcacaagctgcctccctgtcca

SEQ ID NO: 3720451 - DNA, 16 bp, Homo sapiens
tcacaagtgaaaaaca

SEQ ID NO: 3720452 - DNA, 16 bp, Homo sapiens
tcacaatagaaactca

SEQ ID NO: 3720453 - DNA, 19 bp, Homo sapiens
tcacacaatacaataagtt

SEQ ID NO: 3720454 - DNA, 10 bp, Homo sapiens
tcacacacac

SEQ ID NO: 3720455 - DNA, 20 bp, Homo sapiens
tcacacacaggcaactgagg

SEQ ID NO: 3720456 - DNA, 21 bp, Homo sapiens
tcacacacaggcaactgaggc

SEQ ID NO: 3720457 - DNA, 22 bp, Homo sapiens
tcacacagtattacttctgcta

SEQ ID NO: 3720458 - DNA, 19 bp, Homo sapiens
tcacacctgtaatcccaac

SEQ ID NO: 3720459 - DNA, 18 bp, Homo sapiens
tcacactgcaagagcctt

SEQ ID NO: 3720460 - DNA, 20 bp, Homo sapiens
tcacactgcaagagccttgg

SEQ ID NO: 3720461 - DNA, 18 bp, Homo sapiens
tcacacttccaccagcct

SEQ ID NO: 3720462 - DNA, 14 bp, Homo sapiens
tcacagaaatcaga

SEQ ID NO: 3720463 - DNA, 12 bp, Homo sapiens
tcacagaggctt

SEQ ID NO: 3720464 - DNA, 16 bp, Homo sapiens
tcacagccacttggga

SEQ ID NO: 3720465 - DNA, 19 bp, Homo sapiens
tcacagcttcagccaggag

SEQ ID NO: 3720466 - DNA, 23 bp, Homo sapiens
tcacaggactctgcctcctcttc

SEQ ID NO: 3720467 - DNA, 11 bp, Homo sapiens
tcacaggcagg

SEQ ID NO: 3720468 - DNA, 16 bp, Homo sapiens
tcacaggcaggtccag

SEQ ID NO: 3720469 - DNA, 17 bp, Homo sapiens
tcacaggcaggtccagg

SEQ ID NO: 3720470 - DNA, 17 bp, Homo sapiens
tcacagggccccagaag

SEQ ID NO: 3720471 - DNA, 21 bp, Homo sapiens
tcacagtctctttaatcttca

SEQ ID NO: 3720472 - DNA, 23 bp, Homo sapiens
tcacagtctctttaatcttcagt

SEQ ID NO: 3720473 - DNA, 17 bp, Homo sapiens
tcatgggttatgtgtat

SEQ ID NO: 3720474 - DNA, 12 bp, Homo sapiens
tcatgtacattt

SEQ ID NO: 3720475 - DNA, 19 bp, Homo sapiens
tcatgtagcaatcagattt

SEQ ID NO: 3720476 - DNA, 19 bp, Homo sapiens
tcatgtggaatataaagat

SEQ ID NO: 3720477 - DNA, 18 bp, Homo sapiens
tcatgttaatcctagctg

SEQ ID NO: 3720478 - DNA, 11 bp, Homo sapiens
tcatgtttctt

SEQ ID NO: 3720479 - DNA, 16 bp, Homo sapiens
tcatgtttcttaaatg

SEQ ID NO: 3720480 - DNA, 21 bp, Homo sapiens
tcattaaaataaataaatgca

SEQ ID NO: 3720481 - DNA, 15 bp, Homo sapiens
tcattaaatggggct

SEQ ID NO: 3720482 - DNA, 13 bp, Homo sapiens
tcattataaacgt

SEQ ID NO: 3720483 - DNA, 15 bp, Homo sapiens
tcattataaacgtga

SEQ ID NO: 3720484 - DNA, 17 bp, Homo sapiens
tcattattggaattaac

SEQ ID NO: 3720485 - DNA, 18 bp, Homo sapiens
tcattattggaattaacc

SEQ ID NO: 3720486 - DNA, 21 bp, Homo sapiens
tcattattggaattaacctgg

SEQ ID NO: 3720487 - DNA, 16 bp, Homo sapiens
tcattcaaaagttgaa

SEQ ID NO: 3720488 - DNA, 22 bp, Homo sapiens
tcattcaaaagttgaaattaac

SEQ ID NO: 3720489 - DNA, 16 bp, Homo sapiens
tcattcaatacaagtg

SEQ ID NO: 3720490 - DNA, 17 bp, Homo sapiens
tcattcctaacacagca

SEQ ID NO: 3720491 - DNA, 16 bp, Homo sapiens
tcattcctgaaagaaa

SEQ ID NO: 3720492 - DNA, 21 bp, Homo sapiens
tcattcctgaaagaaacagtt

SEQ ID NO: 3720493 - DNA, 12 bp, Homo sapiens
tcattcttctgt

SEQ ID NO: 3720494 - DNA, 20 bp, Homo sapiens
tcattgactatcaaactgaa

SEQ ID NO: 3720495 - DNA, 21 bp, Homo sapiens
tcattgactatcaaactgaag

SEQ ID NO: 3720496 - DNA, 13 bp, Homo sapiens
tcattgatatgaa

SEQ ID NO: 3720497 - DNA, 13 bp, Homo sapiens
tcattgccagtgt

SEQ ID NO: 3720498 - DNA, 18 bp, Homo sapiens
tcattgccagtgtctttc

SEQ ID NO: 3720499 - DNA, 21 bp, Homo sapiens
tcattgccagtgtctttcttt

SEQ ID NO: 3720500 - DNA, 23 bp, Homo sapiens
tcattgggctgttttctcaacaa

SEQ ID NO: 3720501 - DNA, 16 bp, Homo sapiens
tcattgtaatgttact

SEQ ID NO: 3720502 - DNA, 23 bp, Homo sapiens
tcattgtttattaacaaattatg

SEQ ID NO: 3720503 - DNA, 15 bp, Homo sapiens
tcatttatgaaaaga

SEQ ID NO: 3720504 - DNA, 17 bp, Homo sapiens
tcatttatgatacaaaa

SEQ ID NO: 3720505 - DNA, 12 bp, Homo sapiens
tcatttcatcta

SEQ ID NO: 3720506 - DNA, 16 bp, Homo sapiens
tcatttcctgtgtctt

SEQ ID NO: 3720507 - DNA, 16 bp, Homo sapiens
tcatttgaacaactag

SEQ ID NO: 3720508 - DNA, 19 bp, Homo sapiens
tcatttgagcagggctcag

SEQ ID NO: 3720509 - DNA, 20 bp, Homo sapiens
tcatttgctaactagcttgg

SEQ ID NO: 3720510 - DNA, 23 bp, Homo sapiens
tcatttggggtagctagaggaac

SEQ ID NO: 3720511 - DNA, 16 bp, Homo sapiens
tcatttgttattctta

SEQ ID NO: 3720512 - DNA, 18 bp, Homo sapiens
tcattttacccttggctc

SEQ ID NO: 3720513 - DNA, 15 bp, Homo sapiens
tcattttctgcattt

SEQ ID NO: 3720514 - DNA, 17 bp, Homo sapiens
tcattttgaagctaatt

SEQ ID NO: 3720515 - DNA, 19 bp, Homo sapiens
tcatttttagtagagacag

SEQ ID NO: 3720516 - DNA, 13 bp, Homo sapiens
tccaaagagaaaa

SEQ ID NO: 3720517 - DNA, 19 bp, Homo sapiens
tccaaaggaggctggcagg

SEQ ID NO: 3720518 - DNA, 19 bp, Homo sapiens
tccaaatgtcctccagaag

SEQ ID NO: 3720519 - DNA, 13 bp, Homo sapiens
tccaaattcacaa

SEQ ID NO: 3720520 - DNA, 17 bp, Homo sapiens
tccaacaggagctggga

SEQ ID NO: 3720521 - DNA, 18 bp, Homo sapiens
tccaacctaacccctttc

SEQ ID NO: 3720522 - DNA, 14 bp, Homo sapiens
tccaacctggacaa

SEQ ID NO: 3720523 - DNA, 21 bp, Homo sapiens
tccaactccagtactggagct

SEQ ID NO: 3720524 - DNA, 22 bp, Homo sapiens
tccaaggagaaacagagacagg

SEQ ID NO: 3720525 - DNA, 18 bp, Homo sapiens
tccaaggagaccaagtcc

SEQ ID NO: 3720526 - DNA, 19 bp, Homo sapiens
tccaaggagctgagaatag

SEQ ID NO: 3720527 - DNA, 13 bp, Homo sapiens
tccaagtgtgtgt

SEQ ID NO: 3720528 - DNA, 18 bp, Homo sapiens
tccaagtgtgtgtgcgtg

SEQ ID NO: 3720529 - DNA, 19 bp, Homo sapiens
tccaataggaatgctaaca

SEQ ID NO: 3720530 - DNA, 14 bp, Homo sapiens
tccaatcctcactg

SEQ ID NO: 3720531 - DNA, 18 bp, Homo sapiens
tccaatcttgtttccaaa

SEQ ID NO: 3720532 - DNA, 17 bp, Homo sapiens
tccaatttacatactct

SEQ ID NO: 3720533 - DNA, 17 bp, Homo sapiens
tccacaagattcccaga

SEQ ID NO: 3720534 - DNA, 12 bp, Homo sapiens
tccacacacaga

SEQ ID NO: 3720535 - DNA, 15 bp, Homo sapiens
tccacacacagagga

SEQ ID NO: 3720536 - DNA, 23 bp, Homo sapiens
tccacacacagaggaagagcagg

SEQ ID NO: 3720537 - DNA, 19 bp, Homo sapiens
tccacaccctctcccagga

SEQ ID NO: 3720538 - DNA, 20 bp, Homo sapiens
tccacaccctctcccaggac

SEQ ID NO: 3720539 - DNA, 14 bp, Homo sapiens
tccacagctacctc

SEQ ID NO: 3720540 - DNA, 23 bp, Homo sapiens
tccacagcttcccctctctcctc

SEQ ID NO: 3720541 - DNA, 18 bp, Homo sapiens
tccacatccggaggagaa

SEQ ID NO: 3720542 - DNA, 16 bp, Homo sapiens
tccaccaacccatcag

SEQ ID NO: 3720543 - DNA, 14 bp, Homo sapiens
tccaccagcctgca

SEQ ID NO: 3720544 - DNA, 15 bp, Homo sapiens
tccaccagcctgcac

SEQ ID NO: 3720545 - DNA, 13 bp, Homo sapiens
tccacccacctca

SEQ ID NO: 3720546 - DNA, 18 bp, Homo sapiens
tccacccacctcagcctc

SEQ ID NO: 3720547 - DNA, 13 bp, Homo sapiens
tccacccagccca

SEQ ID NO: 3720548 - DNA, 14 bp, Homo sapiens
tccacccagcccat

SEQ ID NO: 3720549 - DNA, 17 bp, Homo sapiens
tccacccagcccattct

SEQ ID NO: 3720550 - DNA, 23 bp, Homo sapiens
tccaccccccagaacctgtcctt

SEQ ID NO: 3720551 - DNA, 21 bp, Homo sapiens
tccaccctgctctccgaccag

SEQ ID NO: 3720552 - DNA, 14 bp, Homo sapiens
tccacccttggcct

SEQ ID NO: 3720553 - DNA, 20 bp, Homo sapiens
tccacccttggcctgtctca

SEQ ID NO: 3720554 - DNA, 15 bp, Homo sapiens
tccaccgctgcctaa

SEQ ID NO: 3720555 - DNA, 17 bp, Homo sapiens
tccacctggccccatgt

SEQ ID NO: 3720556 - DNA, 13 bp, Homo sapiens
tccacctgtctca

SEQ ID NO: 3720557 - DNA, 17 bp, Homo sapiens
tccacctgtctcagcct

SEQ ID NO: 3720558 - DNA, 17 bp, Homo sapiens
tccaccttaaattaaac

SEQ ID NO: 3720559 - DNA, 19 bp, Homo sapiens
tccaccttcccatgccctg

SEQ ID NO: 3720560 - DNA, 18 bp, Homo sapiens
tccacgctgtctccagac

SEQ ID NO: 3720561 - DNA, 19 bp, Homo sapiens
tccacgctgtctccagacc

SEQ ID NO: 3720562 - DNA, 20 bp, Homo sapiens
tccacgctgtctccagaccc

SEQ ID NO: 3720563 - DNA, 21 bp, Homo sapiens
tccacggactcaagtttcttc

SEQ ID NO: 3720564 - DNA, 17 bp, Homo sapiens
tccactctaccctccca

SEQ ID NO: 3720565 - DNA, 18 bp, Homo sapiens
tccactctaccctcccac

SEQ ID NO: 3720566 - DNA, 23 bp, Homo sapiens
tccactctaccctcccaccccct

SEQ ID NO: 3720567 - DNA, 10 bp, Homo sapiens
tccactggac

SEQ ID NO: 3720568 - DNA, 12 bp, Homo sapiens
tccactggactt

SEQ ID NO: 3720569 - DNA, 17 bp, Homo sapiens
tccactggacttgagct

SEQ ID NO: 3720570 - DNA, 22 bp, Homo sapiens
tccactgtgccatgtgccaggt

SEQ ID NO: 3720571 - DNA, 22 bp, Homo sapiens
tccactgtttattcaacaacta

SEQ ID NO: 3720572 - DNA, 21 bp, Homo sapiens
tccacttagaaattgcatttc

SEQ ID NO: 3720573 - DNA, 22 bp, Homo sapiens
tccagaagtttgagatcagcct

SEQ ID NO: 3720574 - DNA, 24 bp, Homo sapiens
tccagacaaaccagaagcaacaga

SEQ ID NO: 3720575 - DNA, 16 bp, Homo sapiens
tccagacccccacccc

SEQ ID NO: 3720576 - DNA, 20 bp, Homo sapiens
tccagacccccaccccttcc

SEQ ID NO: 3720577 - DNA, 22 bp, Homo sapiens
tccagacccccaccccttcccc

SEQ ID NO: 3720578 - DNA, 23 bp, Homo sapiens
tccagacccctggcttttcactg

SEQ ID NO: 3720579 - DNA, 14 bp, Homo sapiens
tccagacccggctg

SEQ ID NO: 3720580 - DNA, 18 bp, Homo sapiens
tccagacccggctgcgtg

SEQ ID NO: 3720581 - DNA, 14 bp, Homo sapiens
tccagagactggga

SEQ ID NO: 3720582 - DNA, 15 bp, Homo sapiens
tccagagagtggctc

SEQ ID NO: 3720583 - DNA, 16 bp, Homo sapiens
tccagagagtggctcc

SEQ ID NO: 3720584 - DNA, 20 bp, Homo sapiens
tccagaggctattattttca

SEQ ID NO: 3720585 - DNA, 15 bp, Homo sapiens
tccagatctgcaccg

SEQ ID NO: 3720586 - DNA, 19 bp, Homo sapiens
tcctctcccctctaaggcc

SEQ ID NO: 3720587 - DNA, 17 bp, Homo sapiens
tcctctctaacctcctt

SEQ ID NO: 3720588 - DNA, 14 bp, Homo sapiens
tcctctgccacctc

SEQ ID NO: 3720589 - DNA, 9 bp, Homo sapiens
tcctctggc

SEQ ID NO: 3720590 - DNA, 13 bp, Homo sapiens
tcctctgtccagg

SEQ ID NO: 3720591 - DNA, 19 bp, Homo sapiens
tcctcttctattttgtaaa

SEQ ID NO: 3720592 - DNA, 11 bp, Homo sapiens
tcctctttcca

SEQ ID NO: 3720593 - DNA, 21 bp, Homo sapiens
tcctctttttccatcataatt

SEQ ID NO: 3720594 - DNA, 19 bp, Homo sapiens
tcctgaatgaaatatcaga

SEQ ID NO: 3720595 - DNA, 21 bp, Homo sapiens
tcctgacggcgcccccagtgt

SEQ ID NO: 3720596 - DNA, 23 bp, Homo sapiens
tcctgagccagtgtcaggaggaa

SEQ ID NO: 3720597 - DNA, 19 bp, Homo sapiens
tcctgagcttggccagaag

SEQ ID NO: 3720598 - DNA, 15 bp, Homo sapiens
tcctgaggatcagaa

SEQ ID NO: 3720599 - DNA, 18 bp, Homo sapiens
tcctgaggatcagaaagt

SEQ ID NO: 3720600 - DNA, 16 bp, Homo sapiens
tcctgaggggcatctg

SEQ ID NO: 3720601 - DNA, 19 bp, Homo sapiens
tcctgaggggcatctgccc

SEQ ID NO: 3720602 - DNA, 22 bp, Homo sapiens
tcctgatgacccaggctgcctg

SEQ ID NO: 3720603 - DNA, 19 bp, Homo sapiens
tcctgcaaaattttatagc

SEQ ID NO: 3720604 - DNA, 16 bp, Homo sapiens
tcctgcagcagagcct

SEQ ID NO: 3720605 - DNA, 17 bp, Homo sapiens
tcctgcagcctggaggc

SEQ ID NO: 3720606 - DNA, 22 bp, Homo sapiens
tcctgcattcacccagacagct

SEQ ID NO: 3720607 - DNA, 13 bp, Homo sapiens
tcctgccaggcat

SEQ ID NO: 3720608 - DNA, 14 bp, Homo sapiens
tcctgcccaggaga

SEQ ID NO: 3720609 - DNA, 19 bp, Homo sapiens
tcctgcccaggagagccag

SEQ ID NO: 3720610 - DNA, 14 bp, Homo sapiens
tcctgcccagtgtt

SEQ ID NO: 3720611 - DNA, 20 bp, Homo sapiens
tcctgcccccacacctggcc

SEQ ID NO: 3720612 - DNA, 13 bp, Homo sapiens
tcctgcctcagcc

SEQ ID NO: 3720613 - DNA, 16 bp, Homo sapiens
tcctgcctcagcctcc

SEQ ID NO: 3720614 - DNA, 19 bp, Homo sapiens
tcctgcctcagcctcccaa

SEQ ID NO: 3720615 - DNA, 17 bp, Homo sapiens
tcctgcctcagcctccg

SEQ ID NO: 3720616 - DNA, 20 bp, Homo sapiens
tcctgcctcgaactggctgc

SEQ ID NO: 3720617 - DNA, 21 bp, Homo sapiens
tcctgcctcgaactggctgca

SEQ ID NO: 3720618 - DNA, 16 bp, Homo sapiens
tcctgcctggccaggc

SEQ ID NO: 3720619 - DNA, 17 bp, Homo sapiens
tcctgcctggtctcctg

SEQ ID NO: 3720620 - DNA, 18 bp, Homo sapiens
tcctgctaagttaatgtt

SEQ ID NO: 3720621 - DNA, 22 bp, Homo sapiens
tcctgctatttcccaagctgga

SEQ ID NO: 3720622 - DNA, 19 bp, Homo sapiens
tcctgctctctacccagcc

SEQ ID NO: 3720623 - DNA, 22 bp, Homo sapiens
tcctggaaaggctcagtctcag

SEQ ID NO: 3720624 - DNA, 14 bp, Homo sapiens
tcctggactcattg

SEQ ID NO: 3720625 - DNA, 19 bp, Homo sapiens
tcctggactcattgcttca

SEQ ID NO: 3720626 - DNA, 14 bp, Homo sapiens
tcctggagagtctc

SEQ ID NO: 3720627 - DNA, 15 bp, Homo sapiens
tcctggagcccgagg

SEQ ID NO: 3720628 - DNA, 22 bp, Homo sapiens
tcctggcaatagtgtgttctga

SEQ ID NO: 3720629 - DNA, 23 bp, Homo sapiens
tcctggcaatagtgtgttctgat

SEQ ID NO: 3720630 - DNA, 14 bp, Homo sapiens
tcctggcacccggc

SEQ ID NO: 3720631 - DNA, 16 bp, Homo sapiens
tcctggcacccggccc

SEQ ID NO: 3720632 - DNA, 16 bp, Homo sapiens
tcctggctcagcctca

SEQ ID NO: 3720633 - DNA, 13 bp, Homo sapiens
tcctggctcctga

SEQ ID NO: 3720634 - DNA, 12 bp, Homo sapiens
tcctgggagtga

SEQ ID NO: 3720635 - DNA, 14 bp, Homo sapiens
tcctgggagtgagc

SEQ ID NO: 3720636 - DNA, 13 bp, Homo sapiens
tcctggggcctcg

SEQ ID NO: 3720637 - DNA, 13 bp, Homo sapiens
tcctgggggcctg

SEQ ID NO: 3720638 - DNA, 19 bp, Homo sapiens
tcctgggggcctgacctcc

SEQ ID NO: 3720639 - DNA, 19 bp, Homo sapiens
tcctgggtggtctgcaggc

SEQ ID NO: 3720640 - DNA, 22 bp, Homo sapiens
tcctgggtggtctgcaggcagg

SEQ ID NO: 3720641 - DNA, 21 bp, Homo sapiens
tcctgtacactgaatatttat

SEQ ID NO: 3720642 - DNA, 21 bp, Homo sapiens
tcctgtcccttctcttaattt

SEQ ID NO: 3720643 - DNA, 15 bp, Homo sapiens
tcctgtccgccctct

SEQ ID NO: 3720644 - DNA, 16 bp, Homo sapiens
tcctgtcctcagcttc

SEQ ID NO: 3720645 - DNA, 19 bp, Homo sapiens
tcctgtcggagccctgtct

SEQ ID NO: 3720646 - DNA, 18 bp, Homo sapiens
tcctgtctcccctctgct

SEQ ID NO: 3720647 - DNA, 12 bp, Homo sapiens
tcctgtctgcca

SEQ ID NO: 3720648 - DNA, 16 bp, Homo sapiens
tcctgtctgccagcca

SEQ ID NO: 3720649 - DNA, 17 bp, Homo sapiens
tcctgtctgccagccag

SEQ ID NO: 3720650 - DNA, 16 bp, Homo sapiens
tcctgtgcatgggtga

SEQ ID NO: 3720651 - DNA, 18 bp, Homo sapiens
tcctgtgtaatcatttct

SEQ ID NO: 3720652 - DNA, 23 bp, Homo sapiens
tcctgtgtaatcatttcttgggc

SEQ ID NO: 3720653 - DNA, 23 bp, Homo sapiens
tcctgttagctgttatttctatt

SEQ ID NO: 3720654 - DNA, 17 bp, Homo sapiens
tcctgttgaaaagccat

SEQ ID NO: 3720655 - DNA, 21 bp, Homo sapiens
tcctgttgttgttaatgaaaa

SEQ ID NO: 3720656 - DNA, 13 bp, Homo sapiens
tcctgtttttgtt

SEQ ID NO: 3720657 - DNA, 14 bp, Homo sapiens
tcctgtttttgtta

SEQ ID NO: 3720658 - DNA, 16 bp, Homo sapiens
tccttaaactgtgtgg

SEQ ID NO: 3720659 - DNA, 23 bp, Homo sapiens
tccttaaactgtgtggactgtga

SEQ ID NO: 3720660 - DNA, 14 bp, Homo sapiens
tccttaatgatccg

SEQ ID NO: 3720661 - DNA, 16 bp, Homo sapiens
tccttagctgccaagc

SEQ ID NO: 3720662 - DNA, 22 bp, Homo sapiens
tccttagcttagacctcagcct

SEQ ID NO: 3720663 - DNA, 18 bp, Homo sapiens
tccttcaagttagctcag

SEQ ID NO: 3720664 - DNA, 20 bp, Homo sapiens
tccttcacatcctgtgtttc

SEQ ID NO: 3720665 - DNA, 22 bp, Homo sapiens
tccttcatttctgatatagaat

SEQ ID NO: 3720666 - DNA, 16 bp, Homo sapiens
tccttcccagctgccc

SEQ ID NO: 3720667 - DNA, 17 bp, Homo sapiens
tccttccctcaaagctt

SEQ ID NO: 3720668 - DNA, 16 bp, Homo sapiens
tccttcctcacaccag

SEQ ID NO: 3720669 - DNA, 17 bp, Homo sapiens
tccttcctgtcttcctg

SEQ ID NO: 3720670 - DNA, 19 bp, Homo sapiens
tccttccttgctgtcctag

SEQ ID NO: 3720671 - DNA, 13 bp, Homo sapiens
tccttgataacag

SEQ ID NO: 3720672 - DNA, 22 bp, Homo sapiens
tccttgataatgttgtggtttg

SEQ ID NO: 3720673 - DNA, 22 bp, Homo sapiens
tccttgatttatcacacaaagc

SEQ ID NO: 3720674 - DNA, 21 bp, Homo sapiens
tccttgcacactcccctgcac

SEQ ID NO: 3720675 - DNA, 16 bp, Homo sapiens
tccttgcctcctgtgt

SEQ ID NO: 3720676 - DNA, 19 bp, Homo sapiens
tccttgctgtcctaggcca

SEQ ID NO: 3720677 - DNA, 18 bp, Homo sapiens
tccttggcatgccttcca

SEQ ID NO: 3720678 - DNA, 20 bp, Homo sapiens
tccttggcatgccttccagc

SEQ ID NO: 3720679 - DNA, 22 bp, Homo sapiens
tccttgggaggccccactgggg

SEQ ID NO: 3720680 - DNA, 15 bp, Homo sapiens
tcctttaccctcatc

SEQ ID NO: 3720681 - DNA, 15 bp, Homo sapiens
tcctttcaccacatg

SEQ ID NO: 3720682 - DNA, 21 bp, Homo sapiens
tcctttcagggaatttcagga

SEQ ID NO: 3720683 - DNA, 21 bp, Homo sapiens
tcctttccagtggcctggctc

SEQ ID NO: 3720684 - DNA, 22 bp, Homo sapiens
tcctttccagtggcctggctcc

SEQ ID NO: 3720685 - DNA, 14 bp, Homo sapiens
tcctttctcagccg

SEQ ID NO: 3720686 - DNA, 23 bp, Homo sapiens
tcctttgtttttttttcctgtcc

SEQ ID NO: 3720687 - DNA, 14 bp, Homo sapiens
tcctttttgttatt

SEQ ID NO: 3720688 - DNA, 12 bp, Homo sapiens
tcctttttttcc

SEQ ID NO: 3720689 - DNA, 16 bp, Homo sapiens
tcgaactcctgggctc

SEQ ID NO: 3720690 - DNA, 23 bp, Homo sapiens
tcgaagcgcgccactcgcttccc

SEQ ID NO: 3720691 - DNA, 14 bp, Homo sapiens
tcgaagctcagccc

SEQ ID NO: 3720692 - DNA, 18 bp, Homo sapiens
tcgaagctcagcccaccc

SEQ ID NO: 3720693 - DNA, 17 bp, Homo sapiens
tcgagaccagcctggcc

SEQ ID NO: 3720694 - DNA, 18 bp, Homo sapiens
tcgagaccagcctggcca

SEQ ID NO: 3720695 - DNA, 19 bp, Homo sapiens
tcgagaccagcctggccaa

SEQ ID NO: 3720696 - DNA, 13 bp, Homo sapiens
tcgaggacaggga

SEQ ID NO: 3720697 - DNA, 16 bp, Homo sapiens
tcgaggctgcagtcag

SEQ ID NO: 3720698 - DNA, 20 bp, Homo sapiens
tcgaggctgcagtcagtcat

SEQ ID NO: 3720699 - DNA, 16 bp, Homo sapiens
tgcagcaaccagagca

SEQ ID NO: 3720700 - DNA, 13 bp, Homo sapiens
tgcagcagagcct

SEQ ID NO: 3720701 - DNA, 16 bp, Homo sapiens
tgcagcagcttgctgc

SEQ ID NO: 3720702 - DNA, 20 bp, Homo sapiens
tgcagcagcttgctgcaccc

SEQ ID NO: 3720703 - DNA, 15 bp, Homo sapiens
tgcagcatatgagga

SEQ ID NO: 3720704 - DNA, 17 bp, Homo sapiens
tgcagcatgacctgtga

SEQ ID NO: 3720705 - DNA, 16 bp, Homo sapiens
tgcagccagcccagcc

SEQ ID NO: 3720706 - DNA, 19 bp, Homo sapiens
tgcagccagcccagcccag

SEQ ID NO: 3720707 - DNA, 21 bp, Homo sapiens
tgcagcccgtgtggccccttc

SEQ ID NO: 3720708 - DNA, 19 bp, Homo sapiens
tgcagcctcaacctcctgg

SEQ ID NO: 3720709 - DNA, 19 bp, Homo sapiens
tgcagcctcgaactcctgg

SEQ ID NO: 3720710 - DNA, 22 bp, Homo sapiens
tgcagcctcgaactcctgggct

SEQ ID NO: 3720711 - DNA, 23 bp, Homo sapiens
tgcagcctttgcctccccggctc

SEQ ID NO: 3720712 - DNA, 20 bp, Homo sapiens
tgcagctgattttaacaata

SEQ ID NO: 3720713 - DNA, 22 bp, Homo sapiens
tgcagctgattttaacaataac

SEQ ID NO: 3720714 - DNA, 17 bp, Homo sapiens
tgcaggaataaggcctt

SEQ ID NO: 3720715 - DNA, 15 bp, Homo sapiens
tgcaggacctcaggt

SEQ ID NO: 3720716 - DNA, 18 bp, Homo sapiens
tgcaggctggcaccgcct

SEQ ID NO: 3720717 - DNA, 22 bp, Homo sapiens
tgcaggctggcaccgccttctc

SEQ ID NO: 3720718 - DNA, 23 bp, Homo sapiens
tgcaggctggcaccgccttctct

SEQ ID NO: 3720719 - DNA, 24 bp, Homo sapiens
tgcagggaggaggtggcagccctg

SEQ ID NO: 3720720 - DNA, 16 bp, Homo sapiens
tgcagtagagtcatct

SEQ ID NO: 3720721 - DNA, 22 bp, Homo sapiens
tgcagtagagtcatctccatca

SEQ ID NO: 3720722 - DNA, 15 bp, Homo sapiens
tgcagtctgcttctg

SEQ ID NO: 3720723 - DNA, 19 bp, Homo sapiens
tgcagtgacgtgcacctgt

SEQ ID NO: 3720724 - DNA, 15 bp, Homo sapiens
tgcagtgagccaaga

SEQ ID NO: 3720725 - DNA, 15 bp, Homo sapiens
tgcagttcagcacca

SEQ ID NO: 3720726 - DNA, 18 bp, Homo sapiens
tgcagttcagcaccaccc

SEQ ID NO: 3720727 - DNA, 19 bp, Homo sapiens
tgcagttcagcaccaccct

SEQ ID NO: 3720728 - DNA, 11 bp, Homo sapiens
tgcataaaatg

SEQ ID NO: 3720729 - DNA, 17 bp, Homo sapiens
tgcataaagtcagtgcc

SEQ ID NO: 3720730 - DNA, 15 bp, Homo sapiens
tgcataactgacaaa

SEQ ID NO: 3720731 - DNA, 23 bp, Homo sapiens
tgcataataagctaaagaggctg

SEQ ID NO: 3720732 - DNA, 24 bp, Homo sapiens
tgcataataagctaaagaggctga

SEQ ID NO: 3720733 - DNA, 16 bp, Homo sapiens
tgcatacatacacata

SEQ ID NO: 3720734 - DNA, 12 bp, Homo sapiens
tgcataccaacc

SEQ ID NO: 3720735 - DNA, 18 bp, Homo sapiens
tgcataccaacctgggca

SEQ ID NO: 3720736 - DNA, 13 bp, Homo sapiens
tgcatagaaggag

SEQ ID NO: 3720737 - DNA, 19 bp, Homo sapiens
tgcatagagccacgtatgt

SEQ ID NO: 3720738 - DNA, 19 bp, Homo sapiens
tgcatagttcccatgttaa

SEQ ID NO: 3720739 - DNA, 23 bp, Homo sapiens
tgcatattcttatgtatgtgaaa

SEQ ID NO: 3720740 - DNA, 14 bp, Homo sapiens
tgcatcaatcctgt

SEQ ID NO: 3720741 - DNA, 23 bp, Homo sapiens
tgcatcagaaatgtctggagaat

SEQ ID NO: 3720742 - DNA, 16 bp, Homo sapiens
tgcatcatctgtagat

SEQ ID NO: 3720743 - DNA, 15 bp, Homo sapiens
tgcatcgtttcatct

SEQ ID NO: 3720744 - DNA, 17 bp, Homo sapiens
tgcatcgtttcatcttc

SEQ ID NO: 3720745 - DNA, 14 bp, Homo sapiens
tgcatcttactgaa

SEQ ID NO: 3720746 - DNA, 18 bp, Homo sapiens
tgcatgaaggtttctgaa

SEQ ID NO: 3720747 - DNA, 13 bp, Homo sapiens
tgcatgctgcttt

SEQ ID NO: 3720748 - DNA, 17 bp, Homo sapiens
tgcatgctgctttaatt

SEQ ID NO: 3720749 - DNA, 20 bp, Homo sapiens
tgcatgctgctttaattgtg

SEQ ID NO: 3720750 - DNA, 23 bp, Homo sapiens
tgcatgggttttgtaggtacttt

SEQ ID NO: 3720751 - DNA, 11 bp, Homo sapiens
tgcatgtgtgt

SEQ ID NO: 3720752 - DNA, 14 bp, Homo sapiens
tgcatgtgtgtgct

SEQ ID NO: 3720753 - DNA, 22 bp, Homo sapiens
tgcatgttaggaaaatttcaca

SEQ ID NO: 3720754 - DNA, 15 bp, Homo sapiens
tgcattacagagagg

SEQ ID NO: 3720755 - DNA, 16 bp, Homo sapiens
tgcattacagagagga

SEQ ID NO: 3720756 - DNA, 17 bp, Homo sapiens
tgcattacagagaggag

SEQ ID NO: 3720757 - DNA, 19 bp, Homo sapiens
tgcattagaaatagacagt

SEQ ID NO: 3720758 - DNA, 14 bp, Homo sapiens
tgcattagaaatta

SEQ ID NO: 3720759 - DNA, 15 bp, Homo sapiens
tgcattgagaactgc

SEQ ID NO: 3720760 - DNA, 17 bp, Homo sapiens
tgcattgagaactgcat

SEQ ID NO: 3720761 - DNA, 21 bp, Homo sapiens
tgcattttaaagttaaacatt

SEQ ID NO: 3720762 - DNA, 22 bp, Homo sapiens
tgcattttctgaaactaatgaa

SEQ ID NO: 3720763 - DNA, 16 bp, Homo sapiens
tgcattttctgggttc

SEQ ID NO: 3720764 - DNA, 18 bp, Homo sapiens
tgcattttgcagcagtga

SEQ ID NO: 3720765 - DNA, 16 bp, Homo sapiens
tgcatttttgtgaaat

SEQ ID NO: 3720766 - DNA, 14 bp, Homo sapiens
tgccaaaataatgt

SEQ ID NO: 3720767 - DNA, 21 bp, Homo sapiens
tgccaaaataatgtcttgtta

SEQ ID NO: 3720768 - DNA, 22 bp, Homo sapiens
tgccaaagctagggtggccctt

SEQ ID NO: 3720769 - DNA, 18 bp, Homo sapiens
tgccaaagggaaatatca

SEQ ID NO: 3720770 - DNA, 18 bp, Homo sapiens
tgccaagaactgaaaaca

SEQ ID NO: 3720771 - DNA, 19 bp, Homo sapiens
tgccaagaactgaaaacat

SEQ ID NO: 3720772 - DNA, 15 bp, Homo sapiens
tgccaagcacagtgc

SEQ ID NO: 3720773 - DNA, 18 bp, Homo sapiens
tgccaagccccatcctgc

SEQ ID NO: 3720774 - DNA, 18 bp, Homo sapiens
tgccaataaaagttttct

SEQ ID NO: 3720775 - DNA, 12 bp, Homo sapiens
tgccacacttca

SEQ ID NO: 3720776 - DNA, 16 bp, Homo sapiens
tgccacacttcaggct

SEQ ID NO: 3720777 - DNA, 22 bp, Homo sapiens
tgccacacttcaggctcttctc

SEQ ID NO: 3720778 - DNA, 12 bp, Homo sapiens
tgccacagctct

SEQ ID NO: 3720779 - DNA, 18 bp, Homo sapiens
tgccaccaactggccctc

SEQ ID NO: 3720780 - DNA, 20 bp, Homo sapiens
tgccaccaactggccctctt

SEQ ID NO: 3720781 - DNA, 13 bp, Homo sapiens
tgccaccaggaga

SEQ ID NO: 3720782 - DNA, 17 bp, Homo sapiens
tgccaccaggagaacca

SEQ ID NO: 3720783 - DNA, 22 bp, Homo sapiens
tgccaccaggagaaccactaca

SEQ ID NO: 3720784 - DNA, 18 bp, Homo sapiens
tgccaccatggccagcca

SEQ ID NO: 3720785 - DNA, 12 bp, Homo sapiens
tgccacccacca

SEQ ID NO: 3720786 - DNA, 17 bp, Homo sapiens
tgccacctcccctatcc

SEQ ID NO: 3720787 - DNA, 16 bp, Homo sapiens
tgccacctggggcagt

SEQ ID NO: 3720788 - DNA, 18 bp, Homo sapiens
tgccactaggctgggtgc

SEQ ID NO: 3720789 - DNA, 20 bp, Homo sapiens
tgccactgagagatctgctg

SEQ ID NO: 3720790 - DNA, 13 bp, Homo sapiens
tgccactgcactc

SEQ ID NO: 3720791 - DNA, 17 bp, Homo sapiens
tgccactgcccgagctg

SEQ ID NO: 3720792 - DNA, 19 bp, Homo sapiens
tgccactgcccgagctggt

SEQ ID NO: 3720793 - DNA, 17 bp, Homo sapiens
tgccactgcctcttcct

SEQ ID NO: 3720794 - DNA, 19 bp, Homo sapiens
tgccactgcctcttcctcc

SEQ ID NO: 3720795 - DNA, 23 bp, Homo sapiens
tgccactttggtacatggccagt

SEQ ID NO: 3720796 - DNA, 14 bp, Homo sapiens
tgccagaacagttt

SEQ ID NO: 3720797 - DNA, 19 bp, Homo sapiens
tgccagaacagtttgtaca

SEQ ID NO: 3720798 - DNA, 20 bp, Homo sapiens
tgccagaacagtttgtacag

SEQ ID NO: 3720799 - DNA, 12 bp, Homo sapiens
tgccagacatgt

SEQ ID NO: 3720800 - DNA, 15 bp, Homo sapiens
tgccagagatggagg

SEQ ID NO: 3720801 - DNA, 21 bp, Homo sapiens
tgccagagatggaggttctct

SEQ ID NO: 3720802 - DNA, 11 bp, Homo sapiens
tgccagccagc

SEQ ID NO: 3720803 - DNA, 17 bp, Homo sapiens
tgccagccagcagccag

SEQ ID NO: 3720804 - DNA, 22 bp, Homo sapiens
tgccagccagcagccagctctc

SEQ ID NO: 3720805 - DNA, 12 bp, Homo sapiens
tgccagcctggc

SEQ ID NO: 3720806 - DNA, 10 bp, Homo sapiens
tgccaggcat

SEQ ID NO: 3720807 - DNA, 19 bp, Homo sapiens
tgccagtccccctgcccca

SEQ ID NO: 3720808 - DNA, 15 bp, Homo sapiens
tgccagtgccttacc

SEQ ID NO: 3720809 - DNA, 21 bp, Homo sapiens
tgccagtgccttacctcctgc

SEQ ID NO: 3720810 - DNA, 23 bp, Homo sapiens
tgccagtgccttacctcctgccc

SEQ ID NO: 3720811 - DNA, 13 bp, Homo sapiens
tgccagtgtcttt

SEQ ID NO: 3720812 - DNA, 17 bp, Homo sapiens
tgctaatcttcagggca

SEQ ID NO: 3720813 - DNA, 22 bp, Homo sapiens
tgctaatcttcttatgcaattt

SEQ ID NO: 3720814 - DNA, 22 bp, Homo sapiens
tgctacctcactggggtcctgg

SEQ ID NO: 3720815 - DNA, 18 bp, Homo sapiens
tgctacctgatcccactc

SEQ ID NO: 3720816 - DNA, 14 bp, Homo sapiens
tgctactacaaaaa

SEQ ID NO: 3720817 - DNA, 14 bp, Homo sapiens
tgctactgattgtt

SEQ ID NO: 3720818 - DNA, 22 bp, Homo sapiens
tgctactgtcctacccaccctc

SEQ ID NO: 3720819 - DNA, 18 bp, Homo sapiens
tgctactttgtatcctct

SEQ ID NO: 3720820 - DNA, 18 bp, Homo sapiens
tgctagctatgtgacctt

SEQ ID NO: 3720821 - DNA, 19 bp, Homo sapiens
tgctaggtgggccagcccc

SEQ ID NO: 3720822 - DNA, 20 bp, Homo sapiens
tgctatcaaaataaattgaa

SEQ ID NO: 3720823 - DNA, 12 bp, Homo sapiens
tgctatggggac

SEQ ID NO: 3720824 - DNA, 18 bp, Homo sapiens
tgctatggggagaaaaga

SEQ ID NO: 3720825 - DNA, 19 bp, Homo sapiens
tgctatggggagaaaagac

SEQ ID NO: 3720826 - DNA, 17 bp, Homo sapiens
tgctattttactgtctt

SEQ ID NO: 3720827 - DNA, 18 bp, Homo sapiens
tgctattttactgtctta

SEQ ID NO: 3720828 - DNA, 14 bp, Homo sapiens
tgctcaagaaacaa

SEQ ID NO: 3720829 - DNA, 15 bp, Homo sapiens
tgctcacatatctgt

SEQ ID NO: 3720830 - DNA, 17 bp, Homo sapiens
tgctcacatatctgtca

SEQ ID NO: 3720831 - DNA, 22 bp, Homo sapiens
tgctcacctggggtgtgggagg

SEQ ID NO: 3720832 - DNA, 20 bp, Homo sapiens
tgctcagcttctccaacaat

SEQ ID NO: 3720833 - DNA, 19 bp, Homo sapiens
tgctcaggggcgtgtggct

SEQ ID NO: 3720834 - DNA, 22 bp, Homo sapiens
tgctcatggtccccatggcatg

SEQ ID NO: 3720835 - DNA, 16 bp, Homo sapiens
tgctccaccccactca

SEQ ID NO: 3720836 - DNA, 16 bp, Homo sapiens
tgctccacccttggcc

SEQ ID NO: 3720837 - DNA, 22 bp, Homo sapiens
tgctccacccttggcctgtctc

SEQ ID NO: 3720838 - DNA, 20 bp, Homo sapiens
tgctccagccaacccctgtg

SEQ ID NO: 3720839 - DNA, 22 bp, Homo sapiens
tgctccagccaacccctgtgga

SEQ ID NO: 3720840 - DNA, 16 bp, Homo sapiens
tgctccagctgttcag

SEQ ID NO: 3720841 - DNA, 21 bp, Homo sapiens
tgctccagctgttcagctggt

SEQ ID NO: 3720842 - DNA, 21 bp, Homo sapiens
tgctcccccatcctccccttc

SEQ ID NO: 3720843 - DNA, 23 bp, Homo sapiens
tgctcccccatcctccccttccc

SEQ ID NO: 3720844 - DNA, 14 bp, Homo sapiens
tgctcccctccctc

SEQ ID NO: 3720845 - DNA, 16 bp, Homo sapiens
tgctcccctccctcct

SEQ ID NO: 3720846 - DNA, 20 bp, Homo sapiens
tgctccctaccacctcccca

SEQ ID NO: 3720847 - DNA, 13 bp, Homo sapiens
tgctccctcccct

SEQ ID NO: 3720848 - DNA, 15 bp, Homo sapiens
tgctccctcccctgc

SEQ ID NO: 3720849 - DNA, 17 bp, Homo sapiens
tgctccctcccctgccc

SEQ ID NO: 3720850 - DNA, 20 bp, Homo sapiens
tgctccctcccctgccctgg

SEQ ID NO: 3720851 - DNA, 12 bp, Homo sapiens
tgctcctccagg

SEQ ID NO: 3720852 - DNA, 14 bp, Homo sapiens
tgctcctctcccca

SEQ ID NO: 3720853 - DNA, 18 bp, Homo sapiens
tgctcctctccccagcaa

SEQ ID NO: 3720854 - DNA, 18 bp, Homo sapiens
tgctccttagctgccaag

SEQ ID NO: 3720855 - DNA, 21 bp, Homo sapiens
tgctccttccaacaggagctg

SEQ ID NO: 3720856 - DNA, 23 bp, Homo sapiens
tgctcgattattccctgtacaat

SEQ ID NO: 3720857 - DNA, 17 bp, Homo sapiens
tgctctaagcacacgga

SEQ ID NO: 3720858 - DNA, 20 bp, Homo sapiens
tgctctatctcacagcacac

SEQ ID NO: 3720859 - DNA, 14 bp, Homo sapiens
tgctctcccctgcc

SEQ ID NO: 3720860 - DNA, 23 bp, Homo sapiens
tgctctccgaccagacaccttga

SEQ ID NO: 3720861 - DNA, 22 bp, Homo sapiens
tgctctcctcttgccactgcct

SEQ ID NO: 3720862 - DNA, 18 bp, Homo sapiens
tgctctctacccagccca

SEQ ID NO: 3720863 - DNA, 22 bp, Homo sapiens
tgctctctacccagcccatctt

SEQ ID NO: 3720864 - DNA, 21 bp, Homo sapiens
tgctctctgcagccagcccag

SEQ ID NO: 3720865 - DNA, 19 bp, Homo sapiens
tgctctgatcatccactgt

SEQ ID NO: 3720866 - DNA, 18 bp, Homo sapiens
tgctctgcatgttacata

SEQ ID NO: 3720867 - DNA, 11 bp, Homo sapiens
tgctctgccca

SEQ ID NO: 3720868 - DNA, 16 bp, Homo sapiens
tgctctgctgacagac

SEQ ID NO: 3720869 - DNA, 21 bp, Homo sapiens
tgctctgctgacagacacagg

SEQ ID NO: 3720870 - DNA, 16 bp, Homo sapiens
tgctctggaagagagg

SEQ ID NO: 3720871 - DNA, 17 bp, Homo sapiens
tgctctggacaggcatg

SEQ ID NO: 3720872 - DNA, 12 bp, Homo sapiens
tgctcttagctg

SEQ ID NO: 3720873 - DNA, 19 bp, Homo sapiens
tgctcttgtcctagcttgg

SEQ ID NO: 3720874 - DNA, 15 bp, Homo sapiens
tgctgaaacaggaga

SEQ ID NO: 3720875 - DNA, 17 bp, Homo sapiens
tgctgaaacaggagaga

SEQ ID NO: 3720876 - DNA, 15 bp, Homo sapiens
tgctgaacaaaaaat

SEQ ID NO: 3720877 - DNA, 20 bp, Homo sapiens
tgctgaacaaaaaataaaaa

SEQ ID NO: 3720878 - DNA, 19 bp, Homo sapiens
tgctgaagcttattaatgc

SEQ ID NO: 3720879 - DNA, 15 bp, Homo sapiens
tgctgacctccacag

SEQ ID NO: 3720880 - DNA, 16 bp, Homo sapiens
tgctgacctccacagc

SEQ ID NO: 3720881 - DNA, 22 bp, Homo sapiens
tgctgactgtactcctcccagg

SEQ ID NO: 3720882 - DNA, 22 bp, Homo sapiens
tgctgagagacccaaggaggaa

SEQ ID NO: 3720883 - DNA, 14 bp, Homo sapiens
tgctgagggaccag

SEQ ID NO: 3720884 - DNA, 16 bp, Homo sapiens
tgctgagggaccagcc

SEQ ID NO: 3720885 - DNA, 17 bp, Homo sapiens
tgctgagggaccagcca

SEQ ID NO: 3720886 - DNA, 15 bp, Homo sapiens
tgctgccacacttca

SEQ ID NO: 3720887 - DNA, 14 bp, Homo sapiens
tgctgccatccagg

SEQ ID NO: 3720888 - DNA, 21 bp, Homo sapiens
tgctgccatccaggttcagct

SEQ ID NO: 3720889 - DNA, 22 bp, Homo sapiens
tgctgccatccaggttcagctt

SEQ ID NO: 3720890 - DNA, 17 bp, Homo sapiens
tgctgccgcctcccagc

SEQ ID NO: 3720891 - DNA, 14 bp, Homo sapiens
tgctgcctccccaa

SEQ ID NO: 3720892 - DNA, 19 bp, Homo sapiens
tgctgcctccccaaccctg

SEQ ID NO: 3720893 - DNA, 22 bp, Homo sapiens
tgctgcctccccaaccctgccc

SEQ ID NO: 3720894 - DNA, 21 bp, Homo sapiens
tgctgctaatcttcagggcac

SEQ ID NO: 3720895 - DNA, 18 bp, Homo sapiens
tgctgctattttactgtc

SEQ ID NO: 3720896 - DNA, 21 bp, Homo sapiens
tgctgctattttactgtctta

SEQ ID NO: 3720897 - DNA, 22 bp, Homo sapiens
tgctgctattttactgtcttaa

SEQ ID NO: 3720898 - DNA, 20 bp, Homo sapiens
tgctgctccttagctgccaa

SEQ ID NO: 3720899 - DNA, 20 bp, Homo sapiens
tgctgctgaactaatttctg

SEQ ID NO: 3720900 - DNA, 15 bp, Homo sapiens
tgctgcttccctctg

SEQ ID NO: 3720901 - DNA, 21 bp, Homo sapiens
tgctgcttccctctgcctgtc

SEQ ID NO: 3720902 - DNA, 19 bp, Homo sapiens
tgctgctttaattgtgaat

SEQ ID NO: 3720903 - DNA, 20 bp, Homo sapiens
tgctgcttttccttggggca

SEQ ID NO: 3720904 - DNA, 19 bp, Homo sapiens
tgctggacggcattcctgc

SEQ ID NO: 3720905 - DNA, 20 bp, Homo sapiens
tgctggacggcattcctgct

SEQ ID NO: 3720906 - DNA, 19 bp, Homo sapiens
tgctggactgtcatagaaa

SEQ ID NO: 3720907 - DNA, 17 bp, Homo sapiens
tgctggatattttcaaa

SEQ ID NO: 3720908 - DNA, 18 bp, Homo sapiens
tgctggcacatttcccca

SEQ ID NO: 3720909 - DNA, 12 bp, Homo sapiens
tgctggcccctc

SEQ ID NO: 3720910 - DNA, 22 bp, Homo sapiens
tgctggcccctcacctgggcac

SEQ ID NO: 3720911 - DNA, 24 bp, Homo sapiens
tgctggcccctcacctgggcacct

SEQ ID NO: 3720912 - DNA, 16 bp, Homo sapiens
tgctggccgggcacag

SEQ ID NO: 3720913 - DNA, 19 bp, Homo sapiens
tgctggccgggcacagctg

SEQ ID NO: 3720914 - DNA, 16 bp, Homo sapiens
tgctggctcccagggc

SEQ ID NO: 3720915 - DNA, 14 bp, Homo sapiens
tgctggctgcccag

SEQ ID NO: 3720916 - DNA, 13 bp, Homo sapiens
tgctggctgcctt

SEQ ID NO: 3720917 - DNA, 21 bp, Homo sapiens
tgctggctgccttagaacctt

SEQ ID NO: 3720918 - DNA, 19 bp, Homo sapiens
tgctggctgttggctgggg

SEQ ID NO: 3720919 - DNA, 17 bp, Homo sapiens
tgctgggactggccagg

SEQ ID NO: 3720920 - DNA, 14 bp, Homo sapiens
tgctgggctctcca

SEQ ID NO: 3720921 - DNA, 22 bp, Homo sapiens
tgctgggctctccacctcagcc

SEQ ID NO: 3720922 - DNA, 23 bp, Homo sapiens
tgctgggctctccacctcagcct

SEQ ID NO: 3720923 - DNA, 23 bp, Homo sapiens
tgctggggcaagtccctgactct

SEQ ID NO: 3720924 - DNA, 19 bp, Homo sapiens
tggggtttatcagaattct

SEQ ID NO: 3720925 - DNA, 16 bp, Homo sapiens
tgggtaactagggaag

SEQ ID NO: 3720926 - DNA, 21 bp, Homo sapiens
tgggtatcaccactggagatc

SEQ ID NO: 3720927 - DNA, 22 bp, Homo sapiens
tgggtatcaccactggagatca

SEQ ID NO: 3720928 - DNA, 20 bp, Homo sapiens
tgggtatcctgcccagtgtt

SEQ ID NO: 3720929 - DNA, 13 bp, Homo sapiens
tgggtcaaggaat

SEQ ID NO: 3720930 - DNA, 15 bp, Homo sapiens
tgggtccaggggatg

SEQ ID NO: 3720931 - DNA, 20 bp, Homo sapiens
tgggtccaggggatgggagg

SEQ ID NO: 3720932 - DNA, 21 bp, Homo sapiens
tgggtccaggggatgggaggt

SEQ ID NO: 3720933 - DNA, 20 bp, Homo sapiens
tgggtctgtgtctcttttct

SEQ ID NO: 3720934 - DNA, 22 bp, Homo sapiens
tgggtcttgttttttttttcca

SEQ ID NO: 3720935 - DNA, 17 bp, Homo sapiens
tgggtgacagagcaaga

SEQ ID NO: 3720936 - DNA, 23 bp, Homo sapiens
tgggtgccccccttgccagacat

SEQ ID NO: 3720937 - DNA, 22 bp, Homo sapiens
tgggtggcaccagcagcctgga

SEQ ID NO: 3720938 - DNA, 21 bp, Homo sapiens
tgggtggggctgctcctccag

SEQ ID NO: 3720939 - DNA, 20 bp, Homo sapiens
tgggtggggtgaggaccact

SEQ ID NO: 3720940 - DNA, 22 bp, Homo sapiens
tgggtgtaacaggtctcctctt

SEQ ID NO: 3720941 - DNA, 21 bp, Homo sapiens
tgggtgtcaagagggtctgag

SEQ ID NO: 3720942 - DNA, 23 bp, Homo sapiens
tgggtgtcaagagggtctgagga

SEQ ID NO: 3720943 - DNA, 18 bp, Homo sapiens
tgggttcattattggaat

SEQ ID NO: 3720944 - DNA, 20 bp, Homo sapiens
tgggttcattattggaatta

SEQ ID NO: 3720945 - DNA, 14 bp, Homo sapiens
tgggttgactttca

SEQ ID NO: 3720946 - DNA, 14 bp, Homo sapiens
tgggttttcttccc

SEQ ID NO: 3720947 - DNA, 22 bp, Homo sapiens
tgggtttttgttacctttatgg

SEQ ID NO: 3720948 - DNA, 13 bp, Homo sapiens
tggtaaagatatt

SEQ ID NO: 3720949 - DNA, 22 bp, Homo sapiens
tggtaaagatattattcaccat

SEQ ID NO: 3720950 - DNA, 22 bp, Homo sapiens
tggtaagaagccgggaacagac

SEQ ID NO: 3720951 - DNA, 14 bp, Homo sapiens
tggtaagagaatgt

SEQ ID NO: 3720952 - DNA, 16 bp, Homo sapiens
tggtaagagaatgtta

SEQ ID NO: 3720953 - DNA, 13 bp, Homo sapiens
tggtaagcttcca

SEQ ID NO: 3720954 - DNA, 13 bp, Homo sapiens
tggtaattgttgc

SEQ ID NO: 3720955 - DNA, 22 bp, Homo sapiens
tggtaatttaagattccagaga

SEQ ID NO: 3720956 - DNA, 16 bp, Homo sapiens
tggtactaactttcct

SEQ ID NO: 3720957 - DNA, 21 bp, Homo sapiens
tggtagtctaaccaaatgcat

SEQ ID NO: 3720958 - DNA, 22 bp, Homo sapiens
tggtagtctaaccaaatgcatc

SEQ ID NO: 3720959 - DNA, 18 bp, Homo sapiens
tggtagttagtagcatgt

SEQ ID NO: 3720960 - DNA, 18 bp, Homo sapiens
tggtatgatcacggctca

SEQ ID NO: 3720961 - DNA, 21 bp, Homo sapiens
tggtatgtgacatgcgggctg

SEQ ID NO: 3720962 - DNA, 12 bp, Homo sapiens
tggtatgtgtgt

SEQ ID NO: 3720963 - DNA, 19 bp, Homo sapiens
tggtattcaggattacatg

SEQ ID NO: 3720964 - DNA, 19 bp, Homo sapiens
tggtatttgagacattcca

SEQ ID NO: 3720965 - DNA, 14 bp, Homo sapiens
tggtcaacacttaa

SEQ ID NO: 3720966 - DNA, 18 bp, Homo sapiens
tggtcaccaaatcagctg

SEQ ID NO: 3720967 - DNA, 20 bp, Homo sapiens
tggtcaccaaatcagctgct

SEQ ID NO: 3720968 - DNA, 14 bp, Homo sapiens
tggtcactgccatg

SEQ ID NO: 3720969 - DNA, 15 bp, Homo sapiens
tggtcagatttgaac

SEQ ID NO: 3720970 - DNA, 16 bp, Homo sapiens
tggtcatctttttctc

SEQ ID NO: 3720971 - DNA, 13 bp, Homo sapiens
tggtccctgggag

SEQ ID NO: 3720972 - DNA, 19 bp, Homo sapiens
tggtccctgggaggaaatt

SEQ ID NO: 3720973 - DNA, 20 bp, Homo sapiens
tggtcctaagtccctgcccc

SEQ ID NO: 3720974 - DNA, 15 bp, Homo sapiens
tggtcctcttgccat

SEQ ID NO: 3720975 - DNA, 11 bp, Homo sapiens
tggtcctgggg

SEQ ID NO: 3720976 - DNA, 17 bp, Homo sapiens
tggtctcctgcccccac

SEQ ID NO: 3720977 - DNA, 14 bp, Homo sapiens
tggtctgaatgttc

SEQ ID NO: 3720978 - DNA, 17 bp, Homo sapiens
tggtctgaatgttctga

SEQ ID NO: 3720979 - DNA, 18 bp, Homo sapiens
tggtctgaatgttctgac

SEQ ID NO: 3720980 - DNA, 19 bp, Homo sapiens
tggtctgaatgttctgaca

SEQ ID NO: 3720981 - DNA, 17 bp, Homo sapiens
tggtctgacccactgct

SEQ ID NO: 3720982 - DNA, 14 bp, Homo sapiens
tggtctgcaggcag

SEQ ID NO: 3720983 - DNA, 17 bp, Homo sapiens
tggtcttgagatgtctt

SEQ ID NO: 3720984 - DNA, 14 bp, Homo sapiens
tggtcttgtaagag

SEQ ID NO: 3720985 - DNA, 14 bp, Homo sapiens
tggtgaatttgaat

SEQ ID NO: 3720986 - DNA, 17 bp, Homo sapiens
tggtgacccagtcagag

SEQ ID NO: 3720987 - DNA, 13 bp, Homo sapiens
tggtgacctctgc

SEQ ID NO: 3720988 - DNA, 22 bp, Homo sapiens
tggtgagaactactcagggaat

SEQ ID NO: 3720989 - DNA, 17 bp, Homo sapiens
tggtgcagggcctccat

SEQ ID NO: 3720990 - DNA, 16 bp, Homo sapiens
tggtgcattacagaga

SEQ ID NO: 3720991 - DNA, 19 bp, Homo sapiens
tggtgcattacagagagga

SEQ ID NO: 3720992 - DNA, 20 bp, Homo sapiens
tggtgcctttcctgttcagc

SEQ ID NO: 3720993 - DNA, 20 bp, Homo sapiens
tggtgcgatcatggctcact

SEQ ID NO: 3720994 - DNA, 19 bp, Homo sapiens
tggtgctgctgctgctgtg

SEQ ID NO: 3720995 - DNA, 18 bp, Homo sapiens
tggtgctggatattttca

SEQ ID NO: 3720996 - DNA, 15 bp, Homo sapiens
tggtggcagctgcgg

SEQ ID NO: 3720997 - DNA, 21 bp, Homo sapiens
tggtggcagtgcagcaaccag

SEQ ID NO: 3720998 - DNA, 13 bp, Homo sapiens
tggtggcagtggg

SEQ ID NO: 3720999 - DNA, 18 bp, Homo sapiens
tggtggcagtgggagctg

SEQ ID NO: 3721000 - DNA, 21 bp, Homo sapiens
tggtggcctctgccccgtctc

SEQ ID NO: 3721001 - DNA, 17 bp, Homo sapiens
tggtgggcaccaagagc

SEQ ID NO: 3721002 - DNA, 16 bp, Homo sapiens
tggtgggggcctcggt

SEQ ID NO: 3721003 - DNA, 15 bp, Homo sapiens
tggtgggtgaaagaa

SEQ ID NO: 3721004 - DNA, 21 bp, Homo sapiens
tggtgggtgaaagaaatcatg

SEQ ID NO: 3721005 - DNA, 23 bp, Homo sapiens
tggtgtaacctgagatggccctc

SEQ ID NO: 3721006 - DNA, 14 bp, Homo sapiens
tggtgtacaaaatg

SEQ ID NO: 3721007 - DNA, 17 bp, Homo sapiens
tggtgtccacctggccc

SEQ ID NO: 3721008 - DNA, 18 bp, Homo sapiens
tggtgtccacctggcccc

SEQ ID NO: 3721009 - DNA, 16 bp, Homo sapiens
tggtgtggcaaagcct

SEQ ID NO: 3721010 - DNA, 17 bp, Homo sapiens
tggtgttttaaagagaa

SEQ ID NO: 3721011 - DNA, 21 bp, Homo sapiens
tggtgttttaaagagaatgta

SEQ ID NO: 3721012 - DNA, 23 bp, Homo sapiens
tggttacactgttagaacactat

SEQ ID NO: 3721013 - DNA, 13 bp, Homo sapiens
tggttagaaatgc

SEQ ID NO: 3721014 - DNA, 19 bp, Homo sapiens
tggttagctcagccccagc

SEQ ID NO: 3721015 - DNA, 17 bp, Homo sapiens
tggttatacatgacact

SEQ ID NO: 3721016 - DNA, 22 bp, Homo sapiens
tggttatttagggaactgcttg

SEQ ID NO: 3721017 - DNA, 17 bp, Homo sapiens
tggttatttttatacag

SEQ ID NO: 3721018 - DNA, 19 bp, Homo sapiens
tggttatttttatacagta

SEQ ID NO: 3721019 - DNA, 18 bp, Homo sapiens
tggttcatcagtgttaaa

SEQ ID NO: 3721020 - DNA, 19 bp, Homo sapiens
tggttcctgctagaaatgg

SEQ ID NO: 3721021 - DNA, 23 bp, Homo sapiens
tggttcctggggtgccctccact

SEQ ID NO: 3721022 - DNA, 15 bp, Homo sapiens
tggttgactgggttt

SEQ ID NO: 3721023 - DNA, 15 bp, Homo sapiens
tggttgaggtggaag

SEQ ID NO: 3721024 - DNA, 14 bp, Homo sapiens
tggttgtttcttcc

SEQ ID NO: 3721025 - DNA, 23 bp, Homo sapiens
tggtttaaaagacacacttgtcc

SEQ ID NO: 3721026 - DNA, 16 bp, Homo sapiens
tggtttccaaggagct

SEQ ID NO: 3721027 - DNA, 20 bp, Homo sapiens
tggtttccacgatgaaaaac

SEQ ID NO: 3721028 - DNA, 19 bp, Homo sapiens
tggtttcctcattcctgaa

SEQ ID NO: 3721029 - DNA, 13 bp, Homo sapiens
tggtttccttcct

SEQ ID NO: 3721030 - DNA, 12 bp, Homo sapiens
tggtttctccag

SEQ ID NO: 3721031 - DNA, 17 bp, Homo sapiens
tggtttgagcttagtga

SEQ ID NO: 3721032 - DNA, 15 bp, Homo sapiens
tggtttgcaaggaag

SEQ ID NO: 3721033 - DNA, 16 bp, Homo sapiens
tggttttcctaaatgc

SEQ ID NO: 3721034 - DNA, 22 bp, Homo sapiens
tggttttcctaaatgcagtgaa

SEQ ID NO: 3721035 - DNA, 19 bp, Homo sapiens
tgtaaaaacagcattgctt

SEQ ID NO: 3721036 - DNA, 12 bp, Homo sapiens
tgtggtttcatt

SEQ ID NO: 3721037 - DNA, 18 bp, Homo sapiens
tgtggtttccaaggagct

SEQ ID NO: 3721038 - DNA, 12 bp, Homo sapiens
tgtggtttgttg

SEQ ID NO: 3721039 - DNA, 19 bp, Homo sapiens
tgtggttttcttttgccat

SEQ ID NO: 3721040 - DNA, 13 bp, Homo sapiens
tgtgtaacatatt

SEQ ID NO: 3721041 - DNA, 18 bp, Homo sapiens
tgtgtaactgcccaaagc

SEQ ID NO: 3721042 - DNA, 14 bp, Homo sapiens
tgtgtaagagaatg

SEQ ID NO: 3721043 - DNA, 21 bp, Homo sapiens
tgtgtaataaagtgttttcag

SEQ ID NO: 3721044 - DNA, 22 bp, Homo sapiens
tgtgtaatcatttcttgggccc

SEQ ID NO: 3721045 - DNA, 23 bp, Homo sapiens
tgtgtaatcatttcttgggccct

SEQ ID NO: 3721046 - DNA, 13 bp, Homo sapiens
tgtgtacacatgg

SEQ ID NO: 3721047 - DNA, 21 bp, Homo sapiens
tgtgtacagaattctgctacc

SEQ ID NO: 3721048 - DNA, 19 bp, Homo sapiens
tgtgtacagtgtgtaaagt

SEQ ID NO: 3721049 - DNA, 16 bp, Homo sapiens
tgtgtactctggcctc

SEQ ID NO: 3721050 - DNA, 16 bp, Homo sapiens
tgtgtagggcgggagg

SEQ ID NO: 3721051 - DNA, 14 bp, Homo sapiens
tgtgtatgtgcgtg

SEQ ID NO: 3721052 - DNA, 14 bp, Homo sapiens
tgtgtattgttccc

SEQ ID NO: 3721053 - DNA, 16 bp, Homo sapiens
tgtgtccatgtgtgtg

SEQ ID NO: 3721054 - DNA, 17 bp, Homo sapiens
tgtgtccatgtgtgtgc

SEQ ID NO: 3721055 - DNA, 15 bp, Homo sapiens
tgtgtccctctctct

SEQ ID NO: 3721056 - DNA, 19 bp, Homo sapiens
tgtgtctcctgcatgcaga

SEQ ID NO: 3721057 - DNA, 19 bp, Homo sapiens
tgtgtctgcgtctgtgttg

SEQ ID NO: 3721058 - DNA, 17 bp, Homo sapiens
tgtgtgagcaagcattt

SEQ ID NO: 3721059 - DNA, 17 bp, Homo sapiens
tgtgtgaggagctgctg

SEQ ID NO: 3721060 - DNA, 16 bp, Homo sapiens
tgtgtggactgtgatg

SEQ ID NO: 3721061 - DNA, 19 bp, Homo sapiens
tgtgtggactgtgatgcca

SEQ ID NO: 3721062 - DNA, 17 bp, Homo sapiens
tgtgtggctttcagagc

SEQ ID NO: 3721063 - DNA, 23 bp, Homo sapiens
tgtgtggtttagtgtaaaaatga

SEQ ID NO: 3721064 - DNA, 14 bp, Homo sapiens
tgtgtgtgtatgct

SEQ ID NO: 3721065 - DNA, 14 bp, Homo sapiens
tgtgtgtgtatgtt

SEQ ID NO: 3721066 - DNA, 11 bp, Homo sapiens
tgtgtgtgtgt

SEQ ID NO: 3721067 - DNA, 16 bp, Homo sapiens
tgtgttatttaaatga

SEQ ID NO: 3721068 - DNA, 24 bp, Homo sapiens
tgtgttcctggcaatagtgtgttc

SEQ ID NO: 3721069 - DNA, 15 bp, Homo sapiens
tgtgttcgttcttgt

SEQ ID NO: 3721070 - DNA, 12 bp, Homo sapiens
tgtgttggctgt

SEQ ID NO: 3721071 - DNA, 17 bp, Homo sapiens
tgtgttttcataataaa

SEQ ID NO: 3721072 - DNA, 19 bp, Homo sapiens
tgtgttttgctaaaggaaa

SEQ ID NO: 3721073 - DNA, 18 bp, Homo sapiens
tgtgtttttgggatgtct

SEQ ID NO: 3721074 - DNA, 20 bp, Homo sapiens
tgtgtttttgggatgtctta

SEQ ID NO: 3721075 - DNA, 12 bp, Homo sapiens
tgttaaaataac

SEQ ID NO: 3721076 - DNA, 16 bp, Homo sapiens
tgttaaccagaataaa

SEQ ID NO: 3721077 - DNA, 15 bp, Homo sapiens
tgttaacctcagtgt

SEQ ID NO: 3721078 - DNA, 17 bp, Homo sapiens
tgttaacctcagtgtca

SEQ ID NO: 3721079 - DNA, 19 bp, Homo sapiens
tgttaacctcagtgtcatt

SEQ ID NO: 3721080 - DNA, 23 bp, Homo sapiens
tgttaatcttaggggagagcttt

SEQ ID NO: 3721081 - DNA, 19 bp, Homo sapiens
tgttaatgatagctactgt

SEQ ID NO: 3721082 - DNA, 20 bp, Homo sapiens
tgttaatggtgcaaatccta

SEQ ID NO: 3721083 - DNA, 17 bp, Homo sapiens
tgttaatggtttgaata

SEQ ID NO: 3721084 - DNA, 21 bp, Homo sapiens
tgttacaggcaccgagaatgt

SEQ ID NO: 3721085 - DNA, 15 bp, Homo sapiens
tgttacatagtgtag

SEQ ID NO: 3721086 - DNA, 17 bp, Homo sapiens
tgttactggtgtccagc

SEQ ID NO: 3721087 - DNA, 13 bp, Homo sapiens
tgttagaacacta

SEQ ID NO: 3721088 - DNA, 14 bp, Homo sapiens
tgttagaacactat

SEQ ID NO: 3721089 - DNA, 18 bp, Homo sapiens
tgttagaacactattttc

SEQ ID NO: 3721090 - DNA, 18 bp, Homo sapiens
tgttagagtccaacgtgg

SEQ ID NO: 3721091 - DNA, 14 bp, Homo sapiens
tgttagtagaaatt

SEQ ID NO: 3721092 - DNA, 20 bp, Homo sapiens
tgttatcaaaactttctttt

SEQ ID NO: 3721093 - DNA, 21 bp, Homo sapiens
tgttatgataaaaaattttgt

SEQ ID NO: 3721094 - DNA, 14 bp, Homo sapiens
tgttattgaaaaaa

SEQ ID NO: 3721095 - DNA, 14 bp, Homo sapiens
tgttatttaaagaa

SEQ ID NO: 3721096 - DNA, 15 bp, Homo sapiens
tgttatttaaatgag

SEQ ID NO: 3721097 - DNA, 18 bp, Homo sapiens
tgttattttttaattatt

SEQ ID NO: 3721098 - DNA, 14 bp, Homo sapiens
tgttcagcattctt

SEQ ID NO: 3721099 - DNA, 18 bp, Homo sapiens
tgttcagctccagctcac

SEQ ID NO: 3721100 - DNA, 14 bp, Homo sapiens
tgttcattgtaatg

SEQ ID NO: 3721101 - DNA, 16 bp, Homo sapiens
tgttcattgtaatgtt

SEQ ID NO: 3721102 - DNA, 21 bp, Homo sapiens
tgttcattgtaatgttactga

SEQ ID NO: 3721103 - DNA, 22 bp, Homo sapiens
tgttcattgtaatgttactgat

SEQ ID NO: 3721104 - DNA, 19 bp, Homo sapiens
tgttcatttgttattctta

SEQ ID NO: 3721105 - DNA, 20 bp, Homo sapiens
tgttcatttgttattcttaa

SEQ ID NO: 3721106 - DNA, 14 bp, Homo sapiens
tgttccaagacatt

SEQ ID NO: 3721107 - DNA, 15 bp, Homo sapiens
tgttccaagacattg

SEQ ID NO: 3721108 - DNA, 21 bp, Homo sapiens
tgttcccaccaggctgctcag

SEQ ID NO: 3721109 - DNA, 22 bp, Homo sapiens
tgttcccagtgacacttcagag

SEQ ID NO: 3721110 - DNA, 20 bp, Homo sapiens
tgttcctaagttcttagata

SEQ ID NO: 3721111 - DNA, 14 bp, Homo sapiens
tgttcctggcaata

SEQ ID NO: 3721112 - DNA, 18 bp, Homo sapiens
tgttccttcacatcctgt

SEQ ID NO: 3721113 - DNA, 16 bp, Homo sapiens
tgttctctcttctcca

SEQ ID NO: 3721114 - DNA, 16 bp, Homo sapiens
tgttctctgaggacac

SEQ ID NO: 3721115 - DNA, 15 bp, Homo sapiens
tgttctgacattaac

SEQ ID NO: 3721116 - DNA, 19 bp, Homo sapiens
tgttctgacattaacagtt

SEQ ID NO: 3721117 - DNA, 20 bp, Homo sapiens
tgttctgacattaacagttt

SEQ ID NO: 3721118 - DNA, 14 bp, Homo sapiens
tgttctgggacaca

SEQ ID NO: 3721119 - DNA, 16 bp, Homo sapiens
tgttctgggacacagt

SEQ ID NO: 3721120 - DNA, 13 bp, Homo sapiens
tgttctgttttgt

SEQ ID NO: 3721121 - DNA, 22 bp, Homo sapiens
tgttcttacctgtatgtctcca

SEQ ID NO: 3721122 - DNA, 18 bp, Homo sapiens
tgttcttagtttgcagtt

SEQ ID NO: 3721123 - DNA, 14 bp, Homo sapiens
tgttctttcagaaa

SEQ ID NO: 3721124 - DNA, 22 bp, Homo sapiens
tgttgaaaagccatgtttaaga

SEQ ID NO: 3721125 - DNA, 17 bp, Homo sapiens
tgttgaaaatgttcaga

SEQ ID NO: 3721126 - DNA, 19 bp, Homo sapiens
tgttgaggtggtctgaatg

SEQ ID NO: 3721127 - DNA, 21 bp, Homo sapiens
tgttgaggtggtctgaatgtt

SEQ ID NO: 3721128 - DNA, 12 bp, Homo sapiens
tgttgccagaga

SEQ ID NO: 3721129 - DNA, 13 bp, Homo sapiens
tgttgcccaggct

SEQ ID NO: 3721130 - DNA, 20 bp, Homo sapiens
tgttgcccaggctggcgtgc

SEQ ID NO: 3721131 - DNA, 14 bp, Homo sapiens
tgttgctcagaagt

SEQ ID NO: 3721132 - DNA, 23 bp, Homo sapiens
tgttgctcagcaaggggctctgc

SEQ ID NO: 3721133 - DNA, 14 bp, Homo sapiens
tgttgcttggacta

SEQ ID NO: 3721134 - DNA, 21 bp, Homo sapiens
tgttggaaaagaatacagaaa

SEQ ID NO: 3721135 - DNA, 12 bp, Homo sapiens
tgttggaatgaa

SEQ ID NO: 3721136 - DNA, 14 bp, Homo sapiens
tgttggctagcctc

SEQ ID NO: 3721137 - DNA, 15 bp, Homo sapiens
tgttggtatttatct

SEQ ID NO: 3721138 - DNA, 13 bp, Homo sapiens
tgttgtcagctga

SEQ ID NO: 3721139 - DNA, 16 bp, Homo sapiens
tgttgtcattgcttta

SEQ ID NO: 3721140 - DNA, 20 bp, Homo sapiens
tgttgtcattgctttactgg

SEQ ID NO: 3721141 - DNA, 18 bp, Homo sapiens
tgttgtgaagatgtttgc

SEQ ID NO: 3721142 - DNA, 21 bp, Homo sapiens
tgttgttaatgaaaatgtcag

SEQ ID NO: 3721143 - DNA, 13 bp, Homo sapiens
tgttgttatttaa

SEQ ID NO: 3721144 - DNA, 16 bp, Homo sapiens
tgttgttctttcagaa

SEQ ID NO: 3721145 - DNA, 18 bp, Homo sapiens
tgttgttctttcagaaag

SEQ ID NO: 3721146 - DNA, 12 bp, Homo sapiens
tgttgtttgttt

SEQ ID NO: 3721147 - DNA, 21 bp, Homo sapiens
tgtttaaaaaagtttaaaatg

SEQ ID NO: 3721148 - DNA, 22 bp, Homo sapiens
tgtttaaaaaagtttaaaatgt

SEQ ID NO: 3721149 - DNA, 13 bp, Homo sapiens
tgtttaagattta

SEQ ID NO: 3721150 - DNA, 18 bp, Homo sapiens
ttattgacaataatttca

SEQ ID NO: 3721151 - DNA, 19 bp, Homo sapiens
ttattgagaattttaaatt

SEQ ID NO: 3721152 - DNA, 12 bp, Homo sapiens
ttattgcacaaa

SEQ ID NO: 3721153 - DNA, 15 bp, Homo sapiens
ttattgcccacgctg

SEQ ID NO: 3721154 - DNA, 20 bp, Homo sapiens
ttattgtgtttttaatttat

SEQ ID NO: 3721155 - DNA, 13 bp, Homo sapiens
ttattgttccaag

SEQ ID NO: 3721156 - DNA, 18 bp, Homo sapiens
ttattgttccaagacatt

SEQ ID NO: 3721157 - DNA, 14 bp, Homo sapiens
ttatttaaatttta

SEQ ID NO: 3721158 - DNA, 18 bp, Homo sapiens
ttatttaatgaaagactg

SEQ ID NO: 3721159 - DNA, 14 bp, Homo sapiens
ttatttaattaaaa

SEQ ID NO: 3721160 - DNA, 21 bp, Homo sapiens
ttatttactgagcttctctgt

SEQ ID NO: 3721161 - DNA, 18 bp, Homo sapiens
ttatttagggaactgctt

SEQ ID NO: 3721162 - DNA, 14 bp, Homo sapiens
ttatttatcagtga

SEQ ID NO: 3721163 - DNA, 18 bp, Homo sapiens
ttatttatcagtgacaga

SEQ ID NO: 3721164 - DNA, 14 bp, Homo sapiens
ttatttattaagat

SEQ ID NO: 3721165 - DNA, 11 bp, Homo sapiens
ttatttcagaa

SEQ ID NO: 3721166 - DNA, 15 bp, Homo sapiens
ttatttcagaaatgt

SEQ ID NO: 3721167 - DNA, 17 bp, Homo sapiens
ttatttcagaaatgtac

SEQ ID NO: 3721168 - DNA, 19 bp, Homo sapiens
ttatttcttaaacaaatgt

SEQ ID NO: 3721169 - DNA, 21 bp, Homo sapiens
ttattttaaattataaggact

SEQ ID NO: 3721170 - DNA, 22 bp, Homo sapiens
ttattttaaattataaggactg

SEQ ID NO: 3721171 - DNA, 12 bp, Homo sapiens
ttattttagcag

SEQ ID NO: 3721172 - DNA, 14 bp, Homo sapiens
ttattttcacctgt

SEQ ID NO: 3721173 - DNA, 16 bp, Homo sapiens
ttattttctcctgata

SEQ ID NO: 3721174 - DNA, 21 bp, Homo sapiens
ttattttctggtagatagaaa

SEQ ID NO: 3721175 - DNA, 17 bp, Homo sapiens
ttattttctttgaaatt

SEQ ID NO: 3721176 - DNA, 22 bp, Homo sapiens
ttattttggaaaataaattatt

SEQ ID NO: 3721177 - DNA, 14 bp, Homo sapiens
ttatttttatacag

SEQ ID NO: 3721178 - DNA, 19 bp, Homo sapiens
ttatttttatatagcttga

SEQ ID NO: 3721179 - DNA, 23 bp, Homo sapiens
ttatttttgacagtgttgaaaat

SEQ ID NO: 3721180 - DNA, 18 bp, Homo sapiens
ttattttttaagtattta

SEQ ID NO: 3721181 - DNA, 14 bp, Homo sapiens
ttattttttaatta

SEQ ID NO: 3721182 - DNA, 14 bp, Homo sapiens
ttattttttataca

SEQ ID NO: 3721183 - DNA, 17 bp, Homo sapiens
ttcaaaaatttggaatt

SEQ ID NO: 3721184 - DNA, 16 bp, Homo sapiens
ttcaaaatatgttctt

SEQ ID NO: 3721185 - DNA, 11 bp, Homo sapiens
ttcaaagctga

SEQ ID NO: 3721186 - DNA, 13 bp, Homo sapiens
ttcaaatttcaca

SEQ ID NO: 3721187 - DNA, 14 bp, Homo sapiens
ttcaacatcaatgt

SEQ ID NO: 3721188 - DNA, 15 bp, Homo sapiens
ttcaacatcaatgtt

SEQ ID NO: 3721189 - DNA, 16 bp, Homo sapiens
ttcaacatcaatgttc

SEQ ID NO: 3721190 - DNA, 17 bp, Homo sapiens
ttcaaccattccccatg

SEQ ID NO: 3721191 - DNA, 15 bp, Homo sapiens
ttcaacgcagccctg

SEQ ID NO: 3721192 - DNA, 20 bp, Homo sapiens
ttcaacgcagccctgctttg

SEQ ID NO: 3721193 - DNA, 14 bp, Homo sapiens
ttcaactgaaaaga

SEQ ID NO: 3721194 - DNA, 17 bp, Homo sapiens
ttcaactgaccagcctc

SEQ ID NO: 3721195 - DNA, 14 bp, Homo sapiens
ttcaagaccagcct

SEQ ID NO: 3721196 - DNA, 23 bp, Homo sapiens
ttcaagcatctcctgaggatcag

SEQ ID NO: 3721197 - DNA, 12 bp, Homo sapiens
ttcaaggaatca

SEQ ID NO: 3721198 - DNA, 15 bp, Homo sapiens
ttcaagggaattaaa

SEQ ID NO: 3721199 - DNA, 22 bp, Homo sapiens
ttcaagggaattaaataaataa

SEQ ID NO: 3721200 - DNA, 17 bp, Homo sapiens
ttcaaggtcatttactt

SEQ ID NO: 3721201 - DNA, 16 bp, Homo sapiens
ttcaagtaattgtgaa

SEQ ID NO: 3721202 - DNA, 21 bp, Homo sapiens
ttcaagtctgtgcctggagct

SEQ ID NO: 3721203 - DNA, 17 bp, Homo sapiens
ttcaagttaaattttat

SEQ ID NO: 3721204 - DNA, 16 bp, Homo sapiens
ttcaagttagctcagg

SEQ ID NO: 3721205 - DNA, 23 bp, Homo sapiens
ttcaatctgaagatacatgtctt

SEQ ID NO: 3721206 - DNA, 20 bp, Homo sapiens
ttcaatggtttgcaaggaag

SEQ ID NO: 3721207 - DNA, 22 bp, Homo sapiens
ttcaatggtttgcaaggaagcc

SEQ ID NO: 3721208 - DNA, 23 bp, Homo sapiens
ttcaatggtttgcaaggaagcca

SEQ ID NO: 3721209 - DNA, 16 bp, Homo sapiens
ttcaattcaaaaatgt

SEQ ID NO: 3721210 - DNA, 13 bp, Homo sapiens
ttcaattcctggg

SEQ ID NO: 3721211 - DNA, 14 bp, Homo sapiens
ttcaattcctgggc

SEQ ID NO: 3721212 - DNA, 17 bp, Homo sapiens
ttcaatttattcaagaa

SEQ ID NO: 3721213 - DNA, 19 bp, Homo sapiens
ttcaatttccaagagctga

SEQ ID NO: 3721214 - DNA, 15 bp, Homo sapiens
ttcacaaaatttcca

SEQ ID NO: 3721215 - DNA, 14 bp, Homo sapiens
ttcacaacccatct

SEQ ID NO: 3721216 - DNA, 14 bp, Homo sapiens
ttcacaagctgcct

SEQ ID NO: 3721217 - DNA, 19 bp, Homo sapiens
ttcacaagctgcctccctg

SEQ ID NO: 3721218 - DNA, 21 bp, Homo sapiens
ttcacactgcaagagccttgg

SEQ ID NO: 3721219 - DNA, 23 bp, Homo sapiens
ttcacagctctgtgttgccatgt

SEQ ID NO: 3721220 - DNA, 19 bp, Homo sapiens
ttcacatcctgtgtttcta

SEQ ID NO: 3721221 - DNA, 17 bp, Homo sapiens
ttcacccacagaaagag

SEQ ID NO: 3721222 - DNA, 13 bp, Homo sapiens
ttcacctgtaaaa

SEQ ID NO: 3721223 - DNA, 21 bp, Homo sapiens
ttcacctgtttttaagctgtt

SEQ ID NO: 3721224 - DNA, 23 bp, Homo sapiens
ttcacctgtttttaagctgtttc

SEQ ID NO: 3721225 - DNA, 16 bp, Homo sapiens
ttcaccttgggatgat

SEQ ID NO: 3721226 - DNA, 14 bp, Homo sapiens
ttcactaaagcagt

SEQ ID NO: 3721227 - DNA, 18 bp, Homo sapiens
ttcactataaatggtgtt

SEQ ID NO: 3721228 - DNA, 24 bp, Homo sapiens
ttcactccggtgtgcctgcagccc

SEQ ID NO: 3721229 - DNA, 22 bp, Homo sapiens
ttcactgtagaatgatttcatg

SEQ ID NO: 3721230 - DNA, 19 bp, Homo sapiens
ttcacttgtgttttaaaat

SEQ ID NO: 3721231 - DNA, 12 bp, Homo sapiens
ttcagaaaacag

SEQ ID NO: 3721232 - DNA, 18 bp, Homo sapiens
ttcagaaaacagaaaaaa

SEQ ID NO: 3721233 - DNA, 19 bp, Homo sapiens
ttcagaaaacagaaaaaaa

SEQ ID NO: 3721234 - DNA, 23 bp, Homo sapiens
ttcagaaaacagaaaaaaaacac

SEQ ID NO: 3721235 - DNA, 15 bp, Homo sapiens
ttcagaaagaagtgg

SEQ ID NO: 3721236 - DNA, 20 bp, Homo sapiens
ttcagaacaccaagacttga

SEQ ID NO: 3721237 - DNA, 16 bp, Homo sapiens
ttcagaacctcttccc

SEQ ID NO: 3721238 - DNA, 18 bp, Homo sapiens
ttcagaacctcttcccca

SEQ ID NO: 3721239 - DNA, 19 bp, Homo sapiens
ttcagaacctcttccccag

SEQ ID NO: 3721240 - DNA, 13 bp, Homo sapiens
ttcagaatctgaa

SEQ ID NO: 3721241 - DNA, 17 bp, Homo sapiens
ttcagaatctgaatgta

SEQ ID NO: 3721242 - DNA, 12 bp, Homo sapiens
ttcagactcaga

SEQ ID NO: 3721243 - DNA, 15 bp, Homo sapiens
ttcagagactcaggg

SEQ ID NO: 3721244 - DNA, 20 bp, Homo sapiens
ttcagagactcagggcccca

SEQ ID NO: 3721245 - DNA, 15 bp, Homo sapiens
ttcagagagctggta

SEQ ID NO: 3721246 - DNA, 17 bp, Homo sapiens
ttcagagggaaagtaaa

SEQ ID NO: 3721247 - DNA, 12 bp, Homo sapiens
ttcagatacatg

SEQ ID NO: 3721248 - DNA, 14 bp, Homo sapiens
ttcagatgctttag

SEQ ID NO: 3721249 - DNA, 14 bp, Homo sapiens
ttcagattcccaga

SEQ ID NO: 3721250 - DNA, 21 bp, Homo sapiens
ttcagcaatatttaaggagat

SEQ ID NO: 3721251 - DNA, 16 bp, Homo sapiens
ttcagcaccaccctag

SEQ ID NO: 3721252 - DNA, 20 bp, Homo sapiens
ttcagcattcttagcctgtg

SEQ ID NO: 3721253 - DNA, 15 bp, Homo sapiens
ttcagcccctcctct

SEQ ID NO: 3721254 - DNA, 17 bp, Homo sapiens
ttcagcccctcctctgc

SEQ ID NO: 3721255 - DNA, 19 bp, Homo sapiens
ttcagcccctcctctgcca

SEQ ID NO: 3721256 - DNA, 20 bp, Homo sapiens
ttcagcccctcctctgccac

SEQ ID NO: 3721257 - DNA, 23 bp, Homo sapiens
ttcagcccctcctctgccacctc

SEQ ID NO: 3721258 - DNA, 15 bp, Homo sapiens
ttcagccctcagaat

SEQ ID NO: 3721259 - DNA, 20 bp, Homo sapiens
ttcagcctagccgacctcag

SEQ ID NO: 3721260 - DNA, 23 bp, Homo sapiens
ttcagcctagccgacctcagcct

SEQ ID NO: 3721261 - DNA, 22 bp, Homo sapiens
ttcagctccagctcaccagccc

SEQ ID NO: 3721262 - DNA, 17 bp, Homo sapiens
ttcagctctgcaagaat

SEQ ID NO: 3721263 - DNA, 15 bp, Homo sapiens
ttctccatcctacca

SEQ ID NO: 3721264 - DNA, 23 bp, Homo sapiens
ttctccatgagacacatctcctc

SEQ ID NO: 3721265 - DNA, 15 bp, Homo sapiens
ttctccttagtcttc

SEQ ID NO: 3721266 - DNA, 20 bp, Homo sapiens
ttctccttagtcttctcata

SEQ ID NO: 3721267 - DNA, 17 bp, Homo sapiens
ttctccttgataacagc

SEQ ID NO: 3721268 - DNA, 20 bp, Homo sapiens
ttctctacagacttctccag

SEQ ID NO: 3721269 - DNA, 22 bp, Homo sapiens
ttctctctatggtaaagatatt

SEQ ID NO: 3721270 - DNA, 21 bp, Homo sapiens
ttctctctgcctgtgagccag

SEQ ID NO: 3721271 - DNA, 20 bp, Homo sapiens
ttctctgaggacactaacca

SEQ ID NO: 3721272 - DNA, 16 bp, Homo sapiens
ttctctgcccattccc

SEQ ID NO: 3721273 - DNA, 14 bp, Homo sapiens
ttctctgctccacc

SEQ ID NO: 3721274 - DNA, 12 bp, Homo sapiens
ttctctgcttca

SEQ ID NO: 3721275 - DNA, 15 bp, Homo sapiens
ttctctgcttcagct

SEQ ID NO: 3721276 - DNA, 20 bp, Homo sapiens
ttctctgtgaacgatttaga

SEQ ID NO: 3721277 - DNA, 15 bp, Homo sapiens
ttctcttaatttaat

SEQ ID NO: 3721278 - DNA, 16 bp, Homo sapiens
ttctcttggctggctt

SEQ ID NO: 3721279 - DNA, 17 bp, Homo sapiens
ttctctttggtgtacaa

SEQ ID NO: 3721280 - DNA, 13 bp, Homo sapiens
ttctgaaactaat

SEQ ID NO: 3721281 - DNA, 23 bp, Homo sapiens
ttctgacatcttagtatttgcat

SEQ ID NO: 3721282 - DNA, 23 bp, Homo sapiens
ttctgacattaacagttttccat

SEQ ID NO: 3721283 - DNA, 22 bp, Homo sapiens
ttctgaccacacttcctgtcca

SEQ ID NO: 3721284 - DNA, 18 bp, Homo sapiens
ttctgaccctgcttcaaa

SEQ ID NO: 3721285 - DNA, 21 bp, Homo sapiens
ttctgaccctgcttcaaatat

SEQ ID NO: 3721286 - DNA, 15 bp, Homo sapiens
ttctgacctcagcat

SEQ ID NO: 3721287 - DNA, 18 bp, Homo sapiens
ttctgagaaggtccttaa

SEQ ID NO: 3721288 - DNA, 14 bp, Homo sapiens
ttctgattttatgt

SEQ ID NO: 3721289 - DNA, 20 bp, Homo sapiens
ttctgcatcatctgtagata

SEQ ID NO: 3721290 - DNA, 14 bp, Homo sapiens
ttctgccacataaa

SEQ ID NO: 3721291 - DNA, 19 bp, Homo sapiens
ttctgcccacattggaccc

SEQ ID NO: 3721292 - DNA, 20 bp, Homo sapiens
ttctgcccatcctgtctgtt

SEQ ID NO: 3721293 - DNA, 17 bp, Homo sapiens
ttctgccggccctgggg

SEQ ID NO: 3721294 - DNA, 20 bp, Homo sapiens
ttctgcctttgcagaaacag

SEQ ID NO: 3721295 - DNA, 21 bp, Homo sapiens
ttctgctacctcactggggtc

SEQ ID NO: 3721296 - DNA, 19 bp, Homo sapiens
ttctgctcacatatctgtc

SEQ ID NO: 3721297 - DNA, 17 bp, Homo sapiens
ttctggaatacatgaaa

SEQ ID NO: 3721298 - DNA, 20 bp, Homo sapiens
ttctggaatgtaatcaatgt

SEQ ID NO: 3721299 - DNA, 22 bp, Homo sapiens
ttctggaatgtaatcaatgttt

SEQ ID NO: 3721300 - DNA, 19 bp, Homo sapiens
ttctggctgaacactggca

SEQ ID NO: 3721301 - DNA, 20 bp, Homo sapiens
ttctggtaggaatagcatgt

SEQ ID NO: 3721302 - DNA, 16 bp, Homo sapiens
ttctggttagctcagc

SEQ ID NO: 3721303 - DNA, 19 bp, Homo sapiens
ttctggttagctcagcccc

SEQ ID NO: 3721304 - DNA, 22 bp, Homo sapiens
ttctggttagctcagccccagc

SEQ ID NO: 3721305 - DNA, 17 bp, Homo sapiens
ttctgtaccaaagtgtt

SEQ ID NO: 3721306 - DNA, 20 bp, Homo sapiens
ttctgtagtactccttaaga

SEQ ID NO: 3721307 - DNA, 17 bp, Homo sapiens
ttctgtccgagctttga

SEQ ID NO: 3721308 - DNA, 21 bp, Homo sapiens
ttctgtccgagctttgaaaat

SEQ ID NO: 3721309 - DNA, 17 bp, Homo sapiens
ttctgtcctactctgtg

SEQ ID NO: 3721310 - DNA, 22 bp, Homo sapiens
ttctgtccttttggcactgaga

SEQ ID NO: 3721311 - DNA, 23 bp, Homo sapiens
ttctgtccttttggcactgagat

SEQ ID NO: 3721312 - DNA, 16 bp, Homo sapiens
ttctgtggctcacaga

SEQ ID NO: 3721313 - DNA, 23 bp, Homo sapiens
ttctgtgtatttaattgtaaact

SEQ ID NO: 3721314 - DNA, 14 bp, Homo sapiens
ttctgtttgttaaa

SEQ ID NO: 3721315 - DNA, 17 bp, Homo sapiens
ttctgttttgcctgaag

SEQ ID NO: 3721316 - DNA, 21 bp, Homo sapiens
ttctgttttgcctgaagttgg

SEQ ID NO: 3721317 - DNA, 12 bp, Homo sapiens
ttctgttttgtt

SEQ ID NO: 3721318 - DNA, 20 bp, Homo sapiens
ttctgtttttctaggcctgg

SEQ ID NO: 3721319 - DNA, 14 bp, Homo sapiens
ttcttaaaaagtta

SEQ ID NO: 3721320 - DNA, 14 bp, Homo sapiens
ttcttacatgtttt

SEQ ID NO: 3721321 - DNA, 13 bp, Homo sapiens
ttcttagtgtcac

SEQ ID NO: 3721322 - DNA, 21 bp, Homo sapiens
ttcttatacatttgataaagt

SEQ ID NO: 3721323 - DNA, 19 bp, Homo sapiens
ttcttattctcactccacc

SEQ ID NO: 3721324 - DNA, 22 bp, Homo sapiens
ttcttcacctaagtctctgtga

SEQ ID NO: 3721325 - DNA, 14 bp, Homo sapiens
ttcttcagaagaca

SEQ ID NO: 3721326 - DNA, 17 bp, Homo sapiens
ttcttcagatcagtgct

SEQ ID NO: 3721327 - DNA, 23 bp, Homo sapiens
ttcttcagccacctctctttttc

SEQ ID NO: 3721328 - DNA, 13 bp, Homo sapiens
ttcttcagttggt

SEQ ID NO: 3721329 - DNA, 15 bp, Homo sapiens
ttcttcatgcaatga

SEQ ID NO: 3721330 - DNA, 17 bp, Homo sapiens
ttcttcatgcaatgaca

SEQ ID NO: 3721331 - DNA, 20 bp, Homo sapiens
ttcttcattcaatacaagtg

SEQ ID NO: 3721332 - DNA, 21 bp, Homo sapiens
ttcttcattcaatacaagtgt

SEQ ID NO: 3721333 - DNA, 19 bp, Homo sapiens
ttcttcccatcactggagc

SEQ ID NO: 3721334 - DNA, 16 bp, Homo sapiens
ttcttcccttcaaggt

SEQ ID NO: 3721335 - DNA, 20 bp, Homo sapiens
ttcttcccttttacatactg

SEQ ID NO: 3721336 - DNA, 22 bp, Homo sapiens
ttcttcccttttacatactgct

SEQ ID NO: 3721337 - DNA, 23 bp, Homo sapiens
ttcttcctccctccctctttccc

SEQ ID NO: 3721338 - DNA, 12 bp, Homo sapiens
ttcttcctctgc

SEQ ID NO: 3721339 - DNA, 13 bp, Homo sapiens
ttcttcctctgct

SEQ ID NO: 3721340 - DNA, 23 bp, Homo sapiens
ttcttcgaggtggatcacagagg

SEQ ID NO: 3721341 - DNA, 11 bp, Homo sapiens
ttcttctccct

SEQ ID NO: 3721342 - DNA, 13 bp, Homo sapiens
ttcttctgcttca

SEQ ID NO: 3721343 - DNA, 13 bp, Homo sapiens
ttcttcttcagaa

SEQ ID NO: 3721344 - DNA, 22 bp, Homo sapiens
ttcttcttccaacgtggcccag

SEQ ID NO: 3721345 - DNA, 14 bp, Homo sapiens
ttcttgggccctcc

SEQ ID NO: 3721346 - DNA, 19 bp, Homo sapiens
ttcttgtgaatatgtacat

SEQ ID NO: 3721347 - DNA, 17 bp, Homo sapiens
ttcttgtgatcttgctc

SEQ ID NO: 3721348 - DNA, 14 bp, Homo sapiens
ttcttgttctgttt

SEQ ID NO: 3721349 - DNA, 22 bp, Homo sapiens
ttctttcaagtgaatctaaaag

SEQ ID NO: 3721350 - DNA, 13 bp, Homo sapiens
ttctttcttcctc

SEQ ID NO: 3721351 - DNA, 12 bp, Homo sapiens
ttctttgattat

SEQ ID NO: 3721352 - DNA, 17 bp, Homo sapiens
ttctttgcttgaacaca

SEQ ID NO: 3721353 - DNA, 14 bp, Homo sapiens
ttctttggtgcctt

SEQ ID NO: 3721354 - DNA, 12 bp, Homo sapiens
ttctttgtgtag

SEQ ID NO: 3721355 - DNA, 16 bp, Homo sapiens
ttctttgttacaggca

SEQ ID NO: 3721356 - DNA, 21 bp, Homo sapiens
ttcttttaaaggggcagaaaa

SEQ ID NO: 3721357 - DNA, 21 bp, Homo sapiens
ttcttttctggaatgtaatca

SEQ ID NO: 3721358 - DNA, 21 bp, Homo sapiens
ttcttttgcccttcacagtgt

SEQ ID NO: 3721359 - DNA, 23 bp, Homo sapiens
ttcttttgcccttcacagtgttt

SEQ ID NO: 3721360 - DNA, 16 bp, Homo sapiens
ttctttttatttttta

SEQ ID NO: 3721361 - DNA, 18 bp, Homo sapiens
ttcttttttttcattata

SEQ ID NO: 3721362 - DNA, 22 bp, Homo sapiens
ttgaaaaaagaaattccctgga

SEQ ID NO: 3721363 - DNA, 16 bp, Homo sapiens
ttgaaaacctgacaaa

SEQ ID NO: 3721364 - DNA, 20 bp, Homo sapiens
ttgaaaactacattttaaca

SEQ ID NO: 3721365 - DNA, 22 bp, Homo sapiens
ttgaaaactacattttaacatg

SEQ ID NO: 3721366 - DNA, 13 bp, Homo sapiens
ttgaaaagacatc

SEQ ID NO: 3721367 - DNA, 19 bp, Homo sapiens
ttgaaaagccatgtttaag

SEQ ID NO: 3721368 - DNA, 21 bp, Homo sapiens
ttgaaaagccatgtttaagat

SEQ ID NO: 3721369 - DNA, 17 bp, Homo sapiens
ttgaaagagaaccagtt

SEQ ID NO: 3721370 - DNA, 16 bp, Homo sapiens
ttgaaagcatccatgt

SEQ ID NO: 3721371 - DNA, 15 bp, Homo sapiens
ttgaaataataaatc

SEQ ID NO: 3721372 - DNA, 19 bp, Homo sapiens
ttgaaatataatgcaaacc

SEQ ID NO: 3721373 - DNA, 21 bp, Homo sapiens
ttgaaatttttattaaattat

SEQ ID NO: 3721374 - DNA, 14 bp, Homo sapiens
ttgaacacagtatt

SEQ ID NO: 3721375 - DNA, 19 bp, Homo sapiens
tttcaatttccaagagctg

SEQ ID NO: 3721376 - DNA, 17 bp, Homo sapiens
tttcaattttgcatgct

SEQ ID NO: 3721377 - DNA, 15 bp, Homo sapiens
tttcacattaatatt

SEQ ID NO: 3721378 - DNA, 18 bp, Homo sapiens
tttcacccacagaaagag

SEQ ID NO: 3721379 - DNA, 19 bp, Homo sapiens
tttcacccacagaaagaga

SEQ ID NO: 3721380 - DNA, 15 bp, Homo sapiens
tttcacgggagattt

SEQ ID NO: 3721381 - DNA, 14 bp, Homo sapiens
tttcactgctggct

SEQ ID NO: 3721382 - DNA, 20 bp, Homo sapiens
tttcactgctggctgcctta

SEQ ID NO: 3721383 - DNA, 21 bp, Homo sapiens
tttcagaaagaagtggggaca

SEQ ID NO: 3721384 - DNA, 16 bp, Homo sapiens
tttcagaaatatgtgg

SEQ ID NO: 3721385 - DNA, 18 bp, Homo sapiens
tttcagaacctcttcccc

SEQ ID NO: 3721386 - DNA, 17 bp, Homo sapiens
tttcagaatctgaatgt

SEQ ID NO: 3721387 - DNA, 19 bp, Homo sapiens
tttcagaatctgaatgtaa

SEQ ID NO: 3721388 - DNA, 14 bp, Homo sapiens
tttcagacagggtc

SEQ ID NO: 3721389 - DNA, 21 bp, Homo sapiens
tttcagcagactatgaatatt

SEQ ID NO: 3721390 - DNA, 21 bp, Homo sapiens
tttcaggatactctgtcagat

SEQ ID NO: 3721391 - DNA, 19 bp, Homo sapiens
tttcagggaggtggctggg

SEQ ID NO: 3721392 - DNA, 21 bp, Homo sapiens
tttcagttgatcactggcaat

SEQ ID NO: 3721393 - DNA, 14 bp, Homo sapiens
tttcataaatttga

SEQ ID NO: 3721394 - DNA, 18 bp, Homo sapiens
tttcatctatttctgaga

SEQ ID NO: 3721395 - DNA, 16 bp, Homo sapiens
tttcatctcttgtata

SEQ ID NO: 3721396 - DNA, 13 bp, Homo sapiens
tttcattaaagca

SEQ ID NO: 3721397 - DNA, 14 bp, Homo sapiens
tttcattaaagcat

SEQ ID NO: 3721398 - DNA, 21 bp, Homo sapiens
tttcattaatacagggcattt

SEQ ID NO: 3721399 - DNA, 19 bp, Homo sapiens
tttcattgccagtgtcttt

SEQ ID NO: 3721400 - DNA, 23 bp, Homo sapiens
tttccaaattcacaagttgtgtt

SEQ ID NO: 3721401 - DNA, 18 bp, Homo sapiens
tttccaagcaaatgttac

SEQ ID NO: 3721402 - DNA, 21 bp, Homo sapiens
tttccaagcaaatgttacata

SEQ ID NO: 3721403 - DNA, 18 bp, Homo sapiens
tttccaaggagctgagaa

SEQ ID NO: 3721404 - DNA, 19 bp, Homo sapiens
tttccaaggagctgagaat

SEQ ID NO: 3721405 - DNA, 15 bp, Homo sapiens
tttccactactgcta

SEQ ID NO: 3721406 - DNA, 19 bp, Homo sapiens
tttccagaggctattattt

SEQ ID NO: 3721407 - DNA, 15 bp, Homo sapiens
tttccagtacctttg

SEQ ID NO: 3721408 - DNA, 19 bp, Homo sapiens
tttccagtgagcttatcat

SEQ ID NO: 3721409 - DNA, 14 bp, Homo sapiens
tttccatcataatt

SEQ ID NO: 3721410 - DNA, 13 bp, Homo sapiens
tttccatgggaaa

SEQ ID NO: 3721411 - DNA, 13 bp, Homo sapiens
tttccattattta

SEQ ID NO: 3721412 - DNA, 12 bp, Homo sapiens
tttccccccact

SEQ ID NO: 3721413 - DNA, 17 bp, Homo sapiens
tttccccccactctccc

SEQ ID NO: 3721414 - DNA, 19 bp, Homo sapiens
tttccccccactctcccca

SEQ ID NO: 3721415 - DNA, 20 bp, Homo sapiens
tttccctaagccaagggcct

SEQ ID NO: 3721416 - DNA, 15 bp, Homo sapiens
tttccctactcccca

SEQ ID NO: 3721417 - DNA, 16 bp, Homo sapiens
tttccctattagagaa

SEQ ID NO: 3721418 - DNA, 23 bp, Homo sapiens
tttccctcccttcctctttccat

SEQ ID NO: 3721419 - DNA, 13 bp, Homo sapiens
tttccctgacctc

SEQ ID NO: 3721420 - DNA, 15 bp, Homo sapiens
tttcccttcttctgt

SEQ ID NO: 3721421 - DNA, 17 bp, Homo sapiens
tttcctaaatgcagtga

SEQ ID NO: 3721422 - DNA, 22 bp, Homo sapiens
tttcctaacaggattagacagt

SEQ ID NO: 3721423 - DNA, 23 bp, Homo sapiens
tttcctagccctctcacatttat

SEQ ID NO: 3721424 - DNA, 12 bp, Homo sapiens
tttcctccccag

SEQ ID NO: 3721425 - DNA, 21 bp, Homo sapiens
tttcctcttctattttgtaaa

SEQ ID NO: 3721426 - DNA, 13 bp, Homo sapiens
tttcctgagcttg

SEQ ID NO: 3721427 - DNA, 22 bp, Homo sapiens
tttcctgagcttggccagaagg

SEQ ID NO: 3721428 - DNA, 15 bp, Homo sapiens
tttcctgttcagcat

SEQ ID NO: 3721429 - DNA, 16 bp, Homo sapiens
tttcctgttcagcatt

SEQ ID NO: 3721430 - DNA, 23 bp, Homo sapiens
tttccttaaactgtgtggactgt

SEQ ID NO: 3721431 - DNA, 13 bp, Homo sapiens
tttccttcagtgc

SEQ ID NO: 3721432 - DNA, 23 bp, Homo sapiens
tttccttcattcaacccacctgc

SEQ ID NO: 3721433 - DNA, 19 bp, Homo sapiens
tttccttccatccctaccc

SEQ ID NO: 3721434 - DNA, 18 bp, Homo sapiens
tttcgttaacattgacca

SEQ ID NO: 3721435 - DNA, 20 bp, Homo sapiens
tttctaactctgatgtaaat

SEQ ID NO: 3721436 - DNA, 16 bp, Homo sapiens
tttctaccatttcaga

SEQ ID NO: 3721437 - DNA, 16 bp, Homo sapiens
tttctagacttgtgct

SEQ ID NO: 3721438 - DNA, 18 bp, Homo sapiens
tttctagagcctgctgga

SEQ ID NO: 3721439 - DNA, 18 bp, Homo sapiens
tttctagctaatggaaaa

SEQ ID NO: 3721440 - DNA, 19 bp, Homo sapiens
tttctagctgttgagctgt

SEQ ID NO: 3721441 - DNA, 14 bp, Homo sapiens
tttctagggaaatg

SEQ ID NO: 3721442 - DNA, 18 bp, Homo sapiens
tttctagggaaatgaaag

SEQ ID NO: 3721443 - DNA, 15 bp, Homo sapiens
tttctcatcacatca

SEQ ID NO: 3721444 - DNA, 14 bp, Homo sapiens
tttctccccctggg

SEQ ID NO: 3721445 - DNA, 14 bp, Homo sapiens
tttctctctccagt

SEQ ID NO: 3721446 - DNA, 12 bp, Homo sapiens
tttctcttgggc

SEQ ID NO: 3721447 - DNA, 20 bp, Homo sapiens
tttctgaaaattaacactgc

SEQ ID NO: 3721448 - DNA, 19 bp, Homo sapiens
tttctgacccactgatctc

SEQ ID NO: 3721449 - DNA, 16 bp, Homo sapiens
tttctgagaaggtcct

SEQ ID NO: 3721450 - DNA, 18 bp, Homo sapiens
tttctggaatacatgaaa

SEQ ID NO: 3721451 - DNA, 18 bp, Homo sapiens
tttctggaatgtaatcaa

SEQ ID NO: 3721452 - DNA, 21 bp, Homo sapiens
tttctggactgaagcctgcag

SEQ ID NO: 3721453 - DNA, 17 bp, Homo sapiens
tttctggtagatagaaa

SEQ ID NO: 3721454 - DNA, 22 bp, Homo sapiens
tttctggttcttgtgttggctg

SEQ ID NO: 3721455 - DNA, 15 bp, Homo sapiens
tttctgttgaagttt

SEQ ID NO: 3721456 - DNA, 14 bp, Homo sapiens
tttctgttgccaca

SEQ ID NO: 3721457 - DNA, 18 bp, Homo sapiens
tttcttatttaacttaac

SEQ ID NO: 3721458 - DNA, 18 bp, Homo sapiens
tttcttcatgcaatgaca

SEQ ID NO: 3721459 - DNA, 17 bp, Homo sapiens
tttcttcccttcaaggt

SEQ ID NO: 3721460 - DNA, 14 bp, Homo sapiens
tttcttcctctgct

SEQ ID NO: 3721461 - DNA, 16 bp, Homo sapiens
tttcttcctctgctga

SEQ ID NO: 3721462 - DNA, 12 bp, Homo sapiens
tttcttctccct

SEQ ID NO: 3721463 - DNA, 16 bp, Homo sapiens
tttcttgcagatcaaa

SEQ ID NO: 3721464 - DNA, 11 bp, Homo sapiens
tttcttgctgg

SEQ ID NO: 3721465 - DNA, 21 bp, Homo sapiens
tttcttgctggttgtcatttt

SEQ ID NO: 3721466 - DNA, 17 bp, Homo sapiens
tttctttttatttttta

SEQ ID NO: 3721467 - DNA, 24 bp, Homo sapiens
tttgaaacaactttctcttgtaaa

SEQ ID NO: 3721468 - DNA, 19 bp, Homo sapiens
tttgaaagaaggaagactt

SEQ ID NO: 3721469 - DNA, 20 bp, Homo sapiens
tttgaaatagtctgtgtgaa

SEQ ID NO: 3721470 - DNA, 15 bp, Homo sapiens
tttgaactaataaaa

SEQ ID NO: 3721471 - DNA, 17 bp, Homo sapiens
tttgaatccatgcttgg

SEQ ID NO: 3721472 - DNA, 13 bp, Homo sapiens
tttgaatgaaaaa

SEQ ID NO: 3721473 - DNA, 19 bp, Homo sapiens
tttgacagtgttgaaaatg

SEQ ID NO: 3721474 - DNA, 13 bp, Homo sapiens
tttgacatgtgga

SEQ ID NO: 3721475 - DNA, 16 bp, Homo sapiens
tttgagaccagcctgg

SEQ ID NO: 3721476 - DNA, 19 bp, Homo sapiens
tttgagaccagcctgggca

SEQ ID NO: 3721477 - DNA, 15 bp, Homo sapiens
tttgagcagggctca

SEQ ID NO: 3721478 - DNA, 15 bp, Homo sapiens
tttgaggctgcagcg

SEQ ID NO: 3721479 - DNA, 20 bp, Homo sapiens
tttgaggtcaagtaagaaga

SEQ ID NO: 3721480 - DNA, 22 bp, Homo sapiens
tttgagtcccttccaggccatc

SEQ ID NO: 3721481 - DNA, 15 bp, Homo sapiens
tttgatacttgttca

SEQ ID NO: 3721482 - DNA, 18 bp, Homo sapiens
tttgatagtattgtgcat

SEQ ID NO: 3721483 - DNA, 17 bp, Homo sapiens
tttgatatccaaagctg

SEQ ID NO: 3721484 - DNA, 14 bp, Homo sapiens
tttgatccaagctg

SEQ ID NO: 3721485 - DNA, 14 bp, Homo sapiens
tttgatttcattaa

SEQ ID NO: 3721486 - DNA, 14 bp, Homo sapiens
tttgcaatgtcaca

SEQ ID NO: 3721487 - DNA, 16 bp, Homo sapiens
tttgcacagctctccg

SEQ ID NO: 3721488 - DNA, 13 bp, Homo sapiens
aaaaaaaatcctt

SEQ ID NO: 3721489 - DNA, 13 bp, Homo sapiens
aaaaaaacacaaa

SEQ ID NO: 3721490 - DNA, 13 bp, Homo sapiens
aaaaaaactttta

SEQ ID NO: 3721491 - DNA, 12 bp, Homo sapiens
aaaaaaatgact

SEQ ID NO: 3721492 - DNA, 22 bp, Homo sapiens
aaaaaactgctgactgttttct

SEQ ID NO: 3721493 - DNA, 21 bp, Homo sapiens
aaaaaagctggtgggtgaaag

SEQ ID NO: 3721494 - DNA, 17 bp, Homo sapiens
aaaaaagtctctattta

SEQ ID NO: 3721495 - DNA, 11 bp, Homo sapiens
aaaaaatgtcc

SEQ ID NO: 3721496 - DNA, 13 bp, Homo sapiens
aaaaaattggcat

SEQ ID NO: 3721497 - DNA, 12 bp, Homo sapiens
aaaaaatttaaa

SEQ ID NO: 3721498 - DNA, 16 bp, Homo sapiens
aaaaaatttccagtga

SEQ ID NO: 3721499 - DNA, 18 bp, Homo sapiens
aaaaacaatatttattgt

SEQ ID NO: 3721500 - DNA, 14 bp, Homo sapiens
aaaaacacaaaagt

SEQ ID NO: 3721501 - DNA, 14 bp, Homo sapiens
aaaaacagaggcca

SEQ ID NO: 3721502 - DNA, 17 bp, Homo sapiens
aaaaacagcattgcttt

SEQ ID NO: 3721503 - DNA, 19 bp, Homo sapiens
aaaaacagcattgctttct

SEQ ID NO: 3721504 - DNA, 13 bp, Homo sapiens
aaaaacattgttt

SEQ ID NO: 3721505 - DNA, 20 bp, Homo sapiens
aaaaactctgggaaataaga

SEQ ID NO: 3721506 - DNA, 12 bp, Homo sapiens
aaaaactgaatg

SEQ ID NO: 3721507 - DNA, 18 bp, Homo sapiens
aaaaacttgtaaatgctg

SEQ ID NO: 3721508 - DNA, 18 bp, Homo sapiens
aaaaacttttataaatta

SEQ ID NO: 3721509 - DNA, 11 bp, Homo sapiens
aaaaagaatgt

SEQ ID NO: 3721510 - DNA, 17 bp, Homo sapiens
aaaaagcactagtataa

SEQ ID NO: 3721511 - DNA, 22 bp, Homo sapiens
aaaaagggcagggcatctcctg

SEQ ID NO: 3721512 - DNA, 23 bp, Homo sapiens
aaaaagtctctatttaaattctt

SEQ ID NO: 3721513 - DNA, 12 bp, Homo sapiens
aaaaagtttaaa

SEQ ID NO: 3721514 - DNA, 16 bp, Homo sapiens
aaaaagtttaaaatgt

SEQ ID NO: 3721515 - DNA, 17 bp, Homo sapiens
aaaaagtttgccagaag

SEQ ID NO: 3721516 - DNA, 18 bp, Homo sapiens
aaaaagtttgccagaagt

SEQ ID NO: 3721517 - DNA, 19 bp, Homo sapiens
aaaaataaccccaaaatga

SEQ ID NO: 3721518 - DNA, 16 bp, Homo sapiens
aaaaataataataatg

SEQ ID NO: 3721519 - DNA, 15 bp, Homo sapiens
aaaaatacattttat

SEQ ID NO: 3721520 - DNA, 15 bp, Homo sapiens
aaaaatactctaatt

SEQ ID NO: 3721521 - DNA, 22 bp, Homo sapiens
aaaaatactctaattctaacca

SEQ ID NO: 3721522 - DNA, 22 bp, Homo sapiens
aaaaatctgaccaaaacaaaca

SEQ ID NO: 3721523 - DNA, 20 bp, Homo sapiens
aaaaatgactaaaaatatta

SEQ ID NO: 3721524 - DNA, 16 bp, Homo sapiens
aaaaatgagaacatgt

SEQ ID NO: 3721525 - DNA, 11 bp, Homo sapiens
aaaaatggtaa

SEQ ID NO: 3721526 - DNA, 20 bp, Homo sapiens
aaaaatttaagcattgtttg

SEQ ID NO: 3721527 - DNA, 12 bp, Homo sapiens
aaaaatttgaac

SEQ ID NO: 3721528 - DNA, 21 bp, Homo sapiens
aaaaatttttggattgacagt

SEQ ID NO: 3721529 - DNA, 23 bp, Homo sapiens
aaaacaaaaattcacaagctgcc

SEQ ID NO: 3721530 - DNA, 10 bp, Homo sapiens
aaaacaaaat

SEQ ID NO: 3721531 - DNA, 12 bp, Homo sapiens
aaaacaaagaag

SEQ ID NO: 3721532 - DNA, 12 bp, Homo sapiens
aaaacaacaaaa

SEQ ID NO: 3721533 - DNA, 13 bp, Homo sapiens
aaaacaacaaaaa

SEQ ID NO: 3721534 - DNA, 18 bp, Homo sapiens
aaaacaacttctttgtaa

SEQ ID NO: 3721535 - DNA, 15 bp, Homo sapiens
aaaacaatattgttt

SEQ ID NO: 3721536 - DNA, 17 bp, Homo sapiens
aaaacaatattgtttct

SEQ ID NO: 3721537 - DNA, 14 bp, Homo sapiens
aaaacaatatttat

SEQ ID NO: 3721538 - DNA, 21 bp, Homo sapiens
aaaacagaaaaaaaacacaca

SEQ ID NO: 3721539 - DNA, 20 bp, Homo sapiens
aaagtcaaaaggtgcctgtg

SEQ ID NO: 3721540 - DNA, 16 bp, Homo sapiens
aaagtcaggtccaatt

SEQ ID NO: 3721541 - DNA, 15 bp, Homo sapiens
aaagtctccagccca

SEQ ID NO: 3721542 - DNA, 17 bp, Homo sapiens
aaagtctctatttaaat

SEQ ID NO: 3721543 - DNA, 21 bp, Homo sapiens
aaagtctctatttaaattctt

SEQ ID NO: 3721544 - DNA, 13 bp, Homo sapiens
aaagtcttgctgt

SEQ ID NO: 3721545 - DNA, 18 bp, Homo sapiens
aaagtcttgtgactagtg

SEQ ID NO: 3721546 - DNA, 19 bp, Homo sapiens
aaagtcttgtgactagtgc

SEQ ID NO: 3721547 - DNA, 23 bp, Homo sapiens
aaagtgaagcaaatcagaaactt

SEQ ID NO: 3721548 - DNA, 15 bp, Homo sapiens
aaagtgaataaaaat

SEQ ID NO: 3721549 - DNA, 22 bp, Homo sapiens
aaagtgaatttgaatgaaaaat

SEQ ID NO: 3721550 - DNA, 21 bp, Homo sapiens
aaagtgataatttctggaatt

SEQ ID NO: 3721551 - DNA, 14 bp, Homo sapiens
aaagtgctgggatt

SEQ ID NO: 3721552 - DNA, 13 bp, Homo sapiens
aaagtggaaaaat

SEQ ID NO: 3721553 - DNA, 19 bp, Homo sapiens
aaagtggcaagaccaaaat

SEQ ID NO: 3721554 - DNA, 18 bp, Homo sapiens
aaagtgtattataacagt

SEQ ID NO: 3721555 - DNA, 16 bp, Homo sapiens
aaagtgtattttataa

SEQ ID NO: 3721556 - DNA, 19 bp, Homo sapiens
aaagtgtattttataaaat

SEQ ID NO: 3721557 - DNA, 19 bp, Homo sapiens
aaagtgttggctaatgaag

SEQ ID NO: 3721558 - DNA, 15 bp, Homo sapiens
aaagtgtttccttca

SEQ ID NO: 3721559 - DNA, 15 bp, Homo sapiens
aaagtgttttcagag

SEQ ID NO: 3721560 - DNA, 22 bp, Homo sapiens
aaagttaaaaaaaataataaat

SEQ ID NO: 3721561 - DNA, 22 bp, Homo sapiens
aaagttaaacattgaagtaatg

SEQ ID NO: 3721562 - DNA, 16 bp, Homo sapiens
aaagttctgtgtattt

SEQ ID NO: 3721563 - DNA, 13 bp, Homo sapiens
aaagtttgccaga

SEQ ID NO: 3721564 - DNA, 15 bp, Homo sapiens
aaataaaaatggata

SEQ ID NO: 3721565 - DNA, 18 bp, Homo sapiens
aaataaaacattttcaca

SEQ ID NO: 3721566 - DNA, 11 bp, Homo sapiens
aaataaaacct

SEQ ID NO: 3721567 - DNA, 12 bp, Homo sapiens
aaataaaacctt

SEQ ID NO: 3721568 - DNA, 14 bp, Homo sapiens
aaataaaacctttc

SEQ ID NO: 3721569 - DNA, 11 bp, Homo sapiens
aaataaaagca

SEQ ID NO: 3721570 - DNA, 16 bp, Homo sapiens
aaataaaagtgatcaa

SEQ ID NO: 3721571 - DNA, 22 bp, Homo sapiens
aaataaaattaaagctgaaaac

SEQ ID NO: 3721572 - DNA, 18 bp, Homo sapiens
aaataaacaaataacaat

SEQ ID NO: 3721573 - DNA, 19 bp, Homo sapiens
aaataaacacatagattca

SEQ ID NO: 3721574 - DNA, 18 bp, Homo sapiens
aaataaaggatttctaga

SEQ ID NO: 3721575 - DNA, 16 bp, Homo sapiens
aaataaatagctatat

SEQ ID NO: 3721576 - DNA, 12 bp, Homo sapiens
aaataaatgtac

SEQ ID NO: 3721577 - DNA, 16 bp, Homo sapiens
aaataaatgtatcata

SEQ ID NO: 3721578 - DNA, 14 bp, Homo sapiens
aaataacaatgtgc

SEQ ID NO: 3721579 - DNA, 17 bp, Homo sapiens
aaataacaatgtgctct

SEQ ID NO: 3721580 - DNA, 13 bp, Homo sapiens
aaataacacacat

SEQ ID NO: 3721581 - DNA, 21 bp, Homo sapiens
aaataacacacatataaacat

SEQ ID NO: 3721582 - DNA, 15 bp, Homo sapiens
aaataacacagagag

SEQ ID NO: 3721583 - DNA, 21 bp, Homo sapiens
aaataaccaacccttccctga

SEQ ID NO: 3721584 - DNA, 16 bp, Homo sapiens
aaataacttcaagcaa

SEQ ID NO: 3721585 - DNA, 18 bp, Homo sapiens
aaataacttcaagcaaac

SEQ ID NO: 3721586 - DNA, 14 bp, Homo sapiens
aaataaggtgtatt

SEQ ID NO: 3721587 - DNA, 16 bp, Homo sapiens
aaataaggtgtattgc

SEQ ID NO: 3721588 - DNA, 19 bp, Homo sapiens
aaataataaagatgctctt

SEQ ID NO: 3721589 - DNA, 16 bp, Homo sapiens
aaataataaattgcat

SEQ ID NO: 3721590 - DNA, 13 bp, Homo sapiens
aaataatatgcat

SEQ ID NO: 3721591 - DNA, 15 bp, Homo sapiens
aaataatcggcccac

SEQ ID NO: 3721592 - DNA, 15 bp, Homo sapiens
aaataatgtcttgtt

SEQ ID NO: 3721593 - DNA, 20 bp, Homo sapiens
aaataattttaaacaaaggt

SEQ ID NO: 3721594 - DNA, 17 bp, Homo sapiens
aaatacaagttctattt

SEQ ID NO: 3721595 - DNA, 12 bp, Homo sapiens
aaatacaataaa

SEQ ID NO: 3721596 - DNA, 14 bp, Homo sapiens
aaactgtgtaactg

SEQ ID NO: 3721597 - DNA, 17 bp, Homo sapiens
aaactgtgtaactgccc

SEQ ID NO: 3721598 - DNA, 19 bp, Homo sapiens
aaactgtgtggactgtgat

SEQ ID NO: 3721599 - DNA, 19 bp, Homo sapiens
aaactgttaatagttcagg

SEQ ID NO: 3721600 - DNA, 16 bp, Homo sapiens
aaactgttgccagaga

SEQ ID NO: 3721601 - DNA, 22 bp, Homo sapiens
aaactgttgccagagatggagg

SEQ ID NO: 3721602 - DNA, 18 bp, Homo sapiens
aaacttaaccgcatcaga

SEQ ID NO: 3721603 - DNA, 15 bp, Homo sapiens
aaacttaagatattt

SEQ ID NO: 3721604 - DNA, 23 bp, Homo sapiens
aaacttccatgaggccaaacgtt

SEQ ID NO: 3721605 - DNA, 19 bp, Homo sapiens
aaacttgaattcatagaaa

SEQ ID NO: 3721606 - DNA, 15 bp, Homo sapiens
aaacttgttagaaat

SEQ ID NO: 3721607 - DNA, 18 bp, Homo sapiens
aaactttaatatgtattt

SEQ ID NO: 3721608 - DNA, 19 bp, Homo sapiens
aaactttattttatataat

SEQ ID NO: 3721609 - DNA, 14 bp, Homo sapiens
aaacttttataaat

SEQ ID NO: 3721610 - DNA, 16 bp, Homo sapiens
aaacttttataaatta

SEQ ID NO: 3721611 - DNA, 17 bp, Homo sapiens
aaacttttataaattaa

SEQ ID NO: 3721612 - DNA, 18 bp, Homo sapiens
aaacttttataaattaaa

SEQ ID NO: 3721613 - DNA, 13 bp, Homo sapiens
aaagaaaatatgc

SEQ ID NO: 3721614 - DNA, 15 bp, Homo sapiens
aaagaaaatatgcat

SEQ ID NO: 3721615 - DNA, 20 bp, Homo sapiens
aaagaaacccgacagaggga

SEQ ID NO: 3721616 - DNA, 18 bp, Homo sapiens
aaagaaatcatgttatga

SEQ ID NO: 3721617 - DNA, 19 bp, Homo sapiens
aaagaaattccctggacca

SEQ ID NO: 3721618 - DNA, 20 bp, Homo sapiens
aaagaagcccaatattataa

SEQ ID NO: 3721619 - DNA, 12 bp, Homo sapiens
aaagaaggaagt

SEQ ID NO: 3721620 - DNA, 20 bp, Homo sapiens
aaagaaggtttcagaaagaa

SEQ ID NO: 3721621 - DNA, 21 bp, Homo sapiens
aaagaagtaacaagagtgatt

SEQ ID NO: 3721622 - DNA, 21 bp, Homo sapiens
aaagaagtgtccgagaactaa

SEQ ID NO: 3721623 - DNA, 19 bp, Homo sapiens
aaagaatcattatttatta

SEQ ID NO: 3721624 - DNA, 23 bp, Homo sapiens
aaagaatcattatttattaaatt

SEQ ID NO: 3721625 - DNA, 16 bp, Homo sapiens
aaagacaaattctgtt

SEQ ID NO: 3721626 - DNA, 19 bp, Homo sapiens
aaagacaaattctgtttct

SEQ ID NO: 3721627 - DNA, 13 bp, Homo sapiens
aaagacagaagcc

SEQ ID NO: 3721628 - DNA, 19 bp, Homo sapiens
aaagacattctgacatctt

SEQ ID NO: 3721629 - DNA, 19 bp, Homo sapiens
aaagacgatttgtcagtta

SEQ ID NO: 3721630 - DNA, 15 bp, Homo sapiens
aaagactcagtgttc

SEQ ID NO: 3721631 - DNA, 13 bp, Homo sapiens
aaagactgtacaa

SEQ ID NO: 3721632 - DNA, 11 bp, Homo sapiens
aaagagaaact

SEQ ID NO: 3721633 - DNA, 14 bp, Homo sapiens
aaagagaaactttg

SEQ ID NO: 3721634 - DNA, 23 bp, Homo sapiens
aaagagaaactttgtgctacatg

SEQ ID NO: 3721635 - DNA, 15 bp, Homo sapiens
aaagagcaagtctgg

SEQ ID NO: 3721636 - DNA, 23 bp, Homo sapiens
aaagagcaagtctggatctggga

SEQ ID NO: 3721637 - DNA, 12 bp, Homo sapiens
aaagagctgcct

SEQ ID NO: 3721638 - DNA, 20 bp, Homo sapiens
aaagaggctgaaagaggcca

SEQ ID NO: 3721639 - DNA, 13 bp, Homo sapiens
aaagagttaagaa

SEQ ID NO: 3721640 - DNA, 16 bp, Homo sapiens
aaagagttcttaagga

SEQ ID NO: 3721641 - DNA, 22 bp, Homo sapiens
aaagatattattcaccatgtaa

SEQ ID NO: 3721642 - DNA, 22 bp, Homo sapiens
aaagatggctgtgcctctgcct

SEQ ID NO: 3721643 - DNA, 20 bp, Homo sapiens
aaagatggtatcatatattt

SEQ ID NO: 3721644 - DNA, 13 bp, Homo sapiens
aaagatgtgggga

SEQ ID NO: 3721645 - DNA, 20 bp, Homo sapiens
aaagatgtttgtcagatatg

SEQ ID NO: 3721646 - DNA, 16 bp, Homo sapiens
aaagcaaatgtgacct

SEQ ID NO: 3721647 - DNA, 17 bp, Homo sapiens
aaagcaaggatctttca

SEQ ID NO: 3721648 - DNA, 18 bp, Homo sapiens
aaaacaggtcaatacagt

SEQ ID NO: 3721649 - DNA, 19 bp, Homo sapiens
aaaacattttcacacaata

SEQ ID NO: 3721650 - DNA, 15 bp, Homo sapiens
aaaaccaatgttctc

SEQ ID NO: 3721651 - DNA, 20 bp, Homo sapiens
aaaaccacagccctgtcagt

SEQ ID NO: 3721652 - DNA, 16 bp, Homo sapiens
aaaaccactagaactc

SEQ ID NO: 3721653 - DNA, 17 bp, Homo sapiens
aaaaccactagaactct

SEQ ID NO: 3721654 - DNA, 13 bp, Homo sapiens
aaaaccattgctt

SEQ ID NO: 3721655 - DNA, 12 bp, Homo sapiens
aaaacccaagtg

SEQ ID NO: 3721656 - DNA, 12 bp, Homo sapiens
aaaacccagaga

SEQ ID NO: 3721657 - DNA, 13 bp, Homo sapiens
aaaacccattgtc

SEQ ID NO: 3721658 - DNA, 13 bp, Homo sapiens
aaaacctgacaaa

SEQ ID NO: 3721659 - DNA, 23 bp, Homo sapiens
aaaactagagctctaagcccatt

SEQ ID NO: 3721660 - DNA, 16 bp, Homo sapiens
aaaactgactccttag

SEQ ID NO: 3721661 - DNA, 17 bp, Homo sapiens
aaaactttattttatat

SEQ ID NO: 3721662 - DNA, 19 bp, Homo sapiens
aaaactttattttatataa

SEQ ID NO: 3721663 - DNA, 13 bp, Homo sapiens
aaaacttttataa

SEQ ID NO: 3721664 - DNA, 17 bp, Homo sapiens
aaaactttttatatttt

SEQ ID NO: 3721665 - DNA, 11 bp, Homo sapiens
aaaagaaaaag

SEQ ID NO: 3721666 - DNA, 14 bp, Homo sapiens
aaaagaaatctcta

SEQ ID NO: 3721667 - DNA, 16 bp, Homo sapiens
aaaagaatacagaaag

SEQ ID NO: 3721668 - DNA, 15 bp, Homo sapiens
aaaagaatgtcagaa

SEQ ID NO: 3721669 - DNA, 21 bp, Homo sapiens
aaaagaatgtcagaaaaacaa

SEQ ID NO: 3721670 - DNA, 16 bp, Homo sapiens
aaaagatggtatcata

SEQ ID NO: 3721671 - DNA, 14 bp, Homo sapiens
aaaagatgtatcct

SEQ ID NO: 3721672 - DNA, 14 bp, Homo sapiens
aaaagcaaatgaga

SEQ ID NO: 3721673 - DNA, 13 bp, Homo sapiens
aaaagccatgttt

SEQ ID NO: 3721674 - DNA, 17 bp, Homo sapiens
aaaagccatgtttaaga

SEQ ID NO: 3721675 - DNA, 21 bp, Homo sapiens
aaaagcctcaactagtcattt

SEQ ID NO: 3721676 - DNA, 13 bp, Homo sapiens
aaaaggaagacta

SEQ ID NO: 3721677 - DNA, 15 bp, Homo sapiens
aaaaggaagactaga

SEQ ID NO: 3721678 - DNA, 16 bp, Homo sapiens
aaaaggacacctttta

SEQ ID NO: 3721679 - DNA, 20 bp, Homo sapiens
aaaaggacaggcagaaagag

SEQ ID NO: 3721680 - DNA, 20 bp, Homo sapiens
aaaaggctaggtacacagct

SEQ ID NO: 3721681 - DNA, 15 bp, Homo sapiens
aaaaggtctttaaaa

SEQ ID NO: 3721682 - DNA, 19 bp, Homo sapiens
aaaaggttcttactgcttg

SEQ ID NO: 3721683 - DNA, 22 bp, Homo sapiens
aaaagtaagtaccactcaggcc

SEQ ID NO: 3721684 - DNA, 20 bp, Homo sapiens
aaaagtaggtttacattcat

SEQ ID NO: 3721685 - DNA, 15 bp, Homo sapiens
aaaagtatatgttag

SEQ ID NO: 3721686 - DNA, 15 bp, Homo sapiens
aaaagtcaaaaggtg

SEQ ID NO: 3721687 - DNA, 13 bp, Homo sapiens
aaaagtctctatt

SEQ ID NO: 3721688 - DNA, 21 bp, Homo sapiens
aaaagtctctatttaaattct

SEQ ID NO: 3721689 - DNA, 21 bp, Homo sapiens
aaaagtgatcaataaaatgtg

SEQ ID NO: 3721690 - DNA, 21 bp, Homo sapiens
aaaagtgggccagtgtgggaa

SEQ ID NO: 3721691 - DNA, 22 bp, Homo sapiens
aaaagttaaaaaaaataataaa

SEQ ID NO: 3721692 - DNA, 11 bp, Homo sapiens
aaaataaaaac

SEQ ID NO: 3721693 - DNA, 21 bp, Homo sapiens
aaaataaaaagcgggcacggg

SEQ ID NO: 3721694 - DNA, 15 bp, Homo sapiens
aaaataaaaggtcta

SEQ ID NO: 3721695 - DNA, 19 bp, Homo sapiens
aaaataaaattaaagctga

SEQ ID NO: 3721696 - DNA, 12 bp, Homo sapiens
aaaataaacaaa

SEQ ID NO: 3721697 - DNA, 14 bp, Homo sapiens
aaaataaataaata

SEQ ID NO: 3721698 - DNA, 11 bp, Homo sapiens
aaaataataaa

SEQ ID NO: 3721699 - DNA, 13 bp, Homo sapiens
aaaataataataa

SEQ ID NO: 3721700 - DNA, 18 bp, Homo sapiens
aaaataatgtcttgttaa

SEQ ID NO: 3721701 - DNA, 16 bp, Homo sapiens
aaaataattgatttca

SEQ ID NO: 3721702 - DNA, 20 bp, Homo sapiens
aaaataattttaaacaaagg

SEQ ID NO: 3721703 - DNA, 14 bp, Homo sapiens
aaaataattttatg

SEQ ID NO: 3721704 - DNA, 15 bp, Homo sapiens
aaaataattttatga

SEQ ID NO: 3721705 - DNA, 15 bp, Homo sapiens
aaaatacagtattct

SEQ ID NO: 3721706 - DNA, 15 bp, Homo sapiens
aaaatactctaattc

SEQ ID NO: 3721707 - DNA, 22 bp, Homo sapiens
aaaatagtttaggagaaaccag

SEQ ID NO: 3721708 - DNA, 15 bp, Homo sapiens
aaaatataattgttt

SEQ ID NO: 3721709 - DNA, 14 bp, Homo sapiens
aaaatatcattcag

SEQ ID NO: 3721710 - DNA, 13 bp, Homo sapiens
aaaatatgatatt

SEQ ID NO: 3721711 - DNA, 20 bp, Homo sapiens
aaaatatgggttgcatttgg

SEQ ID NO: 3721712 - DNA, 21 bp, Homo sapiens
aaaatattatctttgtaatta

SEQ ID NO: 3721713 - DNA, 16 bp, Homo sapiens
aaaatattttcctgcc

SEQ ID NO: 3721714 - DNA, 16 bp, Homo sapiens
aaaatcactaacatta

SEQ ID NO: 3721715 - DNA, 13 bp, Homo sapiens
aaaatcataaact

SEQ ID NO: 3721716 - DNA, 22 bp, Homo sapiens
aaaatcattgattgtcagctac

SEQ ID NO: 3721717 - DNA, 14 bp, Homo sapiens
aaaatccatgaaca

SEQ ID NO: 3721718 - DNA, 16 bp, Homo sapiens
aaaatccttctaatct

SEQ ID NO: 3721719 - DNA, 13 bp, Homo sapiens
aaaatccttgctt

SEQ ID NO: 3721720 - DNA, 18 bp, Homo sapiens
aaaatctgtagagcaggg

SEQ ID NO: 3721721 - DNA, 17 bp, Homo sapiens
aaaatcttggcacagaa

SEQ ID NO: 3721722 - DNA, 18 bp, Homo sapiens
aaaatcttggcacagaaa

SEQ ID NO: 3721723 - DNA, 19 bp, Homo sapiens
aaaatgaaagcatgtctca

SEQ ID NO: 3721724 - DNA, 17 bp, Homo sapiens
aaaatgacagatgttga

SEQ ID NO: 3721725 - DNA, 14 bp, Homo sapiens
aaaatgacatccca

SEQ ID NO: 3721726 - DNA, 18 bp, Homo sapiens
aaaatgagaacatgttgg

SEQ ID NO: 3721727 - DNA, 20 bp, Homo sapiens
aaaatgagaacatgttggta

SEQ ID NO: 3721728 - DNA, 23 bp, Homo sapiens
aaaatgagtttttatggggctga

SEQ ID NO: 3721729 - DNA, 14 bp, Homo sapiens
aaaatgattttact

SEQ ID NO: 3721730 - DNA, 23 bp, Homo sapiens
aaaatgctgtattagtcacagag

SEQ ID NO: 3721731 - DNA, 19 bp, Homo sapiens
aaaatgtacaaaataaagt

SEQ ID NO: 3721732 - DNA, 18 bp, Homo sapiens
aaaatgtatgtgtaagta

SEQ ID NO: 3721733 - DNA, 12 bp, Homo sapiens
aaaatgtgattt

SEQ ID NO: 3721734 - DNA, 15 bp, Homo sapiens
aaaattaaagaaaat

SEQ ID NO: 3721735 - DNA, 16 bp, Homo sapiens
aaaattaaagaaaata

SEQ ID NO: 3721736 - DNA, 17 bp, Homo sapiens
aaaattaaggcaactga

SEQ ID NO: 3721737 - DNA, 18 bp, Homo sapiens
aaaattagccgggcgtgg

SEQ ID NO: 3721738 - DNA, 16 bp, Homo sapiens
aaaattatagaagttt

SEQ ID NO: 3721739 - DNA, 16 bp, Homo sapiens
aaaattccagaaagga

SEQ ID NO: 3721740 - DNA, 13 bp, Homo sapiens
aaaattctaaata

SEQ ID NO: 3721741 - DNA, 20 bp, Homo sapiens
aaaattctcagtcagtaatt

SEQ ID NO: 3721742 - DNA, 12 bp, Homo sapiens
aaaattgaattt

SEQ ID NO: 3721743 - DNA, 15 bp, Homo sapiens
aaaattgaatttaac

SEQ ID NO: 3721744 - DNA, 19 bp, Homo sapiens
aaaattggcattaaaactt

SEQ ID NO: 3721745 - DNA, 20 bp, Homo sapiens
aaaattggctagttgaatct

SEQ ID NO: 3721746 - DNA, 13 bp, Homo sapiens
aaaattgtgatca

SEQ ID NO: 3721747 - DNA, 15 bp, Homo sapiens
aaaatttaagcattg

SEQ ID NO: 3721748 - DNA, 21 bp, Homo sapiens
aaaatttaagcattgtttgct

SEQ ID NO: 3721749 - DNA, 13 bp, Homo sapiens
aaaatttcacatt

SEQ ID NO: 3721750 - DNA, 16 bp, Homo sapiens
aaaatttgaaccaaaa

SEQ ID NO: 3721751 - DNA, 14 bp, Homo sapiens
aaaattttatagct

SEQ ID NO: 3721752 - DNA, 13 bp, Homo sapiens
aaaattttattcc

SEQ ID NO: 3721753 - DNA, 23 bp, Homo sapiens
aaaattttgctccccagtgaagg

SEQ ID NO: 3721754 - DNA, 11 bp, Homo sapiens
aaacaaagtgg

SEQ ID NO: 3721755 - DNA, 17 bp, Homo sapiens
aaacaaagtggaaggaa

SEQ ID NO: 3721756 - DNA, 12 bp, Homo sapiens
aaacaaatatgc

SEQ ID NO: 3721757 - DNA, 12 bp, Homo sapiens
aaacaacaaaaa

SEQ ID NO: 3721758 - DNA, 14 bp, Homo sapiens
aaacaacaaaaaat

SEQ ID NO: 3721759 - DNA, 18 bp, Homo sapiens
aaacaagaaagtttcccc

SEQ ID NO: 3721760 - DNA, 15 bp, Homo sapiens
aaacaataaatgtgc

SEQ ID NO: 3721761 - DNA, 18 bp, Homo sapiens
aaacaatatttattgtat

SEQ ID NO: 3721762 - DNA, 23 bp, Homo sapiens
aaacacaccaggctgtgggcctc

SEQ ID NO: 3721763 - DNA, 15 bp, Homo sapiens
aaacacactgaggca

SEQ ID NO: 3721764 - DNA, 15 bp, Homo sapiens
agaacagaaaacaac

SEQ ID NO: 3721765 - DNA, 21 bp, Homo sapiens
agaacagaaaacaacaaaaaa

SEQ ID NO: 3721766 - DNA, 20 bp, Homo sapiens
agaacagactggcctgagga

SEQ ID NO: 3721767 - DNA, 20 bp, Homo sapiens
agaacagatctccaaagctt

SEQ ID NO: 3721768 - DNA, 18 bp, Homo sapiens
agaacagcaggcccacct

SEQ ID NO: 3721769 - DNA, 19 bp, Homo sapiens
agaacagcaggcccaccta

SEQ ID NO: 3721770 - DNA, 22 bp, Homo sapiens
agaacagccgctcctgtctgcc

SEQ ID NO: 3721771 - DNA, 23 bp, Homo sapiens
agaacagccgctcctgtctgcca

SEQ ID NO: 3721772 - DNA, 17 bp, Homo sapiens
agaacagtttgtacaga

SEQ ID NO: 3721773 - DNA, 11 bp, Homo sapiens
agaacatagaa

SEQ ID NO: 3721774 - DNA, 15 bp, Homo sapiens
agaacatccaaggag

SEQ ID NO: 3721775 - DNA, 18 bp, Homo sapiens
agaacatccaaggagaaa

SEQ ID NO: 3721776 - DNA, 19 bp, Homo sapiens
agaacatgttggtatttat

SEQ ID NO: 3721777 - DNA, 18 bp, Homo sapiens
agaacattgattgctgtg

SEQ ID NO: 3721778 - DNA, 13 bp, Homo sapiens
agaaccactatga

SEQ ID NO: 3721779 - DNA, 17 bp, Homo sapiens
agaaccaggcaacttgg

SEQ ID NO: 3721780 - DNA, 17 bp, Homo sapiens
agaacccctacatgaaa

SEQ ID NO: 3721781 - DNA, 19 bp, Homo sapiens
agaacccctacatgaaaca

SEQ ID NO: 3721782 - DNA, 18 bp, Homo sapiens
agaacgccagtctcccag

SEQ ID NO: 3721783 - DNA, 20 bp, Homo sapiens
agaactagaggttttatgat

SEQ ID NO: 3721784 - DNA, 15 bp, Homo sapiens
agaactgaaaacata

SEQ ID NO: 3721785 - DNA, 17 bp, Homo sapiens
agaactgaaaacataaa

SEQ ID NO: 3721786 - DNA, 15 bp, Homo sapiens
agaactgagctcctc

SEQ ID NO: 3721787 - DNA, 19 bp, Homo sapiens
agaactgcatatgtttcgc

SEQ ID NO: 3721788 - DNA, 21 bp, Homo sapiens
agaactgcatatgtttcgctg

SEQ ID NO: 3721789 - DNA, 16 bp, Homo sapiens
agaactgcatggacct

SEQ ID NO: 3721790 - DNA, 15 bp, Homo sapiens
agaactggactcagg

SEQ ID NO: 3721791 - DNA, 12 bp, Homo sapiens
agaagaaatgaa

SEQ ID NO: 3721792 - DNA, 19 bp, Homo sapiens
agaagaaatgaaattttac

SEQ ID NO: 3721793 - DNA, 19 bp, Homo sapiens
agaagaactagaggtttta

SEQ ID NO: 3721794 - DNA, 14 bp, Homo sapiens
agaagaaggaaatg

SEQ ID NO: 3721795 - DNA, 14 bp, Homo sapiens
agaagaaggcagca

SEQ ID NO: 3721796 - DNA, 21 bp, Homo sapiens
agaagaaggcagcaggtggca

SEQ ID NO: 3721797 - DNA, 19 bp, Homo sapiens
agaagaattgaacccagga

SEQ ID NO: 3721798 - DNA, 20 bp, Homo sapiens
agaagaattgaacccaggag

SEQ ID NO: 3721799 - DNA, 21 bp, Homo sapiens
agaagacactgatgggcaacc

SEQ ID NO: 3721800 - DNA, 12 bp, Homo sapiens
agaagacactgc

SEQ ID NO: 3721801 - DNA, 22 bp, Homo sapiens
agaagagatgggcttgttttct

SEQ ID NO: 3721802 - DNA, 18 bp, Homo sapiens
agaagatgaatgagcaaa

SEQ ID NO: 3721803 - DNA, 18 bp, Homo sapiens
agaagattttgaaatttt

SEQ ID NO: 3721804 - DNA, 17 bp, Homo sapiens
agaagcaacagaaaaaa

SEQ ID NO: 3721805 - DNA, 15 bp, Homo sapiens
agaagcaagaaagaa

SEQ ID NO: 3721806 - DNA, 14 bp, Homo sapiens
agaagccgggaaca

SEQ ID NO: 3721807 - DNA, 16 bp, Homo sapiens
agaagccgggaacaga

SEQ ID NO: 3721808 - DNA, 23 bp, Homo sapiens
agaagcctattgtaaatacaagt

SEQ ID NO: 3721809 - DNA, 14 bp, Homo sapiens
agaagcctctggct

SEQ ID NO: 3721810 - DNA, 12 bp, Homo sapiens
agaagcctgagg

SEQ ID NO: 3721811 - DNA, 14 bp, Homo sapiens
agaagcctgaggct

SEQ ID NO: 3721812 - DNA, 17 bp, Homo sapiens
agaagcctgaggctggg

SEQ ID NO: 3721813 - DNA, 14 bp, Homo sapiens
agaagccttggtac

SEQ ID NO: 3721814 - DNA, 15 bp, Homo sapiens
agaagcggctggcag

SEQ ID NO: 3721815 - DNA, 18 bp, Homo sapiens
agaagcttccattccaag

SEQ ID NO: 3721816 - DNA, 14 bp, Homo sapiens
agaaggaagacttt

SEQ ID NO: 3721817 - DNA, 17 bp, Homo sapiens
agaaggagacagagctg

SEQ ID NO: 3721818 - DNA, 19 bp, Homo sapiens
agaaggaggagagggaaaa

SEQ ID NO: 3721819 - DNA, 13 bp, Homo sapiens
agaaggcagcagg

SEQ ID NO: 3721820 - DNA, 15 bp, Homo sapiens
agaaggcagggaaag

SEQ ID NO: 3721821 - DNA, 15 bp, Homo sapiens
agaagggaaacagtc

SEQ ID NO: 3721822 - DNA, 16 bp, Homo sapiens
agaagggaaacagtca

SEQ ID NO: 3721823 - DNA, 19 bp, Homo sapiens
agaagggccagtcctgcct

SEQ ID NO: 3721824 - DNA, 20 bp, Homo sapiens
agaagggccagtcctgcctg

SEQ ID NO: 3721825 - DNA, 18 bp, Homo sapiens
agaagggggtcaaagcaa

SEQ ID NO: 3721826 - DNA, 18 bp, Homo sapiens
agaagggtccttccctct

SEQ ID NO: 3721827 - DNA, 20 bp, Homo sapiens
agaagggtccttccctctcc

SEQ ID NO: 3721828 - DNA, 16 bp, Homo sapiens
agaagggttatatttt

SEQ ID NO: 3721829 - DNA, 19 bp, Homo sapiens
agaagggttatattttact

SEQ ID NO: 3721830 - DNA, 21 bp, Homo sapiens
agaaggtccttaatgatccgt

SEQ ID NO: 3721831 - DNA, 19 bp, Homo sapiens
agaaggtgggggttggctg

SEQ ID NO: 3721832 - DNA, 14 bp, Homo sapiens
agaagtcaaagtaa

SEQ ID NO: 3721833 - DNA, 17 bp, Homo sapiens
agaagtcaaagtaaaac

SEQ ID NO: 3721834 - DNA, 14 bp, Homo sapiens
agaagtcacacagt

SEQ ID NO: 3721835 - DNA, 15 bp, Homo sapiens
agaagtggaccagga

SEQ ID NO: 3721836 - DNA, 18 bp, Homo sapiens
agaagtggaccaggacag

SEQ ID NO: 3721837 - DNA, 17 bp, Homo sapiens
agaagtgggccaggaca

SEQ ID NO: 3721838 - DNA, 18 bp, Homo sapiens
agaagtgggccaggacag

SEQ ID NO: 3721839 - DNA, 23 bp, Homo sapiens
agaagtgggccaggacaggcccg

SEQ ID NO: 3721840 - DNA, 22 bp, Homo sapiens
agaagtttgagatcagcctggg

SEQ ID NO: 3721841 - DNA, 14 bp, Homo sapiens
agaataataagagg

SEQ ID NO: 3721842 - DNA, 15 bp, Homo sapiens
agaataatgaatgga

SEQ ID NO: 3721843 - DNA, 21 bp, Homo sapiens
agaataatgtgggaagaaaca

SEQ ID NO: 3721844 - DNA, 16 bp, Homo sapiens
agaatacaaacatatt

SEQ ID NO: 3721845 - DNA, 14 bp, Homo sapiens
agaatataattatc

SEQ ID NO: 3721846 - DNA, 19 bp, Homo sapiens
agaatattagctttactgt

SEQ ID NO: 3721847 - DNA, 21 bp, Homo sapiens
agaatattagctttactgttt

SEQ ID NO: 3721848 - DNA, 16 bp, Homo sapiens
agaatattgttcctaa

SEQ ID NO: 3721849 - DNA, 16 bp, Homo sapiens
agaatatttattacct

SEQ ID NO: 3721850 - DNA, 22 bp, Homo sapiens
agaatatttattacctctgata

SEQ ID NO: 3721851 - DNA, 22 bp, Homo sapiens
agaatcattatttattaaattt

SEQ ID NO: 3721852 - DNA, 13 bp, Homo sapiens
agaatcattgctt

SEQ ID NO: 3721853 - DNA, 14 bp, Homo sapiens
agaatcattgctta

SEQ ID NO: 3721854 - DNA, 14 bp, Homo sapiens
agaatccctgttca

SEQ ID NO: 3721855 - DNA, 13 bp, Homo sapiens
agaatctgaatgt

SEQ ID NO: 3721856 - DNA, 16 bp, Homo sapiens
agaatgagggccaaga

SEQ ID NO: 3721857 - DNA, 14 bp, Homo sapiens
agaatgatgcacat

SEQ ID NO: 3721858 - DNA, 13 bp, Homo sapiens
agaatgatttcat

SEQ ID NO: 3721859 - DNA, 14 bp, Homo sapiens
agaatgatttcatg

SEQ ID NO: 3721860 - DNA, 18 bp, Homo sapiens
agaatggctttggtctct

SEQ ID NO: 3721861 - DNA, 23 bp, Homo sapiens
agaatggctttggtctcttgctt

SEQ ID NO: 3721862 - DNA, 15 bp, Homo sapiens
agaatggggtgcatg

SEQ ID NO: 3721863 - DNA, 17 bp, Homo sapiens
agaatgtcagaaaaaca

SEQ ID NO: 3721864 - DNA, 19 bp, Homo sapiens
agaatgtcagattcctttc

SEQ ID NO: 3721865 - DNA, 21 bp, Homo sapiens
agaatgtcagattcctttccc

SEQ ID NO: 3721866 - DNA, 18 bp, Homo sapiens
agaatgtgctcatgcatt

SEQ ID NO: 3721867 - DNA, 22 bp, Homo sapiens
agaatgttatagtgaattatcc

SEQ ID NO: 3721868 - DNA, 18 bp, Homo sapiens
agaatgttgtattcagtg

SEQ ID NO: 3721869 - DNA, 14 bp, Homo sapiens
agaattaatttatt

SEQ ID NO: 3721870 - DNA, 13 bp, Homo sapiens
agaattctgctac

SEQ ID NO: 3721871 - DNA, 17 bp, Homo sapiens
agaattcttcaggtgga

SEQ ID NO: 3721872 - DNA, 20 bp, Homo sapiens
agaattgatatacacggatg

SEQ ID NO: 3721873 - DNA, 20 bp, Homo sapiens
agaattgcaattttaacaca

SEQ ID NO: 3721874 - DNA, 15 bp, Homo sapiens
agaattgtatcattt

SEQ ID NO: 3721875 - DNA, 14 bp, Homo sapiens
agaatttcaatttg

SEQ ID NO: 3721876 - DNA, 15 bp, Homo sapiens
agaattttaaattat

SEQ ID NO: 3721877 - DNA, 16 bp, Homo sapiens
agaattttaagtgctt

SEQ ID NO: 3721878 - DNA, 22 bp, Homo sapiens
agaattttaagtgctttgtaat

SEQ ID NO: 3721879 - DNA, 23 bp, Homo sapiens
acttgtcttaaataaaagaaatg

SEQ ID NO: 3721880 - DNA, 14 bp, Homo sapiens
acttgtggacacag

SEQ ID NO: 3721881 - DNA, 15 bp, Homo sapiens
acttgtggacacagc

SEQ ID NO: 3721882 - DNA, 14 bp, Homo sapiens
acttgtgtctctgt

SEQ ID NO: 3721883 - DNA, 22 bp, Homo sapiens
acttgtgtctctgtgcttttaa

SEQ ID NO: 3721884 - DNA, 23 bp, Homo sapiens
acttgtgtgtgggctgtgagtgt

SEQ ID NO: 3721885 - DNA, 10 bp, Homo sapiens
acttgtgttt

SEQ ID NO: 3721886 - DNA, 16 bp, Homo sapiens
acttgttccagctctt

SEQ ID NO: 3721887 - DNA, 17 bp, Homo sapiens
acttgttccagctcttt

SEQ ID NO: 3721888 - DNA, 16 bp, Homo sapiens
actttaaaaggagcca

SEQ ID NO: 3721889 - DNA, 22 bp, Homo sapiens
actttaatatgtattttatgta

SEQ ID NO: 3721890 - DNA, 12 bp, Homo sapiens
actttagaaata

SEQ ID NO: 3721891 - DNA, 21 bp, Homo sapiens
actttagagtagcatgagaga

SEQ ID NO: 3721892 - DNA, 13 bp, Homo sapiens
actttatcacatt

SEQ ID NO: 3721893 - DNA, 14 bp, Homo sapiens
actttatgcaataa

SEQ ID NO: 3721894 - DNA, 21 bp, Homo sapiens
actttattttatataataaag

SEQ ID NO: 3721895 - DNA, 23 bp, Homo sapiens
actttattttatataataaagta

SEQ ID NO: 3721896 - DNA, 13 bp, Homo sapiens
actttattttctg

SEQ ID NO: 3721897 - DNA, 22 bp, Homo sapiens
actttcaggccacatggctaaa

SEQ ID NO: 3721898 - DNA, 18 bp, Homo sapiens
actttcagtgaaagcatc

SEQ ID NO: 3721899 - DNA, 19 bp, Homo sapiens
actttcattaaagcattta

SEQ ID NO: 3721900 - DNA, 13 bp, Homo sapiens
actttcattgcca

SEQ ID NO: 3721901 - DNA, 21 bp, Homo sapiens
actttcattgccagtgtcttt

SEQ ID NO: 3721902 - DNA, 18 bp, Homo sapiens
actttccaccccctccct

SEQ ID NO: 3721903 - DNA, 20 bp, Homo sapiens
actttccaccccctccctgg

SEQ ID NO: 3721904 - DNA, 22 bp, Homo sapiens
actttccccatactctgtctcc

SEQ ID NO: 3721905 - DNA, 22 bp, Homo sapiens
actttccccgtgggccatggca

SEQ ID NO: 3721906 - DNA, 21 bp, Homo sapiens
actttcttttcgccgtggctg

SEQ ID NO: 3721907 - DNA, 15 bp, Homo sapiens
actttcttttctgga

SEQ ID NO: 3721908 - DNA, 12 bp, Homo sapiens
actttgggaggc

SEQ ID NO: 3721909 - DNA, 23 bp, Homo sapiens
actttggtgcgggcacaataaat

SEQ ID NO: 3721910 - DNA, 15 bp, Homo sapiens
actttgtatgatatt

SEQ ID NO: 3721911 - DNA, 16 bp, Homo sapiens
actttgtatgatattc

SEQ ID NO: 3721912 - DNA, 22 bp, Homo sapiens
actttgtatgatattccatagt

SEQ ID NO: 3721913 - DNA, 15 bp, Homo sapiens
actttgtcagaggca

SEQ ID NO: 3721914 - DNA, 13 bp, Homo sapiens
acttttagaaact

SEQ ID NO: 3721915 - DNA, 15 bp, Homo sapiens
acttttataaattaa

SEQ ID NO: 3721916 - DNA, 17 bp, Homo sapiens
acttttataaattaaat

SEQ ID NO: 3721917 - DNA, 23 bp, Homo sapiens
acttttccttccctcaaagcttc

SEQ ID NO: 3721918 - DNA, 12 bp, Homo sapiens
acttttcgttaa

SEQ ID NO: 3721919 - DNA, 17 bp, Homo sapiens
acttttcgttaacattg

SEQ ID NO: 3721920 - DNA, 16 bp, Homo sapiens
acttttgagacttttt

SEQ ID NO: 3721921 - DNA, 21 bp, Homo sapiens
acttttggaatctagaagaaa

SEQ ID NO: 3721922 - DNA, 16 bp, Homo sapiens
actttttcaagattga

SEQ ID NO: 3721923 - DNA, 13 bp, Homo sapiens
agaaaaaaaacac

SEQ ID NO: 3721924 - DNA, 20 bp, Homo sapiens
agaaaaaaaataacacagag

SEQ ID NO: 3721925 - DNA, 13 bp, Homo sapiens
agaaaaaaaccat

SEQ ID NO: 3721926 - DNA, 22 bp, Homo sapiens
agaaaaaaataattttatgaac

SEQ ID NO: 3721927 - DNA, 18 bp, Homo sapiens
agaaaaaataacacacat

SEQ ID NO: 3721928 - DNA, 14 bp, Homo sapiens
agaaaaaatacatt

SEQ ID NO: 3721929 - DNA, 19 bp, Homo sapiens
agaaaaaatattttcccta

SEQ ID NO: 3721930 - DNA, 23 bp, Homo sapiens
agaaaaaatattttcctgccagg

SEQ ID NO: 3721931 - DNA, 20 bp, Homo sapiens
agaaaaagcaataacctcaa

SEQ ID NO: 3721932 - DNA, 20 bp, Homo sapiens
agaaaacaaaaaaacctcta

SEQ ID NO: 3721933 - DNA, 17 bp, Homo sapiens
agaaaacacttgtaagt

SEQ ID NO: 3721934 - DNA, 13 bp, Homo sapiens
agaaaacagaaaa

SEQ ID NO: 3721935 - DNA, 14 bp, Homo sapiens
agaaaacagaaaaa

SEQ ID NO: 3721936 - DNA, 16 bp, Homo sapiens
agaaaacagaaaacaa

SEQ ID NO: 3721937 - DNA, 18 bp, Homo sapiens
agaaaactagaatttcat

SEQ ID NO: 3721938 - DNA, 22 bp, Homo sapiens
agaaaacttgaattcatagaaa

SEQ ID NO: 3721939 - DNA, 17 bp, Homo sapiens
agaaaagaactggaaac

SEQ ID NO: 3721940 - DNA, 21 bp, Homo sapiens
agaaaagaatccctgttcatt

SEQ ID NO: 3721941 - DNA, 20 bp, Homo sapiens
agaaaagatacgactttatt

SEQ ID NO: 3721942 - DNA, 15 bp, Homo sapiens
agaaaagtaagccct

SEQ ID NO: 3721943 - DNA, 14 bp, Homo sapiens
agaaaattgaattt

SEQ ID NO: 3721944 - DNA, 14 bp, Homo sapiens
agaaacacaatatt

SEQ ID NO: 3721945 - DNA, 19 bp, Homo sapiens
agaaacacactgaggcagg

SEQ ID NO: 3721946 - DNA, 20 bp, Homo sapiens
agaaacacactgaggcaggg

SEQ ID NO: 3721947 - DNA, 22 bp, Homo sapiens
agaaacacactgaggcagggaa

SEQ ID NO: 3721948 - DNA, 14 bp, Homo sapiens
agaaacagagacag

SEQ ID NO: 3721949 - DNA, 15 bp, Homo sapiens
agaaacagagacagg

SEQ ID NO: 3721950 - DNA, 19 bp, Homo sapiens
agaaacagagacaggccca

SEQ ID NO: 3721951 - DNA, 20 bp, Homo sapiens
agaaacagttaactttcaga

SEQ ID NO: 3721952 - DNA, 14 bp, Homo sapiens
agaaacatcagtta

SEQ ID NO: 3721953 - DNA, 14 bp, Homo sapiens
agaaaccctgtctc

SEQ ID NO: 3721954 - DNA, 16 bp, Homo sapiens
agaaaccttattgtac

SEQ ID NO: 3721955 - DNA, 15 bp, Homo sapiens
agaaactcaccccca

SEQ ID NO: 3721956 - DNA, 13 bp, Homo sapiens
agaaactgaggaa

SEQ ID NO: 3721957 - DNA, 23 bp, Homo sapiens
agaaacttgtgaagtggaaatgt

SEQ ID NO: 3721958 - DNA, 22 bp, Homo sapiens
agaaagaaacccgacagaggga

SEQ ID NO: 3721959 - DNA, 13 bp, Homo sapiens
agaaagaaggaag

SEQ ID NO: 3721960 - DNA, 23 bp, Homo sapiens
agaaagagtttgagacctgaata

SEQ ID NO: 3721961 - DNA, 23 bp, Homo sapiens
agaaagcagaggctggcctcaga

SEQ ID NO: 3721962 - DNA, 20 bp, Homo sapiens
agaaagccagtcttaacatt

SEQ ID NO: 3721963 - DNA, 19 bp, Homo sapiens
agaaaggagagtcttgcag

SEQ ID NO: 3721964 - DNA, 19 bp, Homo sapiens
agaaaggatatttaagaaa

SEQ ID NO: 3721965 - DNA, 15 bp, Homo sapiens
agaaagtaatttctt

SEQ ID NO: 3721966 - DNA, 22 bp, Homo sapiens
agaaagtacttctccaccctgc

SEQ ID NO: 3721967 - DNA, 21 bp, Homo sapiens
agaaagtgaataaaaattaag

SEQ ID NO: 3721968 - DNA, 17 bp, Homo sapiens
agaaagtgtgagcaaac

SEQ ID NO: 3721969 - DNA, 12 bp, Homo sapiens
agaaagtttccc

SEQ ID NO: 3721970 - DNA, 20 bp, Homo sapiens
agaaagtttccccaccagtg

SEQ ID NO: 3721971 - DNA, 18 bp, Homo sapiens
agaaataaagtttctgtt

SEQ ID NO: 3721972 - DNA, 18 bp, Homo sapiens
agaaataaatagctatat

SEQ ID NO: 3721973 - DNA, 22 bp, Homo sapiens
agaaataaatagctatatccat

SEQ ID NO: 3721974 - DNA, 19 bp, Homo sapiens
agaaatacaattctacatt

SEQ ID NO: 3721975 - DNA, 15 bp, Homo sapiens
agaaatatgtggttt

SEQ ID NO: 3721976 - DNA, 18 bp, Homo sapiens
agaaatgaaattttacca

SEQ ID NO: 3721977 - DNA, 13 bp, Homo sapiens
agaaatgcacaat

SEQ ID NO: 3721978 - DNA, 21 bp, Homo sapiens
agaaatgggaaatgcctaaga

SEQ ID NO: 3721979 - DNA, 23 bp, Homo sapiens
agaaatgggaaatgcctaagaag

SEQ ID NO: 3721980 - DNA, 15 bp, Homo sapiens
agaaatgtctggaga

SEQ ID NO: 3721981 - DNA, 17 bp, Homo sapiens
agaaatgtctggagaat

SEQ ID NO: 3721982 - DNA, 19 bp, Homo sapiens
agaaatgtctggagaataa

SEQ ID NO: 3721983 - DNA, 15 bp, Homo sapiens
agaaattagctgtgt

SEQ ID NO: 3721984 - DNA, 23 bp, Homo sapiens
agaaattccctggaccagatgct

SEQ ID NO: 3721985 - DNA, 24 bp, Homo sapiens
agaaattccctggaccagatgctg

SEQ ID NO: 3721986 - DNA, 17 bp, Homo sapiens
agaaattgcatttcctg

SEQ ID NO: 3721987 - DNA, 21 bp, Homo sapiens
agaaatttaattcatgtttct

SEQ ID NO: 3721988 - DNA, 22 bp, Homo sapiens
agaaatttaattcatgtttctt

SEQ ID NO: 3721989 - DNA, 18 bp, Homo sapiens
agaaatttttcagatgct

SEQ ID NO: 3721990 - DNA, 23 bp, Homo sapiens
agaaatttttcagatgcttctgg

SEQ ID NO: 3721991 - DNA, 17 bp, Homo sapiens
agaacaaggtagttttt

SEQ ID NO: 3721992 - DNA, 18 bp, Homo sapiens
agaacactattttcagaa

SEQ ID NO: 3721993 - DNA, 12 bp, Homo sapiens
acttccatagtg

SEQ ID NO: 3721994 - DNA, 11 bp, Homo sapiens
acttcccagct

SEQ ID NO: 3721995 - DNA, 19 bp, Homo sapiens
acttcctgcctggtctcct

SEQ ID NO: 3721996 - DNA, 21 bp, Homo sapiens
acttcctgcctggtctcctgc

SEQ ID NO: 3721997 - DNA, 20 bp, Homo sapiens
acttcgggaggtcgaggcag

SEQ ID NO: 3721998 - DNA, 23 bp, Homo sapiens
acttcgttttggttaagttggct

SEQ ID NO: 3721999 - DNA, 17 bp, Homo sapiens
acttctaaatgcatatc

SEQ ID NO: 3722000 - DNA, 15 bp, Homo sapiens
acttctccaccctgc

SEQ ID NO: 3722001 - DNA, 19 bp, Homo sapiens
acttctgtgagacccccac

SEQ ID NO: 3722002 - DNA, 20 bp, Homo sapiens
acttctgtgagacccccaca

SEQ ID NO: 3722003 - DNA, 23 bp, Homo sapiens
acttctgtgagacccccacacct

SEQ ID NO: 3722004 - DNA, 17 bp, Homo sapiens
acttcttatacatttga

SEQ ID NO: 3722005 - DNA, 18 bp, Homo sapiens
acttcttatacatttgat

SEQ ID NO: 3722006 - DNA, 20 bp, Homo sapiens
acttgaaagcatccatgtgt

SEQ ID NO: 3722007 - DNA, 23 bp, Homo sapiens
acttgagaacttgacaagttgcg

SEQ ID NO: 3722008 - DNA, 12 bp, Homo sapiens
acttgagcatgt

SEQ ID NO: 3722009 - DNA, 21 bp, Homo sapiens
acttgagcgtgaatctgtatc

SEQ ID NO: 3722010 - DNA, 17 bp, Homo sapiens
acttgctgcctgaagaa

SEQ ID NO: 3722011 - DNA, 14 bp, Homo sapiens
acttggagccaagg

SEQ ID NO: 3722012 - DNA, 14 bp, Homo sapiens
acttgggccactgt

SEQ ID NO: 3722013 - DNA, 14 bp, Homo sapiens
acttggttatacat

SEQ ID NO: 3722014 - DNA, 14 bp, Homo sapiens
acttgtaaatgctg

SEQ ID NO: 3722015 - DNA, 14 bp, Homo sapiens
acttgtacaaaata

SEQ ID NO: 3722016 - DNA, 14 bp, Homo sapiens
acttgtatgaaaga

SEQ ID NO: 3722017 - DNA, 13 bp, Homo sapiens
acttgtcatgtga

SEQ ID NO: 3722018 - DNA, 12 bp, Homo sapiens
acttgtcttaaa

SEQ ID NO: 3722019 - DNA, 13 bp, Homo sapiens
actgctgctgcct

SEQ ID NO: 3722020 - DNA, 15 bp, Homo sapiens
actgctggctgcctt

SEQ ID NO: 3722021 - DNA, 13 bp, Homo sapiens
actgctgggactg

SEQ ID NO: 3722022 - DNA, 18 bp, Homo sapiens
actgctgggactggccag

SEQ ID NO: 3722023 - DNA, 22 bp, Homo sapiens
actgctgtaaataaatgcttta

SEQ ID NO: 3722024 - DNA, 16 bp, Homo sapiens
actgctgtgaacaagt

SEQ ID NO: 3722025 - DNA, 20 bp, Homo sapiens
actgcttttaacttctgata

SEQ ID NO: 3722026 - DNA, 16 bp, Homo sapiens
actgcttttggtctgt

SEQ ID NO: 3722027 - DNA, 12 bp, Homo sapiens
actggaagcaca

SEQ ID NO: 3722028 - DNA, 19 bp, Homo sapiens
actggaagcacagcttcat

SEQ ID NO: 3722029 - DNA, 13 bp, Homo sapiens
actggaagttttg

SEQ ID NO: 3722030 - DNA, 18 bp, Homo sapiens
actggaatttttattatg

SEQ ID NO: 3722031 - DNA, 23 bp, Homo sapiens
actggaatttttattatgcataa

SEQ ID NO: 3722032 - DNA, 16 bp, Homo sapiens
actggaccactgggca

SEQ ID NO: 3722033 - DNA, 14 bp, Homo sapiens
actggactcaggat

SEQ ID NO: 3722034 - DNA, 18 bp, Homo sapiens
actggagacaatgcagat

SEQ ID NO: 3722035 - DNA, 15 bp, Homo sapiens
actggagcaccaggc

SEQ ID NO: 3722036 - DNA, 14 bp, Homo sapiens
actggagcccagga

SEQ ID NO: 3722037 - DNA, 16 bp, Homo sapiens
actggagcccaggagt

SEQ ID NO: 3722038 - DNA, 17 bp, Homo sapiens
actggagtccagtctct

SEQ ID NO: 3722039 - DNA, 13 bp, Homo sapiens
actggattggcca

SEQ ID NO: 3722040 - DNA, 21 bp, Homo sapiens
actggcaaacttcagactgaa

SEQ ID NO: 3722041 - DNA, 12 bp, Homo sapiens
acagaaaacaac

SEQ ID NO: 3722042 - DNA, 14 bp, Homo sapiens
acagaaaacaacaa

SEQ ID NO: 3722043 - DNA, 18 bp, Homo sapiens
acagaaaacaacaaaaaa

SEQ ID NO: 3722044 - DNA, 21 bp, Homo sapiens
acagaaaacaacaaaaaataa

SEQ ID NO: 3722045 - DNA, 14 bp, Homo sapiens
acagaaaactagaa

SEQ ID NO: 3722046 - DNA, 11 bp, Homo sapiens
acagaaagaga

SEQ ID NO: 3722047 - DNA, 12 bp, Homo sapiens
acagaacactgt

SEQ ID NO: 3722048 - DNA, 20 bp, Homo sapiens
acagaagaaggcagcaggtg

SEQ ID NO: 3722049 - DNA, 16 bp, Homo sapiens
acagaagtcatgaagc

SEQ ID NO: 3722050 - DNA, 17 bp, Homo sapiens
acagaagtcatgaagcc

SEQ ID NO: 3722051 - DNA, 18 bp, Homo sapiens
acagaagtcatgaagccc

SEQ ID NO: 3722052 - DNA, 18 bp, Homo sapiens
acagacaaaaacagcctc

SEQ ID NO: 3722053 - DNA, 22 bp, Homo sapiens
acagacaaggtagccctggcca

SEQ ID NO: 3722054 - DNA, 14 bp, Homo sapiens
acagacacaggccc

SEQ ID NO: 3722055 - DNA, 23 bp, Homo sapiens
acagacacaggcccggctccagg

SEQ ID NO: 3722056 - DNA, 16 bp, Homo sapiens
acagacagacacacac

SEQ ID NO: 3722057 - DNA, 16 bp, Homo sapiens
acagacgtccctccac

SEQ ID NO: 3722058 - DNA, 17 bp, Homo sapiens
acagactggaagcacag

SEQ ID NO: 3722059 - DNA, 20 bp, Homo sapiens
acagactggcctgaggagca

SEQ ID NO: 3722060 - DNA, 16 bp, Homo sapiens
acagacttctccagac

SEQ ID NO: 3722061 - DNA, 14 bp, Homo sapiens
acagacttgagaac

SEQ ID NO: 3722062 - DNA, 18 bp, Homo sapiens
acagacttgagaacttga

SEQ ID NO: 3722063 - DNA, 11 bp, Homo sapiens
acagagaaagt

SEQ ID NO: 3722064 - DNA, 18 bp, Homo sapiens
acagagaaagtacttctc

SEQ ID NO: 3722065 - DNA, 23 bp, Homo sapiens
acagagaactagtggtggctctg

SEQ ID NO: 3722066 - DNA, 12 bp, Homo sapiens
acagagaaggaa

SEQ ID NO: 3722067 - DNA, 13 bp, Homo sapiens
acagagaaggaat

SEQ ID NO: 3722068 - DNA, 15 bp, Homo sapiens
acagagaaggaatgt

SEQ ID NO: 3722069 - DNA, 16 bp, Homo sapiens
acagagaaggcaggaa

SEQ ID NO: 3722070 - DNA, 15 bp, Homo sapiens
acagagacacctgca

SEQ ID NO: 3722071 - DNA, 17 bp, Homo sapiens
acagagacacctgcacc

SEQ ID NO: 3722072 - DNA, 15 bp, Homo sapiens
acagagacaggccca

SEQ ID NO: 3722073 - DNA, 15 bp, Homo sapiens
acagagaggacgtgg

SEQ ID NO: 3722074 - DNA, 18 bp, Homo sapiens
acagagaggagaaacaca

SEQ ID NO: 3722075 - DNA, 21 bp, Homo sapiens
acagagcgagagtctgtctca

SEQ ID NO: 3722076 - DNA, 14 bp, Homo sapiens
acagaggaagagca

SEQ ID NO: 3722077 - DNA, 18 bp, Homo sapiens
acagaggaagagcaggca

SEQ ID NO: 3722078 - DNA, 15 bp, Homo sapiens
acagaggcagcccca

SEQ ID NO: 3722079 - DNA, 17 bp, Homo sapiens
acagaggccatggcaga

SEQ ID NO: 3722080 - DNA, 15 bp, Homo sapiens
acagagggaagaaaa

SEQ ID NO: 3722081 - DNA, 16 bp, Homo sapiens
acagagggaagaaaag

SEQ ID NO: 3722082 - DNA, 19 bp, Homo sapiens
acagagtctcactgttgcc

SEQ ID NO: 3722083 - DNA, 19 bp, Homo sapiens
acagagtgagactctgtct

SEQ ID NO: 3722084 - DNA, 24 bp, Homo sapiens
acagagtggtctttctggagaggt

SEQ ID NO: 3722085 - DNA, 19 bp, Homo sapiens
acagatgaactctttctgg

SEQ ID NO: 3722086 - DNA, 14 bp, Homo sapiens
acagatgccccaga

SEQ ID NO: 3722087 - DNA, 16 bp, Homo sapiens
acagatgccccagagc

SEQ ID NO: 3722088 - DNA, 17 bp, Homo sapiens
acagatgccccagagct

SEQ ID NO: 3722089 - DNA, 16 bp, Homo sapiens
acagatggatttgcct

SEQ ID NO: 3722090 - DNA, 13 bp, Homo sapiens
acagattgcctcc

SEQ ID NO: 3722091 - DNA, 13 bp, Homo sapiens
acagattgctgct

SEQ ID NO: 3722092 - DNA, 21 bp, Homo sapiens
acagcaaaaccattgcttcac

SEQ ID NO: 3722093 - DNA, 20 bp, Homo sapiens
acagcaaatttataatttta

SEQ ID NO: 3722094 - DNA, 15 bp, Homo sapiens
acagcaattcctcag

SEQ ID NO: 3722095 - DNA, 11 bp, Homo sapiens
acagcaggtgt

SEQ ID NO: 3722096 - DNA, 17 bp, Homo sapiens
acagcatggtgcatgcc

SEQ ID NO: 3722097 - DNA, 13 bp, Homo sapiens
acagcatgtgtat

SEQ ID NO: 3722098 - DNA, 23 bp, Homo sapiens
acagcattcttgtcacaataaat

SEQ ID NO: 3722099 - DNA, 11 bp, Homo sapiens
acagcattgct

SEQ ID NO: 3722100 - DNA, 15 bp, Homo sapiens
acagcattgctttct

SEQ ID NO: 3722101 - DNA, 15 bp, Homo sapiens
acagccacggccagg

SEQ ID NO: 3722102 - DNA, 16 bp, Homo sapiens
acagccacggccaggc

SEQ ID NO: 3722103 - DNA, 17 bp, Homo sapiens
acagccacggccaggcc

SEQ ID NO: 3722104 - DNA, 20 bp, Homo sapiens
acagcccgcatgcagcagct

SEQ ID NO: 3722105 - DNA, 22 bp, Homo sapiens
acagccgagtggatagatgccc

SEQ ID NO: 3722106 - DNA, 23 bp, Homo sapiens
acagccgcagcctccctctgacc

SEQ ID NO: 3722107 - DNA, 20 bp, Homo sapiens
acagccgctcctgtctgcca

SEQ ID NO: 3722108 - DNA, 18 bp, Homo sapiens
acagccggggcctgccta

SEQ ID NO: 3722109 - DNA, 19 bp, Homo sapiens
acagccgtcagccaaatgt

SEQ ID NO: 3722110 - DNA, 16 bp, Homo sapiens
acagcctcccaccccc

SEQ ID NO: 3722111 - DNA, 14 bp, Homo sapiens
acagcctggcacag

SEQ ID NO: 3722112 - DNA, 22 bp, Homo sapiens
acagcctgtggcggtgcctggg

SEQ ID NO: 3722113 - DNA, 18 bp, Homo sapiens
acagcgagactccgtctc

SEQ ID NO: 3722114 - DNA, 22 bp, Homo sapiens
acagctaatcagcattctcact

SEQ ID NO: 3722115 - DNA, 16 bp, Homo sapiens
acagctaatgggacac

SEQ ID NO: 3722116 - DNA, 13 bp, Homo sapiens
acagctacacaga

SEQ ID NO: 3722117 - DNA, 16 bp, Homo sapiens
acagctatgggagccc

SEQ ID NO: 3722118 - DNA, 15 bp, Homo sapiens
acagctccttctgtc

SEQ ID NO: 3722119 - DNA, 18 bp, Homo sapiens
acagctccttctgtccta

SEQ ID NO: 3722120 - DNA, 20 bp, Homo sapiens
acagctctgtgttgccatgt

SEQ ID NO: 3722121 - DNA, 17 bp, Homo sapiens
acagctcttctccaggc

SEQ ID NO: 3722122 - DNA, 18 bp, Homo sapiens
acagctcttctccaggct

SEQ ID NO: 3722123 - DNA, 19 bp, Homo sapiens
acagctcttctccaggctg

SEQ ID NO: 3722124 - DNA, 12 bp, Homo sapiens
acagctgcctgc

SEQ ID NO: 3722125 - DNA, 16 bp, Homo sapiens
acagctgtccctgtca

SEQ ID NO: 3722126 - DNA, 21 bp, Homo sapiens
acagcttcatttcctgtgtct

SEQ ID NO: 3722127 - DNA, 21 bp, Homo sapiens
acagcttttagtacccacctg

SEQ ID NO: 3722128 - DNA, 14 bp, Homo sapiens
acaggaaaaaaact

SEQ ID NO: 3722129 - DNA, 16 bp, Homo sapiens
acaggaaaaaaacttt

SEQ ID NO: 3722130 - DNA, 23 bp, Homo sapiens
acaggaaaaaaacttttataaat

SEQ ID NO: 3722131 - DNA, 15 bp, Homo sapiens
acaggaaaagctgct

SEQ ID NO: 3722132 - DNA, 17 bp, Homo sapiens
acaggaaaatcctctgg

SEQ ID NO: 3722133 - DNA, 22 bp, Homo sapiens
acaggaaagggaaggccccaca

SEQ ID NO: 3722134 - DNA, 17 bp, Homo sapiens
acaggaagtcttcaggg

SEQ ID NO: 3722135 - DNA, 20 bp, Homo sapiens
acaggacagcatggtgcatg

SEQ ID NO: 3722136 - DNA, 22 bp, Homo sapiens
acaggacagcatggtgcatgcc

SEQ ID NO: 3722137 - DNA, 17 bp, Homo sapiens
acaggacagtgcttcag

SEQ ID NO: 3722138 - DNA, 20 bp, Homo sapiens
acaggacagtgcttcagcct

SEQ ID NO: 3722139 - DNA, 16 bp, Homo sapiens
acaggactctgcctcc

SEQ ID NO: 3722140 - DNA, 15 bp, Homo sapiens
acaggagagaaaggg

SEQ ID NO: 3722141 - DNA, 13 bp, Homo sapiens
acaggagctggga

SEQ ID NO: 3722142 - DNA, 14 bp, Homo sapiens
acaggagctgggat

SEQ ID NO: 3722143 - DNA, 16 bp, Homo sapiens
acaggatggtctctgc

SEQ ID NO: 3722144 - DNA, 17 bp, Homo sapiens
acaggatggtctctgcc

SEQ ID NO: 3722145 - DNA, 14 bp, Homo sapiens
acaggattattgga

SEQ ID NO: 3722146 - DNA, 19 bp, Homo sapiens
acaggcaaaatccttgctt

SEQ ID NO: 3722147 - DNA, 14 bp, Homo sapiens
acaggcaaatgcat

SEQ ID NO: 3722148 - DNA, 16 bp, Homo sapiens
acaggcaagcacctcc

SEQ ID NO: 3722149 - DNA, 19 bp, Homo sapiens
acaggcaagcacctcctgc

SEQ ID NO: 3722150 - DNA, 23 bp, Homo sapiens
acaggcaagcacctcctgcctcg

SEQ ID NO: 3722151 - DNA, 17 bp, Homo sapiens
acaggcaatgctggctg

SEQ ID NO: 3722152 - DNA, 18 bp, Homo sapiens
acaggcaatgctggctgt

SEQ ID NO: 3722153 - DNA, 19 bp, Homo sapiens
acaggcaatgctggctgtt

SEQ ID NO: 3722154 - DNA, 23 bp, Homo sapiens
acaggcaatgctggctgttggct

SEQ ID NO: 3722155 - DNA, 17 bp, Homo sapiens
acaggcaccgagaatgt

SEQ ID NO: 3722156 - DNA, 12 bp, Homo sapiens
acaggcagaaag

SEQ ID NO: 3722157 - DNA, 13 bp, Homo sapiens
acaggcagcacag

SEQ ID NO: 3722158 - DNA, 22 bp, Homo sapiens
acaggcatgttctctgaggaca

SEQ ID NO: 3722159 - DNA, 22 bp, Homo sapiens
acaggcccaagagatgaagagt

SEQ ID NO: 3722160 - DNA, 20 bp, Homo sapiens
acaggcccggctccaggctc

SEQ ID NO: 3722161 - DNA, 21 bp, Homo sapiens
acaggcccggctccaggctcc

SEQ ID NO: 3722162 - DNA, 15 bp, Homo sapiens
acaggcccttcctct

SEQ ID NO: 3722163 - DNA, 22 bp, Homo sapiens
acaggcccttcctctccactgc

SEQ ID NO: 3722164 - DNA, 12 bp, Homo sapiens
acagggcacacc

SEQ ID NO: 3722165 - DNA, 22 bp, Homo sapiens
acagggcacaccgggcactcag

SEQ ID NO: 3722166 - DNA, 16 bp, Homo sapiens
acagggcagagccggg

SEQ ID NO: 3722167 - DNA, 17 bp, Homo sapiens
acaggggaatattttat

SEQ ID NO: 3722168 - DNA, 12 bp, Homo sapiens
acaggggctggt

SEQ ID NO: 3722169 - DNA, 16 bp, Homo sapiens
acagggtgttgtcagc

SEQ ID NO: 3722170 - DNA, 14 bp, Homo sapiens
acagggttgggccc

SEQ ID NO: 3722171 - DNA, 18 bp, Homo sapiens
acaggtaaactatcttgg

SEQ ID NO: 3722172 - DNA, 23 bp, Homo sapiens
acaggtcaatacagtacaggcag

SEQ ID NO: 3722173 - DNA, 18 bp, Homo sapiens
acaggtctcctcttaaaa

SEQ ID NO: 3722174 - DNA, 19 bp, Homo sapiens
acaggtctcctcttaaaaa

SEQ ID NO: 3722175 - DNA, 16 bp, Homo sapiens
acaggtggacacacaa

SEQ ID NO: 3722176 - DNA, 22 bp, Homo sapiens
acaggtgtccccagcccactgg

SEQ ID NO: 3722177 - DNA, 22 bp, Homo sapiens
acaggtgtgagtcaccaagccc

SEQ ID NO: 3722178 - DNA, 12 bp, Homo sapiens
acagtacaggca

SEQ ID NO: 3722179 - DNA, 18 bp, Homo sapiens
acagtacaggcagcacag

SEQ ID NO: 3722180 - DNA, 20 bp, Homo sapiens
acagtacaggcagcacagag

SEQ ID NO: 3722181 - DNA, 14 bp, Homo sapiens
acagtattctgtac

SEQ ID NO: 3722182 - DNA, 17 bp, Homo sapiens
acagtattctgtaccat

SEQ ID NO: 3722183 - DNA, 17 bp, Homo sapiens
acagtcaaaacagagat

SEQ ID NO: 3722184 - DNA, 17 bp, Homo sapiens
acagtcacatgcttgat

SEQ ID NO: 3722185 - DNA, 12 bp, Homo sapiens
acagtcctggga

SEQ ID NO: 3722186 - DNA, 21 bp, Homo sapiens
acagtcctgggagaacctcag

SEQ ID NO: 3722187 - DNA, 22 bp, Homo sapiens
acagtcctgggagaacctcagg

SEQ ID NO: 3722188 - DNA, 19 bp, Homo sapiens
acagtctctttaatcttca

SEQ ID NO: 3722189 - DNA, 14 bp, Homo sapiens
acagtgagcctgaa

SEQ ID NO: 3722190 - DNA, 23 bp, Homo sapiens
acagtgagcttggaaaggaccag

SEQ ID NO: 3722191 - DNA, 15 bp, Homo sapiens
acagtgatctccata

SEQ ID NO: 3722192 - DNA, 17 bp, Homo sapiens
acagtgcagacaggcca

SEQ ID NO: 3722193 - DNA, 15 bp, Homo sapiens
acagtgcatctcagc

SEQ ID NO: 3722194 - DNA, 17 bp, Homo sapiens
acagtgccattgtcttt

SEQ ID NO: 3722195 - DNA, 11 bp, Homo sapiens
acagtgcctgc

SEQ ID NO: 3722196 - DNA, 13 bp, Homo sapiens
acagtgcctgctg

SEQ ID NO: 3722197 - DNA, 15 bp, Homo sapiens
acagtgcttcagcct

SEQ ID NO: 3722198 - DNA, 18 bp, Homo sapiens
acagtgcttcagcctgag

SEQ ID NO: 3722199 - DNA, 13 bp, Homo sapiens
acagtgggagcca

SEQ ID NO: 3722200 - DNA, 21 bp, Homo sapiens
acagtgggtgccccccttgcc

SEQ ID NO: 3722201 - DNA, 23 bp, Homo sapiens
acagtggttctacaatctattta

SEQ ID NO: 3722202 - DNA, 16 bp, Homo sapiens
acagtgttattttctt

SEQ ID NO: 3722203 - DNA, 21 bp, Homo sapiens
acagtgttgaaaatgttcaga

SEQ ID NO: 3722204 - DNA, 15 bp, Homo sapiens
acagtgtttcccata

SEQ ID NO: 3722205 - DNA, 22 bp, Homo sapiens
acagttagggttgagttacttc

SEQ ID NO: 3722206 - DNA, 12 bp, Homo sapiens
acagttcctcgc

SEQ ID NO: 3722207 - DNA, 14 bp, Homo sapiens
acagttcctcgccc

SEQ ID NO: 3722208 - DNA, 18 bp, Homo sapiens
acagttcctcgccctggg

SEQ ID NO: 3722209 - DNA, 19 bp, Homo sapiens
acagttcctcgccctgggt

SEQ ID NO: 3722210 - DNA, 22 bp, Homo sapiens
acagttcttttgttgtaaagag

SEQ ID NO: 3722211 - DNA, 15 bp, Homo sapiens
acagttgaaaaacag

SEQ ID NO: 3722212 - DNA, 19 bp, Homo sapiens
acagtttcttttttcttac

SEQ ID NO: 3722213 - DNA, 14 bp, Homo sapiens
acagttttaaagaa

SEQ ID NO: 3722214 - DNA, 19 bp, Homo sapiens
acagttttaaagaatcatt

SEQ ID NO: 3722215 - DNA, 21 bp, Homo sapiens
acagttttaaagaatcattat

SEQ ID NO: 3722216 - DNA, 12 bp, Homo sapiens
acagttttccat

SEQ ID NO: 3722217 - DNA, 15 bp, Homo sapiens
acagttttccatgaa

SEQ ID NO: 3722218 - DNA, 18 bp, Homo sapiens
acagttttccatgaaaac

SEQ ID NO: 3722219 - DNA, 21 bp, Homo sapiens
acagttttccatgaaaacgtt

SEQ ID NO: 3722220 - DNA, 19 bp, Homo sapiens
acagttttcctaaatgtat

SEQ ID NO: 3722221 - DNA, 13 bp, Homo sapiens
acataaaggataa

SEQ ID NO: 3722222 - DNA, 21 bp, Homo sapiens
acataaaggtggtatgtgtgt

SEQ ID NO: 3722223 - DNA, 18 bp, Homo sapiens
acataaaggttattttct

SEQ ID NO: 3722224 - DNA, 13 bp, Homo sapiens
acataaattagag

SEQ ID NO: 3722225 - DNA, 14 bp, Homo sapiens
acataacaaaatca

SEQ ID NO: 3722226 - DNA, 13 bp, Homo sapiens
acataacagaatg

SEQ ID NO: 3722227 - DNA, 16 bp, Homo sapiens
acataacagggtaaat

SEQ ID NO: 3722228 - DNA, 20 bp, Homo sapiens
acataacagggtaaattatt

SEQ ID NO: 3722229 - DNA, 22 bp, Homo sapiens
acataacagggtaaattattca

SEQ ID NO: 3722230 - DNA, 16 bp, Homo sapiens
acataaccactgcttc

SEQ ID NO: 3722231 - DNA, 20 bp, Homo sapiens
acatacaggaaggtagaaat

SEQ ID NO: 3722232 - DNA, 24 bp, Homo sapiens
acatactccttccatcaaatagaa

SEQ ID NO: 3722233 - DNA, 15 bp, Homo sapiens
acatactttttcaag

SEQ ID NO: 3722234 - DNA, 16 bp, Homo sapiens
acatactttttcaaga

SEQ ID NO: 3722235 - DNA, 17 bp, Homo sapiens
acatagactagagaaac

SEQ ID NO: 3722236 - DNA, 21 bp, Homo sapiens
acatagactttatgcaataaa

SEQ ID NO: 3722237 - DNA, 13 bp, Homo sapiens
acatagatgtccc

SEQ ID NO: 3722238 - DNA, 22 bp, Homo sapiens
acatagattcacctgtaaaact

SEQ ID NO: 3722239 - DNA, 17 bp, Homo sapiens
acatagtgtaggcttta

SEQ ID NO: 3722240 - DNA, 15 bp, Homo sapiens
acatagttatttatt

SEQ ID NO: 3722241 - DNA, 20 bp, Homo sapiens
acatataaacatcacacaca

SEQ ID NO: 3722242 - DNA, 16 bp, Homo sapiens
acatataatatatgtt

SEQ ID NO: 3722243 - DNA, 15 bp, Homo sapiens
acatatatacacaca

SEQ ID NO: 3722244 - DNA, 20 bp, Homo sapiens
acatatatatattttttaat

SEQ ID NO: 3722245 - DNA, 16 bp, Homo sapiens
acatcaacatcttggt

SEQ ID NO: 3722246 - DNA, 14 bp, Homo sapiens
acatcaagcacaga

SEQ ID NO: 3722247 - DNA, 15 bp, Homo sapiens
acatcaatgttcatt

SEQ ID NO: 3722248 - DNA, 16 bp, Homo sapiens
acatcacttgtacaaa

SEQ ID NO: 3722249 - DNA, 19 bp, Homo sapiens
acatcacttgtacaaaata

SEQ ID NO: 3722250 - DNA, 19 bp, Homo sapiens
acatcagacctgtcttcca

SEQ ID NO: 3722251 - DNA, 15 bp, Homo sapiens
acatcagtaatgtat

SEQ ID NO: 3722252 - DNA, 22 bp, Homo sapiens
acatcagtggcatggctccagt

SEQ ID NO: 3722253 - DNA, 23 bp, Homo sapiens
acatcagtggcatggctccagtc

SEQ ID NO: 3722254 - DNA, 13 bp, Homo sapiens
acatccaagcttc

SEQ ID NO: 3722255 - DNA, 16 bp, Homo sapiens
acatccaagcttcctt

SEQ ID NO: 3722256 - DNA, 13 bp, Homo sapiens
acatccaaggaga

SEQ ID NO: 3722257 - DNA, 19 bp, Homo sapiens
acatccaggcaatggccta

SEQ ID NO: 3722258 - DNA, 18 bp, Homo sapiens
acatcccattgccctggt

SEQ ID NO: 3722259 - DNA, 23 bp, Homo sapiens
acatccctacaaaaaattagaaa

SEQ ID NO: 3722260 - DNA, 16 bp, Homo sapiens
acatccctgccagctc

SEQ ID NO: 3722261 - DNA, 17 bp, Homo sapiens
acatccctgccagctct

SEQ ID NO: 3722262 - DNA, 14 bp, Homo sapiens
acatcctgtgtttc

SEQ ID NO: 3722263 - DNA, 23 bp, Homo sapiens
acatcctgtgtttctagggaaat

SEQ ID NO: 3722264 - DNA, 23 bp, Homo sapiens
acatcttccacaggtctcagaat

SEQ ID NO: 3722265 - DNA, 19 bp, Homo sapiens
acatcttgctctgctgaca

SEQ ID NO: 3722266 - DNA, 20 bp, Homo sapiens
acatctttcacacttccacc

SEQ ID NO: 3722267 - DNA, 13 bp, Homo sapiens
acatctttcacat

SEQ ID NO: 3722268 - DNA, 22 bp, Homo sapiens
acgatgtggccctggcctgctg

SEQ ID NO: 3722269 - DNA, 12 bp, Homo sapiens
acgcacacagct

SEQ ID NO: 3722270 - DNA, 13 bp, Homo sapiens
acgcacacagctt

SEQ ID NO: 3722271 - DNA, 22 bp, Homo sapiens
acgcacacgtacttaaatgaaa

SEQ ID NO: 3722272 - DNA, 15 bp, Homo sapiens
acgcacctcccatcc

SEQ ID NO: 3722273 - DNA, 19 bp, Homo sapiens
acgcacgtgggtcttcagg

SEQ ID NO: 3722274 - DNA, 19 bp, Homo sapiens
acgcagatgatccatgagt

SEQ ID NO: 3722275 - DNA, 12 bp, Homo sapiens
acgcaggaatgg

SEQ ID NO: 3722276 - DNA, 20 bp, Homo sapiens
acgccactgcactccagcct

SEQ ID NO: 3722277 - DNA, 18 bp, Homo sapiens
acgccaggggaaaatcag

SEQ ID NO: 3722278 - DNA, 22 bp, Homo sapiens
acgccagtctcccaggccccct

SEQ ID NO: 3722279 - DNA, 16 bp, Homo sapiens
acgcccatgtgtgagt

SEQ ID NO: 3722280 - DNA, 18 bp, Homo sapiens
acgcctatgatcccagca

SEQ ID NO: 3722281 - DNA, 21 bp, Homo sapiens
acgcctgtaatcccagcactt

SEQ ID NO: 3722282 - DNA, 16 bp, Homo sapiens
acgcctgtagtcctag

SEQ ID NO: 3722283 - DNA, 23 bp, Homo sapiens
acgcgtgcacacaccagagccca

SEQ ID NO: 3722284 - DNA, 17 bp, Homo sapiens
acgctccctccccctgc

SEQ ID NO: 3722285 - DNA, 22 bp, Homo sapiens
acgctctcctttctttctaact

SEQ ID NO: 3722286 - DNA, 13 bp, Homo sapiens
acgctggaccttg

SEQ ID NO: 3722287 - DNA, 16 bp, Homo sapiens
acgctggagtgcagtg

SEQ ID NO: 3722288 - DNA, 17 bp, Homo sapiens
acgctggagtgcagtga

SEQ ID NO: 3722289 - DNA, 21 bp, Homo sapiens
acgctggtagagatggaggag

SEQ ID NO: 3722290 - DNA, 15 bp, Homo sapiens
acgctgtctccagac

SEQ ID NO: 3722291 - DNA, 18 bp, Homo sapiens
acgcttgacaggacagca

SEQ ID NO: 3722292 - DNA, 17 bp, Homo sapiens
acggaacgttggacttt

SEQ ID NO: 3722293 - DNA, 15 bp, Homo sapiens
acggaagagccttgc

SEQ ID NO: 3722294 - DNA, 17 bp, Homo sapiens
acggacactcaaaagct

SEQ ID NO: 3722295 - DNA, 13 bp, Homo sapiens
acggagagaaaaa

SEQ ID NO: 3722296 - DNA, 21 bp, Homo sapiens
acggagtcccaccttggctgc

SEQ ID NO: 3722297 - DNA, 20 bp, Homo sapiens
acggatccatgtagcaggac

SEQ ID NO: 3722298 - DNA, 13 bp, Homo sapiens
acggcacccaccc

SEQ ID NO: 3722299 - DNA, 14 bp, Homo sapiens
acggcactgtggcc

SEQ ID NO: 3722300 - DNA, 13 bp, Homo sapiens
acggccaggccag

SEQ ID NO: 3722301 - DNA, 19 bp, Homo sapiens
acggcctgatgctccctcc

SEQ ID NO: 3722302 - DNA, 22 bp, Homo sapiens
acggcctgatgctccctcccct

SEQ ID NO: 3722303 - DNA, 23 bp, Homo sapiens
acggccttgctgggggccgccct

SEQ ID NO: 3722304 - DNA, 15 bp, Homo sapiens
acggctcactgcagc

SEQ ID NO: 3722305 - DNA, 14 bp, Homo sapiens
acggggaggccaag

SEQ ID NO: 3722306 - DNA, 23 bp, Homo sapiens
acggggaggccaagtgcaggctg

SEQ ID NO: 3722307 - DNA, 16 bp, Homo sapiens
acggttcaccagcctc

SEQ ID NO: 3722308 - DNA, 19 bp, Homo sapiens
acggttcaccagcctctct

SEQ ID NO: 3722309 - DNA, 17 bp, Homo sapiens
acggttttactgcagct

SEQ ID NO: 3722310 - DNA, 22 bp, Homo sapiens
acgtaaatctgttcaaggaatc

SEQ ID NO: 3722311 - DNA, 18 bp, Homo sapiens
acgtacttagcagctatc

SEQ ID NO: 3722312 - DNA, 22 bp, Homo sapiens
acgtagtgtagatttgttttgt

SEQ ID NO: 3722313 - DNA, 20 bp, Homo sapiens
acgtatgtttttgtgtattt

SEQ ID NO: 3722314 - DNA, 15 bp, Homo sapiens
acgtcctgccacctg

SEQ ID NO: 3722315 - DNA, 20 bp, Homo sapiens
acgtcctgccacctggggca

SEQ ID NO: 3722316 - DNA, 19 bp, Homo sapiens
acgtcgtcttctgtatact

SEQ ID NO: 3722317 - DNA, 21 bp, Homo sapiens
acgtgcacctgtactcaggag

SEQ ID NO: 3722318 - DNA, 21 bp, Homo sapiens
acgtgccaggcccggggctgg

SEQ ID NO: 3722319 - DNA, 17 bp, Homo sapiens
acgtggacgtttttaat

SEQ ID NO: 3722320 - DNA, 12 bp, Homo sapiens
acgtggagaggg

SEQ ID NO: 3722321 - DNA, 14 bp, Homo sapiens
acgtggagagggat

SEQ ID NO: 3722322 - DNA, 15 bp, Homo sapiens
acgtggagagggatg

SEQ ID NO: 3722323 - DNA, 21 bp, Homo sapiens
acgtggaggaatgctccccca

SEQ ID NO: 3722324 - DNA, 20 bp, Homo sapiens
acgtggcttctgatgaatct

SEQ ID NO: 3722325 - DNA, 23 bp, Homo sapiens
acgtgtgtgactcagatgtctct

SEQ ID NO: 3722326 - DNA, 16 bp, Homo sapiens
acgttccttactgcag

SEQ ID NO: 3722327 - DNA, 18 bp, Homo sapiens
acgttccttactgcagaa

SEQ ID NO: 3722328 - DNA, 19 bp, Homo sapiens
acgttccttactgcagaat

SEQ ID NO: 3722329 - DNA, 20 bp, Homo sapiens
acgttccttactgcagaata

SEQ ID NO: 3722330 - DNA, 21 bp, Homo sapiens
acgttccttactgcagaatag

SEQ ID NO: 3722331 - DNA, 23 bp, Homo sapiens
acgttggacttttcgttaacatt

SEQ ID NO: 3722332 - DNA, 13 bp, Homo sapiens
acgtttaaagttc

SEQ ID NO: 3722333 - DNA, 15 bp, Homo sapiens
acgttttattgtgtt

SEQ ID NO: 3722334 - DNA, 18 bp, Homo sapiens
acgttttattgtgttttt

SEQ ID NO: 3722335 - DNA, 12 bp, Homo sapiens
actaaagagaga

SEQ ID NO: 3722336 - DNA, 16 bp, Homo sapiens
actaaagagagaatgt

SEQ ID NO: 3722337 - DNA, 21 bp, Homo sapiens
actaaagagagaatgtagata

SEQ ID NO: 3722338 - DNA, 20 bp, Homo sapiens
actaaagcaggccttttgat

SEQ ID NO: 3722339 - DNA, 14 bp, Homo sapiens
actaaatctgtaag

SEQ ID NO: 3722340 - DNA, 19 bp, Homo sapiens
actaaatctgtaagctctt

SEQ ID NO: 3722341 - DNA, 17 bp, Homo sapiens
actaacagataagcaag

SEQ ID NO: 3722342 - DNA, 17 bp, Homo sapiens
actaacaggatatttaa

SEQ ID NO: 3722343 - DNA, 23 bp, Homo sapiens
actaaccagggaagctgtccctc

SEQ ID NO: 3722344 - DNA, 19 bp, Homo sapiens
actaatattttatgtgaga

SEQ ID NO: 3722345 - DNA, 18 bp, Homo sapiens
actaatctattgggttca

SEQ ID NO: 3722346 - DNA, 20 bp, Homo sapiens
actaattggcctctttaaga

SEQ ID NO: 3722347 - DNA, 21 bp, Homo sapiens
actacaaaaaagttgttaact

SEQ ID NO: 3722348 - DNA, 16 bp, Homo sapiens
actacaaaatttgaaa

SEQ ID NO: 3722349 - DNA, 17 bp, Homo sapiens
actacaatttaaagcaa

SEQ ID NO: 3722350 - DNA, 20 bp, Homo sapiens
actacactccagcctgagca

SEQ ID NO: 3722351 - DNA, 11 bp, Homo sapiens
actacaggcac

SEQ ID NO: 3722352 - DNA, 19 bp, Homo sapiens
actacatcgccctccacat

SEQ ID NO: 3722353 - DNA, 12 bp, Homo sapiens
actacattttaa

SEQ ID NO: 3722354 - DNA, 13 bp, Homo sapiens
actaccacaagga

SEQ ID NO: 3722355 - DNA, 14 bp, Homo sapiens
actaccacaaggaa

SEQ ID NO: 3722356 - DNA, 18 bp, Homo sapiens
actacggaatagttggct

SEQ ID NO: 3722357 - DNA, 20 bp, Homo sapiens
actactgctaccacaactat

SEQ ID NO: 3722358 - DNA, 21 bp, Homo sapiens
actactgtggaaaaatattta

SEQ ID NO: 3722359 - DNA, 22 bp, Homo sapiens
actactgtggaaaaatatttaa

SEQ ID NO: 3722360 - DNA, 18 bp, Homo sapiens
actactgtgttcctggca

SEQ ID NO: 3722361 - DNA, 19 bp, Homo sapiens
actacttgatggtcagaca

SEQ ID NO: 3722362 - DNA, 21 bp, Homo sapiens
actacttgatggtcagacaca

SEQ ID NO: 3722363 - DNA, 17 bp, Homo sapiens
actacttgggagcaccg

SEQ ID NO: 3722364 - DNA, 22 bp, Homo sapiens
actagaaagtgaataaaaatta

SEQ ID NO: 3722365 - DNA, 14 bp, Homo sapiens
actagaagggccag

SEQ ID NO: 3722366 - DNA, 12 bp, Homo sapiens
actagagaaacc

SEQ ID NO: 3722367 - DNA, 16 bp, Homo sapiens
actagaggcagggagg

SEQ ID NO: 3722368 - DNA, 19 bp, Homo sapiens
actagaggttttatgatat

SEQ ID NO: 3722369 - DNA, 23 bp, Homo sapiens
actagctggaattttttattctt

SEQ ID NO: 3722370 - DNA, 24 bp, Homo sapiens
actagctggaattttttattcttg

SEQ ID NO: 3722371 - DNA, 14 bp, Homo sapiens
actagcttacatga

SEQ ID NO: 3722372 - DNA, 19 bp, Homo sapiens
actagcttacatgagaaca

SEQ ID NO: 3722373 - DNA, 20 bp, Homo sapiens
actagcttacatgagaacag

SEQ ID NO: 3722374 - DNA, 17 bp, Homo sapiens
actaggactctgaggct

SEQ ID NO: 3722375 - DNA, 14 bp, Homo sapiens
actaggctgggtgc

SEQ ID NO: 3722376 - DNA, 13 bp, Homo sapiens
actagggacctgg

SEQ ID NO: 3722377 - DNA, 16 bp, Homo sapiens
actagggacctgggga

SEQ ID NO: 3722378 - DNA, 23 bp, Homo sapiens
actagtaccttcagatcctaccc

SEQ ID NO: 3722379 - DNA, 14 bp, Homo sapiens
actagtgctgaagc

SEQ ID NO: 3722380 - DNA, 15 bp, Homo sapiens
actagtgctgaagct

SEQ ID NO: 3722381 - DNA, 23 bp, Homo sapiens
actagtttttagaaaagaaagca

SEQ ID NO: 3722382 - DNA, 18 bp, Homo sapiens
accacggaaaagagcgca

SEQ ID NO: 3722383 - DNA, 23 bp, Homo sapiens
accactaaaagatcgcagtttgc

SEQ ID NO: 3722384 - DNA, 17 bp, Homo sapiens
accccgtgaagcatcca

SEQ ID NO: 3722385 - DNA, 19 bp, Homo sapiens
acccctccatgtgggctag

SEQ ID NO: 3722386 - DNA, 18 bp, Homo sapiens
acccctcccctaatgcct

SEQ ID NO: 3722387 - DNA, 16 bp, Homo sapiens
acccctccttccttga

SEQ ID NO: 3722388 - DNA, 22 bp, Homo sapiens
acccctccttccttgaccagca

SEQ ID NO: 3722389 - DNA, 14 bp, Homo sapiens
acccctctggccag

SEQ ID NO: 3722390 - DNA, 18 bp, Homo sapiens
acccctctggccaggatg

SEQ ID NO: 3722391 - DNA, 13 bp, Homo sapiens
acccctgccctgg

SEQ ID NO: 3722392 - DNA, 14 bp, Homo sapiens
acccctgccctggg

SEQ ID NO: 3722393 - DNA, 16 bp, Homo sapiens
acccctgcccttgtcc

SEQ ID NO: 3722394 - DNA, 12 bp, Homo sapiens
acccctggcttt

SEQ ID NO: 3722395 - DNA, 18 bp, Homo sapiens
acccctggcttttcactg

SEQ ID NO: 3722396 - DNA, 21 bp, Homo sapiens
acccctggcttttcactgctg

SEQ ID NO: 3722397 - DNA, 14 bp, Homo sapiens
accccttccccact

SEQ ID NO: 3722398 - DNA, 16 bp, Homo sapiens
acccgacagagggaag

SEQ ID NO: 3722399 - DNA, 13 bp, Homo sapiens
acccgaggaaact

SEQ ID NO: 3722400 - DNA, 16 bp, Homo sapiens
acccgctttcttgctg

SEQ ID NO: 3722401 - DNA, 15 bp, Homo sapiens
acccggcccctgctg

SEQ ID NO: 3722402 - DNA, 20 bp, Homo sapiens
acccggcccctgctggttca

SEQ ID NO: 3722403 - DNA, 22 bp, Homo sapiens
acccggcccctgctggttcagg

SEQ ID NO: 3722404 - DNA, 15 bp, Homo sapiens
accctaaatctgagg

SEQ ID NO: 3722405 - DNA, 14 bp, Homo sapiens
accctacttctttt

SEQ ID NO: 3722406 - DNA, 18 bp, Homo sapiens
accctacttcttttgctc

SEQ ID NO: 3722407 - DNA, 23 bp, Homo sapiens
accctatattttgcatagtacca

SEQ ID NO: 3722408 - DNA, 20 bp, Homo sapiens
accctcagatgcacatgagc

SEQ ID NO: 3722409 - DNA, 14 bp, Homo sapiens
accctcaggcaggt

SEQ ID NO: 3722410 - DNA, 18 bp, Homo sapiens
accctcatacacagaaac

SEQ ID NO: 3722411 - DNA, 15 bp, Homo sapiens
accctcatctgtctg

SEQ ID NO: 3722412 - DNA, 16 bp, Homo sapiens
accctcatctgtctgg

SEQ ID NO: 3722413 - DNA, 13 bp, Homo sapiens
accctcccacccc

SEQ ID NO: 3722414 - DNA, 14 bp, Homo sapiens
accctcccaccccc

SEQ ID NO: 3722415 - DNA, 20 bp, Homo sapiens
accctcccacccccttctct

SEQ ID NO: 3722416 - DNA, 16 bp, Homo sapiens
accctcccagctctga

SEQ ID NO: 3722417 - DNA, 23 bp, Homo sapiens
accctcccccaggaggtcgaccc

SEQ ID NO: 3722418 - DNA, 17 bp, Homo sapiens
accctccctcagcccct

SEQ ID NO: 3722419 - DNA, 14 bp, Homo sapiens
accctcgctggccc

SEQ ID NO: 3722420 - DNA, 20 bp, Homo sapiens
accctcgctggcccccactg

SEQ ID NO: 3722421 - DNA, 14 bp, Homo sapiens
accctcgtggcctt

SEQ ID NO: 3722422 - DNA, 15 bp, Homo sapiens
accctctccacccca

SEQ ID NO: 3722423 - DNA, 16 bp, Homo sapiens
accctgaaagccctga

SEQ ID NO: 3722424 - DNA, 17 bp, Homo sapiens
accctgatttcttgctt

SEQ ID NO: 3722425 - DNA, 22 bp, Homo sapiens
accctgcgaaggggccctggtc

SEQ ID NO: 3722426 - DNA, 11 bp, Homo sapiens
accctgtctct

SEQ ID NO: 3722427 - DNA, 21 bp, Homo sapiens
accctgtctcttaaagaaaaa

SEQ ID NO: 3722428 - DNA, 16 bp, Homo sapiens
accctgttttatactg

SEQ ID NO: 3722429 - DNA, 19 bp, Homo sapiens
acccttcccttgagccctc

SEQ ID NO: 3722430 - DNA, 14 bp, Homo sapiens
acccttctgtgccc

SEQ ID NO: 3722431 - DNA, 20 bp, Homo sapiens
acccttctttccatttctct

SEQ ID NO: 3722432 - DNA, 12 bp, Homo sapiens
acccttcttttc

SEQ ID NO: 3722433 - DNA, 16 bp, Homo sapiens
acccttgaaaagacat

SEQ ID NO: 3722434 - DNA, 12 bp, Homo sapiens
acccttggcctg

SEQ ID NO: 3722435 - DNA, 13 bp, Homo sapiens
acccttggcctgt

SEQ ID NO: 3722436 - DNA, 17 bp, Homo sapiens
acccttggcctgtctca

SEQ ID NO: 3722437 - DNA, 17 bp, Homo sapiens
acccttggctcaatcct

SEQ ID NO: 3722438 - DNA, 23 bp, Homo sapiens
accctttggggggggcccgcctg

SEQ ID NO: 3722439 - DNA, 23 bp, Homo sapiens
acccttttggcccccgagctggg

SEQ ID NO: 3722440 - DNA, 17 bp, Homo sapiens
accgagtctcttctcca

SEQ ID NO: 3722441 - DNA, 15 bp, Homo sapiens
accgatgctccagcc

SEQ ID NO: 3722442 - DNA, 12 bp, Homo sapiens
accgccttctct

SEQ ID NO: 3722443 - DNA, 14 bp, Homo sapiens
accgctccccagcc

SEQ ID NO: 3722444 - DNA, 17 bp, Homo sapiens
accgctccccagcccag

SEQ ID NO: 3722445 - DNA, 19 bp, Homo sapiens
accgctgcctaagtggctg

SEQ ID NO: 3722446 - DNA, 15 bp, Homo sapiens
accggaagctcctgg

SEQ ID NO: 3722447 - DNA, 23 bp, Homo sapiens
accggagctttcaaagaaggaat

SEQ ID NO: 3722448 - DNA, 20 bp, Homo sapiens
accggaggcaaaaggcagtg

SEQ ID NO: 3722449 - DNA, 13 bp, Homo sapiens
accggatcctggg

SEQ ID NO: 3722450 - DNA, 17 bp, Homo sapiens
accggcaatttccggcc

SEQ ID NO: 3722451 - DNA, 12 bp, Homo sapiens
accgggcactca

SEQ ID NO: 3722452 - DNA, 13 bp, Homo sapiens
accggtacagaaa

SEQ ID NO: 3722453 - DNA, 18 bp, Homo sapiens
accgttggggattgggga

SEQ ID NO: 3722454 - DNA, 21 bp, Homo sapiens
acctaaaaggaaatctcaccc

SEQ ID NO: 3722455 - DNA, 19 bp, Homo sapiens
acctaacattcgatctcat

SEQ ID NO: 3722456 - DNA, 15 bp, Homo sapiens
acctaacccctttcc

SEQ ID NO: 3722457 - DNA, 17 bp, Homo sapiens
acctaacccctttcctg

SEQ ID NO: 3722458 - DNA, 18 bp, Homo sapiens
acctaacccctttcctgc

SEQ ID NO: 3722459 - DNA, 16 bp, Homo sapiens
acctaattagagcaga

SEQ ID NO: 3722460 - DNA, 22 bp, Homo sapiens
acctacaccattatcttggaaa

SEQ ID NO: 3722461 - DNA, 18 bp, Homo sapiens
acctacctgtaacttttt

SEQ ID NO: 3722462 - DNA, 13 bp, Homo sapiens
acctagatcagaa

SEQ ID NO: 3722463 - DNA, 17 bp, Homo sapiens
acctaggccactcctcc

SEQ ID NO: 3722464 - DNA, 18 bp, Homo sapiens
acctaggccactcctcca

SEQ ID NO: 3722465 - DNA, 22 bp, Homo sapiens
acctatggtataatggttgact

SEQ ID NO: 3722466 - DNA, 12 bp, Homo sapiens
acctatgtttgc

SEQ ID NO: 3722467 - DNA, 23 bp, Homo sapiens
acctcaaacttccagtcaggtag

SEQ ID NO: 3722468 - DNA, 12 bp, Homo sapiens
acctcaaattta

SEQ ID NO: 3722469 - DNA, 21 bp, Homo sapiens
acctcaacccccatttctatt

SEQ ID NO: 3722470 - DNA, 21 bp, Homo sapiens
acctcaacctgtaaattattt

SEQ ID NO: 3722471 - DNA, 16 bp, Homo sapiens
acctcaacctgtgatg

SEQ ID NO: 3722472 - DNA, 21 bp, Homo sapiens
acctcaagggggactgtcttt

SEQ ID NO: 3722473 - DNA, 19 bp, Homo sapiens
acctcacccgaggctgccc

SEQ ID NO: 3722474 - DNA, 16 bp, Homo sapiens
acctcacgcacctccc

SEQ ID NO: 3722475 - DNA, 15 bp, Homo sapiens
acctcagagccccgc

SEQ ID NO: 3722476 - DNA, 14 bp, Homo sapiens
acctcagccatgag

SEQ ID NO: 3722477 - DNA, 23 bp, Homo sapiens
acctcagccatgaggagttgctg

SEQ ID NO: 3722478 - DNA, 15 bp, Homo sapiens
acctcagcctcctgt

SEQ ID NO: 3722479 - DNA, 11 bp, Homo sapiens
acctcagcctg

SEQ ID NO: 3722480 - DNA, 18 bp, Homo sapiens
acctcaggcttccttggc

SEQ ID NO: 3722481 - DNA, 18 bp, Homo sapiens
acctcaggtgagaagcag

SEQ ID NO: 3722482 - DNA, 23 bp, Homo sapiens
acctcagttcccttggcctcaga

SEQ ID NO: 3722483 - DNA, 17 bp, Homo sapiens
acctcagttttatcatt

SEQ ID NO: 3722484 - DNA, 19 bp, Homo sapiens
acctccaaaagccctgagt

SEQ ID NO: 3722485 - DNA, 12 bp, Homo sapiens
acctccacagct

SEQ ID NO: 3722486 - DNA, 13 bp, Homo sapiens
acctccacagctt

SEQ ID NO: 3722487 - DNA, 15 bp, Homo sapiens
acctccacagcttcc

SEQ ID NO: 3722488 - DNA, 12 bp, Homo sapiens
acctcccagccc

SEQ ID NO: 3722489 - DNA, 13 bp, Homo sapiens
acctcccagcccc

SEQ ID NO: 3722490 - DNA, 16 bp, Homo sapiens
acctcccagcccctgc

SEQ ID NO: 3722491 - DNA, 21 bp, Homo sapiens
acctcccagcccctgcccctc

SEQ ID NO: 3722492 - DNA, 15 bp, Homo sapiens
acctcccatcctaat

SEQ ID NO: 3722493 - DNA, 13 bp, Homo sapiens
acctccccaggcc

SEQ ID NO: 3722494 - DNA, 14 bp, Homo sapiens
acctccccccactg

SEQ ID NO: 3722495 - DNA, 22 bp, Homo sapiens
acctccccccactgcaggcccc

SEQ ID NO: 3722496 - DNA, 16 bp, Homo sapiens
acctccccctccttcc

SEQ ID NO: 3722497 - DNA, 22 bp, Homo sapiens
acctccccctccttcccagctg

SEQ ID NO: 3722498 - DNA, 14 bp, Homo sapiens
acgacttcagggca

SEQ ID NO: 3722499 - DNA, 17 bp, Homo sapiens
acgagataatgtgaact

SEQ ID NO: 3722500 - DNA, 19 bp, Homo sapiens
acgagatcaagagatcaag

SEQ ID NO: 3722501 - DNA, 16 bp, Homo sapiens
acgatgtggccctggc

SEQ ID NO: 3722502 - DNA, 21 bp, Homo sapiens
agatttgtactacagttcttt

SEQ ID NO: 3722503 - DNA, 13 bp, Homo sapiens
agattttaaattc

SEQ ID NO: 3722504 - DNA, 22 bp, Homo sapiens
agattttaaattcacaatagaa

SEQ ID NO: 3722505 - DNA, 17 bp, Homo sapiens
agattttaattttgaat

SEQ ID NO: 3722506 - DNA, 21 bp, Homo sapiens
agattttaattttgaataaat

SEQ ID NO: 3722507 - DNA, 19 bp, Homo sapiens
agattttacaaaagatgta

SEQ ID NO: 3722508 - DNA, 20 bp, Homo sapiens
agattttacaaaagatgtat

SEQ ID NO: 3722509 - DNA, 12 bp, Homo sapiens
agattttgaaaa

SEQ ID NO: 3722510 - DNA, 17 bp, Homo sapiens
agattttgaaaactaca

SEQ ID NO: 3722511 - DNA, 21 bp, Homo sapiens
agattttgaaaactacatttt

SEQ ID NO: 3722512 - DNA, 16 bp, Homo sapiens
agatttttaacgaatg

SEQ ID NO: 3722513 - DNA, 19 bp, Homo sapiens
agcaaaaccattgcttcac

SEQ ID NO: 3722514 - DNA, 18 bp, Homo sapiens
agcaaaagatgcttctca

SEQ ID NO: 3722515 - DNA, 16 bp, Homo sapiens
agcaaatcagaaactt

SEQ ID NO: 3722516 - DNA, 16 bp, Homo sapiens
agcaaatgtggctcct

SEQ ID NO: 3722517 - DNA, 15 bp, Homo sapiens
agcaaatgttacata

SEQ ID NO: 3722518 - DNA, 20 bp, Homo sapiens
agcaaatgttacatagtgta

SEQ ID NO: 3722519 - DNA, 16 bp, Homo sapiens
agcaaatttataattt

SEQ ID NO: 3722520 - DNA, 13 bp, Homo sapiens
agcaacacaatgt

SEQ ID NO: 3722521 - DNA, 22 bp, Homo sapiens
agcaacagagtgagaccctgtc

SEQ ID NO: 3722522 - DNA, 15 bp, Homo sapiens
agcaacatgcttcat

SEQ ID NO: 3722523 - DNA, 20 bp, Homo sapiens
agcaacatgcttcatgaaaa

SEQ ID NO: 3722524 - DNA, 16 bp, Homo sapiens
agcaaccagagcactg

SEQ ID NO: 3722525 - DNA, 23 bp, Homo sapiens
agcaacttgtctttttctggact

SEQ ID NO: 3722526 - DNA, 21 bp, Homo sapiens
agcaagatcctgtctttaagg

SEQ ID NO: 3722527 - DNA, 20 bp, Homo sapiens
agcaagtgagaccctgtctc

SEQ ID NO: 3722528 - DNA, 16 bp, Homo sapiens
agcaatatttaaggag

SEQ ID NO: 3722529 - DNA, 18 bp, Homo sapiens
agcaattgctgcatctta

SEQ ID NO: 3722530 - DNA, 20 bp, Homo sapiens
agcaattgctgcatcttagt

SEQ ID NO: 3722531 - DNA, 23 bp, Homo sapiens
agcaattgtgtggtcagtggctc

SEQ ID NO: 3722532 - DNA, 22 bp, Homo sapiens
agcaatttcgccgttgaagagg

SEQ ID NO: 3722533 - DNA, 14 bp, Homo sapiens
agcacactgtagca

SEQ ID NO: 3722534 - DNA, 16 bp, Homo sapiens
agcacagaaggaggag

SEQ ID NO: 3722535 - DNA, 19 bp, Homo sapiens
agcacagagagggggccac

SEQ ID NO: 3722536 - DNA, 21 bp, Homo sapiens
agcacagctcaggaactagac

SEQ ID NO: 3722537 - DNA, 16 bp, Homo sapiens
agcacagcttcatttc

SEQ ID NO: 3722538 - DNA, 22 bp, Homo sapiens
agcacatccaggcaatggccta

SEQ ID NO: 3722539 - DNA, 22 bp, Homo sapiens
agcaccaaaagcttaccaaggg

SEQ ID NO: 3722540 - DNA, 16 bp, Homo sapiens
agcaccaccaggtctc

SEQ ID NO: 3722541 - DNA, 19 bp, Homo sapiens
agcaccccatgccaaagct

SEQ ID NO: 3722542 - DNA, 17 bp, Homo sapiens
agcacctagcctcgctc

SEQ ID NO: 3722543 - DNA, 18 bp, Homo sapiens
agcacctcccagcccctg

SEQ ID NO: 3722544 - DNA, 11 bp, Homo sapiens
agcacctgccg

SEQ ID NO: 3722545 - DNA, 15 bp, Homo sapiens
agcacctgccgacct

SEQ ID NO: 3722546 - DNA, 21 bp, Homo sapiens
agcacctgccgacctcgtcct

SEQ ID NO: 3722547 - DNA, 22 bp, Homo sapiens
agcacctgccgacctcgtcctc

SEQ ID NO: 3722548 - DNA, 16 bp, Homo sapiens
agcacgtttaaagttc

SEQ ID NO: 3722549 - DNA, 18 bp, Homo sapiens
agcacgtttaaagttctg

SEQ ID NO: 3722550 - DNA, 13 bp, Homo sapiens
agcactaaagcag

SEQ ID NO: 3722551 - DNA, 17 bp, Homo sapiens
agcactaaagcagtgga

SEQ ID NO: 3722552 - DNA, 20 bp, Homo sapiens
agcactaaggtgtgctctga

SEQ ID NO: 3722553 - DNA, 21 bp, Homo sapiens
agcactcacatgctggacagg

SEQ ID NO: 3722554 - DNA, 20 bp, Homo sapiens
agcactcctccctgatgtac

SEQ ID NO: 3722555 - DNA, 20 bp, Homo sapiens
agcacttacagataggcctt

SEQ ID NO: 3722556 - DNA, 14 bp, Homo sapiens
agcactttgggagg

SEQ ID NO: 3722557 - DNA, 22 bp, Homo sapiens
agcactttgggaggccaaggtg

SEQ ID NO: 3722558 - DNA, 21 bp, Homo sapiens
agcagagaatgaaagggccca

SEQ ID NO: 3722559 - DNA, 14 bp, Homo sapiens
agcagagaattctc

SEQ ID NO: 3722560 - DNA, 14 bp, Homo sapiens
agcagagcaggggc

SEQ ID NO: 3722561 - DNA, 13 bp, Homo sapiens
agcagaggcagcg

SEQ ID NO: 3722562 - DNA, 19 bp, Homo sapiens
agcagaggctggcctcaga

SEQ ID NO: 3722563 - DNA, 20 bp, Homo sapiens
agccaggctgccaaggccag

SEQ ID NO: 3722564 - DNA, 21 bp, Homo sapiens
agccagggatggggccacagc

SEQ ID NO: 3722565 - DNA, 22 bp, Homo sapiens
agccagggatggggccacagcc

SEQ ID NO: 3722566 - DNA, 12 bp, Homo sapiens
agccagggtctc

SEQ ID NO: 3722567 - DNA, 12 bp, Homo sapiens
agccagtcttaa

SEQ ID NO: 3722568 - DNA, 13 bp, Homo sapiens
agccatcatggat

SEQ ID NO: 3722569 - DNA, 12 bp, Homo sapiens
agccatcatgta

SEQ ID NO: 3722570 - DNA, 20 bp, Homo sapiens
agccatgacttgagaaacaa

SEQ ID NO: 3722571 - DNA, 18 bp, Homo sapiens
agccatggactctacact

SEQ ID NO: 3722572 - DNA, 16 bp, Homo sapiens
agccatgtttaagatt

SEQ ID NO: 3722573 - DNA, 20 bp, Homo sapiens
agccatgtttaagatttaat

SEQ ID NO: 3722574 - DNA, 13 bp, Homo sapiens
agcccaccttggc

SEQ ID NO: 3722575 - DNA, 13 bp, Homo sapiens
agcccacttctgc

SEQ ID NO: 3722576 - DNA, 22 bp, Homo sapiens
agcccacttctgccatattctg

SEQ ID NO: 3722577 - DNA, 23 bp, Homo sapiens
agcccagccattaccatggagac

SEQ ID NO: 3722578 - DNA, 16 bp, Homo sapiens
agcccagcccagctgc

SEQ ID NO: 3722579 - DNA, 17 bp, Homo sapiens
agcccagcccagctgct

SEQ ID NO: 3722580 - DNA, 15 bp, Homo sapiens
agcccagctgctctg

SEQ ID NO: 3722581 - DNA, 18 bp, Homo sapiens
agcccagctgctctgccc

SEQ ID NO: 3722582 - DNA, 21 bp, Homo sapiens
agcccagctgctctgcccaga

SEQ ID NO: 3722583 - DNA, 13 bp, Homo sapiens
agcccagctggtg

SEQ ID NO: 3722584 - DNA, 16 bp, Homo sapiens
agcccagctggtggga

SEQ ID NO: 3722585 - DNA, 24 bp, Homo sapiens
agcccaggaatttgaagctgcagt

SEQ ID NO: 3722586 - DNA, 19 bp, Homo sapiens
agcccaggagtttgaggct

SEQ ID NO: 3722587 - DNA, 19 bp, Homo sapiens
agcccaggcctccagctca

SEQ ID NO: 3722588 - DNA, 20 bp, Homo sapiens
agcccagggagcggaaagca

SEQ ID NO: 3722589 - DNA, 23 bp, Homo sapiens
agcccagggagcggaaagcagct

SEQ ID NO: 3722590 - DNA, 17 bp, Homo sapiens
agcccagggttccccca

SEQ ID NO: 3722591 - DNA, 21 bp, Homo sapiens
agcccagggttcccccagccc

SEQ ID NO: 3722592 - DNA, 22 bp, Homo sapiens
agcccagggttcccccagccct

SEQ ID NO: 3722593 - DNA, 13 bp, Homo sapiens
agcccatcaatta

SEQ ID NO: 3722594 - DNA, 17 bp, Homo sapiens
agcccatcttgcctcca

SEQ ID NO: 3722595 - DNA, 14 bp, Homo sapiens
agcccattcctctg

SEQ ID NO: 3722596 - DNA, 17 bp, Homo sapiens
agcccattctctctcct

SEQ ID NO: 3722597 - DNA, 19 bp, Homo sapiens
agcccattctctctcctgt

SEQ ID NO: 3722598 - DNA, 20 bp, Homo sapiens
agcccattctctctcctgtc

SEQ ID NO: 3722599 - DNA, 20 bp, Homo sapiens
agccccaacccaaacctgga

SEQ ID NO: 3722600 - DNA, 22 bp, Homo sapiens
agccccaacccaaacctggaga

SEQ ID NO: 3722601 - DNA, 18 bp, Homo sapiens
agccccaagaaggctggg

SEQ ID NO: 3722602 - DNA, 12 bp, Homo sapiens
agccccacccag

SEQ ID NO: 3722603 - DNA, 13 bp, Homo sapiens
agccccacccagg

SEQ ID NO: 3722604 - DNA, 15 bp, Homo sapiens
agccccacccaggag

SEQ ID NO: 3722605 - DNA, 16 bp, Homo sapiens
agccccacccaggagg

SEQ ID NO: 3722606 - DNA, 12 bp, Homo sapiens
agccccagcact

SEQ ID NO: 3722607 - DNA, 15 bp, Homo sapiens
agccccagcccagcc

SEQ ID NO: 3722608 - DNA, 13 bp, Homo sapiens
agccccaggcagg

SEQ ID NO: 3722609 - DNA, 18 bp, Homo sapiens
agccccagggtcttccct

SEQ ID NO: 3722610 - DNA, 22 bp, Homo sapiens
agccccagggtcttccctacct

SEQ ID NO: 3722611 - DNA, 13 bp, Homo sapiens
agccccagtgcca

SEQ ID NO: 3722612 - DNA, 20 bp, Homo sapiens
agccccagtgccaagcacag

SEQ ID NO: 3722613 - DNA, 15 bp, Homo sapiens
agccccagtgcccac

SEQ ID NO: 3722614 - DNA, 15 bp, Homo sapiens
agccccgcgcctcct

SEQ ID NO: 3722615 - DNA, 18 bp, Homo sapiens
agccccgcgcctccttcc

SEQ ID NO: 3722616 - DNA, 17 bp, Homo sapiens
agcccctcccaccacag

SEQ ID NO: 3722617 - DNA, 11 bp, Homo sapiens
agcccctcctc

SEQ ID NO: 3722618 - DNA, 12 bp, Homo sapiens
agcccctcctct

SEQ ID NO: 3722619 - DNA, 10 bp, Homo sapiens
agcccctctt

SEQ ID NO: 3722620 - DNA, 17 bp, Homo sapiens
agcccctcttgcccccc

SEQ ID NO: 3722621 - DNA, 13 bp, Homo sapiens
agagtgcccagaa

SEQ ID NO: 3722622 - DNA, 13 bp, Homo sapiens
agagtgccccacc

SEQ ID NO: 3722623 - DNA, 19 bp, Homo sapiens
agagtgccccacctgccac

SEQ ID NO: 3722624 - DNA, 11 bp, Homo sapiens
agagtggcctg

SEQ ID NO: 3722625 - DNA, 19 bp, Homo sapiens
agagtggcctggccaggag

SEQ ID NO: 3722626 - DNA, 13 bp, Homo sapiens
agagtggctcctc

SEQ ID NO: 3722627 - DNA, 19 bp, Homo sapiens
agagtggctcctcccggtg

SEQ ID NO: 3722628 - DNA, 19 bp, Homo sapiens
agagtggggatatgattta

SEQ ID NO: 3722629 - DNA, 16 bp, Homo sapiens
agagtgggtttcacaa

SEQ ID NO: 3722630 - DNA, 17 bp, Homo sapiens
agagtgtggccttcgga

SEQ ID NO: 3722631 - DNA, 19 bp, Homo sapiens
agagttaatcaactgaaag

SEQ ID NO: 3722632 - DNA, 21 bp, Homo sapiens
agagttaggtttaacataaag

SEQ ID NO: 3722633 - DNA, 23 bp, Homo sapiens
agagttaggtttaacataaaggt

SEQ ID NO: 3722634 - DNA, 22 bp, Homo sapiens
agagttcagtaagaccggaagc

SEQ ID NO: 3722635 - DNA, 14 bp, Homo sapiens
agataaaaagatgg

SEQ ID NO: 3722636 - DNA, 14 bp, Homo sapiens
agataaagatttct

SEQ ID NO: 3722637 - DNA, 18 bp, Homo sapiens
agataaagatttcttgag

SEQ ID NO: 3722638 - DNA, 21 bp, Homo sapiens
agataacaagatctttcagga

SEQ ID NO: 3722639 - DNA, 15 bp, Homo sapiens
agataactctttgga

SEQ ID NO: 3722640 - DNA, 22 bp, Homo sapiens
agataactctttggatagcatg

SEQ ID NO: 3722641 - DNA, 13 bp, Homo sapiens
agataagcaagag

SEQ ID NO: 3722642 - DNA, 20 bp, Homo sapiens
agataagcaagagagatgtt

SEQ ID NO: 3722643 - DNA, 22 bp, Homo sapiens
agataagcaagagagatgtttt

SEQ ID NO: 3722644 - DNA, 16 bp, Homo sapiens
agataatctagaacac

SEQ ID NO: 3722645 - DNA, 14 bp, Homo sapiens
agataatgcccaga

SEQ ID NO: 3722646 - DNA, 22 bp, Homo sapiens
agataatgtgaactagctggaa

SEQ ID NO: 3722647 - DNA, 20 bp, Homo sapiens
agatacaagtttcagacagg

SEQ ID NO: 3722648 - DNA, 19 bp, Homo sapiens
agatacaggaaaagctgct

SEQ ID NO: 3722649 - DNA, 20 bp, Homo sapiens
agatacaggaaaagctgctg

SEQ ID NO: 3722650 - DNA, 18 bp, Homo sapiens
agatacatttgtatgttg

SEQ ID NO: 3722651 - DNA, 18 bp, Homo sapiens
agataccaggttgaaaga

SEQ ID NO: 3722652 - DNA, 21 bp, Homo sapiens
agatactggaagttttgcatt

SEQ ID NO: 3722653 - DNA, 21 bp, Homo sapiens
agatacttggaccgagtagag

SEQ ID NO: 3722654 - DNA, 22 bp, Homo sapiens
agatacttggggggctgaggtg

SEQ ID NO: 3722655 - DNA, 15 bp, Homo sapiens
agatagaaataaata

SEQ ID NO: 3722656 - DNA, 13 bp, Homo sapiens
agatagaagaaaa

SEQ ID NO: 3722657 - DNA, 13 bp, Homo sapiens
agataggctctgc

SEQ ID NO: 3722658 - DNA, 21 bp, Homo sapiens
agataggctctgcacagatgg

SEQ ID NO: 3722659 - DNA, 18 bp, Homo sapiens
agatagtacataaaggtg

SEQ ID NO: 3722660 - DNA, 19 bp, Homo sapiens
agatatatgctctgcatgt

SEQ ID NO: 3722661 - DNA, 16 bp, Homo sapiens
agatatatttttcaca

SEQ ID NO: 3722662 - DNA, 17 bp, Homo sapiens
agatatcttgaaatgaa

SEQ ID NO: 3722663 - DNA, 22 bp, Homo sapiens
agatatctttttattgatgtgc

SEQ ID NO: 3722664 - DNA, 24 bp, Homo sapiens
agatatctttttattgatgtgcaa

SEQ ID NO: 3722665 - DNA, 21 bp, Homo sapiens
agatattgtgaagtacatatt

SEQ ID NO: 3722666 - DNA, 20 bp, Homo sapiens
agatatttatatttttattt

SEQ ID NO: 3722667 - DNA, 14 bp, Homo sapiens
agatcaaccccttc

SEQ ID NO: 3722668 - DNA, 15 bp, Homo sapiens
agatcaagagatcaa

SEQ ID NO: 3722669 - DNA, 19 bp, Homo sapiens
agatcacataacagaatgc

SEQ ID NO: 3722670 - DNA, 14 bp, Homo sapiens
agatcacgccactg

SEQ ID NO: 3722671 - DNA, 17 bp, Homo sapiens
agatcacgccactgcac

SEQ ID NO: 3722672 - DNA, 19 bp, Homo sapiens
agatcatagatttctgatt

SEQ ID NO: 3722673 - DNA, 12 bp, Homo sapiens
agatcatgaaga

SEQ ID NO: 3722674 - DNA, 22 bp, Homo sapiens
agatcccagaaggacctcctga

SEQ ID NO: 3722675 - DNA, 13 bp, Homo sapiens
agatcccagctca

SEQ ID NO: 3722676 - DNA, 15 bp, Homo sapiens
agatcccgcctcttc

SEQ ID NO: 3722677 - DNA, 19 bp, Homo sapiens
agatcggggccagaggcag

SEQ ID NO: 3722678 - DNA, 22 bp, Homo sapiens
agatcgtgccgttactctccaa

SEQ ID NO: 3722679 - DNA, 20 bp, Homo sapiens
agatctaagcctttccataa

SEQ ID NO: 3722680 - DNA, 13 bp, Homo sapiens
agatctccaaagc

SEQ ID NO: 3722681 - DNA, 18 bp, Homo sapiens
agatctctgctttggaaa

SEQ ID NO: 3722682 - DNA, 15 bp, Homo sapiens
agatctgcaccgccg

SEQ ID NO: 3722683 - DNA, 12 bp, Homo sapiens
agatctgtgccc

SEQ ID NO: 3722684 - DNA, 16 bp, Homo sapiens
agatctgtgccccatg

SEQ ID NO: 3722685 - DNA, 19 bp, Homo sapiens
agatctgtgccccatgcct

SEQ ID NO: 3722686 - DNA, 21 bp, Homo sapiens
agatctttcaggaaagacgga

SEQ ID NO: 3722687 - DNA, 18 bp, Homo sapiens
agacttgtatgaaagatg

SEQ ID NO: 3722688 - DNA, 12 bp, Homo sapiens
agactttagaaa

SEQ ID NO: 3722689 - DNA, 16 bp, Homo sapiens
agactttagaaataaa

SEQ ID NO: 3722690 - DNA, 17 bp, Homo sapiens
agactttagaaataaat

SEQ ID NO: 3722691 - DNA, 18 bp, Homo sapiens
agactttagaaataaatg

SEQ ID NO: 3722692 - DNA, 13 bp, Homo sapiens
agactttttggtg

SEQ ID NO: 3722693 - DNA, 23 bp, Homo sapiens
agactttttggtggatgtaaata

SEQ ID NO: 3722694 - DNA, 22 bp, Homo sapiens
agagaaaaaatattttcctgcc

SEQ ID NO: 3722695 - DNA, 18 bp, Homo sapiens
agagaaagtacttctcca

SEQ ID NO: 3722696 - DNA, 10 bp, Homo sapiens
agagaagaga

SEQ ID NO: 3722697 - DNA, 18 bp, Homo sapiens
agagaagtgcccctgctg

SEQ ID NO: 3722698 - DNA, 23 bp, Homo sapiens
agagaatgataggcttttgttct

SEQ ID NO: 3722699 - DNA, 16 bp, Homo sapiens
agagaatgtctgatct

SEQ ID NO: 3722700 - DNA, 21 bp, Homo sapiens
agagaatgttatagtgaatta

SEQ ID NO: 3722701 - DNA, 23 bp, Homo sapiens
agagaatttctaccatttcagag

SEQ ID NO: 3722702 - DNA, 19 bp, Homo sapiens
agagacaaacacctcccag

SEQ ID NO: 3722703 - DNA, 16 bp, Homo sapiens
agagacacctgcacct

SEQ ID NO: 3722704 - DNA, 21 bp, Homo sapiens
agagacacctgcacctccccc

SEQ ID NO: 3722705 - DNA, 23 bp, Homo sapiens
agagacaggaaaatcctctggct

SEQ ID NO: 3722706 - DNA, 18 bp, Homo sapiens
agagacaggcccaagaga

SEQ ID NO: 3722707 - DNA, 16 bp, Homo sapiens
agagacccaaggagga

SEQ ID NO: 3722708 - DNA, 20 bp, Homo sapiens
agagaccgtcgggggctgag

SEQ ID NO: 3722709 - DNA, 23 bp, Homo sapiens
agagactgggaagataggctctg

SEQ ID NO: 3722710 - DNA, 21 bp, Homo sapiens
agagagaaagaagtaggcatg

SEQ ID NO: 3722711 - DNA, 19 bp, Homo sapiens
agagagaagtgcccctgct

SEQ ID NO: 3722712 - DNA, 16 bp, Homo sapiens
agagagaccacttttc

SEQ ID NO: 3722713 - DNA, 23 bp, Homo sapiens
agagagccttggttcatcagtgt

SEQ ID NO: 3722714 - DNA, 18 bp, Homo sapiens
agagagcgagcgctaccc

SEQ ID NO: 3722715 - DNA, 12 bp, Homo sapiens
agagagctggta

SEQ ID NO: 3722716 - DNA, 14 bp, Homo sapiens
agagaggagaaaca

SEQ ID NO: 3722717 - DNA, 14 bp, Homo sapiens
agagaggccttttg

SEQ ID NO: 3722718 - DNA, 17 bp, Homo sapiens
agagagggaattctctt

SEQ ID NO: 3722719 - DNA, 17 bp, Homo sapiens
agagagtggctcctccc

SEQ ID NO: 3722720 - DNA, 14 bp, Homo sapiens
agagagttaatcaa

SEQ ID NO: 3722721 - DNA, 16 bp, Homo sapiens
agagatcatgagaaat

SEQ ID NO: 3722722 - DNA, 13 bp, Homo sapiens
agagatctgctgt

SEQ ID NO: 3722723 - DNA, 21 bp, Homo sapiens
agagatgcctccaccgctgcc

SEQ ID NO: 3722724 - DNA, 23 bp, Homo sapiens
agagatgggactgggagggccca

SEQ ID NO: 3722725 - DNA, 16 bp, Homo sapiens
agagcaaagggccagg

SEQ ID NO: 3722726 - DNA, 14 bp, Homo sapiens
agagcaagactctg

SEQ ID NO: 3722727 - DNA, 23 bp, Homo sapiens
agagcaagatcctgtctttaagg

SEQ ID NO: 3722728 - DNA, 15 bp, Homo sapiens
agagcaagctttttt

SEQ ID NO: 3722729 - DNA, 18 bp, Homo sapiens
agagcaagcttttttatt

SEQ ID NO: 3722730 - DNA, 14 bp, Homo sapiens
agagcaagtctgga

SEQ ID NO: 3722731 - DNA, 17 bp, Homo sapiens
agagcactgtatacccc

SEQ ID NO: 3722732 - DNA, 12 bp, Homo sapiens
agagcagcctgt

SEQ ID NO: 3722733 - DNA, 16 bp, Homo sapiens
agagcagcctgtggca

SEQ ID NO: 3722734 - DNA, 13 bp, Homo sapiens
agagcaggcacat

SEQ ID NO: 3722735 - DNA, 18 bp, Homo sapiens
agagcaggcacatggagg

SEQ ID NO: 3722736 - DNA, 13 bp, Homo sapiens
agagcagggcaag

SEQ ID NO: 3722737 - DNA, 13 bp, Homo sapiens
agagccagccctc

SEQ ID NO: 3722738 - DNA, 16 bp, Homo sapiens
agagccagccctccct

SEQ ID NO: 3722739 - DNA, 22 bp, Homo sapiens
agagccagccctccctgtcctc

SEQ ID NO: 3722740 - DNA, 13 bp, Homo sapiens
agagccagggtct

SEQ ID NO: 3722741 - DNA, 15 bp, Homo sapiens
agagccccacacgga

SEQ ID NO: 3722742 - DNA, 13 bp, Homo sapiens
agagccgggaagc

SEQ ID NO: 3722743 - DNA, 20 bp, Homo sapiens
agagcctcctttctggcttt

SEQ ID NO: 3722744 - DNA, 10 bp, Homo sapiens
agagcctggt

SEQ ID NO: 3722745 - DNA, 16 bp, Homo sapiens
agagcctggtgctgct

SEQ ID NO: 3722746 - DNA, 18 bp, Homo sapiens
agagcctggtgctgctgc

SEQ ID NO: 3722747 - DNA, 11 bp, Homo sapiens
agagccttgcg

SEQ ID NO: 3722748 - DNA, 21 bp, Homo sapiens
agagccttgcggaaggttcta

SEQ ID NO: 3722749 - DNA, 21 bp, Homo sapiens
agagccttggtgtccacctgg

SEQ ID NO: 3722750 - DNA, 12 bp, Homo sapiens
agagcgaggctg

SEQ ID NO: 3722751 - DNA, 20 bp, Homo sapiens
agagcgcctgcccctcccag

SEQ ID NO: 3722752 - DNA, 17 bp, Homo sapiens
agagcgtccttccccct

SEQ ID NO: 3722753 - DNA, 13 bp, Homo sapiens
agagctagcgctg

SEQ ID NO: 3722754 - DNA, 16 bp, Homo sapiens
agagctagcgctgccg

SEQ ID NO: 3722755 - DNA, 13 bp, Homo sapiens
agagctatacagt

SEQ ID NO: 3722756 - DNA, 18 bp, Homo sapiens
agagctctggagccacct

SEQ ID NO: 3722757 - DNA, 20 bp, Homo sapiens
agagctctggagccacctgt

SEQ ID NO: 3722758 - DNA, 11 bp, Homo sapiens
agagctgggtg

SEQ ID NO: 3722759 - DNA, 13 bp, Homo sapiens
agagctggtgccc

SEQ ID NO: 3722760 - DNA, 17 bp, Homo sapiens
agaggaatattatgact

SEQ ID NO: 3722761 - DNA, 21 bp, Homo sapiens
agaggacttttctttgtggct

SEQ ID NO: 3722762 - DNA, 22 bp, Homo sapiens
agaggacttttctttgtggctt

SEQ ID NO: 3722763 - DNA, 23 bp, Homo sapiens
agaggacttttctttgtggcttc

SEQ ID NO: 3722764 - DNA, 19 bp, Homo sapiens
agaggagggcgtgactcac

SEQ ID NO: 3722765 - DNA, 21 bp, Homo sapiens
agaggagggcgtgactcaccc

SEQ ID NO: 3722766 - DNA, 15 bp, Homo sapiens
agaggcagaaccctg

SEQ ID NO: 3722767 - DNA, 14 bp, Homo sapiens
agaggcagagtgcc

SEQ ID NO: 3722768 - DNA, 21 bp, Homo sapiens
agaggcagagtgccccacctg

SEQ ID NO: 3722769 - DNA, 24 bp, Homo sapiens
agaggcagccccattctgcctgcc

SEQ ID NO: 3722770 - DNA, 10 bp, Homo sapiens
agaggcaggg

SEQ ID NO: 3722771 - DNA, 17 bp, Homo sapiens
agaggcagggaggggac

SEQ ID NO: 3722772 - DNA, 16 bp, Homo sapiens
agaggccagccccacc

SEQ ID NO: 3722773 - DNA, 17 bp, Homo sapiens
agaggccagccccaccc

SEQ ID NO: 3722774 - DNA, 23 bp, Homo sapiens
agaggccagccccacccaggagg

SEQ ID NO: 3722775 - DNA, 19 bp, Homo sapiens
agaggccttttggaatgtg

SEQ ID NO: 3722776 - DNA, 19 bp, Homo sapiens
agaggctattattttcact

SEQ ID NO: 3722777 - DNA, 13 bp, Homo sapiens
agaggctgaaaga

SEQ ID NO: 3722778 - DNA, 16 bp, Homo sapiens
agaggctggaggcagg

SEQ ID NO: 3722779 - DNA, 20 bp, Homo sapiens
agaggctggaggcagggcct

SEQ ID NO: 3722780 - DNA, 14 bp, Homo sapiens
agaggcttcttcag

SEQ ID NO: 3722781 - DNA, 23 bp, Homo sapiens
agagggaagaaaagagctttctt

SEQ ID NO: 3722782 - DNA, 16 bp, Homo sapiens
agagggagaagcatga

SEQ ID NO: 3722783 - DNA, 15 bp, Homo sapiens
agagggagtgacaga

SEQ ID NO: 3722784 - DNA, 22 bp, Homo sapiens
agaggggaacagactggaagca

SEQ ID NO: 3722785 - DNA, 15 bp, Homo sapiens
agaggggcagaacag

SEQ ID NO: 3722786 - DNA, 18 bp, Homo sapiens
agaggggctttctggaga

SEQ ID NO: 3722787 - DNA, 20 bp, Homo sapiens
agagggtctgaggaatccag

SEQ ID NO: 3722788 - DNA, 23 bp, Homo sapiens
agagggtgctgccccatgaagcc

SEQ ID NO: 3722789 - DNA, 16 bp, Homo sapiens
agaggtcttttttaaa

SEQ ID NO: 3722790 - DNA, 14 bp, Homo sapiens
agaggtgagggaag

SEQ ID NO: 3722791 - DNA, 16 bp, Homo sapiens
agaggtggggagcaga

SEQ ID NO: 3722792 - DNA, 17 bp, Homo sapiens
agaggttttatgatatt

SEQ ID NO: 3722793 - DNA, 16 bp, Homo sapiens
agagtaagctgctttt

SEQ ID NO: 3722794 - DNA, 13 bp, Homo sapiens
agagtagccgaga

SEQ ID NO: 3722795 - DNA, 22 bp, Homo sapiens
agagtagccgagagcctgctcc

SEQ ID NO: 3722796 - DNA, 23 bp, Homo sapiens
agagtagccgagagcctgctccc

SEQ ID NO: 3722797 - DNA, 13 bp, Homo sapiens
agagtatatgcac

SEQ ID NO: 3722798 - DNA, 14 bp, Homo sapiens
agagtcatctccat

SEQ ID NO: 3722799 - DNA, 16 bp, Homo sapiens
agagtccaggccccaa

SEQ ID NO: 3722800 - DNA, 17 bp, Homo sapiens
agagtgataatacaagt

SEQ ID NO: 3722801 - DNA, 12 bp, Homo sapiens
agagtgcccaga

SEQ ID NO: 3722802 - DNA, 21 bp, Homo sapiens
agaattttcagaccccagcgg

SEQ ID NO: 3722803 - DNA, 15 bp, Homo sapiens
agaattttgagcagg

SEQ ID NO: 3722804 - DNA, 16 bp, Homo sapiens
agacaaaaacagcctc

SEQ ID NO: 3722805 - DNA, 17 bp, Homo sapiens
agacaaaaatactctaa

SEQ ID NO: 3722806 - DNA, 18 bp, Homo sapiens
agacaaatgctgcgccct

SEQ ID NO: 3722807 - DNA, 18 bp, Homo sapiens
agacaaatggaggaatat

SEQ ID NO: 3722808 - DNA, 21 bp, Homo sapiens
agacaaattctgtttcttgag

SEQ ID NO: 3722809 - DNA, 15 bp, Homo sapiens
agacaacagaagtca

SEQ ID NO: 3722810 - DNA, 20 bp, Homo sapiens
agacaaccctgcaaaggact

SEQ ID NO: 3722811 - DNA, 20 bp, Homo sapiens
agacaagtgactgtatctgt

SEQ ID NO: 3722812 - DNA, 22 bp, Homo sapiens
agacaagtgactgtatctgtgt

SEQ ID NO: 3722813 - DNA, 17 bp, Homo sapiens
agacaatgcagatgcca

SEQ ID NO: 3722814 - DNA, 11 bp, Homo sapiens
agacacacaca

SEQ ID NO: 3722815 - DNA, 18 bp, Homo sapiens
agacacacgcacacacac

SEQ ID NO: 3722816 - DNA, 12 bp, Homo sapiens
agacacagactg

SEQ ID NO: 3722817 - DNA, 17 bp, Homo sapiens
agacacaggatagataa

SEQ ID NO: 3722818 - DNA, 23 bp, Homo sapiens
agacacaggatagataactcttt

SEQ ID NO: 3722819 - DNA, 13 bp, Homo sapiens
agacacaggcccg

SEQ ID NO: 3722820 - DNA, 17 bp, Homo sapiens
agacacaggcccggctc

SEQ ID NO: 3722821 - DNA, 19 bp, Homo sapiens
agacacaggcccggctcca

SEQ ID NO: 3722822 - DNA, 23 bp, Homo sapiens
agacacaggcccggctccaggct

SEQ ID NO: 3722823 - DNA, 15 bp, Homo sapiens
agacacagggcatcc

SEQ ID NO: 3722824 - DNA, 21 bp, Homo sapiens
agacacagggcatccaactga

SEQ ID NO: 3722825 - DNA, 18 bp, Homo sapiens
agacaccctaatgtggca

SEQ ID NO: 3722826 - DNA, 19 bp, Homo sapiens
agacaccgttcattcaggc

SEQ ID NO: 3722827 - DNA, 15 bp, Homo sapiens
agacacctcagagcc

SEQ ID NO: 3722828 - DNA, 16 bp, Homo sapiens
agacacctcagagccc

SEQ ID NO: 3722829 - DNA, 21 bp, Homo sapiens
agacactgaaatatacacaca

SEQ ID NO: 3722830 - DNA, 20 bp, Homo sapiens
agacactgtttacaagaaaa

SEQ ID NO: 3722831 - DNA, 23 bp, Homo sapiens
agacactttggaagtttgtgttc

SEQ ID NO: 3722832 - DNA, 14 bp, Homo sapiens
agacagatgcccca

SEQ ID NO: 3722833 - DNA, 16 bp, Homo sapiens
agacagatgccccaga

SEQ ID NO: 3722834 - DNA, 15 bp, Homo sapiens
agacagctccctctg

SEQ ID NO: 3722835 - DNA, 20 bp, Homo sapiens
agacagctccctctgcctga

SEQ ID NO: 3722836 - DNA, 23 bp, Homo sapiens
agacagcttctcatcctgcaggc

SEQ ID NO: 3722837 - DNA, 19 bp, Homo sapiens
agacaggaaaatcctctgg

SEQ ID NO: 3722838 - DNA, 21 bp, Homo sapiens
agacaggaaaatcctctggct

SEQ ID NO: 3722839 - DNA, 14 bp, Homo sapiens
agacaggaaaggga

SEQ ID NO: 3722840 - DNA, 14 bp, Homo sapiens
agacaggagaaatg

SEQ ID NO: 3722841 - DNA, 21 bp, Homo sapiens
agacagggttttgccatgttg

SEQ ID NO: 3722842 - DNA, 18 bp, Homo sapiens
agacataaccactgcttc

SEQ ID NO: 3722843 - DNA, 17 bp, Homo sapiens
agacatcaagcacagaa

SEQ ID NO: 3722844 - DNA, 12 bp, Homo sapiens
agacatggggag

SEQ ID NO: 3722845 - DNA, 16 bp, Homo sapiens
agacatggggaggaag

SEQ ID NO: 3722846 - DNA, 14 bp, Homo sapiens
agaccaaggcggga

SEQ ID NO: 3722847 - DNA, 23 bp, Homo sapiens
agaccaaggcgggagcatctctt

SEQ ID NO: 3722848 - DNA, 16 bp, Homo sapiens
agaccaagtcctggct

SEQ ID NO: 3722849 - DNA, 14 bp, Homo sapiens
agaccagagctctg

SEQ ID NO: 3722850 - DNA, 16 bp, Homo sapiens
agaccagagctctgga

SEQ ID NO: 3722851 - DNA, 13 bp, Homo sapiens
agaccataatgtt

SEQ ID NO: 3722852 - DNA, 21 bp, Homo sapiens
agaccatcctggccaacatga

SEQ ID NO: 3722853 - DNA, 16 bp, Homo sapiens
agacccaaggaggaaa

SEQ ID NO: 3722854 - DNA, 15 bp, Homo sapiens
agacccccacacctc

SEQ ID NO: 3722855 - DNA, 12 bp, Homo sapiens
agacccccaccc

SEQ ID NO: 3722856 - DNA, 16 bp, Homo sapiens
agacccccaccccttc

SEQ ID NO: 3722857 - DNA, 17 bp, Homo sapiens
agacccccaccccttcc

SEQ ID NO: 3722858 - DNA, 20 bp, Homo sapiens
agacccccaccccttcccca

SEQ ID NO: 3722859 - DNA, 21 bp, Homo sapiens
agacccccaccccttccccac

SEQ ID NO: 3722860 - DNA, 12 bp, Homo sapiens
agacccctggct

SEQ ID NO: 3722861 - DNA, 13 bp, Homo sapiens
agacccctggctg

SEQ ID NO: 3722862 - DNA, 18 bp, Homo sapiens
agaccctaccccaccacg

SEQ ID NO: 3722863 - DNA, 14 bp, Homo sapiens
agaccctcgtggcc

SEQ ID NO: 3722864 - DNA, 19 bp, Homo sapiens
agacctaacgagaaataga

SEQ ID NO: 3722865 - DNA, 15 bp, Homo sapiens
agacctagggaggac

SEQ ID NO: 3722866 - DNA, 14 bp, Homo sapiens
agacctcagccatg

SEQ ID NO: 3722867 - DNA, 15 bp, Homo sapiens
agacctcagcctgtg

SEQ ID NO: 3722868 - DNA, 17 bp, Homo sapiens
agacctcagcctgtgct

SEQ ID NO: 3722869 - DNA, 19 bp, Homo sapiens
agacctcagcctgtgctgc

SEQ ID NO: 3722870 - DNA, 19 bp, Homo sapiens
agacctctatatttgctct

SEQ ID NO: 3722871 - DNA, 18 bp, Homo sapiens
agacctgactcaggcatc

SEQ ID NO: 3722872 - DNA, 15 bp, Homo sapiens
agacctgtcttccaa

SEQ ID NO: 3722873 - DNA, 19 bp, Homo sapiens
agacctgtgctagttttac

SEQ ID NO: 3722874 - DNA, 18 bp, Homo sapiens
agaccttctccaaatgag

SEQ ID NO: 3722875 - DNA, 14 bp, Homo sapiens
agacgcaggaatgg

SEQ ID NO: 3722876 - DNA, 18 bp, Homo sapiens
agacggagtcccaccttg

SEQ ID NO: 3722877 - DNA, 14 bp, Homo sapiens
agacggattgcatt

SEQ ID NO: 3722878 - DNA, 18 bp, Homo sapiens
agacgtatgcttatttta

SEQ ID NO: 3722879 - DNA, 14 bp, Homo sapiens
agactagagaaacc

SEQ ID NO: 3722880 - DNA, 16 bp, Homo sapiens
agactagattgccttt

SEQ ID NO: 3722881 - DNA, 20 bp, Homo sapiens
agactattgacatcagcatc

SEQ ID NO: 3722882 - DNA, 15 bp, Homo sapiens
agactcacctctgcc

SEQ ID NO: 3722883 - DNA, 13 bp, Homo sapiens
agactcagtgttc

SEQ ID NO: 3722884 - DNA, 12 bp, Homo sapiens
agactcagtttg

SEQ ID NO: 3722885 - DNA, 15 bp, Homo sapiens
agactcagtttgtca

SEQ ID NO: 3722886 - DNA, 21 bp, Homo sapiens
agactcagtttgtcagacttt

SEQ ID NO: 3722887 - DNA, 15 bp, Homo sapiens
agactcattcttctg

SEQ ID NO: 3722888 - DNA, 17 bp, Homo sapiens
agactcattcttctgta

SEQ ID NO: 3722889 - DNA, 16 bp, Homo sapiens
agactcccaagctgga

SEQ ID NO: 3722890 - DNA, 17 bp, Homo sapiens
agactctacagaggcca

SEQ ID NO: 3722891 - DNA, 19 bp, Homo sapiens
agactctacagaggccatg

SEQ ID NO: 3722892 - DNA, 19 bp, Homo sapiens
agactctacccatattaca

SEQ ID NO: 3722893 - DNA, 16 bp, Homo sapiens
agactctgtggggcct

SEQ ID NO: 3722894 - DNA, 16 bp, Homo sapiens
agactctttggacact

SEQ ID NO: 3722895 - DNA, 15 bp, Homo sapiens
agactgaacagccaa

SEQ ID NO: 3722896 - DNA, 16 bp, Homo sapiens
agactgaactgtgtga

SEQ ID NO: 3722897 - DNA, 13 bp, Homo sapiens
agactgagctcaa

SEQ ID NO: 3722898 - DNA, 15 bp, Homo sapiens
agactgctgggactg

SEQ ID NO: 3722899 - DNA, 20 bp, Homo sapiens
agactgctgggactggccag

SEQ ID NO: 3722900 - DNA, 22 bp, Homo sapiens
agactgctgggactggccaggt

SEQ ID NO: 3722901 - DNA, 19 bp, Homo sapiens
agactggaagcacagcttc

SEQ ID NO: 3722902 - DNA, 23 bp, Homo sapiens
agactggaggggacgctggtaga

SEQ ID NO: 3722903 - DNA, 21 bp, Homo sapiens
agactggatagtccgtctctg

SEQ ID NO: 3722904 - DNA, 11 bp, Homo sapiens
agactggcctg

SEQ ID NO: 3722905 - DNA, 18 bp, Homo sapiens
agactggcctgaggagca

SEQ ID NO: 3722906 - DNA, 21 bp, Homo sapiens
agactgggaagataggctctg

SEQ ID NO: 3722907 - DNA, 23 bp, Homo sapiens
agactgggaagataggctctgca

SEQ ID NO: 3722908 - DNA, 21 bp, Homo sapiens
agactgggtgaggataacaca

SEQ ID NO: 3722909 - DNA, 18 bp, Homo sapiens
agactggtgagcagactg

SEQ ID NO: 3722910 - DNA, 23 bp, Homo sapiens
agactgtagattgcttctgtagt

SEQ ID NO: 3722911 - DNA, 11 bp, Homo sapiens
agactgtggct

SEQ ID NO: 3722912 - DNA, 17 bp, Homo sapiens
agacttcatttttccta

SEQ ID NO: 3722913 - DNA, 15 bp, Homo sapiens
agacttccctgaatg

SEQ ID NO: 3722914 - DNA, 17 bp, Homo sapiens
agacttgaaagaaaggg

SEQ ID NO: 3722915 - DNA, 12 bp, Homo sapiens
agacttgctgaa

SEQ ID NO: 3722916 - DNA, 23 bp, Homo sapiens
agacttggtgtcctttccctcca

SEQ ID NO: 3722917 - DNA, 19 bp, Homo sapiens
aggccgagaagcaagaaag

SEQ ID NO: 3722918 - DNA, 19 bp, Homo sapiens
aggccgccccagcctctga

SEQ ID NO: 3722919 - DNA, 20 bp, Homo sapiens
aggccgggtgctcagggctg

SEQ ID NO: 3722920 - DNA, 13 bp, Homo sapiens
aggcctcagtgga

SEQ ID NO: 3722921 - DNA, 23 bp, Homo sapiens
aggcctcagtggactttccaccc

SEQ ID NO: 3722922 - DNA, 18 bp, Homo sapiens
aggcctccagctcagcag

SEQ ID NO: 3722923 - DNA, 20 bp, Homo sapiens
aggcctccagctcagcagtg

SEQ ID NO: 3722924 - DNA, 23 bp, Homo sapiens
aggcctggccagatgcaccagcc

SEQ ID NO: 3722925 - DNA, 21 bp, Homo sapiens
aggcctgggtctgtgtctctt

SEQ ID NO: 3722926 - DNA, 17 bp, Homo sapiens
aggcctgggtgctggct

SEQ ID NO: 3722927 - DNA, 18 bp, Homo sapiens
aggccttctctgaaggac

SEQ ID NO: 3722928 - DNA, 14 bp, Homo sapiens
aggcgccccttccc

SEQ ID NO: 3722929 - DNA, 15 bp, Homo sapiens
aggctagatcatgaa

SEQ ID NO: 3722930 - DNA, 16 bp, Homo sapiens
aggctattattttcac

SEQ ID NO: 3722931 - DNA, 18 bp, Homo sapiens
aggctcagtctcaggagc

SEQ ID NO: 3722932 - DNA, 22 bp, Homo sapiens
aggctccaccccatccagttca

SEQ ID NO: 3722933 - DNA, 23 bp, Homo sapiens
aggctccttcctgtcttcctgca

SEQ ID NO: 3722934 - DNA, 20 bp, Homo sapiens
aggctctaaccacacagcct

SEQ ID NO: 3722935 - DNA, 18 bp, Homo sapiens
aggctctgaaagccagct

SEQ ID NO: 3722936 - DNA, 13 bp, Homo sapiens
aggctctgccctg

SEQ ID NO: 3722937 - DNA, 20 bp, Homo sapiens
aggctctttctgggccaagt

SEQ ID NO: 3722938 - DNA, 13 bp, Homo sapiens
aggctgaaagagg

SEQ ID NO: 3722939 - DNA, 17 bp, Homo sapiens
aggctgaccaagagaga

SEQ ID NO: 3722940 - DNA, 18 bp, Homo sapiens
aggctgaccaagagagaa

SEQ ID NO: 3722941 - DNA, 18 bp, Homo sapiens
aggctgaggaaaggccag

SEQ ID NO: 3722942 - DNA, 18 bp, Homo sapiens
aggctgaggcaagagaat

SEQ ID NO: 3722943 - DNA, 22 bp, Homo sapiens
aggctgaggggaggatcactgg

SEQ ID NO: 3722944 - DNA, 15 bp, Homo sapiens
aggctgcagcgagct

SEQ ID NO: 3722945 - DNA, 15 bp, Homo sapiens
aggctgcatagaagg

SEQ ID NO: 3722946 - DNA, 19 bp, Homo sapiens
aggctgcctgagcacctcc

SEQ ID NO: 3722947 - DNA, 16 bp, Homo sapiens
aggctgctcagggctg

SEQ ID NO: 3722948 - DNA, 14 bp, Homo sapiens
aggctgctggagga

SEQ ID NO: 3722949 - DNA, 13 bp, Homo sapiens
aggctgcttggga

SEQ ID NO: 3722950 - DNA, 14 bp, Homo sapiens
aggctggactccag

SEQ ID NO: 3722951 - DNA, 13 bp, Homo sapiens
aggctggagccca

SEQ ID NO: 3722952 - DNA, 13 bp, Homo sapiens
aggctggaggcag

SEQ ID NO: 3722953 - DNA, 18 bp, Homo sapiens
aggctggaggcagggcct

SEQ ID NO: 3722954 - DNA, 23 bp, Homo sapiens
aggctggaggcagggccttgccc

SEQ ID NO: 3722955 - DNA, 13 bp, Homo sapiens
aggctggcctcag

SEQ ID NO: 3722956 - DNA, 16 bp, Homo sapiens
aggctggcctcagact

SEQ ID NO: 3722957 - DNA, 13 bp, Homo sapiens
aggctggctggcc

SEQ ID NO: 3722958 - DNA, 22 bp, Homo sapiens
aggctggctggcccgtcatgtt

SEQ ID NO: 3722959 - DNA, 22 bp, Homo sapiens
aggctggcttgtcccctcctca

SEQ ID NO: 3722960 - DNA, 13 bp, Homo sapiens
aggctgggccaag

SEQ ID NO: 3722961 - DNA, 13 bp, Homo sapiens
aggctgggcccag

SEQ ID NO: 3722962 - DNA, 15 bp, Homo sapiens
aggctgggcccagag

SEQ ID NO: 3722963 - DNA, 16 bp, Homo sapiens
aggctgggcccagagg

SEQ ID NO: 3722964 - DNA, 17 bp, Homo sapiens
aggctgggcccagaggc

SEQ ID NO: 3722965 - DNA, 21 bp, Homo sapiens
aggctgggcccagaggcacag

SEQ ID NO: 3722966 - DNA, 16 bp, Homo sapiens
aggctgggtgcccaca

SEQ ID NO: 3722967 - DNA, 18 bp, Homo sapiens
aggctgtatcccatgagc

SEQ ID NO: 3722968 - DNA, 20 bp, Homo sapiens
aggctgtatcccatgagcct

SEQ ID NO: 3722969 - DNA, 22 bp, Homo sapiens
aggctgtatcccatgagcctca

SEQ ID NO: 3722970 - DNA, 23 bp, Homo sapiens
aggctgtatcccatgagcctcag

SEQ ID NO: 3722971 - DNA, 24 bp, Homo sapiens
aggctgtatcccatgagcctcagc

SEQ ID NO: 3722972 - DNA, 23 bp, Homo sapiens
aggcttccacgtactgcagcctc

SEQ ID NO: 3722973 - DNA, 13 bp, Homo sapiens
aggcttccttggc

SEQ ID NO: 3722974 - DNA, 16 bp, Homo sapiens
aggcttcttcagatca

SEQ ID NO: 3722975 - DNA, 23 bp, Homo sapiens
aggcttcttcagatcagtgcttg

SEQ ID NO: 3722976 - DNA, 15 bp, Homo sapiens
aggcttgcctgcagg

SEQ ID NO: 3722977 - DNA, 17 bp, Homo sapiens
aggcttgtcagagctgg

SEQ ID NO: 3722978 - DNA, 21 bp, Homo sapiens
aggctttacttagcttatcaa

SEQ ID NO: 3722979 - DNA, 15 bp, Homo sapiens
agggaaacgtgccct

SEQ ID NO: 3722980 - DNA, 22 bp, Homo sapiens
agggaaaggctctgaaagccag

SEQ ID NO: 3722981 - DNA, 14 bp, Homo sapiens
agggaaatgaaaga

SEQ ID NO: 3722982 - DNA, 15 bp, Homo sapiens
agggaacagacagga

SEQ ID NO: 3722983 - DNA, 13 bp, Homo sapiens
agggaagagaaac

SEQ ID NO: 3722984 - DNA, 12 bp, Homo sapiens
agggaagcccag

SEQ ID NO: 3722985 - DNA, 21 bp, Homo sapiens
agggaatgaaggtgtcagaat

SEQ ID NO: 3722986 - DNA, 18 bp, Homo sapiens
agggaattgaggtctgct

SEQ ID NO: 3722987 - DNA, 19 bp, Homo sapiens
agggacaaatttaaaacaa

SEQ ID NO: 3722988 - DNA, 20 bp, Homo sapiens
agggacaaatttaaaacaaa

SEQ ID NO: 3722989 - DNA, 17 bp, Homo sapiens
agggacacatttctctg

SEQ ID NO: 3722990 - DNA, 10 bp, Homo sapiens
agggacagag

SEQ ID NO: 3722991 - DNA, 18 bp, Homo sapiens
agggacagagacacctgc

SEQ ID NO: 3722992 - DNA, 19 bp, Homo sapiens
agggacagagacacctgca

SEQ ID NO: 3722993 - DNA, 23 bp, Homo sapiens
agggacatattcatttggaaata

SEQ ID NO: 3722994 - DNA, 23 bp, Homo sapiens
agggacccctgcccttgtcccac

SEQ ID NO: 3722995 - DNA, 12 bp, Homo sapiens
agggacctgggg

SEQ ID NO: 3722996 - DNA, 16 bp, Homo sapiens
agggacctggggaagc

SEQ ID NO: 3722997 - DNA, 12 bp, Homo sapiens
agggacttaaaa

SEQ ID NO: 3722998 - DNA, 18 bp, Homo sapiens
agggacttggaagctccg

SEQ ID NO: 3722999 - DNA, 21 bp, Homo sapiens
agggagaagactatattgtac

SEQ ID NO: 3723000 - DNA, 15 bp, Homo sapiens
agggagagccagctc

SEQ ID NO: 3723001 - DNA, 18 bp, Homo sapiens
agggagcaagacagagac

SEQ ID NO: 3723002 - DNA, 13 bp, Homo sapiens
agggagcactggg

SEQ ID NO: 3723003 - DNA, 20 bp, Homo sapiens
agggagcagagaaggccagg

SEQ ID NO: 3723004 - DNA, 14 bp, Homo sapiens
agggagcggaaagc

SEQ ID NO: 3723005 - DNA, 18 bp, Homo sapiens
agggagcggaaagcagct

SEQ ID NO: 3723006 - DNA, 23 bp, Homo sapiens
agggaggaatcgaggaaccagag

SEQ ID NO: 3723007 - DNA, 15 bp, Homo sapiens
agggagggcttctgc

SEQ ID NO: 3723008 - DNA, 12 bp, Homo sapiens
agggaggggact

SEQ ID NO: 3723009 - DNA, 17 bp, Homo sapiens
agggaggtgaccccagg

SEQ ID NO: 3723010 - DNA, 13 bp, Homo sapiens
agggaggtttgtg

SEQ ID NO: 3723011 - DNA, 17 bp, Homo sapiens
agggaggtttgtgagag

SEQ ID NO: 3723012 - DNA, 13 bp, Homo sapiens
agggatagagggg

SEQ ID NO: 3723013 - DNA, 17 bp, Homo sapiens
agggatagcactgagca

SEQ ID NO: 3723014 - DNA, 22 bp, Homo sapiens
agggatagcactgagcaaagca

SEQ ID NO: 3723015 - DNA, 19 bp, Homo sapiens
agggatagtcaccttttaa

SEQ ID NO: 3723016 - DNA, 18 bp, Homo sapiens
agggatcagccctgccct

SEQ ID NO: 3723017 - DNA, 17 bp, Homo sapiens
agggatgaggtgctggg

SEQ ID NO: 3723018 - DNA, 23 bp, Homo sapiens
agggatgaggtgctgggagggat

SEQ ID NO: 3723019 - DNA, 16 bp, Homo sapiens
agggatgctgcctgag

SEQ ID NO: 3723020 - DNA, 17 bp, Homo sapiens
agggatgctgcctgagt

SEQ ID NO: 3723021 - DNA, 19 bp, Homo sapiens
agggatgctgcctgagtca

SEQ ID NO: 3723022 - DNA, 22 bp, Homo sapiens
agggatggaaaaggaagactag

SEQ ID NO: 3723023 - DNA, 18 bp, Homo sapiens
agggatgttctggccctc

SEQ ID NO: 3723024 - DNA, 18 bp, Homo sapiens
agggattcacatctgcat

SEQ ID NO: 3723025 - DNA, 17 bp, Homo sapiens
agggattttcagccctc

SEQ ID NO: 3723026 - DNA, 21 bp, Homo sapiens
agggcacaccgggcactcaga

SEQ ID NO: 3723027 - DNA, 16 bp, Homo sapiens
agggcactggtggccc

SEQ ID NO: 3723028 - DNA, 16 bp, Homo sapiens
agggcaggaaggagag

SEQ ID NO: 3723029 - DNA, 19 bp, Homo sapiens
agggcaggaaggagagcct

SEQ ID NO: 3723030 - DNA, 23 bp, Homo sapiens
agggcaggaaggagagcctgctg

SEQ ID NO: 3723031 - DNA, 16 bp, Homo sapiens
aggatatttaagaaaa

SEQ ID NO: 3723032 - DNA, 18 bp, Homo sapiens
aggatatttaagaaaata

SEQ ID NO: 3723033 - DNA, 15 bp, Homo sapiens
aggatcactggagcc

SEQ ID NO: 3723034 - DNA, 19 bp, Homo sapiens
aggatcactggagcccagg

SEQ ID NO: 3723035 - DNA, 20 bp, Homo sapiens
aggatcactggagcccagga

SEQ ID NO: 3723036 - DNA, 22 bp, Homo sapiens
aggatcactggagcccaggagt

SEQ ID NO: 3723037 - DNA, 12 bp, Homo sapiens
aggatcagaaag

SEQ ID NO: 3723038 - DNA, 18 bp, Homo sapiens
aggatcagaaagtaattt

SEQ ID NO: 3723039 - DNA, 19 bp, Homo sapiens
aggatgaatgaggtcccag

SEQ ID NO: 3723040 - DNA, 15 bp, Homo sapiens
aggatgattgtacag

SEQ ID NO: 3723041 - DNA, 18 bp, Homo sapiens
aggatgcagagtcagcag

SEQ ID NO: 3723042 - DNA, 14 bp, Homo sapiens
aggatgcccagggc

SEQ ID NO: 3723043 - DNA, 16 bp, Homo sapiens
aggatggagagagggg

SEQ ID NO: 3723044 - DNA, 22 bp, Homo sapiens
aggatgggtctggtttgcagag

SEQ ID NO: 3723045 - DNA, 20 bp, Homo sapiens
aggatgtaaacagtgcctgc

SEQ ID NO: 3723046 - DNA, 21 bp, Homo sapiens
aggatgtaaacagtgcctgct

SEQ ID NO: 3723047 - DNA, 20 bp, Homo sapiens
aggatgtggaaacctccttc

SEQ ID NO: 3723048 - DNA, 16 bp, Homo sapiens
aggatgttctgggaca

SEQ ID NO: 3723049 - DNA, 16 bp, Homo sapiens
aggattacatgcatgt

SEQ ID NO: 3723050 - DNA, 14 bp, Homo sapiens
aggattattggaaa

SEQ ID NO: 3723051 - DNA, 15 bp, Homo sapiens
aggattgctactgtc

SEQ ID NO: 3723052 - DNA, 22 bp, Homo sapiens
aggattgctactgtcctaccca

SEQ ID NO: 3723053 - DNA, 21 bp, Homo sapiens
aggattgcttgagcccaggag

SEQ ID NO: 3723054 - DNA, 19 bp, Homo sapiens
aggatttcatgatttcatt

SEQ ID NO: 3723055 - DNA, 20 bp, Homo sapiens
aggatttcatgatttcattt

SEQ ID NO: 3723056 - DNA, 17 bp, Homo sapiens
aggcaaaatccttgctt

SEQ ID NO: 3723057 - DNA, 17 bp, Homo sapiens
aggcaactcatcttagg

SEQ ID NO: 3723058 - DNA, 18 bp, Homo sapiens
aggcaactgaacaaaaaa

SEQ ID NO: 3723059 - DNA, 15 bp, Homo sapiens
aggcaactgaggcag

SEQ ID NO: 3723060 - DNA, 19 bp, Homo sapiens
aggcaactgaggcagacag

SEQ ID NO: 3723061 - DNA, 12 bp, Homo sapiens
aggcaagagaat

SEQ ID NO: 3723062 - DNA, 14 bp, Homo sapiens
aggcaagcacctcc

SEQ ID NO: 3723063 - DNA, 19 bp, Homo sapiens
aggcaagcacctcctgcct

SEQ ID NO: 3723064 - DNA, 20 bp, Homo sapiens
aggcaagcacctcctgcctc

SEQ ID NO: 3723065 - DNA, 15 bp, Homo sapiens
aggcaatgctggctg

SEQ ID NO: 3723066 - DNA, 16 bp, Homo sapiens
aggcaatgctggctgt

SEQ ID NO: 3723067 - DNA, 19 bp, Homo sapiens
aggcaatggcctaaacttc

SEQ ID NO: 3723068 - DNA, 23 bp, Homo sapiens
aggcaatgtcaggaacagaagga

SEQ ID NO: 3723069 - DNA, 23 bp, Homo sapiens
aggcacacagctgcagagacaga

SEQ ID NO: 3723070 - DNA, 12 bp, Homo sapiens
aggcacacttct

SEQ ID NO: 3723071 - DNA, 15 bp, Homo sapiens
aggcacacttcttct

SEQ ID NO: 3723072 - DNA, 20 bp, Homo sapiens
aggcacacttcttcttggtc

SEQ ID NO: 3723073 - DNA, 20 bp, Homo sapiens
aggcacagccggggcctgcc

SEQ ID NO: 3723074 - DNA, 17 bp, Homo sapiens
aggcacagtgaaggctg

SEQ ID NO: 3723075 - DNA, 14 bp, Homo sapiens
aggcaccagtgtcc

SEQ ID NO: 3723076 - DNA, 20 bp, Homo sapiens
aggcacccaccatcatgtct

SEQ ID NO: 3723077 - DNA, 12 bp, Homo sapiens
aggcacccatcc

SEQ ID NO: 3723078 - DNA, 15 bp, Homo sapiens
aggcaccgagaatgt

SEQ ID NO: 3723079 - DNA, 21 bp, Homo sapiens
aggcacctataaaacaggtca

SEQ ID NO: 3723080 - DNA, 17 bp, Homo sapiens
aggcacgaacccacctg

SEQ ID NO: 3723081 - DNA, 21 bp, Homo sapiens
aggcagaaagcagaggctggc

SEQ ID NO: 3723082 - DNA, 15 bp, Homo sapiens
aggcagaagaattga

SEQ ID NO: 3723083 - DNA, 22 bp, Homo sapiens
aggcagaagaattgaacccagg

SEQ ID NO: 3723084 - DNA, 15 bp, Homo sapiens
aggcagacagcagct

SEQ ID NO: 3723085 - DNA, 14 bp, Homo sapiens
aggcagagaatcat

SEQ ID NO: 3723086 - DNA, 24 bp, Homo sapiens
aggcagagtgccccacctgccact

SEQ ID NO: 3723087 - DNA, 15 bp, Homo sapiens
aggcagatctgtgcc

SEQ ID NO: 3723088 - DNA, 20 bp, Homo sapiens
aggcagatctgtgccccatg

SEQ ID NO: 3723089 - DNA, 23 bp, Homo sapiens
aggcagatctgtgccccatgcct

SEQ ID NO: 3723090 - DNA, 12 bp, Homo sapiens
aggcagcattta

SEQ ID NO: 3723091 - DNA, 17 bp, Homo sapiens
aggcagccccattctgc

SEQ ID NO: 3723092 - DNA, 20 bp, Homo sapiens
aggcagctttttctctccca

SEQ ID NO: 3723093 - DNA, 16 bp, Homo sapiens
aggcaggaagggcagg

SEQ ID NO: 3723094 - DNA, 22 bp, Homo sapiens
aggcagggaaaggctctgaaag

SEQ ID NO: 3723095 - DNA, 21 bp, Homo sapiens
aggcagggaagtgtaagaaac

SEQ ID NO: 3723096 - DNA, 18 bp, Homo sapiens
aggcagggtctcactctg

SEQ ID NO: 3723097 - DNA, 22 bp, Homo sapiens
aggcagggttttatctctgtct

SEQ ID NO: 3723098 - DNA, 16 bp, Homo sapiens
aggcaggtgacagtga

SEQ ID NO: 3723099 - DNA, 18 bp, Homo sapiens
aggcaggtgacagtgagg

SEQ ID NO: 3723100 - DNA, 16 bp, Homo sapiens
aggcagtggggctggg

SEQ ID NO: 3723101 - DNA, 14 bp, Homo sapiens
aggcataggcctgg

SEQ ID NO: 3723102 - DNA, 15 bp, Homo sapiens
aggcataggcctggg

SEQ ID NO: 3723103 - DNA, 18 bp, Homo sapiens
aggcatccttcctcacac

SEQ ID NO: 3723104 - DNA, 14 bp, Homo sapiens
aggcatgcctgtgt

SEQ ID NO: 3723105 - DNA, 15 bp, Homo sapiens
aggcatgcctgtgtg

SEQ ID NO: 3723106 - DNA, 22 bp, Homo sapiens
aggcatgttctctgaggacact

SEQ ID NO: 3723107 - DNA, 12 bp, Homo sapiens
aggcattcaagt

SEQ ID NO: 3723108 - DNA, 17 bp, Homo sapiens
aggccaagagcagaggc

SEQ ID NO: 3723109 - DNA, 18 bp, Homo sapiens
aggccaagagcagaggca

SEQ ID NO: 3723110 - DNA, 15 bp, Homo sapiens
aggccaagtgcaggc

SEQ ID NO: 3723111 - DNA, 11 bp, Homo sapiens
aggccacctgc

SEQ ID NO: 3723112 - DNA, 12 bp, Homo sapiens
aggccacctgca

SEQ ID NO: 3723113 - DNA, 14 bp, Homo sapiens
aggccacctgcccc

SEQ ID NO: 3723114 - DNA, 19 bp, Homo sapiens
aggccacctgcccccttct

SEQ ID NO: 3723115 - DNA, 22 bp, Homo sapiens
aggccacctgcccccttctccc

SEQ ID NO: 3723116 - DNA, 13 bp, Homo sapiens
aggccacggcagc

SEQ ID NO: 3723117 - DNA, 14 bp, Homo sapiens
aggccagagggagt

SEQ ID NO: 3723118 - DNA, 19 bp, Homo sapiens
aggccagagtggcctggcc

SEQ ID NO: 3723119 - DNA, 21 bp, Homo sapiens
aggccagagtggcctggccag

SEQ ID NO: 3723120 - DNA, 22 bp, Homo sapiens
aggccagagtggcctggccagg

SEQ ID NO: 3723121 - DNA, 15 bp, Homo sapiens
aggccagccccaccc

SEQ ID NO: 3723122 - DNA, 21 bp, Homo sapiens
aggccagccccacccaggagg

SEQ ID NO: 3723123 - DNA, 16 bp, Homo sapiens
aggccagctggcagca

SEQ ID NO: 3723124 - DNA, 20 bp, Homo sapiens
aggccagctggcagcagagt

SEQ ID NO: 3723125 - DNA, 21 bp, Homo sapiens
aggccaggagtttgagaccag

SEQ ID NO: 3723126 - DNA, 15 bp, Homo sapiens
aggccatggcagaat

SEQ ID NO: 3723127 - DNA, 15 bp, Homo sapiens
aggccatgtgagcca

SEQ ID NO: 3723128 - DNA, 23 bp, Homo sapiens
aggcccaaattatcaagctaata

SEQ ID NO: 3723129 - DNA, 12 bp, Homo sapiens
aggcccaagaga

SEQ ID NO: 3723130 - DNA, 22 bp, Homo sapiens
aggcccacctaccttcaaagct

SEQ ID NO: 3723131 - DNA, 18 bp, Homo sapiens
aggcccatggttgagaaa

SEQ ID NO: 3723132 - DNA, 13 bp, Homo sapiens
aggccccactggg

SEQ ID NO: 3723133 - DNA, 15 bp, Homo sapiens
aggccccactgggga

SEQ ID NO: 3723134 - DNA, 17 bp, Homo sapiens
aggccccactggggaaa

SEQ ID NO: 3723135 - DNA, 16 bp, Homo sapiens
aggccccaggaagccg

SEQ ID NO: 3723136 - DNA, 13 bp, Homo sapiens
aggcccccaagcc

SEQ ID NO: 3723137 - DNA, 13 bp, Homo sapiens
aggccccctgcat

SEQ ID NO: 3723138 - DNA, 20 bp, Homo sapiens
aggccccgcttgtccagcgc

SEQ ID NO: 3723139 - DNA, 12 bp, Homo sapiens
aggcccctgcca

SEQ ID NO: 3723140 - DNA, 17 bp, Homo sapiens
aggcccctgccaccctg

SEQ ID NO: 3723141 - DNA, 19 bp, Homo sapiens
aggcccgcatgcggcccag

SEQ ID NO: 3723142 - DNA, 16 bp, Homo sapiens
aggcccggctccaggc

SEQ ID NO: 3723143 - DNA, 20 bp, Homo sapiens
aggcccttattttcaagaaa

SEQ ID NO: 3723144 - DNA, 15 bp, Homo sapiens
aggcccttcctctcc

SEQ ID NO: 3723145 - DNA, 22 bp, Homo sapiens
aggccgaagaagggtccttccc

SEQ ID NO: 3723146 - DNA, 20 bp, Homo sapiens
agcccctcttgccccccacc

SEQ ID NO: 3723147 - DNA, 22 bp, Homo sapiens
agcccctcttgccccccacccc

SEQ ID NO: 3723148 - DNA, 14 bp, Homo sapiens
agcccctgcccctc

SEQ ID NO: 3723149 - DNA, 19 bp, Homo sapiens
agcccgcacccccaccctt

SEQ ID NO: 3723150 - DNA, 12 bp, Homo sapiens
agcccgcatgca

SEQ ID NO: 3723151 - DNA, 17 bp, Homo sapiens
agcccgcatgcagcagc

SEQ ID NO: 3723152 - DNA, 14 bp, Homo sapiens
agcccggatgcttc

SEQ ID NO: 3723153 - DNA, 17 bp, Homo sapiens
agcccgtgtggcccctt

SEQ ID NO: 3723154 - DNA, 19 bp, Homo sapiens
agcccgtgtggccccttca

SEQ ID NO: 3723155 - DNA, 16 bp, Homo sapiens
agccctccctgcccct

SEQ ID NO: 3723156 - DNA, 19 bp, Homo sapiens
agccctccctgcccctccc

SEQ ID NO: 3723157 - DNA, 14 bp, Homo sapiens
agccctccctgtcc

SEQ ID NO: 3723158 - DNA, 21 bp, Homo sapiens
agccctccctgtcctcctcgg

SEQ ID NO: 3723159 - DNA, 22 bp, Homo sapiens
agccctccctgtcctcctcgga

SEQ ID NO: 3723160 - DNA, 18 bp, Homo sapiens
agccctctcactgtgtcc

SEQ ID NO: 3723161 - DNA, 21 bp, Homo sapiens
agccctgaggtgaaagggagc

SEQ ID NO: 3723162 - DNA, 21 bp, Homo sapiens
agccctgattgcgcaaaactg

SEQ ID NO: 3723163 - DNA, 17 bp, Homo sapiens
agccctgctttgggctg

SEQ ID NO: 3723164 - DNA, 19 bp, Homo sapiens
agccctgctttgggctgcc

SEQ ID NO: 3723165 - DNA, 20 bp, Homo sapiens
agccctgctttgggctgccc

SEQ ID NO: 3723166 - DNA, 21 bp, Homo sapiens
agccctgctttgggctgccct

SEQ ID NO: 3723167 - DNA, 12 bp, Homo sapiens
agccctggcagg

SEQ ID NO: 3723168 - DNA, 13 bp, Homo sapiens
agccctggcagga

SEQ ID NO: 3723169 - DNA, 17 bp, Homo sapiens
agccctggcaggatgac

SEQ ID NO: 3723170 - DNA, 21 bp, Homo sapiens
agccctggcaggatgaccctg

SEQ ID NO: 3723171 - DNA, 13 bp, Homo sapiens
agccctggccaga

SEQ ID NO: 3723172 - DNA, 16 bp, Homo sapiens
agccctggccagaggc

SEQ ID NO: 3723173 - DNA, 21 bp, Homo sapiens
agccctgggccccaccaccta

SEQ ID NO: 3723174 - DNA, 14 bp, Homo sapiens
agccctggtggcag

SEQ ID NO: 3723175 - DNA, 21 bp, Homo sapiens
agccctggtggcagtgggagc

SEQ ID NO: 3723176 - DNA, 16 bp, Homo sapiens
agccctgtcagtgcag

SEQ ID NO: 3723177 - DNA, 17 bp, Homo sapiens
agccctgtcagtgcagc

SEQ ID NO: 3723178 - DNA, 13 bp, Homo sapiens
agcccttcatttg

SEQ ID NO: 3723179 - DNA, 14 bp, Homo sapiens
agcccttcatttgg

SEQ ID NO: 3723180 - DNA, 22 bp, Homo sapiens
agcccttccatgtcgcctctgc

SEQ ID NO: 3723181 - DNA, 20 bp, Homo sapiens
agcccttgagctccccaaaa

SEQ ID NO: 3723182 - DNA, 22 bp, Homo sapiens
agccctttgggaggctgaggcg

SEQ ID NO: 3723183 - DNA, 13 bp, Homo sapiens
agccgacctcagc

SEQ ID NO: 3723184 - DNA, 14 bp, Homo sapiens
agccgacctcagcc

SEQ ID NO: 3723185 - DNA, 16 bp, Homo sapiens
agccgacctcagcctt

SEQ ID NO: 3723186 - DNA, 14 bp, Homo sapiens
agccgagagcctgc

SEQ ID NO: 3723187 - DNA, 18 bp, Homo sapiens
agccgagatcacgccact

SEQ ID NO: 3723188 - DNA, 18 bp, Homo sapiens
agccgcagcctccctctg

SEQ ID NO: 3723189 - DNA, 18 bp, Homo sapiens
agccgccattgccaccag

SEQ ID NO: 3723190 - DNA, 16 bp, Homo sapiens
agccgctcctgtctgc

SEQ ID NO: 3723191 - DNA, 21 bp, Homo sapiens
agccgctcctgtctgccagcc

SEQ ID NO: 3723192 - DNA, 12 bp, Homo sapiens
agccgctgctgg

SEQ ID NO: 3723193 - DNA, 19 bp, Homo sapiens
agccggagtgacagagtaa

SEQ ID NO: 3723194 - DNA, 23 bp, Homo sapiens
agccgggaacagacaacagaagt

SEQ ID NO: 3723195 - DNA, 22 bp, Homo sapiens
agccgggcgtggtggcgggcac

SEQ ID NO: 3723196 - DNA, 15 bp, Homo sapiens
agccgtgccttcagc

SEQ ID NO: 3723197 - DNA, 17 bp, Homo sapiens
agccgtgccttcagctc

SEQ ID NO: 3723198 - DNA, 18 bp, Homo sapiens
aaatgatattaaaaattg

SEQ ID NO: 3723199 - DNA, 17 bp, Homo sapiens
aaatgcaaacacacaaa

SEQ ID NO: 3723200 - DNA, 21 bp, Homo sapiens
aaatgcaaacacacaaaggta

SEQ ID NO: 3723201 - DNA, 16 bp, Homo sapiens
aaatgcaacaacatgt

SEQ ID NO: 3723202 - DNA, 13 bp, Homo sapiens
aaatgcaatatgt

SEQ ID NO: 3723203 - DNA, 21 bp, Homo sapiens
aaatgcagcgaaccaatattt

SEQ ID NO: 3723204 - DNA, 17 bp, Homo sapiens
aaatgcatcaatcctgt

SEQ ID NO: 3723205 - DNA, 23 bp, Homo sapiens
aaatgcatccattcctcagggac

SEQ ID NO: 3723206 - DNA, 15 bp, Homo sapiens
aaatgcctaagaaga

SEQ ID NO: 3723207 - DNA, 18 bp, Homo sapiens
aaatgccttactttgtat

SEQ ID NO: 3723208 - DNA, 19 bp, Homo sapiens
aaatgccttactttgtatg

SEQ ID NO: 3723209 - DNA, 17 bp, Homo sapiens
aaatgctgcgcccttcc

SEQ ID NO: 3723210 - DNA, 21 bp, Homo sapiens
aaatgctgcgcccttccccag

SEQ ID NO: 3723211 - DNA, 16 bp, Homo sapiens
aaatggccatttgctt

SEQ ID NO: 3723212 - DNA, 15 bp, Homo sapiens
aaatgggaatttata

SEQ ID NO: 3723213 - DNA, 13 bp, Homo sapiens
aaatggtaaaatt

SEQ ID NO: 3723214 - DNA, 22 bp, Homo sapiens
aaatggtggttgtttcttccaa

SEQ ID NO: 3723215 - DNA, 19 bp, Homo sapiens
aaatggtgttttcatgtaa

SEQ ID NO: 3723216 - DNA, 22 bp, Homo sapiens
aaatggtgttttcatgtaaata

SEQ ID NO: 3723217 - DNA, 24 bp, Homo sapiens
aaatgtctagttgtaacaccatga

SEQ ID NO: 3723218 - DNA, 21 bp, Homo sapiens
aaatgtctctttaatgtcaca

SEQ ID NO: 3723219 - DNA, 13 bp, Homo sapiens
aaatgtgattttt

SEQ ID NO: 3723220 - DNA, 18 bp, Homo sapiens
aaatgtggcatttgtgat

SEQ ID NO: 3723221 - DNA, 20 bp, Homo sapiens
aaatgttaagttgatggtga

SEQ ID NO: 3723222 - DNA, 15 bp, Homo sapiens
aaatgttcagaaggt

SEQ ID NO: 3723223 - DNA, 21 bp, Homo sapiens
aaatgttcagaaggttgctct

SEQ ID NO: 3723224 - DNA, 23 bp, Homo sapiens
aaatgttttaaggcttcaattta

SEQ ID NO: 3723225 - DNA, 21 bp, Homo sapiens
aaatgtttttctgccagggag

SEQ ID NO: 3723226 - DNA, 12 bp, Homo sapiens
aaattaaacaat

SEQ ID NO: 3723227 - DNA, 13 bp, Homo sapiens
aaattaaacaatt

SEQ ID NO: 3723228 - DNA, 14 bp, Homo sapiens
aaattaaagaaaat

SEQ ID NO: 3723229 - DNA, 17 bp, Homo sapiens
aaattaaagctgaaaac

SEQ ID NO: 3723230 - DNA, 15 bp, Homo sapiens
aaattaaataaaata

SEQ ID NO: 3723231 - DNA, 23 bp, Homo sapiens
aaattaaatatatgtatgtaaaa

SEQ ID NO: 3723232 - DNA, 20 bp, Homo sapiens
aaattaaccatagatgtaga

SEQ ID NO: 3723233 - DNA, 16 bp, Homo sapiens
aaattacacccaaaga

SEQ ID NO: 3723234 - DNA, 15 bp, Homo sapiens
aaattactacaaaat

SEQ ID NO: 3723235 - DNA, 15 bp, Homo sapiens
aaattatcaagctaa

SEQ ID NO: 3723236 - DNA, 17 bp, Homo sapiens
aaattatcaagctaata

SEQ ID NO: 3723237 - DNA, 19 bp, Homo sapiens
aaattatcaagctaataaa

SEQ ID NO: 3723238 - DNA, 20 bp, Homo sapiens
aaattatcaagctaataaaa

SEQ ID NO: 3723239 - DNA, 14 bp, Homo sapiens
aaattatctatttg

SEQ ID NO: 3723240 - DNA, 16 bp, Homo sapiens
aaattattatgacacc

SEQ ID NO: 3723241 - DNA, 16 bp, Homo sapiens
aaattattcagttaag

SEQ ID NO: 3723242 - DNA, 19 bp, Homo sapiens
aaattcacaagttgtgttt

SEQ ID NO: 3723243 - DNA, 20 bp, Homo sapiens
aaattcagatatatttttca

SEQ ID NO: 3723244 - DNA, 12 bp, Homo sapiens
aaattccctgga

SEQ ID NO: 3723245 - DNA, 21 bp, Homo sapiens
aaattcgctgcaacctgttga

SEQ ID NO: 3723246 - DNA, 23 bp, Homo sapiens
aaattctataggaacatatgaaa

SEQ ID NO: 3723247 - DNA, 21 bp, Homo sapiens
aaattctattctgatcttatt

SEQ ID NO: 3723248 - DNA, 15 bp, Homo sapiens
aaattctgtttcttg

SEQ ID NO: 3723249 - DNA, 16 bp, Homo sapiens
aaattgaatttaacaa

SEQ ID NO: 3723250 - DNA, 17 bp, Homo sapiens
aaattgaatttaacaat

SEQ ID NO: 3723251 - DNA, 23 bp, Homo sapiens
aaattgagctggacctcaccaag

SEQ ID NO: 3723252 - DNA, 19 bp, Homo sapiens
aaattgcatgctgctttaa

SEQ ID NO: 3723253 - DNA, 21 bp, Homo sapiens
aaattgcatgctgctttaatt

SEQ ID NO: 3723254 - DNA, 23 bp, Homo sapiens
aaattgcatgggttttgtaggta

SEQ ID NO: 3723255 - DNA, 18 bp, Homo sapiens
aaattgcatttcctgaca

SEQ ID NO: 3723256 - DNA, 16 bp, Homo sapiens
aaattgcttgaaagaa

SEQ ID NO: 3723257 - DNA, 17 bp, Homo sapiens
aaattggcattaaaact

SEQ ID NO: 3723258 - DNA, 19 bp, Homo sapiens
aaattggctagttgaatct

SEQ ID NO: 3723259 - DNA, 12 bp, Homo sapiens
agctttgaaaat

SEQ ID NO: 3723260 - DNA, 10 bp, Homo sapiens
agctttgctc

SEQ ID NO: 3723261 - DNA, 16 bp, Homo sapiens
agctttggaaacagga

SEQ ID NO: 3723262 - DNA, 19 bp, Homo sapiens
agctttggacgcacacagc

SEQ ID NO: 3723263 - DNA, 22 bp, Homo sapiens
agctttgtttgttgtcagctga

SEQ ID NO: 3723264 - DNA, 16 bp, Homo sapiens
agcttttaaaccctat

SEQ ID NO: 3723265 - DNA, 14 bp, Homo sapiens
agcttttactgttt

SEQ ID NO: 3723266 - DNA, 13 bp, Homo sapiens
agcttttcccttc

SEQ ID NO: 3723267 - DNA, 13 bp, Homo sapiens
agctttttgtctt

SEQ ID NO: 3723268 - DNA, 23 bp, Homo sapiens
aggaaaaagtatcatggaaatat

SEQ ID NO: 3723269 - DNA, 21 bp, Homo sapiens
aggaaaaccaagccgtggctt

SEQ ID NO: 3723270 - DNA, 16 bp, Homo sapiens
aggaaactcacctgct

SEQ ID NO: 3723271 - DNA, 23 bp, Homo sapiens
aggaaactcacctgctggcccct

SEQ ID NO: 3723272 - DNA, 19 bp, Homo sapiens
aggaaagccccagcactaa

SEQ ID NO: 3723273 - DNA, 18 bp, Homo sapiens
aggaaataaaaaagtctc

SEQ ID NO: 3723274 - DNA, 21 bp, Homo sapiens
aggaaataaaacctttcaaat

SEQ ID NO: 3723275 - DNA, 14 bp, Homo sapiens
aggaacagaaggat

SEQ ID NO: 3723276 - DNA, 19 bp, Homo sapiens
aggaacctcctccacacca

SEQ ID NO: 3723277 - DNA, 20 bp, Homo sapiens
aggaacggtaaatttctgtg

SEQ ID NO: 3723278 - DNA, 14 bp, Homo sapiens
aggaagaaaaatca

SEQ ID NO: 3723279 - DNA, 14 bp, Homo sapiens
aggaagagaaaaaa

SEQ ID NO: 3723280 - DNA, 20 bp, Homo sapiens
aggaagagcaggcacatgga

SEQ ID NO: 3723281 - DNA, 14 bp, Homo sapiens
aggaagatcaggcc

SEQ ID NO: 3723282 - DNA, 15 bp, Homo sapiens
aggaagccacagctg

SEQ ID NO: 3723283 - DNA, 18 bp, Homo sapiens
aggaagccacagctggtg

SEQ ID NO: 3723284 - DNA, 21 bp, Homo sapiens
aggaagctccagtcctgctct

SEQ ID NO: 3723285 - DNA, 21 bp, Homo sapiens
aggaaggagactcacctctgc

SEQ ID NO: 3723286 - DNA, 23 bp, Homo sapiens
aggaaggagactcacctctgcct

SEQ ID NO: 3723287 - DNA, 21 bp, Homo sapiens
aggaaggagagaaggggagga

SEQ ID NO: 3723288 - DNA, 17 bp, Homo sapiens
aggaaggagagcctgct

SEQ ID NO: 3723289 - DNA, 15 bp, Homo sapiens
aggaaggagaggaga

SEQ ID NO: 3723290 - DNA, 23 bp, Homo sapiens
aggaaggggctggactggctgtc

SEQ ID NO: 3723291 - DNA, 13 bp, Homo sapiens
aggaataaataaa

SEQ ID NO: 3723292 - DNA, 19 bp, Homo sapiens
aggaataaataaaaatgga

SEQ ID NO: 3723293 - DNA, 19 bp, Homo sapiens
aggaataaattgctccttg

SEQ ID NO: 3723294 - DNA, 23 bp, Homo sapiens
aggaatgaaatcctgcttcagtg

SEQ ID NO: 3723295 - DNA, 17 bp, Homo sapiens
aggaatgcctgtgccaa

SEQ ID NO: 3723296 - DNA, 15 bp, Homo sapiens
aggaatgctccccca

SEQ ID NO: 3723297 - DNA, 22 bp, Homo sapiens
aggaatgctcccccatcctccc

SEQ ID NO: 3723298 - DNA, 16 bp, Homo sapiens
cattgaagagagagct

SEQ ID NO: 3723299 - DNA, 15 bp, Homo sapiens
cattgaccaagaact

SEQ ID NO: 3723300 - DNA, 16 bp, Homo sapiens
cattgaccaagaactg

SEQ ID NO: 3723301 - DNA, 23 bp, Homo sapiens
cattgagaactgcatatgtttcg

SEQ ID NO: 3723302 - DNA, 16 bp, Homo sapiens
cattgcactccagcct

SEQ ID NO: 3723303 - DNA, 17 bp, Homo sapiens
cattgcactccagcctg

SEQ ID NO: 3723304 - DNA, 14 bp, Homo sapiens
cattgccaccagga

SEQ ID NO: 3723305 - DNA, 16 bp, Homo sapiens
cattgccaccaggaga

SEQ ID NO: 3723306 - DNA, 14 bp, Homo sapiens
cattgccagtgtct

SEQ ID NO: 3723307 - DNA, 16 bp, Homo sapiens
cattgccagtgtcttt

SEQ ID NO: 3723308 - DNA, 15 bp, Homo sapiens
cattgcggacagcca

SEQ ID NO: 3723309 - DNA, 18 bp, Homo sapiens
cattgctgctccttagct

SEQ ID NO: 3723310 - DNA, 20 bp, Homo sapiens
cattgctgctccttagctgc

SEQ ID NO: 3723311 - DNA, 18 bp, Homo sapiens
cattgctgggcttgtctg

SEQ ID NO: 3723312 - DNA, 15 bp, Homo sapiens
cattgcttcacaacc

SEQ ID NO: 3723313 - DNA, 17 bp, Homo sapiens
cattgcttcactaccca

SEQ ID NO: 3723314 - DNA, 14 bp, Homo sapiens
cattgctttactgg

SEQ ID NO: 3723315 - DNA, 12 bp, Homo sapiens
cattgctttctg

SEQ ID NO: 3723316 - DNA, 18 bp, Homo sapiens
cattggacccacatgagg

SEQ ID NO: 3723317 - DNA, 16 bp, Homo sapiens
cattgtaatgttactg

SEQ ID NO: 3723318 - DNA, 17 bp, Homo sapiens
cattgtagagcttctgg

SEQ ID NO: 3723319 - DNA, 14 bp, Homo sapiens
cattgtctcagagc

SEQ ID NO: 3723320 - DNA, 21 bp, Homo sapiens
cattgtctttatatgaacata

SEQ ID NO: 3723321 - DNA, 19 bp, Homo sapiens
cattgtggctgtcagcagg

SEQ ID NO: 3723322 - DNA, 20 bp, Homo sapiens
cattgtggttatttttatac

SEQ ID NO: 3723323 - DNA, 22 bp, Homo sapiens
cattgtggttatttttatacag

SEQ ID NO: 3723324 - DNA, 21 bp, Homo sapiens
cattgttgaggtggtctgaat

SEQ ID NO: 3723325 - DNA, 17 bp, Homo sapiens
cattgtttgcttattgt

SEQ ID NO: 3723326 - DNA, 15 bp, Homo sapiens
cattgtttggcattg

SEQ ID NO: 3723327 - DNA, 14 bp, Homo sapiens
catttaattgagaa

SEQ ID NO: 3723328 - DNA, 19 bp, Homo sapiens
catttacacttttgagact

SEQ ID NO: 3723329 - DNA, 21 bp, Homo sapiens
catttactttgtgttcacctt

SEQ ID NO: 3723330 - DNA, 20 bp, Homo sapiens
catttagtccaatgtctttt

SEQ ID NO: 3723331 - DNA, 21 bp, Homo sapiens
catttatggtcaacacttaag

SEQ ID NO: 3723332 - DNA, 17 bp, Homo sapiens
catttattttttacatt

SEQ ID NO: 3723333 - DNA, 15 bp, Homo sapiens
catttcattcctaac

SEQ ID NO: 3723334 - DNA, 13 bp, Homo sapiens
catttccccagac

SEQ ID NO: 3723335 - DNA, 17 bp, Homo sapiens
catttcctatgtaactg

SEQ ID NO: 3723336 - DNA, 13 bp, Homo sapiens
catttcctgacag

SEQ ID NO: 3723337 - DNA, 23 bp, Homo sapiens
catttctaaaggcctcttccttg

SEQ ID NO: 3723338 - DNA, 20 bp, Homo sapiens
catttctaactctgatgtaa

SEQ ID NO: 3723339 - DNA, 23 bp, Homo sapiens
catttctaactctgatgtaaatg

SEQ ID NO: 3723340 - DNA, 23 bp, Homo sapiens
catttctagaacatccctgccag

SEQ ID NO: 3723341 - DNA, 15 bp, Homo sapiens
catttcttgggccct

SEQ ID NO: 3723342 - DNA, 17 bp, Homo sapiens
catttcttgggccctcc

SEQ ID NO: 3723343 - DNA, 16 bp, Homo sapiens
catttgatgctaaata

SEQ ID NO: 3723344 - DNA, 15 bp, Homo sapiens
catttgcaccctccg

SEQ ID NO: 3723345 - DNA, 15 bp, Homo sapiens
catttggattggatg

SEQ ID NO: 3723346 - DNA, 20 bp, Homo sapiens
catttggctttccagtcata

SEQ ID NO: 3723347 - DNA, 16 bp, Homo sapiens
catttgggtaaatcat

SEQ ID NO: 3723348 - DNA, 23 bp, Homo sapiens
catttgggtggtaagagaatgtt

SEQ ID NO: 3723349 - DNA, 14 bp, Homo sapiens
catttgtatgttgt

SEQ ID NO: 3723350 - DNA, 15 bp, Homo sapiens
catttgtatgttgtg

SEQ ID NO: 3723351 - DNA, 12 bp, Homo sapiens
catttgtgaggc

SEQ ID NO: 3723352 - DNA, 13 bp, Homo sapiens
catttgtgtgtgt

SEQ ID NO: 3723353 - DNA, 19 bp, Homo sapiens
catttgtgtgtgtgcaagt

SEQ ID NO: 3723354 - DNA, 19 bp, Homo sapiens
catttgttattcttaagac

SEQ ID NO: 3723355 - DNA, 16 bp, Homo sapiens
cattttaactttatca

SEQ ID NO: 3723356 - DNA, 15 bp, Homo sapiens
cattttatattagaa

SEQ ID NO: 3723357 - DNA, 19 bp, Homo sapiens
cattttattaaaacagaaa

SEQ ID NO: 3723358 - DNA, 17 bp, Homo sapiens
cattttcaccccaccct

SEQ ID NO: 3723359 - DNA, 14 bp, Homo sapiens
cattttcagactgc

SEQ ID NO: 3723360 - DNA, 15 bp, Homo sapiens
cattttcatatgctt

SEQ ID NO: 3723361 - DNA, 17 bp, Homo sapiens
cattttctgaaactaat

SEQ ID NO: 3723362 - DNA, 17 bp, Homo sapiens
cattttgaagctaatta

SEQ ID NO: 3723363 - DNA, 13 bp, Homo sapiens
cattttgcaaaat

SEQ ID NO: 3723364 - DNA, 14 bp, Homo sapiens
cattttgcaaaatt

SEQ ID NO: 3723365 - DNA, 15 bp, Homo sapiens
cattttgcagcagtg

SEQ ID NO: 3723366 - DNA, 20 bp, Homo sapiens
cattttgcagcagtgagtct

SEQ ID NO: 3723367 - DNA, 20 bp, Homo sapiens
cattttggaagttttcagga

SEQ ID NO: 3723368 - DNA, 22 bp, Homo sapiens
cattttggaagttttcaggact

SEQ ID NO: 3723369 - DNA, 21 bp, Homo sapiens
cattttggggtacccactgct

SEQ ID NO: 3723370 - DNA, 22 bp, Homo sapiens
cattttgtggtcattaagcatt

SEQ ID NO: 3723371 - DNA, 14 bp, Homo sapiens
catttttaaagctt

SEQ ID NO: 3723372 - DNA, 17 bp, Homo sapiens
cattttttaaaacaaga

SEQ ID NO: 3723373 - DNA, 21 bp, Homo sapiens
cattttttttcagcagactat

SEQ ID NO: 3723374 - DNA, 20 bp, Homo sapiens
catttttttttttaattttg

SEQ ID NO: 3723375 - DNA, 23 bp, Homo sapiens
ccaaaaagaatctgcatttagca

SEQ ID NO: 3723376 - DNA, 18 bp, Homo sapiens
ccaaaacaaacaaacaga

SEQ ID NO: 3723377 - DNA, 22 bp, Homo sapiens
ccaaaacattccgtttacattt

SEQ ID NO: 3723378 - DNA, 18 bp, Homo sapiens
ccaaaagtatcgggggct

SEQ ID NO: 3723379 - DNA, 22 bp, Homo sapiens
ccaaaataatgtcttgttaata

SEQ ID NO: 3723380 - DNA, 16 bp, Homo sapiens
ccaaacccatgaggca

SEQ ID NO: 3723381 - DNA, 14 bp, Homo sapiens
ccaaaccctgtctg

SEQ ID NO: 3723382 - DNA, 15 bp, Homo sapiens
ccaaagagctgccta

SEQ ID NO: 3723383 - DNA, 22 bp, Homo sapiens
ccaaagccaccagactgacaaa

SEQ ID NO: 3723384 - DNA, 15 bp, Homo sapiens
ccaaagccagacagc

SEQ ID NO: 3723385 - DNA, 22 bp, Homo sapiens
ccaaagcctcctccagccgcca

SEQ ID NO: 3723386 - DNA, 15 bp, Homo sapiens
ccaaagctaggcctg

SEQ ID NO: 3723387 - DNA, 17 bp, Homo sapiens
ccaaagctaggcctggc

SEQ ID NO: 3723388 - DNA, 19 bp, Homo sapiens
ccaaagctagggtggccct

SEQ ID NO: 3723389 - DNA, 18 bp, Homo sapiens
ccaaaggaagtctaggag

SEQ ID NO: 3723390 - DNA, 14 bp, Homo sapiens
ccaaaggaggatgg

SEQ ID NO: 3723391 - DNA, 15 bp, Homo sapiens
ccaaaggaggctggc

SEQ ID NO: 3723392 - DNA, 16 bp, Homo sapiens
ccaaaggaggctggca

SEQ ID NO: 3723393 - DNA, 17 bp, Homo sapiens
ccaaaggaggctggcag

SEQ ID NO: 3723394 - DNA, 18 bp, Homo sapiens
ccaaaggaggctggcagg

SEQ ID NO: 3723395 - DNA, 19 bp, Homo sapiens
ccaaatatattctctttgg

SEQ ID NO: 3723396 - DNA, 15 bp, Homo sapiens
ccaaatcaaaatatg

SEQ ID NO: 3723397 - DNA, 15 bp, Homo sapiens
ccaaatcagctgcta

SEQ ID NO: 3723398 - DNA, 23 bp, Homo sapiens
ccaaatcagctgctactactcct

SEQ ID NO: 3723399 - DNA, 16 bp, Homo sapiens
ccaaatcatagtggct

SEQ ID NO: 3723400 - DNA, 20 bp, Homo sapiens
ccaaatctgcctattgcagc

SEQ ID NO: 3723401 - DNA, 18 bp, Homo sapiens
ccaaatgtaattgaataa

SEQ ID NO: 3723402 - DNA, 22 bp, Homo sapiens
ccaaatgtaattgaataaagtt

SEQ ID NO: 3723403 - DNA, 18 bp, Homo sapiens
ccaaattatcaagctaat

SEQ ID NO: 3723404 - DNA, 22 bp, Homo sapiens
ccaaattatcaagctaataaaa

SEQ ID NO: 3723405 - DNA, 20 bp, Homo sapiens
ccaaattccttggcatgcct

SEQ ID NO: 3723406 - DNA, 23 bp, Homo sapiens
ccaaattccttggcatgccttcc

SEQ ID NO: 3723407 - DNA, 15 bp, Homo sapiens
ccaaattctttcagt

SEQ ID NO: 3723408 - DNA, 20 bp, Homo sapiens
ccaacacaaggtgggcaggg

SEQ ID NO: 3723409 - DNA, 12 bp, Homo sapiens
ccaacaccaggg

SEQ ID NO: 3723410 - DNA, 15 bp, Homo sapiens
ccaacaggagctggg

SEQ ID NO: 3723411 - DNA, 16 bp, Homo sapiens
ccaacatcaacatctt

SEQ ID NO: 3723412 - DNA, 16 bp, Homo sapiens
catggacctaacattc

SEQ ID NO: 3723413 - DNA, 14 bp, Homo sapiens
catggagaaaccct

SEQ ID NO: 3723414 - DNA, 16 bp, Homo sapiens
catggagaaaccctgt

SEQ ID NO: 3723415 - DNA, 20 bp, Homo sapiens
catggagaaaccctgtctct

SEQ ID NO: 3723416 - DNA, 19 bp, Homo sapiens
catggagaacagtgatttt

SEQ ID NO: 3723417 - DNA, 19 bp, Homo sapiens
catggaggcacacagctgc

SEQ ID NO: 3723418 - DNA, 17 bp, Homo sapiens
catggaggtttgaagat

SEQ ID NO: 3723419 - DNA, 16 bp, Homo sapiens
catggagtatatgtca

SEQ ID NO: 3723420 - DNA, 22 bp, Homo sapiens
catggagtgtgtattgttccca

SEQ ID NO: 3723421 - DNA, 13 bp, Homo sapiens
catggccaggtgg

SEQ ID NO: 3723422 - DNA, 22 bp, Homo sapiens
catggcgtagagggtgctgccc

SEQ ID NO: 3723423 - DNA, 14 bp, Homo sapiens
catggcgtgtccct

SEQ ID NO: 3723424 - DNA, 19 bp, Homo sapiens
catggcgtgtccctctcgg

SEQ ID NO: 3723425 - DNA, 22 bp, Homo sapiens
catggctaagcttaaaaaaaac

SEQ ID NO: 3723426 - DNA, 16 bp, Homo sapiens
catggctaaggcacca

SEQ ID NO: 3723427 - DNA, 18 bp, Homo sapiens
catggctaaggcaccagc

SEQ ID NO: 3723428 - DNA, 15 bp, Homo sapiens
catgggcctcctgtg

SEQ ID NO: 3723429 - DNA, 16 bp, Homo sapiens
catgggcctcctgtgt

SEQ ID NO: 3723430 - DNA, 17 bp, Homo sapiens
catgggggcctcagggc

SEQ ID NO: 3723431 - DNA, 20 bp, Homo sapiens
catgggggtattatccattc

SEQ ID NO: 3723432 - DNA, 21 bp, Homo sapiens
catggggtggggtagggctga

SEQ ID NO: 3723433 - DNA, 20 bp, Homo sapiens
catggggttggctgggccca

SEQ ID NO: 3723434 - DNA, 22 bp, Homo sapiens
catggggttggctgggcccaga

SEQ ID NO: 3723435 - DNA, 23 bp, Homo sapiens
catgggtagcttctgacctcagc

SEQ ID NO: 3723436 - DNA, 23 bp, Homo sapiens
catgggttatgtgtatgtgccat

SEQ ID NO: 3723437 - DNA, 16 bp, Homo sapiens
catgggttttgtaggt

SEQ ID NO: 3723438 - DNA, 21 bp, Homo sapiens
catgggttttgtaggtacttt

SEQ ID NO: 3723439 - DNA, 14 bp, Homo sapiens
catggtcacagaga

SEQ ID NO: 3723440 - DNA, 15 bp, Homo sapiens
catggtccccatggc

SEQ ID NO: 3723441 - DNA, 14 bp, Homo sapiens
catggtgcctctgg

SEQ ID NO: 3723442 - DNA, 23 bp, Homo sapiens
catggtgtgaaagtcagatgccc

SEQ ID NO: 3723443 - DNA, 19 bp, Homo sapiens
catggttaaggtaaagtaa

SEQ ID NO: 3723444 - DNA, 14 bp, Homo sapiens
catgtaaaagagtc

SEQ ID NO: 3723445 - DNA, 16 bp, Homo sapiens
catgtaaaagagtcat

SEQ ID NO: 3723446 - DNA, 14 bp, Homo sapiens
catgtaaataaata

SEQ ID NO: 3723447 - DNA, 21 bp, Homo sapiens
catgtaatggtatcttaaagt

SEQ ID NO: 3723448 - DNA, 21 bp, Homo sapiens
catgtaattaagtactatgta

SEQ ID NO: 3723449 - DNA, 19 bp, Homo sapiens
catgtaccctaaggtcatt

SEQ ID NO: 3723450 - DNA, 22 bp, Homo sapiens
catgtactgtagtttttcttca

SEQ ID NO: 3723451 - DNA, 18 bp, Homo sapiens
catgtagcctcaacctcc

SEQ ID NO: 3723452 - DNA, 14 bp, Homo sapiens
catgtataaatgaa

SEQ ID NO: 3723453 - DNA, 23 bp, Homo sapiens
catgtataaatgaagtttataca

SEQ ID NO: 3723454 - DNA, 15 bp, Homo sapiens
catgtataatatttt

SEQ ID NO: 3723455 - DNA, 20 bp, Homo sapiens
catgtcaccggatcctgggt

SEQ ID NO: 3723456 - DNA, 14 bp, Homo sapiens
catgtcgcctctgc

SEQ ID NO: 3723457 - DNA, 18 bp, Homo sapiens
catgtcgcctctgcattc

SEQ ID NO: 3723458 - DNA, 12 bp, Homo sapiens
catgtctggcta

SEQ ID NO: 3723459 - DNA, 23 bp, Homo sapiens
catgtgagccaccgctgccagca

SEQ ID NO: 3723460 - DNA, 15 bp, Homo sapiens
catgtgcctgcacca

SEQ ID NO: 3723461 - DNA, 20 bp, Homo sapiens
catgtgcctgcaccaggaga

SEQ ID NO: 3723462 - DNA, 21 bp, Homo sapiens
catgtgcctgcaccaggagac

SEQ ID NO: 3723463 - DNA, 22 bp, Homo sapiens
catgtgcctgcaccaggagaca

SEQ ID NO: 3723464 - DNA, 20 bp, Homo sapiens
catgtggaaagtgaatttga

SEQ ID NO: 3723465 - DNA, 17 bp, Homo sapiens
catgtgggtgagccagt

SEQ ID NO: 3723466 - DNA, 18 bp, Homo sapiens
catgtgggtgagccagtg

SEQ ID NO: 3723467 - DNA, 23 bp, Homo sapiens
catgtgggtgagccagtggaaca

SEQ ID NO: 3723468 - DNA, 12 bp, Homo sapiens
catgtggtggga

SEQ ID NO: 3723469 - DNA, 21 bp, Homo sapiens
catgtgtccatcccagcggct

SEQ ID NO: 3723470 - DNA, 15 bp, Homo sapiens
catgtgtgagtgtgt

SEQ ID NO: 3723471 - DNA, 21 bp, Homo sapiens
catgtgtgagtgtgtgcaagt

SEQ ID NO: 3723472 - DNA, 13 bp, Homo sapiens
catgtgtgcgtgt

SEQ ID NO: 3723473 - DNA, 15 bp, Homo sapiens
catgtgtgtgcaagt

SEQ ID NO: 3723474 - DNA, 15 bp, Homo sapiens
catgtgtgtgctcag

SEQ ID NO: 3723475 - DNA, 16 bp, Homo sapiens
catgttaatcctagct

SEQ ID NO: 3723476 - DNA, 18 bp, Homo sapiens
catgttaggaaaatttca

SEQ ID NO: 3723477 - DNA, 23 bp, Homo sapiens
catgttatgataaaaaattttgt

SEQ ID NO: 3723478 - DNA, 13 bp, Homo sapiens
catgttcctcaaa

SEQ ID NO: 3723479 - DNA, 21 bp, Homo sapiens
catgttcctcaaaagcaccct

SEQ ID NO: 3723480 - DNA, 19 bp, Homo sapiens
catgttgagccaggcctgg

SEQ ID NO: 3723481 - DNA, 12 bp, Homo sapiens
catgttggccag

SEQ ID NO: 3723482 - DNA, 16 bp, Homo sapiens
catgtttaagatttaa

SEQ ID NO: 3723483 - DNA, 23 bp, Homo sapiens
catgtttgatgtatctgagcagg

SEQ ID NO: 3723484 - DNA, 23 bp, Homo sapiens
cattaaaacttaaccgcatcaga

SEQ ID NO: 3723485 - DNA, 13 bp, Homo sapiens
cattaaagcagtc

SEQ ID NO: 3723486 - DNA, 19 bp, Homo sapiens
cattaattattattgctgt

SEQ ID NO: 3723487 - DNA, 20 bp, Homo sapiens
cattaattattattgctgtt

SEQ ID NO: 3723488 - DNA, 20 bp, Homo sapiens
cattacagagaggagaaaca

SEQ ID NO: 3723489 - DNA, 21 bp, Homo sapiens
cattacagtgggtgcccccct

SEQ ID NO: 3723490 - DNA, 22 bp, Homo sapiens
cattacattccttgataatgtt

SEQ ID NO: 3723491 - DNA, 16 bp, Homo sapiens
cattacggctcctctc

SEQ ID NO: 3723492 - DNA, 19 bp, Homo sapiens
cataattatgacagttata

SEQ ID NO: 3723493 - DNA, 21 bp, Homo sapiens
cataattctaatctaacaatg

SEQ ID NO: 3723494 - DNA, 18 bp, Homo sapiens
cataattcttgtatatta

SEQ ID NO: 3723495 - DNA, 15 bp, Homo sapiens
cataatttgtacata

SEQ ID NO: 3723496 - DNA, 14 bp, Homo sapiens
cataattttcttca

SEQ ID NO: 3723497 - DNA, 23 bp, Homo sapiens
catacaggaaggtagaaatatct

SEQ ID NO: 3723498 - DNA, 23 bp, Homo sapiens
catacatttataatgtttgctat

SEQ ID NO: 3723499 - DNA, 24 bp, Homo sapiens
catacatttataatgtttgctatt

SEQ ID NO: 3723500 - DNA, 22 bp, Homo sapiens
cataccaggccgccccagcctc

SEQ ID NO: 3723501 - DNA, 15 bp, Homo sapiens
catactgagggacca

SEQ ID NO: 3723502 - DNA, 19 bp, Homo sapiens
catactgagggaccaactg

SEQ ID NO: 3723503 - DNA, 11 bp, Homo sapiens
catactgctgt

SEQ ID NO: 3723504 - DNA, 21 bp, Homo sapiens
catagaaggaggagagggaaa

SEQ ID NO: 3723505 - DNA, 15 bp, Homo sapiens
catagactagagaaa

SEQ ID NO: 3723506 - DNA, 16 bp, Homo sapiens
catagactagagaaac

SEQ ID NO: 3723507 - DNA, 20 bp, Homo sapiens
catagattcacctgtaaaac

SEQ ID NO: 3723508 - DNA, 21 bp, Homo sapiens
catagattcacctgtaaaact

SEQ ID NO: 3723509 - DNA, 19 bp, Homo sapiens
catagatttctgattttat

SEQ ID NO: 3723510 - DNA, 15 bp, Homo sapiens
catagcaagacacat

SEQ ID NO: 3723511 - DNA, 16 bp, Homo sapiens
catagcagattttaat

SEQ ID NO: 3723512 - DNA, 15 bp, Homo sapiens
catagcattaactaa

SEQ ID NO: 3723513 - DNA, 16 bp, Homo sapiens
catagcgctgctctta

SEQ ID NO: 3723514 - DNA, 17 bp, Homo sapiens
cataggcctgggtgctg

SEQ ID NO: 3723515 - DNA, 19 bp, Homo sapiens
cataggcctgggtgctggc

SEQ ID NO: 3723516 - DNA, 17 bp, Homo sapiens
catagggtctcttcagg

SEQ ID NO: 3723517 - DNA, 19 bp, Homo sapiens
catagtatattaaaaatgg

SEQ ID NO: 3723518 - DNA, 22 bp, Homo sapiens
catagtgaccggctgcttttcc

SEQ ID NO: 3723519 - DNA, 20 bp, Homo sapiens
catagtgagacccctgtctc

SEQ ID NO: 3723520 - DNA, 22 bp, Homo sapiens
catagtggcttaaaacaacact

SEQ ID NO: 3723521 - DNA, 19 bp, Homo sapiens
catagtggtgggcacctat

SEQ ID NO: 3723522 - DNA, 16 bp, Homo sapiens
catataatatatgttt

SEQ ID NO: 3723523 - DNA, 19 bp, Homo sapiens
catataatatatgttttaa

SEQ ID NO: 3723524 - DNA, 22 bp, Homo sapiens
catataatatatgttttaaata

SEQ ID NO: 3723525 - DNA, 18 bp, Homo sapiens
catatataactagctaga

SEQ ID NO: 3723526 - DNA, 13 bp, Homo sapiens
catatcagttgag

SEQ ID NO: 3723527 - DNA, 18 bp, Homo sapiens
catatctaaccagtgatt

SEQ ID NO: 3723528 - DNA, 20 bp, Homo sapiens
catatgactcacatgatgca

SEQ ID NO: 3723529 - DNA, 14 bp, Homo sapiens
catatgcaaacata

SEQ ID NO: 3723530 - DNA, 21 bp, Homo sapiens
catatgcttcaaactaacaca

SEQ ID NO: 3723531 - DNA, 13 bp, Homo sapiens
catatgtaaaata

SEQ ID NO: 3723532 - DNA, 14 bp, Homo sapiens
catatgtaaaataa

SEQ ID NO: 3723533 - DNA, 15 bp, Homo sapiens
catatgtaccatgta

SEQ ID NO: 3723534 - DNA, 17 bp, Homo sapiens
catatgtattcctgatc

SEQ ID NO: 3723535 - DNA, 17 bp, Homo sapiens
catatgtgaatatggac

SEQ ID NO: 3723536 - DNA, 17 bp, Homo sapiens
catattcctgcagcctg

SEQ ID NO: 3723537 - DNA, 18 bp, Homo sapiens
catattcctgcagcctgg

SEQ ID NO: 3723538 - DNA, 21 bp, Homo sapiens
catattcctgcagcctggagg

SEQ ID NO: 3723539 - DNA, 18 bp, Homo sapiens
catattctgttggccagt

SEQ ID NO: 3723540 - DNA, 12 bp, Homo sapiens
catatttaagaa

SEQ ID NO: 3723541 - DNA, 15 bp, Homo sapiens
catatttgcatatgt

SEQ ID NO: 3723542 - DNA, 17 bp, Homo sapiens
catatttgcatatgtat

SEQ ID NO: 3723543 - DNA, 19 bp, Homo sapiens
catatttgcatatgtatga

SEQ ID NO: 3723544 - DNA, 21 bp, Homo sapiens
catatttgttaaatatttaca

SEQ ID NO: 3723545 - DNA, 21 bp, Homo sapiens
catcaagttattgacaaactc

SEQ ID NO: 3723546 - DNA, 11 bp, Homo sapiens
catcaatgttc

SEQ ID NO: 3723547 - DNA, 14 bp, Homo sapiens
catcaatgttcatt

SEQ ID NO: 3723548 - DNA, 15 bp, Homo sapiens
catcaatgttcattg

SEQ ID NO: 3723549 - DNA, 11 bp, Homo sapiens
catcacacaca

SEQ ID NO: 3723550 - DNA, 12 bp, Homo sapiens
catcacacacac

SEQ ID NO: 3723551 - DNA, 13 bp, Homo sapiens
catcacagggcag

SEQ ID NO: 3723552 - DNA, 20 bp, Homo sapiens
catcacagggcagagccggg

SEQ ID NO: 3723553 - DNA, 15 bp, Homo sapiens
catcacatcatgctg

SEQ ID NO: 3723554 - DNA, 18 bp, Homo sapiens
catcacctcaggccaggt

SEQ ID NO: 3723555 - DNA, 20 bp, Homo sapiens
catcaccttaggcagggaag

SEQ ID NO: 3723556 - DNA, 23 bp, Homo sapiens
catcaccttaggcagggaagtgt

SEQ ID NO: 3723557 - DNA, 14 bp, Homo sapiens
catcacttccctac

SEQ ID NO: 3723558 - DNA, 11 bp, Homo sapiens
catcagaaatg

SEQ ID NO: 3723559 - DNA, 20 bp, Homo sapiens
catcagaagcctattgtaaa

SEQ ID NO: 3723560 - DNA, 20 bp, Homo sapiens
catcagaggcctagtcagcc

SEQ ID NO: 3723561 - DNA, 17 bp, Homo sapiens
catcagctgtaagaaga

SEQ ID NO: 3723562 - DNA, 19 bp, Homo sapiens
catcagctgtaagaagaga

SEQ ID NO: 3723563 - DNA, 22 bp, Homo sapiens
catcagtgttaaaaaatttttg

SEQ ID NO: 3723564 - DNA, 22 bp, Homo sapiens
catcagttactctgaagggcat

SEQ ID NO: 3723565 - DNA, 18 bp, Homo sapiens
catcagttcccccagtac

SEQ ID NO: 3723566 - DNA, 13 bp, Homo sapiens
catcataaaataa

SEQ ID NO: 3723567 - DNA, 18 bp, Homo sapiens
catcataaaataaagtat

SEQ ID NO: 3723568 - DNA, 20 bp, Homo sapiens
catcataaaataaagtatat

SEQ ID NO: 3723569 - DNA, 23 bp, Homo sapiens
catcataaaataaagtatatata

SEQ ID NO: 3723570 - DNA, 23 bp, Homo sapiens
catcatgacactcgtataagcat

SEQ ID NO: 3723571 - DNA, 20 bp, Homo sapiens
catcatgtaaattaccagta

SEQ ID NO: 3723572 - DNA, 13 bp, Homo sapiens
catcatgtctggc

SEQ ID NO: 3723573 - DNA, 21 bp, Homo sapiens
catcattatttgcagagacag

SEQ ID NO: 3723574 - DNA, 21 bp, Homo sapiens
catccaaccccccacctgcca

SEQ ID NO: 3723575 - DNA, 22 bp, Homo sapiens
catccaaggagaaacagagaca

SEQ ID NO: 3723576 - DNA, 14 bp, Homo sapiens
catccaatcctcac

SEQ ID NO: 3723577 - DNA, 16 bp, Homo sapiens
catccaatcctcactg

SEQ ID NO: 3723578 - DNA, 17 bp, Homo sapiens
catccaatcctcactgg

SEQ ID NO: 3723579 - DNA, 19 bp, Homo sapiens
catccaatcctcactgggt

SEQ ID NO: 3723580 - DNA, 15 bp, Homo sapiens
catccactctaccct

SEQ ID NO: 3723581 - DNA, 18 bp, Homo sapiens
catccatgtgtggactca

SEQ ID NO: 3723582 - DNA, 17 bp, Homo sapiens
catccattcctcaggga

SEQ ID NO: 3723583 - DNA, 19 bp, Homo sapiens
catccattcctcagggaca

SEQ ID NO: 3723584 - DNA, 22 bp, Homo sapiens
catccatttatttggcatctgt

SEQ ID NO: 3723585 - DNA, 12 bp, Homo sapiens
catcccagcctg

SEQ ID NO: 3723586 - DNA, 23 bp, Homo sapiens
catcccagtggcctcaaccctcc

SEQ ID NO: 3723587 - DNA, 15 bp, Homo sapiens
catcccatcccatcc

SEQ ID NO: 3723588 - DNA, 12 bp, Homo sapiens
catcccatcccg

SEQ ID NO: 3723589 - DNA, 13 bp, Homo sapiens
catcccattgccc

SEQ ID NO: 3723590 - DNA, 16 bp, Homo sapiens
catcccattgccctgg

SEQ ID NO: 3723591 - DNA, 11 bp, Homo sapiens
catccccaggg

SEQ ID NO: 3723592 - DNA, 12 bp, Homo sapiens
catccccagggg

SEQ ID NO: 3723593 - DNA, 16 bp, Homo sapiens
catccccgctggctgg

SEQ ID NO: 3723594 - DNA, 17 bp, Homo sapiens
catcccgctcttttcct

SEQ ID NO: 3723595 - DNA, 22 bp, Homo sapiens
catccctgaggctggactccag

SEQ ID NO: 3723596 - DNA, 21 bp, Homo sapiens
catccctgccagctcttctgc

SEQ ID NO: 3723597 - DNA, 16 bp, Homo sapiens
catccgaggcagggtc

SEQ ID NO: 3723598 - DNA, 22 bp, Homo sapiens
catccgaggcagggtcaggaga

SEQ ID NO: 3723599 - DNA, 16 bp, Homo sapiens
catccgtagttccctg

SEQ ID NO: 3723600 - DNA, 21 bp, Homo sapiens
catccgtagttccctgaaaac

SEQ ID NO: 3723601 - DNA, 20 bp, Homo sapiens
catccgtgagcagtgtgtct

SEQ ID NO: 3723602 - DNA, 23 bp, Homo sapiens
catcctaccacaatgcagtgcct

SEQ ID NO: 3723603 - DNA, 13 bp, Homo sapiens
catcctcccaagg

SEQ ID NO: 3723604 - DNA, 23 bp, Homo sapiens
catcctggcacccggcccctgct

SEQ ID NO: 3723605 - DNA, 22 bp, Homo sapiens
catccttcaagaactctgggct

SEQ ID NO: 3723606 - DNA, 21 bp, Homo sapiens
cagggtctcactatgttgccc

SEQ ID NO: 3723607 - DNA, 18 bp, Homo sapiens
cagggtctcactctgtcg

SEQ ID NO: 3723608 - DNA, 21 bp, Homo sapiens
cagggtctcactctgtcgccc

SEQ ID NO: 3723609 - DNA, 22 bp, Homo sapiens
cagggtctcactctgtcgccca

SEQ ID NO: 3723610 - DNA, 22 bp, Homo sapiens
cagggttcccccagccctgtgg

SEQ ID NO: 3723611 - DNA, 15 bp, Homo sapiens
cagggttctcctctc

SEQ ID NO: 3723612 - DNA, 20 bp, Homo sapiens
cagggttctcctctcccctc

SEQ ID NO: 3723613 - DNA, 14 bp, Homo sapiens
cagggttggcccct

SEQ ID NO: 3723614 - DNA, 15 bp, Homo sapiens
cagggttggcccctg

SEQ ID NO: 3723615 - DNA, 15 bp, Homo sapiens
cagggttgggcccag

SEQ ID NO: 3723616 - DNA, 14 bp, Homo sapiens
caggtaacaggcag

SEQ ID NO: 3723617 - DNA, 17 bp, Homo sapiens
caggtaacaggcagata

SEQ ID NO: 3723618 - DNA, 15 bp, Homo sapiens
caggtaccccagctc

SEQ ID NO: 3723619 - DNA, 14 bp, Homo sapiens
caggtagctgcccc

SEQ ID NO: 3723620 - DNA, 22 bp, Homo sapiens
caggtagctgcccctggctctg

SEQ ID NO: 3723621 - DNA, 23 bp, Homo sapiens
caggtcaatacagtacaggcagc

SEQ ID NO: 3723622 - DNA, 22 bp, Homo sapiens
caggtcgggctcagctctggct

SEQ ID NO: 3723623 - DNA, 15 bp, Homo sapiens
caggtctcctcttaa

SEQ ID NO: 3723624 - DNA, 17 bp, Homo sapiens
caggtctcctcttaaaa

SEQ ID NO: 3723625 - DNA, 22 bp, Homo sapiens
caggtctcctcttaaaaaataa

SEQ ID NO: 3723626 - DNA, 18 bp, Homo sapiens
caggtcttgaactcctgg

SEQ ID NO: 3723627 - DNA, 19 bp, Homo sapiens
caggtcttgaactcctggc

SEQ ID NO: 3723628 - DNA, 14 bp, Homo sapiens
caggtgacagtgag

SEQ ID NO: 3723629 - DNA, 19 bp, Homo sapiens
caggtgacagtgaggtcct

SEQ ID NO: 3723630 - DNA, 13 bp, Homo sapiens
caggtgagaagca

SEQ ID NO: 3723631 - DNA, 17 bp, Homo sapiens
caggtgatccacccacc

SEQ ID NO: 3723632 - DNA, 23 bp, Homo sapiens
caggtgatccacccacctcagcc

SEQ ID NO: 3723633 - DNA, 22 bp, Homo sapiens
caggtgcccctctctccatcag

SEQ ID NO: 3723634 - DNA, 14 bp, Homo sapiens
caggtgcgaaagga

SEQ ID NO: 3723635 - DNA, 14 bp, Homo sapiens
caggtggctgaccc

SEQ ID NO: 3723636 - DNA, 16 bp, Homo sapiens
caggtggctgacccag

SEQ ID NO: 3723637 - DNA, 23 bp, Homo sapiens
caggtggctgacccagtccctgg

SEQ ID NO: 3723638 - DNA, 14 bp, Homo sapiens
caggtggggcagct

SEQ ID NO: 3723639 - DNA, 21 bp, Homo sapiens
caggtgtcatatatggggggc

SEQ ID NO: 3723640 - DNA, 18 bp, Homo sapiens
caggtgtccctgcacttg

SEQ ID NO: 3723641 - DNA, 23 bp, Homo sapiens
caggtgtgaaccaccacacccag

SEQ ID NO: 3723642 - DNA, 21 bp, Homo sapiens
caggtgtgagtcaccaagccc

SEQ ID NO: 3723643 - DNA, 20 bp, Homo sapiens
caggtgttctacactcatct

SEQ ID NO: 3723644 - DNA, 16 bp, Homo sapiens
caggtgtttagttgca

SEQ ID NO: 3723645 - DNA, 23 bp, Homo sapiens
caggttctggttagctcagcccc

SEQ ID NO: 3723646 - DNA, 22 bp, Homo sapiens
caggttgaggggctcctggaaa

SEQ ID NO: 3723647 - DNA, 18 bp, Homo sapiens
caggtttaagctgttact

SEQ ID NO: 3723648 - DNA, 15 bp, Homo sapiens
cagtaaagagaaact

SEQ ID NO: 3723649 - DNA, 16 bp, Homo sapiens
cagtaaagagaaactt

SEQ ID NO: 3723650 - DNA, 18 bp, Homo sapiens
cagtaaagagaaactttg

SEQ ID NO: 3723651 - DNA, 23 bp, Homo sapiens
cagtaagaccggaagctcctggt

SEQ ID NO: 3723652 - DNA, 15 bp, Homo sapiens
cagtaagccactgcc

SEQ ID NO: 3723653 - DNA, 14 bp, Homo sapiens
cagtaataaaacat

SEQ ID NO: 3723654 - DNA, 13 bp, Homo sapiens
cagtaataactct

SEQ ID NO: 3723655 - DNA, 21 bp, Homo sapiens
cagtaattggtccgatctttg

SEQ ID NO: 3723656 - DNA, 16 bp, Homo sapiens
cagtacaggcagcaca

SEQ ID NO: 3723657 - DNA, 16 bp, Homo sapiens
cagtacagtggttcta

SEQ ID NO: 3723658 - DNA, 17 bp, Homo sapiens
cagtacagtggttctac

SEQ ID NO: 3723659 - DNA, 12 bp, Homo sapiens
cagtacatttaa

SEQ ID NO: 3723660 - DNA, 13 bp, Homo sapiens
cagtacctccaag

SEQ ID NO: 3723661 - DNA, 15 bp, Homo sapiens
cagtacctccaagca

SEQ ID NO: 3723662 - DNA, 16 bp, Homo sapiens
cagtacctccaagcaa

SEQ ID NO: 3723663 - DNA, 16 bp, Homo sapiens
cagtacctttgtcaca

SEQ ID NO: 3723664 - DNA, 13 bp, Homo sapiens
cagtactggagct

SEQ ID NO: 3723665 - DNA, 18 bp, Homo sapiens
cagtagcagtagatgcat

SEQ ID NO: 3723666 - DNA, 16 bp, Homo sapiens
cagtagtgagaagaat

SEQ ID NO: 3723667 - DNA, 22 bp, Homo sapiens
cagtagtgagaagaatattgtt

SEQ ID NO: 3723668 - DNA, 17 bp, Homo sapiens
cagtatcaggcctgcca

SEQ ID NO: 3723669 - DNA, 20 bp, Homo sapiens
cagtatcaggcctgccagac

SEQ ID NO: 3723670 - DNA, 18 bp, Homo sapiens
cagtattacttctgctac

SEQ ID NO: 3723671 - DNA, 15 bp, Homo sapiens
cagtcaaaacagaga

SEQ ID NO: 3723672 - DNA, 15 bp, Homo sapiens
cagtcaaggagtggc

SEQ ID NO: 3723673 - DNA, 17 bp, Homo sapiens
cagtcaaggagtggctt

SEQ ID NO: 3723674 - DNA, 16 bp, Homo sapiens
cagtcagtaattgcca

SEQ ID NO: 3723675 - DNA, 15 bp, Homo sapiens
cagtcataactaaat

SEQ ID NO: 3723676 - DNA, 22 bp, Homo sapiens
cagtcatcgtaggtgatttgaa

SEQ ID NO: 3723677 - DNA, 18 bp, Homo sapiens
cagtcatcttgaccaagc

SEQ ID NO: 3723678 - DNA, 13 bp, Homo sapiens
cagtcattatgag

SEQ ID NO: 3723679 - DNA, 23 bp, Homo sapiens
cagtccaaatgtcctccagaagc

SEQ ID NO: 3723680 - DNA, 17 bp, Homo sapiens
cagtccccctgccccag

SEQ ID NO: 3723681 - DNA, 12 bp, Homo sapiens
cagtccctgggg

SEQ ID NO: 3723682 - DNA, 13 bp, Homo sapiens
cagtcctgcctgg

SEQ ID NO: 3723683 - DNA, 17 bp, Homo sapiens
cagtcctgcctggccag

SEQ ID NO: 3723684 - DNA, 21 bp, Homo sapiens
cagtcctgcctggccaggcag

SEQ ID NO: 3723685 - DNA, 12 bp, Homo sapiens
cagtcctgggag

SEQ ID NO: 3723686 - DNA, 13 bp, Homo sapiens
cagtcctgggaga

SEQ ID NO: 3723687 - DNA, 14 bp, Homo sapiens
cagtctcaggagca

SEQ ID NO: 3723688 - DNA, 23 bp, Homo sapiens
cagtctcccaggccccctgcatc

SEQ ID NO: 3723689 - DNA, 15 bp, Homo sapiens
cagtctctttaatct

SEQ ID NO: 3723690 - DNA, 23 bp, Homo sapiens
cagtctgattcccaagctctgct

SEQ ID NO: 3723691 - DNA, 12 bp, Homo sapiens
cagtctgctgcc

SEQ ID NO: 3723692 - DNA, 18 bp, Homo sapiens
cagtctggaatgcagtgg

SEQ ID NO: 3723693 - DNA, 13 bp, Homo sapiens
cagtctggagggg

SEQ ID NO: 3723694 - DNA, 15 bp, Homo sapiens
cagtcttgaatttct

SEQ ID NO: 3723695 - DNA, 19 bp, Homo sapiens
cagtgacacttcagagagc

SEQ ID NO: 3723696 - DNA, 16 bp, Homo sapiens
cagtgacagagttcac

SEQ ID NO: 3723697 - DNA, 17 bp, Homo sapiens
cagtgacctgaggaagc

SEQ ID NO: 3723698 - DNA, 18 bp, Homo sapiens
cagtgacgtgcacctgta

SEQ ID NO: 3723699 - DNA, 19 bp, Homo sapiens
cagtgagccgcatcttctc

SEQ ID NO: 3723700 - DNA, 13 bp, Homo sapiens
cagtgaggcccag

SEQ ID NO: 3723701 - DNA, 16 bp, Homo sapiens
cagtgaggcccaggga

SEQ ID NO: 3723702 - DNA, 23 bp, Homo sapiens
cagtgaggggtatatctgggctg

SEQ ID NO: 3723703 - DNA, 16 bp, Homo sapiens
cagtgagggtcttctt

SEQ ID NO: 3723704 - DNA, 23 bp, Homo sapiens
cagtgagggtcttcttacatgca

SEQ ID NO: 3723705 - DNA, 15 bp, Homo sapiens
cagctgccagagaag

SEQ ID NO: 3723706 - DNA, 20 bp, Homo sapiens
cagctgcccccgctcatggg

SEQ ID NO: 3723707 - DNA, 12 bp, Homo sapiens
cagctgcccctc

SEQ ID NO: 3723708 - DNA, 15 bp, Homo sapiens
cagctgcccctccct

SEQ ID NO: 3723709 - DNA, 14 bp, Homo sapiens
cagctgcctcactt

SEQ ID NO: 3723710 - DNA, 22 bp, Homo sapiens
cagctgcggtccacccaggagc

SEQ ID NO: 3723711 - DNA, 24 bp, Homo sapiens
cagctgcggtccacccaggagccc

SEQ ID NO: 3723712 - DNA, 17 bp, Homo sapiens
cagctgctactactcct

SEQ ID NO: 3723713 - DNA, 17 bp, Homo sapiens
cagctgctcccctccct

SEQ ID NO: 3723714 - DNA, 21 bp, Homo sapiens
cagctgctcccctccctcctc

SEQ ID NO: 3723715 - DNA, 11 bp, Homo sapiens
cagctgctctg

SEQ ID NO: 3723716 - DNA, 21 bp, Homo sapiens
cagctgctctgcccagagctg

SEQ ID NO: 3723717 - DNA, 23 bp, Homo sapiens
cagctgcttttgtctatgggact

SEQ ID NO: 3723718 - DNA, 15 bp, Homo sapiens
cagctggcagcagag

SEQ ID NO: 3723719 - DNA, 19 bp, Homo sapiens
cagctgggatctgactgca

SEQ ID NO: 3723720 - DNA, 21 bp, Homo sapiens
cagctgtaagaagagactggg

SEQ ID NO: 3723721 - DNA, 16 bp, Homo sapiens
cagctgtccctgtcac

SEQ ID NO: 3723722 - DNA, 19 bp, Homo sapiens
cagctgttcagctggttga

SEQ ID NO: 3723723 - DNA, 23 bp, Homo sapiens
cagctgttgagcccctcctagtt

SEQ ID NO: 3723724 - DNA, 14 bp, Homo sapiens
cagctgtttgtcat

SEQ ID NO: 3723725 - DNA, 15 bp, Homo sapiens
cagctgtttgtcata

SEQ ID NO: 3723726 - DNA, 17 bp, Homo sapiens
cagcttcaccctgtcaa

SEQ ID NO: 3723727 - DNA, 18 bp, Homo sapiens
cagcttcatttcctgtgt

SEQ ID NO: 3723728 - DNA, 20 bp, Homo sapiens
cagcttcatttcctgtgtct

SEQ ID NO: 3723729 - DNA, 18 bp, Homo sapiens
cagcttctcatcctgcag

SEQ ID NO: 3723730 - DNA, 20 bp, Homo sapiens
cagcttctcatcctgcaggc

SEQ ID NO: 3723731 - DNA, 15 bp, Homo sapiens
cagcttgctcttcag

SEQ ID NO: 3723732 - DNA, 17 bp, Homo sapiens
cagcttggggccatcgg

SEQ ID NO: 3723733 - DNA, 19 bp, Homo sapiens
cagcttgtaaatagctcag

SEQ ID NO: 3723734 - DNA, 17 bp, Homo sapiens
cagcttgttatttataa

SEQ ID NO: 3723735 - DNA, 16 bp, Homo sapiens
cagctttgccttccac

SEQ ID NO: 3723736 - DNA, 22 bp, Homo sapiens
cagctttgctaccaaagcacct

SEQ ID NO: 3723737 - DNA, 21 bp, Homo sapiens
cagctttgtttgttgtcagct

SEQ ID NO: 3723738 - DNA, 18 bp, Homo sapiens
cagcttttagtacccacc

SEQ ID NO: 3723739 - DNA, 23 bp, Homo sapiens
cagcttttagtacccacctgagc

SEQ ID NO: 3723740 - DNA, 19 bp, Homo sapiens
cagctttttgtcttttctg

SEQ ID NO: 3723741 - DNA, 16 bp, Homo sapiens
caggaaaaaaactttt

SEQ ID NO: 3723742 - DNA, 16 bp, Homo sapiens
caggaaaaaggacagg

SEQ ID NO: 3723743 - DNA, 18 bp, Homo sapiens
caggaaaagctgctgaca

SEQ ID NO: 3723744 - DNA, 16 bp, Homo sapiens
caggaaaatcctctgg

SEQ ID NO: 3723745 - DNA, 17 bp, Homo sapiens
caggaaagggaaggccc

SEQ ID NO: 3723746 - DNA, 23 bp, Homo sapiens
caggaaatatatatgtgtgtgta

SEQ ID NO: 3723747 - DNA, 22 bp, Homo sapiens
caggaacacccgactcctcaaa

SEQ ID NO: 3723748 - DNA, 12 bp, Homo sapiens
caggaacagaag

SEQ ID NO: 3723749 - DNA, 15 bp, Homo sapiens
caggaacagaaggat

SEQ ID NO: 3723750 - DNA, 18 bp, Homo sapiens
caggaacagaaggatgaa

SEQ ID NO: 3723751 - DNA, 23 bp, Homo sapiens
caggaacagctatgggagcccca

SEQ ID NO: 3723752 - DNA, 15 bp, Homo sapiens
caggaagcaccccat

SEQ ID NO: 3723753 - DNA, 17 bp, Homo sapiens
caggaagcaccccatgc

SEQ ID NO: 3723754 - DNA, 17 bp, Homo sapiens
caggaagctcagactgg

SEQ ID NO: 3723755 - DNA, 15 bp, Homo sapiens
caggaagctgctccg

SEQ ID NO: 3723756 - DNA, 17 bp, Homo sapiens
caggaagctgctccgtg

SEQ ID NO: 3723757 - DNA, 13 bp, Homo sapiens
caggaagctgtga

SEQ ID NO: 3723758 - DNA, 14 bp, Homo sapiens
caggaaggagagcc

SEQ ID NO: 3723759 - DNA, 17 bp, Homo sapiens
caggaaggagagcctgc

SEQ ID NO: 3723760 - DNA, 18 bp, Homo sapiens
caggaatgttaaagtcag

SEQ ID NO: 3723761 - DNA, 19 bp, Homo sapiens
caggaatgttaaagtcagt

SEQ ID NO: 3723762 - DNA, 20 bp, Homo sapiens
caggaatttgaagctgcagt

SEQ ID NO: 3723763 - DNA, 18 bp, Homo sapiens
caggacaacgaggaagcc

SEQ ID NO: 3723764 - DNA, 13 bp, Homo sapiens
caggacaggacca

SEQ ID NO: 3723765 - DNA, 16 bp, Homo sapiens
caggaccacaaaaatg

SEQ ID NO: 3723766 - DNA, 20 bp, Homo sapiens
caggacccaccatgtctgcc

SEQ ID NO: 3723767 - DNA, 17 bp, Homo sapiens
caggaccctcgctggcc

SEQ ID NO: 3723768 - DNA, 19 bp, Homo sapiens
caggaccctcgctggcccc

SEQ ID NO: 3723769 - DNA, 20 bp, Homo sapiens
caggaccctcgctggccccc

SEQ ID NO: 3723770 - DNA, 21 bp, Homo sapiens
caggaccctcgctggccccca

SEQ ID NO: 3723771 - DNA, 23 bp, Homo sapiens
caggacctcaggtgagaagcaga

SEQ ID NO: 3723772 - DNA, 17 bp, Homo sapiens
caggactccagcccatt

SEQ ID NO: 3723773 - DNA, 17 bp, Homo sapiens
caggactccctcctcac

SEQ ID NO: 3723774 - DNA, 22 bp, Homo sapiens
caggactccctcctcacctctg

SEQ ID NO: 3723775 - DNA, 23 bp, Homo sapiens
caggactccctcctcacctctgg

SEQ ID NO: 3723776 - DNA, 20 bp, Homo sapiens
caggactctgcccagaccac

SEQ ID NO: 3723777 - DNA, 20 bp, Homo sapiens
caggactgaattgtccccag

SEQ ID NO: 3723778 - DNA, 20 bp, Homo sapiens
caggacttggtctgatttca

SEQ ID NO: 3723779 - DNA, 18 bp, Homo sapiens
caggagagccagccctcc

SEQ ID NO: 3723780 - DNA, 15 bp, Homo sapiens
caggagccccgaggc

SEQ ID NO: 3723781 - DNA, 20 bp, Homo sapiens
caggagccccgaggccttct

SEQ ID NO: 3723782 - DNA, 12 bp, Homo sapiens
caggagctcttc

SEQ ID NO: 3723783 - DNA, 18 bp, Homo sapiens
caggagctcttcaggcct

SEQ ID NO: 3723784 - DNA, 23 bp, Homo sapiens
caggagctcttcaggcctccctc

SEQ ID NO: 3723785 - DNA, 21 bp, Homo sapiens
caggaggactgccccgtgcag

SEQ ID NO: 3723786 - DNA, 22 bp, Homo sapiens
caggaggattgcttgagcccag

SEQ ID NO: 3723787 - DNA, 13 bp, Homo sapiens
caggaggctgagg

SEQ ID NO: 3723788 - DNA, 17 bp, Homo sapiens
caggaggctgaggcaga

SEQ ID NO: 3723789 - DNA, 21 bp, Homo sapiens
caggaggctgaggcagaagaa

SEQ ID NO: 3723790 - DNA, 18 bp, Homo sapiens
caggaggctgaggcagga

SEQ ID NO: 3723791 - DNA, 15 bp, Homo sapiens
caggaggctgagggg

SEQ ID NO: 3723792 - DNA, 15 bp, Homo sapiens
caggaggctggagga

SEQ ID NO: 3723793 - DNA, 19 bp, Homo sapiens
caggagggaggtttgtgag

SEQ ID NO: 3723794 - DNA, 23 bp, Homo sapiens
caggagggaggtttgtgagagcg

SEQ ID NO: 3723795 - DNA, 16 bp, Homo sapiens
caggagggccctacct

SEQ ID NO: 3723796 - DNA, 13 bp, Homo sapiens
caggaggggagtg

SEQ ID NO: 3723797 - DNA, 20 bp, Homo sapiens
caggaggtggaggctgcagt

SEQ ID NO: 3723798 - DNA, 18 bp, Homo sapiens
caggagtcccaaggaaag

SEQ ID NO: 3723799 - DNA, 16 bp, Homo sapiens
caggagttagaggcca

SEQ ID NO: 3723800 - DNA, 22 bp, Homo sapiens
caggagttagaggccagcctgg

SEQ ID NO: 3723801 - DNA, 19 bp, Homo sapiens
caggagttcgaggctgcag

SEQ ID NO: 3723802 - DNA, 22 bp, Homo sapiens
caggagtttgagaccaacctgg

SEQ ID NO: 3723803 - DNA, 20 bp, Homo sapiens
caggagtttgaggctgcagc

SEQ ID NO: 3723804 - DNA, 19 bp, Homo sapiens
caggatagataactctttg

SEQ ID NO: 3723805 - DNA, 15 bp, Homo sapiens
caggatagttgctcc

SEQ ID NO: 3723806 - DNA, 23 bp, Homo sapiens
caggatgaaagttcccccatcag

SEQ ID NO: 3723807 - DNA, 14 bp, Homo sapiens
caggatgactttac

SEQ ID NO: 3723808 - DNA, 22 bp, Homo sapiens
caggatgcccagggccactctg

SEQ ID NO: 3723809 - DNA, 23 bp, Homo sapiens
caggatggccgggcgcggtggct

SEQ ID NO: 3723810 - DNA, 18 bp, Homo sapiens
caggcaactgaggcagac

SEQ ID NO: 3723811 - DNA, 13 bp, Homo sapiens
cagccctccctgc

SEQ ID NO: 3723812 - DNA, 13 bp, Homo sapiens
cagccctccctgt

SEQ ID NO: 3723813 - DNA, 16 bp, Homo sapiens
cagccctccctgtcct

SEQ ID NO: 3723814 - DNA, 12 bp, Homo sapiens
cagccctcctca

SEQ ID NO: 3723815 - DNA, 14 bp, Homo sapiens
cagccctcctcacc

SEQ ID NO: 3723816 - DNA, 22 bp, Homo sapiens
cagccctgaggtgaaagggagc

SEQ ID NO: 3723817 - DNA, 11 bp, Homo sapiens
cagccctgctt

SEQ ID NO: 3723818 - DNA, 21 bp, Homo sapiens
cagccctgctttgggctgccc

SEQ ID NO: 3723819 - DNA, 23 bp, Homo sapiens
cagccctgctttgggctgccctg

SEQ ID NO: 3723820 - DNA, 18 bp, Homo sapiens
cagccctgggccccacca

SEQ ID NO: 3723821 - DNA, 22 bp, Homo sapiens
cagccctgggccccaccaccta

SEQ ID NO: 3723822 - DNA, 18 bp, Homo sapiens
cagccctgtcagtgcagc

SEQ ID NO: 3723823 - DNA, 11 bp, Homo sapiens
cagccctgtgg

SEQ ID NO: 3723824 - DNA, 21 bp, Homo sapiens
cagcccttagcagggaaacag

SEQ ID NO: 3723825 - DNA, 19 bp, Homo sapiens
cagccgcagcctccctctg

SEQ ID NO: 3723826 - DNA, 14 bp, Homo sapiens
cagccgccacatcc

SEQ ID NO: 3723827 - DNA, 23 bp, Homo sapiens
cagccgccatgctcctggcccac

SEQ ID NO: 3723828 - DNA, 18 bp, Homo sapiens
cagccgccattgccacca

SEQ ID NO: 3723829 - DNA, 21 bp, Homo sapiens
cagccgctcctgtctgccagc

SEQ ID NO: 3723830 - DNA, 23 bp, Homo sapiens
cagccgctcctgtctgccagcca

SEQ ID NO: 3723831 - DNA, 17 bp, Homo sapiens
cagccggggaagacttg

SEQ ID NO: 3723832 - DNA, 18 bp, Homo sapiens
cagccggggcctgcctag

SEQ ID NO: 3723833 - DNA, 19 bp, Homo sapiens
cagccggggcctgcctagc

SEQ ID NO: 3723834 - DNA, 19 bp, Homo sapiens
cagccgtcagccaaatgta

SEQ ID NO: 3723835 - DNA, 14 bp, Homo sapiens
cagccgtgccttca

SEQ ID NO: 3723836 - DNA, 21 bp, Homo sapiens
cagcctagccgacctcagcct

SEQ ID NO: 3723837 - DNA, 18 bp, Homo sapiens
cagcctaggggtcaggga

SEQ ID NO: 3723838 - DNA, 19 bp, Homo sapiens
cagcctcaacctcctgggc

SEQ ID NO: 3723839 - DNA, 12 bp, Homo sapiens
cagcctcacaga

SEQ ID NO: 3723840 - DNA, 15 bp, Homo sapiens
cagcctccatgctgc

SEQ ID NO: 3723841 - DNA, 17 bp, Homo sapiens
cagcctccatgctgcct

SEQ ID NO: 3723842 - DNA, 23 bp, Homo sapiens
cagcctcccaaagtgctgggatt

SEQ ID NO: 3723843 - DNA, 19 bp, Homo sapiens
cagcctcccacccccatct

SEQ ID NO: 3723844 - DNA, 13 bp, Homo sapiens
cagcctccctctg

SEQ ID NO: 3723845 - DNA, 23 bp, Homo sapiens
cagcctccctctgacctgcaggc

SEQ ID NO: 3723846 - DNA, 20 bp, Homo sapiens
cagcctcgaactcctgggct

SEQ ID NO: 3723847 - DNA, 22 bp, Homo sapiens
cagcctctcttggtttccttcc

SEQ ID NO: 3723848 - DNA, 19 bp, Homo sapiens
cagcctctgagcccctggg

SEQ ID NO: 3723849 - DNA, 19 bp, Homo sapiens
cagcctcttaaagctgcct

SEQ ID NO: 3723850 - DNA, 21 bp, Homo sapiens
cagcctcttaaagctgcctgt

SEQ ID NO: 3723851 - DNA, 12 bp, Homo sapiens
cagcctgaggct

SEQ ID NO: 3723852 - DNA, 18 bp, Homo sapiens
cagcctgaggctgagact

SEQ ID NO: 3723853 - DNA, 12 bp, Homo sapiens
cagcctgcctgg

SEQ ID NO: 3723854 - DNA, 12 bp, Homo sapiens
cagcctgctcca

SEQ ID NO: 3723855 - DNA, 20 bp, Homo sapiens
cagcctgctccagctgttca

SEQ ID NO: 3723856 - DNA, 20 bp, Homo sapiens
cagcctggcacagggcagtg

SEQ ID NO: 3723857 - DNA, 19 bp, Homo sapiens
cagcctggcttctggagcc

SEQ ID NO: 3723858 - DNA, 20 bp, Homo sapiens
cagcctggtcaacatggtga

SEQ ID NO: 3723859 - DNA, 21 bp, Homo sapiens
cagcctgtggcatctttgcct

SEQ ID NO: 3723860 - DNA, 12 bp, Homo sapiens
cagcctgtggcg

SEQ ID NO: 3723861 - DNA, 14 bp, Homo sapiens
cagccttccccctc

SEQ ID NO: 3723862 - DNA, 23 bp, Homo sapiens
cagccttccccttgcccagggct

SEQ ID NO: 3723863 - DNA, 13 bp, Homo sapiens
cagcctttaagat

SEQ ID NO: 3723864 - DNA, 18 bp, Homo sapiens
cagcctttctcccaggcc

SEQ ID NO: 3723865 - DNA, 23 bp, Homo sapiens
cagcctttgatcaggtggggagt

SEQ ID NO: 3723866 - DNA, 16 bp, Homo sapiens
cagcgagccctggtgg

SEQ ID NO: 3723867 - DNA, 17 bp, Homo sapiens
cagcgagccctggtggc

SEQ ID NO: 3723868 - DNA, 19 bp, Homo sapiens
cagcgagccctggtggcag

SEQ ID NO: 3723869 - DNA, 22 bp, Homo sapiens
cagcgagttgtggaaagcctct

SEQ ID NO: 3723870 - DNA, 17 bp, Homo sapiens
cagcggctggtgcaggg

SEQ ID NO: 3723871 - DNA, 13 bp, Homo sapiens
cagcgggagacct

SEQ ID NO: 3723872 - DNA, 18 bp, Homo sapiens
cagcgggagacctgtgct

SEQ ID NO: 3723873 - DNA, 15 bp, Homo sapiens
cagcggggacagctc

SEQ ID NO: 3723874 - DNA, 17 bp, Homo sapiens
cagcgtagcctctccgg

SEQ ID NO: 3723875 - DNA, 15 bp, Homo sapiens
cagctaccatgacaa

SEQ ID NO: 3723876 - DNA, 24 bp, Homo sapiens
cagctacccaggaggctgaggtgg

SEQ ID NO: 3723877 - DNA, 19 bp, Homo sapiens
cagctactcaagaggctga

SEQ ID NO: 3723878 - DNA, 19 bp, Homo sapiens
cagctactcagaagcctga

SEQ ID NO: 3723879 - DNA, 20 bp, Homo sapiens
cagctactcagaagcctgag

SEQ ID NO: 3723880 - DNA, 22 bp, Homo sapiens
cagctactcagaagcctgaggc

SEQ ID NO: 3723881 - DNA, 23 bp, Homo sapiens
cagctactcagaagcctgaggct

SEQ ID NO: 3723882 - DNA, 19 bp, Homo sapiens
cagctaggtggggcctaga

SEQ ID NO: 3723883 - DNA, 18 bp, Homo sapiens
cagctatctctcagtgaa

SEQ ID NO: 3723884 - DNA, 13 bp, Homo sapiens
cagctatgggagc

SEQ ID NO: 3723885 - DNA, 17 bp, Homo sapiens
cagctatgggagcccca

SEQ ID NO: 3723886 - DNA, 18 bp, Homo sapiens
cagctatgggagccccag

SEQ ID NO: 3723887 - DNA, 20 bp, Homo sapiens
cagctatgggagccccaggg

SEQ ID NO: 3723888 - DNA, 23 bp, Homo sapiens
cagctatgggagccccagggtct

SEQ ID NO: 3723889 - DNA, 19 bp, Homo sapiens
cagctcaagtcttccctga

SEQ ID NO: 3723890 - DNA, 22 bp, Homo sapiens
cagctcaagtcttccctgatca

SEQ ID NO: 3723891 - DNA, 14 bp, Homo sapiens
cagctcaccagccc

SEQ ID NO: 3723892 - DNA, 19 bp, Homo sapiens
cagctcaccagccccagtg

SEQ ID NO: 3723893 - DNA, 20 bp, Homo sapiens
cagctcaccagccccagtgc

SEQ ID NO: 3723894 - DNA, 21 bp, Homo sapiens
cagctcaccagccccagtgcc

SEQ ID NO: 3723895 - DNA, 23 bp, Homo sapiens
cagctcaggctgtttttgggtgc

SEQ ID NO: 3723896 - DNA, 22 bp, Homo sapiens
cagctcattataatgtcattaa

SEQ ID NO: 3723897 - DNA, 18 bp, Homo sapiens
cagctccagctcaccagc

SEQ ID NO: 3723898 - DNA, 14 bp, Homo sapiens
cagctccctctgcc

SEQ ID NO: 3723899 - DNA, 17 bp, Homo sapiens
cagctccttctgtccta

SEQ ID NO: 3723900 - DNA, 17 bp, Homo sapiens
cagctctagacaaccct

SEQ ID NO: 3723901 - DNA, 20 bp, Homo sapiens
cagctctagacactgccaca

SEQ ID NO: 3723902 - DNA, 12 bp, Homo sapiens
cagctctccctc

SEQ ID NO: 3723903 - DNA, 15 bp, Homo sapiens
cagctctccctctgg

SEQ ID NO: 3723904 - DNA, 16 bp, Homo sapiens
cagctctccctctggc

SEQ ID NO: 3723905 - DNA, 21 bp, Homo sapiens
cagctctccctctggccctgc

SEQ ID NO: 3723906 - DNA, 12 bp, Homo sapiens
cagctctgcttg

SEQ ID NO: 3723907 - DNA, 23 bp, Homo sapiens
cagctctgcttgccgaaactgga

SEQ ID NO: 3723908 - DNA, 14 bp, Homo sapiens
cagctctggcttcc

SEQ ID NO: 3723909 - DNA, 13 bp, Homo sapiens
cagctctgtcctg

SEQ ID NO: 3723910 - DNA, 21 bp, Homo sapiens
cagctctgtgttgccatgtgt

SEQ ID NO: 3723911 - DNA, 17 bp, Homo sapiens
cagctcttctccaggct

SEQ ID NO: 3723912 - DNA, 19 bp, Homo sapiens
cagctcttctccaggctgt

SEQ ID NO: 3723913 - DNA, 23 bp, Homo sapiens
cagctcttctccaggctgtatcc

SEQ ID NO: 3723914 - DNA, 22 bp, Homo sapiens
cagctgaacagtgttggctttc

SEQ ID NO: 3723915 - DNA, 15 bp, Homo sapiens
cagctgactgtggcc

SEQ ID NO: 3723916 - DNA, 16 bp, Homo sapiens
cagctgactgtggccc

SEQ ID NO: 3723917 - DNA, 18 bp, Homo sapiens
cagctgattttaacaata

SEQ ID NO: 3723918 - DNA, 20 bp, Homo sapiens
cagctgattttaacaataac

SEQ ID NO: 3723919 - DNA, 18 bp, Homo sapiens
cagctgcacctgccagcc

SEQ ID NO: 3723920 - DNA, 15 bp, Homo sapiens
cagctgcagagacag

SEQ ID NO: 3723921 - DNA, 16 bp, Homo sapiens
cagctgcagagacaga

SEQ ID NO: 3723922 - DNA, 17 bp, Homo sapiens
cagctgcagctgggctg

SEQ ID NO: 3723923 - DNA, 19 bp, Homo sapiens
cagacctgtcttccaagga

SEQ ID NO: 3723924 - DNA, 23 bp, Homo sapiens
cagacctgtcttccaaggagacc

SEQ ID NO: 3723925 - DNA, 17 bp, Homo sapiens
cagacgcacgtgggtct

SEQ ID NO: 3723926 - DNA, 16 bp, Homo sapiens
cagacggcacccaccc

SEQ ID NO: 3723927 - DNA, 20 bp, Homo sapiens
cagacgtatgcttattttaa

SEQ ID NO: 3723928 - DNA, 20 bp, Homo sapiens
cagactcatacagaaggtgg

SEQ ID NO: 3723929 - DNA, 18 bp, Homo sapiens
cagactctacagaggcca

SEQ ID NO: 3723930 - DNA, 19 bp, Homo sapiens
cagactctacagaggccat

SEQ ID NO: 3723931 - DNA, 18 bp, Homo sapiens
cagatggaaccgcaggaa

SEQ ID NO: 3723932 - DNA, 19 bp, Homo sapiens
cagatggaaccgcaggaag

SEQ ID NO: 3723933 - DNA, 20 bp, Homo sapiens
cagatggaaccgcaggaagc

SEQ ID NO: 3723934 - DNA, 15 bp, Homo sapiens
cagatggatttgcct

SEQ ID NO: 3723935 - DNA, 17 bp, Homo sapiens
cagattcccagagcaaa

SEQ ID NO: 3723936 - DNA, 19 bp, Homo sapiens
cagattcccagagcaaaat

SEQ ID NO: 3723937 - DNA, 14 bp, Homo sapiens
cagattcctttccc

SEQ ID NO: 3723938 - DNA, 16 bp, Homo sapiens
cagattcctttccctt

SEQ ID NO: 3723939 - DNA, 20 bp, Homo sapiens
cagattcctttccctttagc

SEQ ID NO: 3723940 - DNA, 14 bp, Homo sapiens
cagattgcctcctt

SEQ ID NO: 3723941 - DNA, 20 bp, Homo sapiens
cagatttagtgaaagctaga

SEQ ID NO: 3723942 - DNA, 21 bp, Homo sapiens
cagatttcagtcttttcctgt

SEQ ID NO: 3723943 - DNA, 17 bp, Homo sapiens
cagattttacaaaagat

SEQ ID NO: 3723944 - DNA, 12 bp, Homo sapiens
cagattttcctg

SEQ ID NO: 3723945 - DNA, 14 bp, Homo sapiens
cagattttcctgtg

SEQ ID NO: 3723946 - DNA, 17 bp, Homo sapiens
cagcaaaaccattgctt

SEQ ID NO: 3723947 - DNA, 19 bp, Homo sapiens
cagcaaaaccattgcttca

SEQ ID NO: 3723948 - DNA, 16 bp, Homo sapiens
cagcaaatttataatt

SEQ ID NO: 3723949 - DNA, 21 bp, Homo sapiens
cagcaaccagagcactgtata

SEQ ID NO: 3723950 - DNA, 18 bp, Homo sapiens
cagcaacctgtaagactg

SEQ ID NO: 3723951 - DNA, 19 bp, Homo sapiens
cagcaacctgtaagactga

SEQ ID NO: 3723952 - DNA, 15 bp, Homo sapiens
cagcaacttgtcttt

SEQ ID NO: 3723953 - DNA, 20 bp, Homo sapiens
cagcaaggggctctgccctc

SEQ ID NO: 3723954 - DNA, 12 bp, Homo sapiens
cagcaagtgaga

SEQ ID NO: 3723955 - DNA, 14 bp, Homo sapiens
cagcaagtgagagc

SEQ ID NO: 3723956 - DNA, 16 bp, Homo sapiens
cagcaagtgagagctg

SEQ ID NO: 3723957 - DNA, 21 bp, Homo sapiens
cagcaagtgagagctgggtgt

SEQ ID NO: 3723958 - DNA, 13 bp, Homo sapiens
cagcacactcagc

SEQ ID NO: 3723959 - DNA, 13 bp, Homo sapiens
cagcaccaccagg

SEQ ID NO: 3723960 - DNA, 15 bp, Homo sapiens
cagcaccaccaggtc

SEQ ID NO: 3723961 - DNA, 16 bp, Homo sapiens
cagcaccaccaggtct

SEQ ID NO: 3723962 - DNA, 22 bp, Homo sapiens
cagcaccaccctagtcccttcc

SEQ ID NO: 3723963 - DNA, 20 bp, Homo sapiens
cagcactaaagcagtggaca

SEQ ID NO: 3723964 - DNA, 15 bp, Homo sapiens
cagcactgtctcagt

SEQ ID NO: 3723965 - DNA, 19 bp, Homo sapiens
cagcactttgggaggctga

SEQ ID NO: 3723966 - DNA, 20 bp, Homo sapiens
cagcactttgggaggctgag

SEQ ID NO: 3723967 - DNA, 23 bp, Homo sapiens
cagcactttgggaggctgaggcg

SEQ ID NO: 3723968 - DNA, 14 bp, Homo sapiens
cagcagactatgaa

SEQ ID NO: 3723969 - DNA, 15 bp, Homo sapiens
cagcagatcccagct

SEQ ID NO: 3723970 - DNA, 13 bp, Homo sapiens
cagcagccagctc

SEQ ID NO: 3723971 - DNA, 15 bp, Homo sapiens
cagcagccagctctc

SEQ ID NO: 3723972 - DNA, 17 bp, Homo sapiens
cagcagccagctctcag

SEQ ID NO: 3723973 - DNA, 14 bp, Homo sapiens
cagcagccctcctc

SEQ ID NO: 3723974 - DNA, 13 bp, Homo sapiens
cagcagcctctga

SEQ ID NO: 3723975 - DNA, 19 bp, Homo sapiens
cagcagcctggaccctgtg

SEQ ID NO: 3723976 - DNA, 14 bp, Homo sapiens
cagcagctcaggca

SEQ ID NO: 3723977 - DNA, 17 bp, Homo sapiens
cagcagcttttaataca

SEQ ID NO: 3723978 - DNA, 13 bp, Homo sapiens
cagcaggcccacc

SEQ ID NO: 3723979 - DNA, 23 bp, Homo sapiens
cagcaggcggcctttgttgctca

SEQ ID NO: 3723980 - DNA, 19 bp, Homo sapiens
cagcagtgagtctcttcag

SEQ ID NO: 3723981 - DNA, 17 bp, Homo sapiens
cagcagtttgggaggtc

SEQ ID NO: 3723982 - DNA, 14 bp, Homo sapiens
cagcataagggagc

SEQ ID NO: 3723983 - DNA, 19 bp, Homo sapiens
cagcatagcaagacacatc

SEQ ID NO: 3723984 - DNA, 17 bp, Homo sapiens
cagcatcctggcacccg

SEQ ID NO: 3723985 - DNA, 21 bp, Homo sapiens
cagcatgacctgtgaccagca

SEQ ID NO: 3723986 - DNA, 23 bp, Homo sapiens
cagcatgacctgtgaccagcact

SEQ ID NO: 3723987 - DNA, 16 bp, Homo sapiens
cagcatggtgcatgcc

SEQ ID NO: 3723988 - DNA, 22 bp, Homo sapiens
cagcatgtgtatttccagtgca

SEQ ID NO: 3723989 - DNA, 15 bp, Homo sapiens
cagcattctcactcc

SEQ ID NO: 3723990 - DNA, 18 bp, Homo sapiens
cagcattcttagcctgtg

SEQ ID NO: 3723991 - DNA, 20 bp, Homo sapiens
cagcattcttgtcacaataa

SEQ ID NO: 3723992 - DNA, 21 bp, Homo sapiens
cagcattcttgtcacaataaa

SEQ ID NO: 3723993 - DNA, 12 bp, Homo sapiens
cagcattgcttt

SEQ ID NO: 3723994 - DNA, 19 bp, Homo sapiens
cagccaaacccatgaggca

SEQ ID NO: 3723995 - DNA, 16 bp, Homo sapiens
cagccaaaccctgtct

SEQ ID NO: 3723996 - DNA, 17 bp, Homo sapiens
cagccaaaccctgtctg

SEQ ID NO: 3723997 - DNA, 21 bp, Homo sapiens
cagccaaagcctcctccagcc

SEQ ID NO: 3723998 - DNA, 14 bp, Homo sapiens
cagccaacccctgt

SEQ ID NO: 3723999 - DNA, 21 bp, Homo sapiens
cagccaacccctgtggagccc

SEQ ID NO: 3724000 - DNA, 20 bp, Homo sapiens
cagccaaccttacttacagc

SEQ ID NO: 3724001 - DNA, 12 bp, Homo sapiens
cagccacactgt

SEQ ID NO: 3724002 - DNA, 15 bp, Homo sapiens
cagccagcagccagc

SEQ ID NO: 3724003 - DNA, 18 bp, Homo sapiens
cagccagcagccagctct

SEQ ID NO: 3724004 - DNA, 19 bp, Homo sapiens
cagccagcagccagctctc

SEQ ID NO: 3724005 - DNA, 21 bp, Homo sapiens
cagccagcagccagctctcag

SEQ ID NO: 3724006 - DNA, 12 bp, Homo sapiens
cagccagcccag

SEQ ID NO: 3724007 - DNA, 14 bp, Homo sapiens
cagccagcccagcc

SEQ ID NO: 3724008 - DNA, 16 bp, Homo sapiens
cagccagcccagccca

SEQ ID NO: 3724009 - DNA, 12 bp, Homo sapiens
cagccagctctc

SEQ ID NO: 3724010 - DNA, 21 bp, Homo sapiens
cagccagctctcagccaacga

SEQ ID NO: 3724011 - DNA, 11 bp, Homo sapiens
cagccaggagc

SEQ ID NO: 3724012 - DNA, 16 bp, Homo sapiens
cagccaggagctgggc

SEQ ID NO: 3724013 - DNA, 13 bp, Homo sapiens
cagccaggctgcc

SEQ ID NO: 3724014 - DNA, 19 bp, Homo sapiens
cagccagtgacctgaggaa

SEQ ID NO: 3724015 - DNA, 21 bp, Homo sapiens
cagccagtgacctgaggaagc

SEQ ID NO: 3724016 - DNA, 22 bp, Homo sapiens
cagccagtgacctgaggaagcg

SEQ ID NO: 3724017 - DNA, 15 bp, Homo sapiens
cagcccacttctgcc

SEQ ID NO: 3724018 - DNA, 18 bp, Homo sapiens
cagcccacttctgccata

SEQ ID NO: 3724019 - DNA, 18 bp, Homo sapiens
cagcccagctgctctgcc

SEQ ID NO: 3724020 - DNA, 20 bp, Homo sapiens
cagcccagctgctctgccca

SEQ ID NO: 3724021 - DNA, 14 bp, Homo sapiens
cagcccatcttgcc

SEQ ID NO: 3724022 - DNA, 16 bp, Homo sapiens
cagcccatcttgcctc

SEQ ID NO: 3724023 - DNA, 21 bp, Homo sapiens
cagcccatgcccacctgccca

SEQ ID NO: 3724024 - DNA, 24 bp, Homo sapiens
cagcccatgcccacctgcccatca

SEQ ID NO: 3724025 - DNA, 11 bp, Homo sapiens
cagccccaccc

SEQ ID NO: 3724026 - DNA, 13 bp, Homo sapiens
cagccccacccag

SEQ ID NO: 3724027 - DNA, 17 bp, Homo sapiens
cagccccattctgcctg

SEQ ID NO: 3724028 - DNA, 19 bp, Homo sapiens
cagccccattctgcctgcc

SEQ ID NO: 3724029 - DNA, 22 bp, Homo sapiens
cagccccattctgcctgcccag

SEQ ID NO: 3724030 - DNA, 18 bp, Homo sapiens
cagccccgcgcctccttc

SEQ ID NO: 3724031 - DNA, 21 bp, Homo sapiens
cagcccctcccaccacagcag

SEQ ID NO: 3724032 - DNA, 13 bp, Homo sapiens
cagcccctcctct

SEQ ID NO: 3724033 - DNA, 14 bp, Homo sapiens
cagcccctcctctg

SEQ ID NO: 3724034 - DNA, 17 bp, Homo sapiens
cagcccctcctctgcca

SEQ ID NO: 3724035 - DNA, 19 bp, Homo sapiens
cagcccctcctctgccacc

SEQ ID NO: 3724036 - DNA, 23 bp, Homo sapiens
cagcccctcctctgccacctccc

SEQ ID NO: 3724037 - DNA, 15 bp, Homo sapiens
cagcccctcttgccc

SEQ ID NO: 3724038 - DNA, 21 bp, Homo sapiens
cagcccctcttgccccccacc

SEQ ID NO: 3724039 - DNA, 18 bp, Homo sapiens
cagccccttgagaaacct

SEQ ID NO: 3724040 - DNA, 15 bp, Homo sapiens
cagcccgtgtggccc

SEQ ID NO: 3724041 - DNA, 21 bp, Homo sapiens
cagcccgtgtggccccttcac

SEQ ID NO: 3724042 - DNA, 12 bp, Homo sapiens
cactgtttctct

SEQ ID NO: 3724043 - DNA, 18 bp, Homo sapiens
cactgtttctctgctgtt

SEQ ID NO: 3724044 - DNA, 18 bp, Homo sapiens
cacttacactttatgcac

SEQ ID NO: 3724045 - DNA, 19 bp, Homo sapiens
cacttacagataggccttc

SEQ ID NO: 3724046 - DNA, 18 bp, Homo sapiens
cacttacctagatttaca

SEQ ID NO: 3724047 - DNA, 14 bp, Homo sapiens
cacttaccttcaat

SEQ ID NO: 3724048 - DNA, 16 bp, Homo sapiens
cacttaccttcaataa

SEQ ID NO: 3724049 - DNA, 19 bp, Homo sapiens
cacttaccttcaataaagt

SEQ ID NO: 3724050 - DNA, 14 bp, Homo sapiens
cacttattgctttg

SEQ ID NO: 3724051 - DNA, 15 bp, Homo sapiens
cacttattgctttga

SEQ ID NO: 3724052 - DNA, 12 bp, Homo sapiens
cacttcagctga

SEQ ID NO: 3724053 - DNA, 14 bp, Homo sapiens
cacttcaggctctt

SEQ ID NO: 3724054 - DNA, 15 bp, Homo sapiens
cacttcaggctcttc

SEQ ID NO: 3724055 - DNA, 13 bp, Homo sapiens
cacctcccagccc

SEQ ID NO: 3724056 - DNA, 15 bp, Homo sapiens
cacctcccagcccct

SEQ ID NO: 3724057 - DNA, 11 bp, Homo sapiens
cacctcccagg

SEQ ID NO: 3724058 - DNA, 13 bp, Homo sapiens
cacctcccatcct

SEQ ID NO: 3724059 - DNA, 14 bp, Homo sapiens
cacctccccaggcc

SEQ ID NO: 3724060 - DNA, 21 bp, Homo sapiens
cacctccccccactgcaggcc

SEQ ID NO: 3724061 - DNA, 20 bp, Homo sapiens
cacctcccctatccacccag

SEQ ID NO: 3724062 - DNA, 21 bp, Homo sapiens
cacctcgttagggaagagaaa

SEQ ID NO: 3724063 - DNA, 14 bp, Homo sapiens
cacctctgcctcaa

SEQ ID NO: 3724064 - DNA, 18 bp, Homo sapiens
cacctctggactggctag

SEQ ID NO: 3724065 - DNA, 14 bp, Homo sapiens
cacctgaagactca

SEQ ID NO: 3724066 - DNA, 15 bp, Homo sapiens
cacctgaagactcat

SEQ ID NO: 3724067 - DNA, 21 bp, Homo sapiens
cacctgagcccggatgcttct

SEQ ID NO: 3724068 - DNA, 16 bp, Homo sapiens
cacctgagctttggac

SEQ ID NO: 3724069 - DNA, 19 bp, Homo sapiens
cacctgagtcaccctacct

SEQ ID NO: 3724070 - DNA, 23 bp, Homo sapiens
cacctgagtcaccctacctgtgc

SEQ ID NO: 3724071 - DNA, 13 bp, Homo sapiens
cacctgcacctcc

SEQ ID NO: 3724072 - DNA, 22 bp, Homo sapiens
cacctgcacctccccccactgc

SEQ ID NO: 3724073 - DNA, 23 bp, Homo sapiens
cacctgccactaggctgggtgcc

SEQ ID NO: 3724074 - DNA, 15 bp, Homo sapiens
cacctgccagcctgg

SEQ ID NO: 3724075 - DNA, 18 bp, Homo sapiens
cacctgcccaacctgctc

SEQ ID NO: 3724076 - DNA, 22 bp, Homo sapiens
cacctgcccatcacagggttgg

SEQ ID NO: 3724077 - DNA, 15 bp, Homo sapiens
cacctgccccctggt

SEQ ID NO: 3724078 - DNA, 21 bp, Homo sapiens
cacctgccccctggtggacag

SEQ ID NO: 3724079 - DNA, 17 bp, Homo sapiens
cacctgcccccttctcc

SEQ ID NO: 3724080 - DNA, 23 bp, Homo sapiens
cacctgccgacctcgtcctcccc

SEQ ID NO: 3724081 - DNA, 18 bp, Homo sapiens
cacctgctgagagaccca

SEQ ID NO: 3724082 - DNA, 22 bp, Homo sapiens
cacctgctgagagacccaagga

SEQ ID NO: 3724083 - DNA, 14 bp, Homo sapiens
cacctgctggcccc

SEQ ID NO: 3724084 - DNA, 14 bp, Homo sapiens
cacctggccccatg

SEQ ID NO: 3724085 - DNA, 13 bp, Homo sapiens
cacctggccctgg

SEQ ID NO: 3724086 - DNA, 14 bp, Homo sapiens
cacctggccctggg

SEQ ID NO: 3724087 - DNA, 15 bp, Homo sapiens
cacctgggcacctgg

SEQ ID NO: 3724088 - DNA, 17 bp, Homo sapiens
cacctggggagtgggac

SEQ ID NO: 3724089 - DNA, 14 bp, Homo sapiens
cacctggggcagtc

SEQ ID NO: 3724090 - DNA, 19 bp, Homo sapiens
cacctggggcagtcacctg

SEQ ID NO: 3724091 - DNA, 20 bp, Homo sapiens
cacctggggcagtcacctgc

SEQ ID NO: 3724092 - DNA, 10 bp, Homo sapiens
cacctggggt

SEQ ID NO: 3724093 - DNA, 18 bp, Homo sapiens
cacctggggtgtgggagg

SEQ ID NO: 3724094 - DNA, 20 bp, Homo sapiens
cacctggggtgtgggaggcc

SEQ ID NO: 3724095 - DNA, 16 bp, Homo sapiens
cacctgtaatcccagc

SEQ ID NO: 3724096 - DNA, 21 bp, Homo sapiens
cacctgtaatcccagctactt

SEQ ID NO: 3724097 - DNA, 16 bp, Homo sapiens
cacctgtactcaggag

SEQ ID NO: 3724098 - DNA, 23 bp, Homo sapiens
cacctgtactcaggaggctgagg

SEQ ID NO: 3724099 - DNA, 15 bp, Homo sapiens
cacctgtactggaga

SEQ ID NO: 3724100 - DNA, 23 bp, Homo sapiens
cacctgtcaaacaaagccagaag

SEQ ID NO: 3724101 - DNA, 14 bp, Homo sapiens
cacctgtcccacct

SEQ ID NO: 3724102 - DNA, 17 bp, Homo sapiens
cacctgtcgcccagtgc

SEQ ID NO: 3724103 - DNA, 19 bp, Homo sapiens
cacctgtctcagcctccca

SEQ ID NO: 3724104 - DNA, 15 bp, Homo sapiens
caccttaaattaaac

SEQ ID NO: 3724105 - DNA, 18 bp, Homo sapiens
caccttaaattaaacaat

SEQ ID NO: 3724106 - DNA, 22 bp, Homo sapiens
caccttaaattaaacaatttat

SEQ ID NO: 3724107 - DNA, 14 bp, Homo sapiens
caccttaggcaggg

SEQ ID NO: 3724108 - DNA, 18 bp, Homo sapiens
caccttcaattcctgggc

SEQ ID NO: 3724109 - DNA, 19 bp, Homo sapiens
caccttcaattcctgggcc

SEQ ID NO: 3724110 - DNA, 20 bp, Homo sapiens
caccttcagaggctgaggtg

SEQ ID NO: 3724111 - DNA, 18 bp, Homo sapiens
caccttgaacaccacgct

SEQ ID NO: 3724112 - DNA, 18 bp, Homo sapiens
caccttgacagggcacac

SEQ ID NO: 3724113 - DNA, 16 bp, Homo sapiens
caccttgcaacacaca

SEQ ID NO: 3724114 - DNA, 18 bp, Homo sapiens
caccttgcaacacacaga

SEQ ID NO: 3724115 - DNA, 14 bp, Homo sapiens
caccttggctcaag

SEQ ID NO: 3724116 - DNA, 16 bp, Homo sapiens
caccttggctgcaggg

SEQ ID NO: 3724117 - DNA, 20 bp, Homo sapiens
caccttgggatgatgcctca

SEQ ID NO: 3724118 - DNA, 13 bp, Homo sapiens
caccttttaaatc

SEQ ID NO: 3724119 - DNA, 13 bp, Homo sapiens
cacgaaatgttat

SEQ ID NO: 3724120 - DNA, 16 bp, Homo sapiens
cacgaaatgttatttt

SEQ ID NO: 3724121 - DNA, 18 bp, Homo sapiens
cacgaacccacctgctga

SEQ ID NO: 3724122 - DNA, 12 bp, Homo sapiens
cacgatgaaaaa

SEQ ID NO: 3724123 - DNA, 15 bp, Homo sapiens
cacgatgaaaaactt

SEQ ID NO: 3724124 - DNA, 21 bp, Homo sapiens
cacgatgtggccctggcctgc

SEQ ID NO: 3724125 - DNA, 14 bp, Homo sapiens
cacgcacacacaca

SEQ ID NO: 3724126 - DNA, 20 bp, Homo sapiens
cacgcacacacacacacagg

SEQ ID NO: 3724127 - DNA, 12 bp, Homo sapiens
cacgcacctccc

SEQ ID NO: 3724128 - DNA, 14 bp, Homo sapiens
cacgcacctcccat

SEQ ID NO: 3724129 - DNA, 19 bp, Homo sapiens
cacgcacctcccatcctaa

SEQ ID NO: 3724130 - DNA, 15 bp, Homo sapiens
cacgcccatgtgtga

SEQ ID NO: 3724131 - DNA, 23 bp, Homo sapiens
cacgcccatgtgtgagtgtgtgc

SEQ ID NO: 3724132 - DNA, 19 bp, Homo sapiens
cacgcctgtaatcccagca

SEQ ID NO: 3724133 - DNA, 21 bp, Homo sapiens
cacgcctgtaatcccagcact

SEQ ID NO: 3724134 - DNA, 19 bp, Homo sapiens
cacgcctgtaatcctagca

SEQ ID NO: 3724135 - DNA, 20 bp, Homo sapiens
cacgctggaccttgaactgg

SEQ ID NO: 3724136 - DNA, 20 bp, Homo sapiens
cacgctggagtgcagtgagc

SEQ ID NO: 3724137 - DNA, 21 bp, Homo sapiens
cacgctggagtgcagtgagcc

SEQ ID NO: 3724138 - DNA, 22 bp, Homo sapiens
cacgctgtgggcaggtgggagc

SEQ ID NO: 3724139 - DNA, 14 bp, Homo sapiens
cacgctttctagct

SEQ ID NO: 3724140 - DNA, 17 bp, Homo sapiens
cacgctttctagctgtt

SEQ ID NO: 3724141 - DNA, 23 bp, Homo sapiens
cacggatccatgtagcaggactg

SEQ ID NO: 3724142 - DNA, 15 bp, Homo sapiens
cacggctcactgcag

SEQ ID NO: 3724143 - DNA, 15 bp, Homo sapiens
cacgggagatttctt

SEQ ID NO: 3724144 - DNA, 18 bp, Homo sapiens
cacgtacacacacataca

SEQ ID NO: 3724145 - DNA, 21 bp, Homo sapiens
cacgtagtagggtcaggccac

SEQ ID NO: 3724146 - DNA, 14 bp, Homo sapiens
cacgtctgtcttca

SEQ ID NO: 3724147 - DNA, 21 bp, Homo sapiens
cacgtgcagcagcaacacaat

SEQ ID NO: 3724148 - DNA, 13 bp, Homo sapiens
cacgtggagagct

SEQ ID NO: 3724149 - DNA, 23 bp, Homo sapiens
cacgtggagagctggtgcccgga

SEQ ID NO: 3724150 - DNA, 15 bp, Homo sapiens
cacgtggcttctgat

SEQ ID NO: 3724151 - DNA, 18 bp, Homo sapiens
cactaacattatattgca

SEQ ID NO: 3724152 - DNA, 19 bp, Homo sapiens
cactaacgacttcagggca

SEQ ID NO: 3724153 - DNA, 18 bp, Homo sapiens
cactaaggtgtgctctga

SEQ ID NO: 3724154 - DNA, 18 bp, Homo sapiens
cactaattctgcatctgg

SEQ ID NO: 3724155 - DNA, 19 bp, Homo sapiens
cactacactccagcctgag

SEQ ID NO: 3724156 - DNA, 17 bp, Homo sapiens
cactagcctctccagga

SEQ ID NO: 3724157 - DNA, 15 bp, Homo sapiens
cactaggctgggtgc

SEQ ID NO: 3724158 - DNA, 22 bp, Homo sapiens
cactaggctgggtgcccacagc

SEQ ID NO: 3724159 - DNA, 21 bp, Homo sapiens
cactatgaagatgtttcaaaa

SEQ ID NO: 3724160 - DNA, 14 bp, Homo sapiens
cactatgcatttta

SEQ ID NO: 3724161 - DNA, 17 bp, Homo sapiens
cactatggtatttgagt

SEQ ID NO: 3724162 - DNA, 12 bp, Homo sapiens
cactattttcag

SEQ ID NO: 3724163 - DNA, 16 bp, Homo sapiens
cactattttcagaatc

SEQ ID NO: 3724164 - DNA, 17 bp, Homo sapiens
cactattttcagaatct

SEQ ID NO: 3724165 - DNA, 23 bp, Homo sapiens
atggttacactgttagaacacta

SEQ ID NO: 3724166 - DNA, 16 bp, Homo sapiens
atggttgagaaatgaa

SEQ ID NO: 3724167 - DNA, 16 bp, Homo sapiens
atggtttgcaaggaag

SEQ ID NO: 3724168 - DNA, 11 bp, Homo sapiens
atgtaaaacaa

SEQ ID NO: 3724169 - DNA, 14 bp, Homo sapiens
atgtaaaattttgc

SEQ ID NO: 3724170 - DNA, 15 bp, Homo sapiens
atgtaaacagtgcct

SEQ ID NO: 3724171 - DNA, 17 bp, Homo sapiens
atgtaaacagtgcctgc

SEQ ID NO: 3724172 - DNA, 22 bp, Homo sapiens
atgtaaacagtgcctgctgaat

SEQ ID NO: 3724173 - DNA, 21 bp, Homo sapiens
atgtaaataaccccattcttt

SEQ ID NO: 3724174 - DNA, 15 bp, Homo sapiens
atgtaaattaccagt

SEQ ID NO: 3724175 - DNA, 20 bp, Homo sapiens
atgtaaattaccagtaaagt

SEQ ID NO: 3724176 - DNA, 23 bp, Homo sapiens
atgtaactgcattgagaactgca

SEQ ID NO: 3724177 - DNA, 14 bp, Homo sapiens
atgtaacttttgta

SEQ ID NO: 3724178 - DNA, 18 bp, Homo sapiens
atgtaacttttgtaagac

SEQ ID NO: 3724179 - DNA, 15 bp, Homo sapiens
atgtaagaatcattg

SEQ ID NO: 3724180 - DNA, 19 bp, Homo sapiens
atgtaagagctttacaaaa

SEQ ID NO: 3724181 - DNA, 21 bp, Homo sapiens
atgtaagagctttacaaaaag

SEQ ID NO: 3724182 - DNA, 22 bp, Homo sapiens
atgtaagagctttacaaaaaga

SEQ ID NO: 3724183 - DNA, 17 bp, Homo sapiens
atgtaagtaaatgtctg

SEQ ID NO: 3724184 - DNA, 17 bp, Homo sapiens
atgtaatttgtgtaata

SEQ ID NO: 3724185 - DNA, 21 bp, Homo sapiens
atgtacaatattttaagcatt

SEQ ID NO: 3724186 - DNA, 14 bp, Homo sapiens
atgtacattaatta

SEQ ID NO: 3724187 - DNA, 18 bp, Homo sapiens
atgtaccatgaaacaaag

SEQ ID NO: 3724188 - DNA, 15 bp, Homo sapiens
atgtaccatgtacat

SEQ ID NO: 3724189 - DNA, 12 bp, Homo sapiens
atgtagaaagct

SEQ ID NO: 3724190 - DNA, 23 bp, Homo sapiens
atgtagatattgtgaagtacata

SEQ ID NO: 3724191 - DNA, 15 bp, Homo sapiens
atgtagctggtttcc

SEQ ID NO: 3724192 - DNA, 16 bp, Homo sapiens
atgtagtataaagaaa

SEQ ID NO: 3724193 - DNA, 23 bp, Homo sapiens
atgtataatatttttaattaaat

SEQ ID NO: 3724194 - DNA, 15 bp, Homo sapiens
atgtatcaatgagta

SEQ ID NO: 3724195 - DNA, 17 bp, Homo sapiens
atgtatccagtacattt

SEQ ID NO: 3724196 - DNA, 15 bp, Homo sapiens
atgtatgtgtaagta

SEQ ID NO: 3724197 - DNA, 16 bp, Homo sapiens
atgtattaatattcat

SEQ ID NO: 3724198 - DNA, 14 bp, Homo sapiens
atgtattataactt

SEQ ID NO: 3724199 - DNA, 21 bp, Homo sapiens
atgctcaggtacagagaagga

SEQ ID NO: 3724200 - DNA, 18 bp, Homo sapiens
atgctccagccaacccct

SEQ ID NO: 3724201 - DNA, 19 bp, Homo sapiens
atgctccctcccctgccct

SEQ ID NO: 3724202 - DNA, 14 bp, Homo sapiens
atgctctcctttcc

SEQ ID NO: 3724203 - DNA, 19 bp, Homo sapiens
atgctctctgcagccagcc

SEQ ID NO: 3724204 - DNA, 21 bp, Homo sapiens
atgctctctgcagccagccca

SEQ ID NO: 3724205 - DNA, 23 bp, Homo sapiens
atgctctctgcagccagcccagc

SEQ ID NO: 3724206 - DNA, 15 bp, Homo sapiens
atgctgaaacaggag

SEQ ID NO: 3724207 - DNA, 16 bp, Homo sapiens
atgctgaaacaggaga

SEQ ID NO: 3724208 - DNA, 19 bp, Homo sapiens
atgctgcctaggctgacct

SEQ ID NO: 3724209 - DNA, 15 bp, Homo sapiens
atgctgcctccagaa

SEQ ID NO: 3724210 - DNA, 16 bp, Homo sapiens
atgctgcgcccttccc

SEQ ID NO: 3724211 - DNA, 18 bp, Homo sapiens
atgctgcgcccttcccca

SEQ ID NO: 3724212 - DNA, 21 bp, Homo sapiens
atgctgctttaattgtgaatt

SEQ ID NO: 3724213 - DNA, 21 bp, Homo sapiens
atgctggacaggtctgggaga

SEQ ID NO: 3724214 - DNA, 21 bp, Homo sapiens
atgctggacggcattcctgct

SEQ ID NO: 3724215 - DNA, 18 bp, Homo sapiens
atgctggctcccagggcc

SEQ ID NO: 3724216 - DNA, 22 bp, Homo sapiens
atgctggttttcctaaatgcag

SEQ ID NO: 3724217 - DNA, 20 bp, Homo sapiens
atgctgtcaactatgatatg

SEQ ID NO: 3724218 - DNA, 14 bp, Homo sapiens
atgctgttgcctca

SEQ ID NO: 3724219 - DNA, 17 bp, Homo sapiens
atgctgttgcctcatct

SEQ ID NO: 3724220 - DNA, 21 bp, Homo sapiens
atgcttattttaaaattttat

SEQ ID NO: 3724221 - DNA, 18 bp, Homo sapiens
atgcttcaaactaacaca

SEQ ID NO: 3724222 - DNA, 16 bp, Homo sapiens
atgcttcctgacaatc

SEQ ID NO: 3724223 - DNA, 13 bp, Homo sapiens
atgcttctcactg

SEQ ID NO: 3724224 - DNA, 20 bp, Homo sapiens
atgcttctcactgccatgcc

SEQ ID NO: 3724225 - DNA, 14 bp, Homo sapiens
atgcttctgggaga

SEQ ID NO: 3724226 - DNA, 16 bp, Homo sapiens
atgcttgaatgccacg

SEQ ID NO: 3724227 - DNA, 20 bp, Homo sapiens
atgcttgcctagggcctggt

SEQ ID NO: 3724228 - DNA, 22 bp, Homo sapiens
atctgtagatactagctatcta

SEQ ID NO: 3724229 - DNA, 20 bp, Homo sapiens
atctgtatatacaataacat

SEQ ID NO: 3724230 - DNA, 18 bp, Homo sapiens
atctgtccaaaggaggct

SEQ ID NO: 3724231 - DNA, 19 bp, Homo sapiens
atctgtccaaaggaggctg

SEQ ID NO: 3724232 - DNA, 15 bp, Homo sapiens
atctgtctggagggg

SEQ ID NO: 3724233 - DNA, 21 bp, Homo sapiens
atctgtgaaatgctggcattt

SEQ ID NO: 3724234 - DNA, 22 bp, Homo sapiens
atctgtgcaaatccttgatact

SEQ ID NO: 3724235 - DNA, 14 bp, Homo sapiens
atctgtgcccagag

SEQ ID NO: 3724236 - DNA, 21 bp, Homo sapiens
atctgtgcccagagatgggac

SEQ ID NO: 3724237 - DNA, 12 bp, Homo sapiens
atctgtgcccca

SEQ ID NO: 3724238 - DNA, 16 bp, Homo sapiens
atctgtgcgtgaaaca

SEQ ID NO: 3724239 - DNA, 18 bp, Homo sapiens
atctgtgcgtgaaacaca

SEQ ID NO: 3724240 - DNA, 22 bp, Homo sapiens
atctgtgggcatggtcaaaggc

SEQ ID NO: 3724241 - DNA, 16 bp, Homo sapiens
atctgtgtttttgaaa

SEQ ID NO: 3724242 - DNA, 18 bp, Homo sapiens
atctgtgtttttgaaata

SEQ ID NO: 3724243 - DNA, 22 bp, Homo sapiens
atctgttttaaatttatttcaa

SEQ ID NO: 3724244 - DNA, 20 bp, Homo sapiens
atctgtttttaaaaatcata

SEQ ID NO: 3724245 - DNA, 14 bp, Homo sapiens
atcttaactctttg

SEQ ID NO: 3724246 - DNA, 19 bp, Homo sapiens
atcttaatctgtttattta

SEQ ID NO: 3724247 - DNA, 22 bp, Homo sapiens
atcttacaaagtgtattttata

SEQ ID NO: 3724248 - DNA, 14 bp, Homo sapiens
atcttactgaaggt

SEQ ID NO: 3724249 - DNA, 16 bp, Homo sapiens
atcttagtatttgcat

SEQ ID NO: 3724250 - DNA, 18 bp, Homo sapiens
atcttagtgcctgagagt

SEQ ID NO: 3724251 - DNA, 14 bp, Homo sapiens
atcttcagttttat

SEQ ID NO: 3724252 - DNA, 22 bp, Homo sapiens
atcttcatatctatcagagtat

SEQ ID NO: 3724253 - DNA, 21 bp, Homo sapiens
atcttgaccaagcaggaagct

SEQ ID NO: 3724254 - DNA, 19 bp, Homo sapiens
atcttgcccgctcaggctg

SEQ ID NO: 3724255 - DNA, 20 bp, Homo sapiens
atcttgctctatctcacagc

SEQ ID NO: 3724256 - DNA, 15 bp, Homo sapiens
atcttgctctgctga

SEQ ID NO: 3724257 - DNA, 19 bp, Homo sapiens
atcttgctctgctgacaga

SEQ ID NO: 3724258 - DNA, 12 bp, Homo sapiens
atcttggcaggg

SEQ ID NO: 3724259 - DNA, 20 bp, Homo sapiens
atcttggtcagatttgaact

SEQ ID NO: 3724260 - DNA, 15 bp, Homo sapiens
atcttggtgtgttaa

SEQ ID NO: 3724261 - DNA, 22 bp, Homo sapiens
atctttcacacttccaccagcc

SEQ ID NO: 3724262 - DNA, 18 bp, Homo sapiens
atctttcacccacagaaa

SEQ ID NO: 3724263 - DNA, 19 bp, Homo sapiens
atctttcacccacagaaag

SEQ ID NO: 3724264 - DNA, 22 bp, Homo sapiens
atctttcttctattttattccc

SEQ ID NO: 3724265 - DNA, 11 bp, Homo sapiens
atcttttacat

SEQ ID NO: 3724266 - DNA, 19 bp, Homo sapiens
atctttttattgatgtgca

SEQ ID NO: 3724267 - DNA, 22 bp, Homo sapiens
atctttttattgatgtgcaaaa

SEQ ID NO: 3724268 - DNA, 13 bp, Homo sapiens
atgaaaaatatga

SEQ ID NO: 3724269 - DNA, 16 bp, Homo sapiens
atgaaaaatttaagca

SEQ ID NO: 3724270 - DNA, 21 bp, Homo sapiens
atgaaaaatttaagcattgtt

SEQ ID NO: 3724271 - DNA, 13 bp, Homo sapiens
atgaaaacatgta

SEQ ID NO: 3724272 - DNA, 19 bp, Homo sapiens
atgaaaacgttttattgtg

SEQ ID NO: 3724273 - DNA, 13 bp, Homo sapiens
atgaaaatacaac

SEQ ID NO: 3724274 - DNA, 20 bp, Homo sapiens
atgaaaatcctaccaacctc

SEQ ID NO: 3724275 - DNA, 20 bp, Homo sapiens
atgaaaatgcaacaacatgt

SEQ ID NO: 3724276 - DNA, 19 bp, Homo sapiens
atgaaaatgtcagaaacca

SEQ ID NO: 3724277 - DNA, 20 bp, Homo sapiens
atgaaagatggctgtgcctc

SEQ ID NO: 3724278 - DNA, 12 bp, Homo sapiens
atgaaagcatgt

SEQ ID NO: 3724279 - DNA, 21 bp, Homo sapiens
atgaaagctgattactgtcaa

SEQ ID NO: 3724280 - DNA, 22 bp, Homo sapiens
atgaaagctgattactgtcaat

SEQ ID NO: 3724281 - DNA, 18 bp, Homo sapiens
atgaaagggcccagagag

SEQ ID NO: 3724282 - DNA, 19 bp, Homo sapiens
atgaaataaatcatgttaa

SEQ ID NO: 3724283 - DNA, 19 bp, Homo sapiens
atgaaatatcagactagtg

SEQ ID NO: 3724284 - DNA, 14 bp, Homo sapiens
atgaaatgaggtca

SEQ ID NO: 3724285 - DNA, 14 bp, Homo sapiens
atgaaattttacca

SEQ ID NO: 3724286 - DNA, 15 bp, Homo sapiens
atgaaattttaccaa

SEQ ID NO: 3724287 - DNA, 21 bp, Homo sapiens
atgaacatagactagagaaac

SEQ ID NO: 3724288 - DNA, 19 bp, Homo sapiens
atgaagaaaagtgggccag

SEQ ID NO: 3724289 - DNA, 21 bp, Homo sapiens
atgaagaaaagtgggccagtg

SEQ ID NO: 3724290 - DNA, 22 bp, Homo sapiens
atgaagaaaagtgggccagtgt

SEQ ID NO: 3724291 - DNA, 21 bp, Homo sapiens
atgaagacaggacagtgcttc

SEQ ID NO: 3724292 - DNA, 19 bp, Homo sapiens
atgaagagtgagagggcat

SEQ ID NO: 3724293 - DNA, 12 bp, Homo sapiens
atgaagattatt

SEQ ID NO: 3724294 - DNA, 15 bp, Homo sapiens
atgaagcccaagtga

SEQ ID NO: 3724295 - DNA, 14 bp, Homo sapiens
atgaagctacctca

SEQ ID NO: 3724296 - DNA, 17 bp, Homo sapiens
atgaaggtttctgaaaa

SEQ ID NO: 3724297 - DNA, 17 bp, Homo sapiens
atgaagtttatacagta

SEQ ID NO: 3724298 - DNA, 21 bp, Homo sapiens
atgaatacagggcatgcattt

SEQ ID NO: 3724299 - DNA, 21 bp, Homo sapiens
atgaatgggctgagctgcctg

SEQ ID NO: 3724300 - DNA, 21 bp, Homo sapiens
atgaatggtatggaactctct

SEQ ID NO: 3724301 - DNA, 14 bp, Homo sapiens
atgaattaaataaa

SEQ ID NO: 3724302 - DNA, 15 bp, Homo sapiens
atgaatttggagact

SEQ ID NO: 3724303 - DNA, 18 bp, Homo sapiens
atgacaacttctaattgc

SEQ ID NO: 3724304 - DNA, 15 bp, Homo sapiens
atgacaagccccagg

SEQ ID NO: 3724305 - DNA, 15 bp, Homo sapiens
atgacactgaaatgc

SEQ ID NO: 3724306 - DNA, 16 bp, Homo sapiens
atgacactgagaacag

SEQ ID NO: 3724307 - DNA, 13 bp, Homo sapiens
atgacagagccag

SEQ ID NO: 3724308 - DNA, 17 bp, Homo sapiens
atgacagctgtccctgt

SEQ ID NO: 3724309 - DNA, 19 bp, Homo sapiens
atgacatcacttgtacaaa

SEQ ID NO: 3724310 - DNA, 20 bp, Homo sapiens
atgacatcacttgtacaaaa

SEQ ID NO: 3724311 - DNA, 13 bp, Homo sapiens
atgacatgtgtca

SEQ ID NO: 3724312 - DNA, 21 bp, Homo sapiens
atgacctgtgaccagcactgt

SEQ ID NO: 3724313 - DNA, 18 bp, Homo sapiens
atgaccttctaggaagct

SEQ ID NO: 3724314 - DNA, 23 bp, Homo sapiens
atgacgacaaagctgctaaatct

SEQ ID NO: 3724315 - DNA, 14 bp, Homo sapiens
atgacgcggctcaa

SEQ ID NO: 3724316 - DNA, 18 bp, Homo sapiens
atgacgcggctcaaaagg

SEQ ID NO: 3724317 - DNA, 14 bp, Homo sapiens
atgactaaaaatat

SEQ ID NO: 3724318 - DNA, 11 bp, Homo sapiens
atgactaaaga

SEQ ID NO: 3724319 - DNA, 13 bp, Homo sapiens
atgactaaagaga

SEQ ID NO: 3724320 - DNA, 16 bp, Homo sapiens
atgactaaagagagaa

SEQ ID NO: 3724321 - DNA, 18 bp, Homo sapiens
atgactaaagagagaatg

SEQ ID NO: 3724322 - DNA, 23 bp, Homo sapiens
atgactaaagagagaatgtagat

SEQ ID NO: 3724323 - DNA, 18 bp, Homo sapiens
atgactagaaagtgaata

SEQ ID NO: 3724324 - DNA, 19 bp, Homo sapiens
atgactagaggcagggagg

SEQ ID NO: 3724325 - DNA, 12 bp, Homo sapiens
atgactggaatt

SEQ ID NO: 3724326 - DNA, 15 bp, Homo sapiens
atgactgttttttaa

SEQ ID NO: 3724327 - DNA, 19 bp, Homo sapiens
atgagaacagactggcctg

SEQ ID NO: 3724328 - DNA, 23 bp, Homo sapiens
atgagaacagactggcctgagga

SEQ ID NO: 3724329 - DNA, 12 bp, Homo sapiens
atgagaacatgt

SEQ ID NO: 3724330 - DNA, 19 bp, Homo sapiens
atgagaacatgttggtatt

SEQ ID NO: 3724331 - DNA, 11 bp, Homo sapiens
atgagaatcta

SEQ ID NO: 3724332 - DNA, 18 bp, Homo sapiens
atgagaattcagctgccc

SEQ ID NO: 3724333 - DNA, 21 bp, Homo sapiens
atgagatagaagatgtttgct

SEQ ID NO: 3724334 - DNA, 13 bp, Homo sapiens
atgagatccttta

SEQ ID NO: 3724335 - DNA, 23 bp, Homo sapiens
atgagatctaagcctttccataa

SEQ ID NO: 3724336 - DNA, 18 bp, Homo sapiens
atgagcctcagcatcctg

SEQ ID NO: 3724337 - DNA, 19 bp, Homo sapiens
atgagcctcagcatcctgg

SEQ ID NO: 3724338 - DNA, 21 bp, Homo sapiens
atgagcctcagcatcctggca

SEQ ID NO: 3724339 - DNA, 11 bp, Homo sapiens
atgagcctggc

SEQ ID NO: 3724340 - DNA, 14 bp, Homo sapiens
atgagcctggcaag

SEQ ID NO: 3724341 - DNA, 22 bp, Homo sapiens
atgagctccagacccccagcaa

SEQ ID NO: 3724342 - DNA, 18 bp, Homo sapiens
atgttatgcataaagtca

SEQ ID NO: 3724343 - DNA, 14 bp, Homo sapiens
atgttattgaaaaa

SEQ ID NO: 3724344 - DNA, 22 bp, Homo sapiens
atgttattgaaaaaaattggca

SEQ ID NO: 3724345 - DNA, 21 bp, Homo sapiens
atgttattttctgttgaagtt

SEQ ID NO: 3724346 - DNA, 14 bp, Homo sapiens
atgttcaaagtcaa

SEQ ID NO: 3724347 - DNA, 14 bp, Homo sapiens
atgttcaactggag

SEQ ID NO: 3724348 - DNA, 16 bp, Homo sapiens
atgttctctcttctcc

SEQ ID NO: 3724349 - DNA, 18 bp, Homo sapiens
atgttctctgaggacact

SEQ ID NO: 3724350 - DNA, 15 bp, Homo sapiens
atgttctgacattaa

SEQ ID NO: 3724351 - DNA, 22 bp, Homo sapiens
atgttctgaccctgcttcaaat

SEQ ID NO: 3724352 - DNA, 11 bp, Homo sapiens
atgttctggga

SEQ ID NO: 3724353 - DNA, 15 bp, Homo sapiens
atgttgcccaggttg

SEQ ID NO: 3724354 - DNA, 17 bp, Homo sapiens
atgttggtatttatcta

SEQ ID NO: 3724355 - DNA, 17 bp, Homo sapiens
atgttgttatttaaaga

SEQ ID NO: 3724356 - DNA, 15 bp, Homo sapiens
atgttgtttaacata

SEQ ID NO: 3724357 - DNA, 12 bp, Homo sapiens
atgtttaagatt

SEQ ID NO: 3724358 - DNA, 20 bp, Homo sapiens
atgtttatgcaaggaaggaa

SEQ ID NO: 3724359 - DNA, 22 bp, Homo sapiens
atgtttatgcaaggaaggaaag

SEQ ID NO: 3724360 - DNA, 20 bp, Homo sapiens
atgtttcgtgaagtatactg

SEQ ID NO: 3724361 - DNA, 23 bp, Homo sapiens
atgtttcgtgaagtatactgtat

SEQ ID NO: 3724362 - DNA, 18 bp, Homo sapiens
atgtttgcctctgcctct

SEQ ID NO: 3724363 - DNA, 16 bp, Homo sapiens
atgtttgctattgaca

SEQ ID NO: 3724364 - DNA, 22 bp, Homo sapiens
atgtttgctcagaacacattct

SEQ ID NO: 3724365 - DNA, 22 bp, Homo sapiens
atgtttgctcagcttctccaac

SEQ ID NO: 3724366 - DNA, 23 bp, Homo sapiens
atgtttgtcctgaacacttttgt

SEQ ID NO: 3724367 - DNA, 10 bp, Homo sapiens
atgtttgtgg

SEQ ID NO: 3724368 - DNA, 13 bp, Homo sapiens
atgtttgtggcct

SEQ ID NO: 3724369 - DNA, 14 bp, Homo sapiens
atgtttgtggcctc

SEQ ID NO: 3724370 - DNA, 15 bp, Homo sapiens
atgtttgtggcctca

SEQ ID NO: 3724371 - DNA, 17 bp, Homo sapiens
atgtttgtggcctcaga

SEQ ID NO: 3724372 - DNA, 12 bp, Homo sapiens
atgttttagcat

SEQ ID NO: 3724373 - DNA, 13 bp, Homo sapiens
atgttttgtaaga

SEQ ID NO: 3724374 - DNA, 18 bp, Homo sapiens
atgtttttcttctccctc

SEQ ID NO: 3724375 - DNA, 17 bp, Homo sapiens
atgtttttgtgtatttg

SEQ ID NO: 3724376 - DNA, 19 bp, Homo sapiens
attaaaaatggtaaaattg

SEQ ID NO: 3724377 - DNA, 20 bp, Homo sapiens
attaaaacaatattgtttct

SEQ ID NO: 3724378 - DNA, 22 bp, Homo sapiens
attaaaacttaaccgcatcaga

SEQ ID NO: 3724379 - DNA, 13 bp, Homo sapiens
attaaaatgaata

SEQ ID NO: 3724380 - DNA, 15 bp, Homo sapiens
attaaacaatttatt

SEQ ID NO: 3724381 - DNA, 16 bp, Homo sapiens
attatcaagctaataa

SEQ ID NO: 3724382 - DNA, 22 bp, Homo sapiens
attatcaagctaataaaatatc

SEQ ID NO: 3724383 - DNA, 19 bp, Homo sapiens
attatcaattaccacacca

SEQ ID NO: 3724384 - DNA, 17 bp, Homo sapiens
attatcatgcaaatgct

SEQ ID NO: 3724385 - DNA, 16 bp, Homo sapiens
attatcggaagcagtg

SEQ ID NO: 3724386 - DNA, 16 bp, Homo sapiens
attatcgggaacagtg

SEQ ID NO: 3724387 - DNA, 19 bp, Homo sapiens
attatcgggaacagtgttt

SEQ ID NO: 3724388 - DNA, 18 bp, Homo sapiens
attatcttggaaagaaac

SEQ ID NO: 3724389 - DNA, 14 bp, Homo sapiens
attatgactgtttt

SEQ ID NO: 3724390 - DNA, 20 bp, Homo sapiens
attatgagaggcaatgattg

SEQ ID NO: 3724391 - DNA, 21 bp, Homo sapiens
attatgatgtgggtcaaggaa

SEQ ID NO: 3724392 - DNA, 15 bp, Homo sapiens
attatgcataactga

SEQ ID NO: 3724393 - DNA, 17 bp, Homo sapiens
attatgcataactgaca

SEQ ID NO: 3724394 - DNA, 14 bp, Homo sapiens
attatgttattgaa

SEQ ID NO: 3724395 - DNA, 18 bp, Homo sapiens
attatgttattgaaaaaa

SEQ ID NO: 3724396 - DNA, 22 bp, Homo sapiens
attatgttattgaaaaaaattg

SEQ ID NO: 3724397 - DNA, 15 bp, Homo sapiens
attattattcttcat

SEQ ID NO: 3724398 - DNA, 18 bp, Homo sapiens
attattcaccatgtaaaa

SEQ ID NO: 3724399 - DNA, 22 bp, Homo sapiens
attattcaccatgtaaaacaaa

SEQ ID NO: 3724400 - DNA, 21 bp, Homo sapiens
attattccctgtacaatattt

SEQ ID NO: 3724401 - DNA, 13 bp, Homo sapiens
attattctgcagc

SEQ ID NO: 3724402 - DNA, 18 bp, Homo sapiens
attattggaattaacctg

SEQ ID NO: 3724403 - DNA, 23 bp, Homo sapiens
attattgtgtgttatttaaatga

SEQ ID NO: 3724404 - DNA, 12 bp, Homo sapiens
attattgtttat

SEQ ID NO: 3724405 - DNA, 16 bp, Homo sapiens
attatttatatatgta

SEQ ID NO: 3724406 - DNA, 11 bp, Homo sapiens
attatttcaga

SEQ ID NO: 3724407 - DNA, 16 bp, Homo sapiens
attattttaaattata

SEQ ID NO: 3724408 - DNA, 17 bp, Homo sapiens
attattttaaattataa

SEQ ID NO: 3724409 - DNA, 23 bp, Homo sapiens
attattttaaattataaggactg

SEQ ID NO: 3724410 - DNA, 15 bp, Homo sapiens
attattttaattagg

SEQ ID NO: 3724411 - DNA, 14 bp, Homo sapiens
attattttttatga

SEQ ID NO: 3724412 - DNA, 12 bp, Homo sapiens
attcaaaaatgt

SEQ ID NO: 3724413 - DNA, 14 bp, Homo sapiens
attcaaataccaat

SEQ ID NO: 3724414 - DNA, 22 bp, Homo sapiens
attcaaccactgtaaaatgaaa

SEQ ID NO: 3724415 - DNA, 22 bp, Homo sapiens
attcaagaaagccagtcttaac

SEQ ID NO: 3724416 - DNA, 16 bp, Homo sapiens
attcaattcctctggg

SEQ ID NO: 3724417 - DNA, 20 bp, Homo sapiens
attcacaagctgcctccctg

SEQ ID NO: 3724418 - DNA, 14 bp, Homo sapiens
attcacaatagaaa

SEQ ID NO: 3724419 - DNA, 21 bp, Homo sapiens
attcaccatgtaaaacaaaaa

SEQ ID NO: 3724420 - DNA, 13 bp, Homo sapiens
attcacctgtaaa

SEQ ID NO: 3724421 - DNA, 20 bp, Homo sapiens
attcagcccatttcacacct

SEQ ID NO: 3724422 - DNA, 12 bp, Homo sapiens
attcagctgccc

SEQ ID NO: 3724423 - DNA, 22 bp, Homo sapiens
attcaggaaaactgacagagga

SEQ ID NO: 3724424 - DNA, 11 bp, Homo sapiens
attcaggctgc

SEQ ID NO: 3724425 - DNA, 13 bp, Homo sapiens
attcaggctgctt

SEQ ID NO: 3724426 - DNA, 16 bp, Homo sapiens
attcaggctgcttggg

SEQ ID NO: 3724427 - DNA, 15 bp, Homo sapiens
attcagtgagggtct

SEQ ID NO: 3724428 - DNA, 18 bp, Homo sapiens
attcatatttacttctta

SEQ ID NO: 3724429 - DNA, 18 bp, Homo sapiens
attcatatttatgaatct

SEQ ID NO: 3724430 - DNA, 19 bp, Homo sapiens
attcattctggtctctcta

SEQ ID NO: 3724431 - DNA, 22 bp, Homo sapiens
attcattctggtctctctatta

SEQ ID NO: 3724432 - DNA, 22 bp, Homo sapiens
attcattgtggttatttttata

SEQ ID NO: 3724433 - DNA, 11 bp, Homo sapiens
attcatttcaa

SEQ ID NO: 3724434 - DNA, 22 bp, Homo sapiens
attcatttcaaagggagagaga

SEQ ID NO: 3724435 - DNA, 20 bp, Homo sapiens
attccaacagctcaagtctt

SEQ ID NO: 3724436 - DNA, 18 bp, Homo sapiens
attccaccttaaattaaa

SEQ ID NO: 3724437 - DNA, 20 bp, Homo sapiens
attccaccttaaattaaaca

SEQ ID NO: 3724438 - DNA, 16 bp, Homo sapiens
attccagaaaggatat

SEQ ID NO: 3724439 - DNA, 19 bp, Homo sapiens
attccagagagtggctcct

SEQ ID NO: 3724440 - DNA, 15 bp, Homo sapiens
attccagtttgttta

SEQ ID NO: 3724441 - DNA, 21 bp, Homo sapiens
attccatagtatattaaaaat

SEQ ID NO: 3724442 - DNA, 11 bp, Homo sapiens
attccatctcc

SEQ ID NO: 3724443 - DNA, 12 bp, Homo sapiens
attccatctcct

SEQ ID NO: 3724444 - DNA, 17 bp, Homo sapiens
attccatgaatgtatca

SEQ ID NO: 3724445 - DNA, 23 bp, Homo sapiens
attccatgaatgtatcaggaaat

SEQ ID NO: 3724446 - DNA, 16 bp, Homo sapiens
attccattgtgtgagt

SEQ ID NO: 3724447 - DNA, 19 bp, Homo sapiens
attcccagagacaggaaaa

SEQ ID NO: 3724448 - DNA, 18 bp, Homo sapiens
attcccagatttgaagac

SEQ ID NO: 3724449 - DNA, 14 bp, Homo sapiens
attcccagctgtct

SEQ ID NO: 3724450 - DNA, 17 bp, Homo sapiens
attcccagctgtctgtg

SEQ ID NO: 3724451 - DNA, 14 bp, Homo sapiens
attcccattgaaaa

SEQ ID NO: 3724452 - DNA, 18 bp, Homo sapiens
attcccattgaaaatgta

SEQ ID NO: 3724453 - DNA, 22 bp, Homo sapiens
attccccaccctgaaagccctg

SEQ ID NO: 3724454 - DNA, 21 bp, Homo sapiens
attccccagcctctcttccta

SEQ ID NO: 3724455 - DNA, 21 bp, Homo sapiens
attccccaggtggctgaccca

SEQ ID NO: 3724456 - DNA, 15 bp, Homo sapiens
attccccattcttcc

SEQ ID NO: 3724457 - DNA, 21 bp, Homo sapiens
attccctcctgctactctgtt

SEQ ID NO: 3724458 - DNA, 20 bp, Homo sapiens
attccctgagtcaccaggaa

SEQ ID NO: 3724459 - DNA, 14 bp, Homo sapiens
attccctggaccag

SEQ ID NO: 3724460 - DNA, 19 bp, Homo sapiens
attccctggaccagatgct

SEQ ID NO: 3724461 - DNA, 21 bp, Homo sapiens
attccctgtacaatatttaaa

SEQ ID NO: 3724462 - DNA, 20 bp, Homo sapiens
attccgtttacattttagac

SEQ ID NO: 3724463 - DNA, 20 bp, Homo sapiens
attcctaacacagcatgtgt

SEQ ID NO: 3724464 - DNA, 15 bp, Homo sapiens
attcctagataaaaa

SEQ ID NO: 3724465 - DNA, 19 bp, Homo sapiens
attcctagataaaaagatg

SEQ ID NO: 3724466 - DNA, 14 bp, Homo sapiens
attcctcagggaca

SEQ ID NO: 3724467 - DNA, 17 bp, Homo sapiens
attcctgaatgaaatat

SEQ ID NO: 3724468 - DNA, 18 bp, Homo sapiens
attcctgcatttgtgaaa

SEQ ID NO: 3724469 - DNA, 17 bp, Homo sapiens
attcctgcctgtctcct

SEQ ID NO: 3724470 - DNA, 20 bp, Homo sapiens
attccttgataatgttgtgg

SEQ ID NO: 3724471 - DNA, 17 bp, Homo sapiens
attcctttccctttagc

SEQ ID NO: 3724472 - DNA, 14 bp, Homo sapiens
attcgagctatatt

SEQ ID NO: 3724473 - DNA, 21 bp, Homo sapiens
attcgcccaaagccagacagc

SEQ ID NO: 3724474 - DNA, 19 bp, Homo sapiens
attctaaataaaatataat

SEQ ID NO: 3724475 - DNA, 20 bp, Homo sapiens
attctaaataaaatataatt

SEQ ID NO: 3724476 - DNA, 17 bp, Homo sapiens
attctaaatgaatgttt

SEQ ID NO: 3724477 - DNA, 16 bp, Homo sapiens
attctacgtatctgct

SEQ ID NO: 3724478 - DNA, 16 bp, Homo sapiens
attctactttgagtgc

SEQ ID NO: 3724479 - DNA, 16 bp, Homo sapiens
attctaggcatcccag

SEQ ID NO: 3724480 - DNA, 16 bp, Homo sapiens
attctagttttgtcaa

SEQ ID NO: 3724481 - DNA, 17 bp, Homo sapiens
attctagttttgtcaaa

SEQ ID NO: 3724482 - DNA, 13 bp, Homo sapiens
attctcaaagcag

SEQ ID NO: 3724483 - DNA, 15 bp, Homo sapiens
attctcaagccctgc

SEQ ID NO: 3724484 - DNA, 16 bp, Homo sapiens
attctcaagccctgca

SEQ ID NO: 3724485 - DNA, 19 bp, Homo sapiens
attctcaagccgcatccca

SEQ ID NO: 3724486 - DNA, 20 bp, Homo sapiens
attctcaagccgcatcccag

SEQ ID NO: 3724487 - DNA, 15 bp, Homo sapiens
attctcactccacca

SEQ ID NO: 3724488 - DNA, 23 bp, Homo sapiens
attctcagatatttatattttta

SEQ ID NO: 3724489 - DNA, 15 bp, Homo sapiens
attctcctgcctcag

SEQ ID NO: 3724490 - DNA, 17 bp, Homo sapiens
attctcctgcctcagcc

SEQ ID NO: 3724491 - DNA, 13 bp, Homo sapiens
attgttaaaataa

SEQ ID NO: 3724492 - DNA, 15 bp, Homo sapiens
attgttccaagacat

SEQ ID NO: 3724493 - DNA, 17 bp, Homo sapiens
attgttccaagacattg

SEQ ID NO: 3724494 - DNA, 19 bp, Homo sapiens
attgttcccagtgacactt

SEQ ID NO: 3724495 - DNA, 16 bp, Homo sapiens
attgttcctaagttct

SEQ ID NO: 3724496 - DNA, 19 bp, Homo sapiens
attgttcctaagttcttag

SEQ ID NO: 3724497 - DNA, 22 bp, Homo sapiens
attgttgaggtggtctgaatgt

SEQ ID NO: 3724498 - DNA, 23 bp, Homo sapiens
attgttgaggtggtctgaatgtt

SEQ ID NO: 3724499 - DNA, 19 bp, Homo sapiens
attgtttatttatcagtga

SEQ ID NO: 3724500 - DNA, 22 bp, Homo sapiens
attgtttcattgcgaatctttt

SEQ ID NO: 3724501 - DNA, 18 bp, Homo sapiens
attgtttgcttattgttc

SEQ ID NO: 3724502 - DNA, 21 bp, Homo sapiens
attgtttgcttattgttccaa

SEQ ID NO: 3724503 - DNA, 23 bp, Homo sapiens
attgtttgcttattgttccaaga

SEQ ID NO: 3724504 - DNA, 14 bp, Homo sapiens
atttaaaaaaaatc

SEQ ID NO: 3724505 - DNA, 11 bp, Homo sapiens
atttaaaacaa

SEQ ID NO: 3724506 - DNA, 12 bp, Homo sapiens
atttaaaacaaa

SEQ ID NO: 3724507 - DNA, 13 bp, Homo sapiens
atttaaaacatta

SEQ ID NO: 3724508 - DNA, 19 bp, Homo sapiens
atttaaacaataaatgtgc

SEQ ID NO: 3724509 - DNA, 16 bp, Homo sapiens
atttaaattctttttt

SEQ ID NO: 3724510 - DNA, 13 bp, Homo sapiens
atttaacaagatc

SEQ ID NO: 3724511 - DNA, 15 bp, Homo sapiens
atttaacaatgcgaa

SEQ ID NO: 3724512 - DNA, 20 bp, Homo sapiens
atttaacaatgcgaatggta

SEQ ID NO: 3724513 - DNA, 17 bp, Homo sapiens
atttaagaaaatacaat

SEQ ID NO: 3724514 - DNA, 13 bp, Homo sapiens
atttaagcattgt

SEQ ID NO: 3724515 - DNA, 15 bp, Homo sapiens
atttaagcattgttt

SEQ ID NO: 3724516 - DNA, 18 bp, Homo sapiens
atttaagcttatgtcaga

SEQ ID NO: 3724517 - DNA, 22 bp, Homo sapiens
atttaaggagatgtaagagctt

SEQ ID NO: 3724518 - DNA, 15 bp, Homo sapiens
atttaagtattcaag

SEQ ID NO: 3724519 - DNA, 13 bp, Homo sapiens
atttaataacata

SEQ ID NO: 3724520 - DNA, 16 bp, Homo sapiens
atttaatatagctatt

SEQ ID NO: 3724521 - DNA, 17 bp, Homo sapiens
atttaatatagctattt

SEQ ID NO: 3724522 - DNA, 18 bp, Homo sapiens
atttaatcttttttatgt

SEQ ID NO: 3724523 - DNA, 20 bp, Homo sapiens
atttaatgaaagactgtaca

SEQ ID NO: 3724524 - DNA, 21 bp, Homo sapiens
atttaatgaaagactgtacaa

SEQ ID NO: 3724525 - DNA, 14 bp, Homo sapiens
atttaattgtaaac

SEQ ID NO: 3724526 - DNA, 12 bp, Homo sapiens
atttacactttt

SEQ ID NO: 3724527 - DNA, 16 bp, Homo sapiens
atttacatatgaaatt

SEQ ID NO: 3724528 - DNA, 13 bp, Homo sapiens
atttactgagctt

SEQ ID NO: 3724529 - DNA, 20 bp, Homo sapiens
atttactgagcttctctgtg

SEQ ID NO: 3724530 - DNA, 14 bp, Homo sapiens
atttacttcttata

SEQ ID NO: 3724531 - DNA, 20 bp, Homo sapiens
atttacttcttatacatttg

SEQ ID NO: 3724532 - DNA, 15 bp, Homo sapiens
atttagaaatataat

SEQ ID NO: 3724533 - DNA, 13 bp, Homo sapiens
atttagcacaaaa

SEQ ID NO: 3724534 - DNA, 23 bp, Homo sapiens
atttagcacatactacacattca

SEQ ID NO: 3724535 - DNA, 22 bp, Homo sapiens
atttagcatgacaagccccagg

SEQ ID NO: 3724536 - DNA, 18 bp, Homo sapiens
atttagggaactgcttga

SEQ ID NO: 3724537 - DNA, 20 bp, Homo sapiens
atttagtgaaagctagagat

SEQ ID NO: 3724538 - DNA, 17 bp, Homo sapiens
atttagttctttgttat

SEQ ID NO: 3724539 - DNA, 20 bp, Homo sapiens
atttagtttttgtaatttat

SEQ ID NO: 3724540 - DNA, 22 bp, Homo sapiens
atttataaatatatttaagata

SEQ ID NO: 3724541 - DNA, 16 bp, Homo sapiens
atttataactcatcat

SEQ ID NO: 3724542 - DNA, 19 bp, Homo sapiens
atttataactcatcataaa

SEQ ID NO: 3724543 - DNA, 16 bp, Homo sapiens
cacatgtgtccatccc

SEQ ID NO: 3724544 - DNA, 19 bp, Homo sapiens
cacatgtgtccatcccagc

SEQ ID NO: 3724545 - DNA, 23 bp, Homo sapiens
cacattaagccttccacactcac

SEQ ID NO: 3724546 - DNA, 16 bp, Homo sapiens
cacattatcgggagca

SEQ ID NO: 3724547 - DNA, 23 bp, Homo sapiens
cacattatcgggagcagtgtctt

SEQ ID NO: 3724548 - DNA, 20 bp, Homo sapiens
cacattgtgtcacatcatga

SEQ ID NO: 3724549 - DNA, 14 bp, Homo sapiens
caccaacatcccat

SEQ ID NO: 3724550 - DNA, 17 bp, Homo sapiens
caccaacatcccattgc

SEQ ID NO: 3724551 - DNA, 22 bp, Homo sapiens
caccaacatcccattgccctgg

SEQ ID NO: 3724552 - DNA, 23 bp, Homo sapiens
caccaacatcccattgccctggt

SEQ ID NO: 3724553 - DNA, 13 bp, Homo sapiens
caccaaccctcag

SEQ ID NO: 3724554 - DNA, 19 bp, Homo sapiens
caccaagacttgaaggtgc

SEQ ID NO: 3724555 - DNA, 22 bp, Homo sapiens
caccaagacttgttttatgctc

SEQ ID NO: 3724556 - DNA, 15 bp, Homo sapiens
caccaagcccacagg

SEQ ID NO: 3724557 - DNA, 12 bp, Homo sapiens
caccaagcccag

SEQ ID NO: 3724558 - DNA, 14 bp, Homo sapiens
caccaagctcacag

SEQ ID NO: 3724559 - DNA, 15 bp, Homo sapiens
caccaagctcacagt

SEQ ID NO: 3724560 - DNA, 20 bp, Homo sapiens
caccaagctcacagttcctc

SEQ ID NO: 3724561 - DNA, 22 bp, Homo sapiens
caccaagttggaacatccttgg

SEQ ID NO: 3724562 - DNA, 13 bp, Homo sapiens
caccacagcaggt

SEQ ID NO: 3724563 - DNA, 19 bp, Homo sapiens
caccacatgtgcacatgca

SEQ ID NO: 3724564 - DNA, 21 bp, Homo sapiens
caccaccccagctgctcccct

SEQ ID NO: 3724565 - DNA, 22 bp, Homo sapiens
caccaccctagtcccttcccct

SEQ ID NO: 3724566 - DNA, 15 bp, Homo sapiens
caccaccttcccagc

SEQ ID NO: 3724567 - DNA, 21 bp, Homo sapiens
caccaccttcccagctctccc

SEQ ID NO: 3724568 - DNA, 19 bp, Homo sapiens
caccacgatgtggccctgg

SEQ ID NO: 3724569 - DNA, 20 bp, Homo sapiens
caccacgatgtggccctggc

SEQ ID NO: 3724570 - DNA, 15 bp, Homo sapiens
caccagagcccacct

SEQ ID NO: 3724571 - DNA, 17 bp, Homo sapiens
caccagagcccaccttg

SEQ ID NO: 3724572 - DNA, 20 bp, Homo sapiens
caccagagcccaccttggct

SEQ ID NO: 3724573 - DNA, 21 bp, Homo sapiens
caccagccccagtgcccacag

SEQ ID NO: 3724574 - DNA, 13 bp, Homo sapiens
caccagcctgcac

SEQ ID NO: 3724575 - DNA, 22 bp, Homo sapiens
caccagcctttctcccaggcca

SEQ ID NO: 3724576 - DNA, 19 bp, Homo sapiens
caccaggagaaccactaca

SEQ ID NO: 3724577 - DNA, 20 bp, Homo sapiens
caccaggcttgcctgcaggc

SEQ ID NO: 3724578 - DNA, 13 bp, Homo sapiens
caccagggaagat

SEQ ID NO: 3724579 - DNA, 14 bp, Homo sapiens
caccaggtctcccg

SEQ ID NO: 3724580 - DNA, 17 bp, Homo sapiens
caccagtgtcctcccct

SEQ ID NO: 3724581 - DNA, 18 bp, Homo sapiens
caccagtgtcctcccctc

SEQ ID NO: 3724582 - DNA, 23 bp, Homo sapiens
caccagtgtcctcccctcaagga

SEQ ID NO: 3724583 - DNA, 23 bp, Homo sapiens
caccagtgtgtggctttcagagc

SEQ ID NO: 3724584 - DNA, 16 bp, Homo sapiens
caccatattcagtgct

SEQ ID NO: 3724585 - DNA, 21 bp, Homo sapiens
caccatattcagtgctgtggc

SEQ ID NO: 3724586 - DNA, 15 bp, Homo sapiens
caccatcatgtctgg

SEQ ID NO: 3724587 - DNA, 14 bp, Homo sapiens
caccatctcaggcc

SEQ ID NO: 3724588 - DNA, 21 bp, Homo sapiens
caccatctcaggccacctgcc

SEQ ID NO: 3724589 - DNA, 16 bp, Homo sapiens
caccatggccagccaa

SEQ ID NO: 3724590 - DNA, 20 bp, Homo sapiens
caccatggctaaggcaccag

SEQ ID NO: 3724591 - DNA, 22 bp, Homo sapiens
caccatggctaaggcaccagcc

SEQ ID NO: 3724592 - DNA, 15 bp, Homo sapiens
caccatgtaaaacaa

SEQ ID NO: 3724593 - DNA, 16 bp, Homo sapiens
caccatgtaaaacaaa

SEQ ID NO: 3724594 - DNA, 21 bp, Homo sapiens
caccatgtaaaacaaaaaaca

SEQ ID NO: 3724595 - DNA, 22 bp, Homo sapiens
caccattcaggaacctggacca

SEQ ID NO: 3724596 - DNA, 17 bp, Homo sapiens
cacccacagaaagagag

SEQ ID NO: 3724597 - DNA, 17 bp, Homo sapiens
cacccacctcagcctcc

SEQ ID NO: 3724598 - DNA, 12 bp, Homo sapiens
cacccagcccac

SEQ ID NO: 3724599 - DNA, 17 bp, Homo sapiens
cacccagcccacttctg

SEQ ID NO: 3724600 - DNA, 13 bp, Homo sapiens
cacccagcccatt

SEQ ID NO: 3724601 - DNA, 11 bp, Homo sapiens
cacccaggagg

SEQ ID NO: 3724602 - DNA, 11 bp, Homo sapiens
caccccacact

SEQ ID NO: 3724603 - DNA, 13 bp, Homo sapiens
caccccaccccct

SEQ ID NO: 3724604 - DNA, 11 bp, Homo sapiens
caccccagcct

SEQ ID NO: 3724605 - DNA, 16 bp, Homo sapiens
caccccagctgctccc

SEQ ID NO: 3724606 - DNA, 20 bp, Homo sapiens
caccccagtgcacccactct

SEQ ID NO: 3724607 - DNA, 17 bp, Homo sapiens
caccccatgccaaagct

SEQ ID NO: 3724608 - DNA, 12 bp, Homo sapiens
cacccccagctt

SEQ ID NO: 3724609 - DNA, 11 bp, Homo sapiens
caccccctccc

SEQ ID NO: 3724610 - DNA, 18 bp, Homo sapiens
caccccctccccagggga

SEQ ID NO: 3724611 - DNA, 20 bp, Homo sapiens
cacccccttcagtgcccacc

SEQ ID NO: 3724612 - DNA, 23 bp, Homo sapiens
cacccccttctctgcccattccc

SEQ ID NO: 3724613 - DNA, 15 bp, Homo sapiens
caccccgggctctct

SEQ ID NO: 3724614 - DNA, 15 bp, Homo sapiens
cacccctcccctgcc

SEQ ID NO: 3724615 - DNA, 24 bp, Homo sapiens
cacccctgccctgggatgtccaca

SEQ ID NO: 3724616 - DNA, 12 bp, Homo sapiens
caccccttcccc

SEQ ID NO: 3724617 - DNA, 14 bp, Homo sapiens
caccccttccccac

SEQ ID NO: 3724618 - DNA, 15 bp, Homo sapiens
caccccttccccact

SEQ ID NO: 3724619 - DNA, 15 bp, Homo sapiens
cacccgaggctgccc

SEQ ID NO: 3724620 - DNA, 18 bp, Homo sapiens
cacccgaggctgcccact

SEQ ID NO: 3724621 - DNA, 14 bp, Homo sapiens
cacccggcccctgc

SEQ ID NO: 3724622 - DNA, 20 bp, Homo sapiens
caccctaatgtggcagctgt

SEQ ID NO: 3724623 - DNA, 16 bp, Homo sapiens
caccctacctgtgcct

SEQ ID NO: 3724624 - DNA, 20 bp, Homo sapiens
caccctcagatgcacatgag

SEQ ID NO: 3724625 - DNA, 16 bp, Homo sapiens
caccctcccagctctg

SEQ ID NO: 3724626 - DNA, 12 bp, Homo sapiens
caccctcctttc

SEQ ID NO: 3724627 - DNA, 16 bp, Homo sapiens
caccctctcccaggac

SEQ ID NO: 3724628 - DNA, 21 bp, Homo sapiens
caccctggaggatttcatctc

SEQ ID NO: 3724629 - DNA, 16 bp, Homo sapiens
caccctggggagaaag

SEQ ID NO: 3724630 - DNA, 17 bp, Homo sapiens
caccctggggagaaagt

SEQ ID NO: 3724631 - DNA, 18 bp, Homo sapiens
cacaccctctcccaggac

SEQ ID NO: 3724632 - DNA, 20 bp, Homo sapiens
cacacctcagttcccttggc

SEQ ID NO: 3724633 - DNA, 21 bp, Homo sapiens
cacacctcagttcccttggcc

SEQ ID NO: 3724634 - DNA, 22 bp, Homo sapiens
cacacctcagttcccttggcct

SEQ ID NO: 3724635 - DNA, 13 bp, Homo sapiens
cacacctggccct

SEQ ID NO: 3724636 - DNA, 22 bp, Homo sapiens
cacacctgtaatcccagcactt

SEQ ID NO: 3724637 - DNA, 15 bp, Homo sapiens
cacacgcacacacac

SEQ ID NO: 3724638 - DNA, 22 bp, Homo sapiens
cacacggacactcaaaagctgg

SEQ ID NO: 3724639 - DNA, 18 bp, Homo sapiens
cacacggaggcatctgca

SEQ ID NO: 3724640 - DNA, 19 bp, Homo sapiens
cacacgtcatgtttcttca

SEQ ID NO: 3724641 - DNA, 17 bp, Homo sapiens
cacactagcctctccag

SEQ ID NO: 3724642 - DNA, 19 bp, Homo sapiens
cacactagcctctccagga

SEQ ID NO: 3724643 - DNA, 23 bp, Homo sapiens
cacactgaaaaggaaaatgggaa

SEQ ID NO: 3724644 - DNA, 14 bp, Homo sapiens
cacactgcaacagg

SEQ ID NO: 3724645 - DNA, 16 bp, Homo sapiens
cacactgcaagagcct

SEQ ID NO: 3724646 - DNA, 18 bp, Homo sapiens
cacactgcaagagccttg

SEQ ID NO: 3724647 - DNA, 17 bp, Homo sapiens
cacacttcaggctcttc

SEQ ID NO: 3724648 - DNA, 21 bp, Homo sapiens
cacacttcaggctcttctcct

SEQ ID NO: 3724649 - DNA, 16 bp, Homo sapiens
cacacttccaccagcc

SEQ ID NO: 3724650 - DNA, 14 bp, Homo sapiens
cacacttcctgtcc

SEQ ID NO: 3724651 - DNA, 15 bp, Homo sapiens
cacacttcctgtcca

SEQ ID NO: 3724652 - DNA, 20 bp, Homo sapiens
cacacttcctgtccagagag

SEQ ID NO: 3724653 - DNA, 23 bp, Homo sapiens
cacacttgtgtgtgggctgtgag

SEQ ID NO: 3724654 - DNA, 15 bp, Homo sapiens
cacacttgttccagc

SEQ ID NO: 3724655 - DNA, 16 bp, Homo sapiens
cacacttgttccagct

SEQ ID NO: 3724656 - DNA, 18 bp, Homo sapiens
cacacttgttccagctct

SEQ ID NO: 3724657 - DNA, 14 bp, Homo sapiens
cacagaaaactaga

SEQ ID NO: 3724658 - DNA, 18 bp, Homo sapiens
cacagaaacacaatattt

SEQ ID NO: 3724659 - DNA, 15 bp, Homo sapiens
cacagaaagactgag

SEQ ID NO: 3724660 - DNA, 11 bp, Homo sapiens
cacagaaagag

SEQ ID NO: 3724661 - DNA, 15 bp, Homo sapiens
cacagaaagagagca

SEQ ID NO: 3724662 - DNA, 17 bp, Homo sapiens
cacagaaatcagaggag

SEQ ID NO: 3724663 - DNA, 13 bp, Homo sapiens
cacagaacccttg

SEQ ID NO: 3724664 - DNA, 20 bp, Homo sapiens
cacagacattctgccaggcc

SEQ ID NO: 3724665 - DNA, 23 bp, Homo sapiens
cacagactattgacatcagcatc

SEQ ID NO: 3724666 - DNA, 20 bp, Homo sapiens
cacagactggagacaatgca

SEQ ID NO: 3724667 - DNA, 18 bp, Homo sapiens
cacagagacacagggcat

SEQ ID NO: 3724668 - DNA, 14 bp, Homo sapiens
cacagagacccccg

SEQ ID NO: 3724669 - DNA, 12 bp, Homo sapiens
cacagagagaaa

SEQ ID NO: 3724670 - DNA, 18 bp, Homo sapiens
cacagaggcttcttcaga

SEQ ID NO: 3724671 - DNA, 19 bp, Homo sapiens
cacagatcacagcttcagc

SEQ ID NO: 3724672 - DNA, 22 bp, Homo sapiens
cacagatcacagcttcagccag

SEQ ID NO: 3724673 - DNA, 20 bp, Homo sapiens
cacagatggatttgcctgtg

SEQ ID NO: 3724674 - DNA, 18 bp, Homo sapiens
cacagcagcctctgaagt

SEQ ID NO: 3724675 - DNA, 13 bp, Homo sapiens
cacagcatgtgta

SEQ ID NO: 3724676 - DNA, 22 bp, Homo sapiens
cacagcccaggcctccagctca

SEQ ID NO: 3724677 - DNA, 18 bp, Homo sapiens
cacagccctgtcagtgca

SEQ ID NO: 3724678 - DNA, 18 bp, Homo sapiens
cacagccggggcctgcct

SEQ ID NO: 3724679 - DNA, 19 bp, Homo sapiens
cacagccggggcctgccta

SEQ ID NO: 3724680 - DNA, 20 bp, Homo sapiens
cacagccggggcctgcctag

SEQ ID NO: 3724681 - DNA, 14 bp, Homo sapiens
cacagcctctgcct

SEQ ID NO: 3724682 - DNA, 20 bp, Homo sapiens
cacagcggggccccagggct

SEQ ID NO: 3724683 - DNA, 19 bp, Homo sapiens
cacagctcccaccccaccc

SEQ ID NO: 3724684 - DNA, 21 bp, Homo sapiens
cacagctctccggtctctctc

SEQ ID NO: 3724685 - DNA, 15 bp, Homo sapiens
cacagctctgtcctg

SEQ ID NO: 3724686 - DNA, 18 bp, Homo sapiens
cacagctctgtcctggga

SEQ ID NO: 3724687 - DNA, 19 bp, Homo sapiens
cacagctctgtcctgggag

SEQ ID NO: 3724688 - DNA, 20 bp, Homo sapiens
cacagctctgtcctgggagt

SEQ ID NO: 3724689 - DNA, 23 bp, Homo sapiens
cacagctctgtcctgggagtgag

SEQ ID NO: 3724690 - DNA, 17 bp, Homo sapiens
cacagctcttctccagg

SEQ ID NO: 3724691 - DNA, 18 bp, Homo sapiens
cacagctgcagagacaga

SEQ ID NO: 3724692 - DNA, 12 bp, Homo sapiens
cacagctgtggt

SEQ ID NO: 3724693 - DNA, 14 bp, Homo sapiens
cacagcttcagcca

SEQ ID NO: 3724694 - DNA, 22 bp, Homo sapiens
cacagcttcagccaggagctgg

SEQ ID NO: 3724695 - DNA, 21 bp, Homo sapiens
cacagcttcatttcctgtgtc

SEQ ID NO: 3724696 - DNA, 22 bp, Homo sapiens
cacagcttcatttcctgtgtct

SEQ ID NO: 3724697 - DNA, 14 bp, Homo sapiens
cacagcttcccctc

SEQ ID NO: 3724698 - DNA, 15 bp, Homo sapiens
cacagcttcccctct

SEQ ID NO: 3724699 - DNA, 12 bp, Homo sapiens
cacagcttgggg

SEQ ID NO: 3724700 - DNA, 15 bp, Homo sapiens
cacagcttggggcca

SEQ ID NO: 3724701 - DNA, 23 bp, Homo sapiens
cacagcttttagtacccacctga

SEQ ID NO: 3724702 - DNA, 16 bp, Homo sapiens
cacaggactctgcctc

SEQ ID NO: 3724703 - DNA, 16 bp, Homo sapiens
cacaggcaaaatcctt

SEQ ID NO: 3724704 - DNA, 15 bp, Homo sapiens
cacaggcagcattta

SEQ ID NO: 3724705 - DNA, 19 bp, Homo sapiens
cacaggcccggctccaggc

SEQ ID NO: 3724706 - DNA, 23 bp, Homo sapiens
cacaggcccggctccaggctcct

SEQ ID NO: 3724707 - DNA, 21 bp, Homo sapiens
cacaggcccttcctctccact

SEQ ID NO: 3724708 - DNA, 22 bp, Homo sapiens
cacaggcccttcctctccactg

SEQ ID NO: 3724709 - DNA, 23 bp, Homo sapiens
cacaggcccttcctctccactgc

SEQ ID NO: 3724710 - DNA, 20 bp, Homo sapiens
cacagggcatccaactgaga

SEQ ID NO: 3724711 - DNA, 22 bp, Homo sapiens
cacagggccccagaaggcaggg

SEQ ID NO: 3724712 - DNA, 22 bp, Homo sapiens
cacagggttgggcccagatctg

SEQ ID NO: 3724713 - DNA, 18 bp, Homo sapiens
caataggaatgctaacag

SEQ ID NO: 3724714 - DNA, 14 bp, Homo sapiens
caatagtgtgttct

SEQ ID NO: 3724715 - DNA, 20 bp, Homo sapiens
caatataaccaatgtttaaa

SEQ ID NO: 3724716 - DNA, 21 bp, Homo sapiens
caatataaccaatgtttaaaa

SEQ ID NO: 3724717 - DNA, 19 bp, Homo sapiens
caatatcctcgctcccggg

SEQ ID NO: 3724718 - DNA, 22 bp, Homo sapiens
caatatgtattaatattcattg

SEQ ID NO: 3724719 - DNA, 19 bp, Homo sapiens
caatattcaatcaaaattt

SEQ ID NO: 3724720 - DNA, 17 bp, Homo sapiens
caatattcgctgtgtca

SEQ ID NO: 3724721 - DNA, 16 bp, Homo sapiens
caatatttaaggagat

SEQ ID NO: 3724722 - DNA, 12 bp, Homo sapiens
caatatttatta

SEQ ID NO: 3724723 - DNA, 19 bp, Homo sapiens
caatatttattattttcac

SEQ ID NO: 3724724 - DNA, 13 bp, Homo sapiens
caatatttattgt

SEQ ID NO: 3724725 - DNA, 16 bp, Homo sapiens
caatatttattgtatt

SEQ ID NO: 3724726 - DNA, 14 bp, Homo sapiens
caatattttaagca

SEQ ID NO: 3724727 - DNA, 16 bp, Homo sapiens
caatattttaagcatt

SEQ ID NO: 3724728 - DNA, 11 bp, Homo sapiens
caatattttcc

SEQ ID NO: 3724729 - DNA, 13 bp, Homo sapiens
caatattttccat

SEQ ID NO: 3724730 - DNA, 15 bp, Homo sapiens
caatattttccatga

SEQ ID NO: 3724731 - DNA, 20 bp, Homo sapiens
caatattttccatgaaaatg

SEQ ID NO: 3724732 - DNA, 23 bp, Homo sapiens
caatccatgttagtttttacttt

SEQ ID NO: 3724733 - DNA, 17 bp, Homo sapiens
caatcccaccaaccctc

SEQ ID NO: 3724734 - DNA, 20 bp, Homo sapiens
caatgaaggaaataaaaaag

SEQ ID NO: 3724735 - DNA, 15 bp, Homo sapiens
caatgacatcttcaa

SEQ ID NO: 3724736 - DNA, 19 bp, Homo sapiens
caatgacatcttcaaagct

SEQ ID NO: 3724737 - DNA, 21 bp, Homo sapiens
caatgatggcaattttgtaac

SEQ ID NO: 3724738 - DNA, 14 bp, Homo sapiens
caatgatggtcacc

SEQ ID NO: 3724739 - DNA, 22 bp, Homo sapiens
caatgattgttaatttacagct

SEQ ID NO: 3724740 - DNA, 14 bp, Homo sapiens
caatgcactgacat

SEQ ID NO: 3724741 - DNA, 19 bp, Homo sapiens
caatgcgaatggtagtcta

SEQ ID NO: 3724742 - DNA, 22 bp, Homo sapiens
caatgctggctgttggctgggg

SEQ ID NO: 3724743 - DNA, 17 bp, Homo sapiens
caatggaagatttgccc

SEQ ID NO: 3724744 - DNA, 12 bp, Homo sapiens
caatggcagcct

SEQ ID NO: 3724745 - DNA, 15 bp, Homo sapiens
caatggcagccttgg

SEQ ID NO: 3724746 - DNA, 17 bp, Homo sapiens
caatggtttgcaaggaa

SEQ ID NO: 3724747 - DNA, 19 bp, Homo sapiens
caatggtttgcaaggaagc

SEQ ID NO: 3724748 - DNA, 17 bp, Homo sapiens
caatgtagaaagctttg

SEQ ID NO: 3724749 - DNA, 19 bp, Homo sapiens
caatgtcacaacctctctg

SEQ ID NO: 3724750 - DNA, 14 bp, Homo sapiens
caatgtcaggaaca

SEQ ID NO: 3724751 - DNA, 19 bp, Homo sapiens
caatgtgaaaagaaaaatg

SEQ ID NO: 3724752 - DNA, 15 bp, Homo sapiens
caatgtgataaaacc

SEQ ID NO: 3724753 - DNA, 17 bp, Homo sapiens
caatgtgataaaacccc

SEQ ID NO: 3724754 - DNA, 16 bp, Homo sapiens
caatgtgctactgatt

SEQ ID NO: 3724755 - DNA, 21 bp, Homo sapiens
caatgtggttgcaaggccgct

SEQ ID NO: 3724756 - DNA, 23 bp, Homo sapiens
caatgtttatgcaaggaaggaaa

SEQ ID NO: 3724757 - DNA, 18 bp, Homo sapiens
caatgtttcttttatcac

SEQ ID NO: 3724758 - DNA, 22 bp, Homo sapiens
caattaaatgtaggtatgaata

SEQ ID NO: 3724759 - DNA, 15 bp, Homo sapiens
caattaggaagtgta

SEQ ID NO: 3724760 - DNA, 16 bp, Homo sapiens
caattaggaagtgtaa

SEQ ID NO: 3724761 - DNA, 17 bp, Homo sapiens
caattagtaacattcat

SEQ ID NO: 3724762 - DNA, 14 bp, Homo sapiens
caattcaaaaatgt

SEQ ID NO: 3724763 - DNA, 15 bp, Homo sapiens
caattcaaaaatgta

SEQ ID NO: 3724764 - DNA, 18 bp, Homo sapiens
caattcatcctcactcag

SEQ ID NO: 3724765 - DNA, 16 bp, Homo sapiens
caattcctagataaaa

SEQ ID NO: 3724766 - DNA, 22 bp, Homo sapiens
caattcctagataaaaagatgg

SEQ ID NO: 3724767 - DNA, 13 bp, Homo sapiens
caattcctgggcc

SEQ ID NO: 3724768 - DNA, 16 bp, Homo sapiens
caattcctgggcccca

SEQ ID NO: 3724769 - DNA, 22 bp, Homo sapiens
caattgggatggcgctaggcat

SEQ ID NO: 3724770 - DNA, 14 bp, Homo sapiens
caatttattcaaga

SEQ ID NO: 3724771 - DNA, 22 bp, Homo sapiens
caatttattgcacaaaatataa

SEQ ID NO: 3724772 - DNA, 14 bp, Homo sapiens
caatttattttatt

SEQ ID NO: 3724773 - DNA, 17 bp, Homo sapiens
caatttccaagagctga

SEQ ID NO: 3724774 - DNA, 23 bp, Homo sapiens
caatttgttcagtctttcattta

SEQ ID NO: 3724775 - DNA, 20 bp, Homo sapiens
caattttaacacacataaag

SEQ ID NO: 3724776 - DNA, 18 bp, Homo sapiens
cacaaaagtttctctttt

SEQ ID NO: 3724777 - DNA, 15 bp, Homo sapiens
cacaaaccatgcaaa

SEQ ID NO: 3724778 - DNA, 17 bp, Homo sapiens
cacaaacgggctcagca

SEQ ID NO: 3724779 - DNA, 18 bp, Homo sapiens
cacaaagcccttccatgt

SEQ ID NO: 3724780 - DNA, 18 bp, Homo sapiens
cacaaagcggggggaggg

SEQ ID NO: 3724781 - DNA, 16 bp, Homo sapiens
cacaaaggtataattt

SEQ ID NO: 3724782 - DNA, 17 bp, Homo sapiens
cacaacaaaaatttgaa

SEQ ID NO: 3724783 - DNA, 22 bp, Homo sapiens
cacaacaaaaatttgaaccaaa

SEQ ID NO: 3724784 - DNA, 21 bp, Homo sapiens
cacaacccatctacccctgga

SEQ ID NO: 3724785 - DNA, 17 bp, Homo sapiens
cacaacctctctgatct

SEQ ID NO: 3724786 - DNA, 23 bp, Homo sapiens
cacaacctctctgatcttgtgct

SEQ ID NO: 3724787 - DNA, 18 bp, Homo sapiens
cacaaccttctgtggctc

SEQ ID NO: 3724788 - DNA, 19 bp, Homo sapiens
cacaaccttctgtggctca

SEQ ID NO: 3724789 - DNA, 23 bp, Homo sapiens
cacaaccttctgtggctcacaga

SEQ ID NO: 3724790 - DNA, 23 bp, Homo sapiens
cacaacttaaaaagtctgcatta

SEQ ID NO: 3724791 - DNA, 16 bp, Homo sapiens
caaggagaaacagaga

SEQ ID NO: 3724792 - DNA, 18 bp, Homo sapiens
caaggagaaacagagaca

SEQ ID NO: 3724793 - DNA, 13 bp, Homo sapiens
caaggaggaaaaa

SEQ ID NO: 3724794 - DNA, 12 bp, Homo sapiens
caaggagggaga

SEQ ID NO: 3724795 - DNA, 14 bp, Homo sapiens
caaggatctttcac

SEQ ID NO: 3724796 - DNA, 19 bp, Homo sapiens
caaggattgctactgtcct

SEQ ID NO: 3724797 - DNA, 13 bp, Homo sapiens
caaggcaaggggt

SEQ ID NO: 3724798 - DNA, 20 bp, Homo sapiens
caaggcaaggggtgcctggg

SEQ ID NO: 3724799 - DNA, 16 bp, Homo sapiens
caaggcactgtactag

SEQ ID NO: 3724800 - DNA, 17 bp, Homo sapiens
caaggccagagtggcct

SEQ ID NO: 3724801 - DNA, 19 bp, Homo sapiens
caaggccagagtggcctgg

SEQ ID NO: 3724802 - DNA, 22 bp, Homo sapiens
caaggccagagtggcctggcca

SEQ ID NO: 3724803 - DNA, 23 bp, Homo sapiens
caaggccagcaaggtggagtgga

SEQ ID NO: 3724804 - DNA, 12 bp, Homo sapiens
caaggccccaga

SEQ ID NO: 3724805 - DNA, 14 bp, Homo sapiens
caaggccccagaga

SEQ ID NO: 3724806 - DNA, 16 bp, Homo sapiens
caaggccccagagact

SEQ ID NO: 3724807 - DNA, 17 bp, Homo sapiens
caaggccccagagactc

SEQ ID NO: 3724808 - DNA, 20 bp, Homo sapiens
caaggccgctgttcacccac

SEQ ID NO: 3724809 - DNA, 22 bp, Homo sapiens
caaggccgctgttcacccacag

SEQ ID NO: 3724810 - DNA, 16 bp, Homo sapiens
caaggcctgtccctgg

SEQ ID NO: 3724811 - DNA, 16 bp, Homo sapiens
caaggcgtgaggatgg

SEQ ID NO: 3724812 - DNA, 19 bp, Homo sapiens
caaggctagatcatgaaga

SEQ ID NO: 3724813 - DNA, 20 bp, Homo sapiens
caaggctgaccaagagagaa

SEQ ID NO: 3724814 - DNA, 21 bp, Homo sapiens
caaggctgggggaagaagctc

SEQ ID NO: 3724815 - DNA, 14 bp, Homo sapiens
caagggcagtggag

SEQ ID NO: 3724816 - DNA, 19 bp, Homo sapiens
caagggctgcttcaaactc

SEQ ID NO: 3724817 - DNA, 18 bp, Homo sapiens
caaggggcccaaattctt

SEQ ID NO: 3724818 - DNA, 14 bp, Homo sapiens
caaggggtgcctgg

SEQ ID NO: 3724819 - DNA, 18 bp, Homo sapiens
caaggggtgcctgggaac

SEQ ID NO: 3724820 - DNA, 17 bp, Homo sapiens
caagggtctagggagag

SEQ ID NO: 3724821 - DNA, 20 bp, Homo sapiens
caagggttcagagactcagg

SEQ ID NO: 3724822 - DNA, 15 bp, Homo sapiens
caaggtaaaattcta

SEQ ID NO: 3724823 - DNA, 21 bp, Homo sapiens
caaggtagccctggccagagg

SEQ ID NO: 3724824 - DNA, 17 bp, Homo sapiens
caaggtgctgttgtcat

SEQ ID NO: 3724825 - DNA, 21 bp, Homo sapiens
caaggtggagtggatgcctca

SEQ ID NO: 3724826 - DNA, 22 bp, Homo sapiens
caaggtgggccttgctacctca

SEQ ID NO: 3724827 - DNA, 21 bp, Homo sapiens
caaggtgggctgagccctggc

SEQ ID NO: 3724828 - DNA, 23 bp, Homo sapiens
caaggtgggctgagccctggcag

SEQ ID NO: 3724829 - DNA, 13 bp, Homo sapiens
caagtaagaagac

SEQ ID NO: 3724830 - DNA, 20 bp, Homo sapiens
caagtagatgcctgaacttg

SEQ ID NO: 3724831 - DNA, 15 bp, Homo sapiens
caagtagctttccac

SEQ ID NO: 3724832 - DNA, 19 bp, Homo sapiens
caagtatgaataaagacac

SEQ ID NO: 3724833 - DNA, 17 bp, Homo sapiens
caagtatgttttagcat

SEQ ID NO: 3724834 - DNA, 14 bp, Homo sapiens
caagtcacaaagga

SEQ ID NO: 3724835 - DNA, 20 bp, Homo sapiens
caagtcagctttgccttcca

SEQ ID NO: 3724836 - DNA, 12 bp, Homo sapiens
caagtcatttta

SEQ ID NO: 3724837 - DNA, 23 bp, Homo sapiens
caagtcccaccggttgcttctgg

SEQ ID NO: 3724838 - DNA, 13 bp, Homo sapiens
caagtcctggcta

SEQ ID NO: 3724839 - DNA, 22 bp, Homo sapiens
caagtcctggctacatcccagc

SEQ ID NO: 3724840 - DNA, 15 bp, Homo sapiens
caagtccttacctct

SEQ ID NO: 3724841 - DNA, 23 bp, Homo sapiens
caagtccttacctcttccggaga

SEQ ID NO: 3724842 - DNA, 14 bp, Homo sapiens
caagtctccttccc

SEQ ID NO: 3724843 - DNA, 17 bp, Homo sapiens
caagtctccttcccctt

SEQ ID NO: 3724844 - DNA, 19 bp, Homo sapiens
caagtctctgctggcccag

SEQ ID NO: 3724845 - DNA, 22 bp, Homo sapiens
caagtctctgctggcccagcca

SEQ ID NO: 3724846 - DNA, 13 bp, Homo sapiens
caagtctggatct

SEQ ID NO: 3724847 - DNA, 16 bp, Homo sapiens
caagtctgtgcctgga

SEQ ID NO: 3724848 - DNA, 17 bp, Homo sapiens
caagtctgtgcctggag

SEQ ID NO: 3724849 - DNA, 13 bp, Homo sapiens
caagtgaatctaa

SEQ ID NO: 3724850 - DNA, 19 bp, Homo sapiens
caagtgaatttttctctaa

SEQ ID NO: 3724851 - DNA, 15 bp, Homo sapiens
caagtgacatctctt

SEQ ID NO: 3724852 - DNA, 19 bp, Homo sapiens
caagtgactgtatctgtgt

SEQ ID NO: 3724853 - DNA, 21 bp, Homo sapiens
caagtgactgtatctgtgtag

SEQ ID NO: 3724854 - DNA, 17 bp, Homo sapiens
caagtgagagctgggtg

SEQ ID NO: 3724855 - DNA, 20 bp, Homo sapiens
caagtgagcaaacctgcccc

SEQ ID NO: 3724856 - DNA, 17 bp, Homo sapiens
caagtgattctcctgcc

SEQ ID NO: 3724857 - DNA, 18 bp, Homo sapiens
caagtgattctcctgcct

SEQ ID NO: 3724858 - DNA, 13 bp, Homo sapiens
caagtgcaggctg

SEQ ID NO: 3724859 - DNA, 19 bp, Homo sapiens
caagtgcatgctctctgca

SEQ ID NO: 3724860 - DNA, 22 bp, Homo sapiens
caagtgccactgcccgagctgg

SEQ ID NO: 3724861 - DNA, 16 bp, Homo sapiens
caagtgcctgctttta

SEQ ID NO: 3724862 - DNA, 19 bp, Homo sapiens
caagtggcatgtgctgtga

SEQ ID NO: 3724863 - DNA, 13 bp, Homo sapiens
caagtgggggcag

SEQ ID NO: 3724864 - DNA, 22 bp, Homo sapiens
caagtgtatgcacgtgtgcaca

SEQ ID NO: 3724865 - DNA, 15 bp, Homo sapiens
attttgcagcagtga

SEQ ID NO: 3724866 - DNA, 23 bp, Homo sapiens
attttgcctaatacattaaagca

SEQ ID NO: 3724867 - DNA, 20 bp, Homo sapiens
attttgctaaatgtgaatga

SEQ ID NO: 3724868 - DNA, 20 bp, Homo sapiens
attttggaagttttcaggac

SEQ ID NO: 3724869 - DNA, 22 bp, Homo sapiens
attttggggtacccactgctct

SEQ ID NO: 3724870 - DNA, 23 bp, Homo sapiens
attttggggtacccactgctctg

SEQ ID NO: 3724871 - DNA, 19 bp, Homo sapiens
attttgggttttgggtctt

SEQ ID NO: 3724872 - DNA, 22 bp, Homo sapiens
attttggtaaaatacttcttga

SEQ ID NO: 3724873 - DNA, 20 bp, Homo sapiens
attttgtaaactcaaaatat

SEQ ID NO: 3724874 - DNA, 18 bp, Homo sapiens
attttgtaacgaagacac

SEQ ID NO: 3724875 - DNA, 15 bp, Homo sapiens
attttgtaattttct

SEQ ID NO: 3724876 - DNA, 18 bp, Homo sapiens
attttgtaattttcttga

SEQ ID NO: 3724877 - DNA, 20 bp, Homo sapiens
attttgtaattttcttgatg

SEQ ID NO: 3724878 - DNA, 20 bp, Homo sapiens
attttgtggctttctttctt

SEQ ID NO: 3724879 - DNA, 19 bp, Homo sapiens
attttgttgctgttttgat

SEQ ID NO: 3724880 - DNA, 21 bp, Homo sapiens
attttgtttttgtcttaaaaa

SEQ ID NO: 3724881 - DNA, 13 bp, Homo sapiens
atttttaaagctt

SEQ ID NO: 3724882 - DNA, 20 bp, Homo sapiens
atttttacctttttccttcc

SEQ ID NO: 3724883 - DNA, 14 bp, Homo sapiens
atttttagacagag

SEQ ID NO: 3724884 - DNA, 12 bp, Homo sapiens
atttttatacag

SEQ ID NO: 3724885 - DNA, 17 bp, Homo sapiens
atttttattatgcataa

SEQ ID NO: 3724886 - DNA, 14 bp, Homo sapiens
atttttatttcaaa

SEQ ID NO: 3724887 - DNA, 18 bp, Homo sapiens
atttttcagatgcttctg

SEQ ID NO: 3724888 - DNA, 19 bp, Homo sapiens
atttttcattgatatgaaa

SEQ ID NO: 3724889 - DNA, 18 bp, Homo sapiens
atttttggattgacagta

SEQ ID NO: 3724890 - DNA, 19 bp, Homo sapiens
atttttgtagagccagggt

SEQ ID NO: 3724891 - DNA, 20 bp, Homo sapiens
atttttgtgaaatgaaaaca

SEQ ID NO: 3724892 - DNA, 22 bp, Homo sapiens
atttttgttggagccactctgt

SEQ ID NO: 3724893 - DNA, 15 bp, Homo sapiens
attttttaaaacaag

SEQ ID NO: 3724894 - DNA, 20 bp, Homo sapiens
attttttaagtatttatata

SEQ ID NO: 3724895 - DNA, 22 bp, Homo sapiens
attttttaagtatttatatatt

SEQ ID NO: 3724896 - DNA, 12 bp, Homo sapiens
attttttaatta

SEQ ID NO: 3724897 - DNA, 14 bp, Homo sapiens
attttttaattatt

SEQ ID NO: 3724898 - DNA, 15 bp, Homo sapiens
attttttattcttgt

SEQ ID NO: 3724899 - DNA, 13 bp, Homo sapiens
attttttcagaaa

SEQ ID NO: 3724900 - DNA, 20 bp, Homo sapiens
attttttcgtgcactctgct

SEQ ID NO: 3724901 - DNA, 15 bp, Homo sapiens
atttttttaaaatca

SEQ ID NO: 3724902 - DNA, 18 bp, Homo sapiens
atttttttaaaatcacta

SEQ ID NO: 3724903 - DNA, 15 bp, Homo sapiens
atttttttcaatatt

SEQ ID NO: 3724904 - DNA, 13 bp, Homo sapiens
atttttttctctc

SEQ ID NO: 3724905 - DNA, 15 bp, Homo sapiens
atttttttttagaac

SEQ ID NO: 3724906 - DNA, 17 bp, Homo sapiens
atttttttttcctagcc

SEQ ID NO: 3724907 - DNA, 12 bp, Homo sapiens
caaaaaacaata

SEQ ID NO: 3724908 - DNA, 23 bp, Homo sapiens
caaaaaacaatatttattgtatt

SEQ ID NO: 3724909 - DNA, 18 bp, Homo sapiens
caaaaaattagccgggcg

SEQ ID NO: 3724910 - DNA, 13 bp, Homo sapiens
caaaaacagcctc

SEQ ID NO: 3724911 - DNA, 18 bp, Homo sapiens
caaaaagaatctgcattt

SEQ ID NO: 3724912 - DNA, 19 bp, Homo sapiens
caaaaagaatctgcattta

SEQ ID NO: 3724913 - DNA, 23 bp, Homo sapiens
caaaaagaatctgcatttagcac

SEQ ID NO: 3724914 - DNA, 21 bp, Homo sapiens
caaaaagacacttgatacttg

SEQ ID NO: 3724915 - DNA, 14 bp, Homo sapiens
caaaaagcttcccc

SEQ ID NO: 3724916 - DNA, 13 bp, Homo sapiens
caaaaaggcagga

SEQ ID NO: 3724917 - DNA, 17 bp, Homo sapiens
caaaaatactctaattc

SEQ ID NO: 3724918 - DNA, 20 bp, Homo sapiens
caaaaatactctaattctaa

SEQ ID NO: 3724919 - DNA, 14 bp, Homo sapiens
caaaaatgtacaaa

SEQ ID NO: 3724920 - DNA, 22 bp, Homo sapiens
caaaaatttgaaccaaaacatt

SEQ ID NO: 3724921 - DNA, 21 bp, Homo sapiens
caaaacagtattgacttgtat

SEQ ID NO: 3724922 - DNA, 18 bp, Homo sapiens
caaaaccacagccctgtc

SEQ ID NO: 3724923 - DNA, 17 bp, Homo sapiens
caaaaccattgcttcac

SEQ ID NO: 3724924 - DNA, 18 bp, Homo sapiens
caaaacctgatgttaaaa

SEQ ID NO: 3724925 - DNA, 23 bp, Homo sapiens
atttctgagaaggtccttaatga

SEQ ID NO: 3724926 - DNA, 17 bp, Homo sapiens
atttctgattttatgta

SEQ ID NO: 3724927 - DNA, 19 bp, Homo sapiens
atttctgattttatgtaaa

SEQ ID NO: 3724928 - DNA, 13 bp, Homo sapiens
atttctgtgggag

SEQ ID NO: 3724929 - DNA, 13 bp, Homo sapiens
atttctgtgtcta

SEQ ID NO: 3724930 - DNA, 11 bp, Homo sapiens
atttcttatag

SEQ ID NO: 3724931 - DNA, 21 bp, Homo sapiens
atttcttgagttttgttttaa

SEQ ID NO: 3724932 - DNA, 14 bp, Homo sapiens
atttcttgggccct

SEQ ID NO: 3724933 - DNA, 20 bp, Homo sapiens
atttgaagacaaaaatactc

SEQ ID NO: 3724934 - DNA, 13 bp, Homo sapiens
atttgagacattc

SEQ ID NO: 3724935 - DNA, 15 bp, Homo sapiens
atttgagcagggctc

SEQ ID NO: 3724936 - DNA, 12 bp, Homo sapiens
atttgagtgttt

SEQ ID NO: 3724937 - DNA, 20 bp, Homo sapiens
atttgagttaacctttaaga

SEQ ID NO: 3724938 - DNA, 23 bp, Homo sapiens
atttgatcgttccagttcccact

SEQ ID NO: 3724939 - DNA, 16 bp, Homo sapiens
atttgatgaaagctga

SEQ ID NO: 3724940 - DNA, 21 bp, Homo sapiens
atttgatgaaagctgattact

SEQ ID NO: 3724941 - DNA, 15 bp, Homo sapiens
atttgcagagacagg

SEQ ID NO: 3724942 - DNA, 22 bp, Homo sapiens
atttgcagagacaggacctgac

SEQ ID NO: 3724943 - DNA, 14 bp, Homo sapiens
atttgccaaaataa

SEQ ID NO: 3724944 - DNA, 20 bp, Homo sapiens
atttgccaaaataatgtctt

SEQ ID NO: 3724945 - DNA, 19 bp, Homo sapiens
atttgcccatttacacttt

SEQ ID NO: 3724946 - DNA, 18 bp, Homo sapiens
atttgcgcacaacttaaa

SEQ ID NO: 3724947 - DNA, 12 bp, Homo sapiens
atttggaaaata

SEQ ID NO: 3724948 - DNA, 15 bp, Homo sapiens
atttggaattctgtt

SEQ ID NO: 3724949 - DNA, 16 bp, Homo sapiens
atttggcctgcactaa

SEQ ID NO: 3724950 - DNA, 21 bp, Homo sapiens
atttggggtagctagaggaac

SEQ ID NO: 3724951 - DNA, 16 bp, Homo sapiens
atttgggtaaatcatg

SEQ ID NO: 3724952 - DNA, 16 bp, Homo sapiens
atttgggtggtaagag

SEQ ID NO: 3724953 - DNA, 14 bp, Homo sapiens
atttgtaataaagt

SEQ ID NO: 3724954 - DNA, 23 bp, Homo sapiens
atttgtactgaaaaatggtaatt

SEQ ID NO: 3724955 - DNA, 13 bp, Homo sapiens
atttgtcaacaaa

SEQ ID NO: 3724956 - DNA, 22 bp, Homo sapiens
atttgtcacagaaatcagagga

SEQ ID NO: 3724957 - DNA, 21 bp, Homo sapiens
atttgtcattttgaagctaat

SEQ ID NO: 3724958 - DNA, 16 bp, Homo sapiens
atttgtgtaataaagt

SEQ ID NO: 3724959 - DNA, 20 bp, Homo sapiens
atttgtgtaataaagtgttt

SEQ ID NO: 3724960 - DNA, 12 bp, Homo sapiens
atttgtgtgtgt

SEQ ID NO: 3724961 - DNA, 16 bp, Homo sapiens
atttgttaaatattta

SEQ ID NO: 3724962 - DNA, 12 bp, Homo sapiens
atttgttaatgg

SEQ ID NO: 3724963 - DNA, 16 bp, Homo sapiens
atttgttattcttaag

SEQ ID NO: 3724964 - DNA, 20 bp, Homo sapiens
atttgttgttctttcagaaa

SEQ ID NO: 3724965 - DNA, 11 bp, Homo sapiens
attttaaatta

SEQ ID NO: 3724966 - DNA, 14 bp, Homo sapiens
attttaaattataa

SEQ ID NO: 3724967 - DNA, 19 bp, Homo sapiens
attttaaattataaggact

SEQ ID NO: 3724968 - DNA, 21 bp, Homo sapiens
attttaaattataaggactgc

SEQ ID NO: 3724969 - DNA, 23 bp, Homo sapiens
attttaaattataaggactgcat

SEQ ID NO: 3724970 - DNA, 16 bp, Homo sapiens
attttaaattcacaat

SEQ ID NO: 3724971 - DNA, 14 bp, Homo sapiens
attttaacaataac

SEQ ID NO: 3724972 - DNA, 15 bp, Homo sapiens
attttaacaataact

SEQ ID NO: 3724973 - DNA, 16 bp, Homo sapiens
attttaacaataacta

SEQ ID NO: 3724974 - DNA, 14 bp, Homo sapiens
attttaacacacat

SEQ ID NO: 3724975 - DNA, 21 bp, Homo sapiens
attttaacacacataaaggat

SEQ ID NO: 3724976 - DNA, 13 bp, Homo sapiens
attttaacatgga

SEQ ID NO: 3724977 - DNA, 19 bp, Homo sapiens
attttaactttatcacatt

SEQ ID NO: 3724978 - DNA, 16 bp, Homo sapiens
attttaagattccttt

SEQ ID NO: 3724979 - DNA, 14 bp, Homo sapiens
attttaagtgcttt

SEQ ID NO: 3724980 - DNA, 16 bp, Homo sapiens
attttaagtgctttgt

SEQ ID NO: 3724981 - DNA, 15 bp, Homo sapiens
caacctgtaagactg

SEQ ID NO: 3724982 - DNA, 14 bp, Homo sapiens
caacctgtgatcaa

SEQ ID NO: 3724983 - DNA, 18 bp, Homo sapiens
caacctgtgatcaagcaa

SEQ ID NO: 3724984 - DNA, 18 bp, Homo sapiens
caacgaaaagcacatcca

SEQ ID NO: 3724985 - DNA, 22 bp, Homo sapiens
caacgaaaagcacatccaggca

SEQ ID NO: 3724986 - DNA, 14 bp, Homo sapiens
caacgaagaaaaaa

SEQ ID NO: 3724987 - DNA, 13 bp, Homo sapiens
caacgacaaagcc

SEQ ID NO: 3724988 - DNA, 13 bp, Homo sapiens
caacgaggaagcc

SEQ ID NO: 3724989 - DNA, 12 bp, Homo sapiens
caacgcagccct

SEQ ID NO: 3724990 - DNA, 15 bp, Homo sapiens
caacgcagccctgct

SEQ ID NO: 3724991 - DNA, 13 bp, Homo sapiens
caacgtggcccag

SEQ ID NO: 3724992 - DNA, 19 bp, Homo sapiens
caacgtggcccagagaagc

SEQ ID NO: 3724993 - DNA, 22 bp, Homo sapiens
caactaacaagaaactcacccc

SEQ ID NO: 3724994 - DNA, 18 bp, Homo sapiens
caactatattatcatgca

SEQ ID NO: 3724995 - DNA, 18 bp, Homo sapiens
caactatgatttggaaaa

SEQ ID NO: 3724996 - DNA, 23 bp, Homo sapiens
caactcagtccctaaaaacacag

SEQ ID NO: 3724997 - DNA, 22 bp, Homo sapiens
caactccagtactggagcttct

SEQ ID NO: 3724998 - DNA, 21 bp, Homo sapiens
caactcctggaagctgtgtcc

SEQ ID NO: 3724999 - DNA, 21 bp, Homo sapiens
caactcttccccctctcccag

SEQ ID NO: 3725000 - DNA, 14 bp, Homo sapiens
caactgaaagtgtt

SEQ ID NO: 3725001 - DNA, 14 bp, Homo sapiens
caactgaacaaaaa

SEQ ID NO: 3725002 - DNA, 13 bp, Homo sapiens
caactgaggcaga

SEQ ID NO: 3725003 - DNA, 16 bp, Homo sapiens
caactgaggcagacag

SEQ ID NO: 3725004 - DNA, 17 bp, Homo sapiens
caactgaggcagacagc

SEQ ID NO: 3725005 - DNA, 20 bp, Homo sapiens
caactgaggcagacagcagc

SEQ ID NO: 3725006 - DNA, 21 bp, Homo sapiens
caactgaggcagacagcagct

SEQ ID NO: 3725007 - DNA, 22 bp, Homo sapiens
caactgaggcagacagcagctc

SEQ ID NO: 3725008 - DNA, 16 bp, Homo sapiens
caactgcattggcttt

SEQ ID NO: 3725009 - DNA, 21 bp, Homo sapiens
caactgtctcctacctctgct

SEQ ID NO: 3725010 - DNA, 17 bp, Homo sapiens
caacttcaagtgcatgc

SEQ ID NO: 3725011 - DNA, 14 bp, Homo sapiens
caacttctaattgc

SEQ ID NO: 3725012 - DNA, 20 bp, Homo sapiens
caacttgagcatgttactga

SEQ ID NO: 3725013 - DNA, 12 bp, Homo sapiens
caacttgggaac

SEQ ID NO: 3725014 - DNA, 16 bp, Homo sapiens
caacttgtaaatgtgg

SEQ ID NO: 3725015 - DNA, 23 bp, Homo sapiens
caacttgtattaaagacagaggc

SEQ ID NO: 3725016 - DNA, 19 bp, Homo sapiens
caacttgtctttttctgga

SEQ ID NO: 3725017 - DNA, 19 bp, Homo sapiens
caactttagcagaatcaaa

SEQ ID NO: 3725018 - DNA, 19 bp, Homo sapiens
caagaaactgaggaatttt

SEQ ID NO: 3725019 - DNA, 15 bp, Homo sapiens
caagaaagaaacccg

SEQ ID NO: 3725020 - DNA, 22 bp, Homo sapiens
caagaaagaaacccgacagagg

SEQ ID NO: 3725021 - DNA, 13 bp, Homo sapiens
caagaaaggagag

SEQ ID NO: 3725022 - DNA, 14 bp, Homo sapiens
caagaaagtttccc

SEQ ID NO: 3725023 - DNA, 13 bp, Homo sapiens
caagaacagcagg

SEQ ID NO: 3725024 - DNA, 17 bp, Homo sapiens
caagaactgaaaacata

SEQ ID NO: 3725025 - DNA, 13 bp, Homo sapiens
caagaactgcatg

SEQ ID NO: 3725026 - DNA, 19 bp, Homo sapiens
caagaactgcatggaccta

SEQ ID NO: 3725027 - DNA, 23 bp, Homo sapiens
caagaagggttttccaccctgga

SEQ ID NO: 3725028 - DNA, 19 bp, Homo sapiens
caagaattctccaaaacaa

SEQ ID NO: 3725029 - DNA, 22 bp, Homo sapiens
caagaattgaagcaggactaaa

SEQ ID NO: 3725030 - DNA, 15 bp, Homo sapiens
caagacacatcccta

SEQ ID NO: 3725031 - DNA, 18 bp, Homo sapiens
caagacagagacgcagga

SEQ ID NO: 3725032 - DNA, 21 bp, Homo sapiens
caagacagagacgcaggaatg

SEQ ID NO: 3725033 - DNA, 22 bp, Homo sapiens
caagacagagacgcaggaatgg

SEQ ID NO: 3725034 - DNA, 13 bp, Homo sapiens
caagacctgactc

SEQ ID NO: 3725035 - DNA, 14 bp, Homo sapiens
caagacctgactca

SEQ ID NO: 3725036 - DNA, 18 bp, Homo sapiens
caagacttgaaggtgcct

SEQ ID NO: 3725037 - DNA, 17 bp, Homo sapiens
caagacttttctttgaa

SEQ ID NO: 3725038 - DNA, 18 bp, Homo sapiens
caagacttttctttgaag

SEQ ID NO: 3725039 - DNA, 13 bp, Homo sapiens
caagagagaaaga

SEQ ID NO: 3725040 - DNA, 17 bp, Homo sapiens
caagagagaaagaagta

SEQ ID NO: 3725041 - DNA, 15 bp, Homo sapiens
caagagagatgtttt

SEQ ID NO: 3725042 - DNA, 14 bp, Homo sapiens
caagagcagcctgt

SEQ ID NO: 3725043 - DNA, 16 bp, Homo sapiens
caagagcagcctgtgg

SEQ ID NO: 3725044 - DNA, 17 bp, Homo sapiens
caagagcagcctgtggc

SEQ ID NO: 3725045 - DNA, 22 bp, Homo sapiens
caagagccttggtgtccacctg

SEQ ID NO: 3725046 - DNA, 18 bp, Homo sapiens
caagagttttcttccttg

SEQ ID NO: 3725047 - DNA, 16 bp, Homo sapiens
caagataaaggacagt

SEQ ID NO: 3725048 - DNA, 18 bp, Homo sapiens
caagatgccatctgtgtc

SEQ ID NO: 3725049 - DNA, 19 bp, Homo sapiens
caagatgcttttcaaactg

SEQ ID NO: 3725050 - DNA, 19 bp, Homo sapiens
caagatgtcctccttgttc

SEQ ID NO: 3725051 - DNA, 19 bp, Homo sapiens
caagattcccagagacagg

SEQ ID NO: 3725052 - DNA, 20 bp, Homo sapiens
caaagcacgaaatgttattt

SEQ ID NO: 3725053 - DNA, 17 bp, Homo sapiens
caaagcattgagcaaag

SEQ ID NO: 3725054 - DNA, 22 bp, Homo sapiens
caaagccaaactctgccagcca

SEQ ID NO: 3725055 - DNA, 21 bp, Homo sapiens
caaagccaaagctaggcctgg

SEQ ID NO: 3725056 - DNA, 16 bp, Homo sapiens
caaagccagaagctga

SEQ ID NO: 3725057 - DNA, 17 bp, Homo sapiens
caaagcggggggagggt

SEQ ID NO: 3725058 - DNA, 18 bp, Homo sapiens
caaagctaggcctggcca

SEQ ID NO: 3725059 - DNA, 17 bp, Homo sapiens
caaagctgctaaatctc

SEQ ID NO: 3725060 - DNA, 15 bp, Homo sapiens
caaagctttcctgga

SEQ ID NO: 3725061 - DNA, 16 bp, Homo sapiens
caaagctttttccaga

SEQ ID NO: 3725062 - DNA, 22 bp, Homo sapiens
caaaggaaaatagtaatgtttt

SEQ ID NO: 3725063 - DNA, 23 bp, Homo sapiens
caaaggactgttttttcctgagc

SEQ ID NO: 3725064 - DNA, 20 bp, Homo sapiens
caaaggagggtcaggaagga

SEQ ID NO: 3725065 - DNA, 23 bp, Homo sapiens
caaaggcgcagtgcttctctaca

SEQ ID NO: 3725066 - DNA, 21 bp, Homo sapiens
caaagggtgaagctatttatc

SEQ ID NO: 3725067 - DNA, 11 bp, Homo sapiens
caaaggttttc

SEQ ID NO: 3725068 - DNA, 16 bp, Homo sapiens
caaagtaaaacttgct

SEQ ID NO: 3725069 - DNA, 22 bp, Homo sapiens
caaagtagaagtcttagatgta

SEQ ID NO: 3725070 - DNA, 19 bp, Homo sapiens
caaagtgctgggattacag

SEQ ID NO: 3725071 - DNA, 16 bp, Homo sapiens
caaagtggaaggaaag

SEQ ID NO: 3725072 - DNA, 22 bp, Homo sapiens
caaagttccctacttcctgtga

SEQ ID NO: 3725073 - DNA, 20 bp, Homo sapiens
caaatactgatggtgcattt

SEQ ID NO: 3725074 - DNA, 17 bp, Homo sapiens
caaatacttattcattg

SEQ ID NO: 3725075 - DNA, 21 bp, Homo sapiens
caaatacttattcattgtggt

SEQ ID NO: 3725076 - DNA, 12 bp, Homo sapiens
caaatagaaaac

SEQ ID NO: 3725077 - DNA, 17 bp, Homo sapiens
caaatagaaaacaggaa

SEQ ID NO: 3725078 - DNA, 17 bp, Homo sapiens
caaatattccagagact

SEQ ID NO: 3725079 - DNA, 16 bp, Homo sapiens
caaatatttattttct

SEQ ID NO: 3725080 - DNA, 24 bp, Homo sapiens
caaatcaagtttccaagcaaatgt

SEQ ID NO: 3725081 - DNA, 17 bp, Homo sapiens
caaatcagctgctacta

SEQ ID NO: 3725082 - DNA, 21 bp, Homo sapiens
caaatctgcctattgcagctg

SEQ ID NO: 3725083 - DNA, 22 bp, Homo sapiens
caaatgaccagcagattcaaat

SEQ ID NO: 3725084 - DNA, 20 bp, Homo sapiens
caaatgagatctaagccttt

SEQ ID NO: 3725085 - DNA, 18 bp, Homo sapiens
caaatgctgcgcccttcc

SEQ ID NO: 3725086 - DNA, 15 bp, Homo sapiens
caaatgctgtattct

SEQ ID NO: 3725087 - DNA, 21 bp, Homo sapiens
caaatgtaattgaataaagtt

SEQ ID NO: 3725088 - DNA, 19 bp, Homo sapiens
caaatgtcctccagaagcc

SEQ ID NO: 3725089 - DNA, 17 bp, Homo sapiens
caaatgtggcatttgtg

SEQ ID NO: 3725090 - DNA, 14 bp, Homo sapiens
caaatgttacatag

SEQ ID NO: 3725091 - DNA, 21 bp, Homo sapiens
caaatgttatgcataaagtca

SEQ ID NO: 3725092 - DNA, 18 bp, Homo sapiens
caaattaggttttgtaca

SEQ ID NO: 3725093 - DNA, 20 bp, Homo sapiens
caaattaggttttgtacaat

SEQ ID NO: 3725094 - DNA, 17 bp, Homo sapiens
caaattatcaagctaat

SEQ ID NO: 3725095 - DNA, 21 bp, Homo sapiens
caaattatcaagctaataaaa

SEQ ID NO: 3725096 - DNA, 20 bp, Homo sapiens
caaattcccagatttgaaga

SEQ ID NO: 3725097 - DNA, 18 bp, Homo sapiens
caaattccctcctccctt

SEQ ID NO: 3725098 - DNA, 14 bp, Homo sapiens
caaattctgtttct

SEQ ID NO: 3725099 - DNA, 19 bp, Homo sapiens
caaattgtatctagtgcag

SEQ ID NO: 3725100 - DNA, 13 bp, Homo sapiens
caaatttataatt

SEQ ID NO: 3725101 - DNA, 15 bp, Homo sapiens
caaatttataatttt

SEQ ID NO: 3725102 - DNA, 13 bp, Homo sapiens
caaattttggcca

SEQ ID NO: 3725103 - DNA, 15 bp, Homo sapiens
caaattttggccaaa

SEQ ID NO: 3725104 - DNA, 10 bp, Homo sapiens
caacaaaaat

SEQ ID NO: 3725105 - DNA, 19 bp, Homo sapiens
caacaaattaggttttgta

SEQ ID NO: 3725106 - DNA, 21 bp, Homo sapiens
caacaacatgtataatatttt

SEQ ID NO: 3725107 - DNA, 23 bp, Homo sapiens
caacaccttcagaggctgaggtg

SEQ ID NO: 3725108 - DNA, 15 bp, Homo sapiens
caacacttcagactg

SEQ ID NO: 3725109 - DNA, 19 bp, Homo sapiens
caacacttcagactgcaag

SEQ ID NO: 3725110 - DNA, 19 bp, Homo sapiens
caacagagtgagaccctgt

SEQ ID NO: 3725111 - DNA, 17 bp, Homo sapiens
caacagatactggaagt

SEQ ID NO: 3725112 - DNA, 15 bp, Homo sapiens
caacagctcaagtct

SEQ ID NO: 3725113 - DNA, 14 bp, Homo sapiens
caacaggaactgtg

SEQ ID NO: 3725114 - DNA, 12 bp, Homo sapiens
caacaggctggg

SEQ ID NO: 3725115 - DNA, 14 bp, Homo sapiens
caacaggctgggct

SEQ ID NO: 3725116 - DNA, 23 bp, Homo sapiens
caacaggctgggcttcagtggca

SEQ ID NO: 3725117 - DNA, 10 bp, Homo sapiens
cccaaagtgg

SEQ ID NO: 3725118 - DNA, 20 bp, Homo sapiens
cccaaattatcaagctaata

SEQ ID NO: 3725119 - DNA, 12 bp, Homo sapiens
cccaacccccac

SEQ ID NO: 3725120 - DNA, 12 bp, Homo sapiens
cccaacctcagc

SEQ ID NO: 3725121 - DNA, 19 bp, Homo sapiens
cccaacgaaaagcacatcc

SEQ ID NO: 3725122 - DNA, 17 bp, Homo sapiens
cccaactcctggaagct

SEQ ID NO: 3725123 - DNA, 21 bp, Homo sapiens
cccaactgcaagtcacaaagg

SEQ ID NO: 3725124 - DNA, 12 bp, Homo sapiens
cccaactgttat

SEQ ID NO: 3725125 - DNA, 20 bp, Homo sapiens
cccaagaatagatgctgact

SEQ ID NO: 3725126 - DNA, 12 bp, Homo sapiens
cccaagctctgc

SEQ ID NO: 3725127 - DNA, 22 bp, Homo sapiens
cccaagctggagtgcagtggtg

SEQ ID NO: 3725128 - DNA, 22 bp, Homo sapiens
cccaaggaaagccccagcacta

SEQ ID NO: 3725129 - DNA, 15 bp, Homo sapiens
cccaaggaggaaaaa

SEQ ID NO: 3725130 - DNA, 21 bp, Homo sapiens
cccaaggcaaggggtgcctgg

SEQ ID NO: 3725131 - DNA, 22 bp, Homo sapiens
cccaaggcaaggggtgcctggg

SEQ ID NO: 3725132 - DNA, 17 bp, Homo sapiens
cccaaggggtttctgtt

SEQ ID NO: 3725133 - DNA, 15 bp, Homo sapiens
cccaagtgccagtct

SEQ ID NO: 3725134 - DNA, 18 bp, Homo sapiens
cccaagtgccagtcttgt

SEQ ID NO: 3725135 - DNA, 14 bp, Homo sapiens
cccaagtgggggca

SEQ ID NO: 3725136 - DNA, 19 bp, Homo sapiens
cccaagtgggggcagaggg

SEQ ID NO: 3725137 - DNA, 11 bp, Homo sapiens
cccaatattat

SEQ ID NO: 3725138 - DNA, 15 bp, Homo sapiens
cccaatattataatt

SEQ ID NO: 3725139 - DNA, 14 bp, Homo sapiens
cccaattaggaagt

SEQ ID NO: 3725140 - DNA, 16 bp, Homo sapiens
cccacacctggccctg

SEQ ID NO: 3725141 - DNA, 23 bp, Homo sapiens
cccacacggaggcatctgcaccc

SEQ ID NO: 3725142 - DNA, 19 bp, Homo sapiens
cccacacttgttccagctc

SEQ ID NO: 3725143 - DNA, 19 bp, Homo sapiens
cccacagaggtgctgtaga

SEQ ID NO: 3725144 - DNA, 17 bp, Homo sapiens
cccacagctcccacccc

SEQ ID NO: 3725145 - DNA, 19 bp, Homo sapiens
cccacagctcccaccccac

SEQ ID NO: 3725146 - DNA, 13 bp, Homo sapiens
cccacaggatcag

SEQ ID NO: 3725147 - DNA, 16 bp, Homo sapiens
cccacaggcccttcct

SEQ ID NO: 3725148 - DNA, 18 bp, Homo sapiens
cccacatgtgtccatccc

SEQ ID NO: 3725149 - DNA, 21 bp, Homo sapiens
cccaccaacatcccattgccc

SEQ ID NO: 3725150 - DNA, 18 bp, Homo sapiens
cccaccaccccagctgct

SEQ ID NO: 3725151 - DNA, 21 bp, Homo sapiens
cccaccacctaggccactcct

SEQ ID NO: 3725152 - DNA, 22 bp, Homo sapiens
cccaccacctaggccactcctc

SEQ ID NO: 3725153 - DNA, 13 bp, Homo sapiens
cccaccaggctgc

SEQ ID NO: 3725154 - DNA, 21 bp, Homo sapiens
cccacccagcacccagcaact

SEQ ID NO: 3725155 - DNA, 19 bp, Homo sapiens
cccacccccttctctgctc

SEQ ID NO: 3725156 - DNA, 13 bp, Homo sapiens
cccaccccttccc

SEQ ID NO: 3725157 - DNA, 23 bp, Homo sapiens
cccaccggttgcttctgggaagg

SEQ ID NO: 3725158 - DNA, 22 bp, Homo sapiens
cccaccgtaaagtgagcatgct

SEQ ID NO: 3725159 - DNA, 12 bp, Homo sapiens
cccacctcagcc

SEQ ID NO: 3725160 - DNA, 14 bp, Homo sapiens
cccacctcagcctc

SEQ ID NO: 3725161 - DNA, 17 bp, Homo sapiens
cccacctcagcctcccg

SEQ ID NO: 3725162 - DNA, 15 bp, Homo sapiens
cccacctgagctttg

SEQ ID NO: 3725163 - DNA, 23 bp, Homo sapiens
cccacctgccactaggctgggtg

SEQ ID NO: 3725164 - DNA, 20 bp, Homo sapiens
cccacctgcccatcacaggg

SEQ ID NO: 3725165 - DNA, 13 bp, Homo sapiens
cccacctgctgag

SEQ ID NO: 3725166 - DNA, 19 bp, Homo sapiens
cccacctgctgagagaccc

SEQ ID NO: 3725167 - DNA, 23 bp, Homo sapiens
cccacctgtcaaacaaagccaga

SEQ ID NO: 3725168 - DNA, 21 bp, Homo sapiens
cccaccttcaattcctgggcc

SEQ ID NO: 3725169 - DNA, 22 bp, Homo sapiens
cccaccttcaattcctgggccc

SEQ ID NO: 3725170 - DNA, 12 bp, Homo sapiens
cccaccttggct

SEQ ID NO: 3725171 - DNA, 17 bp, Homo sapiens
cccaccttggctgcagg

SEQ ID NO: 3725172 - DNA, 19 bp, Homo sapiens
cccaccttggctgcaggga

SEQ ID NO: 3725173 - DNA, 20 bp, Homo sapiens
cccaccttggctgcagggag

SEQ ID NO: 3725174 - DNA, 19 bp, Homo sapiens
cccacgctggagtgcagtg

SEQ ID NO: 3725175 - DNA, 20 bp, Homo sapiens
cccacgctggagtgcagtga

SEQ ID NO: 3725176 - DNA, 22 bp, Homo sapiens
cccacggaaaatgccaatctct

SEQ ID NO: 3725177 - DNA, 16 bp, Homo sapiens
cccactcaagccaagc

SEQ ID NO: 3725178 - DNA, 19 bp, Homo sapiens
cccactcaagccaagcagc

SEQ ID NO: 3725179 - DNA, 12 bp, Homo sapiens
cccactcacaga

SEQ ID NO: 3725180 - DNA, 17 bp, Homo sapiens
cccactccccaccttca

SEQ ID NO: 3725181 - DNA, 20 bp, Homo sapiens
cccactccctggctctcaga

SEQ ID NO: 3725182 - DNA, 14 bp, Homo sapiens
cccactctcattcc

SEQ ID NO: 3725183 - DNA, 15 bp, Homo sapiens
cccactctccccaca

SEQ ID NO: 3725184 - DNA, 21 bp, Homo sapiens
cccactctgctttgactgagc

SEQ ID NO: 3725185 - DNA, 13 bp, Homo sapiens
cccactgctctgg

SEQ ID NO: 3725186 - DNA, 23 bp, Homo sapiens
cccactgcttttggtctgtgtga

SEQ ID NO: 3725187 - DNA, 15 bp, Homo sapiens
cccactggcagcatc

SEQ ID NO: 3725188 - DNA, 16 bp, Homo sapiens
cccactggctgtgggc

SEQ ID NO: 3725189 - DNA, 12 bp, Homo sapiens
cccacttctgcc

SEQ ID NO: 3725190 - DNA, 23 bp, Homo sapiens
cccacttgagaattacccttttg

SEQ ID NO: 3725191 - DNA, 17 bp, Homo sapiens
cccagaaaggagactag

SEQ ID NO: 3725192 - DNA, 22 bp, Homo sapiens
cccagaacacactccatcagct

SEQ ID NO: 3725193 - DNA, 14 bp, Homo sapiens
cccagaacctgtcc

SEQ ID NO: 3725194 - DNA, 13 bp, Homo sapiens
cccagaaggcagg

SEQ ID NO: 3725195 - DNA, 12 bp, Homo sapiens
cccagacagctc

SEQ ID NO: 3725196 - DNA, 14 bp, Homo sapiens
cccagacagctccc

SEQ ID NO: 3725197 - DNA, 18 bp, Homo sapiens
cccagacccctctggcca

SEQ ID NO: 3725198 - DNA, 21 bp, Homo sapiens
cccagacccctctggccagga

SEQ ID NO: 3725199 - DNA, 13 bp, Homo sapiens
cccagagaagcca

SEQ ID NO: 3725200 - DNA, 13 bp, Homo sapiens
cccagagacagga

SEQ ID NO: 3725201 - DNA, 14 bp, Homo sapiens
cccagagacaggaa

SEQ ID NO: 3725202 - DNA, 15 bp, Homo sapiens
cccagagaggaatca

SEQ ID NO: 3725203 - DNA, 18 bp, Homo sapiens
cccagagatgcctccacc

SEQ ID NO: 3725204 - DNA, 20 bp, Homo sapiens
cccagagatgcctccaccgc

SEQ ID NO: 3725205 - DNA, 21 bp, Homo sapiens
cccagagatgcctccaccgct

SEQ ID NO: 3725206 - DNA, 21 bp, Homo sapiens
cccagagatgggactgggagg

SEQ ID NO: 3725207 - DNA, 14 bp, Homo sapiens
cccagagctgggtg

SEQ ID NO: 3725208 - DNA, 21 bp, Homo sapiens
cccagagctgtttatggcctc

SEQ ID NO: 3725209 - DNA, 16 bp, Homo sapiens
cccagaggcacagccg

SEQ ID NO: 3725210 - DNA, 18 bp, Homo sapiens
cccagaggcacagccggg

SEQ ID NO: 3725211 - DNA, 14 bp, Homo sapiens
cccagagggcccag

SEQ ID NO: 3725212 - DNA, 15 bp, Homo sapiens
cccagagggcccagg

SEQ ID NO: 3725213 - DNA, 22 bp, Homo sapiens
cccagagggcccaggcaggcca

SEQ ID NO: 3725214 - DNA, 16 bp, Homo sapiens
cccagagtgtgggaag

SEQ ID NO: 3725215 - DNA, 14 bp, Homo sapiens
cccagatcccagaa

SEQ ID NO: 3725216 - DNA, 16 bp, Homo sapiens
cccagatcccagaagg

SEQ ID NO: 3725217 - DNA, 18 bp, Homo sapiens
cccagatctggtcccttg

SEQ ID NO: 3725218 - DNA, 19 bp, Homo sapiens
cccagatctggtcccttgc

SEQ ID NO: 3725219 - DNA, 20 bp, Homo sapiens
cccagattgcaacaggctgg

SEQ ID NO: 3725220 - DNA, 19 bp, Homo sapiens
cccagatttcagtcttttc

SEQ ID NO: 3725221 - DNA, 16 bp, Homo sapiens
cccagcaactccaact

SEQ ID NO: 3725222 - DNA, 22 bp, Homo sapiens
cccagcaagtgagagctgggtg

SEQ ID NO: 3725223 - DNA, 19 bp, Homo sapiens
cccagcaccaccaggtctc

SEQ ID NO: 3725224 - DNA, 16 bp, Homo sapiens
cccagcactaaagcag

SEQ ID NO: 3725225 - DNA, 16 bp, Homo sapiens
cccagcaggtggggag

SEQ ID NO: 3725226 - DNA, 17 bp, Homo sapiens
cccagcccacttctgcc

SEQ ID NO: 3725227 - DNA, 12 bp, Homo sapiens
cccagcccagct

SEQ ID NO: 3725228 - DNA, 16 bp, Homo sapiens
cccagcccagctgctc

SEQ ID NO: 3725229 - DNA, 13 bp, Homo sapiens
cccagcccatctt

SEQ ID NO: 3725230 - DNA, 16 bp, Homo sapiens
cccagcccatcttgcc

SEQ ID NO: 3725231 - DNA, 16 bp, Homo sapiens
cccagcccctgcccct

SEQ ID NO: 3725232 - DNA, 13 bp, Homo sapiens
ccagtgtctttct

SEQ ID NO: 3725233 - DNA, 14 bp, Homo sapiens
ccagtgtctttctt

SEQ ID NO: 3725234 - DNA, 15 bp, Homo sapiens
ccagtgtctttcttt

SEQ ID NO: 3725235 - DNA, 18 bp, Homo sapiens
ccagtgtgtggctttcag

SEQ ID NO: 3725236 - DNA, 15 bp, Homo sapiens
ccagtgttgtttgta

SEQ ID NO: 3725237 - DNA, 20 bp, Homo sapiens
ccagtgttgtttgtaaataa

SEQ ID NO: 3725238 - DNA, 23 bp, Homo sapiens
ccagtgttgtttgtaaataagag

SEQ ID NO: 3725239 - DNA, 19 bp, Homo sapiens
ccagtgttttaggagcatg

SEQ ID NO: 3725240 - DNA, 17 bp, Homo sapiens
ccagttagcctctgcag

SEQ ID NO: 3725241 - DNA, 17 bp, Homo sapiens
ccagttatgtgaatgat

SEQ ID NO: 3725242 - DNA, 21 bp, Homo sapiens
ccagttcaggagtcccaagga

SEQ ID NO: 3725243 - DNA, 22 bp, Homo sapiens
ccagttcctttcaatggtttgc

SEQ ID NO: 3725244 - DNA, 23 bp, Homo sapiens
ccagttcctttcaatggtttgca

SEQ ID NO: 3725245 - DNA, 17 bp, Homo sapiens
ccagttgggtggatgcc

SEQ ID NO: 3725246 - DNA, 21 bp, Homo sapiens
ccagtttcaggtgtttagttg

SEQ ID NO: 3725247 - DNA, 23 bp, Homo sapiens
ccagtttgcagaaaagcacctgc

SEQ ID NO: 3725248 - DNA, 15 bp, Homo sapiens
ccataaggaatgtag

SEQ ID NO: 3725249 - DNA, 14 bp, Homo sapiens
ccataatctggact

SEQ ID NO: 3725250 - DNA, 21 bp, Homo sapiens
ccataatctggactcctctgt

SEQ ID NO: 3725251 - DNA, 16 bp, Homo sapiens
ccatactctgtctccc

SEQ ID NO: 3725252 - DNA, 17 bp, Homo sapiens
ccatactctgtctccct

SEQ ID NO: 3725253 - DNA, 15 bp, Homo sapiens
ccatagcttccatga

SEQ ID NO: 3725254 - DNA, 17 bp, Homo sapiens
ccatagtatattaaaaa

SEQ ID NO: 3725255 - DNA, 13 bp, Homo sapiens
ccatatggatatt

SEQ ID NO: 3725256 - DNA, 12 bp, Homo sapiens
ccatatgtgctt

SEQ ID NO: 3725257 - DNA, 13 bp, Homo sapiens
ccatcacagggtt

SEQ ID NO: 3725258 - DNA, 21 bp, Homo sapiens
ccatcagcttaggggctgctg

SEQ ID NO: 3725259 - DNA, 16 bp, Homo sapiens
ccatcagttcccccag

SEQ ID NO: 3725260 - DNA, 14 bp, Homo sapiens
ccatcataattcta

SEQ ID NO: 3725261 - DNA, 17 bp, Homo sapiens
ccatcattataaacgtg

SEQ ID NO: 3725262 - DNA, 19 bp, Homo sapiens
ccatccactctaccctccc

SEQ ID NO: 3725263 - DNA, 18 bp, Homo sapiens
ccatccaggttcagcttg

SEQ ID NO: 3725264 - DNA, 14 bp, Homo sapiens
ccatcccacaccct

SEQ ID NO: 3725265 - DNA, 16 bp, Homo sapiens
ccatcccctgtagagt

SEQ ID NO: 3725266 - DNA, 22 bp, Homo sapiens
ccatcccgacatggacccggag

SEQ ID NO: 3725267 - DNA, 13 bp, Homo sapiens
ccatcctcccctt

SEQ ID NO: 3725268 - DNA, 15 bp, Homo sapiens
ccatcctccccttcc

SEQ ID NO: 3725269 - DNA, 15 bp, Homo sapiens
ccatctacccctgga

SEQ ID NO: 3725270 - DNA, 20 bp, Homo sapiens
ccatctatgtcccttgctgt

SEQ ID NO: 3725271 - DNA, 22 bp, Homo sapiens
ccatctatgtcccttgctgtga

SEQ ID NO: 3725272 - DNA, 16 bp, Homo sapiens
ccatctcaggccacct

SEQ ID NO: 3725273 - DNA, 20 bp, Homo sapiens
ccatctcaggccacctgccc

SEQ ID NO: 3725274 - DNA, 22 bp, Homo sapiens
ccatctcaggccacctgccccc

SEQ ID NO: 3725275 - DNA, 16 bp, Homo sapiens
ccatctccttgtcttt

SEQ ID NO: 3725276 - DNA, 18 bp, Homo sapiens
ccatctcctttcagggaa

SEQ ID NO: 3725277 - DNA, 23 bp, Homo sapiens
ccatctcgccacccctccttcct

SEQ ID NO: 3725278 - DNA, 23 bp, Homo sapiens
ccatctctccctcccctgccatt

SEQ ID NO: 3725279 - DNA, 23 bp, Homo sapiens
ccatctctgattttcaaagcttt

SEQ ID NO: 3725280 - DNA, 15 bp, Homo sapiens
ccatctgtgtcctgg

SEQ ID NO: 3725281 - DNA, 13 bp, Homo sapiens
ccatcttgcctcc

SEQ ID NO: 3725282 - DNA, 20 bp, Homo sapiens
ccatgaaaacgttttattgt

SEQ ID NO: 3725283 - DNA, 22 bp, Homo sapiens
ccatgaaaatgcaacaacatgt

SEQ ID NO: 3725284 - DNA, 13 bp, Homo sapiens
ccatgaaacaaag

SEQ ID NO: 3725285 - DNA, 15 bp, Homo sapiens
ccagcagatcccagc

SEQ ID NO: 3725286 - DNA, 21 bp, Homo sapiens
ccagcagatcccagctcacgt

SEQ ID NO: 3725287 - DNA, 15 bp, Homo sapiens
ccagcagccagctct

SEQ ID NO: 3725288 - DNA, 15 bp, Homo sapiens
ccagcagcctggacc

SEQ ID NO: 3725289 - DNA, 19 bp, Homo sapiens
ccagccaaaccctgtctga

SEQ ID NO: 3725290 - DNA, 15 bp, Homo sapiens
ccagccaaagcctcc

SEQ ID NO: 3725291 - DNA, 18 bp, Homo sapiens
ccagccaacccctgtgga

SEQ ID NO: 3725292 - DNA, 22 bp, Homo sapiens
ccagccaacttttgcatgtttt

SEQ ID NO: 3725293 - DNA, 13 bp, Homo sapiens
ccagccagcagcc

SEQ ID NO: 3725294 - DNA, 19 bp, Homo sapiens
ccagccagtgacctgagga

SEQ ID NO: 3725295 - DNA, 22 bp, Homo sapiens
ccagccagtgacctgaggaagc

SEQ ID NO: 3725296 - DNA, 18 bp, Homo sapiens
ccagcccagcccagctgg

SEQ ID NO: 3725297 - DNA, 16 bp, Homo sapiens
ccagcccagctgctct

SEQ ID NO: 3725298 - DNA, 17 bp, Homo sapiens
ccagcccagctgctctg

SEQ ID NO: 3725299 - DNA, 22 bp, Homo sapiens
ccagcccagctgctctgcccag

SEQ ID NO: 3725300 - DNA, 13 bp, Homo sapiens
ccagcccagctgg

SEQ ID NO: 3725301 - DNA, 12 bp, Homo sapiens
ccagcccagggt

SEQ ID NO: 3725302 - DNA, 18 bp, Homo sapiens
ccagcccagggttccccc

SEQ ID NO: 3725303 - DNA, 21 bp, Homo sapiens
ccagcccagggttcccccagc

SEQ ID NO: 3725304 - DNA, 18 bp, Homo sapiens
ccagcccatcttgcctcc

SEQ ID NO: 3725305 - DNA, 22 bp, Homo sapiens
ccagcccattctctctcctgtc

SEQ ID NO: 3725306 - DNA, 15 bp, Homo sapiens
ccagccccagtgccc

SEQ ID NO: 3725307 - DNA, 16 bp, Homo sapiens
ccagcccctcccacca

SEQ ID NO: 3725308 - DNA, 14 bp, Homo sapiens
ccagccccttgaga

SEQ ID NO: 3725309 - DNA, 13 bp, Homo sapiens
ccagccctccctg

SEQ ID NO: 3725310 - DNA, 22 bp, Homo sapiens
ccagccctccctgtcctcctcg

SEQ ID NO: 3725311 - DNA, 18 bp, Homo sapiens
ccagccctgtggaaggga

SEQ ID NO: 3725312 - DNA, 16 bp, Homo sapiens
ccagcccttagcaggg

SEQ ID NO: 3725313 - DNA, 18 bp, Homo sapiens
ccagccgccatgctcctg

SEQ ID NO: 3725314 - DNA, 15 bp, Homo sapiens
ccagcctccatgctg

SEQ ID NO: 3725315 - DNA, 19 bp, Homo sapiens
ccagcctccgtatttcaga

SEQ ID NO: 3725316 - DNA, 12 bp, Homo sapiens
ccagcctctctt

SEQ ID NO: 3725317 - DNA, 15 bp, Homo sapiens
ccagcctctcttcct

SEQ ID NO: 3725318 - DNA, 22 bp, Homo sapiens
ccagcctctcttggtttccttc

SEQ ID NO: 3725319 - DNA, 10 bp, Homo sapiens
ccagcctggc

SEQ ID NO: 3725320 - DNA, 13 bp, Homo sapiens
ccagcctggcttc

SEQ ID NO: 3725321 - DNA, 17 bp, Homo sapiens
ccagcctggcttctgga

SEQ ID NO: 3725322 - DNA, 19 bp, Homo sapiens
ccagcctgggcaacagagc

SEQ ID NO: 3725323 - DNA, 18 bp, Homo sapiens
ccagcctgggcagccagg

SEQ ID NO: 3725324 - DNA, 20 bp, Homo sapiens
ccagcctttctcccaggcca

SEQ ID NO: 3725325 - DNA, 20 bp, Homo sapiens
ccagcctttgatcaggtggg

SEQ ID NO: 3725326 - DNA, 13 bp, Homo sapiens
ccagcggctgagt

SEQ ID NO: 3725327 - DNA, 23 bp, Homo sapiens
ccagctaaggacatttcccaggg

SEQ ID NO: 3725328 - DNA, 14 bp, Homo sapiens
ccagctactcagaa

SEQ ID NO: 3725329 - DNA, 16 bp, Homo sapiens
ccagctactcagaagc

SEQ ID NO: 3725330 - DNA, 21 bp, Homo sapiens
ccagctactcagaagcctgag

SEQ ID NO: 3725331 - DNA, 14 bp, Homo sapiens
ccagctactcagga

SEQ ID NO: 3725332 - DNA, 20 bp, Homo sapiens
ccagctactcaggaggctga

SEQ ID NO: 3725333 - DNA, 22 bp, Homo sapiens
ccagctattgatataaataaaa

SEQ ID NO: 3725334 - DNA, 16 bp, Homo sapiens
ccagctcaccagcccc

SEQ ID NO: 3725335 - DNA, 12 bp, Homo sapiens
ccagctcagcag

SEQ ID NO: 3725336 - DNA, 15 bp, Homo sapiens
ccagctcagtcccat

SEQ ID NO: 3725337 - DNA, 22 bp, Homo sapiens
cagtgcagcaaccagagcactg

SEQ ID NO: 3725338 - DNA, 18 bp, Homo sapiens
cagtgcatctcagcccac

SEQ ID NO: 3725339 - DNA, 23 bp, Homo sapiens
cagtgccaagcacagtgcctgca

SEQ ID NO: 3725340 - DNA, 16 bp, Homo sapiens
cagtgccattgtcttt

SEQ ID NO: 3725341 - DNA, 17 bp, Homo sapiens
cagtgccattgtcttta

SEQ ID NO: 3725342 - DNA, 19 bp, Homo sapiens
cagtgccctcattttatgt

SEQ ID NO: 3725343 - DNA, 14 bp, Homo sapiens
cagtgccctggggc

SEQ ID NO: 3725344 - DNA, 15 bp, Homo sapiens
cagtgccgagaagga

SEQ ID NO: 3725345 - DNA, 15 bp, Homo sapiens
cagtgccttccataa

SEQ ID NO: 3725346 - DNA, 23 bp, Homo sapiens
cagtgccttccataattatgaca

SEQ ID NO: 3725347 - DNA, 23 bp, Homo sapiens
cagtgctgaccagacagcctccc

SEQ ID NO: 3725348 - DNA, 14 bp, Homo sapiens
cagtgctgctgaac

SEQ ID NO: 3725349 - DNA, 12 bp, Homo sapiens
cagtgctgtggc

SEQ ID NO: 3725350 - DNA, 13 bp, Homo sapiens
cagtgctgtggcc

SEQ ID NO: 3725351 - DNA, 20 bp, Homo sapiens
cagtgctgtggcctgggcaa

SEQ ID NO: 3725352 - DNA, 16 bp, Homo sapiens
cagtgcttcagcctga

SEQ ID NO: 3725353 - DNA, 17 bp, Homo sapiens
cagtgcttcagcctgag

SEQ ID NO: 3725354 - DNA, 19 bp, Homo sapiens
cagtgcttcagcctgaggc

SEQ ID NO: 3725355 - DNA, 20 bp, Homo sapiens
cagtgcttcagcctgaggct

SEQ ID NO: 3725356 - DNA, 17 bp, Homo sapiens
cagtgcttctctacaga

SEQ ID NO: 3725357 - DNA, 13 bp, Homo sapiens
cagtggacaccag

SEQ ID NO: 3725358 - DNA, 19 bp, Homo sapiens
cagtggactttccaccccc

SEQ ID NO: 3725359 - DNA, 23 bp, Homo sapiens
cagtggactttccaccccctccc

SEQ ID NO: 3725360 - DNA, 14 bp, Homo sapiens
cagtggaggtgctg

SEQ ID NO: 3725361 - DNA, 14 bp, Homo sapiens
cagtggattaatta

SEQ ID NO: 3725362 - DNA, 16 bp, Homo sapiens
cagtggcagctgcttt

SEQ ID NO: 3725363 - DNA, 15 bp, Homo sapiens
cagtggcatggctcc

SEQ ID NO: 3725364 - DNA, 16 bp, Homo sapiens
cagtggcatggctcca

SEQ ID NO: 3725365 - DNA, 17 bp, Homo sapiens
cagtggcatggctccag

SEQ ID NO: 3725366 - DNA, 20 bp, Homo sapiens
cagtggcctcaaccctccct

SEQ ID NO: 3725367 - DNA, 21 bp, Homo sapiens
cagtggcctcaaccctccctc

SEQ ID NO: 3725368 - DNA, 23 bp, Homo sapiens
cagtggcctggctccgctgtgtg

SEQ ID NO: 3725369 - DNA, 13 bp, Homo sapiens
cagtggctctttt

SEQ ID NO: 3725370 - DNA, 14 bp, Homo sapiens
cagtgggagaaaac

SEQ ID NO: 3725371 - DNA, 13 bp, Homo sapiens
cagtgggagccag

SEQ ID NO: 3725372 - DNA, 17 bp, Homo sapiens
cagtgggagccagggct

SEQ ID NO: 3725373 - DNA, 18 bp, Homo sapiens
cagtgggagccagggctg

SEQ ID NO: 3725374 - DNA, 20 bp, Homo sapiens
cagtgggagctgcctgttca

SEQ ID NO: 3725375 - DNA, 20 bp, Homo sapiens
cagtggtatgatcacggctc

SEQ ID NO: 3725376 - DNA, 21 bp, Homo sapiens
cagtggtgcgatcatggctca

SEQ ID NO: 3725377 - DNA, 19 bp, Homo sapiens
cagtggtgcgatctgggtt

SEQ ID NO: 3725378 - DNA, 16 bp, Homo sapiens
cagtgtacatggaata

SEQ ID NO: 3725379 - DNA, 22 bp, Homo sapiens
cagtgtagccccaagaaggctg

SEQ ID NO: 3725380 - DNA, 17 bp, Homo sapiens
cagtgtatggaaataaa

SEQ ID NO: 3725381 - DNA, 12 bp, Homo sapiens
cagtgtcctccc

SEQ ID NO: 3725382 - DNA, 13 bp, Homo sapiens
cagtgtcttccat

SEQ ID NO: 3725383 - DNA, 15 bp, Homo sapiens
cagtgtcttccataa

SEQ ID NO: 3725384 - DNA, 22 bp, Homo sapiens
cagtgtcttccataatgtataa

SEQ ID NO: 3725385 - DNA, 21 bp, Homo sapiens
cagtgtgcacgagtgggaagg

SEQ ID NO: 3725386 - DNA, 15 bp, Homo sapiens
cagtgtggtagttaa

SEQ ID NO: 3725387 - DNA, 17 bp, Homo sapiens
cagtgtgtctcctgcat

SEQ ID NO: 3725388 - DNA, 19 bp, Homo sapiens
cagtgtgtctcctgcatgc

SEQ ID NO: 3725389 - DNA, 14 bp, Homo sapiens
cagtgttattttct

SEQ ID NO: 3725390 - DNA, 14 bp, Homo sapiens
cagtgttgtttgta

SEQ ID NO: 3725391 - DNA, 21 bp, Homo sapiens
cagtgttgtttgtaaataaga

SEQ ID NO: 3725392 - DNA, 22 bp, Homo sapiens
cagtgttgtttgtaaataagag

SEQ ID NO: 3725393 - DNA, 23 bp, Homo sapiens
cagtgttgtttgtaaataagaga

SEQ ID NO: 3725394 - DNA, 17 bp, Homo sapiens
cagtgtttcccataatt

SEQ ID NO: 3725395 - DNA, 22 bp, Homo sapiens
cagtgttttctgggataagtaa

SEQ ID NO: 3725396 - DNA, 18 bp, Homo sapiens
cagttaagaaaaaaataa

SEQ ID NO: 3725397 - DNA, 19 bp, Homo sapiens
cagttaagcagccgccaca

SEQ ID NO: 3725398 - DNA, 20 bp, Homo sapiens
cagttacgtgagaagaggtc

SEQ ID NO: 3725399 - DNA, 13 bp, Homo sapiens
cagttactctgaa

SEQ ID NO: 3725400 - DNA, 15 bp, Homo sapiens
cagttactctgaagg

SEQ ID NO: 3725401 - DNA, 15 bp, Homo sapiens
cagttagagatgcct

SEQ ID NO: 3725402 - DNA, 17 bp, Homo sapiens
cagttagagatgcctcc

SEQ ID NO: 3725403 - DNA, 18 bp, Homo sapiens
cagttatgtgaatgatct

SEQ ID NO: 3725404 - DNA, 23 bp, Homo sapiens
cagttcagtaataaactgtgttt

SEQ ID NO: 3725405 - DNA, 23 bp, Homo sapiens
cagttcatatgtaccatgtacat

SEQ ID NO: 3725406 - DNA, 17 bp, Homo sapiens
cagttcccttggcctca

SEQ ID NO: 3725407 - DNA, 20 bp, Homo sapiens
cagttcccttggcctcagaa

SEQ ID NO: 3725408 - DNA, 15 bp, Homo sapiens
cagttcctttcaatg

SEQ ID NO: 3725409 - DNA, 12 bp, Homo sapiens
cagttctgcaaa

SEQ ID NO: 3725410 - DNA, 18 bp, Homo sapiens
cagttctgcaaatagaaa

SEQ ID NO: 3725411 - DNA, 20 bp, Homo sapiens
cagttctgcaaatagaaaac

SEQ ID NO: 3725412 - DNA, 20 bp, Homo sapiens
cagttcttttgttgtaaaga

SEQ ID NO: 3725413 - DNA, 12 bp, Homo sapiens
cagttgaaaaac

SEQ ID NO: 3725414 - DNA, 19 bp, Homo sapiens
cagttgaaaaacagctgag

SEQ ID NO: 3725415 - DNA, 14 bp, Homo sapiens
cagttgaatttcat

SEQ ID NO: 3725416 - DNA, 19 bp, Homo sapiens
cagttgcacttggcctctg

SEQ ID NO: 3725417 - DNA, 20 bp, Homo sapiens
cagttgcacttggcctctgg

SEQ ID NO: 3725418 - DNA, 17 bp, Homo sapiens
cagttgcgcgttctgaa

SEQ ID NO: 3725419 - DNA, 22 bp, Homo sapiens
cagttgcgcgttctgaaatatt

SEQ ID NO: 3725420 - DNA, 16 bp, Homo sapiens
cagttggccagagagc

SEQ ID NO: 3725421 - DNA, 17 bp, Homo sapiens
cagttggccagagagcc

SEQ ID NO: 3725422 - DNA, 19 bp, Homo sapiens
cagttgggtggatgcctgg

SEQ ID NO: 3725423 - DNA, 18 bp, Homo sapiens
cagttgtcccgattgtaa

SEQ ID NO: 3725424 - DNA, 20 bp, Homo sapiens
cagttgtcccgattgtaact

SEQ ID NO: 3725425 - DNA, 22 bp, Homo sapiens
cagttgtcccgattgtaactca

SEQ ID NO: 3725426 - DNA, 22 bp, Homo sapiens
cagtttcaggtgtttagttgca

SEQ ID NO: 3725427 - DNA, 14 bp, Homo sapiens
cagtttgctttgta

SEQ ID NO: 3725428 - DNA, 16 bp, Homo sapiens
cagttttaactagaat

SEQ ID NO: 3725429 - DNA, 13 bp, Homo sapiens
cagttttccatga

SEQ ID NO: 3725430 - DNA, 15 bp, Homo sapiens
cagttttccatgaaa

SEQ ID NO: 3725431 - DNA, 16 bp, Homo sapiens
ccactcgcttccccca

SEQ ID NO: 3725432 - DNA, 20 bp, Homo sapiens
ccactctaccctcccacccc

SEQ ID NO: 3725433 - DNA, 14 bp, Homo sapiens
ccactctcattccc

SEQ ID NO: 3725434 - DNA, 16 bp, Homo sapiens
ccactctcattcccca

SEQ ID NO: 3725435 - DNA, 18 bp, Homo sapiens
ccactctcattccccagg

SEQ ID NO: 3725436 - DNA, 19 bp, Homo sapiens
ccactctcattccccaggt

SEQ ID NO: 3725437 - DNA, 13 bp, Homo sapiens
ccactctccccac

SEQ ID NO: 3725438 - DNA, 18 bp, Homo sapiens
ccactgaagatagaagaa

SEQ ID NO: 3725439 - DNA, 14 bp, Homo sapiens
ccactgaagctggg

SEQ ID NO: 3725440 - DNA, 11 bp, Homo sapiens
ccactgcactc

SEQ ID NO: 3725441 - DNA, 14 bp, Homo sapiens
ccactgcactccag

SEQ ID NO: 3725442 - DNA, 19 bp, Homo sapiens
ccactgcactccagcctgg

SEQ ID NO: 3725443 - DNA, 22 bp, Homo sapiens
ccactgcccgagctggtgcatt

SEQ ID NO: 3725444 - DNA, 14 bp, Homo sapiens
ccactgccctctgt

SEQ ID NO: 3725445 - DNA, 16 bp, Homo sapiens
ccactgcctgcccacc

SEQ ID NO: 3725446 - DNA, 12 bp, Homo sapiens
ccactgctctgg

SEQ ID NO: 3725447 - DNA, 21 bp, Homo sapiens
ccactggacttgagcttggca

SEQ ID NO: 3725448 - DNA, 22 bp, Homo sapiens
ccactggacttgagcttggcag

SEQ ID NO: 3725449 - DNA, 19 bp, Homo sapiens
ccactggctgtgggctccc

SEQ ID NO: 3725450 - DNA, 21 bp, Homo sapiens
ccactggctgtgggctccctt

SEQ ID NO: 3725451 - DNA, 14 bp, Homo sapiens
ccactgtaaaatga

SEQ ID NO: 3725452 - DNA, 18 bp, Homo sapiens
ccactgtaaaatgaaatt

SEQ ID NO: 3725453 - DNA, 24 bp, Homo sapiens
ccactgtcactgtttctctgctgt

SEQ ID NO: 3725454 - DNA, 15 bp, Homo sapiens
ccactgtgaagagaa

SEQ ID NO: 3725455 - DNA, 21 bp, Homo sapiens
ccacttaaaaaatgtccatga

SEQ ID NO: 3725456 - DNA, 19 bp, Homo sapiens
ccacttaccttcaataaag

SEQ ID NO: 3725457 - DNA, 19 bp, Homo sapiens
ccacttagaaattgcattt

SEQ ID NO: 3725458 - DNA, 13 bp, Homo sapiens
ccacttcaataga

SEQ ID NO: 3725459 - DNA, 13 bp, Homo sapiens
ccacttcagctga

SEQ ID NO: 3725460 - DNA, 19 bp, Homo sapiens
ccacttcttgttccccact

SEQ ID NO: 3725461 - DNA, 12 bp, Homo sapiens
ccagaaagaaaa

SEQ ID NO: 3725462 - DNA, 15 bp, Homo sapiens
ccagaaaggatattt

SEQ ID NO: 3725463 - DNA, 17 bp, Homo sapiens
ccagaaaggatatttaa

SEQ ID NO: 3725464 - DNA, 21 bp, Homo sapiens
ccagaaataaagttggtgaca

SEQ ID NO: 3725465 - DNA, 23 bp, Homo sapiens
ccagaaataaagttggtgacaga

SEQ ID NO: 3725466 - DNA, 14 bp, Homo sapiens
ccagaaccccgagc

SEQ ID NO: 3725467 - DNA, 16 bp, Homo sapiens
ccagaagccaaagact

SEQ ID NO: 3725468 - DNA, 20 bp, Homo sapiens
ccagaagctgagcaccaggg

SEQ ID NO: 3725469 - DNA, 22 bp, Homo sapiens
ccagaagtttgagatcagcctg

SEQ ID NO: 3725470 - DNA, 20 bp, Homo sapiens
ccagaagtttgtcaagtcaa

SEQ ID NO: 3725471 - DNA, 16 bp, Homo sapiens
ccagaatttaaaccta

SEQ ID NO: 3725472 - DNA, 17 bp, Homo sapiens
ccagacaccttgacagg

SEQ ID NO: 3725473 - DNA, 23 bp, Homo sapiens
ccagacactgaccatccactcta

SEQ ID NO: 3725474 - DNA, 21 bp, Homo sapiens
ccagaccattgtctcagagca

SEQ ID NO: 3725475 - DNA, 15 bp, Homo sapiens
ccagacccccacccc

SEQ ID NO: 3725476 - DNA, 19 bp, Homo sapiens
ccagacccccaccccttcc

SEQ ID NO: 3725477 - DNA, 22 bp, Homo sapiens
ccagacccccaccccttcccca

SEQ ID NO: 3725478 - DNA, 19 bp, Homo sapiens
cccgccccacattccgaca

SEQ ID NO: 3725479 - DNA, 18 bp, Homo sapiens
cccgcctccctcccctgc

SEQ ID NO: 3725480 - DNA, 19 bp, Homo sapiens
cccgctcagccctccctgc

SEQ ID NO: 3725481 - DNA, 13 bp, Homo sapiens
cccgctggctggg

SEQ ID NO: 3725482 - DNA, 14 bp, Homo sapiens
cccgcttgtccagc

SEQ ID NO: 3725483 - DNA, 14 bp, Homo sapiens
cccggaacaagcct

SEQ ID NO: 3725484 - DNA, 18 bp, Homo sapiens
cccggaggggcctggcag

SEQ ID NO: 3725485 - DNA, 16 bp, Homo sapiens
cccggcagggtcctag

SEQ ID NO: 3725486 - DNA, 15 bp, Homo sapiens
cccggcccctgctgg

SEQ ID NO: 3725487 - DNA, 14 bp, Homo sapiens
cccggcgcggtggc

SEQ ID NO: 3725488 - DNA, 22 bp, Homo sapiens
cccggcgcggtggctcacgcct

SEQ ID NO: 3725489 - DNA, 14 bp, Homo sapiens
cccggctccaggct

SEQ ID NO: 3725490 - DNA, 16 bp, Homo sapiens
cccggctccaggctcc

SEQ ID NO: 3725491 - DNA, 12 bp, Homo sapiens
cccggctgcgga

SEQ ID NO: 3725492 - DNA, 24 bp, Homo sapiens
cccgggactcactggcagccccag

SEQ ID NO: 3725493 - DNA, 19 bp, Homo sapiens
cccggggcagctgccagag

SEQ ID NO: 3725494 - DNA, 20 bp, Homo sapiens
cccgggtttggcgggccaag

SEQ ID NO: 3725495 - DNA, 22 bp, Homo sapiens
cccggtcccttgagacctcagc

SEQ ID NO: 3725496 - DNA, 18 bp, Homo sapiens
cccgtcaccatctcaggc

SEQ ID NO: 3725497 - DNA, 19 bp, Homo sapiens
cccgtcaggacgttgagga

SEQ ID NO: 3725498 - DNA, 20 bp, Homo sapiens
cccgtctggggttcagcccc

SEQ ID NO: 3725499 - DNA, 16 bp, Homo sapiens
cccgtcttcagcctag

SEQ ID NO: 3725500 - DNA, 22 bp, Homo sapiens
cccgtgtggccccttcacttct

SEQ ID NO: 3725501 - DNA, 17 bp, Homo sapiens
ccctaagccaagggcct

SEQ ID NO: 3725502 - DNA, 21 bp, Homo sapiens
ccctaaggtcattaccacagg

SEQ ID NO: 3725503 - DNA, 18 bp, Homo sapiens
ccctacacccctcccctg

SEQ ID NO: 3725504 - DNA, 15 bp, Homo sapiens
ccctacctcaacctg

SEQ ID NO: 3725505 - DNA, 13 bp, Homo sapiens
ccctacctcaggc

SEQ ID NO: 3725506 - DNA, 16 bp, Homo sapiens
ccctacctcaggcagg

SEQ ID NO: 3725507 - DNA, 22 bp, Homo sapiens
ccctacctgattggtgcaaccc

SEQ ID NO: 3725508 - DNA, 20 bp, Homo sapiens
ccctagctccacaccctctc

SEQ ID NO: 3725509 - DNA, 14 bp, Homo sapiens
ccctaggagaccaa

SEQ ID NO: 3725510 - DNA, 21 bp, Homo sapiens
ccctaggtcagcttgctgccc

SEQ ID NO: 3725511 - DNA, 16 bp, Homo sapiens
ccctagtcccttcccc

SEQ ID NO: 3725512 - DNA, 22 bp, Homo sapiens
ccctagtcccttcccctccctg

SEQ ID NO: 3725513 - DNA, 18 bp, Homo sapiens
ccctatggggatggtcca

SEQ ID NO: 3725514 - DNA, 14 bp, Homo sapiens
ccctcacctgggca

SEQ ID NO: 3725515 - DNA, 23 bp, Homo sapiens
ccctcacctgggcacctggggag

SEQ ID NO: 3725516 - DNA, 21 bp, Homo sapiens
ccctcaccttgcaacacacag

SEQ ID NO: 3725517 - DNA, 14 bp, Homo sapiens
ccctcagcccctct

SEQ ID NO: 3725518 - DNA, 17 bp, Homo sapiens
ccctcaggaccctcgct

SEQ ID NO: 3725519 - DNA, 18 bp, Homo sapiens
ccctcaggaccctcgctg

SEQ ID NO: 3725520 - DNA, 19 bp, Homo sapiens
ccctcaggcataggcctgg

SEQ ID NO: 3725521 - DNA, 22 bp, Homo sapiens
ccctcaggcataggcctgggtg

SEQ ID NO: 3725522 - DNA, 19 bp, Homo sapiens
ccctcattacggctcctct

SEQ ID NO: 3725523 - DNA, 16 bp, Homo sapiens
ccctcattcaggaaaa

SEQ ID NO: 3725524 - DNA, 17 bp, Homo sapiens
ccctcattcaggaaaac

SEQ ID NO: 3725525 - DNA, 22 bp, Homo sapiens
ccctcattccaccttcccatgc

SEQ ID NO: 3725526 - DNA, 14 bp, Homo sapiens
ccctccactgccct

SEQ ID NO: 3725527 - DNA, 15 bp, Homo sapiens
ccctccactgccctc

SEQ ID NO: 3725528 - DNA, 15 bp, Homo sapiens
ccctccatcccgaca

SEQ ID NO: 3725529 - DNA, 12 bp, Homo sapiens
ccctcccaccac

SEQ ID NO: 3725530 - DNA, 12 bp, Homo sapiens
ccctcccacccc

SEQ ID NO: 3725531 - DNA, 22 bp, Homo sapiens
ccctcccagggccagggccctg

SEQ ID NO: 3725532 - DNA, 17 bp, Homo sapiens
ccctccccgcacccccc

SEQ ID NO: 3725533 - DNA, 14 bp, Homo sapiens
ccctcccctgccct

SEQ ID NO: 3725534 - DNA, 16 bp, Homo sapiens
ccctcccctgccctag

SEQ ID NO: 3725535 - DNA, 15 bp, Homo sapiens
ccctccctacctcaa

SEQ ID NO: 3725536 - DNA, 20 bp, Homo sapiens
ccctccctacctcaacctgt

SEQ ID NO: 3725537 - DNA, 13 bp, Homo sapiens
ccctccctcctct

SEQ ID NO: 3725538 - DNA, 23 bp, Homo sapiens
ccctccctctttccctcccttcc

SEQ ID NO: 3725539 - DNA, 15 bp, Homo sapiens
ccctccctggcctgt

SEQ ID NO: 3725540 - DNA, 14 bp, Homo sapiens
ccctccctggctcc

SEQ ID NO: 3725541 - DNA, 11 bp, Homo sapiens
ccctccctgtc

SEQ ID NO: 3725542 - DNA, 14 bp, Homo sapiens
ccctcccttcaacc

SEQ ID NO: 3725543 - DNA, 13 bp, Homo sapiens
ccctccgccttca

SEQ ID NO: 3725544 - DNA, 20 bp, Homo sapiens
ccctcctatcacctcccctc

SEQ ID NO: 3725545 - DNA, 21 bp, Homo sapiens
ccctcctatcacctcccctcc

SEQ ID NO: 3725546 - DNA, 12 bp, Homo sapiens
ccctcctcacct

SEQ ID NO: 3725547 - DNA, 17 bp, Homo sapiens
ccctcctcacctctgga

SEQ ID NO: 3725548 - DNA, 23 bp, Homo sapiens
ccctcctcacctctggactggct

SEQ ID NO: 3725549 - DNA, 11 bp, Homo sapiens
ccctcctctgc

SEQ ID NO: 3725550 - DNA, 18 bp, Homo sapiens
ccctcctgaaacttacac

SEQ ID NO: 3725551 - DNA, 18 bp, Homo sapiens
ccctccttgcctcctgtg

SEQ ID NO: 3725552 - DNA, 14 bp, Homo sapiens
ccctcctttcacca

SEQ ID NO: 3725553 - DNA, 21 bp, Homo sapiens
ccctcgaagcgcgccactcgc

SEQ ID NO: 3725554 - DNA, 23 bp, Homo sapiens
ccctcgctggcccccactggctg

SEQ ID NO: 3725555 - DNA, 22 bp, Homo sapiens
ccctctcaggcatgcctgtgtg

SEQ ID NO: 3725556 - DNA, 13 bp, Homo sapiens
ccctctcccagga

SEQ ID NO: 3725557 - DNA, 13 bp, Homo sapiens
ccctctctcctcc

SEQ ID NO: 3725558 - DNA, 11 bp, Homo sapiens
ccctctctctg

SEQ ID NO: 3725559 - DNA, 17 bp, Homo sapiens
ccctctctcttctgctc

SEQ ID NO: 3725560 - DNA, 18 bp, Homo sapiens
ccctctctcttctgctcc

SEQ ID NO: 3725561 - DNA, 22 bp, Homo sapiens
ccctctctcttctgctccaccc

SEQ ID NO: 3725562 - DNA, 21 bp, Homo sapiens
ccctctgcctgaaccttccat

SEQ ID NO: 3725563 - DNA, 14 bp, Homo sapiens
ccctctgctggccg

SEQ ID NO: 3725564 - DNA, 12 bp, Homo sapiens
ccctctggccag

SEQ ID NO: 3725565 - DNA, 13 bp, Homo sapiens
ccctctggccctg

SEQ ID NO: 3725566 - DNA, 17 bp, Homo sapiens
ccctctgttcagtaaca

SEQ ID NO: 3725567 - DNA, 23 bp, Homo sapiens
ccctctgttcagtaacagggcct

SEQ ID NO: 3725568 - DNA, 18 bp, Homo sapiens
ccctcttatgtacctctt

SEQ ID NO: 3725569 - DNA, 16 bp, Homo sapiens
ccctcttgccccccac

SEQ ID NO: 3725570 - DNA, 15 bp, Homo sapiens
ccctgaaaacccaga

SEQ ID NO: 3725571 - DNA, 16 bp, Homo sapiens
ccctgaaaacccagag

SEQ ID NO: 3725572 - DNA, 22 bp, Homo sapiens
ccctgaaaatgtttttctgcca

SEQ ID NO: 3725573 - DNA, 23 bp, Homo sapiens
ccctgaaaatgtttttctgccag

SEQ ID NO: 3725574 - DNA, 13 bp, Homo sapiens
ccctgaaccatcc

SEQ ID NO: 3725575 - DNA, 15 bp, Homo sapiens
ccctgacctcactgt

SEQ ID NO: 3725576 - DNA, 18 bp, Homo sapiens
ccctgactctctgtgacc

SEQ ID NO: 3725577 - DNA, 20 bp, Homo sapiens
ccctgagacaaatggaggcc

SEQ ID NO: 3725578 - DNA, 17 bp, Homo sapiens
ccctgagtcaccaggaa

SEQ ID NO: 3725579 - DNA, 19 bp, Homo sapiens
ccctgcaaaatgagaccct

SEQ ID NO: 3725580 - DNA, 22 bp, Homo sapiens
ccctgcacttgcagactctaca

SEQ ID NO: 3725581 - DNA, 14 bp, Homo sapiens
ccctgccaccctgg

SEQ ID NO: 3725582 - DNA, 12 bp, Homo sapiens
ccctgccagctc

SEQ ID NO: 3725583 - DNA, 13 bp, Homo sapiens
ccctgccagctct

SEQ ID NO: 3725584 - DNA, 14 bp, Homo sapiens
ccctgccagtgcct

SEQ ID NO: 3725585 - DNA, 15 bp, Homo sapiens
ccctgccccgtcacc

SEQ ID NO: 3725586 - DNA, 12 bp, Homo sapiens
ccctgcccctgc

SEQ ID NO: 3725587 - DNA, 19 bp, Homo sapiens
ccctgcccctgccccgtca

SEQ ID NO: 3725588 - DNA, 15 bp, Homo sapiens
ccctgccctggtcca

SEQ ID NO: 3725589 - DNA, 19 bp, Homo sapiens
ccctgcccttcagcatcct

SEQ ID NO: 3725590 - DNA, 20 bp, Homo sapiens
ccctgcgaaggggccctggt

SEQ ID NO: 3725591 - DNA, 22 bp, Homo sapiens
ccctgctagatgagaattcagc

SEQ ID NO: 3725592 - DNA, 19 bp, Homo sapiens
ccctgctgccgcctcccag

SEQ ID NO: 3725593 - DNA, 17 bp, Homo sapiens
cccagggccagggccct

SEQ ID NO: 3725594 - DNA, 20 bp, Homo sapiens
cccagggccagggccctgca

SEQ ID NO: 3725595 - DNA, 15 bp, Homo sapiens
cccagggctaccctc

SEQ ID NO: 3725596 - DNA, 17 bp, Homo sapiens
cccagggctcagcctgg

SEQ ID NO: 3725597 - DNA, 18 bp, Homo sapiens
cccagggctcagcctggt

SEQ ID NO: 3725598 - DNA, 18 bp, Homo sapiens
cccagggttcccccagcc

SEQ ID NO: 3725599 - DNA, 16 bp, Homo sapiens
cccaggtggctgaccc

SEQ ID NO: 3725600 - DNA, 16 bp, Homo sapiens
cccagtacctccaagc

SEQ ID NO: 3725601 - DNA, 19 bp, Homo sapiens
cccagtccaaatgtcctcc

SEQ ID NO: 3725602 - DNA, 19 bp, Homo sapiens
cccagtgaaaactagagct

SEQ ID NO: 3725603 - DNA, 18 bp, Homo sapiens
cccagtgacacttcagag

SEQ ID NO: 3725604 - DNA, 19 bp, Homo sapiens
cccagtgacacttcagaga

SEQ ID NO: 3725605 - DNA, 14 bp, Homo sapiens
cccagtgcacccac

SEQ ID NO: 3725606 - DNA, 16 bp, Homo sapiens
cccagtgccctggggc

SEQ ID NO: 3725607 - DNA, 17 bp, Homo sapiens
cccagtgccctggggct

SEQ ID NO: 3725608 - DNA, 14 bp, Homo sapiens
cccagttaatcttg

SEQ ID NO: 3725609 - DNA, 14 bp, Homo sapiens
cccagttagctctc

SEQ ID NO: 3725610 - DNA, 19 bp, Homo sapiens
cccagttcaggagtcccaa

SEQ ID NO: 3725611 - DNA, 23 bp, Homo sapiens
cccagttctctagggaaggccac

SEQ ID NO: 3725612 - DNA, 19 bp, Homo sapiens
cccataattttcttcatgc

SEQ ID NO: 3725613 - DNA, 20 bp, Homo sapiens
cccatcactggagcaccagg

SEQ ID NO: 3725614 - DNA, 18 bp, Homo sapiens
cccatcagctccagctgc

SEQ ID NO: 3725615 - DNA, 20 bp, Homo sapiens
cccatccagtctcccaactt

SEQ ID NO: 3725616 - DNA, 21 bp, Homo sapiens
cccatccagttcatgagaatc

SEQ ID NO: 3725617 - DNA, 15 bp, Homo sapiens
cccatcccacaccct

SEQ ID NO: 3725618 - DNA, 18 bp, Homo sapiens
cccatcccatcccatccc

SEQ ID NO: 3725619 - DNA, 21 bp, Homo sapiens
cccatctatgtcccttgctgt

SEQ ID NO: 3725620 - DNA, 19 bp, Homo sapiens
cccatctctacaaaaagca

SEQ ID NO: 3725621 - DNA, 18 bp, Homo sapiens
cccatctctccctcccct

SEQ ID NO: 3725622 - DNA, 18 bp, Homo sapiens
cccatgaagacaggacag

SEQ ID NO: 3725623 - DNA, 15 bp, Homo sapiens
cccatgagcctcagc

SEQ ID NO: 3725624 - DNA, 20 bp, Homo sapiens
cccatgagcctcagcatcct

SEQ ID NO: 3725625 - DNA, 18 bp, Homo sapiens
cccatgcccacctgccca

SEQ ID NO: 3725626 - DNA, 14 bp, Homo sapiens
cccatgcctgtcca

SEQ ID NO: 3725627 - DNA, 19 bp, Homo sapiens
cccatgcctgtccagcctg

SEQ ID NO: 3725628 - DNA, 16 bp, Homo sapiens
cccatgtctctcagaa

SEQ ID NO: 3725629 - DNA, 19 bp, Homo sapiens
cccatgtgcctgcaccagg

SEQ ID NO: 3725630 - DNA, 21 bp, Homo sapiens
cccattctgcctccattctga

SEQ ID NO: 3725631 - DNA, 15 bp, Homo sapiens
cccattctgcctgcc

SEQ ID NO: 3725632 - DNA, 14 bp, Homo sapiens
cccattgccctggt

SEQ ID NO: 3725633 - DNA, 18 bp, Homo sapiens
cccatttctaaaggcctc

SEQ ID NO: 3725634 - DNA, 20 bp, Homo sapiens
cccatttctagaacatccct

SEQ ID NO: 3725635 - DNA, 15 bp, Homo sapiens
cccatttctatttat

SEQ ID NO: 3725636 - DNA, 17 bp, Homo sapiens
cccatttctatttattt

SEQ ID NO: 3725637 - DNA, 20 bp, Homo sapiens
cccatttctatttatttact

SEQ ID NO: 3725638 - DNA, 19 bp, Homo sapiens
ccccaaaaccacagccctg

SEQ ID NO: 3725639 - DNA, 20 bp, Homo sapiens
ccccaaaaccacagccctgt

SEQ ID NO: 3725640 - DNA, 23 bp, Homo sapiens
ccccaaaaccacagccctgtcag

SEQ ID NO: 3725641 - DNA, 15 bp, Homo sapiens
ccccaaagaagaagt

SEQ ID NO: 3725642 - DNA, 18 bp, Homo sapiens
ccccaacccaaacctgga

SEQ ID NO: 3725643 - DNA, 15 bp, Homo sapiens
ccccaaccctgcccc

SEQ ID NO: 3725644 - DNA, 18 bp, Homo sapiens
ccccaaccctgcccctgc

SEQ ID NO: 3725645 - DNA, 14 bp, Homo sapiens
ccccaactcctgga

SEQ ID NO: 3725646 - DNA, 15 bp, Homo sapiens
ccccaactcctggaa

SEQ ID NO: 3725647 - DNA, 16 bp, Homo sapiens
ccccaagaaggctggg

SEQ ID NO: 3725648 - DNA, 16 bp, Homo sapiens
ccccaaggggcagtct

SEQ ID NO: 3725649 - DNA, 18 bp, Homo sapiens
ccccaaggggcagtctgg

SEQ ID NO: 3725650 - DNA, 22 bp, Homo sapiens
ccccaatatcctcgctcccggg

SEQ ID NO: 3725651 - DNA, 14 bp, Homo sapiens
ccccacacctggcc

SEQ ID NO: 3725652 - DNA, 14 bp, Homo sapiens
ccccaccaccccag

SEQ ID NO: 3725653 - DNA, 12 bp, Homo sapiens
ccccacccagga

SEQ ID NO: 3725654 - DNA, 16 bp, Homo sapiens
ccccaccccacacttg

SEQ ID NO: 3725655 - DNA, 23 bp, Homo sapiens
ccccaccccctccccaggggaga

SEQ ID NO: 3725656 - DNA, 18 bp, Homo sapiens
ccccaccccttccccact

SEQ ID NO: 3725657 - DNA, 12 bp, Homo sapiens
ccccacctgcca

SEQ ID NO: 3725658 - DNA, 13 bp, Homo sapiens
ccccacctgccac

SEQ ID NO: 3725659 - DNA, 14 bp, Homo sapiens
ccccacctgccact

SEQ ID NO: 3725660 - DNA, 22 bp, Homo sapiens
ccccacctgccactaggctggg

SEQ ID NO: 3725661 - DNA, 14 bp, Homo sapiens
ccccacgccctcat

SEQ ID NO: 3725662 - DNA, 19 bp, Homo sapiens
ccccacgtgacagtgcctg

SEQ ID NO: 3725663 - DNA, 13 bp, Homo sapiens
ccccactcacaga

SEQ ID NO: 3725664 - DNA, 14 bp, Homo sapiens
ccccactccccacc

SEQ ID NO: 3725665 - DNA, 12 bp, Homo sapiens
ccaggcctgcct

SEQ ID NO: 3725666 - DNA, 18 bp, Homo sapiens
ccaggcctgggtctgtgt

SEQ ID NO: 3725667 - DNA, 18 bp, Homo sapiens
ccaggcgatgtgcaagtg

SEQ ID NO: 3725668 - DNA, 19 bp, Homo sapiens
ccaggcgccccttccccct

SEQ ID NO: 3725669 - DNA, 16 bp, Homo sapiens
ccaggctcctccctcc

SEQ ID NO: 3725670 - DNA, 14 bp, Homo sapiens
ccaggctccttcct

SEQ ID NO: 3725671 - DNA, 13 bp, Homo sapiens
ccaggctgccaag

SEQ ID NO: 3725672 - DNA, 13 bp, Homo sapiens
ccaggctgctcag

SEQ ID NO: 3725673 - DNA, 19 bp, Homo sapiens
ccaggctgctcagggctgg

SEQ ID NO: 3725674 - DNA, 12 bp, Homo sapiens
ccaggctggcgt

SEQ ID NO: 3725675 - DNA, 17 bp, Homo sapiens
ccaggctggcgtgcagt

SEQ ID NO: 3725676 - DNA, 18 bp, Homo sapiens
ccaggctggcgtgcagtg

SEQ ID NO: 3725677 - DNA, 20 bp, Homo sapiens
ccaggctgtatcccatgagc

SEQ ID NO: 3725678 - DNA, 19 bp, Homo sapiens
ccagggagcggaaagcagc

SEQ ID NO: 3725679 - DNA, 20 bp, Homo sapiens
ccagggagcggaaagcagct

SEQ ID NO: 3725680 - DNA, 18 bp, Homo sapiens
ccagggatggggccacag

SEQ ID NO: 3725681 - DNA, 20 bp, Homo sapiens
ccagggatggggccacagcc

SEQ ID NO: 3725682 - DNA, 21 bp, Homo sapiens
ccagggatggggccacagcca

SEQ ID NO: 3725683 - DNA, 22 bp, Homo sapiens
ccagggatttgtccttggggac

SEQ ID NO: 3725684 - DNA, 15 bp, Homo sapiens
ccagggcaccaagcc

SEQ ID NO: 3725685 - DNA, 19 bp, Homo sapiens
ccagggcaccaagcccaca

SEQ ID NO: 3725686 - DNA, 17 bp, Homo sapiens
ccagggccacgtgccag

SEQ ID NO: 3725687 - DNA, 19 bp, Homo sapiens
ccagggccactctgcctct

SEQ ID NO: 3725688 - DNA, 20 bp, Homo sapiens
ccagggccactctgcctctg

SEQ ID NO: 3725689 - DNA, 15 bp, Homo sapiens
ccagggccctgagct

SEQ ID NO: 3725690 - DNA, 13 bp, Homo sapiens
ccagggctcagcc

SEQ ID NO: 3725691 - DNA, 19 bp, Homo sapiens
ccaggggaaaatcagcctg

SEQ ID NO: 3725692 - DNA, 18 bp, Homo sapiens
ccaggggagagggtctgg

SEQ ID NO: 3725693 - DNA, 20 bp, Homo sapiens
ccaggggagagggtctggag

SEQ ID NO: 3725694 - DNA, 17 bp, Homo sapiens
ccaggggtcccagccac

SEQ ID NO: 3725695 - DNA, 18 bp, Homo sapiens
ccaggggtcccagccacc

SEQ ID NO: 3725696 - DNA, 20 bp, Homo sapiens
ccaggtcgggctcagctctg

SEQ ID NO: 3725697 - DNA, 13 bp, Homo sapiens
ccaggtctcccgg

SEQ ID NO: 3725698 - DNA, 13 bp, Homo sapiens
ccaggtgcacaga

SEQ ID NO: 3725699 - DNA, 16 bp, Homo sapiens
ccaggtgcacagacgt

SEQ ID NO: 3725700 - DNA, 21 bp, Homo sapiens
ccaggtggccactccagaccc

SEQ ID NO: 3725701 - DNA, 13 bp, Homo sapiens
ccaggtgtttata

SEQ ID NO: 3725702 - DNA, 15 bp, Homo sapiens
ccaggttcagcttgt

SEQ ID NO: 3725703 - DNA, 21 bp, Homo sapiens
ccaggttctggttagctcagc

SEQ ID NO: 3725704 - DNA, 13 bp, Homo sapiens
ccaggtttaagct

SEQ ID NO: 3725705 - DNA, 12 bp, Homo sapiens
ccagtacctcca

SEQ ID NO: 3725706 - DNA, 17 bp, Homo sapiens
ccagtcataccaacttt

SEQ ID NO: 3725707 - DNA, 21 bp, Homo sapiens
ccagtccaaatgtcctccaga

SEQ ID NO: 3725708 - DNA, 13 bp, Homo sapiens
ccagtccctgggg

SEQ ID NO: 3725709 - DNA, 15 bp, Homo sapiens
ccagtcctgcctggc

SEQ ID NO: 3725710 - DNA, 21 bp, Homo sapiens
ccagtcctgcctggccaggca

SEQ ID NO: 3725711 - DNA, 22 bp, Homo sapiens
ccagtcctgcctggccaggcag

SEQ ID NO: 3725712 - DNA, 12 bp, Homo sapiens
ccagtctcttct

SEQ ID NO: 3725713 - DNA, 18 bp, Homo sapiens
ccagtctgctgccctcca

SEQ ID NO: 3725714 - DNA, 22 bp, Homo sapiens
ccagtgccctggggctgatctc

SEQ ID NO: 3725715 - DNA, 23 bp, Homo sapiens
ccagtggcctcaaccctccctca

SEQ ID NO: 3725716 - DNA, 24 bp, Homo sapiens
ccagtggcctcaaccctccctcag

SEQ ID NO: 3725717 - DNA, 15 bp, Homo sapiens
ccagtggcctggctc

SEQ ID NO: 3725718 - DNA, 16 bp, Homo sapiens
ccagtggcctggctcc

SEQ ID NO: 3725719 - DNA, 14 bp, Homo sapiens
ccagtggtgccttg

SEQ ID NO: 3725720 - DNA, 15 bp, Homo sapiens
ccagtgtagccttgc

SEQ ID NO: 3725721 - DNA, 17 bp, Homo sapiens
ccagtgtcctcccctca

SEQ ID NO: 3725722 - DNA, 20 bp, Homo sapiens
ccctgctgccgcctcccagc

SEQ ID NO: 3725723 - DNA, 18 bp, Homo sapiens
ccctgctttgggctgccc

SEQ ID NO: 3725724 - DNA, 23 bp, Homo sapiens
ccctgctttgggctgccctggtg

SEQ ID NO: 3725725 - DNA, 17 bp, Homo sapiens
ccctggaccagatgctg

SEQ ID NO: 3725726 - DNA, 23 bp, Homo sapiens
ccctggactggtggcccctgcct

SEQ ID NO: 3725727 - DNA, 14 bp, Homo sapiens
ccctggccatctct

SEQ ID NO: 3725728 - DNA, 15 bp, Homo sapiens
ccctggcctgttctg

SEQ ID NO: 3725729 - DNA, 19 bp, Homo sapiens
ccctggctcccacaggccc

SEQ ID NO: 3725730 - DNA, 23 bp, Homo sapiens
ccctggctcccatgaccatactg

SEQ ID NO: 3725731 - DNA, 19 bp, Homo sapiens
ccctggctctcagaaggta

SEQ ID NO: 3725732 - DNA, 11 bp, Homo sapiens
ccctggctggt

SEQ ID NO: 3725733 - DNA, 20 bp, Homo sapiens
ccctggctggtaagggccaa

SEQ ID NO: 3725734 - DNA, 13 bp, Homo sapiens
ccctggcttttca

SEQ ID NO: 3725735 - DNA, 21 bp, Homo sapiens
ccctggggctaggctggagcc

SEQ ID NO: 3725736 - DNA, 23 bp, Homo sapiens
ccctggtaataagtactgtgtac

SEQ ID NO: 3725737 - DNA, 16 bp, Homo sapiens
ccctggtccagggaag

SEQ ID NO: 3725738 - DNA, 18 bp, Homo sapiens
ccctggtccagggaagct

SEQ ID NO: 3725739 - DNA, 21 bp, Homo sapiens
ccctggtgaggaagctccagt

SEQ ID NO: 3725740 - DNA, 16 bp, Homo sapiens
ccctggtgctgccaca

SEQ ID NO: 3725741 - DNA, 17 bp, Homo sapiens
ccctggtgctgccacac

SEQ ID NO: 3725742 - DNA, 20 bp, Homo sapiens
ccctggtggacagtcctggg

SEQ ID NO: 3725743 - DNA, 16 bp, Homo sapiens
ccctggtggcagtggg

SEQ ID NO: 3725744 - DNA, 19 bp, Homo sapiens
ccctggtggcagtgggagc

SEQ ID NO: 3725745 - DNA, 18 bp, Homo sapiens
ccctgtacaatatttaaa

SEQ ID NO: 3725746 - DNA, 19 bp, Homo sapiens
ccctgtagactagtgccgt

SEQ ID NO: 3725747 - DNA, 18 bp, Homo sapiens
ccctgtcaagttaacaag

SEQ ID NO: 3725748 - DNA, 21 bp, Homo sapiens
ccctgtcaagttaacaaggaa

SEQ ID NO: 3725749 - DNA, 17 bp, Homo sapiens
ccctgtcagtgcagccc

SEQ ID NO: 3725750 - DNA, 22 bp, Homo sapiens
ccctgtcagtgcagcccgtgtg

SEQ ID NO: 3725751 - DNA, 16 bp, Homo sapiens
ccctgtcctcctcgga

SEQ ID NO: 3725752 - DNA, 13 bp, Homo sapiens
cctctcccagttg

SEQ ID NO: 3725753 - DNA, 14 bp, Homo sapiens
cctctccccaagac

SEQ ID NO: 3725754 - DNA, 10 bp, Homo sapiens
cctctccctg

SEQ ID NO: 3725755 - DNA, 13 bp, Homo sapiens
cctctccctggcc

SEQ ID NO: 3725756 - DNA, 15 bp, Homo sapiens
cctctcctgcctact

SEQ ID NO: 3725757 - DNA, 13 bp, Homo sapiens
cctctctaacctc

SEQ ID NO: 3725758 - DNA, 19 bp, Homo sapiens
cctctctaacctcctttac

SEQ ID NO: 3725759 - DNA, 21 bp, Homo sapiens
cctctctgatcttgtgctcag

SEQ ID NO: 3725760 - DNA, 19 bp, Homo sapiens
cctctcttggtttccttcc

SEQ ID NO: 3725761 - DNA, 13 bp, Homo sapiens
cctctgacacaca

SEQ ID NO: 3725762 - DNA, 11 bp, Homo sapiens
cctctgcacaa

SEQ ID NO: 3725763 - DNA, 17 bp, Homo sapiens
cctctgcacaagctgca

SEQ ID NO: 3725764 - DNA, 20 bp, Homo sapiens
cctctgcacaagctgcaccc

SEQ ID NO: 3725765 - DNA, 11 bp, Homo sapiens
cctctgccacc

SEQ ID NO: 3725766 - DNA, 15 bp, Homo sapiens
cctctgccacctccc

SEQ ID NO: 3725767 - DNA, 14 bp, Homo sapiens
cctctgcctcaatg

SEQ ID NO: 3725768 - DNA, 21 bp, Homo sapiens
cctctgcctgaagtcacacag

SEQ ID NO: 3725769 - DNA, 14 bp, Homo sapiens
cctctgcctgtccc

SEQ ID NO: 3725770 - DNA, 15 bp, Homo sapiens
cctctgcctgtccct

SEQ ID NO: 3725771 - DNA, 14 bp, Homo sapiens
cctcacttgaatgt

SEQ ID NO: 3725772 - DNA, 10 bp, Homo sapiens
cctcagactg

SEQ ID NO: 3725773 - DNA, 16 bp, Homo sapiens
cctcagagccacccct

SEQ ID NO: 3725774 - DNA, 13 bp, Homo sapiens
cctcagagtccag

SEQ ID NO: 3725775 - DNA, 15 bp, Homo sapiens
cctcagagtccaggc

SEQ ID NO: 3725776 - DNA, 16 bp, Homo sapiens
cctcagagtccaggcc

SEQ ID NO: 3725777 - DNA, 18 bp, Homo sapiens
cctcagagtccaggcccc

SEQ ID NO: 3725778 - DNA, 21 bp, Homo sapiens
cctcagccatgaggagttgct

SEQ ID NO: 3725779 - DNA, 13 bp, Homo sapiens
cctcagcccctct

SEQ ID NO: 3725780 - DNA, 22 bp, Homo sapiens
cctcagcctcccgaatagctgg

SEQ ID NO: 3725781 - DNA, 11 bp, Homo sapiens
cctcagcctgt

SEQ ID NO: 3725782 - DNA, 22 bp, Homo sapiens
cctcagccttccccttgcccag

SEQ ID NO: 3725783 - DNA, 23 bp, Homo sapiens
cctcagccttggataatgctgtt

SEQ ID NO: 3725784 - DNA, 16 bp, Homo sapiens
cctcagctgcctcact

SEQ ID NO: 3725785 - DNA, 18 bp, Homo sapiens
cctcagctgcctcacttc

SEQ ID NO: 3725786 - DNA, 11 bp, Homo sapiens
cctcaggcagg

SEQ ID NO: 3725787 - DNA, 12 bp, Homo sapiens
cctcaggcaggt

SEQ ID NO: 3725788 - DNA, 18 bp, Homo sapiens
cctcaggcaggtgggatg

SEQ ID NO: 3725789 - DNA, 22 bp, Homo sapiens
cctcaggcataggcctgggtgc

SEQ ID NO: 3725790 - DNA, 12 bp, Homo sapiens
cctcaggctgct

SEQ ID NO: 3725791 - DNA, 15 bp, Homo sapiens
cctcaggctgctgga

SEQ ID NO: 3725792 - DNA, 17 bp, Homo sapiens
cctcaggctgctggagg

SEQ ID NO: 3725793 - DNA, 11 bp, Homo sapiens
cctcagggaca

SEQ ID NO: 3725794 - DNA, 22 bp, Homo sapiens
ctccaaacctcctgttagctgt

SEQ ID NO: 3725795 - DNA, 18 bp, Homo sapiens
ctccaagctccatctcca

SEQ ID NO: 3725796 - DNA, 19 bp, Homo sapiens
ctccaagctccatctccac

SEQ ID NO: 3725797 - DNA, 22 bp, Homo sapiens
ctccaatcccaccaaccctcag

SEQ ID NO: 3725798 - DNA, 14 bp, Homo sapiens
ctccacagccgcag

SEQ ID NO: 3725799 - DNA, 12 bp, Homo sapiens
ctccaccaaccc

SEQ ID NO: 3725800 - DNA, 12 bp, Homo sapiens
ctccaccccact

SEQ ID NO: 3725801 - DNA, 14 bp, Homo sapiens
ctccaccccactca

SEQ ID NO: 3725802 - DNA, 20 bp, Homo sapiens
ctccaccccactcacagaga

SEQ ID NO: 3725803 - DNA, 23 bp, Homo sapiens
ctccaccccccagaacctgtcct

SEQ ID NO: 3725804 - DNA, 11 bp, Homo sapiens
ctccaccctgc

SEQ ID NO: 3725805 - DNA, 13 bp, Homo sapiens
ctccaccctgctc

SEQ ID NO: 3725806 - DNA, 13 bp, Homo sapiens
ctccacccttggc

SEQ ID NO: 3725807 - DNA, 15 bp, Homo sapiens
ctccacccttggcct

SEQ ID NO: 3725808 - DNA, 21 bp, Homo sapiens
ctccacccttggcctgtctca

SEQ ID NO: 3725809 - DNA, 14 bp, Homo sapiens
ctccaccgctgcct

SEQ ID NO: 3725810 - DNA, 13 bp, Homo sapiens
ctccacctcagcc

SEQ ID NO: 3725811 - DNA, 15 bp, Homo sapiens
ctccacctcagcctt

SEQ ID NO: 3725812 - DNA, 17 bp, Homo sapiens
ctccacctcagccttgg

SEQ ID NO: 3725813 - DNA, 17 bp, Homo sapiens
ctccaccttgcagctct

SEQ ID NO: 3725814 - DNA, 20 bp, Homo sapiens
ctccacgttcacccctccac

SEQ ID NO: 3725815 - DNA, 14 bp, Homo sapiens
ctccactccttcct

SEQ ID NO: 3725816 - DNA, 15 bp, Homo sapiens
ctccactccttcctg

SEQ ID NO: 3725817 - DNA, 13 bp, Homo sapiens
ctccactgccctc

SEQ ID NO: 3725818 - DNA, 14 bp, Homo sapiens
ctccactgccctct

SEQ ID NO: 3725819 - DNA, 15 bp, Homo sapiens
ctccactgccctctg

SEQ ID NO: 3725820 - DNA, 14 bp, Homo sapiens
ctccactgccttcg

SEQ ID NO: 3725821 - DNA, 14 bp, Homo sapiens
ctccactggatgga

SEQ ID NO: 3725822 - DNA, 21 bp, Homo sapiens
ctccacttcttgttccccact

SEQ ID NO: 3725823 - DNA, 14 bp, Homo sapiens
ctccagaagcctct

SEQ ID NO: 3725824 - DNA, 16 bp, Homo sapiens
ctccagaagcctctgg

SEQ ID NO: 3725825 - DNA, 18 bp, Homo sapiens
ctccagaagcctctggct

SEQ ID NO: 3725826 - DNA, 19 bp, Homo sapiens
ctccagaagcctctggcta

SEQ ID NO: 3725827 - DNA, 21 bp, Homo sapiens
ctccagaagcctctggctaga

SEQ ID NO: 3725828 - DNA, 20 bp, Homo sapiens
ctccagacaaaccagaagca

SEQ ID NO: 3725829 - DNA, 12 bp, Homo sapiens
ctccagaccccc

SEQ ID NO: 3725830 - DNA, 21 bp, Homo sapiens
ctccagacccccaccccttcc

SEQ ID NO: 3725831 - DNA, 14 bp, Homo sapiens
ctccagacccccag

SEQ ID NO: 3725832 - DNA, 17 bp, Homo sapiens
ctccagacccctggctt

SEQ ID NO: 3725833 - DNA, 21 bp, Homo sapiens
ctccagagagtatctgaggca

SEQ ID NO: 3725834 - DNA, 21 bp, Homo sapiens
ctccagatagctcatttcatt

SEQ ID NO: 3725835 - DNA, 14 bp, Homo sapiens
ctccagatctgcac

SEQ ID NO: 3725836 - DNA, 13 bp, Homo sapiens
ctccagccaaccc

SEQ ID NO: 3725837 - DNA, 18 bp, Homo sapiens
ctccagccaacccctgtg

SEQ ID NO: 3725838 - DNA, 14 bp, Homo sapiens
ctccagcctgagca

SEQ ID NO: 3725839 - DNA, 12 bp, Homo sapiens
ctccagcctggg

SEQ ID NO: 3725840 - DNA, 15 bp, Homo sapiens
ctccagctcaccagc

SEQ ID NO: 3725841 - DNA, 18 bp, Homo sapiens
ctccagctcaccagcccc

SEQ ID NO: 3725842 - DNA, 20 bp, Homo sapiens
ctccagctcaccagccccag

SEQ ID NO: 3725843 - DNA, 16 bp, Homo sapiens
ctccaggaaggggctg

SEQ ID NO: 3725844 - DNA, 20 bp, Homo sapiens
ctccaggaaggggctggact

SEQ ID NO: 3725845 - DNA, 20 bp, Homo sapiens
ctccaggaatgcctcctccc

SEQ ID NO: 3725846 - DNA, 20 bp, Homo sapiens
ctccagggagcaagacagag

SEQ ID NO: 3725847 - DNA, 19 bp, Homo sapiens
ctccagggccacgtgccag

SEQ ID NO: 3725848 - DNA, 23 bp, Homo sapiens
ctccagggccacgtgccaggccc

SEQ ID NO: 3725849 - DNA, 15 bp, Homo sapiens
ctccagtcctgctct

SEQ ID NO: 3725850 - DNA, 23 bp, Homo sapiens
ctccagtcctgctctctacccag

SEQ ID NO: 3725851 - DNA, 15 bp, Homo sapiens
ctccagtctgctgcc

SEQ ID NO: 3725852 - DNA, 21 bp, Homo sapiens
ctccagtctgctgccctccat

SEQ ID NO: 3725853 - DNA, 19 bp, Homo sapiens
ctccagtggaagaagaaaa

SEQ ID NO: 3725854 - DNA, 14 bp, Homo sapiens
ctccatctccactc

SEQ ID NO: 3725855 - DNA, 16 bp, Homo sapiens
ctccatctggcagggt

SEQ ID NO: 3725856 - DNA, 12 bp, Homo sapiens
ctccatcttatt

SEQ ID NO: 3725857 - DNA, 14 bp, Homo sapiens
ctccatgctgcctc

SEQ ID NO: 3725858 - DNA, 15 bp, Homo sapiens
ctccatgctgcctcc

SEQ ID NO: 3725859 - DNA, 16 bp, Homo sapiens
ctccatgctgcctcca

SEQ ID NO: 3725860 - DNA, 17 bp, Homo sapiens
ctccatgctgcctccag

SEQ ID NO: 3725861 - DNA, 18 bp, Homo sapiens
ctccatggtgcctctgga

SEQ ID NO: 3725862 - DNA, 13 bp, Homo sapiens
ctccatgtgggct

SEQ ID NO: 3725863 - DNA, 16 bp, Homo sapiens
ctccattcctggagcc

SEQ ID NO: 3725864 - DNA, 21 bp, Homo sapiens
ctccattcctggagcccgagg

SEQ ID NO: 3725865 - DNA, 15 bp, Homo sapiens
ctccatttagttctt

SEQ ID NO: 3725866 - DNA, 22 bp, Homo sapiens
ctcccaaaagtatcgggggctg

SEQ ID NO: 3725867 - DNA, 16 bp, Homo sapiens
ctcccaaagtgctggg

SEQ ID NO: 3725868 - DNA, 23 bp, Homo sapiens
ctcccaaagtgctgggattacag

SEQ ID NO: 3725869 - DNA, 18 bp, Homo sapiens
ctcccaagaacagcaggc

SEQ ID NO: 3725870 - DNA, 13 bp, Homo sapiens
ctcccaattcatc

SEQ ID NO: 3725871 - DNA, 15 bp, Homo sapiens
ctcccacaaaggaga

SEQ ID NO: 3725872 - DNA, 15 bp, Homo sapiens
ctcccacactgctag

SEQ ID NO: 3725873 - DNA, 23 bp, Homo sapiens
ctcctcttcttttttttcattat

SEQ ID NO: 3725874 - DNA, 12 bp, Homo sapiens
ctcctcttgcca

SEQ ID NO: 3725875 - DNA, 19 bp, Homo sapiens
ctcctcttgccactgcctc

SEQ ID NO: 3725876 - DNA, 19 bp, Homo sapiens
ctcctgaggatcagaaagt

SEQ ID NO: 3725877 - DNA, 23 bp, Homo sapiens
ctcctgaggggcatctgcccctc

SEQ ID NO: 3725878 - DNA, 13 bp, Homo sapiens
ctcctgatataga

SEQ ID NO: 3725879 - DNA, 13 bp, Homo sapiens
ctcctgcatgcag

SEQ ID NO: 3725880 - DNA, 14 bp, Homo sapiens
ctcctgcccaggag

SEQ ID NO: 3725881 - DNA, 22 bp, Homo sapiens
ctcctgcccaggagagccagcc

SEQ ID NO: 3725882 - DNA, 13 bp, Homo sapiens
ctcctgcccccac

SEQ ID NO: 3725883 - DNA, 14 bp, Homo sapiens
ctcctgcctcagcc

SEQ ID NO: 3725884 - DNA, 19 bp, Homo sapiens
ctcctggaaaggctcagtc

SEQ ID NO: 3725885 - DNA, 14 bp, Homo sapiens
ctcctggaaatatt

SEQ ID NO: 3725886 - DNA, 16 bp, Homo sapiens
ctcctggcccactgca

SEQ ID NO: 3725887 - DNA, 23 bp, Homo sapiens
ctcctgggaaggctactcacctt

SEQ ID NO: 3725888 - DNA, 23 bp, Homo sapiens
ctcctgggcccctccctacctca

SEQ ID NO: 3725889 - DNA, 14 bp, Homo sapiens
ctcctgggggttct

SEQ ID NO: 3725890 - DNA, 20 bp, Homo sapiens
ctcctgggggttctttcttc

SEQ ID NO: 3725891 - DNA, 15 bp, Homo sapiens
ctcctggtcttgaga

SEQ ID NO: 3725892 - DNA, 23 bp, Homo sapiens
ctcctggtcttgagatgtcttct

SEQ ID NO: 3725893 - DNA, 17 bp, Homo sapiens
ctcctgtactttttcca

SEQ ID NO: 3725894 - DNA, 19 bp, Homo sapiens
ctcctgtctgccagccagc

SEQ ID NO: 3725895 - DNA, 23 bp, Homo sapiens
ctcctgtctgccagccagcagcc

SEQ ID NO: 3725896 - DNA, 18 bp, Homo sapiens
ctcctgtgtagctgggat

SEQ ID NO: 3725897 - DNA, 16 bp, Homo sapiens
ctcctgtgtgtgcgcc

SEQ ID NO: 3725898 - DNA, 20 bp, Homo sapiens
ctccttagagacatcaaaat

SEQ ID NO: 3725899 - DNA, 19 bp, Homo sapiens
ctccttagtcttctcatag

SEQ ID NO: 3725900 - DNA, 14 bp, Homo sapiens
ctccttccaacagg

SEQ ID NO: 3725901 - DNA, 14 bp, Homo sapiens
ctccttccaactgc

SEQ ID NO: 3725902 - DNA, 15 bp, Homo sapiens
ctccttcccagctgc

SEQ ID NO: 3725903 - DNA, 18 bp, Homo sapiens
ctccttcccagctgcccc

SEQ ID NO: 3725904 - DNA, 16 bp, Homo sapiens
ctccttcctgccacct

SEQ ID NO: 3725905 - DNA, 21 bp, Homo sapiens
ctccttcctgccacctgctgc

SEQ ID NO: 3725906 - DNA, 14 bp, Homo sapiens
ctccttccttgacc

SEQ ID NO: 3725907 - DNA, 17 bp, Homo sapiens
ctccttccttgaccagc

SEQ ID NO: 3725908 - DNA, 15 bp, Homo sapiens
ctccttctgtcctac

SEQ ID NO: 3725909 - DNA, 18 bp, Homo sapiens
ctccttgataacagctac

SEQ ID NO: 3725910 - DNA, 17 bp, Homo sapiens
ctccttgcctcctgtgt

SEQ ID NO: 3725911 - DNA, 22 bp, Homo sapiens
ctccttgggaggccccactggg

SEQ ID NO: 3725912 - DNA, 18 bp, Homo sapiens
ctcctttaccctcatctg

SEQ ID NO: 3725913 - DNA, 21 bp, Homo sapiens
ctcctttaccctcatctgtct

SEQ ID NO: 3725914 - DNA, 16 bp, Homo sapiens
ctcctttagcgcccag

SEQ ID NO: 3725915 - DNA, 16 bp, Homo sapiens
ctcctttcacaacctt

SEQ ID NO: 3725916 - DNA, 14 bp, Homo sapiens
ctcctttctggctt

SEQ ID NO: 3725917 - DNA, 14 bp, Homo sapiens
ctcctttctttcta

SEQ ID NO: 3725918 - DNA, 22 bp, Homo sapiens
ctcgaacatggaactcattcct

SEQ ID NO: 3725919 - DNA, 16 bp, Homo sapiens
ctcgaactggctgcaa

SEQ ID NO: 3725920 - DNA, 17 bp, Homo sapiens
ctcgagcagtcctgcct

SEQ ID NO: 3725921 - DNA, 14 bp, Homo sapiens
ctcgcaagctgggt

SEQ ID NO: 3725922 - DNA, 18 bp, Homo sapiens
ctcgctgcacaaatactc

SEQ ID NO: 3725923 - DNA, 12 bp, Homo sapiens
ctcgctggcccc

SEQ ID NO: 3725924 - DNA, 18 bp, Homo sapiens
ctcgcttcccccatagcc

SEQ ID NO: 3725925 - DNA, 19 bp, Homo sapiens
ctcgcttcccccatagcca

SEQ ID NO: 3725926 - DNA, 13 bp, Homo sapiens
ctcgcttctctgt

SEQ ID NO: 3725927 - DNA, 14 bp, Homo sapiens
ctcgcttctctgtg

SEQ ID NO: 3725928 - DNA, 22 bp, Homo sapiens
ctcggagcctcatccgaggcag

SEQ ID NO: 3725929 - DNA, 20 bp, Homo sapiens
ctcggagtatctgggaactg

SEQ ID NO: 3725930 - DNA, 21 bp, Homo sapiens
ctcggccgtcttcactcgccc

SEQ ID NO: 3725931 - DNA, 12 bp, Homo sapiens
ctcggctcctgg

SEQ ID NO: 3725932 - DNA, 17 bp, Homo sapiens
ctcggctcctggactca

SEQ ID NO: 3725933 - DNA, 18 bp, Homo sapiens
ctcggctcctggactcat

SEQ ID NO: 3725934 - DNA, 21 bp, Homo sapiens
ctcgggcgagtcactgcctct

SEQ ID NO: 3725935 - DNA, 11 bp, Homo sapiens
ctcggtgcctt

SEQ ID NO: 3725936 - DNA, 17 bp, Homo sapiens
ctcgtcctccccctgcc

SEQ ID NO: 3725937 - DNA, 24 bp, Homo sapiens
ctcgtcctccccctgccagtgcct

SEQ ID NO: 3725938 - DNA, 12 bp, Homo sapiens
ctcgtgctttaa

SEQ ID NO: 3725939 - DNA, 14 bp, Homo sapiens
ctctaagcacacgg

SEQ ID NO: 3725940 - DNA, 23 bp, Homo sapiens
ctctaaggccgaagaagggtcct

SEQ ID NO: 3725941 - DNA, 13 bp, Homo sapiens
ctctaattctaac

SEQ ID NO: 3725942 - DNA, 18 bp, Homo sapiens
ctctaattctaaccagag

SEQ ID NO: 3725943 - DNA, 22 bp, Homo sapiens
ctctaattctaaccagagcaag

SEQ ID NO: 3725944 - DNA, 13 bp, Homo sapiens
ctctacaaaaagc

SEQ ID NO: 3725945 - DNA, 14 bp, Homo sapiens
ctctacactgtgaa

SEQ ID NO: 3725946 - DNA, 16 bp, Homo sapiens
ctctacccatattaca

SEQ ID NO: 3725947 - DNA, 14 bp, Homo sapiens
ctctaccctcccac

SEQ ID NO: 3725948 - DNA, 22 bp, Homo sapiens
ctctaccctcccacccccttct

SEQ ID NO: 3725949 - DNA, 15 bp, Homo sapiens
ctctacttaatgaga

SEQ ID NO: 3725950 - DNA, 12 bp, Homo sapiens
ctctagaaattt

SEQ ID NO: 3725951 - DNA, 21 bp, Homo sapiens
ctctagacactgccacacagg

SEQ ID NO: 3725952 - DNA, 23 bp, Homo sapiens
ctctagggaaaaaccagcgtgtg

SEQ ID NO: 3725953 - DNA, 19 bp, Homo sapiens
ctctagggaaggccacctg

SEQ ID NO: 3725954 - DNA, 22 bp, Homo sapiens
ctctagggaaggccacctgcag

SEQ ID NO: 3725955 - DNA, 22 bp, Homo sapiens
ctctaggtgcccttggaggcca

SEQ ID NO: 3725956 - DNA, 11 bp, Homo sapiens
ctctatattta

SEQ ID NO: 3725957 - DNA, 21 bp, Homo sapiens
ctctatgccagctcagtccca

SEQ ID NO: 3725958 - DNA, 20 bp, Homo sapiens
ctctatgggtatcaaacagc

SEQ ID NO: 3725959 - DNA, 21 bp, Homo sapiens
ctctatgggtatcaaacagct

SEQ ID NO: 3725960 - DNA, 20 bp, Homo sapiens
ctctatggtaaagatattat

SEQ ID NO: 3725961 - DNA, 23 bp, Homo sapiens
ctctattaccactgaagatagaa

SEQ ID NO: 3725962 - DNA, 23 bp, Homo sapiens
ctctattagactttagaaataaa

SEQ ID NO: 3725963 - DNA, 24 bp, Homo sapiens
ctctattagactttagaaataaat

SEQ ID NO: 3725964 - DNA, 13 bp, Homo sapiens
ctctatttagcat

SEQ ID NO: 3725965 - DNA, 11 bp, Homo sapiens
ctctcagccaa

SEQ ID NO: 3725966 - DNA, 16 bp, Homo sapiens
ctctcaggcatgcctg

SEQ ID NO: 3725967 - DNA, 20 bp, Homo sapiens
ctctcaggcatgcctgtgtg

SEQ ID NO: 3725968 - DNA, 15 bp, Homo sapiens
ctctcatcccccatt

SEQ ID NO: 3725969 - DNA, 11 bp, Homo sapiens
ctctcattccc

SEQ ID NO: 3725970 - DNA, 14 bp, Homo sapiens
ctctcattccccag

SEQ ID NO: 3725971 - DNA, 15 bp, Homo sapiens
ctctccacctcagcc

SEQ ID NO: 3725972 - DNA, 18 bp, Homo sapiens
ctctccacctcagccttg

SEQ ID NO: 3725973 - DNA, 20 bp, Homo sapiens
ctctccacctcagccttgga

SEQ ID NO: 3725974 - DNA, 11 bp, Homo sapiens
ctctccactgc

SEQ ID NO: 3725975 - DNA, 14 bp, Homo sapiens
ctctccactgcctt

SEQ ID NO: 3725976 - DNA, 18 bp, Homo sapiens
ctctccagtcttccacct

SEQ ID NO: 3725977 - DNA, 21 bp, Homo sapiens
ctctccagtcttccacctgga

SEQ ID NO: 3725978 - DNA, 22 bp, Homo sapiens
ctctccagtcttccacctggaa

SEQ ID NO: 3725979 - DNA, 12 bp, Homo sapiens
ctctcccagttg

SEQ ID NO: 3725980 - DNA, 13 bp, Homo sapiens
ctctcccatcact

SEQ ID NO: 3725981 - DNA, 12 bp, Homo sapiens
ctctccccacac

SEQ ID NO: 3725982 - DNA, 14 bp, Homo sapiens
ctctccccacacta

SEQ ID NO: 3725983 - DNA, 15 bp, Homo sapiens
ctctccccacactaa

SEQ ID NO: 3725984 - DNA, 22 bp, Homo sapiens
ctctccccagcaagtgagagct

SEQ ID NO: 3725985 - DNA, 15 bp, Homo sapiens
ctctcccctgccctg

SEQ ID NO: 3725986 - DNA, 13 bp, Homo sapiens
ctctccctctggc

SEQ ID NO: 3725987 - DNA, 19 bp, Homo sapiens
ctctccctctggccctgcc

SEQ ID NO: 3725988 - DNA, 12 bp, Homo sapiens
ctctccctggcc

SEQ ID NO: 3725989 - DNA, 14 bp, Homo sapiens
ctctcctcagactg

SEQ ID NO: 3725990 - DNA, 18 bp, Homo sapiens
ctctcctcagactgctca

SEQ ID NO: 3725991 - DNA, 19 bp, Homo sapiens
ctctcctcctgcccacctg

SEQ ID NO: 3725992 - DNA, 20 bp, Homo sapiens
ctctcctcctgcccacctgt

SEQ ID NO: 3725993 - DNA, 14 bp, Homo sapiens
ctctcctcttgcca

SEQ ID NO: 3725994 - DNA, 17 bp, Homo sapiens
ctctcctcttgccactg

SEQ ID NO: 3725995 - DNA, 13 bp, Homo sapiens
ctctcctgcctac

SEQ ID NO: 3725996 - DNA, 16 bp, Homo sapiens
ctctcggaaggctggc

SEQ ID NO: 3725997 - DNA, 19 bp, Homo sapiens
ctctcgggttgtgtgtctg

SEQ ID NO: 3725998 - DNA, 13 bp, Homo sapiens
ctctctacccagc

SEQ ID NO: 3725999 - DNA, 18 bp, Homo sapiens
ctctctacccagcccatc

SEQ ID NO: 3726000 - DNA, 19 bp, Homo sapiens
ctctctacccagcccatct

SEQ ID NO: 3726001 - DNA, 18 bp, Homo sapiens
ctctctatggtaaagata

SEQ ID NO: 3726002 - DNA, 20 bp, Homo sapiens
ctctctattaccactgaaga

SEQ ID NO: 3726003 - DNA, 18 bp, Homo sapiens
ctctctccagtcttccac

SEQ ID NO: 3726004 - DNA, 12 bp, Homo sapiens
ctctctccatca

SEQ ID NO: 3726005 - DNA, 13 bp, Homo sapiens
ctctctcctccct

SEQ ID NO: 3726006 - DNA, 14 bp, Homo sapiens
ctctctcctcctgc

SEQ ID NO: 3726007 - DNA, 20 bp, Homo sapiens
ctctctcctgtactttttcc

SEQ ID NO: 3726008 - DNA, 14 bp, Homo sapiens
ctctctcctgtcca

SEQ ID NO: 3726009 - DNA, 19 bp, Homo sapiens
ctctctcctgtccaaccta

SEQ ID NO: 3726010 - DNA, 13 bp, Homo sapiens
ctctctctgttgt

SEQ ID NO: 3726011 - DNA, 22 bp, Homo sapiens
ctctctgatcttgtgctcagca

SEQ ID NO: 3726012 - DNA, 16 bp, Homo sapiens
ctctctgcagccagcc

SEQ ID NO: 3726013 - DNA, 19 bp, Homo sapiens
ctctctgcagccagcccag

SEQ ID NO: 3726014 - DNA, 20 bp, Homo sapiens
ctctctgcagccagcccagc

SEQ ID NO: 3726015 - DNA, 15 bp, Homo sapiens
ctctctgcctgtgag

SEQ ID NO: 3726016 - DNA, 22 bp, Homo sapiens
ctctctgcctgtgagccagtct

SEQ ID NO: 3726017 - DNA, 18 bp, Homo sapiens
ctctcttacccttctgtg

SEQ ID NO: 3726018 - DNA, 23 bp, Homo sapiens
ctctcttacccttctgtgcccag

SEQ ID NO: 3726019 - DNA, 18 bp, Homo sapiens
ctctcttatagaatattt

SEQ ID NO: 3726020 - DNA, 19 bp, Homo sapiens
ctctcttatagaatattta

SEQ ID NO: 3726021 - DNA, 20 bp, Homo sapiens
ctctcttcctatcccatccc

SEQ ID NO: 3726022 - DNA, 16 bp, Homo sapiens
ctctctttggactctc

SEQ ID NO: 3726023 - DNA, 19 bp, Homo sapiens
ctctgaacttcagctagag

SEQ ID NO: 3726024 - DNA, 22 bp, Homo sapiens
ctctgaagagtgggtttcacaa

SEQ ID NO: 3726025 - DNA, 20 bp, Homo sapiens
ctcactgttgcccaggctgg

SEQ ID NO: 3726026 - DNA, 17 bp, Homo sapiens
ctcacttcttccatcca

SEQ ID NO: 3726027 - DNA, 14 bp, Homo sapiens
ctcacttttctcca

SEQ ID NO: 3726028 - DNA, 17 bp, Homo sapiens
ctcagaagacactgatg

SEQ ID NO: 3726029 - DNA, 20 bp, Homo sapiens
ctcagaagacactgatgggc

SEQ ID NO: 3726030 - DNA, 23 bp, Homo sapiens
ctcagaagacactgatgggcaac

SEQ ID NO: 3726031 - DNA, 13 bp, Homo sapiens
ctcagacccccac

SEQ ID NO: 3726032 - DNA, 16 bp, Homo sapiens
ctcagacccccactct

SEQ ID NO: 3726033 - DNA, 17 bp, Homo sapiens
ctcagagtcggaacgga

SEQ ID NO: 3726034 - DNA, 14 bp, Homo sapiens
ctcagatatttata

SEQ ID NO: 3726035 - DNA, 17 bp, Homo sapiens
ctcagatatttatattt

SEQ ID NO: 3726036 - DNA, 16 bp, Homo sapiens
ctcagatggaaccgca

SEQ ID NO: 3726037 - DNA, 21 bp, Homo sapiens
ctcagatggaaccgcaggaag

SEQ ID NO: 3726038 - DNA, 23 bp, Homo sapiens
ctcagatggaaccgcaggaagct

SEQ ID NO: 3726039 - DNA, 15 bp, Homo sapiens
ctcagcaacctgtaa

SEQ ID NO: 3726040 - DNA, 16 bp, Homo sapiens
ctcagcaaggggctct

SEQ ID NO: 3726041 - DNA, 12 bp, Homo sapiens
ctcagcacttgg

SEQ ID NO: 3726042 - DNA, 19 bp, Homo sapiens
ctcagcagccctcctcacc

SEQ ID NO: 3726043 - DNA, 21 bp, Homo sapiens
ctcagcagccctcctcacccc

SEQ ID NO: 3726044 - DNA, 13 bp, Homo sapiens
ctcagcatcctgg

SEQ ID NO: 3726045 - DNA, 15 bp, Homo sapiens
ctcagcatcctggca

SEQ ID NO: 3726046 - DNA, 21 bp, Homo sapiens
ctcagccatgaggagttgctg

SEQ ID NO: 3726047 - DNA, 11 bp, Homo sapiens
ctcagcccacc

SEQ ID NO: 3726048 - DNA, 17 bp, Homo sapiens
ctcagcccacccccctc

SEQ ID NO: 3726049 - DNA, 18 bp, Homo sapiens
ctcagccccagcccagcc

SEQ ID NO: 3726050 - DNA, 23 bp, Homo sapiens
ctcagccccagcccagcccagct

SEQ ID NO: 3726051 - DNA, 11 bp, Homo sapiens
ctcagcccctc

SEQ ID NO: 3726052 - DNA, 18 bp, Homo sapiens
ctcagcccctcttgcccc

SEQ ID NO: 3726053 - DNA, 19 bp, Homo sapiens
ctcagcccctcttgccccc

SEQ ID NO: 3726054 - DNA, 13 bp, Homo sapiens
ctcagccctgagg

SEQ ID NO: 3726055 - DNA, 15 bp, Homo sapiens
ctcagccctgaggtg

SEQ ID NO: 3726056 - DNA, 12 bp, Homo sapiens
ctcagccctggg

SEQ ID NO: 3726057 - DNA, 13 bp, Homo sapiens
ctcagccctgggc

SEQ ID NO: 3726058 - DNA, 22 bp, Homo sapiens
ctcagcctcccaaagtgctggg

SEQ ID NO: 3726059 - DNA, 23 bp, Homo sapiens
ctcagcctcctgtgtagctggga

SEQ ID NO: 3726060 - DNA, 12 bp, Homo sapiens
ctcagcctggtg

SEQ ID NO: 3726061 - DNA, 16 bp, Homo sapiens
ctcagcctggtgggcc

SEQ ID NO: 3726062 - DNA, 16 bp, Homo sapiens
ctcagcctgtgctgcc

SEQ ID NO: 3726063 - DNA, 18 bp, Homo sapiens
ctcagcctgtgctgcccg

SEQ ID NO: 3726064 - DNA, 14 bp, Homo sapiens
ctcagcggggacag

SEQ ID NO: 3726065 - DNA, 21 bp, Homo sapiens
ctcagcggggacagctccttc

SEQ ID NO: 3726066 - DNA, 23 bp, Homo sapiens
ctcagcgtttttttgtttttaat

SEQ ID NO: 3726067 - DNA, 19 bp, Homo sapiens
ctcagctcccaaggctctg

SEQ ID NO: 3726068 - DNA, 18 bp, Homo sapiens
ctcagctctggctcacag

SEQ ID NO: 3726069 - DNA, 19 bp, Homo sapiens
ctcagctctggctcacaga

SEQ ID NO: 3726070 - DNA, 16 bp, Homo sapiens
ctcagctgcctcactt

SEQ ID NO: 3726071 - DNA, 14 bp, Homo sapiens
ctcagctttctaag

SEQ ID NO: 3726072 - DNA, 15 bp, Homo sapiens
ctcaggaactagact

SEQ ID NO: 3726073 - DNA, 13 bp, Homo sapiens
ctcaggaccctcg

SEQ ID NO: 3726074 - DNA, 15 bp, Homo sapiens
ctcaggaccctcgct

SEQ ID NO: 3726075 - DNA, 19 bp, Homo sapiens
ctcaggaccctcgctggcc

SEQ ID NO: 3726076 - DNA, 20 bp, Homo sapiens
ctcaggaccctcgctggccc

SEQ ID NO: 3726077 - DNA, 14 bp, Homo sapiens
ctcaggactccagc

SEQ ID NO: 3726078 - DNA, 18 bp, Homo sapiens
ctcaggaggctgaggcag

SEQ ID NO: 3726079 - DNA, 22 bp, Homo sapiens
ctcaggaggctgaggcaggagg

SEQ ID NO: 3726080 - DNA, 18 bp, Homo sapiens
ctcaggagtttgagacca

SEQ ID NO: 3726081 - DNA, 14 bp, Homo sapiens
ctcaggatgcccag

SEQ ID NO: 3726082 - DNA, 15 bp, Homo sapiens
ctcaggatgcccagg

SEQ ID NO: 3726083 - DNA, 16 bp, Homo sapiens
ctcaggatgcccaggg

SEQ ID NO: 3726084 - DNA, 19 bp, Homo sapiens
ctcaggatgcccagggcca

SEQ ID NO: 3726085 - DNA, 22 bp, Homo sapiens
ctcaggatgcccagggccactc

SEQ ID NO: 3726086 - DNA, 21 bp, Homo sapiens
ctcaggcataggcctgggtgc

SEQ ID NO: 3726087 - DNA, 23 bp, Homo sapiens
ctcaggcataggcctgggtgctg

SEQ ID NO: 3726088 - DNA, 15 bp, Homo sapiens
ctcaggcatgcctgt

SEQ ID NO: 3726089 - DNA, 17 bp, Homo sapiens
ctcaggcatgcctgtgt

SEQ ID NO: 3726090 - DNA, 18 bp, Homo sapiens
ctcaggcatgcctgtgtg

SEQ ID NO: 3726091 - DNA, 13 bp, Homo sapiens
ctcaggccacctg

SEQ ID NO: 3726092 - DNA, 16 bp, Homo sapiens
ctcaggccacctgccc

SEQ ID NO: 3726093 - DNA, 22 bp, Homo sapiens
ctcaggccacctgcccccttct

SEQ ID NO: 3726094 - DNA, 15 bp, Homo sapiens
ctcaggccaggtgca

SEQ ID NO: 3726095 - DNA, 23 bp, Homo sapiens
ctcaggcctataaccccagctcc

SEQ ID NO: 3726096 - DNA, 15 bp, Homo sapiens
ctcaggctctgccct

SEQ ID NO: 3726097 - DNA, 16 bp, Homo sapiens
ctcaggctctgccctg

SEQ ID NO: 3726098 - DNA, 12 bp, Homo sapiens
ctcaggctgctg

SEQ ID NO: 3726099 - DNA, 14 bp, Homo sapiens
ctcagggaagccca

SEQ ID NO: 3726100 - DNA, 17 bp, Homo sapiens
ctcagggaagcccagct

SEQ ID NO: 3726101 - DNA, 19 bp, Homo sapiens
ctcagggaagcccagctcc

SEQ ID NO: 3726102 - DNA, 21 bp, Homo sapiens
ctcagggaagcccagctccag

SEQ ID NO: 3726103 - DNA, 19 bp, Homo sapiens
ctcagggcagcctgcctgg

SEQ ID NO: 3726104 - DNA, 16 bp, Homo sapiens
ctcagggccccagcac

SEQ ID NO: 3726105 - DNA, 18 bp, Homo sapiens
ctcaggtccctgcagggc

SEQ ID NO: 3726106 - DNA, 19 bp, Homo sapiens
ctcaggtgagaagcagagg

SEQ ID NO: 3726107 - DNA, 18 bp, Homo sapiens
ctcaggtgtccctgcact

SEQ ID NO: 3726108 - DNA, 13 bp, Homo sapiens
cctgccctgctgc

SEQ ID NO: 3726109 - DNA, 12 bp, Homo sapiens
cctgccctggtc

SEQ ID NO: 3726110 - DNA, 15 bp, Homo sapiens
cctgccctggtccag

SEQ ID NO: 3726111 - DNA, 21 bp, Homo sapiens
cctgcctaggaattcccagcc

SEQ ID NO: 3726112 - DNA, 15 bp, Homo sapiens
cctgcctcagcctcc

SEQ ID NO: 3726113 - DNA, 16 bp, Homo sapiens
cctgcctcagcctccc

SEQ ID NO: 3726114 - DNA, 19 bp, Homo sapiens
cctgcctcgaactggctgc

SEQ ID NO: 3726115 - DNA, 23 bp, Homo sapiens
cctgcctcgaactggctgcaaag

SEQ ID NO: 3726116 - DNA, 12 bp, Homo sapiens
cctgcctggcca

SEQ ID NO: 3726117 - DNA, 14 bp, Homo sapiens
cctgcctggccagg

SEQ ID NO: 3726118 - DNA, 22 bp, Homo sapiens
cctgcctggccaggcagatctg

SEQ ID NO: 3726119 - DNA, 14 bp, Homo sapiens
cctgcctggtctcc

SEQ ID NO: 3726120 - DNA, 15 bp, Homo sapiens
cctgcctgtctcctt

SEQ ID NO: 3726121 - DNA, 22 bp, Homo sapiens
cctgcctgttcccattcttgca

SEQ ID NO: 3726122 - DNA, 12 bp, Homo sapiens
cctggtggacag

SEQ ID NO: 3726123 - DNA, 17 bp, Homo sapiens
cctggtggacagtcctg

SEQ ID NO: 3726124 - DNA, 18 bp, Homo sapiens
cctggtggacagtcctgg

SEQ ID NO: 3726125 - DNA, 14 bp, Homo sapiens
cctggtggcagctg

SEQ ID NO: 3726126 - DNA, 16 bp, Homo sapiens
cctggtggcagctgcg

SEQ ID NO: 3726127 - DNA, 17 bp, Homo sapiens
cctggtggcagctgcgg

SEQ ID NO: 3726128 - DNA, 18 bp, Homo sapiens
cctggtggcagctgcggt

SEQ ID NO: 3726129 - DNA, 14 bp, Homo sapiens
cctggtggcagtgg

SEQ ID NO: 3726130 - DNA, 13 bp, Homo sapiens
cctgtaaaacttt

SEQ ID NO: 3726131 - DNA, 18 bp, Homo sapiens
cctgtaaaactttatttt

SEQ ID NO: 3726132 - DNA, 13 bp, Homo sapiens
cctgtaaattatt

SEQ ID NO: 3726133 - DNA, 14 bp, Homo sapiens
cctgtaaattattt

SEQ ID NO: 3726134 - DNA, 20 bp, Homo sapiens
cctgtaatcatataataaat

SEQ ID NO: 3726135 - DNA, 16 bp, Homo sapiens
cctgtaatcccagcag

SEQ ID NO: 3726136 - DNA, 18 bp, Homo sapiens
cctgtaatcccagctact

SEQ ID NO: 3726137 - DNA, 14 bp, Homo sapiens
cctgtactcaggag

SEQ ID NO: 3726138 - DNA, 22 bp, Homo sapiens
cctgtactcaggaggctgaggg

SEQ ID NO: 3726139 - DNA, 13 bp, Homo sapiens
cctgtactggaga

SEQ ID NO: 3726140 - DNA, 13 bp, Homo sapiens
cctgtagacctag

SEQ ID NO: 3726141 - DNA, 19 bp, Homo sapiens
cctgtagagtgggagctga

SEQ ID NO: 3726142 - DNA, 21 bp, Homo sapiens
cctgtagagtgggagctgagt

SEQ ID NO: 3726143 - DNA, 15 bp, Homo sapiens
cctgtagtcccagct

SEQ ID NO: 3726144 - DNA, 21 bp, Homo sapiens
cctgtagttaggaaataaaac

SEQ ID NO: 3726145 - DNA, 22 bp, Homo sapiens
cctgtagttaggaaataaaacc

SEQ ID NO: 3726146 - DNA, 20 bp, Homo sapiens
cctgtcaaacaaagccagaa

SEQ ID NO: 3726147 - DNA, 15 bp, Homo sapiens
cctgtcaagttaaca

SEQ ID NO: 3726148 - DNA, 19 bp, Homo sapiens
cctgtcaagttaacaagga

SEQ ID NO: 3726149 - DNA, 23 bp, Homo sapiens
cctgtcaagttaacaaggaatgc

SEQ ID NO: 3726150 - DNA, 17 bp, Homo sapiens
cctgtccaaactgccta

SEQ ID NO: 3726151 - DNA, 12 bp, Homo sapiens
cctgtccaacct

SEQ ID NO: 3726152 - DNA, 13 bp, Homo sapiens
cctgtccagagag

SEQ ID NO: 3726153 - DNA, 12 bp, Homo sapiens
cctgtccagcct

SEQ ID NO: 3726154 - DNA, 14 bp, Homo sapiens
cctgtccagcctgg

SEQ ID NO: 3726155 - DNA, 16 bp, Homo sapiens
cctgtccagcctgggc

SEQ ID NO: 3726156 - DNA, 15 bp, Homo sapiens
cctgtccctctcagg

SEQ ID NO: 3726157 - DNA, 14 bp, Homo sapiens
cctgtccctggcca

SEQ ID NO: 3726158 - DNA, 19 bp, Homo sapiens
cctgtccgccctcttcccc

SEQ ID NO: 3726159 - DNA, 15 bp, Homo sapiens
cctgtcctcagcttc

SEQ ID NO: 3726160 - DNA, 13 bp, Homo sapiens
cctgtcctcctcg

SEQ ID NO: 3726161 - DNA, 23 bp, Homo sapiens
cctgtcctcctcggatcaccgag

SEQ ID NO: 3726162 - DNA, 19 bp, Homo sapiens
cctgtcctgacctgtctca

SEQ ID NO: 3726163 - DNA, 21 bp, Homo sapiens
cctgtccttctctcacctcct

SEQ ID NO: 3726164 - DNA, 20 bp, Homo sapiens
cctgtctcatccccaggggt

SEQ ID NO: 3726165 - DNA, 16 bp, Homo sapiens
cctgtctgccagccag

SEQ ID NO: 3726166 - DNA, 19 bp, Homo sapiens
cctgtctgccagccagcag

SEQ ID NO: 3726167 - DNA, 23 bp, Homo sapiens
cctgtctgccagccagcagccag

SEQ ID NO: 3726168 - DNA, 15 bp, Homo sapiens
cctgtcttccaagga

SEQ ID NO: 3726169 - DNA, 22 bp, Homo sapiens
cctgtcttcctgcattcaccca

SEQ ID NO: 3726170 - DNA, 14 bp, Homo sapiens
cctgtctttaagga

SEQ ID NO: 3726171 - DNA, 17 bp, Homo sapiens
cctgtctttaaggaaaa

SEQ ID NO: 3726172 - DNA, 14 bp, Homo sapiens
cctgtgagccagtc

SEQ ID NO: 3726173 - DNA, 16 bp, Homo sapiens
cctgtgagccagtcta

SEQ ID NO: 3726174 - DNA, 19 bp, Homo sapiens
cctgtgaggtgcagagtgc

SEQ ID NO: 3726175 - DNA, 19 bp, Homo sapiens
cctgtgccacccaccaggg

SEQ ID NO: 3726176 - DNA, 16 bp, Homo sapiens
cctgtggaagggacta

SEQ ID NO: 3726177 - DNA, 21 bp, Homo sapiens
cctgtggcagtaaagagaaac

SEQ ID NO: 3726178 - DNA, 15 bp, Homo sapiens
cctgtggcggtgcct

SEQ ID NO: 3726179 - DNA, 16 bp, Homo sapiens
cctgtggcggtgcctg

SEQ ID NO: 3726180 - DNA, 18 bp, Homo sapiens
cctgtggcggtgcctggg

SEQ ID NO: 3726181 - DNA, 19 bp, Homo sapiens
cctgtggttacagtgcaga

SEQ ID NO: 3726182 - DNA, 23 bp, Homo sapiens
cctgtggttacagtgcagacagg

SEQ ID NO: 3726183 - DNA, 21 bp, Homo sapiens
cctgtggtttccaaggagctg

SEQ ID NO: 3726184 - DNA, 21 bp, Homo sapiens
cctgtgtaatcatttcttggg

SEQ ID NO: 3726185 - DNA, 14 bp, Homo sapiens
cctgttcagctcca

SEQ ID NO: 3726186 - DNA, 16 bp, Homo sapiens
cctgttcagctccagc

SEQ ID NO: 3726187 - DNA, 23 bp, Homo sapiens
cctgttcagctccagctcaccag

SEQ ID NO: 3726188 - DNA, 18 bp, Homo sapiens
cctgtttttaagctgttt

SEQ ID NO: 3726189 - DNA, 16 bp, Homo sapiens
cctgtttttgttaact

SEQ ID NO: 3726190 - DNA, 16 bp, Homo sapiens
ccttacctcctgccca

SEQ ID NO: 3726191 - DNA, 20 bp, Homo sapiens
ccttacctcctgcccaggag

SEQ ID NO: 3726192 - DNA, 14 bp, Homo sapiens
ccttacctcttccg

SEQ ID NO: 3726193 - DNA, 12 bp, Homo sapiens
ccttactgcaga

SEQ ID NO: 3726194 - DNA, 16 bp, Homo sapiens
ccttagaacctttctt

SEQ ID NO: 3726195 - DNA, 18 bp, Homo sapiens
ccttagaagtcacacagt

SEQ ID NO: 3726196 - DNA, 16 bp, Homo sapiens
ccttagcaaattctgt

SEQ ID NO: 3726197 - DNA, 16 bp, Homo sapiens
ccttagcctccctgaa

SEQ ID NO: 3726198 - DNA, 13 bp, Homo sapiens
ccttagctgccaa

SEQ ID NO: 3726199 - DNA, 15 bp, Homo sapiens
ccttagctgccaagc

SEQ ID NO: 3726200 - DNA, 21 bp, Homo sapiens
ccttagcttagacctcagcct

SEQ ID NO: 3726201 - DNA, 13 bp, Homo sapiens
ccttaggcaggga

SEQ ID NO: 3726202 - DNA, 13 bp, Homo sapiens
ccttagtcttctc

SEQ ID NO: 3726203 - DNA, 21 bp, Homo sapiens
ccttatctgtgcgtgaaacac

SEQ ID NO: 3726204 - DNA, 16 bp, Homo sapiens
ccttattgtacctctc

SEQ ID NO: 3726205 - DNA, 18 bp, Homo sapiens
ccttattttcaagaaact

SEQ ID NO: 3726206 - DNA, 17 bp, Homo sapiens
ccttcaagttagctcag

SEQ ID NO: 3726207 - DNA, 16 bp, Homo sapiens
ccttcaataaagtatc

SEQ ID NO: 3726208 - DNA, 15 bp, Homo sapiens
ccttcaattcctggg

SEQ ID NO: 3726209 - DNA, 22 bp, Homo sapiens
ccttcacttctgaccacacttc

SEQ ID NO: 3726210 - DNA, 11 bp, Homo sapiens
ccttcagaggc

SEQ ID NO: 3726211 - DNA, 16 bp, Homo sapiens
ccttcagatcctaccc

SEQ ID NO: 3726212 - DNA, 21 bp, Homo sapiens
ccttcagcatcctcagttcct

SEQ ID NO: 3726213 - DNA, 21 bp, Homo sapiens
ccttcagtcttgaatttctaa

SEQ ID NO: 3726214 - DNA, 11 bp, Homo sapiens
ccttcagtgcc

SEQ ID NO: 3726215 - DNA, 15 bp, Homo sapiens
ccttcatttctgata

SEQ ID NO: 3726216 - DNA, 16 bp, Homo sapiens
ccttccaactgctgcc

SEQ ID NO: 3726217 - DNA, 20 bp, Homo sapiens
ccttccacgctgtctccaga

SEQ ID NO: 3726218 - DNA, 20 bp, Homo sapiens
ccttccacggatccatgtag

SEQ ID NO: 3726219 - DNA, 13 bp, Homo sapiens
ccttccaggccat

SEQ ID NO: 3726220 - DNA, 13 bp, Homo sapiens
ccttccaggcccc

SEQ ID NO: 3726221 - DNA, 12 bp, Homo sapiens
ccttccataatt

SEQ ID NO: 3726222 - DNA, 15 bp, Homo sapiens
ccttccataattatg

SEQ ID NO: 3726223 - DNA, 23 bp, Homo sapiens
ccttccatgtcgcctctgcattc

SEQ ID NO: 3726224 - DNA, 18 bp, Homo sapiens
ccttcccagctgcccctc

SEQ ID NO: 3726225 - DNA, 15 bp, Homo sapiens
ccttcccatgccctg

SEQ ID NO: 3726226 - DNA, 22 bp, Homo sapiens
ccttccccactgcctgcccacc

SEQ ID NO: 3726227 - DNA, 20 bp, Homo sapiens
ccttccccctcccagggcca

SEQ ID NO: 3726228 - DNA, 13 bp, Homo sapiens
cgaaccccaagga

SEQ ID NO: 3726229 - DNA, 18 bp, Homo sapiens
ccttcctgccacctgctg

SEQ ID NO: 3726230 - DNA, 19 bp, Homo sapiens
ccttcctggggcatctggc

SEQ ID NO: 3726231 - DNA, 12 bp, Homo sapiens
ccttcctgtccg

SEQ ID NO: 3726232 - DNA, 17 bp, Homo sapiens
ccttcctgtcttcctgc

SEQ ID NO: 3726233 - DNA, 16 bp, Homo sapiens
ccttccttccctggct

SEQ ID NO: 3726234 - DNA, 23 bp, Homo sapiens
ccttccttgaccagcagatccca

SEQ ID NO: 3726235 - DNA, 15 bp, Homo sapiens
ccttcgctcctgtgt

SEQ ID NO: 3726236 - DNA, 18 bp, Homo sapiens
ccttcgctcctgtgtctt

SEQ ID NO: 3726237 - DNA, 17 bp, Homo sapiens
ccttcgttaactgtgta

SEQ ID NO: 3726238 - DNA, 14 bp, Homo sapiens
ccttctacactctc

SEQ ID NO: 3726239 - DNA, 18 bp, Homo sapiens
ccttctacactctcctgg

SEQ ID NO: 3726240 - DNA, 19 bp, Homo sapiens
ccttctacactctcctggg

SEQ ID NO: 3726241 - DNA, 14 bp, Homo sapiens
ccttctactgagcc

SEQ ID NO: 3726242 - DNA, 15 bp, Homo sapiens
ccttctactgagcct

SEQ ID NO: 3726243 - DNA, 23 bp, Homo sapiens
ccttctacttacacatcttccac

SEQ ID NO: 3726244 - DNA, 15 bp, Homo sapiens
ccttctccaaatgag

SEQ ID NO: 3726245 - DNA, 14 bp, Homo sapiens
ccttctcccacact

SEQ ID NO: 3726246 - DNA, 16 bp, Homo sapiens
ccttctcccacactgc

SEQ ID NO: 3726247 - DNA, 19 bp, Homo sapiens
ccttctccttgataacagc

SEQ ID NO: 3726248 - DNA, 14 bp, Homo sapiens
ccttctctgaagga

SEQ ID NO: 3726249 - DNA, 22 bp, Homo sapiens
ccttctctgcccattccccagc

SEQ ID NO: 3726250 - DNA, 13 bp, Homo sapiens
ccttctctgctcc

SEQ ID NO: 3726251 - DNA, 16 bp, Homo sapiens
ccttctctgctccacc

SEQ ID NO: 3726252 - DNA, 20 bp, Homo sapiens
ccttctctgctccaccacat

SEQ ID NO: 3726253 - DNA, 21 bp, Homo sapiens
ccttctgctggataaaatgag

SEQ ID NO: 3726254 - DNA, 20 bp, Homo sapiens
ccttctgggcagaccttgac

SEQ ID NO: 3726255 - DNA, 22 bp, Homo sapiens
ccttctgtcctactctgtgtca

SEQ ID NO: 3726256 - DNA, 14 bp, Homo sapiens
ccttctgtgcccag

SEQ ID NO: 3726257 - DNA, 17 bp, Homo sapiens
ccttctgtgcccagctc

SEQ ID NO: 3726258 - DNA, 18 bp, Homo sapiens
ccttcttattctcactcc

SEQ ID NO: 3726259 - DNA, 19 bp, Homo sapiens
ccttctttccatttctctc

SEQ ID NO: 3726260 - DNA, 16 bp, Homo sapiens
ccttctttttcttctt

SEQ ID NO: 3726261 - DNA, 21 bp, Homo sapiens
ccttgaaagtcatgaacacat

SEQ ID NO: 3726262 - DNA, 18 bp, Homo sapiens
ccttgaagaacctctcac

SEQ ID NO: 3726263 - DNA, 23 bp, Homo sapiens
ccttgaagatatcttgaaatgaa

SEQ ID NO: 3726264 - DNA, 14 bp, Homo sapiens
ccttgaagccactg

SEQ ID NO: 3726265 - DNA, 13 bp, Homo sapiens
ccttgacagggca

SEQ ID NO: 3726266 - DNA, 21 bp, Homo sapiens
ccttgacagggcacaccgggc

SEQ ID NO: 3726267 - DNA, 20 bp, Homo sapiens
ccttgacgtcaagtctcctt

SEQ ID NO: 3726268 - DNA, 14 bp, Homo sapiens
ccttgagacctcag

SEQ ID NO: 3726269 - DNA, 17 bp, Homo sapiens
ccttgagctccccaaaa

SEQ ID NO: 3726270 - DNA, 12 bp, Homo sapiens
ccttgagctgag

SEQ ID NO: 3726271 - DNA, 14 bp, Homo sapiens
ccttgagctgagat

SEQ ID NO: 3726272 - DNA, 16 bp, Homo sapiens
ccttgcaacacacaga

SEQ ID NO: 3726273 - DNA, 15 bp, Homo sapiens
ccttgcaagaatcag

SEQ ID NO: 3726274 - DNA, 14 bp, Homo sapiens
ccttgcacctgcat

SEQ ID NO: 3726275 - DNA, 15 bp, Homo sapiens
ccttgcagctagttt

SEQ ID NO: 3726276 - DNA, 13 bp, Homo sapiens
ccttgccagacat

SEQ ID NO: 3726277 - DNA, 12 bp, Homo sapiens
ccttgcccagag

SEQ ID NO: 3726278 - DNA, 13 bp, Homo sapiens
ccttgcccagaga

SEQ ID NO: 3726279 - DNA, 13 bp, Homo sapiens
ccttgcccagggc

SEQ ID NO: 3726280 - DNA, 18 bp, Homo sapiens
ccttgcccggattctggg

SEQ ID NO: 3726281 - DNA, 16 bp, Homo sapiens
ccttgcctcctgtgta

SEQ ID NO: 3726282 - DNA, 21 bp, Homo sapiens
ccttgcgcttttgctggtcac

SEQ ID NO: 3726283 - DNA, 14 bp, Homo sapiens
ccttgctacctcaa

SEQ ID NO: 3726284 - DNA, 22 bp, Homo sapiens
ccttgctctcccctgccctgct

SEQ ID NO: 3726285 - DNA, 18 bp, Homo sapiens
ccttggataatgctgttg

SEQ ID NO: 3726286 - DNA, 23 bp, Homo sapiens
ccttggataatgctgttgcctca

SEQ ID NO: 3726287 - DNA, 17 bp, Homo sapiens
ccttggcatgccttcca

SEQ ID NO: 3726288 - DNA, 23 bp, Homo sapiens
ccttggcctgtctcatccccagg

SEQ ID NO: 3726289 - DNA, 13 bp, Homo sapiens
ccttggctgcagg

SEQ ID NO: 3726290 - DNA, 16 bp, Homo sapiens
ccttggctgcagggag

SEQ ID NO: 3726291 - DNA, 15 bp, Homo sapiens
ccttgggaggcccca

SEQ ID NO: 3726292 - DNA, 14 bp, Homo sapiens
ccttgggctgctcc

SEQ ID NO: 3726293 - DNA, 17 bp, Homo sapiens
ccttgggctgctcctca

SEQ ID NO: 3726294 - DNA, 18 bp, Homo sapiens
ccttgggctgctcctcat

SEQ ID NO: 3726295 - DNA, 16 bp, Homo sapiens
ccttggggcaggcagt

SEQ ID NO: 3726296 - DNA, 18 bp, Homo sapiens
ccttggtgtccacctggc

SEQ ID NO: 3726297 - DNA, 19 bp, Homo sapiens
ccttggtgtccacctggcc

SEQ ID NO: 3726298 - DNA, 18 bp, Homo sapiens
ccttggttcatcagtgtt

SEQ ID NO: 3726299 - DNA, 17 bp, Homo sapiens
ccttggttcccttgtgt

SEQ ID NO: 3726300 - DNA, 16 bp, Homo sapiens
ccttgtaattctaaat

SEQ ID NO: 3726301 - DNA, 14 bp, Homo sapiens
ccttgtatttaaat

SEQ ID NO: 3726302 - DNA, 16 bp, Homo sapiens
ccttgtcactggtaga

SEQ ID NO: 3726303 - DNA, 16 bp, Homo sapiens
cctttaccctcatctg

SEQ ID NO: 3726304 - DNA, 18 bp, Homo sapiens
cctttagcacgtttaaag

SEQ ID NO: 3726305 - DNA, 20 bp, Homo sapiens
cctttagcgcccagttgggt

SEQ ID NO: 3726306 - DNA, 15 bp, Homo sapiens
cctttagcttaagag

SEQ ID NO: 3726307 - DNA, 14 bp, Homo sapiens
cctttattaaaatc

SEQ ID NO: 3726308 - DNA, 15 bp, Homo sapiens
cctttcacaaccttc

SEQ ID NO: 3726309 - DNA, 17 bp, Homo sapiens
cctttcatccccacctt

SEQ ID NO: 3726310 - DNA, 22 bp, Homo sapiens
cctttcccaacacttcagactg

SEQ ID NO: 3726311 - DNA, 12 bp, Homo sapiens
cctttccctcca

SEQ ID NO: 3726312 - DNA, 15 bp, Homo sapiens
cctttcctgttcagc

SEQ ID NO: 3726313 - DNA, 18 bp, Homo sapiens
cctttcctgttcagcatt

SEQ ID NO: 3726314 - DNA, 18 bp, Homo sapiens
cctttccttccatcccta

SEQ ID NO: 3726315 - DNA, 16 bp, Homo sapiens
cctttctgtaccattt

SEQ ID NO: 3726316 - DNA, 22 bp, Homo sapiens
cctttgagtttcctcaggctgc

SEQ ID NO: 3726317 - DNA, 19 bp, Homo sapiens
cctttgcttatgaatattt

SEQ ID NO: 3726318 - DNA, 19 bp, Homo sapiens
cctttgggaggctgaggcg

SEQ ID NO: 3726319 - DNA, 23 bp, Homo sapiens
cctttgtcatctttcttctattt

SEQ ID NO: 3726320 - DNA, 20 bp, Homo sapiens
cctttgtttttatgaagaaa

SEQ ID NO: 3726321 - DNA, 17 bp, Homo sapiens
ccttttacatactgctg

SEQ ID NO: 3726322 - DNA, 12 bp, Homo sapiens
ccttttccatgc

SEQ ID NO: 3726323 - DNA, 15 bp, Homo sapiens
ccttttctcctatct

SEQ ID NO: 3726324 - DNA, 12 bp, Homo sapiens
ccttttcttgtt

SEQ ID NO: 3726325 - DNA, 17 bp, Homo sapiens
ccttttcttgtttatca

SEQ ID NO: 3726326 - DNA, 23 bp, Homo sapiens
ccttttggcccccgagctggggg

SEQ ID NO: 3726327 - DNA, 21 bp, Homo sapiens
ccttttgggtttctgccctgc

SEQ ID NO: 3726328 - DNA, 17 bp, Homo sapiens
cctttttcccaataaat

SEQ ID NO: 3726329 - DNA, 16 bp, Homo sapiens
cctttttctttataaa

SEQ ID NO: 3726330 - DNA, 13 bp, Homo sapiens
cgaaacagcgctg

SEQ ID NO: 3726331 - DNA, 16 bp, Homo sapiens
cgaaactggaagttat

SEQ ID NO: 3726332 - DNA, 23 bp, Homo sapiens
cgaaaggatgtaaacagtgcctg

SEQ ID NO: 3726333 - DNA, 22 bp, Homo sapiens
cgaaagggacttggaagctccg

SEQ ID NO: 3726334 - DNA, 14 bp, Homo sapiens
cgaaatgttatttt

SEQ ID NO: 3726335 - DNA, 21 bp, Homo sapiens
cgaacatgtttttcttctccc

SEQ ID NO: 3726336 - DNA, 14 bp, Homo sapiens
cgaaccaatatttg

SEQ ID NO: 3726337 - DNA, 20 bp, Homo sapiens
cgaacccacactgcaacagg

SEQ ID NO: 3726338 - DNA, 14 bp, Homo sapiens
cgaacccacctgct

SEQ ID NO: 3726339 - DNA, 18 bp, Homo sapiens
ctaatgaagggaaaggat

SEQ ID NO: 3726340 - DNA, 17 bp, Homo sapiens
ctaatggaaaatgattt

SEQ ID NO: 3726341 - DNA, 21 bp, Homo sapiens
ctaatggaaaatgattttact

SEQ ID NO: 3726342 - DNA, 19 bp, Homo sapiens
ctaatgggtatttaaacaa

SEQ ID NO: 3726343 - DNA, 14 bp, Homo sapiens
ctaattaacatata

SEQ ID NO: 3726344 - DNA, 15 bp, Homo sapiens
ctaattaacatataa

SEQ ID NO: 3726345 - DNA, 14 bp, Homo sapiens
ctaattagagcaga

SEQ ID NO: 3726346 - DNA, 22 bp, Homo sapiens
ctaattattttaattaggttaa

SEQ ID NO: 3726347 - DNA, 21 bp, Homo sapiens
ctaattcccattttgcaaaat

SEQ ID NO: 3726348 - DNA, 13 bp, Homo sapiens
ctagccctctcac

SEQ ID NO: 3726349 - DNA, 18 bp, Homo sapiens
ctagccctctcacattta

SEQ ID NO: 3726350 - DNA, 13 bp, Homo sapiens
ctagccgacctca

SEQ ID NO: 3726351 - DNA, 14 bp, Homo sapiens
ctagccgacctcag

SEQ ID NO: 3726352 - DNA, 15 bp, Homo sapiens
ctagccgacctcagc

SEQ ID NO: 3726353 - DNA, 19 bp, Homo sapiens
ctagctagaagtgggccag

SEQ ID NO: 3726354 - DNA, 23 bp, Homo sapiens
ctagctagaagtgggccaggaca

SEQ ID NO: 3726355 - DNA, 13 bp, Homo sapiens
ctagctcagataa

SEQ ID NO: 3726356 - DNA, 22 bp, Homo sapiens
ctagctccacaccctctcccag

SEQ ID NO: 3726357 - DNA, 23 bp, Homo sapiens
ctagctggaattttttattcttg

SEQ ID NO: 3726358 - DNA, 18 bp, Homo sapiens
ctagctgttgagctgttt

SEQ ID NO: 3726359 - DNA, 12 bp, Homo sapiens
ctaggactctga

SEQ ID NO: 3726360 - DNA, 16 bp, Homo sapiens
ctaggagaccaaggcg

SEQ ID NO: 3726361 - DNA, 13 bp, Homo sapiens
ctaggatttcatg

SEQ ID NO: 3726362 - DNA, 18 bp, Homo sapiens
ctaggcagttagagatgc

SEQ ID NO: 3726363 - DNA, 20 bp, Homo sapiens
ctaggcagttagagatgcct

SEQ ID NO: 3726364 - DNA, 23 bp, Homo sapiens
ctaggcagttagagatgcctccc

SEQ ID NO: 3726365 - DNA, 21 bp, Homo sapiens
ctaggcatttgctgaatacag

SEQ ID NO: 3726366 - DNA, 15 bp, Homo sapiens
ctaggccactcctcc

SEQ ID NO: 3726367 - DNA, 19 bp, Homo sapiens
ctaggcctggcatggcacc

SEQ ID NO: 3726368 - DNA, 15 bp, Homo sapiens
ctaggcgtgagaagc

SEQ ID NO: 3726369 - DNA, 12 bp, Homo sapiens
ctaggctgggtg

SEQ ID NO: 3726370 - DNA, 17 bp, Homo sapiens
ctaggctgggtgcccac

SEQ ID NO: 3726371 - DNA, 19 bp, Homo sapiens
ctaggctgggtgcccacag

SEQ ID NO: 3726372 - DNA, 21 bp, Homo sapiens
ctaggcttcagcatatttata

SEQ ID NO: 3726373 - DNA, 14 bp, Homo sapiens
ctagggaagataat

SEQ ID NO: 3726374 - DNA, 19 bp, Homo sapiens
ctagggaaggccacctgca

SEQ ID NO: 3726375 - DNA, 20 bp, Homo sapiens
ctagggaaggccacctgcag

SEQ ID NO: 3726376 - DNA, 13 bp, Homo sapiens
ctagggacctggg

SEQ ID NO: 3726377 - DNA, 14 bp, Homo sapiens
ctagggacctgggg

SEQ ID NO: 3726378 - DNA, 14 bp, Homo sapiens
ctagggagagaccc

SEQ ID NO: 3726379 - DNA, 15 bp, Homo sapiens
ctagggattcaggct

SEQ ID NO: 3726380 - DNA, 17 bp, Homo sapiens
ctagggattcaggctgc

SEQ ID NO: 3726381 - DNA, 14 bp, Homo sapiens
ctagggctgggtgt

SEQ ID NO: 3726382 - DNA, 14 bp, Homo sapiens
ctagggggaagtga

SEQ ID NO: 3726383 - DNA, 13 bp, Homo sapiens
ctagggtggccct

SEQ ID NO: 3726384 - DNA, 22 bp, Homo sapiens
ctaggtcaaggcctgtccctgg

SEQ ID NO: 3726385 - DNA, 17 bp, Homo sapiens
ctaggtcagtacccacc

SEQ ID NO: 3726386 - DNA, 21 bp, Homo sapiens
ctaggtcagtacccacctgag

SEQ ID NO: 3726387 - DNA, 14 bp, Homo sapiens
ctaggtgacagagt

SEQ ID NO: 3726388 - DNA, 18 bp, Homo sapiens
ctaggtgacagagtgaga

SEQ ID NO: 3726389 - DNA, 18 bp, Homo sapiens
ctaggtgcccttggaggc

SEQ ID NO: 3726390 - DNA, 22 bp, Homo sapiens
ctaggtgcccttggaggccagc

SEQ ID NO: 3726391 - DNA, 15 bp, Homo sapiens
ctaggtgggccagcc

SEQ ID NO: 3726392 - DNA, 18 bp, Homo sapiens
ctaggtgggccagcccct

SEQ ID NO: 3726393 - DNA, 13 bp, Homo sapiens
ctaggttctaaaa

SEQ ID NO: 3726394 - DNA, 14 bp, Homo sapiens
ctagtcagccacat

SEQ ID NO: 3726395 - DNA, 14 bp, Homo sapiens
ctagtcccttcccc

SEQ ID NO: 3726396 - DNA, 15 bp, Homo sapiens
ctagtcccttcccct

SEQ ID NO: 3726397 - DNA, 12 bp, Homo sapiens
ctagtccttgtt

SEQ ID NO: 3726398 - DNA, 15 bp, Homo sapiens
ctagtcctttactaa

SEQ ID NO: 3726399 - DNA, 14 bp, Homo sapiens
ctagtctgtgtgct

SEQ ID NO: 3726400 - DNA, 21 bp, Homo sapiens
ctagtgcagctgattttaaca

SEQ ID NO: 3726401 - DNA, 23 bp, Homo sapiens
ctagtgcagctgattttaacaat

SEQ ID NO: 3726402 - DNA, 15 bp, Homo sapiens
ctagtgctgaagctt

SEQ ID NO: 3726403 - DNA, 19 bp, Homo sapiens
ctagtggggtctccctctc

SEQ ID NO: 3726404 - DNA, 20 bp, Homo sapiens
ctagtggggtctccctctcc

SEQ ID NO: 3726405 - DNA, 18 bp, Homo sapiens
ctagttcatccaatcctc

SEQ ID NO: 3726406 - DNA, 15 bp, Homo sapiens
ctagttgaggagttt

SEQ ID NO: 3726407 - DNA, 18 bp, Homo sapiens
ctagtttgtgagaaacat

SEQ ID NO: 3726408 - DNA, 13 bp, Homo sapiens
ctagttttacaga

SEQ ID NO: 3726409 - DNA, 14 bp, Homo sapiens
ctagttttacagat

SEQ ID NO: 3726410 - DNA, 21 bp, Homo sapiens
ctagttttacagattgcctcc

SEQ ID NO: 3726411 - DNA, 19 bp, Homo sapiens
ctagttttctcctcccagg

SEQ ID NO: 3726412 - DNA, 18 bp, Homo sapiens
ctataaccccagctccct

SEQ ID NO: 3726413 - DNA, 22 bp, Homo sapiens
ctataaccccagctccctagga

SEQ ID NO: 3726414 - DNA, 17 bp, Homo sapiens
ctataataccagctact

SEQ ID NO: 3726415 - DNA, 16 bp, Homo sapiens
ctataattgccactga

SEQ ID NO: 3726416 - DNA, 19 bp, Homo sapiens
ctatagacccgaggaaact

SEQ ID NO: 3726417 - DNA, 21 bp, Homo sapiens
ctatagcctaggtgacagagt

SEQ ID NO: 3726418 - DNA, 13 bp, Homo sapiens
ctatagtcccagc

SEQ ID NO: 3726419 - DNA, 15 bp, Homo sapiens
ctatagtcccagcta

SEQ ID NO: 3726420 - DNA, 19 bp, Homo sapiens
ctatatagtacctttgctc

SEQ ID NO: 3726421 - DNA, 20 bp, Homo sapiens
ctatatagtacctttgctct

SEQ ID NO: 3726422 - DNA, 16 bp, Homo sapiens
ctatatccatgtactg

SEQ ID NO: 3726423 - DNA, 20 bp, Homo sapiens
ctatatccatgtactgtagt

SEQ ID NO: 3726424 - DNA, 14 bp, Homo sapiens
ctatatctgtttta

SEQ ID NO: 3726425 - DNA, 15 bp, Homo sapiens
ctatatctgttttac

SEQ ID NO: 3726426 - DNA, 23 bp, Homo sapiens
ctatattgttttcagtgtacatg

SEQ ID NO: 3726427 - DNA, 16 bp, Homo sapiens
ctatatttaagtattc

SEQ ID NO: 3726428 - DNA, 21 bp, Homo sapiens
ctatatttaagtattcaagaa

SEQ ID NO: 3726429 - DNA, 23 bp, Homo sapiens
ctatatttagattgttaaaataa

SEQ ID NO: 3726430 - DNA, 20 bp, Homo sapiens
ctatcaaactgaagccagaa

SEQ ID NO: 3726431 - DNA, 12 bp, Homo sapiens
ctatccacccag

SEQ ID NO: 3726432 - DNA, 14 bp, Homo sapiens
ctatcccatcccat

SEQ ID NO: 3726433 - DNA, 13 bp, Homo sapiens
ctatcctacccca

SEQ ID NO: 3726434 - DNA, 21 bp, Homo sapiens
ctatcctggctttgcccaacc

SEQ ID NO: 3726435 - DNA, 20 bp, Homo sapiens
ctatcgagtttgcaatgtca

SEQ ID NO: 3726436 - DNA, 14 bp, Homo sapiens
ctatctaaatgttg

SEQ ID NO: 3726437 - DNA, 20 bp, Homo sapiens
ctatctcacagcacactcag

SEQ ID NO: 3726438 - DNA, 21 bp, Homo sapiens
ctatctctgtgtgcacaaata

SEQ ID NO: 3726439 - DNA, 20 bp, Homo sapiens
ctatgatatggtaaaagtta

SEQ ID NO: 3726440 - DNA, 22 bp, Homo sapiens
ctatgatcccagcactttggga

SEQ ID NO: 3726441 - DNA, 20 bp, Homo sapiens
ctatgcatatcagttgagct

SEQ ID NO: 3726442 - DNA, 19 bp, Homo sapiens
ctatgccagctcagtccca

SEQ ID NO: 3726443 - DNA, 20 bp, Homo sapiens
ctatgccagctcagtcccat

SEQ ID NO: 3726444 - DNA, 14 bp, Homo sapiens
ctatgctgcctagg

SEQ ID NO: 3726445 - DNA, 14 bp, Homo sapiens
ctatggatggcttc

SEQ ID NO: 3726446 - DNA, 18 bp, Homo sapiens
ctatgggactcaatgcac

SEQ ID NO: 3726447 - DNA, 14 bp, Homo sapiens
ctatgggagcccca

SEQ ID NO: 3726448 - DNA, 16 bp, Homo sapiens
ctatgggagccccagg

SEQ ID NO: 3726449 - DNA, 17 bp, Homo sapiens
ctatggggagaaaagac

SEQ ID NO: 3726450 - DNA, 18 bp, Homo sapiens
ctatggggatggtccact

SEQ ID NO: 3726451 - DNA, 19 bp, Homo sapiens
ctatgggggcactgaggac

SEQ ID NO: 3726452 - DNA, 22 bp, Homo sapiens
ctatgggtatcaaacagctcag

SEQ ID NO: 3726453 - DNA, 23 bp, Homo sapiens
ctatgggtatcaaacagctcagg

SEQ ID NO: 3726454 - DNA, 21 bp, Homo sapiens
ctatggtaaagatattattca

SEQ ID NO: 3726455 - DNA, 18 bp, Homo sapiens
ctatgtacaatattttaa

SEQ ID NO: 3726456 - DNA, 21 bp, Homo sapiens
ctatgtacaatattttaagca

SEQ ID NO: 3726457 - DNA, 13 bp, Homo sapiens
ctatgtcccttgc

SEQ ID NO: 3726458 - DNA, 22 bp, Homo sapiens
ctatgtgtagggcgggaggatg

SEQ ID NO: 3726459 - DNA, 18 bp, Homo sapiens
ctatgttgcccaggcagg

SEQ ID NO: 3726460 - DNA, 19 bp, Homo sapiens
ctatgttgcccaggcaggt

SEQ ID NO: 3726461 - DNA, 22 bp, Homo sapiens
ctatgttgcccaggcaggtctt

SEQ ID NO: 3726462 - DNA, 12 bp, Homo sapiens
ctattagacttt

SEQ ID NO: 3726463 - DNA, 22 bp, Homo sapiens
ctctgtatttgaatcagcctac

SEQ ID NO: 3726464 - DNA, 23 bp, Homo sapiens
ctctgtcagatgggaagacatga

SEQ ID NO: 3726465 - DNA, 22 bp, Homo sapiens
ctctgtccagggccctgagctc

SEQ ID NO: 3726466 - DNA, 14 bp, Homo sapiens
ctctgtcctgggag

SEQ ID NO: 3726467 - DNA, 15 bp, Homo sapiens
ctctgtcctgggagt

SEQ ID NO: 3726468 - DNA, 23 bp, Homo sapiens
ctctgtgaacgatttagaaagaa

SEQ ID NO: 3726469 - DNA, 22 bp, Homo sapiens
ctctgtgtcaggtggggcagct

SEQ ID NO: 3726470 - DNA, 17 bp, Homo sapiens
ctctgtgtgcacaaata

SEQ ID NO: 3726471 - DNA, 14 bp, Homo sapiens
ctctgttcagtaac

SEQ ID NO: 3726472 - DNA, 15 bp, Homo sapiens
ctctgttcctggctc

SEQ ID NO: 3726473 - DNA, 16 bp, Homo sapiens
ctctgttccttcacat

SEQ ID NO: 3726474 - DNA, 24 bp, Homo sapiens
ctcttaaaacccaagtgccttagc

SEQ ID NO: 3726475 - DNA, 22 bp, Homo sapiens
ctcttaagcttccgccgtctca

SEQ ID NO: 3726476 - DNA, 16 bp, Homo sapiens
ctcttacccttctgtg

SEQ ID NO: 3726477 - DNA, 19 bp, Homo sapiens
ctcttacccttctgtgccc

SEQ ID NO: 3726478 - DNA, 13 bp, Homo sapiens
ctcttagctgtct

SEQ ID NO: 3726479 - DNA, 22 bp, Homo sapiens
ctcttatagaatatttattacc

SEQ ID NO: 3726480 - DNA, 13 bp, Homo sapiens
ctcttatgccatt

SEQ ID NO: 3726481 - DNA, 15 bp, Homo sapiens
ctcttattttacaat

SEQ ID NO: 3726482 - DNA, 16 bp, Homo sapiens
ctcttcaactgaccag

SEQ ID NO: 3726483 - DNA, 15 bp, Homo sapiens
ctcttcaggcctccc

SEQ ID NO: 3726484 - DNA, 16 bp, Homo sapiens
ctcttcaggcctccct

SEQ ID NO: 3726485 - DNA, 17 bp, Homo sapiens
ctcttcaggcctccctc

SEQ ID NO: 3726486 - DNA, 19 bp, Homo sapiens
ctcttcaggcctccctctc

SEQ ID NO: 3726487 - DNA, 24 bp, Homo sapiens
ctcttcccctctaatgctcacgct

SEQ ID NO: 3726488 - DNA, 20 bp, Homo sapiens
ctcttccgtgacgtcactgg

SEQ ID NO: 3726489 - DNA, 18 bp, Homo sapiens
ctcttcctatcccatccc

SEQ ID NO: 3726490 - DNA, 19 bp, Homo sapiens
ctcttcctatcccatccca

SEQ ID NO: 3726491 - DNA, 17 bp, Homo sapiens
ctcttctattttgtaaa

SEQ ID NO: 3726492 - DNA, 19 bp, Homo sapiens
ctcttctattttgtaaact

SEQ ID NO: 3726493 - DNA, 13 bp, Homo sapiens
ctcttctccactg

SEQ ID NO: 3726494 - DNA, 14 bp, Homo sapiens
ctcttctccactgg

SEQ ID NO: 3726495 - DNA, 15 bp, Homo sapiens
ctcttctccaggctg

SEQ ID NO: 3726496 - DNA, 21 bp, Homo sapiens
ctcttctgctccacccttggc

SEQ ID NO: 3726497 - DNA, 15 bp, Homo sapiens
ctcttcttcttcaga

SEQ ID NO: 3726498 - DNA, 20 bp, Homo sapiens
ctcttgaagatgctgaaaca

SEQ ID NO: 3726499 - DNA, 17 bp, Homo sapiens
ctcttgaggccaggagt

SEQ ID NO: 3726500 - DNA, 12 bp, Homo sapiens
ctcttgcccccc

SEQ ID NO: 3726501 - DNA, 16 bp, Homo sapiens
ctcttgggctgagact

SEQ ID NO: 3726502 - DNA, 17 bp, Homo sapiens
ctcttgggctgagactg

SEQ ID NO: 3726503 - DNA, 19 bp, Homo sapiens
ctcttgggttcaagcgatt

SEQ ID NO: 3726504 - DNA, 20 bp, Homo sapiens
ctcttggtttccttccttgg

SEQ ID NO: 3726505 - DNA, 13 bp, Homo sapiens
ctcttgtaagatt

SEQ ID NO: 3726506 - DNA, 18 bp, Homo sapiens
ctcttgtaagattttgaa

SEQ ID NO: 3726507 - DNA, 16 bp, Homo sapiens
ctcttgttttcagttt

SEQ ID NO: 3726508 - DNA, 18 bp, Homo sapiens
ctctttaactcaggactc

SEQ ID NO: 3726509 - DNA, 15 bp, Homo sapiens
ctctttcagaaaaca

SEQ ID NO: 3726510 - DNA, 18 bp, Homo sapiens
ctctttctccttagtctt

SEQ ID NO: 3726511 - DNA, 23 bp, Homo sapiens
ctctttgagatagaagaactgca

SEQ ID NO: 3726512 - DNA, 18 bp, Homo sapiens
ctctttggacactcacac

SEQ ID NO: 3726513 - DNA, 14 bp, Homo sapiens
ctcttttcaaaaca

SEQ ID NO: 3726514 - DNA, 14 bp, Homo sapiens
ctcttttctgcatc

SEQ ID NO: 3726515 - DNA, 11 bp, Homo sapiens
ctctttttaag

SEQ ID NO: 3726516 - DNA, 15 bp, Homo sapiens
ctgaaaacccagaga

SEQ ID NO: 3726517 - DNA, 17 bp, Homo sapiens
ctgaaaacccagagagg

SEQ ID NO: 3726518 - DNA, 18 bp, Homo sapiens
ctgaaaagactcagtgtt

SEQ ID NO: 3726519 - DNA, 13 bp, Homo sapiens
ctgaaaatgttag

SEQ ID NO: 3726520 - DNA, 16 bp, Homo sapiens
ctgaaaattaacactg

SEQ ID NO: 3726521 - DNA, 16 bp, Homo sapiens
ctgaaactaatgaaag

SEQ ID NO: 3726522 - DNA, 17 bp, Homo sapiens
ctgaaacttacacacaa

SEQ ID NO: 3726523 - DNA, 14 bp, Homo sapiens
ctgaaagaggccaa

SEQ ID NO: 3726524 - DNA, 14 bp, Homo sapiens
ctgaaagccagctg

SEQ ID NO: 3726525 - DNA, 17 bp, Homo sapiens
ctgaaagccctgagctt

SEQ ID NO: 3726526 - DNA, 18 bp, Homo sapiens
ctgaaatatacacacagc

SEQ ID NO: 3726527 - DNA, 19 bp, Homo sapiens
ctgaaatctcagaattcct

SEQ ID NO: 3726528 - DNA, 17 bp, Homo sapiens
ctgaaatgccttacttt

SEQ ID NO: 3726529 - DNA, 14 bp, Homo sapiens
ctgaaatttcagat

SEQ ID NO: 3726530 - DNA, 13 bp, Homo sapiens
ctgaacaagaatt

SEQ ID NO: 3726531 - DNA, 16 bp, Homo sapiens
ctgaacaagaattgga

SEQ ID NO: 3726532 - DNA, 16 bp, Homo sapiens
ctgaacacttattgct

SEQ ID NO: 3726533 - DNA, 20 bp, Homo sapiens
ctgaacacttattgctttga

SEQ ID NO: 3726534 - DNA, 21 bp, Homo sapiens
ctgaagactcattcttctgta

SEQ ID NO: 3726535 - DNA, 14 bp, Homo sapiens
ctgaagatagaaga

SEQ ID NO: 3726536 - DNA, 14 bp, Homo sapiens
ctgaagcttattaa

SEQ ID NO: 3726537 - DNA, 18 bp, Homo sapiens
ctgaagcttattaatgct

SEQ ID NO: 3726538 - DNA, 23 bp, Homo sapiens
ctgaagcttattaatgctaaggg

SEQ ID NO: 3726539 - DNA, 21 bp, Homo sapiens
ctgaaggacattgcggacagc

SEQ ID NO: 3726540 - DNA, 23 bp, Homo sapiens
ctgaaggacattgcggacagcca

SEQ ID NO: 3726541 - DNA, 12 bp, Homo sapiens
ctgaaggactgg

SEQ ID NO: 3726542 - DNA, 13 bp, Homo sapiens
ctgaaggactgga

SEQ ID NO: 3726543 - DNA, 20 bp, Homo sapiens
ctgaaggctttcagggcctc

SEQ ID NO: 3726544 - DNA, 17 bp, Homo sapiens
ctgaaggtaaaattgaa

SEQ ID NO: 3726545 - DNA, 19 bp, Homo sapiens
ctgaaggtaaaattgaaag

SEQ ID NO: 3726546 - DNA, 22 bp, Homo sapiens
ctgaagtcacatcacaggacac

SEQ ID NO: 3726547 - DNA, 14 bp, Homo sapiens
ctgaagtcactgca

SEQ ID NO: 3726548 - DNA, 15 bp, Homo sapiens
ctgaagtttcattta

SEQ ID NO: 3726549 - DNA, 16 bp, Homo sapiens
ctgaatacagaggcaa

SEQ ID NO: 3726550 - DNA, 18 bp, Homo sapiens
ctgaatacattctgcttt

SEQ ID NO: 3726551 - DNA, 22 bp, Homo sapiens
ctgaatgaacaacctcggctcc

SEQ ID NO: 3726552 - DNA, 15 bp, Homo sapiens
ctgaatgtaatttgt

SEQ ID NO: 3726553 - DNA, 18 bp, Homo sapiens
ctgaatgtaatttgtgta

SEQ ID NO: 3726554 - DNA, 13 bp, Homo sapiens
ctgaatgttctga

SEQ ID NO: 3726555 - DNA, 14 bp, Homo sapiens
ctgaatgttctgac

SEQ ID NO: 3726556 - DNA, 15 bp, Homo sapiens
ctgaattgtccccag

SEQ ID NO: 3726557 - DNA, 16 bp, Homo sapiens
ctgaatttataaaaat

SEQ ID NO: 3726558 - DNA, 21 bp, Homo sapiens
ctgacaaccaccgctccccag

SEQ ID NO: 3726559 - DNA, 16 bp, Homo sapiens
ctgacacacagctctg

SEQ ID NO: 3726560 - DNA, 19 bp, Homo sapiens
ctgacacacagctctgtcc

SEQ ID NO: 3726561 - DNA, 22 bp, Homo sapiens
ctgacacacagctctgtcctgg

SEQ ID NO: 3726562 - DNA, 23 bp, Homo sapiens
ctgacacacagctctgtcctggg

SEQ ID NO: 3726563 - DNA, 21 bp, Homo sapiens
ctgacagacacaggcccggct

SEQ ID NO: 3726564 - DNA, 13 bp, Homo sapiens
ctgacagaggggg

SEQ ID NO: 3726565 - DNA, 12 bp, Homo sapiens
ctgacagcctcc

SEQ ID NO: 3726566 - DNA, 14 bp, Homo sapiens
ctgacattaacagt

SEQ ID NO: 3726567 - DNA, 21 bp, Homo sapiens
ctgacattaacagttttccat

SEQ ID NO: 3726568 - DNA, 17 bp, Homo sapiens
ctgacattgttggccaa

SEQ ID NO: 3726569 - DNA, 19 bp, Homo sapiens
ctgaccaacagttccttca

SEQ ID NO: 3726570 - DNA, 12 bp, Homo sapiens
ctgaccacactt

SEQ ID NO: 3726571 - DNA, 17 bp, Homo sapiens
ctgaccacacttcctgt

SEQ ID NO: 3726572 - DNA, 19 bp, Homo sapiens
ctgaccatccactctaccc

SEQ ID NO: 3726573 - DNA, 18 bp, Homo sapiens
ctgaccatttcaggggtc

SEQ ID NO: 3726574 - DNA, 14 bp, Homo sapiens
ctgacccactgctt

SEQ ID NO: 3726575 - DNA, 17 bp, Homo sapiens
ctgacccagtccctggg

SEQ ID NO: 3726576 - DNA, 18 bp, Homo sapiens
ctgacccagtccctgggg

SEQ ID NO: 3726577 - DNA, 20 bp, Homo sapiens
ctgacccccctcaggaccct

SEQ ID NO: 3726578 - DNA, 23 bp, Homo sapiens
ctgacccccctcaggaccctcgc

SEQ ID NO: 3726579 - DNA, 17 bp, Homo sapiens
ctgaccctgcagagatg

SEQ ID NO: 3726580 - DNA, 18 bp, Homo sapiens
ctgaccctgcagagatgc

SEQ ID NO: 3726581 - DNA, 18 bp, Homo sapiens
ctgaccgaaacagcgctg

SEQ ID NO: 3726582 - DNA, 11 bp, Homo sapiens
ctgacctcagc

SEQ ID NO: 3726583 - DNA, 12 bp, Homo sapiens
ctgacctcagca

SEQ ID NO: 3726584 - DNA, 12 bp, Homo sapiens
ctgacctgcagg

SEQ ID NO: 3726585 - DNA, 20 bp, Homo sapiens
ctgaccttgaactcctgggc

SEQ ID NO: 3726586 - DNA, 23 bp, Homo sapiens
ctgacgacttgagtgctcagtag

SEQ ID NO: 3726587 - DNA, 16 bp, Homo sapiens
ctgacgaggctgggcc

SEQ ID NO: 3726588 - DNA, 14 bp, Homo sapiens
ctgacggcgccccc

SEQ ID NO: 3726589 - DNA, 22 bp, Homo sapiens
ctgactagaagggccagtcctg

SEQ ID NO: 3726590 - DNA, 18 bp, Homo sapiens
ctgactcccaaagagctg

SEQ ID NO: 3726591 - DNA, 21 bp, Homo sapiens
ctgactcccaaagagctgcct

SEQ ID NO: 3726592 - DNA, 13 bp, Homo sapiens
ctgactccttaga

SEQ ID NO: 3726593 - DNA, 21 bp, Homo sapiens
ctgactctaggtgcccttgga

SEQ ID NO: 3726594 - DNA, 16 bp, Homo sapiens
ctgactctctgtgacc

SEQ ID NO: 3726595 - DNA, 16 bp, Homo sapiens
ctgactgtggccccct

SEQ ID NO: 3726596 - DNA, 23 bp, Homo sapiens
ctgacttccccgcattccaggct

SEQ ID NO: 3726597 - DNA, 15 bp, Homo sapiens
ctgactttgctcttt

SEQ ID NO: 3726598 - DNA, 21 bp, Homo sapiens
ctgagaaaacgaaactgctct

SEQ ID NO: 3726599 - DNA, 23 bp, Homo sapiens
ctgagaacagatctccaaagctt

SEQ ID NO: 3726600 - DNA, 23 bp, Homo sapiens
ctgagaaggggaggacctctggg

SEQ ID NO: 3726601 - DNA, 17 bp, Homo sapiens
ctgagacaaatggaggc

SEQ ID NO: 3726602 - DNA, 20 bp, Homo sapiens
ctgagacaaatggaggcctg

SEQ ID NO: 3726603 - DNA, 13 bp, Homo sapiens
ctgagagatctgc

SEQ ID NO: 3726604 - DNA, 15 bp, Homo sapiens
ctgagagatctgctg

SEQ ID NO: 3726605 - DNA, 16 bp, Homo sapiens
ctgagagatctgctgt

SEQ ID NO: 3726606 - DNA, 19 bp, Homo sapiens
ctgagagtatttaggcaga

SEQ ID NO: 3726607 - DNA, 20 bp, Homo sapiens
ctgagagtatttaggcagat

SEQ ID NO: 3726608 - DNA, 14 bp, Homo sapiens
ctgagatcgtgccg

SEQ ID NO: 3726609 - DNA, 18 bp, Homo sapiens
ctgagatggccctctggt

SEQ ID NO: 3726610 - DNA, 12 bp, Homo sapiens
ctgagcaaagca

SEQ ID NO: 3726611 - DNA, 21 bp, Homo sapiens
ctgagcaaatgtggctcctgg

SEQ ID NO: 3726612 - DNA, 16 bp, Homo sapiens
ctgagcaacagagtga

SEQ ID NO: 3726613 - DNA, 13 bp, Homo sapiens
ctgagcaccaggg

SEQ ID NO: 3726614 - DNA, 16 bp, Homo sapiens
ctgagcacctcccagc

SEQ ID NO: 3726615 - DNA, 21 bp, Homo sapiens
ctgagcacctcccagcccctg

SEQ ID NO: 3726616 - DNA, 17 bp, Homo sapiens
ctgagcagactggtgag

SEQ ID NO: 3726617 - DNA, 22 bp, Homo sapiens
ctgagcagactggtgagcagac

SEQ ID NO: 3726618 - DNA, 13 bp, Homo sapiens
ctgagccctggca

SEQ ID NO: 3726619 - DNA, 14 bp, Homo sapiens
ctgagccctggcag

SEQ ID NO: 3726620 - DNA, 17 bp, Homo sapiens
ctgagcctacagatgaa

SEQ ID NO: 3726621 - DNA, 17 bp, Homo sapiens
ctgagccttcagtcttg

SEQ ID NO: 3726622 - DNA, 18 bp, Homo sapiens
ctgagctccccaccaccc

SEQ ID NO: 3726623 - DNA, 20 bp, Homo sapiens
ctgagctccccaccacccca

SEQ ID NO: 3726624 - DNA, 18 bp, Homo sapiens
ctgagctcggtggaccca

SEQ ID NO: 3726625 - DNA, 22 bp, Homo sapiens
ctgagctcggtggacccaggga

SEQ ID NO: 3726626 - DNA, 15 bp, Homo sapiens
ctgagctgccatcca

SEQ ID NO: 3726627 - DNA, 16 bp, Homo sapiens
ctgagctgccatccag

SEQ ID NO: 3726628 - DNA, 22 bp, Homo sapiens
ctgagctttggacacacacagc

SEQ ID NO: 3726629 - DNA, 23 bp, Homo sapiens
ctgagctttggacacacacagct

SEQ ID NO: 3726630 - DNA, 21 bp, Homo sapiens
ctgagctttggacgcacacag

SEQ ID NO: 3726631 - DNA, 16 bp, Homo sapiens
ctgaggaaaggccagc

SEQ ID NO: 3726632 - DNA, 18 bp, Homo sapiens
ctgaggaaaggccagctg

SEQ ID NO: 3726633 - DNA, 20 bp, Homo sapiens
ctgaggaaaggccagctggc

SEQ ID NO: 3726634 - DNA, 20 bp, Homo sapiens
ctgaggaatcaacagggcag

SEQ ID NO: 3726635 - DNA, 14 bp, Homo sapiens
ctgaggaatccaga

SEQ ID NO: 3726636 - DNA, 17 bp, Homo sapiens
ctgaggaatccagaccc

SEQ ID NO: 3726637 - DNA, 20 bp, Homo sapiens
ctgaggaatccagacccggc

SEQ ID NO: 3726638 - DNA, 23 bp, Homo sapiens
ctgaggacactaaccacgctgga

SEQ ID NO: 3726639 - DNA, 15 bp, Homo sapiens
ctgaggactgcacca

SEQ ID NO: 3726640 - DNA, 15 bp, Homo sapiens
ctgaggatcagaaag

SEQ ID NO: 3726641 - DNA, 18 bp, Homo sapiens
ctgaggatcagaaagtaa

SEQ ID NO: 3726642 - DNA, 15 bp, Homo sapiens
ctgaggcagaagaat

SEQ ID NO: 3726643 - DNA, 15 bp, Homo sapiens
ctgaggcagacagca

SEQ ID NO: 3726644 - DNA, 17 bp, Homo sapiens
ctgaggcagacagcagc

SEQ ID NO: 3726645 - DNA, 18 bp, Homo sapiens
ctgaggcagacagcagct

SEQ ID NO: 3726646 - DNA, 15 bp, Homo sapiens
ctgaggcaggagaat

SEQ ID NO: 3726647 - DNA, 20 bp, Homo sapiens
ctgaggctctttctgggcca

SEQ ID NO: 3726648 - DNA, 17 bp, Homo sapiens
ctgaggctggactccag

SEQ ID NO: 3726649 - DNA, 18 bp, Homo sapiens
ctgaggctggactccaga

SEQ ID NO: 3726650 - DNA, 18 bp, Homo sapiens
ctgagggaccaactgggc

SEQ ID NO: 3726651 - DNA, 20 bp, Homo sapiens
ctgagggaccaactgggccc

SEQ ID NO: 3726652 - DNA, 21 bp, Homo sapiens
ctgaggggaggatcactggag

SEQ ID NO: 3726653 - DNA, 23 bp, Homo sapiens
ctgaggggaggatcactggagcc

SEQ ID NO: 3726654 - DNA, 21 bp, Homo sapiens
ctgaggggcaacgaagaaaaa

SEQ ID NO: 3726655 - DNA, 16 bp, Homo sapiens
ctgaggggcatctgcc

SEQ ID NO: 3726656 - DNA, 21 bp, Homo sapiens
ctgaggtctcttgagggagct

SEQ ID NO: 3726657 - DNA, 13 bp, Homo sapiens
ctgaggtgggagg

SEQ ID NO: 3726658 - DNA, 20 bp, Homo sapiens
ctgaggtgggcagatcacga

SEQ ID NO: 3726659 - DNA, 20 bp, Homo sapiens
ctgagtcacccatgaagaca

SEQ ID NO: 3726660 - DNA, 18 bp, Homo sapiens
ctgagtttaccatttgta

SEQ ID NO: 3726661 - DNA, 23 bp, Homo sapiens
ctgagtttaccatttgtaataaa

SEQ ID NO: 3726662 - DNA, 16 bp, Homo sapiens
ctgatagcgttggaat

SEQ ID NO: 3726663 - DNA, 15 bp, Homo sapiens
ctgatatagaattgc

SEQ ID NO: 3726664 - DNA, 22 bp, Homo sapiens
ctgatatatgtgtttttcacat

SEQ ID NO: 3726665 - DNA, 15 bp, Homo sapiens
ctgatcatgcattgt

SEQ ID NO: 3726666 - DNA, 12 bp, Homo sapiens
ctgatcccactc

SEQ ID NO: 3726667 - DNA, 16 bp, Homo sapiens
ctgatcccactcctag

SEQ ID NO: 3726668 - DNA, 15 bp, Homo sapiens
ctgatcgtgctaaat

SEQ ID NO: 3726669 - DNA, 19 bp, Homo sapiens
ctgatcgtgctaaattttc

SEQ ID NO: 3726670 - DNA, 20 bp, Homo sapiens
ctgatctcagggaagcccag

SEQ ID NO: 3726671 - DNA, 21 bp, Homo sapiens
ctgatctcagggaagcccagc

SEQ ID NO: 3726672 - DNA, 23 bp, Homo sapiens
ctgatctcagggaagcccagctc

SEQ ID NO: 3726673 - DNA, 21 bp, Homo sapiens
ctgatctctactaccacaagg

SEQ ID NO: 3726674 - DNA, 15 bp, Homo sapiens
ctgatgacactgaga

SEQ ID NO: 3726675 - DNA, 12 bp, Homo sapiens
ctgatgacccag

SEQ ID NO: 3726676 - DNA, 17 bp, Homo sapiens
ctgatgagaatactgag

SEQ ID NO: 3726677 - DNA, 15 bp, Homo sapiens
ctgatgctccctccc

SEQ ID NO: 3726678 - DNA, 17 bp, Homo sapiens
ctgatgctccctcccct

SEQ ID NO: 3726679 - DNA, 21 bp, Homo sapiens
ctgatgctccctcccctgccc

SEQ ID NO: 3726680 - DNA, 22 bp, Homo sapiens
ctgatgctccctcccctgccct

SEQ ID NO: 3726681 - DNA, 20 bp, Homo sapiens
ctgatggaaacaaagtggaa

SEQ ID NO: 3726682 - DNA, 22 bp, Homo sapiens
ctgatgggcaacccccagcctg

SEQ ID NO: 3726683 - DNA, 18 bp, Homo sapiens
ctgatgttaggctgggcc

SEQ ID NO: 3726684 - DNA, 14 bp, Homo sapiens
ctgattactgtcaa

SEQ ID NO: 3726685 - DNA, 19 bp, Homo sapiens
ctgattactgtcaataaac

SEQ ID NO: 3726686 - DNA, 13 bp, Homo sapiens
ctgattagaaatg

SEQ ID NO: 3726687 - DNA, 22 bp, Homo sapiens
ctgattcataataaatatctgt

SEQ ID NO: 3726688 - DNA, 15 bp, Homo sapiens
ctgattcccaagctc

SEQ ID NO: 3726689 - DNA, 18 bp, Homo sapiens
ctgattcccaagctctgc

SEQ ID NO: 3726690 - DNA, 13 bp, Homo sapiens
ctgatttcttgct

SEQ ID NO: 3726691 - DNA, 13 bp, Homo sapiens
ctgattttaacaa

SEQ ID NO: 3726692 - DNA, 13 bp, Homo sapiens
ctgcaaaatttta

SEQ ID NO: 3726693 - DNA, 22 bp, Homo sapiens
ctgcaaaggactgttttttcct

SEQ ID NO: 3726694 - DNA, 23 bp, Homo sapiens
ctgcaaaggtaataatacagcca

SEQ ID NO: 3726695 - DNA, 20 bp, Homo sapiens
ctgcaacaggaactgtgaga

SEQ ID NO: 3726696 - DNA, 13 bp, Homo sapiens
ctgcaagagcctt

SEQ ID NO: 3726697 - DNA, 14 bp, Homo sapiens
ctgcaagagccttg

SEQ ID NO: 3726698 - DNA, 18 bp, Homo sapiens
ctgcaagagccttggtgt

SEQ ID NO: 3726699 - DNA, 21 bp, Homo sapiens
ctgcaagagccttggtgtcca

SEQ ID NO: 3726700 - DNA, 17 bp, Homo sapiens
ctgcaaggtctttggtt

SEQ ID NO: 3726701 - DNA, 16 bp, Homo sapiens
ctgcaagtcacaaagg

SEQ ID NO: 3726702 - DNA, 17 bp, Homo sapiens
ctgcaagtcacaaagga

SEQ ID NO: 3726703 - DNA, 18 bp, Homo sapiens
ctgcaagtcacaaaggaa

SEQ ID NO: 3726704 - DNA, 19 bp, Homo sapiens
ctgcaagtgacatctcttt

SEQ ID NO: 3726705 - DNA, 22 bp, Homo sapiens
ctgcaagtgagcaaacctgccc

SEQ ID NO: 3726706 - DNA, 14 bp, Homo sapiens
ctgcaatagagact

SEQ ID NO: 3726707 - DNA, 16 bp, Homo sapiens
ctgcaatagagactgt

SEQ ID NO: 3726708 - DNA, 18 bp, Homo sapiens
ctgcaatagagactgtag

SEQ ID NO: 3726709 - DNA, 21 bp, Homo sapiens
ctgcacaaagcccttccatgt

SEQ ID NO: 3726710 - DNA, 22 bp, Homo sapiens
ctgcacaagctgcaccctcagg

SEQ ID NO: 3726711 - DNA, 12 bp, Homo sapiens
ctgcacagatgg

SEQ ID NO: 3726712 - DNA, 13 bp, Homo sapiens
ctgcacagatgga

SEQ ID NO: 3726713 - DNA, 23 bp, Homo sapiens
ctgcacagatggatttgcctgtg

SEQ ID NO: 3726714 - DNA, 14 bp, Homo sapiens
ctgcaccaggagac

SEQ ID NO: 3726715 - DNA, 15 bp, Homo sapiens
ctgcaccaggagaca

SEQ ID NO: 3726716 - DNA, 17 bp, Homo sapiens
ctgcacccccctgggct

SEQ ID NO: 3726717 - DNA, 16 bp, Homo sapiens
ctgcaccctcaggcag

SEQ ID NO: 3726718 - DNA, 18 bp, Homo sapiens
ctgcaccctcaggcaggt

SEQ ID NO: 3726719 - DNA, 20 bp, Homo sapiens
ctgcaccgggccacagagaa

SEQ ID NO: 3726720 - DNA, 17 bp, Homo sapiens
ctgcacctccccccact

SEQ ID NO: 3726721 - DNA, 18 bp, Homo sapiens
ctgcacctccccccactg

SEQ ID NO: 3726722 - DNA, 20 bp, Homo sapiens
ctgcacctccccccactgca

SEQ ID NO: 3726723 - DNA, 22 bp, Homo sapiens
ctgcacctccccccactgcagg

SEQ ID NO: 3726724 - DNA, 15 bp, Homo sapiens
ctgcaccttatctta

SEQ ID NO: 3726725 - DNA, 17 bp, Homo sapiens
ctgcacgtggcttctga

SEQ ID NO: 3726726 - DNA, 17 bp, Homo sapiens
ctgcactatagcctagg

SEQ ID NO: 3726727 - DNA, 20 bp, Homo sapiens
ctgcactccaatctgggtga

SEQ ID NO: 3726728 - DNA, 14 bp, Homo sapiens
ctgcactccagcct

SEQ ID NO: 3726729 - DNA, 19 bp, Homo sapiens
ctgcactccagcctgggcg

SEQ ID NO: 3726730 - DNA, 19 bp, Homo sapiens
ctgcactccagcctgggtg

SEQ ID NO: 3726731 - DNA, 20 bp, Homo sapiens
ctgcactccagcctgggtga

SEQ ID NO: 3726732 - DNA, 20 bp, Homo sapiens
ctgcactgacccacagcctc

SEQ ID NO: 3726733 - DNA, 20 bp, Homo sapiens
ctgcagaacgtattggtcca

SEQ ID NO: 3726734 - DNA, 13 bp, Homo sapiens
ctgccctgcccac

SEQ ID NO: 3726735 - DNA, 18 bp, Homo sapiens
ctgccctgccctagctcc

SEQ ID NO: 3726736 - DNA, 11 bp, Homo sapiens
ctgccctggga

SEQ ID NO: 3726737 - DNA, 14 bp, Homo sapiens
ctgccctggtccag

SEQ ID NO: 3726738 - DNA, 20 bp, Homo sapiens
ctgccctggtccagggaagc

SEQ ID NO: 3726739 - DNA, 23 bp, Homo sapiens
ctgccctggtccagggaagctgg

SEQ ID NO: 3726740 - DNA, 14 bp, Homo sapiens
ctgccctggtgctg

SEQ ID NO: 3726741 - DNA, 17 bp, Homo sapiens
ctgccctggtgctgcca

SEQ ID NO: 3726742 - DNA, 23 bp, Homo sapiens
ctgccctggtgctgccacacttc

SEQ ID NO: 3726743 - DNA, 12 bp, Homo sapiens
ctgccctgtcta

SEQ ID NO: 3726744 - DNA, 16 bp, Homo sapiens
ctgcccttcagcatcc

SEQ ID NO: 3726745 - DNA, 18 bp, Homo sapiens
ctgcccttgtcccactca

SEQ ID NO: 3726746 - DNA, 20 bp, Homo sapiens
ctgccgacacgctccctccc

SEQ ID NO: 3726747 - DNA, 15 bp, Homo sapiens
ctgccgaccagagcc

SEQ ID NO: 3726748 - DNA, 15 bp, Homo sapiens
ctgccgacctcgtcc

SEQ ID NO: 3726749 - DNA, 19 bp, Homo sapiens
ctgccgacctcgtcctccc

SEQ ID NO: 3726750 - DNA, 17 bp, Homo sapiens
ctgccgcaccccagagt

SEQ ID NO: 3726751 - DNA, 21 bp, Homo sapiens
ctgccggccctggggctaggc

SEQ ID NO: 3726752 - DNA, 15 bp, Homo sapiens
ctgcctaagaggcaa

SEQ ID NO: 3726753 - DNA, 20 bp, Homo sapiens
ctgcctagcactcacatgct

SEQ ID NO: 3726754 - DNA, 13 bp, Homo sapiens
ctgcctcagcctc

SEQ ID NO: 3726755 - DNA, 14 bp, Homo sapiens
ctgcctcagcctcc

SEQ ID NO: 3726756 - DNA, 22 bp, Homo sapiens
ctgcctccagaatggtctttct

SEQ ID NO: 3726757 - DNA, 12 bp, Homo sapiens
ctgcctccccaa

SEQ ID NO: 3726758 - DNA, 22 bp, Homo sapiens
ctgcctccccaaccctgcccct

SEQ ID NO: 3726759 - DNA, 15 bp, Homo sapiens
ctgcctccctgtcca

SEQ ID NO: 3726760 - DNA, 17 bp, Homo sapiens
ctgcctccctgtccacc

SEQ ID NO: 3726761 - DNA, 14 bp, Homo sapiens
ctgcctcctcttca

SEQ ID NO: 3726762 - DNA, 15 bp, Homo sapiens
ctgcctcctcttcaa

SEQ ID NO: 3726763 - DNA, 18 bp, Homo sapiens
ctgcctctgcctgcattc

SEQ ID NO: 3726764 - DNA, 15 bp, Homo sapiens
ctgcctgaagtcaca

SEQ ID NO: 3726765 - DNA, 13 bp, Homo sapiens
ctgcctgcccacc

SEQ ID NO: 3726766 - DNA, 15 bp, Homo sapiens
ctgcctgcccaggcc

SEQ ID NO: 3726767 - DNA, 17 bp, Homo sapiens
ctgcctgcccaggcccc

SEQ ID NO: 3726768 - DNA, 22 bp, Homo sapiens
ctgcctgcccaggcccctgcca

SEQ ID NO: 3726769 - DNA, 13 bp, Homo sapiens
ctgcctggagccc

SEQ ID NO: 3726770 - DNA, 13 bp, Homo sapiens
ctgcctggccagg

SEQ ID NO: 3726771 - DNA, 16 bp, Homo sapiens
ctgcctggcccccagc

SEQ ID NO: 3726772 - DNA, 15 bp, Homo sapiens
ctgcctggtctcctg

SEQ ID NO: 3726773 - DNA, 16 bp, Homo sapiens
ctgcctggtctcctgc

SEQ ID NO: 3726774 - DNA, 17 bp, Homo sapiens
ctgcctggtctcctgcc

SEQ ID NO: 3726775 - DNA, 19 bp, Homo sapiens
ctgcctggtctcctgcccc

SEQ ID NO: 3726776 - DNA, 22 bp, Homo sapiens
ctgcctggtctcctgcccccac

SEQ ID NO: 3726777 - DNA, 19 bp, Homo sapiens
ctgcctgtaacttgagagt

SEQ ID NO: 3726778 - DNA, 16 bp, Homo sapiens
ctgcctgtagttagga

SEQ ID NO: 3726779 - DNA, 20 bp, Homo sapiens
ctgcctgtagttaggaaata

SEQ ID NO: 3726780 - DNA, 21 bp, Homo sapiens
ctgcctgtagttaggaaataa

SEQ ID NO: 3726781 - DNA, 16 bp, Homo sapiens
ctgcctgtccctctca

SEQ ID NO: 3726782 - DNA, 13 bp, Homo sapiens
ctgcctgtctcct

SEQ ID NO: 3726783 - DNA, 16 bp, Homo sapiens
ctgcctgtgagccagt

SEQ ID NO: 3726784 - DNA, 18 bp, Homo sapiens
ctgcctgtgagccagtct

SEQ ID NO: 3726785 - DNA, 13 bp, Homo sapiens
ctgcctgtggagt

SEQ ID NO: 3726786 - DNA, 20 bp, Homo sapiens
ctgccttgaagccactgaag

SEQ ID NO: 3726787 - DNA, 23 bp, Homo sapiens
ctgccttggactgtgtttttcct

SEQ ID NO: 3726788 - DNA, 19 bp, Homo sapiens
ctgcgaaggggccctggtc

SEQ ID NO: 3726789 - DNA, 14 bp, Homo sapiens
ctgcgcccttcccc

SEQ ID NO: 3726790 - DNA, 15 bp, Homo sapiens
ctgcggcctgctgga

SEQ ID NO: 3726791 - DNA, 18 bp, Homo sapiens
ctgcgggatggtcctggg

SEQ ID NO: 3726792 - DNA, 15 bp, Homo sapiens
ctgcggtcaaggcca

SEQ ID NO: 3726793 - DNA, 16 bp, Homo sapiens
ctgcggtcaaggccag

SEQ ID NO: 3726794 - DNA, 17 bp, Homo sapiens
ctgcggtcaaggccagc

SEQ ID NO: 3726795 - DNA, 15 bp, Homo sapiens
ctgcgtggctgaccc

SEQ ID NO: 3726796 - DNA, 23 bp, Homo sapiens
ctgcgtggctgacccccctcagg

SEQ ID NO: 3726797 - DNA, 12 bp, Homo sapiens
ctgctaaatctc

SEQ ID NO: 3726798 - DNA, 18 bp, Homo sapiens
ctgctaaatctcctattt

SEQ ID NO: 3726799 - DNA, 17 bp, Homo sapiens
ctgctacccagaaatca

SEQ ID NO: 3726800 - DNA, 22 bp, Homo sapiens
ctgctactctgttccttcacat

SEQ ID NO: 3726801 - DNA, 13 bp, Homo sapiens
ctgctagaaatgg

SEQ ID NO: 3726802 - DNA, 21 bp, Homo sapiens
ctgctagcacttggagccaag

SEQ ID NO: 3726803 - DNA, 20 bp, Homo sapiens
ctgctaggtgggccagcccc

SEQ ID NO: 3726804 - DNA, 16 bp, Homo sapiens
ctgctatcctgccaaa

SEQ ID NO: 3726805 - DNA, 13 bp, Homo sapiens
ctgctatttccca

SEQ ID NO: 3726806 - DNA, 21 bp, Homo sapiens
ctgctatttcccaagctggag

SEQ ID NO: 3726807 - DNA, 24 bp, Homo sapiens
ctgctatttcccaagctggagtgc

SEQ ID NO: 3726808 - DNA, 19 bp, Homo sapiens
ctgctcacatatctgtcat

SEQ ID NO: 3726809 - DNA, 13 bp, Homo sapiens
ctgctcagacaga

SEQ ID NO: 3726810 - DNA, 13 bp, Homo sapiens
ctgctccaccaca

SEQ ID NO: 3726811 - DNA, 11 bp, Homo sapiens
ctgctccaccc

SEQ ID NO: 3726812 - DNA, 16 bp, Homo sapiens
ctgctccacccttggc

SEQ ID NO: 3726813 - DNA, 18 bp, Homo sapiens
ctgctccacccttggcct

SEQ ID NO: 3726814 - DNA, 20 bp, Homo sapiens
ctgctccagctgttcagctg

SEQ ID NO: 3726815 - DNA, 12 bp, Homo sapiens
ctgctcccccac

SEQ ID NO: 3726816 - DNA, 14 bp, Homo sapiens
ctgctcccccaccc

SEQ ID NO: 3726817 - DNA, 21 bp, Homo sapiens
ctgctcccccaccccctcccc

SEQ ID NO: 3726818 - DNA, 17 bp, Homo sapiens
ctgctcccctccctcct

SEQ ID NO: 3726819 - DNA, 13 bp, Homo sapiens
ctgctcctcatgg

SEQ ID NO: 3726820 - DNA, 23 bp, Homo sapiens
ctgctcctctccccagcaagtga

SEQ ID NO: 3726821 - DNA, 22 bp, Homo sapiens
ctgctctctacccagcccatct

SEQ ID NO: 3726822 - DNA, 13 bp, Homo sapiens
ctgctctgcccag

SEQ ID NO: 3726823 - DNA, 18 bp, Homo sapiens
ctgctctgcccagagctg

SEQ ID NO: 3726824 - DNA, 21 bp, Homo sapiens
ctgctctgcccagagctgggt

SEQ ID NO: 3726825 - DNA, 23 bp, Homo sapiens
ctgctgaatgatttccaaagaga

SEQ ID NO: 3726826 - DNA, 20 bp, Homo sapiens
ctgctgacagacacaggccc

SEQ ID NO: 3726827 - DNA, 12 bp, Homo sapiens
ctgctgacagtg

SEQ ID NO: 3726828 - DNA, 13 bp, Homo sapiens
ctgctgacagtgt

SEQ ID NO: 3726829 - DNA, 15 bp, Homo sapiens
ctgctgagagaccca

SEQ ID NO: 3726830 - DNA, 21 bp, Homo sapiens
ctgctgagagacccaaggagg

SEQ ID NO: 3726831 - DNA, 18 bp, Homo sapiens
ctgctgatgtggcaactg

SEQ ID NO: 3726832 - DNA, 16 bp, Homo sapiens
ctgctgcatggggtgg

SEQ ID NO: 3726833 - DNA, 15 bp, Homo sapiens
ctgctgcccagcctc

SEQ ID NO: 3726834 - DNA, 18 bp, Homo sapiens
ctgctgccccaaaggaag

SEQ ID NO: 3726835 - DNA, 22 bp, Homo sapiens
ctgctgccccagctgactgtgg

SEQ ID NO: 3726836 - DNA, 17 bp, Homo sapiens
ctgctgccgcctcccag

SEQ ID NO: 3726837 - DNA, 21 bp, Homo sapiens
ctgctgctaatcttcagggca

SEQ ID NO: 3726838 - DNA, 19 bp, Homo sapiens
ctgctggatctcccagggc

SEQ ID NO: 3726839 - DNA, 20 bp, Homo sapiens
ctgctggatctcccagggct

SEQ ID NO: 3726840 - DNA, 16 bp, Homo sapiens
ctgctggcccagccaa

SEQ ID NO: 3726841 - DNA, 16 bp, Homo sapiens
ctgctggccgggcaca

SEQ ID NO: 3726842 - DNA, 19 bp, Homo sapiens
ctgctggccgggcacagct

SEQ ID NO: 3726843 - DNA, 21 bp, Homo sapiens
ctgctggccgggcacagctgt

SEQ ID NO: 3726844 - DNA, 14 bp, Homo sapiens
ctgctggcttgcag

SEQ ID NO: 3726845 - DNA, 14 bp, Homo sapiens
ctgctgggctctcc

SEQ ID NO: 3726846 - DNA, 16 bp, Homo sapiens
ctgctgggctctccac

SEQ ID NO: 3726847 - DNA, 14 bp, Homo sapiens
ctgcttaatgaaaa

SEQ ID NO: 3726848 - DNA, 12 bp, Homo sapiens
ctgcttagcttg

SEQ ID NO: 3726849 - DNA, 15 bp, Homo sapiens
ctgcttcagcttgct

SEQ ID NO: 3726850 - DNA, 13 bp, Homo sapiens
ctgcttctgcacc

SEQ ID NO: 3726851 - DNA, 13 bp, Homo sapiens
ctgcttgaggcaa

SEQ ID NO: 3726852 - DNA, 22 bp, Homo sapiens
ctgcttgaggcaactcatctta

SEQ ID NO: 3726853 - DNA, 18 bp, Homo sapiens
ctgcttggtccttgattt

SEQ ID NO: 3726854 - DNA, 23 bp, Homo sapiens
ctgctttgactgagcagactggt

SEQ ID NO: 3726855 - DNA, 22 bp, Homo sapiens
ctgctttgggctgccctggtgc

SEQ ID NO: 3726856 - DNA, 21 bp, Homo sapiens
ctgcttttccttggggcaggc

SEQ ID NO: 3726857 - DNA, 22 bp, Homo sapiens
ctgcttttccttggggcaggca

SEQ ID NO: 3726858 - DNA, 20 bp, Homo sapiens
ctgcttttgtctatgggact

SEQ ID NO: 3726859 - DNA, 21 bp, Homo sapiens
ctgcttttgtctatgggactc

SEQ ID NO: 3726860 - DNA, 20 bp, Homo sapiens
ctggaaaggctcagtctcag

SEQ ID NO: 3726861 - DNA, 23 bp, Homo sapiens
ctggaaaggctcagtctcaggag

SEQ ID NO: 3726862 - DNA, 16 bp, Homo sapiens
ctggaaatattaagaa

SEQ ID NO: 3726863 - DNA, 12 bp, Homo sapiens
ctggaagagagg

SEQ ID NO: 3726864 - DNA, 16 bp, Homo sapiens
ctggaagagcagccct

SEQ ID NO: 3726865 - DNA, 18 bp, Homo sapiens
ctggaagcacagcttcat

SEQ ID NO: 3726866 - DNA, 23 bp, Homo sapiens
ctggaagcatgtaggagaatcca

SEQ ID NO: 3726867 - DNA, 16 bp, Homo sapiens
ctggaagccctctctg

SEQ ID NO: 3726868 - DNA, 16 bp, Homo sapiens
ctggaagctgtgtcct

SEQ ID NO: 3726869 - DNA, 17 bp, Homo sapiens
ctggaaggggcccgtgg

SEQ ID NO: 3726870 - DNA, 19 bp, Homo sapiens
ctggaaggggcccgtggga

SEQ ID NO: 3726871 - DNA, 17 bp, Homo sapiens
ctggaagttttgcattt

SEQ ID NO: 3726872 - DNA, 15 bp, Homo sapiens
ctggaatgcagtggt

SEQ ID NO: 3726873 - DNA, 15 bp, Homo sapiens
ctggaatggaaaagg

SEQ ID NO: 3726874 - DNA, 17 bp, Homo sapiens
ctggaattttttattct

SEQ ID NO: 3726875 - DNA, 18 bp, Homo sapiens
ctggaattttttattctt

SEQ ID NO: 3726876 - DNA, 16 bp, Homo sapiens
ctggacaggtctggga

SEQ ID NO: 3726877 - DNA, 18 bp, Homo sapiens
ctggacaggtctgggaga

SEQ ID NO: 3726878 - DNA, 14 bp, Homo sapiens
ctggaccaaagctg

SEQ ID NO: 3726879 - DNA, 13 bp, Homo sapiens
ctggaccagatgc

SEQ ID NO: 3726880 - DNA, 14 bp, Homo sapiens
ctggaccagatgct

SEQ ID NO: 3726881 - DNA, 20 bp, Homo sapiens
ctggaccttgaactgggtac

SEQ ID NO: 3726882 - DNA, 17 bp, Homo sapiens
ctggacggcattcctgc

SEQ ID NO: 3726883 - DNA, 16 bp, Homo sapiens
ctggactccagatctg

SEQ ID NO: 3726884 - DNA, 22 bp, Homo sapiens
ctggactgaagcctgcaggagt

SEQ ID NO: 3726885 - DNA, 15 bp, Homo sapiens
ctggactggctagag

SEQ ID NO: 3726886 - DNA, 21 bp, Homo sapiens
ctggactggctagagtcctca

SEQ ID NO: 3726887 - DNA, 13 bp, Homo sapiens
ctggactggctgt

SEQ ID NO: 3726888 - DNA, 19 bp, Homo sapiens
ctggactgtcatagaaatt

SEQ ID NO: 3726889 - DNA, 18 bp, Homo sapiens
ctggacttgagcttggca

SEQ ID NO: 3726890 - DNA, 20 bp, Homo sapiens
ctggagacaatgcagatgcc

SEQ ID NO: 3726891 - DNA, 15 bp, Homo sapiens
ctggagatggggaga

SEQ ID NO: 3726892 - DNA, 13 bp, Homo sapiens
ctggagcaccagg

SEQ ID NO: 3726893 - DNA, 14 bp, Homo sapiens
ctggagcaccaggc

SEQ ID NO: 3726894 - DNA, 16 bp, Homo sapiens
ctggagccacctgtcc

SEQ ID NO: 3726895 - DNA, 20 bp, Homo sapiens
ctggagccacctgtcccacc

SEQ ID NO: 3726896 - DNA, 22 bp, Homo sapiens
ctggagccacctgtcccacctc

SEQ ID NO: 3726897 - DNA, 12 bp, Homo sapiens
ctggagcccagg

SEQ ID NO: 3726898 - DNA, 13 bp, Homo sapiens
ctggagcccaggg

SEQ ID NO: 3726899 - DNA, 14 bp, Homo sapiens
ctggagcccaggga

SEQ ID NO: 3726900 - DNA, 16 bp, Homo sapiens
ctggagccccactgcc

SEQ ID NO: 3726901 - DNA, 13 bp, Homo sapiens
ctggagctcctgg

SEQ ID NO: 3726902 - DNA, 14 bp, Homo sapiens
ctggaggaaaactg

SEQ ID NO: 3726903 - DNA, 17 bp, Homo sapiens
ctggaggaaaactgaga

SEQ ID NO: 3726904 - DNA, 13 bp, Homo sapiens
ctggaggcagggc

SEQ ID NO: 3726905 - DNA, 14 bp, Homo sapiens
ctggaggcctctgg

SEQ ID NO: 3726906 - DNA, 18 bp, Homo sapiens
ctggaggcctctgggcct

SEQ ID NO: 3726907 - DNA, 21 bp, Homo sapiens
ctggaggggacgctggtagag

SEQ ID NO: 3726908 - DNA, 16 bp, Homo sapiens
ctggaggggagctctg

SEQ ID NO: 3726909 - DNA, 21 bp, Homo sapiens
ctggaggggagctctgtctgt

SEQ ID NO: 3726910 - DNA, 15 bp, Homo sapiens
ctggagtccagtctc

SEQ ID NO: 3726911 - DNA, 14 bp, Homo sapiens
ctggagtccctgtg

SEQ ID NO: 3726912 - DNA, 15 bp, Homo sapiens
ctggagtgcagtgag

SEQ ID NO: 3726913 - DNA, 17 bp, Homo sapiens
ctggatccatcaggcca

SEQ ID NO: 3726914 - DNA, 17 bp, Homo sapiens
ctggatctcccagggct

SEQ ID NO: 3726915 - DNA, 19 bp, Homo sapiens
ctggatctcccagggctac

SEQ ID NO: 3726916 - DNA, 20 bp, Homo sapiens
ctggatctgggaccctttcc

SEQ ID NO: 3726917 - DNA, 21 bp, Homo sapiens
ctggatggaggaaaaccaagc

SEQ ID NO: 3726918 - DNA, 20 bp, Homo sapiens
ctggatgttttttccctgtt

SEQ ID NO: 3726919 - DNA, 21 bp, Homo sapiens
ctggcaaagcagaaaattgta

SEQ ID NO: 3726920 - DNA, 17 bp, Homo sapiens
ctggcacatttccccag

SEQ ID NO: 3726921 - DNA, 23 bp, Homo sapiens
ctggcacatttccccagacctga

SEQ ID NO: 3726922 - DNA, 16 bp, Homo sapiens
ctggcacccggcccct

SEQ ID NO: 3726923 - DNA, 17 bp, Homo sapiens
ctggcacccggcccctg

SEQ ID NO: 3726924 - DNA, 18 bp, Homo sapiens
ctggcacccggcccctgc

SEQ ID NO: 3726925 - DNA, 21 bp, Homo sapiens
ctggcacccggcccctgctgg

SEQ ID NO: 3726926 - DNA, 21 bp, Homo sapiens
ctggcactggatgcagaaaca

SEQ ID NO: 3726927 - DNA, 14 bp, Homo sapiens
ctggcacttggaga

SEQ ID NO: 3726928 - DNA, 23 bp, Homo sapiens
ctggcagaaagcaaatgtgacct

SEQ ID NO: 3726929 - DNA, 13 bp, Homo sapiens
ctggcagaactga

SEQ ID NO: 3726930 - DNA, 17 bp, Homo sapiens
ctggcagaactgagctc

SEQ ID NO: 3726931 - DNA, 15 bp, Homo sapiens
ctggcagcagagtgt

SEQ ID NO: 3726932 - DNA, 15 bp, Homo sapiens
ctggcagccccagca

SEQ ID NO: 3726933 - DNA, 18 bp, Homo sapiens
ctggcagccccagcacca

SEQ ID NO: 3726934 - DNA, 18 bp, Homo sapiens
ctggcaggatgaccctgc

SEQ ID NO: 3726935 - DNA, 20 bp, Homo sapiens
ctggcaggatgaccctgcga

SEQ ID NO: 3726936 - DNA, 18 bp, Homo sapiens
ctggcagggtgggatgga

SEQ ID NO: 3726937 - DNA, 17 bp, Homo sapiens
ctggcatctgacacaaa

SEQ ID NO: 3726938 - DNA, 13 bp, Homo sapiens
ctggccagaggct

SEQ ID NO: 3726939 - DNA, 14 bp, Homo sapiens
ctggccagatgcac

SEQ ID NO: 3726940 - DNA, 17 bp, Homo sapiens
ctggccagatgcaccag

SEQ ID NO: 3726941 - DNA, 18 bp, Homo sapiens
ctggccagatgcaccagc

SEQ ID NO: 3726942 - DNA, 13 bp, Homo sapiens
ctggccaggagct

SEQ ID NO: 3726943 - DNA, 17 bp, Homo sapiens
ctggccaggagctcttc

SEQ ID NO: 3726944 - DNA, 22 bp, Homo sapiens
ctggccaggagctcttcaggcc

SEQ ID NO: 3726945 - DNA, 23 bp, Homo sapiens
ctggccaggatggaggggtggtc

SEQ ID NO: 3726946 - DNA, 12 bp, Homo sapiens
ctggccatctct

SEQ ID NO: 3726947 - DNA, 16 bp, Homo sapiens
ctggccccatgtctct

SEQ ID NO: 3726948 - DNA, 19 bp, Homo sapiens
ctggccccatgtctctcag

SEQ ID NO: 3726949 - DNA, 19 bp, Homo sapiens
ctggcccccactggctgtg

SEQ ID NO: 3726950 - DNA, 20 bp, Homo sapiens
ctggcccctagaatcagcct

SEQ ID NO: 3726951 - DNA, 13 bp, Homo sapiens
ctggcccctcacc

SEQ ID NO: 3726952 - DNA, 22 bp, Homo sapiens
ctggcccctcacctgggcacct

SEQ ID NO: 3726953 - DNA, 17 bp, Homo sapiens
ctggccctcacccctgc

SEQ ID NO: 3726954 - DNA, 19 bp, Homo sapiens
ctggccgagggtcctggct

SEQ ID NO: 3726955 - DNA, 21 bp, Homo sapiens
ctggccgagggtcctggctcc

SEQ ID NO: 3726956 - DNA, 15 bp, Homo sapiens
ctggccgggcacagc

SEQ ID NO: 3726957 - DNA, 16 bp, Homo sapiens
ctggccgggcacagct

SEQ ID NO: 3726958 - DNA, 23 bp, Homo sapiens
ctggcctcaagtgattctcctgc

SEQ ID NO: 3726959 - DNA, 13 bp, Homo sapiens
ctggcctgaggag

SEQ ID NO: 3726960 - DNA, 16 bp, Homo sapiens
ctggcctgaggagcag

SEQ ID NO: 3726961 - DNA, 20 bp, Homo sapiens
ctggcctgctgggctctcca

SEQ ID NO: 3726962 - DNA, 14 bp, Homo sapiens
ctggccttacacct

SEQ ID NO: 3726963 - DNA, 16 bp, Homo sapiens
ctggcggctactcagc

SEQ ID NO: 3726964 - DNA, 22 bp, Homo sapiens
ctggctagaggccagccccacc

SEQ ID NO: 3726965 - DNA, 18 bp, Homo sapiens
ctggctagagtcctcact

SEQ ID NO: 3726966 - DNA, 19 bp, Homo sapiens
ctggctagagtcctcactc

SEQ ID NO: 3726967 - DNA, 21 bp, Homo sapiens
ctggctagagtcctcactccc

SEQ ID NO: 3726968 - DNA, 20 bp, Homo sapiens
ctggctcatattcctgcagc

SEQ ID NO: 3726969 - DNA, 18 bp, Homo sapiens
ctggctcccagggccatg

SEQ ID NO: 3726970 - DNA, 15 bp, Homo sapiens
ctggctcctgagggg

SEQ ID NO: 3726971 - DNA, 13 bp, Homo sapiens
ctggctgcccaga

SEQ ID NO: 3726972 - DNA, 17 bp, Homo sapiens
ctggctggctgcagtga

SEQ ID NO: 3726973 - DNA, 15 bp, Homo sapiens
ctggctgggcatgga

SEQ ID NO: 3726974 - DNA, 21 bp, Homo sapiens
ctggctgggtggcaccagcag

SEQ ID NO: 3726975 - DNA, 22 bp, Homo sapiens
ctggctgggtggcaccagcagc

SEQ ID NO: 3726976 - DNA, 12 bp, Homo sapiens
ctggctgtgggc

SEQ ID NO: 3726977 - DNA, 13 bp, Homo sapiens
ctggctgtgggct

SEQ ID NO: 3726978 - DNA, 18 bp, Homo sapiens
ctggctgtgggctccctt

SEQ ID NO: 3726979 - DNA, 17 bp, Homo sapiens
ctggctgttggctgggg

SEQ ID NO: 3726980 - DNA, 19 bp, Homo sapiens
ctggctgttggctgggggc

SEQ ID NO: 3726981 - DNA, 14 bp, Homo sapiens
ctggcttcacagat

SEQ ID NO: 3726982 - DNA, 20 bp, Homo sapiens
ctggcttgtaactccaccaa

SEQ ID NO: 3726983 - DNA, 14 bp, Homo sapiens
ctggctttgcccaa

SEQ ID NO: 3726984 - DNA, 22 bp, Homo sapiens
ctggctttgcccaacctcagca

SEQ ID NO: 3726985 - DNA, 14 bp, Homo sapiens
ctggctttgtccca

SEQ ID NO: 3726986 - DNA, 22 bp, Homo sapiens
ctggcttttcactgctggctgc

SEQ ID NO: 3726987 - DNA, 16 bp, Homo sapiens
ctgggaaataagagag

SEQ ID NO: 3726988 - DNA, 17 bp, Homo sapiens
ctgggaaataagagaga

SEQ ID NO: 3726989 - DNA, 23 bp, Homo sapiens
ctgggaaatggcttgaagccaag

SEQ ID NO: 3726990 - DNA, 18 bp, Homo sapiens
ctgggaactcccaagaac

SEQ ID NO: 3726991 - DNA, 20 bp, Homo sapiens
ctgggaagataggctctgca

SEQ ID NO: 3726992 - DNA, 15 bp, Homo sapiens
ctgggaccctttcct

SEQ ID NO: 3726993 - DNA, 19 bp, Homo sapiens
ctgggaccctttccttcct

SEQ ID NO: 3726994 - DNA, 15 bp, Homo sapiens
ctgggactacaggca

SEQ ID NO: 3726995 - DNA, 16 bp, Homo sapiens
ctgggactacaggcac

SEQ ID NO: 3726996 - DNA, 15 bp, Homo sapiens
ctgggagaacctcag

SEQ ID NO: 3726997 - DNA, 16 bp, Homo sapiens
ctgggagaacctcagg

SEQ ID NO: 3726998 - DNA, 17 bp, Homo sapiens
ctgggagaggcagagtg

SEQ ID NO: 3726999 - DNA, 24 bp, Homo sapiens
ctgggagaggcagagtgccccacc

SEQ ID NO: 3727000 - DNA, 15 bp, Homo sapiens
ctgggagctctgcag

SEQ ID NO: 3727001 - DNA, 21 bp, Homo sapiens
ctgggaggaagcaggttgagg

SEQ ID NO: 3727002 - DNA, 18 bp, Homo sapiens
ctgggaggtcaaggctgc

SEQ ID NO: 3727003 - DNA, 19 bp, Homo sapiens
ctgggaggtcaaggctgca

SEQ ID NO: 3727004 - DNA, 14 bp, Homo sapiens
ctgggatgtccaca

SEQ ID NO: 3727005 - DNA, 18 bp, Homo sapiens
ctgggcaacagagcaaga

SEQ ID NO: 3727006 - DNA, 20 bp, Homo sapiens
ctgggcacctggggagtggg

SEQ ID NO: 3727007 - DNA, 16 bp, Homo sapiens
ctgggcattgctttcc

SEQ ID NO: 3727008 - DNA, 20 bp, Homo sapiens
ctgggccaagttcctctagt

SEQ ID NO: 3727009 - DNA, 21 bp, Homo sapiens
ctgggccaagttcctctagtg

SEQ ID NO: 3727010 - DNA, 15 bp, Homo sapiens
ctgggcccagaggca

SEQ ID NO: 3727011 - DNA, 22 bp, Homo sapiens
ctgggcccagaggcacagccgg

SEQ ID NO: 3727012 - DNA, 12 bp, Homo sapiens
ctgggcccctcc

SEQ ID NO: 3727013 - DNA, 16 bp, Homo sapiens
ctgggcctcctctaac

SEQ ID NO: 3727014 - DNA, 13 bp, Homo sapiens
ctgggctcaagca

SEQ ID NO: 3727015 - DNA, 24 bp, Homo sapiens
ctgggctcaagcaatcctcctgag

SEQ ID NO: 3727016 - DNA, 12 bp, Homo sapiens
ctgggctctcca

SEQ ID NO: 3727017 - DNA, 17 bp, Homo sapiens
ctgggctctccacctca

SEQ ID NO: 3727018 - DNA, 14 bp, Homo sapiens
ctgggctgcagaga

SEQ ID NO: 3727019 - DNA, 20 bp, Homo sapiens
ctgggctgccatgtgaagag

SEQ ID NO: 3727020 - DNA, 22 bp, Homo sapiens
ctgggctggccagttggaacca

SEQ ID NO: 3727021 - DNA, 19 bp, Homo sapiens
ctgggcttcagtggcagct

SEQ ID NO: 3727022 - DNA, 21 bp, Homo sapiens
ctgggctttgattccatctcc

SEQ ID NO: 3727023 - DNA, 19 bp, Homo sapiens
ctggggaaataacagctgt

SEQ ID NO: 3727024 - DNA, 13 bp, Homo sapiens
ctggggaagcaaa

SEQ ID NO: 3727025 - DNA, 14 bp, Homo sapiens
ctggggagaaagta

SEQ ID NO: 3727026 - DNA, 20 bp, Homo sapiens
ctggggagtgggacagagtc

SEQ ID NO: 3727027 - DNA, 14 bp, Homo sapiens
ctggggcaagtccc

SEQ ID NO: 3727028 - DNA, 16 bp, Homo sapiens
ctggggcaagtccctg

SEQ ID NO: 3727029 - DNA, 21 bp, Homo sapiens
ctggggcaagtccctgactct

SEQ ID NO: 3727030 - DNA, 15 bp, Homo sapiens
ctggggcagtcacct

SEQ ID NO: 3727031 - DNA, 17 bp, Homo sapiens
ctggggctgatctcagg

SEQ ID NO: 3727032 - DNA, 22 bp, Homo sapiens
ctggggctgatctcagggaagc

SEQ ID NO: 3727033 - DNA, 13 bp, Homo sapiens
ctgggggaagaag

SEQ ID NO: 3727034 - DNA, 15 bp, Homo sapiens
ctgggggaagaagct

SEQ ID NO: 3727035 - DNA, 17 bp, Homo sapiens
ctgggggaagccctgga

SEQ ID NO: 3727036 - DNA, 20 bp, Homo sapiens
ctgggggcagcctgcgtggc

SEQ ID NO: 3727037 - DNA, 23 bp, Homo sapiens
ctgggggcagcctgcgtggctga

SEQ ID NO: 3727038 - DNA, 12 bp, Homo sapiens
ctgggggcagga

SEQ ID NO: 3727039 - DNA, 19 bp, Homo sapiens
ctgggggcaggagggccct

SEQ ID NO: 3727040 - DNA, 14 bp, Homo sapiens
ctgggggccatgag

SEQ ID NO: 3727041 - DNA, 22 bp, Homo sapiens
ctgggggccatgagctccagac

SEQ ID NO: 3727042 - DNA, 13 bp, Homo sapiens
ctgggggcctcac

SEQ ID NO: 3727043 - DNA, 19 bp, Homo sapiens
ctggggtcctggggcctcg

SEQ ID NO: 3727044 - DNA, 19 bp, Homo sapiens
ctggggtgccctccactgc

SEQ ID NO: 3727045 - DNA, 21 bp, Homo sapiens
ctggggtgccctccactgccc

SEQ ID NO: 3727046 - DNA, 20 bp, Homo sapiens
ctgggtaactagggaagata

SEQ ID NO: 3727047 - DNA, 22 bp, Homo sapiens
ctgggtaactagggaagataat

SEQ ID NO: 3727048 - DNA, 14 bp, Homo sapiens
ctgggtacttgtgg

SEQ ID NO: 3727049 - DNA, 18 bp, Homo sapiens
ctgggtacttgtggacac

SEQ ID NO: 3727050 - DNA, 21 bp, Homo sapiens
ctgggtacttgtggacacagc

SEQ ID NO: 3727051 - DNA, 22 bp, Homo sapiens
ctgggtgacagagcaagactct

SEQ ID NO: 3727052 - DNA, 15 bp, Homo sapiens
ctgggtgcccacagc

SEQ ID NO: 3727053 - DNA, 23 bp, Homo sapiens
ctgggtgcccacagcccgcatgc

SEQ ID NO: 3727054 - DNA, 15 bp, Homo sapiens
ctgggtgctggctgc

SEQ ID NO: 3727055 - DNA, 13 bp, Homo sapiens
ctgggtggggctg

SEQ ID NO: 3727056 - DNA, 16 bp, Homo sapiens
ctgggtggggtgagga

SEQ ID NO: 3727057 - DNA, 13 bp, Homo sapiens
ctgggtggtctgc

SEQ ID NO: 3727058 - DNA, 19 bp, Homo sapiens
ctgggtggtctgcaggcag

SEQ ID NO: 3727059 - DNA, 21 bp, Homo sapiens
ctgggtggtctgcaggcaggg

SEQ ID NO: 3727060 - DNA, 18 bp, Homo sapiens
ctgggtggttgcccttca

SEQ ID NO: 3727061 - DNA, 17 bp, Homo sapiens
ctgggttccaatcctgg

SEQ ID NO: 3727062 - DNA, 20 bp, Homo sapiens
ctgggttccctttccttcca

SEQ ID NO: 3727063 - DNA, 15 bp, Homo sapiens
ctgggttggagggtg

SEQ ID NO: 3727064 - DNA, 21 bp, Homo sapiens
ctggtagacacaggatagata

SEQ ID NO: 3727065 - DNA, 14 bp, Homo sapiens
ctggtagagatgga

SEQ ID NO: 3727066 - DNA, 23 bp, Homo sapiens
ctggtagatagaaataaatagct

SEQ ID NO: 3727067 - DNA, 19 bp, Homo sapiens
ctggtagttagtagcatgt

SEQ ID NO: 3727068 - DNA, 19 bp, Homo sapiens
ctggtcacaggactctgcc

SEQ ID NO: 3727069 - DNA, 22 bp, Homo sapiens
ctggtcacaggactctgcctcc

SEQ ID NO: 3727070 - DNA, 23 bp, Homo sapiens
ctggtcacaggactctgcctcct

SEQ ID NO: 3727071 - DNA, 16 bp, Homo sapiens
ctggtccttccaggcc

SEQ ID NO: 3727072 - DNA, 17 bp, Homo sapiens
ctggtccttccaggccc

SEQ ID NO: 3727073 - DNA, 22 bp, Homo sapiens
ctggtctcctctttgttttgtt

SEQ ID NO: 3727074 - DNA, 17 bp, Homo sapiens
ctggtctcctgccccca

SEQ ID NO: 3727075 - DNA, 18 bp, Homo sapiens
ctggtctcctgcccccac

SEQ ID NO: 3727076 - DNA, 14 bp, Homo sapiens
ctggtcttgtaaga

SEQ ID NO: 3727077 - DNA, 17 bp, Homo sapiens
ctggtgacaccagcctt

SEQ ID NO: 3727078 - DNA, 13 bp, Homo sapiens
ctggtgcagggcc

SEQ ID NO: 3727079 - DNA, 14 bp, Homo sapiens
ctggtgcagggcct

SEQ ID NO: 3727080 - DNA, 12 bp, Homo sapiens
ctggtgcagtgg

SEQ ID NO: 3727081 - DNA, 15 bp, Homo sapiens
ctggtgcattacaga

SEQ ID NO: 3727082 - DNA, 14 bp, Homo sapiens
ctggtgcccggaga

SEQ ID NO: 3727083 - DNA, 13 bp, Homo sapiens
ctggtgctgccac

SEQ ID NO: 3727084 - DNA, 19 bp, Homo sapiens
ctggtggacagtcctggga

SEQ ID NO: 3727085 - DNA, 21 bp, Homo sapiens
ctggtggacagtcctgggaga

SEQ ID NO: 3727086 - DNA, 12 bp, Homo sapiens
ctggtggcagct

SEQ ID NO: 3727087 - DNA, 13 bp, Homo sapiens
ctggtggcagctg

SEQ ID NO: 3727088 - DNA, 14 bp, Homo sapiens
ctggtggcagtggg

SEQ ID NO: 3727089 - DNA, 19 bp, Homo sapiens
ctggtggcagtgggagctg

SEQ ID NO: 3727090 - DNA, 20 bp, Homo sapiens
ctggtggcccgacagcctgg

SEQ ID NO: 3727091 - DNA, 17 bp, Homo sapiens
ctggtgggcaccaagag

SEQ ID NO: 3727092 - DNA, 20 bp, Homo sapiens
ctggtgggtgaaagaaatca

SEQ ID NO: 3727093 - DNA, 22 bp, Homo sapiens
ctggtgggtgaaagaaatcatg

SEQ ID NO: 3727094 - DNA, 14 bp, Homo sapiens
ctggtgtccagctg

SEQ ID NO: 3727095 - DNA, 14 bp, Homo sapiens
ctggttagaaatgc

SEQ ID NO: 3727096 - DNA, 23 bp, Homo sapiens
ctggttagaaatgcagaatccta

SEQ ID NO: 3727097 - DNA, 16 bp, Homo sapiens
ctggttagctcagccc

SEQ ID NO: 3727098 - DNA, 21 bp, Homo sapiens
ctggttggtgttgcagaaggt

SEQ ID NO: 3727099 - DNA, 13 bp, Homo sapiens
ctggtttcactgg

SEQ ID NO: 3727100 - DNA, 17 bp, Homo sapiens
ctggtttcactggccca

SEQ ID NO: 3727101 - DNA, 18 bp, Homo sapiens
ctggttttcctaaatgca

SEQ ID NO: 3727102 - DNA, 15 bp, Homo sapiens
ctgtaaaaactgtgg

SEQ ID NO: 3727103 - DNA, 16 bp, Homo sapiens
ctgtaaaatgaaatta

SEQ ID NO: 3727104 - DNA, 16 bp, Homo sapiens
ctgtaaattattttaa

SEQ ID NO: 3727105 - DNA, 13 bp, Homo sapiens
ctgtaagctcttt

SEQ ID NO: 3727106 - DNA, 20 bp, Homo sapiens
ctgtaagctctttgaaacaa

SEQ ID NO: 3727107 - DNA, 19 bp, Homo sapiens
ctgtaatcccagctactca

SEQ ID NO: 3727108 - DNA, 22 bp, Homo sapiens
ctgtaatcccagctactcggga

SEQ ID NO: 3727109 - DNA, 19 bp, Homo sapiens
ctgtaatcctagcactttg

SEQ ID NO: 3727110 - DNA, 20 bp, Homo sapiens
ctgtaatcctagcactttgg

SEQ ID NO: 3727111 - DNA, 15 bp, Homo sapiens
ctgtacaatatttaa

SEQ ID NO: 3727112 - DNA, 18 bp, Homo sapiens
ctgtacaatatttaaaat

SEQ ID NO: 3727113 - DNA, 21 bp, Homo sapiens
ctgtacaatatttaaaattta

SEQ ID NO: 3727114 - DNA, 16 bp, Homo sapiens
ctgtacacactttatt

SEQ ID NO: 3727115 - DNA, 14 bp, Homo sapiens
ctgtacgtctgaca

SEQ ID NO: 3727116 - DNA, 20 bp, Homo sapiens
ctgtactcaggaggctgagg

SEQ ID NO: 3727117 - DNA, 15 bp, Homo sapiens
ctgtactggagagca

SEQ ID NO: 3727118 - DNA, 18 bp, Homo sapiens
ctgtacttaataaattca

SEQ ID NO: 3727119 - DNA, 15 bp, Homo sapiens
ctgtagactagtgcc

SEQ ID NO: 3727120 - DNA, 18 bp, Homo sapiens
ctgtagattgcttctgta

SEQ ID NO: 3727121 - DNA, 20 bp, Homo sapiens
ctgtagtcctagccactcag

SEQ ID NO: 3727122 - DNA, 21 bp, Homo sapiens
ctgtagttaggaaataaaacc

SEQ ID NO: 3727123 - DNA, 18 bp, Homo sapiens
ctgtatatacaataacat

SEQ ID NO: 3727124 - DNA, 19 bp, Homo sapiens
ctgtatcccatgagcctca

SEQ ID NO: 3727125 - DNA, 20 bp, Homo sapiens
ctgtatcccatgagcctcag

SEQ ID NO: 3727126 - DNA, 18 bp, Homo sapiens
ctgtatcggagacagtga

SEQ ID NO: 3727127 - DNA, 13 bp, Homo sapiens
ctgtatctgtgta

SEQ ID NO: 3727128 - DNA, 18 bp, Homo sapiens
ctgtatcttgtttttcca

SEQ ID NO: 3727129 - DNA, 20 bp, Homo sapiens
ctgtatgtcaactttatgca

SEQ ID NO: 3727130 - DNA, 17 bp, Homo sapiens
ctgtattacataaataa

SEQ ID NO: 3727131 - DNA, 17 bp, Homo sapiens
ctgtattagtcacagag

SEQ ID NO: 3727132 - DNA, 16 bp, Homo sapiens
ctgtattttcttttta

SEQ ID NO: 3727133 - DNA, 21 bp, Homo sapiens
ctgtatttttacctttttcct

SEQ ID NO: 3727134 - DNA, 14 bp, Homo sapiens
ctgtcaaacaaagc

SEQ ID NO: 3727135 - DNA, 15 bp, Homo sapiens
ctgtcaaagaatcaa

SEQ ID NO: 3727136 - DNA, 12 bp, Homo sapiens
ctgtcaataaac

SEQ ID NO: 3727137 - DNA, 16 bp, Homo sapiens
ctgtcagtatgacatt

SEQ ID NO: 3727138 - DNA, 19 bp, Homo sapiens
ctgtcagtgcagcccgtgt

SEQ ID NO: 3727139 - DNA, 18 bp, Homo sapiens
ctgtcatttgagcagggc

SEQ ID NO: 3727140 - DNA, 20 bp, Homo sapiens
ctgtcatttgagcagggctc

SEQ ID NO: 3727141 - DNA, 22 bp, Homo sapiens
ctgtcatttgagcagggctcag

SEQ ID NO: 3727142 - DNA, 20 bp, Homo sapiens
ctgtccaaaggaggctggca

SEQ ID NO: 3727143 - DNA, 22 bp, Homo sapiens
ctgtccaaaggaggctggcagg

SEQ ID NO: 3727144 - DNA, 20 bp, Homo sapiens
ctgtccaacctaaccccttt

SEQ ID NO: 3727145 - DNA, 20 bp, Homo sapiens
ctgtccaggcactgctgccc

SEQ ID NO: 3727146 - DNA, 22 bp, Homo sapiens
ctgtccaggcactgctgcccag

SEQ ID NO: 3727147 - DNA, 18 bp, Homo sapiens
ctgtccagggccctgagc

SEQ ID NO: 3727148 - DNA, 23 bp, Homo sapiens
ctgtccccctgagatcagagtcc

SEQ ID NO: 3727149 - DNA, 19 bp, Homo sapiens
ctgtcccttcccccataag

SEQ ID NO: 3727150 - DNA, 14 bp, Homo sapiens
ctgtccgagctttg

SEQ ID NO: 3727151 - DNA, 15 bp, Homo sapiens
ctgtccgagctttga

SEQ ID NO: 3727152 - DNA, 17 bp, Homo sapiens
ctgtcctactctgtgtc

SEQ ID NO: 3727153 - DNA, 21 bp, Homo sapiens
ctgtcctactctgtgtcaggt

SEQ ID NO: 3727154 - DNA, 15 bp, Homo sapiens
ctgtcctaggccaca

SEQ ID NO: 3727155 - DNA, 15 bp, Homo sapiens
ctgtcctcagcttct

SEQ ID NO: 3727156 - DNA, 12 bp, Homo sapiens
ctgtcctcctcg

SEQ ID NO: 3727157 - DNA, 21 bp, Homo sapiens
ctgtcctgggagtgagctggt

SEQ ID NO: 3727158 - DNA, 15 bp, Homo sapiens
ctgtccttctctcac

SEQ ID NO: 3727159 - DNA, 13 bp, Homo sapiens
ctgtcgcccagtg

SEQ ID NO: 3727160 - DNA, 12 bp, Homo sapiens
ctgtcgtgccag

SEQ ID NO: 3727161 - DNA, 22 bp, Homo sapiens
ctgtctaggtcagtacccacct

SEQ ID NO: 3727162 - DNA, 13 bp, Homo sapiens
ctgtctcaaaaaa

SEQ ID NO: 3727163 - DNA, 22 bp, Homo sapiens
ctgtctcaaaaaaagaaaaaga

SEQ ID NO: 3727164 - DNA, 18 bp, Homo sapiens
ctgtctcaagagggcact

SEQ ID NO: 3727165 - DNA, 21 bp, Homo sapiens
ctgtctcaagagggcactggt

SEQ ID NO: 3727166 - DNA, 15 bp, Homo sapiens
ctgtctcatccccag

SEQ ID NO: 3727167 - DNA, 16 bp, Homo sapiens
ctgtctccagaccccc

SEQ ID NO: 3727168 - DNA, 18 bp, Homo sapiens
ctgtctccatgtttgatg

SEQ ID NO: 3727169 - DNA, 18 bp, Homo sapiens
ctgtctcccctctgctgg

SEQ ID NO: 3727170 - DNA, 21 bp, Homo sapiens
ctgtctcttaaaaaaataaaa

SEQ ID NO: 3727171 - DNA, 20 bp, Homo sapiens
ctgtctggaggggagctctg

SEQ ID NO: 3727172 - DNA, 14 bp, Homo sapiens
ctgtcttcaagggc

SEQ ID NO: 3727173 - DNA, 15 bp, Homo sapiens
ctgtcttcaagggct

SEQ ID NO: 3727174 - DNA, 19 bp, Homo sapiens
ctgtcttcacagctctgtg

SEQ ID NO: 3727175 - DNA, 17 bp, Homo sapiens
ctgtcttcatccttagc

SEQ ID NO: 3727176 - DNA, 14 bp, Homo sapiens
ctgtcttccaagga

SEQ ID NO: 3727177 - DNA, 14 bp, Homo sapiens
ctgtcttcctgcat

SEQ ID NO: 3727178 - DNA, 18 bp, Homo sapiens
ctgtcttcctgcattcac

SEQ ID NO: 3727179 - DNA, 16 bp, Homo sapiens
ctgtgaaatgctggca

SEQ ID NO: 3727180 - DNA, 14 bp, Homo sapiens
ctgtgaacttgggg

SEQ ID NO: 3727181 - DNA, 22 bp, Homo sapiens
ctgtgaacttggggaacaaggg

SEQ ID NO: 3727182 - DNA, 15 bp, Homo sapiens
ctgtgaagagaacca

SEQ ID NO: 3727183 - DNA, 21 bp, Homo sapiens
ctgtgaccctcaattcatatt

SEQ ID NO: 3727184 - DNA, 15 bp, Homo sapiens
ctgtgacctgtgggg

SEQ ID NO: 3727185 - DNA, 22 bp, Homo sapiens
ctgtgacttcagctctgtttta

SEQ ID NO: 3727186 - DNA, 15 bp, Homo sapiens
ctgtgagcaagaagt

SEQ ID NO: 3727187 - DNA, 13 bp, Homo sapiens
ctgtgagccagtc

SEQ ID NO: 3727188 - DNA, 14 bp, Homo sapiens
ctgtgaggcagggg

SEQ ID NO: 3727189 - DNA, 21 bp, Homo sapiens
ctgtgagtgtaagtgtgagta

SEQ ID NO: 3727190 - DNA, 14 bp, Homo sapiens
ctgtgatcaagcaa

SEQ ID NO: 3727191 - DNA, 16 bp, Homo sapiens
ctgtgatgccacacag

SEQ ID NO: 3727192 - DNA, 17 bp, Homo sapiens
ctgtgcacggccagctg

SEQ ID NO: 3727193 - DNA, 22 bp, Homo sapiens
ctgtgcatgggtgaagggagag

SEQ ID NO: 3727194 - DNA, 17 bp, Homo sapiens
ctgtgccaataaaagtt

SEQ ID NO: 3727195 - DNA, 15 bp, Homo sapiens
ctgtgccatgtgcca

SEQ ID NO: 3727196 - DNA, 17 bp, Homo sapiens
ctgtgcccagagatggg

SEQ ID NO: 3727197 - DNA, 19 bp, Homo sapiens
ctgtgcccagctcagtctt

SEQ ID NO: 3727198 - DNA, 17 bp, Homo sapiens
ctgtgccccatgcctgt

SEQ ID NO: 3727199 - DNA, 11 bp, Homo sapiens
ctgtgcctctg

SEQ ID NO: 3727200 - DNA, 12 bp, Homo sapiens
ctgtgcctctgc

SEQ ID NO: 3727201 - DNA, 16 bp, Homo sapiens
ctgtgcctctgcctgt

SEQ ID NO: 3727202 - DNA, 16 bp, Homo sapiens
ctgtgcctctgggact

SEQ ID NO: 3727203 - DNA, 17 bp, Homo sapiens
ctgtgcctctgggactg

SEQ ID NO: 3727204 - DNA, 14 bp, Homo sapiens
ctgtgcctggagct

SEQ ID NO: 3727205 - DNA, 17 bp, Homo sapiens
ctgtgcctggagctcct

SEQ ID NO: 3727206 - DNA, 21 bp, Homo sapiens
ctgtgcctttgagtttcctca

SEQ ID NO: 3727207 - DNA, 14 bp, Homo sapiens
ctgtgcgtgaaaca

SEQ ID NO: 3727208 - DNA, 14 bp, Homo sapiens
ctgtgctctggaca

SEQ ID NO: 3727209 - DNA, 17 bp, Homo sapiens
ctgtgcttttaaatgca

SEQ ID NO: 3727210 - DNA, 18 bp, Homo sapiens
ctgtggaaaaatatttaa

SEQ ID NO: 3727211 - DNA, 16 bp, Homo sapiens
ctgtggaagggactag

SEQ ID NO: 3727212 - DNA, 17 bp, Homo sapiens
ctgtggcatctttgcct

SEQ ID NO: 3727213 - DNA, 15 bp, Homo sapiens
ctgtggccccctccg

SEQ ID NO: 3727214 - DNA, 13 bp, Homo sapiens
ctgtggcctgggc

SEQ ID NO: 3727215 - DNA, 15 bp, Homo sapiens
ctgtggccttggtct

SEQ ID NO: 3727216 - DNA, 15 bp, Homo sapiens
ctgtgggccagattg

SEQ ID NO: 3727217 - DNA, 14 bp, Homo sapiens
ctgtgggcctcaag

SEQ ID NO: 3727218 - DNA, 15 bp, Homo sapiens
ctgtgggctcccttc

SEQ ID NO: 3727219 - DNA, 19 bp, Homo sapiens
ctgtggggatttctcccag

SEQ ID NO: 3727220 - DNA, 19 bp, Homo sapiens
ctgtggggccttggttccc

SEQ ID NO: 3727221 - DNA, 22 bp, Homo sapiens
ctgtgggtgaagacagagggaa

SEQ ID NO: 3727222 - DNA, 19 bp, Homo sapiens
ctgtggtgaggttgggcag

SEQ ID NO: 3727223 - DNA, 14 bp, Homo sapiens
ctgtggttacagtg

SEQ ID NO: 3727224 - DNA, 22 bp, Homo sapiens
ctgtggttacagtgcagacagg

SEQ ID NO: 3727225 - DNA, 20 bp, Homo sapiens
ctgtggtttccaaggagctg

SEQ ID NO: 3727226 - DNA, 22 bp, Homo sapiens
ctgtggttttcttttgccatga

SEQ ID NO: 3727227 - DNA, 16 bp, Homo sapiens
ctgtgtaactgcccaa

SEQ ID NO: 3727228 - DNA, 21 bp, Homo sapiens
ctgtgtacagaattctgctac

SEQ ID NO: 3727229 - DNA, 20 bp, Homo sapiens
ctgtgtatttaattgtaaac

SEQ ID NO: 3727230 - DNA, 22 bp, Homo sapiens
ctgtgtatttaattgtaaactg

SEQ ID NO: 3727231 - DNA, 16 bp, Homo sapiens
ctgtgtcagcctgtcc

SEQ ID NO: 3727232 - DNA, 19 bp, Homo sapiens
ctgtgtcaggtggggcagc

SEQ ID NO: 3727233 - DNA, 14 bp, Homo sapiens
ctgtgtccaactcc

SEQ ID NO: 3727234 - DNA, 16 bp, Homo sapiens
ctgtgtccaactccag

SEQ ID NO: 3727235 - DNA, 19 bp, Homo sapiens
ctgtgtccaactccagtac

SEQ ID NO: 3727236 - DNA, 19 bp, Homo sapiens
ctgtgtccctctctctgga

SEQ ID NO: 3727237 - DNA, 21 bp, Homo sapiens
ctgtgtgaaataccagtgtgg

SEQ ID NO: 3727238 - DNA, 18 bp, Homo sapiens
ctgtgtgcagtctctctt

SEQ ID NO: 3727239 - DNA, 21 bp, Homo sapiens
ctgtgtgctgtggttcctggg

SEQ ID NO: 3727240 - DNA, 17 bp, Homo sapiens
ctgtgtgggactgtaca

SEQ ID NO: 3727241 - DNA, 19 bp, Homo sapiens
ctgtgtgggactgtacaca

SEQ ID NO: 3727242 - DNA, 15 bp, Homo sapiens
ctgtgtttttgaaat

SEQ ID NO: 3727243 - DNA, 16 bp, Homo sapiens
ctgttaatagttcagg

SEQ ID NO: 3727244 - DNA, 14 bp, Homo sapiens
ctgttagaacacta

SEQ ID NO: 3727245 - DNA, 18 bp, Homo sapiens
ctgttagtcatttgctga

SEQ ID NO: 3727246 - DNA, 19 bp, Homo sapiens
ctgttatcaaaactttctt

SEQ ID NO: 3727247 - DNA, 13 bp, Homo sapiens
ctgttcactctac

SEQ ID NO: 3727248 - DNA, 12 bp, Homo sapiens
ctgttcagcatt

SEQ ID NO: 3727249 - DNA, 13 bp, Homo sapiens
ctgttcagcattc

SEQ ID NO: 3727250 - DNA, 14 bp, Homo sapiens
ctgttcagcattct

SEQ ID NO: 3727251 - DNA, 14 bp, Homo sapiens
ctgttcagctccag

SEQ ID NO: 3727252 - DNA, 18 bp, Homo sapiens
ctgttcagctccagctca

SEQ ID NO: 3727253 - DNA, 19 bp, Homo sapiens
ctgttcagctccagctcac

SEQ ID NO: 3727254 - DNA, 18 bp, Homo sapiens
ctgttcagctggttgagg

SEQ ID NO: 3727255 - DNA, 19 bp, Homo sapiens
ctgttcatttgttattctt

SEQ ID NO: 3727256 - DNA, 18 bp, Homo sapiens
ctgttcccattcttgcat

SEQ ID NO: 3727257 - DNA, 18 bp, Homo sapiens
ctgttccttcacatcctg

SEQ ID NO: 3727258 - DNA, 20 bp, Homo sapiens
ctgttctgggtgcagctgag

SEQ ID NO: 3727259 - DNA, 17 bp, Homo sapiens
ctgttctgttttgcctg

SEQ ID NO: 3727260 - DNA, 13 bp, Homo sapiens
ctgttgcccaggc

SEQ ID NO: 3727261 - DNA, 18 bp, Homo sapiens
ctgttgccctttctgtac

SEQ ID NO: 3727262 - DNA, 14 bp, Homo sapiens
ctgttgcctcatct

SEQ ID NO: 3727263 - DNA, 22 bp, Homo sapiens
ctgttggctgggggcctcagtg

SEQ ID NO: 3727264 - DNA, 17 bp, Homo sapiens
ctgttgttgttaatgaa

SEQ ID NO: 3727265 - DNA, 9 bp, Homo sapiens
ctgttgttt

SEQ ID NO: 3727266 - DNA, 15 bp, Homo sapiens
ctgtttacaagaaaa

SEQ ID NO: 3727267 - DNA, 14 bp, Homo sapiens
ctgtttatggcctc

SEQ ID NO: 3727268 - DNA, 16 bp, Homo sapiens
ctgtttatggcctcag

SEQ ID NO: 3727269 - DNA, 17 bp, Homo sapiens
ctgtttatggcctcagc

SEQ ID NO: 3727270 - DNA, 19 bp, Homo sapiens
ctgtttatggcctcagctg

SEQ ID NO: 3727271 - DNA, 15 bp, Homo sapiens
ctgtttattaaaaat

SEQ ID NO: 3727272 - DNA, 13 bp, Homo sapiens
ctgttttactgct

SEQ ID NO: 3727273 - DNA, 12 bp, Homo sapiens
ctgttttcttct

SEQ ID NO: 3727274 - DNA, 16 bp, Homo sapiens
ctgtttttaagctgtt

SEQ ID NO: 3727275 - DNA, 17 bp, Homo sapiens
ctgtttttaagctgttt

SEQ ID NO: 3727276 - DNA, 23 bp, Homo sapiens
ctgtttttaagctgtttccatag

SEQ ID NO: 3727277 - DNA, 17 bp, Homo sapiens
ctgtttttcagggaggt

SEQ ID NO: 3727278 - DNA, 19 bp, Homo sapiens
ctgttttttaaactaggaa

SEQ ID NO: 3727279 - DNA, 13 bp, Homo sapiens
ctgttttttagtt

SEQ ID NO: 3727280 - DNA, 18 bp, Homo sapiens
cttaaaaaacttgtaaat

SEQ ID NO: 3727281 - DNA, 14 bp, Homo sapiens
cttaaaaaatgtcc

SEQ ID NO: 3727282 - DNA, 16 bp, Homo sapiens
cttaaaaagtggaaaa

SEQ ID NO: 3727283 - DNA, 17 bp, Homo sapiens
cttaaaaagtggaaaaa

SEQ ID NO: 3727284 - DNA, 15 bp, Homo sapiens
cttaaaacttttcaa

SEQ ID NO: 3727285 - DNA, 13 bp, Homo sapiens
cttaaaagccatc

SEQ ID NO: 3727286 - DNA, 17 bp, Homo sapiens
cttaaaatatatttcag

SEQ ID NO: 3727287 - DNA, 23 bp, Homo sapiens
cttaaactgtgtggactgtgatg

SEQ ID NO: 3727288 - DNA, 23 bp, Homo sapiens
cttaaaggctgtggtagtactcc

SEQ ID NO: 3727289 - DNA, 12 bp, Homo sapiens
cttaaattaaac

SEQ ID NO: 3727290 - DNA, 15 bp, Homo sapiens
cttaaattaaacaat

SEQ ID NO: 3727291 - DNA, 19 bp, Homo sapiens
cttaaattaaacaatttat

SEQ ID NO: 3727292 - DNA, 17 bp, Homo sapiens
cttaacattctgtaaaa

SEQ ID NO: 3727293 - DNA, 20 bp, Homo sapiens
cttaacatttctaactctga

SEQ ID NO: 3727294 - DNA, 19 bp, Homo sapiens
cttaactgcatttttagac

SEQ ID NO: 3727295 - DNA, 18 bp, Homo sapiens
cttaagaattttgagcag

SEQ ID NO: 3727296 - DNA, 21 bp, Homo sapiens
cttaagaggcctgtgattatt

SEQ ID NO: 3727297 - DNA, 23 bp, Homo sapiens
cttaagctaggatgttgctcaga

SEQ ID NO: 3727298 - DNA, 14 bp, Homo sapiens
cttaagtatcagaa

SEQ ID NO: 3727299 - DNA, 20 bp, Homo sapiens
cttaatcaggtcctcagaga

SEQ ID NO: 3727300 - DNA, 22 bp, Homo sapiens
cttaatcaggtcctcagagaat

SEQ ID NO: 3727301 - DNA, 14 bp, Homo sapiens
cttaatgagatagt

SEQ ID NO: 3727302 - DNA, 13 bp, Homo sapiens
cttaattaagtaa

SEQ ID NO: 3727303 - DNA, 15 bp, Homo sapiens
cttaattaagtaaac

SEQ ID NO: 3727304 - DNA, 19 bp, Homo sapiens
cttaattaagtaaactaat

SEQ ID NO: 3727305 - DNA, 18 bp, Homo sapiens
cttacacatcttccacag

SEQ ID NO: 3727306 - DNA, 23 bp, Homo sapiens
cttacagcataagggagcgtaga

SEQ ID NO: 3727307 - DNA, 14 bp, Homo sapiens
cttacatgttttct

SEQ ID NO: 3727308 - DNA, 15 bp, Homo sapiens
cttaccatatgtgct

SEQ ID NO: 3727309 - DNA, 13 bp, Homo sapiens
cttaccattaaag

SEQ ID NO: 3727310 - DNA, 23 bp, Homo sapiens
cttacccttctgtgcccagctca

SEQ ID NO: 3727311 - DNA, 14 bp, Homo sapiens
cttacctcccacct

SEQ ID NO: 3727312 - DNA, 14 bp, Homo sapiens
cttacctcctgccc

SEQ ID NO: 3727313 - DNA, 17 bp, Homo sapiens
cttacctcctgcccagg

SEQ ID NO: 3727314 - DNA, 18 bp, Homo sapiens
cttacctcctgcccagga

SEQ ID NO: 3727315 - DNA, 20 bp, Homo sapiens
cttacctcctgcccaggaga

SEQ ID NO: 3727316 - DNA, 19 bp, Homo sapiens
cttacctcggtgccttcct

SEQ ID NO: 3727317 - DNA, 15 bp, Homo sapiens
cttacctcttccgga

SEQ ID NO: 3727318 - DNA, 17 bp, Homo sapiens
cttaccttcaataaagt

SEQ ID NO: 3727319 - DNA, 22 bp, Homo sapiens
cttaccttcaataaagtatcta

SEQ ID NO: 3727320 - DNA, 19 bp, Homo sapiens
cttactattaagcagtaaa

SEQ ID NO: 3727321 - DNA, 13 bp, Homo sapiens
cttactgcagaat

SEQ ID NO: 3727322 - DNA, 11 bp, Homo sapiens
cttactgcttg

SEQ ID NO: 3727323 - DNA, 15 bp, Homo sapiens
cttactttgtatgat

SEQ ID NO: 3727324 - DNA, 16 bp, Homo sapiens
cttagaaattgcattt

SEQ ID NO: 3727325 - DNA, 13 bp, Homo sapiens
cttagacctcagc

SEQ ID NO: 3727326 - DNA, 14 bp, Homo sapiens
cttagacctcagcc

SEQ ID NO: 3727327 - DNA, 20 bp, Homo sapiens
cttagacctcagcctgtgct

SEQ ID NO: 3727328 - DNA, 16 bp, Homo sapiens
cttagacttgaaatac

SEQ ID NO: 3727329 - DNA, 12 bp, Homo sapiens
cttagcaacagc

SEQ ID NO: 3727330 - DNA, 23 bp, Homo sapiens
cttagcagctatctctcagtgaa

SEQ ID NO: 3727331 - DNA, 21 bp, Homo sapiens
cttagcagggaaacagctaat

SEQ ID NO: 3727332 - DNA, 22 bp, Homo sapiens
cttagcagtgatttttatccaa

SEQ ID NO: 3727333 - DNA, 14 bp, Homo sapiens
cttagcatgcacaa

SEQ ID NO: 3727334 - DNA, 11 bp, Homo sapiens
cttagcctccc

SEQ ID NO: 3727335 - DNA, 14 bp, Homo sapiens
cttagcctccctga

SEQ ID NO: 3727336 - DNA, 17 bp, Homo sapiens
cttagctgccaagtaaa

SEQ ID NO: 3727337 - DNA, 15 bp, Homo sapiens
cttagcttagacctc

SEQ ID NO: 3727338 - DNA, 20 bp, Homo sapiens
cttagcttagacctcagcct

SEQ ID NO: 3727339 - DNA, 21 bp, Homo sapiens
cttagcttagacctcagcctg

SEQ ID NO: 3727340 - DNA, 14 bp, Homo sapiens
cttagcttatcaat

SEQ ID NO: 3727341 - DNA, 16 bp, Homo sapiens
cttagcttatcaattt

SEQ ID NO: 3727342 - DNA, 15 bp, Homo sapiens
cttaggcagggaagt

SEQ ID NO: 3727343 - DNA, 18 bp, Homo sapiens
cttaggtacttattccag

SEQ ID NO: 3727344 - DNA, 17 bp, Homo sapiens
cttaggttggcaaaaag

SEQ ID NO: 3727345 - DNA, 16 bp, Homo sapiens
cttagtcttctcatag

SEQ ID NO: 3727346 - DNA, 20 bp, Homo sapiens
cttagtcttctcatagcatt

SEQ ID NO: 3727347 - DNA, 20 bp, Homo sapiens
cttagtgcggacaagtttta

SEQ ID NO: 3727348 - DNA, 22 bp, Homo sapiens
cttagtgcggacaagttttaat

SEQ ID NO: 3727349 - DNA, 19 bp, Homo sapiens
cttatatagtttactattt

SEQ ID NO: 3727350 - DNA, 22 bp, Homo sapiens
cttatcaatttgtcattttgaa

SEQ ID NO: 3727351 - DNA, 20 bp, Homo sapiens
cttatcatgctgtctttaca

SEQ ID NO: 3727352 - DNA, 21 bp, Homo sapiens
cttatcctaaaacaaatagtt

SEQ ID NO: 3727353 - DNA, 21 bp, Homo sapiens
cttatccttccacggactcaa

SEQ ID NO: 3727354 - DNA, 19 bp, Homo sapiens
cttatctgtgcgtgaaaca

SEQ ID NO: 3727355 - DNA, 20 bp, Homo sapiens
cttatctgtgcgtgaaacac

SEQ ID NO: 3727356 - DNA, 17 bp, Homo sapiens
cttatgccatttgttta

SEQ ID NO: 3727357 - DNA, 14 bp, Homo sapiens
cttattaatgctaa

SEQ ID NO: 3727358 - DNA, 15 bp, Homo sapiens
cttattaatgctaag

SEQ ID NO: 3727359 - DNA, 16 bp, Homo sapiens
cttattaatgctaagg

SEQ ID NO: 3727360 - DNA, 19 bp, Homo sapiens
cttattaatgctaagggca

SEQ ID NO: 3727361 - DNA, 18 bp, Homo sapiens
cttattgcccacgctgga

SEQ ID NO: 3727362 - DNA, 20 bp, Homo sapiens
cttattgctttgaaactaga

SEQ ID NO: 3727363 - DNA, 20 bp, Homo sapiens
cttattgttccaagacattg

SEQ ID NO: 3727364 - DNA, 22 bp, Homo sapiens
cttattgttccaagacattgtc

SEQ ID NO: 3727365 - DNA, 15 bp, Homo sapiens
cttattttcaagaaa

SEQ ID NO: 3727366 - DNA, 19 bp, Homo sapiens
cttattttcaagaaactga

SEQ ID NO: 3727367 - DNA, 16 bp, Homo sapiens
cttattttcatgtata

SEQ ID NO: 3727368 - DNA, 21 bp, Homo sapiens
cttcaaaaactgtcaaagaat

SEQ ID NO: 3727369 - DNA, 11 bp, Homo sapiens
cttcaaagctg

SEQ ID NO: 3727370 - DNA, 18 bp, Homo sapiens
cttcaaagcttgaagatc

SEQ ID NO: 3727371 - DNA, 15 bp, Homo sapiens
cttcaaatatttccc

SEQ ID NO: 3727372 - DNA, 24 bp, Homo sapiens
cttcaacagaccccctctagaaat

SEQ ID NO: 3727373 - DNA, 22 bp, Homo sapiens
cttcaacatcaatgttcattgt

SEQ ID NO: 3727374 - DNA, 17 bp, Homo sapiens
cttcaactgaccagcct

SEQ ID NO: 3727375 - DNA, 18 bp, Homo sapiens
cttcaagaactctgggct

SEQ ID NO: 3727376 - DNA, 18 bp, Homo sapiens
cttcaagcaccagggaag

SEQ ID NO: 3727377 - DNA, 16 bp, Homo sapiens
cttcaagtctgtgcct

SEQ ID NO: 3727378 - DNA, 22 bp, Homo sapiens
cttcaagtctgtgcctggagct

SEQ ID NO: 3727379 - DNA, 21 bp, Homo sapiens
cttcacaatggtgctcatttc

SEQ ID NO: 3727380 - DNA, 19 bp, Homo sapiens
cttcacacctaccctcctt

SEQ ID NO: 3727381 - DNA, 20 bp, Homo sapiens
cttcacactgcaagagcctt

SEQ ID NO: 3727382 - DNA, 16 bp, Homo sapiens
cttcacagctctgtgt

SEQ ID NO: 3727383 - DNA, 13 bp, Homo sapiens
cttcacagtgttt

SEQ ID NO: 3727384 - DNA, 14 bp, Homo sapiens
cttcaccctgtcaa

SEQ ID NO: 3727385 - DNA, 13 bp, Homo sapiens
cttcacggcagga

SEQ ID NO: 3727386 - DNA, 16 bp, Homo sapiens
cttcacggcaggacaa

SEQ ID NO: 3727387 - DNA, 20 bp, Homo sapiens
cttcactccagcctgggtga

SEQ ID NO: 3727388 - DNA, 24 bp, Homo sapiens
cttcactccggtgtgcctgcagcc

SEQ ID NO: 3727389 - DNA, 15 bp, Homo sapiens
cttcacttctgacca

SEQ ID NO: 3727390 - DNA, 17 bp, Homo sapiens
cttcagaagacactgca

SEQ ID NO: 3727391 - DNA, 16 bp, Homo sapiens
cttcagactgcaagtg

SEQ ID NO: 3727392 - DNA, 17 bp, Homo sapiens
cttcagatcagtgcttg

SEQ ID NO: 3727393 - DNA, 20 bp, Homo sapiens
cttcagatcagtgcttgagt

SEQ ID NO: 3727394 - DNA, 14 bp, Homo sapiens
cttcagatcctacc

SEQ ID NO: 3727395 - DNA, 19 bp, Homo sapiens
cttcagccaggagctgggc

SEQ ID NO: 3727396 - DNA, 22 bp, Homo sapiens
cttcagcctagccgacctcagc

SEQ ID NO: 3727397 - DNA, 14 bp, Homo sapiens
cttcagcctcccga

SEQ ID NO: 3727398 - DNA, 20 bp, Homo sapiens
cttcagcctgaggctgagac

SEQ ID NO: 3727399 - DNA, 15 bp, Homo sapiens
cttcagctgactttt

SEQ ID NO: 3727400 - DNA, 16 bp, Homo sapiens
cttcaggacactcact

SEQ ID NO: 3727401 - DNA, 22 bp, Homo sapiens
cttcaggctcttctcctttcac

SEQ ID NO: 3727402 - DNA, 16 bp, Homo sapiens
cttcagggcagggctc

SEQ ID NO: 3727403 - DNA, 19 bp, Homo sapiens
cttcagggcagggctctga

SEQ ID NO: 3727404 - DNA, 21 bp, Homo sapiens
cttcaggggagtcccgtcagg

SEQ ID NO: 3727405 - DNA, 18 bp, Homo sapiens
cttcagggttctcctctc

SEQ ID NO: 3727406 - DNA, 23 bp, Homo sapiens
cttcagggttctcctctcccctc

SEQ ID NO: 3727407 - DNA, 16 bp, Homo sapiens
cttcagtaagccgtga

SEQ ID NO: 3727408 - DNA, 11 bp, Homo sapiens
cttcagtgccc

SEQ ID NO: 3727409 - DNA, 13 bp, Homo sapiens
cttcagtgcccac

SEQ ID NO: 3727410 - DNA, 15 bp, Homo sapiens
cttcagtggcagctg

SEQ ID NO: 3727411 - DNA, 18 bp, Homo sapiens
cttcagtggcagctgctt

SEQ ID NO: 3727412 - DNA, 17 bp, Homo sapiens
cttcagttggtgtgttt

SEQ ID NO: 3727413 - DNA, 19 bp, Homo sapiens
cttcataacaattttagga

SEQ ID NO: 3727414 - DNA, 18 bp, Homo sapiens
cttcatagcagattttaa

SEQ ID NO: 3727415 - DNA, 19 bp, Homo sapiens
cttcatccggcagcctgga

SEQ ID NO: 3727416 - DNA, 16 bp, Homo sapiens
cttcatgaaaatccta

SEQ ID NO: 3727417 - DNA, 12 bp, Homo sapiens
cttcatgcaatg

SEQ ID NO: 3727418 - DNA, 22 bp, Homo sapiens
cttcatgcaatgacatcttcaa

SEQ ID NO: 3727419 - DNA, 14 bp, Homo sapiens
cttcatgcctttgt

SEQ ID NO: 3727420 - DNA, 15 bp, Homo sapiens
cttcatgcctttgta

SEQ ID NO: 3727421 - DNA, 18 bp, Homo sapiens
cttccaacaggagctggg

SEQ ID NO: 3727422 - DNA, 14 bp, Homo sapiens
cttccaactgctgc

SEQ ID NO: 3727423 - DNA, 17 bp, Homo sapiens
ctgcagagacagagagg

SEQ ID NO: 3727424 - DNA, 23 bp, Homo sapiens
ctgcagaggggctttctggagag

SEQ ID NO: 3727425 - DNA, 14 bp, Homo sapiens
ctgcagcagagcct

SEQ ID NO: 3727426 - DNA, 11 bp, Homo sapiens
ctgcagcatga

SEQ ID NO: 3727427 - DNA, 19 bp, Homo sapiens
ctgcagcatgacctgtgac

SEQ ID NO: 3727428 - DNA, 12 bp, Homo sapiens
ctgcagccagcc

SEQ ID NO: 3727429 - DNA, 17 bp, Homo sapiens
ctgcagccagcccagcc

SEQ ID NO: 3727430 - DNA, 20 bp, Homo sapiens
ctgcagcctcaacctcctgg

SEQ ID NO: 3727431 - DNA, 22 bp, Homo sapiens
ctgcagcctcgaactcctgggc

SEQ ID NO: 3727432 - DNA, 14 bp, Homo sapiens
ctgcagcctggagg

SEQ ID NO: 3727433 - DNA, 15 bp, Homo sapiens
ctgcagcctggaggc

SEQ ID NO: 3727434 - DNA, 12 bp, Homo sapiens
ctgcagctttgt

SEQ ID NO: 3727435 - DNA, 16 bp, Homo sapiens
ctgcaggagttaaaaa

SEQ ID NO: 3727436 - DNA, 19 bp, Homo sapiens
ctgcaggatgattgtacag

SEQ ID NO: 3727437 - DNA, 21 bp, Homo sapiens
ctgcaggccaagagcagaggc

SEQ ID NO: 3727438 - DNA, 23 bp, Homo sapiens
ctgcaggccaagagcagaggcag

SEQ ID NO: 3727439 - DNA, 21 bp, Homo sapiens
ctgcagtcagtcatgatggca

SEQ ID NO: 3727440 - DNA, 19 bp, Homo sapiens
ctgcagtttgagacaggag

SEQ ID NO: 3727441 - DNA, 22 bp, Homo sapiens
ctgcataaaaaggtctttaaaa

SEQ ID NO: 3727442 - DNA, 14 bp, Homo sapiens
ctgcatacaatctg

SEQ ID NO: 3727443 - DNA, 14 bp, Homo sapiens
ctgcatagaaggag

SEQ ID NO: 3727444 - DNA, 21 bp, Homo sapiens
ctgcatagtattccattgtgt

SEQ ID NO: 3727445 - DNA, 15 bp, Homo sapiens
ctgcatatgaaagga

SEQ ID NO: 3727446 - DNA, 14 bp, Homo sapiens
ctgcatcatctgta

SEQ ID NO: 3727447 - DNA, 17 bp, Homo sapiens
ctgcatcatctgtagat

SEQ ID NO: 3727448 - DNA, 18 bp, Homo sapiens
ctgcatcatctgtagata

SEQ ID NO: 3727449 - DNA, 19 bp, Homo sapiens
ctgcatccgtagttccctg

SEQ ID NO: 3727450 - DNA, 21 bp, Homo sapiens
ctgcatccgtagttccctgaa

SEQ ID NO: 3727451 - DNA, 17 bp, Homo sapiens
ctgcatctactcaggcc

SEQ ID NO: 3727452 - DNA, 15 bp, Homo sapiens
ctgcatgcagaaagg

SEQ ID NO: 3727453 - DNA, 17 bp, Homo sapiens
ctgcatggacctaacat

SEQ ID NO: 3727454 - DNA, 16 bp, Homo sapiens
ctgcatggtaatttat

SEQ ID NO: 3727455 - DNA, 18 bp, Homo sapiens
ctgcatgtataaatgaag

SEQ ID NO: 3727456 - DNA, 13 bp, Homo sapiens
ctgcatgttacat

SEQ ID NO: 3727457 - DNA, 15 bp, Homo sapiens
ctgcattacattcct

SEQ ID NO: 3727458 - DNA, 17 bp, Homo sapiens
ctgcattgagaactgca

SEQ ID NO: 3727459 - DNA, 13 bp, Homo sapiens
ctgcatttagcac

SEQ ID NO: 3727460 - DNA, 15 bp, Homo sapiens
ctgcatttagcacaa

SEQ ID NO: 3727461 - DNA, 17 bp, Homo sapiens
ctgcatttagcacaaaa

SEQ ID NO: 3727462 - DNA, 18 bp, Homo sapiens
ctgcatttagcacaaaaa

SEQ ID NO: 3727463 - DNA, 17 bp, Homo sapiens
ctgcatttgtgaaatga

SEQ ID NO: 3727464 - DNA, 22 bp, Homo sapiens
ctgcatttgtgaaatgatggtg

SEQ ID NO: 3727465 - DNA, 20 bp, Homo sapiens
ctgccaaattttggccaaag

SEQ ID NO: 3727466 - DNA, 15 bp, Homo sapiens
ctgccaagccccatc

SEQ ID NO: 3727467 - DNA, 21 bp, Homo sapiens
ctgccaagccccatcctgccg

SEQ ID NO: 3727468 - DNA, 15 bp, Homo sapiens
ctgccaaggccagag

SEQ ID NO: 3727469 - DNA, 18 bp, Homo sapiens
ctgccaaggccagagtgg

SEQ ID NO: 3727470 - DNA, 12 bp, Homo sapiens
ctgccaccctgg

SEQ ID NO: 3727471 - DNA, 14 bp, Homo sapiens
ctgccaccctgggg

SEQ ID NO: 3727472 - DNA, 13 bp, Homo sapiens
ctgccacctcccc

SEQ ID NO: 3727473 - DNA, 14 bp, Homo sapiens
ctgccacctcccct

SEQ ID NO: 3727474 - DNA, 15 bp, Homo sapiens
ctgccacctggggca

SEQ ID NO: 3727475 - DNA, 13 bp, Homo sapiens
ctgccagagaagc

SEQ ID NO: 3727476 - DNA, 19 bp, Homo sapiens
ctgccagccagcagccagc

SEQ ID NO: 3727477 - DNA, 20 bp, Homo sapiens
ctgccagccagcagccagct

SEQ ID NO: 3727478 - DNA, 15 bp, Homo sapiens
ctgccagcctggctt

SEQ ID NO: 3727479 - DNA, 11 bp, Homo sapiens
ctgccaggcat

SEQ ID NO: 3727480 - DNA, 18 bp, Homo sapiens
ctgccaggcccccaagcc

SEQ ID NO: 3727481 - DNA, 21 bp, Homo sapiens
ctgccaggcccccaagcctgc

SEQ ID NO: 3727482 - DNA, 22 bp, Homo sapiens
ctgccaggcccccaagcctgca

SEQ ID NO: 3727483 - DNA, 12 bp, Homo sapiens
ctgccagggagc

SEQ ID NO: 3727484 - DNA, 20 bp, Homo sapiens
ctgccagtgccttacctcct

SEQ ID NO: 3727485 - DNA, 21 bp, Homo sapiens
ctgccagtgccttacctcctg

SEQ ID NO: 3727486 - DNA, 23 bp, Homo sapiens
ctgccagtgccttacctcctgcc

SEQ ID NO: 3727487 - DNA, 16 bp, Homo sapiens
ctgccatattctgttg

SEQ ID NO: 3727488 - DNA, 23 bp, Homo sapiens
ctgccatattctgttggccagtg

SEQ ID NO: 3727489 - DNA, 18 bp, Homo sapiens
ctgccatccaggttcagc

SEQ ID NO: 3727490 - DNA, 15 bp, Homo sapiens
ctgccatcctcccaa

SEQ ID NO: 3727491 - DNA, 18 bp, Homo sapiens
ctgccatgaactggaggc

SEQ ID NO: 3727492 - DNA, 19 bp, Homo sapiens
ctgccatgccagcttatct

SEQ ID NO: 3727493 - DNA, 14 bp, Homo sapiens
ctgccatggcgtgt

SEQ ID NO: 3727494 - DNA, 15 bp, Homo sapiens
ctgccatttctgaga

SEQ ID NO: 3727495 - DNA, 23 bp, Homo sapiens
ctgcccaaagcagcacttataaa

SEQ ID NO: 3727496 - DNA, 20 bp, Homo sapiens
ctgcccagaattcccagctg

SEQ ID NO: 3727497 - DNA, 21 bp, Homo sapiens
ctgcccagacccctctggcca

SEQ ID NO: 3727498 - DNA, 22 bp, Homo sapiens
ctgcccagacccctctggccag

SEQ ID NO: 3727499 - DNA, 17 bp, Homo sapiens
ctgcccagagctgggtg

SEQ ID NO: 3727500 - DNA, 12 bp, Homo sapiens
ctgcccaggaga

SEQ ID NO: 3727501 - DNA, 15 bp, Homo sapiens
ctgcccaggcccctg

SEQ ID NO: 3727502 - DNA, 18 bp, Homo sapiens
ctgcccaggcccctgcca

SEQ ID NO: 3727503 - DNA, 19 bp, Homo sapiens
ctgcccaggcccctgccac

SEQ ID NO: 3727504 - DNA, 11 bp, Homo sapiens
ctgcccagtgt

SEQ ID NO: 3727505 - DNA, 20 bp, Homo sapiens
ctgcccagtgttgtttgtaa

SEQ ID NO: 3727506 - DNA, 15 bp, Homo sapiens
ctgcccatcacaggg

SEQ ID NO: 3727507 - DNA, 15 bp, Homo sapiens
ctgcccattccccag

SEQ ID NO: 3727508 - DNA, 21 bp, Homo sapiens
ctgccccaaacaaatatgcaa

SEQ ID NO: 3727509 - DNA, 19 bp, Homo sapiens
ctgccccaaaggaagcttt

SEQ ID NO: 3727510 - DNA, 21 bp, Homo sapiens
ctgccccagctgactgtggcc

SEQ ID NO: 3727511 - DNA, 17 bp, Homo sapiens
ctgcccccacacctggc

SEQ ID NO: 3727512 - DNA, 23 bp, Homo sapiens
ctgccccctccccttcacaccat

SEQ ID NO: 3727513 - DNA, 14 bp, Homo sapiens
ctgccccctggtgg

SEQ ID NO: 3727514 - DNA, 14 bp, Homo sapiens
ctgcccccttctcc

SEQ ID NO: 3727515 - DNA, 16 bp, Homo sapiens
ctgcccccttctccca

SEQ ID NO: 3727516 - DNA, 17 bp, Homo sapiens
ctgcccccttctcccac

SEQ ID NO: 3727517 - DNA, 21 bp, Homo sapiens
ctgccccgtcaccatctcagg

SEQ ID NO: 3727518 - DNA, 15 bp, Homo sapiens
ctgccccgtgcagac

SEQ ID NO: 3727519 - DNA, 15 bp, Homo sapiens
ctgcccctcatgcca

SEQ ID NO: 3727520 - DNA, 13 bp, Homo sapiens
ctgcccctcccag

SEQ ID NO: 3727521 - DNA, 22 bp, Homo sapiens
ctgcccctccctgccagcaccc

SEQ ID NO: 3727522 - DNA, 14 bp, Homo sapiens
ctgcccctcccttc

SEQ ID NO: 3727523 - DNA, 17 bp, Homo sapiens
ctgcccctcccttcaac

SEQ ID NO: 3727524 - DNA, 10 bp, Homo sapiens
ctgcccctgc

SEQ ID NO: 3727525 - DNA, 13 bp, Homo sapiens
ctgcccctgcccc

SEQ ID NO: 3727526 - DNA, 20 bp, Homo sapiens
ctgccccttctacactctcc

SEQ ID NO: 3727527 - DNA, 23 bp, Homo sapiens
ctgccccttctacactctcctgg

SEQ ID NO: 3727528 - DNA, 15 bp, Homo sapiens
ctgcccgagctggtg

SEQ ID NO: 3727529 - DNA, 17 bp, Homo sapiens
ctgcccgagctggtgca

SEQ ID NO: 3727530 - DNA, 11 bp, Homo sapiens
ctgcccggctg

SEQ ID NO: 3727531 - DNA, 20 bp, Homo sapiens
ctgcccggggcagctgccag

SEQ ID NO: 3727532 - DNA, 23 bp, Homo sapiens
ctgcccggggcagctgccagaga

SEQ ID NO: 3727533 - DNA, 21 bp, Homo sapiens
ctgcccgtcttcagcctagcc

SEQ ID NO: 3727534 - DNA, 16 bp, Homo sapiens
ctgccctactcactct

SEQ ID NO: 3727535 - DNA, 15 bp, Homo sapiens
ctgccctagagcaca

SEQ ID NO: 3727536 - DNA, 16 bp, Homo sapiens
ctgccctagctccaca

SEQ ID NO: 3727537 - DNA, 15 bp, Homo sapiens
ctgccctccatcccg

SEQ ID NO: 3727538 - DNA, 16 bp, Homo sapiens
cttccaagacctgact

SEQ ID NO: 3727539 - DNA, 19 bp, Homo sapiens
cttccaagactccagccct

SEQ ID NO: 3727540 - DNA, 13 bp, Homo sapiens
cttccaaggagac

SEQ ID NO: 3727541 - DNA, 17 bp, Homo sapiens
cttccaaggagaccaag

SEQ ID NO: 3727542 - DNA, 21 bp, Homo sapiens
cttccacaggtctcagaatct

SEQ ID NO: 3727543 - DNA, 13 bp, Homo sapiens
cttccaccagcct

SEQ ID NO: 3727544 - DNA, 13 bp, Homo sapiens
cttccacctggaa

SEQ ID NO: 3727545 - DNA, 16 bp, Homo sapiens
cttccacgctgtctcc

SEQ ID NO: 3727546 - DNA, 21 bp, Homo sapiens
cttccacgctgtctccagacc

SEQ ID NO: 3727547 - DNA, 22 bp, Homo sapiens
cttccacgctgtctccagaccc

SEQ ID NO: 3727548 - DNA, 14 bp, Homo sapiens
cttccagcaccctg

SEQ ID NO: 3727549 - DNA, 16 bp, Homo sapiens
cttccaggaaaaagga

SEQ ID NO: 3727550 - DNA, 19 bp, Homo sapiens
cttccaggaaaaaggacag

SEQ ID NO: 3727551 - DNA, 20 bp, Homo sapiens
cttccaggaaaaaggacagg

SEQ ID NO: 3727552 - DNA, 19 bp, Homo sapiens
cttccaggcccccaccact

SEQ ID NO: 3727553 - DNA, 23 bp, Homo sapiens
cttccaggttctggttagctcag

SEQ ID NO: 3727554 - DNA, 22 bp, Homo sapiens
cttccatagcctaatccctggg

SEQ ID NO: 3727555 - DNA, 16 bp, Homo sapiens
cttccatccctacccc

SEQ ID NO: 3727556 - DNA, 17 bp, Homo sapiens
cttccatgagaacagca

SEQ ID NO: 3727557 - DNA, 16 bp, Homo sapiens
cttccattccacatcc

SEQ ID NO: 3727558 - DNA, 14 bp, Homo sapiens
cttcccaactgcaa

SEQ ID NO: 3727559 - DNA, 14 bp, Homo sapiens
cttcccagctctcc

SEQ ID NO: 3727560 - DNA, 20 bp, Homo sapiens
cttcccagctctccctctgg

SEQ ID NO: 3727561 - DNA, 15 bp, Homo sapiens
cttcccagctgcccc

SEQ ID NO: 3727562 - DNA, 16 bp, Homo sapiens
cttcccagctgcccct

SEQ ID NO: 3727563 - DNA, 22 bp, Homo sapiens
cttcccagctgcccctccctgc

SEQ ID NO: 3727564 - DNA, 11 bp, Homo sapiens
cttcccagctt

SEQ ID NO: 3727565 - DNA, 23 bp, Homo sapiens
cttccccaacgaaaagcacatcc

SEQ ID NO: 3727566 - DNA, 14 bp, Homo sapiens
cttccccactgcct

SEQ ID NO: 3727567 - DNA, 14 bp, Homo sapiens
cttccccagcctct

SEQ ID NO: 3727568 - DNA, 14 bp, Homo sapiens
cttcccccatagcc

SEQ ID NO: 3727569 - DNA, 12 bp, Homo sapiens
cttccccctcca

SEQ ID NO: 3727570 - DNA, 18 bp, Homo sapiens
cttccccctgtagactag

SEQ ID NO: 3727571 - DNA, 15 bp, Homo sapiens
cttcccgctcagccc

SEQ ID NO: 3727572 - DNA, 15 bp, Homo sapiens
cttccctacctcagg

SEQ ID NO: 3727573 - DNA, 17 bp, Homo sapiens
cttccctagggctgggt

SEQ ID NO: 3727574 - DNA, 15 bp, Homo sapiens
cttccctctgcctgt

SEQ ID NO: 3727575 - DNA, 19 bp, Homo sapiens
cttccctctgcctgtccct

SEQ ID NO: 3727576 - DNA, 10 bp, Homo sapiens
cttccctggc

SEQ ID NO: 3727577 - DNA, 12 bp, Homo sapiens
cttccctggctt

SEQ ID NO: 3727578 - DNA, 15 bp, Homo sapiens
cttccggagatgtag

SEQ ID NO: 3727579 - DNA, 21 bp, Homo sapiens
cttcctacaagagcagcctgt

SEQ ID NO: 3727580 - DNA, 17 bp, Homo sapiens
cttcctatcccatccca

SEQ ID NO: 3727581 - DNA, 18 bp, Homo sapiens
cttcctatcccatcccat

SEQ ID NO: 3727582 - DNA, 14 bp, Homo sapiens
cttcctatttctgg

SEQ ID NO: 3727583 - DNA, 15 bp, Homo sapiens
cttcctccctcattc

SEQ ID NO: 3727584 - DNA, 14 bp, Homo sapiens
cttcctccctccct

SEQ ID NO: 3727585 - DNA, 18 bp, Homo sapiens
cttcctccctccctcttt

SEQ ID NO: 3727586 - DNA, 13 bp, Homo sapiens
cttcctctccact

SEQ ID NO: 3727587 - DNA, 11 bp, Homo sapiens
cttcctctgct

SEQ ID NO: 3727588 - DNA, 21 bp, Homo sapiens
cttcctctttccatctaccct

SEQ ID NO: 3727589 - DNA, 21 bp, Homo sapiens
cttcctgcattcacccagaca

SEQ ID NO: 3727590 - DNA, 17 bp, Homo sapiens
cttcctgcctggtctcc

SEQ ID NO: 3727591 - DNA, 18 bp, Homo sapiens
cttcctgcctggtctcct

SEQ ID NO: 3727592 - DNA, 23 bp, Homo sapiens
cttcctggggcatctggcgaatc

SEQ ID NO: 3727593 - DNA, 17 bp, Homo sapiens
cttcctgtccgccctct

SEQ ID NO: 3727594 - DNA, 20 bp, Homo sapiens
cttcctgtcttcctgcattc

SEQ ID NO: 3727595 - DNA, 13 bp, Homo sapiens
cttccttccctgg

SEQ ID NO: 3727596 - DNA, 21 bp, Homo sapiens
cttccttttagcctagttcat

SEQ ID NO: 3727597 - DNA, 19 bp, Homo sapiens
cttcgcgtatttcaggatt

SEQ ID NO: 3727598 - DNA, 15 bp, Homo sapiens
cttcgctcctgtgtc

SEQ ID NO: 3727599 - DNA, 16 bp, Homo sapiens
cttcgctcctgtgtct

SEQ ID NO: 3727600 - DNA, 20 bp, Homo sapiens
cttcgggaggtcgaggcagg

SEQ ID NO: 3727601 - DNA, 17 bp, Homo sapiens
cttctacactctcctgg

SEQ ID NO: 3727602 - DNA, 21 bp, Homo sapiens
cttctagtgatttctggggcc

SEQ ID NO: 3727603 - DNA, 23 bp, Homo sapiens
cttctatggactggttgttgcca

SEQ ID NO: 3727604 - DNA, 14 bp, Homo sapiens
cttctattttgtaa

SEQ ID NO: 3727605 - DNA, 16 bp, Homo sapiens
cttctcactcccttct

SEQ ID NO: 3727606 - DNA, 15 bp, Homo sapiens
cttctcaggctctgc

SEQ ID NO: 3727607 - DNA, 19 bp, Homo sapiens
cttctcaggctctgccctg

SEQ ID NO: 3727608 - DNA, 22 bp, Homo sapiens
cttctcaggctctgccctgccc

SEQ ID NO: 3727609 - DNA, 13 bp, Homo sapiens
cttctcatagcat

SEQ ID NO: 3727610 - DNA, 12 bp, Homo sapiens
cttctcatctgt

SEQ ID NO: 3727611 - DNA, 14 bp, Homo sapiens
cttctccaccctgc

SEQ ID NO: 3727612 - DNA, 21 bp, Homo sapiens
cttctccaccctgctctccga

SEQ ID NO: 3727613 - DNA, 13 bp, Homo sapiens
cttctccactgga

SEQ ID NO: 3727614 - DNA, 14 bp, Homo sapiens
cttctccaggctgt

SEQ ID NO: 3727615 - DNA, 13 bp, Homo sapiens
cttctcccacact

SEQ ID NO: 3727616 - DNA, 20 bp, Homo sapiens
cttctccttccaactgctgc

SEQ ID NO: 3727617 - DNA, 19 bp, Homo sapiens
cttctccttgataacagct

SEQ ID NO: 3727618 - DNA, 14 bp, Homo sapiens
cttctcctttcaca

SEQ ID NO: 3727619 - DNA, 20 bp, Homo sapiens
cttctcctttcacaaccttc

SEQ ID NO: 3727620 - DNA, 22 bp, Homo sapiens
cttctcctttcacaaccttctg

SEQ ID NO: 3727621 - DNA, 20 bp, Homo sapiens
cttctctaaatgaggggcct

SEQ ID NO: 3727622 - DNA, 11 bp, Homo sapiens
cttctctacag

SEQ ID NO: 3727623 - DNA, 18 bp, Homo sapiens
cttctctcacctcctaaa

SEQ ID NO: 3727624 - DNA, 17 bp, Homo sapiens
cttctctgcccattccc

SEQ ID NO: 3727625 - DNA, 19 bp, Homo sapiens
cttctctgcccattcccca

SEQ ID NO: 3727626 - DNA, 22 bp, Homo sapiens
cttctctgcccattccccagcc

SEQ ID NO: 3727627 - DNA, 12 bp, Homo sapiens
cttctctgctcc

SEQ ID NO: 3727628 - DNA, 16 bp, Homo sapiens
cttctctgctccacca

SEQ ID NO: 3727629 - DNA, 21 bp, Homo sapiens
cttctgactgctgattctccc

SEQ ID NO: 3727630 - DNA, 15 bp, Homo sapiens
cttctgatgaatctt

SEQ ID NO: 3727631 - DNA, 15 bp, Homo sapiens
cttctgccatattct

SEQ ID NO: 3727632 - DNA, 17 bp, Homo sapiens
cttctgccatattctgt

SEQ ID NO: 3727633 - DNA, 18 bp, Homo sapiens
cttctgccctccctggag

SEQ ID NO: 3727634 - DNA, 13 bp, Homo sapiens
cttctgctccacc

SEQ ID NO: 3727635 - DNA, 23 bp, Homo sapiens
cttctgctccacccttggcctgt

SEQ ID NO: 3727636 - DNA, 15 bp, Homo sapiens
cttctgctggataaa

SEQ ID NO: 3727637 - DNA, 19 bp, Homo sapiens
cttctgctggataaaatga

SEQ ID NO: 3727638 - DNA, 13 bp, Homo sapiens
cttctgcttcagc

SEQ ID NO: 3727639 - DNA, 16 bp, Homo sapiens
cttctgcttcagcctc

SEQ ID NO: 3727640 - DNA, 17 bp, Homo sapiens
cttctggcacttggaga

SEQ ID NO: 3727641 - DNA, 22 bp, Homo sapiens
cttctgggaaggggtttctaac

SEQ ID NO: 3727642 - DNA, 15 bp, Homo sapiens
cttctgtagtactcc

SEQ ID NO: 3727643 - DNA, 17 bp, Homo sapiens
cttctgtcctactctgt

SEQ ID NO: 3727644 - DNA, 18 bp, Homo sapiens
cttctgtcctactctgtg

SEQ ID NO: 3727645 - DNA, 13 bp, Homo sapiens
cttctgtggctca

SEQ ID NO: 3727646 - DNA, 14 bp, Homo sapiens
cttcttacatgcat

SEQ ID NO: 3727647 - DNA, 13 bp, Homo sapiens
cttcttatacatt

SEQ ID NO: 3727648 - DNA, 20 bp, Homo sapiens
cttcttattctcactccacc

SEQ ID NO: 3727649 - DNA, 19 bp, Homo sapiens
cttcttgtgatcttgctct

SEQ ID NO: 3727650 - DNA, 13 bp, Homo sapiens
cttcttttactca

SEQ ID NO: 3727651 - DNA, 14 bp, Homo sapiens
cttcttttgctctt

SEQ ID NO: 3727652 - DNA, 19 bp, Homo sapiens
cttgaaagaagaaaaggtt

SEQ ID NO: 3727653 - DNA, 21 bp, Homo sapiens
cttgaaagaagaaaaggttct

SEQ ID NO: 3727654 - DNA, 16 bp, Homo sapiens
cttgaaagcatccatg

SEQ ID NO: 3727655 - DNA, 17 bp, Homo sapiens
cttgaaagcatccatgt

SEQ ID NO: 3727656 - DNA, 20 bp, Homo sapiens
cttgaaagcatccatgtgtg

SEQ ID NO: 3727657 - DNA, 22 bp, Homo sapiens
cttgaaatgaaagtataactga

SEQ ID NO: 3727658 - DNA, 15 bp, Homo sapiens
cttgaacacagtatt

SEQ ID NO: 3727659 - DNA, 17 bp, Homo sapiens
cttgaacacagtatttt

SEQ ID NO: 3727660 - DNA, 20 bp, Homo sapiens
cttgaacacagtattttccc

SEQ ID NO: 3727661 - DNA, 16 bp, Homo sapiens
cttgaacactggggga

SEQ ID NO: 3727662 - DNA, 15 bp, Homo sapiens
cttgaactcctggcc

SEQ ID NO: 3727663 - DNA, 13 bp, Homo sapiens
cttgaagccactg

SEQ ID NO: 3727664 - DNA, 16 bp, Homo sapiens
cttgaagccactgaag

SEQ ID NO: 3727665 - DNA, 20 bp, Homo sapiens
cttgaagtcacccggccccc

SEQ ID NO: 3727666 - DNA, 20 bp, Homo sapiens
cttgaattgcattttttaaa

SEQ ID NO: 3727667 - DNA, 14 bp, Homo sapiens
cttgacagaacact

SEQ ID NO: 3727668 - DNA, 17 bp, Homo sapiens
cttgacagaacactgtc

SEQ ID NO: 3727669 - DNA, 12 bp, Homo sapiens
cttgacagggca

SEQ ID NO: 3727670 - DNA, 13 bp, Homo sapiens
cttgacagggcac

SEQ ID NO: 3727671 - DNA, 14 bp, Homo sapiens
cttgacagggcaca

SEQ ID NO: 3727672 - DNA, 20 bp, Homo sapiens
cttgacagggcacaccgggc

SEQ ID NO: 3727673 - DNA, 12 bp, Homo sapiens
cttgaccaagca

SEQ ID NO: 3727674 - DNA, 15 bp, Homo sapiens
cttgaccaagcagga

SEQ ID NO: 3727675 - DNA, 17 bp, Homo sapiens
cttgaccaagcaggaag

SEQ ID NO: 3727676 - DNA, 18 bp, Homo sapiens
cttgaccaagcaggaagc

SEQ ID NO: 3727677 - DNA, 11 bp, Homo sapiens
cttgaccagca

SEQ ID NO: 3727678 - DNA, 16 bp, Homo sapiens
cttgagcccaggagtt

SEQ ID NO: 3727679 - DNA, 12 bp, Homo sapiens
cttgagcctggg

SEQ ID NO: 3727680 - DNA, 16 bp, Homo sapiens
cttgagcctgggaggt

SEQ ID NO: 3727681 - DNA, 13 bp, Homo sapiens
cttgagctcagga

SEQ ID NO: 3727682 - DNA, 10 bp, Homo sapiens
cttgagctga

SEQ ID NO: 3727683 - DNA, 12 bp, Homo sapiens
cttgagcttggc

SEQ ID NO: 3727684 - DNA, 20 bp, Homo sapiens
cttgagcttggcagctgaac

SEQ ID NO: 3727685 - DNA, 21 bp, Homo sapiens
cttgagcttggcagctgaact

SEQ ID NO: 3727686 - DNA, 14 bp, Homo sapiens
cttgaggccaggag

SEQ ID NO: 3727687 - DNA, 19 bp, Homo sapiens
cttgagggttgggctggtg

SEQ ID NO: 3727688 - DNA, 20 bp, Homo sapiens
cttgagttgattcagctctg

SEQ ID NO: 3727689 - DNA, 13 bp, Homo sapiens
cttgataacagct

SEQ ID NO: 3727690 - DNA, 18 bp, Homo sapiens
cttgatacttgttttcaa

SEQ ID NO: 3727691 - DNA, 15 bp, Homo sapiens
cttgatctgtatata

SEQ ID NO: 3727692 - DNA, 20 bp, Homo sapiens
cttgatctgtatatacaata

SEQ ID NO: 3727693 - DNA, 17 bp, Homo sapiens
cttgatgactggaattt

SEQ ID NO: 3727694 - DNA, 20 bp, Homo sapiens
cttgatgagtgtaacaagaa

SEQ ID NO: 3727695 - DNA, 20 bp, Homo sapiens
cttgatgtctttgttaagac

SEQ ID NO: 3727696 - DNA, 17 bp, Homo sapiens
cttgcaacacacagaca

SEQ ID NO: 3727697 - DNA, 19 bp, Homo sapiens
cttgcaacacacagacaca

SEQ ID NO: 3727698 - DNA, 22 bp, Homo sapiens
cttgcaagaatcagtgcaaaga

SEQ ID NO: 3727699 - DNA, 15 bp, Homo sapiens
cttgcaatggcagcc

SEQ ID NO: 3727700 - DNA, 19 bp, Homo sapiens
cttgcacactcccctgcac

SEQ ID NO: 3727701 - DNA, 20 bp, Homo sapiens
cttgcagactctacagaggc

SEQ ID NO: 3727702 - DNA, 15 bp, Homo sapiens
cttgcagagaagcct

SEQ ID NO: 3727703 - DNA, 18 bp, Homo sapiens
cttgcagagaagccttgg

SEQ ID NO: 3727704 - DNA, 20 bp, Homo sapiens
cttgcagtggaagatacttg

SEQ ID NO: 3727705 - DNA, 18 bp, Homo sapiens
cttgcagttcagcaccac

SEQ ID NO: 3727706 - DNA, 21 bp, Homo sapiens
cttgcataataagctaaagag

SEQ ID NO: 3727707 - DNA, 18 bp, Homo sapiens
cttgcattgaatatatta

SEQ ID NO: 3727708 - DNA, 22 bp, Homo sapiens
cttgccaatgaggtctgaaatg

SEQ ID NO: 3727709 - DNA, 23 bp, Homo sapiens
cttgccaatgaggtctgaaatgg

SEQ ID NO: 3727710 - DNA, 13 bp, Homo sapiens
cttgcccagggct

SEQ ID NO: 3727711 - DNA, 18 bp, Homo sapiens
cttgcccagggctcagcc

SEQ ID NO: 3727712 - DNA, 15 bp, Homo sapiens
cttgccccccacccc

SEQ ID NO: 3727713 - DNA, 17 bp, Homo sapiens
cttgcccgctcaggctg

SEQ ID NO: 3727714 - DNA, 18 bp, Homo sapiens
cttgcccggattctggga

SEQ ID NO: 3727715 - DNA, 19 bp, Homo sapiens
cttgcctagggcctggtcc

SEQ ID NO: 3727716 - DNA, 19 bp, Homo sapiens
cttgcctccatggtgcctc

SEQ ID NO: 3727717 - DNA, 20 bp, Homo sapiens
cttgcctccatggtgcctct

SEQ ID NO: 3727718 - DNA, 12 bp, Homo sapiens
cttgcctcctgt

SEQ ID NO: 3727719 - DNA, 13 bp, Homo sapiens
cttgcctgcaggc

SEQ ID NO: 3727720 - DNA, 20 bp, Homo sapiens
cttgctcgctgtaaaatctt

SEQ ID NO: 3727721 - DNA, 19 bp, Homo sapiens
cttgctctatctcacagca

SEQ ID NO: 3727722 - DNA, 23 bp, Homo sapiens
cttgctctatctcacagcacact

SEQ ID NO: 3727723 - DNA, 19 bp, Homo sapiens
cttgctctcccctgccctg

SEQ ID NO: 3727724 - DNA, 12 bp, Homo sapiens
cttgctctgctg

SEQ ID NO: 3727725 - DNA, 23 bp, Homo sapiens
cttgctgccctaggctccgtcag

SEQ ID NO: 3727726 - DNA, 15 bp, Homo sapiens
cttgctgtcctaggc

SEQ ID NO: 3727727 - DNA, 13 bp, Homo sapiens
cttgctgtggtct

SEQ ID NO: 3727728 - DNA, 23 bp, Homo sapiens
cttggaaaagtggcaagaccaaa

SEQ ID NO: 3727729 - DNA, 22 bp, Homo sapiens
cttggaaagcatcacctcaggc

SEQ ID NO: 3727730 - DNA, 22 bp, Homo sapiens
cttggacctcgtgctttaagtg

SEQ ID NO: 3727731 - DNA, 22 bp, Homo sapiens
cttggagccaatggagactgtc

SEQ ID NO: 3727732 - DNA, 20 bp, Homo sapiens
cttggagggcccacttgtat

SEQ ID NO: 3727733 - DNA, 18 bp, Homo sapiens
cttggataatgctgttgc

SEQ ID NO: 3727734 - DNA, 23 bp, Homo sapiens
cttggataatgctgttgcctcat

SEQ ID NO: 3727735 - DNA, 20 bp, Homo sapiens
cttggcatcacagggcagag

SEQ ID NO: 3727736 - DNA, 17 bp, Homo sapiens
cttggcatgccttccag

SEQ ID NO: 3727737 - DNA, 17 bp, Homo sapiens
cttggccagaagggggc

SEQ ID NO: 3727738 - DNA, 21 bp, Homo sapiens
cttggcgtggagccagggagc

SEQ ID NO: 3727739 - DNA, 12 bp, Homo sapiens
cttggctgcagg

SEQ ID NO: 3727740 - DNA, 13 bp, Homo sapiens
cttggctgcaggg

SEQ ID NO: 3727741 - DNA, 17 bp, Homo sapiens
cttggctgcagggagtc

SEQ ID NO: 3727742 - DNA, 22 bp, Homo sapiens
cttggctgtagaaggagacaga

SEQ ID NO: 3727743 - DNA, 12 bp, Homo sapiens
cttggctttgtt

SEQ ID NO: 3727744 - DNA, 13 bp, Homo sapiens
cttggctttgttt

SEQ ID NO: 3727745 - DNA, 19 bp, Homo sapiens
cttgggactaaatgccctg

SEQ ID NO: 3727746 - DNA, 20 bp, Homo sapiens
cttgggccactgtgaagaga

SEQ ID NO: 3727747 - DNA, 12 bp, Homo sapiens
cttgggccctcc

SEQ ID NO: 3727748 - DNA, 13 bp, Homo sapiens
cttgggccctcct

SEQ ID NO: 3727749 - DNA, 17 bp, Homo sapiens
cttgggctgagactgga

SEQ ID NO: 3727750 - DNA, 14 bp, Homo sapiens
cttgggctgctcct

SEQ ID NO: 3727751 - DNA, 14 bp, Homo sapiens
cttggggcttccta

SEQ ID NO: 3727752 - DNA, 22 bp, Homo sapiens
cttggggggctgaggtgggagg

SEQ ID NO: 3727753 - DNA, 15 bp, Homo sapiens
cttgggtaggcggga

SEQ ID NO: 3727754 - DNA, 22 bp, Homo sapiens
cttgggtgtaacaggtctcctc

SEQ ID NO: 3727755 - DNA, 15 bp, Homo sapiens
cttggtcttatttat

SEQ ID NO: 3727756 - DNA, 19 bp, Homo sapiens
cttggtggctcacgcctgt

SEQ ID NO: 3727757 - DNA, 14 bp, Homo sapiens
cttggtgtcctttc

SEQ ID NO: 3727758 - DNA, 20 bp, Homo sapiens
cttggtgtcctttccctcca

SEQ ID NO: 3727759 - DNA, 13 bp, Homo sapiens
cttggttatacat

SEQ ID NO: 3727760 - DNA, 17 bp, Homo sapiens
cttggttatacatgaca

SEQ ID NO: 3727761 - DNA, 17 bp, Homo sapiens
cttggttcatcagtgtt

SEQ ID NO: 3727762 - DNA, 18 bp, Homo sapiens
cttgtaaagactgtagaa

SEQ ID NO: 3727763 - DNA, 17 bp, Homo sapiens
cttgtaaatagctcagg

SEQ ID NO: 3727764 - DNA, 18 bp, Homo sapiens
cttgtaaatagctcaggt

SEQ ID NO: 3727765 - DNA, 17 bp, Homo sapiens
cttgtaacaagaaaaca

SEQ ID NO: 3727766 - DNA, 14 bp, Homo sapiens
cttgtaactccacc

SEQ ID NO: 3727767 - DNA, 19 bp, Homo sapiens
cttgtaagagctatacagt

SEQ ID NO: 3727768 - DNA, 12 bp, Homo sapiens
cttgtaagattt

SEQ ID NO: 3727769 - DNA, 16 bp, Homo sapiens
cttgtaattctaaatg

SEQ ID NO: 3727770 - DNA, 12 bp, Homo sapiens
cttgtacaaaat

SEQ ID NO: 3727771 - DNA, 16 bp, Homo sapiens
cttgtcacaataaatg

SEQ ID NO: 3727772 - DNA, 21 bp, Homo sapiens
cttgtcccctcctcactccct

SEQ ID NO: 3727773 - DNA, 16 bp, Homo sapiens
cttgtccctgcccaga

SEQ ID NO: 3727774 - DNA, 13 bp, Homo sapiens
cttgtctctgggc

SEQ ID NO: 3727775 - DNA, 14 bp, Homo sapiens
cttgtctctgggct

SEQ ID NO: 3727776 - DNA, 11 bp, Homo sapiens
cttgtcttaaa

SEQ ID NO: 3727777 - DNA, 14 bp, Homo sapiens
cttgtcttgttcac

SEQ ID NO: 3727778 - DNA, 21 bp, Homo sapiens
cttgtgacatattatgtcttc

SEQ ID NO: 3727779 - DNA, 15 bp, Homo sapiens
cttgtgactagtgct

SEQ ID NO: 3727780 - DNA, 18 bp, Homo sapiens
cttgtgactagtgctgaa

SEQ ID NO: 3727781 - DNA, 14 bp, Homo sapiens
cttgtggacacagc

SEQ ID NO: 3727782 - DNA, 15 bp, Homo sapiens
cttgtggacacagct

SEQ ID NO: 3727783 - DNA, 13 bp, Homo sapiens
cttgtgtctgcgt

SEQ ID NO: 3727784 - DNA, 22 bp, Homo sapiens
cttgtgtttttaactcaatatt

SEQ ID NO: 3727785 - DNA, 22 bp, Homo sapiens
cttgttctactcatatatatct

SEQ ID NO: 3727786 - DNA, 12 bp, Homo sapiens
cttgtttcaatt

SEQ ID NO: 3727787 - DNA, 20 bp, Homo sapiens
cttgtttgattttagctgca

SEQ ID NO: 3727788 - DNA, 23 bp, Homo sapiens
cttgtttgattttagctgcagaa

SEQ ID NO: 3727789 - DNA, 17 bp, Homo sapiens
cttgtttgcttcaactg

SEQ ID NO: 3727790 - DNA, 17 bp, Homo sapiens
cttgttttcttgccaat

SEQ ID NO: 3727791 - DNA, 18 bp, Homo sapiens
cttgttttcttgccaatg

SEQ ID NO: 3727792 - DNA, 19 bp, Homo sapiens
cttgttttttttttccact

SEQ ID NO: 3727793 - DNA, 19 bp, Homo sapiens
ctttaactcaggactccag

SEQ ID NO: 3727794 - DNA, 12 bp, Homo sapiens
ctttaaggaaaa

SEQ ID NO: 3727795 - DNA, 14 bp, Homo sapiens
ctttaatatgtatt

SEQ ID NO: 3727796 - DNA, 20 bp, Homo sapiens
ctttaatgtcacaggcaggt

SEQ ID NO: 3727797 - DNA, 14 bp, Homo sapiens
ctttaattgtgaat

SEQ ID NO: 3727798 - DNA, 12 bp, Homo sapiens
ctttactgtttg

SEQ ID NO: 3727799 - DNA, 15 bp, Homo sapiens
ctttactgtttgtta

SEQ ID NO: 3727800 - DNA, 15 bp, Homo sapiens
ctttacttagcttat

SEQ ID NO: 3727801 - DNA, 18 bp, Homo sapiens
ctttacttagcttatcaa

SEQ ID NO: 3727802 - DNA, 22 bp, Homo sapiens
ctttagaatgagagtgtgaaat

SEQ ID NO: 3727803 - DNA, 23 bp, Homo sapiens
ctttagcacgtttaaagttctgt

SEQ ID NO: 3727804 - DNA, 15 bp, Homo sapiens
ctttagcgcccagtt

SEQ ID NO: 3727805 - DNA, 13 bp, Homo sapiens
ctttataaacttt

SEQ ID NO: 3727806 - DNA, 15 bp, Homo sapiens
ctttatgcacaaaat

SEQ ID NO: 3727807 - DNA, 13 bp, Homo sapiens
ctttattaaaatc

SEQ ID NO: 3727808 - DNA, 18 bp, Homo sapiens
ctttattaaaatcttaaa

SEQ ID NO: 3727809 - DNA, 20 bp, Homo sapiens
ctttattttatataataaag

SEQ ID NO: 3727810 - DNA, 11 bp, Homo sapiens
ctttattttct

SEQ ID NO: 3727811 - DNA, 23 bp, Homo sapiens
ctttattttttaagtatttatat

SEQ ID NO: 3727812 - DNA, 15 bp, Homo sapiens
ctttcaaagaaggaa

SEQ ID NO: 3727813 - DNA, 18 bp, Homo sapiens
ctttcaaagaaggaattc

SEQ ID NO: 3727814 - DNA, 21 bp, Homo sapiens
ctttcaaattgagagaatgga

SEQ ID NO: 3727815 - DNA, 14 bp, Homo sapiens
ctttcaaatttcac

SEQ ID NO: 3727816 - DNA, 15 bp, Homo sapiens
ctttcaaatttcaca

SEQ ID NO: 3727817 - DNA, 16 bp, Homo sapiens
ctttcaataacgaagt

SEQ ID NO: 3727818 - DNA, 21 bp, Homo sapiens
ctttcaatggtttgcaaggaa

SEQ ID NO: 3727819 - DNA, 22 bp, Homo sapiens
ctttcaatggtttgcaaggaag

SEQ ID NO: 3727820 - DNA, 14 bp, Homo sapiens
ctttcacacttcca

SEQ ID NO: 3727821 - DNA, 23 bp, Homo sapiens
ctttcacacttccaccagcctgc

SEQ ID NO: 3727822 - DNA, 17 bp, Homo sapiens
ctttcacagtaccatct

SEQ ID NO: 3727823 - DNA, 12 bp, Homo sapiens
ctttcagagcct

SEQ ID NO: 3727824 - DNA, 13 bp, Homo sapiens
ctttcagagcctc

SEQ ID NO: 3727825 - DNA, 13 bp, Homo sapiens
ctttcagggcctc

SEQ ID NO: 3727826 - DNA, 12 bp, Homo sapiens
ctttcaggtact

SEQ ID NO: 3727827 - DNA, 17 bp, Homo sapiens
ctttcagtgaaagcatc

SEQ ID NO: 3727828 - DNA, 17 bp, Homo sapiens
ctttcatccccaccttg

SEQ ID NO: 3727829 - DNA, 18 bp, Homo sapiens
ctttccaaatgcccagct

SEQ ID NO: 3727830 - DNA, 18 bp, Homo sapiens
ctttccacatttgtcaca

SEQ ID NO: 3727831 - DNA, 17 bp, Homo sapiens
ctttccaccccctccct

SEQ ID NO: 3727832 - DNA, 22 bp, Homo sapiens
ctttccaccccctccctggcct

SEQ ID NO: 3727833 - DNA, 23 bp, Homo sapiens
ctttccaccccctccctggcctg

SEQ ID NO: 3727834 - DNA, 16 bp, Homo sapiens
ctttccatgggaaact

SEQ ID NO: 3727835 - DNA, 15 bp, Homo sapiens
ctttccatttctctc

SEQ ID NO: 3727836 - DNA, 21 bp, Homo sapiens
ctttcccaacacttcagactg

SEQ ID NO: 3727837 - DNA, 22 bp, Homo sapiens
ctttcccaacacttcagactgc

SEQ ID NO: 3727838 - DNA, 16 bp, Homo sapiens
ctttcccatcttccaa

SEQ ID NO: 3727839 - DNA, 11 bp, Homo sapiens
ctttccctccc

SEQ ID NO: 3727840 - DNA, 14 bp, Homo sapiens
ctttcctgttcagc

SEQ ID NO: 3727841 - DNA, 19 bp, Homo sapiens
ctttcctgttcagcattct

SEQ ID NO: 3727842 - DNA, 15 bp, Homo sapiens
ctttccttccatccc

SEQ ID NO: 3727843 - DNA, 14 bp, Homo sapiens
ctttccttcctctc

SEQ ID NO: 3727844 - DNA, 16 bp, Homo sapiens
ctttccttcctctcat

SEQ ID NO: 3727845 - DNA, 22 bp, Homo sapiens
ctttcggggagaggctgaggac

SEQ ID NO: 3727846 - DNA, 14 bp, Homo sapiens
ctttctagctgttg

SEQ ID NO: 3727847 - DNA, 23 bp, Homo sapiens
ctttctccttagtcttctcatag

SEQ ID NO: 3727848 - DNA, 12 bp, Homo sapiens
ctttctctgctt

SEQ ID NO: 3727849 - DNA, 14 bp, Homo sapiens
ctttctctgcttca

SEQ ID NO: 3727850 - DNA, 21 bp, Homo sapiens
ctttctctgcttcagcttgct

SEQ ID NO: 3727851 - DNA, 14 bp, Homo sapiens
ctttctgggccaag

SEQ ID NO: 3727852 - DNA, 13 bp, Homo sapiens
ctttctttggtgc

SEQ ID NO: 3727853 - DNA, 18 bp, Homo sapiens
ctttctttggtgcctttc

SEQ ID NO: 3727854 - DNA, 20 bp, Homo sapiens
ctttctttggtgcctttcct

SEQ ID NO: 3727855 - DNA, 19 bp, Homo sapiens
ctttgaaatagtctgtgtg

SEQ ID NO: 3727856 - DNA, 15 bp, Homo sapiens
ctttgaaattgttta

SEQ ID NO: 3727857 - DNA, 21 bp, Homo sapiens
ctttgacaattcctagataaa

SEQ ID NO: 3727858 - DNA, 17 bp, Homo sapiens
ctttgacctcaacctgt

SEQ ID NO: 3727859 - DNA, 21 bp, Homo sapiens
ctttgactcttttgccattaa

SEQ ID NO: 3727860 - DNA, 19 bp, Homo sapiens
ctttgagtttcctcaggct

SEQ ID NO: 3727861 - DNA, 20 bp, Homo sapiens
ctttgcagacaggcaagcac

SEQ ID NO: 3727862 - DNA, 17 bp, Homo sapiens
ctttgcccaacctcagc

SEQ ID NO: 3727863 - DNA, 16 bp, Homo sapiens
ctttgccttgggctgc

SEQ ID NO: 3727864 - DNA, 22 bp, Homo sapiens
ctttgccttgggctgctcctca

SEQ ID NO: 3727865 - DNA, 23 bp, Homo sapiens
ctttgccttgggctgctcctcat

SEQ ID NO: 3727866 - DNA, 14 bp, Homo sapiens
ctttgctctttctt

SEQ ID NO: 3727867 - DNA, 20 bp, Homo sapiens
ctttgcttgaacacagtatt

SEQ ID NO: 3727868 - DNA, 18 bp, Homo sapiens
ctttggacacacacagct

SEQ ID NO: 3727869 - DNA, 16 bp, Homo sapiens
ctttggacgcacacag

SEQ ID NO: 3727870 - DNA, 21 bp, Homo sapiens
ctttggactctcccctcttat

SEQ ID NO: 3727871 - DNA, 20 bp, Homo sapiens
ctttggagaacgccagtctc

SEQ ID NO: 3727872 - DNA, 15 bp, Homo sapiens
ctttgggaaaggaga

SEQ ID NO: 3727873 - DNA, 14 bp, Homo sapiens
ctttgggaggctga

SEQ ID NO: 3727874 - DNA, 15 bp, Homo sapiens
ctttgggctgccctg

SEQ ID NO: 3727875 - DNA, 19 bp, Homo sapiens
ctttgggctgccctggtgc

SEQ ID NO: 3727876 - DNA, 21 bp, Homo sapiens
ctttgggctgccctggtgctg

SEQ ID NO: 3727877 - DNA, 16 bp, Homo sapiens
ctttggtctcttgctt

SEQ ID NO: 3727878 - DNA, 13 bp, Homo sapiens
ctttggtgccttt

SEQ ID NO: 3727879 - DNA, 21 bp, Homo sapiens
ctttgtaagtaaactgccctg

SEQ ID NO: 3727880 - DNA, 13 bp, Homo sapiens
ctttgtaatggga

SEQ ID NO: 3727881 - DNA, 14 bp, Homo sapiens
ctttgtatgatatt

SEQ ID NO: 3727882 - DNA, 20 bp, Homo sapiens
ctttgtatgatattccatag

SEQ ID NO: 3727883 - DNA, 12 bp, Homo sapiens
ctttgtatgcac

SEQ ID NO: 3727884 - DNA, 17 bp, Homo sapiens
ctttgtcctttttgtta

SEQ ID NO: 3727885 - DNA, 20 bp, Homo sapiens
ctttgtgctacatgacgaca

SEQ ID NO: 3727886 - DNA, 13 bp, Homo sapiens
ctttgtggcttcc

SEQ ID NO: 3727887 - DNA, 17 bp, Homo sapiens
ctttgtgtagctttgct

SEQ ID NO: 3727888 - DNA, 20 bp, Homo sapiens
ctttgttatttttgtttctt

SEQ ID NO: 3727889 - DNA, 21 bp, Homo sapiens
ctttgttgcaagtactgctgt

SEQ ID NO: 3727890 - DNA, 16 bp, Homo sapiens
ctttgttgcccaggct

SEQ ID NO: 3727891 - DNA, 20 bp, Homo sapiens
ctttgttgctcagcaagggg

SEQ ID NO: 3727892 - DNA, 15 bp, Homo sapiens
ctttgtttggctggg

SEQ ID NO: 3727893 - DNA, 20 bp, Homo sapiens
ctttgtttgttgtcagctga

SEQ ID NO: 3727894 - DNA, 24 bp, Homo sapiens
ctttgttttgatgtttgtggcctc

SEQ ID NO: 3727895 - DNA, 19 bp, Homo sapiens
ctttgttttgttttaagga

SEQ ID NO: 3727896 - DNA, 22 bp, Homo sapiens
cttttaaaggggcagaaaaact

SEQ ID NO: 3727897 - DNA, 12 bp, Homo sapiens
cttttaaatcct

SEQ ID NO: 3727898 - DNA, 17 bp, Homo sapiens
cttttaaatcctgttga

SEQ ID NO: 3727899 - DNA, 13 bp, Homo sapiens
cttttacatactg

SEQ ID NO: 3727900 - DNA, 23 bp, Homo sapiens
cttttactcatgatcttgtgaca

SEQ ID NO: 3727901 - DNA, 13 bp, Homo sapiens
cttttagcctagt

SEQ ID NO: 3727902 - DNA, 18 bp, Homo sapiens
cttttagtacccacctga

SEQ ID NO: 3727903 - DNA, 21 bp, Homo sapiens
cttttagtacccacctgagct

SEQ ID NO: 3727904 - DNA, 22 bp, Homo sapiens
cttttagtacccacctgagctt

SEQ ID NO: 3727905 - DNA, 21 bp, Homo sapiens
cttttataaaaaaaatgaaat

SEQ ID NO: 3727906 - DNA, 14 bp, Homo sapiens
cttttataaattaa

SEQ ID NO: 3727907 - DNA, 15 bp, Homo sapiens
cttttataaattaaa

SEQ ID NO: 3727908 - DNA, 20 bp, Homo sapiens
cttttataaattaaatatat

SEQ ID NO: 3727909 - DNA, 12 bp, Homo sapiens
cttttcactgct

SEQ ID NO: 3727910 - DNA, 14 bp, Homo sapiens
cttttccccggtcc

SEQ ID NO: 3727911 - DNA, 14 bp, Homo sapiens
cttttcccttcttt

SEQ ID NO: 3727912 - DNA, 22 bp, Homo sapiens
cttttcctacttttccttccct

SEQ ID NO: 3727913 - DNA, 20 bp, Homo sapiens
cttttccttggggcaggcag

SEQ ID NO: 3727914 - DNA, 21 bp, Homo sapiens
cttttcgcaggattcttcctc

SEQ ID NO: 3727915 - DNA, 16 bp, Homo sapiens
cttttcgttaacattg

SEQ ID NO: 3727916 - DNA, 20 bp, Homo sapiens
cttttcgttaacattgacca

SEQ ID NO: 3727917 - DNA, 13 bp, Homo sapiens
cttttctctttct

SEQ ID NO: 3727918 - DNA, 12 bp, Homo sapiens
cttttctgcaga

SEQ ID NO: 3727919 - DNA, 18 bp, Homo sapiens
cttttctgtccgagcttt

SEQ ID NO: 3727920 - DNA, 21 bp, Homo sapiens
cttttcttgactattggagga

SEQ ID NO: 3727921 - DNA, 19 bp, Homo sapiens
cttttcttgtttatcagca

SEQ ID NO: 3727922 - DNA, 23 bp, Homo sapiens
cttttgacggaaggacctatgtt

SEQ ID NO: 3727923 - DNA, 20 bp, Homo sapiens
cttttgcccttcacagtgtt

SEQ ID NO: 3727924 - DNA, 16 bp, Homo sapiens
cttttggaatctagaa

SEQ ID NO: 3727925 - DNA, 18 bp, Homo sapiens
cttttggaatctagaaga

SEQ ID NO: 3727926 - DNA, 22 bp, Homo sapiens
cttttggaatctagaagaaatg

SEQ ID NO: 3727927 - DNA, 23 bp, Homo sapiens
cttttggaatctagaagaaatga

SEQ ID NO: 3727928 - DNA, 15 bp, Homo sapiens
cttttggcactgaga

SEQ ID NO: 3727929 - DNA, 19 bp, Homo sapiens
cttttgggtttctgccctg

SEQ ID NO: 3727930 - DNA, 16 bp, Homo sapiens
cttttggtctgtgtga

SEQ ID NO: 3727931 - DNA, 13 bp, Homo sapiens
cttttgtaagaca

SEQ ID NO: 3727932 - DNA, 20 bp, Homo sapiens
cttttgtaagacaaaggttt

SEQ ID NO: 3727933 - DNA, 14 bp, Homo sapiens
cttttgtaagttga

SEQ ID NO: 3727934 - DNA, 11 bp, Homo sapiens
cttttgtttct

SEQ ID NO: 3727935 - DNA, 15 bp, Homo sapiens
ctttttactcccctt

SEQ ID NO: 3727936 - DNA, 19 bp, Homo sapiens
ctttttactccccttgagc

SEQ ID NO: 3727937 - DNA, 22 bp, Homo sapiens
ctttttccagacacttttttga

SEQ ID NO: 3727938 - DNA, 18 bp, Homo sapiens
ctttttctttataaactt

SEQ ID NO: 3727939 - DNA, 16 bp, Homo sapiens
ctttttggtggatgta

SEQ ID NO: 3727940 - DNA, 17 bp, Homo sapiens
ctttttggtggatgtaa

SEQ ID NO: 3727941 - DNA, 19 bp, Homo sapiens
ctttttggtggatgtaaat

SEQ ID NO: 3727942 - DNA, 21 bp, Homo sapiens
cttttttaaattttcttcagt

SEQ ID NO: 3727943 - DNA, 18 bp, Homo sapiens
cttttttatgtgccgtgt

SEQ ID NO: 3727944 - DNA, 16 bp, Homo sapiens
cttttttcttatttaa

SEQ ID NO: 3727945 - DNA, 20 bp, Homo sapiens
gaaaaaaaatgttctttggg

SEQ ID NO: 3727946 - DNA, 18 bp, Homo sapiens
gaaaaaaagtttgccaga

SEQ ID NO: 3727947 - DNA, 13 bp, Homo sapiens
gaaaaaagaatgt

SEQ ID NO: 3727948 - DNA, 17 bp, Homo sapiens
gaaaaaataacacacat

SEQ ID NO: 3727949 - DNA, 23 bp, Homo sapiens
gaaaaactctgggaaataagaga

SEQ ID NO: 3727950 - DNA, 11 bp, Homo sapiens
gaaaaagaaaa

SEQ ID NO: 3727951 - DNA, 18 bp, Homo sapiens
gaaaaaggagcttacctc

SEQ ID NO: 3727952 - DNA, 19 bp, Homo sapiens
gaaaaagttaaacattgaa

SEQ ID NO: 3727953 - DNA, 15 bp, Homo sapiens
gaaaaatatgatatt

SEQ ID NO: 3727954 - DNA, 17 bp, Homo sapiens
gaaaaatccagaaagaa

SEQ ID NO: 3727955 - DNA, 20 bp, Homo sapiens
gaaaaatttaagcattgttt

SEQ ID NO: 3727956 - DNA, 18 bp, Homo sapiens
gaaaacaacaaaaaataa

SEQ ID NO: 3727957 - DNA, 19 bp, Homo sapiens
gaaaaccaagccgtggctt

SEQ ID NO: 3727958 - DNA, 14 bp, Homo sapiens
gaaaaccccagcat

SEQ ID NO: 3727959 - DNA, 14 bp, Homo sapiens
gaaaacgttttatt

SEQ ID NO: 3727960 - DNA, 16 bp, Homo sapiens
gaaaactacattttaa

SEQ ID NO: 3727961 - DNA, 21 bp, Homo sapiens
gaaaacttgaattcatagaaa

SEQ ID NO: 3727962 - DNA, 22 bp, Homo sapiens
gaaaagaaaccccaaactcagg

SEQ ID NO: 3727963 - DNA, 18 bp, Homo sapiens
gaaaagaatacagaaaga

SEQ ID NO: 3727964 - DNA, 19 bp, Homo sapiens
gaaaagaatacagaaagat

SEQ ID NO: 3727965 - DNA, 20 bp, Homo sapiens
gaaaagatacgactttattt

SEQ ID NO: 3727966 - DNA, 23 bp, Homo sapiens
gaaaagcatcctgtctggcattt

SEQ ID NO: 3727967 - DNA, 13 bp, Homo sapiens
gaaaaggaagact

SEQ ID NO: 3727968 - DNA, 20 bp, Homo sapiens
gaaaaggaagactagaggct

SEQ ID NO: 3727969 - DNA, 19 bp, Homo sapiens
gaaaagtggcaagaccaaa

SEQ ID NO: 3727970 - DNA, 13 bp, Homo sapiens
gaaaataaaatta

SEQ ID NO: 3727971 - DNA, 20 bp, Homo sapiens
gaaaataaaattaagaatgt

SEQ ID NO: 3727972 - DNA, 19 bp, Homo sapiens
gaaaatacaacttaaataa

SEQ ID NO: 3727973 - DNA, 14 bp, Homo sapiens
gaaaatacaataaa

SEQ ID NO: 3727974 - DNA, 16 bp, Homo sapiens
gaaaatacaataaact

SEQ ID NO: 3727975 - DNA, 12 bp, Homo sapiens
gaaaatatgcat

SEQ ID NO: 3727976 - DNA, 22 bp, Homo sapiens
gaaaatcagcctgctccagctg

SEQ ID NO: 3727977 - DNA, 15 bp, Homo sapiens
gaaaatcctctggct

SEQ ID NO: 3727978 - DNA, 19 bp, Homo sapiens
gaaaatggaagtggcaata

SEQ ID NO: 3727979 - DNA, 16 bp, Homo sapiens
gaaaatgtaagtaaat

SEQ ID NO: 3727980 - DNA, 15 bp, Homo sapiens
gaaaatgtatgtgta

SEQ ID NO: 3727981 - DNA, 22 bp, Homo sapiens
gaaaatgtcagaaaccagttat

SEQ ID NO: 3727982 - DNA, 22 bp, Homo sapiens
gaaaatgttttgtaagaaacca

SEQ ID NO: 3727983 - DNA, 15 bp, Homo sapiens
gaaaattaacactgc

SEQ ID NO: 3727984 - DNA, 20 bp, Homo sapiens
gaaaattccagaaaggatat

SEQ ID NO: 3727985 - DNA, 19 bp, Homo sapiens
gaaaattgaatttaacaat

SEQ ID NO: 3727986 - DNA, 21 bp, Homo sapiens
gaaacaaagtggaaggaaaga

SEQ ID NO: 3727987 - DNA, 23 bp, Homo sapiens
gaaacacaccaggctgtgggcct

SEQ ID NO: 3727988 - DNA, 19 bp, Homo sapiens
gaaacacactgaggcaggg

SEQ ID NO: 3727989 - DNA, 18 bp, Homo sapiens
gaaacacctagatcagaa

SEQ ID NO: 3727990 - DNA, 14 bp, Homo sapiens
gaaacagagacagg

SEQ ID NO: 3727991 - DNA, 16 bp, Homo sapiens
gaaacagagacaggcc

SEQ ID NO: 3727992 - DNA, 18 bp, Homo sapiens
gaaacagctaatgggaca

SEQ ID NO: 3727993 - DNA, 16 bp, Homo sapiens
gaaacccgacagaggg

SEQ ID NO: 3727994 - DNA, 17 bp, Homo sapiens
gaaacccttgaaaagac

SEQ ID NO: 3727995 - DNA, 19 bp, Homo sapiens
gaaaccttattgtacctct

SEQ ID NO: 3727996 - DNA, 20 bp, Homo sapiens
gaaaccttattgtacctctc

SEQ ID NO: 3727997 - DNA, 12 bp, Homo sapiens
gaaactaacaga

SEQ ID NO: 3727998 - DNA, 21 bp, Homo sapiens
gaaactcacccccaaggggca

SEQ ID NO: 3727999 - DNA, 18 bp, Homo sapiens
gaaactcacctgctggcc

SEQ ID NO: 3728000 - DNA, 20 bp, Homo sapiens
gaaactcacctgctggcccc

SEQ ID NO: 3728001 - DNA, 18 bp, Homo sapiens
gaaactgtagtctcagga

SEQ ID NO: 3728002 - DNA, 16 bp, Homo sapiens
gaaacttatcttacaa

SEQ ID NO: 3728003 - DNA, 22 bp, Homo sapiens
gaaagaaacccgacagagggaa

SEQ ID NO: 3728004 - DNA, 11 bp, Homo sapiens
gaaagaaatca

SEQ ID NO: 3728005 - DNA, 14 bp, Homo sapiens
gaaagaaatcatgt

SEQ ID NO: 3728006 - DNA, 15 bp, Homo sapiens
gaaagaaatcatgtt

SEQ ID NO: 3728007 - DNA, 16 bp, Homo sapiens
gaaagaaatcatgtta

SEQ ID NO: 3728008 - DNA, 16 bp, Homo sapiens
gaaagaagaaaaggtt

SEQ ID NO: 3728009 - DNA, 16 bp, Homo sapiens
gaaagacagcttctca

SEQ ID NO: 3728010 - DNA, 17 bp, Homo sapiens
gaaagacagcttctcat

SEQ ID NO: 3728011 - DNA, 18 bp, Homo sapiens
gaaagactatctaaatgt

SEQ ID NO: 3728012 - DNA, 20 bp, Homo sapiens
gaaagactatctaaatgttg

SEQ ID NO: 3728013 - DNA, 14 bp, Homo sapiens
gaaagactgagctc

SEQ ID NO: 3728014 - DNA, 17 bp, Homo sapiens
gaaagactgtacaaagt

SEQ ID NO: 3728015 - DNA, 19 bp, Homo sapiens
gaaagagagagaattcttt

SEQ ID NO: 3728016 - DNA, 16 bp, Homo sapiens
gaaagagagcactgac

SEQ ID NO: 3728017 - DNA, 23 bp, Homo sapiens
gaaagcactcctccctgatgtac

SEQ ID NO: 3728018 - DNA, 14 bp, Homo sapiens
gaaagcagaggctg

SEQ ID NO: 3728019 - DNA, 21 bp, Homo sapiens
gaaagcatgtggcatgttcat

SEQ ID NO: 3728020 - DNA, 14 bp, Homo sapiens
gaaagccagtctta

SEQ ID NO: 3728021 - DNA, 15 bp, Homo sapiens
gaaagccagtcttaa

SEQ ID NO: 3728022 - DNA, 14 bp, Homo sapiens
gaaagccccagcac

SEQ ID NO: 3728023 - DNA, 15 bp, Homo sapiens
gaaagcctctgctgc

SEQ ID NO: 3728024 - DNA, 16 bp, Homo sapiens
gaaagcctctgctgcc

SEQ ID NO: 3728025 - DNA, 17 bp, Homo sapiens
gaaagcggagttcctaa

SEQ ID NO: 3728026 - DNA, 13 bp, Homo sapiens
gaaagctagagat

SEQ ID NO: 3728027 - DNA, 16 bp, Homo sapiens
gaaagctagagatatg

SEQ ID NO: 3728028 - DNA, 17 bp, Homo sapiens
gaaagcttcaaactgca

SEQ ID NO: 3728029 - DNA, 13 bp, Homo sapiens
gaaaggagactag

SEQ ID NO: 3728030 - DNA, 14 bp, Homo sapiens
gaaaggatatttaa

SEQ ID NO: 3728031 - DNA, 17 bp, Homo sapiens
gaaaggatatttaagaa

SEQ ID NO: 3728032 - DNA, 20 bp, Homo sapiens
gaaaggatgtaaacagtgcc

SEQ ID NO: 3728033 - DNA, 16 bp, Homo sapiens
gaaaggcattctctga

SEQ ID NO: 3728034 - DNA, 16 bp, Homo sapiens
gaaaggccagctggca

SEQ ID NO: 3728035 - DNA, 19 bp, Homo sapiens
gaaaggccagctggcagca

SEQ ID NO: 3728036 - DNA, 21 bp, Homo sapiens
gaaaggccagctggcagcaga

SEQ ID NO: 3728037 - DNA, 18 bp, Homo sapiens
gaaaggctcagtctcagg

SEQ ID NO: 3728038 - DNA, 22 bp, Homo sapiens
gaaaggctcagtctcaggagca

SEQ ID NO: 3728039 - DNA, 15 bp, Homo sapiens
gaaaggctctgaaag

SEQ ID NO: 3728040 - DNA, 17 bp, Homo sapiens
gaaaggctctgaaagcc

SEQ ID NO: 3728041 - DNA, 12 bp, Homo sapiens
gaaagggatttt

SEQ ID NO: 3728042 - DNA, 13 bp, Homo sapiens
gaaagggcccaga

SEQ ID NO: 3728043 - DNA, 19 bp, Homo sapiens
gaaagggtgctgcttccct

SEQ ID NO: 3728044 - DNA, 22 bp, Homo sapiens
gaaagtacttctccaccctgct

SEQ ID NO: 3728045 - DNA, 20 bp, Homo sapiens
gaaagtcagatgcccagagg

SEQ ID NO: 3728046 - DNA, 21 bp, Homo sapiens
gaaagtggccatgccaccctg

SEQ ID NO: 3728047 - DNA, 22 bp, Homo sapiens
gaaagttcccccatcagttccc

SEQ ID NO: 3728048 - DNA, 11 bp, Homo sapiens
gaaagtttccc

SEQ ID NO: 3728049 - DNA, 20 bp, Homo sapiens
gaaataaaaaagtctctatt

SEQ ID NO: 3728050 - DNA, 18 bp, Homo sapiens
gaaataaagttggtgaca

SEQ ID NO: 3728051 - DNA, 21 bp, Homo sapiens
gaaataaatagctatatccat

SEQ ID NO: 3728052 - DNA, 23 bp, Homo sapiens
gaaataaatagctatatccatgt

SEQ ID NO: 3728053 - DNA, 20 bp, Homo sapiens
gaaataaatgtacctgatgt

SEQ ID NO: 3728054 - DNA, 15 bp, Homo sapiens
gaaataatatgcatt

SEQ ID NO: 3728055 - DNA, 19 bp, Homo sapiens
gaaatacaagatacttttt

SEQ ID NO: 3728056 - DNA, 13 bp, Homo sapiens
gaaatataattga

SEQ ID NO: 3728057 - DNA, 17 bp, Homo sapiens
gaaatatacacacagca

SEQ ID NO: 3728058 - DNA, 17 bp, Homo sapiens
gaaatatatatgtgtgt

SEQ ID NO: 3728059 - DNA, 21 bp, Homo sapiens
gaaatatcagttactcagccc

SEQ ID NO: 3728060 - DNA, 23 bp, Homo sapiens
gaaatatcagttactcagccctg

SEQ ID NO: 3728061 - DNA, 14 bp, Homo sapiens
gaaatatcatttat

SEQ ID NO: 3728062 - DNA, 18 bp, Homo sapiens
gaaatatctgaaaatgta

SEQ ID NO: 3728063 - DNA, 20 bp, Homo sapiens
gaaatatctgaaaatgtatg

SEQ ID NO: 3728064 - DNA, 21 bp, Homo sapiens
gaaatatctgaaaatgtatgt

SEQ ID NO: 3728065 - DNA, 14 bp, Homo sapiens
gaaatcatgttatg

SEQ ID NO: 3728066 - DNA, 18 bp, Homo sapiens
gaaatccccctttctcta

SEQ ID NO: 3728067 - DNA, 12 bp, Homo sapiens
gaaatctcaccc

SEQ ID NO: 3728068 - DNA, 17 bp, Homo sapiens
gaaatctgtgcaataaa

SEQ ID NO: 3728069 - DNA, 18 bp, Homo sapiens
gaaatctgtgcaataaaa

SEQ ID NO: 3728070 - DNA, 16 bp, Homo sapiens
gaaatgaaaacatgta

SEQ ID NO: 3728071 - DNA, 13 bp, Homo sapiens
gaaatgaaatttt

SEQ ID NO: 3728072 - DNA, 16 bp, Homo sapiens
gaaatgaaattttacc

SEQ ID NO: 3728073 - DNA, 17 bp, Homo sapiens
gaaatgaaattttacca

SEQ ID NO: 3728074 - DNA, 14 bp, Homo sapiens
gaaatgaataattt

SEQ ID NO: 3728075 - DNA, 12 bp, Homo sapiens
gaaatgaatata

SEQ ID NO: 3728076 - DNA, 14 bp, Homo sapiens
gaaatgaatttctc

SEQ ID NO: 3728077 - DNA, 19 bp, Homo sapiens
gaaatgactaaaaaacaaa

SEQ ID NO: 3728078 - DNA, 12 bp, Homo sapiens
gaaatgcacaat

SEQ ID NO: 3728079 - DNA, 13 bp, Homo sapiens
gaaatgcacaatg

SEQ ID NO: 3728080 - DNA, 16 bp, Homo sapiens
gaaatgcacaatgtct

SEQ ID NO: 3728081 - DNA, 17 bp, Homo sapiens
gaaatgcacaatgtctt

SEQ ID NO: 3728082 - DNA, 23 bp, Homo sapiens
gaaatgcatccattcctcaggga

SEQ ID NO: 3728083 - DNA, 17 bp, Homo sapiens
gaaatgcctaagaagat

SEQ ID NO: 3728084 - DNA, 20 bp, Homo sapiens
gaaatgccttactttgtatg

SEQ ID NO: 3728085 - DNA, 21 bp, Homo sapiens
gaaatgccttactttgtatga

SEQ ID NO: 3728086 - DNA, 18 bp, Homo sapiens
gaaatggcttgaagccaa

SEQ ID NO: 3728087 - DNA, 13 bp, Homo sapiens
gaaattagccggg

SEQ ID NO: 3728088 - DNA, 16 bp, Homo sapiens
gaaattagctgtgtga

SEQ ID NO: 3728089 - DNA, 19 bp, Homo sapiens
gaaattgcatttcctgaca

SEQ ID NO: 3728090 - DNA, 20 bp, Homo sapiens
gaaattgtctagcagagcag

SEQ ID NO: 3728091 - DNA, 21 bp, Homo sapiens
gaaattgtctagcagagcagg

SEQ ID NO: 3728092 - DNA, 20 bp, Homo sapiens
gaaatttaattcatgtttct

SEQ ID NO: 3728093 - DNA, 21 bp, Homo sapiens
gaaatttcagattcccagagc

SEQ ID NO: 3728094 - DNA, 17 bp, Homo sapiens
gaaatttgttataatga

SEQ ID NO: 3728095 - DNA, 21 bp, Homo sapiens
gaaattttaccaagttatata

SEQ ID NO: 3728096 - DNA, 17 bp, Homo sapiens
gaaatttttcagatgct

SEQ ID NO: 3728097 - DNA, 22 bp, Homo sapiens
gaaatttttcagatgcttctgg

SEQ ID NO: 3728098 - DNA, 22 bp, Homo sapiens
gaacacaaagcggggggagggt

SEQ ID NO: 3728099 - DNA, 17 bp, Homo sapiens
gaacacaggcaaaatcc

SEQ ID NO: 3728100 - DNA, 15 bp, Homo sapiens
gaacacagtattttc

SEQ ID NO: 3728101 - DNA, 22 bp, Homo sapiens
gaacaccacgcttgacaggaca

SEQ ID NO: 3728102 - DNA, 14 bp, Homo sapiens
gaacaccctcgaag

SEQ ID NO: 3728103 - DNA, 17 bp, Homo sapiens
gaacactattttcagaa

SEQ ID NO: 3728104 - DNA, 18 bp, Homo sapiens
gaacactattttcagaat

SEQ ID NO: 3728105 - DNA, 19 bp, Homo sapiens
gaacactattttcagaatc

SEQ ID NO: 3728106 - DNA, 20 bp, Homo sapiens
gaacactgggggaggggaca

SEQ ID NO: 3728107 - DNA, 17 bp, Homo sapiens
gaacagaaaacaacaaa

SEQ ID NO: 3728108 - DNA, 20 bp, Homo sapiens
gaacagaaaacaacaaaaaa

SEQ ID NO: 3728109 - DNA, 19 bp, Homo sapiens
gaacagaaggatgaatgag

SEQ ID NO: 3728110 - DNA, 18 bp, Homo sapiens
gaacagacaggagaaatg

SEQ ID NO: 3728111 - DNA, 20 bp, Homo sapiens
gaacagactggaagcacagc

SEQ ID NO: 3728112 - DNA, 22 bp, Homo sapiens
gaacagactggaagcacagctt

SEQ ID NO: 3728113 - DNA, 15 bp, Homo sapiens
gagcagcctgtggca

SEQ ID NO: 3728114 - DNA, 18 bp, Homo sapiens
gagcagcggtttggggag

SEQ ID NO: 3728115 - DNA, 15 bp, Homo sapiens
gagcaggcacatgga

SEQ ID NO: 3728116 - DNA, 18 bp, Homo sapiens
gagcagggacagatcata

SEQ ID NO: 3728117 - DNA, 14 bp, Homo sapiens
gagcagggctcagc

SEQ ID NO: 3728118 - DNA, 20 bp, Homo sapiens
gagcagtcctgcctcagcct

SEQ ID NO: 3728119 - DNA, 12 bp, Homo sapiens
gagcagtgtctt

SEQ ID NO: 3728120 - DNA, 17 bp, Homo sapiens
gagcagtgtcttccata

SEQ ID NO: 3728121 - DNA, 19 bp, Homo sapiens
gagcagtgtgtctcctgca

SEQ ID NO: 3728122 - DNA, 19 bp, Homo sapiens
gagcatctcttgaggccag

SEQ ID NO: 3728123 - DNA, 22 bp, Homo sapiens
gagcatggggataaaggagaag

SEQ ID NO: 3728124 - DNA, 22 bp, Homo sapiens
gagcatgtactgagccttgtaa

SEQ ID NO: 3728125 - DNA, 17 bp, Homo sapiens
gagcatttagggcaagg

SEQ ID NO: 3728126 - DNA, 14 bp, Homo sapiens
gagccaaagagaat

SEQ ID NO: 3728127 - DNA, 19 bp, Homo sapiens
gagccaagggttcagagac

SEQ ID NO: 3728128 - DNA, 22 bp, Homo sapiens
gagccaatggagtagacccctg

SEQ ID NO: 3728129 - DNA, 14 bp, Homo sapiens
gagccaccgctgcc

SEQ ID NO: 3728130 - DNA, 21 bp, Homo sapiens
gagccagcagcctggctctcc

SEQ ID NO: 3728131 - DNA, 19 bp, Homo sapiens
gagccagccctccctgtcc

SEQ ID NO: 3728132 - DNA, 12 bp, Homo sapiens
gagccaggcctg

SEQ ID NO: 3728133 - DNA, 21 bp, Homo sapiens
gagccaggcctgggtctgtgt

SEQ ID NO: 3728134 - DNA, 14 bp, Homo sapiens
gagccagggtctca

SEQ ID NO: 3728135 - DNA, 19 bp, Homo sapiens
gagccagtctagttcctga

SEQ ID NO: 3728136 - DNA, 22 bp, Homo sapiens
gagccatggaccacgcaggaag

SEQ ID NO: 3728137 - DNA, 11 bp, Homo sapiens
gagcccaggag

SEQ ID NO: 3728138 - DNA, 23 bp, Homo sapiens
gagcccaggagttcgaggctgca

SEQ ID NO: 3728139 - DNA, 21 bp, Homo sapiens
gagcccaggagtttgaatcca

SEQ ID NO: 3728140 - DNA, 14 bp, Homo sapiens
gagccccacacgga

SEQ ID NO: 3728141 - DNA, 16 bp, Homo sapiens
gagccccacacggagg

SEQ ID NO: 3728142 - DNA, 24 bp, Homo sapiens
gagccccagggtcttccctacctc

SEQ ID NO: 3728143 - DNA, 14 bp, Homo sapiens
gagccccagtgcca

SEQ ID NO: 3728144 - DNA, 17 bp, Homo sapiens
gagcccccgccccgccc

SEQ ID NO: 3728145 - DNA, 22 bp, Homo sapiens
gagcccccgccccgccccacat

SEQ ID NO: 3728146 - DNA, 16 bp, Homo sapiens
gagcccgaggcaccag

SEQ ID NO: 3728147 - DNA, 17 bp, Homo sapiens
gagcccgcacccccacc

SEQ ID NO: 3728148 - DNA, 20 bp, Homo sapiens
gagcccgcacccccaccctt

SEQ ID NO: 3728149 - DNA, 16 bp, Homo sapiens
gagccctacttccagg

SEQ ID NO: 3728150 - DNA, 13 bp, Homo sapiens
gagccctggcagg

SEQ ID NO: 3728151 - DNA, 14 bp, Homo sapiens
gagccctggtggca

SEQ ID NO: 3728152 - DNA, 19 bp, Homo sapiens
gagccgagatcacgccact

SEQ ID NO: 3728153 - DNA, 20 bp, Homo sapiens
gagccgagatcgcgccactg

SEQ ID NO: 3728154 - DNA, 17 bp, Homo sapiens
gagcctcagcatcctgg

SEQ ID NO: 3728155 - DNA, 17 bp, Homo sapiens
gagcctcatccgaggca

SEQ ID NO: 3728156 - DNA, 18 bp, Homo sapiens
gagcctgctcccccaccc

SEQ ID NO: 3728157 - DNA, 23 bp, Homo sapiens
gagcctggctccgtccaggagcc

SEQ ID NO: 3728158 - DNA, 13 bp, Homo sapiens
gagcctgggaggt

SEQ ID NO: 3728159 - DNA, 16 bp, Homo sapiens
gagcctggtgctgctg

SEQ ID NO: 3728160 - DNA, 17 bp, Homo sapiens
gagcctggtgctgctgc

SEQ ID NO: 3728161 - DNA, 19 bp, Homo sapiens
gagcctgtgcctcctcacc

SEQ ID NO: 3728162 - DNA, 19 bp, Homo sapiens
gagccttggtgtccacctg

SEQ ID NO: 3728163 - DNA, 21 bp, Homo sapiens
gagcgagacttggtttcaaaa

SEQ ID NO: 3728164 - DNA, 13 bp, Homo sapiens
gagcggaaagcag

SEQ ID NO: 3728165 - DNA, 17 bp, Homo sapiens
gagcggaaagcagctca

SEQ ID NO: 3728166 - DNA, 15 bp, Homo sapiens
gagctaacactggcc

SEQ ID NO: 3728167 - DNA, 14 bp, Homo sapiens
gagctagcgctgcc

SEQ ID NO: 3728168 - DNA, 14 bp, Homo sapiens
gagctatacagttt

SEQ ID NO: 3728169 - DNA, 13 bp, Homo sapiens
gagctccagaccc

SEQ ID NO: 3728170 - DNA, 17 bp, Homo sapiens
gagctccagacccccag

SEQ ID NO: 3728171 - DNA, 22 bp, Homo sapiens
gagctcctctgggcaggacctc

SEQ ID NO: 3728172 - DNA, 20 bp, Homo sapiens
gagctctggagccacctgtc

SEQ ID NO: 3728173 - DNA, 16 bp, Homo sapiens
gagctgacaaaatttt

SEQ ID NO: 3728174 - DNA, 13 bp, Homo sapiens
gagctgagatcgt

SEQ ID NO: 3728175 - DNA, 13 bp, Homo sapiens
gagctgagcaggg

SEQ ID NO: 3728176 - DNA, 15 bp, Homo sapiens
gagctgagtggggga

SEQ ID NO: 3728177 - DNA, 15 bp, Homo sapiens
gagctgcctgttcag

SEQ ID NO: 3728178 - DNA, 14 bp, Homo sapiens
gagctgggaggaaa

SEQ ID NO: 3728179 - DNA, 19 bp, Homo sapiens
gagctgggcagaaggccaa

SEQ ID NO: 3728180 - DNA, 21 bp, Homo sapiens
gagctggtagttagtagcatg

SEQ ID NO: 3728181 - DNA, 14 bp, Homo sapiens
gagctggtgcatta

SEQ ID NO: 3728182 - DNA, 21 bp, Homo sapiens
gagctggtgcccggagattgg

SEQ ID NO: 3728183 - DNA, 22 bp, Homo sapiens
gagctgtttatggcctcagctg

SEQ ID NO: 3728184 - DNA, 10 bp, Homo sapiens
gagcttctct

SEQ ID NO: 3728185 - DNA, 16 bp, Homo sapiens
gagcttctctgtgaac

SEQ ID NO: 3728186 - DNA, 23 bp, Homo sapiens
gagcttctctttaactcaggact

SEQ ID NO: 3728187 - DNA, 13 bp, Homo sapiens
gagcttgggaatg

SEQ ID NO: 3728188 - DNA, 19 bp, Homo sapiens
gagctttacaaaaagacac

SEQ ID NO: 3728189 - DNA, 21 bp, Homo sapiens
gaggaaaaccaagccgtggct

SEQ ID NO: 3728190 - DNA, 17 bp, Homo sapiens
gaggaaactcacctgct

SEQ ID NO: 3728191 - DNA, 22 bp, Homo sapiens
gaggaaactcacctgctggccc

SEQ ID NO: 3728192 - DNA, 13 bp, Homo sapiens
gaggaaaggccag

SEQ ID NO: 3728193 - DNA, 23 bp, Homo sapiens
gaggaaaggccagctggcagcag

SEQ ID NO: 3728194 - DNA, 14 bp, Homo sapiens
gaggaaccagagcc

SEQ ID NO: 3728195 - DNA, 18 bp, Homo sapiens
gaggaaccagagccatgg

SEQ ID NO: 3728196 - DNA, 13 bp, Homo sapiens
gaggaagagcagg

SEQ ID NO: 3728197 - DNA, 17 bp, Homo sapiens
gaggaagagcaggcaca

SEQ ID NO: 3728198 - DNA, 19 bp, Homo sapiens
gaggaagagcaggcacatg

SEQ ID NO: 3728199 - DNA, 19 bp, Homo sapiens
gaggaagccctaagacgtc

SEQ ID NO: 3728200 - DNA, 20 bp, Homo sapiens
gaggaagcgtgaaggccgag

SEQ ID NO: 3728201 - DNA, 19 bp, Homo sapiens
gaggaagctccagtcctgc

SEQ ID NO: 3728202 - DNA, 16 bp, Homo sapiens
gaggaaggagagaagg

SEQ ID NO: 3728203 - DNA, 14 bp, Homo sapiens
gaggaatccagacc

SEQ ID NO: 3728204 - DNA, 13 bp, Homo sapiens
gaggaatgctccc

SEQ ID NO: 3728205 - DNA, 21 bp, Homo sapiens
gaggaatgctcccccatcctc

SEQ ID NO: 3728206 - DNA, 22 bp, Homo sapiens
gaggaccactcctgtacactga

SEQ ID NO: 3728207 - DNA, 13 bp, Homo sapiens
gaggacctctggg

SEQ ID NO: 3728208 - DNA, 14 bp, Homo sapiens
gaggacctctgggc

SEQ ID NO: 3728209 - DNA, 18 bp, Homo sapiens
gaggacgtgggcggcaga

SEQ ID NO: 3728210 - DNA, 23 bp, Homo sapiens
gaggactgccccgtgcagactgg

SEQ ID NO: 3728211 - DNA, 18 bp, Homo sapiens
gaggacttgtgtctctgt

SEQ ID NO: 3728212 - DNA, 22 bp, Homo sapiens
gaggagaagaattttcagaccc

SEQ ID NO: 3728213 - DNA, 22 bp, Homo sapiens
gaggagactagatttatgaata

SEQ ID NO: 3728214 - DNA, 11 bp, Homo sapiens
gaggagctgct

SEQ ID NO: 3728215 - DNA, 19 bp, Homo sapiens
gaggaggaaggagagaagg

SEQ ID NO: 3728216 - DNA, 19 bp, Homo sapiens
gaggagggatgctgcctga

SEQ ID NO: 3728217 - DNA, 18 bp, Homo sapiens
gaggaggtggcagccctg

SEQ ID NO: 3728218 - DNA, 12 bp, Homo sapiens
gaggagtttcct

SEQ ID NO: 3728219 - DNA, 19 bp, Homo sapiens
gaggatcactggagcccag

SEQ ID NO: 3728220 - DNA, 20 bp, Homo sapiens
gaggatcactggagcccagg

SEQ ID NO: 3728221 - DNA, 14 bp, Homo sapiens
gaggatcagaaagt

SEQ ID NO: 3728222 - DNA, 18 bp, Homo sapiens
gatccacctgtctcagcc

SEQ ID NO: 3728223 - DNA, 16 bp, Homo sapiens
gatccatgtagcagga

SEQ ID NO: 3728224 - DNA, 19 bp, Homo sapiens
gatccatgtagcaggactg

SEQ ID NO: 3728225 - DNA, 16 bp, Homo sapiens
gatcctcccacctcag

SEQ ID NO: 3728226 - DNA, 19 bp, Homo sapiens
gatcctcccacctcagcct

SEQ ID NO: 3728227 - DNA, 18 bp, Homo sapiens
gatctaccagcataaata

SEQ ID NO: 3728228 - DNA, 15 bp, Homo sapiens
gatctaggtgaggat

SEQ ID NO: 3728229 - DNA, 14 bp, Homo sapiens
gatctcagggaagc

SEQ ID NO: 3728230 - DNA, 20 bp, Homo sapiens
gatctcagggaagcccagct

SEQ ID NO: 3728231 - DNA, 15 bp, Homo sapiens
gcatgcagcagcttg

SEQ ID NO: 3728232 - DNA, 14 bp, Homo sapiens
gcatgcctggacaa

SEQ ID NO: 3728233 - DNA, 14 bp, Homo sapiens
gcatgcgcacaagg

SEQ ID NO: 3728234 - DNA, 17 bp, Homo sapiens
gcatgctctctgcagcc

SEQ ID NO: 3728235 - DNA, 21 bp, Homo sapiens
gcatgctctctgcagccagcc

SEQ ID NO: 3728236 - DNA, 23 bp, Homo sapiens
gcatgctctctgcagccagccca

SEQ ID NO: 3728237 - DNA, 13 bp, Homo sapiens
gcatgctgcttta

SEQ ID NO: 3728238 - DNA, 14 bp, Homo sapiens
gcatgctgctttaa

SEQ ID NO: 3728239 - DNA, 17 bp, Homo sapiens
gcatggacctaacattc

SEQ ID NO: 3728240 - DNA, 18 bp, Homo sapiens
gcatggacctaacattcg

SEQ ID NO: 3728241 - DNA, 19 bp, Homo sapiens
gcatggagtgtgtattgtt

SEQ ID NO: 3728242 - DNA, 22 bp, Homo sapiens
gcatggagtgtgtattgttccc

SEQ ID NO: 3728243 - DNA, 14 bp, Homo sapiens
gcatggcacctgtc

SEQ ID NO: 3728244 - DNA, 20 bp, Homo sapiens
gcatggcagcaggcctgttg

SEQ ID NO: 3728245 - DNA, 21 bp, Homo sapiens
gcatggctccagtctgctgcc

SEQ ID NO: 3728246 - DNA, 18 bp, Homo sapiens
gcatgggggcctcagggc

SEQ ID NO: 3728247 - DNA, 21 bp, Homo sapiens
gcatgggtgaagggagagcca

SEQ ID NO: 3728248 - DNA, 16 bp, Homo sapiens
gcatgggttttgtagg

SEQ ID NO: 3728249 - DNA, 22 bp, Homo sapiens
gcatggtatttgagacattcca

SEQ ID NO: 3728250 - DNA, 14 bp, Homo sapiens
gcatggtgcatgcc

SEQ ID NO: 3728251 - DNA, 13 bp, Homo sapiens
gcatggtggcatg

SEQ ID NO: 3728252 - DNA, 19 bp, Homo sapiens
gcatggtggcgcaagcctg

SEQ ID NO: 3728253 - DNA, 16 bp, Homo sapiens
gcatgtctttttttct

SEQ ID NO: 3728254 - DNA, 12 bp, Homo sapiens
gcatgtgtattt

SEQ ID NO: 3728255 - DNA, 20 bp, Homo sapiens
gcatgtgtatttccagtgca

SEQ ID NO: 3728256 - DNA, 13 bp, Homo sapiens
gcatgttacataa

SEQ ID NO: 3728257 - DNA, 21 bp, Homo sapiens
gcatgttctctgaggacacta

SEQ ID NO: 3728258 - DNA, 19 bp, Homo sapiens
gcattaaatataatatgca

SEQ ID NO: 3728259 - DNA, 14 bp, Homo sapiens
gcattaactaatct

SEQ ID NO: 3728260 - DNA, 22 bp, Homo sapiens
gcattaactaatctattgggtt

SEQ ID NO: 3728261 - DNA, 15 bp, Homo sapiens
gcattactcttgtaa

SEQ ID NO: 3728262 - DNA, 15 bp, Homo sapiens
gcattcacccagaca

SEQ ID NO: 3728263 - DNA, 22 bp, Homo sapiens
gcattccctgagtcaccaggaa

SEQ ID NO: 3728264 - DNA, 14 bp, Homo sapiens
gcattctctgaaga

SEQ ID NO: 3728265 - DNA, 20 bp, Homo sapiens
gcattctgccgtgtgccctc

SEQ ID NO: 3728266 - DNA, 12 bp, Homo sapiens
gcattgagaact

SEQ ID NO: 3728267 - DNA, 16 bp, Homo sapiens
gcattgtggctgtcag

SEQ ID NO: 3728268 - DNA, 19 bp, Homo sapiens
gcattgtggctgtcagcag

SEQ ID NO: 3728269 - DNA, 16 bp, Homo sapiens
gcattgttgaggtggt

SEQ ID NO: 3728270 - DNA, 18 bp, Homo sapiens
gcattgtttgcttattgt

SEQ ID NO: 3728271 - DNA, 22 bp, Homo sapiens
gcattgtttgcttattgttcca

SEQ ID NO: 3728272 - DNA, 16 bp, Homo sapiens
gcatttagcacaaaaa

SEQ ID NO: 3728273 - DNA, 23 bp, Homo sapiens
gcatttgctgaatacagaggcaa

SEQ ID NO: 3728274 - DNA, 18 bp, Homo sapiens
gcatttgtcaatgacagt

SEQ ID NO: 3728275 - DNA, 18 bp, Homo sapiens
gcattttcaccccaccct

SEQ ID NO: 3728276 - DNA, 22 bp, Homo sapiens
gcattttctgggttctgggtgg

SEQ ID NO: 3728277 - DNA, 16 bp, Homo sapiens
gcattttttaaaacaa

SEQ ID NO: 3728278 - DNA, 21 bp, Homo sapiens
gccaaaataatgtcttgttaa

SEQ ID NO: 3728279 - DNA, 23 bp, Homo sapiens
gccaaaataatgtcttgttaata

SEQ ID NO: 3728280 - DNA, 17 bp, Homo sapiens
gccaaagaatgccttga

SEQ ID NO: 3728281 - DNA, 16 bp, Homo sapiens
gccaaagcctcctcca

SEQ ID NO: 3728282 - DNA, 17 bp, Homo sapiens
gccaaatatattctctt

SEQ ID NO: 3728283 - DNA, 18 bp, Homo sapiens
gccaaatgtaattgaata

SEQ ID NO: 3728284 - DNA, 14 bp, Homo sapiens
gccaaattttggcc

SEQ ID NO: 3728285 - DNA, 14 bp, Homo sapiens
gccaacaccaggga

SEQ ID NO: 3728286 - DNA, 20 bp, Homo sapiens
gccaacagtcaaaacagaga

SEQ ID NO: 3728287 - DNA, 23 bp, Homo sapiens
gccaaccccgccctaggcctggc

SEQ ID NO: 3728288 - DNA, 15 bp, Homo sapiens
gccaacccctgtgga

SEQ ID NO: 3728289 - DNA, 14 bp, Homo sapiens
gccaacgacaaagc

SEQ ID NO: 3728290 - DNA, 18 bp, Homo sapiens
gccaagaactgaaaacat

SEQ ID NO: 3728291 - DNA, 16 bp, Homo sapiens
gccaagctccttggga

SEQ ID NO: 3728292 - DNA, 20 bp, Homo sapiens
gccaaggccagagtggcctg

SEQ ID NO: 3728293 - DNA, 16 bp, Homo sapiens
gccaaggtgggctgag

SEQ ID NO: 3728294 - DNA, 16 bp, Homo sapiens
gccaagtaagaaagtg

SEQ ID NO: 3728295 - DNA, 18 bp, Homo sapiens
gccaatgccccactggca

SEQ ID NO: 3728296 - DNA, 16 bp, Homo sapiens
gccaatggagactgtc

SEQ ID NO: 3728297 - DNA, 21 bp, Homo sapiens
gccaatggagactgtctcaag

SEQ ID NO: 3728298 - DNA, 13 bp, Homo sapiens
gccacagagaaag

SEQ ID NO: 3728299 - DNA, 23 bp, Homo sapiens
gccacagagaaagtacttctcca

SEQ ID NO: 3728300 - DNA, 23 bp, Homo sapiens
gccacagcccaggcctccagctc

SEQ ID NO: 3728301 - DNA, 18 bp, Homo sapiens
gccacatccccgctggct

SEQ ID NO: 3728302 - DNA, 14 bp, Homo sapiens
gccaccacgtccag

SEQ ID NO: 3728303 - DNA, 23 bp, Homo sapiens
gccaccatattcagtgctgtggc

SEQ ID NO: 3728304 - DNA, 18 bp, Homo sapiens
gccaccccgggctctctg

SEQ ID NO: 3728305 - DNA, 19 bp, Homo sapiens
gccaccccgggctctctgc

SEQ ID NO: 3728306 - DNA, 16 bp, Homo sapiens
gccacccctccttcct

SEQ ID NO: 3728307 - DNA, 15 bp, Homo sapiens
gccaccctcccagct

SEQ ID NO: 3728308 - DNA, 13 bp, Homo sapiens
gccaccctgggga

SEQ ID NO: 3728309 - DNA, 16 bp, Homo sapiens
gccaccgctgccagca

SEQ ID NO: 3728310 - DNA, 13 bp, Homo sapiens
gccacctccccta

SEQ ID NO: 3728311 - DNA, 22 bp, Homo sapiens
gccacctcccctatccacccag

SEQ ID NO: 3728312 - DNA, 20 bp, Homo sapiens
gccacctgcccccttctccc

SEQ ID NO: 3728313 - DNA, 12 bp, Homo sapiens
gccacctggggc

SEQ ID NO: 3728314 - DNA, 16 bp, Homo sapiens
gccacctggggcagtc

SEQ ID NO: 3728315 - DNA, 13 bp, Homo sapiens
gccacctgtccca

SEQ ID NO: 3728316 - DNA, 21 bp, Homo sapiens
gccacgcggtacaaaggaaaa

SEQ ID NO: 3728317 - DNA, 14 bp, Homo sapiens
gccacggccaggcc

SEQ ID NO: 3728318 - DNA, 15 bp, Homo sapiens
gccacggccaggcca

SEQ ID NO: 3728319 - DNA, 16 bp, Homo sapiens
gccacggccaggccag

SEQ ID NO: 3728320 - DNA, 18 bp, Homo sapiens
gccacggccaggccagag

SEQ ID NO: 3728321 - DNA, 14 bp, Homo sapiens
gccacgtgccaggc

SEQ ID NO: 3728322 - DNA, 16 bp, Homo sapiens
gccacgtgccaggccc

SEQ ID NO: 3728323 - DNA, 21 bp, Homo sapiens
gccacgtgggcaaacaggcag

SEQ ID NO: 3728324 - DNA, 17 bp, Homo sapiens
gccactacactccagcc

SEQ ID NO: 3728325 - DNA, 21 bp, Homo sapiens
gccactacactccagcctgag

SEQ ID NO: 3728326 - DNA, 23 bp, Homo sapiens
gccactacactccagcctgagca

SEQ ID NO: 3728327 - DNA, 15 bp, Homo sapiens
gccactaggctgggt

SEQ ID NO: 3728328 - DNA, 16 bp, Homo sapiens
gccactaggctgggtg

SEQ ID NO: 3728329 - DNA, 17 bp, Homo sapiens
gccactaggctgggtgc

SEQ ID NO: 3728330 - DNA, 20 bp, Homo sapiens
gccactaggctgggtgccca

SEQ ID NO: 3728331 - DNA, 21 bp, Homo sapiens
gccactaggctgggtgcccac

SEQ ID NO: 3728332 - DNA, 22 bp, Homo sapiens
gccactaggctgggtgcccaca

SEQ ID NO: 3728333 - DNA, 20 bp, Homo sapiens
gccactcaggaggctgaggc

SEQ ID NO: 3728334 - DNA, 21 bp, Homo sapiens
gccactcaggaggctgaggca

SEQ ID NO: 3728335 - DNA, 14 bp, Homo sapiens
gccactcgcttccc

SEQ ID NO: 3728336 - DNA, 12 bp, Homo sapiens
gccactctgcct

SEQ ID NO: 3728337 - DNA, 13 bp, Homo sapiens
gccactctgcctc

SEQ ID NO: 3728338 - DNA, 15 bp, Homo sapiens
gccactctgcctctg

SEQ ID NO: 3728339 - DNA, 19 bp, Homo sapiens
gccactctgcctctgcctg

SEQ ID NO: 3728340 - DNA, 21 bp, Homo sapiens
gccactctgcctctgcctgca

SEQ ID NO: 3728341 - DNA, 13 bp, Homo sapiens
gccactctgttcc

SEQ ID NO: 3728342 - DNA, 17 bp, Homo sapiens
gccactgaagctgggat

SEQ ID NO: 3728343 - DNA, 17 bp, Homo sapiens
gccactgcaccgggcca

SEQ ID NO: 3728344 - DNA, 17 bp, Homo sapiens
gcccaccaacatcccat

SEQ ID NO: 3728345 - DNA, 14 bp, Homo sapiens
gcccacccccctca

SEQ ID NO: 3728346 - DNA, 15 bp, Homo sapiens
gcccacccccctcat

SEQ ID NO: 3728347 - DNA, 19 bp, Homo sapiens
gcccacccgtggagatggg

SEQ ID NO: 3728348 - DNA, 15 bp, Homo sapiens
gcccacctaccttca

SEQ ID NO: 3728349 - DNA, 21 bp, Homo sapiens
gcccacctaccttcaaagctg

SEQ ID NO: 3728350 - DNA, 14 bp, Homo sapiens
gcccacctgcccat

SEQ ID NO: 3728351 - DNA, 15 bp, Homo sapiens
gcccaccttggctca

SEQ ID NO: 3728352 - DNA, 15 bp, Homo sapiens
gcccacgctggagtg

SEQ ID NO: 3728353 - DNA, 21 bp, Homo sapiens
gcccacgttctctctgcctgt

SEQ ID NO: 3728354 - DNA, 18 bp, Homo sapiens
gcccactatggtcatctt

SEQ ID NO: 3728355 - DNA, 13 bp, Homo sapiens
gcccactggatca

SEQ ID NO: 3728356 - DNA, 23 bp, Homo sapiens
gcccacttgtatcctctggttct

SEQ ID NO: 3728357 - DNA, 19 bp, Homo sapiens
gcccagacccctctggcca

SEQ ID NO: 3728358 - DNA, 13 bp, Homo sapiens
gcccagagaagcc

SEQ ID NO: 3728359 - DNA, 21 bp, Homo sapiens
gcccagagagggtggtgacct

SEQ ID NO: 3728360 - DNA, 21 bp, Homo sapiens
gcccagagatgggactgggag

SEQ ID NO: 3728361 - DNA, 15 bp, Homo sapiens
gcccagagctgggtg

SEQ ID NO: 3728362 - DNA, 19 bp, Homo sapiens
gcccagaggcacagccggg

SEQ ID NO: 3728363 - DNA, 20 bp, Homo sapiens
gcccagccaaaccctgtctg

SEQ ID NO: 3728364 - DNA, 21 bp, Homo sapiens
gcccagccaaaccctgtctga

SEQ ID NO: 3728365 - DNA, 15 bp, Homo sapiens
gcccagccctgttct

SEQ ID NO: 3728366 - DNA, 16 bp, Homo sapiens
gcccagccctgttctg

SEQ ID NO: 3728367 - DNA, 14 bp, Homo sapiens
gcccagctcagtct

SEQ ID NO: 3728368 - DNA, 11 bp, Homo sapiens
gattcatgtgg

SEQ ID NO: 3728369 - DNA, 14 bp, Homo sapiens
gattccatctcctt

SEQ ID NO: 3728370 - DNA, 15 bp, Homo sapiens
gattccatctccttg

SEQ ID NO: 3728371 - DNA, 15 bp, Homo sapiens
gattcccaagctctg

SEQ ID NO: 3728372 - DNA, 16 bp, Homo sapiens
gattcccaagctctgc

SEQ ID NO: 3728373 - DNA, 19 bp, Homo sapiens
gattcccaagctctgctcc

SEQ ID NO: 3728374 - DNA, 20 bp, Homo sapiens
gattcccaagctctgctcct

SEQ ID NO: 3728375 - DNA, 22 bp, Homo sapiens
gattcccaagctctgctcctct

SEQ ID NO: 3728376 - DNA, 13 bp, Homo sapiens
gattcccagagca

SEQ ID NO: 3728377 - DNA, 10 bp, Homo sapiens
gattcctttt

SEQ ID NO: 3728378 - DNA, 22 bp, Homo sapiens
gattctgtgtgttttcataata

SEQ ID NO: 3728379 - DNA, 18 bp, Homo sapiens
gattcttcctccctccct

SEQ ID NO: 3728380 - DNA, 15 bp, Homo sapiens
gattcttctgcttca

SEQ ID NO: 3728381 - DNA, 19 bp, Homo sapiens
gattgatagagtgttatca

SEQ ID NO: 3728382 - DNA, 22 bp, Homo sapiens
gattgcgtggaattgtgctgag

SEQ ID NO: 3728383 - DNA, 23 bp, Homo sapiens
gattgctgtgtccaactccagta

SEQ ID NO: 3728384 - DNA, 17 bp, Homo sapiens
gattgcttaaaatagca

SEQ ID NO: 3728385 - DNA, 14 bp, Homo sapiens
gattgcttctgtag

SEQ ID NO: 3728386 - DNA, 16 bp, Homo sapiens
gattgcttctgtagta

SEQ ID NO: 3728387 - DNA, 18 bp, Homo sapiens
gattgcttgagctcagga

SEQ ID NO: 3728388 - DNA, 20 bp, Homo sapiens
gattggggaagactgtggct

SEQ ID NO: 3728389 - DNA, 21 bp, Homo sapiens
gattggttttaattgaaggaa

SEQ ID NO: 3728390 - DNA, 12 bp, Homo sapiens
gatttaaatcag

SEQ ID NO: 3728391 - DNA, 14 bp, Homo sapiens
gatttaatttgcca

SEQ ID NO: 3728392 - DNA, 20 bp, Homo sapiens
gatttaatttgccaaaataa

SEQ ID NO: 3728393 - DNA, 23 bp, Homo sapiens
gatttaatttgccaaaataatgt

SEQ ID NO: 3728394 - DNA, 19 bp, Homo sapiens
gatttatcacacaaagcag

SEQ ID NO: 3728395 - DNA, 22 bp, Homo sapiens
gatttcaggatactctgtcaga

SEQ ID NO: 3728396 - DNA, 20 bp, Homo sapiens
gatttcatgctatctctgtg

SEQ ID NO: 3728397 - DNA, 15 bp, Homo sapiens
gatttcccttcttct

SEQ ID NO: 3728398 - DNA, 11 bp, Homo sapiens
gatttctccca

SEQ ID NO: 3728399 - DNA, 12 bp, Homo sapiens
gatttctgattt

SEQ ID NO: 3728400 - DNA, 17 bp, Homo sapiens
gatttgcccatttacac

SEQ ID NO: 3728401 - DNA, 19 bp, Homo sapiens
gatttgcccatttacactt

SEQ ID NO: 3728402 - DNA, 18 bp, Homo sapiens
gatttgctatcaaaataa

SEQ ID NO: 3728403 - DNA, 21 bp, Homo sapiens
gatttgtactacagttctttt

SEQ ID NO: 3728404 - DNA, 14 bp, Homo sapiens
gatttgtactgaaa

SEQ ID NO: 3728405 - DNA, 14 bp, Homo sapiens
gatttgttttagaa

SEQ ID NO: 3728406 - DNA, 12 bp, Homo sapiens
gattttaacaat

SEQ ID NO: 3728407 - DNA, 16 bp, Homo sapiens
gattttacaaaagatg

SEQ ID NO: 3728408 - DNA, 17 bp, Homo sapiens
gattttacaaaagatgt

SEQ ID NO: 3728409 - DNA, 18 bp, Homo sapiens
gattttacatgtggccca

SEQ ID NO: 3728410 - DNA, 18 bp, Homo sapiens
gattttcaaagctttttc

SEQ ID NO: 3728411 - DNA, 13 bp, Homo sapiens
gattttcctgtgg

SEQ ID NO: 3728412 - DNA, 13 bp, Homo sapiens
gattttgaaaact

SEQ ID NO: 3728413 - DNA, 20 bp, Homo sapiens
gatttttatccaatcttgtt

SEQ ID NO: 3728414 - DNA, 15 bp, Homo sapiens
gcaaaaccattgctt

SEQ ID NO: 3728415 - DNA, 18 bp, Homo sapiens
gcaaaaccattgcttcac

SEQ ID NO: 3728416 - DNA, 20 bp, Homo sapiens
gcaaaacgcatggagtgtgt

SEQ ID NO: 3728417 - DNA, 15 bp, Homo sapiens
gcaaaagatgcttct

SEQ ID NO: 3728418 - DNA, 22 bp, Homo sapiens
gcaaaagatgcttctcactgcc

SEQ ID NO: 3728419 - DNA, 15 bp, Homo sapiens
gcaaaataattttaa

SEQ ID NO: 3728420 - DNA, 21 bp, Homo sapiens
gcaaacatggggttggctggg

SEQ ID NO: 3728421 - DNA, 13 bp, Homo sapiens
gcaaacctgcccc

SEQ ID NO: 3728422 - DNA, 14 bp, Homo sapiens
gcaaacctgcccca

SEQ ID NO: 3728423 - DNA, 18 bp, Homo sapiens
gcaaacctgccccatccc

SEQ ID NO: 3728424 - DNA, 22 bp, Homo sapiens
gcaaagactattcccttctaac

SEQ ID NO: 3728425 - DNA, 18 bp, Homo sapiens
gcaaagaggcaagaggct

SEQ ID NO: 3728426 - DNA, 23 bp, Homo sapiens
gcaaaggactgttttttcctgag

SEQ ID NO: 3728427 - DNA, 17 bp, Homo sapiens
gcaaaggagtagaaaga

SEQ ID NO: 3728428 - DNA, 20 bp, Homo sapiens
gcaaagggagcactgggttg

SEQ ID NO: 3728429 - DNA, 16 bp, Homo sapiens
gcaaagggccaggaag

SEQ ID NO: 3728430 - DNA, 23 bp, Homo sapiens
gcaaaggggtcccatagaggtga

SEQ ID NO: 3728431 - DNA, 12 bp, Homo sapiens
gcaaatcaatgc

SEQ ID NO: 3728432 - DNA, 13 bp, Homo sapiens
gcaaatcagaaac

SEQ ID NO: 3728433 - DNA, 22 bp, Homo sapiens
gcaaatcagaaacttgtgaagt

SEQ ID NO: 3728434 - DNA, 12 bp, Homo sapiens
gcaaatgttaca

SEQ ID NO: 3728435 - DNA, 12 bp, Homo sapiens
gcaaattctcaa

SEQ ID NO: 3728436 - DNA, 21 bp, Homo sapiens
gcaaatttataattttaagat

SEQ ID NO: 3728437 - DNA, 13 bp, Homo sapiens
gcaacacacagac

SEQ ID NO: 3728438 - DNA, 17 bp, Homo sapiens
gcaacactctatattta

SEQ ID NO: 3728439 - DNA, 14 bp, Homo sapiens
gcaacagagtgaga

SEQ ID NO: 3728440 - DNA, 19 bp, Homo sapiens
gcaacagagtgagaccctg

SEQ ID NO: 3728441 - DNA, 14 bp, Homo sapiens
gcaacaggctgggc

SEQ ID NO: 3728442 - DNA, 16 bp, Homo sapiens
gcaacaggctgggctt

SEQ ID NO: 3728443 - DNA, 18 bp, Homo sapiens
gcaacatctagcaaatgt

SEQ ID NO: 3728444 - DNA, 14 bp, Homo sapiens
gcaacccccagcct

SEQ ID NO: 3728445 - DNA, 18 bp, Homo sapiens
gcaacccccagcctgcta

SEQ ID NO: 3728446 - DNA, 12 bp, Homo sapiens
gcaaccctccta

SEQ ID NO: 3728447 - DNA, 23 bp, Homo sapiens
gcaaccctcctatcacctcccct

SEQ ID NO: 3728448 - DNA, 21 bp, Homo sapiens
gcaacccttaccccttagcct

SEQ ID NO: 3728449 - DNA, 14 bp, Homo sapiens
gcaactgaggcaga

SEQ ID NO: 3728450 - DNA, 21 bp, Homo sapiens
gcaactgaggcagacagcagc

SEQ ID NO: 3728451 - DNA, 19 bp, Homo sapiens
gcaagacagagacgcagga

SEQ ID NO: 3728452 - DNA, 17 bp, Homo sapiens
gcaagagagatgttttg

SEQ ID NO: 3728453 - DNA, 22 bp, Homo sapiens
gcaagattttccacaagattcc

SEQ ID NO: 3728454 - DNA, 18 bp, Homo sapiens
gcaagcacctcctgcctc

SEQ ID NO: 3728455 - DNA, 20 bp, Homo sapiens
gcaagcacctcctgcctcga

SEQ ID NO: 3728456 - DNA, 14 bp, Homo sapiens
gcaaggaccaggac

SEQ ID NO: 3728457 - DNA, 20 bp, Homo sapiens
gcaaggaccaggactccctc

SEQ ID NO: 3728458 - DNA, 15 bp, Homo sapiens
gcaaggggaaaatct

SEQ ID NO: 3728459 - DNA, 13 bp, Homo sapiens
gcaaggtggagtg

SEQ ID NO: 3728460 - DNA, 23 bp, Homo sapiens
gcaagtatgttttagcatgtgtt

SEQ ID NO: 3728461 - DNA, 20 bp, Homo sapiens
gcaagtccctgactctctgt

SEQ ID NO: 3728462 - DNA, 13 bp, Homo sapiens
gcaagtgagagct

SEQ ID NO: 3728463 - DNA, 18 bp, Homo sapiens
gcaagtgagagctgggtg

SEQ ID NO: 3728464 - DNA, 16 bp, Homo sapiens
gcaagtgtctgtgtgc

SEQ ID NO: 3728465 - DNA, 17 bp, Homo sapiens
gcaagtgtctgtgtgca

SEQ ID NO: 3728466 - DNA, 12 bp, Homo sapiens
gcaagtgtgtgc

SEQ ID NO: 3728467 - DNA, 21 bp, Homo sapiens
gcaagtgtgtgcatgtgtgcg

SEQ ID NO: 3728468 - DNA, 17 bp, Homo sapiens
gcaatagtgtgttctga

SEQ ID NO: 3728469 - DNA, 20 bp, Homo sapiens
gcaatagtgtgttctgatta

SEQ ID NO: 3728470 - DNA, 14 bp, Homo sapiens
gcaatataaccaat

SEQ ID NO: 3728471 - DNA, 15 bp, Homo sapiens
gcaatcaaatctgct

SEQ ID NO: 3728472 - DNA, 17 bp, Homo sapiens
gcaatcaaatctgcttt

SEQ ID NO: 3728473 - DNA, 20 bp, Homo sapiens
gcaatccatgttagttttta

SEQ ID NO: 3728474 - DNA, 23 bp, Homo sapiens
gcaatctggggatactggcaaag

SEQ ID NO: 3728475 - DNA, 22 bp, Homo sapiens
gcaatgctggctgttggctggg

SEQ ID NO: 3728476 - DNA, 23 bp, Homo sapiens
gcaatgctggctgttggctgggg

SEQ ID NO: 3728477 - DNA, 14 bp, Homo sapiens
gcaatggcagcctt

SEQ ID NO: 3728478 - DNA, 22 bp, Homo sapiens
gcaatgtcaggaacagaaggat

SEQ ID NO: 3728479 - DNA, 17 bp, Homo sapiens
gcaattccgcatttaat

SEQ ID NO: 3728480 - DNA, 18 bp, Homo sapiens
gcaattttgcatttgaat

SEQ ID NO: 3728481 - DNA, 14 bp, Homo sapiens
gcagctcaaaggca

SEQ ID NO: 3728482 - DNA, 15 bp, Homo sapiens
gcagctcaaaggcac

SEQ ID NO: 3728483 - DNA, 14 bp, Homo sapiens
gcagctgattttaa

SEQ ID NO: 3728484 - DNA, 17 bp, Homo sapiens
gcagctgattttaacaa

SEQ ID NO: 3728485 - DNA, 20 bp, Homo sapiens
gcagctgcttttgtctatgg

SEQ ID NO: 3728486 - DNA, 17 bp, Homo sapiens
gcagctgggagaagggg

SEQ ID NO: 3728487 - DNA, 17 bp, Homo sapiens
gcagctgttagagtcca

SEQ ID NO: 3728488 - DNA, 16 bp, Homo sapiens
gcagcttgagggttgg

SEQ ID NO: 3728489 - DNA, 18 bp, Homo sapiens
gcaggaagctcagactgg

SEQ ID NO: 3728490 - DNA, 17 bp, Homo sapiens
gcaggaaggagagcctg

SEQ ID NO: 3728491 - DNA, 17 bp, Homo sapiens
gcaggaatgtgtggcag

SEQ ID NO: 3728492 - DNA, 18 bp, Homo sapiens
gcaggaattggtggcaga

SEQ ID NO: 3728493 - DNA, 18 bp, Homo sapiens
gcaggacaacgaggaagc

SEQ ID NO: 3728494 - DNA, 19 bp, Homo sapiens
gcaggacaacgaggaagcc

SEQ ID NO: 3728495 - DNA, 11 bp, Homo sapiens
gcaggacctca

SEQ ID NO: 3728496 - DNA, 14 bp, Homo sapiens
gcaggacctcagag

SEQ ID NO: 3728497 - DNA, 16 bp, Homo sapiens
gcaggacctcagagtc

SEQ ID NO: 3728498 - DNA, 19 bp, Homo sapiens
gacagccacggccaggcca

SEQ ID NO: 3728499 - DNA, 21 bp, Homo sapiens
gacagccacggccaggccaga

SEQ ID NO: 3728500 - DNA, 11 bp, Homo sapiens
gacagcctggc

SEQ ID NO: 3728501 - DNA, 20 bp, Homo sapiens
gacagcctgtggcggtgcct

SEQ ID NO: 3728502 - DNA, 14 bp, Homo sapiens
gacagctccttctg

SEQ ID NO: 3728503 - DNA, 17 bp, Homo sapiens
gacagctccttctgtcc

SEQ ID NO: 3728504 - DNA, 18 bp, Homo sapiens
gacagctccttctgtcct

SEQ ID NO: 3728505 - DNA, 19 bp, Homo sapiens
gacagctccttctgtccta

SEQ ID NO: 3728506 - DNA, 18 bp, Homo sapiens
gacaggaaaatcctctgg

SEQ ID NO: 3728507 - DNA, 14 bp, Homo sapiens
gacaggacagtgct

SEQ ID NO: 3728508 - DNA, 17 bp, Homo sapiens
gacaggcaagcacctcc

SEQ ID NO: 3728509 - DNA, 18 bp, Homo sapiens
gacaggcaagcacctcct

SEQ ID NO: 3728510 - DNA, 19 bp, Homo sapiens
gacaggccatgtgagccac

SEQ ID NO: 3728511 - DNA, 16 bp, Homo sapiens
gacaggcccaagagat

SEQ ID NO: 3728512 - DNA, 21 bp, Homo sapiens
gacaggcccaagagatgaaga

SEQ ID NO: 3728513 - DNA, 16 bp, Homo sapiens
gacagggaggtgaccc

SEQ ID NO: 3728514 - DNA, 20 bp, Homo sapiens
gacagggcatggccaggtgg

SEQ ID NO: 3728515 - DNA, 22 bp, Homo sapiens
gacagggcatggccaggtggcc

SEQ ID NO: 3728516 - DNA, 20 bp, Homo sapiens
gacagggttttgccatgttg

SEQ ID NO: 3728517 - DNA, 17 bp, Homo sapiens
gacagtaacttggttat

SEQ ID NO: 3728518 - DNA, 21 bp, Homo sapiens
gacagtaacttggttatacat

SEQ ID NO: 3728519 - DNA, 23 bp, Homo sapiens
gacagtcctgggagaacctcagg

SEQ ID NO: 3728520 - DNA, 15 bp, Homo sapiens
gacagtgaggtcctg

SEQ ID NO: 3728521 - DNA, 17 bp, Homo sapiens
gacagtgcctgggaatg

SEQ ID NO: 3728522 - DNA, 23 bp, Homo sapiens
gacagtgttgaaaatgttcagaa

SEQ ID NO: 3728523 - DNA, 17 bp, Homo sapiens
gacagttcatatgtacc

SEQ ID NO: 3728524 - DNA, 22 bp, Homo sapiens
gacagttttccttctcatctgt

SEQ ID NO: 3728525 - DNA, 17 bp, Homo sapiens
gacataaccactgcttc

SEQ ID NO: 3728526 - DNA, 15 bp, Homo sapiens
gacatcacttgtaca

SEQ ID NO: 3728527 - DNA, 16 bp, Homo sapiens
gacatcacttgtacaa

SEQ ID NO: 3728528 - DNA, 17 bp, Homo sapiens
gacatccaagcttcctt

SEQ ID NO: 3728529 - DNA, 23 bp, Homo sapiens
gacatccatgttccgagaagaac

SEQ ID NO: 3728530 - DNA, 19 bp, Homo sapiens
gacatcttagtatttgcat

SEQ ID NO: 3728531 - DNA, 12 bp, Homo sapiens
gacatgaatatg

SEQ ID NO: 3728532 - DNA, 15 bp, Homo sapiens
gacatgcgggctggg

SEQ ID NO: 3728533 - DNA, 21 bp, Homo sapiens
gacatgcgggctgggcagctg

SEQ ID NO: 3728534 - DNA, 19 bp, Homo sapiens
gacatgtggaaagtgaatt

SEQ ID NO: 3728535 - DNA, 22 bp, Homo sapiens
gacatgtggtgggacagggacc

SEQ ID NO: 3728536 - DNA, 19 bp, Homo sapiens
gacattaacagttttccat

SEQ ID NO: 3728537 - DNA, 22 bp, Homo sapiens
gacattaagcatcacaaatgat

SEQ ID NO: 3728538 - DNA, 17 bp, Homo sapiens
gacattctgccaggccc

SEQ ID NO: 3728539 - DNA, 23 bp, Homo sapiens
gacattgcggacagccacggcca

SEQ ID NO: 3728540 - DNA, 12 bp, Homo sapiens
gacattgtcaat

SEQ ID NO: 3728541 - DNA, 13 bp, Homo sapiens
gacattgtcaata

SEQ ID NO: 3728542 - DNA, 14 bp, Homo sapiens
gacattgtcaataa

SEQ ID NO: 3728543 - DNA, 15 bp, Homo sapiens
gacattttagggaca

SEQ ID NO: 3728544 - DNA, 17 bp, Homo sapiens
gaccaaaatgacaatga

SEQ ID NO: 3728545 - DNA, 21 bp, Homo sapiens
gaccaaaatgacaatgatgat

SEQ ID NO: 3728546 - DNA, 23 bp, Homo sapiens
gaccaaattccttggcatgcctt

SEQ ID NO: 3728547 - DNA, 16 bp, Homo sapiens
gaccaacatggagaaa

SEQ ID NO: 3728548 - DNA, 14 bp, Homo sapiens
gaccaactgggccc

SEQ ID NO: 3728549 - DNA, 19 bp, Homo sapiens
gaccaactgggcccaagac

SEQ ID NO: 3728550 - DNA, 12 bp, Homo sapiens
gaccaagaactg

SEQ ID NO: 3728551 - DNA, 13 bp, Homo sapiens
gaccaagaactgc

SEQ ID NO: 3728552 - DNA, 15 bp, Homo sapiens
gaccaagagagaaag

SEQ ID NO: 3728553 - DNA, 12 bp, Homo sapiens
gaccaagcagga

SEQ ID NO: 3728554 - DNA, 14 bp, Homo sapiens
gaccaagcaggaag

SEQ ID NO: 3728555 - DNA, 15 bp, Homo sapiens
gaccaagcaggaagc

SEQ ID NO: 3728556 - DNA, 19 bp, Homo sapiens
gaccaagcaggaagctcag

SEQ ID NO: 3728557 - DNA, 16 bp, Homo sapiens
gaccaaggagatgaag

SEQ ID NO: 3728558 - DNA, 16 bp, Homo sapiens
gaccaagtcctggcta

SEQ ID NO: 3728559 - DNA, 20 bp, Homo sapiens
gaccaatattatactaagaa

SEQ ID NO: 3728560 - DNA, 18 bp, Homo sapiens
gaccacaaaacttttcta

SEQ ID NO: 3728561 - DNA, 17 bp, Homo sapiens
gaccacacttcctgtcc

SEQ ID NO: 3728562 - DNA, 18 bp, Homo sapiens
gaccacacttcctgtcca

SEQ ID NO: 3728563 - DNA, 22 bp, Homo sapiens
gaccacacttcctgtccagaga

SEQ ID NO: 3728564 - DNA, 13 bp, Homo sapiens
gaccacctgccca

SEQ ID NO: 3728565 - DNA, 14 bp, Homo sapiens
gaccacgctttcta

SEQ ID NO: 3728566 - DNA, 21 bp, Homo sapiens
gaccacgctttctagctgttg

SEQ ID NO: 3728567 - DNA, 19 bp, Homo sapiens
gaccagaagggaaacagtc

SEQ ID NO: 3728568 - DNA, 21 bp, Homo sapiens
gaccagacaccttgacagggc

SEQ ID NO: 3728569 - DNA, 14 bp, Homo sapiens
gaccagagctctgg

SEQ ID NO: 3728570 - DNA, 18 bp, Homo sapiens
gaccagcagatcccagct

SEQ ID NO: 3728571 - DNA, 21 bp, Homo sapiens
gaccagcctccatgctgcctc

SEQ ID NO: 3728572 - DNA, 12 bp, Homo sapiens
gaccagcctggc

SEQ ID NO: 3728573 - DNA, 17 bp, Homo sapiens
gaccagcctgggcagca

SEQ ID NO: 3728574 - DNA, 17 bp, Homo sapiens
gaccaggactccctcct

SEQ ID NO: 3728575 - DNA, 22 bp, Homo sapiens
gaccagtggtgccttggaggga

SEQ ID NO: 3728576 - DNA, 15 bp, Homo sapiens
gaccataatgttaca

SEQ ID NO: 3728577 - DNA, 20 bp, Homo sapiens
gaccataatgttacattatt

SEQ ID NO: 3728578 - DNA, 19 bp, Homo sapiens
gaccatccactctaccctc

SEQ ID NO: 3728579 - DNA, 13 bp, Homo sapiens
gaccatcctattt

SEQ ID NO: 3728580 - DNA, 20 bp, Homo sapiens
gaccatcctggccaacatga

SEQ ID NO: 3728581 - DNA, 22 bp, Homo sapiens
gacccacctggtggcctctgcc

SEQ ID NO: 3728582 - DNA, 11 bp, Homo sapiens
gacccactgct

SEQ ID NO: 3728583 - DNA, 12 bp, Homo sapiens
gacccccaacca

SEQ ID NO: 3728584 - DNA, 21 bp, Homo sapiens
gacccccaaccaagtggctcc

SEQ ID NO: 3728585 - DNA, 15 bp, Homo sapiens
gacccccacacctca

SEQ ID NO: 3728586 - DNA, 16 bp, Homo sapiens
gacccccaccccttcc

SEQ ID NO: 3728587 - DNA, 17 bp, Homo sapiens
gacccccaccccttccc

SEQ ID NO: 3728588 - DNA, 21 bp, Homo sapiens
gacccccaccccttccccact

SEQ ID NO: 3728589 - DNA, 22 bp, Homo sapiens
gacccccaccccttccccactg

SEQ ID NO: 3728590 - DNA, 19 bp, Homo sapiens
gacccccactctcattccc

SEQ ID NO: 3728591 - DNA, 12 bp, Homo sapiens
gacccctcacct

SEQ ID NO: 3728592 - DNA, 22 bp, Homo sapiens
gacccctcaccttgcaacacac

SEQ ID NO: 3728593 - DNA, 18 bp, Homo sapiens
gacccctccatgtgggct

SEQ ID NO: 3728594 - DNA, 19 bp, Homo sapiens
gacccctcccctaatgcct

SEQ ID NO: 3728595 - DNA, 17 bp, Homo sapiens
gacccggaggggcctgg

SEQ ID NO: 3728596 - DNA, 19 bp, Homo sapiens
gacccggaggggcctggca

SEQ ID NO: 3728597 - DNA, 13 bp, Homo sapiens
gacccggctgcgt

SEQ ID NO: 3728598 - DNA, 17 bp, Homo sapiens
gaccctaaatctgagga

SEQ ID NO: 3728599 - DNA, 21 bp, Homo sapiens
gaccctacttcctgcactgac

SEQ ID NO: 3728600 - DNA, 16 bp, Homo sapiens
gaccctcgctggcccc

SEQ ID NO: 3728601 - DNA, 20 bp, Homo sapiens
gaccctgcgaaggggccctg

SEQ ID NO: 3728602 - DNA, 21 bp, Homo sapiens
gaccctgcgaaggggccctgg

SEQ ID NO: 3728603 - DNA, 19 bp, Homo sapiens
gacccttcccttgagccct

SEQ ID NO: 3728604 - DNA, 21 bp, Homo sapiens
gaccctttccttccttccctg

SEQ ID NO: 3728605 - DNA, 22 bp, Homo sapiens
gaccctttccttccttccctgg

SEQ ID NO: 3728606 - DNA, 23 bp, Homo sapiens
gaccctttccttccttccctggc

SEQ ID NO: 3728607 - DNA, 21 bp, Homo sapiens
gaccggaggcaaaaggcagtg

SEQ ID NO: 3728608 - DNA, 21 bp, Homo sapiens
gacctagggaggaccttatct

SEQ ID NO: 3728609 - DNA, 22 bp, Homo sapiens
gacctagggatgttctggccct

SEQ ID NO: 3728610 - DNA, 14 bp, Homo sapiens
gacctatgtttgct

SEQ ID NO: 3728611 - DNA, 13 bp, Homo sapiens
gacctcaacctgt

SEQ ID NO: 3728612 - DNA, 17 bp, Homo sapiens
gacctcagagtccaggc

SEQ ID NO: 3728613 - DNA, 19 bp, Homo sapiens
gacctcagagtccaggccc

SEQ ID NO: 3728614 - DNA, 19 bp, Homo sapiens
gacctcagcctgtgctgcc

SEQ ID NO: 3728615 - DNA, 13 bp, Homo sapiens
gacctcagccttc

SEQ ID NO: 3728616 - DNA, 21 bp, Homo sapiens
gacctcaggtgatccacccac

SEQ ID NO: 3728617 - DNA, 15 bp, Homo sapiens
gacctccccctcctt

SEQ ID NO: 3728618 - DNA, 19 bp, Homo sapiens
gacctccccctccttccca

SEQ ID NO: 3728619 - DNA, 17 bp, Homo sapiens
gacctcgtcctccccct

SEQ ID NO: 3728620 - DNA, 18 bp, Homo sapiens
gacctcgtgctttaagtg

SEQ ID NO: 3728621 - DNA, 15 bp, Homo sapiens
gacctgactattgaa

SEQ ID NO: 3728622 - DNA, 18 bp, Homo sapiens
gacctgagctccccacca

SEQ ID NO: 3728623 - DNA, 22 bp, Homo sapiens
gacctgagctccccaccacccc

SEQ ID NO: 3728624 - DNA, 14 bp, Homo sapiens
gacctgaggaagcg

SEQ ID NO: 3728625 - DNA, 19 bp, Homo sapiens
gacctgctgagggaccagc

SEQ ID NO: 3728626 - DNA, 13 bp, Homo sapiens
gacctgtcttcca

SEQ ID NO: 3728627 - DNA, 20 bp, Homo sapiens
gacctgtgctagttttacag

SEQ ID NO: 3728628 - DNA, 20 bp, Homo sapiens
gacctgtggggatttctccc

SEQ ID NO: 3728629 - DNA, 22 bp, Homo sapiens
gacctgtggggatttctcccag

SEQ ID NO: 3728630 - DNA, 18 bp, Homo sapiens
gaccttctccaaatgaga

SEQ ID NO: 3728631 - DNA, 17 bp, Homo sapiens
gaccttctgagaggggc

SEQ ID NO: 3728632 - DNA, 12 bp, Homo sapiens
gaccttctggga

SEQ ID NO: 3728633 - DNA, 17 bp, Homo sapiens
gaccttgaactcctggg

SEQ ID NO: 3728634 - DNA, 14 bp, Homo sapiens
gacgaggctgggcc

SEQ ID NO: 3728635 - DNA, 13 bp, Homo sapiens
gacggagtcccac

SEQ ID NO: 3728636 - DNA, 20 bp, Homo sapiens
gacggcctgatgctccctcc

SEQ ID NO: 3728637 - DNA, 19 bp, Homo sapiens
gacggttcaccagcctctc

SEQ ID NO: 3728638 - DNA, 23 bp, Homo sapiens
gacgtatgcttattttaaaattt

SEQ ID NO: 3728639 - DNA, 14 bp, Homo sapiens
gacgtcaagtctcc

SEQ ID NO: 3728640 - DNA, 18 bp, Homo sapiens
gacgtcccttttttctct

SEQ ID NO: 3728641 - DNA, 13 bp, Homo sapiens
gacgtcctgccac

SEQ ID NO: 3728642 - DNA, 14 bp, Homo sapiens
gacgtcctgccacc

SEQ ID NO: 3728643 - DNA, 18 bp, Homo sapiens
gacgtgcacctgtactca

SEQ ID NO: 3728644 - DNA, 19 bp, Homo sapiens
gacgtgtgtttctagagcc

SEQ ID NO: 3728645 - DNA, 14 bp, Homo sapiens
gactaaagagagaa

SEQ ID NO: 3728646 - DNA, 13 bp, Homo sapiens
gactacaggtgtg

SEQ ID NO: 3728647 - DNA, 18 bp, Homo sapiens
gactacaggtgtgagtca

SEQ ID NO: 3728648 - DNA, 18 bp, Homo sapiens
gactacttgggagcaccg

SEQ ID NO: 3728649 - DNA, 20 bp, Homo sapiens
gactacttgggagcaccgcc

SEQ ID NO: 3728650 - DNA, 20 bp, Homo sapiens
gactagaaaatttaaaacat

SEQ ID NO: 3728651 - DNA, 16 bp, Homo sapiens
gactagacgttcattt

SEQ ID NO: 3728652 - DNA, 15 bp, Homo sapiens
gactagaggcaggga

SEQ ID NO: 3728653 - DNA, 17 bp, Homo sapiens
gactagaggcagggagg

SEQ ID NO: 3728654 - DNA, 20 bp, Homo sapiens
gactagaggcagggagggga

SEQ ID NO: 3728655 - DNA, 22 bp, Homo sapiens
gactagaggcagggaggggact

SEQ ID NO: 3728656 - DNA, 19 bp, Homo sapiens
gactagggattcaggctgc

SEQ ID NO: 3728657 - DNA, 23 bp, Homo sapiens
gactagtgctgaagcttattaat

SEQ ID NO: 3728658 - DNA, 22 bp, Homo sapiens
gactatcaaactgaagccagaa

SEQ ID NO: 3728659 - DNA, 13 bp, Homo sapiens
gactatttatgaa

SEQ ID NO: 3728660 - DNA, 17 bp, Homo sapiens
gactcaagtccttacct

SEQ ID NO: 3728661 - DNA, 14 bp, Homo sapiens
gactcaatgcactg

SEQ ID NO: 3728662 - DNA, 15 bp, Homo sapiens
gactcacctctgcct

SEQ ID NO: 3728663 - DNA, 14 bp, Homo sapiens
gactcactggcagc

SEQ ID NO: 3728664 - DNA, 16 bp, Homo sapiens
gactcactggcagccc

SEQ ID NO: 3728665 - DNA, 23 bp, Homo sapiens
gactcactggcagccccagcacc

SEQ ID NO: 3728666 - DNA, 16 bp, Homo sapiens
gactcagactccattt

SEQ ID NO: 3728667 - DNA, 11 bp, Homo sapiens
gactcagccct

SEQ ID NO: 3728668 - DNA, 13 bp, Homo sapiens
gactcagccctga

SEQ ID NO: 3728669 - DNA, 18 bp, Homo sapiens
gactcaggatgcccaggg

SEQ ID NO: 3728670 - DNA, 17 bp, Homo sapiens
gactcagggccccagca

SEQ ID NO: 3728671 - DNA, 20 bp, Homo sapiens
gactcagggccccagcacta

SEQ ID NO: 3728672 - DNA, 21 bp, Homo sapiens
gactcaggttgtagtaaagaa

SEQ ID NO: 3728673 - DNA, 23 bp, Homo sapiens
gactcaggttgtagtaaagaaat

SEQ ID NO: 3728674 - DNA, 17 bp, Homo sapiens
gactcccaaagagctgc

SEQ ID NO: 3728675 - DNA, 14 bp, Homo sapiens
gactcctctgtcca

SEQ ID NO: 3728676 - DNA, 16 bp, Homo sapiens
gactcctgtgcaactt

SEQ ID NO: 3728677 - DNA, 15 bp, Homo sapiens
gactctctgtgacct

SEQ ID NO: 3728678 - DNA, 19 bp, Homo sapiens
gactctgaggctctttctg

SEQ ID NO: 3728679 - DNA, 16 bp, Homo sapiens
gactctgcctcctctt

SEQ ID NO: 3728680 - DNA, 14 bp, Homo sapiens
gactcttgttttca

SEQ ID NO: 3728681 - DNA, 18 bp, Homo sapiens
gactgaattgtccccagt

SEQ ID NO: 3728682 - DNA, 13 bp, Homo sapiens
gactgagctcaag

SEQ ID NO: 3728683 - DNA, 21 bp, Homo sapiens
gactgcaagtgagcaaacctg

SEQ ID NO: 3728684 - DNA, 19 bp, Homo sapiens
gactgcatggtaatttata

SEQ ID NO: 3728685 - DNA, 17 bp, Homo sapiens
gactgccccgtgcagac

SEQ ID NO: 3728686 - DNA, 19 bp, Homo sapiens
gactgccccgtgcagactg

SEQ ID NO: 3728687 - DNA, 21 bp, Homo sapiens
gactgccccgtgcagactgga

SEQ ID NO: 3728688 - DNA, 19 bp, Homo sapiens
gactgccgaccgaggctgg

SEQ ID NO: 3728689 - DNA, 21 bp, Homo sapiens
gactgcgggatggtcctgggg

SEQ ID NO: 3728690 - DNA, 15 bp, Homo sapiens
gactggaagcacagc

SEQ ID NO: 3728691 - DNA, 15 bp, Homo sapiens
gactggaatttttat

SEQ ID NO: 3728692 - DNA, 15 bp, Homo sapiens
gactggagtccctgt

SEQ ID NO: 3728693 - DNA, 15 bp, Homo sapiens
gactggatactgccc

SEQ ID NO: 3728694 - DNA, 21 bp, Homo sapiens
gactggctagagtcctcactc

SEQ ID NO: 3728695 - DNA, 16 bp, Homo sapiens
gactggctggctgcag

SEQ ID NO: 3728696 - DNA, 17 bp, Homo sapiens
gactggctggctgcagt

SEQ ID NO: 3728697 - DNA, 20 bp, Homo sapiens
gactgggaagataggctctg

SEQ ID NO: 3728698 - DNA, 17 bp, Homo sapiens
gactggtgagcagactg

SEQ ID NO: 3728699 - DNA, 23 bp, Homo sapiens
gactgtacacactttatttactt

SEQ ID NO: 3728700 - DNA, 16 bp, Homo sapiens
gactgtactcctccca

SEQ ID NO: 3728701 - DNA, 20 bp, Homo sapiens
gactgtagattgcttctgta

SEQ ID NO: 3728702 - DNA, 22 bp, Homo sapiens
gactgtagattgcttctgtagt

SEQ ID NO: 3728703 - DNA, 19 bp, Homo sapiens
gactgtatctgtgtagact

SEQ ID NO: 3728704 - DNA, 19 bp, Homo sapiens
gactgttttttcctgagct

SEQ ID NO: 3728705 - DNA, 20 bp, Homo sapiens
gactgttttttcctgagctt

SEQ ID NO: 3728706 - DNA, 20 bp, Homo sapiens
gacttaactgcatttttaga

SEQ ID NO: 3728707 - DNA, 13 bp, Homo sapiens
gacttatgggccc

SEQ ID NO: 3728708 - DNA, 16 bp, Homo sapiens
gacttcacactgcaag

SEQ ID NO: 3728709 - DNA, 18 bp, Homo sapiens
gacttcgactgtgacctg

SEQ ID NO: 3728710 - DNA, 13 bp, Homo sapiens
gacttgaaagcat

SEQ ID NO: 3728711 - DNA, 17 bp, Homo sapiens
gacttgaaagcatccat

SEQ ID NO: 3728712 - DNA, 16 bp, Homo sapiens
gacttgacagaacact

SEQ ID NO: 3728713 - DNA, 19 bp, Homo sapiens
gacttgagaaacaaataat

SEQ ID NO: 3728714 - DNA, 15 bp, Homo sapiens
gacttggaagctccg

SEQ ID NO: 3728715 - DNA, 13 bp, Homo sapiens
gacttgtgtctct

SEQ ID NO: 3728716 - DNA, 16 bp, Homo sapiens
gacttgtgtctctgtg

SEQ ID NO: 3728717 - DNA, 18 bp, Homo sapiens
gacttgttttatgctcag

SEQ ID NO: 3728718 - DNA, 13 bp, Homo sapiens
gactttactgggt

SEQ ID NO: 3728719 - DNA, 15 bp, Homo sapiens
gactttatgcaataa

SEQ ID NO: 3728720 - DNA, 19 bp, Homo sapiens
gactttattttctggtaga

SEQ ID NO: 3728721 - DNA, 12 bp, Homo sapiens
gactttcaggta

SEQ ID NO: 3728722 - DNA, 14 bp, Homo sapiens
gactttcaggtact

SEQ ID NO: 3728723 - DNA, 15 bp, Homo sapiens
gactttccaccccct

SEQ ID NO: 3728724 - DNA, 17 bp, Homo sapiens
gactttccaccccctcc

SEQ ID NO: 3728725 - DNA, 21 bp, Homo sapiens
gacttttctttgtggcttcct

SEQ ID NO: 3728726 - DNA, 18 bp, Homo sapiens
gactttttggtggatgta

SEQ ID NO: 3728727 - DNA, 21 bp, Homo sapiens
gactttttggtggatgtaaat

SEQ ID NO: 3728728 - DNA, 23 bp, Homo sapiens
gactttttggtggatgtaaataa

SEQ ID NO: 3728729 - DNA, 13 bp, Homo sapiens
gagaaaattgaat

SEQ ID NO: 3728730 - DNA, 14 bp, Homo sapiens
gagaaacagagaca

SEQ ID NO: 3728731 - DNA, 23 bp, Homo sapiens
gagaaagtacttctccaccctgc

SEQ ID NO: 3728732 - DNA, 18 bp, Homo sapiens
gagaaagtgtgagcaaac

SEQ ID NO: 3728733 - DNA, 17 bp, Homo sapiens
gagaacatgttggtatt

SEQ ID NO: 3728734 - DNA, 18 bp, Homo sapiens
gagaacctaagtttcagt

SEQ ID NO: 3728735 - DNA, 18 bp, Homo sapiens
gagaacgccagtctccca

SEQ ID NO: 3728736 - DNA, 15 bp, Homo sapiens
gagaactcctagggt

SEQ ID NO: 3728737 - DNA, 23 bp, Homo sapiens
gagaactgcatatgtttcgctga

SEQ ID NO: 3728738 - DNA, 21 bp, Homo sapiens
gagaagaattttcagacccca

SEQ ID NO: 3728739 - DNA, 21 bp, Homo sapiens
gagaagcatcggagggaattg

SEQ ID NO: 3728740 - DNA, 13 bp, Homo sapiens
gagaagcatgaaa

SEQ ID NO: 3728741 - DNA, 13 bp, Homo sapiens
gagaagcggctgg

SEQ ID NO: 3728742 - DNA, 15 bp, Homo sapiens
gagaagcggctggca

SEQ ID NO: 3728743 - DNA, 20 bp, Homo sapiens
gagaaggacccggaggggcc

SEQ ID NO: 3728744 - DNA, 22 bp, Homo sapiens
gagaaggacccggaggggcctg

SEQ ID NO: 3728745 - DNA, 12 bp, Homo sapiens
gagaaggcagga

SEQ ID NO: 3728746 - DNA, 17 bp, Homo sapiens
gagaaggggaagcactc

SEQ ID NO: 3728747 - DNA, 23 bp, Homo sapiens
gagaagtgcccctgctgcctccc

SEQ ID NO: 3728748 - DNA, 13 bp, Homo sapiens
gagaatagaagga

SEQ ID NO: 3728749 - DNA, 14 bp, Homo sapiens
gagaatagaaggaa

SEQ ID NO: 3728750 - DNA, 22 bp, Homo sapiens
gagaatagaaggaaactagctt

SEQ ID NO: 3728751 - DNA, 15 bp, Homo sapiens
gagaatgaaagggcc

SEQ ID NO: 3728752 - DNA, 23 bp, Homo sapiens
gagaatgaaagggcccagagagg

SEQ ID NO: 3728753 - DNA, 13 bp, Homo sapiens
gagaatgagcctc

SEQ ID NO: 3728754 - DNA, 19 bp, Homo sapiens
gagaatggctttggtctct

SEQ ID NO: 3728755 - DNA, 16 bp, Homo sapiens
gagaattttaaattat

SEQ ID NO: 3728756 - DNA, 11 bp, Homo sapiens
gagacaaaaat

SEQ ID NO: 3728757 - DNA, 15 bp, Homo sapiens
gagacaaaaattatc

SEQ ID NO: 3728758 - DNA, 20 bp, Homo sapiens
gagacaaaaattatctattt

SEQ ID NO: 3728759 - DNA, 18 bp, Homo sapiens
gagacaatgcagatgcca

SEQ ID NO: 3728760 - DNA, 12 bp, Homo sapiens
gagacacctcag

SEQ ID NO: 3728761 - DNA, 13 bp, Homo sapiens
gagacacctcaga

SEQ ID NO: 3728762 - DNA, 18 bp, Homo sapiens
gagacacctgcacctccc

SEQ ID NO: 3728763 - DNA, 20 bp, Homo sapiens
gagacactaacgacttcagg

SEQ ID NO: 3728764 - DNA, 19 bp, Homo sapiens
gagacagagttttcactct

SEQ ID NO: 3728765 - DNA, 19 bp, Homo sapiens
gagacaggaaaatcctctg

SEQ ID NO: 3728766 - DNA, 16 bp, Homo sapiens
gagacagttcaagaaa

SEQ ID NO: 3728767 - DNA, 18 bp, Homo sapiens
gagacattccaaaacgaa

SEQ ID NO: 3728768 - DNA, 17 bp, Homo sapiens
gagaccaacctgaccaa

SEQ ID NO: 3728769 - DNA, 23 bp, Homo sapiens
gagaccaagactctgaaatctca

SEQ ID NO: 3728770 - DNA, 18 bp, Homo sapiens
gagaccaagtcctggcta

SEQ ID NO: 3728771 - DNA, 13 bp, Homo sapiens
gagacccccacac

SEQ ID NO: 3728772 - DNA, 17 bp, Homo sapiens
gagaccctacaggagag

SEQ ID NO: 3728773 - DNA, 11 bp, Homo sapiens
gagacctcagc

SEQ ID NO: 3728774 - DNA, 15 bp, Homo sapiens
gagacctcagccatg

SEQ ID NO: 3728775 - DNA, 19 bp, Homo sapiens
gagacctggcactggatgc

SEQ ID NO: 3728776 - DNA, 14 bp, Homo sapiens
gagacggagtccca

SEQ ID NO: 3728777 - DNA, 19 bp, Homo sapiens
gagacggagtcccaccttg

SEQ ID NO: 3728778 - DNA, 23 bp, Homo sapiens
gagactcacctctgcctcaatgt

SEQ ID NO: 3728779 - DNA, 17 bp, Homo sapiens
gagactcagggccccag

SEQ ID NO: 3728780 - DNA, 18 bp, Homo sapiens
gagactccgtctcaagga

SEQ ID NO: 3728781 - DNA, 13 bp, Homo sapiens
gagactgggaaga

SEQ ID NO: 3728782 - DNA, 22 bp, Homo sapiens
gagactgtctcaagagggcact

SEQ ID NO: 3728783 - DNA, 17 bp, Homo sapiens
gagactgttttgaattt

SEQ ID NO: 3728784 - DNA, 21 bp, Homo sapiens
gagactttttggtggatgtaa

SEQ ID NO: 3728785 - DNA, 11 bp, Homo sapiens
gagagaaagaa

SEQ ID NO: 3728786 - DNA, 12 bp, Homo sapiens
gagagaagggga

SEQ ID NO: 3728787 - DNA, 17 bp, Homo sapiens
gagagaaggggaggagg

SEQ ID NO: 3728788 - DNA, 13 bp, Homo sapiens
gagagaagtgccc

SEQ ID NO: 3728789 - DNA, 21 bp, Homo sapiens
gagagaagtgcccctgctgcc

SEQ ID NO: 3728790 - DNA, 13 bp, Homo sapiens
gagagagagaggt

SEQ ID NO: 3728791 - DNA, 16 bp, Homo sapiens
gagagatctgctgtca

SEQ ID NO: 3728792 - DNA, 22 bp, Homo sapiens
gagagcaagggaagtggttctt

SEQ ID NO: 3728793 - DNA, 10 bp, Homo sapiens
gagagcccag

SEQ ID NO: 3728794 - DNA, 22 bp, Homo sapiens
gagagcctgctcccccaccccc

SEQ ID NO: 3728795 - DNA, 11 bp, Homo sapiens
gagagcctggt

SEQ ID NO: 3728796 - DNA, 13 bp, Homo sapiens
gagagcctggtgc

SEQ ID NO: 3728797 - DNA, 22 bp, Homo sapiens
gagagcgcctgcccctcccaga

SEQ ID NO: 3728798 - DNA, 15 bp, Homo sapiens
gagagctagcagcag

SEQ ID NO: 3728799 - DNA, 23 bp, Homo sapiens
gagagctggggaagcttcttaaa

SEQ ID NO: 3728800 - DNA, 13 bp, Homo sapiens
gagagctgggtgt

SEQ ID NO: 3728801 - DNA, 21 bp, Homo sapiens
gagagggcatgcgcacaaggc

SEQ ID NO: 3728802 - DNA, 18 bp, Homo sapiens
gagaggggaacagactgg

SEQ ID NO: 3728803 - DNA, 19 bp, Homo sapiens
gagaggggaacagactgga

SEQ ID NO: 3728804 - DNA, 18 bp, Homo sapiens
gagagggggccacctccc

SEQ ID NO: 3728805 - DNA, 21 bp, Homo sapiens
gagagtagccgagagcctgct

SEQ ID NO: 3728806 - DNA, 22 bp, Homo sapiens
gagagtagccgagagcctgctc

SEQ ID NO: 3728807 - DNA, 17 bp, Homo sapiens
gagagtcttgcagtgat

SEQ ID NO: 3728808 - DNA, 21 bp, Homo sapiens
gagagtggctcctcccggtgc

SEQ ID NO: 3728809 - DNA, 21 bp, Homo sapiens
gagagtgtcttcacggcagga

SEQ ID NO: 3728810 - DNA, 17 bp, Homo sapiens
gagataccaagatgcca

SEQ ID NO: 3728811 - DNA, 16 bp, Homo sapiens
gagatagaagaactgc

SEQ ID NO: 3728812 - DNA, 17 bp, Homo sapiens
gagatatggcagcgaaa

SEQ ID NO: 3728813 - DNA, 23 bp, Homo sapiens
gagatcaaccccttcgctcctgt

SEQ ID NO: 3728814 - DNA, 21 bp, Homo sapiens
gagatcaccagtgtgtggctt

SEQ ID NO: 3728815 - DNA, 16 bp, Homo sapiens
gagatcacgccactgc

SEQ ID NO: 3728816 - DNA, 12 bp, Homo sapiens
gagatcagagtc

SEQ ID NO: 3728817 - DNA, 17 bp, Homo sapiens
gagatcccgcctcttct

SEQ ID NO: 3728818 - DNA, 15 bp, Homo sapiens
gagatccttatcgaa

SEQ ID NO: 3728819 - DNA, 16 bp, Homo sapiens
gagatcggggccagag

SEQ ID NO: 3728820 - DNA, 21 bp, Homo sapiens
gagatcgtgccgttactctcc

SEQ ID NO: 3728821 - DNA, 21 bp, Homo sapiens
gagatctaagcctttccataa

SEQ ID NO: 3728822 - DNA, 18 bp, Homo sapiens
gagatgaagcaaacacat

SEQ ID NO: 3728823 - DNA, 20 bp, Homo sapiens
gagatgaagcaaacacatta

SEQ ID NO: 3728824 - DNA, 16 bp, Homo sapiens
gagatgactgagtcct

SEQ ID NO: 3728825 - DNA, 20 bp, Homo sapiens
gagatgcctccaccgctgcc

SEQ ID NO: 3728826 - DNA, 17 bp, Homo sapiens
gagatggccctctggta

SEQ ID NO: 3728827 - DNA, 15 bp, Homo sapiens
gagatgtaagagctt

SEQ ID NO: 3728828 - DNA, 19 bp, Homo sapiens
gagcaaaatcgatgcagtg

SEQ ID NO: 3728829 - DNA, 13 bp, Homo sapiens
gagcaaacctgcc

SEQ ID NO: 3728830 - DNA, 15 bp, Homo sapiens
gagcaaacctgcccc

SEQ ID NO: 3728831 - DNA, 18 bp, Homo sapiens
gagcaagaccctgtctct

SEQ ID NO: 3728832 - DNA, 17 bp, Homo sapiens
gagcaagcttttttatt

SEQ ID NO: 3728833 - DNA, 22 bp, Homo sapiens
gagcacaagaggagatccaggg

SEQ ID NO: 3728834 - DNA, 15 bp, Homo sapiens
gagcaccaggcacga

SEQ ID NO: 3728835 - DNA, 23 bp, Homo sapiens
gagcaccaggcacgaacccacct

SEQ ID NO: 3728836 - DNA, 15 bp, Homo sapiens
gagcacctcccagcc

SEQ ID NO: 3728837 - DNA, 16 bp, Homo sapiens
gagcacctcccagccc

SEQ ID NO: 3728838 - DNA, 17 bp, Homo sapiens
gagcactgggttgactt

SEQ ID NO: 3728839 - DNA, 16 bp, Homo sapiens
gagcactgtatacccc

SEQ ID NO: 3728840 - DNA, 13 bp, Homo sapiens
gagcagagacact

SEQ ID NO: 3728841 - DNA, 21 bp, Homo sapiens
gagcagagacactaacgactt

SEQ ID NO: 3728842 - DNA, 17 bp, Homo sapiens
gaacagataatccctgt

SEQ ID NO: 3728843 - DNA, 18 bp, Homo sapiens
gaacagatctccaaagct

SEQ ID NO: 3728844 - DNA, 20 bp, Homo sapiens
gaacagcaggcccacctacc

SEQ ID NO: 3728845 - DNA, 21 bp, Homo sapiens
gaacagcaggcccacctacct

SEQ ID NO: 3728846 - DNA, 19 bp, Homo sapiens
gaacagcgggagacctgtg

SEQ ID NO: 3728847 - DNA, 21 bp, Homo sapiens
gaacagcgggagacctgtgct

SEQ ID NO: 3728848 - DNA, 21 bp, Homo sapiens
gaacagctatgggagccccag

SEQ ID NO: 3728849 - DNA, 22 bp, Homo sapiens
gaacagctatgggagccccagg

SEQ ID NO: 3728850 - DNA, 23 bp, Homo sapiens
gaacagctatgggagccccaggg

SEQ ID NO: 3728851 - DNA, 15 bp, Homo sapiens
gaacaggaaaagaaa

SEQ ID NO: 3728852 - DNA, 14 bp, Homo sapiens
gaacagtaactgcc

SEQ ID NO: 3728853 - DNA, 14 bp, Homo sapiens
gaacagtgtttccc

SEQ ID NO: 3728854 - DNA, 16 bp, Homo sapiens
gaacagttaagcagcc

SEQ ID NO: 3728855 - DNA, 21 bp, Homo sapiens
gaacagttaagcagccgccac

SEQ ID NO: 3728856 - DNA, 14 bp, Homo sapiens
gaacagtttgtaca

SEQ ID NO: 3728857 - DNA, 12 bp, Homo sapiens
gaacatccaagg

SEQ ID NO: 3728858 - DNA, 14 bp, Homo sapiens
gaacatccctgcca

SEQ ID NO: 3728859 - DNA, 15 bp, Homo sapiens
gaaccaaaacattcc

SEQ ID NO: 3728860 - DNA, 23 bp, Homo sapiens
gaaccaagtggaccttgagacca

SEQ ID NO: 3728861 - DNA, 13 bp, Homo sapiens
gaaccaatatttg

SEQ ID NO: 3728862 - DNA, 21 bp, Homo sapiens
gaaccacatcttgctctgctg

SEQ ID NO: 3728863 - DNA, 22 bp, Homo sapiens
gaaccaccacacccagcccact

SEQ ID NO: 3728864 - DNA, 19 bp, Homo sapiens
gaaccagtttcaggtgttt

SEQ ID NO: 3728865 - DNA, 20 bp, Homo sapiens
gaaccatcattataaacgtg

SEQ ID NO: 3728866 - DNA, 15 bp, Homo sapiens
gaacccacctgctga

SEQ ID NO: 3728867 - DNA, 14 bp, Homo sapiens
gaacccaggaggca

SEQ ID NO: 3728868 - DNA, 17 bp, Homo sapiens
gaaccccttcatcctct

SEQ ID NO: 3728869 - DNA, 19 bp, Homo sapiens
gaacctcacgcacctccca

SEQ ID NO: 3728870 - DNA, 13 bp, Homo sapiens
gaacctcttcccc

SEQ ID NO: 3728871 - DNA, 14 bp, Homo sapiens
gaacctcttcccca

SEQ ID NO: 3728872 - DNA, 12 bp, Homo sapiens
gaacctggacca

SEQ ID NO: 3728873 - DNA, 17 bp, Homo sapiens
gaacctggaccaaagct

SEQ ID NO: 3728874 - DNA, 18 bp, Homo sapiens
gaacctggaccaaagctg

SEQ ID NO: 3728875 - DNA, 12 bp, Homo sapiens
gaacctgtcctt

SEQ ID NO: 3728876 - DNA, 18 bp, Homo sapiens
gaacgatttagaaagaag

SEQ ID NO: 3728877 - DNA, 17 bp, Homo sapiens
gaacggtaaatttctgt

SEQ ID NO: 3728878 - DNA, 15 bp, Homo sapiens
gaacgtcttatctaa

SEQ ID NO: 3728879 - DNA, 18 bp, Homo sapiens
gaactagaggttttatga

SEQ ID NO: 3728880 - DNA, 17 bp, Homo sapiens
gaactagtggtggctct

SEQ ID NO: 3728881 - DNA, 19 bp, Homo sapiens
gaactagtggtggctctga

SEQ ID NO: 3728882 - DNA, 19 bp, Homo sapiens
gaactatattagtatgtat

SEQ ID NO: 3728883 - DNA, 16 bp, Homo sapiens
gaactcaactttgaca

SEQ ID NO: 3728884 - DNA, 13 bp, Homo sapiens
gaactcattcctg

SEQ ID NO: 3728885 - DNA, 16 bp, Homo sapiens
gaactcattcctgcct

SEQ ID NO: 3728886 - DNA, 15 bp, Homo sapiens
gaactcctaaatcaa

SEQ ID NO: 3728887 - DNA, 20 bp, Homo sapiens
gaactcctggaaatatcagt

SEQ ID NO: 3728888 - DNA, 13 bp, Homo sapiens
gaactcctggcct

SEQ ID NO: 3728889 - DNA, 14 bp, Homo sapiens
gaactcctggcctc

SEQ ID NO: 3728890 - DNA, 15 bp, Homo sapiens
gaactcctggcctca

SEQ ID NO: 3728891 - DNA, 18 bp, Homo sapiens
gaactctgggctgccatg

SEQ ID NO: 3728892 - DNA, 18 bp, Homo sapiens
gaactctttctggcctgc

SEQ ID NO: 3728893 - DNA, 19 bp, Homo sapiens
gaactgagctcctctgggc

SEQ ID NO: 3728894 - DNA, 16 bp, Homo sapiens
gaactgatgacactga

SEQ ID NO: 3728895 - DNA, 20 bp, Homo sapiens
gaactgcatgtataaatgaa

SEQ ID NO: 3728896 - DNA, 14 bp, Homo sapiens
gaactggactcagg

SEQ ID NO: 3728897 - DNA, 21 bp, Homo sapiens
gaactggactcaggatgccca

SEQ ID NO: 3728898 - DNA, 20 bp, Homo sapiens
gaacttatcctaaaacaaat

SEQ ID NO: 3728899 - DNA, 17 bp, Homo sapiens
gaacttgggccactgtg

SEQ ID NO: 3728900 - DNA, 13 bp, Homo sapiens
gaagaaaaaatac

SEQ ID NO: 3728901 - DNA, 14 bp, Homo sapiens
gaagaagctctctc

SEQ ID NO: 3728902 - DNA, 12 bp, Homo sapiens
gaagaaggaaat

SEQ ID NO: 3728903 - DNA, 21 bp, Homo sapiens
gaagaaggaaatgaatttctc

SEQ ID NO: 3728904 - DNA, 18 bp, Homo sapiens
gaagaattgaacccagga

SEQ ID NO: 3728905 - DNA, 23 bp, Homo sapiens
gaagaattgaacccaggaggtgg

SEQ ID NO: 3728906 - DNA, 15 bp, Homo sapiens
gaagaattttcagac

SEQ ID NO: 3728907 - DNA, 21 bp, Homo sapiens
gaagaattttcagaccccagc

SEQ ID NO: 3728908 - DNA, 14 bp, Homo sapiens
gaagacaaaaatac

SEQ ID NO: 3728909 - DNA, 15 bp, Homo sapiens
gaagacaaaaatact

SEQ ID NO: 3728910 - DNA, 12 bp, Homo sapiens
gaagacacagac

SEQ ID NO: 3728911 - DNA, 21 bp, Homo sapiens
gaagacactgatgggcaaccc

SEQ ID NO: 3728912 - DNA, 19 bp, Homo sapiens
gaagactcattcttctgta

SEQ ID NO: 3728913 - DNA, 11 bp, Homo sapiens
gaagactgtgg

SEQ ID NO: 3728914 - DNA, 15 bp, Homo sapiens
gaagacttcccagct

SEQ ID NO: 3728915 - DNA, 12 bp, Homo sapiens
gaagagaaacag

SEQ ID NO: 3728916 - DNA, 15 bp, Homo sapiens
gaagagagagctgag

SEQ ID NO: 3728917 - DNA, 18 bp, Homo sapiens
gaagagatgggcttgttt

SEQ ID NO: 3728918 - DNA, 15 bp, Homo sapiens
gaagagcaggcacat

SEQ ID NO: 3728919 - DNA, 12 bp, Homo sapiens
gaagagccttgc

SEQ ID NO: 3728920 - DNA, 16 bp, Homo sapiens
gaagaggcagattcaa

SEQ ID NO: 3728921 - DNA, 20 bp, Homo sapiens
gaagagggagaagcatgaaa

SEQ ID NO: 3728922 - DNA, 20 bp, Homo sapiens
gaagataatattaaggaaga

SEQ ID NO: 3728923 - DNA, 14 bp, Homo sapiens
gaagatagaagaaa

SEQ ID NO: 3728924 - DNA, 14 bp, Homo sapiens
gaagatatcttgaa

SEQ ID NO: 3728925 - DNA, 15 bp, Homo sapiens
gaagatgacttccca

SEQ ID NO: 3728926 - DNA, 15 bp, Homo sapiens
gaagatgtttcaaaa

SEQ ID NO: 3728927 - DNA, 18 bp, Homo sapiens
gaagattattttttatga

SEQ ID NO: 3728928 - DNA, 20 bp, Homo sapiens
gaagcaaaaacgaaagctgg

SEQ ID NO: 3728929 - DNA, 13 bp, Homo sapiens
gaagcaaacacat

SEQ ID NO: 3728930 - DNA, 15 bp, Homo sapiens
gaagcaaacacatta

SEQ ID NO: 3728931 - DNA, 18 bp, Homo sapiens
gaagcacagaaaactaga

SEQ ID NO: 3728932 - DNA, 20 bp, Homo sapiens
gaagcagatgcaaagaggca

SEQ ID NO: 3728933 - DNA, 22 bp, Homo sapiens
gaagcaggttgaggggctcctg

SEQ ID NO: 3728934 - DNA, 23 bp, Homo sapiens
gaagcaggttgaggggctcctgg

SEQ ID NO: 3728935 - DNA, 11 bp, Homo sapiens
gaagcatccag

SEQ ID NO: 3728936 - DNA, 13 bp, Homo sapiens
gaagcatgaaaaa

SEQ ID NO: 3728937 - DNA, 17 bp, Homo sapiens
gaagcatgtaggagaat

SEQ ID NO: 3728938 - DNA, 17 bp, Homo sapiens
gaagccacagcccaggc

SEQ ID NO: 3728939 - DNA, 19 bp, Homo sapiens
gaagccatctaaagtaaaa

SEQ ID NO: 3728940 - DNA, 15 bp, Homo sapiens
gaagcccaagtgaaa

SEQ ID NO: 3728941 - DNA, 14 bp, Homo sapiens
gaagcccaataaac

SEQ ID NO: 3728942 - DNA, 18 bp, Homo sapiens
gaagcccaataaacctct

SEQ ID NO: 3728943 - DNA, 19 bp, Homo sapiens
gaagcccaataaacctctt

SEQ ID NO: 3728944 - DNA, 12 bp, Homo sapiens
gaagcccagctc

SEQ ID NO: 3728945 - DNA, 20 bp, Homo sapiens
gaagcccagctccagggcca

SEQ ID NO: 3728946 - DNA, 11 bp, Homo sapiens
gaagccctcct

SEQ ID NO: 3728947 - DNA, 11 bp, Homo sapiens
gaagccctgga

SEQ ID NO: 3728948 - DNA, 19 bp, Homo sapiens
gaagccctggatttcagaa

SEQ ID NO: 3728949 - DNA, 16 bp, Homo sapiens
gaagccgccaggaccg

SEQ ID NO: 3728950 - DNA, 16 bp, Homo sapiens
gaagccgggaacagac

SEQ ID NO: 3728951 - DNA, 17 bp, Homo sapiens
gaagcctctggctagag

SEQ ID NO: 3728952 - DNA, 17 bp, Homo sapiens
gaagctaattattttaa

SEQ ID NO: 3728953 - DNA, 18 bp, Homo sapiens
gaagctaattattttaat

SEQ ID NO: 3728954 - DNA, 15 bp, Homo sapiens
gaagctactttgttt

SEQ ID NO: 3728955 - DNA, 15 bp, Homo sapiens
gaagctcagcccacc

SEQ ID NO: 3728956 - DNA, 11 bp, Homo sapiens
gaagctccagt

SEQ ID NO: 3728957 - DNA, 22 bp, Homo sapiens
gaagctccgctttctacccagc

SEQ ID NO: 3728958 - DNA, 18 bp, Homo sapiens
gaagctcttgaagacact

SEQ ID NO: 3728959 - DNA, 14 bp, Homo sapiens
gaagctgagcacca

SEQ ID NO: 3728960 - DNA, 17 bp, Homo sapiens
gaagctgagcaccaggg

SEQ ID NO: 3728961 - DNA, 16 bp, Homo sapiens
gaagctgccctgccca

SEQ ID NO: 3728962 - DNA, 13 bp, Homo sapiens
gaagctgctccgt

SEQ ID NO: 3728963 - DNA, 12 bp, Homo sapiens
gaagctgtgtcc

SEQ ID NO: 3728964 - DNA, 23 bp, Homo sapiens
gaagctgtgtccttgcacctgca

SEQ ID NO: 3728965 - DNA, 15 bp, Homo sapiens
gaagctttctctgct

SEQ ID NO: 3728966 - DNA, 21 bp, Homo sapiens
gaagctttctctgcttcagct

SEQ ID NO: 3728967 - DNA, 18 bp, Homo sapiens
gaaggaaaaggcagggag

SEQ ID NO: 3728968 - DNA, 20 bp, Homo sapiens
gaaggaaaaggcagggagcg

SEQ ID NO: 3728969 - DNA, 15 bp, Homo sapiens
gaaggaaagatgctc

SEQ ID NO: 3728970 - DNA, 17 bp, Homo sapiens
gaaggaaataaaaaagt

SEQ ID NO: 3728971 - DNA, 20 bp, Homo sapiens
gaaggaaatgaatttctcta

SEQ ID NO: 3728972 - DNA, 16 bp, Homo sapiens
gaaggaagtgaagagg

SEQ ID NO: 3728973 - DNA, 16 bp, Homo sapiens
gaaggacaaggctaga

SEQ ID NO: 3728974 - DNA, 15 bp, Homo sapiens
gaaggagactcacct

SEQ ID NO: 3728975 - DNA, 20 bp, Homo sapiens
gaaggagactcacctctgcc

SEQ ID NO: 3728976 - DNA, 15 bp, Homo sapiens
gaaggagagaagggg

SEQ ID NO: 3728977 - DNA, 16 bp, Homo sapiens
gaaggagagcctgctg

SEQ ID NO: 3728978 - DNA, 12 bp, Homo sapiens
gaaggaggagag

SEQ ID NO: 3728979 - DNA, 15 bp, Homo sapiens
gaaggatgtacattt

SEQ ID NO: 3728980 - DNA, 15 bp, Homo sapiens
gaaggcaaagcacga

SEQ ID NO: 3728981 - DNA, 18 bp, Homo sapiens
gaaggcatgcctggacaa

SEQ ID NO: 3728982 - DNA, 14 bp, Homo sapiens
gaaggccacagcaa

SEQ ID NO: 3728983 - DNA, 13 bp, Homo sapiens
gaaggccacctgc

SEQ ID NO: 3728984 - DNA, 14 bp, Homo sapiens
gaaggccacctgca

SEQ ID NO: 3728985 - DNA, 18 bp, Homo sapiens
gaaggccgagaagcaaga

SEQ ID NO: 3728986 - DNA, 23 bp, Homo sapiens
gaaggctttcagggcctccagcc

SEQ ID NO: 3728987 - DNA, 14 bp, Homo sapiens
gaagggccagtcct

SEQ ID NO: 3728988 - DNA, 18 bp, Homo sapiens
gaagggccagtcctgcct

SEQ ID NO: 3728989 - DNA, 19 bp, Homo sapiens
gaagggccagtcctgcctg

SEQ ID NO: 3728990 - DNA, 22 bp, Homo sapiens
gaagggccagtcctgcctggcc

SEQ ID NO: 3728991 - DNA, 15 bp, Homo sapiens
gaaggggaggagggc

SEQ ID NO: 3728992 - DNA, 12 bp, Homo sapiens
gaaggggctgga

SEQ ID NO: 3728993 - DNA, 21 bp, Homo sapiens
gaagggtttgtggctgggggc

SEQ ID NO: 3728994 - DNA, 13 bp, Homo sapiens
gaaggtaaaattg

SEQ ID NO: 3728995 - DNA, 17 bp, Homo sapiens
gaaggtcacctgagccc

SEQ ID NO: 3728996 - DNA, 17 bp, Homo sapiens
gaaggtcttgatttgtt

SEQ ID NO: 3728997 - DNA, 22 bp, Homo sapiens
gaaggtgtctggacattcagaa

SEQ ID NO: 3728998 - DNA, 20 bp, Homo sapiens
gaagtaacttgtcttaaata

SEQ ID NO: 3728999 - DNA, 15 bp, Homo sapiens
gaagtcaaacatttc

SEQ ID NO: 3729000 - DNA, 15 bp, Homo sapiens
gaagtcactgcacag

SEQ ID NO: 3729001 - DNA, 17 bp, Homo sapiens
gaagtccccaggcccca

SEQ ID NO: 3729002 - DNA, 22 bp, Homo sapiens
gaagtctaggagctgggaggaa

SEQ ID NO: 3729003 - DNA, 18 bp, Homo sapiens
gaagtcttagatgtatat

SEQ ID NO: 3729004 - DNA, 21 bp, Homo sapiens
gaagtgacaaggccccagaga

SEQ ID NO: 3729005 - DNA, 24 bp, Homo sapiens
gaagtgacaaggccccagagactc

SEQ ID NO: 3729006 - DNA, 15 bp, Homo sapiens
gaagtgcccctgctg

SEQ ID NO: 3729007 - DNA, 21 bp, Homo sapiens
gaagtgggccaggacaggccc

SEQ ID NO: 3729008 - DNA, 15 bp, Homo sapiens
gaagtggggacagag

SEQ ID NO: 3729009 - DNA, 16 bp, Homo sapiens
gaagtgtaacagctga

SEQ ID NO: 3729010 - DNA, 18 bp, Homo sapiens
gaagtgtaacagctgagg

SEQ ID NO: 3729011 - DNA, 14 bp, Homo sapiens
gaagtttcatttat

SEQ ID NO: 3729012 - DNA, 15 bp, Homo sapiens
gaagtttcatttatg

SEQ ID NO: 3729013 - DNA, 20 bp, Homo sapiens
gaagtttgagatcagcctgg

SEQ ID NO: 3729014 - DNA, 13 bp, Homo sapiens
gaagttttcagga

SEQ ID NO: 3729015 - DNA, 14 bp, Homo sapiens
gaataaagttctga

SEQ ID NO: 3729016 - DNA, 23 bp, Homo sapiens
gaataaccacttaaaaaatgtcc

SEQ ID NO: 3729017 - DNA, 12 bp, Homo sapiens
gaataaggcctt

SEQ ID NO: 3729018 - DNA, 22 bp, Homo sapiens
gaataataattatccagagttt

SEQ ID NO: 3729019 - DNA, 12 bp, Homo sapiens
gaataatagaag

SEQ ID NO: 3729020 - DNA, 17 bp, Homo sapiens
gaataatgtgggaagaa

SEQ ID NO: 3729021 - DNA, 20 bp, Homo sapiens
gaataatgtgggaagaaaca

SEQ ID NO: 3729022 - DNA, 14 bp, Homo sapiens
gaatagaaggaaac

SEQ ID NO: 3729023 - DNA, 20 bp, Homo sapiens
gaatagaaggaaactagctt

SEQ ID NO: 3729024 - DNA, 14 bp, Homo sapiens
gaatagctgggact

SEQ ID NO: 3729025 - DNA, 22 bp, Homo sapiens
gaatagctgggactacaggtgt

SEQ ID NO: 3729026 - DNA, 17 bp, Homo sapiens
gaatatgacggaagaac

SEQ ID NO: 3729027 - DNA, 21 bp, Homo sapiens
gaatattagctttactgtttg

SEQ ID NO: 3729028 - DNA, 16 bp, Homo sapiens
gaatatttataacagc

SEQ ID NO: 3729029 - DNA, 17 bp, Homo sapiens
gaatatttattacctct

SEQ ID NO: 3729030 - DNA, 18 bp, Homo sapiens
gaatatttattacctctg

SEQ ID NO: 3729031 - DNA, 13 bp, Homo sapiens
gaatcaaaactct

SEQ ID NO: 3729032 - DNA, 14 bp, Homo sapiens
gaatcaacagggca

SEQ ID NO: 3729033 - DNA, 18 bp, Homo sapiens
gaatcagcctacaggcct

SEQ ID NO: 3729034 - DNA, 15 bp, Homo sapiens
gaatcagtgcaaaga

SEQ ID NO: 3729035 - DNA, 21 bp, Homo sapiens
gaatcattatttattaaattt

SEQ ID NO: 3729036 - DNA, 20 bp, Homo sapiens
gaatcattgtaaacattagt

SEQ ID NO: 3729037 - DNA, 18 bp, Homo sapiens
gaatccagacccggctgc

SEQ ID NO: 3729038 - DNA, 20 bp, Homo sapiens
gaatccagacccggctgcgt

SEQ ID NO: 3729039 - DNA, 17 bp, Homo sapiens
gaatccctgttcattgt

SEQ ID NO: 3729040 - DNA, 20 bp, Homo sapiens
gaatcctaggctccacccca

SEQ ID NO: 3729041 - DNA, 14 bp, Homo sapiens
gaatcgaggaacca

SEQ ID NO: 3729042 - DNA, 18 bp, Homo sapiens
gaatcgaggaaccagagc

SEQ ID NO: 3729043 - DNA, 15 bp, Homo sapiens
gaatcggaatctctg

SEQ ID NO: 3729044 - DNA, 14 bp, Homo sapiens
gaatctagaagaaa

SEQ ID NO: 3729045 - DNA, 16 bp, Homo sapiens
gaatctagaagaaatg

SEQ ID NO: 3729046 - DNA, 19 bp, Homo sapiens
gaatctagaagaaatgaaa

SEQ ID NO: 3729047 - DNA, 15 bp, Homo sapiens
gaatgaaaaatttaa

SEQ ID NO: 3729048 - DNA, 19 bp, Homo sapiens
gaatgaaagggcccagaga

SEQ ID NO: 3729049 - DNA, 20 bp, Homo sapiens
gaatgaaagtcttgtgacta

SEQ ID NO: 3729050 - DNA, 23 bp, Homo sapiens
gaatgaaagtcttgtgactagtg

SEQ ID NO: 3729051 - DNA, 13 bp, Homo sapiens
gaatgaggaggaa

SEQ ID NO: 3729052 - DNA, 18 bp, Homo sapiens
gaatgaggtcccaggcag

SEQ ID NO: 3729053 - DNA, 21 bp, Homo sapiens
gaatgaggtcccaggcagaga

SEQ ID NO: 3729054 - DNA, 20 bp, Homo sapiens
gaatgatgatcctaggcatt

SEQ ID NO: 3729055 - DNA, 14 bp, Homo sapiens
gaatgatttcatgc

SEQ ID NO: 3729056 - DNA, 16 bp, Homo sapiens
gaatgatttccaaaga

SEQ ID NO: 3729057 - DNA, 20 bp, Homo sapiens
gaatgcacactagcctctcc

SEQ ID NO: 3729058 - DNA, 12 bp, Homo sapiens
gaatgcctgtgc

SEQ ID NO: 3729059 - DNA, 13 bp, Homo sapiens
gaatgcctgtgcc

SEQ ID NO: 3729060 - DNA, 14 bp, Homo sapiens
gaatgcctgtgcca

SEQ ID NO: 3729061 - DNA, 13 bp, Homo sapiens
gaatgctccccca

SEQ ID NO: 3729062 - DNA, 23 bp, Homo sapiens
gaatgctcccccatcctcccctt

SEQ ID NO: 3729063 - DNA, 17 bp, Homo sapiens
gaatgctggttttccta

SEQ ID NO: 3729064 - DNA, 15 bp, Homo sapiens
gaatgctgtatatgt

SEQ ID NO: 3729065 - DNA, 13 bp, Homo sapiens
gaatgcttggaat

SEQ ID NO: 3729066 - DNA, 16 bp, Homo sapiens
gaatggaaagcggagt

SEQ ID NO: 3729067 - DNA, 17 bp, Homo sapiens
gaatggcctgccttgaa

SEQ ID NO: 3729068 - DNA, 13 bp, Homo sapiens
gaatggtagtcta

SEQ ID NO: 3729069 - DNA, 13 bp, Homo sapiens
gaatgtaatcaat

SEQ ID NO: 3729070 - DNA, 16 bp, Homo sapiens
gaatgtaatcaatgtt

SEQ ID NO: 3729071 - DNA, 18 bp, Homo sapiens
gaatgtaatcaatgtttc

SEQ ID NO: 3729072 - DNA, 19 bp, Homo sapiens
gaatgtaatcaatgtttct

SEQ ID NO: 3729073 - DNA, 14 bp, Homo sapiens
gaatgtaatttgtg

SEQ ID NO: 3729074 - DNA, 20 bp, Homo sapiens
gaatgtaatttgtgtaataa

SEQ ID NO: 3729075 - DNA, 16 bp, Homo sapiens
gaatgtatcaggaaat

SEQ ID NO: 3729076 - DNA, 17 bp, Homo sapiens
gaatgtattattctgca

SEQ ID NO: 3729077 - DNA, 16 bp, Homo sapiens
gaatgttaaagtcagt

SEQ ID NO: 3729078 - DNA, 21 bp, Homo sapiens
gaatgtttacactctttgtaa

SEQ ID NO: 3729079 - DNA, 20 bp, Homo sapiens
gaattaaataaacccttcct

SEQ ID NO: 3729080 - DNA, 21 bp, Homo sapiens
gaattaaattaggaataaata

SEQ ID NO: 3729081 - DNA, 13 bp, Homo sapiens
gaattaaatttaa

SEQ ID NO: 3729082 - DNA, 18 bp, Homo sapiens
gaattaacctggtgctgg

SEQ ID NO: 3729083 - DNA, 22 bp, Homo sapiens
gaattaacctggtgctggatat

SEQ ID NO: 3729084 - DNA, 19 bp, Homo sapiens
gaattaatgacagagccag

SEQ ID NO: 3729085 - DNA, 16 bp, Homo sapiens
gaattcattctggtct

SEQ ID NO: 3729086 - DNA, 18 bp, Homo sapiens
gaattctgctacctcact

SEQ ID NO: 3729087 - DNA, 19 bp, Homo sapiens
gaattctgttcatttgtta

SEQ ID NO: 3729088 - DNA, 22 bp, Homo sapiens
gaattcttacatgttttctttg

SEQ ID NO: 3729089 - DNA, 15 bp, Homo sapiens
gaattgaacccagga

SEQ ID NO: 3729090 - DNA, 14 bp, Homo sapiens
gaattgaagcagga

SEQ ID NO: 3729091 - DNA, 22 bp, Homo sapiens
gaattgaatcgctgcgatactg

SEQ ID NO: 3729092 - DNA, 23 bp, Homo sapiens
gaattgataataaactgtcctct

SEQ ID NO: 3729093 - DNA, 16 bp, Homo sapiens
gaattgcaattttaac

SEQ ID NO: 3729094 - DNA, 17 bp, Homo sapiens
gaattgcttgaacctgg

SEQ ID NO: 3729095 - DNA, 24 bp, Homo sapiens
gaattgcttgtttgcttcaactgt

SEQ ID NO: 3729096 - DNA, 22 bp, Homo sapiens
gaattggaccatcctatttaac

SEQ ID NO: 3729097 - DNA, 18 bp, Homo sapiens
gaatttaacaatgcgaat

SEQ ID NO: 3729098 - DNA, 22 bp, Homo sapiens
gaatttaacaatgcgaatggta

SEQ ID NO: 3729099 - DNA, 23 bp, Homo sapiens
gaatttattcaattcctctggga

SEQ ID NO: 3729100 - DNA, 12 bp, Homo sapiens
gaatttctaaaa

SEQ ID NO: 3729101 - DNA, 14 bp, Homo sapiens
gaatttgaatctca

SEQ ID NO: 3729102 - DNA, 16 bp, Homo sapiens
gaatttgaatgaaaaa

SEQ ID NO: 3729103 - DNA, 23 bp, Homo sapiens
gaatttgatcgttccagttccca

SEQ ID NO: 3729104 - DNA, 19 bp, Homo sapiens
gaatttggagactctgtgg

SEQ ID NO: 3729105 - DNA, 17 bp, Homo sapiens
gaattttcaagcatctc

SEQ ID NO: 3729106 - DNA, 14 bp, Homo sapiens
gaattttcagaccc

SEQ ID NO: 3729107 - DNA, 23 bp, Homo sapiens
gaattttctttgtgtagctttgc

SEQ ID NO: 3729108 - DNA, 22 bp, Homo sapiens
gaattttgtttggacttctttt

SEQ ID NO: 3729109 - DNA, 19 bp, Homo sapiens
gaatttttattatgcataa

SEQ ID NO: 3729110 - DNA, 18 bp, Homo sapiens
gaattttttattcttgtg

SEQ ID NO: 3729111 - DNA, 22 bp, Homo sapiens
gaattttttattcttgtgaata

SEQ ID NO: 3729112 - DNA, 16 bp, Homo sapiens
gaatttttttcatctt

SEQ ID NO: 3729113 - DNA, 16 bp, Homo sapiens
gacaaaaacagcctca

SEQ ID NO: 3729114 - DNA, 20 bp, Homo sapiens
gacaaaaacagcctcacaga

SEQ ID NO: 3729115 - DNA, 13 bp, Homo sapiens
gacaaaaatactc

SEQ ID NO: 3729116 - DNA, 17 bp, Homo sapiens
gacaaaaattatctatt

SEQ ID NO: 3729117 - DNA, 19 bp, Homo sapiens
gacaaacacctcccaggag

SEQ ID NO: 3729118 - DNA, 22 bp, Homo sapiens
gacaaacacctcccaggagaca

SEQ ID NO: 3729119 - DNA, 14 bp, Homo sapiens
gacaaagacaaatt

SEQ ID NO: 3729120 - DNA, 20 bp, Homo sapiens
gacaaagccaaactctgcca

SEQ ID NO: 3729121 - DNA, 16 bp, Homo sapiens
gacaaagctgctaaat

SEQ ID NO: 3729122 - DNA, 14 bp, Homo sapiens
gacaaagtctccag

SEQ ID NO: 3729123 - DNA, 16 bp, Homo sapiens
gacaaagtctccagcc

SEQ ID NO: 3729124 - DNA, 21 bp, Homo sapiens
gacaaatgctgcgcccttccc

SEQ ID NO: 3729125 - DNA, 14 bp, Homo sapiens
gacaaattctgttt

SEQ ID NO: 3729126 - DNA, 20 bp, Homo sapiens
gacaaatttaaaacaaacaa

SEQ ID NO: 3729127 - DNA, 12 bp, Homo sapiens
gacaacagaagt

SEQ ID NO: 3729128 - DNA, 17 bp, Homo sapiens
gacaacagaagtcatga

SEQ ID NO: 3729129 - DNA, 18 bp, Homo sapiens
gacaaccaccgctcccca

SEQ ID NO: 3729130 - DNA, 23 bp, Homo sapiens
gacaaccaccgctccccagccca

SEQ ID NO: 3729131 - DNA, 20 bp, Homo sapiens
gacaaccctgcaaaggactg

SEQ ID NO: 3729132 - DNA, 19 bp, Homo sapiens
gacaaccgatgctccagcc

SEQ ID NO: 3729133 - DNA, 20 bp, Homo sapiens
gacaaccgatgctccagcca

SEQ ID NO: 3729134 - DNA, 14 bp, Homo sapiens
gacaacgaggaagc

SEQ ID NO: 3729135 - DNA, 16 bp, Homo sapiens
gacaacgaggaagccc

SEQ ID NO: 3729136 - DNA, 15 bp, Homo sapiens
gacaagccccaggca

SEQ ID NO: 3729137 - DNA, 13 bp, Homo sapiens
gacaaggccccag

SEQ ID NO: 3729138 - DNA, 23 bp, Homo sapiens
gacaaggccccagagactcagag

SEQ ID NO: 3729139 - DNA, 22 bp, Homo sapiens
gacaaggttcttcccttttaca

SEQ ID NO: 3729140 - DNA, 19 bp, Homo sapiens
gacaagtgactgtatctgt

SEQ ID NO: 3729141 - DNA, 20 bp, Homo sapiens
gacaagtgactgtatctgtg

SEQ ID NO: 3729142 - DNA, 13 bp, Homo sapiens
gacaataatttca

SEQ ID NO: 3729143 - DNA, 17 bp, Homo sapiens
gacaatcaactctaata

SEQ ID NO: 3729144 - DNA, 12 bp, Homo sapiens
gacaatgtgaaa

SEQ ID NO: 3729145 - DNA, 23 bp, Homo sapiens
gacaattcctagataaaaagatg

SEQ ID NO: 3729146 - DNA, 16 bp, Homo sapiens
gacacaaaaagtagat

SEQ ID NO: 3729147 - DNA, 12 bp, Homo sapiens
gacacacacaca

SEQ ID NO: 3729148 - DNA, 15 bp, Homo sapiens
gacacacagctctgt

SEQ ID NO: 3729149 - DNA, 14 bp, Homo sapiens
gacacagctcttct

SEQ ID NO: 3729150 - DNA, 19 bp, Homo sapiens
gacacagctcttctccagg

SEQ ID NO: 3729151 - DNA, 20 bp, Homo sapiens
gacacagctcttctccaggc

SEQ ID NO: 3729152 - DNA, 23 bp, Homo sapiens
gacacagctcttctccaggctgt

SEQ ID NO: 3729153 - DNA, 19 bp, Homo sapiens
gacaccaggagtccctggt

SEQ ID NO: 3729154 - DNA, 17 bp, Homo sapiens
gacacctgcacctcccc

SEQ ID NO: 3729155 - DNA, 20 bp, Homo sapiens
gacacctgcacctcccccca

SEQ ID NO: 3729156 - DNA, 16 bp, Homo sapiens
gacacctgtactggag

SEQ ID NO: 3729157 - DNA, 20 bp, Homo sapiens
gacaccttgacagggcacac

SEQ ID NO: 3729158 - DNA, 18 bp, Homo sapiens
gacactaaccacgctgga

SEQ ID NO: 3729159 - DNA, 16 bp, Homo sapiens
gacactagaagatttt

SEQ ID NO: 3729160 - DNA, 23 bp, Homo sapiens
gacactgaaatatacacacagca

SEQ ID NO: 3729161 - DNA, 12 bp, Homo sapiens
gacactgaaatg

SEQ ID NO: 3729162 - DNA, 13 bp, Homo sapiens
gacactgatgggc

SEQ ID NO: 3729163 - DNA, 19 bp, Homo sapiens
gacactgtttacaagaaaa

SEQ ID NO: 3729164 - DNA, 22 bp, Homo sapiens
gacactgtttacaagaaaaaat

SEQ ID NO: 3729165 - DNA, 20 bp, Homo sapiens
gacacttcagagagctggta

SEQ ID NO: 3729166 - DNA, 14 bp, Homo sapiens
gacagacacaggcc

SEQ ID NO: 3729167 - DNA, 15 bp, Homo sapiens
gacagacacaggccc

SEQ ID NO: 3729168 - DNA, 21 bp, Homo sapiens
gacagagcaagtgagaccctg

SEQ ID NO: 3729169 - DNA, 14 bp, Homo sapiens
gacagaggcagccc

SEQ ID NO: 3729170 - DNA, 16 bp, Homo sapiens
gacagagggaagaaaa

SEQ ID NO: 3729171 - DNA, 14 bp, Homo sapiens
gacagagtctcact

SEQ ID NO: 3729172 - DNA, 21 bp, Homo sapiens
gacagagtctcactgttgccc

SEQ ID NO: 3729173 - DNA, 13 bp, Homo sapiens
gacagagtctggg

SEQ ID NO: 3729174 - DNA, 16 bp, Homo sapiens
gacagagtgagactct

SEQ ID NO: 3729175 - DNA, 20 bp, Homo sapiens
gacagagtgagactctgtct

SEQ ID NO: 3729176 - DNA, 22 bp, Homo sapiens
gacagagtgagactctgtctca

SEQ ID NO: 3729177 - DNA, 21 bp, Homo sapiens
gacagagttcactataaatgg

SEQ ID NO: 3729178 - DNA, 13 bp, Homo sapiens
gacagataactct

SEQ ID NO: 3729179 - DNA, 23 bp, Homo sapiens
gacagatctctgctttggaaatc

SEQ ID NO: 3729180 - DNA, 14 bp, Homo sapiens
gacagatgccccag

SEQ ID NO: 3729181 - DNA, 18 bp, Homo sapiens
gacagatgccccagagct

SEQ ID NO: 3729182 - DNA, 19 bp, Homo sapiens
gacagcaaaaccattgctt

SEQ ID NO: 3729183 - DNA, 21 bp, Homo sapiens
gacagcaaaaccattgcttca

SEQ ID NO: 3729184 - DNA, 13 bp, Homo sapiens
gacagcagctcag

SEQ ID NO: 3729185 - DNA, 18 bp, Homo sapiens
gacagcatggtgcatgcc

SEQ ID NO: 3729186 - DNA, 18 bp, Homo sapiens
gacagccacggccaggcc

SEQ ID NO: 3729187 - DNA, 14 bp, Homo sapiens
ggaggatggagaga

SEQ ID NO: 3729188 - DNA, 20 bp, Homo sapiens
ggaggattgcttgagcccag

SEQ ID NO: 3729189 - DNA, 18 bp, Homo sapiens
ggaggccaagtgcaggct

SEQ ID NO: 3729190 - DNA, 20 bp, Homo sapiens
ggaggccaagtgcaggctgg

SEQ ID NO: 3729191 - DNA, 12 bp, Homo sapiens
ggaggccagcca

SEQ ID NO: 3729192 - DNA, 13 bp, Homo sapiens
ggaggccagccag

SEQ ID NO: 3729193 - DNA, 17 bp, Homo sapiens
ggaggccccactgggga

SEQ ID NO: 3729194 - DNA, 16 bp, Homo sapiens
ggaggctatgtggagt

SEQ ID NO: 3729195 - DNA, 20 bp, Homo sapiens
ggaggctggaggaagggggg

SEQ ID NO: 3729196 - DNA, 22 bp, Homo sapiens
ggaggcttgtcagagctgggag

SEQ ID NO: 3729197 - DNA, 17 bp, Homo sapiens
ggagggaattgaggtct

SEQ ID NO: 3729198 - DNA, 13 bp, Homo sapiens
ggagggagatgga

SEQ ID NO: 3729199 - DNA, 13 bp, Homo sapiens
ggaggggacgctg

SEQ ID NO: 3729200 - DNA, 12 bp, Homo sapiens
ggaggggagctc

SEQ ID NO: 3729201 - DNA, 18 bp, Homo sapiens
ggaggggcctggcagccg

SEQ ID NO: 3729202 - DNA, 16 bp, Homo sapiens
ggagggtcaggaagga

SEQ ID NO: 3729203 - DNA, 20 bp, Homo sapiens
ggaggtagaggttgtggtga

SEQ ID NO: 3729204 - DNA, 20 bp, Homo sapiens
ggaggtttaggtcaagaaga

SEQ ID NO: 3729205 - DNA, 13 bp, Homo sapiens
ggagtacctgctg

SEQ ID NO: 3729206 - DNA, 20 bp, Homo sapiens
ggagtagacccctggctggt

SEQ ID NO: 3729207 - DNA, 13 bp, Homo sapiens
ggagtatctggga

SEQ ID NO: 3729208 - DNA, 14 bp, Homo sapiens
ggagtatctgggaa

SEQ ID NO: 3729209 - DNA, 21 bp, Homo sapiens
ggagtcccaccttggctgcag

SEQ ID NO: 3729210 - DNA, 18 bp, Homo sapiens
ggagtgacagaggcagcc

SEQ ID NO: 3729211 - DNA, 12 bp, Homo sapiens
ggagtgagctgg

SEQ ID NO: 3729212 - DNA, 18 bp, Homo sapiens
ggagtgaggcaggtgaca

SEQ ID NO: 3729213 - DNA, 18 bp, Homo sapiens
ggagtgggacagagtctg

SEQ ID NO: 3729214 - DNA, 17 bp, Homo sapiens
ggagtgtgtattgttcc

SEQ ID NO: 3729215 - DNA, 15 bp, Homo sapiens
ggagtgtttcatggg

SEQ ID NO: 3729216 - DNA, 18 bp, Homo sapiens
ggagttagaggccagcct

SEQ ID NO: 3729217 - DNA, 21 bp, Homo sapiens
ggagttagaggccagcctggc

SEQ ID NO: 3729218 - DNA, 21 bp, Homo sapiens
ggagttcaagaccagcctggc

SEQ ID NO: 3729219 - DNA, 21 bp, Homo sapiens
ggagttcgaggctgcagtcag

SEQ ID NO: 3729220 - DNA, 19 bp, Homo sapiens
ggagtttaagaccagcctg

SEQ ID NO: 3729221 - DNA, 19 bp, Homo sapiens
ggagtttcctaaaagttca

SEQ ID NO: 3729222 - DNA, 15 bp, Homo sapiens
ggataaaatgaggtt

SEQ ID NO: 3729223 - DNA, 15 bp, Homo sapiens
ggatactggcaaagc

SEQ ID NO: 3729224 - DNA, 19 bp, Homo sapiens
ggatagataactctttgga

SEQ ID NO: 3729225 - DNA, 17 bp, Homo sapiens
ggatagtcaccttttaa

SEQ ID NO: 3729226 - DNA, 18 bp, Homo sapiens
ggatagtcaccttttaaa

SEQ ID NO: 3729227 - DNA, 17 bp, Homo sapiens
ggatcacttgagcccag

SEQ ID NO: 3729228 - DNA, 17 bp, Homo sapiens
ggatctcccagggctac

SEQ ID NO: 3729229 - DNA, 18 bp, Homo sapiens
ggatctcttgagcctggg

SEQ ID NO: 3729230 - DNA, 15 bp, Homo sapiens
ggatctgactgcacg

SEQ ID NO: 3729231 - DNA, 23 bp, Homo sapiens
ggatctgggaccctttccttcct

SEQ ID NO: 3729232 - DNA, 15 bp, Homo sapiens
ggatctgtgcccaga

SEQ ID NO: 3729233 - DNA, 16 bp, Homo sapiens
ggatctgtgcccagag

SEQ ID NO: 3729234 - DNA, 20 bp, Homo sapiens
ggatctttcacccacagaaa

SEQ ID NO: 3729235 - DNA, 20 bp, Homo sapiens
ggatgacatgtccctacacc

SEQ ID NO: 3729236 - DNA, 18 bp, Homo sapiens
ggatgaggtgctgggagg

SEQ ID NO: 3729237 - DNA, 15 bp, Homo sapiens
ggatgatgcctcatg

SEQ ID NO: 3729238 - DNA, 18 bp, Homo sapiens
ggatgccatctgtgggca

SEQ ID NO: 3729239 - DNA, 17 bp, Homo sapiens
ggatgcctggtggcagc

SEQ ID NO: 3729240 - DNA, 19 bp, Homo sapiens
ggatgcctggtggcagctg

SEQ ID NO: 3729241 - DNA, 21 bp, Homo sapiens
ggatgcctggtggcagctgcg

SEQ ID NO: 3729242 - DNA, 21 bp, Homo sapiens
ggatgcttgcctagggcctgg

SEQ ID NO: 3729243 - DNA, 19 bp, Homo sapiens
ggatggaaaaggaagacta

SEQ ID NO: 3729244 - DNA, 16 bp, Homo sapiens
ggatggagagagggga

SEQ ID NO: 3729245 - DNA, 14 bp, Homo sapiens
ggatggaggagaag

SEQ ID NO: 3729246 - DNA, 17 bp, Homo sapiens
ggacagcatggtgcatg

SEQ ID NO: 3729247 - DNA, 19 bp, Homo sapiens
ggacagcatggtgcatgcc

SEQ ID NO: 3729248 - DNA, 14 bp, Homo sapiens
ggacagcccactga

SEQ ID NO: 3729249 - DNA, 16 bp, Homo sapiens
ggacagctccttctgt

SEQ ID NO: 3729250 - DNA, 19 bp, Homo sapiens
ggacagctccttctgtcct

SEQ ID NO: 3729251 - DNA, 17 bp, Homo sapiens
ggacaggcagaaagagt

SEQ ID NO: 3729252 - DNA, 11 bp, Homo sapiens
ggacaggcccg

SEQ ID NO: 3729253 - DNA, 13 bp, Homo sapiens
ggacagtcctggg

SEQ ID NO: 3729254 - DNA, 14 bp, Homo sapiens
ggacagtcctggga

SEQ ID NO: 3729255 - DNA, 21 bp, Homo sapiens
ggacagtgcttcagcctgagg

SEQ ID NO: 3729256 - DNA, 23 bp, Homo sapiens
ggacagtgcttcagcctgaggct

SEQ ID NO: 3729257 - DNA, 13 bp, Homo sapiens
ggaccaaagctga

SEQ ID NO: 3729258 - DNA, 22 bp, Homo sapiens
ggaccacaaaaatgaaagcatg

SEQ ID NO: 3729259 - DNA, 17 bp, Homo sapiens
ggaccaggactccctcc

SEQ ID NO: 3729260 - DNA, 20 bp, Homo sapiens
ggacccggaggggcctggca

SEQ ID NO: 3729261 - DNA, 20 bp, Homo sapiens
ggaccctcgctggcccccac

SEQ ID NO: 3729262 - DNA, 17 bp, Homo sapiens
ggaccctttccttcctt

SEQ ID NO: 3729263 - DNA, 17 bp, Homo sapiens
ggaccggtacagaaagg

SEQ ID NO: 3729264 - DNA, 14 bp, Homo sapiens
ggacctctgggctt

SEQ ID NO: 3729265 - DNA, 17 bp, Homo sapiens
ggaccttgaactgggta

SEQ ID NO: 3729266 - DNA, 22 bp, Homo sapiens
ggacggcctgatgctccctccc

SEQ ID NO: 3729267 - DNA, 22 bp, Homo sapiens
ggacgtcctgccacctggggca

SEQ ID NO: 3729268 - DNA, 14 bp, Homo sapiens
ggactacaggtgtg

SEQ ID NO: 3729269 - DNA, 16 bp, Homo sapiens
ggactcaatgcactga

SEQ ID NO: 3729270 - DNA, 16 bp, Homo sapiens
ggactcactggcagcc

SEQ ID NO: 3729271 - DNA, 19 bp, Homo sapiens
ggactcactggcagcccca

SEQ ID NO: 3729272 - DNA, 15 bp, Homo sapiens
ggactcagccctgag

SEQ ID NO: 3729273 - DNA, 16 bp, Homo sapiens
ggactcagccctgagg

SEQ ID NO: 3729274 - DNA, 17 bp, Homo sapiens
ggactcaggatgcccag

SEQ ID NO: 3729275 - DNA, 22 bp, Homo sapiens
ggactccagatctgcaccgccg

SEQ ID NO: 3729276 - DNA, 11 bp, Homo sapiens
ggactctcccc

SEQ ID NO: 3729277 - DNA, 14 bp, Homo sapiens
ggactgaagcctgc

SEQ ID NO: 3729278 - DNA, 16 bp, Homo sapiens
ggactgaagcctgcag

SEQ ID NO: 3729279 - DNA, 19 bp, Homo sapiens
ggactgaattgtccccagt

SEQ ID NO: 3729280 - DNA, 18 bp, Homo sapiens
ggactgccccgtgcagac

SEQ ID NO: 3729281 - DNA, 20 bp, Homo sapiens
ggactggctagagtcctcac

SEQ ID NO: 3729282 - DNA, 15 bp, Homo sapiens
ggactggctgtcctt

SEQ ID NO: 3729283 - DNA, 21 bp, Homo sapiens
ggactggctttgtcccacagc

SEQ ID NO: 3729284 - DNA, 19 bp, Homo sapiens
ggactggtggcccctgcct

SEQ ID NO: 3729285 - DNA, 20 bp, Homo sapiens
ggactgttttttcctgagct

SEQ ID NO: 3729286 - DNA, 21 bp, Homo sapiens
ggactttccaccccctccctg

SEQ ID NO: 3729287 - DNA, 21 bp, Homo sapiens
ggactttcttttcgccgtggc

SEQ ID NO: 3729288 - DNA, 15 bp, Homo sapiens
ggagaaacagagaca

SEQ ID NO: 3729289 - DNA, 16 bp, Homo sapiens
ggagaaacagagacag

SEQ ID NO: 3729290 - DNA, 19 bp, Homo sapiens
ggagaaacccttgaaaaga

SEQ ID NO: 3729291 - DNA, 14 bp, Homo sapiens
ggagaagggatgga

SEQ ID NO: 3729292 - DNA, 22 bp, Homo sapiens
ggagaagtcttagacttgaaat

SEQ ID NO: 3729293 - DNA, 16 bp, Homo sapiens
ggagaataattctttg

SEQ ID NO: 3729294 - DNA, 13 bp, Homo sapiens
ggagacagtgatc

SEQ ID NO: 3729295 - DNA, 19 bp, Homo sapiens
ggagaccaagtcctggcta

SEQ ID NO: 3729296 - DNA, 12 bp, Homo sapiens
ggagacctgtgc

SEQ ID NO: 3729297 - DNA, 14 bp, Homo sapiens
ggagacctgtgcta

SEQ ID NO: 3729298 - DNA, 15 bp, Homo sapiens
ggagacctgtgctag

SEQ ID NO: 3729299 - DNA, 14 bp, Homo sapiens
ggagactagattgc

SEQ ID NO: 3729300 - DNA, 15 bp, Homo sapiens
gctgttgcctcatct

SEQ ID NO: 3729301 - DNA, 22 bp, Homo sapiens
gctgttggctgggggcctcagt

SEQ ID NO: 3729302 - DNA, 18 bp, Homo sapiens
gctgttgtcattgcttta

SEQ ID NO: 3729303 - DNA, 16 bp, Homo sapiens
gctgtttatggcctca

SEQ ID NO: 3729304 - DNA, 13 bp, Homo sapiens
gcttagacctcag

SEQ ID NO: 3729305 - DNA, 15 bp, Homo sapiens
gcttagacctcagcc

SEQ ID NO: 3729306 - DNA, 13 bp, Homo sapiens
gcttatcaatttg

SEQ ID NO: 3729307 - DNA, 16 bp, Homo sapiens
gcttatcaatttgtca

SEQ ID NO: 3729308 - DNA, 21 bp, Homo sapiens
gcttatgaatatttataacag

SEQ ID NO: 3729309 - DNA, 13 bp, Homo sapiens
gcttattgttcca

SEQ ID NO: 3729310 - DNA, 11 bp, Homo sapiens
gcttatttaat

SEQ ID NO: 3729311 - DNA, 22 bp, Homo sapiens
gcttcaagtctgtgcctggagc

SEQ ID NO: 3729312 - DNA, 17 bp, Homo sapiens
gcttcacggaagagcct

SEQ ID NO: 3729313 - DNA, 17 bp, Homo sapiens
gcttcagcatatttata

SEQ ID NO: 3729314 - DNA, 14 bp, Homo sapiens
gcttcagccaggag

SEQ ID NO: 3729315 - DNA, 17 bp, Homo sapiens
gcttcagcctccccacc

SEQ ID NO: 3729316 - DNA, 23 bp, Homo sapiens
gcttcagcctgaggctgagactg

SEQ ID NO: 3729317 - DNA, 14 bp, Homo sapiens
gcttcagtggcagc

SEQ ID NO: 3729318 - DNA, 17 bp, Homo sapiens
gcttcatgcctttgtaa

SEQ ID NO: 3729319 - DNA, 13 bp, Homo sapiens
gcttcatttcctg

SEQ ID NO: 3729320 - DNA, 18 bp, Homo sapiens
gcttcatttcctgtgtct

SEQ ID NO: 3729321 - DNA, 17 bp, Homo sapiens
gcttccatttgtgtgtg

SEQ ID NO: 3729322 - DNA, 20 bp, Homo sapiens
gcttccatttgtgtgtgtgc

SEQ ID NO: 3729323 - DNA, 15 bp, Homo sapiens
gcttcccccatagcc

SEQ ID NO: 3729324 - DNA, 16 bp, Homo sapiens
gcttcccctctctcct

SEQ ID NO: 3729325 - DNA, 17 bp, Homo sapiens
gcttcccgctcagccct

SEQ ID NO: 3729326 - DNA, 20 bp, Homo sapiens
gcttccctctgcctgtccct

SEQ ID NO: 3729327 - DNA, 22 bp, Homo sapiens
gcttccttggcatcacagggca

SEQ ID NO: 3729328 - DNA, 23 bp, Homo sapiens
gcttcctttgtttttttttcctg

SEQ ID NO: 3729329 - DNA, 21 bp, Homo sapiens
gcttcgaggcccagcgacctc

SEQ ID NO: 3729330 - DNA, 16 bp, Homo sapiens
gcttctgacctcagca

SEQ ID NO: 3729331 - DNA, 15 bp, Homo sapiens
gcttctgatgaatct

SEQ ID NO: 3729332 - DNA, 17 bp, Homo sapiens
gcttctgatgaatcttg

SEQ ID NO: 3729333 - DNA, 18 bp, Homo sapiens
gcttctgatgaatcttgc

SEQ ID NO: 3729334 - DNA, 16 bp, Homo sapiens
gcttctgccacataaa

SEQ ID NO: 3729335 - DNA, 13 bp, Homo sapiens
gcttctgcctgca

SEQ ID NO: 3729336 - DNA, 17 bp, Homo sapiens
gcttctggagcccttgg

SEQ ID NO: 3729337 - DNA, 18 bp, Homo sapiens
gcttctggagcccttggg

SEQ ID NO: 3729338 - DNA, 14 bp, Homo sapiens
gcttctgtttctag

SEQ ID NO: 3729339 - DNA, 21 bp, Homo sapiens
gcttcttaatataactgcctt

SEQ ID NO: 3729340 - DNA, 16 bp, Homo sapiens
gcttcttcagatcagt

SEQ ID NO: 3729341 - DNA, 23 bp, Homo sapiens
gcttcttttagttgtatctcttt

SEQ ID NO: 3729342 - DNA, 14 bp, Homo sapiens
gcttgaagccaagt

SEQ ID NO: 3729343 - DNA, 14 bp, Homo sapiens
gcttgagcccagga

SEQ ID NO: 3729344 - DNA, 14 bp, Homo sapiens
gcttgagctcagga

SEQ ID NO: 3729345 - DNA, 18 bp, Homo sapiens
gcttgagggttgggctgg

SEQ ID NO: 3729346 - DNA, 19 bp, Homo sapiens
gcttgagtttggggaatgc

SEQ ID NO: 3729347 - DNA, 19 bp, Homo sapiens
gcttgcagtgagccgagat

SEQ ID NO: 3729348 - DNA, 19 bp, Homo sapiens
gcttgccgaaactggaagt

SEQ ID NO: 3729349 - DNA, 21 bp, Homo sapiens
gcttggaaagcatcacctcag

SEQ ID NO: 3729350 - DNA, 19 bp, Homo sapiens
gcttgggtgtaacaggtct

SEQ ID NO: 3729351 - DNA, 22 bp, Homo sapiens
gcttgggtgtaacaggtctcct

SEQ ID NO: 3729352 - DNA, 19 bp, Homo sapiens
gcttgtaaatagctcaggt

SEQ ID NO: 3729353 - DNA, 15 bp, Homo sapiens
gcttgtaactccacc

SEQ ID NO: 3729354 - DNA, 21 bp, Homo sapiens
gcttgtccaacccgaggcccg

SEQ ID NO: 3729355 - DNA, 22 bp, Homo sapiens
gcttgtcccctcctcactccct

SEQ ID NO: 3729356 - DNA, 16 bp, Homo sapiens
gcttgtccctgcccag

SEQ ID NO: 3729357 - DNA, 23 bp, Homo sapiens
gctttattttttaagtatttata

SEQ ID NO: 3729358 - DNA, 20 bp, Homo sapiens
gctttcaagacccctgtctt

SEQ ID NO: 3729359 - DNA, 18 bp, Homo sapiens
gctttcatgattagcaag

SEQ ID NO: 3729360 - DNA, 13 bp, Homo sapiens
gctttctacccag

SEQ ID NO: 3729361 - DNA, 22 bp, Homo sapiens
gctttctacccagcgagccctg

SEQ ID NO: 3729362 - DNA, 18 bp, Homo sapiens
gctttctctgcttcagct

SEQ ID NO: 3729363 - DNA, 22 bp, Homo sapiens
gctttgactgagcagactggtg

SEQ ID NO: 3729364 - DNA, 20 bp, Homo sapiens
gctttgcattcctacaaaga

SEQ ID NO: 3729365 - DNA, 14 bp, Homo sapiens
gctttgggctgccc

SEQ ID NO: 3729366 - DNA, 19 bp, Homo sapiens
gctttgggctgccctggtg

SEQ ID NO: 3729367 - DNA, 17 bp, Homo sapiens
gctttggtctcttgctt

SEQ ID NO: 3729368 - DNA, 12 bp, Homo sapiens
gctttgtcccac

SEQ ID NO: 3729369 - DNA, 13 bp, Homo sapiens
gcttttactgttt

SEQ ID NO: 3729370 - DNA, 14 bp, Homo sapiens
gcttttcactgctg

SEQ ID NO: 3729371 - DNA, 18 bp, Homo sapiens
gcttttccccggtccctt

SEQ ID NO: 3729372 - DNA, 22 bp, Homo sapiens
gcttttgctggtcactgccatg

SEQ ID NO: 3729373 - DNA, 16 bp, Homo sapiens
gcttttgtttcttccc

SEQ ID NO: 3729374 - DNA, 12 bp, Homo sapiens
ggaaaaaggaca

SEQ ID NO: 3729375 - DNA, 22 bp, Homo sapiens
ggaaaaaggacaggcagaaaga

SEQ ID NO: 3729376 - DNA, 11 bp, Homo sapiens
ggaaaaatatt

SEQ ID NO: 3729377 - DNA, 15 bp, Homo sapiens
ggaaaaatccagaaa

SEQ ID NO: 3729378 - DNA, 22 bp, Homo sapiens
ggaaaaccaagccgtggcttcc

SEQ ID NO: 3729379 - DNA, 17 bp, Homo sapiens
ggaaaatgccaatctct

SEQ ID NO: 3729380 - DNA, 18 bp, Homo sapiens
ggaaacatatttaagaaa

SEQ ID NO: 3729381 - DNA, 20 bp, Homo sapiens
ggaaacatatttaagaaata

SEQ ID NO: 3729382 - DNA, 19 bp, Homo sapiens
ggaaaccaagtggtcagga

SEQ ID NO: 3729383 - DNA, 16 bp, Homo sapiens
ggaaactagcttacat

SEQ ID NO: 3729384 - DNA, 17 bp, Homo sapiens
ggaaactggatgaggtc

SEQ ID NO: 3729385 - DNA, 23 bp, Homo sapiens
ggaaagaattcctacaatatata

SEQ ID NO: 3729386 - DNA, 13 bp, Homo sapiens
ggaaagcctctgc

SEQ ID NO: 3729387 - DNA, 14 bp, Homo sapiens
ggaaagcctctgct

SEQ ID NO: 3729388 - DNA, 20 bp, Homo sapiens
ggaaaggccagctggcagca

SEQ ID NO: 3729389 - DNA, 22 bp, Homo sapiens
ggaaaggccagctggcagcaga

SEQ ID NO: 3729390 - DNA, 12 bp, Homo sapiens
ggaaaggctcag

SEQ ID NO: 3729391 - DNA, 23 bp, Homo sapiens
ggaaaggctcagtctcaggagca

SEQ ID NO: 3729392 - DNA, 15 bp, Homo sapiens
ggaaaggctctgaaa

SEQ ID NO: 3729393 - DNA, 20 bp, Homo sapiens
ggaaagggtgctgcttccct

SEQ ID NO: 3729394 - DNA, 13 bp, Homo sapiens
ggaaagtgaattt

SEQ ID NO: 3729395 - DNA, 14 bp, Homo sapiens
ggaaataaaaaagt

SEQ ID NO: 3729396 - DNA, 15 bp, Homo sapiens
ggaaataaaaccttt

SEQ ID NO: 3729397 - DNA, 20 bp, Homo sapiens
ggaaataaaacctttcaaat

SEQ ID NO: 3729398 - DNA, 14 bp, Homo sapiens
ggaaatatatatgt

SEQ ID NO: 3729399 - DNA, 18 bp, Homo sapiens
ggaaatctcaccccatcc

SEQ ID NO: 3729400 - DNA, 17 bp, Homo sapiens
ggaaatgtcaacaagta

SEQ ID NO: 3729401 - DNA, 11 bp, Homo sapiens
ggaacagaagg

SEQ ID NO: 3729402 - DNA, 18 bp, Homo sapiens
ggaacagacaacagaagt

SEQ ID NO: 3729403 - DNA, 13 bp, Homo sapiens
ggaacagacagga

SEQ ID NO: 3729404 - DNA, 20 bp, Homo sapiens
ggaacagcgggagacctgtg

SEQ ID NO: 3729405 - DNA, 12 bp, Homo sapiens
ggaaccagagcc

SEQ ID NO: 3729406 - DNA, 16 bp, Homo sapiens
ggaaccgcaggaagct

SEQ ID NO: 3729407 - DNA, 13 bp, Homo sapiens
ggaacctggacca

SEQ ID NO: 3729408 - DNA, 18 bp, Homo sapiens
ggaacggggtccttcaag

SEQ ID NO: 3729409 - DNA, 15 bp, Homo sapiens
ggaacgttggacttt

SEQ ID NO: 3729410 - DNA, 23 bp, Homo sapiens
ggaactagactcccaagctggac

SEQ ID NO: 3729411 - DNA, 20 bp, Homo sapiens
ggaactagactgcctgggtt

SEQ ID NO: 3729412 - DNA, 22 bp, Homo sapiens
ggaactagagggatacactgaa

SEQ ID NO: 3729413 - DNA, 21 bp, Homo sapiens
ggaactcattcctgcctgtct

SEQ ID NO: 3729414 - DNA, 22 bp, Homo sapiens
ggaactcattcctgcctgtctc

SEQ ID NO: 3729415 - DNA, 18 bp, Homo sapiens
gctggtcactgccatgga

SEQ ID NO: 3729416 - DNA, 14 bp, Homo sapiens
gctggtcccactca

SEQ ID NO: 3729417 - DNA, 15 bp, Homo sapiens
gctggtcccactcag

SEQ ID NO: 3729418 - DNA, 15 bp, Homo sapiens
gctggtgcagggcct

SEQ ID NO: 3729419 - DNA, 18 bp, Homo sapiens
gctggtgcattacagaga

SEQ ID NO: 3729420 - DNA, 13 bp, Homo sapiens
gctggtgcccgga

SEQ ID NO: 3729421 - DNA, 19 bp, Homo sapiens
gctggtgggtgaaagaaat

SEQ ID NO: 3729422 - DNA, 16 bp, Homo sapiens
gctggttcctgctaga

SEQ ID NO: 3729423 - DNA, 19 bp, Homo sapiens
gctggttcctgctagaaat

SEQ ID NO: 3729424 - DNA, 14 bp, Homo sapiens
gctggttttcctaa

SEQ ID NO: 3729425 - DNA, 23 bp, Homo sapiens
gctggttttcctaaatgcagtga

SEQ ID NO: 3729426 - DNA, 15 bp, Homo sapiens
gctgtaaataaatgc

SEQ ID NO: 3729427 - DNA, 16 bp, Homo sapiens
gctgtaagaagagact

SEQ ID NO: 3729428 - DNA, 13 bp, Homo sapiens
gctgtagaaggag

SEQ ID NO: 3729429 - DNA, 18 bp, Homo sapiens
gctgtatcttgtttttcc

SEQ ID NO: 3729430 - DNA, 13 bp, Homo sapiens
gctgtattcttct

SEQ ID NO: 3729431 - DNA, 14 bp, Homo sapiens
gctgtccctgtcac

SEQ ID NO: 3729432 - DNA, 13 bp, Homo sapiens
gctgtcctaggcc

SEQ ID NO: 3729433 - DNA, 14 bp, Homo sapiens
gctgtcctaggcca

SEQ ID NO: 3729434 - DNA, 17 bp, Homo sapiens
gctgtccttacccatct

SEQ ID NO: 3729435 - DNA, 22 bp, Homo sapiens
gctgtccttacccatctgcacc

SEQ ID NO: 3729436 - DNA, 22 bp, Homo sapiens
gctgtctccagacccccacccc

SEQ ID NO: 3729437 - DNA, 12 bp, Homo sapiens
gctgtgcctctg

SEQ ID NO: 3729438 - DNA, 15 bp, Homo sapiens
gctgtgctatgaatt

SEQ ID NO: 3729439 - DNA, 16 bp, Homo sapiens
gctgtgctatgaattt

SEQ ID NO: 3729440 - DNA, 13 bp, Homo sapiens
gctgtgctctgga

SEQ ID NO: 3729441 - DNA, 16 bp, Homo sapiens
gctgtgctctggacag

SEQ ID NO: 3729442 - DNA, 23 bp, Homo sapiens
gctgtggcaggccagctgtggtt

SEQ ID NO: 3729443 - DNA, 15 bp, Homo sapiens
gctgtggcctgggca

SEQ ID NO: 3729444 - DNA, 19 bp, Homo sapiens
gctgtgggcctcaaggact

SEQ ID NO: 3729445 - DNA, 12 bp, Homo sapiens
gctgtgggctcc

SEQ ID NO: 3729446 - DNA, 18 bp, Homo sapiens
gctgtgggtacagagagg

SEQ ID NO: 3729447 - DNA, 13 bp, Homo sapiens
gctgtggttcctg

SEQ ID NO: 3729448 - DNA, 16 bp, Homo sapiens
gctgtggttcctgggg

SEQ ID NO: 3729449 - DNA, 13 bp, Homo sapiens
gctgtggttttct

SEQ ID NO: 3729450 - DNA, 15 bp, Homo sapiens
gctgtggttttcttt

SEQ ID NO: 3729451 - DNA, 17 bp, Homo sapiens
gctgtgtccaactccag

SEQ ID NO: 3729452 - DNA, 14 bp, Homo sapiens
gctgtgtccttgca

SEQ ID NO: 3729453 - DNA, 18 bp, Homo sapiens
gctgtgtccttgcacctg

SEQ ID NO: 3729454 - DNA, 20 bp, Homo sapiens
gctgtgtccttgcacctgca

SEQ ID NO: 3729455 - DNA, 22 bp, Homo sapiens
gctgttcacccacagggctaag

SEQ ID NO: 3729456 - DNA, 13 bp, Homo sapiens
gctgttcagctgg

SEQ ID NO: 3729457 - DNA, 16 bp, Homo sapiens
gctgttgagctgtttt

SEQ ID NO: 3729458 - DNA, 18 bp, Homo sapiens
gctgttgagctgttttcc

SEQ ID NO: 3729459 - DNA, 13 bp, Homo sapiens
gctgttgcctcat

SEQ ID NO: 3729460 - DNA, 23 bp, Homo sapiens
ctagaggccagccccacccagga

SEQ ID NO: 3729461 - DNA, 15 bp, Homo sapiens
ctagagggttcctgt

SEQ ID NO: 3729462 - DNA, 20 bp, Homo sapiens
ctagaggttttatgatattt

SEQ ID NO: 3729463 - DNA, 15 bp, Homo sapiens
ctagagtcctcactc

SEQ ID NO: 3729464 - DNA, 21 bp, Homo sapiens
ctagagtgaacttgggccact

SEQ ID NO: 3729465 - DNA, 15 bp, Homo sapiens
ctagataaaaagatg

SEQ ID NO: 3729466 - DNA, 18 bp, Homo sapiens
ctagatcatgaagaacct

SEQ ID NO: 3729467 - DNA, 13 bp, Homo sapiens
ctagatttatgaa

SEQ ID NO: 3729468 - DNA, 15 bp, Homo sapiens
ctagcaaaagaagta

SEQ ID NO: 3729469 - DNA, 19 bp, Homo sapiens
ctagcaaaagaagtaacaa

SEQ ID NO: 3729470 - DNA, 17 bp, Homo sapiens
ctagcactttgggaggc

SEQ ID NO: 3729471 - DNA, 19 bp, Homo sapiens
ctagcagagcaggggcagg

SEQ ID NO: 3729472 - DNA, 12 bp, Homo sapiens
ctagcagcaggg

SEQ ID NO: 3729473 - DNA, 16 bp, Homo sapiens
ctagcatctcatgagt

SEQ ID NO: 3729474 - DNA, 16 bp, Homo sapiens
gcggtccacccaggag

SEQ ID NO: 3729475 - DNA, 19 bp, Homo sapiens
gcggtccacccaggagccc

SEQ ID NO: 3729476 - DNA, 20 bp, Homo sapiens
gcggtccacccaggagcccc

SEQ ID NO: 3729477 - DNA, 19 bp, Homo sapiens
gcggtgagaggggaacaga

SEQ ID NO: 3729478 - DNA, 22 bp, Homo sapiens
gcgtcctgtcggagccctgtct

SEQ ID NO: 3729479 - DNA, 18 bp, Homo sapiens
gcgtctcccatcttaact

SEQ ID NO: 3729480 - DNA, 18 bp, Homo sapiens
gcgtctgtcttcaagggc

SEQ ID NO: 3729481 - DNA, 12 bp, Homo sapiens
gcgtgaaacaca

SEQ ID NO: 3729482 - DNA, 23 bp, Homo sapiens
gcgtgaacccgggaggcggagct

SEQ ID NO: 3729483 - DNA, 15 bp, Homo sapiens
gcgtgaaggccgaga

SEQ ID NO: 3729484 - DNA, 12 bp, Homo sapiens
gcgtgaatctgt

SEQ ID NO: 3729485 - DNA, 13 bp, Homo sapiens
gcgtgactcaccc

SEQ ID NO: 3729486 - DNA, 16 bp, Homo sapiens
gcgtgactcacccaag

SEQ ID NO: 3729487 - DNA, 14 bp, Homo sapiens
gcgtgagccactgc

SEQ ID NO: 3729488 - DNA, 14 bp, Homo sapiens
gcgtgcacacacca

SEQ ID NO: 3729489 - DNA, 19 bp, Homo sapiens
gcgtgcacacaccagagcc

SEQ ID NO: 3729490 - DNA, 13 bp, Homo sapiens
gcgtgtggctcac

SEQ ID NO: 3729491 - DNA, 16 bp, Homo sapiens
gctaaatgtgaatgat

SEQ ID NO: 3729492 - DNA, 16 bp, Homo sapiens
gctaacactggcccct

SEQ ID NO: 3729493 - DNA, 17 bp, Homo sapiens
gctaacactggccccta

SEQ ID NO: 3729494 - DNA, 20 bp, Homo sapiens
gctaacttggagccccagtg

SEQ ID NO: 3729495 - DNA, 18 bp, Homo sapiens
gctaagagctagcgctgc

SEQ ID NO: 3729496 - DNA, 15 bp, Homo sapiens
gctaagctaggaatg

SEQ ID NO: 3729497 - DNA, 19 bp, Homo sapiens
gctaagctaggaatgaaat

SEQ ID NO: 3729498 - DNA, 17 bp, Homo sapiens
gctaaggacatttccca

SEQ ID NO: 3729499 - DNA, 20 bp, Homo sapiens
gctaaggacatttcccaggg

SEQ ID NO: 3729500 - DNA, 14 bp, Homo sapiens
gctaaggcaccagc

SEQ ID NO: 3729501 - DNA, 14 bp, Homo sapiens
gctaataaaatatc

SEQ ID NO: 3729502 - DNA, 21 bp, Homo sapiens
gctaataaaatatcattcagc

SEQ ID NO: 3729503 - DNA, 20 bp, Homo sapiens
gctaatatcaatagaaggat

SEQ ID NO: 3729504 - DNA, 16 bp, Homo sapiens
gctaatcagcattctc

SEQ ID NO: 3729505 - DNA, 23 bp, Homo sapiens
gctaatcatgtgggtgagccagt

SEQ ID NO: 3729506 - DNA, 21 bp, Homo sapiens
gctaatgaagggaaaggatat

SEQ ID NO: 3729507 - DNA, 16 bp, Homo sapiens
gctaatttttcatttt

SEQ ID NO: 3729508 - DNA, 16 bp, Homo sapiens
gctacacagatcacag

SEQ ID NO: 3729509 - DNA, 22 bp, Homo sapiens
gctacaggaagcaccccatgcc

SEQ ID NO: 3729510 - DNA, 14 bp, Homo sapiens
gctacatcccagcc

SEQ ID NO: 3729511 - DNA, 13 bp, Homo sapiens
gctacctcaaggg

SEQ ID NO: 3729512 - DNA, 23 bp, Homo sapiens
gctacctgaacacttattgcttt

SEQ ID NO: 3729513 - DNA, 17 bp, Homo sapiens
gctaccttattgtacgt

SEQ ID NO: 3729514 - DNA, 14 bp, Homo sapiens
gctactaatgatgt

SEQ ID NO: 3729515 - DNA, 17 bp, Homo sapiens
gctactcaagaggctga

SEQ ID NO: 3729516 - DNA, 17 bp, Homo sapiens
gctactcactcaagttc

SEQ ID NO: 3729517 - DNA, 20 bp, Homo sapiens
gctactcactcaagttcaag

SEQ ID NO: 3729518 - DNA, 16 bp, Homo sapiens
gctactcagaagcctg

SEQ ID NO: 3729519 - DNA, 17 bp, Homo sapiens
gctactcagaagcctga

SEQ ID NO: 3729520 - DNA, 16 bp, Homo sapiens
gctactcagcagccct

SEQ ID NO: 3729521 - DNA, 17 bp, Homo sapiens
gctactcagcagccctc

SEQ ID NO: 3729522 - DNA, 14 bp, Homo sapiens
gctactcaggaggc

SEQ ID NO: 3729523 - DNA, 17 bp, Homo sapiens
gctactctgttccttca

SEQ ID NO: 3729524 - DNA, 18 bp, Homo sapiens
gctactctgttccttcac

SEQ ID NO: 3729525 - DNA, 18 bp, Homo sapiens
gctactgatgagaattta

SEQ ID NO: 3729526 - DNA, 11 bp, Homo sapiens
gctagaaatgg

SEQ ID NO: 3729527 - DNA, 21 bp, Homo sapiens
gctagaagtgggccaggacag

SEQ ID NO: 3729528 - DNA, 20 bp, Homo sapiens
gctagaggaaccaaccccca

SEQ ID NO: 3729529 - DNA, 18 bp, Homo sapiens
gctagagtcctcactccc

SEQ ID NO: 3729530 - DNA, 22 bp, Homo sapiens
gctagatgagaattcagctgcc

SEQ ID NO: 3729531 - DNA, 17 bp, Homo sapiens
gctagcaaaagaagtaa

SEQ ID NO: 3729532 - DNA, 17 bp, Homo sapiens
gctagcacttggagcca

SEQ ID NO: 3729533 - DNA, 22 bp, Homo sapiens
gctagcgctgccgcaccccaga

SEQ ID NO: 3729534 - DNA, 14 bp, Homo sapiens
gctaggtgggccag

SEQ ID NO: 3729535 - DNA, 17 bp, Homo sapiens
gctaggtgggccagccc

SEQ ID NO: 3729536 - DNA, 18 bp, Homo sapiens
gctaggtgggccagcccc

SEQ ID NO: 3729537 - DNA, 23 bp, Homo sapiens
gctatagacccgaggaaactcag

SEQ ID NO: 3729538 - DNA, 16 bp, Homo sapiens
gctatagctacaggaa

SEQ ID NO: 3729539 - DNA, 14 bp, Homo sapiens
gctatatccatgta

SEQ ID NO: 3729540 - DNA, 15 bp, Homo sapiens
gctatatccatgtac

SEQ ID NO: 3729541 - DNA, 19 bp, Homo sapiens
gctatatccatgtactgta

SEQ ID NO: 3729542 - DNA, 15 bp, Homo sapiens
gctatatttaagtat

SEQ ID NO: 3729543 - DNA, 20 bp, Homo sapiens
gctatcctgccaaaatcatt

SEQ ID NO: 3729544 - DNA, 17 bp, Homo sapiens
gctatgatcgcgccact

SEQ ID NO: 3729545 - DNA, 13 bp, Homo sapiens
gctatgcttgaat

SEQ ID NO: 3729546 - DNA, 17 bp, Homo sapiens
gctatgggagccccagg

SEQ ID NO: 3729547 - DNA, 20 bp, Homo sapiens
gctattcagtaataactcta

SEQ ID NO: 3729548 - DNA, 16 bp, Homo sapiens
gctattttactgtctt

SEQ ID NO: 3729549 - DNA, 22 bp, Homo sapiens
gctatttttatttgtttgtgca

SEQ ID NO: 3729550 - DNA, 19 bp, Homo sapiens
gctcaaagagcctcacagt

SEQ ID NO: 3729551 - DNA, 12 bp, Homo sapiens
gctcaaaggcac

SEQ ID NO: 3729552 - DNA, 17 bp, Homo sapiens
gctcaagtcttccctga

SEQ ID NO: 3729553 - DNA, 22 bp, Homo sapiens
gctcaatattcctgaatgaaat

SEQ ID NO: 3729554 - DNA, 16 bp, Homo sapiens
gctcaatcaagaaaat

SEQ ID NO: 3729555 - DNA, 16 bp, Homo sapiens
gctcaatcctctaagc

SEQ ID NO: 3729556 - DNA, 14 bp, Homo sapiens
gctcacaaaccatg

SEQ ID NO: 3729557 - DNA, 13 bp, Homo sapiens
gctcacagttcct

SEQ ID NO: 3729558 - DNA, 23 bp, Homo sapiens
gctcacagttcctcgccctgggt

SEQ ID NO: 3729559 - DNA, 12 bp, Homo sapiens
gctcaccagccc

SEQ ID NO: 3729560 - DNA, 22 bp, Homo sapiens
gctcacgtgagagtgtcttcac

SEQ ID NO: 3729561 - DNA, 15 bp, Homo sapiens
gctcacgtgtgtgac

SEQ ID NO: 3729562 - DNA, 17 bp, Homo sapiens
gctcacgtgtgtgactc

SEQ ID NO: 3729563 - DNA, 12 bp, Homo sapiens
gctcactgcagc

SEQ ID NO: 3729564 - DNA, 12 bp, Homo sapiens
gctcagaacaca

SEQ ID NO: 3729565 - DNA, 20 bp, Homo sapiens
gctcagcaaaagatgcttct

SEQ ID NO: 3729566 - DNA, 22 bp, Homo sapiens
gctcagcaaaagatgcttctca

SEQ ID NO: 3729567 - DNA, 17 bp, Homo sapiens
gctcagcagtgactgtg

SEQ ID NO: 3729568 - DNA, 11 bp, Homo sapiens
gctcagcccac

SEQ ID NO: 3729569 - DNA, 15 bp, Homo sapiens
gctcagcccaccccc

SEQ ID NO: 3729570 - DNA, 12 bp, Homo sapiens
gctcagccccag

SEQ ID NO: 3729571 - DNA, 16 bp, Homo sapiens
gctcagccccagccca

SEQ ID NO: 3729572 - DNA, 17 bp, Homo sapiens
gctcagccccagcccag

SEQ ID NO: 3729573 - DNA, 18 bp, Homo sapiens
gctcagccccagcccagc

SEQ ID NO: 3729574 - DNA, 15 bp, Homo sapiens
gctcagccctccctg

SEQ ID NO: 3729575 - DNA, 16 bp, Homo sapiens
gctcagccctccctgc

SEQ ID NO: 3729576 - DNA, 21 bp, Homo sapiens
gctcagccctccctgcccctc

SEQ ID NO: 3729577 - DNA, 14 bp, Homo sapiens
gctcagcctggtgg

SEQ ID NO: 3729578 - DNA, 17 bp, Homo sapiens
gctcagcctggtgggcc

SEQ ID NO: 3729579 - DNA, 18 bp, Homo sapiens
gctcagcctggtgggcct

SEQ ID NO: 3729580 - DNA, 20 bp, Homo sapiens
gctcagcctggtgggcctcc

SEQ ID NO: 3729581 - DNA, 23 bp, Homo sapiens
gctcagcggggacagctccttct

SEQ ID NO: 3729582 - DNA, 13 bp, Homo sapiens
gctcagctctggc

SEQ ID NO: 3729583 - DNA, 17 bp, Homo sapiens
gctcaggaggcttggaa

SEQ ID NO: 3729584 - DNA, 13 bp, Homo sapiens
gctcaggagtttg

SEQ ID NO: 3729585 - DNA, 20 bp, Homo sapiens
gctcaggggcgtgtggctca

SEQ ID NO: 3729586 - DNA, 23 bp, Homo sapiens
gctcaggtacagagaaggaatgt

SEQ ID NO: 3729587 - DNA, 15 bp, Homo sapiens
gctgaggcaattcta

SEQ ID NO: 3729588 - DNA, 13 bp, Homo sapiens
gctgaggcagaag

SEQ ID NO: 3729589 - DNA, 23 bp, Homo sapiens
gctgagggtgagtgggtgaataa

SEQ ID NO: 3729590 - DNA, 17 bp, Homo sapiens
gctgaggtctcttgagg

SEQ ID NO: 3729591 - DNA, 19 bp, Homo sapiens
gctgaggtgagaggatcag

SEQ ID NO: 3729592 - DNA, 13 bp, Homo sapiens
gctgagttggtgt

SEQ ID NO: 3729593 - DNA, 17 bp, Homo sapiens
gctgatatatgtgtttt

SEQ ID NO: 3729594 - DNA, 13 bp, Homo sapiens
gctgatctcaggg

SEQ ID NO: 3729595 - DNA, 14 bp, Homo sapiens
gctgatctcaggga

SEQ ID NO: 3729596 - DNA, 17 bp, Homo sapiens
gctgatctcagggaagc

SEQ ID NO: 3729597 - DNA, 14 bp, Homo sapiens
gctgattactgtca

SEQ ID NO: 3729598 - DNA, 13 bp, Homo sapiens
gctgcaccctcag

SEQ ID NO: 3729599 - DNA, 15 bp, Homo sapiens
gctgcaccctcaggc

SEQ ID NO: 3729600 - DNA, 16 bp, Homo sapiens
gctgcaccctcaggca

SEQ ID NO: 3729601 - DNA, 17 bp, Homo sapiens
gctgcacctgccagcct

SEQ ID NO: 3729602 - DNA, 18 bp, Homo sapiens
gctgcagagacagagagg

SEQ ID NO: 3729603 - DNA, 15 bp, Homo sapiens
gctgcatctactcag

SEQ ID NO: 3729604 - DNA, 22 bp, Homo sapiens
gctgcatggggtggggtagggc

SEQ ID NO: 3729605 - DNA, 17 bp, Homo sapiens
gctgccaaattttggcc

SEQ ID NO: 3729606 - DNA, 22 bp, Homo sapiens
gctgccaaggccagagtggcct

SEQ ID NO: 3729607 - DNA, 13 bp, Homo sapiens
gctgccatccagg

SEQ ID NO: 3729608 - DNA, 23 bp, Homo sapiens
gctgccatggcgtgtccctctcg

SEQ ID NO: 3729609 - DNA, 21 bp, Homo sapiens
gctgccatgtgaagagggaga

SEQ ID NO: 3729610 - DNA, 15 bp, Homo sapiens
gctgccccagctgac

SEQ ID NO: 3729611 - DNA, 20 bp, Homo sapiens
gctgcccgtcttcagcctag

SEQ ID NO: 3729612 - DNA, 21 bp, Homo sapiens
gctgccctggaggaaccgaaa

SEQ ID NO: 3729613 - DNA, 15 bp, Homo sapiens
gctgccctggtgctg

SEQ ID NO: 3729614 - DNA, 17 bp, Homo sapiens
gctgccctggtgctgcc

SEQ ID NO: 3729615 - DNA, 18 bp, Homo sapiens
gctgccctgtaccccagc

SEQ ID NO: 3729616 - DNA, 17 bp, Homo sapiens
gctgccgaccagagccc

SEQ ID NO: 3729617 - DNA, 15 bp, Homo sapiens
gctgcctaagaggca

SEQ ID NO: 3729618 - DNA, 17 bp, Homo sapiens
gctgcctccccaaccct

SEQ ID NO: 3729619 - DNA, 23 bp, Homo sapiens
gctgcctccccaaccctgcccct

SEQ ID NO: 3729620 - DNA, 16 bp, Homo sapiens
gctgcctctcccatca

SEQ ID NO: 3729621 - DNA, 18 bp, Homo sapiens
gctgcctctcggtggcca

SEQ ID NO: 3729622 - DNA, 22 bp, Homo sapiens
gctgcctgagcacctcccagcc

SEQ ID NO: 3729623 - DNA, 22 bp, Homo sapiens
gctgcctggagccccactgccc

SEQ ID NO: 3729624 - DNA, 19 bp, Homo sapiens
gctgcctggcccccagctg

SEQ ID NO: 3729625 - DNA, 12 bp, Homo sapiens
gctgcctgtagt

SEQ ID NO: 3729626 - DNA, 18 bp, Homo sapiens
gctgcctgttcagctcca

SEQ ID NO: 3729627 - DNA, 18 bp, Homo sapiens
gggttgcagtggagaggg

SEQ ID NO: 3729628 - DNA, 20 bp, Homo sapiens
gggttggctgggcccagaag

SEQ ID NO: 3729629 - DNA, 13 bp, Homo sapiens
gggttggctgggt

SEQ ID NO: 3729630 - DNA, 22 bp, Homo sapiens
gggttgggcccagatctggtcc

SEQ ID NO: 3729631 - DNA, 15 bp, Homo sapiens
gggttgtgtgtctgt

SEQ ID NO: 3729632 - DNA, 15 bp, Homo sapiens
gggtttctgccctgc

SEQ ID NO: 3729633 - DNA, 16 bp, Homo sapiens
gggttttccaccctgg

SEQ ID NO: 3729634 - DNA, 20 bp, Homo sapiens
gggttttgccatgttggcca

SEQ ID NO: 3729635 - DNA, 13 bp, Homo sapiens
ggtaaatttctgt

SEQ ID NO: 3729636 - DNA, 13 bp, Homo sapiens
ggtaagcttccag

SEQ ID NO: 3729637 - DNA, 17 bp, Homo sapiens
ggtacccactgctctgg

SEQ ID NO: 3729638 - DNA, 23 bp, Homo sapiens
ggtagaaatatctgaaaatgtat

SEQ ID NO: 3729639 - DNA, 11 bp, Homo sapiens
ggtagaacaca

SEQ ID NO: 3729640 - DNA, 16 bp, Homo sapiens
ggtagccatcatggat

SEQ ID NO: 3729641 - DNA, 18 bp, Homo sapiens
ggtagccctggccagagg

SEQ ID NO: 3729642 - DNA, 15 bp, Homo sapiens
ggtagctagaggaac

SEQ ID NO: 3729643 - DNA, 19 bp, Homo sapiens
ggtagctgcccctggctct

SEQ ID NO: 3729644 - DNA, 23 bp, Homo sapiens
ggtagtactcctgcaaaatttta

SEQ ID NO: 3729645 - DNA, 18 bp, Homo sapiens
ggtagttgcaattgaatt

SEQ ID NO: 3729646 - DNA, 20 bp, Homo sapiens
ggtataatggttgactgggt

SEQ ID NO: 3729647 - DNA, 22 bp, Homo sapiens
ggtatatcattataactgaagg

SEQ ID NO: 3729648 - DNA, 12 bp, Homo sapiens
ggtatcatatat

SEQ ID NO: 3729649 - DNA, 12 bp, Homo sapiens
ggtatcctgccc

SEQ ID NO: 3729650 - DNA, 21 bp, Homo sapiens
ggtatgaccttctaggaagct

SEQ ID NO: 3729651 - DNA, 22 bp, Homo sapiens
ggtatgatcacggctcactgca

SEQ ID NO: 3729652 - DNA, 18 bp, Homo sapiens
ggtattccttttgtgtac

SEQ ID NO: 3729653 - DNA, 19 bp, Homo sapiens
ggtattccttttgtgtaca

SEQ ID NO: 3729654 - DNA, 20 bp, Homo sapiens
ggtcaacagagaaggcagga

SEQ ID NO: 3729655 - DNA, 11 bp, Homo sapiens
ggtcaaggcct

SEQ ID NO: 3729656 - DNA, 21 bp, Homo sapiens
gggctcagcggggacagctcc

SEQ ID NO: 3729657 - DNA, 21 bp, Homo sapiens
gggctccccttcgcgtatttc

SEQ ID NO: 3729658 - DNA, 20 bp, Homo sapiens
gggctcccctttcgcccaca

SEQ ID NO: 3729659 - DNA, 13 bp, Homo sapiens
gggctctccacct

SEQ ID NO: 3729660 - DNA, 19 bp, Homo sapiens
gggctctgccccagctctg

SEQ ID NO: 3729661 - DNA, 20 bp, Homo sapiens
gggctctgccccagctctgg

SEQ ID NO: 3729662 - DNA, 16 bp, Homo sapiens
gggctctgccctccct

SEQ ID NO: 3729663 - DNA, 22 bp, Homo sapiens
gggctctgccctccctccttcc

SEQ ID NO: 3729664 - DNA, 16 bp, Homo sapiens
gggctgagccctggca

SEQ ID NO: 3729665 - DNA, 18 bp, Homo sapiens
gggctgagccctggcagg

SEQ ID NO: 3729666 - DNA, 18 bp, Homo sapiens
gggctgaggggcaacgaa

SEQ ID NO: 3729667 - DNA, 16 bp, Homo sapiens
gggctgaggtgggagg

SEQ ID NO: 3729668 - DNA, 14 bp, Homo sapiens
gggctgatctcagg

SEQ ID NO: 3729669 - DNA, 16 bp, Homo sapiens
gggctgatctcaggga

SEQ ID NO: 3729670 - DNA, 15 bp, Homo sapiens
gggctgccctggtgc

SEQ ID NO: 3729671 - DNA, 14 bp, Homo sapiens
gggctgctcctcat

SEQ ID NO: 3729672 - DNA, 17 bp, Homo sapiens
gggctgctgacctccac

SEQ ID NO: 3729673 - DNA, 17 bp, Homo sapiens
gggctggactggctgtc

SEQ ID NO: 3729674 - DNA, 16 bp, Homo sapiens
gggctgggagctctgc

SEQ ID NO: 3729675 - DNA, 22 bp, Homo sapiens
gggctggggcaggaggggagtg

SEQ ID NO: 3729676 - DNA, 14 bp, Homo sapiens
gggcttcagtggca

SEQ ID NO: 3729677 - DNA, 15 bp, Homo sapiens
gggcttcagtggcag

SEQ ID NO: 3729678 - DNA, 23 bp, Homo sapiens
gggcttccatttgtgtgtgtgca

SEQ ID NO: 3729679 - DNA, 19 bp, Homo sapiens
gggcttgcaagtatgtttt

SEQ ID NO: 3729680 - DNA, 14 bp, Homo sapiens
gggctttctggaga

SEQ ID NO: 3729681 - DNA, 20 bp, Homo sapiens
gggctttgattccatctcct

SEQ ID NO: 3729682 - DNA, 16 bp, Homo sapiens
ggggaaaatcagcctg

SEQ ID NO: 3729683 - DNA, 19 bp, Homo sapiens
ggggaaaatcagcctgctc

SEQ ID NO: 3729684 - DNA, 15 bp, Homo sapiens
ggggaattcatctct

SEQ ID NO: 3729685 - DNA, 13 bp, Homo sapiens
ggggactcagccc

SEQ ID NO: 3729686 - DNA, 14 bp, Homo sapiens
ggggactcagccct

SEQ ID NO: 3729687 - DNA, 16 bp, Homo sapiens
ggggagacacctcaga

SEQ ID NO: 3729688 - DNA, 17 bp, Homo sapiens
ggggagacacctcagag

SEQ ID NO: 3729689 - DNA, 14 bp, Homo sapiens
ggggagcagagaca

SEQ ID NO: 3729690 - DNA, 18 bp, Homo sapiens
ggggaggaaactcacctg

SEQ ID NO: 3729691 - DNA, 14 bp, Homo sapiens
ggggaggcagccgg

SEQ ID NO: 3729692 - DNA, 17 bp, Homo sapiens
ggggagtctgaagcaga

SEQ ID NO: 3729693 - DNA, 19 bp, Homo sapiens
ggggagtgggacagagtct

SEQ ID NO: 3729694 - DNA, 13 bp, Homo sapiens
ggggcagaacagc

SEQ ID NO: 3729695 - DNA, 16 bp, Homo sapiens
ggggcagagggcagag

SEQ ID NO: 3729696 - DNA, 10 bp, Homo sapiens
ggggcaggca

SEQ ID NO: 3729697 - DNA, 12 bp, Homo sapiens
ggggcaggcagt

SEQ ID NO: 3729698 - DNA, 21 bp, Homo sapiens
ggggcagggaaggggaggcag

SEQ ID NO: 3729699 - DNA, 11 bp, Homo sapiens
ggggcagtctg

SEQ ID NO: 3729700 - DNA, 20 bp, Homo sapiens
ggggcatctgcccctccccc

SEQ ID NO: 3729701 - DNA, 16 bp, Homo sapiens
ggggcatgctggggca

SEQ ID NO: 3729702 - DNA, 19 bp, Homo sapiens
ggggccacttttgactagg

SEQ ID NO: 3729703 - DNA, 20 bp, Homo sapiens
ggggccatgagctccagacc

SEQ ID NO: 3729704 - DNA, 14 bp, Homo sapiens
ggggccccagggct

SEQ ID NO: 3729705 - DNA, 21 bp, Homo sapiens
ggggcccctttttactcccct

SEQ ID NO: 3729706 - DNA, 16 bp, Homo sapiens
ggggcccgcctggcag

SEQ ID NO: 3729707 - DNA, 21 bp, Homo sapiens
ggggcctgacctccccctcct

SEQ ID NO: 3729708 - DNA, 11 bp, Homo sapiens
ggggcctggca

SEQ ID NO: 3729709 - DNA, 16 bp, Homo sapiens
ggggctgctcctccag

SEQ ID NO: 3729710 - DNA, 17 bp, Homo sapiens
ggggctggcactgactg

SEQ ID NO: 3729711 - DNA, 17 bp, Homo sapiens
ggggctggggcaggagg

SEQ ID NO: 3729712 - DNA, 14 bp, Homo sapiens
gggggccaggtgca

SEQ ID NO: 3729713 - DNA, 14 bp, Homo sapiens
gggggccatgagct

SEQ ID NO: 3729714 - DNA, 21 bp, Homo sapiens
gggggccatgaggcctcagtg

SEQ ID NO: 3729715 - DNA, 17 bp, Homo sapiens
gggggcctcagtgccac

SEQ ID NO: 3729716 - DNA, 18 bp, Homo sapiens
gggggcctcagtgccact

SEQ ID NO: 3729717 - DNA, 23 bp, Homo sapiens
ggggggcccgcctggcagaactg

SEQ ID NO: 3729718 - DNA, 18 bp, Homo sapiens
gggggtcaggaggcaggg

SEQ ID NO: 3729719 - DNA, 19 bp, Homo sapiens
gggggttgcagtggagagg

SEQ ID NO: 3729720 - DNA, 18 bp, Homo sapiens
ggggtagctagaggaacc

SEQ ID NO: 3729721 - DNA, 22 bp, Homo sapiens
ggggtcagggaccaaggacccc

SEQ ID NO: 3729722 - DNA, 20 bp, Homo sapiens
ggggtctccctctcctgcct

SEQ ID NO: 3729723 - DNA, 22 bp, Homo sapiens
ggggtctccctctcctgcctac

SEQ ID NO: 3729724 - DNA, 13 bp, Homo sapiens
ggggtgaggacca

SEQ ID NO: 3729725 - DNA, 13 bp, Homo sapiens
ggggttacaaact

SEQ ID NO: 3729726 - DNA, 13 bp, Homo sapiens
ggggttggctggg

SEQ ID NO: 3729727 - DNA, 23 bp, Homo sapiens
ggggttttcgaagctcagcccac

SEQ ID NO: 3729728 - DNA, 22 bp, Homo sapiens
gggtaaaattccttagcttaga

SEQ ID NO: 3729729 - DNA, 13 bp, Homo sapiens
gggtaaggtgcct

SEQ ID NO: 3729730 - DNA, 14 bp, Homo sapiens
gggtaaggtgcctt

SEQ ID NO: 3729731 - DNA, 15 bp, Homo sapiens
gggtacccactgctc

SEQ ID NO: 3729732 - DNA, 18 bp, Homo sapiens
gggtacccactgctctgg

SEQ ID NO: 3729733 - DNA, 23 bp, Homo sapiens
gggtaccttgaacactgggggag

SEQ ID NO: 3729734 - DNA, 22 bp, Homo sapiens
gggtacttgtggacacagctct

SEQ ID NO: 3729735 - DNA, 21 bp, Homo sapiens
gggtagccactggactgacga

SEQ ID NO: 3729736 - DNA, 15 bp, Homo sapiens
gggtagctagaggaa

SEQ ID NO: 3729737 - DNA, 16 bp, Homo sapiens
gggtatatctgggctg

SEQ ID NO: 3729738 - DNA, 20 bp, Homo sapiens
gggtatatttttgtttgttt

SEQ ID NO: 3729739 - DNA, 23 bp, Homo sapiens
gggtatatttttgtttgttttgt

SEQ ID NO: 3729740 - DNA, 19 bp, Homo sapiens
gggtatccaagttggactg

SEQ ID NO: 3729741 - DNA, 21 bp, Homo sapiens
gggtatccaagttggactggg

SEQ ID NO: 3729742 - DNA, 12 bp, Homo sapiens
gggtcaaggaat

SEQ ID NO: 3729743 - DNA, 13 bp, Homo sapiens
gggtcaagttatt

SEQ ID NO: 3729744 - DNA, 21 bp, Homo sapiens
gggtcaggccacggcagccta

SEQ ID NO: 3729745 - DNA, 19 bp, Homo sapiens
gggtccaggggatgggagg

SEQ ID NO: 3729746 - DNA, 16 bp, Homo sapiens
gggtcccagccacccc

SEQ ID NO: 3729747 - DNA, 18 bp, Homo sapiens
gggtcctggctcctgagg

SEQ ID NO: 3729748 - DNA, 23 bp, Homo sapiens
gggtccttccctctccccaagac

SEQ ID NO: 3729749 - DNA, 23 bp, Homo sapiens
gggtctcactatgttgcccaggc

SEQ ID NO: 3729750 - DNA, 15 bp, Homo sapiens
gggtctccctctcct

SEQ ID NO: 3729751 - DNA, 21 bp, Homo sapiens
gggtctgaggaatccagaccc

SEQ ID NO: 3729752 - DNA, 18 bp, Homo sapiens
gggtgaggaccactcctg

SEQ ID NO: 3729753 - DNA, 21 bp, Homo sapiens
gggtgccccccttgccagaca

SEQ ID NO: 3729754 - DNA, 20 bp, Homo sapiens
gggtgccctccactgccctc

SEQ ID NO: 3729755 - DNA, 15 bp, Homo sapiens
gggtggaggagagcc

SEQ ID NO: 3729756 - DNA, 19 bp, Homo sapiens
gggtggaggagagcctggt

SEQ ID NO: 3729757 - DNA, 23 bp, Homo sapiens
gggtggatttgggttggaagtga

SEQ ID NO: 3729758 - DNA, 14 bp, Homo sapiens
gggtgggagagccc

SEQ ID NO: 3729759 - DNA, 17 bp, Homo sapiens
gggtggggtagggctga

SEQ ID NO: 3729760 - DNA, 21 bp, Homo sapiens
gggtggtaagagaatgttata

SEQ ID NO: 3729761 - DNA, 23 bp, Homo sapiens
gggtgtatttattttcctcccca

SEQ ID NO: 3729762 - DNA, 13 bp, Homo sapiens
gggtgtgggaggc

SEQ ID NO: 3729763 - DNA, 22 bp, Homo sapiens
gggtgtgtgtttgtgtgagaga

SEQ ID NO: 3729764 - DNA, 20 bp, Homo sapiens
gggttatgtgtatgtgccat

SEQ ID NO: 3729765 - DNA, 20 bp, Homo sapiens
gggttcacctgggctgaggc

SEQ ID NO: 3729766 - DNA, 17 bp, Homo sapiens
gggttcagcccctcctc

SEQ ID NO: 3729767 - DNA, 13 bp, Homo sapiens
gggttcattattg

SEQ ID NO: 3729768 - DNA, 21 bp, Homo sapiens
gggttccctttccttccatcc

SEQ ID NO: 3729769 - DNA, 15 bp, Homo sapiens
gggttctcacagtgg

SEQ ID NO: 3729770 - DNA, 16 bp, Homo sapiens
ggccatgggcctcctg

SEQ ID NO: 3729771 - DNA, 14 bp, Homo sapiens
ggccatgtgagcca

SEQ ID NO: 3729772 - DNA, 23 bp, Homo sapiens
ggccatgtgagccaccgctgcca

SEQ ID NO: 3729773 - DNA, 23 bp, Homo sapiens
ggcccaaattatcaagctaataa

SEQ ID NO: 3729774 - DNA, 15 bp, Homo sapiens
ggcccacagctccca

SEQ ID NO: 3729775 - DNA, 15 bp, Homo sapiens
ggcccagagaagcca

SEQ ID NO: 3729776 - DNA, 17 bp, Homo sapiens
ggcccagaggcacagcc

SEQ ID NO: 3729777 - DNA, 24 bp, Homo sapiens
ggcccatatctgtgaaatgctggc

SEQ ID NO: 3729778 - DNA, 21 bp, Homo sapiens
ggccccaaaaccacagccctg

SEQ ID NO: 3729779 - DNA, 15 bp, Homo sapiens
ggccccaccacctag

SEQ ID NO: 3729780 - DNA, 19 bp, Homo sapiens
ggccccagaaggcagggaa

SEQ ID NO: 3729781 - DNA, 11 bp, Homo sapiens
ggccccagaga

SEQ ID NO: 3729782 - DNA, 23 bp, Homo sapiens
ggccccagagactcagagggagg

SEQ ID NO: 3729783 - DNA, 13 bp, Homo sapiens
ggccccagcacta

SEQ ID NO: 3729784 - DNA, 18 bp, Homo sapiens
ggccccagggctaccctc

SEQ ID NO: 3729785 - DNA, 13 bp, Homo sapiens
ggcccccgagctg

SEQ ID NO: 3729786 - DNA, 24 bp, Homo sapiens
ggcccctctgactcccaaagagct

SEQ ID NO: 3729787 - DNA, 18 bp, Homo sapiens
ggcccctgccaccctggg

SEQ ID NO: 3729788 - DNA, 19 bp, Homo sapiens
ggcccctttttactcccct

SEQ ID NO: 3729789 - DNA, 16 bp, Homo sapiens
ggcccgacagcctggc

SEQ ID NO: 3729790 - DNA, 23 bp, Homo sapiens
ggcccgcctggcagaactgagct

SEQ ID NO: 3729791 - DNA, 13 bp, Homo sapiens
ggcccggctccag

SEQ ID NO: 3729792 - DNA, 15 bp, Homo sapiens
ggcccggctccaggc

SEQ ID NO: 3729793 - DNA, 19 bp, Homo sapiens
ggccctctggtagacacag

SEQ ID NO: 3729794 - DNA, 14 bp, Homo sapiens
ggccctgccttctt

SEQ ID NO: 3729795 - DNA, 15 bp, Homo sapiens
ggccctggcctgctg

SEQ ID NO: 3729796 - DNA, 17 bp, Homo sapiens
ggccctggcctgctggg

SEQ ID NO: 3729797 - DNA, 15 bp, Homo sapiens
ggccctggggcctgt

SEQ ID NO: 3729798 - DNA, 22 bp, Homo sapiens
ggcccttcctctccactgcctt

SEQ ID NO: 3729799 - DNA, 23 bp, Homo sapiens
ggcccttcctctccactgccttc

SEQ ID NO: 3729800 - DNA, 18 bp, Homo sapiens
ggccgccccagcctctga

SEQ ID NO: 3729801 - DNA, 19 bp, Homo sapiens
ggccgctgttcacccacag

SEQ ID NO: 3729802 - DNA, 20 bp, Homo sapiens
ggccgtcttcactcgccccc

SEQ ID NO: 3729803 - DNA, 16 bp, Homo sapiens
ggccgtggctgcccac

SEQ ID NO: 3729804 - DNA, 17 bp, Homo sapiens
ggcctagatccacacac

SEQ ID NO: 3729805 - DNA, 15 bp, Homo sapiens
ggcctcaaccctccc

SEQ ID NO: 3729806 - DNA, 18 bp, Homo sapiens
ggcctcaaccctccctca

SEQ ID NO: 3729807 - DNA, 13 bp, Homo sapiens
ggcctcagctgcc

SEQ ID NO: 3729808 - DNA, 17 bp, Homo sapiens
ggcctcagctgcctcac

SEQ ID NO: 3729809 - DNA, 22 bp, Homo sapiens
ggcctcagctgcctcacttcct

SEQ ID NO: 3729810 - DNA, 13 bp, Homo sapiens
ggcctcagtgcca

SEQ ID NO: 3729811 - DNA, 20 bp, Homo sapiens
ggcctcagtggactttccac

SEQ ID NO: 3729812 - DNA, 22 bp, Homo sapiens
ggcctcagtggactttccaccc

SEQ ID NO: 3729813 - DNA, 15 bp, Homo sapiens
ggcctccagctcagc

SEQ ID NO: 3729814 - DNA, 23 bp, Homo sapiens
ggcctccctctctcttctgctcc

SEQ ID NO: 3729815 - DNA, 19 bp, Homo sapiens
ggcctcggagcctcatccg

SEQ ID NO: 3729816 - DNA, 15 bp, Homo sapiens
ggcctgatgctccct

SEQ ID NO: 3729817 - DNA, 17 bp, Homo sapiens
ggcctgcctagcactca

SEQ ID NO: 3729818 - DNA, 11 bp, Homo sapiens
ggcctgcctgt

SEQ ID NO: 3729819 - DNA, 19 bp, Homo sapiens
ggcctgctgggctctccac

SEQ ID NO: 3729820 - DNA, 21 bp, Homo sapiens
ggcctgctgggctctccacct

SEQ ID NO: 3729821 - DNA, 22 bp, Homo sapiens
ggcctgctgggctctccacctc

SEQ ID NO: 3729822 - DNA, 23 bp, Homo sapiens
ggcctgctgggctctccacctca

SEQ ID NO: 3729823 - DNA, 12 bp, Homo sapiens
ggcctggccaga

SEQ ID NO: 3729824 - DNA, 15 bp, Homo sapiens
ggcctggccagatgc

SEQ ID NO: 3729825 - DNA, 12 bp, Homo sapiens
ggcctggctccg

SEQ ID NO: 3729826 - DNA, 18 bp, Homo sapiens
ggcctggctccgctgtgt

SEQ ID NO: 3729827 - DNA, 19 bp, Homo sapiens
ggcctgggtctgtgtctct

SEQ ID NO: 3729828 - DNA, 21 bp, Homo sapiens
ggcctgtccctggccatctct

SEQ ID NO: 3729829 - DNA, 17 bp, Homo sapiens
ggcctgtctcatcccca

SEQ ID NO: 3729830 - DNA, 15 bp, Homo sapiens
ggcctgttgcccttt

SEQ ID NO: 3729831 - DNA, 17 bp, Homo sapiens
ggccttccccagcctct

SEQ ID NO: 3729832 - DNA, 12 bp, Homo sapiens
ggccttctctga

SEQ ID NO: 3729833 - DNA, 15 bp, Homo sapiens
ggccttgttctctct

SEQ ID NO: 3729834 - DNA, 14 bp, Homo sapiens
ggcctttggcttca

SEQ ID NO: 3729835 - DNA, 18 bp, Homo sapiens
ggcgacagttttccttct

SEQ ID NO: 3729836 - DNA, 17 bp, Homo sapiens
ggcgatccacctgtctc

SEQ ID NO: 3729837 - DNA, 11 bp, Homo sapiens
ggcgcaggagg

SEQ ID NO: 3729838 - DNA, 14 bp, Homo sapiens
ggctctgccccagc

SEQ ID NO: 3729839 - DNA, 21 bp, Homo sapiens
ggctctgccccagctctggct

SEQ ID NO: 3729840 - DNA, 18 bp, Homo sapiens
ggctctgtggcttgctag

SEQ ID NO: 3729841 - DNA, 12 bp, Homo sapiens
ggctcttctcct

SEQ ID NO: 3729842 - DNA, 13 bp, Homo sapiens
ggctcttctcctt

SEQ ID NO: 3729843 - DNA, 14 bp, Homo sapiens
ggctcttctccttt

SEQ ID NO: 3729844 - DNA, 15 bp, Homo sapiens
ggctcttctcctttc

SEQ ID NO: 3729845 - DNA, 20 bp, Homo sapiens
ggctgaaagaggccaatgcc

SEQ ID NO: 3729846 - DNA, 17 bp, Homo sapiens
ggctgaacggggagaaa

SEQ ID NO: 3729847 - DNA, 21 bp, Homo sapiens
ggctgagactggatactgccc

SEQ ID NO: 3729848 - DNA, 13 bp, Homo sapiens
ggctgagccctgg

SEQ ID NO: 3729849 - DNA, 14 bp, Homo sapiens
ggctgagccctggc

SEQ ID NO: 3729850 - DNA, 17 bp, Homo sapiens
ggctgaggcagaagaat

SEQ ID NO: 3729851 - DNA, 23 bp, Homo sapiens
ggctgagtcatgatctccctgcc

SEQ ID NO: 3729852 - DNA, 24 bp, Homo sapiens
ggctgcaaagggtatcaggtgctg

SEQ ID NO: 3729853 - DNA, 16 bp, Homo sapiens
ggctgcatagaaggag

SEQ ID NO: 3729854 - DNA, 15 bp, Homo sapiens
ggctgccaaggccag

SEQ ID NO: 3729855 - DNA, 17 bp, Homo sapiens
ggctgccaaggccagag

SEQ ID NO: 3729856 - DNA, 18 bp, Homo sapiens
ggctgccatgtgaagagg

SEQ ID NO: 3729857 - DNA, 16 bp, Homo sapiens
ggctgcccacagaggt

SEQ ID NO: 3729858 - DNA, 12 bp, Homo sapiens
ggctgccctgcc

SEQ ID NO: 3729859 - DNA, 12 bp, Homo sapiens
ggctgccctggt

SEQ ID NO: 3729860 - DNA, 15 bp, Homo sapiens
ggctgccctggtgct

SEQ ID NO: 3729861 - DNA, 19 bp, Homo sapiens
ggctgccctggtgctgcca

SEQ ID NO: 3729862 - DNA, 15 bp, Homo sapiens
ggctgctacccagaa

SEQ ID NO: 3729863 - DNA, 16 bp, Homo sapiens
ggctgctacccagaaa

SEQ ID NO: 3729864 - DNA, 18 bp, Homo sapiens
ggctgctcctccagggcc

SEQ ID NO: 3729865 - DNA, 16 bp, Homo sapiens
ggctgctctgcctgtg

SEQ ID NO: 3729866 - DNA, 16 bp, Homo sapiens
ggctgctgacctccac

SEQ ID NO: 3729867 - DNA, 21 bp, Homo sapiens
ggctgctgacctccacagctt

SEQ ID NO: 3729868 - DNA, 12 bp, Homo sapiens
ggctgctggagg

SEQ ID NO: 3729869 - DNA, 15 bp, Homo sapiens
ggctggactccagat

SEQ ID NO: 3729870 - DNA, 23 bp, Homo sapiens
ggctggactccagatctgcaccg

SEQ ID NO: 3729871 - DNA, 14 bp, Homo sapiens
ggctggactggctg

SEQ ID NO: 3729872 - DNA, 13 bp, Homo sapiens
ggctggaggcagg

SEQ ID NO: 3729873 - DNA, 15 bp, Homo sapiens
ggctggcctcagact

SEQ ID NO: 3729874 - DNA, 17 bp, Homo sapiens
ggctggctaactggaag

SEQ ID NO: 3729875 - DNA, 13 bp, Homo sapiens
ggctgggcagctg

SEQ ID NO: 3729876 - DNA, 17 bp, Homo sapiens
ggctgggcccagaggca

SEQ ID NO: 3729877 - DNA, 11 bp, Homo sapiens
ggctgggcttc

SEQ ID NO: 3729878 - DNA, 13 bp, Homo sapiens
ggctgggcttcag

SEQ ID NO: 3729879 - DNA, 15 bp, Homo sapiens
ggctgggggcctcac

SEQ ID NO: 3729880 - DNA, 19 bp, Homo sapiens
ggctgggggcctcagtgcc

SEQ ID NO: 3729881 - DNA, 17 bp, Homo sapiens
ggctgggtgcccacagc

SEQ ID NO: 3729882 - DNA, 21 bp, Homo sapiens
ggctgggtgcccacagcccgc

SEQ ID NO: 3729883 - DNA, 22 bp, Homo sapiens
ggctgggtgcccacagcccgca

SEQ ID NO: 3729884 - DNA, 16 bp, Homo sapiens
ggctggtgtcacctga

SEQ ID NO: 3729885 - DNA, 17 bp, Homo sapiens
ggctgtcagcaggaagc

SEQ ID NO: 3729886 - DNA, 18 bp, Homo sapiens
ggctgtcagtatgacatt

SEQ ID NO: 3729887 - DNA, 18 bp, Homo sapiens
ggctgtcttctcaggctc

SEQ ID NO: 3729888 - DNA, 19 bp, Homo sapiens
ggctgtgcgctgacaacca

SEQ ID NO: 3729889 - DNA, 14 bp, Homo sapiens
ggctgtgggctccc

SEQ ID NO: 3729890 - DNA, 18 bp, Homo sapiens
ggctgtgggctcccttcc

SEQ ID NO: 3729891 - DNA, 21 bp, Homo sapiens
ggcttcacggaagagccttgc

SEQ ID NO: 3729892 - DNA, 18 bp, Homo sapiens
ggcttccatttgtgtgtg

SEQ ID NO: 3729893 - DNA, 22 bp, Homo sapiens
ggcttcccgctcagccctccct

SEQ ID NO: 3729894 - DNA, 18 bp, Homo sapiens
ggcttctgatgaatcttg

SEQ ID NO: 3729895 - DNA, 13 bp, Homo sapiens
ggcttctggagcc

SEQ ID NO: 3729896 - DNA, 16 bp, Homo sapiens
ggctttcatgaggagg

SEQ ID NO: 3729897 - DNA, 13 bp, Homo sapiens
ggctttctggaga

SEQ ID NO: 3729898 - DNA, 13 bp, Homo sapiens
ggcttttcactgc

SEQ ID NO: 3729899 - DNA, 17 bp, Homo sapiens
ggcttttcactgctggc

SEQ ID NO: 3729900 - DNA, 18 bp, Homo sapiens
ggcttttgtttcttccct

SEQ ID NO: 3729901 - DNA, 13 bp, Homo sapiens
gggaaaatcagcc

SEQ ID NO: 3729902 - DNA, 14 bp, Homo sapiens
gggaaataagagag

SEQ ID NO: 3729903 - DNA, 22 bp, Homo sapiens
gggaacagactggaagcacagc

SEQ ID NO: 3729904 - DNA, 15 bp, Homo sapiens
gggaacatgaagcca

SEQ ID NO: 3729905 - DNA, 12 bp, Homo sapiens
gggaagagaaac

SEQ ID NO: 3729906 - DNA, 14 bp, Homo sapiens
gggaagagaaacag

SEQ ID NO: 3729907 - DNA, 22 bp, Homo sapiens
gggaagcaaaaacgaaagctgg

SEQ ID NO: 3729908 - DNA, 14 bp, Homo sapiens
gggaagcccagctc

SEQ ID NO: 3729909 - DNA, 12 bp, Homo sapiens
gggaagccctgg

SEQ ID NO: 3729910 - DNA, 22 bp, Homo sapiens
gggaaggaagaggaagagtgca

SEQ ID NO: 3729911 - DNA, 23 bp, Homo sapiens
gggaggaagcaggttgaggggct

SEQ ID NO: 3729912 - DNA, 19 bp, Homo sapiens
gggaggaatcgaggaacca

SEQ ID NO: 3729913 - DNA, 22 bp, Homo sapiens
gggaggatgttctgggacacag

SEQ ID NO: 3729914 - DNA, 13 bp, Homo sapiens
gggaggccaagga

SEQ ID NO: 3729915 - DNA, 14 bp, Homo sapiens
gggaggctgaggcg

SEQ ID NO: 3729916 - DNA, 15 bp, Homo sapiens
gggagggcccacttc

SEQ ID NO: 3729917 - DNA, 14 bp, Homo sapiens
gggaggtcattttg

SEQ ID NO: 3729918 - DNA, 17 bp, Homo sapiens
gggagtacctgctgccc

SEQ ID NO: 3729919 - DNA, 17 bp, Homo sapiens
gggagtctgaagcagat

SEQ ID NO: 3729920 - DNA, 18 bp, Homo sapiens
gggagtgacagaggcagc

SEQ ID NO: 3729921 - DNA, 11 bp, Homo sapiens
gggagtgagct

SEQ ID NO: 3729922 - DNA, 14 bp, Homo sapiens
gggagtgagctggt

SEQ ID NO: 3729923 - DNA, 21 bp, Homo sapiens
gggagtgggacagagtctggg

SEQ ID NO: 3729924 - DNA, 20 bp, Homo sapiens
gggagttcgagaccaacctg

SEQ ID NO: 3729925 - DNA, 23 bp, Homo sapiens
gggagttcgagaccaacctgacc

SEQ ID NO: 3729926 - DNA, 22 bp, Homo sapiens
gggagttgtcaagtctctgctg

SEQ ID NO: 3729927 - DNA, 13 bp, Homo sapiens
gggatagagagag

SEQ ID NO: 3729928 - DNA, 16 bp, Homo sapiens
gggatagcactgagca

SEQ ID NO: 3729929 - DNA, 17 bp, Homo sapiens
gggatgccatctgtggg

SEQ ID NO: 3729930 - DNA, 12 bp, Homo sapiens
gggatgcttcat

SEQ ID NO: 3729931 - DNA, 16 bp, Homo sapiens
gggatgttctggccct

SEQ ID NO: 3729932 - DNA, 15 bp, Homo sapiens
gggattcaggctgct

SEQ ID NO: 3729933 - DNA, 20 bp, Homo sapiens
gggcaacccccagcctgcta

SEQ ID NO: 3729934 - DNA, 14 bp, Homo sapiens
gggcaacgaagaaa

SEQ ID NO: 3729935 - DNA, 13 bp, Homo sapiens
gggcaaggagacc

SEQ ID NO: 3729936 - DNA, 24 bp, Homo sapiens
gggcaagtccctgactctctgtga

SEQ ID NO: 3729937 - DNA, 13 bp, Homo sapiens
gggcacagggtct

SEQ ID NO: 3729938 - DNA, 16 bp, Homo sapiens
gggcacagggtctcta

SEQ ID NO: 3729939 - DNA, 18 bp, Homo sapiens
gggcacctataataccag

SEQ ID NO: 3729940 - DNA, 20 bp, Homo sapiens
gggcactcagaagacactga

SEQ ID NO: 3729941 - DNA, 13 bp, Homo sapiens
gggcactggtggc

SEQ ID NO: 3729942 - DNA, 16 bp, Homo sapiens
gggcactggtggcccg

SEQ ID NO: 3729943 - DNA, 15 bp, Homo sapiens
gggcagaaagtggcc

SEQ ID NO: 3729944 - DNA, 14 bp, Homo sapiens
gggcagagccggga

SEQ ID NO: 3729945 - DNA, 17 bp, Homo sapiens
gggcagagccgggaagc

SEQ ID NO: 3729946 - DNA, 15 bp, Homo sapiens
gggcagaggctggag

SEQ ID NO: 3729947 - DNA, 14 bp, Homo sapiens
gggcagagggcaga

SEQ ID NO: 3729948 - DNA, 16 bp, Homo sapiens
gggcagcacagagagg

SEQ ID NO: 3729949 - DNA, 12 bp, Homo sapiens
gggcagctgcca

SEQ ID NO: 3729950 - DNA, 16 bp, Homo sapiens
gggcagctgccagaga

SEQ ID NO: 3729951 - DNA, 19 bp, Homo sapiens
gggcagctgttagagtcca

SEQ ID NO: 3729952 - DNA, 16 bp, Homo sapiens
gggcaggaaggagagc

SEQ ID NO: 3729953 - DNA, 19 bp, Homo sapiens
gggcaggaaggagagcctg

SEQ ID NO: 3729954 - DNA, 18 bp, Homo sapiens
gggcatctggccttacac

SEQ ID NO: 3729955 - DNA, 14 bp, Homo sapiens
gggcatgctggggc

SEQ ID NO: 3729956 - DNA, 17 bp, Homo sapiens
gggcatgctggggcaag

SEQ ID NO: 3729957 - DNA, 15 bp, Homo sapiens
gggcatggccaggtg

SEQ ID NO: 3729958 - DNA, 19 bp, Homo sapiens
gggcatggtatttgagaca

SEQ ID NO: 3729959 - DNA, 23 bp, Homo sapiens
gggccaaatatattctctttggt

SEQ ID NO: 3729960 - DNA, 15 bp, Homo sapiens
gggccaacaccaggg

SEQ ID NO: 3729961 - DNA, 15 bp, Homo sapiens
gggccaagtcccacc

SEQ ID NO: 3729962 - DNA, 17 bp, Homo sapiens
gggccacctccccaggc

SEQ ID NO: 3729963 - DNA, 14 bp, Homo sapiens
gggccacgtgccag

SEQ ID NO: 3729964 - DNA, 18 bp, Homo sapiens
gggccacgtgccaggccc

SEQ ID NO: 3729965 - DNA, 15 bp, Homo sapiens
gggccagcccctccc

SEQ ID NO: 3729966 - DNA, 14 bp, Homo sapiens
gggccagggccctg

SEQ ID NO: 3729967 - DNA, 16 bp, Homo sapiens
gggccagggccctgca

SEQ ID NO: 3729968 - DNA, 18 bp, Homo sapiens
gggcccaagacagatgcc

SEQ ID NO: 3729969 - DNA, 14 bp, Homo sapiens
gggcccagattcta

SEQ ID NO: 3729970 - DNA, 18 bp, Homo sapiens
gggccccagaaggcaggg

SEQ ID NO: 3729971 - DNA, 12 bp, Homo sapiens
gggccctgagct

SEQ ID NO: 3729972 - DNA, 15 bp, Homo sapiens
gggccctgcagaggg

SEQ ID NO: 3729973 - DNA, 19 bp, Homo sapiens
gggccctggtccttccagg

SEQ ID NO: 3729974 - DNA, 19 bp, Homo sapiens
gggcctcagggcagcctgc

SEQ ID NO: 3729975 - DNA, 13 bp, Homo sapiens
gggcctcagtgcc

SEQ ID NO: 3729976 - DNA, 15 bp, Homo sapiens
gggcctcagtgccac

SEQ ID NO: 3729977 - DNA, 22 bp, Homo sapiens
gggcctccattcctggagcccg

SEQ ID NO: 3729978 - DNA, 18 bp, Homo sapiens
gggcctgacctccccctc

SEQ ID NO: 3729979 - DNA, 10 bp, Homo sapiens
gggcctggca

SEQ ID NO: 3729980 - DNA, 22 bp, Homo sapiens
gggcctggcagccgtgccttca

SEQ ID NO: 3729981 - DNA, 23 bp, Homo sapiens
gggccttgctacctcaaggggga

SEQ ID NO: 3729982 - DNA, 15 bp, Homo sapiens
gggcgggaggatgtt

SEQ ID NO: 3729983 - DNA, 20 bp, Homo sapiens
gggctaagagctagcgctgc

SEQ ID NO: 3729984 - DNA, 23 bp, Homo sapiens
gggctaagagctagcgctgccgc

SEQ ID NO: 3729985 - DNA, 11 bp, Homo sapiens
gggctcagcct

SEQ ID NO: 3729986 - DNA, 13 bp, Homo sapiens
gggctcagcctgg

SEQ ID NO: 3729987 - DNA, 20 bp, Homo sapiens
gggctcagcctggtgggcct

SEQ ID NO: 3729988 - DNA, 13 bp, Homo sapiens
ggtggggcagctt

SEQ ID NO: 3729989 - DNA, 16 bp, Homo sapiens
ggtggtctgcaggcag

SEQ ID NO: 3729990 - DNA, 17 bp, Homo sapiens
ggtgtatttattttcct

SEQ ID NO: 3729991 - DNA, 17 bp, Homo sapiens
ggtgtccccagcccact

SEQ ID NO: 3729992 - DNA, 21 bp, Homo sapiens
ggtgtgcggcctttggcttca

SEQ ID NO: 3729993 - DNA, 13 bp, Homo sapiens
ggtgtgggggaag

SEQ ID NO: 3729994 - DNA, 17 bp, Homo sapiens
ggtgttgacatgtgctt

SEQ ID NO: 3729995 - DNA, 13 bp, Homo sapiens
ggttaataagttt

SEQ ID NO: 3729996 - DNA, 21 bp, Homo sapiens
ggttacactgttagaacacta

SEQ ID NO: 3729997 - DNA, 17 bp, Homo sapiens
ggttagcagagctggac

SEQ ID NO: 3729998 - DNA, 22 bp, Homo sapiens
ggttagctcagccccagcccag

SEQ ID NO: 3729999 - DNA, 14 bp, Homo sapiens
ggttatacatgaca

SEQ ID NO: 3730000 - DNA, 20 bp, Homo sapiens
ggttatttagggaactgctt

SEQ ID NO: 3730001 - DNA, 21 bp, Homo sapiens
ggttcaagcgattcttctgct

SEQ ID NO: 3730002 - DNA, 15 bp, Homo sapiens
ggttcaccagcctct

SEQ ID NO: 3730003 - DNA, 16 bp, Homo sapiens
ggttcagcccctcctc

SEQ ID NO: 3730004 - DNA, 18 bp, Homo sapiens
ggttcagggttggcccct

SEQ ID NO: 3730005 - DNA, 17 bp, Homo sapiens
ggttcattattggaatt

SEQ ID NO: 3730006 - DNA, 14 bp, Homo sapiens
ggttcccccagccc

SEQ ID NO: 3730007 - DNA, 17 bp, Homo sapiens
ggttctcctctcccctc

SEQ ID NO: 3730008 - DNA, 12 bp, Homo sapiens
ggttctgggtgg

SEQ ID NO: 3730009 - DNA, 17 bp, Homo sapiens
ggttctttcttcctctg

SEQ ID NO: 3730010 - DNA, 14 bp, Homo sapiens
ggttgaagcaccaa

SEQ ID NO: 3730011 - DNA, 16 bp, Homo sapiens
ggttgactttcaggta

SEQ ID NO: 3730012 - DNA, 13 bp, Homo sapiens
ggttgaggtttca

SEQ ID NO: 3730013 - DNA, 13 bp, Homo sapiens
tggacagtcctgg

SEQ ID NO: 3730014 - DNA, 15 bp, Homo sapiens
tggacattcagaaca

SEQ ID NO: 3730015 - DNA, 15 bp, Homo sapiens
tggacattgtctgcg

SEQ ID NO: 3730016 - DNA, 13 bp, Homo sapiens
tggaccaaagctg

SEQ ID NO: 3730017 - DNA, 14 bp, Homo sapiens
tggaccaaagctga

SEQ ID NO: 3730018 - DNA, 15 bp, Homo sapiens
tggaccactgggcaa

SEQ ID NO: 3730019 - DNA, 13 bp, Homo sapiens
tggaccaggacag

SEQ ID NO: 3730020 - DNA, 14 bp, Homo sapiens
tggaccaggacagg

SEQ ID NO: 3730021 - DNA, 18 bp, Homo sapiens
tggaccaggacaggacca

SEQ ID NO: 3730022 - DNA, 13 bp, Homo sapiens
tggaccgagtaga

SEQ ID NO: 3730023 - DNA, 17 bp, Homo sapiens
tggaccgagtagaggca

SEQ ID NO: 3730024 - DNA, 16 bp, Homo sapiens
tggaccttgagaccac

SEQ ID NO: 3730025 - DNA, 18 bp, Homo sapiens
tggactccagatctgcac

SEQ ID NO: 3730026 - DNA, 18 bp, Homo sapiens
tggactgaagcctgcagg

SEQ ID NO: 3730027 - DNA, 19 bp, Homo sapiens
tggactgaagcctgcagga

SEQ ID NO: 3730028 - DNA, 13 bp, Homo sapiens
tggactggctaga

SEQ ID NO: 3730029 - DNA, 20 bp, Homo sapiens
tggactggctagagtcctca

SEQ ID NO: 3730030 - DNA, 16 bp, Homo sapiens
tggactggtggcccct

SEQ ID NO: 3730031 - DNA, 20 bp, Homo sapiens
tggactgtgatgccacacag

SEQ ID NO: 3730032 - DNA, 20 bp, Homo sapiens
tggacttcttttactcatga

SEQ ID NO: 3730033 - DNA, 19 bp, Homo sapiens
tggacttttcgttaacatt

SEQ ID NO: 3730034 - DNA, 22 bp, Homo sapiens
tggacttttcgttaacattgac

SEQ ID NO: 3730035 - DNA, 14 bp, Homo sapiens
tggagaaaccctgt

SEQ ID NO: 3730036 - DNA, 16 bp, Homo sapiens
tggagaaaccctgtct

SEQ ID NO: 3730037 - DNA, 22 bp, Homo sapiens
tggagaaactgtagtctcagga

SEQ ID NO: 3730038 - DNA, 13 bp, Homo sapiens
tggagaagcggct

SEQ ID NO: 3730039 - DNA, 18 bp, Homo sapiens
tggagaataattctttga

SEQ ID NO: 3730040 - DNA, 13 bp, Homo sapiens
tggagagagggga

SEQ ID NO: 3730041 - DNA, 14 bp, Homo sapiens
tggagagcaacaca

SEQ ID NO: 3730042 - DNA, 20 bp, Homo sapiens
tggagagggacagcccactg

SEQ ID NO: 3730043 - DNA, 19 bp, Homo sapiens
tggagagggatgaggtgct

SEQ ID NO: 3730044 - DNA, 17 bp, Homo sapiens
tggagagtgcaacagta

SEQ ID NO: 3730045 - DNA, 23 bp, Homo sapiens
tggagatcaccagtgtgtggctt

SEQ ID NO: 3730046 - DNA, 18 bp, Homo sapiens
tggagatgggatgcttgc

SEQ ID NO: 3730047 - DNA, 17 bp, Homo sapiens
tggagcaccaggcacga

SEQ ID NO: 3730048 - DNA, 21 bp, Homo sapiens
tggagcactctgagtttacca

SEQ ID NO: 3730049 - DNA, 17 bp, Homo sapiens
tggagccaatggagact

SEQ ID NO: 3730050 - DNA, 22 bp, Homo sapiens
tggagccacctgtcccacctca

SEQ ID NO: 3730051 - DNA, 14 bp, Homo sapiens
tggagccagggagc

SEQ ID NO: 3730052 - DNA, 23 bp, Homo sapiens
tggagccagggagcggccgcctg

SEQ ID NO: 3730053 - DNA, 20 bp, Homo sapiens
tggagcccagggagcggaaa

SEQ ID NO: 3730054 - DNA, 14 bp, Homo sapiens
tggagccccatcag

SEQ ID NO: 3730055 - DNA, 15 bp, Homo sapiens
tggagcccttgggtt

SEQ ID NO: 3730056 - DNA, 12 bp, Homo sapiens
tggagctcctgg

SEQ ID NO: 3730057 - DNA, 15 bp, Homo sapiens
tggaggaatgctccc

SEQ ID NO: 3730058 - DNA, 21 bp, Homo sapiens
tggaggagaagaattttcaga

SEQ ID NO: 3730059 - DNA, 13 bp, Homo sapiens
tggaggaggaggc

SEQ ID NO: 3730060 - DNA, 15 bp, Homo sapiens
tggaggaggaggcaa

SEQ ID NO: 3730061 - DNA, 15 bp, Homo sapiens
tggaggatggagaga

SEQ ID NO: 3730062 - DNA, 20 bp, Homo sapiens
tggaggatggagagagggga

SEQ ID NO: 3730063 - DNA, 17 bp, Homo sapiens
tggaggcacacagctgc

SEQ ID NO: 3730064 - DNA, 14 bp, Homo sapiens
tggaggcagggcct

SEQ ID NO: 3730065 - DNA, 22 bp, Homo sapiens
tggaggcagggccttgcccaga

SEQ ID NO: 3730066 - DNA, 14 bp, Homo sapiens
tggaggccagccag

SEQ ID NO: 3730067 - DNA, 14 bp, Homo sapiens
tggaggccaggaat

SEQ ID NO: 3730068 - DNA, 21 bp, Homo sapiens
tggaggccgggtgctcagggc

SEQ ID NO: 3730069 - DNA, 16 bp, Homo sapiens
tggaggcctctgggcc

SEQ ID NO: 3730070 - DNA, 22 bp, Homo sapiens
tggaggcctctgggcctcctct

SEQ ID NO: 3730071 - DNA, 20 bp, Homo sapiens
tggaggttaaggctgaggaa

SEQ ID NO: 3730072 - DNA, 21 bp, Homo sapiens
tggaggttaaggctgaggaaa

SEQ ID NO: 3730073 - DNA, 14 bp, Homo sapiens
tggaggttgcagtg

SEQ ID NO: 3730074 - DNA, 17 bp, Homo sapiens
tggagtggatgcctcag

SEQ ID NO: 3730075 - DNA, 15 bp, Homo sapiens
tggagtgtgtattgt

SEQ ID NO: 3730076 - DNA, 19 bp, Homo sapiens
tggagtgtgtattgttccc

SEQ ID NO: 3730077 - DNA, 18 bp, Homo sapiens
tggataatgctgttgcct

SEQ ID NO: 3730078 - DNA, 17 bp, Homo sapiens
tggatactgcccggggc

SEQ ID NO: 3730079 - DNA, 22 bp, Homo sapiens
tggatactgcccggggcagctg

SEQ ID NO: 3730080 - DNA, 13 bp, Homo sapiens
tggatattttcaa

SEQ ID NO: 3730081 - DNA, 18 bp, Homo sapiens
tggatattttcaaattgt

SEQ ID NO: 3730082 - DNA, 24 bp, Homo sapiens
tggatcaaaatctgtagagcaggg

SEQ ID NO: 3730083 - DNA, 21 bp, Homo sapiens
tggatctgggaccctttcctt

SEQ ID NO: 3730084 - DNA, 17 bp, Homo sapiens
tggatgatgtttcgtga

SEQ ID NO: 3730085 - DNA, 14 bp, Homo sapiens
tggatgcctggtgg

SEQ ID NO: 3730086 - DNA, 15 bp, Homo sapiens
tggatgcctggtggc

SEQ ID NO: 3730087 - DNA, 18 bp, Homo sapiens
tggatgcctggtggcagc

SEQ ID NO: 3730088 - DNA, 13 bp, Homo sapiens
tggatggcttcta

SEQ ID NO: 3730089 - DNA, 15 bp, Homo sapiens
tggattctcagatat

SEQ ID NO: 3730090 - DNA, 16 bp, Homo sapiens
tggattctcagatatt

SEQ ID NO: 3730091 - DNA, 17 bp, Homo sapiens
tggattgacagtaactt

SEQ ID NO: 3730092 - DNA, 18 bp, Homo sapiens
tggatttgcctgtgccac

SEQ ID NO: 3730093 - DNA, 17 bp, Homo sapiens
tggcaaacttcagactg

SEQ ID NO: 3730094 - DNA, 16 bp, Homo sapiens
tggcaatagtgtgttc

SEQ ID NO: 3730095 - DNA, 18 bp, Homo sapiens
tggcaatagtgtgttctg

SEQ ID NO: 3730096 - DNA, 23 bp, Homo sapiens
tggcaattctttgacctcaacct

SEQ ID NO: 3730097 - DNA, 14 bp, Homo sapiens
tggcacagaaacac

SEQ ID NO: 3730098 - DNA, 15 bp, Homo sapiens
tggcacagggcagtg

SEQ ID NO: 3730099 - DNA, 18 bp, Homo sapiens
tggcacagggcagtggga

SEQ ID NO: 3730100 - DNA, 20 bp, Homo sapiens
tggcacccggcccctgctgg

SEQ ID NO: 3730101 - DNA, 21 bp, Homo sapiens
tggcacccggcccctgctggt

SEQ ID NO: 3730102 - DNA, 19 bp, Homo sapiens
tggcactgactgggcatag

SEQ ID NO: 3730103 - DNA, 13 bp, Homo sapiens
tggcactggatgc

SEQ ID NO: 3730104 - DNA, 15 bp, Homo sapiens
tggcactggatgcag

SEQ ID NO: 3730105 - DNA, 18 bp, Homo sapiens
tggcactggatgcagaaa

SEQ ID NO: 3730106 - DNA, 23 bp, Homo sapiens
tggcagaaagcaaatgtgacctg

SEQ ID NO: 3730107 - DNA, 14 bp, Homo sapiens
tggcagaagtgttt

SEQ ID NO: 3730108 - DNA, 20 bp, Homo sapiens
tggcagaataatctttgggt

SEQ ID NO: 3730109 - DNA, 20 bp, Homo sapiens
tggcagataatcagcctctt

SEQ ID NO: 3730110 - DNA, 16 bp, Homo sapiens
tggcagattttacaaa

SEQ ID NO: 3730111 - DNA, 22 bp, Homo sapiens
tggcagattttacaaaagatgt

SEQ ID NO: 3730112 - DNA, 14 bp, Homo sapiens
tggcagcagagtgt

SEQ ID NO: 3730113 - DNA, 17 bp, Homo sapiens
tggcagccctgtaggga

SEQ ID NO: 3730114 - DNA, 16 bp, Homo sapiens
tggcagccgtgccttc

SEQ ID NO: 3730115 - DNA, 17 bp, Homo sapiens
tggcagctgcggtccac

SEQ ID NO: 3730116 - DNA, 23 bp, Homo sapiens
tggcagctgcggtccacccagga

SEQ ID NO: 3730117 - DNA, 22 bp, Homo sapiens
tggcaggggtggaggagagcct

SEQ ID NO: 3730118 - DNA, 17 bp, Homo sapiens
tggcagtaaagagaaac

SEQ ID NO: 3730119 - DNA, 19 bp, Homo sapiens
tggcagtaaagagaaactt

SEQ ID NO: 3730120 - DNA, 22 bp, Homo sapiens
tggcagtaaagagaaactttgt

SEQ ID NO: 3730121 - DNA, 13 bp, Homo sapiens
tgggaagacatga

SEQ ID NO: 3730122 - DNA, 22 bp, Homo sapiens
tgggaagataggctctgcacag

SEQ ID NO: 3730123 - DNA, 12 bp, Homo sapiens
tgggaaggactt

SEQ ID NO: 3730124 - DNA, 23 bp, Homo sapiens
tgggacctcagttttatcatttt

SEQ ID NO: 3730125 - DNA, 16 bp, Homo sapiens
tgggactacaggcacc

SEQ ID NO: 3730126 - DNA, 13 bp, Homo sapiens
tgggactggagtc

SEQ ID NO: 3730127 - DNA, 18 bp, Homo sapiens
tgggactgggagggccca

SEQ ID NO: 3730128 - DNA, 22 bp, Homo sapiens
tgggagaagggggtcaaagcaa

SEQ ID NO: 3730129 - DNA, 19 bp, Homo sapiens
tgggagacacccaaagggt

SEQ ID NO: 3730130 - DNA, 14 bp, Homo sapiens
tgggagagcccagc

SEQ ID NO: 3730131 - DNA, 21 bp, Homo sapiens
tgggagcagcggtttggggag

SEQ ID NO: 3730132 - DNA, 12 bp, Homo sapiens
tgggagccaggg

SEQ ID NO: 3730133 - DNA, 22 bp, Homo sapiens
tgggagctgcctgttcagctcc

SEQ ID NO: 3730134 - DNA, 23 bp, Homo sapiens
tgggagctgcctgttcagctcca

SEQ ID NO: 3730135 - DNA, 24 bp, Homo sapiens
tgggagctgcctgttcagctccag

SEQ ID NO: 3730136 - DNA, 20 bp, Homo sapiens
tgggagcttgattctcagca

SEQ ID NO: 3730137 - DNA, 20 bp, Homo sapiens
tgggaggatctcttgagcct

SEQ ID NO: 3730138 - DNA, 21 bp, Homo sapiens
tgggaggattgcttgagctca

SEQ ID NO: 3730139 - DNA, 22 bp, Homo sapiens
tgggaggattgcttgagctcag

SEQ ID NO: 3730140 - DNA, 20 bp, Homo sapiens
tgggaggcagaggttgcagt

SEQ ID NO: 3730141 - DNA, 14 bp, Homo sapiens
tgggaggccaagga

SEQ ID NO: 3730142 - DNA, 19 bp, Homo sapiens
tgggaggccaaggtgggag

SEQ ID NO: 3730143 - DNA, 13 bp, Homo sapiens
tgggaggctgagg

SEQ ID NO: 3730144 - DNA, 14 bp, Homo sapiens
tgggaggcttcccc

SEQ ID NO: 3730145 - DNA, 12 bp, Homo sapiens
tgggagggccca

SEQ ID NO: 3730146 - DNA, 17 bp, Homo sapiens
tgggaggtcaaggctgc

SEQ ID NO: 3730147 - DNA, 19 bp, Homo sapiens
tgggaggtcaaggctgcag

SEQ ID NO: 3730148 - DNA, 20 bp, Homo sapiens
tgggaggtcaaggctgcagt

SEQ ID NO: 3730149 - DNA, 13 bp, Homo sapiens
tgggaggtcgagg

SEQ ID NO: 3730150 - DNA, 20 bp, Homo sapiens
tgggaggtggaggttgcagt

SEQ ID NO: 3730151 - DNA, 15 bp, Homo sapiens
tgggagtgagctggt

SEQ ID NO: 3730152 - DNA, 17 bp, Homo sapiens
tgggagttcagctgctt

SEQ ID NO: 3730153 - DNA, 20 bp, Homo sapiens
tgggataaaggcccagactc

SEQ ID NO: 3730154 - DNA, 13 bp, Homo sapiens
tgggatggaggag

SEQ ID NO: 3730155 - DNA, 14 bp, Homo sapiens
tgggatggaggaga

SEQ ID NO: 3730156 - DNA, 16 bp, Homo sapiens
tgggattacaggtgtg

SEQ ID NO: 3730157 - DNA, 15 bp, Homo sapiens
tgggcaaacaggcag

SEQ ID NO: 3730158 - DNA, 16 bp, Homo sapiens
tgggcaaacaggcagt

SEQ ID NO: 3730159 - DNA, 16 bp, Homo sapiens
tgggcaacagagcaag

SEQ ID NO: 3730160 - DNA, 17 bp, Homo sapiens
tgggcaacccccagcct

SEQ ID NO: 3730161 - DNA, 16 bp, Homo sapiens
tgggcaatatagcaag

SEQ ID NO: 3730162 - DNA, 19 bp, Homo sapiens
tgggcacctataataccag

SEQ ID NO: 3730163 - DNA, 17 bp, Homo sapiens
tgggcacctggggagtg

SEQ ID NO: 3730164 - DNA, 21 bp, Homo sapiens
tgggcacgctgtgggcaggtg

SEQ ID NO: 3730165 - DNA, 15 bp, Homo sapiens
tgggcagccaggctg

SEQ ID NO: 3730166 - DNA, 16 bp, Homo sapiens
tgggcagccaggctgc

SEQ ID NO: 3730167 - DNA, 18 bp, Homo sapiens
tgggcattgatggggaag

SEQ ID NO: 3730168 - DNA, 14 bp, Homo sapiens
tgggcattgctttc

SEQ ID NO: 3730169 - DNA, 20 bp, Homo sapiens
tgggcattgctttccactga

SEQ ID NO: 3730170 - DNA, 16 bp, Homo sapiens
tgggccaactcacctg

SEQ ID NO: 3730171 - DNA, 19 bp, Homo sapiens
tgggccaagccagggatgg

SEQ ID NO: 3730172 - DNA, 15 bp, Homo sapiens
tgggccagcccctcc

SEQ ID NO: 3730173 - DNA, 17 bp, Homo sapiens
tgggccaggacaggccc

SEQ ID NO: 3730174 - DNA, 14 bp, Homo sapiens
tgggccagtgtggg

SEQ ID NO: 3730175 - DNA, 22 bp, Homo sapiens
tgggcccaagacagatgcccca

SEQ ID NO: 3730176 - DNA, 12 bp, Homo sapiens
tgggcccagaag

SEQ ID NO: 3730177 - DNA, 20 bp, Homo sapiens
tgggcccctccctacctcaa

SEQ ID NO: 3730178 - DNA, 23 bp, Homo sapiens
tgggcctcaaggacttgaaagca

SEQ ID NO: 3730179 - DNA, 18 bp, Homo sapiens
tgggcctcctctgtccag

SEQ ID NO: 3730180 - DNA, 14 bp, Homo sapiens
tgggcctcctgtgt

SEQ ID NO: 3730181 - DNA, 22 bp, Homo sapiens
tgggcctgtcgtgccagtcctg

SEQ ID NO: 3730182 - DNA, 13 bp, Homo sapiens
tgggccttgctac

SEQ ID NO: 3730183 - DNA, 22 bp, Homo sapiens
tgggctaagtgatcctcccacc

SEQ ID NO: 3730184 - DNA, 16 bp, Homo sapiens
tgggctactttgtcct

SEQ ID NO: 3730185 - DNA, 17 bp, Homo sapiens
tgggctctccacctcag

SEQ ID NO: 3730186 - DNA, 18 bp, Homo sapiens
tgggctctccacctcagc

SEQ ID NO: 3730187 - DNA, 20 bp, Homo sapiens
tgggctctccacctcagcct

SEQ ID NO: 3730188 - DNA, 20 bp, Homo sapiens
tgggctctgccccagctctg

SEQ ID NO: 3730189 - DNA, 14 bp, Homo sapiens
tgggctgagactgg

SEQ ID NO: 3730190 - DNA, 23 bp, Homo sapiens
tgggctgagactggatactgccc

SEQ ID NO: 3730191 - DNA, 15 bp, Homo sapiens
tgggctgagccctgg

SEQ ID NO: 3730192 - DNA, 16 bp, Homo sapiens
tgggctgccatgtgaa

SEQ ID NO: 3730193 - DNA, 19 bp, Homo sapiens
tgggctgccctggtgctgc

SEQ ID NO: 3730194 - DNA, 22 bp, Homo sapiens
tgggctgtgagtgtaagtgtga

SEQ ID NO: 3730195 - DNA, 15 bp, Homo sapiens
tgggcttcagtggca

SEQ ID NO: 3730196 - DNA, 21 bp, Homo sapiens
tgggcttcagtggcagctgct

SEQ ID NO: 3730197 - DNA, 23 bp, Homo sapiens
tgggctttgattccatctccttg

SEQ ID NO: 3730198 - DNA, 15 bp, Homo sapiens
tggggaacaagggtg

SEQ ID NO: 3730199 - DNA, 24 bp, Homo sapiens
tggggaagactgtggctgctagca

SEQ ID NO: 3730200 - DNA, 18 bp, Homo sapiens
tggggagacacctcagag

SEQ ID NO: 3730201 - DNA, 20 bp, Homo sapiens
tggggagatcggggccagag

SEQ ID NO: 3730202 - DNA, 23 bp, Homo sapiens
tggggagatcggggccagaggca

SEQ ID NO: 3730203 - DNA, 22 bp, Homo sapiens
tggggagccaacagaagcttcc

SEQ ID NO: 3730204 - DNA, 19 bp, Homo sapiens
tggggagtaggacatacca

SEQ ID NO: 3730205 - DNA, 13 bp, Homo sapiens
tggggagtgggac

SEQ ID NO: 3730206 - DNA, 16 bp, Homo sapiens
tggggagtgggacaga

SEQ ID NO: 3730207 - DNA, 14 bp, Homo sapiens
tggggcagcacaga

SEQ ID NO: 3730208 - DNA, 13 bp, Homo sapiens
tggggcagcttga

SEQ ID NO: 3730209 - DNA, 12 bp, Homo sapiens
tggggcaggcag

SEQ ID NO: 3730210 - DNA, 22 bp, Homo sapiens
tggggcccctttttactcccct

SEQ ID NO: 3730211 - DNA, 17 bp, Homo sapiens
tggggctctgtgcaggg

SEQ ID NO: 3730212 - DNA, 11 bp, Homo sapiens
tggggctgaac

SEQ ID NO: 3730213 - DNA, 17 bp, Homo sapiens
tggggctgatctcaggg

SEQ ID NO: 3730214 - DNA, 15 bp, Homo sapiens
tggggctgctcctcc

SEQ ID NO: 3730215 - DNA, 16 bp, Homo sapiens
tggggctgctcctcca

SEQ ID NO: 3730216 - DNA, 19 bp, Homo sapiens
tggggctgctcctccaggg

SEQ ID NO: 3730217 - DNA, 13 bp, Homo sapiens
tggggcttcttgg

SEQ ID NO: 3730218 - DNA, 19 bp, Homo sapiens
tgggggagtctgaagcaga

SEQ ID NO: 3730219 - DNA, 20 bp, Homo sapiens
tgggggatcacagcctctga

SEQ ID NO: 3730220 - DNA, 15 bp, Homo sapiens
tgggggatgcttcat

SEQ ID NO: 3730221 - DNA, 17 bp, Homo sapiens
tgggggcagagggcaga

SEQ ID NO: 3730222 - DNA, 13 bp, Homo sapiens
tgggggccatgag

SEQ ID NO: 3730223 - DNA, 16 bp, Homo sapiens
tgggggccatgagctc

SEQ ID NO: 3730224 - DNA, 21 bp, Homo sapiens
tggggggccaacaccagggat

SEQ ID NO: 3730225 - DNA, 16 bp, Homo sapiens
tgggggttggctgggt

SEQ ID NO: 3730226 - DNA, 21 bp, Homo sapiens
tggggtctccctctcctgcct

SEQ ID NO: 3730227 - DNA, 22 bp, Homo sapiens
tggggtctccctctcctgccta

SEQ ID NO: 3730228 - DNA, 17 bp, Homo sapiens
tggggtgaggaccactc

SEQ ID NO: 3730229 - DNA, 19 bp, Homo sapiens
tggggtgccctccactgcc

SEQ ID NO: 3730230 - DNA, 15 bp, Homo sapiens
tggggtgggagaggt

SEQ ID NO: 3730231 - DNA, 14 bp, Homo sapiens
tggggttcagcccc

SEQ ID NO: 3730232 - DNA, 15 bp, Homo sapiens
tgggtacagagaggt

SEQ ID NO: 3730233 - DNA, 21 bp, Homo sapiens
tgggtagcttctgacctcagc

SEQ ID NO: 3730234 - DNA, 17 bp, Homo sapiens
tgggtcccccacgtgac

SEQ ID NO: 3730235 - DNA, 18 bp, Homo sapiens
tgggtcctcacatctttc

SEQ ID NO: 3730236 - DNA, 14 bp, Homo sapiens
tgggtctgtgtctc

SEQ ID NO: 3730237 - DNA, 18 bp, Homo sapiens
tgggtgaaagaaatcatg

SEQ ID NO: 3730238 - DNA, 20 bp, Homo sapiens
tgggtgaaagaaatcatgtt

SEQ ID NO: 3730239 - DNA, 15 bp, Homo sapiens
tgggtgaagacagag

SEQ ID NO: 3730240 - DNA, 14 bp, Homo sapiens
tgggtgacagagca

SEQ ID NO: 3730241 - DNA, 23 bp, Homo sapiens
tgggtgcccacagcccgcatgca

SEQ ID NO: 3730242 - DNA, 13 bp, Homo sapiens
tgggtgctcccta

SEQ ID NO: 3730243 - DNA, 18 bp, Homo sapiens
tgggtgctggctgcccag

SEQ ID NO: 3730244 - DNA, 14 bp, Homo sapiens
tgggtggatgcctg

SEQ ID NO: 3730245 - DNA, 23 bp, Homo sapiens
tgggtggatgcctggtggcagct

SEQ ID NO: 3730246 - DNA, 23 bp, Homo sapiens
tgggtgtaacaggtctcctctta

SEQ ID NO: 3730247 - DNA, 18 bp, Homo sapiens
tgggtgtgtgtagccaag

SEQ ID NO: 3730248 - DNA, 13 bp, Homo sapiens
tgggttcattatt

SEQ ID NO: 3730249 - DNA, 13 bp, Homo sapiens
tgggttcctcttc

SEQ ID NO: 3730250 - DNA, 21 bp, Homo sapiens
tgggttcctcttccccactcc

SEQ ID NO: 3730251 - DNA, 19 bp, Homo sapiens
tgggttgcgtcctgacggc

SEQ ID NO: 3730252 - DNA, 22 bp, Homo sapiens
tgggtttcacaagtgaaaaaca

SEQ ID NO: 3730253 - DNA, 24 bp, Homo sapiens
tgggttttcttcccatcactggag

SEQ ID NO: 3730254 - DNA, 18 bp, Homo sapiens
tgggttttgtaggtactt

SEQ ID NO: 3730255 - DNA, 15 bp, Homo sapiens
tgggtttttgttacc

SEQ ID NO: 3730256 - DNA, 14 bp, Homo sapiens
tggtaaaattgcat

SEQ ID NO: 3730257 - DNA, 16 bp, Homo sapiens
tggtaaaattgcatgg

SEQ ID NO: 3730258 - DNA, 23 bp, Homo sapiens
tggtaagagaatgttatagtgaa

SEQ ID NO: 3730259 - DNA, 15 bp, Homo sapiens
tggtacatggccagt

SEQ ID NO: 3730260 - DNA, 18 bp, Homo sapiens
tggtacggagatgtttca

SEQ ID NO: 3730261 - DNA, 17 bp, Homo sapiens
tggtagaccaaaataaa

SEQ ID NO: 3730262 - DNA, 20 bp, Homo sapiens
tggtagagtgtgcctgaagt

SEQ ID NO: 3730263 - DNA, 17 bp, Homo sapiens
tggtagcttttcccttc

SEQ ID NO: 3730264 - DNA, 20 bp, Homo sapiens
tggtagcttttcccttcttt

SEQ ID NO: 3730265 - DNA, 18 bp, Homo sapiens
tggtaggaatagcatgtc

SEQ ID NO: 3730266 - DNA, 19 bp, Homo sapiens
tggtagggggaaaatgtgt

SEQ ID NO: 3730267 - DNA, 22 bp, Homo sapiens
tggtagtactcctgcaaaattt

SEQ ID NO: 3730268 - DNA, 17 bp, Homo sapiens
tggtagttagtagcatg

SEQ ID NO: 3730269 - DNA, 14 bp, Homo sapiens
tggtatcatatatt

SEQ ID NO: 3730270 - DNA, 14 bp, Homo sapiens
tggtatgggtttct

SEQ ID NO: 3730271 - DNA, 21 bp, Homo sapiens
tggtatgtgtgtgtatgctac

SEQ ID NO: 3730272 - DNA, 21 bp, Homo sapiens
tggtatttatctattgtaaga

SEQ ID NO: 3730273 - DNA, 14 bp, Homo sapiens
tggtcacagagaac

SEQ ID NO: 3730274 - DNA, 20 bp, Homo sapiens
tggtcacaggactctgcctc

SEQ ID NO: 3730275 - DNA, 23 bp, Homo sapiens
tggtcacaggactctgcctcctc

SEQ ID NO: 3730276 - DNA, 21 bp, Homo sapiens
tggtcaccaaatcagctgcta

SEQ ID NO: 3730277 - DNA, 13 bp, Homo sapiens
tggtcactgccat

SEQ ID NO: 3730278 - DNA, 21 bp, Homo sapiens
tggtcaggttatactcctcct

SEQ ID NO: 3730279 - DNA, 14 bp, Homo sapiens
tggtccctgggagg

SEQ ID NO: 3730280 - DNA, 12 bp, Homo sapiens
tggtcctgactc

SEQ ID NO: 3730281 - DNA, 16 bp, Homo sapiens
tggtcctggggctctg

SEQ ID NO: 3730282 - DNA, 13 bp, Homo sapiens
tggtcgcccagga

SEQ ID NO: 3730283 - DNA, 23 bp, Homo sapiens
tggtctcaaactcttgacctcag

SEQ ID NO: 3730284 - DNA, 14 bp, Homo sapiens
tggtctcctgcccc

SEQ ID NO: 3730285 - DNA, 13 bp, Homo sapiens
tggtctctgccat

SEQ ID NO: 3730286 - DNA, 22 bp, Homo sapiens
tggtctctgctgaaggttgtaa

SEQ ID NO: 3730287 - DNA, 13 bp, Homo sapiens
tggtctcttgctt

SEQ ID NO: 3730288 - DNA, 13 bp, Homo sapiens
tggtctgaatgtt

SEQ ID NO: 3730289 - DNA, 16 bp, Homo sapiens
tggtctgacccactgc

SEQ ID NO: 3730290 - DNA, 16 bp, Homo sapiens
tggtctgatttcagga

SEQ ID NO: 3730291 - DNA, 21 bp, Homo sapiens
tggtcttgtaagagctataca

SEQ ID NO: 3730292 - DNA, 17 bp, Homo sapiens
tggtctttctggagagg

SEQ ID NO: 3730293 - DNA, 14 bp, Homo sapiens
tggtgaactatatt

SEQ ID NO: 3730294 - DNA, 13 bp, Homo sapiens
tggtgaatttgaa

SEQ ID NO: 3730295 - DNA, 16 bp, Homo sapiens
tggtgacctctgcctg

SEQ ID NO: 3730296 - DNA, 17 bp, Homo sapiens
tggtgacctctgcctga

SEQ ID NO: 3730297 - DNA, 22 bp, Homo sapiens
tggtgacctctgcctgaagtca

SEQ ID NO: 3730298 - DNA, 16 bp, Homo sapiens
tggtgaggaagctcca

SEQ ID NO: 3730299 - DNA, 17 bp, Homo sapiens
tggtgaggttgggcagc

SEQ ID NO: 3730300 - DNA, 16 bp, Homo sapiens
tggtgatttagcagga

SEQ ID NO: 3730301 - DNA, 21 bp, Homo sapiens
tggtgcctctggaggcctctg

SEQ ID NO: 3730302 - DNA, 16 bp, Homo sapiens
tggtgcgatctgggtt

SEQ ID NO: 3730303 - DNA, 17 bp, Homo sapiens
tggtgcgatctgggttc

SEQ ID NO: 3730304 - DNA, 14 bp, Homo sapiens
tggtgctcatttca

SEQ ID NO: 3730305 - DNA, 21 bp, Homo sapiens
tggtgctggatattttcaaat

SEQ ID NO: 3730306 - DNA, 16 bp, Homo sapiens
tggtggacagtcctgg

SEQ ID NO: 3730307 - DNA, 12 bp, Homo sapiens
tggtggcagctg

SEQ ID NO: 3730308 - DNA, 12 bp, Homo sapiens
tggtggcagtgg

SEQ ID NO: 3730309 - DNA, 13 bp, Homo sapiens
tggtggctgggtt

SEQ ID NO: 3730310 - DNA, 21 bp, Homo sapiens
tggtgggttcaggggactcag

SEQ ID NO: 3730311 - DNA, 16 bp, Homo sapiens
tggtgtcacctgaaga

SEQ ID NO: 3730312 - DNA, 15 bp, Homo sapiens
tggtgtccacctggc

SEQ ID NO: 3730313 - DNA, 13 bp, Homo sapiens
tggtgtccagctg

SEQ ID NO: 3730314 - DNA, 21 bp, Homo sapiens
tggttaagttggcttctgttt

SEQ ID NO: 3730315 - DNA, 14 bp, Homo sapiens
tggttagaaatgca

SEQ ID NO: 3730316 - DNA, 13 bp, Homo sapiens
tggttagctcagc

SEQ ID NO: 3730317 - DNA, 12 bp, Homo sapiens
tggttatacatg

SEQ ID NO: 3730318 - DNA, 13 bp, Homo sapiens
tggttatacatga

SEQ ID NO: 3730319 - DNA, 21 bp, Homo sapiens
tggttatacatgacactgaaa

SEQ ID NO: 3730320 - DNA, 16 bp, Homo sapiens
tggttatttttataca

SEQ ID NO: 3730321 - DNA, 22 bp, Homo sapiens
tggttcagggttggcccctgcc

SEQ ID NO: 3730322 - DNA, 23 bp, Homo sapiens
tggttcagggttggcccctgccc

SEQ ID NO: 3730323 - DNA, 16 bp, Homo sapiens
tggttcatcagtgtta

SEQ ID NO: 3730324 - DNA, 19 bp, Homo sapiens
tggttcccctgttcactct

SEQ ID NO: 3730325 - DNA, 23 bp, Homo sapiens
tggttccctttgctccaccccac

SEQ ID NO: 3730326 - DNA, 15 bp, Homo sapiens
tggttctaatagaac

SEQ ID NO: 3730327 - DNA, 15 bp, Homo sapiens
tggttgccttaaaag

SEQ ID NO: 3730328 - DNA, 14 bp, Homo sapiens
tggtttagtgtaaa

SEQ ID NO: 3730329 - DNA, 22 bp, Homo sapiens
tggtttcagcaatatttaagga

SEQ ID NO: 3730330 - DNA, 17 bp, Homo sapiens
tggtttcataggagaca

SEQ ID NO: 3730331 - DNA, 23 bp, Homo sapiens
tggtttccaaggagctgagaata

SEQ ID NO: 3730332 - DNA, 23 bp, Homo sapiens
tggtttgagcttagtgaaattac

SEQ ID NO: 3730333 - DNA, 17 bp, Homo sapiens
tggttttaattgaagga

SEQ ID NO: 3730334 - DNA, 17 bp, Homo sapiens
tggttttcaaaataaaa

SEQ ID NO: 3730335 - DNA, 18 bp, Homo sapiens
tggttttcttttgccatg

SEQ ID NO: 3730336 - DNA, 13 bp, Homo sapiens
tgtaaaacaaaaa

SEQ ID NO: 3730337 - DNA, 16 bp, Homo sapiens
tgtaaaacaaaaaaca

SEQ ID NO: 3730338 - DNA, 15 bp, Homo sapiens
tgtaaaactgaggca

SEQ ID NO: 3730339 - DNA, 14 bp, Homo sapiens
tgtaaaataaaatt

SEQ ID NO: 3730340 - DNA, 20 bp, Homo sapiens
tgtaaaattttgcctaatac

SEQ ID NO: 3730341 - DNA, 19 bp, Homo sapiens
tgtaaacagtgcctgctga

SEQ ID NO: 3730342 - DNA, 20 bp, Homo sapiens
tgtaaactcaaaatatttgt

SEQ ID NO: 3730343 - DNA, 18 bp, Homo sapiens
tgtaaactgtactagtct

SEQ ID NO: 3730344 - DNA, 19 bp, Homo sapiens
tgtaaataaccccattctt

SEQ ID NO: 3730345 - DNA, 15 bp, Homo sapiens
tgtaaatagctcagg

SEQ ID NO: 3730346 - DNA, 21 bp, Homo sapiens
tgtaaatgaagtaacttgtct

SEQ ID NO: 3730347 - DNA, 20 bp, Homo sapiens
tgtaaattaccagtaaagtg

SEQ ID NO: 3730348 - DNA, 18 bp, Homo sapiens
tgtaaattattttaaatt

SEQ ID NO: 3730349 - DNA, 15 bp, Homo sapiens
tgtaacaagaaaaca

SEQ ID NO: 3730350 - DNA, 18 bp, Homo sapiens
tgcatgctctctgcagcc

SEQ ID NO: 3730351 - DNA, 15 bp, Homo sapiens
tgcatgctgctttaa

SEQ ID NO: 3730352 - DNA, 15 bp, Homo sapiens
tgcatggacctaaca

SEQ ID NO: 3730353 - DNA, 17 bp, Homo sapiens
tgcatggacctaacatt

SEQ ID NO: 3730354 - DNA, 18 bp, Homo sapiens
tgcatggacctaacattc

SEQ ID NO: 3730355 - DNA, 16 bp, Homo sapiens
tgcatgggtgaaggga

SEQ ID NO: 3730356 - DNA, 19 bp, Homo sapiens
tgcatgggttttgtaggta

SEQ ID NO: 3730357 - DNA, 16 bp, Homo sapiens
tgcatggtaatttata

SEQ ID NO: 3730358 - DNA, 18 bp, Homo sapiens
tgcatggtaatttatagt

SEQ ID NO: 3730359 - DNA, 17 bp, Homo sapiens
tgcatgtataaatgaag

SEQ ID NO: 3730360 - DNA, 12 bp, Homo sapiens
tgcatgtgtgcg

SEQ ID NO: 3730361 - DNA, 19 bp, Homo sapiens
tgcatgttacataagataa

SEQ ID NO: 3730362 - DNA, 11 bp, Homo sapiens
tgcattacaga

SEQ ID NO: 3730363 - DNA, 14 bp, Homo sapiens
tgcattacattcct

SEQ ID NO: 3730364 - DNA, 22 bp, Homo sapiens
tgcattagaaatagacagtata

SEQ ID NO: 3730365 - DNA, 13 bp, Homo sapiens
tgcattagaaatt

SEQ ID NO: 3730366 - DNA, 14 bp, Homo sapiens
tgcattcacccaga

SEQ ID NO: 3730367 - DNA, 16 bp, Homo sapiens
tgcattcacccagaca

SEQ ID NO: 3730368 - DNA, 20 bp, Homo sapiens
tgcattcacccagacagctc

SEQ ID NO: 3730369 - DNA, 21 bp, Homo sapiens
tgcattctgccgtgtgccctc

SEQ ID NO: 3730370 - DNA, 15 bp, Homo sapiens
tgcattgaatatatt

SEQ ID NO: 3730371 - DNA, 16 bp, Homo sapiens
tgcattgaatatatta

SEQ ID NO: 3730372 - DNA, 22 bp, Homo sapiens
tgcatttagcacaaaaaaaatt

SEQ ID NO: 3730373 - DNA, 14 bp, Homo sapiens
tgcatttcctgaca

SEQ ID NO: 3730374 - DNA, 16 bp, Homo sapiens
tgcatttggtcaagat

SEQ ID NO: 3730375 - DNA, 18 bp, Homo sapiens
tgcattttattcttgaag

SEQ ID NO: 3730376 - DNA, 17 bp, Homo sapiens
tgcattttcaccccacc

SEQ ID NO: 3730377 - DNA, 16 bp, Homo sapiens
tgcattttctgaaact

SEQ ID NO: 3730378 - DNA, 23 bp, Homo sapiens
tgcattttctgaaactaatgaaa

SEQ ID NO: 3730379 - DNA, 23 bp, Homo sapiens
tgcattttctgggttctgggtgg

SEQ ID NO: 3730380 - DNA, 12 bp, Homo sapiens
tgccaaaataat

SEQ ID NO: 3730381 - DNA, 18 bp, Homo sapiens
tgccaaaataatgtcttg

SEQ ID NO: 3730382 - DNA, 22 bp, Homo sapiens
tgccaaaataatgtcttgttaa

SEQ ID NO: 3730383 - DNA, 21 bp, Homo sapiens
tgccaaagctagggtggccct

SEQ ID NO: 3730384 - DNA, 16 bp, Homo sapiens
tgccaagaactgaaaa

SEQ ID NO: 3730385 - DNA, 17 bp, Homo sapiens
tgccaagaactgaaaac

SEQ ID NO: 3730386 - DNA, 16 bp, Homo sapiens
tgccaaggccagagtg

SEQ ID NO: 3730387 - DNA, 21 bp, Homo sapiens
tgccaaggccagagtggcctg

SEQ ID NO: 3730388 - DNA, 16 bp, Homo sapiens
tgccacacgtctgacc

SEQ ID NO: 3730389 - DNA, 23 bp, Homo sapiens
tgccacacttcaggctcttctcc

SEQ ID NO: 3730390 - DNA, 17 bp, Homo sapiens
tgccaccaactggccct

SEQ ID NO: 3730391 - DNA, 17 bp, Homo sapiens
tgccacccaccagggcg

SEQ ID NO: 3730392 - DNA, 19 bp, Homo sapiens
tgccaccctggggagaaag

SEQ ID NO: 3730393 - DNA, 18 bp, Homo sapiens
tgccacctcccctatcca

SEQ ID NO: 3730394 - DNA, 22 bp, Homo sapiens
tgccactacggaatagttggct

SEQ ID NO: 3730395 - DNA, 18 bp, Homo sapiens
tgccactgcccgagctgg

SEQ ID NO: 3730396 - DNA, 20 bp, Homo sapiens
tgccactgcccgagctggtg

SEQ ID NO: 3730397 - DNA, 22 bp, Homo sapiens
tgccactgcccgagctggtgca

SEQ ID NO: 3730398 - DNA, 13 bp, Homo sapiens
tgccagacatgtg

SEQ ID NO: 3730399 - DNA, 13 bp, Homo sapiens
tgccagcacagag

SEQ ID NO: 3730400 - DNA, 11 bp, Homo sapiens
tgccagccaca

SEQ ID NO: 3730401 - DNA, 16 bp, Homo sapiens
tgccagccagcagcca

SEQ ID NO: 3730402 - DNA, 15 bp, Homo sapiens
tgccagcctggcttc

SEQ ID NO: 3730403 - DNA, 16 bp, Homo sapiens
tgccagcctggcttct

SEQ ID NO: 3730404 - DNA, 17 bp, Homo sapiens
tgccagcctggcttctg

SEQ ID NO: 3730405 - DNA, 18 bp, Homo sapiens
tgccagcctggcttctgg

SEQ ID NO: 3730406 - DNA, 14 bp, Homo sapiens
tgccaggcatggtg

SEQ ID NO: 3730407 - DNA, 14 bp, Homo sapiens
tgccaggcccgggg

SEQ ID NO: 3730408 - DNA, 19 bp, Homo sapiens
tgccaggctctaaagccaa

SEQ ID NO: 3730409 - DNA, 12 bp, Homo sapiens
tgccagggagct

SEQ ID NO: 3730410 - DNA, 17 bp, Homo sapiens
tgccaggtttttggtct

SEQ ID NO: 3730411 - DNA, 24 bp, Homo sapiens
tgccaggtttttggtctgacccac

SEQ ID NO: 3730412 - DNA, 17 bp, Homo sapiens
tgccagtccccctgccc

SEQ ID NO: 3730413 - DNA, 13 bp, Homo sapiens
tgccagtgcctta

SEQ ID NO: 3730414 - DNA, 15 bp, Homo sapiens
tgccagtgtctttct

SEQ ID NO: 3730415 - DNA, 16 bp, Homo sapiens
tgccagtgtctttctt

SEQ ID NO: 3730416 - DNA, 20 bp, Homo sapiens
tgccatattctgttggccag

SEQ ID NO: 3730417 - DNA, 16 bp, Homo sapiens
tgccatctgtgggcac

SEQ ID NO: 3730418 - DNA, 18 bp, Homo sapiens
tgccatggacagaagaag

SEQ ID NO: 3730419 - DNA, 20 bp, Homo sapiens
tgccatggacagaagaaggc

SEQ ID NO: 3730420 - DNA, 16 bp, Homo sapiens
tgccatgtgaagaggg

SEQ ID NO: 3730421 - DNA, 15 bp, Homo sapiens
tgccatgtgccaggt

SEQ ID NO: 3730422 - DNA, 12 bp, Homo sapiens
tgccatgttggc

SEQ ID NO: 3730423 - DNA, 18 bp, Homo sapiens
tgccatgttggccaggct

SEQ ID NO: 3730424 - DNA, 21 bp, Homo sapiens
tgccatgttttgccaccccct

SEQ ID NO: 3730425 - DNA, 14 bp, Homo sapiens
tgccattgtcttta

SEQ ID NO: 3730426 - DNA, 22 bp, Homo sapiens
tgccatttgcaccctccgcctt

SEQ ID NO: 3730427 - DNA, 14 bp, Homo sapiens
tgcccaactgttat

SEQ ID NO: 3730428 - DNA, 11 bp, Homo sapiens
tgcccacagcc

SEQ ID NO: 3730429 - DNA, 23 bp, Homo sapiens
tgcccacatgtgtccatcccagc

SEQ ID NO: 3730430 - DNA, 23 bp, Homo sapiens
tgcccaccaacatcccattgccc

SEQ ID NO: 3730431 - DNA, 21 bp, Homo sapiens
tgcccacccgtggagatggga

SEQ ID NO: 3730432 - DNA, 11 bp, Homo sapiens
tgcccacctgt

SEQ ID NO: 3730433 - DNA, 16 bp, Homo sapiens
tgcccagaattcccag

SEQ ID NO: 3730434 - DNA, 22 bp, Homo sapiens
tgcccagaattcccagctgtct

SEQ ID NO: 3730435 - DNA, 23 bp, Homo sapiens
tgcccagaattcccagctgtctg

SEQ ID NO: 3730436 - DNA, 21 bp, Homo sapiens
tgcccagacatttttttccct

SEQ ID NO: 3730437 - DNA, 18 bp, Homo sapiens
tgcccagagggcccaggc

SEQ ID NO: 3730438 - DNA, 12 bp, Homo sapiens
tgcccagctcag

SEQ ID NO: 3730439 - DNA, 17 bp, Homo sapiens
tgcccagctcagagggt

SEQ ID NO: 3730440 - DNA, 17 bp, Homo sapiens
tgcccaggagagccagc

SEQ ID NO: 3730441 - DNA, 23 bp, Homo sapiens
tgcccaggagagccagccctccc

SEQ ID NO: 3730442 - DNA, 12 bp, Homo sapiens
tgcccaggcagg

SEQ ID NO: 3730443 - DNA, 13 bp, Homo sapiens
tgcccaggcaggt

SEQ ID NO: 3730444 - DNA, 20 bp, Homo sapiens
tgcccaggctggcgtgcagt

SEQ ID NO: 3730445 - DNA, 17 bp, Homo sapiens
tgcccagggatttgtcc

SEQ ID NO: 3730446 - DNA, 11 bp, Homo sapiens
tgcccagggct

SEQ ID NO: 3730447 - DNA, 17 bp, Homo sapiens
tgcccagggctcagcct

SEQ ID NO: 3730448 - DNA, 22 bp, Homo sapiens
tgcccagttaatcttgctttct

SEQ ID NO: 3730449 - DNA, 23 bp, Homo sapiens
tgcccagttaatcttgctttctt

SEQ ID NO: 3730450 - DNA, 14 bp, Homo sapiens
tgccccaaacaaat

SEQ ID NO: 3730451 - DNA, 16 bp, Homo sapiens
tgccccaactcctgga

SEQ ID NO: 3730452 - DNA, 16 bp, Homo sapiens
tgccccacctgccact

SEQ ID NO: 3730453 - DNA, 21 bp, Homo sapiens
tgccccacctgccactaggct

SEQ ID NO: 3730454 - DNA, 17 bp, Homo sapiens
tgccccagagctgttta

SEQ ID NO: 3730455 - DNA, 23 bp, Homo sapiens
tgccccagagctgtttatggcct

SEQ ID NO: 3730456 - DNA, 14 bp, Homo sapiens
tgccccagctctgg

SEQ ID NO: 3730457 - DNA, 16 bp, Homo sapiens
tgccccagctctggct

SEQ ID NO: 3730458 - DNA, 19 bp, Homo sapiens
tgccccagctctggcttcc

SEQ ID NO: 3730459 - DNA, 15 bp, Homo sapiens
tgccccagggctccc

SEQ ID NO: 3730460 - DNA, 14 bp, Homo sapiens
tgccccccacccca

SEQ ID NO: 3730461 - DNA, 16 bp, Homo sapiens
tgccccccaccccagc

SEQ ID NO: 3730462 - DNA, 12 bp, Homo sapiens
tgcccccttctc

SEQ ID NO: 3730463 - DNA, 23 bp, Homo sapiens
tgcgctgacaaccaccgctcccc

SEQ ID NO: 3730464 - DNA, 14 bp, Homo sapiens
tgcggacgggctgt

SEQ ID NO: 3730465 - DNA, 18 bp, Homo sapiens
tgcgggatggtcctgggg

SEQ ID NO: 3730466 - DNA, 14 bp, Homo sapiens
tgcgggctgggcag

SEQ ID NO: 3730467 - DNA, 15 bp, Homo sapiens
tgcgggctgggcagc

SEQ ID NO: 3730468 - DNA, 16 bp, Homo sapiens
tgcgggctgggcagct

SEQ ID NO: 3730469 - DNA, 17 bp, Homo sapiens
tgcgggctgggcagctg

SEQ ID NO: 3730470 - DNA, 14 bp, Homo sapiens
tgcggtcaaggcca

SEQ ID NO: 3730471 - DNA, 13 bp, Homo sapiens
tgcgtgtcgtggg

SEQ ID NO: 3730472 - DNA, 18 bp, Homo sapiens
tgcgtgtgcgtgcatgtg

SEQ ID NO: 3730473 - DNA, 17 bp, Homo sapiens
tgcgtgtgtccatgtgt

SEQ ID NO: 3730474 - DNA, 19 bp, Homo sapiens
tgcgtgtgtccatgtgtgt

SEQ ID NO: 3730475 - DNA, 13 bp, Homo sapiens
tgcgttttggaag

SEQ ID NO: 3730476 - DNA, 16 bp, Homo sapiens
tgctaaatctcctatt

SEQ ID NO: 3730477 - DNA, 17 bp, Homo sapiens
tgctaaatctcctattt

SEQ ID NO: 3730478 - DNA, 24 bp, Homo sapiens
tgctaaatgtaagaatcattgtaa

SEQ ID NO: 3730479 - DNA, 20 bp, Homo sapiens
tgctaactagcttggaaact

SEQ ID NO: 3730480 - DNA, 22 bp, Homo sapiens
tgctaactagcttggaaactgg

SEQ ID NO: 3730481 - DNA, 12 bp, Homo sapiens
tgctaataaaac

SEQ ID NO: 3730482 - DNA, 20 bp, Homo sapiens
tgctaatcgggttgtcactc

SEQ ID NO: 3730483 - DNA, 20 bp, Homo sapiens
tgctaatcttcttatgcaat

SEQ ID NO: 3730484 - DNA, 18 bp, Homo sapiens
tgctaatttatcctgaaa

SEQ ID NO: 3730485 - DNA, 13 bp, Homo sapiens
tgctaccaaagca

SEQ ID NO: 3730486 - DNA, 14 bp, Homo sapiens
tgctacctcactgg

SEQ ID NO: 3730487 - DNA, 15 bp, Homo sapiens
tgctacctcactggg

SEQ ID NO: 3730488 - DNA, 16 bp, Homo sapiens
tgctacctcactgggg

SEQ ID NO: 3730489 - DNA, 15 bp, Homo sapiens
tgctactctgttcct

SEQ ID NO: 3730490 - DNA, 16 bp, Homo sapiens
tgctactctgttcctt

SEQ ID NO: 3730491 - DNA, 22 bp, Homo sapiens
tgctacttcctgcctggtctcc

SEQ ID NO: 3730492 - DNA, 18 bp, Homo sapiens
tgctagcacttggagcca

SEQ ID NO: 3730493 - DNA, 20 bp, Homo sapiens
tgctagcacttggagccaag

SEQ ID NO: 3730494 - DNA, 17 bp, Homo sapiens
tgctagctatgtgacct

SEQ ID NO: 3730495 - DNA, 14 bp, Homo sapiens
tgctaggtgggcca

SEQ ID NO: 3730496 - DNA, 17 bp, Homo sapiens
tgctaggtgggccagcc

SEQ ID NO: 3730497 - DNA, 13 bp, Homo sapiens
tgctagttttaca

SEQ ID NO: 3730498 - DNA, 21 bp, Homo sapiens
tgctatcaaaataaattgaaa

SEQ ID NO: 3730499 - DNA, 20 bp, Homo sapiens
tgctatcctgccaaaatcat

SEQ ID NO: 3730500 - DNA, 20 bp, Homo sapiens
tgctatctctgtgtgcacaa

SEQ ID NO: 3730501 - DNA, 16 bp, Homo sapiens
tgctattgacaagtca

SEQ ID NO: 3730502 - DNA, 15 bp, Homo sapiens
tgctcaaaaaatgag

SEQ ID NO: 3730503 - DNA, 14 bp, Homo sapiens
tgctcacagctgta

SEQ ID NO: 3730504 - DNA, 16 bp, Homo sapiens
tgctcacatatctgtc

SEQ ID NO: 3730505 - DNA, 23 bp, Homo sapiens
tgctcacctggggtgtgggaggc

SEQ ID NO: 3730506 - DNA, 20 bp, Homo sapiens
tgctcagcaaggggctctgc

SEQ ID NO: 3730507 - DNA, 16 bp, Homo sapiens
tgctcagggtcaattt

SEQ ID NO: 3730508 - DNA, 17 bp, Homo sapiens
tgctcagtaatttgagg

SEQ ID NO: 3730509 - DNA, 14 bp, Homo sapiens
tgctccaccacatc

SEQ ID NO: 3730510 - DNA, 15 bp, Homo sapiens
tgctccaccacatcc

SEQ ID NO: 3730511 - DNA, 18 bp, Homo sapiens
tgctccacccttggcctg

SEQ ID NO: 3730512 - DNA, 19 bp, Homo sapiens
tgctccacccttggcctgt

SEQ ID NO: 3730513 - DNA, 18 bp, Homo sapiens
tgctccagccaacccctg

SEQ ID NO: 3730514 - DNA, 23 bp, Homo sapiens
tgctccagccaacccctgtggag

SEQ ID NO: 3730515 - DNA, 20 bp, Homo sapiens
tgctccagctgttcagctgg

SEQ ID NO: 3730516 - DNA, 13 bp, Homo sapiens
tgctcccccatcc

SEQ ID NO: 3730517 - DNA, 18 bp, Homo sapiens
tgctcccccatcctcccc

SEQ ID NO: 3730518 - DNA, 16 bp, Homo sapiens
tgctccctaccacctc

SEQ ID NO: 3730519 - DNA, 18 bp, Homo sapiens
tgctccctcccctgccct

SEQ ID NO: 3730520 - DNA, 19 bp, Homo sapiens
tgctccctcccctgccctg

SEQ ID NO: 3730521 - DNA, 13 bp, Homo sapiens
tgctccgtgcttg

SEQ ID NO: 3730522 - DNA, 13 bp, Homo sapiens
tgctcctccaggg

SEQ ID NO: 3730523 - DNA, 17 bp, Homo sapiens
tgctcctctccccagca

SEQ ID NO: 3730524 - DNA, 20 bp, Homo sapiens
tgctccttagctgccaagcc

SEQ ID NO: 3730525 - DNA, 15 bp, Homo sapiens
tgctctaagcacacg

SEQ ID NO: 3730526 - DNA, 12 bp, Homo sapiens
tgctctcccctg

SEQ ID NO: 3730527 - DNA, 15 bp, Homo sapiens
tgctctcccctgccc

SEQ ID NO: 3730528 - DNA, 20 bp, Homo sapiens
tgctctcccctgccctgctg

SEQ ID NO: 3730529 - DNA, 16 bp, Homo sapiens
tgctctcctcttgcca

SEQ ID NO: 3730530 - DNA, 14 bp, Homo sapiens
tgctctctacccag

SEQ ID NO: 3730531 - DNA, 14 bp, Homo sapiens
tgctctctgcagcc

SEQ ID NO: 3730532 - DNA, 20 bp, Homo sapiens
tgctctctgcagccagccca

SEQ ID NO: 3730533 - DNA, 18 bp, Homo sapiens
tgctctgaacacgaagct

SEQ ID NO: 3730534 - DNA, 14 bp, Homo sapiens
tgctctgatttatc

SEQ ID NO: 3730535 - DNA, 15 bp, Homo sapiens
tgctctgcatgttac

SEQ ID NO: 3730536 - DNA, 13 bp, Homo sapiens
tgctctgcccaga

SEQ ID NO: 3730537 - DNA, 14 bp, Homo sapiens
tgctctgcccagag

SEQ ID NO: 3730538 - DNA, 15 bp, Homo sapiens
tgctctgcccagagc

SEQ ID NO: 3730539 - DNA, 20 bp, Homo sapiens
tgctctgcccagagctgggt

SEQ ID NO: 3730540 - DNA, 22 bp, Homo sapiens
tgctctgctgacagacacaggc

SEQ ID NO: 3730541 - DNA, 15 bp, Homo sapiens
tgctctggacaggca

SEQ ID NO: 3730542 - DNA, 15 bp, Homo sapiens
tgctcttagctgtct

SEQ ID NO: 3730543 - DNA, 17 bp, Homo sapiens
tgctcttatgccatttg

SEQ ID NO: 3730544 - DNA, 13 bp, Homo sapiens
tgctgaagcttat

SEQ ID NO: 3730545 - DNA, 18 bp, Homo sapiens
tgctgaagcttattaatg

SEQ ID NO: 3730546 - DNA, 17 bp, Homo sapiens
tgctgaatggttttcaa

SEQ ID NO: 3730547 - DNA, 18 bp, Homo sapiens
tgctgaatggttttcaaa

SEQ ID NO: 3730548 - DNA, 15 bp, Homo sapiens
tgctgacagacacag

SEQ ID NO: 3730549 - DNA, 23 bp, Homo sapiens
tgctgacagacacaggcccggct

SEQ ID NO: 3730550 - DNA, 15 bp, Homo sapiens
tgctgacagctgacc

SEQ ID NO: 3730551 - DNA, 16 bp, Homo sapiens
tgctgactgtactcct

SEQ ID NO: 3730552 - DNA, 16 bp, Homo sapiens
tgctgactgttttctc

SEQ ID NO: 3730553 - DNA, 17 bp, Homo sapiens
tgctgactgttttctct

SEQ ID NO: 3730554 - DNA, 21 bp, Homo sapiens
tgctgactgttttctcttgag

SEQ ID NO: 3730555 - DNA, 24 bp, Homo sapiens
tgctgactgttttctcttgagagg

SEQ ID NO: 3730556 - DNA, 18 bp, Homo sapiens
tgctgagagacccaagga

SEQ ID NO: 3730557 - DNA, 21 bp, Homo sapiens
tgctgatgaactcttaatcaa

SEQ ID NO: 3730558 - DNA, 16 bp, Homo sapiens
tgctgatgctcatggt

SEQ ID NO: 3730559 - DNA, 22 bp, Homo sapiens
tgctgatgctcatggtccccat

SEQ ID NO: 3730560 - DNA, 21 bp, Homo sapiens
tgctgatgtggcaactgctga

SEQ ID NO: 3730561 - DNA, 11 bp, Homo sapiens
tgctgccatcc

SEQ ID NO: 3730562 - DNA, 15 bp, Homo sapiens
tgctgccatccaggt

SEQ ID NO: 3730563 - DNA, 14 bp, Homo sapiens
tgctgccccagctg

SEQ ID NO: 3730564 - DNA, 18 bp, Homo sapiens
tgctgccccatgaagcca

SEQ ID NO: 3730565 - DNA, 16 bp, Homo sapiens
tgagcacctcccagcc

SEQ ID NO: 3730566 - DNA, 17 bp, Homo sapiens
tgagcagactggtgagc

SEQ ID NO: 3730567 - DNA, 22 bp, Homo sapiens
tgagcagggagatcctggttgg

SEQ ID NO: 3730568 - DNA, 12 bp, Homo sapiens
tgagcagggctc

SEQ ID NO: 3730569 - DNA, 13 bp, Homo sapiens
tgagcagggctca

SEQ ID NO: 3730570 - DNA, 14 bp, Homo sapiens
tgagcagggctcag

SEQ ID NO: 3730571 - DNA, 15 bp, Homo sapiens
tgagcagggctcagc

SEQ ID NO: 3730572 - DNA, 17 bp, Homo sapiens
tgagcagggctcagcgg

SEQ ID NO: 3730573 - DNA, 19 bp, Homo sapiens
tgagcagggctcagcgggg

SEQ ID NO: 3730574 - DNA, 23 bp, Homo sapiens
tgagcagggctcagcggggacag

SEQ ID NO: 3730575 - DNA, 14 bp, Homo sapiens
tgagccaaagagaa

SEQ ID NO: 3730576 - DNA, 23 bp, Homo sapiens
tgagccaccgctgccagcacaga

SEQ ID NO: 3730577 - DNA, 13 bp, Homo sapiens
tgagccactgcac

SEQ ID NO: 3730578 - DNA, 14 bp, Homo sapiens
tgagccactgcacc

SEQ ID NO: 3730579 - DNA, 23 bp, Homo sapiens
tgagccactgcaccgggccacag

SEQ ID NO: 3730580 - DNA, 14 bp, Homo sapiens
tgagccaggcctgg

SEQ ID NO: 3730581 - DNA, 12 bp, Homo sapiens
tgagcccaggag

SEQ ID NO: 3730582 - DNA, 13 bp, Homo sapiens
tgagcccctggga

SEQ ID NO: 3730583 - DNA, 19 bp, Homo sapiens
tgagccgagatcacgccac

SEQ ID NO: 3730584 - DNA, 22 bp, Homo sapiens
tgagccgagatcacgccactgc

SEQ ID NO: 3730585 - DNA, 20 bp, Homo sapiens
tgagccgcatcttctccatc

SEQ ID NO: 3730586 - DNA, 17 bp, Homo sapiens
tgagcctcagcatcctg

SEQ ID NO: 3730587 - DNA, 10 bp, Homo sapiens
tgagcctggc

SEQ ID NO: 3730588 - DNA, 11 bp, Homo sapiens
tgagcctggca

SEQ ID NO: 3730589 - DNA, 13 bp, Homo sapiens
tgagccttgtaat

SEQ ID NO: 3730590 - DNA, 23 bp, Homo sapiens
tgcaaggccgctgttcacccaca

SEQ ID NO: 3730591 - DNA, 22 bp, Homo sapiens
tgcaagtatgtgagtgtgtcca

SEQ ID NO: 3730592 - DNA, 17 bp, Homo sapiens
tgcaagtcacaaaggaa

SEQ ID NO: 3730593 - DNA, 18 bp, Homo sapiens
tgcaagtcacaaaggaat

SEQ ID NO: 3730594 - DNA, 20 bp, Homo sapiens
tgcaagtgagcaaacctgcc

SEQ ID NO: 3730595 - DNA, 18 bp, Homo sapiens
tgcaagtgtctgtgtgca

SEQ ID NO: 3730596 - DNA, 14 bp, Homo sapiens
tgcaagtgtgtgca

SEQ ID NO: 3730597 - DNA, 18 bp, Homo sapiens
tgcaagtgtgtgcatgtg

SEQ ID NO: 3730598 - DNA, 23 bp, Homo sapiens
tgcaagtgtgtgcatgtgtgcga

SEQ ID NO: 3730599 - DNA, 16 bp, Homo sapiens
tgcaatagagactgta

SEQ ID NO: 3730600 - DNA, 16 bp, Homo sapiens
tgcaatgacatcttca

SEQ ID NO: 3730601 - DNA, 17 bp, Homo sapiens
tgcaatgacatcttcaa

SEQ ID NO: 3730602 - DNA, 13 bp, Homo sapiens
tgcaatggcagcc

SEQ ID NO: 3730603 - DNA, 19 bp, Homo sapiens
tgcacactagcctctccag

SEQ ID NO: 3730604 - DNA, 21 bp, Homo sapiens
tgcacactagcctctccagga

SEQ ID NO: 3730605 - DNA, 18 bp, Homo sapiens
tgcacactcactggcatc

SEQ ID NO: 3730606 - DNA, 23 bp, Homo sapiens
tgcacacttgtgtgtgggctgtg

SEQ ID NO: 3730607 - DNA, 16 bp, Homo sapiens
tgcacagtgcatctca

SEQ ID NO: 3730608 - DNA, 12 bp, Homo sapiens
tgcacatccctg

SEQ ID NO: 3730609 - DNA, 19 bp, Homo sapiens
tgcacatgtgtgcgtgtgc

SEQ ID NO: 3730610 - DNA, 15 bp, Homo sapiens
tgcaccaggagacag

SEQ ID NO: 3730611 - DNA, 14 bp, Homo sapiens
tgcacccccctggg

SEQ ID NO: 3730612 - DNA, 15 bp, Homo sapiens
tgcacccccctgggc

SEQ ID NO: 3730613 - DNA, 17 bp, Homo sapiens
tgcacctccccccactg

SEQ ID NO: 3730614 - DNA, 18 bp, Homo sapiens
tgcacctccccccactgc

SEQ ID NO: 3730615 - DNA, 19 bp, Homo sapiens
tgcacctgccagcctggct

SEQ ID NO: 3730616 - DNA, 16 bp, Homo sapiens
tgcacctgtactcagg

SEQ ID NO: 3730617 - DNA, 20 bp, Homo sapiens
tgcacctgtactcaggaggc

SEQ ID NO: 3730618 - DNA, 16 bp, Homo sapiens
tgcacgcacactgtct

SEQ ID NO: 3730619 - DNA, 19 bp, Homo sapiens
tgcacgcacactgtctgcc

SEQ ID NO: 3730620 - DNA, 17 bp, Homo sapiens
tgcacgcccatgtgtga

SEQ ID NO: 3730621 - DNA, 19 bp, Homo sapiens
tgcacgtagtagggtcagg

SEQ ID NO: 3730622 - DNA, 12 bp, Homo sapiens
tgcacgtggaga

SEQ ID NO: 3730623 - DNA, 16 bp, Homo sapiens
tgcacgtggagagctg

SEQ ID NO: 3730624 - DNA, 16 bp, Homo sapiens
tgcactccagcctggg

SEQ ID NO: 3730625 - DNA, 17 bp, Homo sapiens
tgcactccagcctgggc

SEQ ID NO: 3730626 - DNA, 21 bp, Homo sapiens
tgcactgacattgttggccaa

SEQ ID NO: 3730627 - DNA, 18 bp, Homo sapiens
tgcactgacccacagcct

SEQ ID NO: 3730628 - DNA, 22 bp, Homo sapiens
tgcactgacccacagcctctgc

SEQ ID NO: 3730629 - DNA, 19 bp, Homo sapiens
tgcactggagtccagtctc

SEQ ID NO: 3730630 - DNA, 16 bp, Homo sapiens
tgcacttgcagactct

SEQ ID NO: 3730631 - DNA, 14 bp, Homo sapiens
tgcacttggcctct

SEQ ID NO: 3730632 - DNA, 19 bp, Homo sapiens
tgcagaaaagcacctgccg

SEQ ID NO: 3730633 - DNA, 20 bp, Homo sapiens
tgcagaaaagcacctgccga

SEQ ID NO: 3730634 - DNA, 22 bp, Homo sapiens
tgcagaaaagcacctgccgacc

SEQ ID NO: 3730635 - DNA, 22 bp, Homo sapiens
tgcagacaggcaagcacctcct

SEQ ID NO: 3730636 - DNA, 13 bp, Homo sapiens
tgcagacaggcca

SEQ ID NO: 3730637 - DNA, 16 bp, Homo sapiens
tgcagactctacagag

SEQ ID NO: 3730638 - DNA, 13 bp, Homo sapiens
tgcagactggagg

SEQ ID NO: 3730639 - DNA, 16 bp, Homo sapiens
tgcagactggagggga

SEQ ID NO: 3730640 - DNA, 21 bp, Homo sapiens
tgcagagcaggaaacatgact

SEQ ID NO: 3730641 - DNA, 21 bp, Homo sapiens
tgcagaggggctttctggaga

SEQ ID NO: 3730642 - DNA, 11 bp, Homo sapiens
tgcagatgcca

SEQ ID NO: 3730643 - DNA, 15 bp, Homo sapiens
tgcagatgccagagc

SEQ ID NO: 3730644 - DNA, 19 bp, Homo sapiens
tgcagcaaccagagcactg

SEQ ID NO: 3730645 - DNA, 20 bp, Homo sapiens
tgcagcaaccagagcactgt

SEQ ID NO: 3730646 - DNA, 22 bp, Homo sapiens
tgcagcaaccagagcactgtat

SEQ ID NO: 3730647 - DNA, 20 bp, Homo sapiens
tgcagcagcaacacaatgtt

SEQ ID NO: 3730648 - DNA, 12 bp, Homo sapiens
tgcagcagcttg

SEQ ID NO: 3730649 - DNA, 22 bp, Homo sapiens
tgcagcagtgagtctcttcaga

SEQ ID NO: 3730650 - DNA, 19 bp, Homo sapiens
tgcagcatgacctgtgacc

SEQ ID NO: 3730651 - DNA, 23 bp, Homo sapiens
tgcagcatgacctgtgaccagca

SEQ ID NO: 3730652 - DNA, 12 bp, Homo sapiens
tgcagccagccc

SEQ ID NO: 3730653 - DNA, 19 bp, Homo sapiens
tgcagcccatgcccacctg

SEQ ID NO: 3730654 - DNA, 23 bp, Homo sapiens
tgcagcccatgcccacctgccca

SEQ ID NO: 3730655 - DNA, 19 bp, Homo sapiens
tgcagcccgtgtggcccct

SEQ ID NO: 3730656 - DNA, 23 bp, Homo sapiens
tgcagcccgtgtggccccttcac

SEQ ID NO: 3730657 - DNA, 23 bp, Homo sapiens
tgcagcctcgaactcctgggctc

SEQ ID NO: 3730658 - DNA, 19 bp, Homo sapiens
tgcagcgaaccaatatttg

SEQ ID NO: 3730659 - DNA, 14 bp, Homo sapiens
tgcagctgatttta

SEQ ID NO: 3730660 - DNA, 16 bp, Homo sapiens
tgcaggaataaggcct

SEQ ID NO: 3730661 - DNA, 23 bp, Homo sapiens
tgcaggagttaaaaagggcaggg

SEQ ID NO: 3730662 - DNA, 20 bp, Homo sapiens
tgcaggccaagagcagaggc

SEQ ID NO: 3730663 - DNA, 10 bp, Homo sapiens
tgcaggcccc

SEQ ID NO: 3730664 - DNA, 14 bp, Homo sapiens
tgcagggagccgag

SEQ ID NO: 3730665 - DNA, 14 bp, Homo sapiens
tgcagggcctccat

SEQ ID NO: 3730666 - DNA, 19 bp, Homo sapiens
tgcagtagagtcatctcca

SEQ ID NO: 3730667 - DNA, 21 bp, Homo sapiens
tgcagtcagtcatgatggcac

SEQ ID NO: 3730668 - DNA, 13 bp, Homo sapiens
tgcagtcatcttg

SEQ ID NO: 3730669 - DNA, 14 bp, Homo sapiens
tgcagtctgcttct

SEQ ID NO: 3730670 - DNA, 18 bp, Homo sapiens
tgcagtgacgtgcacctg

SEQ ID NO: 3730671 - DNA, 22 bp, Homo sapiens
tgcagtgacgtgcacctgtact

SEQ ID NO: 3730672 - DNA, 16 bp, Homo sapiens
tgcagtgcttccaagg

SEQ ID NO: 3730673 - DNA, 17 bp, Homo sapiens
tgcagtggctcacgcct

SEQ ID NO: 3730674 - DNA, 21 bp, Homo sapiens
tgcagttacactaaaaggtga

SEQ ID NO: 3730675 - DNA, 19 bp, Homo sapiens
tgcagtttgagacaggaga

SEQ ID NO: 3730676 - DNA, 17 bp, Homo sapiens
tgcataaaattggatta

SEQ ID NO: 3730677 - DNA, 22 bp, Homo sapiens
tgcataactgacaaatcaagtt

SEQ ID NO: 3730678 - DNA, 23 bp, Homo sapiens
tgcataactgacaaatcaagttt

SEQ ID NO: 3730679 - DNA, 14 bp, Homo sapiens
tgcataagttaact

SEQ ID NO: 3730680 - DNA, 18 bp, Homo sapiens
tgcatagaaggaggagag

SEQ ID NO: 3730681 - DNA, 17 bp, Homo sapiens
tgcatagagccacgtat

SEQ ID NO: 3730682 - DNA, 21 bp, Homo sapiens
ttagaacactattttcagaat

SEQ ID NO: 3730683 - DNA, 17 bp, Homo sapiens
ttagaacagaaaacaac

SEQ ID NO: 3730684 - DNA, 16 bp, Homo sapiens
ttagaatgttttcctt

SEQ ID NO: 3730685 - DNA, 14 bp, Homo sapiens
ttagacaaatctaa

SEQ ID NO: 3730686 - DNA, 11 bp, Homo sapiens
ttagacagagt

SEQ ID NO: 3730687 - DNA, 13 bp, Homo sapiens
ttagacagagtct

SEQ ID NO: 3730688 - DNA, 12 bp, Homo sapiens
ttagacctcagc

SEQ ID NO: 3730689 - DNA, 15 bp, Homo sapiens
ttagacctcagcctg

SEQ ID NO: 3730690 - DNA, 16 bp, Homo sapiens
ttagacctcagcctgt

SEQ ID NO: 3730691 - DNA, 20 bp, Homo sapiens
ttagagacagggtcctgcta

SEQ ID NO: 3730692 - DNA, 15 bp, Homo sapiens
ttagagataagagtt

SEQ ID NO: 3730693 - DNA, 14 bp, Homo sapiens
ttagagtcagcctt

SEQ ID NO: 3730694 - DNA, 23 bp, Homo sapiens
ttagatatctttttattgatgtg

SEQ ID NO: 3730695 - DNA, 13 bp, Homo sapiens
ttagatggttaca

SEQ ID NO: 3730696 - DNA, 14 bp, Homo sapiens
ttagattatattga

SEQ ID NO: 3730697 - DNA, 20 bp, Homo sapiens
ttagcaaagagttaatatat

SEQ ID NO: 3730698 - DNA, 22 bp, Homo sapiens
ttagcacgtttaaagttctgtg

SEQ ID NO: 3730699 - DNA, 15 bp, Homo sapiens
ttagcagaatcaaaa

SEQ ID NO: 3730700 - DNA, 17 bp, Homo sapiens
ttagcagtgatttttat

SEQ ID NO: 3730701 - DNA, 16 bp, Homo sapiens
ttagcagttctgcaaa

SEQ ID NO: 3730702 - DNA, 21 bp, Homo sapiens
ttagcagttctgcaaatagaa

SEQ ID NO: 3730703 - DNA, 18 bp, Homo sapiens
ttagccaagtgtggtaga

SEQ ID NO: 3730704 - DNA, 13 bp, Homo sapiens
ttagccacaaaat

SEQ ID NO: 3730705 - DNA, 14 bp, Homo sapiens
ttagcggagacgga

SEQ ID NO: 3730706 - DNA, 13 bp, Homo sapiens
ttagctcagcccc

SEQ ID NO: 3730707 - DNA, 19 bp, Homo sapiens
ttagctcagccccagccca

SEQ ID NO: 3730708 - DNA, 13 bp, Homo sapiens
ttagctgcagaac

SEQ ID NO: 3730709 - DNA, 15 bp, Homo sapiens
ttagctgccaagccc

SEQ ID NO: 3730710 - DNA, 18 bp, Homo sapiens
ttagcttagacctcagcc

SEQ ID NO: 3730711 - DNA, 19 bp, Homo sapiens
ttagcttatcaatttgtca

SEQ ID NO: 3730712 - DNA, 21 bp, Homo sapiens
ttagcttgaaggatctgtttt

SEQ ID NO: 3730713 - DNA, 17 bp, Homo sapiens
ttaggaaataaaacctt

SEQ ID NO: 3730714 - DNA, 19 bp, Homo sapiens
ttaggaaataaaacctttc

SEQ ID NO: 3730715 - DNA, 15 bp, Homo sapiens
ttaggacttgccctc

SEQ ID NO: 3730716 - DNA, 15 bp, Homo sapiens
ttaggcagattgaaa

SEQ ID NO: 3730717 - DNA, 23 bp, Homo sapiens
ttaggcagcagcttttaatacag

SEQ ID NO: 3730718 - DNA, 18 bp, Homo sapiens
ttaggcatgcacagctgt

SEQ ID NO: 3730719 - DNA, 15 bp, Homo sapiens
ttaggctattcacaa

SEQ ID NO: 3730720 - DNA, 16 bp, Homo sapiens
ttaggctattcacaac

SEQ ID NO: 3730721 - DNA, 14 bp, Homo sapiens
ttaggctgggccca

SEQ ID NO: 3730722 - DNA, 16 bp, Homo sapiens
ttaggctgggcccaga

SEQ ID NO: 3730723 - DNA, 13 bp, Homo sapiens
ttagggaagagaa

SEQ ID NO: 3730724 - DNA, 17 bp, Homo sapiens
ttagggaagagaaacag

SEQ ID NO: 3730725 - DNA, 19 bp, Homo sapiens
ttaggttaactatgtacaa

SEQ ID NO: 3730726 - DNA, 14 bp, Homo sapiens
ttaggttaggactt

SEQ ID NO: 3730727 - DNA, 22 bp, Homo sapiens
ttaggttttgtacaattgaact

SEQ ID NO: 3730728 - DNA, 14 bp, Homo sapiens
ttagtaaagaaatg

SEQ ID NO: 3730729 - DNA, 15 bp, Homo sapiens
ttagtacccacctga

SEQ ID NO: 3730730 - DNA, 20 bp, Homo sapiens
ttagtactatatctgtttta

SEQ ID NO: 3730731 - DNA, 14 bp, Homo sapiens
ttagtagagacagg

SEQ ID NO: 3730732 - DNA, 15 bp, Homo sapiens
ttagtatctaacatg

SEQ ID NO: 3730733 - DNA, 16 bp, Homo sapiens
ttagtatttgcatatt

SEQ ID NO: 3730734 - DNA, 14 bp, Homo sapiens
ttagtcatagaaga

SEQ ID NO: 3730735 - DNA, 17 bp, Homo sapiens
ttagtgcggacaagttt

SEQ ID NO: 3730736 - DNA, 14 bp, Homo sapiens
ttagtgtaaaaatg

SEQ ID NO: 3730737 - DNA, 23 bp, Homo sapiens
ttagtgtcacttacctagattta

SEQ ID NO: 3730738 - DNA, 12 bp, Homo sapiens
ttagttctattt

SEQ ID NO: 3730739 - DNA, 22 bp, Homo sapiens
ttagtttgcagttacactaaaa

SEQ ID NO: 3730740 - DNA, 18 bp, Homo sapiens
ttagtttttgtaatttat

SEQ ID NO: 3730741 - DNA, 19 bp, Homo sapiens
ttagtttttgtaatttatt

SEQ ID NO: 3730742 - DNA, 17 bp, Homo sapiens
ttataaaattaaagaaa

SEQ ID NO: 3730743 - DNA, 22 bp, Homo sapiens
ttataaaattaaagaaaataaa

SEQ ID NO: 3730744 - DNA, 20 bp, Homo sapiens
ttataaccatggttttcctg

SEQ ID NO: 3730745 - DNA, 17 bp, Homo sapiens
ttataactcatcataaa

SEQ ID NO: 3730746 - DNA, 21 bp, Homo sapiens
ttataactcatcataaaataa

SEQ ID NO: 3730747 - DNA, 16 bp, Homo sapiens
ttataagcagatttaa

SEQ ID NO: 3730748 - DNA, 11 bp, Homo sapiens
ttataaggact

SEQ ID NO: 3730749 - DNA, 13 bp, Homo sapiens
ttataaggactgc

SEQ ID NO: 3730750 - DNA, 15 bp, Homo sapiens
ttataataatgttaa

SEQ ID NO: 3730751 - DNA, 15 bp, Homo sapiens
ttataattttaagat

SEQ ID NO: 3730752 - DNA, 18 bp, Homo sapiens
ttataattttaagattcc

SEQ ID NO: 3730753 - DNA, 21 bp, Homo sapiens
ttataattttaagattccttt

SEQ ID NO: 3730754 - DNA, 18 bp, Homo sapiens
ttatacagctcagctttt

SEQ ID NO: 3730755 - DNA, 12 bp, Homo sapiens
ttatacagtaca

SEQ ID NO: 3730756 - DNA, 17 bp, Homo sapiens
ttatacagtagtgagaa

SEQ ID NO: 3730757 - DNA, 21 bp, Homo sapiens
ttatacagtagtgagaagaat

SEQ ID NO: 3730758 - DNA, 12 bp, Homo sapiens
ttatactaagaa

SEQ ID NO: 3730759 - DNA, 22 bp, Homo sapiens
ttatactgtacttaataaattc

SEQ ID NO: 3730760 - DNA, 15 bp, Homo sapiens
ttatagaatatttat

SEQ ID NO: 3730761 - DNA, 16 bp, Homo sapiens
ttatagctcagtttat

SEQ ID NO: 3730762 - DNA, 17 bp, Homo sapiens
ttatagtttatacagtt

SEQ ID NO: 3730763 - DNA, 16 bp, Homo sapiens
ttccaagacctgactc

SEQ ID NO: 3730764 - DNA, 17 bp, Homo sapiens
ttccaagggtactaagg

SEQ ID NO: 3730765 - DNA, 15 bp, Homo sapiens
ttccaatcctggctc

SEQ ID NO: 3730766 - DNA, 23 bp, Homo sapiens
ttccaatcctggctctgtggctt

SEQ ID NO: 3730767 - DNA, 19 bp, Homo sapiens
ttccacacctagcatctca

SEQ ID NO: 3730768 - DNA, 12 bp, Homo sapiens
ttccaccagcct

SEQ ID NO: 3730769 - DNA, 14 bp, Homo sapiens
ttccaccccctccc

SEQ ID NO: 3730770 - DNA, 18 bp, Homo sapiens
ttccaccccctccctggc

SEQ ID NO: 3730771 - DNA, 13 bp, Homo sapiens
ttccaccctggaa

SEQ ID NO: 3730772 - DNA, 13 bp, Homo sapiens
ttccaccttaaat

SEQ ID NO: 3730773 - DNA, 14 bp, Homo sapiens
ttccaccttaaatt

SEQ ID NO: 3730774 - DNA, 17 bp, Homo sapiens
ttccaccttaaattaaa

SEQ ID NO: 3730775 - DNA, 18 bp, Homo sapiens
ttccaccttaaattaaac

SEQ ID NO: 3730776 - DNA, 20 bp, Homo sapiens
ttccaccttaaattaaacaa

SEQ ID NO: 3730777 - DNA, 19 bp, Homo sapiens
ttccacgatgaaaaacttc

SEQ ID NO: 3730778 - DNA, 18 bp, Homo sapiens
ttccacgctgtctccaga

SEQ ID NO: 3730779 - DNA, 12 bp, Homo sapiens
ttccactggact

SEQ ID NO: 3730780 - DNA, 22 bp, Homo sapiens
ttccactggacttgagcttggc

SEQ ID NO: 3730781 - DNA, 17 bp, Homo sapiens
ttccagaaaaccccagc

SEQ ID NO: 3730782 - DNA, 15 bp, Homo sapiens
ttccagaaaggatat

SEQ ID NO: 3730783 - DNA, 20 bp, Homo sapiens
ttccagatgccttctccaga

SEQ ID NO: 3730784 - DNA, 13 bp, Homo sapiens
ttccaggaaaaag

SEQ ID NO: 3730785 - DNA, 11 bp, Homo sapiens
ttccaggctcc

SEQ ID NO: 3730786 - DNA, 19 bp, Homo sapiens
ttccaggctgcatagaagg

SEQ ID NO: 3730787 - DNA, 17 bp, Homo sapiens
ttccagtacctttgtca

SEQ ID NO: 3730788 - DNA, 15 bp, Homo sapiens
ttccagtgcaacact

SEQ ID NO: 3730789 - DNA, 22 bp, Homo sapiens
ttccagtggcctggctccgctg

SEQ ID NO: 3730790 - DNA, 16 bp, Homo sapiens
ttccataatgtataaa

SEQ ID NO: 3730791 - DNA, 17 bp, Homo sapiens
ttccatagtatattaaa

SEQ ID NO: 3730792 - DNA, 23 bp, Homo sapiens
ttccatagtatattaaaaatggt

SEQ ID NO: 3730793 - DNA, 15 bp, Homo sapiens
ttccatgaaaacgtt

SEQ ID NO: 3730794 - DNA, 22 bp, Homo sapiens
ttccatgaaaacgttttattgt

SEQ ID NO: 3730795 - DNA, 18 bp, Homo sapiens
ttccatgtcgcctctgca

SEQ ID NO: 3730796 - DNA, 19 bp, Homo sapiens
ttccatgtcgcctctgcat

SEQ ID NO: 3730797 - DNA, 20 bp, Homo sapiens
ttccatgtcgcctctgcatt

SEQ ID NO: 3730798 - DNA, 16 bp, Homo sapiens
ttccatgtgcccagtt

SEQ ID NO: 3730799 - DNA, 17 bp, Homo sapiens
ttccatgtgcccagtta

SEQ ID NO: 3730800 - DNA, 15 bp, Homo sapiens
ttccattatgattct

SEQ ID NO: 3730801 - DNA, 13 bp, Homo sapiens
ttccattgtgtga

SEQ ID NO: 3730802 - DNA, 14 bp, Homo sapiens
ttccatttgtgtgt

SEQ ID NO: 3730803 - DNA, 15 bp, Homo sapiens
ttcccaactgcaagt

SEQ ID NO: 3730804 - DNA, 18 bp, Homo sapiens
ttcccagctctccctctg

SEQ ID NO: 3730805 - DNA, 19 bp, Homo sapiens
ttcccagctgcccctccct

SEQ ID NO: 3730806 - DNA, 23 bp, Homo sapiens
ttcccagtgacacttcagagagc

SEQ ID NO: 3730807 - DNA, 16 bp, Homo sapiens
ttcccataattttctt

SEQ ID NO: 3730808 - DNA, 14 bp, Homo sapiens
ttcccattcttgca

SEQ ID NO: 3730809 - DNA, 19 bp, Homo sapiens
ttcccattttgcaaaattt

SEQ ID NO: 3730810 - DNA, 21 bp, Homo sapiens
ttccccactgacagcctccca

SEQ ID NO: 3730811 - DNA, 18 bp, Homo sapiens
ttcccccatagccacccc

SEQ ID NO: 3730812 - DNA, 15 bp, Homo sapiens
ttccccctcccaggg

SEQ ID NO: 3730813 - DNA, 19 bp, Homo sapiens
ttccccgcattccaggctc

SEQ ID NO: 3730814 - DNA, 14 bp, Homo sapiens
ttcccctgttcact

SEQ ID NO: 3730815 - DNA, 14 bp, Homo sapiens
ttcccgctcagccc

SEQ ID NO: 3730816 - DNA, 19 bp, Homo sapiens
ttccctaagccaagggcct

SEQ ID NO: 3730817 - DNA, 16 bp, Homo sapiens
ttccctacttcctgtg

SEQ ID NO: 3730818 - DNA, 12 bp, Homo sapiens
ttccctatcact

SEQ ID NO: 3730819 - DNA, 23 bp, Homo sapiens
ttccctcaaagcttccattccac

SEQ ID NO: 3730820 - DNA, 15 bp, Homo sapiens
ttccctcctgctact

SEQ ID NO: 3730821 - DNA, 14 bp, Homo sapiens
ttccctctgcctgt

SEQ ID NO: 3730822 - DNA, 17 bp, Homo sapiens
ttccctgaaaacccaga

SEQ ID NO: 3730823 - DNA, 19 bp, Homo sapiens
ttccctgaaaacccagaga

SEQ ID NO: 3730824 - DNA, 20 bp, Homo sapiens
ttccctgaaaacccagagag

SEQ ID NO: 3730825 - DNA, 10 bp, Homo sapiens
ttccctgcaa

SEQ ID NO: 3730826 - DNA, 22 bp, Homo sapiens
ttcccttcaaggtcatttactt

SEQ ID NO: 3730827 - DNA, 20 bp, Homo sapiens
ttcccttctccttccaactg

SEQ ID NO: 3730828 - DNA, 17 bp, Homo sapiens
ttccctttgctccaccc

SEQ ID NO: 3730829 - DNA, 18 bp, Homo sapiens
ttccctttgctccacccc

SEQ ID NO: 3730830 - DNA, 21 bp, Homo sapiens
ttccggaatcctgtcctcagc

SEQ ID NO: 3730831 - DNA, 18 bp, Homo sapiens
ttccgtgacgtcactgga

SEQ ID NO: 3730832 - DNA, 19 bp, Homo sapiens
ttcctaacaggattagaca

SEQ ID NO: 3730833 - DNA, 17 bp, Homo sapiens
ttcctaagttcttagat

SEQ ID NO: 3730834 - DNA, 18 bp, Homo sapiens
ttcctaagttcttagata

SEQ ID NO: 3730835 - DNA, 20 bp, Homo sapiens
ttcctacaagagcagcctgt

SEQ ID NO: 3730836 - DNA, 18 bp, Homo sapiens
ttcctacttttccttccc

SEQ ID NO: 3730837 - DNA, 18 bp, Homo sapiens
ttcctagttttctcctcc

SEQ ID NO: 3730838 - DNA, 21 bp, Homo sapiens
ttcctatatagtttattgaca

SEQ ID NO: 3730839 - DNA, 15 bp, Homo sapiens
ttcctatcccatccc

SEQ ID NO: 3730840 - DNA, 23 bp, Homo sapiens
ttcctcatagtatggtggctggg

SEQ ID NO: 3730841 - DNA, 11 bp, Homo sapiens
ttcctccccag

SEQ ID NO: 3730842 - DNA, 23 bp, Homo sapiens
ttcctctagtgccctccacagcc

SEQ ID NO: 3730843 - DNA, 23 bp, Homo sapiens
ttcctctcatccttttctcctat

SEQ ID NO: 3730844 - DNA, 12 bp, Homo sapiens
ttcctctccact

SEQ ID NO: 3730845 - DNA, 13 bp, Homo sapiens
ttcctctccactg

SEQ ID NO: 3730846 - DNA, 15 bp, Homo sapiens
ttcctctccactgcc

SEQ ID NO: 3730847 - DNA, 18 bp, Homo sapiens
ttcctctccactgccttc

SEQ ID NO: 3730848 - DNA, 20 bp, Homo sapiens
ttcctcttctattttgtaaa

SEQ ID NO: 3730849 - DNA, 17 bp, Homo sapiens
ttcctctttccatctac

SEQ ID NO: 3730850 - DNA, 22 bp, Homo sapiens
ttcctctttccatctaccctcc

SEQ ID NO: 3730851 - DNA, 22 bp, Homo sapiens
ttcctctttttatttagttcct

SEQ ID NO: 3730852 - DNA, 16 bp, Homo sapiens
ttcctgaatgaaatat

SEQ ID NO: 3730853 - DNA, 11 bp, Homo sapiens
ttcctgagctt

SEQ ID NO: 3730854 - DNA, 16 bp, Homo sapiens
ttcctgagcttggcca

SEQ ID NO: 3730855 - DNA, 20 bp, Homo sapiens
ttcctgagcttggccagaag

SEQ ID NO: 3730856 - DNA, 15 bp, Homo sapiens
ttcctgcagcctgga

SEQ ID NO: 3730857 - DNA, 18 bp, Homo sapiens
ttcctgcagcctggaggc

SEQ ID NO: 3730858 - DNA, 18 bp, Homo sapiens
ttcctgcattcacccaga

SEQ ID NO: 3730859 - DNA, 15 bp, Homo sapiens
ttcctgcatttgtga

SEQ ID NO: 3730860 - DNA, 16 bp, Homo sapiens
ttcctgcatttgtgaa

SEQ ID NO: 3730861 - DNA, 17 bp, Homo sapiens
ttcctgccaggcatggt

SEQ ID NO: 3730862 - DNA, 15 bp, Homo sapiens
ttcctgcctggtctc

SEQ ID NO: 3730863 - DNA, 15 bp, Homo sapiens
ttcctgcctgtctcc

SEQ ID NO: 3730864 - DNA, 13 bp, Homo sapiens
ttcctggagcccg

SEQ ID NO: 3730865 - DNA, 22 bp, Homo sapiens
ttcctggcaatagtgtgttctg

SEQ ID NO: 3730866 - DNA, 14 bp, Homo sapiens
ttcctggcttctta

SEQ ID NO: 3730867 - DNA, 20 bp, Homo sapiens
ttcctggggtgccctccact

SEQ ID NO: 3730868 - DNA, 21 bp, Homo sapiens
ttcctggggtgccctccactg

SEQ ID NO: 3730869 - DNA, 11 bp, Homo sapiens
ttcctgtgtct

SEQ ID NO: 3730870 - DNA, 14 bp, Homo sapiens
ttcctgttcagcat

SEQ ID NO: 3730871 - DNA, 22 bp, Homo sapiens
ttcctgttgttatggaaactgt

SEQ ID NO: 3730872 - DNA, 20 bp, Homo sapiens
ttccttagcttagacctcag

SEQ ID NO: 3730873 - DNA, 21 bp, Homo sapiens
ttccttagcttagacctcagc

SEQ ID NO: 3730874 - DNA, 13 bp, Homo sapiens
ttccttccctcaa

SEQ ID NO: 3730875 - DNA, 14 bp, Homo sapiens
ttccttccctggct

SEQ ID NO: 3730876 - DNA, 14 bp, Homo sapiens
ttccttccttccct

SEQ ID NO: 3730877 - DNA, 20 bp, Homo sapiens
ttccttgctgtcctaggcca

SEQ ID NO: 3730878 - DNA, 21 bp, Homo sapiens
ttccttggcatgccttccagc

SEQ ID NO: 3730879 - DNA, 16 bp, Homo sapiens
ttccttgtcactggta

SEQ ID NO: 3730880 - DNA, 18 bp, Homo sapiens
ttcctttccctttagcac

SEQ ID NO: 3730881 - DNA, 12 bp, Homo sapiens
ttcctttctcag

SEQ ID NO: 3730882 - DNA, 21 bp, Homo sapiens
ttcctttgtttttttttcctg

SEQ ID NO: 3730883 - DNA, 20 bp, Homo sapiens
ttccttttagcctagttcat

SEQ ID NO: 3730884 - DNA, 18 bp, Homo sapiens
ttccttttctaactctcc

SEQ ID NO: 3730885 - DNA, 14 bp, Homo sapiens
ttccttttcttgtt

SEQ ID NO: 3730886 - DNA, 22 bp, Homo sapiens
ttccttttcttgtttatcagca

SEQ ID NO: 3730887 - DNA, 16 bp, Homo sapiens
ttcgaagctcagccca

SEQ ID NO: 3730888 - DNA, 14 bp, Homo sapiens
ttcgagaccagcct

SEQ ID NO: 3730889 - DNA, 16 bp, Homo sapiens
ttcgagaccagcctgg

SEQ ID NO: 3730890 - DNA, 19 bp, Homo sapiens
ttcgagaccagcctggcca

SEQ ID NO: 3730891 - DNA, 21 bp, Homo sapiens
ttcgcaggattcttcctccct

SEQ ID NO: 3730892 - DNA, 19 bp, Homo sapiens
ttcgcccaaagccagacag

SEQ ID NO: 3730893 - DNA, 14 bp, Homo sapiens
ttcgccgtggctgc

SEQ ID NO: 3730894 - DNA, 20 bp, Homo sapiens
ttcgccgtggctgcggcacc

SEQ ID NO: 3730895 - DNA, 21 bp, Homo sapiens
ttcgccgtggctgcggcaccc

SEQ ID NO: 3730896 - DNA, 16 bp, Homo sapiens
ttcgtgcactctgcta

SEQ ID NO: 3730897 - DNA, 22 bp, Homo sapiens
ttcgttttggttaagttggctt

SEQ ID NO: 3730898 - DNA, 18 bp, Homo sapiens
ttctaaaaattgtgatca

SEQ ID NO: 3730899 - DNA, 13 bp, Homo sapiens
ttctaaatgcata

SEQ ID NO: 3730900 - DNA, 18 bp, Homo sapiens
ttctaaggaatatgagct

SEQ ID NO: 3730901 - DNA, 14 bp, Homo sapiens
ttctaatagaactc

SEQ ID NO: 3730902 - DNA, 23 bp, Homo sapiens
ttctaatgtgtgaatcagagcac

SEQ ID NO: 3730903 - DNA, 18 bp, Homo sapiens
ttctaccaactggaagca

SEQ ID NO: 3730904 - DNA, 19 bp, Homo sapiens
ttctacccagcgagccctg

SEQ ID NO: 3730905 - DNA, 19 bp, Homo sapiens
ttctaccttgaggtctttt

SEQ ID NO: 3730906 - DNA, 22 bp, Homo sapiens
ttctagctaatggaaaatgatt

SEQ ID NO: 3730907 - DNA, 12 bp, Homo sapiens
ttctagctgttg

SEQ ID NO: 3730908 - DNA, 13 bp, Homo sapiens
ttctaggcctggg

SEQ ID NO: 3730909 - DNA, 21 bp, Homo sapiens
ttctaggtcaaggcctgtccc

SEQ ID NO: 3730910 - DNA, 15 bp, Homo sapiens
ttctaggttctaaaa

SEQ ID NO: 3730911 - DNA, 14 bp, Homo sapiens
ttctatcccaaact

SEQ ID NO: 3730912 - DNA, 23 bp, Homo sapiens
ttctatcccaaactaagctatgt

SEQ ID NO: 3730913 - DNA, 22 bp, Homo sapiens
ttctatgtgacaattttgtaca

SEQ ID NO: 3730914 - DNA, 20 bp, Homo sapiens
ttctattctctcctcagact

SEQ ID NO: 3730915 - DNA, 13 bp, Homo sapiens
ttctattttgtaa

SEQ ID NO: 3730916 - DNA, 15 bp, Homo sapiens
ttctatttttgtaga

SEQ ID NO: 3730917 - DNA, 15 bp, Homo sapiens
ttctcaaagcaggaa

SEQ ID NO: 3730918 - DNA, 19 bp, Homo sapiens
ttctcaaagggtacttcca

SEQ ID NO: 3730919 - DNA, 18 bp, Homo sapiens
ttctcaagccgcatccca

SEQ ID NO: 3730920 - DNA, 22 bp, Homo sapiens
ttctcacagtgggagccagggc

SEQ ID NO: 3730921 - DNA, 19 bp, Homo sapiens
ttctcagaatctcaaataa

SEQ ID NO: 3730922 - DNA, 15 bp, Homo sapiens
ttctcagatatttat

SEQ ID NO: 3730923 - DNA, 21 bp, Homo sapiens
ttaagaaaaaataacacacat

SEQ ID NO: 3730924 - DNA, 18 bp, Homo sapiens
ttaagaaaatacaataaa

SEQ ID NO: 3730925 - DNA, 22 bp, Homo sapiens
ttaagaaagactatctaaatgt

SEQ ID NO: 3730926 - DNA, 19 bp, Homo sapiens
ttaagaccacctcaaattt

SEQ ID NO: 3730927 - DNA, 13 bp, Homo sapiens
ttaagaggcaggg

SEQ ID NO: 3730928 - DNA, 17 bp, Homo sapiens
ttaagatggattctcag

SEQ ID NO: 3730929 - DNA, 22 bp, Homo sapiens
ttaagatggattctcagatatt

SEQ ID NO: 3730930 - DNA, 17 bp, Homo sapiens
ttaagatgtgtcttcaa

SEQ ID NO: 3730931 - DNA, 15 bp, Homo sapiens
ttaagatttaatttg

SEQ ID NO: 3730932 - DNA, 18 bp, Homo sapiens
ttaagcagtaaaaactgt

SEQ ID NO: 3730933 - DNA, 15 bp, Homo sapiens
ttaagcatcacaaat

SEQ ID NO: 3730934 - DNA, 23 bp, Homo sapiens
ttaagcattactcttgtaagatt

SEQ ID NO: 3730935 - DNA, 12 bp, Homo sapiens
ttaagcttattt

SEQ ID NO: 3730936 - DNA, 21 bp, Homo sapiens
ttaaggaagacaatgtgaaaa

SEQ ID NO: 3730937 - DNA, 17 bp, Homo sapiens
ttaaggtctctctttgg

SEQ ID NO: 3730938 - DNA, 14 bp, Homo sapiens
ttaagtatcagaaa

SEQ ID NO: 3730939 - DNA, 15 bp, Homo sapiens
ttaagtattcaagaa

SEQ ID NO: 3730940 - DNA, 19 bp, Homo sapiens
ttaagtatttatatattta

SEQ ID NO: 3730941 - DNA, 16 bp, Homo sapiens
ttaagtgatgaacatt

SEQ ID NO: 3730942 - DNA, 18 bp, Homo sapiens
ttaagttgctgatgaact

SEQ ID NO: 3730943 - DNA, 17 bp, Homo sapiens
ttaagttggcttctgtt

SEQ ID NO: 3730944 - DNA, 11 bp, Homo sapiens
ttaataaaaag

SEQ ID NO: 3730945 - DNA, 14 bp, Homo sapiens
ttaataaaaaggca

SEQ ID NO: 3730946 - DNA, 18 bp, Homo sapiens
ttaataacataacaaata

SEQ ID NO: 3730947 - DNA, 19 bp, Homo sapiens
ttaatagaatataattatc

SEQ ID NO: 3730948 - DNA, 16 bp, Homo sapiens
ttaatatggggatgca

SEQ ID NO: 3730949 - DNA, 22 bp, Homo sapiens
ttaatatggggatgcagcatta

SEQ ID NO: 3730950 - DNA, 23 bp, Homo sapiens
ttaatatgttaacctcagtgtca

SEQ ID NO: 3730951 - DNA, 20 bp, Homo sapiens
ttaatattctttcaataacg

SEQ ID NO: 3730952 - DNA, 12 bp, Homo sapiens
ttaatatttgct

SEQ ID NO: 3730953 - DNA, 15 bp, Homo sapiens
ttaatcttcagtttt

SEQ ID NO: 3730954 - DNA, 18 bp, Homo sapiens
ttaatgaaagactgtaca

SEQ ID NO: 3730955 - DNA, 19 bp, Homo sapiens
ttaatgacagagccagtgg

SEQ ID NO: 3730956 - DNA, 20 bp, Homo sapiens
ttaatgcatgttaggaaaat

SEQ ID NO: 3730957 - DNA, 11 bp, Homo sapiens
ttaatgttttt

SEQ ID NO: 3730958 - DNA, 13 bp, Homo sapiens
ttaattaaatgca

SEQ ID NO: 3730959 - DNA, 18 bp, Homo sapiens
ttaattaggttaactatg

SEQ ID NO: 3730960 - DNA, 15 bp, Homo sapiens
ttaattcatgtttct

SEQ ID NO: 3730961 - DNA, 14 bp, Homo sapiens
ttaattgaaggaaa

SEQ ID NO: 3730962 - DNA, 15 bp, Homo sapiens
ttaattgtaaactgt

SEQ ID NO: 3730963 - DNA, 20 bp, Homo sapiens
ttaattgtgaattgataata

SEQ ID NO: 3730964 - DNA, 23 bp, Homo sapiens
ttaattttgtaaaggtgaaaaaa

SEQ ID NO: 3730965 - DNA, 19 bp, Homo sapiens
ttaatttttttgagacaga

SEQ ID NO: 3730966 - DNA, 13 bp, Homo sapiens
ttacaaaagatgt

SEQ ID NO: 3730967 - DNA, 15 bp, Homo sapiens
ttacaaactgcaata

SEQ ID NO: 3730968 - DNA, 18 bp, Homo sapiens
ttacaagggaagatttat

SEQ ID NO: 3730969 - DNA, 21 bp, Homo sapiens
ttacaataaaactttgctgcc

SEQ ID NO: 3730970 - DNA, 23 bp, Homo sapiens
ttacaataaaatcttgaaaatgc

SEQ ID NO: 3730971 - DNA, 13 bp, Homo sapiens
ttacaattgaaat

SEQ ID NO: 3730972 - DNA, 13 bp, Homo sapiens
ttacactgttaga

SEQ ID NO: 3730973 - DNA, 20 bp, Homo sapiens
ttacactttatgcacaaaat

SEQ ID NO: 3730974 - DNA, 14 bp, Homo sapiens
ttacacttttgaga

SEQ ID NO: 3730975 - DNA, 17 bp, Homo sapiens
ttacagagaggagaaac

SEQ ID NO: 3730976 - DNA, 19 bp, Homo sapiens
ttacagattgcctccttat

SEQ ID NO: 3730977 - DNA, 18 bp, Homo sapiens
ttacaggcaccgagaatg

SEQ ID NO: 3730978 - DNA, 14 bp, Homo sapiens
ttacagttgcattt

SEQ ID NO: 3730979 - DNA, 21 bp, Homo sapiens
ttacatccttgtggcacattt

SEQ ID NO: 3730980 - DNA, 21 bp, Homo sapiens
ttacatctgttttaaatttat

SEQ ID NO: 3730981 - DNA, 15 bp, Homo sapiens
ttacatgagaacaga

SEQ ID NO: 3730982 - DNA, 13 bp, Homo sapiens
ttacatgcatttg

SEQ ID NO: 3730983 - DNA, 22 bp, Homo sapiens
ttacatgttttctttgctttaa

SEQ ID NO: 3730984 - DNA, 19 bp, Homo sapiens
ttacattattatcaacaat

SEQ ID NO: 3730985 - DNA, 21 bp, Homo sapiens
ttacattccttgataatgttg

SEQ ID NO: 3730986 - DNA, 20 bp, Homo sapiens
ttacattgctggtcttgtaa

SEQ ID NO: 3730987 - DNA, 21 bp, Homo sapiens
ttacattgctggtcttgtaag

SEQ ID NO: 3730988 - DNA, 16 bp, Homo sapiens
ttaccaagttatataa

SEQ ID NO: 3730989 - DNA, 17 bp, Homo sapiens
ttaccaagttatataaa

SEQ ID NO: 3730990 - DNA, 23 bp, Homo sapiens
ttaccagcctccgtatttcagac

SEQ ID NO: 3730991 - DNA, 20 bp, Homo sapiens
ttaccagtaaagtgtaacat

SEQ ID NO: 3730992 - DNA, 15 bp, Homo sapiens
ttaccatatgtgctt

SEQ ID NO: 3730993 - DNA, 14 bp, Homo sapiens
ttaccatttgtaat

SEQ ID NO: 3730994 - DNA, 23 bp, Homo sapiens
ttaccattttggggtacccactg

SEQ ID NO: 3730995 - DNA, 16 bp, Homo sapiens
ttacccagaatgtcag

SEQ ID NO: 3730996 - DNA, 22 bp, Homo sapiens
ttaccctcaggcataggcctgg

SEQ ID NO: 3730997 - DNA, 17 bp, Homo sapiens
ttacctaccacagtgtc

SEQ ID NO: 3730998 - DNA, 18 bp, Homo sapiens
ttacctaccacagtgtct

SEQ ID NO: 3730999 - DNA, 14 bp, Homo sapiens
ttacctcctgccca

SEQ ID NO: 3731000 - DNA, 21 bp, Homo sapiens
ttacctctgatacctcaaccc

SEQ ID NO: 3731001 - DNA, 15 bp, Homo sapiens
ttaccttcaataaag

SEQ ID NO: 3731002 - DNA, 14 bp, Homo sapiens
ttactacaaaattt

SEQ ID NO: 3731003 - DNA, 13 bp, Homo sapiens
ttactacagttgt

SEQ ID NO: 3731004 - DNA, 19 bp, Homo sapiens
ttactatcatgtcaaacgt

SEQ ID NO: 3731005 - DNA, 19 bp, Homo sapiens
ttactattttacttctaga

SEQ ID NO: 3731006 - DNA, 13 bp, Homo sapiens
ttactcagccctg

SEQ ID NO: 3731007 - DNA, 15 bp, Homo sapiens
tggcatcccagtggc

SEQ ID NO: 3731008 - DNA, 15 bp, Homo sapiens
tggcatgccttccag

SEQ ID NO: 3731009 - DNA, 14 bp, Homo sapiens
tggcatggcacctg

SEQ ID NO: 3731010 - DNA, 19 bp, Homo sapiens
tggcatgggggcctcaggg

SEQ ID NO: 3731011 - DNA, 21 bp, Homo sapiens
tggccaaagccaaagctaggc

SEQ ID NO: 3731012 - DNA, 23 bp, Homo sapiens
tggccaaagccaaagctaggcct

SEQ ID NO: 3731013 - DNA, 17 bp, Homo sapiens
tggccactccagacccc

SEQ ID NO: 3731014 - DNA, 14 bp, Homo sapiens
tggccagaccagag

SEQ ID NO: 3731015 - DNA, 15 bp, Homo sapiens
tggccagaccagagc

SEQ ID NO: 3731016 - DNA, 20 bp, Homo sapiens
tggccagaccagagctctgg

SEQ ID NO: 3731017 - DNA, 23 bp, Homo sapiens
tggccagagagcctggtgctgct

SEQ ID NO: 3731018 - DNA, 19 bp, Homo sapiens
tggccagatgcaccagccc

SEQ ID NO: 3731019 - DNA, 20 bp, Homo sapiens
tggccagatgcaccagccct

SEQ ID NO: 3731020 - DNA, 13 bp, Homo sapiens
tggccagcagctt

SEQ ID NO: 3731021 - DNA, 15 bp, Homo sapiens
tggccaggagctctt

SEQ ID NO: 3731022 - DNA, 17 bp, Homo sapiens
tggccaggcagatctgt

SEQ ID NO: 3731023 - DNA, 19 bp, Homo sapiens
tggccaggcagatctgtgc

SEQ ID NO: 3731024 - DNA, 16 bp, Homo sapiens
tggccagtgtgatccc

SEQ ID NO: 3731025 - DNA, 14 bp, Homo sapiens
tggccatttgcttt

SEQ ID NO: 3731026 - DNA, 14 bp, Homo sapiens
tggcccactgcatc

SEQ ID NO: 3731027 - DNA, 23 bp, Homo sapiens
tggccccatgtctctcagaattc

SEQ ID NO: 3731028 - DNA, 14 bp, Homo sapiens
tggcccccactggc

SEQ ID NO: 3731029 - DNA, 14 bp, Homo sapiens
tggcccccgagctg

SEQ ID NO: 3731030 - DNA, 16 bp, Homo sapiens
tggcccccgagctggg

SEQ ID NO: 3731031 - DNA, 17 bp, Homo sapiens
tggcccccgagctgggg

SEQ ID NO: 3731032 - DNA, 19 bp, Homo sapiens
tggcccccgagctgggggc

SEQ ID NO: 3731033 - DNA, 15 bp, Homo sapiens
tggcccctgcccggc

SEQ ID NO: 3731034 - DNA, 14 bp, Homo sapiens
tggcccctgccttg

SEQ ID NO: 3731035 - DNA, 16 bp, Homo sapiens
tggccccttcacttct

SEQ ID NO: 3731036 - DNA, 21 bp, Homo sapiens
tggccccttcacttctgacca

SEQ ID NO: 3731037 - DNA, 14 bp, Homo sapiens
tggcccgacagcct

SEQ ID NO: 3731038 - DNA, 18 bp, Homo sapiens
tggcccgacagcctggca

SEQ ID NO: 3731039 - DNA, 19 bp, Homo sapiens
tggcccgacagcctggcac

SEQ ID NO: 3731040 - DNA, 13 bp, Homo sapiens
tggccctcttctt

SEQ ID NO: 3731041 - DNA, 17 bp, Homo sapiens
tggccctggcctgctgg

SEQ ID NO: 3731042 - DNA, 23 bp, Homo sapiens
tggcccttgcagttcagcaccac

SEQ ID NO: 3731043 - DNA, 20 bp, Homo sapiens
tggccgagggtcctggctcc

SEQ ID NO: 3731044 - DNA, 19 bp, Homo sapiens
tggccgggcacagctgtgg

SEQ ID NO: 3731045 - DNA, 18 bp, Homo sapiens
tggcctcagctgcctcac

SEQ ID NO: 3731046 - DNA, 19 bp, Homo sapiens
tggcctcagctgcctcact

SEQ ID NO: 3731047 - DNA, 12 bp, Homo sapiens
tggcctgaggag

SEQ ID NO: 3731048 - DNA, 20 bp, Homo sapiens
tggcctgctgggctctccac

SEQ ID NO: 3731049 - DNA, 22 bp, Homo sapiens
tggcctgctgggctctccacct

SEQ ID NO: 3731050 - DNA, 12 bp, Homo sapiens
tggcctggccag

SEQ ID NO: 3731051 - DNA, 16 bp, Homo sapiens
tggcctggccaggagc

SEQ ID NO: 3731052 - DNA, 21 bp, Homo sapiens
tggcctggccaggagctcttc

SEQ ID NO: 3731053 - DNA, 18 bp, Homo sapiens
tggcctggctccgctgtg

SEQ ID NO: 3731054 - DNA, 16 bp, Homo sapiens
tggcctgtctcatccc

SEQ ID NO: 3731055 - DNA, 18 bp, Homo sapiens
tggccttccccagcctct

SEQ ID NO: 3731056 - DNA, 13 bp, Homo sapiens
tggcgctaggcat

SEQ ID NO: 3731057 - DNA, 22 bp, Homo sapiens
tggcggctactcagcagccctc

SEQ ID NO: 3731058 - DNA, 20 bp, Homo sapiens
tggcgtagagggtgctgccc

SEQ ID NO: 3731059 - DNA, 15 bp, Homo sapiens
tggcgtctgtcttca

SEQ ID NO: 3731060 - DNA, 20 bp, Homo sapiens
tggcgtctgtcttcaagggc

SEQ ID NO: 3731061 - DNA, 22 bp, Homo sapiens
tggcgtctgtcttcaagggctt

SEQ ID NO: 3731062 - DNA, 22 bp, Homo sapiens
tggcgtgcagtggtgcgatctg

SEQ ID NO: 3731063 - DNA, 14 bp, Homo sapiens
tggctaaaggtccc

SEQ ID NO: 3731064 - DNA, 15 bp, Homo sapiens
tggctaagagtgtcc

SEQ ID NO: 3731065 - DNA, 14 bp, Homo sapiens
tggctaaggcacca

SEQ ID NO: 3731066 - DNA, 15 bp, Homo sapiens
tggctacatcccagc

SEQ ID NO: 3731067 - DNA, 22 bp, Homo sapiens
tggctagaggccagccccaccc

SEQ ID NO: 3731068 - DNA, 16 bp, Homo sapiens
tggctagagtcctcac

SEQ ID NO: 3731069 - DNA, 16 bp, Homo sapiens
tggctagtcagagaga

SEQ ID NO: 3731070 - DNA, 15 bp, Homo sapiens
tggctagtccttgtt

SEQ ID NO: 3731071 - DNA, 18 bp, Homo sapiens
tggctcaagtcctctttt

SEQ ID NO: 3731072 - DNA, 16 bp, Homo sapiens
tggctcacacctgtaa

SEQ ID NO: 3731073 - DNA, 17 bp, Homo sapiens
tggctcacagactggag

SEQ ID NO: 3731074 - DNA, 18 bp, Homo sapiens
tggctcacagactggaga

SEQ ID NO: 3731075 - DNA, 13 bp, Homo sapiens
tggctcacgcctg

SEQ ID NO: 3731076 - DNA, 16 bp, Homo sapiens
tggctcacgcctgtaa

SEQ ID NO: 3731077 - DNA, 16 bp, Homo sapiens
tggctcacgtgtgtga

SEQ ID NO: 3731078 - DNA, 13 bp, Homo sapiens
tggctcactgcag

SEQ ID NO: 3731079 - DNA, 18 bp, Homo sapiens
tggctcactgcagcctcg

SEQ ID NO: 3731080 - DNA, 20 bp, Homo sapiens
tggctccagtctgctgccct

SEQ ID NO: 3731081 - DNA, 23 bp, Homo sapiens
tggctccagtctgctgccctcca

SEQ ID NO: 3731082 - DNA, 21 bp, Homo sapiens
tggctcccctctatttagcat

SEQ ID NO: 3731083 - DNA, 19 bp, Homo sapiens
tggctcctcccggtgccca

SEQ ID NO: 3731084 - DNA, 21 bp, Homo sapiens
tggctcctgaggggcatctgc

SEQ ID NO: 3731085 - DNA, 13 bp, Homo sapiens
tggctctgagaag

SEQ ID NO: 3731086 - DNA, 16 bp, Homo sapiens
tggctgacccagtccc

SEQ ID NO: 3731087 - DNA, 16 bp, Homo sapiens
tggctgacccccctca

SEQ ID NO: 3731088 - DNA, 16 bp, Homo sapiens
tggctgactttgctct

SEQ ID NO: 3731089 - DNA, 13 bp, Homo sapiens
tggctgataaaag

SEQ ID NO: 3731090 - DNA, 19 bp, Homo sapiens
tggctgataaaagatacat

SEQ ID NO: 3731091 - DNA, 13 bp, Homo sapiens
tggctgcagggag

SEQ ID NO: 3731092 - DNA, 21 bp, Homo sapiens
tggctgcccagacccctctgg

SEQ ID NO: 3731093 - DNA, 14 bp, Homo sapiens
tggctgctgactga

SEQ ID NO: 3731094 - DNA, 13 bp, Homo sapiens
tggctggctgcag

SEQ ID NO: 3731095 - DNA, 12 bp, Homo sapiens
tggctgggggcc

SEQ ID NO: 3731096 - DNA, 14 bp, Homo sapiens
tggctgggggcctc

SEQ ID NO: 3731097 - DNA, 16 bp, Homo sapiens
tggctgggggcctcag

SEQ ID NO: 3731098 - DNA, 20 bp, Homo sapiens
tggctgggggcctcagtgcc

SEQ ID NO: 3731099 - DNA, 14 bp, Homo sapiens
tggctggtcaactt

SEQ ID NO: 3731100 - DNA, 17 bp, Homo sapiens
tggctgtatcttgtttt

SEQ ID NO: 3731101 - DNA, 22 bp, Homo sapiens
tggctgtgcctctgcctgtctc

SEQ ID NO: 3731102 - DNA, 14 bp, Homo sapiens
tggctgtggcaggc

SEQ ID NO: 3731103 - DNA, 15 bp, Homo sapiens
tggctgtgggctccc

SEQ ID NO: 3731104 - DNA, 22 bp, Homo sapiens
tggcttcaaatattatgcaggg

SEQ ID NO: 3731105 - DNA, 16 bp, Homo sapiens
tggcttcccgctcagc

SEQ ID NO: 3731106 - DNA, 19 bp, Homo sapiens
tggcttcccgctcagccct

SEQ ID NO: 3731107 - DNA, 15 bp, Homo sapiens
tggcttctgatgaat

SEQ ID NO: 3731108 - DNA, 14 bp, Homo sapiens
tggcttctggagcc

SEQ ID NO: 3731109 - DNA, 17 bp, Homo sapiens
tggcttgtaactccacc

SEQ ID NO: 3731110 - DNA, 14 bp, Homo sapiens
tggctttggtctct

SEQ ID NO: 3731111 - DNA, 21 bp, Homo sapiens
tggctttggtctcttgcttgt

SEQ ID NO: 3731112 - DNA, 22 bp, Homo sapiens
tggctttgtcccacagcttggg

SEQ ID NO: 3731113 - DNA, 11 bp, Homo sapiens
tggctttgttt

SEQ ID NO: 3731114 - DNA, 21 bp, Homo sapiens
tggcttttcatgcgtgtgtgt

SEQ ID NO: 3731115 - DNA, 20 bp, Homo sapiens
tgggaaagggattttcagcc

SEQ ID NO: 3731116 - DNA, 22 bp, Homo sapiens
tgggaaccccttcatcctctga

SEQ ID NO: 3731117 - DNA, 16 bp, Homo sapiens
tgggaaccttcctgtc

SEQ ID NO: 3731118 - DNA, 24 bp, Homo sapiens
tgggaacgcagatgatccatgagt

SEQ ID NO: 3731119 - DNA, 18 bp, Homo sapiens
tgggaacgtgactgcccc

SEQ ID NO: 3731120 - DNA, 23 bp, Homo sapiens
tgtttaagatttaatttgccaaa

SEQ ID NO: 3731121 - DNA, 20 bp, Homo sapiens
tgtttaatattgagaaagaa

SEQ ID NO: 3731122 - DNA, 18 bp, Homo sapiens
tgtttacactctttgtaa

SEQ ID NO: 3731123 - DNA, 14 bp, Homo sapiens
tgtttatgagccag

SEQ ID NO: 3731124 - DNA, 14 bp, Homo sapiens
tgtttatggcctca

SEQ ID NO: 3731125 - DNA, 13 bp, Homo sapiens
tgtttattaacaa

SEQ ID NO: 3731126 - DNA, 16 bp, Homo sapiens
tgtttattaacaaatt

SEQ ID NO: 3731127 - DNA, 14 bp, Homo sapiens
tgtttatttacaag

SEQ ID NO: 3731128 - DNA, 22 bp, Homo sapiens
tgtttatttttatatagcttga

SEQ ID NO: 3731129 - DNA, 23 bp, Homo sapiens
tgtttatttttatatagcttgaa

SEQ ID NO: 3731130 - DNA, 12 bp, Homo sapiens
tgtttccttcag

SEQ ID NO: 3731131 - DNA, 15 bp, Homo sapiens
tgtttcgtgaagtat

SEQ ID NO: 3731132 - DNA, 19 bp, Homo sapiens
tgtttcgtgaagtatactg

SEQ ID NO: 3731133 - DNA, 20 bp, Homo sapiens
tgtttctagagcctgctgga

SEQ ID NO: 3731134 - DNA, 23 bp, Homo sapiens
tgtttctagttgaggagtttcct

SEQ ID NO: 3731135 - DNA, 18 bp, Homo sapiens
tgtttgcaatatcgatca

SEQ ID NO: 3731136 - DNA, 16 bp, Homo sapiens
tgtttgcctctgcctc

SEQ ID NO: 3731137 - DNA, 17 bp, Homo sapiens
tgtttgctcagaacaca

SEQ ID NO: 3731138 - DNA, 20 bp, Homo sapiens
tgtttgctcagcttctccaa

SEQ ID NO: 3731139 - DNA, 20 bp, Homo sapiens
tgtttgcttattgttccaag

SEQ ID NO: 3731140 - DNA, 21 bp, Homo sapiens
tgtttgcttattgttccaaga

SEQ ID NO: 3731141 - DNA, 11 bp, Homo sapiens
tgtttggctgg

SEQ ID NO: 3731142 - DNA, 15 bp, Homo sapiens
tgtttggggatgaga

SEQ ID NO: 3731143 - DNA, 15 bp, Homo sapiens
tgtttgggtatcctg

SEQ ID NO: 3731144 - DNA, 14 bp, Homo sapiens
tgtttgtgtgagag

SEQ ID NO: 3731145 - DNA, 18 bp, Homo sapiens
tgttttaaggaagaaaaa

SEQ ID NO: 3731146 - DNA, 22 bp, Homo sapiens
tgttttcaaaccagtatacaag

SEQ ID NO: 3731147 - DNA, 15 bp, Homo sapiens
tgttttcagtgtaca

SEQ ID NO: 3731148 - DNA, 17 bp, Homo sapiens
tgttttcagtgtacatg

SEQ ID NO: 3731149 - DNA, 15 bp, Homo sapiens
tgttttcataataaa

SEQ ID NO: 3731150 - DNA, 20 bp, Homo sapiens
tgtttttaagctgtttccat

SEQ ID NO: 3731151 - DNA, 20 bp, Homo sapiens
tgtttttatgaagaaaaaat

SEQ ID NO: 3731152 - DNA, 20 bp, Homo sapiens
tgtttttccttgtatttaaa

SEQ ID NO: 3731153 - DNA, 13 bp, Homo sapiens
tgtttttgaaata

SEQ ID NO: 3731154 - DNA, 13 bp, Homo sapiens
tgtttttgtctta

SEQ ID NO: 3731155 - DNA, 20 bp, Homo sapiens
tgttttttaaactaggaaaa

SEQ ID NO: 3731156 - DNA, 23 bp, Homo sapiens
tgttttttatcttttctacagca

SEQ ID NO: 3731157 - DNA, 14 bp, Homo sapiens
tgttttttgaaaac

SEQ ID NO: 3731158 - DNA, 19 bp, Homo sapiens
ttaaaaaaaataataaatt

SEQ ID NO: 3731159 - DNA, 13 bp, Homo sapiens
ttaaaaaaaatcc

SEQ ID NO: 3731160 - DNA, 19 bp, Homo sapiens
ttaaaaaaaatccttctaa

SEQ ID NO: 3731161 - DNA, 13 bp, Homo sapiens
ttaaaaaatgtcc

SEQ ID NO: 3731162 - DNA, 16 bp, Homo sapiens
ttaaaaaatttttgaa

SEQ ID NO: 3731163 - DNA, 17 bp, Homo sapiens
ttaaaaaatttttgaaa

SEQ ID NO: 3731164 - DNA, 21 bp, Homo sapiens
ttaaaaagtctgcattacatt

SEQ ID NO: 3731165 - DNA, 22 bp, Homo sapiens
ttaaaaagtctgcattacattc

SEQ ID NO: 3731166 - DNA, 20 bp, Homo sapiens
ttaaaaagttataaccaact

SEQ ID NO: 3731167 - DNA, 20 bp, Homo sapiens
ttaaaaataatagagcccca

SEQ ID NO: 3731168 - DNA, 13 bp, Homo sapiens
ttaaaaatggtaa

SEQ ID NO: 3731169 - DNA, 22 bp, Homo sapiens
ttaaaaatggtaaaattgcatg

SEQ ID NO: 3731170 - DNA, 12 bp, Homo sapiens
ttaaaacaaaca

SEQ ID NO: 3731171 - DNA, 19 bp, Homo sapiens
ttaaaacaagaaagtttcc

SEQ ID NO: 3731172 - DNA, 12 bp, Homo sapiens
ttaaaacaatgt

SEQ ID NO: 3731173 - DNA, 20 bp, Homo sapiens
ttaaaagaaagcctcagaga

SEQ ID NO: 3731174 - DNA, 14 bp, Homo sapiens
ttaaaagacactgt

SEQ ID NO: 3731175 - DNA, 12 bp, Homo sapiens
ttaaaatatatt

SEQ ID NO: 3731176 - DNA, 16 bp, Homo sapiens
ttaaaatattcctgca

SEQ ID NO: 3731177 - DNA, 12 bp, Homo sapiens
ttaaaatcacta

SEQ ID NO: 3731178 - DNA, 17 bp, Homo sapiens
ttaaaatcactaacatt

SEQ ID NO: 3731179 - DNA, 19 bp, Homo sapiens
ttaaaatcactaacattat

SEQ ID NO: 3731180 - DNA, 14 bp, Homo sapiens
ttaaaatcttaaac

SEQ ID NO: 3731181 - DNA, 12 bp, Homo sapiens
ttaaaatttatt

SEQ ID NO: 3731182 - DNA, 22 bp, Homo sapiens
ttaaacaaatgtatgattacat

SEQ ID NO: 3731183 - DNA, 18 bp, Homo sapiens
ttaaacagtgagcctgaa

SEQ ID NO: 3731184 - DNA, 20 bp, Homo sapiens
ttaaaccctggatcagtcct

SEQ ID NO: 3731185 - DNA, 17 bp, Homo sapiens
ttaaaccgccaaggctg

SEQ ID NO: 3731186 - DNA, 21 bp, Homo sapiens
ttaaactgtgtggactgtgat

SEQ ID NO: 3731187 - DNA, 23 bp, Homo sapiens
ttaaagaaaataaaattaagaat

SEQ ID NO: 3731188 - DNA, 17 bp, Homo sapiens
ttaaagaatcattattt

SEQ ID NO: 3731189 - DNA, 14 bp, Homo sapiens
ttaaagcagtcact

SEQ ID NO: 3731190 - DNA, 15 bp, Homo sapiens
ttaaagcatttactt

SEQ ID NO: 3731191 - DNA, 19 bp, Homo sapiens
ttaaagctaaagtatctgt

SEQ ID NO: 3731192 - DNA, 16 bp, Homo sapiens
ttaaagtatatattta

SEQ ID NO: 3731193 - DNA, 18 bp, Homo sapiens
ttaaagtgtattataaca

SEQ ID NO: 3731194 - DNA, 13 bp, Homo sapiens
ttaaagttctgtg

SEQ ID NO: 3731195 - DNA, 20 bp, Homo sapiens
ttaaataaaagtgatcaata

SEQ ID NO: 3731196 - DNA, 20 bp, Homo sapiens
ttaaataaataaataagaat

SEQ ID NO: 3731197 - DNA, 15 bp, Homo sapiens
ttaaataaatcataa

SEQ ID NO: 3731198 - DNA, 12 bp, Homo sapiens
ttaaataaatgt

SEQ ID NO: 3731199 - DNA, 18 bp, Homo sapiens
ttaaataaatgtcattaa

SEQ ID NO: 3731200 - DNA, 13 bp, Homo sapiens
ttaaatatagaat

SEQ ID NO: 3731201 - DNA, 18 bp, Homo sapiens
ttaaatatatgtatgtaa

SEQ ID NO: 3731202 - DNA, 22 bp, Homo sapiens
ttaaatatatgtatgtaaaaat

SEQ ID NO: 3731203 - DNA, 12 bp, Homo sapiens
ttaaatatcaat

SEQ ID NO: 3731204 - DNA, 17 bp, Homo sapiens
ttaaatatcaatcattt

SEQ ID NO: 3731205 - DNA, 18 bp, Homo sapiens
ttaaatatcaatcatttt

SEQ ID NO: 3731206 - DNA, 14 bp, Homo sapiens
ttaaatcctgttga

SEQ ID NO: 3731207 - DNA, 16 bp, Homo sapiens
ttaaatgtaaataatc

SEQ ID NO: 3731208 - DNA, 12 bp, Homo sapiens
ttaaattaaaca

SEQ ID NO: 3731209 - DNA, 19 bp, Homo sapiens
ttttcaaattgtatctagt

SEQ ID NO: 3731210 - DNA, 14 bp, Homo sapiens
ttttcaagaaactg

SEQ ID NO: 3731211 - DNA, 13 bp, Homo sapiens
ttttcaagattga

SEQ ID NO: 3731212 - DNA, 22 bp, Homo sapiens
ttttcaagcatctcctgaggat

SEQ ID NO: 3731213 - DNA, 17 bp, Homo sapiens
ttttcaattcaaaaatg

SEQ ID NO: 3731214 - DNA, 18 bp, Homo sapiens
ttttcaattttgcatgct

SEQ ID NO: 3731215 - DNA, 20 bp, Homo sapiens
ttttcaccccacccttcccc

SEQ ID NO: 3731216 - DNA, 15 bp, Homo sapiens
ttttcagaaatatgt

SEQ ID NO: 3731217 - DNA, 22 bp, Homo sapiens
ttttcagaacctcttccccaga

SEQ ID NO: 3731218 - DNA, 23 bp, Homo sapiens
ttttcagaatctgaatgtaattt

SEQ ID NO: 3731219 - DNA, 18 bp, Homo sapiens
ttttcatacttttacctt

SEQ ID NO: 3731220 - DNA, 20 bp, Homo sapiens
ttttcattccatgtgcccag

SEQ ID NO: 3731221 - DNA, 17 bp, Homo sapiens
ttttcattgatatgaaa

SEQ ID NO: 3731222 - DNA, 13 bp, Homo sapiens
ttttcccaataaa

SEQ ID NO: 3731223 - DNA, 14 bp, Homo sapiens
ttttcccaataaat

SEQ ID NO: 3731224 - DNA, 14 bp, Homo sapiens
ttttcctaaatgca

SEQ ID NO: 3731225 - DNA, 12 bp, Homo sapiens
ttttcgtttgtt

SEQ ID NO: 3731226 - DNA, 13 bp, Homo sapiens
ttttctcctccca

SEQ ID NO: 3731227 - DNA, 11 bp, Homo sapiens
ttttctcctga

SEQ ID NO: 3731228 - DNA, 22 bp, Homo sapiens
ttttctctttctccttagtctt

SEQ ID NO: 3731229 - DNA, 13 bp, Homo sapiens
ttttctgaaacta

SEQ ID NO: 3731230 - DNA, 18 bp, Homo sapiens
ttttctggaatgtaatca

SEQ ID NO: 3731231 - DNA, 16 bp, Homo sapiens
ttttctggtagataga

SEQ ID NO: 3731232 - DNA, 21 bp, Homo sapiens
ttttcttcaacatcaatgttc

SEQ ID NO: 3731233 - DNA, 16 bp, Homo sapiens
ttttcttcatgcaatg

SEQ ID NO: 3731234 - DNA, 19 bp, Homo sapiens
ttttcttgtttatcagcag

SEQ ID NO: 3731235 - DNA, 14 bp, Homo sapiens
ttttctttgaaatt

SEQ ID NO: 3731236 - DNA, 12 bp, Homo sapiens
ttttctttgtgt

SEQ ID NO: 3731237 - DNA, 22 bp, Homo sapiens
ttttgaaatattaaaccctgga

SEQ ID NO: 3731238 - DNA, 20 bp, Homo sapiens
ttttgaactaataaaagcat

SEQ ID NO: 3731239 - DNA, 19 bp, Homo sapiens
ttttgacagtgttgaaaat

SEQ ID NO: 3731240 - DNA, 24 bp, Homo sapiens
ttttgacagtgttgaaaatgttca

SEQ ID NO: 3731241 - DNA, 22 bp, Homo sapiens
ttttgactagggattcaggctg

SEQ ID NO: 3731242 - DNA, 18 bp, Homo sapiens
ttttgagtggatgatgtt

SEQ ID NO: 3731243 - DNA, 15 bp, Homo sapiens
ttttgatgtttgtgg

SEQ ID NO: 3731244 - DNA, 20 bp, Homo sapiens
ttttgatgtttgtggcctca

SEQ ID NO: 3731245 - DNA, 21 bp, Homo sapiens
ttttgatttgtactgaaaaat

SEQ ID NO: 3731246 - DNA, 22 bp, Homo sapiens
ttttgcagtagagtcatctcca

SEQ ID NO: 3731247 - DNA, 23 bp, Homo sapiens
ttttgcctaatacattaaagcag

SEQ ID NO: 3731248 - DNA, 22 bp, Homo sapiens
ttttggaatctagaagaaatga

SEQ ID NO: 3731249 - DNA, 19 bp, Homo sapiens
ttttggattgacagtaact

SEQ ID NO: 3731250 - DNA, 19 bp, Homo sapiens
ttttggcactgagatattt

SEQ ID NO: 3731251 - DNA, 16 bp, Homo sapiens
ttttggccaaagtgtt

SEQ ID NO: 3731252 - DNA, 14 bp, Homo sapiens
ttttggtggatgta

SEQ ID NO: 3731253 - DNA, 18 bp, Homo sapiens
ttttgtaaactcaaaata

SEQ ID NO: 3731254 - DNA, 15 bp, Homo sapiens
ttttgtaaagatgcc

SEQ ID NO: 3731255 - DNA, 21 bp, Homo sapiens
ttttgtaaagatgccgggttt

SEQ ID NO: 3731256 - DNA, 14 bp, Homo sapiens
ttttgtaggtactt

SEQ ID NO: 3731257 - DNA, 16 bp, Homo sapiens
ttttgtaggtactttt

SEQ ID NO: 3731258 - DNA, 16 bp, Homo sapiens
ttttgtcatataagat

SEQ ID NO: 3731259 - DNA, 21 bp, Homo sapiens
ttttgtggtcattaagcattg

SEQ ID NO: 3731260 - DNA, 13 bp, Homo sapiens
ttttgtgtacagt

SEQ ID NO: 3731261 - DNA, 15 bp, Homo sapiens
ttttgttgtgtatat

SEQ ID NO: 3731262 - DNA, 16 bp, Homo sapiens
ttttgtttttgtctta

SEQ ID NO: 3731263 - DNA, 16 bp, Homo sapiens
tttttaaataaaagca

SEQ ID NO: 3731264 - DNA, 14 bp, Homo sapiens
tttttaagtctttt

SEQ ID NO: 3731265 - DNA, 17 bp, Homo sapiens
tttttaatttgatgaaa

SEQ ID NO: 3731266 - DNA, 20 bp, Homo sapiens
tttttaatttgatgaaagct

SEQ ID NO: 3731267 - DNA, 22 bp, Homo sapiens
tttttaatttgatgaaagctga

SEQ ID NO: 3731268 - DNA, 16 bp, Homo sapiens
tttttactacagttgt

SEQ ID NO: 3731269 - DNA, 14 bp, Homo sapiens
tttttagaacagaa

SEQ ID NO: 3731270 - DNA, 17 bp, Homo sapiens
tttttagaacagaaaac

SEQ ID NO: 3731271 - DNA, 20 bp, Homo sapiens
tttttagatggttacactgt

SEQ ID NO: 3731272 - DNA, 17 bp, Homo sapiens
tttttatacaggggaat

SEQ ID NO: 3731273 - DNA, 23 bp, Homo sapiens
tttttatctccccttcacatgca

SEQ ID NO: 3731274 - DNA, 14 bp, Homo sapiens
tttttattatgcat

SEQ ID NO: 3731275 - DNA, 18 bp, Homo sapiens
tttttccctatcactgaa

SEQ ID NO: 3731276 - DNA, 18 bp, Homo sapiens
tttttcctagccctctca

SEQ ID NO: 3731277 - DNA, 16 bp, Homo sapiens
tttttcgtttgtttgt

SEQ ID NO: 3731278 - DNA, 11 bp, Homo sapiens
tttttctctaa

SEQ ID NO: 3731279 - DNA, 13 bp, Homo sapiens
tttttctttataa

SEQ ID NO: 3731280 - DNA, 13 bp, Homo sapiens
tttttgaaaacat

SEQ ID NO: 3731281 - DNA, 14 bp, Homo sapiens
tttttgaaataata

SEQ ID NO: 3731282 - DNA, 17 bp, Homo sapiens
tttttggattgacagta

SEQ ID NO: 3731283 - DNA, 19 bp, Homo sapiens
tttttggtggatgtaaata

SEQ ID NO: 3731284 - DNA, 14 bp, Homo sapiens
tttttgttaacttt

SEQ ID NO: 3731285 - DNA, 12 bp, Homo sapiens
ttttttaattga

SEQ ID NO: 3731286 - DNA, 12 bp, Homo sapiens
ttttttatcttt

SEQ ID NO: 3731287 - DNA, 14 bp, Homo sapiens
ttttttattcttgt

SEQ ID NO: 3731288 - DNA, 13 bp, Homo sapiens
ttttttccactta

SEQ ID NO: 3731289 - DNA, 17 bp, Homo sapiens
tttgcccaacctcagca

SEQ ID NO: 3731290 - DNA, 15 bp, Homo sapiens
tttgcccatttacac

SEQ ID NO: 3731291 - DNA, 13 bp, Homo sapiens
tttgcctctgcct

SEQ ID NO: 3731292 - DNA, 12 bp, Homo sapiens
tttgcctgtgcc

SEQ ID NO: 3731293 - DNA, 21 bp, Homo sapiens
tttgcgcacaacttaaaaagt

SEQ ID NO: 3731294 - DNA, 23 bp, Homo sapiens
tttgctattgacaagtcatttta

SEQ ID NO: 3731295 - DNA, 16 bp, Homo sapiens
tttgctcacctggggt

SEQ ID NO: 3731296 - DNA, 19 bp, Homo sapiens
tttgctcagaacacattct

SEQ ID NO: 3731297 - DNA, 12 bp, Homo sapiens
tttgctccaccc

SEQ ID NO: 3731298 - DNA, 19 bp, Homo sapiens
tttgctgagcatgtactga

SEQ ID NO: 3731299 - DNA, 16 bp, Homo sapiens
tttgcttattgttcca

SEQ ID NO: 3731300 - DNA, 16 bp, Homo sapiens
tttgcttgaacacagt

SEQ ID NO: 3731301 - DNA, 12 bp, Homo sapiens
tttggaaaataa

SEQ ID NO: 3731302 - DNA, 14 bp, Homo sapiens
tttggaagttttca

SEQ ID NO: 3731303 - DNA, 13 bp, Homo sapiens
tttggaatctaga

SEQ ID NO: 3731304 - DNA, 21 bp, Homo sapiens
tttggaatctagaagaaatga

SEQ ID NO: 3731305 - DNA, 23 bp, Homo sapiens
tttggaatctagaagaaatgaaa

SEQ ID NO: 3731306 - DNA, 11 bp, Homo sapiens
tttggaatgtg

SEQ ID NO: 3731307 - DNA, 16 bp, Homo sapiens
tttggacacacacagc

SEQ ID NO: 3731308 - DNA, 17 bp, Homo sapiens
tttggacgcacacagct

SEQ ID NO: 3731309 - DNA, 18 bp, Homo sapiens
tttggagcactctgagtt

SEQ ID NO: 3731310 - DNA, 20 bp, Homo sapiens
tttggcatctgtttaaagta

SEQ ID NO: 3731311 - DNA, 17 bp, Homo sapiens
tttggcctgcactaatt

SEQ ID NO: 3731312 - DNA, 14 bp, Homo sapiens
tttggcgggccaag

SEQ ID NO: 3731313 - DNA, 14 bp, Homo sapiens
tttgggatgtctta

SEQ ID NO: 3731314 - DNA, 20 bp, Homo sapiens
tttggggagcagagacacta

SEQ ID NO: 3731315 - DNA, 22 bp, Homo sapiens
tttggggtacccactgctctgg

SEQ ID NO: 3731316 - DNA, 20 bp, Homo sapiens
tttggggtagctagaggaac

SEQ ID NO: 3731317 - DNA, 21 bp, Homo sapiens
tttggggttgcatcagaaatg

SEQ ID NO: 3731318 - DNA, 11 bp, Homo sapiens
tttgggtttct

SEQ ID NO: 3731319 - DNA, 15 bp, Homo sapiens
tttggtgcctttcct

SEQ ID NO: 3731320 - DNA, 19 bp, Homo sapiens
tttggttaagttggcttct

SEQ ID NO: 3731321 - DNA, 22 bp, Homo sapiens
tttggttaagttggcttctgtt

SEQ ID NO: 3731322 - DNA, 16 bp, Homo sapiens
tttgtaaactcaaaat

SEQ ID NO: 3731323 - DNA, 22 bp, Homo sapiens
tttgtaaactcaaaatatttgt

SEQ ID NO: 3731324 - DNA, 21 bp, Homo sapiens
tttgtaaaggtgaaaaaagct

SEQ ID NO: 3731325 - DNA, 17 bp, Homo sapiens
tttgtaaataagagatt

SEQ ID NO: 3731326 - DNA, 21 bp, Homo sapiens
tttgtaatcgttatgtgtgta

SEQ ID NO: 3731327 - DNA, 19 bp, Homo sapiens
tttgtacagacgtatgctt

SEQ ID NO: 3731328 - DNA, 13 bp, Homo sapiens
tttgtagagccag

SEQ ID NO: 3731329 - DNA, 15 bp, Homo sapiens
tttgtagggtttcta

SEQ ID NO: 3731330 - DNA, 19 bp, Homo sapiens
tttgtatatatacataaca

SEQ ID NO: 3731331 - DNA, 23 bp, Homo sapiens
tttgtcacaatcctaacacatta

SEQ ID NO: 3731332 - DNA, 14 bp, Homo sapiens
tttgtcagacttta

SEQ ID NO: 3731333 - DNA, 20 bp, Homo sapiens
tttgtcattttgaagctaat

SEQ ID NO: 3731334 - DNA, 16 bp, Homo sapiens
tttgtcccacagcttg

SEQ ID NO: 3731335 - DNA, 22 bp, Homo sapiens
tttgtccttggggacatctcat

SEQ ID NO: 3731336 - DNA, 17 bp, Homo sapiens
tttgtctacgtttagtt

SEQ ID NO: 3731337 - DNA, 22 bp, Homo sapiens
tttgtgagaaacatctcaataa

SEQ ID NO: 3731338 - DNA, 20 bp, Homo sapiens
tttgtggcagaagtgtttca

SEQ ID NO: 3731339 - DNA, 22 bp, Homo sapiens
tttgtggcagaagtgtttcatg

SEQ ID NO: 3731340 - DNA, 12 bp, Homo sapiens
tttgtggctggg

SEQ ID NO: 3731341 - DNA, 22 bp, Homo sapiens
tttgtggtacgacctttagatt

SEQ ID NO: 3731342 - DNA, 22 bp, Homo sapiens
tttgtgtaataaagtgttttca

SEQ ID NO: 3731343 - DNA, 14 bp, Homo sapiens
tttgtgtacagtgt

SEQ ID NO: 3731344 - DNA, 12 bp, Homo sapiens
tttgtgtgagag

SEQ ID NO: 3731345 - DNA, 12 bp, Homo sapiens
tttgtgttctgt

SEQ ID NO: 3731346 - DNA, 21 bp, Homo sapiens
tttgtgttgttggaaaaagtc

SEQ ID NO: 3731347 - DNA, 13 bp, Homo sapiens
tttgttaccttta

SEQ ID NO: 3731348 - DNA, 13 bp, Homo sapiens
tttgttcttatga

SEQ ID NO: 3731349 - DNA, 15 bp, Homo sapiens
tttgttgtaaagagt

SEQ ID NO: 3731350 - DNA, 16 bp, Homo sapiens
tttgttgtcagctgaa

SEQ ID NO: 3731351 - DNA, 15 bp, Homo sapiens
tttgtttcctttgtt

SEQ ID NO: 3731352 - DNA, 15 bp, Homo sapiens
tttgtttgtttgggt

SEQ ID NO: 3731353 - DNA, 15 bp, Homo sapiens
tttgttttaaaatta

SEQ ID NO: 3731354 - DNA, 20 bp, Homo sapiens
tttgttttaaggaagaaaaa

SEQ ID NO: 3731355 - DNA, 14 bp, Homo sapiens
ttttaaaaagcaaa

SEQ ID NO: 3731356 - DNA, 22 bp, Homo sapiens
ttttaaaaatcataaactgtgt

SEQ ID NO: 3731357 - DNA, 23 bp, Homo sapiens
ttttaaaaatcataaactgtgtg

SEQ ID NO: 3731358 - DNA, 22 bp, Homo sapiens
ttttaaaacaagaaagtttccc

SEQ ID NO: 3731359 - DNA, 13 bp, Homo sapiens
ttttaaacagtga

SEQ ID NO: 3731360 - DNA, 17 bp, Homo sapiens
ttttaaagaatgctctt

SEQ ID NO: 3731361 - DNA, 19 bp, Homo sapiens
ttttaaatgcataaatgca

SEQ ID NO: 3731362 - DNA, 17 bp, Homo sapiens
ttttaaattttcttcag

SEQ ID NO: 3731363 - DNA, 18 bp, Homo sapiens
ttttaaattttcttcagt

SEQ ID NO: 3731364 - DNA, 20 bp, Homo sapiens
ttttaaattttcttcagttg

SEQ ID NO: 3731365 - DNA, 22 bp, Homo sapiens
ttttaacaataactactgtgtt

SEQ ID NO: 3731366 - DNA, 16 bp, Homo sapiens
ttttaactagaattta

SEQ ID NO: 3731367 - DNA, 12 bp, Homo sapiens
ttttaactcacc

SEQ ID NO: 3731368 - DNA, 18 bp, Homo sapiens
ttttaagattccttttct

SEQ ID NO: 3731369 - DNA, 23 bp, Homo sapiens
ttttaagcattactcttgtaaga

SEQ ID NO: 3731370 - DNA, 20 bp, Homo sapiens
ttttaagggtttgtggaaaa

SEQ ID NO: 3731371 - DNA, 12 bp, Homo sapiens
ttttaatacagg

SEQ ID NO: 3731372 - DNA, 21 bp, Homo sapiens
ttttaatagaatataattatc

SEQ ID NO: 3731373 - DNA, 13 bp, Homo sapiens
ttttaattaaata

SEQ ID NO: 3731374 - DNA, 13 bp, Homo sapiens
ttttaattattgt

SEQ ID NO: 3731375 - DNA, 22 bp, Homo sapiens
ttttaatttatttattaagatg

SEQ ID NO: 3731376 - DNA, 21 bp, Homo sapiens
ttttaatttgatgaaagctga

SEQ ID NO: 3731377 - DNA, 13 bp, Homo sapiens
ttttaattttgta

SEQ ID NO: 3731378 - DNA, 22 bp, Homo sapiens
ttttaattttgtaaaggtgaaa

SEQ ID NO: 3731379 - DNA, 16 bp, Homo sapiens
ttttacagctgcctgc

SEQ ID NO: 3731380 - DNA, 20 bp, Homo sapiens
ttttacctaccacagtgtct

SEQ ID NO: 3731381 - DNA, 14 bp, Homo sapiens
ttttactactgtgg

SEQ ID NO: 3731382 - DNA, 23 bp, Homo sapiens
ttttactgcttttaacttctgat

SEQ ID NO: 3731383 - DNA, 18 bp, Homo sapiens
ttttactgtcttaattaa

SEQ ID NO: 3731384 - DNA, 22 bp, Homo sapiens
ttttactgtcttaattaagtaa

SEQ ID NO: 3731385 - DNA, 12 bp, Homo sapiens
ttttactgtttt

SEQ ID NO: 3731386 - DNA, 15 bp, Homo sapiens
ttttagtagagacag

SEQ ID NO: 3731387 - DNA, 13 bp, Homo sapiens
ttttagttttagt

SEQ ID NO: 3731388 - DNA, 20 bp, Homo sapiens
ttttataaaaaaaatgaaat

SEQ ID NO: 3731389 - DNA, 21 bp, Homo sapiens
ttttataaaattaaagaaaat

SEQ ID NO: 3731390 - DNA, 13 bp, Homo sapiens
ttttataaattaa

SEQ ID NO: 3731391 - DNA, 12 bp, Homo sapiens
ttttatactgta

SEQ ID NO: 3731392 - DNA, 17 bp, Homo sapiens
ttttatataataaagta

SEQ ID NO: 3731393 - DNA, 19 bp, Homo sapiens
ttttatatagcttgaaaca

SEQ ID NO: 3731394 - DNA, 16 bp, Homo sapiens
ttttatccaatcttgt

SEQ ID NO: 3731395 - DNA, 23 bp, Homo sapiens
ttttatctccccttcacatgcat

SEQ ID NO: 3731396 - DNA, 17 bp, Homo sapiens
ttttatcttttctacag

SEQ ID NO: 3731397 - DNA, 18 bp, Homo sapiens
ttttatgagctcatgtag

SEQ ID NO: 3731398 - DNA, 12 bp, Homo sapiens
ttttattatgca

SEQ ID NO: 3731399 - DNA, 13 bp, Homo sapiens
ttttattatgcat

SEQ ID NO: 3731400 - DNA, 13 bp, Homo sapiens
ttttattcttgtg

SEQ ID NO: 3731401 - DNA, 18 bp, Homo sapiens
ttttattcttgtgaatat

SEQ ID NO: 3731402 - DNA, 11 bp, Homo sapiens
ttttattttat

SEQ ID NO: 3731403 - DNA, 14 bp, Homo sapiens
ttttcaaattgtat

SEQ ID NO: 3731404 - DNA, 23 bp, Homo sapiens
aatgtttcttctaggttctaaaa

SEQ ID NO: 3731405 - DNA, 18 bp, Homo sapiens
aatgtttgcctctgcctc

SEQ ID NO: 3731406 - DNA, 18 bp, Homo sapiens
aattaaagaaaataaaat

SEQ ID NO: 3731407 - DNA, 17 bp, Homo sapiens
aattaaataaaataacc

SEQ ID NO: 3731408 - DNA, 16 bp, Homo sapiens
aattaacatataatat

SEQ ID NO: 3731409 - DNA, 19 bp, Homo sapiens
aattaacatataatatatg

SEQ ID NO: 3731410 - DNA, 16 bp, Homo sapiens
aattaagaatgttctc

SEQ ID NO: 3731411 - DNA, 16 bp, Homo sapiens
aattaaggcataagaa

SEQ ID NO: 3731412 - DNA, 22 bp, Homo sapiens
aattaagttagggaatggcaca

SEQ ID NO: 3731413 - DNA, 21 bp, Homo sapiens
aattaccacaccatctcccat

SEQ ID NO: 3731414 - DNA, 20 bp, Homo sapiens
aattaccagtaaagtgtaac

SEQ ID NO: 3731415 - DNA, 12 bp, Homo sapiens
aattagagcaga

SEQ ID NO: 3731416 - DNA, 16 bp, Homo sapiens
aattagctgtgtgaaa

SEQ ID NO: 3731417 - DNA, 17 bp, Homo sapiens
aattaggaagtgattat

SEQ ID NO: 3731418 - DNA, 22 bp, Homo sapiens
aattaggaagtgtaacagctga

SEQ ID NO: 3731419 - DNA, 14 bp, Homo sapiens
aattaggttaacta

SEQ ID NO: 3731420 - DNA, 22 bp, Homo sapiens
aatttttctctaactcagaaac

SEQ ID NO: 3731421 - DNA, 21 bp, Homo sapiens
aattttttattcttgtgaata

SEQ ID NO: 3731422 - DNA, 19 bp, Homo sapiens
aatttttttcaatatttat

SEQ ID NO: 3731423 - DNA, 19 bp, Homo sapiens
acaaaaaaagttgaaggcc

SEQ ID NO: 3731424 - DNA, 15 bp, Homo sapiens
acaaaaagcttcccc

SEQ ID NO: 3731425 - DNA, 14 bp, Homo sapiens
acaaaacttttcta

SEQ ID NO: 3731426 - DNA, 10 bp, Homo sapiens
acaaaataaa

SEQ ID NO: 3731427 - DNA, 17 bp, Homo sapiens
acaaaatcacttccata

SEQ ID NO: 3731428 - DNA, 22 bp, Homo sapiens
acaaaatggaattcattctggt

SEQ ID NO: 3731429 - DNA, 22 bp, Homo sapiens
acaaaatgtagggttataataa

SEQ ID NO: 3731430 - DNA, 15 bp, Homo sapiens
acaaacgggctcagc

SEQ ID NO: 3731431 - DNA, 11 bp, Homo sapiens
acaaactgcaa

SEQ ID NO: 3731432 - DNA, 13 bp, Homo sapiens
acaaactgcaata

SEQ ID NO: 3731433 - DNA, 19 bp, Homo sapiens
acaaagccaaactctgcca

SEQ ID NO: 3731434 - DNA, 20 bp, Homo sapiens
acaaagccagaagctgagca

SEQ ID NO: 3731435 - DNA, 23 bp, Homo sapiens
acaaagctgctaaatctcctatt

SEQ ID NO: 3731436 - DNA, 18 bp, Homo sapiens
acaaaggaatggaggctc

SEQ ID NO: 3731437 - DNA, 18 bp, Homo sapiens
acaaaggcttattaattt

SEQ ID NO: 3731438 - DNA, 15 bp, Homo sapiens
acaaagtctccagcc

SEQ ID NO: 3731439 - DNA, 16 bp, Homo sapiens
acaaagtggaaggaaa

SEQ ID NO: 3731440 - DNA, 18 bp, Homo sapiens
acaaagtggaaggaaaga

SEQ ID NO: 3731441 - DNA, 19 bp, Homo sapiens
acaaagtggaaggaaagat

SEQ ID NO: 3731442 - DNA, 17 bp, Homo sapiens
acaaatactcttaggaa

SEQ ID NO: 3731443 - DNA, 19 bp, Homo sapiens
acaaatatgcaaaaggttc

SEQ ID NO: 3731444 - DNA, 22 bp, Homo sapiens
acaaatatttattttctttctg

SEQ ID NO: 3731445 - DNA, 12 bp, Homo sapiens
acaaatcaagtt

SEQ ID NO: 3731446 - DNA, 22 bp, Homo sapiens
acaaatgtgtatcggatgcttt

SEQ ID NO: 3731447 - DNA, 15 bp, Homo sapiens
acaaattatcttaaa

SEQ ID NO: 3731448 - DNA, 22 bp, Homo sapiens
acaaattatgttacatctgttt

SEQ ID NO: 3731449 - DNA, 15 bp, Homo sapiens
acaaattctgtttct

SEQ ID NO: 3731450 - DNA, 14 bp, Homo sapiens
acaaatttaaaaca

SEQ ID NO: 3731451 - DNA, 16 bp, Homo sapiens
acaaatttaaaacaaa

SEQ ID NO: 3731452 - DNA, 13 bp, Homo sapiens
acaacaaaaattt

SEQ ID NO: 3731453 - DNA, 14 bp, Homo sapiens
acaacacacacact

SEQ ID NO: 3731454 - DNA, 12 bp, Homo sapiens
acaacactcaca

SEQ ID NO: 3731455 - DNA, 13 bp, Homo sapiens
acaacagaagtca

SEQ ID NO: 3731456 - DNA, 14 bp, Homo sapiens
acaacagctgcctg

SEQ ID NO: 3731457 - DNA, 14 bp, Homo sapiens
acaacatgtataat

SEQ ID NO: 3731458 - DNA, 22 bp, Homo sapiens
acaacatgtataatatttttaa

SEQ ID NO: 3731459 - DNA, 19 bp, Homo sapiens
acaaccaccgctccccagc

SEQ ID NO: 3731460 - DNA, 23 bp, Homo sapiens
acaaccccccatcacaaacttaa

SEQ ID NO: 3731461 - DNA, 14 bp, Homo sapiens
acaaccctgcaaag

SEQ ID NO: 3731462 - DNA, 22 bp, Homo sapiens
acaaccgatgctccagccaacc

SEQ ID NO: 3731463 - DNA, 13 bp, Homo sapiens
acaaccgttggaa

SEQ ID NO: 3731464 - DNA, 15 bp, Homo sapiens
acaacgaggaagccc

SEQ ID NO: 3731465 - DNA, 16 bp, Homo sapiens
acaacttaaaaagtct

SEQ ID NO: 3731466 - DNA, 17 bp, Homo sapiens
acaacttcaagtgcatg

SEQ ID NO: 3731467 - DNA, 16 bp, Homo sapiens
acaagaaaaaatgaat

SEQ ID NO: 3731468 - DNA, 17 bp, Homo sapiens
acaagaaaggagagtct

SEQ ID NO: 3731469 - DNA, 21 bp, Homo sapiens
acaagaaaggagagtcttgca

SEQ ID NO: 3731470 - DNA, 17 bp, Homo sapiens
acaagaaagtttcccca

SEQ ID NO: 3731471 - DNA, 19 bp, Homo sapiens
acaagagcagcctgtggca

SEQ ID NO: 3731472 - DNA, 12 bp, Homo sapiens
acaagagtgatt

SEQ ID NO: 3731473 - DNA, 14 bp, Homo sapiens
acaagatctttcag

SEQ ID NO: 3731474 - DNA, 16 bp, Homo sapiens
acaagatctttcagga

SEQ ID NO: 3731475 - DNA, 20 bp, Homo sapiens
acaagatctttcaggaaaga

SEQ ID NO: 3731476 - DNA, 16 bp, Homo sapiens
acaagattcccagaga

SEQ ID NO: 3731477 - DNA, 17 bp, Homo sapiens
acaagattcccagagac

SEQ ID NO: 3731478 - DNA, 18 bp, Homo sapiens
acaagattcccagagaca

SEQ ID NO: 3731479 - DNA, 12 bp, Homo sapiens
acaagccacccc

SEQ ID NO: 3731480 - DNA, 20 bp, Homo sapiens
acaagcgtgagccactgcac

SEQ ID NO: 3731481 - DNA, 21 bp, Homo sapiens
acaagctgcaccctcaggcag

SEQ ID NO: 3731482 - DNA, 11 bp, Homo sapiens
acaagctgcct

SEQ ID NO: 3731483 - DNA, 17 bp, Homo sapiens
acaaggcattcaagtgt

SEQ ID NO: 3731484 - DNA, 13 bp, Homo sapiens
acaaggccccaga

SEQ ID NO: 3731485 - DNA, 15 bp, Homo sapiens
acaaggccccagaga

SEQ ID NO: 3731486 - DNA, 18 bp, Homo sapiens
acaaggccccagagactc

SEQ ID NO: 3731487 - DNA, 18 bp, Homo sapiens
acaaggctgaccaagaga

SEQ ID NO: 3731488 - DNA, 19 bp, Homo sapiens
acaagggtctagggagaga

SEQ ID NO: 3731489 - DNA, 14 bp, Homo sapiens
acaaggtgggcagg

SEQ ID NO: 3731490 - DNA, 22 bp, Homo sapiens
acaaggttcttcccttttacat

SEQ ID NO: 3731491 - DNA, 23 bp, Homo sapiens
acaagtatgaataaagacaccta

SEQ ID NO: 3731492 - DNA, 19 bp, Homo sapiens
acaagtgactgtatctgtg

SEQ ID NO: 3731493 - DNA, 22 bp, Homo sapiens
acaagtgactgtatctgtgtag

SEQ ID NO: 3731494 - DNA, 17 bp, Homo sapiens
acaagttgcgacggaga

SEQ ID NO: 3731495 - DNA, 12 bp, Homo sapiens
acaagtttcaga

SEQ ID NO: 3731496 - DNA, 16 bp, Homo sapiens
acaagtttcagacagg

SEQ ID NO: 3731497 - DNA, 17 bp, Homo sapiens
acaagtttcagacaggg

SEQ ID NO: 3731498 - DNA, 10 bp, Homo sapiens
acaataaact

SEQ ID NO: 3731499 - DNA, 12 bp, Homo sapiens
acaataaatgta

SEQ ID NO: 3731500 - DNA, 13 bp, Homo sapiens
acaataaatgtat

SEQ ID NO: 3731501 - DNA, 19 bp, Homo sapiens
acaatagctttaccctcag

SEQ ID NO: 3731502 - DNA, 16 bp, Homo sapiens
acaatatttaaaattt

SEQ ID NO: 3731503 - DNA, 19 bp, Homo sapiens
acaatatttattgtatttt

SEQ ID NO: 3731504 - DNA, 14 bp, Homo sapiens
acaatattttaagc

SEQ ID NO: 3731505 - DNA, 15 bp, Homo sapiens
acaatattttaagca

SEQ ID NO: 3731506 - DNA, 16 bp, Homo sapiens
acaatattttaagcat

SEQ ID NO: 3731507 - DNA, 18 bp, Homo sapiens
acaatattttaagcatta

SEQ ID NO: 3731508 - DNA, 23 bp, Homo sapiens
acaatattttaagcattactctt

SEQ ID NO: 3731509 - DNA, 14 bp, Homo sapiens
acaatcaaaggaaa

SEQ ID NO: 3731510 - DNA, 19 bp, Homo sapiens
acaattcctagataaaaag

SEQ ID NO: 3731511 - DNA, 20 bp, Homo sapiens
acaattgtaaaactgaggca

SEQ ID NO: 3731512 - DNA, 19 bp, Homo sapiens
acacagaggctgcctctcc

SEQ ID NO: 3731513 - DNA, 21 bp, Homo sapiens
acacagagtggtctttctgga

SEQ ID NO: 3731514 - DNA, 23 bp, Homo sapiens
acacagagtggtctttctggaga

SEQ ID NO: 3731515 - DNA, 15 bp, Homo sapiens
acacagcatgtgtat

SEQ ID NO: 3731516 - DNA, 12 bp, Homo sapiens
acacagctctgt

SEQ ID NO: 3731517 - DNA, 11 bp, Homo sapiens
acacagctctt

SEQ ID NO: 3731518 - DNA, 16 bp, Homo sapiens
acacagctcttctcca

SEQ ID NO: 3731519 - DNA, 21 bp, Homo sapiens
acacagctcttctccaggctg

SEQ ID NO: 3731520 - DNA, 22 bp, Homo sapiens
acacagctcttctccaggctgt

SEQ ID NO: 3731521 - DNA, 14 bp, Homo sapiens
acacaggaggagaa

SEQ ID NO: 3731522 - DNA, 19 bp, Homo sapiens
acacaggcaactgaggcag

SEQ ID NO: 3731523 - DNA, 18 bp, Homo sapiens
acacaggcccggctccag

SEQ ID NO: 3731524 - DNA, 21 bp, Homo sapiens
acacaggcccggctccaggct

SEQ ID NO: 3731525 - DNA, 23 bp, Homo sapiens
acacaggcccggctccaggctcc

SEQ ID NO: 3731526 - DNA, 16 bp, Homo sapiens
acacagtattacttct

SEQ ID NO: 3731527 - DNA, 15 bp, Homo sapiens
acacagttgctgtca

SEQ ID NO: 3731528 - DNA, 12 bp, Homo sapiens
acacataaagga

SEQ ID NO: 3731529 - DNA, 13 bp, Homo sapiens
acacataaaggat

SEQ ID NO: 3731530 - DNA, 17 bp, Homo sapiens
acacatagcatgtaatg

SEQ ID NO: 3731531 - DNA, 14 bp, Homo sapiens
acacatataaacat

SEQ ID NO: 3731532 - DNA, 22 bp, Homo sapiens
acacatataaacatcacacaca

SEQ ID NO: 3731533 - DNA, 14 bp, Homo sapiens
acacatcttcccta

SEQ ID NO: 3731534 - DNA, 13 bp, Homo sapiens
acaccagagccca

SEQ ID NO: 3731535 - DNA, 18 bp, Homo sapiens
acaccagagcccaccttg

SEQ ID NO: 3731536 - DNA, 23 bp, Homo sapiens
acaccatgtttgagctcagaccc

SEQ ID NO: 3731537 - DNA, 13 bp, Homo sapiens
acacccagcccac

SEQ ID NO: 3731538 - DNA, 19 bp, Homo sapiens
acacccagcccacttctgc

SEQ ID NO: 3731539 - DNA, 22 bp, Homo sapiens
acaccctcgaagcgcgccactc

SEQ ID NO: 3731540 - DNA, 18 bp, Homo sapiens
acaccggccaagatgctt

SEQ ID NO: 3731541 - DNA, 16 bp, Homo sapiens
acaccgggcactcaga

SEQ ID NO: 3731542 - DNA, 16 bp, Homo sapiens
acaccgggcctggaga

SEQ ID NO: 3731543 - DNA, 15 bp, Homo sapiens
acacctagcatctca

SEQ ID NO: 3731544 - DNA, 10 bp, Homo sapiens
acacctcaga

SEQ ID NO: 3731545 - DNA, 12 bp, Homo sapiens
acacctgcacct

SEQ ID NO: 3731546 - DNA, 19 bp, Homo sapiens
acacctgcacctcccccca

SEQ ID NO: 3731547 - DNA, 12 bp, Homo sapiens
acacctggccct

SEQ ID NO: 3731548 - DNA, 14 bp, Homo sapiens
acacctggccctgg

SEQ ID NO: 3731549 - DNA, 15 bp, Homo sapiens
acacctggccctggg

SEQ ID NO: 3731550 - DNA, 18 bp, Homo sapiens
acacctggccctggggcc

SEQ ID NO: 3731551 - DNA, 20 bp, Homo sapiens
acacctggccctggggcctg

SEQ ID NO: 3731552 - DNA, 15 bp, Homo sapiens
acacctgtactggag

SEQ ID NO: 3731553 - DNA, 16 bp, Homo sapiens
acacctgtagtcccag

SEQ ID NO: 3731554 - DNA, 15 bp, Homo sapiens
acaccttatatttac

SEQ ID NO: 3731555 - DNA, 17 bp, Homo sapiens
acaccttttaactcacc

SEQ ID NO: 3731556 - DNA, 13 bp, Homo sapiens
acacgcacacaca

SEQ ID NO: 3731557 - DNA, 14 bp, Homo sapiens
acacgcacacacac

SEQ ID NO: 3731558 - DNA, 14 bp, Homo sapiens
acacggaggcatct

SEQ ID NO: 3731559 - DNA, 17 bp, Homo sapiens
acacggaggcatctgca

SEQ ID NO: 3731560 - DNA, 22 bp, Homo sapiens
acacgtggaggaatgctccccc

SEQ ID NO: 3731561 - DNA, 14 bp, Homo sapiens
acactaaaaataaa

SEQ ID NO: 3731562 - DNA, 14 bp, Homo sapiens
acactaaccacgct

SEQ ID NO: 3731563 - DNA, 20 bp, Homo sapiens
acactaaccacgctggacct

SEQ ID NO: 3731564 - DNA, 14 bp, Homo sapiens
acactaagggtgta

SEQ ID NO: 3731565 - DNA, 15 bp, Homo sapiens
acactagcctctcca

SEQ ID NO: 3731566 - DNA, 20 bp, Homo sapiens
acactagtctgtgtgctgtg

SEQ ID NO: 3731567 - DNA, 17 bp, Homo sapiens
acactatggtatttgag

SEQ ID NO: 3731568 - DNA, 15 bp, Homo sapiens
acactattttcagaa

SEQ ID NO: 3731569 - DNA, 16 bp, Homo sapiens
acactattttcagaat

SEQ ID NO: 3731570 - DNA, 22 bp, Homo sapiens
acactcacatttattctgctca

SEQ ID NO: 3731571 - DNA, 18 bp, Homo sapiens
acactcacctctaaaaca

SEQ ID NO: 3731572 - DNA, 14 bp, Homo sapiens
acactccagcctga

SEQ ID NO: 3731573 - DNA, 15 bp, Homo sapiens
acactccagcctgag

SEQ ID NO: 3731574 - DNA, 17 bp, Homo sapiens
acactccagcctgagca

SEQ ID NO: 3731575 - DNA, 12 bp, Homo sapiens
acactctcctgg

SEQ ID NO: 3731576 - DNA, 17 bp, Homo sapiens
acactctcctgggcccc

SEQ ID NO: 3731577 - DNA, 20 bp, Homo sapiens
acactctcctgggcccctcc

SEQ ID NO: 3731578 - DNA, 16 bp, Homo sapiens
acactctttgtaagag

SEQ ID NO: 3731579 - DNA, 22 bp, Homo sapiens
acactgaaatatacacacagca

SEQ ID NO: 3731580 - DNA, 18 bp, Homo sapiens
acactgcaagagccttgg

SEQ ID NO: 3731581 - DNA, 12 bp, Homo sapiens
acactggcccct

SEQ ID NO: 3731582 - DNA, 13 bp, Homo sapiens
acactggccccta

SEQ ID NO: 3731583 - DNA, 16 bp, Homo sapiens
acactgggggagggga

SEQ ID NO: 3731584 - DNA, 20 bp, Homo sapiens
acactgtcaaacatctggaa

SEQ ID NO: 3731585 - DNA, 16 bp, Homo sapiens
acactgttagaacact

SEQ ID NO: 3731586 - DNA, 18 bp, Homo sapiens
acactgttagaacactat

SEQ ID NO: 3731587 - DNA, 19 bp, Homo sapiens
acactgttagaacactatt

SEQ ID NO: 3731588 - DNA, 20 bp, Homo sapiens
acactgttagaacactattt

SEQ ID NO: 3731589 - DNA, 21 bp, Homo sapiens
acactgtttacaagaaaaaat

SEQ ID NO: 3731590 - DNA, 11 bp, Homo sapiens
acacttaacag

SEQ ID NO: 3731591 - DNA, 20 bp, Homo sapiens
acacttaagggttttagaaa

SEQ ID NO: 3731592 - DNA, 21 bp, Homo sapiens
acacttacactttatgcacaa

SEQ ID NO: 3731593 - DNA, 20 bp, Homo sapiens
acacttattgctttgaaact

SEQ ID NO: 3731594 - DNA, 16 bp, Homo sapiens
acacttcagagagctg

SEQ ID NO: 3731595 - DNA, 17 bp, Homo sapiens
acacttcagagagctgg

SEQ ID NO: 3731596 - DNA, 20 bp, Homo sapiens
acacttcagagagctggtag

SEQ ID NO: 3731597 - DNA, 15 bp, Homo sapiens
acacttcaggctctt

SEQ ID NO: 3731598 - DNA, 17 bp, Homo sapiens
acacttccaccagcctg

SEQ ID NO: 3731599 - DNA, 21 bp, Homo sapiens
acacttccaccagcctgcact

SEQ ID NO: 3731600 - DNA, 23 bp, Homo sapiens
gctcagcaaaagatgcttctcac

SEQ ID NO: 3731601 - DNA, 19 bp, Homo sapiens
gctcagcaaggggctctgc

SEQ ID NO: 3731602 - DNA, 16 bp, Homo sapiens
gctcagcccacccccc

SEQ ID NO: 3731603 - DNA, 17 bp, Homo sapiens
gctcagccctccctgcc

SEQ ID NO: 3731604 - DNA, 18 bp, Homo sapiens
gctcagccctccctgccc

SEQ ID NO: 3731605 - DNA, 19 bp, Homo sapiens
gctcagcctggtgggcctc

SEQ ID NO: 3731606 - DNA, 19 bp, Homo sapiens
aatgaaatgctctcctttc

SEQ ID NO: 3731607 - DNA, 17 bp, Homo sapiens
aatgaaattactacaaa

SEQ ID NO: 3731608 - DNA, 16 bp, Homo sapiens
aatgaaattttaccaa

SEQ ID NO: 3731609 - DNA, 21 bp, Homo sapiens
aatgaagataccatcagcaaa

SEQ ID NO: 3731610 - DNA, 22 bp, Homo sapiens
aatgaagattattttttatgag

SEQ ID NO: 3731611 - DNA, 22 bp, Homo sapiens
aatgaaggaaataaaaaagtct

SEQ ID NO: 3731612 - DNA, 17 bp, Homo sapiens
aatgaagttgtaggtaa

SEQ ID NO: 3731613 - DNA, 14 bp, Homo sapiens
aatgaagtttatac

SEQ ID NO: 3731614 - DNA, 21 bp, Homo sapiens
aatgaataataattatccaga

SEQ ID NO: 3731615 - DNA, 13 bp, Homo sapiens
aatgaattttgtt

SEQ ID NO: 3731616 - DNA, 14 bp, Homo sapiens
aatgacatgtgtca

SEQ ID NO: 3731617 - DNA, 21 bp, Homo sapiens
aatgacatgtgtcaagctgct

SEQ ID NO: 3731618 - DNA, 17 bp, Homo sapiens
aatgagaacatgttggt

SEQ ID NO: 3731619 - DNA, 11 bp, Homo sapiens
aatgagcctgg

SEQ ID NO: 3731620 - DNA, 12 bp, Homo sapiens
aatgagcctggc

SEQ ID NO: 3731621 - DNA, 13 bp, Homo sapiens
aatgagcctggca

SEQ ID NO: 3731622 - DNA, 18 bp, Homo sapiens
aatgaggtcagagcctgc

SEQ ID NO: 3731623 - DNA, 15 bp, Homo sapiens
aatgaggtcccaggc

SEQ ID NO: 3731624 - DNA, 16 bp, Homo sapiens
aatgaggtctgaaatg

SEQ ID NO: 3731625 - DNA, 19 bp, Homo sapiens
aatgagttacctacatttt

SEQ ID NO: 3731626 - DNA, 21 bp, Homo sapiens
aatgagtttttatggggctga

SEQ ID NO: 3731627 - DNA, 17 bp, Homo sapiens
aatgatgatgataatga

SEQ ID NO: 3731628 - DNA, 21 bp, Homo sapiens
aatgatgatgtggaagaactt

SEQ ID NO: 3731629 - DNA, 13 bp, Homo sapiens
aatgatgcacatt

SEQ ID NO: 3731630 - DNA, 18 bp, Homo sapiens
aatgatggcaattttgta

SEQ ID NO: 3731631 - DNA, 14 bp, Homo sapiens
aatgatgttgaata

SEQ ID NO: 3731632 - DNA, 18 bp, Homo sapiens
aatgatttccaaagagaa

SEQ ID NO: 3731633 - DNA, 21 bp, Homo sapiens
aatgattttacttagcaatgt

SEQ ID NO: 3731634 - DNA, 18 bp, Homo sapiens
aatgcaacaacatgtata

SEQ ID NO: 3731635 - DNA, 21 bp, Homo sapiens
aatgcaagattttccacaaga

SEQ ID NO: 3731636 - DNA, 15 bp, Homo sapiens
aatgcacaatgtctt

SEQ ID NO: 3731637 - DNA, 16 bp, Homo sapiens
aatgcacaatgtcttg

SEQ ID NO: 3731638 - DNA, 22 bp, Homo sapiens
aatgcagcgaaccaatatttgt

SEQ ID NO: 3731639 - DNA, 17 bp, Homo sapiens
aatgcagtgaattgtga

SEQ ID NO: 3731640 - DNA, 15 bp, Homo sapiens
aatgcatcaatcctg

SEQ ID NO: 3731641 - DNA, 19 bp, Homo sapiens
aatgcatccattcctcagg

SEQ ID NO: 3731642 - DNA, 23 bp, Homo sapiens
aatgccaacttgtccttttgtac

SEQ ID NO: 3731643 - DNA, 13 bp, Homo sapiens
aatgccaatctct

SEQ ID NO: 3731644 - DNA, 15 bp, Homo sapiens
aatgccttactttgt

SEQ ID NO: 3731645 - DNA, 19 bp, Homo sapiens
aatgcgaatggtagtctaa

SEQ ID NO: 3731646 - DNA, 20 bp, Homo sapiens
aatgctaacagttcacttgc

SEQ ID NO: 3731647 - DNA, 23 bp, Homo sapiens
aatgctataactatgttgataaa

SEQ ID NO: 3731648 - DNA, 22 bp, Homo sapiens
aatgctcccccatcctcccctt

SEQ ID NO: 3731649 - DNA, 13 bp, Homo sapiens
aatgctctccttt

SEQ ID NO: 3731650 - DNA, 15 bp, Homo sapiens
aatgctggttttcct

SEQ ID NO: 3731651 - DNA, 18 bp, Homo sapiens
aatgctggttttcctaaa

SEQ ID NO: 3731652 - DNA, 19 bp, Homo sapiens
aatgctggttttcctaaat

SEQ ID NO: 3731653 - DNA, 22 bp, Homo sapiens
aatgctgtattagtcacagaga

SEQ ID NO: 3731654 - DNA, 17 bp, Homo sapiens
aatgctgtcaactatga

SEQ ID NO: 3731655 - DNA, 16 bp, Homo sapiens
aatgctgttgcctcat

SEQ ID NO: 3731656 - DNA, 14 bp, Homo sapiens
aatggaaaatgatt

SEQ ID NO: 3731657 - DNA, 18 bp, Homo sapiens
aatggacaaaatccatga

SEQ ID NO: 3731658 - DNA, 14 bp, Homo sapiens
aatggactcaaact

SEQ ID NO: 3731659 - DNA, 23 bp, Homo sapiens
aatggagtagacccctggctggt

SEQ ID NO: 3731660 - DNA, 19 bp, Homo sapiens
aatggagtcagtttgcagt

SEQ ID NO: 3731661 - DNA, 17 bp, Homo sapiens
aatggccatttgctttt

SEQ ID NO: 3731662 - DNA, 19 bp, Homo sapiens
aatggcgtgaacccgggag

SEQ ID NO: 3731663 - DNA, 18 bp, Homo sapiens
aatggctttggtctcttg

SEQ ID NO: 3731664 - DNA, 18 bp, Homo sapiens
aatgggactggagtccct

SEQ ID NO: 3731665 - DNA, 22 bp, Homo sapiens
aatggtagtctaaccaaatgca

SEQ ID NO: 3731666 - DNA, 17 bp, Homo sapiens
aatggtttgcaaggaag

SEQ ID NO: 3731667 - DNA, 14 bp, Homo sapiens
aatggttttcaaaa

SEQ ID NO: 3731668 - DNA, 16 bp, Homo sapiens
aatggttttcaaaata

SEQ ID NO: 3731669 - DNA, 17 bp, Homo sapiens
aatgtaagaatcattgt

SEQ ID NO: 3731670 - DNA, 19 bp, Homo sapiens
aatgtaagtaaatgtctgt

SEQ ID NO: 3731671 - DNA, 14 bp, Homo sapiens
aatgtaattgaata

SEQ ID NO: 3731672 - DNA, 16 bp, Homo sapiens
aatgtaattgaataaa

SEQ ID NO: 3731673 - DNA, 13 bp, Homo sapiens
aatgtacaaaata

SEQ ID NO: 3731674 - DNA, 17 bp, Homo sapiens
aatgtacatctggcctt

SEQ ID NO: 3731675 - DNA, 15 bp, Homo sapiens
aatgtacattaatta

SEQ ID NO: 3731676 - DNA, 14 bp, Homo sapiens
aatgtacccagtat

SEQ ID NO: 3731677 - DNA, 12 bp, Homo sapiens
aatgtactgcat

SEQ ID NO: 3731678 - DNA, 14 bp, Homo sapiens
aatgtactgcatat

SEQ ID NO: 3731679 - DNA, 14 bp, Homo sapiens
aatgtagctggttt

SEQ ID NO: 3731680 - DNA, 17 bp, Homo sapiens
aatgtagctggtttcct

SEQ ID NO: 3731681 - DNA, 21 bp, Homo sapiens
aatgtagctggtttcctcatt

SEQ ID NO: 3731682 - DNA, 19 bp, Homo sapiens
aatgtatcatagaaatgta

SEQ ID NO: 3731683 - DNA, 16 bp, Homo sapiens
aatgtatcttattcac

SEQ ID NO: 3731684 - DNA, 18 bp, Homo sapiens
aatgtatcttattcacat

SEQ ID NO: 3731685 - DNA, 12 bp, Homo sapiens
aatgtatgtgta

SEQ ID NO: 3731686 - DNA, 14 bp, Homo sapiens
aatgtattattctg

SEQ ID NO: 3731687 - DNA, 14 bp, Homo sapiens
aatgtcaaggtgct

SEQ ID NO: 3731688 - DNA, 16 bp, Homo sapiens
aatgtcaaggtgctgt

SEQ ID NO: 3731689 - DNA, 13 bp, Homo sapiens
aatgtcacaggca

SEQ ID NO: 3731690 - DNA, 15 bp, Homo sapiens
aatgtcacaggcagg

SEQ ID NO: 3731691 - DNA, 15 bp, Homo sapiens
aatgtcaccaccttc

SEQ ID NO: 3731692 - DNA, 16 bp, Homo sapiens
aatgtcaccaccttcc

SEQ ID NO: 3731693 - DNA, 17 bp, Homo sapiens
aatgtcacttaaaggct

SEQ ID NO: 3731694 - DNA, 19 bp, Homo sapiens
aatgtcagaaaccagttat

SEQ ID NO: 3731695 - DNA, 20 bp, Homo sapiens
aatgtcagattcctttccct

SEQ ID NO: 3731696 - DNA, 19 bp, Homo sapiens
aatgtcattaaaataaata

SEQ ID NO: 3731697 - DNA, 21 bp, Homo sapiens
aatgtccaccaatagaatgag

SEQ ID NO: 3731698 - DNA, 21 bp, Homo sapiens
aatgtcctccagaagcctctg

SEQ ID NO: 3731699 - DNA, 17 bp, Homo sapiens
aatgtctgttaacttaa

SEQ ID NO: 3731700 - DNA, 14 bp, Homo sapiens
gtggacagtcctgg

SEQ ID NO: 3731701 - DNA, 21 bp, Homo sapiens
gtggactagacctccagctgt

SEQ ID NO: 3731702 - DNA, 12 bp, Homo sapiens
gtggagagctgg

SEQ ID NO: 3731703 - DNA, 22 bp, Homo sapiens
gtggagagggacagcccactga

SEQ ID NO: 3731704 - DNA, 21 bp, Homo sapiens
gtggagcacaaaagcctctca

SEQ ID NO: 3731705 - DNA, 23 bp, Homo sapiens
gtgtccaactccagtactggagc

SEQ ID NO: 3731706 - DNA, 13 bp, Homo sapiens
gtgtccacctggc

SEQ ID NO: 3731707 - DNA, 13 bp, Homo sapiens
gtgtccatcccag

SEQ ID NO: 3731708 - DNA, 19 bp, Homo sapiens
gtgtccatcccagcggctg

SEQ ID NO: 3731709 - DNA, 13 bp, Homo sapiens
gtgtccctgcact

SEQ ID NO: 3731710 - DNA, 23 bp, Homo sapiens
gtgtccctgcacttgcagactct

SEQ ID NO: 3731711 - DNA, 14 bp, Homo sapiens
gtgtccggtccctg

SEQ ID NO: 3731712 - DNA, 14 bp, Homo sapiens
gtgtcctaggagta

SEQ ID NO: 3731713 - DNA, 18 bp, Homo sapiens
gtgtcctcccctcaagga

SEQ ID NO: 3731714 - DNA, 17 bp, Homo sapiens
gtgtccttgcacctgca

SEQ ID NO: 3731715 - DNA, 16 bp, Homo sapiens
gtgtcctttccctcca

SEQ ID NO: 3731716 - DNA, 17 bp, Homo sapiens
gtgtcctttccctccac

SEQ ID NO: 3731717 - DNA, 15 bp, Homo sapiens
gtgtctgctcagtaa

SEQ ID NO: 3731718 - DNA, 22 bp, Homo sapiens
gtgtctggacattcagaacacc

SEQ ID NO: 3731719 - DNA, 14 bp, Homo sapiens
gtgtctgtatttat

SEQ ID NO: 3731720 - DNA, 19 bp, Homo sapiens
gtgtcttgcaatggcagcc

SEQ ID NO: 3731721 - DNA, 18 bp, Homo sapiens
gtgtcttttttcactaca

SEQ ID NO: 3731722 - DNA, 22 bp, Homo sapiens
gtgtgacaaggattgctactgt

SEQ ID NO: 3731723 - DNA, 16 bp, Homo sapiens
gtgtgaggagctgctg

SEQ ID NO: 3731724 - DNA, 17 bp, Homo sapiens
gtgtgagtaagagctgg

SEQ ID NO: 3731725 - DNA, 18 bp, Homo sapiens
gtgtgagtcaccaagccc

SEQ ID NO: 3731726 - DNA, 20 bp, Homo sapiens
gtgtgcacaaatatttattt

SEQ ID NO: 3731727 - DNA, 15 bp, Homo sapiens
gtgtgcacgagtggg

SEQ ID NO: 3731728 - DNA, 20 bp, Homo sapiens
gtgtgcatgtgtgtgctcag

SEQ ID NO: 3731729 - DNA, 14 bp, Homo sapiens
gtgtgcctgcagcc

SEQ ID NO: 3731730 - DNA, 18 bp, Homo sapiens
gtgtgcctgcagccccgc

SEQ ID NO: 3731731 - DNA, 14 bp, Homo sapiens
gtgtgcgtcctgtc

SEQ ID NO: 3731732 - DNA, 15 bp, Homo sapiens
gtgtgctctgatcat

SEQ ID NO: 3731733 - DNA, 13 bp, Homo sapiens
gtgtgggaaggga

SEQ ID NO: 3731734 - DNA, 16 bp, Homo sapiens
gtgtgggaagggagag

SEQ ID NO: 3731735 - DNA, 15 bp, Homo sapiens
gtgtgggactgtaca

SEQ ID NO: 3731736 - DNA, 16 bp, Homo sapiens
gtgtggtagagtgtgc

SEQ ID NO: 3731737 - DNA, 14 bp, Homo sapiens
gtgtgtagccaagg

SEQ ID NO: 3731738 - DNA, 18 bp, Homo sapiens
gtgtgtatgggtgtgtgt

SEQ ID NO: 3731739 - DNA, 20 bp, Homo sapiens
gtgtgtatgtgcgtgtgtgc

SEQ ID NO: 3731740 - DNA, 19 bp, Homo sapiens
gtgtgtctcctgcatgcag

SEQ ID NO: 3731741 - DNA, 16 bp, Homo sapiens
gtgtgtctgctcagta

SEQ ID NO: 3731742 - DNA, 12 bp, Homo sapiens
gtgtgtgtatgt

SEQ ID NO: 3731743 - DNA, 14 bp, Homo sapiens
gtgtgttatttaaa

SEQ ID NO: 3731744 - DNA, 15 bp, Homo sapiens
gtgtgtttctgatct

SEQ ID NO: 3731745 - DNA, 17 bp, Homo sapiens
gtgttatttaaatgagt

SEQ ID NO: 3731746 - DNA, 15 bp, Homo sapiens
gtgttccaacaacca

SEQ ID NO: 3731747 - DNA, 21 bp, Homo sapiens
gtgttcgttcttgttctgttt

SEQ ID NO: 3731748 - DNA, 14 bp, Homo sapiens
gtgttctgttgttt

SEQ ID NO: 3731749 - DNA, 20 bp, Homo sapiens
gtgttgcccaggctggtctc

SEQ ID NO: 3731750 - DNA, 19 bp, Homo sapiens
gtgttgtcagcatcttctc

SEQ ID NO: 3731751 - DNA, 15 bp, Homo sapiens
gtgtttagttgcaga

SEQ ID NO: 3731752 - DNA, 13 bp, Homo sapiens
gtgttttcataat

SEQ ID NO: 3731753 - DNA, 22 bp, Homo sapiens
gtgttttgttttgatttaataa

SEQ ID NO: 3731754 - DNA, 18 bp, Homo sapiens
gtgtttttgggatgtctt

SEQ ID NO: 3731755 - DNA, 19 bp, Homo sapiens
gtgtttttgggatgtctta

SEQ ID NO: 3731756 - DNA, 13 bp, Homo sapiens
gttaaatatttac

SEQ ID NO: 3731757 - DNA, 22 bp, Homo sapiens
gttaaatatttacatatgaaat

SEQ ID NO: 3731758 - DNA, 18 bp, Homo sapiens
gttaacattgaccaagaa

SEQ ID NO: 3731759 - DNA, 21 bp, Homo sapiens
gttaacattgaccaagaactg

SEQ ID NO: 3731760 - DNA, 20 bp, Homo sapiens
gttaaccagaataaagttct

SEQ ID NO: 3731761 - DNA, 14 bp, Homo sapiens
gttaagcagccgcc

SEQ ID NO: 3731762 - DNA, 16 bp, Homo sapiens
gttaaggctgaggaaa

SEQ ID NO: 3731763 - DNA, 23 bp, Homo sapiens
gttaagttggcttctgtttctag

SEQ ID NO: 3731764 - DNA, 17 bp, Homo sapiens
gttaatattctttcaat

SEQ ID NO: 3731765 - DNA, 12 bp, Homo sapiens
gttaatcttagg

SEQ ID NO: 3731766 - DNA, 14 bp, Homo sapiens
gttacaaactgcaa

SEQ ID NO: 3731767 - DNA, 16 bp, Homo sapiens
gttacactaaaaggtg

SEQ ID NO: 3731768 - DNA, 22 bp, Homo sapiens
gttacattgctggtcttgtaag

SEQ ID NO: 3731769 - DNA, 23 bp, Homo sapiens
gttaccattttggggtacccact

SEQ ID NO: 3731770 - DNA, 10 bp, Homo sapiens
gttacctaat

SEQ ID NO: 3731771 - DNA, 19 bp, Homo sapiens
gttacctaattagagcaga

SEQ ID NO: 3731772 - DNA, 17 bp, Homo sapiens
gttacctcctataaact

SEQ ID NO: 3731773 - DNA, 23 bp, Homo sapiens
gttacgcacacgtacttaaatga

SEQ ID NO: 3731774 - DNA, 13 bp, Homo sapiens
gttactcagccct

SEQ ID NO: 3731775 - DNA, 16 bp, Homo sapiens
gttactcagccctggg

SEQ ID NO: 3731776 - DNA, 17 bp, Homo sapiens
gttactcagccctgggc

SEQ ID NO: 3731777 - DNA, 17 bp, Homo sapiens
gttactctccaacctgg

SEQ ID NO: 3731778 - DNA, 18 bp, Homo sapiens
gttactctccaacctgga

SEQ ID NO: 3731779 - DNA, 22 bp, Homo sapiens
gttactctccaacctggacaac

SEQ ID NO: 3731780 - DNA, 11 bp, Homo sapiens
gttactctgaa

SEQ ID NO: 3731781 - DNA, 14 bp, Homo sapiens
gttactctgaaggg

SEQ ID NO: 3731782 - DNA, 18 bp, Homo sapiens
gttactgatcatgcattg

SEQ ID NO: 3731783 - DNA, 14 bp, Homo sapiens
gttagaacactatt

SEQ ID NO: 3731784 - DNA, 16 bp, Homo sapiens
gttagaatgaggagga

SEQ ID NO: 3731785 - DNA, 13 bp, Homo sapiens
gttagagatgcct

SEQ ID NO: 3731786 - DNA, 22 bp, Homo sapiens
gttagagtccaacgtggggcag

SEQ ID NO: 3731787 - DNA, 23 bp, Homo sapiens
gttagctcagccccagcccagcc

SEQ ID NO: 3731788 - DNA, 17 bp, Homo sapiens
gttaggaaataaaacct

SEQ ID NO: 3731789 - DNA, 18 bp, Homo sapiens
gttagggaagagaaacag

SEQ ID NO: 3731790 - DNA, 23 bp, Homo sapiens
gttagggtgctctggaagagagg

SEQ ID NO: 3731791 - DNA, 21 bp, Homo sapiens
gttaggtagagggagttgtca

SEQ ID NO: 3731792 - DNA, 21 bp, Homo sapiens
gttagtagcatgttgagccag

SEQ ID NO: 3731793 - DNA, 22 bp, Homo sapiens
gttagtcatttgctgagcatgt

SEQ ID NO: 3731794 - DNA, 18 bp, Homo sapiens
gttataaatcaatgtcac

SEQ ID NO: 3731795 - DNA, 18 bp, Homo sapiens
gttatacatgacactgaa

SEQ ID NO: 3731796 - DNA, 21 bp, Homo sapiens
gttatcccttccttttagcct

SEQ ID NO: 3731797 - DNA, 15 bp, Homo sapiens
gttatgataaaaaat

SEQ ID NO: 3731798 - DNA, 21 bp, Homo sapiens
gttattagggtggtatttagt

SEQ ID NO: 3731799 - DNA, 11 bp, Homo sapiens
gttatttaaat

SEQ ID NO: 3731800 - DNA, 14 bp, Homo sapiens
gttatttttataca

SEQ ID NO: 3731801 - DNA, 15 bp, Homo sapiens
gttatttttatacag

SEQ ID NO: 3731802 - DNA, 13 bp, Homo sapiens
gttcaaaatgtct

SEQ ID NO: 3731803 - DNA, 14 bp, Homo sapiens
gttcaaaatgtctg

SEQ ID NO: 3731804 - DNA, 18 bp, Homo sapiens
gttcaagaccagcctggc

SEQ ID NO: 3731805 - DNA, 18 bp, Homo sapiens
gttcaaggaatcattgtt

SEQ ID NO: 3731806 - DNA, 11 bp, Homo sapiens
gttcaccagcc

SEQ ID NO: 3731807 - DNA, 22 bp, Homo sapiens
gttcaccttgaagaacctctca

SEQ ID NO: 3731808 - DNA, 15 bp, Homo sapiens
gttcactaaagcagt

SEQ ID NO: 3731809 - DNA, 24 bp, Homo sapiens
gttcactctacttagcatgtccct

SEQ ID NO: 3731810 - DNA, 16 bp, Homo sapiens
gttcagagactcaggg

SEQ ID NO: 3731811 - DNA, 18 bp, Homo sapiens
gttcagctccagctcacc

SEQ ID NO: 3731812 - DNA, 23 bp, Homo sapiens
gttcagcttgtaaatagctcagg

SEQ ID NO: 3731813 - DNA, 20 bp, Homo sapiens
gttcaggggactcagccctg

SEQ ID NO: 3731814 - DNA, 20 bp, Homo sapiens
gttcagggttggcccctgcc

SEQ ID NO: 3731815 - DNA, 18 bp, Homo sapiens
gttcaggtaacaggcaga

SEQ ID NO: 3731816 - DNA, 22 bp, Homo sapiens
gttcagtaacagggccttgcta

SEQ ID NO: 3731817 - DNA, 13 bp, Homo sapiens
gttcagtctttca

SEQ ID NO: 3731818 - DNA, 18 bp, Homo sapiens
tctatgctcataactgtg

SEQ ID NO: 3731819 - DNA, 23 bp, Homo sapiens
tctatgggactcaatgcactgac

SEQ ID NO: 3731820 - DNA, 17 bp, Homo sapiens
tctatggtaaagatatt

SEQ ID NO: 3731821 - DNA, 21 bp, Homo sapiens
tctattaccactgaagataga

SEQ ID NO: 3731822 - DNA, 14 bp, Homo sapiens
tctattagacttta

SEQ ID NO: 3731823 - DNA, 22 bp, Homo sapiens
tctattgctggcaaagacagaa

SEQ ID NO: 3731824 - DNA, 16 bp, Homo sapiens
tctattgggattttct

SEQ ID NO: 3731825 - DNA, 15 bp, Homo sapiens
tctattgggttcatt

SEQ ID NO: 3731826 - DNA, 18 bp, Homo sapiens
tctattgggttcattatt

SEQ ID NO: 3731827 - DNA, 22 bp, Homo sapiens
tctattgggttcattattggaa

SEQ ID NO: 3731828 - DNA, 19 bp, Homo sapiens
tctattgtaagataaaaaa

SEQ ID NO: 3731829 - DNA, 15 bp, Homo sapiens
tctatttaaattctt

SEQ ID NO: 3731830 - DNA, 20 bp, Homo sapiens
tctatttctgagaaggtcct

SEQ ID NO: 3731831 - DNA, 14 bp, Homo sapiens
tctatttttgtaga

SEQ ID NO: 3731832 - DNA, 16 bp, Homo sapiens
tctcaaaaaaagaaaa

SEQ ID NO: 3731833 - DNA, 13 bp, Homo sapiens
tctcaaactcttg

SEQ ID NO: 3731834 - DNA, 22 bp, Homo sapiens
tctcaaactcttgacctcaggt

SEQ ID NO: 3731835 - DNA, 17 bp, Homo sapiens
tctcaaataactaaaag

SEQ ID NO: 3731836 - DNA, 13 bp, Homo sapiens
tctcaaccatccc

SEQ ID NO: 3731837 - DNA, 17 bp, Homo sapiens
tctcaagagggcactgg

SEQ ID NO: 3731838 - DNA, 18 bp, Homo sapiens
tctcaagagggcactggt

SEQ ID NO: 3731839 - DNA, 19 bp, Homo sapiens
tctcaagagggcactggtg

SEQ ID NO: 3731840 - DNA, 13 bp, Homo sapiens
tctcaagccctgc

SEQ ID NO: 3731841 - DNA, 20 bp, Homo sapiens
tctcaagccgcatcccagac

SEQ ID NO: 3731842 - DNA, 12 bp, Homo sapiens
tctcacagtggg

SEQ ID NO: 3731843 - DNA, 19 bp, Homo sapiens
tctcacagtgggagccagg

SEQ ID NO: 3731844 - DNA, 23 bp, Homo sapiens
tctcacagtgggagccagggctg

SEQ ID NO: 3731845 - DNA, 19 bp, Homo sapiens
tctcactatgttgcccagg

SEQ ID NO: 3731846 - DNA, 17 bp, Homo sapiens
tctcactccaccaccca

SEQ ID NO: 3731847 - DNA, 12 bp, Homo sapiens
tctcactcccct

SEQ ID NO: 3731848 - DNA, 15 bp, Homo sapiens
tctcactcccctcct

SEQ ID NO: 3731849 - DNA, 17 bp, Homo sapiens
tctcactcccttctcct

SEQ ID NO: 3731850 - DNA, 13 bp, Homo sapiens
tctcactcctacc

SEQ ID NO: 3731851 - DNA, 16 bp, Homo sapiens
tctcactcctacctgg

SEQ ID NO: 3731852 - DNA, 12 bp, Homo sapiens
tctcactctgtc

SEQ ID NO: 3731853 - DNA, 22 bp, Homo sapiens
tctcactctgtcgcccagtctg

SEQ ID NO: 3731854 - DNA, 20 bp, Homo sapiens
tctcactgccatgccagctt

SEQ ID NO: 3731855 - DNA, 21 bp, Homo sapiens
tctcactgtgtccctctctct

SEQ ID NO: 3731856 - DNA, 20 bp, Homo sapiens
tctcactgttgcccaggctg

SEQ ID NO: 3731857 - DNA, 15 bp, Homo sapiens
tctcacttttctcca

SEQ ID NO: 3731858 - DNA, 20 bp, Homo sapiens
tctcacttttctccatgagt

SEQ ID NO: 3731859 - DNA, 14 bp, Homo sapiens
tctcagatatttat

SEQ ID NO: 3731860 - DNA, 23 bp, Homo sapiens
tctcagatatttatatttttatt

SEQ ID NO: 3731861 - DNA, 11 bp, Homo sapiens
tctcagcctcc

SEQ ID NO: 3731862 - DNA, 18 bp, Homo sapiens
tctcaggcatgcctgtgt

SEQ ID NO: 3731863 - DNA, 20 bp, Homo sapiens
tctcaggcatgcctgtgtga

SEQ ID NO: 3731864 - DNA, 21 bp, Homo sapiens
tctcaggcatgcctgtgtgac

SEQ ID NO: 3731865 - DNA, 21 bp, Homo sapiens
tctcaggccacctgccccctt

SEQ ID NO: 3731866 - DNA, 15 bp, Homo sapiens
tctcaggctctgccc

SEQ ID NO: 3731867 - DNA, 20 bp, Homo sapiens
tctcagggaagcccagctcc

SEQ ID NO: 3731868 - DNA, 21 bp, Homo sapiens
tctcagggaagcccagctcca

SEQ ID NO: 3731869 - DNA, 13 bp, Homo sapiens
tctcagggcctgg

SEQ ID NO: 3731870 - DNA, 18 bp, Homo sapiens
tctcatactcacctcacc

SEQ ID NO: 3731871 - DNA, 13 bp, Homo sapiens
tctcatctgtgat

SEQ ID NO: 3731872 - DNA, 13 bp, Homo sapiens
tctcattcagtat

SEQ ID NO: 3731873 - DNA, 11 bp, Homo sapiens
tctccaaagct

SEQ ID NO: 3731874 - DNA, 21 bp, Homo sapiens
tctccaaagctttcctggaga

SEQ ID NO: 3731875 - DNA, 15 bp, Homo sapiens
tctccaacctggaca

SEQ ID NO: 3731876 - DNA, 13 bp, Homo sapiens
tctccaccctgct

SEQ ID NO: 3731877 - DNA, 11 bp, Homo sapiens
tctccacctca

SEQ ID NO: 3731878 - DNA, 13 bp, Homo sapiens
tctccacctcagc

SEQ ID NO: 3731879 - DNA, 18 bp, Homo sapiens
tctccacctcagccttgg

SEQ ID NO: 3731880 - DNA, 15 bp, Homo sapiens
tctccagacccccac

SEQ ID NO: 3731881 - DNA, 13 bp, Homo sapiens
tctccagcccacg

SEQ ID NO: 3731882 - DNA, 14 bp, Homo sapiens
tctccagcccacgt

SEQ ID NO: 3731883 - DNA, 19 bp, Homo sapiens
tctccagtatccactttgc

SEQ ID NO: 3731884 - DNA, 15 bp, Homo sapiens
tctccagttttcagt

SEQ ID NO: 3731885 - DNA, 15 bp, Homo sapiens
tctccatatgttaca

SEQ ID NO: 3731886 - DNA, 17 bp, Homo sapiens
tctccatcagaggacac

SEQ ID NO: 3731887 - DNA, 16 bp, Homo sapiens
tctccatgtttgatgt

SEQ ID NO: 3731888 - DNA, 12 bp, Homo sapiens
tctcccacactg

SEQ ID NO: 3731889 - DNA, 13 bp, Homo sapiens
tctcccaggccag

SEQ ID NO: 3731890 - DNA, 22 bp, Homo sapiens
tctcccagggctactcactcaa

SEQ ID NO: 3731891 - DNA, 13 bp, Homo sapiens
tctcccagttgtc

SEQ ID NO: 3731892 - DNA, 13 bp, Homo sapiens
tctccccacacta

SEQ ID NO: 3731893 - DNA, 12 bp, Homo sapiens
tctcccctctgc

SEQ ID NO: 3731894 - DNA, 16 bp, Homo sapiens
tctcccctctgctggc

SEQ ID NO: 3731895 - DNA, 15 bp, Homo sapiens
tctcccctcttatgt

SEQ ID NO: 3731896 - DNA, 15 bp, Homo sapiens
tctcccctgccctgc

SEQ ID NO: 3731897 - DNA, 18 bp, Homo sapiens
tctccctcccctgccatt

SEQ ID NO: 3731898 - DNA, 15 bp, Homo sapiens
tctccctctcctgcc

SEQ ID NO: 3731899 - DNA, 18 bp, Homo sapiens
tctccctctggccctgcc

SEQ ID NO: 3731900 - DNA, 13 bp, Homo sapiens
tctccctgccgcc

SEQ ID NO: 3731901 - DNA, 15 bp, Homo sapiens
tctccctgccgcctc

SEQ ID NO: 3731902 - DNA, 17 bp, Homo sapiens
tctcctagactgaccct

SEQ ID NO: 3731903 - DNA, 23 bp, Homo sapiens
tctcctagactgaccctgatcag

SEQ ID NO: 3731904 - DNA, 12 bp, Homo sapiens
tctcctattttt

SEQ ID NO: 3731905 - DNA, 13 bp, Homo sapiens
tctcctatttttt

SEQ ID NO: 3731906 - DNA, 18 bp, Homo sapiens
tctcctccatactcagga

SEQ ID NO: 3731907 - DNA, 16 bp, Homo sapiens
tctcctcttgccactg

SEQ ID NO: 3731908 - DNA, 22 bp, Homo sapiens
tctcctcttgccactgcctctt

SEQ ID NO: 3731909 - DNA, 18 bp, Homo sapiens
tctcctgaggatcagaaa

SEQ ID NO: 3731910 - DNA, 11 bp, Homo sapiens
tctcctgccta

SEQ ID NO: 3731911 - DNA, 15 bp, Homo sapiens
tctcctgcctactca

SEQ ID NO: 3731912 - DNA, 17 bp, Homo sapiens
tctcctgcctactcacg

SEQ ID NO: 3731913 - DNA, 19 bp, Homo sapiens
tctcctgcctcagcctccc

SEQ ID NO: 3731914 - DNA, 22 bp, Homo sapiens
tctcctgcctcagcctcccaaa

SEQ ID NO: 3731915 - DNA, 22 bp, Homo sapiens
tctcctgggcccctccctacct

SEQ ID NO: 3731916 - DNA, 16 bp, Homo sapiens
tctcctgtccaaccta

SEQ ID NO: 3731917 - DNA, 17 bp, Homo sapiens
tctcctgtgcatgggtg

SEQ ID NO: 3731918 - DNA, 17 bp, Homo sapiens
tctccttagtcttctca

SEQ ID NO: 3731919 - DNA, 22 bp, Homo sapiens
tctccttccaactgctgcccca

SEQ ID NO: 3731920 - DNA, 18 bp, Homo sapiens
tctccttgataacagcta

SEQ ID NO: 3731921 - DNA, 13 bp, Homo sapiens
tctccttgcccta

SEQ ID NO: 3731922 - DNA, 14 bp, Homo sapiens
tctcctttcaggga

SEQ ID NO: 3731923 - DNA, 23 bp, Homo sapiens
tctcgaacatggaactcattcct

SEQ ID NO: 3731924 - DNA, 20 bp, Homo sapiens
tctctaactcagaaacatca

SEQ ID NO: 3731925 - DNA, 18 bp, Homo sapiens
tctctacccagcccatct

SEQ ID NO: 3731926 - DNA, 16 bp, Homo sapiens
tctctagggaaggcca

SEQ ID NO: 3731927 - DNA, 21 bp, Homo sapiens
tctctattaccactgaagata

SEQ ID NO: 3731928 - DNA, 14 bp, Homo sapiens
tctctccctcccct

SEQ ID NO: 3731929 - DNA, 11 bp, Homo sapiens
tctctcctcct

SEQ ID NO: 3731930 - DNA, 14 bp, Homo sapiens
tctctctccagtct

SEQ ID NO: 3731931 - DNA, 11 bp, Homo sapiens
tctctctcctg

SEQ ID NO: 3731932 - DNA, 15 bp, Homo sapiens
tctgccggccctggg

SEQ ID NO: 3731933 - DNA, 18 bp, Homo sapiens
tctgcctctgacacacag

SEQ ID NO: 3731934 - DNA, 22 bp, Homo sapiens
tctgcctctgacacacagctct

SEQ ID NO: 3731935 - DNA, 23 bp, Homo sapiens
tctgcctctgacacacagctctg

SEQ ID NO: 3731936 - DNA, 14 bp, Homo sapiens
tctgcctctgcctg

SEQ ID NO: 3731937 - DNA, 19 bp, Homo sapiens
tctgcctgaagtcacacag

SEQ ID NO: 3731938 - DNA, 14 bp, Homo sapiens
tctgcctgcccagg

SEQ ID NO: 3731939 - DNA, 15 bp, Homo sapiens
tctgcctgcccaggc

SEQ ID NO: 3731940 - DNA, 16 bp, Homo sapiens
tctgcctgcccaggcc

SEQ ID NO: 3731941 - DNA, 17 bp, Homo sapiens
tctgcctgcccaggccc

SEQ ID NO: 3731942 - DNA, 18 bp, Homo sapiens
tctgcctgcccaggcccc

SEQ ID NO: 3731943 - DNA, 12 bp, Homo sapiens
tctgcctgtccc

SEQ ID NO: 3731944 - DNA, 12 bp, Homo sapiens
tctgcctgtctc

SEQ ID NO: 3731945 - DNA, 14 bp, Homo sapiens
tctgcctgtctccc

SEQ ID NO: 3731946 - DNA, 22 bp, Homo sapiens
tctgctaacttggagccccagt

SEQ ID NO: 3731947 - DNA, 14 bp, Homo sapiens
tctgctacctcact

SEQ ID NO: 3731948 - DNA, 13 bp, Homo sapiens
tctgctatgcttg

SEQ ID NO: 3731949 - DNA, 16 bp, Homo sapiens
tctgctcacatatctg

SEQ ID NO: 3731950 - DNA, 17 bp, Homo sapiens
tctgctcacatatctgt

SEQ ID NO: 3731951 - DNA, 22 bp, Homo sapiens
tctgctcagacagaacccctac

SEQ ID NO: 3731952 - DNA, 22 bp, Homo sapiens
tctgctcagtaatttgaggaca

SEQ ID NO: 3731953 - DNA, 12 bp, Homo sapiens
tctgctccaccc

SEQ ID NO: 3731954 - DNA, 16 bp, Homo sapiens
tctgctccacccttgg

SEQ ID NO: 3731955 - DNA, 18 bp, Homo sapiens
tctgctgacagacacagg

SEQ ID NO: 3731956 - DNA, 20 bp, Homo sapiens
tctgctgacagacacaggcc

SEQ ID NO: 3731957 - DNA, 16 bp, Homo sapiens
tctgctggataaaatg

SEQ ID NO: 3731958 - DNA, 22 bp, Homo sapiens
tctgctggataaaatgaggttc

SEQ ID NO: 3731959 - DNA, 20 bp, Homo sapiens
tctgctggcccagccaaacc

SEQ ID NO: 3731960 - DNA, 15 bp, Homo sapiens
tctgctggtcttcaa

SEQ ID NO: 3731961 - DNA, 22 bp, Homo sapiens
tctgctttggggtttatcagaa

SEQ ID NO: 3731962 - DNA, 23 bp, Homo sapiens
tctgctttttaaagaatgctctt

SEQ ID NO: 3731963 - DNA, 15 bp, Homo sapiens
tctggaaaataaaag

SEQ ID NO: 3731964 - DNA, 15 bp, Homo sapiens
tctggaaaggaggaa

SEQ ID NO: 3731965 - DNA, 20 bp, Homo sapiens
tctggaagagaggaatgcct

SEQ ID NO: 3731966 - DNA, 16 bp, Homo sapiens
tctggaatgcagtggt

SEQ ID NO: 3731967 - DNA, 21 bp, Homo sapiens
tctggacaggcatgttctctg

SEQ ID NO: 3731968 - DNA, 16 bp, Homo sapiens
tctggactcctctgtc

SEQ ID NO: 3731969 - DNA, 18 bp, Homo sapiens
tctggactcctctgtcca

SEQ ID NO: 3731970 - DNA, 22 bp, Homo sapiens
tctggactcctctgtccaggca

SEQ ID NO: 3731971 - DNA, 17 bp, Homo sapiens
tctggactgaagcctgc

SEQ ID NO: 3731972 - DNA, 14 bp, Homo sapiens
tctggactggctag

SEQ ID NO: 3731973 - DNA, 15 bp, Homo sapiens
tctggagccacctgt

SEQ ID NO: 3731974 - DNA, 19 bp, Homo sapiens
tctggagccacctgtccca

SEQ ID NO: 3731975 - DNA, 23 bp, Homo sapiens
tctggagccacctgtcccacctc

SEQ ID NO: 3731976 - DNA, 14 bp, Homo sapiens
tctggattgtggga

SEQ ID NO: 3731977 - DNA, 20 bp, Homo sapiens
tctggcagggtgggatggag

SEQ ID NO: 3731978 - DNA, 19 bp, Homo sapiens
tctggccaggatggagggg

SEQ ID NO: 3731979 - DNA, 23 bp, Homo sapiens
tctggccctcacccctgccctgg

SEQ ID NO: 3731980 - DNA, 14 bp, Homo sapiens
tctggccctgcctt

SEQ ID NO: 3731981 - DNA, 15 bp, Homo sapiens
tctggccttacacct

SEQ ID NO: 3731982 - DNA, 23 bp, Homo sapiens
tctggctgataaaagatacattt

SEQ ID NO: 3731983 - DNA, 18 bp, Homo sapiens
tctgggaaataagagaga

SEQ ID NO: 3731984 - DNA, 14 bp, Homo sapiens
tctgggcaggacct

SEQ ID NO: 3731985 - DNA, 12 bp, Homo sapiens
tctgggccaagt

SEQ ID NO: 3731986 - DNA, 19 bp, Homo sapiens
tctgggccaagttcctcta

SEQ ID NO: 3731987 - DNA, 21 bp, Homo sapiens
tctgggcttggggcttcctaa

SEQ ID NO: 3731988 - DNA, 22 bp, Homo sapiens
tctgggctttgattccatctcc

SEQ ID NO: 3731989 - DNA, 16 bp, Homo sapiens
tctggggctctgggat

SEQ ID NO: 3731990 - DNA, 18 bp, Homo sapiens
tctggggttcagcccctc

SEQ ID NO: 3731991 - DNA, 14 bp, Homo sapiens
tctgggttcactgc

SEQ ID NO: 3731992 - DNA, 15 bp, Homo sapiens
tctgggttctgggtg

SEQ ID NO: 3731993 - DNA, 20 bp, Homo sapiens
tctggtagacacaggataga

SEQ ID NO: 3731994 - DNA, 20 bp, Homo sapiens
tctggtaggaatagcatgtc

SEQ ID NO: 3731995 - DNA, 17 bp, Homo sapiens
tctggttagctcagccc

SEQ ID NO: 3731996 - DNA, 19 bp, Homo sapiens
tctgtacatactttttcaa

SEQ ID NO: 3731997 - DNA, 21 bp, Homo sapiens
tctgtacatactttttcaaga

SEQ ID NO: 3731998 - DNA, 16 bp, Homo sapiens
tctgtaccatttattt

SEQ ID NO: 3731999 - DNA, 18 bp, Homo sapiens
tctgtacgtctgacaggc

SEQ ID NO: 3732000 - DNA, 16 bp, Homo sapiens
tctgtagagcagggca

SEQ ID NO: 3732001 - DNA, 14 bp, Homo sapiens
tctgtatactgtgg

SEQ ID NO: 3732002 - DNA, 15 bp, Homo sapiens
tctgtatatacaata

SEQ ID NO: 3732003 - DNA, 19 bp, Homo sapiens
tctgtatcggagacagtga

SEQ ID NO: 3732004 - DNA, 21 bp, Homo sapiens
tctgtatcggagacagtgatc

SEQ ID NO: 3732005 - DNA, 16 bp, Homo sapiens
tctgtccaaaggaggc

SEQ ID NO: 3732006 - DNA, 13 bp, Homo sapiens
tctgtccagggcc

SEQ ID NO: 3732007 - DNA, 19 bp, Homo sapiens
tctgtccgagctttgaaaa

SEQ ID NO: 3732008 - DNA, 14 bp, Homo sapiens
tctgtcctactctg

SEQ ID NO: 3732009 - DNA, 21 bp, Homo sapiens
tctgtcctgggagtgagctgg

SEQ ID NO: 3732010 - DNA, 21 bp, Homo sapiens
tctgtccttttggcactgaga

SEQ ID NO: 3732011 - DNA, 16 bp, Homo sapiens
tctgtctaccatctcc

SEQ ID NO: 3732012 - DNA, 18 bp, Homo sapiens
tctgtctaccatctccct

SEQ ID NO: 3732013 - DNA, 13 bp, Homo sapiens
tctgtgcaataaa

SEQ ID NO: 3732014 - DNA, 18 bp, Homo sapiens
tctgtgcaataaaataac

SEQ ID NO: 3732015 - DNA, 12 bp, Homo sapiens
tctgtgcccagc

SEQ ID NO: 3732016 - DNA, 14 bp, Homo sapiens
tctgtgcccagctc

SEQ ID NO: 3732017 - DNA, 14 bp, Homo sapiens
tctgtgcctggagc

SEQ ID NO: 3732018 - DNA, 15 bp, Homo sapiens
tctgtgcctggagct

SEQ ID NO: 3732019 - DNA, 20 bp, Homo sapiens
tctgtgtatttaattgtaaa

SEQ ID NO: 3732020 - DNA, 22 bp, Homo sapiens
tctgtgtgcaagtgtgtgcaca

SEQ ID NO: 3732021 - DNA, 20 bp, Homo sapiens
tctgtgtgggactgtacaca

SEQ ID NO: 3732022 - DNA, 21 bp, Homo sapiens
tctgtgtgggactgtacacac

SEQ ID NO: 3732023 - DNA, 15 bp, Homo sapiens
tctgtgtttttgaaa

SEQ ID NO: 3732024 - DNA, 19 bp, Homo sapiens
tctgttcacttttcctccc

SEQ ID NO: 3732025 - DNA, 21 bp, Homo sapiens
tctgttcacttttcctccctc

SEQ ID NO: 3732026 - DNA, 22 bp, Homo sapiens
tctgttcctggctcagcctcaa

SEQ ID NO: 3732027 - DNA, 23 bp, Homo sapiens
tctgttcctggctcagcctcaaa

SEQ ID NO: 3732028 - DNA, 13 bp, Homo sapiens
tctgttccttcac

SEQ ID NO: 3732029 - DNA, 17 bp, Homo sapiens
tctgttggccagtgtga

SEQ ID NO: 3732030 - DNA, 18 bp, Homo sapiens
tctgttggccagtgtgac

SEQ ID NO: 3732031 - DNA, 13 bp, Homo sapiens
tctgtttctagtt

SEQ ID NO: 3732032 - DNA, 21 bp, Homo sapiens
tctgtttgttaaaactggcat

SEQ ID NO: 3732033 - DNA, 16 bp, Homo sapiens
tctgttttgcctgaag

SEQ ID NO: 3732034 - DNA, 20 bp, Homo sapiens
tcttaaaacattatgagttt

SEQ ID NO: 3732035 - DNA, 13 bp, Homo sapiens
tcttaaaactcct

SEQ ID NO: 3732036 - DNA, 19 bp, Homo sapiens
tcttaaaatatatttcaga

SEQ ID NO: 3732037 - DNA, 20 bp, Homo sapiens
tcttaaaatatatttcagat

SEQ ID NO: 3732038 - DNA, 15 bp, Homo sapiens
tcttaacttctcccc

SEQ ID NO: 3732039 - DNA, 13 bp, Homo sapiens
tcttaattaagta

SEQ ID NO: 3732040 - DNA, 19 bp, Homo sapiens
tcttaattaagtaaactaa

SEQ ID NO: 3732041 - DNA, 21 bp, Homo sapiens
tcttaattaagtaaactaatg

SEQ ID NO: 3732042 - DNA, 16 bp, Homo sapiens
tcttacccttctgtgc

SEQ ID NO: 3732043 - DNA, 17 bp, Homo sapiens
tcttactattaagcagt

SEQ ID NO: 3732044 - DNA, 23 bp, Homo sapiens
tcttactgaaggtaaaattgaaa

SEQ ID NO: 3732045 - DNA, 20 bp, Homo sapiens
tctttcaagtgaatctaaaa

SEQ ID NO: 3732046 - DNA, 21 bp, Homo sapiens
tctttcaagtgaatctaaaag

SEQ ID NO: 3732047 - DNA, 20 bp, Homo sapiens
tctttcacacttccaccagc

SEQ ID NO: 3732048 - DNA, 10 bp, Homo sapiens
tctttcacat

SEQ ID NO: 3732049 - DNA, 20 bp, Homo sapiens
tctttcacccacagaaagag

SEQ ID NO: 3732050 - DNA, 12 bp, Homo sapiens
tctttccttcct

SEQ ID NO: 3732051 - DNA, 14 bp, Homo sapiens
tctttccttcctct

SEQ ID NO: 3732052 - DNA, 13 bp, Homo sapiens
tctttctgctttg

SEQ ID NO: 3732053 - DNA, 16 bp, Homo sapiens
tctttctggcctgcct

SEQ ID NO: 3732054 - DNA, 15 bp, Homo sapiens
tctttcttcctctgc

SEQ ID NO: 3732055 - DNA, 17 bp, Homo sapiens
tctttcttcctctgctg

SEQ ID NO: 3732056 - DNA, 21 bp, Homo sapiens
tctttctttggtgcctttcct

SEQ ID NO: 3732057 - DNA, 22 bp, Homo sapiens
tctttgaaagaaggaagacttt

SEQ ID NO: 3732058 - DNA, 22 bp, Homo sapiens
tctttgaaatagtctgtgtgaa

SEQ ID NO: 3732059 - DNA, 16 bp, Homo sapiens
tctttgcttgaacaca

SEQ ID NO: 3732060 - DNA, 18 bp, Homo sapiens
tctttggtcctcttgcca

SEQ ID NO: 3732061 - DNA, 13 bp, Homo sapiens
tctttggtgcctt

SEQ ID NO: 3732062 - DNA, 20 bp, Homo sapiens
tctttggtgcctttcctgtt

SEQ ID NO: 3732063 - DNA, 23 bp, Homo sapiens
tctttggtgcctttcctgttcag

SEQ ID NO: 3732064 - DNA, 18 bp, Homo sapiens
tctttgtgtagctttgct

SEQ ID NO: 3732065 - DNA, 18 bp, Homo sapiens
tctttgttggaaaagaat

SEQ ID NO: 3732066 - DNA, 14 bp, Homo sapiens
tcttttacattctg

SEQ ID NO: 3732067 - DNA, 18 bp, Homo sapiens
tcttttagtcattttgct

SEQ ID NO: 3732068 - DNA, 22 bp, Homo sapiens
tcttttataaaaaaaatgaaat

SEQ ID NO: 3732069 - DNA, 22 bp, Homo sapiens
tcttttataactagtcctttac

SEQ ID NO: 3732070 - DNA, 16 bp, Homo sapiens
tcttttctacagcaaa

SEQ ID NO: 3732071 - DNA, 23 bp, Homo sapiens
tcttttctgcatcatctgtagat

SEQ ID NO: 3732072 - DNA, 19 bp, Homo sapiens
tcttttctggaatgtaatc

SEQ ID NO: 3732073 - DNA, 12 bp, Homo sapiens
tctttttcagtt

SEQ ID NO: 3732074 - DNA, 14 bp, Homo sapiens
tctttttctggact

SEQ ID NO: 3732075 - DNA, 22 bp, Homo sapiens
tcttttttaaattttcttcagt

SEQ ID NO: 3732076 - DNA, 16 bp, Homo sapiens
tgaaaaaaaagtttca

SEQ ID NO: 3732077 - DNA, 21 bp, Homo sapiens
tgaaaaaagaaattccctgga

SEQ ID NO: 3732078 - DNA, 19 bp, Homo sapiens
tgaaaaaagcttttatgag

SEQ ID NO: 3732079 - DNA, 12 bp, Homo sapiens
tgaaaaacttcc

SEQ ID NO: 3732080 - DNA, 13 bp, Homo sapiens
tgaaaaagcagac

SEQ ID NO: 3732081 - DNA, 21 bp, Homo sapiens
tgaaaaagcagctaccaggtg

SEQ ID NO: 3732082 - DNA, 16 bp, Homo sapiens
tgaaaaaggaggaaga

SEQ ID NO: 3732083 - DNA, 22 bp, Homo sapiens
tgaaaaaggaggaagagaaaaa

SEQ ID NO: 3732084 - DNA, 19 bp, Homo sapiens
tgaaaaatttaagcattgt

SEQ ID NO: 3732085 - DNA, 18 bp, Homo sapiens
tgaaaacagaaaacggtt

SEQ ID NO: 3732086 - DNA, 14 bp, Homo sapiens
tgaaaacataaaaa

SEQ ID NO: 3732087 - DNA, 14 bp, Homo sapiens
tgaaaacccagaga

SEQ ID NO: 3732088 - DNA, 15 bp, Homo sapiens
tgaaaacccagagag

SEQ ID NO: 3732089 - DNA, 18 bp, Homo sapiens
tgaaaacgttttattgtg

SEQ ID NO: 3732090 - DNA, 17 bp, Homo sapiens
tgaaaactacattttaa

SEQ ID NO: 3732091 - DNA, 15 bp, Homo sapiens
tgaaaagaaaaatga

SEQ ID NO: 3732092 - DNA, 18 bp, Homo sapiens
tgaaaagatggtatcata

SEQ ID NO: 3732093 - DNA, 15 bp, Homo sapiens
tgaaaagccatgttt

SEQ ID NO: 3732094 - DNA, 17 bp, Homo sapiens
tgaaaagccatgtttaa

SEQ ID NO: 3732095 - DNA, 18 bp, Homo sapiens
tgaaaataggtatacagt

SEQ ID NO: 3732096 - DNA, 19 bp, Homo sapiens
tgaaaatattatctttgta

SEQ ID NO: 3732097 - DNA, 13 bp, Homo sapiens
tgaaaatcctacc

SEQ ID NO: 3732098 - DNA, 19 bp, Homo sapiens
tgaaaatcgtgacaacact

SEQ ID NO: 3732099 - DNA, 23 bp, Homo sapiens
tgaaaatgcaacaacatgtataa

SEQ ID NO: 3732100 - DNA, 18 bp, Homo sapiens
tgaaaatgtcagaaacca

SEQ ID NO: 3732101 - DNA, 18 bp, Homo sapiens
tgaaaattaacactgctt

SEQ ID NO: 3732102 - DNA, 18 bp, Homo sapiens
tgaaaattccagaaagga

SEQ ID NO: 3732103 - DNA, 17 bp, Homo sapiens
tgaaacaagaagccaca

SEQ ID NO: 3732104 - DNA, 19 bp, Homo sapiens
tgaaacacaccaggctgtg

SEQ ID NO: 3732105 - DNA, 21 bp, Homo sapiens
tgaaagaaaggggcaggagct

SEQ ID NO: 3732106 - DNA, 12 bp, Homo sapiens
tgaaagaaatca

SEQ ID NO: 3732107 - DNA, 18 bp, Homo sapiens
tgaaagaaatcatgttat

SEQ ID NO: 3732108 - DNA, 22 bp, Homo sapiens
tgaaagaaatcatgttatgata

SEQ ID NO: 3732109 - DNA, 13 bp, Homo sapiens
tgaaagaagaaaa

SEQ ID NO: 3732110 - DNA, 19 bp, Homo sapiens
tgaaagaccttctccaaat

SEQ ID NO: 3732111 - DNA, 19 bp, Homo sapiens
tgaaagactgtacaaagta

SEQ ID NO: 3732112 - DNA, 19 bp, Homo sapiens
tgaaagagttaagaatgtc

SEQ ID NO: 3732113 - DNA, 23 bp, Homo sapiens
tgaaagccagctgccgaccagag

SEQ ID NO: 3732114 - DNA, 13 bp, Homo sapiens
tgaaagctagaga

SEQ ID NO: 3732115 - DNA, 18 bp, Homo sapiens
tgaaagctgattactgtc

SEQ ID NO: 3732116 - DNA, 22 bp, Homo sapiens
tgaaagctgattactgtcaata

SEQ ID NO: 3732117 - DNA, 11 bp, Homo sapiens
tgaaagctgtg

SEQ ID NO: 3732118 - DNA, 17 bp, Homo sapiens
tgaaaggcattctctga

SEQ ID NO: 3732119 - DNA, 13 bp, Homo sapiens
tgaaagggcccag

SEQ ID NO: 3732120 - DNA, 15 bp, Homo sapiens
tgaaagggcccagag

SEQ ID NO: 3732121 - DNA, 19 bp, Homo sapiens
tgaaaggttaccctgtaac

SEQ ID NO: 3732122 - DNA, 18 bp, Homo sapiens
tgaaagtcagatgcccag

SEQ ID NO: 3732123 - DNA, 17 bp, Homo sapiens
tgaaagtcttgtgacta

SEQ ID NO: 3732124 - DNA, 22 bp, Homo sapiens
tgaaagtcttgtgactagtgct

SEQ ID NO: 3732125 - DNA, 18 bp, Homo sapiens
tgaaagttttcagaacct

SEQ ID NO: 3732126 - DNA, 13 bp, Homo sapiens
tgaaataagagaa

SEQ ID NO: 3732127 - DNA, 21 bp, Homo sapiens
tgaaataccaacctgaagaca

SEQ ID NO: 3732128 - DNA, 12 bp, Homo sapiens
tgaaatatgcat

SEQ ID NO: 3732129 - DNA, 14 bp, Homo sapiens
tgaaatcctgcttc

SEQ ID NO: 3732130 - DNA, 16 bp, Homo sapiens
tgaaatctgtgcaata

SEQ ID NO: 3732131 - DNA, 19 bp, Homo sapiens
tgaaatctgtgcaataaaa

SEQ ID NO: 3732132 - DNA, 19 bp, Homo sapiens
tgaaatgaaaacatgtaat

SEQ ID NO: 3732133 - DNA, 20 bp, Homo sapiens
tgaaatgaggtcagagcctg

SEQ ID NO: 3732134 - DNA, 14 bp, Homo sapiens
tgaaatgccttact

SEQ ID NO: 3732135 - DNA, 23 bp, Homo sapiens
tgaaatgccttactttgtatgat

SEQ ID NO: 3732136 - DNA, 16 bp, Homo sapiens
tgaaatgctggcattt

SEQ ID NO: 3732137 - DNA, 18 bp, Homo sapiens
tgaaatgttttaaggctt

SEQ ID NO: 3732138 - DNA, 23 bp, Homo sapiens
tgaaattagggcccaattaataa

SEQ ID NO: 3732139 - DNA, 22 bp, Homo sapiens
tgaaattgtctagcagagcagg

SEQ ID NO: 3732140 - DNA, 13 bp, Homo sapiens
tgaaattttacca

SEQ ID NO: 3732141 - DNA, 14 bp, Homo sapiens
tgaaattttaccaa

SEQ ID NO: 3732142 - DNA, 15 bp, Homo sapiens
tgaaatttttattaa

SEQ ID NO: 3732143 - DNA, 18 bp, Homo sapiens
tgaacaaaaaataaaaat

SEQ ID NO: 3732144 - DNA, 22 bp, Homo sapiens
tgaacaacctcggctcctggac

SEQ ID NO: 3732145 - DNA, 16 bp, Homo sapiens
tgaacaagtgaacaca

SEQ ID NO: 3732146 - DNA, 19 bp, Homo sapiens
tgaacacatcagctagcaa

SEQ ID NO: 3732147 - DNA, 16 bp, Homo sapiens
tgaacacgaagcttag

SEQ ID NO: 3732148 - DNA, 18 bp, Homo sapiens
tgaacactggcaacaaca

SEQ ID NO: 3732149 - DNA, 14 bp, Homo sapiens
tgaacactggggga

SEQ ID NO: 3732150 - DNA, 18 bp, Homo sapiens
tgaacacttattgctttg

SEQ ID NO: 3732151 - DNA, 19 bp, Homo sapiens
tgaaccacatcttgctctg

SEQ ID NO: 3732152 - DNA, 17 bp, Homo sapiens
tgaaccaccacacccag

SEQ ID NO: 3732153 - DNA, 12 bp, Homo sapiens
tgaacccaggag

SEQ ID NO: 3732154 - DNA, 19 bp, Homo sapiens
tgaacccaggaggtggagg

SEQ ID NO: 3732155 - DNA, 12 bp, Homo sapiens
tgaacctgccct

SEQ ID NO: 3732156 - DNA, 13 bp, Homo sapiens
tgaacggggagaa

SEQ ID NO: 3732157 - DNA, 15 bp, Homo sapiens
tgaacggggagaaaa

SEQ ID NO: 3732158 - DNA, 12 bp, Homo sapiens
tgacaccagcct

SEQ ID NO: 3732159 - DNA, 14 bp, Homo sapiens
tgacactgaaatgc

SEQ ID NO: 3732160 - DNA, 22 bp, Homo sapiens
tgacactgaaatgccttacttt

SEQ ID NO: 3732161 - DNA, 13 bp, Homo sapiens
tgacactgagaac

SEQ ID NO: 3732162 - DNA, 17 bp, Homo sapiens
tgacacttcagagagct

SEQ ID NO: 3732163 - DNA, 19 bp, Homo sapiens
tgacacttcagagagctgg

SEQ ID NO: 3732164 - DNA, 13 bp, Homo sapiens
tgacagaacactg

SEQ ID NO: 3732165 - DNA, 13 bp, Homo sapiens
tgacagacacagg

SEQ ID NO: 3732166 - DNA, 14 bp, Homo sapiens
tgacagacacaggc

SEQ ID NO: 3732167 - DNA, 18 bp, Homo sapiens
tgacagacacaggcccgg

SEQ ID NO: 3732168 - DNA, 18 bp, Homo sapiens
tgacagagcaagactctg

SEQ ID NO: 3732169 - DNA, 16 bp, Homo sapiens
tgacagaggcagcccc

SEQ ID NO: 3732170 - DNA, 17 bp, Homo sapiens
tgacagaggcagcccca

SEQ ID NO: 3732171 - DNA, 14 bp, Homo sapiens
tgacagagtgagac

SEQ ID NO: 3732172 - DNA, 17 bp, Homo sapiens
tgacagcctcccacccc

SEQ ID NO: 3732173 - DNA, 17 bp, Homo sapiens
tgacagctgtccctgtc

SEQ ID NO: 3732174 - DNA, 21 bp, Homo sapiens
tgacagctgtccctgtcacca

SEQ ID NO: 3732175 - DNA, 16 bp, Homo sapiens
tgacagctgtgctgta

SEQ ID NO: 3732176 - DNA, 16 bp, Homo sapiens
tgacagggcacaccgg

SEQ ID NO: 3732177 - DNA, 21 bp, Homo sapiens
tgacagtaacttggttataca

SEQ ID NO: 3732178 - DNA, 14 bp, Homo sapiens
tgacagtgcctggg

SEQ ID NO: 3732179 - DNA, 17 bp, Homo sapiens
tgacagtgcctgggaat

SEQ ID NO: 3732180 - DNA, 20 bp, Homo sapiens
tgacagtgcctgggaatgta

SEQ ID NO: 3732181 - DNA, 12 bp, Homo sapiens
tgacagtttaac

SEQ ID NO: 3732182 - DNA, 21 bp, Homo sapiens
tgacataacactataaaggtt

SEQ ID NO: 3732183 - DNA, 13 bp, Homo sapiens
tgacatcacttgt

SEQ ID NO: 3732184 - DNA, 17 bp, Homo sapiens
tgacatcacttgtacaa

SEQ ID NO: 3732185 - DNA, 18 bp, Homo sapiens
tgacatcacttgtacaaa

SEQ ID NO: 3732186 - DNA, 17 bp, Homo sapiens
tgacatcttagtatttg

SEQ ID NO: 3732187 - DNA, 18 bp, Homo sapiens
tgacatgcgggctgggca

SEQ ID NO: 3732188 - DNA, 20 bp, Homo sapiens
tgacatgcgggctgggcagc

SEQ ID NO: 3732189 - DNA, 21 bp, Homo sapiens
tgacatgcgggctgggcagct

SEQ ID NO: 3732190 - DNA, 22 bp, Homo sapiens
tgacatgtggaaagtgaatttg

SEQ ID NO: 3732191 - DNA, 19 bp, Homo sapiens
tgacattaacagttttcca

SEQ ID NO: 3732192 - DNA, 22 bp, Homo sapiens
tgacattgtagagcttctggca

SEQ ID NO: 3732193 - DNA, 16 bp, Homo sapiens
tgaccaacatggagaa

SEQ ID NO: 3732194 - DNA, 20 bp, Homo sapiens
tgaccaacatggagaaaccc

SEQ ID NO: 3732195 - DNA, 19 bp, Homo sapiens
tgaccaagaactgcatgga

SEQ ID NO: 3732196 - DNA, 15 bp, Homo sapiens
tgaccaagagagaaa

SEQ ID NO: 3732197 - DNA, 21 bp, Homo sapiens
tgaccaagcaggaagctcaga

SEQ ID NO: 3732198 - DNA, 13 bp, Homo sapiens
tgaccaagttata

SEQ ID NO: 3732199 - DNA, 20 bp, Homo sapiens
tgaccaagttataaatcaat

SEQ ID NO: 3732200 - DNA, 23 bp, Homo sapiens
tgaccaatattatactaagaaaa

SEQ ID NO: 3732201 - DNA, 15 bp, Homo sapiens
tgaccacacttcctg

SEQ ID NO: 3732202 - DNA, 19 bp, Homo sapiens
tgaccagcaacttgtcttt

SEQ ID NO: 3732203 - DNA, 18 bp, Homo sapiens
tgaccagcactgtctcag

SEQ ID NO: 3732204 - DNA, 21 bp, Homo sapiens
tgaccagcctccatgctgcct

SEQ ID NO: 3732205 - DNA, 23 bp, Homo sapiens
tgaccatttataatgttagtaga

SEQ ID NO: 3732206 - DNA, 15 bp, Homo sapiens
tgacccacagcctct

SEQ ID NO: 3732207 - DNA, 20 bp, Homo sapiens
tgacccacagcctctgcctg

SEQ ID NO: 3732208 - DNA, 12 bp, Homo sapiens
tgacccactgct

SEQ ID NO: 3732209 - DNA, 13 bp, Homo sapiens
tgacccactgctt

SEQ ID NO: 3732210 - DNA, 20 bp, Homo sapiens
tgacccagtccctgggggaa

SEQ ID NO: 3732211 - DNA, 18 bp, Homo sapiens
tgaccctagctctttcct

SEQ ID NO: 3732212 - DNA, 15 bp, Homo sapiens
tgaccctctccaccc

SEQ ID NO: 3732213 - DNA, 16 bp, Homo sapiens
tgaccctgcagagatg

SEQ ID NO: 3732214 - DNA, 20 bp, Homo sapiens
tgaccctgcgaaggggccct

SEQ ID NO: 3732215 - DNA, 22 bp, Homo sapiens
tgacctcaggtgatccacccac

SEQ ID NO: 3732216 - DNA, 13 bp, Homo sapiens
tgacctccccctc

SEQ ID NO: 3732217 - DNA, 17 bp, Homo sapiens
tgacctccccctccttc

SEQ ID NO: 3732218 - DNA, 19 bp, Homo sapiens
tgacctccccctccttccc

SEQ ID NO: 3732219 - DNA, 14 bp, Homo sapiens
tgacctccctctaa

SEQ ID NO: 3732220 - DNA, 13 bp, Homo sapiens
tgacctctgcctg

SEQ ID NO: 3732221 - DNA, 16 bp, Homo sapiens
tgacctgccaggcaca

SEQ ID NO: 3732222 - DNA, 19 bp, Homo sapiens
tgacctgccccgcccagct

SEQ ID NO: 3732223 - DNA, 18 bp, Homo sapiens
tgacctgtgaccagcact

SEQ ID NO: 3732224 - DNA, 21 bp, Homo sapiens
tgacctgtggggatttctccc

SEQ ID NO: 3732225 - DNA, 23 bp, Homo sapiens
tgacctgtggggatttctcccag

SEQ ID NO: 3732226 - DNA, 18 bp, Homo sapiens
tgaccttgaactcctggg

SEQ ID NO: 3732227 - DNA, 14 bp, Homo sapiens
tgacggaagaacat

SEQ ID NO: 3732228 - DNA, 18 bp, Homo sapiens
tgacggcgcccccagtgt

SEQ ID NO: 3732229 - DNA, 20 bp, Homo sapiens
tgactacagacattaaataa

SEQ ID NO: 3732230 - DNA, 17 bp, Homo sapiens
tgactagaggcagggag

SEQ ID NO: 3732231 - DNA, 23 bp, Homo sapiens
tgactagggattcaggctgcttg

SEQ ID NO: 3732232 - DNA, 15 bp, Homo sapiens
tgactagtgctgaag

SEQ ID NO: 3732233 - DNA, 22 bp, Homo sapiens
tgactagtgctgaagcttatta

SEQ ID NO: 3732234 - DNA, 22 bp, Homo sapiens
tgactatcaaactgaagccaga

SEQ ID NO: 3732235 - DNA, 19 bp, Homo sapiens
tgactatttttcagaatct

SEQ ID NO: 3732236 - DNA, 23 bp, Homo sapiens
tgactcaacatgttactgaccag

SEQ ID NO: 3732237 - DNA, 13 bp, Homo sapiens
tgactctctgtga

SEQ ID NO: 3732238 - DNA, 19 bp, Homo sapiens
tgactcttggcacagcatg

SEQ ID NO: 3732239 - DNA, 19 bp, Homo sapiens
tgactgagcaagaccctgt

SEQ ID NO: 3732240 - DNA, 22 bp, Homo sapiens
tgactgagcaagaccctgtctc

SEQ ID NO: 3732241 - DNA, 20 bp, Homo sapiens
tgactgatgttaggctgggc

SEQ ID NO: 3732242 - DNA, 18 bp, Homo sapiens
tgactgcacgtggcttct

SEQ ID NO: 3732243 - DNA, 15 bp, Homo sapiens
tgactgccccaactc

SEQ ID NO: 3732244 - DNA, 17 bp, Homo sapiens
tgactgtatctgtgtag

SEQ ID NO: 3732245 - DNA, 14 bp, Homo sapiens
tgacttccacacct

SEQ ID NO: 3732246 - DNA, 23 bp, Homo sapiens
tgacttccccgcattccaggctc

SEQ ID NO: 3732247 - DNA, 20 bp, Homo sapiens
tgacttcgactgtgacctgt

SEQ ID NO: 3732248 - DNA, 23 bp, Homo sapiens
tgagaaaccttattgtacctctc

SEQ ID NO: 3732249 - DNA, 15 bp, Homo sapiens
tgagaaataaagttt

SEQ ID NO: 3732250 - DNA, 14 bp, Homo sapiens
tgagaagaatattg

SEQ ID NO: 3732251 - DNA, 22 bp, Homo sapiens
tgagaatagaaggaaactagct

SEQ ID NO: 3732252 - DNA, 23 bp, Homo sapiens
tgagaatagaaggaaactagctt

SEQ ID NO: 3732253 - DNA, 18 bp, Homo sapiens
tgagaatctatatttaac

SEQ ID NO: 3732254 - DNA, 12 bp, Homo sapiens
tgagaattaccc

SEQ ID NO: 3732255 - DNA, 22 bp, Homo sapiens
tgagaattcagctgcccccgct

SEQ ID NO: 3732256 - DNA, 16 bp, Homo sapiens
tgagacaaaaattatc

SEQ ID NO: 3732257 - DNA, 15 bp, Homo sapiens
tgagacccccacacc

SEQ ID NO: 3732258 - DNA, 16 bp, Homo sapiens
tgagacccccacacct

SEQ ID NO: 3732259 - DNA, 15 bp, Homo sapiens
tgagacccctgtctc

SEQ ID NO: 3732260 - DNA, 16 bp, Homo sapiens
tgagacccctgtctcc

SEQ ID NO: 3732261 - DNA, 13 bp, Homo sapiens
tgagacctcagcc

SEQ ID NO: 3732262 - DNA, 16 bp, Homo sapiens
tgagacctcagccatg

SEQ ID NO: 3732263 - DNA, 13 bp, Homo sapiens
tgagactctgtct

SEQ ID NO: 3732264 - DNA, 19 bp, Homo sapiens
tgagagaatggaaaacaga

SEQ ID NO: 3732265 - DNA, 19 bp, Homo sapiens
tgagagaattgtatcattt

SEQ ID NO: 3732266 - DNA, 17 bp, Homo sapiens
tgagagatctgctgtca

SEQ ID NO: 3732267 - DNA, 15 bp, Homo sapiens
tgagagcgaggctga

SEQ ID NO: 3732268 - DNA, 19 bp, Homo sapiens
tgagagcgaggctgagcct

SEQ ID NO: 3732269 - DNA, 20 bp, Homo sapiens
tgagaggcaatgattgttaa

SEQ ID NO: 3732270 - DNA, 22 bp, Homo sapiens
tgagagggcatgcgcacaaggc

SEQ ID NO: 3732271 - DNA, 22 bp, Homo sapiens
aaataaggatttttctcttatt

SEQ ID NO: 3732272 - DNA, 15 bp, Homo sapiens
aaataataataatgt

SEQ ID NO: 3732273 - DNA, 12 bp, Homo sapiens
aaataatatgca

SEQ ID NO: 3732274 - DNA, 14 bp, Homo sapiens
aaataatatgcatt

SEQ ID NO: 3732275 - DNA, 13 bp, Homo sapiens
aaataatgtcttg

SEQ ID NO: 3732276 - DNA, 16 bp, Homo sapiens
aaataatgtcttgtta

SEQ ID NO: 3732277 - DNA, 23 bp, Homo sapiens
aaataattttatgaactgcatgt

SEQ ID NO: 3732278 - DNA, 12 bp, Homo sapiens
aaatacaaacaa

SEQ ID NO: 3732279 - DNA, 16 bp, Homo sapiens
aaatacaagttctatt

SEQ ID NO: 3732280 - DNA, 16 bp, Homo sapiens
aaatacagtattctgt

SEQ ID NO: 3732281 - DNA, 14 bp, Homo sapiens
aaatacatgcatct

SEQ ID NO: 3732282 - DNA, 15 bp, Homo sapiens
aaatactctaattct

SEQ ID NO: 3732283 - DNA, 16 bp, Homo sapiens
aaatactctaattcta

SEQ ID NO: 3732284 - DNA, 19 bp, Homo sapiens
aaatactctaattctaacc

SEQ ID NO: 3732285 - DNA, 15 bp, Homo sapiens
aaatagcaacatgct

SEQ ID NO: 3732286 - DNA, 18 bp, Homo sapiens
aaatagcaacatgcttca

SEQ ID NO: 3732287 - DNA, 21 bp, Homo sapiens
aaatagccgggcatggtggcg

SEQ ID NO: 3732288 - DNA, 12 bp, Homo sapiens
aaatagctatat

SEQ ID NO: 3732289 - DNA, 16 bp, Homo sapiens
aaatagctatatccat

SEQ ID NO: 3732290 - DNA, 24 bp, Homo sapiens
aaatagctcaggtgtccctgcact

SEQ ID NO: 3732291 - DNA, 19 bp, Homo sapiens
aaatataattgttttttat

SEQ ID NO: 3732292 - DNA, 21 bp, Homo sapiens
aaatataattgttttttatct

SEQ ID NO: 3732293 - DNA, 15 bp, Homo sapiens
aaatatacacacagc

SEQ ID NO: 3732294 - DNA, 15 bp, Homo sapiens
aaatatatgtatgta

SEQ ID NO: 3732295 - DNA, 19 bp, Homo sapiens
aaatatatgtatgtaaaaa

SEQ ID NO: 3732296 - DNA, 20 bp, Homo sapiens
aaatatatgtatgtaaaaat

SEQ ID NO: 3732297 - DNA, 17 bp, Homo sapiens
aaatatattctctttgg

SEQ ID NO: 3732298 - DNA, 21 bp, Homo sapiens
aaatatatttaagataattat

SEQ ID NO: 3732299 - DNA, 18 bp, Homo sapiens
aaatatcagttactcagc

SEQ ID NO: 3732300 - DNA, 17 bp, Homo sapiens
aaatatcattcagcaac

SEQ ID NO: 3732301 - DNA, 21 bp, Homo sapiens
aaatatctgaaaatgtatgtg

SEQ ID NO: 3732302 - DNA, 19 bp, Homo sapiens
aaatatgatattgcatatg

SEQ ID NO: 3732303 - DNA, 12 bp, Homo sapiens
aaatatgcatct

SEQ ID NO: 3732304 - DNA, 16 bp, Homo sapiens
aaatatgttgatgaaa

SEQ ID NO: 3732305 - DNA, 15 bp, Homo sapiens
aaatattatctttgt

SEQ ID NO: 3732306 - DNA, 12 bp, Homo sapiens
aaatattatgca

SEQ ID NO: 3732307 - DNA, 17 bp, Homo sapiens
aaatatttacatatgaa

SEQ ID NO: 3732308 - DNA, 19 bp, Homo sapiens
aaatatttacatatgaaat

SEQ ID NO: 3732309 - DNA, 15 bp, Homo sapiens
aaatatttatgtaaa

SEQ ID NO: 3732310 - DNA, 13 bp, Homo sapiens
aaatatttatttt

SEQ ID NO: 3732311 - DNA, 20 bp, Homo sapiens
aaatcaagtttccaagcaaa

SEQ ID NO: 3732312 - DNA, 19 bp, Homo sapiens
aaatcaatgctataactat

SEQ ID NO: 3732313 - DNA, 13 bp, Homo sapiens
aaatcaatgtcac

SEQ ID NO: 3732314 - DNA, 16 bp, Homo sapiens
aaatcacttccatagt

SEQ ID NO: 3732315 - DNA, 20 bp, Homo sapiens
aaatcagaggagagacggtg

SEQ ID NO: 3732316 - DNA, 16 bp, Homo sapiens
aaatcagctgctacta

SEQ ID NO: 3732317 - DNA, 16 bp, Homo sapiens
aaatcataaactgtgt

SEQ ID NO: 3732318 - DNA, 16 bp, Homo sapiens
aaatcatgtacatttc

SEQ ID NO: 3732319 - DNA, 16 bp, Homo sapiens
aaatcatgttatgata

SEQ ID NO: 3732320 - DNA, 18 bp, Homo sapiens
aaatcatgttatgataaa

SEQ ID NO: 3732321 - DNA, 19 bp, Homo sapiens
aaatcctaccaacctctga

SEQ ID NO: 3732322 - DNA, 12 bp, Homo sapiens
aaatcctgttga

SEQ ID NO: 3732323 - DNA, 16 bp, Homo sapiens
aaatccttccatgaaa

SEQ ID NO: 3732324 - DNA, 13 bp, Homo sapiens
aaatccttctaat

SEQ ID NO: 3732325 - DNA, 18 bp, Homo sapiens
aaatccttctaatctgct

SEQ ID NO: 3732326 - DNA, 18 bp, Homo sapiens
aaatcctttttctttata

SEQ ID NO: 3732327 - DNA, 17 bp, Homo sapiens
aaatctcaccccatccc

SEQ ID NO: 3732328 - DNA, 22 bp, Homo sapiens
aaatctcagaattccttttcta

SEQ ID NO: 3732329 - DNA, 15 bp, Homo sapiens
aaatctcctattttt

SEQ ID NO: 3732330 - DNA, 17 bp, Homo sapiens
aaatctctctctgttgt

SEQ ID NO: 3732331 - DNA, 18 bp, Homo sapiens
aaatctgctttttaaaga

SEQ ID NO: 3732332 - DNA, 19 bp, Homo sapiens
aaatctgtaagctctttga

SEQ ID NO: 3732333 - DNA, 17 bp, Homo sapiens
aaatctgtgcaataaaa

SEQ ID NO: 3732334 - DNA, 19 bp, Homo sapiens
aaatcttatattccatata

SEQ ID NO: 3732335 - DNA, 21 bp, Homo sapiens
aaatcttatattccatatatt

SEQ ID NO: 3732336 - DNA, 18 bp, Homo sapiens
aaatgaaaacatgtaata

SEQ ID NO: 3732337 - DNA, 17 bp, Homo sapiens
aaatgaaaatcgtgaca

SEQ ID NO: 3732338 - DNA, 12 bp, Homo sapiens
aaatgaaagaaa

SEQ ID NO: 3732339 - DNA, 20 bp, Homo sapiens
aaatgaaagtataactgagt

SEQ ID NO: 3732340 - DNA, 21 bp, Homo sapiens
aaatgaaatgttttaaggctt

SEQ ID NO: 3732341 - DNA, 16 bp, Homo sapiens
aaatgaaattttacca

SEQ ID NO: 3732342 - DNA, 20 bp, Homo sapiens
aaatgaaattttaccaagtt

SEQ ID NO: 3732343 - DNA, 23 bp, Homo sapiens
aaatgaagattattttttatgag

SEQ ID NO: 3732344 - DNA, 21 bp, Homo sapiens
aaatgaagtaacttgtcttaa

SEQ ID NO: 3732345 - DNA, 11 bp, Homo sapiens
aaatgaagtgc

SEQ ID NO: 3732346 - DNA, 20 bp, Homo sapiens
aaatgaagtgcaaatttgat

SEQ ID NO: 3732347 - DNA, 15 bp, Homo sapiens
aaatgacaatgatga

SEQ ID NO: 3732348 - DNA, 14 bp, Homo sapiens
aaatgagaacatgt

SEQ ID NO: 3732349 - DNA, 23 bp, Homo sapiens
aaatgagaacatgttggtattta

SEQ ID NO: 3732350 - DNA, 13 bp, Homo sapiens
aaatgagaaggaa

SEQ ID NO: 3732351 - DNA, 23 bp, Homo sapiens
aaatgaggtactctcctggaaat

SEQ ID NO: 3732352 - DNA, 12 bp, Homo sapiens
aaatgagtgtgt

SEQ ID NO: 3732353 - DNA, 20 bp, Homo sapiens
aaatgatattaaaaattggc

SEQ ID NO: 3732354 - DNA, 15 bp, Homo sapiens
aaatgcaatatgtat

SEQ ID NO: 3732355 - DNA, 12 bp, Homo sapiens
aaatgcacaatg

SEQ ID NO: 3732356 - DNA, 15 bp, Homo sapiens
aaatgcacaatgtct

SEQ ID NO: 3732357 - DNA, 16 bp, Homo sapiens
aaatgcacaatgtctt

SEQ ID NO: 3732358 - DNA, 17 bp, Homo sapiens
aaatgcacaatgtcttg

SEQ ID NO: 3732359 - DNA, 18 bp, Homo sapiens
aaatgcacaatgtcttgg

SEQ ID NO: 3732360 - DNA, 23 bp, Homo sapiens
aaatgcagcgaaccaatatttgt

SEQ ID NO: 3732361 - DNA, 12 bp, Homo sapiens
aaatgcagtgaa

SEQ ID NO: 3732362 - DNA, 20 bp, Homo sapiens
aaatgcatatcctgagccat

SEQ ID NO: 3732363 - DNA, 21 bp, Homo sapiens
aaatgcatcaatcctgtgtgg

SEQ ID NO: 3732364 - DNA, 22 bp, Homo sapiens
aaatgcatccattcctcaggga

SEQ ID NO: 3732365 - DNA, 20 bp, Homo sapiens
aaatgcattataggatcatt

SEQ ID NO: 3732366 - DNA, 16 bp, Homo sapiens
aaatgcctaagaagat

SEQ ID NO: 3732367 - DNA, 15 bp, Homo sapiens
aaatgccttactttg

SEQ ID NO: 3732368 - DNA, 20 bp, Homo sapiens
aaatgctgcgcccttcccca

SEQ ID NO: 3732369 - DNA, 18 bp, Homo sapiens
aaatgctttatgcaaacc

SEQ ID NO: 3732370 - DNA, 13 bp, Homo sapiens
aaatggatactgg

SEQ ID NO: 3732371 - DNA, 23 bp, Homo sapiens
aaatggccatttgctttttcacc

SEQ ID NO: 3732372 - DNA, 19 bp, Homo sapiens
aaatgggtagagaaacact

SEQ ID NO: 3732373 - DNA, 18 bp, Homo sapiens
aaatggtaaaattgcatg

SEQ ID NO: 3732374 - DNA, 21 bp, Homo sapiens
aaatggtggttgtttcttcca

SEQ ID NO: 3732375 - DNA, 14 bp, Homo sapiens
aaatggtgtttttt

SEQ ID NO: 3732376 - DNA, 17 bp, Homo sapiens
aaatgtaacttttgtaa

SEQ ID NO: 3732377 - DNA, 12 bp, Homo sapiens
aaatgtacaaaa

SEQ ID NO: 3732378 - DNA, 16 bp, Homo sapiens
aaatgtacctgatgta

SEQ ID NO: 3732379 - DNA, 16 bp, Homo sapiens
aaatgtaggtatgaat

SEQ ID NO: 3732380 - DNA, 15 bp, Homo sapiens
aaatgtatacctgta

SEQ ID NO: 3732381 - DNA, 18 bp, Homo sapiens
aaatgtatacctgtaact

SEQ ID NO: 3732382 - DNA, 18 bp, Homo sapiens
aaatgtatgattacatca

SEQ ID NO: 3732383 - DNA, 14 bp, Homo sapiens
aaatgtattcaaat

SEQ ID NO: 3732384 - DNA, 20 bp, Homo sapiens
aagaattgaacccaggaggt

SEQ ID NO: 3732385 - DNA, 16 bp, Homo sapiens
aagaattgaagcagga

SEQ ID NO: 3732386 - DNA, 20 bp, Homo sapiens
aagaatttcttggtaagaag

SEQ ID NO: 3732387 - DNA, 15 bp, Homo sapiens
aagacaaaaatactc

SEQ ID NO: 3732388 - DNA, 16 bp, Homo sapiens
aagacaaaaatactct

SEQ ID NO: 3732389 - DNA, 21 bp, Homo sapiens
aagacaaaaatactctaattc

SEQ ID NO: 3732390 - DNA, 15 bp, Homo sapiens
aagacaacattaaaa

SEQ ID NO: 3732391 - DNA, 20 bp, Homo sapiens
aagacaatgtgaaaagaaaa

SEQ ID NO: 3732392 - DNA, 18 bp, Homo sapiens
aagacaccgttcattcag

SEQ ID NO: 3732393 - DNA, 16 bp, Homo sapiens
aagacagagacgcagg

SEQ ID NO: 3732394 - DNA, 15 bp, Homo sapiens
aagacatgaatatga

SEQ ID NO: 3732395 - DNA, 13 bp, Homo sapiens
aagacattgtcaa

SEQ ID NO: 3732396 - DNA, 14 bp, Homo sapiens
aagacattgtcaat

SEQ ID NO: 3732397 - DNA, 17 bp, Homo sapiens
aagaccacctcaaattt

SEQ ID NO: 3732398 - DNA, 12 bp, Homo sapiens
aagaccagcctg

SEQ ID NO: 3732399 - DNA, 14 bp, Homo sapiens
aagaccagcctggc

SEQ ID NO: 3732400 - DNA, 13 bp, Homo sapiens
aagaccctccccg

SEQ ID NO: 3732401 - DNA, 13 bp, Homo sapiens
aagaccctgtctc

SEQ ID NO: 3732402 - DNA, 17 bp, Homo sapiens
aagacccttttgggttt

SEQ ID NO: 3732403 - DNA, 16 bp, Homo sapiens
aagactatctaaatgt

SEQ ID NO: 3732404 - DNA, 17 bp, Homo sapiens
aagactcattcttctgt

SEQ ID NO: 3732405 - DNA, 14 bp, Homo sapiens
aagacttcccagct

SEQ ID NO: 3732406 - DNA, 21 bp, Homo sapiens
aagactttccccatactctgt

SEQ ID NO: 3732407 - DNA, 17 bp, Homo sapiens
aagagaaaatgtaaata

SEQ ID NO: 3732408 - DNA, 22 bp, Homo sapiens
aagagaaatacaagatactttt

SEQ ID NO: 3732409 - DNA, 18 bp, Homo sapiens
aagagaagctactttgtt

SEQ ID NO: 3732410 - DNA, 14 bp, Homo sapiens
aagagaatgttata

SEQ ID NO: 3732411 - DNA, 14 bp, Homo sapiens
aagagagaaagaag

SEQ ID NO: 3732412 - DNA, 16 bp, Homo sapiens
aagagagccttggttc

SEQ ID NO: 3732413 - DNA, 16 bp, Homo sapiens
aagagattgtggtttc

SEQ ID NO: 3732414 - DNA, 15 bp, Homo sapiens
aagagcaagtctgga

SEQ ID NO: 3732415 - DNA, 14 bp, Homo sapiens
aagagcagcctgtg

SEQ ID NO: 3732416 - DNA, 16 bp, Homo sapiens
aagagcagcctgtggc

SEQ ID NO: 3732417 - DNA, 9 bp, Homo sapiens
aagagccat

SEQ ID NO: 3732418 - DNA, 19 bp, Homo sapiens
aagagctagcgctgccgca

SEQ ID NO: 3732419 - DNA, 20 bp, Homo sapiens
aagagctagcgctgccgcac

SEQ ID NO: 3732420 - DNA, 14 bp, Homo sapiens
aagagctatacagt

SEQ ID NO: 3732421 - DNA, 11 bp, Homo sapiens
aagagctgagg

SEQ ID NO: 3732422 - DNA, 11 bp, Homo sapiens
aagaggcaggg

SEQ ID NO: 3732423 - DNA, 18 bp, Homo sapiens
aagaggctgaaagaggcc

SEQ ID NO: 3732424 - DNA, 19 bp, Homo sapiens
aagaggttctcgactggag

SEQ ID NO: 3732425 - DNA, 18 bp, Homo sapiens
aagaggttttaaaaaaat

SEQ ID NO: 3732426 - DNA, 23 bp, Homo sapiens
aagagtgtcctaggagtatcctc

SEQ ID NO: 3732427 - DNA, 21 bp, Homo sapiens
aagataacaagatctttcagg

SEQ ID NO: 3732428 - DNA, 13 bp, Homo sapiens
aagatacatcaca

SEQ ID NO: 3732429 - DNA, 15 bp, Homo sapiens
aagataccatcagca

SEQ ID NO: 3732430 - DNA, 17 bp, Homo sapiens
aagataccatcagcaaa

SEQ ID NO: 3732431 - DNA, 22 bp, Homo sapiens
aagatacttggaccgagtagag

SEQ ID NO: 3732432 - DNA, 21 bp, Homo sapiens
aagatagaagaaaaaagaatg

SEQ ID NO: 3732433 - DNA, 16 bp, Homo sapiens
aagataggctctgcac

SEQ ID NO: 3732434 - DNA, 15 bp, Homo sapiens
aagatcactttgctc

SEQ ID NO: 3732435 - DNA, 14 bp, Homo sapiens
aagatcgttagtat

SEQ ID NO: 3732436 - DNA, 17 bp, Homo sapiens
aagatgcttctcactgc

SEQ ID NO: 3732437 - DNA, 17 bp, Homo sapiens
aagatggattctcagat

SEQ ID NO: 3732438 - DNA, 17 bp, Homo sapiens
aagatggctgactttgc

SEQ ID NO: 3732439 - DNA, 16 bp, Homo sapiens
aagatggctgtgcctc

SEQ ID NO: 3732440 - DNA, 18 bp, Homo sapiens
aagatggtatcatatatt

SEQ ID NO: 3732441 - DNA, 17 bp, Homo sapiens
aagatgtgtcttcaatt

SEQ ID NO: 3732442 - DNA, 15 bp, Homo sapiens
aagatgttgtgtctt

SEQ ID NO: 3732443 - DNA, 18 bp, Homo sapiens
aagatgttgtgtcttgtg

SEQ ID NO: 3732444 - DNA, 11 bp, Homo sapiens
aagatgtttgc

SEQ ID NO: 3732445 - DNA, 20 bp, Homo sapiens
aagattcatatttacttctt

SEQ ID NO: 3732446 - DNA, 13 bp, Homo sapiens
aagattcccagag

SEQ ID NO: 3732447 - DNA, 18 bp, Homo sapiens
aagattcccagagacagg

SEQ ID NO: 3732448 - DNA, 13 bp, Homo sapiens
aagattttaaatt

SEQ ID NO: 3732449 - DNA, 23 bp, Homo sapiens
aagattttgaaaactacatttta

SEQ ID NO: 3732450 - DNA, 20 bp, Homo sapiens
aagcaaaaacgaaagctggg

SEQ ID NO: 3732451 - DNA, 12 bp, Homo sapiens
aagcaaacacat

SEQ ID NO: 3732452 - DNA, 18 bp, Homo sapiens
aagcaaatgtgacctgtg

SEQ ID NO: 3732453 - DNA, 17 bp, Homo sapiens
aagcaagagagatgttt

SEQ ID NO: 3732454 - DNA, 15 bp, Homo sapiens
aagcaagatttcaga

SEQ ID NO: 3732455 - DNA, 16 bp, Homo sapiens
aagcaaggatctttca

SEQ ID NO: 3732456 - DNA, 13 bp, Homo sapiens
aagcaagtagctt

SEQ ID NO: 3732457 - DNA, 16 bp, Homo sapiens
aagcaataaatgaatg

SEQ ID NO: 3732458 - DNA, 18 bp, Homo sapiens
aagcaatcctcctgagtg

SEQ ID NO: 3732459 - DNA, 16 bp, Homo sapiens
aagcacatctgcattt

SEQ ID NO: 3732460 - DNA, 19 bp, Homo sapiens
aagcaccgcctccaaatgc

SEQ ID NO: 3732461 - DNA, 13 bp, Homo sapiens
aagcacctcctgc

SEQ ID NO: 3732462 - DNA, 12 bp, Homo sapiens
aagcactcgtgt

SEQ ID NO: 3732463 - DNA, 18 bp, Homo sapiens
aagcactttgggattctt

SEQ ID NO: 3732464 - DNA, 14 bp, Homo sapiens
aagcagaggaagga

SEQ ID NO: 3732465 - DNA, 21 bp, Homo sapiens
aagcagaggaaggagaggaga

SEQ ID NO: 3732466 - DNA, 13 bp, Homo sapiens
aagcagaggctgg

SEQ ID NO: 3732467 - DNA, 18 bp, Homo sapiens
aagcagaggctggcctca

SEQ ID NO: 3732468 - DNA, 20 bp, Homo sapiens
aagcagaggctggcctcaga

SEQ ID NO: 3732469 - DNA, 16 bp, Homo sapiens
aagcagatgcaaagag

SEQ ID NO: 3732470 - DNA, 18 bp, Homo sapiens
aagcagatgcaaagaggc

SEQ ID NO: 3732471 - DNA, 23 bp, Homo sapiens
aagcagatgcaaagaggcaagag

SEQ ID NO: 3732472 - DNA, 16 bp, Homo sapiens
aagcagcacttataaa

SEQ ID NO: 3732473 - DNA, 21 bp, Homo sapiens
aagcagccaagctccttggga

SEQ ID NO: 3732474 - DNA, 16 bp, Homo sapiens
aagcaggaagctcaga

SEQ ID NO: 3732475 - DNA, 16 bp, Homo sapiens
aagcaggtttttctcc

SEQ ID NO: 3732476 - DNA, 20 bp, Homo sapiens
aagcagtagaaataatatgc

SEQ ID NO: 3732477 - DNA, 17 bp, Homo sapiens
aagcatattgttattat

SEQ ID NO: 3732478 - DNA, 15 bp, Homo sapiens
aagcatcaaactctt

SEQ ID NO: 3732479 - DNA, 12 bp, Homo sapiens
aagcatccatgt

SEQ ID NO: 3732480 - DNA, 17 bp, Homo sapiens
aagcatctaaactttaa

SEQ ID NO: 3732481 - DNA, 16 bp, Homo sapiens
aagcatgtaggagaat

SEQ ID NO: 3732482 - DNA, 17 bp, Homo sapiens
aagcattactcttgtaa

SEQ ID NO: 3732483 - DNA, 20 bp, Homo sapiens
aagcattactcttgtaagat

SEQ ID NO: 3732484 - DNA, 21 bp, Homo sapiens
aagcattactcttgtaagatt

SEQ ID NO: 3732485 - DNA, 23 bp, Homo sapiens
aagcattcaatttattcaagaaa

SEQ ID NO: 3732486 - DNA, 14 bp, Homo sapiens
aagcattgtttgct

SEQ ID NO: 3732487 - DNA, 20 bp, Homo sapiens
aagcattgtttgcttattgt

SEQ ID NO: 3732488 - DNA, 16 bp, Homo sapiens
aagcatttactttgaa

SEQ ID NO: 3732489 - DNA, 14 bp, Homo sapiens
aagccaaactctgc

SEQ ID NO: 3732490 - DNA, 16 bp, Homo sapiens
aagccaaactctgcca

SEQ ID NO: 3732491 - DNA, 18 bp, Homo sapiens
aagccaaagctaggcctg

SEQ ID NO: 3732492 - DNA, 14 bp, Homo sapiens
aagccaagcagcca

SEQ ID NO: 3732493 - DNA, 16 bp, Homo sapiens
aagccaagcagccaag

SEQ ID NO: 3732494 - DNA, 17 bp, Homo sapiens
aagccaagcagccaagc

SEQ ID NO: 3732495 - DNA, 13 bp, Homo sapiens
aagccaagggcct

SEQ ID NO: 3732496 - DNA, 14 bp, Homo sapiens
aagccacagctggt

SEQ ID NO: 3732497 - DNA, 16 bp, Homo sapiens
aagccaccctcccagc

SEQ ID NO: 3732498 - DNA, 17 bp, Homo sapiens
aatgtatcttattcaca

SEQ ID NO: 3732499 - DNA, 16 bp, Homo sapiens
aatgtattattctgca

SEQ ID NO: 3732500 - DNA, 21 bp, Homo sapiens
aatgtattctatctctcttta

SEQ ID NO: 3732501 - DNA, 14 bp, Homo sapiens
aatgtatttttcct

SEQ ID NO: 3732502 - DNA, 14 bp, Homo sapiens
aatgtcacaggcag

SEQ ID NO: 3732503 - DNA, 18 bp, Homo sapiens
aatgtcaccaccttccca

SEQ ID NO: 3732504 - DNA, 13 bp, Homo sapiens
aatgtcagaaaaa

SEQ ID NO: 3732505 - DNA, 18 bp, Homo sapiens
aatgtcagaaaaacaata

SEQ ID NO: 3732506 - DNA, 16 bp, Homo sapiens
aatgtcagattccttt

SEQ ID NO: 3732507 - DNA, 17 bp, Homo sapiens
aatgtcctccagaagcc

SEQ ID NO: 3732508 - DNA, 23 bp, Homo sapiens
aatgtctgtagctcctcaactca

SEQ ID NO: 3732509 - DNA, 20 bp, Homo sapiens
aatgtcttgttaatattctt

SEQ ID NO: 3732510 - DNA, 21 bp, Homo sapiens
aatgtcttgttaatattcttt

SEQ ID NO: 3732511 - DNA, 18 bp, Homo sapiens
aatgtctttgttggaaaa

SEQ ID NO: 3732512 - DNA, 19 bp, Homo sapiens
aatgtgaactagctggaat

SEQ ID NO: 3732513 - DNA, 20 bp, Homo sapiens
aatgtgaactagctggaatt

SEQ ID NO: 3732514 - DNA, 23 bp, Homo sapiens
aatgtgaatcagaccctacccca

SEQ ID NO: 3732515 - DNA, 17 bp, Homo sapiens
aatgtggcagctgtctc

SEQ ID NO: 3732516 - DNA, 16 bp, Homo sapiens
aatgttacatagtgta

SEQ ID NO: 3732517 - DNA, 17 bp, Homo sapiens
aatgttacatagtgtag

SEQ ID NO: 3732518 - DNA, 19 bp, Homo sapiens
aatgttactgatcatgcat

SEQ ID NO: 3732519 - DNA, 20 bp, Homo sapiens
aatgttactgatcatgcatt

SEQ ID NO: 3732520 - DNA, 15 bp, Homo sapiens
aatgttagatagtta

SEQ ID NO: 3732521 - DNA, 20 bp, Homo sapiens
aatgttattttttaattatt

SEQ ID NO: 3732522 - DNA, 21 bp, Homo sapiens
aatgttattttttaattatta

SEQ ID NO: 3732523 - DNA, 12 bp, Homo sapiens
aatgttcattgt

SEQ ID NO: 3732524 - DNA, 12 bp, Homo sapiens
aatgttctgaca

SEQ ID NO: 3732525 - DNA, 15 bp, Homo sapiens
aatgttctgacatta

SEQ ID NO: 3732526 - DNA, 19 bp, Homo sapiens
aatgttctgacattaacag

SEQ ID NO: 3732527 - DNA, 17 bp, Homo sapiens
aatgttgtattcagtga

SEQ ID NO: 3732528 - DNA, 16 bp, Homo sapiens
aatgttgtggtttgtt

SEQ ID NO: 3732529 - DNA, 15 bp, Homo sapiens
aatgtttatgagcca

SEQ ID NO: 3732530 - DNA, 17 bp, Homo sapiens
aatgtttatgagccaga

SEQ ID NO: 3732531 - DNA, 21 bp, Homo sapiens
aatgtttatgcaaggaaggaa

SEQ ID NO: 3732532 - DNA, 23 bp, Homo sapiens
aatgtttatgcaaggaaggaaag

SEQ ID NO: 3732533 - DNA, 12 bp, Homo sapiens
aatgtttgctat

SEQ ID NO: 3732534 - DNA, 16 bp, Homo sapiens
aatgtttttaaatata

SEQ ID NO: 3732535 - DNA, 17 bp, Homo sapiens
aatgtttttaaatatat

SEQ ID NO: 3732536 - DNA, 15 bp, Homo sapiens
aatgtttttctgcca

SEQ ID NO: 3732537 - DNA, 21 bp, Homo sapiens
aatgtttttctgccagggagc

SEQ ID NO: 3732538 - DNA, 21 bp, Homo sapiens
aattaaaacaatgtcaaggtg

SEQ ID NO: 3732539 - DNA, 14 bp, Homo sapiens
aattaaacaattta

SEQ ID NO: 3732540 - DNA, 19 bp, Homo sapiens
aattaaacaatttatttta

SEQ ID NO: 3732541 - DNA, 12 bp, Homo sapiens
aattaaagaaaa

SEQ ID NO: 3732542 - DNA, 14 bp, Homo sapiens
aattaaatatatgt

SEQ ID NO: 3732543 - DNA, 16 bp, Homo sapiens
aattaaatatatgtat

SEQ ID NO: 3732544 - DNA, 19 bp, Homo sapiens
aattaaatatatgtatgta

SEQ ID NO: 3732545 - DNA, 23 bp, Homo sapiens
aattaaatatatgtatgtaaaaa

SEQ ID NO: 3732546 - DNA, 12 bp, Homo sapiens
aattaaatgtag

SEQ ID NO: 3732547 - DNA, 14 bp, Homo sapiens
aattaaattaggaa

SEQ ID NO: 3732548 - DNA, 14 bp, Homo sapiens
aattaacatataat

SEQ ID NO: 3732549 - DNA, 14 bp, Homo sapiens
aattaacctggtgc

SEQ ID NO: 3732550 - DNA, 21 bp, Homo sapiens
aattaaggcaactgaacaaaa

SEQ ID NO: 3732551 - DNA, 16 bp, Homo sapiens
aattaagtactatgta

SEQ ID NO: 3732552 - DNA, 13 bp, Homo sapiens
aattaatgacaga

SEQ ID NO: 3732553 - DNA, 14 bp, Homo sapiens
aattacacccaaag

SEQ ID NO: 3732554 - DNA, 17 bp, Homo sapiens
aattacagcttcaccct

SEQ ID NO: 3732555 - DNA, 22 bp, Homo sapiens
aattaccagtaaagtgtaacat

SEQ ID NO: 3732556 - DNA, 23 bp, Homo sapiens
aattaccagtaaagtgtaacata

SEQ ID NO: 3732557 - DNA, 15 bp, Homo sapiens
aattactacaaaatt

SEQ ID NO: 3732558 - DNA, 15 bp, Homo sapiens
aattagccaagtgtg

SEQ ID NO: 3732559 - DNA, 20 bp, Homo sapiens
aattaggaataaataaaaat

SEQ ID NO: 3732560 - DNA, 17 bp, Homo sapiens
aattaggggttgctaag

SEQ ID NO: 3732561 - DNA, 20 bp, Homo sapiens
aattaggggttgctaagaag

SEQ ID NO: 3732562 - DNA, 16 bp, Homo sapiens
aattaggttttgtaca

SEQ ID NO: 3732563 - DNA, 17 bp, Homo sapiens
aattagtatttatttaa

SEQ ID NO: 3732564 - DNA, 18 bp, Homo sapiens
aattagtatttatttaat

SEQ ID NO: 3732565 - DNA, 15 bp, Homo sapiens
aattataaggactgc

SEQ ID NO: 3732566 - DNA, 16 bp, Homo sapiens
aattataaggactgca

SEQ ID NO: 3732567 - DNA, 18 bp, Homo sapiens
aattataaggactgcatg

SEQ ID NO: 3732568 - DNA, 16 bp, Homo sapiens
aattataatatactat

SEQ ID NO: 3732569 - DNA, 15 bp, Homo sapiens
aattatcaagctaat

SEQ ID NO: 3732570 - DNA, 15 bp, Homo sapiens
aattatcggaagcag

SEQ ID NO: 3732571 - DNA, 16 bp, Homo sapiens
aattatctatttgtat

SEQ ID NO: 3732572 - DNA, 12 bp, Homo sapiens
aattatgacagt

SEQ ID NO: 3732573 - DNA, 13 bp, Homo sapiens
aattatgacagtt

SEQ ID NO: 3732574 - DNA, 15 bp, Homo sapiens
aattatgacagttat

SEQ ID NO: 3732575 - DNA, 15 bp, Homo sapiens
aattatgcatctgct

SEQ ID NO: 3732576 - DNA, 14 bp, Homo sapiens
aattatgttattga

SEQ ID NO: 3732577 - DNA, 13 bp, Homo sapiens
aattattattctt

SEQ ID NO: 3732578 - DNA, 11 bp, Homo sapiens
aattattattt

SEQ ID NO: 3732579 - DNA, 13 bp, Homo sapiens
aattattatttat

SEQ ID NO: 3732580 - DNA, 22 bp, Homo sapiens
aattattgtttatattttcaat

SEQ ID NO: 3732581 - DNA, 17 bp, Homo sapiens
aattatttcagaaatgt

SEQ ID NO: 3732582 - DNA, 22 bp, Homo sapiens
aattattttaaattataaggac

SEQ ID NO: 3732583 - DNA, 17 bp, Homo sapiens
aattatttttacagttc

SEQ ID NO: 3732584 - DNA, 14 bp, Homo sapiens
aattcaaaaatgta

SEQ ID NO: 3732585 - DNA, 14 bp, Homo sapiens
aattcaaccctttg

SEQ ID NO: 3732586 - DNA, 18 bp, Homo sapiens
aattcaaccctttgcccc

SEQ ID NO: 3732587 - DNA, 15 bp, Homo sapiens
aattcacaagctgcc

SEQ ID NO: 3732588 - DNA, 14 bp, Homo sapiens
aattcatgtttctt

SEQ ID NO: 3732589 - DNA, 13 bp, Homo sapiens
aattccactggac

SEQ ID NO: 3732590 - DNA, 14 bp, Homo sapiens
aattccactggact

SEQ ID NO: 3732591 - DNA, 22 bp, Homo sapiens
aattccactgtcaagaaagagc

SEQ ID NO: 3732592 - DNA, 10 bp, Homo sapiens
aattccctat

SEQ ID NO: 3732593 - DNA, 22 bp, Homo sapiens
aattccctatcttttagtttta

SEQ ID NO: 3732594 - DNA, 13 bp, Homo sapiens
aattccctggacc

SEQ ID NO: 3732595 - DNA, 14 bp, Homo sapiens
aattcctctgggaa

SEQ ID NO: 3732596 - DNA, 11 bp, Homo sapiens
aattcctgggc

SEQ ID NO: 3732597 - DNA, 15 bp, Homo sapiens
aattctcttatccaa

SEQ ID NO: 3732598 - DNA, 15 bp, Homo sapiens
aattctgctacctca

SEQ ID NO: 3732599 - DNA, 19 bp, Homo sapiens
aattctgctacctcactgg

SEQ ID NO: 3732600 - DNA, 18 bp, Homo sapiens
aattctgtttttctaggc

SEQ ID NO: 3732601 - DNA, 13 bp, Homo sapiens
aattcttacatgt

SEQ ID NO: 3732602 - DNA, 15 bp, Homo sapiens
aattcttacatgttt

SEQ ID NO: 3732603 - DNA, 14 bp, Homo sapiens
aattcttgtatatt

SEQ ID NO: 3732604 - DNA, 15 bp, Homo sapiens
aattcttgtatatta

SEQ ID NO: 3732605 - DNA, 21 bp, Homo sapiens
aattgaaaggcattctctgaa

SEQ ID NO: 3732606 - DNA, 22 bp, Homo sapiens
aattgaaaggcattctctgaag

SEQ ID NO: 3732607 - DNA, 12 bp, Homo sapiens
aattgaaatata

SEQ ID NO: 3732608 - DNA, 14 bp, Homo sapiens
aattgaaggaaaga

SEQ ID NO: 3732609 - DNA, 16 bp, Homo sapiens
aattgaaggaaagatt

SEQ ID NO: 3732610 - DNA, 13 bp, Homo sapiens
aattgaatttaac

SEQ ID NO: 3732611 - DNA, 16 bp, Homo sapiens
aattgaatttaacaat

SEQ ID NO: 3732612 - DNA, 18 bp, Homo sapiens
acagcccaaagaaggaaa

SEQ ID NO: 3732613 - DNA, 13 bp, Homo sapiens
acagcccaggcct

SEQ ID NO: 3732614 - DNA, 12 bp, Homo sapiens
acagccctgtca

SEQ ID NO: 3732615 - DNA, 13 bp, Homo sapiens
acagccctgtcag

SEQ ID NO: 3732616 - DNA, 13 bp, Homo sapiens
acagccgcagcct

SEQ ID NO: 3732617 - DNA, 20 bp, Homo sapiens
acagccgcagcctccctctg

SEQ ID NO: 3732618 - DNA, 14 bp, Homo sapiens
acagccgctcctgt

SEQ ID NO: 3732619 - DNA, 18 bp, Homo sapiens
acagccgctcctgtctgc

SEQ ID NO: 3732620 - DNA, 16 bp, Homo sapiens
acagccggggcctgcc

SEQ ID NO: 3732621 - DNA, 18 bp, Homo sapiens
acagcctcacttgaatgt

SEQ ID NO: 3732622 - DNA, 15 bp, Homo sapiens
acagcctcccacccc

SEQ ID NO: 3732623 - DNA, 15 bp, Homo sapiens
acagcctggcacagg

SEQ ID NO: 3732624 - DNA, 12 bp, Homo sapiens
acagcgctgggt

SEQ ID NO: 3732625 - DNA, 20 bp, Homo sapiens
acagctaatcagcattctca

SEQ ID NO: 3732626 - DNA, 17 bp, Homo sapiens
acagctatgggagcccc

SEQ ID NO: 3732627 - DNA, 23 bp, Homo sapiens
acagctcaagtcttccctgatca

SEQ ID NO: 3732628 - DNA, 21 bp, Homo sapiens
acagctcagctttttgtcttt

SEQ ID NO: 3732629 - DNA, 16 bp, Homo sapiens
acagctccctctgcct

SEQ ID NO: 3732630 - DNA, 13 bp, Homo sapiens
acagctccttctg

SEQ ID NO: 3732631 - DNA, 14 bp, Homo sapiens
acagctccttctgt

SEQ ID NO: 3732632 - DNA, 13 bp, Homo sapiens
acagctctgtcct

SEQ ID NO: 3732633 - DNA, 16 bp, Homo sapiens
acagctctgtcctggg

SEQ ID NO: 3732634 - DNA, 18 bp, Homo sapiens
acccccactctcattccc

SEQ ID NO: 3732635 - DNA, 22 bp, Homo sapiens
acccccactctcattccccagg

SEQ ID NO: 3732636 - DNA, 11 bp, Homo sapiens
acccccagcaa

SEQ ID NO: 3732637 - DNA, 16 bp, Homo sapiens
acccccagcaaccctc

SEQ ID NO: 3732638 - DNA, 14 bp, Homo sapiens
acccccagcctgct

SEQ ID NO: 3732639 - DNA, 15 bp, Homo sapiens
acccccagcctgcta

SEQ ID NO: 3732640 - DNA, 12 bp, Homo sapiens
acccccctgggc

SEQ ID NO: 3732641 - DNA, 14 bp, Homo sapiens
accccctccctggc

SEQ ID NO: 3732642 - DNA, 20 bp, Homo sapiens
accccctccctggcctgttc

SEQ ID NO: 3732643 - DNA, 16 bp, Homo sapiens
acccccttcagtgccc

SEQ ID NO: 3732644 - DNA, 18 bp, Homo sapiens
acccccttcagtgcccac

SEQ ID NO: 3732645 - DNA, 13 bp, Homo sapiens
acccccttctctg

SEQ ID NO: 3732646 - DNA, 21 bp, Homo sapiens
acccccttctctgcccattcc

SEQ ID NO: 3732647 - DNA, 19 bp, Homo sapiens
acccccttctctgctccac

SEQ ID NO: 3732648 - DNA, 18 bp, Homo sapiens
accccgaccacctgccca

SEQ ID NO: 3732649 - DNA, 14 bp, Homo sapiens
accccgagccctac

SEQ ID NO: 3732650 - DNA, 16 bp, Homo sapiens
acccctcaccttgcaa

SEQ ID NO: 3732651 - DNA, 19 bp, Homo sapiens
acccctcaccttgcaacac

SEQ ID NO: 3732652 - DNA, 12 bp, Homo sapiens
acccctccttcc

SEQ ID NO: 3732653 - DNA, 20 bp, Homo sapiens
acccctccttccttgaccag

SEQ ID NO: 3732654 - DNA, 23 bp, Homo sapiens
acccctccttccttgaccagcag

SEQ ID NO: 3732655 - DNA, 16 bp, Homo sapiens
acccctctaccaagct

SEQ ID NO: 3732656 - DNA, 11 bp, Homo sapiens
acccctggctg

SEQ ID NO: 3732657 - DNA, 13 bp, Homo sapiens
acccctggctggt

SEQ ID NO: 3732658 - DNA, 17 bp, Homo sapiens
acccctggcttttcact

SEQ ID NO: 3732659 - DNA, 20 bp, Homo sapiens
acccctggcttttcactgct

SEQ ID NO: 3732660 - DNA, 14 bp, Homo sapiens
accccttagcctcc

SEQ ID NO: 3732661 - DNA, 17 bp, Homo sapiens
accccttagcctccctg

SEQ ID NO: 3732662 - DNA, 18 bp, Homo sapiens
accccttagcctccctga

SEQ ID NO: 3732663 - DNA, 16 bp, Homo sapiens
accccttccccactgc

SEQ ID NO: 3732664 - DNA, 18 bp, Homo sapiens
accccttccccactgcct

SEQ ID NO: 3732665 - DNA, 20 bp, Homo sapiens
accccttccccactgcctgc

SEQ ID NO: 3732666 - DNA, 22 bp, Homo sapiens
accccttccccactgcctgccc

SEQ ID NO: 3732667 - DNA, 16 bp, Homo sapiens
accccttcgctcctgt

SEQ ID NO: 3732668 - DNA, 14 bp, Homo sapiens
acccgaggctgccc

SEQ ID NO: 3732669 - DNA, 15 bp, Homo sapiens
acccgaggctgccca

SEQ ID NO: 3732670 - DNA, 24 bp, Homo sapiens
acccgaggctgcccactatggtca

SEQ ID NO: 3732671 - DNA, 21 bp, Homo sapiens
acccggaggggcctggcagcc

SEQ ID NO: 3732672 - DNA, 21 bp, Homo sapiens
acccgggaggcggagcttgca

SEQ ID NO: 3732673 - DNA, 14 bp, Homo sapiens
acccgttttatgat

SEQ ID NO: 3732674 - DNA, 21 bp, Homo sapiens
acccgttttatgatttactca

SEQ ID NO: 3732675 - DNA, 17 bp, Homo sapiens
accctacctgtgcctga

SEQ ID NO: 3732676 - DNA, 22 bp, Homo sapiens
accctagtcccttcccctccct

SEQ ID NO: 3732677 - DNA, 11 bp, Homo sapiens
accctcagagc

SEQ ID NO: 3732678 - DNA, 18 bp, Homo sapiens
accctcagagccacccct

SEQ ID NO: 3732679 - DNA, 19 bp, Homo sapiens
accctcaggcataggcctg

SEQ ID NO: 3732680 - DNA, 12 bp, Homo sapiens
accctcccaccc

SEQ ID NO: 3732681 - DNA, 23 bp, Homo sapiens
accctcccacccccttctctgct

SEQ ID NO: 3732682 - DNA, 15 bp, Homo sapiens
accctcccagctctg

SEQ ID NO: 3732683 - DNA, 14 bp, Homo sapiens
accctccctcagcc

SEQ ID NO: 3732684 - DNA, 18 bp, Homo sapiens
accctccctcagcccctc

SEQ ID NO: 3732685 - DNA, 20 bp, Homo sapiens
accctccctcagcccctctt

SEQ ID NO: 3732686 - DNA, 15 bp, Homo sapiens
accctccgccttcac

SEQ ID NO: 3732687 - DNA, 17 bp, Homo sapiens
accctcctatcacctcc

SEQ ID NO: 3732688 - DNA, 20 bp, Homo sapiens
accctcgaagcgcgccactc

SEQ ID NO: 3732689 - DNA, 16 bp, Homo sapiens
accctcgctggccccc

SEQ ID NO: 3732690 - DNA, 17 bp, Homo sapiens
accctcgctggccccca

SEQ ID NO: 3732691 - DNA, 15 bp, Homo sapiens
accctctcccaggac

SEQ ID NO: 3732692 - DNA, 14 bp, Homo sapiens
accctcttagaaaa

SEQ ID NO: 3732693 - DNA, 14 bp, Homo sapiens
accctgcccctgcc

SEQ ID NO: 3732694 - DNA, 18 bp, Homo sapiens
accctgcgaaggggccct

SEQ ID NO: 3732695 - DNA, 23 bp, Homo sapiens
accctggcactataatgtaagct

SEQ ID NO: 3732696 - DNA, 17 bp, Homo sapiens
accctgttaccattttg

SEQ ID NO: 3732697 - DNA, 21 bp, Homo sapiens
acccttctgtgcccagctcag

SEQ ID NO: 3732698 - DNA, 13 bp, Homo sapiens
acccttctttcca

SEQ ID NO: 3732699 - DNA, 11 bp, Homo sapiens
acccttggcct

SEQ ID NO: 3732700 - DNA, 14 bp, Homo sapiens
accctttccttcct

SEQ ID NO: 3732701 - DNA, 15 bp, Homo sapiens
accctttccttcctt

SEQ ID NO: 3732702 - DNA, 22 bp, Homo sapiens
accctttccttccttccctggc

SEQ ID NO: 3732703 - DNA, 23 bp, Homo sapiens
accctttccttccttccctggct

SEQ ID NO: 3732704 - DNA, 14 bp, Homo sapiens
acccttttggcccc

SEQ ID NO: 3732705 - DNA, 17 bp, Homo sapiens
accgaaacagcgctggg

SEQ ID NO: 3732706 - DNA, 23 bp, Homo sapiens
accgagagtagccgagagcctgc

SEQ ID NO: 3732707 - DNA, 24 bp, Homo sapiens
accgagtctcttctccactggatg

SEQ ID NO: 3732708 - DNA, 13 bp, Homo sapiens
accgatgctccag

SEQ ID NO: 3732709 - DNA, 18 bp, Homo sapiens
accgccggccagctggga

SEQ ID NO: 3732710 - DNA, 13 bp, Homo sapiens
accgctccccagc

SEQ ID NO: 3732711 - DNA, 18 bp, Homo sapiens
accgctccccagcccagg

SEQ ID NO: 3732712 - DNA, 20 bp, Homo sapiens
accgctccccagcccagggt

SEQ ID NO: 3732713 - DNA, 14 bp, Homo sapiens
accgctgccagcac

SEQ ID NO: 3732714 - DNA, 16 bp, Homo sapiens
accgctgccagcacag

SEQ ID NO: 3732715 - DNA, 20 bp, Homo sapiens
accgctgcctaagtggctgc

SEQ ID NO: 3732716 - DNA, 21 bp, Homo sapiens
accgctgcctaagtggctgct

SEQ ID NO: 3732717 - DNA, 14 bp, Homo sapiens
accggaagctcctg

SEQ ID NO: 3732718 - DNA, 16 bp, Homo sapiens
accggatcctgggtgg

SEQ ID NO: 3732719 - DNA, 14 bp, Homo sapiens
accggctgcttttc

SEQ ID NO: 3732720 - DNA, 20 bp, Homo sapiens
accggctgcttttccctaag

SEQ ID NO: 3732721 - DNA, 16 bp, Homo sapiens
accgggcactcagaag

SEQ ID NO: 3732722 - DNA, 15 bp, Homo sapiens
accgggccacagaga

SEQ ID NO: 3732723 - DNA, 20 bp, Homo sapiens
accgggccacagagaaagta

SEQ ID NO: 3732724 - DNA, 23 bp, Homo sapiens
accgggctgggagctctgcagag

SEQ ID NO: 3732725 - DNA, 15 bp, Homo sapiens
accggttgcttctgg

SEQ ID NO: 3732726 - DNA, 18 bp, Homo sapiens
accggttgcttctgggaa

SEQ ID NO: 3732727 - DNA, 22 bp, Homo sapiens
acctaaaaggaaatctcacccc

SEQ ID NO: 3732728 - DNA, 20 bp, Homo sapiens
acctaaataaacacatagat

SEQ ID NO: 3732729 - DNA, 16 bp, Homo sapiens
acctaacccctttcct

SEQ ID NO: 3732730 - DNA, 15 bp, Homo sapiens
acctaattagagcag

SEQ ID NO: 3732731 - DNA, 22 bp, Homo sapiens
acctacagaatactagccagag

SEQ ID NO: 3732732 - DNA, 17 bp, Homo sapiens
acctaccacagtgtctg

SEQ ID NO: 3732733 - DNA, 17 bp, Homo sapiens
acctaccttcaaagctg

SEQ ID NO: 3732734 - DNA, 18 bp, Homo sapiens
acctaccttcaaagctga

SEQ ID NO: 3732735 - DNA, 13 bp, Homo sapiens
acctagccttaga

SEQ ID NO: 3732736 - DNA, 15 bp, Homo sapiens
acctatagtcccagc

SEQ ID NO: 3732737 - DNA, 22 bp, Homo sapiens
acctatagtcccagctactcag

SEQ ID NO: 3732738 - DNA, 14 bp, Homo sapiens
acctatttgacata

SEQ ID NO: 3732739 - DNA, 16 bp, Homo sapiens
acctattttagacaaa

SEQ ID NO: 3732740 - DNA, 17 bp, Homo sapiens
acctcaacctgtaaatt

SEQ ID NO: 3732741 - DNA, 18 bp, Homo sapiens
acctcaacctgtaaatta

SEQ ID NO: 3732742 - DNA, 10 bp, Homo sapiens
acctcaaggg

SEQ ID NO: 3732743 - DNA, 22 bp, Homo sapiens
acctcacatgcatacatacaca

SEQ ID NO: 3732744 - DNA, 19 bp, Homo sapiens
acctcacgcacctcccatc

SEQ ID NO: 3732745 - DNA, 21 bp, Homo sapiens
acctcactggggtcctggggc

SEQ ID NO: 3732746 - DNA, 16 bp, Homo sapiens
acctcagagccccgca

SEQ ID NO: 3732747 - DNA, 20 bp, Homo sapiens
actatgttgcccaggcaggt

SEQ ID NO: 3732748 - DNA, 17 bp, Homo sapiens
actattataatttaatg

SEQ ID NO: 3732749 - DNA, 17 bp, Homo sapiens
actattgcttgcacaaa

SEQ ID NO: 3732750 - DNA, 23 bp, Homo sapiens
actatttagtttttgtaatttat

SEQ ID NO: 3732751 - DNA, 23 bp, Homo sapiens
actatttgcttatttaataaaga

SEQ ID NO: 3732752 - DNA, 13 bp, Homo sapiens
actattttacttc

SEQ ID NO: 3732753 - DNA, 20 bp, Homo sapiens
actcaaagttaacctacctg

SEQ ID NO: 3732754 - DNA, 21 bp, Homo sapiens
actcaacatgttactgaccag

SEQ ID NO: 3732755 - DNA, 22 bp, Homo sapiens
actcaacatgttactgaccagc

SEQ ID NO: 3732756 - DNA, 14 bp, Homo sapiens
actcaagaggctga

SEQ ID NO: 3732757 - DNA, 18 bp, Homo sapiens
actcaagaggctgaggca

SEQ ID NO: 3732758 - DNA, 17 bp, Homo sapiens
actcaagccaagcagcc

SEQ ID NO: 3732759 - DNA, 22 bp, Homo sapiens
actcaagccaagcagccaagct

SEQ ID NO: 3732760 - DNA, 17 bp, Homo sapiens
actcaagttcaaggacc

SEQ ID NO: 3732761 - DNA, 18 bp, Homo sapiens
actcaataaaatcatgta

SEQ ID NO: 3732762 - DNA, 18 bp, Homo sapiens
actcaatattttccatga

SEQ ID NO: 3732763 - DNA, 16 bp, Homo sapiens
actcaatgcactgaca

SEQ ID NO: 3732764 - DNA, 18 bp, Homo sapiens
actcacatgctggacagg

SEQ ID NO: 3732765 - DNA, 19 bp, Homo sapiens
actcacatttattctgctc

SEQ ID NO: 3732766 - DNA, 18 bp, Homo sapiens
actcacccccaaggggca

SEQ ID NO: 3732767 - DNA, 20 bp, Homo sapiens
actcacctaatgtttatgag

SEQ ID NO: 3732768 - DNA, 11 bp, Homo sapiens
actcacctctg

SEQ ID NO: 3732769 - DNA, 13 bp, Homo sapiens
actcacctctgcc

SEQ ID NO: 3732770 - DNA, 14 bp, Homo sapiens
actcacctctgcct

SEQ ID NO: 3732771 - DNA, 19 bp, Homo sapiens
actcacctgctggcccctc

SEQ ID NO: 3732772 - DNA, 23 bp, Homo sapiens
actcacgataaataatcggccca

SEQ ID NO: 3732773 - DNA, 21 bp, Homo sapiens
actcactggcagccccagcac

SEQ ID NO: 3732774 - DNA, 14 bp, Homo sapiens
actcagaaacatca

SEQ ID NO: 3732775 - DNA, 21 bp, Homo sapiens
actcagaaatttaattcatgt

SEQ ID NO: 3732776 - DNA, 14 bp, Homo sapiens
actcagaagacact

SEQ ID NO: 3732777 - DNA, 23 bp, Homo sapiens
actcagatggaaccgcaggaagc

SEQ ID NO: 3732778 - DNA, 22 bp, Homo sapiens
actcagatgtctctggcgtgtg

SEQ ID NO: 3732779 - DNA, 15 bp, Homo sapiens
actcagcagccctcc

SEQ ID NO: 3732780 - DNA, 19 bp, Homo sapiens
actcagcagccctcctcac

SEQ ID NO: 3732781 - DNA, 20 bp, Homo sapiens
actcagcagccctcctcacc

SEQ ID NO: 3732782 - DNA, 14 bp, Homo sapiens
actcagccctgagg

SEQ ID NO: 3732783 - DNA, 17 bp, Homo sapiens
actcaggactccagccc

SEQ ID NO: 3732784 - DNA, 17 bp, Homo sapiens
actcaggaggctgaggg

SEQ ID NO: 3732785 - DNA, 18 bp, Homo sapiens
actcaggaggctgagggg

SEQ ID NO: 3732786 - DNA, 17 bp, Homo sapiens
actcaggatgcccaggg

SEQ ID NO: 3732787 - DNA, 14 bp, Homo sapiens
actcagggccccag

SEQ ID NO: 3732788 - DNA, 18 bp, Homo sapiens
actcagggccccagcact

SEQ ID NO: 3732789 - DNA, 22 bp, Homo sapiens
actcagggccccagcactaaag

SEQ ID NO: 3732790 - DNA, 20 bp, Homo sapiens
actcaggttgtagtaaagaa

SEQ ID NO: 3732791 - DNA, 23 bp, Homo sapiens
actcaggttgtagtaaagaaatt

SEQ ID NO: 3732792 - DNA, 15 bp, Homo sapiens
actcagttttaacta

SEQ ID NO: 3732793 - DNA, 13 bp, Homo sapiens
actcagttttctt

SEQ ID NO: 3732794 - DNA, 17 bp, Homo sapiens
actcatcataaaataaa

SEQ ID NO: 3732795 - DNA, 22 bp, Homo sapiens
actcatggtgaggcttaacaat

SEQ ID NO: 3732796 - DNA, 23 bp, Homo sapiens
actcattgcttcacaacccatct

SEQ ID NO: 3732797 - DNA, 14 bp, Homo sapiens
actccaactcttcc

SEQ ID NO: 3732798 - DNA, 15 bp, Homo sapiens
actccagacccctgg

SEQ ID NO: 3732799 - DNA, 21 bp, Homo sapiens
actccagacccctggcttttc

SEQ ID NO: 3732800 - DNA, 13 bp, Homo sapiens
actccagcctgag

SEQ ID NO: 3732801 - DNA, 14 bp, Homo sapiens
actccagcctgagc

SEQ ID NO: 3732802 - DNA, 15 bp, Homo sapiens
actccagcctgagca

SEQ ID NO: 3732803 - DNA, 14 bp, Homo sapiens
actccagcctgggc

SEQ ID NO: 3732804 - DNA, 18 bp, Homo sapiens
actccagcctgggcaaca

SEQ ID NO: 3732805 - DNA, 17 bp, Homo sapiens
actccatgagaagccgt

SEQ ID NO: 3732806 - DNA, 13 bp, Homo sapiens
actcccaaagagc

SEQ ID NO: 3732807 - DNA, 18 bp, Homo sapiens
actcccaaagagctgcct

SEQ ID NO: 3732808 - DNA, 13 bp, Homo sapiens
actcccaagaaca

SEQ ID NO: 3732809 - DNA, 14 bp, Homo sapiens
actcccccaggtgg

SEQ ID NO: 3732810 - DNA, 12 bp, Homo sapiens
actcccctgcac

SEQ ID NO: 3732811 - DNA, 22 bp, Homo sapiens
actccctcctcacctctggact

SEQ ID NO: 3732812 - DNA, 17 bp, Homo sapiens
actccctggctctcaga

SEQ ID NO: 3732813 - DNA, 15 bp, Homo sapiens
actcccttcccataa

SEQ ID NO: 3732814 - DNA, 13 bp, Homo sapiens
actcccttctcct

SEQ ID NO: 3732815 - DNA, 19 bp, Homo sapiens
actccggtgtgcctgcagc

SEQ ID NO: 3732816 - DNA, 16 bp, Homo sapiens
actccgtctcaaggaa

SEQ ID NO: 3732817 - DNA, 16 bp, Homo sapiens
actcctacctcagcct

SEQ ID NO: 3732818 - DNA, 19 bp, Homo sapiens
actcctcattgtaaacaaa

SEQ ID NO: 3732819 - DNA, 15 bp, Homo sapiens
actcctgcaaaattt

SEQ ID NO: 3732820 - DNA, 18 bp, Homo sapiens
actcctgcaaaattttat

SEQ ID NO: 3732821 - DNA, 13 bp, Homo sapiens
actcctggcctca

SEQ ID NO: 3732822 - DNA, 14 bp, Homo sapiens
actcctggcctcaa

SEQ ID NO: 3732823 - DNA, 13 bp, Homo sapiens
actcctgtacact

SEQ ID NO: 3732824 - DNA, 18 bp, Homo sapiens
actcctgtacactgaata

SEQ ID NO: 3732825 - DNA, 11 bp, Homo sapiens
actccttcctg

SEQ ID NO: 3732826 - DNA, 13 bp, Homo sapiens
actccttcctgcc

SEQ ID NO: 3732827 - DNA, 16 bp, Homo sapiens
actcgcttctctgtga

SEQ ID NO: 3732828 - DNA, 23 bp, Homo sapiens
actcgtataagcatggagaacag

SEQ ID NO: 3732829 - DNA, 16 bp, Homo sapiens
actcgtgtgcaacaga

SEQ ID NO: 3732830 - DNA, 15 bp, Homo sapiens
actctaattctaacc

SEQ ID NO: 3732831 - DNA, 16 bp, Homo sapiens
actctaattctaacca

SEQ ID NO: 3732832 - DNA, 15 bp, Homo sapiens
actctaccctcccac

SEQ ID NO: 3732833 - DNA, 19 bp, Homo sapiens
actctaccctcccaccccc

SEQ ID NO: 3732834 - DNA, 13 bp, Homo sapiens
actctaccctctt

SEQ ID NO: 3732835 - DNA, 21 bp, Homo sapiens
actctaccctcttagaaaaac

SEQ ID NO: 3732836 - DNA, 17 bp, Homo sapiens
actctagggaaaaacca

SEQ ID NO: 3732837 - DNA, 15 bp, Homo sapiens
actctatagactcta

SEQ ID NO: 3732838 - DNA, 18 bp, Homo sapiens
actctatagactctagga

SEQ ID NO: 3732839 - DNA, 19 bp, Homo sapiens
actctcaggatcaagaaag

SEQ ID NO: 3732840 - DNA, 16 bp, Homo sapiens
actctcattccccagg

SEQ ID NO: 3732841 - DNA, 17 bp, Homo sapiens
actctccaacctggaca

SEQ ID NO: 3732842 - DNA, 11 bp, Homo sapiens
actctcctggg

SEQ ID NO: 3732843 - DNA, 12 bp, Homo sapiens
actctcctgggc

SEQ ID NO: 3732844 - DNA, 13 bp, Homo sapiens
actctctccaccc

SEQ ID NO: 3732845 - DNA, 21 bp, Homo sapiens
actctgagtttaccatttgta

SEQ ID NO: 3732846 - DNA, 16 bp, Homo sapiens
actctgcattctagta

SEQ ID NO: 3732847 - DNA, 16 bp, Homo sapiens
actctgccagccacat

SEQ ID NO: 3732848 - DNA, 14 bp, Homo sapiens
actctgctttgact

SEQ ID NO: 3732849 - DNA, 23 bp, Homo sapiens
actctgctttgactgagcagact

SEQ ID NO: 3732850 - DNA, 12 bp, Homo sapiens
actctggcctct

SEQ ID NO: 3732851 - DNA, 14 bp, Homo sapiens
actctggcctctgt

SEQ ID NO: 3732852 - DNA, 16 bp, Homo sapiens
actctgtgtcaggtgg

SEQ ID NO: 3732853 - DNA, 21 bp, Homo sapiens
actctgtgtcaggtggggcag

SEQ ID NO: 3732854 - DNA, 12 bp, Homo sapiens
actctgttcctg

SEQ ID NO: 3732855 - DNA, 14 bp, Homo sapiens
actctgttccttca

SEQ ID NO: 3732856 - DNA, 11 bp, Homo sapiens
actcttaaaac

SEQ ID NO: 3732857 - DNA, 17 bp, Homo sapiens
actcttaggaagagaaa

SEQ ID NO: 3732858 - DNA, 16 bp, Homo sapiens
actcttattgcccacg

SEQ ID NO: 3732859 - DNA, 12 bp, Homo sapiens
actcttgtaaga

SEQ ID NO: 3732860 - DNA, 14 bp, Homo sapiens
actcttgtaagatt

SEQ ID NO: 3732861 - DNA, 20 bp, Homo sapiens
agaaatatctgaaaatgtat

SEQ ID NO: 3732862 - DNA, 11 bp, Homo sapiens
agaaatcatgt

SEQ ID NO: 3732863 - DNA, 13 bp, Homo sapiens
agaaatcatgtta

SEQ ID NO: 3732864 - DNA, 14 bp, Homo sapiens
agaaatcatgttat

SEQ ID NO: 3732865 - DNA, 18 bp, Homo sapiens
agaaatctcacttttctc

SEQ ID NO: 3732866 - DNA, 14 bp, Homo sapiens
agaaatgaaatttt

SEQ ID NO: 3732867 - DNA, 12 bp, Homo sapiens
agaaatgaataa

SEQ ID NO: 3732868 - DNA, 19 bp, Homo sapiens
agaaatgaataatttccca

SEQ ID NO: 3732869 - DNA, 16 bp, Homo sapiens
agaaatgcaaattctc

SEQ ID NO: 3732870 - DNA, 22 bp, Homo sapiens
agaaatgcatccattcctcagg

SEQ ID NO: 3732871 - DNA, 15 bp, Homo sapiens
agaaattagccgggc

SEQ ID NO: 3732872 - DNA, 14 bp, Homo sapiens
agaaattccctgga

SEQ ID NO: 3732873 - DNA, 15 bp, Homo sapiens
agaaattggctggat

SEQ ID NO: 3732874 - DNA, 17 bp, Homo sapiens
agaaatttaattcatgt

SEQ ID NO: 3732875 - DNA, 22 bp, Homo sapiens
agaacacaaagcggggggaggg

SEQ ID NO: 3732876 - DNA, 16 bp, Homo sapiens
agaacacaaggtcatt

SEQ ID NO: 3732877 - DNA, 14 bp, Homo sapiens
agaacactattttc

SEQ ID NO: 3732878 - DNA, 11 bp, Homo sapiens
agaacagaaaa

SEQ ID NO: 3732879 - DNA, 13 bp, Homo sapiens
agaacagaaaaca

SEQ ID NO: 3732880 - DNA, 20 bp, Homo sapiens
agaacagaaaacaacaaaaa

SEQ ID NO: 3732881 - DNA, 18 bp, Homo sapiens
agaacagatctccaaagc

SEQ ID NO: 3732882 - DNA, 19 bp, Homo sapiens
agaacagatctccaaagct

SEQ ID NO: 3732883 - DNA, 13 bp, Homo sapiens
agaacagcagagg

SEQ ID NO: 3732884 - DNA, 23 bp, Homo sapiens
agaacagcagggtagtctggttt

SEQ ID NO: 3732885 - DNA, 20 bp, Homo sapiens
agaacagccgctcctgtctg

SEQ ID NO: 3732886 - DNA, 14 bp, Homo sapiens
agaacagtgatttt

SEQ ID NO: 3732887 - DNA, 21 bp, Homo sapiens
agaacagttaagcagccgcca

SEQ ID NO: 3732888 - DNA, 15 bp, Homo sapiens
agaacagtttgtaca

SEQ ID NO: 3732889 - DNA, 16 bp, Homo sapiens
agaacatccctgccag

SEQ ID NO: 3732890 - DNA, 17 bp, Homo sapiens
agaacatccctgccagc

SEQ ID NO: 3732891 - DNA, 19 bp, Homo sapiens
agaacatccctgccagctc

SEQ ID NO: 3732892 - DNA, 16 bp, Homo sapiens
agaacatgttggtatt

SEQ ID NO: 3732893 - DNA, 22 bp, Homo sapiens
agaaccctggtgaggaagctcc

SEQ ID NO: 3732894 - DNA, 18 bp, Homo sapiens
agaacctcacgcacctcc

SEQ ID NO: 3732895 - DNA, 19 bp, Homo sapiens
agaacctcaggcttccttg

SEQ ID NO: 3732896 - DNA, 21 bp, Homo sapiens
agaacctcaggcttccttggc

SEQ ID NO: 3732897 - DNA, 13 bp, Homo sapiens
agaacctcttccc

SEQ ID NO: 3732898 - DNA, 14 bp, Homo sapiens
agaacctcttcccc

SEQ ID NO: 3732899 - DNA, 15 bp, Homo sapiens
agaacctcttcccca

SEQ ID NO: 3732900 - DNA, 12 bp, Homo sapiens
agaacctgtcct

SEQ ID NO: 3732901 - DNA, 20 bp, Homo sapiens
agaacgccagtctcccaggc

SEQ ID NO: 3732902 - DNA, 22 bp, Homo sapiens
agaactagtggtggctctgaga

SEQ ID NO: 3732903 - DNA, 17 bp, Homo sapiens
agaactcagttttaact

SEQ ID NO: 3732904 - DNA, 21 bp, Homo sapiens
agaactcatgacggaagagtt

SEQ ID NO: 3732905 - DNA, 23 bp, Homo sapiens
agaactctccatcttattttcat

SEQ ID NO: 3732906 - DNA, 14 bp, Homo sapiens
agaactctgggctg

SEQ ID NO: 3732907 - DNA, 20 bp, Homo sapiens
agaactctgggctgccatgt

SEQ ID NO: 3732908 - DNA, 20 bp, Homo sapiens
agaactctgggctgctaccc

SEQ ID NO: 3732909 - DNA, 19 bp, Homo sapiens
agaactgaaaacataaaaa

SEQ ID NO: 3732910 - DNA, 21 bp, Homo sapiens
agaactgaaaacataaaaagt

SEQ ID NO: 3732911 - DNA, 16 bp, Homo sapiens
agaactgagctcctct

SEQ ID NO: 3732912 - DNA, 20 bp, Homo sapiens
agaactgcatatgtttcgct

SEQ ID NO: 3732913 - DNA, 20 bp, Homo sapiens
agaactgcatggacctaaca

SEQ ID NO: 3732914 - DNA, 16 bp, Homo sapiens
agaactggactcagga

SEQ ID NO: 3732915 - DNA, 20 bp, Homo sapiens
agaactggactcaggatgcc

SEQ ID NO: 3732916 - DNA, 14 bp, Homo sapiens
agaagaaaaaagaa

SEQ ID NO: 3732917 - DNA, 13 bp, Homo sapiens
agaagaaggaaat

SEQ ID NO: 3732918 - DNA, 16 bp, Homo sapiens
agaagacatgaaccaa

SEQ ID NO: 3732919 - DNA, 20 bp, Homo sapiens
agaagagatgggcttgtttt

SEQ ID NO: 3732920 - DNA, 21 bp, Homo sapiens
agaagagattgtggtttcatt

SEQ ID NO: 3732921 - DNA, 22 bp, Homo sapiens
agaagatgaaaatggaagtggc

SEQ ID NO: 3732922 - DNA, 16 bp, Homo sapiens
agaagcagaggaagga

SEQ ID NO: 3732923 - DNA, 15 bp, Homo sapiens
agaagcatgaaaaag

SEQ ID NO: 3732924 - DNA, 16 bp, Homo sapiens
agaagcatgaaaaagc

SEQ ID NO: 3732925 - DNA, 18 bp, Homo sapiens
agaagcccaatattataa

SEQ ID NO: 3732926 - DNA, 22 bp, Homo sapiens
agaagccgggaacagacaacag

SEQ ID NO: 3732927 - DNA, 14 bp, Homo sapiens
agaagcctattgta

SEQ ID NO: 3732928 - DNA, 12 bp, Homo sapiens
agaagcctctgg

SEQ ID NO: 3732929 - DNA, 13 bp, Homo sapiens
agaagcctctggc

SEQ ID NO: 3732930 - DNA, 16 bp, Homo sapiens
agaagcctctggctag

SEQ ID NO: 3732931 - DNA, 16 bp, Homo sapiens
agaagcggctggcagc

SEQ ID NO: 3732932 - DNA, 23 bp, Homo sapiens
agaagctccctgaagtaagcaaa

SEQ ID NO: 3732933 - DNA, 20 bp, Homo sapiens
agaagctgagcaccagggga

SEQ ID NO: 3732934 - DNA, 22 bp, Homo sapiens
agaaggaaggagactcacctct

SEQ ID NO: 3732935 - DNA, 11 bp, Homo sapiens
agaaggaatgt

SEQ ID NO: 3732936 - DNA, 15 bp, Homo sapiens
agaaggaatttgagt

SEQ ID NO: 3732937 - DNA, 20 bp, Homo sapiens
agaaggagacagagctggtt

SEQ ID NO: 3732938 - DNA, 16 bp, Homo sapiens
agaaggatgtacattt

SEQ ID NO: 3732939 - DNA, 17 bp, Homo sapiens
agaaggatgtacatttc

SEQ ID NO: 3732940 - DNA, 13 bp, Homo sapiens
agaaggccaagag

SEQ ID NO: 3732941 - DNA, 12 bp, Homo sapiens
agaagggaaaca

SEQ ID NO: 3732942 - DNA, 16 bp, Homo sapiens
agaaggggaagcactc

SEQ ID NO: 3732943 - DNA, 17 bp, Homo sapiens
agaagggggccatgagg

SEQ ID NO: 3732944 - DNA, 19 bp, Homo sapiens
agaagggggtcaaagcaag

SEQ ID NO: 3732945 - DNA, 15 bp, Homo sapiens
agaagggtccttccc

SEQ ID NO: 3732946 - DNA, 22 bp, Homo sapiens
agaagggttttccaccctggaa

SEQ ID NO: 3732947 - DNA, 23 bp, Homo sapiens
agaagggttttccaccctggaat

SEQ ID NO: 3732948 - DNA, 20 bp, Homo sapiens
agaaggtccttaatgatccg

SEQ ID NO: 3732949 - DNA, 23 bp, Homo sapiens
agaaggtgggggttggctgggta

SEQ ID NO: 3732950 - DNA, 21 bp, Homo sapiens
agaagtaacaagagtgattct

SEQ ID NO: 3732951 - DNA, 13 bp, Homo sapiens
agaagtcatgaag

SEQ ID NO: 3732952 - DNA, 17 bp, Homo sapiens
agaagtcatgaagccca

SEQ ID NO: 3732953 - DNA, 20 bp, Homo sapiens
agaagtcatgaagcccaagt

SEQ ID NO: 3732954 - DNA, 15 bp, Homo sapiens
agaagtcttagactt

SEQ ID NO: 3732955 - DNA, 17 bp, Homo sapiens
agaagtgaccaaggagg

SEQ ID NO: 3732956 - DNA, 14 bp, Homo sapiens
agaagtgcccctgc

SEQ ID NO: 3732957 - DNA, 19 bp, Homo sapiens
agaagtgcccctgctgcct

SEQ ID NO: 3732958 - DNA, 17 bp, Homo sapiens
agaagtggaccaggaca

SEQ ID NO: 3732959 - DNA, 19 bp, Homo sapiens
agaagtggaccaggacagg

SEQ ID NO: 3732960 - DNA, 19 bp, Homo sapiens
agaagtgggccaggacagg

SEQ ID NO: 3732961 - DNA, 15 bp, Homo sapiens
agaagttaagcaaca

SEQ ID NO: 3732962 - DNA, 15 bp, Homo sapiens
agaagtttagatttt

SEQ ID NO: 3732963 - DNA, 16 bp, Homo sapiens
agaagtttagatttta

SEQ ID NO: 3732964 - DNA, 17 bp, Homo sapiens
agaataaagttctgagt

SEQ ID NO: 3732965 - DNA, 21 bp, Homo sapiens
agaataaagttctgagtgttt

SEQ ID NO: 3732966 - DNA, 22 bp, Homo sapiens
agaataatatgctgccaaattt

SEQ ID NO: 3732967 - DNA, 15 bp, Homo sapiens
agaataattctttga

SEQ ID NO: 3732968 - DNA, 18 bp, Homo sapiens
agaatacagaaagatgga

SEQ ID NO: 3732969 - DNA, 21 bp, Homo sapiens
agaatacagaaagatggatgt

SEQ ID NO: 3732970 - DNA, 12 bp, Homo sapiens
agaatagaagga

SEQ ID NO: 3732971 - DNA, 14 bp, Homo sapiens
agaatagaaggaaa

SEQ ID NO: 3732972 - DNA, 17 bp, Homo sapiens
agaatagaaggaaacta

SEQ ID NO: 3732973 - DNA, 20 bp, Homo sapiens
agaatagaaggaaactagct

SEQ ID NO: 3732974 - DNA, 22 bp, Homo sapiens
agaggctggaggcagggccttg

SEQ ID NO: 3732975 - DNA, 21 bp, Homo sapiens
agagggacagcccactgagaa

SEQ ID NO: 3732976 - DNA, 20 bp, Homo sapiens
agagggagtgacagaggcag

SEQ ID NO: 3732977 - DNA, 23 bp, Homo sapiens
agagggatgaggtgctgggaggg

SEQ ID NO: 3732978 - DNA, 23 bp, Homo sapiens
agagggcatgcgcacaaggctga

SEQ ID NO: 3732979 - DNA, 16 bp, Homo sapiens
agagggcccaggcagg

SEQ ID NO: 3732980 - DNA, 17 bp, Homo sapiens
agagggcccaggcaggc

SEQ ID NO: 3732981 - DNA, 19 bp, Homo sapiens
agaggggaataatagaaga

SEQ ID NO: 3732982 - DNA, 20 bp, Homo sapiens
agaggggaataatagaagaa

SEQ ID NO: 3732983 - DNA, 16 bp, Homo sapiens
agaggggcagaacagc

SEQ ID NO: 3732984 - DNA, 19 bp, Homo sapiens
agagggtggtgacctctgc

SEQ ID NO: 3732985 - DNA, 16 bp, Homo sapiens
agaggtagggctgcca

SEQ ID NO: 3732986 - DNA, 17 bp, Homo sapiens
agaggtatttatcttta

SEQ ID NO: 3732987 - DNA, 18 bp, Homo sapiens
agaggtcaagcccaggag

SEQ ID NO: 3732988 - DNA, 14 bp, Homo sapiens
agaggttgtctgtg

SEQ ID NO: 3732989 - DNA, 17 bp, Homo sapiens
agagtagccgagagcct

SEQ ID NO: 3732990 - DNA, 13 bp, Homo sapiens
agagtcatctcca

SEQ ID NO: 3732991 - DNA, 18 bp, Homo sapiens
agagtcatctccatcagc

SEQ ID NO: 3732992 - DNA, 21 bp, Homo sapiens
agagtcatctccatcagctgt

SEQ ID NO: 3732993 - DNA, 15 bp, Homo sapiens
agagtccaggcccca

SEQ ID NO: 3732994 - DNA, 13 bp, Homo sapiens
agagtcctcactc

SEQ ID NO: 3732995 - DNA, 12 bp, Homo sapiens
agagtctgtctc

SEQ ID NO: 3732996 - DNA, 14 bp, Homo sapiens
agagtcttgcagtg

SEQ ID NO: 3732997 - DNA, 19 bp, Homo sapiens
agagtgagactctgtctca

SEQ ID NO: 3732998 - DNA, 14 bp, Homo sapiens
agagtgagagggca

SEQ ID NO: 3732999 - DNA, 21 bp, Homo sapiens
agagtgagagggcatgcgcac

SEQ ID NO: 3733000 - DNA, 13 bp, Homo sapiens
agagtgcaacagt

SEQ ID NO: 3733001 - DNA, 18 bp, Homo sapiens
agagtgcattgtgagggt

SEQ ID NO: 3733002 - DNA, 16 bp, Homo sapiens
agagtgccccacctgc

SEQ ID NO: 3733003 - DNA, 21 bp, Homo sapiens
agagtgctgtccggtggagat

SEQ ID NO: 3733004 - DNA, 13 bp, Homo sapiens
agagtggcctggc

SEQ ID NO: 3733005 - DNA, 14 bp, Homo sapiens
agagtggcctggcc

SEQ ID NO: 3733006 - DNA, 14 bp, Homo sapiens
agagtggctcctcc

SEQ ID NO: 3733007 - DNA, 11 bp, Homo sapiens
agagtgggagc

SEQ ID NO: 3733008 - DNA, 18 bp, Homo sapiens
agagtggtctttctggag

SEQ ID NO: 3733009 - DNA, 20 bp, Homo sapiens
agagtgtcttcacggcagga

SEQ ID NO: 3733010 - DNA, 19 bp, Homo sapiens
agagtgtgaaatagacatt

SEQ ID NO: 3733011 - DNA, 13 bp, Homo sapiens
agagttaagaatg

SEQ ID NO: 3733012 - DNA, 14 bp, Homo sapiens
agagttaatcaact

SEQ ID NO: 3733013 - DNA, 19 bp, Homo sapiens
agagttagtttctttggga

SEQ ID NO: 3733014 - DNA, 19 bp, Homo sapiens
agagttgggacaattgctt

SEQ ID NO: 3733015 - DNA, 19 bp, Homo sapiens
agagttgtgcacatggctt

SEQ ID NO: 3733016 - DNA, 18 bp, Homo sapiens
agagttgtgttgttcttt

SEQ ID NO: 3733017 - DNA, 21 bp, Homo sapiens
agagttgtgttgttcttttcc

SEQ ID NO: 3733018 - DNA, 19 bp, Homo sapiens
agataaactcagaaattta

SEQ ID NO: 3733019 - DNA, 13 bp, Homo sapiens
agataaaggacag

SEQ ID NO: 3733020 - DNA, 13 bp, Homo sapiens
agataaattataa

SEQ ID NO: 3733021 - DNA, 16 bp, Homo sapiens
agataactctttggat

SEQ ID NO: 3733022 - DNA, 16 bp, Homo sapiens
agataagcaagagaga

SEQ ID NO: 3733023 - DNA, 15 bp, Homo sapiens
agataatatgagaat

SEQ ID NO: 3733024 - DNA, 22 bp, Homo sapiens
agataatattaaggaagacaat

SEQ ID NO: 3733025 - DNA, 16 bp, Homo sapiens
agataatcagcctctt

SEQ ID NO: 3733026 - DNA, 23 bp, Homo sapiens
agataatctagaacacaggcaaa

SEQ ID NO: 3733027 - DNA, 19 bp, Homo sapiens
agataatcttagctgccaa

SEQ ID NO: 3733028 - DNA, 21 bp, Homo sapiens
agataatgcccagacattttt

SEQ ID NO: 3733029 - DNA, 23 bp, Homo sapiens
agatacatttgtatgttgtgaag

SEQ ID NO: 3733030 - DNA, 14 bp, Homo sapiens
agataccatcagca

SEQ ID NO: 3733031 - DNA, 20 bp, Homo sapiens
agataccatcagcaaagaat

SEQ ID NO: 3733032 - DNA, 14 bp, Homo sapiens
agatacgactttat

SEQ ID NO: 3733033 - DNA, 18 bp, Homo sapiens
agatagaaataaatagct

SEQ ID NO: 3733034 - DNA, 17 bp, Homo sapiens
agatagaagaaaaaaga

SEQ ID NO: 3733035 - DNA, 14 bp, Homo sapiens
agatagaagaactg

SEQ ID NO: 3733036 - DNA, 15 bp, Homo sapiens
agatagaagaactgc

SEQ ID NO: 3733037 - DNA, 16 bp, Homo sapiens
agataggctctgcaca

SEQ ID NO: 3733038 - DNA, 14 bp, Homo sapiens
agatagtacataaa

SEQ ID NO: 3733039 - DNA, 17 bp, Homo sapiens
agatagtagcatacatt

SEQ ID NO: 3733040 - DNA, 14 bp, Homo sapiens
agatatatttttca

SEQ ID NO: 3733041 - DNA, 17 bp, Homo sapiens
agatatctttttattga

SEQ ID NO: 3733042 - DNA, 12 bp, Homo sapiens
agatattattca

SEQ ID NO: 3733043 - DNA, 21 bp, Homo sapiens
agatattattcaccatgtaaa

SEQ ID NO: 3733044 - DNA, 23 bp, Homo sapiens
agatatttatatttttattttat

SEQ ID NO: 3733045 - DNA, 16 bp, Homo sapiens
agatcacataacagaa

SEQ ID NO: 3733046 - DNA, 21 bp, Homo sapiens
agatcaccagtgtgtggcttt

SEQ ID NO: 3733047 - DNA, 18 bp, Homo sapiens
agatcacgccactgcact

SEQ ID NO: 3733048 - DNA, 18 bp, Homo sapiens
agatcatagatttctgat

SEQ ID NO: 3733049 - DNA, 23 bp, Homo sapiens
agatcatagatttctgattttat

SEQ ID NO: 3733050 - DNA, 15 bp, Homo sapiens
agatccacacacaga

SEQ ID NO: 3733051 - DNA, 16 bp, Homo sapiens
agatccacacacagag

SEQ ID NO: 3733052 - DNA, 21 bp, Homo sapiens
agatcccagaaggacctcctg

SEQ ID NO: 3733053 - DNA, 21 bp, Homo sapiens
agatcctgtctttaaggaaaa

SEQ ID NO: 3733054 - DNA, 17 bp, Homo sapiens
agatcggggccagaggc

SEQ ID NO: 3733055 - DNA, 23 bp, Homo sapiens
agatctctgctttggaaatcaca

SEQ ID NO: 3733056 - DNA, 12 bp, Homo sapiens
agatctttcagg

SEQ ID NO: 3733057 - DNA, 21 bp, Homo sapiens
agatgaactctttctggcctg

SEQ ID NO: 3733058 - DNA, 20 bp, Homo sapiens
agatgaagagtgagagggca

SEQ ID NO: 3733059 - DNA, 14 bp, Homo sapiens
agatgacccctccc

SEQ ID NO: 3733060 - DNA, 15 bp, Homo sapiens
agatgactgagtcct

SEQ ID NO: 3733061 - DNA, 19 bp, Homo sapiens
agatgagaattcagctgcc

SEQ ID NO: 3733062 - DNA, 20 bp, Homo sapiens
agatgagaattcagctgccc

SEQ ID NO: 3733063 - DNA, 16 bp, Homo sapiens
agatgcaaagaggcaa

SEQ ID NO: 3733064 - DNA, 17 bp, Homo sapiens
agatgcaaagaggcaag

SEQ ID NO: 3733065 - DNA, 15 bp, Homo sapiens
agatgcaaggaccag

SEQ ID NO: 3733066 - DNA, 20 bp, Homo sapiens
agatgcaaggaccaggactc

SEQ ID NO: 3733067 - DNA, 21 bp, Homo sapiens
agatgccagagcaaagggcca

SEQ ID NO: 3733068 - DNA, 21 bp, Homo sapiens
agatgcccagagggcccaggc

SEQ ID NO: 3733069 - DNA, 21 bp, Homo sapiens
agatgcctccaccccccagaa

SEQ ID NO: 3733070 - DNA, 15 bp, Homo sapiens
agatgcctccaccgc

SEQ ID NO: 3733071 - DNA, 16 bp, Homo sapiens
agatgcctccaccgct

SEQ ID NO: 3733072 - DNA, 21 bp, Homo sapiens
agatgcctccaccgctgccta

SEQ ID NO: 3733073 - DNA, 13 bp, Homo sapiens
agatgcctccctg

SEQ ID NO: 3733074 - DNA, 22 bp, Homo sapiens
agatgctgaaacaggagagaaa

SEQ ID NO: 3733075 - DNA, 15 bp, Homo sapiens
agatgcttctcactg

SEQ ID NO: 3733076 - DNA, 18 bp, Homo sapiens
agatggaaccgcaggaag

SEQ ID NO: 3733077 - DNA, 18 bp, Homo sapiens
agatggattctcagatat

SEQ ID NO: 3733078 - DNA, 20 bp, Homo sapiens
agatggattctcagatattt

SEQ ID NO: 3733079 - DNA, 15 bp, Homo sapiens
agatggatttgcctg

SEQ ID NO: 3733080 - DNA, 16 bp, Homo sapiens
agatggcaaatgacca

SEQ ID NO: 3733081 - DNA, 15 bp, Homo sapiens
agatggcctttgctt

SEQ ID NO: 3733082 - DNA, 23 bp, Homo sapiens
agatggcctttgcttatgaatat

SEQ ID NO: 3733083 - DNA, 15 bp, Homo sapiens
agatgggactgggag

SEQ ID NO: 3733084 - DNA, 19 bp, Homo sapiens
agatgggactgggagggcc

SEQ ID NO: 3733085 - DNA, 16 bp, Homo sapiens
agatgggatgcttgcc

SEQ ID NO: 3733086 - DNA, 18 bp, Homo sapiens
agatgggcttgttttctt

SEQ ID NO: 3733087 - DNA, 14 bp, Homo sapiens
agcctgctccccca

SEQ ID NO: 3733088 - DNA, 17 bp, Homo sapiens
agcctgctcccccaccc

SEQ ID NO: 3733089 - DNA, 12 bp, Homo sapiens
agcctgctggat

SEQ ID NO: 3733090 - DNA, 17 bp, Homo sapiens
agcctggcacagggcag

SEQ ID NO: 3733091 - DNA, 17 bp, Homo sapiens
agcctgggcaacagagc

SEQ ID NO: 3733092 - DNA, 20 bp, Homo sapiens
agcctgggcaacagagcaag

SEQ ID NO: 3733093 - DNA, 17 bp, Homo sapiens
agcctgggcagcatagc

SEQ ID NO: 3733094 - DNA, 20 bp, Homo sapiens
agcctgggcagccaggctgc

SEQ ID NO: 3733095 - DNA, 23 bp, Homo sapiens
agcctgtggcagtaaagagaaac

SEQ ID NO: 3733096 - DNA, 24 bp, Homo sapiens
agcctgtggcagtaaagagaaact

SEQ ID NO: 3733097 - DNA, 14 bp, Homo sapiens
agcctgtggcatct

SEQ ID NO: 3733098 - DNA, 17 bp, Homo sapiens
agcctgtggcggtgcct

SEQ ID NO: 3733099 - DNA, 22 bp, Homo sapiens
agccttagaagtcacacagtat

SEQ ID NO: 3733100 - DNA, 16 bp, Homo sapiens
agccttccacactcac

SEQ ID NO: 3733101 - DNA, 20 bp, Homo sapiens
agccttccccttgcccaggg

SEQ ID NO: 3733102 - DNA, 22 bp, Homo sapiens
agccttccccttgcccagggct

SEQ ID NO: 3733103 - DNA, 19 bp, Homo sapiens
agccttgcggaaggttcta

SEQ ID NO: 3733104 - DNA, 18 bp, Homo sapiens
agccttggtgtccacctg

SEQ ID NO: 3733105 - DNA, 20 bp, Homo sapiens
agccttggttcatcagtgtt

SEQ ID NO: 3733106 - DNA, 18 bp, Homo sapiens
agcgaaccaatatttgta

SEQ ID NO: 3733107 - DNA, 19 bp, Homo sapiens
agcgaggtcaacagagaag

SEQ ID NO: 3733108 - DNA, 22 bp, Homo sapiens
agcgaggtcaacagagaaggca

SEQ ID NO: 3733109 - DNA, 23 bp, Homo sapiens
agcgaggtcaacagagaaggcag

SEQ ID NO: 3733110 - DNA, 15 bp, Homo sapiens
agcgattcttctgct

SEQ ID NO: 3733111 - DNA, 17 bp, Homo sapiens
agcgattcttctgcttc

SEQ ID NO: 3733112 - DNA, 12 bp, Homo sapiens
agcgcacctgcc

SEQ ID NO: 3733113 - DNA, 22 bp, Homo sapiens
agcgcccagttgggtggatgcc

SEQ ID NO: 3733114 - DNA, 15 bp, Homo sapiens
agcgcctgcccctcc

SEQ ID NO: 3733115 - DNA, 22 bp, Homo sapiens
agcgcgccactcgcttccccca

SEQ ID NO: 3733116 - DNA, 17 bp, Homo sapiens
agcgctgccgcacccca

SEQ ID NO: 3733117 - DNA, 18 bp, Homo sapiens
agcgctgccgcaccccag

SEQ ID NO: 3733118 - DNA, 14 bp, Homo sapiens
agcggaaagcagct

SEQ ID NO: 3733119 - DNA, 23 bp, Homo sapiens
agcggaaagcagctcaaaggcac

SEQ ID NO: 3733120 - DNA, 18 bp, Homo sapiens
agcggagacggagtccca

SEQ ID NO: 3733121 - DNA, 23 bp, Homo sapiens
agcggaggttgcagggagccgag

SEQ ID NO: 3733122 - DNA, 17 bp, Homo sapiens
agcggggacagctcctt

SEQ ID NO: 3733123 - DNA, 19 bp, Homo sapiens
agcggggacagctccttct

SEQ ID NO: 3733124 - DNA, 21 bp, Homo sapiens
agcggggccccagggctaccc

SEQ ID NO: 3733125 - DNA, 13 bp, Homo sapiens
agcggggggaggg

SEQ ID NO: 3733126 - DNA, 22 bp, Homo sapiens
agcggtttggggagcagagaca

SEQ ID NO: 3733127 - DNA, 23 bp, Homo sapiens
agcgtagctaagtgaaaaggtca

SEQ ID NO: 3733128 - DNA, 22 bp, Homo sapiens
agcgtgaaggccgagaagcaag

SEQ ID NO: 3733129 - DNA, 13 bp, Homo sapiens
agcgtgagccact

SEQ ID NO: 3733130 - DNA, 17 bp, Homo sapiens
agcgtgagccactgcac

SEQ ID NO: 3733131 - DNA, 19 bp, Homo sapiens
agcgttggaattaaaacaa

SEQ ID NO: 3733132 - DNA, 21 bp, Homo sapiens
agctaaagaggctgaaagagg

SEQ ID NO: 3733133 - DNA, 19 bp, Homo sapiens
agctaacactggcccctag

SEQ ID NO: 3733134 - DNA, 16 bp, Homo sapiens
agctaaggacatttcc

SEQ ID NO: 3733135 - DNA, 14 bp, Homo sapiens
agctaataaaatat

SEQ ID NO: 3733136 - DNA, 22 bp, Homo sapiens
agctaataattcttcacctaag

SEQ ID NO: 3733137 - DNA, 16 bp, Homo sapiens
agctaatggaaaatga

SEQ ID NO: 3733138 - DNA, 13 bp, Homo sapiens
agctaatgggaca

SEQ ID NO: 3733139 - DNA, 15 bp, Homo sapiens
agctaatgggacact

SEQ ID NO: 3733140 - DNA, 18 bp, Homo sapiens
agctaattattttaatta

SEQ ID NO: 3733141 - DNA, 21 bp, Homo sapiens
agctaattattttaattaggt

SEQ ID NO: 3733142 - DNA, 22 bp, Homo sapiens
agctacaggaagcaccccatgc

SEQ ID NO: 3733143 - DNA, 22 bp, Homo sapiens
agctacccaggaggctgaggtg

SEQ ID NO: 3733144 - DNA, 19 bp, Homo sapiens
agctactcagaagcctgag

SEQ ID NO: 3733145 - DNA, 13 bp, Homo sapiens
agctactcaggag

SEQ ID NO: 3733146 - DNA, 18 bp, Homo sapiens
agctactcaggaggctga

SEQ ID NO: 3733147 - DNA, 16 bp, Homo sapiens
agctacttgggaggct

SEQ ID NO: 3733148 - DNA, 22 bp, Homo sapiens
agctagaagtgggccaggacag

SEQ ID NO: 3733149 - DNA, 24 bp, Homo sapiens
agctagaagtgggccaggacaggc

SEQ ID NO: 3733150 - DNA, 14 bp, Homo sapiens
agctagagcttcaa

SEQ ID NO: 3733151 - DNA, 12 bp, Homo sapiens
agctagaggaac

SEQ ID NO: 3733152 - DNA, 16 bp, Homo sapiens
agctaggcctggccag

SEQ ID NO: 3733153 - DNA, 21 bp, Homo sapiens
agctaggtgctaattaataaa

SEQ ID NO: 3733154 - DNA, 12 bp, Homo sapiens
agctagttttct

SEQ ID NO: 3733155 - DNA, 19 bp, Homo sapiens
agctatacagttttcctaa

SEQ ID NO: 3733156 - DNA, 19 bp, Homo sapiens
agctatagacccgaggaaa

SEQ ID NO: 3733157 - DNA, 17 bp, Homo sapiens
agctatatccatgtact

SEQ ID NO: 3733158 - DNA, 18 bp, Homo sapiens
agctatctaggtggagtt

SEQ ID NO: 3733159 - DNA, 18 bp, Homo sapiens
agctatctatatggaatt

SEQ ID NO: 3733160 - DNA, 22 bp, Homo sapiens
agctatttttatttgtttgtgc

SEQ ID NO: 3733161 - DNA, 19 bp, Homo sapiens
agctcaccagccccagtgc

SEQ ID NO: 3733162 - DNA, 13 bp, Homo sapiens
agctcacgtcaca

SEQ ID NO: 3733163 - DNA, 15 bp, Homo sapiens
agctcagacccccac

SEQ ID NO: 3733164 - DNA, 20 bp, Homo sapiens
agctcagcccacccccctca

SEQ ID NO: 3733165 - DNA, 21 bp, Homo sapiens
agctcagcccacccccctcat

SEQ ID NO: 3733166 - DNA, 13 bp, Homo sapiens
agctcagccccag

SEQ ID NO: 3733167 - DNA, 15 bp, Homo sapiens
agctcagccccagcc

SEQ ID NO: 3733168 - DNA, 20 bp, Homo sapiens
agctcagccccagcccagcc

SEQ ID NO: 3733169 - DNA, 13 bp, Homo sapiens
agctcagtcccat

SEQ ID NO: 3733170 - DNA, 21 bp, Homo sapiens
agctcagtcccatcagagagc

SEQ ID NO: 3733171 - DNA, 19 bp, Homo sapiens
agctcatgtagcaatcaga

SEQ ID NO: 3733172 - DNA, 18 bp, Homo sapiens
agctccagacccccagca

SEQ ID NO: 3733173 - DNA, 23 bp, Homo sapiens
agctccagacccccagcaaccct

SEQ ID NO: 3733174 - DNA, 21 bp, Homo sapiens
agctccagctcaccagcccca

SEQ ID NO: 3733175 - DNA, 14 bp, Homo sapiens
agctccagtcctgc

SEQ ID NO: 3733176 - DNA, 15 bp, Homo sapiens
agctccagtcctgct

SEQ ID NO: 3733177 - DNA, 19 bp, Homo sapiens
agctccagtggaagaagaa

SEQ ID NO: 3733178 - DNA, 16 bp, Homo sapiens
agctccatctccactc

SEQ ID NO: 3733179 - DNA, 15 bp, Homo sapiens
agctcccaccccacc

SEQ ID NO: 3733180 - DNA, 20 bp, Homo sapiens
agctccgctttctacccagc

SEQ ID NO: 3733181 - DNA, 21 bp, Homo sapiens
agctccgctttctacccagcg

SEQ ID NO: 3733182 - DNA, 16 bp, Homo sapiens
agctcctcaactcacc

SEQ ID NO: 3733183 - DNA, 21 bp, Homo sapiens
agctcctccttgtcttggcag

SEQ ID NO: 3733184 - DNA, 12 bp, Homo sapiens
agctcctctggg

SEQ ID NO: 3733185 - DNA, 16 bp, Homo sapiens
agctcctgggaaggct

SEQ ID NO: 3733186 - DNA, 23 bp, Homo sapiens
agctcctgggaaggctactcacc

SEQ ID NO: 3733187 - DNA, 22 bp, Homo sapiens
agctcctggtcttgagatgtct

SEQ ID NO: 3733188 - DNA, 16 bp, Homo sapiens
agctccttctgtccta

SEQ ID NO: 3733189 - DNA, 21 bp, Homo sapiens
agctccttctgtcctactctg

SEQ ID NO: 3733190 - DNA, 21 bp, Homo sapiens
agctccttgagggcaagagcc

SEQ ID NO: 3733191 - DNA, 19 bp, Homo sapiens
agctccttgggaggcccca

SEQ ID NO: 3733192 - DNA, 22 bp, Homo sapiens
agctccttgggaggccccactg

SEQ ID NO: 3733193 - DNA, 18 bp, Homo sapiens
agctcggtggacccaggg

SEQ ID NO: 3733194 - DNA, 19 bp, Homo sapiens
agctcggtggacccaggga

SEQ ID NO: 3733195 - DNA, 16 bp, Homo sapiens
agctctagacaaccct

SEQ ID NO: 3733196 - DNA, 14 bp, Homo sapiens
agctctccctctgg

SEQ ID NO: 3733197 - DNA, 15 bp, Homo sapiens
agctctccctctggc

SEQ ID NO: 3733198 - DNA, 16 bp, Homo sapiens
agctctccctctggcc

SEQ ID NO: 3733199 - DNA, 16 bp, Homo sapiens
aggactgcaccattgc

SEQ ID NO: 3733200 - DNA, 19 bp, Homo sapiens
aggactgcatggtaattta

SEQ ID NO: 3733201 - DNA, 18 bp, Homo sapiens
aggactgccccgtgcaga

SEQ ID NO: 3733202 - DNA, 21 bp, Homo sapiens
aggactgccccgtgcagactg

SEQ ID NO: 3733203 - DNA, 21 bp, Homo sapiens
aggactgccgaccgaggctgg

SEQ ID NO: 3733204 - DNA, 22 bp, Homo sapiens
aggactggctttgtcccacagc

SEQ ID NO: 3733205 - DNA, 19 bp, Homo sapiens
aggacttgaaagcatccat

SEQ ID NO: 3733206 - DNA, 16 bp, Homo sapiens
aggacttggtctgatt

SEQ ID NO: 3733207 - DNA, 20 bp, Homo sapiens
aggacttggtctgatttcag

SEQ ID NO: 3733208 - DNA, 23 bp, Homo sapiens
aggacttggtctgatttcaggat

SEQ ID NO: 3733209 - DNA, 16 bp, Homo sapiens
aggacttgtgtctctg

SEQ ID NO: 3733210 - DNA, 21 bp, Homo sapiens
aggactttatagatcagccag

SEQ ID NO: 3733211 - DNA, 17 bp, Homo sapiens
aggacttttctttgtgg

SEQ ID NO: 3733212 - DNA, 19 bp, Homo sapiens
aggacttttctttgtggct

SEQ ID NO: 3733213 - DNA, 13 bp, Homo sapiens
aggagaaacacat

SEQ ID NO: 3733214 - DNA, 16 bp, Homo sapiens
aggagaaatgcatcca

SEQ ID NO: 3733215 - DNA, 16 bp, Homo sapiens
aggagaatccaagcga

SEQ ID NO: 3733216 - DNA, 20 bp, Homo sapiens
aggagaatggcgtgaacccg

SEQ ID NO: 3733217 - DNA, 20 bp, Homo sapiens
aggagaattgcttgaacctg

SEQ ID NO: 3733218 - DNA, 18 bp, Homo sapiens
aggagacagttcaagaaa

SEQ ID NO: 3733219 - DNA, 14 bp, Homo sapiens
aggagaccaaggcg

SEQ ID NO: 3733220 - DNA, 20 bp, Homo sapiens
aggagaccaagtcctggcta

SEQ ID NO: 3733221 - DNA, 17 bp, Homo sapiens
aggagactcacctctgc

SEQ ID NO: 3733222 - DNA, 19 bp, Homo sapiens
aggagactcacctctgcct

SEQ ID NO: 3733223 - DNA, 21 bp, Homo sapiens
aggagactcacctctgcctca

SEQ ID NO: 3733224 - DNA, 21 bp, Homo sapiens
aggagagaaggggaggagggc

SEQ ID NO: 3733225 - DNA, 18 bp, Homo sapiens
aggagagagatcatgaga

SEQ ID NO: 3733226 - DNA, 16 bp, Homo sapiens
aggagagccagccctc

SEQ ID NO: 3733227 - DNA, 16 bp, Homo sapiens
aggagagcccttcatt

SEQ ID NO: 3733228 - DNA, 12 bp, Homo sapiens
aggagagcctgc

SEQ ID NO: 3733229 - DNA, 13 bp, Homo sapiens
aggagagcctgct

SEQ ID NO: 3733230 - DNA, 16 bp, Homo sapiens
aggagaggggcacagg

SEQ ID NO: 3733231 - DNA, 18 bp, Homo sapiens
aggagaggggcacagggt

SEQ ID NO: 3733232 - DNA, 18 bp, Homo sapiens
aggagaggggcagaacag

SEQ ID NO: 3733233 - DNA, 17 bp, Homo sapiens
aggagatggggacaggg

SEQ ID NO: 3733234 - DNA, 17 bp, Homo sapiens
aggagcctatggcatct

SEQ ID NO: 3733235 - DNA, 19 bp, Homo sapiens
aggagctcttcaggcctcc

SEQ ID NO: 3733236 - DNA, 15 bp, Homo sapiens
aggagctgagaatag

SEQ ID NO: 3733237 - DNA, 17 bp, Homo sapiens
aggagctgagaatagaa

SEQ ID NO: 3733238 - DNA, 22 bp, Homo sapiens
aggagctgagaatagaaggaaa

SEQ ID NO: 3733239 - DNA, 23 bp, Homo sapiens
aggagctgagaatagaaggaaac

SEQ ID NO: 3733240 - DNA, 17 bp, Homo sapiens
aggagctgctggcttgc

SEQ ID NO: 3733241 - DNA, 17 bp, Homo sapiens
aggagctgggaggaaaa

SEQ ID NO: 3733242 - DNA, 20 bp, Homo sapiens
aggaggattgcttgagccca

SEQ ID NO: 3733243 - DNA, 16 bp, Homo sapiens
aggaggctgaggcaga

SEQ ID NO: 3733244 - DNA, 20 bp, Homo sapiens
aggagggccctacctgattg

SEQ ID NO: 3733245 - DNA, 17 bp, Homo sapiens
aggagggcgtgactcac

SEQ ID NO: 3733246 - DNA, 17 bp, Homo sapiens
aggaggggatagagaga

SEQ ID NO: 3733247 - DNA, 14 bp, Homo sapiens
aggagtcccaagga

SEQ ID NO: 3733248 - DNA, 16 bp, Homo sapiens
aggagtcccaaggaaa

SEQ ID NO: 3733249 - DNA, 23 bp, Homo sapiens
aggagttcagggtcatagcatgc

SEQ ID NO: 3733250 - DNA, 16 bp, Homo sapiens
aggagttcgaggctgc

SEQ ID NO: 3733251 - DNA, 19 bp, Homo sapiens
aggagtttgagaccagcct

SEQ ID NO: 3733252 - DNA, 19 bp, Homo sapiens
aggagtttgaggctgcagc

SEQ ID NO: 3733253 - DNA, 13 bp, Homo sapiens
aggatactctgtc

SEQ ID NO: 3733254 - DNA, 16 bp, Homo sapiens
aggatagataactctt

SEQ ID NO: 3733255 - DNA, 14 bp, Homo sapiens
aggatcagaaagta

SEQ ID NO: 3733256 - DNA, 13 bp, Homo sapiens
aggatcagtctga

SEQ ID NO: 3733257 - DNA, 20 bp, Homo sapiens
aggatcatttgttggaatga

SEQ ID NO: 3733258 - DNA, 21 bp, Homo sapiens
aggatcatttgttggaatgaa

SEQ ID NO: 3733259 - DNA, 21 bp, Homo sapiens
aggatctcttgagcctgggag

SEQ ID NO: 3733260 - DNA, 22 bp, Homo sapiens
aggatctcttgagcctgggagg

SEQ ID NO: 3733261 - DNA, 22 bp, Homo sapiens
aggatctttcacccacagaaag

SEQ ID NO: 3733262 - DNA, 18 bp, Homo sapiens
aggatcttttgaacccag

SEQ ID NO: 3733263 - DNA, 20 bp, Homo sapiens
aggatgaatgaggtcccagg

SEQ ID NO: 3733264 - DNA, 21 bp, Homo sapiens
aggatgaatgaggtcccaggc

SEQ ID NO: 3733265 - DNA, 22 bp, Homo sapiens
aggatgaatgaggtcccaggca

SEQ ID NO: 3733266 - DNA, 20 bp, Homo sapiens
aggatgattgtacagaatca

SEQ ID NO: 3733267 - DNA, 22 bp, Homo sapiens
aggatgcccagggccactctgc

SEQ ID NO: 3733268 - DNA, 13 bp, Homo sapiens
aggatggagagag

SEQ ID NO: 3733269 - DNA, 12 bp, Homo sapiens
aggatgggaagg

SEQ ID NO: 3733270 - DNA, 19 bp, Homo sapiens
aggatgtaaacagtgcctg

SEQ ID NO: 3733271 - DNA, 19 bp, Homo sapiens
aggatgtcactcagatgga

SEQ ID NO: 3733272 - DNA, 18 bp, Homo sapiens
aggatgttctgggacaca

SEQ ID NO: 3733273 - DNA, 20 bp, Homo sapiens
aggatgttctgggacacagt

SEQ ID NO: 3733274 - DNA, 17 bp, Homo sapiens
aggattcttcctccctc

SEQ ID NO: 3733275 - DNA, 17 bp, Homo sapiens
aggattgcttgagccca

SEQ ID NO: 3733276 - DNA, 20 bp, Homo sapiens
aggattgcttgagcccagga

SEQ ID NO: 3733277 - DNA, 22 bp, Homo sapiens
aggattgcttgagcccaggagt

SEQ ID NO: 3733278 - DNA, 16 bp, Homo sapiens
aggatttcaagcctgc

SEQ ID NO: 3733279 - DNA, 23 bp, Homo sapiens
aggcaaaaggcagtggggctggg

SEQ ID NO: 3733280 - DNA, 19 bp, Homo sapiens
aggcaaaatccttgcttat

SEQ ID NO: 3733281 - DNA, 19 bp, Homo sapiens
aggcaactgaacaaaaaaa

SEQ ID NO: 3733282 - DNA, 17 bp, Homo sapiens
aggcaagcacctcctgc

SEQ ID NO: 3733283 - DNA, 18 bp, Homo sapiens
aggcaaggggtgcctggg

SEQ ID NO: 3733284 - DNA, 14 bp, Homo sapiens
aggcaataaaaatc

SEQ ID NO: 3733285 - DNA, 19 bp, Homo sapiens
aggcaatgtcaggaacaga

SEQ ID NO: 3733286 - DNA, 22 bp, Homo sapiens
aggcaatgtcaggaacagaagg

SEQ ID NO: 3733287 - DNA, 14 bp, Homo sapiens
aggcacacagctgc

SEQ ID NO: 3733288 - DNA, 20 bp, Homo sapiens
aggcaccagtgtcctcccct

SEQ ID NO: 3733289 - DNA, 12 bp, Homo sapiens
aggcaccattca

SEQ ID NO: 3733290 - DNA, 17 bp, Homo sapiens
aggcaccattcaggaac

SEQ ID NO: 3733291 - DNA, 16 bp, Homo sapiens
aggcaccgagaatgtt

SEQ ID NO: 3733292 - DNA, 18 bp, Homo sapiens
aggcaccgagaatgttgt

SEQ ID NO: 3733293 - DNA, 17 bp, Homo sapiens
aggcaccgctgatgggg

SEQ ID NO: 3733294 - DNA, 14 bp, Homo sapiens
aggcactgctgccc

SEQ ID NO: 3733295 - DNA, 16 bp, Homo sapiens
aggcactgctgcccag

SEQ ID NO: 3733296 - DNA, 17 bp, Homo sapiens
aggcagaaagcagaggc

SEQ ID NO: 3733297 - DNA, 18 bp, Homo sapiens
aggcagaaagcagaggct

SEQ ID NO: 3733298 - DNA, 23 bp, Homo sapiens
aggcagaaagcagaggctggcct

SEQ ID NO: 3733299 - DNA, 22 bp, Homo sapiens
aggcagaaccctggtgaggaag

SEQ ID NO: 3733300 - DNA, 13 bp, Homo sapiens
aggcagacagcag

SEQ ID NO: 3733301 - DNA, 14 bp, Homo sapiens
aggcagacagcagc

SEQ ID NO: 3733302 - DNA, 17 bp, Homo sapiens
aggcagagtgccccacc

SEQ ID NO: 3733303 - DNA, 22 bp, Homo sapiens
aggcagagtgccccacctgcca

SEQ ID NO: 3733304 - DNA, 16 bp, Homo sapiens
aggcagccccattctg

SEQ ID NO: 3733305 - DNA, 20 bp, Homo sapiens
aggcagccccattctgcctg

SEQ ID NO: 3733306 - DNA, 17 bp, Homo sapiens
aggcaggaagggcagga

SEQ ID NO: 3733307 - DNA, 13 bp, Homo sapiens
aggcagggaagtc

SEQ ID NO: 3733308 - DNA, 23 bp, Homo sapiens
aggcagggaagtccccaggcccc

SEQ ID NO: 3733309 - DNA, 13 bp, Homo sapiens
aggcagggagggg

SEQ ID NO: 3733310 - DNA, 16 bp, Homo sapiens
aggcagggaggggact

SEQ ID NO: 3733311 - DNA, 19 bp, Homo sapiens
aggggatgtatccatgggg

SEQ ID NO: 3733312 - DNA, 18 bp, Homo sapiens
aggggcaacgaagaaaaa

SEQ ID NO: 3733313 - DNA, 15 bp, Homo sapiens
aggggcagtctggag

SEQ ID NO: 3733314 - DNA, 16 bp, Homo sapiens
aggggcagtctggagg

SEQ ID NO: 3733315 - DNA, 18 bp, Homo sapiens
aggggcagtctggagggg

SEQ ID NO: 3733316 - DNA, 19 bp, Homo sapiens
aggggcatctgcccctccc

SEQ ID NO: 3733317 - DNA, 22 bp, Homo sapiens
aggggcatctgcccctccccca

SEQ ID NO: 3733318 - DNA, 22 bp, Homo sapiens
aggggccaaatatattctcttt

SEQ ID NO: 3733319 - DNA, 23 bp, Homo sapiens
aggggcctggcagccgtgccttc

SEQ ID NO: 3733320 - DNA, 14 bp, Homo sapiens
aggggcggcaggag

SEQ ID NO: 3733321 - DNA, 18 bp, Homo sapiens
aggggcggcaggagggag

SEQ ID NO: 3733322 - DNA, 13 bp, Homo sapiens
aggggctcctgga

SEQ ID NO: 3733323 - DNA, 23 bp, Homo sapiens
aggggctcctggaaaggctcagt

SEQ ID NO: 3733324 - DNA, 10 bp, Homo sapiens
aggggctggt

SEQ ID NO: 3733325 - DNA, 15 bp, Homo sapiens
agggggccacctccc

SEQ ID NO: 3733326 - DNA, 17 bp, Homo sapiens
aggggggctgcctggcc

SEQ ID NO: 3733327 - DNA, 12 bp, Homo sapiens
agggggttacaa

SEQ ID NO: 3733328 - DNA, 19 bp, Homo sapiens
agggggttacaaactgcaa

SEQ ID NO: 3733329 - DNA, 22 bp, Homo sapiens
agggggtttgggggcttgcaag

SEQ ID NO: 3733330 - DNA, 21 bp, Homo sapiens
aggggtcaagttattaatttc

SEQ ID NO: 3733331 - DNA, 20 bp, Homo sapiens
aggggtcagggaccaaggac

SEQ ID NO: 3733332 - DNA, 24 bp, Homo sapiens
aggggtcagggaccaaggacccct

SEQ ID NO: 3733333 - DNA, 18 bp, Homo sapiens
aggggtcccagccacccc

SEQ ID NO: 3733334 - DNA, 17 bp, Homo sapiens
agggtaaattattcagt

SEQ ID NO: 3733335 - DNA, 23 bp, Homo sapiens
agggtaccttgaacactggggga

SEQ ID NO: 3733336 - DNA, 15 bp, Homo sapiens
agggtagcaggtacc

SEQ ID NO: 3733337 - DNA, 19 bp, Homo sapiens
agggtatcaggtgctgcca

SEQ ID NO: 3733338 - DNA, 13 bp, Homo sapiens
agggtcagagagg

SEQ ID NO: 3733339 - DNA, 15 bp, Homo sapiens
agggtctagggagag

SEQ ID NO: 3733340 - DNA, 21 bp, Homo sapiens
agggtctcactatgttgccca

SEQ ID NO: 3733341 - DNA, 14 bp, Homo sapiens
agggtctcactctg

SEQ ID NO: 3733342 - DNA, 13 bp, Homo sapiens
agggtgaggatgg

SEQ ID NO: 3733343 - DNA, 14 bp, Homo sapiens
agggtggcccttgc

SEQ ID NO: 3733344 - DNA, 16 bp, Homo sapiens
agggtgggagagccca

SEQ ID NO: 3733345 - DNA, 17 bp, Homo sapiens
agggtgggagagcccag

SEQ ID NO: 3733346 - DNA, 17 bp, Homo sapiens
agggtggtgacctctgc

SEQ ID NO: 3733347 - DNA, 19 bp, Homo sapiens
agggtggtgacctctgcct

SEQ ID NO: 3733348 - DNA, 21 bp, Homo sapiens
agggtggtgacctctgcctga

SEQ ID NO: 3733349 - DNA, 13 bp, Homo sapiens
agggttagggagg

SEQ ID NO: 3733350 - DNA, 13 bp, Homo sapiens
agggttataataa

SEQ ID NO: 3733351 - DNA, 14 bp, Homo sapiens
agggttcaaaatgt

SEQ ID NO: 3733352 - DNA, 18 bp, Homo sapiens
agggttcagagactcagg

SEQ ID NO: 3733353 - DNA, 17 bp, Homo sapiens
agggttcccccagccct

SEQ ID NO: 3733354 - DNA, 23 bp, Homo sapiens
agggttcctgtagacctagggag

SEQ ID NO: 3733355 - DNA, 17 bp, Homo sapiens
agggttctcctctcccc

SEQ ID NO: 3733356 - DNA, 14 bp, Homo sapiens
agggttggcccctg

SEQ ID NO: 3733357 - DNA, 23 bp, Homo sapiens
agggttggcccctgcccggctgc

SEQ ID NO: 3733358 - DNA, 17 bp, Homo sapiens
agggttgggctggtgtc

SEQ ID NO: 3733359 - DNA, 17 bp, Homo sapiens
agggttggggaggggcg

SEQ ID NO: 3733360 - DNA, 14 bp, Homo sapiens
agggtttgtggctg

SEQ ID NO: 3733361 - DNA, 17 bp, Homo sapiens
agggttttatctctgtc

SEQ ID NO: 3733362 - DNA, 18 bp, Homo sapiens
agggttttccaccctgga

SEQ ID NO: 3733363 - DNA, 15 bp, Homo sapiens
aggtaaaattctaaa

SEQ ID NO: 3733364 - DNA, 12 bp, Homo sapiens
aggtacactctt

SEQ ID NO: 3733365 - DNA, 16 bp, Homo sapiens
aggtacagagaaggaa

SEQ ID NO: 3733366 - DNA, 17 bp, Homo sapiens
aggtaccccagctctgc

SEQ ID NO: 3733367 - DNA, 16 bp, Homo sapiens
aggtacttttggaatc

SEQ ID NO: 3733368 - DNA, 17 bp, Homo sapiens
aggtacttttggaatct

SEQ ID NO: 3733369 - DNA, 19 bp, Homo sapiens
aggtagaaatatctgaaaa

SEQ ID NO: 3733370 - DNA, 19 bp, Homo sapiens
aggtagctgcccctggctc

SEQ ID NO: 3733371 - DNA, 17 bp, Homo sapiens
aggtatgcaatcaaatc

SEQ ID NO: 3733372 - DNA, 21 bp, Homo sapiens
aggtatgcaatcaaatctgct

SEQ ID NO: 3733373 - DNA, 14 bp, Homo sapiens
aggtcaacagagaa

SEQ ID NO: 3733374 - DNA, 21 bp, Homo sapiens
aggtcaacagagaaggcagga

SEQ ID NO: 3733375 - DNA, 16 bp, Homo sapiens
aggtcaagcccaggag

SEQ ID NO: 3733376 - DNA, 21 bp, Homo sapiens
aggtcaaggcctgtccctggc

SEQ ID NO: 3733377 - DNA, 18 bp, Homo sapiens
aggtcaagtaagaagaca

SEQ ID NO: 3733378 - DNA, 14 bp, Homo sapiens
aggtcactcctggg

SEQ ID NO: 3733379 - DNA, 18 bp, Homo sapiens
aggtcagagcctgcagtt

SEQ ID NO: 3733380 - DNA, 16 bp, Homo sapiens
aggtcagcttgctgcc

SEQ ID NO: 3733381 - DNA, 19 bp, Homo sapiens
aggtcaggagttagaggcc

SEQ ID NO: 3733382 - DNA, 15 bp, Homo sapiens
aggtcaggagttcct

SEQ ID NO: 3733383 - DNA, 16 bp, Homo sapiens
aggtcaggagttccta

SEQ ID NO: 3733384 - DNA, 17 bp, Homo sapiens
aggtcatagctgagatt

SEQ ID NO: 3733385 - DNA, 14 bp, Homo sapiens
aggtcccaggcaga

SEQ ID NO: 3733386 - DNA, 17 bp, Homo sapiens
aggtcctgggggcctga

SEQ ID NO: 3733387 - DNA, 18 bp, Homo sapiens
aggtcctgggggcctgac

SEQ ID NO: 3733388 - DNA, 21 bp, Homo sapiens
aggtcgaccccaaagcccctt

SEQ ID NO: 3733389 - DNA, 23 bp, Homo sapiens
aggtctcccgggaagccaccctc

SEQ ID NO: 3733390 - DNA, 12 bp, Homo sapiens
aggtctcctctt

SEQ ID NO: 3733391 - DNA, 13 bp, Homo sapiens
aggtctcctctta

SEQ ID NO: 3733392 - DNA, 14 bp, Homo sapiens
aggtctcctcttaa

SEQ ID NO: 3733393 - DNA, 15 bp, Homo sapiens
aggtctctctttgga

SEQ ID NO: 3733394 - DNA, 16 bp, Homo sapiens
aggtctcttgagggag

SEQ ID NO: 3733395 - DNA, 16 bp, Homo sapiens
aggtctgggagaggca

SEQ ID NO: 3733396 - DNA, 21 bp, Homo sapiens
aggtctgggagaggcagagtg

SEQ ID NO: 3733397 - DNA, 20 bp, Homo sapiens
aggtcttgaactcctggcct

SEQ ID NO: 3733398 - DNA, 22 bp, Homo sapiens
aggtcttgaactcctggcctca

SEQ ID NO: 3733399 - DNA, 18 bp, Homo sapiens
aggtctttggttcagcta

SEQ ID NO: 3733400 - DNA, 14 bp, Homo sapiens
aggtcttttgacat

SEQ ID NO: 3733401 - DNA, 14 bp, Homo sapiens
aggtgaaagggagc

SEQ ID NO: 3733402 - DNA, 16 bp, Homo sapiens
aggtgaaagggagcta

SEQ ID NO: 3733403 - DNA, 22 bp, Homo sapiens
aggtgacagagtgagactctgt

SEQ ID NO: 3733404 - DNA, 21 bp, Homo sapiens
aggtgacagtgaggtcctggg

SEQ ID NO: 3733405 - DNA, 16 bp, Homo sapiens
aggtgagaagcagagg

SEQ ID NO: 3733406 - DNA, 23 bp, Homo sapiens
aggtgagaagcagaggaaggaga

SEQ ID NO: 3733407 - DNA, 23 bp, Homo sapiens
aggtgatccacccacctcagcct

SEQ ID NO: 3733408 - DNA, 17 bp, Homo sapiens
aggtgcagagtgcccag

SEQ ID NO: 3733409 - DNA, 20 bp, Homo sapiens
aggtgcagagtgcccagaac

SEQ ID NO: 3733410 - DNA, 23 bp, Homo sapiens
aggtgcatctggggaactagagg

SEQ ID NO: 3733411 - DNA, 20 bp, Homo sapiens
aggtgcccacatgtgtccat

SEQ ID NO: 3733412 - DNA, 19 bp, Homo sapiens
aggtgcctgtgaggcaggg

SEQ ID NO: 3733413 - DNA, 13 bp, Homo sapiens
aggtgccttctta

SEQ ID NO: 3733414 - DNA, 23 bp, Homo sapiens
aggtgccttcttattctcactcc

SEQ ID NO: 3733415 - DNA, 16 bp, Homo sapiens
aggtgctgccatccag

SEQ ID NO: 3733416 - DNA, 17 bp, Homo sapiens
aggtgctgccatccagg

SEQ ID NO: 3733417 - DNA, 14 bp, Homo sapiens
aggtgctgttgtca

SEQ ID NO: 3733418 - DNA, 19 bp, Homo sapiens
aggtgctgttgtcattgct

SEQ ID NO: 3733419 - DNA, 23 bp, Homo sapiens
aggtgctgttgtcattgctttac

SEQ ID NO: 3733420 - DNA, 13 bp, Homo sapiens
aggtggaaaaaca

SEQ ID NO: 3733421 - DNA, 11 bp, Homo sapiens
aggtggaagcc

SEQ ID NO: 3733422 - DNA, 14 bp, Homo sapiens
aggtggaagccctc

SEQ ID NO: 3733423 - DNA, 19 bp, Homo sapiens
aggtggaagccctccttcc

SEQ ID NO: 3733424 - DNA, 13 bp, Homo sapiens
agtcttttccatg

SEQ ID NO: 3733425 - DNA, 12 bp, Homo sapiens
agtgaaaactag

SEQ ID NO: 3733426 - DNA, 16 bp, Homo sapiens
agtgaaagctagagat

SEQ ID NO: 3733427 - DNA, 19 bp, Homo sapiens
agtgaaatctgtgcaataa

SEQ ID NO: 3733428 - DNA, 21 bp, Homo sapiens
agtgaaatctgtgcaataaaa

SEQ ID NO: 3733429 - DNA, 13 bp, Homo sapiens
agtgaaccatcat

SEQ ID NO: 3733430 - DNA, 21 bp, Homo sapiens
agtgaaccatcattataaacg

SEQ ID NO: 3733431 - DNA, 17 bp, Homo sapiens
agtgaaggccacagcaa

SEQ ID NO: 3733432 - DNA, 15 bp, Homo sapiens
agtgaataaaaatta

SEQ ID NO: 3733433 - DNA, 23 bp, Homo sapiens
agtgaatctaaaagcttttgctt

SEQ ID NO: 3733434 - DNA, 17 bp, Homo sapiens
agtgaatttttctctaa

SEQ ID NO: 3733435 - DNA, 23 bp, Homo sapiens
agtgaatttttctctaactcaga

SEQ ID NO: 3733436 - DNA, 18 bp, Homo sapiens
agtgacaaggccccagag

SEQ ID NO: 3733437 - DNA, 20 bp, Homo sapiens
agtgacacttcagagagctg

SEQ ID NO: 3733438 - DNA, 21 bp, Homo sapiens
agtgacacttcagagagctgg

SEQ ID NO: 3733439 - DNA, 22 bp, Homo sapiens
agtgacacttcagagagctggt

SEQ ID NO: 3733440 - DNA, 15 bp, Homo sapiens
agtgacagagttcac

SEQ ID NO: 3733441 - DNA, 19 bp, Homo sapiens
agtgacagtggattgcatt

SEQ ID NO: 3733442 - DNA, 14 bp, Homo sapiens
agtgaccaaggagg

SEQ ID NO: 3733443 - DNA, 15 bp, Homo sapiens
agtgactgtatctgt

SEQ ID NO: 3733444 - DNA, 18 bp, Homo sapiens
agtgactgtatctgtgta

SEQ ID NO: 3733445 - DNA, 20 bp, Homo sapiens
agtgactgtatctgtgtaga

SEQ ID NO: 3733446 - DNA, 19 bp, Homo sapiens
agtgagaagaatattgttc

SEQ ID NO: 3733447 - DNA, 17 bp, Homo sapiens
agtgagaccctgtctct

SEQ ID NO: 3733448 - DNA, 13 bp, Homo sapiens
agtgagactctgt

SEQ ID NO: 3733449 - DNA, 16 bp, Homo sapiens
agtgagactctgtctc

SEQ ID NO: 3733450 - DNA, 12 bp, Homo sapiens
agtgagcatgct

SEQ ID NO: 3733451 - DNA, 19 bp, Homo sapiens
agtgagccgcatcttctcc

SEQ ID NO: 3733452 - DNA, 20 bp, Homo sapiens
agtgagccgcatcttctcca

SEQ ID NO: 3733453 - DNA, 24 bp, Homo sapiens
agtgagccgcatcttctccatctg

SEQ ID NO: 3733454 - DNA, 23 bp, Homo sapiens
agtgagctgagatcgtgccgtta

SEQ ID NO: 3733455 - DNA, 12 bp, Homo sapiens
agtgagctggtt

SEQ ID NO: 3733456 - DNA, 23 bp, Homo sapiens
agtgagctggtttttagcggaga

SEQ ID NO: 3733457 - DNA, 15 bp, Homo sapiens
agtgaggcccaggga

SEQ ID NO: 3733458 - DNA, 22 bp, Homo sapiens
agtgagggtcagagaggagtca

SEQ ID NO: 3733459 - DNA, 23 bp, Homo sapiens
agtgagggtcagagaggagtcag

SEQ ID NO: 3733460 - DNA, 18 bp, Homo sapiens
agtgaggtcctgggggcc

SEQ ID NO: 3733461 - DNA, 16 bp, Homo sapiens
agtgagtcgaggacag

SEQ ID NO: 3733462 - DNA, 16 bp, Homo sapiens
agtgagtctcttcaga

SEQ ID NO: 3733463 - DNA, 19 bp, Homo sapiens
agtgagtgtggctcccctc

SEQ ID NO: 3733464 - DNA, 19 bp, Homo sapiens
agtgataatttctggaatt

SEQ ID NO: 3733465 - DNA, 17 bp, Homo sapiens
agtgatacaacttcaag

SEQ ID NO: 3733466 - DNA, 23 bp, Homo sapiens
agtgatacaacttcaagtgcatg

SEQ ID NO: 3733467 - DNA, 19 bp, Homo sapiens
agtgatcaataaaatgtga

SEQ ID NO: 3733468 - DNA, 22 bp, Homo sapiens
agtgatcctcccacctcagcct

SEQ ID NO: 3733469 - DNA, 21 bp, Homo sapiens
agtgatctccatatgttacac

SEQ ID NO: 3733470 - DNA, 13 bp, Homo sapiens
agtgatggtcaga

SEQ ID NO: 3733471 - DNA, 15 bp, Homo sapiens
agtgattctcctgcc

SEQ ID NO: 3733472 - DNA, 20 bp, Homo sapiens
agtgattctcctgcctcagc

SEQ ID NO: 3733473 - DNA, 18 bp, Homo sapiens
agtgcaaatttgatacat

SEQ ID NO: 3733474 - DNA, 17 bp, Homo sapiens
agtgcaacactgaagct

SEQ ID NO: 3733475 - DNA, 22 bp, Homo sapiens
agtgcaatggtataaatttcaa

SEQ ID NO: 3733476 - DNA, 12 bp, Homo sapiens
agtgcagacagg

SEQ ID NO: 3733477 - DNA, 13 bp, Homo sapiens
agtgcagacaggc

SEQ ID NO: 3733478 - DNA, 22 bp, Homo sapiens
agtgcagcaaccagagcactgt

SEQ ID NO: 3733479 - DNA, 24 bp, Homo sapiens
agtgcagcccgtgtggccccttca

SEQ ID NO: 3733480 - DNA, 17 bp, Homo sapiens
agtgcagctgattttaa

SEQ ID NO: 3733481 - DNA, 17 bp, Homo sapiens
agtgcagtgagccgaga

SEQ ID NO: 3733482 - DNA, 23 bp, Homo sapiens
agtgcagtggtgcgatcatggct

SEQ ID NO: 3733483 - DNA, 21 bp, Homo sapiens
agtgccactgcccgagctggt

SEQ ID NO: 3733484 - DNA, 20 bp, Homo sapiens
agtgccagtcttgtgtctgc

SEQ ID NO: 3733485 - DNA, 15 bp, Homo sapiens
agtgcccaactgtta

SEQ ID NO: 3733486 - DNA, 11 bp, Homo sapiens
agtgcccctgc

SEQ ID NO: 3733487 - DNA, 13 bp, Homo sapiens
agtgcccctgctg

SEQ ID NO: 3733488 - DNA, 21 bp, Homo sapiens
agtgcccctgctgcctcccca

SEQ ID NO: 3733489 - DNA, 17 bp, Homo sapiens
agtgccctccacagccg

SEQ ID NO: 3733490 - DNA, 17 bp, Homo sapiens
agtgccttacctcctgc

SEQ ID NO: 3733491 - DNA, 22 bp, Homo sapiens
agtgccttacctcctgcccagg

SEQ ID NO: 3733492 - DNA, 12 bp, Homo sapiens
agtgctgtaaaa

SEQ ID NO: 3733493 - DNA, 14 bp, Homo sapiens
agtgctgtggcctg

SEQ ID NO: 3733494 - DNA, 19 bp, Homo sapiens
agtgcttaaaaatcattga

SEQ ID NO: 3733495 - DNA, 14 bp, Homo sapiens
agtgcttcagcctg

SEQ ID NO: 3733496 - DNA, 15 bp, Homo sapiens
agtgcttcagcctga

SEQ ID NO: 3733497 - DNA, 16 bp, Homo sapiens
agtgcttcagcctgag

SEQ ID NO: 3733498 - DNA, 19 bp, Homo sapiens
agtgcttcagcctgaggct

SEQ ID NO: 3733499 - DNA, 20 bp, Homo sapiens
agtgcttcagcctgaggctg

SEQ ID NO: 3733500 - DNA, 16 bp, Homo sapiens
agtgcttccaaggatg

SEQ ID NO: 3733501 - DNA, 19 bp, Homo sapiens
agtggaaaaatagcctgcc

SEQ ID NO: 3733502 - DNA, 12 bp, Homo sapiens
agtggaaggaaa

SEQ ID NO: 3733503 - DNA, 13 bp, Homo sapiens
agtggaaggaaag

SEQ ID NO: 3733504 - DNA, 15 bp, Homo sapiens
agtggaaggaaagat

SEQ ID NO: 3733505 - DNA, 20 bp, Homo sapiens
agtggacaccaggagtccct

SEQ ID NO: 3733506 - DNA, 19 bp, Homo sapiens
agtggaccaggacaggacc

SEQ ID NO: 3733507 - DNA, 18 bp, Homo sapiens
agtggaccttgagaccac

SEQ ID NO: 3733508 - DNA, 19 bp, Homo sapiens
agtggaccttgagaccaca

SEQ ID NO: 3733509 - DNA, 12 bp, Homo sapiens
agtggagaggga

SEQ ID NO: 3733510 - DNA, 21 bp, Homo sapiens
agtggatagatgccctgctag

SEQ ID NO: 3733511 - DNA, 13 bp, Homo sapiens
agtggatgatgtt

SEQ ID NO: 3733512 - DNA, 12 bp, Homo sapiens
agtggcagctgc

SEQ ID NO: 3733513 - DNA, 13 bp, Homo sapiens
agtggcagctgct

SEQ ID NO: 3733514 - DNA, 15 bp, Homo sapiens
agtggcatggctcca

SEQ ID NO: 3733515 - DNA, 21 bp, Homo sapiens
agtggccagaccagagctctg

SEQ ID NO: 3733516 - DNA, 20 bp, Homo sapiens
agtggcctcaaccctccctc

SEQ ID NO: 3733517 - DNA, 13 bp, Homo sapiens
agtggcctggcca

SEQ ID NO: 3733518 - DNA, 14 bp, Homo sapiens
agtggcctggccag

SEQ ID NO: 3733519 - DNA, 13 bp, Homo sapiens
agtggcctggctc

SEQ ID NO: 3733520 - DNA, 14 bp, Homo sapiens
agtggcctggctcc

SEQ ID NO: 3733521 - DNA, 17 bp, Homo sapiens
agtggcctggctccgct

SEQ ID NO: 3733522 - DNA, 15 bp, Homo sapiens
agtgggacagagtct

SEQ ID NO: 3733523 - DNA, 12 bp, Homo sapiens
agtgggagaaaa

SEQ ID NO: 3733524 - DNA, 13 bp, Homo sapiens
agtgggagaaaac

SEQ ID NO: 3733525 - DNA, 14 bp, Homo sapiens
agtgggagaaaaca

SEQ ID NO: 3733526 - DNA, 14 bp, Homo sapiens
agtgggagccaggg

SEQ ID NO: 3733527 - DNA, 14 bp, Homo sapiens
agtgggagctgcct

SEQ ID NO: 3733528 - DNA, 16 bp, Homo sapiens
agtgggagctgcctgt

SEQ ID NO: 3733529 - DNA, 13 bp, Homo sapiens
agtgggccaggac

SEQ ID NO: 3733530 - DNA, 21 bp, Homo sapiens
agtgggccaggacaggcccgg

SEQ ID NO: 3733531 - DNA, 18 bp, Homo sapiens
agtggggagacacctcag

SEQ ID NO: 3733532 - DNA, 18 bp, Homo sapiens
agtggggtctccctctcc

SEQ ID NO: 3733533 - DNA, 19 bp, Homo sapiens
agtggggtctccctctcct

SEQ ID NO: 3733534 - DNA, 23 bp, Homo sapiens
agtggggtctccctctcctgcct

SEQ ID NO: 3733535 - DNA, 19 bp, Homo sapiens
agtgggtgaataatacagt

SEQ ID NO: 3733536 - DNA, 15 bp, Homo sapiens
agtgggtttcacaag

SEQ ID NO: 3733537 - DNA, 21 bp, Homo sapiens
ataactgacaaatcaagtttc

SEQ ID NO: 3733538 - DNA, 19 bp, Homo sapiens
ataacttaaaaaaatgaca

SEQ ID NO: 3733539 - DNA, 16 bp, Homo sapiens
ataagaatgctggttt

SEQ ID NO: 3733540 - DNA, 20 bp, Homo sapiens
ataagagagaacaactactg

SEQ ID NO: 3733541 - DNA, 19 bp, Homo sapiens
ataagagagccttggttca

SEQ ID NO: 3733542 - DNA, 16 bp, Homo sapiens
ataagagttggctggt

SEQ ID NO: 3733543 - DNA, 16 bp, Homo sapiens
ataagctaaagaggct

SEQ ID NO: 3733544 - DNA, 17 bp, Homo sapiens
ataagctaaagaggctg

SEQ ID NO: 3733545 - DNA, 13 bp, Homo sapiens
ataagcttccagg

SEQ ID NO: 3733546 - DNA, 13 bp, Homo sapiens
ataaggatttttc

SEQ ID NO: 3733547 - DNA, 16 bp, Homo sapiens
ataaggccttaatatg

SEQ ID NO: 3733548 - DNA, 18 bp, Homo sapiens
ataagtactgtgtacaga

SEQ ID NO: 3733549 - DNA, 19 bp, Homo sapiens
ataagtactgtgtacagaa

SEQ ID NO: 3733550 - DNA, 22 bp, Homo sapiens
ataagttaacttccaatttaca

SEQ ID NO: 3733551 - DNA, 21 bp, Homo sapiens
ataagtttctgggacctcagt

SEQ ID NO: 3733552 - DNA, 14 bp, Homo sapiens
ataataaactgtcc

SEQ ID NO: 3733553 - DNA, 15 bp, Homo sapiens
ataataaatgtacat

SEQ ID NO: 3733554 - DNA, 13 bp, Homo sapiens
ataataagctaaa

SEQ ID NO: 3733555 - DNA, 17 bp, Homo sapiens
ataatacagccaaagat

SEQ ID NO: 3733556 - DNA, 12 bp, Homo sapiens
ataatatgagaa

SEQ ID NO: 3733557 - DNA, 20 bp, Homo sapiens
ataatatttttaattaaata

SEQ ID NO: 3733558 - DNA, 15 bp, Homo sapiens
ataatctagaacaca

SEQ ID NO: 3733559 - DNA, 22 bp, Homo sapiens
ataatctggactcctctgtcca

SEQ ID NO: 3733560 - DNA, 21 bp, Homo sapiens
ataatcttgtttctgaaaaga

SEQ ID NO: 3733561 - DNA, 13 bp, Homo sapiens
ataatgtcttgtt

SEQ ID NO: 3733562 - DNA, 19 bp, Homo sapiens
ataatgtgggaagaaacaa

SEQ ID NO: 3733563 - DNA, 19 bp, Homo sapiens
ataattatcggaagcagtg

SEQ ID NO: 3733564 - DNA, 16 bp, Homo sapiens
ataattatgacagtta

SEQ ID NO: 3733565 - DNA, 19 bp, Homo sapiens
ataattatgacagttatac

SEQ ID NO: 3733566 - DNA, 23 bp, Homo sapiens
ataattatgttattgaaaaaaat

SEQ ID NO: 3733567 - DNA, 14 bp, Homo sapiens
ataattctactttg

SEQ ID NO: 3733568 - DNA, 14 bp, Homo sapiens
ataattctttgatt

SEQ ID NO: 3733569 - DNA, 22 bp, Homo sapiens
ataattgacaggattattggaa

SEQ ID NO: 3733570 - DNA, 19 bp, Homo sapiens
ataattgttttttatcttt

SEQ ID NO: 3733571 - DNA, 21 bp, Homo sapiens
ataattgttttttatcttttc

SEQ ID NO: 3733572 - DNA, 23 bp, Homo sapiens
ataattgttttttatcttttcta

SEQ ID NO: 3733573 - DNA, 19 bp, Homo sapiens
ataatttgtacatatgtaa

SEQ ID NO: 3733574 - DNA, 15 bp, Homo sapiens
ataattttaaacaaa

SEQ ID NO: 3733575 - DNA, 22 bp, Homo sapiens
ataattttcttcatgcaatgac

SEQ ID NO: 3733576 - DNA, 15 bp, Homo sapiens
ataatttttaaagta

SEQ ID NO: 3733577 - DNA, 18 bp, Homo sapiens
ataatttttaaagtatat

SEQ ID NO: 3733578 - DNA, 20 bp, Homo sapiens
ataatttttttcaatattta

SEQ ID NO: 3733579 - DNA, 21 bp, Homo sapiens
ataatttttttcaatatttat

SEQ ID NO: 3733580 - DNA, 22 bp, Homo sapiens
ataatttttttcaatatttatt

SEQ ID NO: 3733581 - DNA, 17 bp, Homo sapiens
atacaagtttcagacag

SEQ ID NO: 3733582 - DNA, 18 bp, Homo sapiens
atacaagtttcagacagg

SEQ ID NO: 3733583 - DNA, 14 bp, Homo sapiens
atacaataacataa

SEQ ID NO: 3733584 - DNA, 15 bp, Homo sapiens
atacaattctacatt

SEQ ID NO: 3733585 - DNA, 17 bp, Homo sapiens
atacacacacaaagaga

SEQ ID NO: 3733586 - DNA, 14 bp, Homo sapiens
atacaccgggcctg

SEQ ID NO: 3733587 - DNA, 18 bp, Homo sapiens
atacaccgggcctggaga

SEQ ID NO: 3733588 - DNA, 21 bp, Homo sapiens
atacactgaagttaacagaga

SEQ ID NO: 3733589 - DNA, 22 bp, Homo sapiens
atacacttacactttatgcaca

SEQ ID NO: 3733590 - DNA, 23 bp, Homo sapiens
atacagatagatatatgctctgc

SEQ ID NO: 3733591 - DNA, 23 bp, Homo sapiens
atacaggaaaagctgctgacagt

SEQ ID NO: 3733592 - DNA, 19 bp, Homo sapiens
atacaggggaatattttat

SEQ ID NO: 3733593 - DNA, 14 bp, Homo sapiens
atacagtattctgt

SEQ ID NO: 3733594 - DNA, 15 bp, Homo sapiens
atacagtgttatttt

SEQ ID NO: 3733595 - DNA, 23 bp, Homo sapiens
atacagtgttattttctttgaaa

SEQ ID NO: 3733596 - DNA, 16 bp, Homo sapiens
atacagttttaaagaa

SEQ ID NO: 3733597 - DNA, 12 bp, Homo sapiens
atacataacagg

SEQ ID NO: 3733598 - DNA, 22 bp, Homo sapiens
atacataacagggtaaattatt

SEQ ID NO: 3733599 - DNA, 17 bp, Homo sapiens
atacatacacatatata

SEQ ID NO: 3733600 - DNA, 14 bp, Homo sapiens
atacatggttgtga

SEQ ID NO: 3733601 - DNA, 20 bp, Homo sapiens
atacatggttgtgacctgag

SEQ ID NO: 3733602 - DNA, 12 bp, Homo sapiens
atacattaaagc

SEQ ID NO: 3733603 - DNA, 14 bp, Homo sapiens
atacattaaagcag

SEQ ID NO: 3733604 - DNA, 16 bp, Homo sapiens
atacattaaagcagtc

SEQ ID NO: 3733605 - DNA, 23 bp, Homo sapiens
atacatttataatgtttgctatt

SEQ ID NO: 3733606 - DNA, 16 bp, Homo sapiens
atacatttgataaagt

SEQ ID NO: 3733607 - DNA, 12 bp, Homo sapiens
atacatttgtat

SEQ ID NO: 3733608 - DNA, 18 bp, Homo sapiens
atacccatagcttccatg

SEQ ID NO: 3733609 - DNA, 16 bp, Homo sapiens
ataccccgtgaagcat

SEQ ID NO: 3733610 - DNA, 15 bp, Homo sapiens
atacctcaacctatg

SEQ ID NO: 3733611 - DNA, 16 bp, Homo sapiens
atacctctttgaaaga

SEQ ID NO: 3733612 - DNA, 17 bp, Homo sapiens
atacctctttgaaagaa

SEQ ID NO: 3733613 - DNA, 14 bp, Homo sapiens
atacctgtcaatac

SEQ ID NO: 3733614 - DNA, 16 bp, Homo sapiens
atactctgcttagaat

SEQ ID NO: 3733615 - DNA, 19 bp, Homo sapiens
atactcttaggaagagaaa

SEQ ID NO: 3733616 - DNA, 22 bp, Homo sapiens
atactcttaggaagagaaacca

SEQ ID NO: 3733617 - DNA, 14 bp, Homo sapiens
atactggaagtttt

SEQ ID NO: 3733618 - DNA, 16 bp, Homo sapiens
atactggaagttttgc

SEQ ID NO: 3733619 - DNA, 20 bp, Homo sapiens
atactggaagttttgcattt

SEQ ID NO: 3733620 - DNA, 21 bp, Homo sapiens
atactggtgcagtcattatga

SEQ ID NO: 3733621 - DNA, 21 bp, Homo sapiens
atacttatatttttaataaaa

SEQ ID NO: 3733622 - DNA, 15 bp, Homo sapiens
atacttattcattgt

SEQ ID NO: 3733623 - DNA, 17 bp, Homo sapiens
atacttgtcttgttcac

SEQ ID NO: 3733624 - DNA, 15 bp, Homo sapiens
atacttgttttcaaa

SEQ ID NO: 3733625 - DNA, 13 bp, Homo sapiens
atactttttcaag

SEQ ID NO: 3733626 - DNA, 21 bp, Homo sapiens
atagaaaacaggaaaaaaact

SEQ ID NO: 3733627 - DNA, 22 bp, Homo sapiens
atagaaagccaaatcaaaatat

SEQ ID NO: 3733628 - DNA, 21 bp, Homo sapiens
atagaactcagttttaactag

SEQ ID NO: 3733629 - DNA, 19 bp, Homo sapiens
atagaagaactgcaaaggt

SEQ ID NO: 3733630 - DNA, 12 bp, Homo sapiens
atagaaggaaac

SEQ ID NO: 3733631 - DNA, 16 bp, Homo sapiens
atagaaggaggagagg

SEQ ID NO: 3733632 - DNA, 14 bp, Homo sapiens
atagaagtttagat

SEQ ID NO: 3733633 - DNA, 12 bp, Homo sapiens
atagaatattta

SEQ ID NO: 3733634 - DNA, 19 bp, Homo sapiens
atagaatttttaatgtttt

SEQ ID NO: 3733635 - DNA, 20 bp, Homo sapiens
atagacagtatatttatagt

SEQ ID NO: 3733636 - DNA, 15 bp, Homo sapiens
atagactagagaaac

SEQ ID NO: 3733637 - DNA, 14 bp, Homo sapiens
atagagagagacca

SEQ ID NO: 3733638 - DNA, 22 bp, Homo sapiens
atagaggtgagggaagcctgaa

SEQ ID NO: 3733639 - DNA, 14 bp, Homo sapiens
atagagtatatgca

SEQ ID NO: 3733640 - DNA, 18 bp, Homo sapiens
atagatagtaaaaagctt

SEQ ID NO: 3733641 - DNA, 21 bp, Homo sapiens
atagatcacataacagaatgc

SEQ ID NO: 3733642 - DNA, 14 bp, Homo sapiens
atagatgccctgct

SEQ ID NO: 3733643 - DNA, 22 bp, Homo sapiens
atagatgtagataaactcagaa

SEQ ID NO: 3733644 - DNA, 13 bp, Homo sapiens
atagattcacctg

SEQ ID NO: 3733645 - DNA, 18 bp, Homo sapiens
atagattcacctgtaaaa

SEQ ID NO: 3733646 - DNA, 23 bp, Homo sapiens
atagattcacctgtaaaacttta

SEQ ID NO: 3733647 - DNA, 13 bp, Homo sapiens
atagcaagtgaat

SEQ ID NO: 3733648 - DNA, 19 bp, Homo sapiens
atagcaagtgaatttttct

SEQ ID NO: 3733649 - DNA, 18 bp, Homo sapiens
atagcactttcattgcca

SEQ ID NO: 3733650 - DNA, 21 bp, Homo sapiens
atctaggtggagttgaaagag

SEQ ID NO: 3733651 - DNA, 22 bp, Homo sapiens
atctaggtggagttgaaagagt

SEQ ID NO: 3733652 - DNA, 20 bp, Homo sapiens
atctatatagtacctttgct

SEQ ID NO: 3733653 - DNA, 15 bp, Homo sapiens
atctattgggatttt

SEQ ID NO: 3733654 - DNA, 22 bp, Homo sapiens
atctattgggttcattattgga

SEQ ID NO: 3733655 - DNA, 14 bp, Homo sapiens
atctattgtaagat

SEQ ID NO: 3733656 - DNA, 19 bp, Homo sapiens
atctattgtaagataaaaa

SEQ ID NO: 3733657 - DNA, 13 bp, Homo sapiens
atctatttattgg

SEQ ID NO: 3733658 - DNA, 20 bp, Homo sapiens
atctatttgtatatatacat

SEQ ID NO: 3733659 - DNA, 23 bp, Homo sapiens
atctcaaataactaaaaggtatg

SEQ ID NO: 3733660 - DNA, 20 bp, Homo sapiens
atctcacagcacactcagca

SEQ ID NO: 3733661 - DNA, 13 bp, Homo sapiens
atctcaccccatc

SEQ ID NO: 3733662 - DNA, 15 bp, Homo sapiens
atctcaggccacctg

SEQ ID NO: 3733663 - DNA, 17 bp, Homo sapiens
atctcaggccacctgcc

SEQ ID NO: 3733664 - DNA, 18 bp, Homo sapiens
atctcagggaagcccagc

SEQ ID NO: 3733665 - DNA, 19 bp, Homo sapiens
atctcagggaagcccagct

SEQ ID NO: 3733666 - DNA, 17 bp, Homo sapiens
atctcagtgctgtaaaa

SEQ ID NO: 3733667 - DNA, 13 bp, Homo sapiens
atctccaaagctt

SEQ ID NO: 3733668 - DNA, 15 bp, Homo sapiens
atctccactccagat

SEQ ID NO: 3733669 - DNA, 22 bp, Homo sapiens
atctccagggagcaagacagag

SEQ ID NO: 3733670 - DNA, 22 bp, Homo sapiens
atctccctcgaacccacactgc

SEQ ID NO: 3733671 - DNA, 23 bp, Homo sapiens
atctccctcgaacccacactgca

SEQ ID NO: 3733672 - DNA, 15 bp, Homo sapiens
atctccgtggctttg

SEQ ID NO: 3733673 - DNA, 14 bp, Homo sapiens
atctcctatttttt

SEQ ID NO: 3733674 - DNA, 20 bp, Homo sapiens
atctcctatttttttaaaat

SEQ ID NO: 3733675 - DNA, 19 bp, Homo sapiens
atctcctgtgcatgggtga

SEQ ID NO: 3733676 - DNA, 20 bp, Homo sapiens
atctcgccacccctccttcc

SEQ ID NO: 3733677 - DNA, 19 bp, Homo sapiens
atctctactaccacaagga

SEQ ID NO: 3733678 - DNA, 21 bp, Homo sapiens
atctctactaccacaaggaaa

SEQ ID NO: 3733679 - DNA, 16 bp, Homo sapiens
atctctagaattttaa

SEQ ID NO: 3733680 - DNA, 11 bp, Homo sapiens
atctctccctc

SEQ ID NO: 3733681 - DNA, 14 bp, Homo sapiens
atctctccctcccc

SEQ ID NO: 3733682 - DNA, 23 bp, Homo sapiens
atctctctactcctacctcagcc

SEQ ID NO: 3733683 - DNA, 15 bp, Homo sapiens
atctctctctgttgt

SEQ ID NO: 3733684 - DNA, 22 bp, Homo sapiens
atctctctgaatcctaagggct

SEQ ID NO: 3733685 - DNA, 15 bp, Homo sapiens
atctctcttcttttc

SEQ ID NO: 3733686 - DNA, 17 bp, Homo sapiens
atctctctttaatataa

SEQ ID NO: 3733687 - DNA, 19 bp, Homo sapiens
atctctgtgtgcacaaata

SEQ ID NO: 3733688 - DNA, 18 bp, Homo sapiens
atctcttgagcctgggag

SEQ ID NO: 3733689 - DNA, 16 bp, Homo sapiens
atctgaaaatgtatgt

SEQ ID NO: 3733690 - DNA, 19 bp, Homo sapiens
atctgaaaatgtatgtgta

SEQ ID NO: 3733691 - DNA, 22 bp, Homo sapiens
atctgaaaatgtatgtgtaagt

SEQ ID NO: 3733692 - DNA, 23 bp, Homo sapiens
atctgaaaatgtatgtgtaagta

SEQ ID NO: 3733693 - DNA, 13 bp, Homo sapiens
atctgacacaaaa

SEQ ID NO: 3733694 - DNA, 23 bp, Homo sapiens
atctgaggaatcaacagggcagc

SEQ ID NO: 3733695 - DNA, 18 bp, Homo sapiens
atctgatcgttctttcta

SEQ ID NO: 3733696 - DNA, 21 bp, Homo sapiens
atctgcacccccctgggctga

SEQ ID NO: 3733697 - DNA, 11 bp, Homo sapiens
atctgcattta

SEQ ID NO: 3733698 - DNA, 11 bp, Homo sapiens
atctgcccctc

SEQ ID NO: 3733699 - DNA, 16 bp, Homo sapiens
atctgcccctccccca

SEQ ID NO: 3733700 - DNA, 16 bp, Homo sapiens
atctgctatgcttgaa

SEQ ID NO: 3733701 - DNA, 19 bp, Homo sapiens
atctggactcctctgtcca

SEQ ID NO: 3733702 - DNA, 22 bp, Homo sapiens
atctggactcctctgtccaggc

SEQ ID NO: 3733703 - DNA, 12 bp, Homo sapiens
atctggcagggt

SEQ ID NO: 3733704 - DNA, 19 bp, Homo sapiens
atctgggaactcccaagaa

SEQ ID NO: 3733705 - DNA, 20 bp, Homo sapiens
atctgggaactcccaagaac

SEQ ID NO: 3733706 - DNA, 16 bp, Homo sapiens
atctgggaccctttcc

SEQ ID NO: 3733707 - DNA, 17 bp, Homo sapiens
atctgggaccctttcct

SEQ ID NO: 3733708 - DNA, 22 bp, Homo sapiens
atctgggaccctttccttcctt

SEQ ID NO: 3733709 - DNA, 17 bp, Homo sapiens
atctgggttcactgcaa

SEQ ID NO: 3733710 - DNA, 19 bp, Homo sapiens
atctgggttcactgcaacc

SEQ ID NO: 3733711 - DNA, 20 bp, Homo sapiens
atctggtagggggaaaatgt

SEQ ID NO: 3733712 - DNA, 16 bp, Homo sapiens
atctgtaagctctttg

SEQ ID NO: 3733713 - DNA, 21 bp, Homo sapiens
atctgtacatactttttcaag

SEQ ID NO: 3733714 - DNA, 22 bp, Homo sapiens
atctgtctggaggggagctctg

SEQ ID NO: 3733715 - DNA, 13 bp, Homo sapiens
atctgtgcaataa

SEQ ID NO: 3733716 - DNA, 15 bp, Homo sapiens
atctgtgcaataaaa

SEQ ID NO: 3733717 - DNA, 17 bp, Homo sapiens
atctgtgcgtgaaacac

SEQ ID NO: 3733718 - DNA, 19 bp, Homo sapiens
atctgtgcgtgaaacacac

SEQ ID NO: 3733719 - DNA, 18 bp, Homo sapiens
atctgttttactgctttt

SEQ ID NO: 3733720 - DNA, 13 bp, Homo sapiens
atcttaactcttt

SEQ ID NO: 3733721 - DNA, 22 bp, Homo sapiens
atcttaatctgtttatttacaa

SEQ ID NO: 3733722 - DNA, 15 bp, Homo sapiens
atcttactgaaggta

SEQ ID NO: 3733723 - DNA, 15 bp, Homo sapiens
atcttcaaagcttga

SEQ ID NO: 3733724 - DNA, 23 bp, Homo sapiens
atcttcacttctaaatgcatatc

SEQ ID NO: 3733725 - DNA, 20 bp, Homo sapiens
atcttcagttttatctttaa

SEQ ID NO: 3733726 - DNA, 22 bp, Homo sapiens
atcttccctagagggttcctgt

SEQ ID NO: 3733727 - DNA, 15 bp, Homo sapiens
atcttcgttcttgtt

SEQ ID NO: 3733728 - DNA, 14 bp, Homo sapiens
atcttctctggcga

SEQ ID NO: 3733729 - DNA, 17 bp, Homo sapiens
atcttcttatgcaattt

SEQ ID NO: 3733730 - DNA, 14 bp, Homo sapiens
atcttctttataat

SEQ ID NO: 3733731 - DNA, 17 bp, Homo sapiens
atcttgaaatgaaagta

SEQ ID NO: 3733732 - DNA, 19 bp, Homo sapiens
atcttgaccaagcaggaag

SEQ ID NO: 3733733 - DNA, 23 bp, Homo sapiens
atcttgaccaagcaggaagctca

SEQ ID NO: 3733734 - DNA, 23 bp, Homo sapiens
atcttgctctatctcacagcaca

SEQ ID NO: 3733735 - DNA, 13 bp, Homo sapiens
atcttgctctgct

SEQ ID NO: 3733736 - DNA, 14 bp, Homo sapiens
atcttgctctgctg

SEQ ID NO: 3733737 - DNA, 16 bp, Homo sapiens
atcttggactgacatt

SEQ ID NO: 3733738 - DNA, 19 bp, Homo sapiens
atcttggactgacatttag

SEQ ID NO: 3733739 - DNA, 22 bp, Homo sapiens
atcttggtactactagatgtct

SEQ ID NO: 3733740 - DNA, 14 bp, Homo sapiens
atcttgtctctggg

SEQ ID NO: 3733741 - DNA, 15 bp, Homo sapiens
atcttgtctctgggc

SEQ ID NO: 3733742 - DNA, 23 bp, Homo sapiens
atcttgtttttccactactgcta

SEQ ID NO: 3733743 - DNA, 13 bp, Homo sapiens
atctttccttcct

SEQ ID NO: 3733744 - DNA, 19 bp, Homo sapiens
atctttcttctattttatt

SEQ ID NO: 3733745 - DNA, 13 bp, Homo sapiens
atctttgccttgg

SEQ ID NO: 3733746 - DNA, 12 bp, Homo sapiens
atcttttctaca

SEQ ID NO: 3733747 - DNA, 15 bp, Homo sapiens
atcttttctacagca

SEQ ID NO: 3733748 - DNA, 20 bp, Homo sapiens
atcttttctacagcaaattt

SEQ ID NO: 3733749 - DNA, 13 bp, Homo sapiens
atcttttgagaac

SEQ ID NO: 3733750 - DNA, 23 bp, Homo sapiens
atcttttggttgccttaaaagaa

SEQ ID NO: 3733751 - DNA, 16 bp, Homo sapiens
atcttttttagcataa

SEQ ID NO: 3733752 - DNA, 18 bp, Homo sapiens
atcttttttagcataaaa

SEQ ID NO: 3733753 - DNA, 19 bp, Homo sapiens
atcttttttagcataaaat

SEQ ID NO: 3733754 - DNA, 23 bp, Homo sapiens
atcttttttagcataaaattttc

SEQ ID NO: 3733755 - DNA, 17 bp, Homo sapiens
atgaaaaatttaagcat

SEQ ID NO: 3733756 - DNA, 22 bp, Homo sapiens
atgaaaatacaacttaaataat

SEQ ID NO: 3733757 - DNA, 19 bp, Homo sapiens
atgaaaatcctaccaacct

SEQ ID NO: 3733758 - DNA, 21 bp, Homo sapiens
atgaaaatcctaccaacctct

SEQ ID NO: 3733759 - DNA, 13 bp, Homo sapiens
atgaaaatgtcag

SEQ ID NO: 3733760 - DNA, 15 bp, Homo sapiens
atgaaaatgtcagaa

SEQ ID NO: 3733761 - DNA, 22 bp, Homo sapiens
atgaaacagaaacaaaaacact

SEQ ID NO: 3733762 - DNA, 17 bp, Homo sapiens
atgcagcatctaagtaa

SEQ ID NO: 3733763 - DNA, 22 bp, Homo sapiens
atgcagcccatgcccacctgcc

SEQ ID NO: 3733764 - DNA, 23 bp, Homo sapiens
atgcagtggtatgatcacggctc

SEQ ID NO: 3733765 - DNA, 12 bp, Homo sapiens
atgcataactga

SEQ ID NO: 3733766 - DNA, 17 bp, Homo sapiens
atgcatacactctcaaa

SEQ ID NO: 3733767 - DNA, 17 bp, Homo sapiens
atgcatatcctgagcca

SEQ ID NO: 3733768 - DNA, 15 bp, Homo sapiens
atgcatcaatcctgt

SEQ ID NO: 3733769 - DNA, 16 bp, Homo sapiens
atgcatcaatcctgtg

SEQ ID NO: 3733770 - DNA, 14 bp, Homo sapiens
atgcatcttactga

SEQ ID NO: 3733771 - DNA, 16 bp, Homo sapiens
atgcatcttactgaag

SEQ ID NO: 3733772 - DNA, 13 bp, Homo sapiens
atgcatttgaggt

SEQ ID NO: 3733773 - DNA, 17 bp, Homo sapiens
atgcatttgaggtcaag

SEQ ID NO: 3733774 - DNA, 22 bp, Homo sapiens
atgcattttaaagttaaacatt

SEQ ID NO: 3733775 - DNA, 18 bp, Homo sapiens
atgcattttgcagcagtg

SEQ ID NO: 3733776 - DNA, 22 bp, Homo sapiens
atgccaaagctagggtggccct

SEQ ID NO: 3733777 - DNA, 14 bp, Homo sapiens
atgccaacttgtcc

SEQ ID NO: 3733778 - DNA, 16 bp, Homo sapiens
atgccacacagagtgg

SEQ ID NO: 3733779 - DNA, 22 bp, Homo sapiens
atgccacgcggtacaaaggaaa

SEQ ID NO: 3733780 - DNA, 20 bp, Homo sapiens
atgccagagcaaagggccag

SEQ ID NO: 3733781 - DNA, 17 bp, Homo sapiens
atgccatggacagaaga

SEQ ID NO: 3733782 - DNA, 16 bp, Homo sapiens
atgcccacctgcccat

SEQ ID NO: 3733783 - DNA, 21 bp, Homo sapiens
atgcccagagggcccaggcag

SEQ ID NO: 3733784 - DNA, 23 bp, Homo sapiens
atgcccagagggcccaggcaggc

SEQ ID NO: 3733785 - DNA, 20 bp, Homo sapiens
atgcccctgtactccagcct

SEQ ID NO: 3733786 - DNA, 23 bp, Homo sapiens
atgccctgctctgaacacgaagc

SEQ ID NO: 3733787 - DNA, 15 bp, Homo sapiens
atgcccttaaatcat

SEQ ID NO: 3733788 - DNA, 22 bp, Homo sapiens
atgccgctgcatccgtgagcag

SEQ ID NO: 3733789 - DNA, 21 bp, Homo sapiens
atgcctaagaagatgacttcc

SEQ ID NO: 3733790 - DNA, 20 bp, Homo sapiens
atgcctccaccccccagaac

SEQ ID NO: 3733791 - DNA, 22 bp, Homo sapiens
atgcctccctgaccctgcagag

SEQ ID NO: 3733792 - DNA, 19 bp, Homo sapiens
atgcctgccccaaacaaat

SEQ ID NO: 3733793 - DNA, 16 bp, Homo sapiens
atgcctgcggagttgt

SEQ ID NO: 3733794 - DNA, 18 bp, Homo sapiens
atgcctggtggcagctgc

SEQ ID NO: 3733795 - DNA, 19 bp, Homo sapiens
atgcctggtggcagctgcg

SEQ ID NO: 3733796 - DNA, 21 bp, Homo sapiens
atgcctggtggcagctgcggt

SEQ ID NO: 3733797 - DNA, 17 bp, Homo sapiens
atgcctgtccagcctgg

SEQ ID NO: 3733798 - DNA, 13 bp, Homo sapiens
atgcctgtgccaa

SEQ ID NO: 3733799 - DNA, 15 bp, Homo sapiens
atgccttactttgta

SEQ ID NO: 3733800 - DNA, 17 bp, Homo sapiens
atgcgaatggtagtcta

SEQ ID NO: 3733801 - DNA, 16 bp, Homo sapiens
atgcggcccaggatgg

SEQ ID NO: 3733802 - DNA, 19 bp, Homo sapiens
atgcggccgcattccctga

SEQ ID NO: 3733803 - DNA, 17 bp, Homo sapiens
atgcgggctgggcagct

SEQ ID NO: 3733804 - DNA, 20 bp, Homo sapiens
atgctaagggcaggcccaaa

SEQ ID NO: 3733805 - DNA, 17 bp, Homo sapiens
atgctatggtcaggtta

SEQ ID NO: 3733806 - DNA, 13 bp, Homo sapiens
atgctcacactcc

SEQ ID NO: 3733807 - DNA, 22 bp, Homo sapiens
atgctcaggtacagagaaggaa

SEQ ID NO: 3733808 - DNA, 12 bp, Homo sapiens
atgctccagcca

SEQ ID NO: 3733809 - DNA, 17 bp, Homo sapiens
atgctccagccaacccc

SEQ ID NO: 3733810 - DNA, 20 bp, Homo sapiens
atgctccagccaacccctgt

SEQ ID NO: 3733811 - DNA, 23 bp, Homo sapiens
atgctcccccatcctccccttcc

SEQ ID NO: 3733812 - DNA, 16 bp, Homo sapiens
atgctccctcccctgc

SEQ ID NO: 3733813 - DNA, 19 bp, Homo sapiens
atgctcctggcccactgca

SEQ ID NO: 3733814 - DNA, 13 bp, Homo sapiens
atgctctctgcag

SEQ ID NO: 3733815 - DNA, 19 bp, Homo sapiens
atgctctgcatgttacata

SEQ ID NO: 3733816 - DNA, 14 bp, Homo sapiens
atgctgccaaattt

SEQ ID NO: 3733817 - DNA, 17 bp, Homo sapiens
atgctgcctaggctgac

SEQ ID NO: 3733818 - DNA, 12 bp, Homo sapiens
atgctgcctcca

SEQ ID NO: 3733819 - DNA, 12 bp, Homo sapiens
atgctgcctgag

SEQ ID NO: 3733820 - DNA, 19 bp, Homo sapiens
atgctgcgcccttccccag

SEQ ID NO: 3733821 - DNA, 12 bp, Homo sapiens
atgctgctttaa

SEQ ID NO: 3733822 - DNA, 19 bp, Homo sapiens
atgctgctttaattgtgaa

SEQ ID NO: 3733823 - DNA, 22 bp, Homo sapiens
atgctggacggcattcctgctt

SEQ ID NO: 3733824 - DNA, 14 bp, Homo sapiens
atgctggagcggct

SEQ ID NO: 3733825 - DNA, 19 bp, Homo sapiens
atgctggatgctccttcca

SEQ ID NO: 3733826 - DNA, 18 bp, Homo sapiens
atgctggctgttggctgg

SEQ ID NO: 3733827 - DNA, 22 bp, Homo sapiens
atgctggggcaagtccctgact

SEQ ID NO: 3733828 - DNA, 14 bp, Homo sapiens
atgctgtatatgtt

SEQ ID NO: 3733829 - DNA, 19 bp, Homo sapiens
atgcttatcatctaaagat

SEQ ID NO: 3733830 - DNA, 21 bp, Homo sapiens
atgcttcatgaaaatcctacc

SEQ ID NO: 3733831 - DNA, 12 bp, Homo sapiens
atgcttcatgtg

SEQ ID NO: 3733832 - DNA, 15 bp, Homo sapiens
atgcttcctgacaat

SEQ ID NO: 3733833 - DNA, 20 bp, Homo sapiens
atgcttcctgacaatcaact

SEQ ID NO: 3733834 - DNA, 22 bp, Homo sapiens
atgcttcctgacaatcaactct

SEQ ID NO: 3733835 - DNA, 18 bp, Homo sapiens
atgcttgatggtttatgt

SEQ ID NO: 3733836 - DNA, 20 bp, Homo sapiens
atgcttggaatatctgctgt

SEQ ID NO: 3733837 - DNA, 20 bp, Homo sapiens
atgcttgtaacaagaaaaca

SEQ ID NO: 3733838 - DNA, 16 bp, Homo sapiens
atggaaccgcaggaag

SEQ ID NO: 3733839 - DNA, 18 bp, Homo sapiens
atggaaccgcaggaagct

SEQ ID NO: 3733840 - DNA, 19 bp, Homo sapiens
atggaactcattcctgcct

SEQ ID NO: 3733841 - DNA, 22 bp, Homo sapiens
atggaactcattcctgcctgtc

SEQ ID NO: 3733842 - DNA, 16 bp, Homo sapiens
atggaagattttaaat

SEQ ID NO: 3733843 - DNA, 14 bp, Homo sapiens
atggaataacatgt

SEQ ID NO: 3733844 - DNA, 19 bp, Homo sapiens
atggacatgatcttcttta

SEQ ID NO: 3733845 - DNA, 13 bp, Homo sapiens
atggaggaatatg

SEQ ID NO: 3733846 - DNA, 13 bp, Homo sapiens
atggaggagaaga

SEQ ID NO: 3733847 - DNA, 16 bp, Homo sapiens
atggaggaggaggcaa

SEQ ID NO: 3733848 - DNA, 19 bp, Homo sapiens
atggaggcacacagctgca

SEQ ID NO: 3733849 - DNA, 17 bp, Homo sapiens
atggagtagacccctgg

SEQ ID NO: 3733850 - DNA, 21 bp, Homo sapiens
atggagtagacccctggctgg

SEQ ID NO: 3733851 - DNA, 16 bp, Homo sapiens
atggatattagtcata

SEQ ID NO: 3733852 - DNA, 17 bp, Homo sapiens
atggattctcagatatt

SEQ ID NO: 3733853 - DNA, 22 bp, Homo sapiens
atggattctcagatatttatat

SEQ ID NO: 3733854 - DNA, 19 bp, Homo sapiens
atggcaaggactgcaggga

SEQ ID NO: 3733855 - DNA, 23 bp, Homo sapiens
atggcaattctttgacctcaacc

SEQ ID NO: 3733856 - DNA, 16 bp, Homo sapiens
atggcaattttgtaac

SEQ ID NO: 3733857 - DNA, 19 bp, Homo sapiens
atggcaccaaagccaccag

SEQ ID NO: 3733858 - DNA, 19 bp, Homo sapiens
atggcagcaggcctgttgc

SEQ ID NO: 3733859 - DNA, 15 bp, Homo sapiens
atggcagtgtctttc

SEQ ID NO: 3733860 - DNA, 16 bp, Homo sapiens
atggccaggtggccac

SEQ ID NO: 3733861 - DNA, 16 bp, Homo sapiens
atggcctcagctgcct

SEQ ID NO: 3733862 - DNA, 17 bp, Homo sapiens
atggcctcagctgcctc

SEQ ID NO: 3733863 - DNA, 19 bp, Homo sapiens
atggcctcagctgcctcac

SEQ ID NO: 3733864 - DNA, 13 bp, Homo sapiens
atggcctttgctt

SEQ ID NO: 3733865 - DNA, 21 bp, Homo sapiens
atggcgattcccattgaaaat

SEQ ID NO: 3733866 - DNA, 22 bp, Homo sapiens
atggcgattcccattgaaaatg

SEQ ID NO: 3733867 - DNA, 15 bp, Homo sapiens
atggctaaggcacca

SEQ ID NO: 3733868 - DNA, 20 bp, Homo sapiens
atggctccagtctgctgccc

SEQ ID NO: 3733869 - DNA, 23 bp, Homo sapiens
atggctccgaacaccctcgaagc

SEQ ID NO: 3733870 - DNA, 15 bp, Homo sapiens
atggctgtgcctctg

SEQ ID NO: 3733871 - DNA, 18 bp, Homo sapiens
atggcttgccacagctct

SEQ ID NO: 3733872 - DNA, 18 bp, Homo sapiens
atgggaaacttccaagac

SEQ ID NO: 3733873 - DNA, 21 bp, Homo sapiens
atgggactggagtccctgtga

SEQ ID NO: 3733874 - DNA, 15 bp, Homo sapiens
attaggaaaatatgg

SEQ ID NO: 3733875 - DNA, 14 bp, Homo sapiens
attaggatttcatg

SEQ ID NO: 3733876 - DNA, 16 bp, Homo sapiens
attaggatttcatgat

SEQ ID NO: 3733877 - DNA, 13 bp, Homo sapiens
attaggttaacta

SEQ ID NO: 3733878 - DNA, 15 bp, Homo sapiens
attaggttttgtaca

SEQ ID NO: 3733879 - DNA, 14 bp, Homo sapiens
attagtaaagaaat

SEQ ID NO: 3733880 - DNA, 18 bp, Homo sapiens
attagtatttatttaatg

SEQ ID NO: 3733881 - DNA, 19 bp, Homo sapiens
attagtcatagaagaacta

SEQ ID NO: 3733882 - DNA, 17 bp, Homo sapiens
attagttctatttctat

SEQ ID NO: 3733883 - DNA, 22 bp, Homo sapiens
attataacttaaaaaaatgaca

SEQ ID NO: 3733884 - DNA, 16 bp, Homo sapiens
attataacttaaaata

SEQ ID NO: 3733885 - DNA, 13 bp, Homo sapiens
attataaggactg

SEQ ID NO: 3733886 - DNA, 22 bp, Homo sapiens
attataatttttttcaatattt

SEQ ID NO: 3733887 - DNA, 21 bp, Homo sapiens
attatacatgggtagcttctg

SEQ ID NO: 3733888 - DNA, 16 bp, Homo sapiens
attataggccaaactg

SEQ ID NO: 3733889 - DNA, 16 bp, Homo sapiens
attatagtgtagaaaa

SEQ ID NO: 3733890 - DNA, 13 bp, Homo sapiens
attatcaagctaa

SEQ ID NO: 3733891 - DNA, 15 bp, Homo sapiens
attatcatgcaaatg

SEQ ID NO: 3733892 - DNA, 18 bp, Homo sapiens
attatcgccttttgacag

SEQ ID NO: 3733893 - DNA, 17 bp, Homo sapiens
attatcgggaacagtgt

SEQ ID NO: 3733894 - DNA, 18 bp, Homo sapiens
attatcgggaacagtgtt

SEQ ID NO: 3733895 - DNA, 20 bp, Homo sapiens
attatcgggaacagtgtttc

SEQ ID NO: 3733896 - DNA, 22 bp, Homo sapiens
attatcgggaacagtgtttccc

SEQ ID NO: 3733897 - DNA, 17 bp, Homo sapiens
attatcgggagcagtgt

SEQ ID NO: 3733898 - DNA, 12 bp, Homo sapiens
attatgacagtt

SEQ ID NO: 3733899 - DNA, 14 bp, Homo sapiens
attatgacagttat

SEQ ID NO: 3733900 - DNA, 17 bp, Homo sapiens
attatgacagttatact

SEQ ID NO: 3733901 - DNA, 16 bp, Homo sapiens
attatggaagatttta

SEQ ID NO: 3733902 - DNA, 20 bp, Homo sapiens
attatggaagattttaaatt

SEQ ID NO: 3733903 - DNA, 15 bp, Homo sapiens
attatgtgtgttttg

SEQ ID NO: 3733904 - DNA, 16 bp, Homo sapiens
attatgttattgaaaa

SEQ ID NO: 3733905 - DNA, 20 bp, Homo sapiens
attattacttatttttgaca

SEQ ID NO: 3733906 - DNA, 22 bp, Homo sapiens
attattagccaggtaatgtgaa

SEQ ID NO: 3733907 - DNA, 18 bp, Homo sapiens
attattcagttaagaaaa

SEQ ID NO: 3733908 - DNA, 17 bp, Homo sapiens
attattccctgtacaat

SEQ ID NO: 3733909 - DNA, 14 bp, Homo sapiens
attattggaattaa

SEQ ID NO: 3733910 - DNA, 19 bp, Homo sapiens
attattgtttatattttca

SEQ ID NO: 3733911 - DNA, 20 bp, Homo sapiens
attattttaaattataagga

SEQ ID NO: 3733912 - DNA, 12 bp, Homo sapiens
attatttttaat

SEQ ID NO: 3733913 - DNA, 16 bp, Homo sapiens
attcaaaagttgaaat

SEQ ID NO: 3733914 - DNA, 16 bp, Homo sapiens
attcaaccactgtaaa

SEQ ID NO: 3733915 - DNA, 19 bp, Homo sapiens
attcaaccactgtaaaatg

SEQ ID NO: 3733916 - DNA, 19 bp, Homo sapiens
attcaagaaaagtaagccc

SEQ ID NO: 3733917 - DNA, 16 bp, Homo sapiens
attcaaggtaaaattc

SEQ ID NO: 3733918 - DNA, 18 bp, Homo sapiens
attcaaggtaaaattcta

SEQ ID NO: 3733919 - DNA, 20 bp, Homo sapiens
attcaaggtaaaattctaaa

SEQ ID NO: 3733920 - DNA, 21 bp, Homo sapiens
attcaaggtaaaattctaaat

SEQ ID NO: 3733921 - DNA, 17 bp, Homo sapiens
attcaattcctctggga

SEQ ID NO: 3733922 - DNA, 13 bp, Homo sapiens
attcacaagctgc

SEQ ID NO: 3733923 - DNA, 18 bp, Homo sapiens
attcaccatgtaaaacaa

SEQ ID NO: 3733924 - DNA, 19 bp, Homo sapiens
attcaccatgtaaaacaaa

SEQ ID NO: 3733925 - DNA, 23 bp, Homo sapiens
attcacctctctcactgactatt

SEQ ID NO: 3733926 - DNA, 17 bp, Homo sapiens
attcacctgtaaaactt

SEQ ID NO: 3733927 - DNA, 23 bp, Homo sapiens
attcaccttccagtgtctcggag

SEQ ID NO: 3733928 - DNA, 14 bp, Homo sapiens
attcacttgcattt

SEQ ID NO: 3733929 - DNA, 11 bp, Homo sapiens
attcagctgcc

SEQ ID NO: 3733930 - DNA, 16 bp, Homo sapiens
attcagtgagggtctt

SEQ ID NO: 3733931 - DNA, 20 bp, Homo sapiens
attcagtgctgtggcctggg

SEQ ID NO: 3733932 - DNA, 20 bp, Homo sapiens
attcagttaagaaaaaaata

SEQ ID NO: 3733933 - DNA, 20 bp, Homo sapiens
attcagttggtaagcttcca

SEQ ID NO: 3733934 - DNA, 11 bp, Homo sapiens
attcataataa

SEQ ID NO: 3733935 - DNA, 17 bp, Homo sapiens
attcatctctctttaat

SEQ ID NO: 3733936 - DNA, 14 bp, Homo sapiens
attccaacagctca

SEQ ID NO: 3733937 - DNA, 22 bp, Homo sapiens
attccaccttaaattaaacaat

SEQ ID NO: 3733938 - DNA, 14 bp, Homo sapiens
attccatagtatat

SEQ ID NO: 3733939 - DNA, 16 bp, Homo sapiens
attccatagtatatta

SEQ ID NO: 3733940 - DNA, 22 bp, Homo sapiens
attccatagtatattaaaaatg

SEQ ID NO: 3733941 - DNA, 23 bp, Homo sapiens
attccatagtatattaaaaatgg

SEQ ID NO: 3733942 - DNA, 15 bp, Homo sapiens
attccatgaatgtat

SEQ ID NO: 3733943 - DNA, 14 bp, Homo sapiens
attccatgtgccca

SEQ ID NO: 3733944 - DNA, 15 bp, Homo sapiens
attccatgtgcccag

SEQ ID NO: 3733945 - DNA, 19 bp, Homo sapiens
attcccagagcaaaataat

SEQ ID NO: 3733946 - DNA, 18 bp, Homo sapiens
attcccattttgcaaaat

SEQ ID NO: 3733947 - DNA, 20 bp, Homo sapiens
attccccagattgcaacagg

SEQ ID NO: 3733948 - DNA, 22 bp, Homo sapiens
attccccaggtggctgacccag

SEQ ID NO: 3733949 - DNA, 14 bp, Homo sapiens
attccctcctgcta

SEQ ID NO: 3733950 - DNA, 19 bp, Homo sapiens
attccctgagtcaccagga

SEQ ID NO: 3733951 - DNA, 19 bp, Homo sapiens
attccctgtacaatattta

SEQ ID NO: 3733952 - DNA, 21 bp, Homo sapiens
attccgacaaccgatgctcca

SEQ ID NO: 3733953 - DNA, 18 bp, Homo sapiens
attcctacaaagatgttt

SEQ ID NO: 3733954 - DNA, 13 bp, Homo sapiens
attcctgaaagaa

SEQ ID NO: 3733955 - DNA, 15 bp, Homo sapiens
attcctgcagcctgg

SEQ ID NO: 3733956 - DNA, 15 bp, Homo sapiens
attcctgcctgtctc

SEQ ID NO: 3733957 - DNA, 15 bp, Homo sapiens
attcctggagcccga

SEQ ID NO: 3733958 - DNA, 21 bp, Homo sapiens
attcctggagcccgaggcacc

SEQ ID NO: 3733959 - DNA, 23 bp, Homo sapiens
attcctggagcccgaggcaccag

SEQ ID NO: 3733960 - DNA, 13 bp, Homo sapiens
attccttgataat

SEQ ID NO: 3733961 - DNA, 20 bp, Homo sapiens
attccttggcatgccttcca

SEQ ID NO: 3733962 - DNA, 21 bp, Homo sapiens
attccttggcatgccttccag

SEQ ID NO: 3733963 - DNA, 18 bp, Homo sapiens
attcctttcctgatcact

SEQ ID NO: 3733964 - DNA, 20 bp, Homo sapiens
attccttttcttgtttatca

SEQ ID NO: 3733965 - DNA, 19 bp, Homo sapiens
attcgatctcattcagtat

SEQ ID NO: 3733966 - DNA, 23 bp, Homo sapiens
attcgtggtgatcaattaaatgt

SEQ ID NO: 3733967 - DNA, 16 bp, Homo sapiens
attctaaataaaatat

SEQ ID NO: 3733968 - DNA, 18 bp, Homo sapiens
attctaaatgaatgttta

SEQ ID NO: 3733969 - DNA, 19 bp, Homo sapiens
attctaacttttttgctat

SEQ ID NO: 3733970 - DNA, 13 bp, Homo sapiens
attctaatctaac

SEQ ID NO: 3733971 - DNA, 16 bp, Homo sapiens
attctatctctcttta

SEQ ID NO: 3733972 - DNA, 14 bp, Homo sapiens
attctcaaagcagg

SEQ ID NO: 3733973 - DNA, 14 bp, Homo sapiens
attctcactccacc

SEQ ID NO: 3733974 - DNA, 16 bp, Homo sapiens
attctcactccaccac

SEQ ID NO: 3733975 - DNA, 17 bp, Homo sapiens
attctcatttgtcacac

SEQ ID NO: 3733976 - DNA, 14 bp, Homo sapiens
attctcctgcctca

SEQ ID NO: 3733977 - DNA, 20 bp, Homo sapiens
attctcctgcctcagcctcc

SEQ ID NO: 3733978 - DNA, 18 bp, Homo sapiens
attctctcctcagactgc

SEQ ID NO: 3733979 - DNA, 19 bp, Homo sapiens
attctctcctcagactgct

SEQ ID NO: 3733980 - DNA, 20 bp, Homo sapiens
attctcttggctggcttcct

SEQ ID NO: 3733981 - DNA, 17 bp, Homo sapiens
attctgagccacactga

SEQ ID NO: 3733982 - DNA, 22 bp, Homo sapiens
attctgcaagcacatctgcatt

SEQ ID NO: 3733983 - DNA, 13 bp, Homo sapiens
attctgcagcatg

SEQ ID NO: 3733984 - DNA, 15 bp, Homo sapiens
attctgcagcatgac

SEQ ID NO: 3733985 - DNA, 22 bp, Homo sapiens
attctgccgtgtgccctcgggc

SEQ ID NO: 3733986 - DNA, 11 bp, Homo sapiens
attctgcctgc

SEQ ID NO: 3733987 - DNA, 18 bp, Homo sapiens
caaaacacttgtaatttt

SEQ ID NO: 3733988 - DNA, 19 bp, Homo sapiens
caaaacagagatgtgataa

SEQ ID NO: 3733989 - DNA, 19 bp, Homo sapiens
caaaaccacagccctgtca

SEQ ID NO: 3733990 - DNA, 16 bp, Homo sapiens
caaaaccattgcttca

SEQ ID NO: 3733991 - DNA, 21 bp, Homo sapiens
caaaactcatttcctatgtaa

SEQ ID NO: 3733992 - DNA, 21 bp, Homo sapiens
caaaagaaaaaaaaaagcacc

SEQ ID NO: 3733993 - DNA, 18 bp, Homo sapiens
caaaagatgcttctcact

SEQ ID NO: 3733994 - DNA, 14 bp, Homo sapiens
caaaagcacccttg

SEQ ID NO: 3733995 - DNA, 13 bp, Homo sapiens
caaaagcctctca

SEQ ID NO: 3733996 - DNA, 15 bp, Homo sapiens
caaaagctgggcagg

SEQ ID NO: 3733997 - DNA, 19 bp, Homo sapiens
caaaagctgggcaggttgg

SEQ ID NO: 3733998 - DNA, 19 bp, Homo sapiens
caaaaggcagtggggctgg

SEQ ID NO: 3733999 - DNA, 21 bp, Homo sapiens
caaaaggcagtggggctgggg

SEQ ID NO: 3734000 - DNA, 18 bp, Homo sapiens
caaaaggtgcctgtgagg

SEQ ID NO: 3734001 - DNA, 22 bp, Homo sapiens
caaaaggtgcctgtgaggcagg

SEQ ID NO: 3734002 - DNA, 16 bp, Homo sapiens
caaaagtatcgggggc

SEQ ID NO: 3734003 - DNA, 18 bp, Homo sapiens
caaaagtatcgggggctg

SEQ ID NO: 3734004 - DNA, 22 bp, Homo sapiens
caaaagtatcgggggctggggc

SEQ ID NO: 3734005 - DNA, 19 bp, Homo sapiens
caaaagtcaaaaggtgcct

SEQ ID NO: 3734006 - DNA, 15 bp, Homo sapiens
caaaataaaaaccaa

SEQ ID NO: 3734007 - DNA, 14 bp, Homo sapiens
caaaatgacaatga

SEQ ID NO: 3734008 - DNA, 15 bp, Homo sapiens
caaaatgtagggtta

SEQ ID NO: 3734009 - DNA, 13 bp, Homo sapiens
caaaatgtctgta

SEQ ID NO: 3734010 - DNA, 17 bp, Homo sapiens
caaaattatttcagaaa

SEQ ID NO: 3734011 - DNA, 17 bp, Homo sapiens
caaaatttccagtacct

SEQ ID NO: 3734012 - DNA, 18 bp, Homo sapiens
caaaattttattcctata

SEQ ID NO: 3734013 - DNA, 15 bp, Homo sapiens
caaacacatacagga

SEQ ID NO: 3734014 - DNA, 13 bp, Homo sapiens
caaacacattaag

SEQ ID NO: 3734015 - DNA, 14 bp, Homo sapiens
caaacacctcccag

SEQ ID NO: 3734016 - DNA, 18 bp, Homo sapiens
caaacatcctatcaacaa

SEQ ID NO: 3734017 - DNA, 21 bp, Homo sapiens
caaacatctggaaaataaaag

SEQ ID NO: 3734018 - DNA, 12 bp, Homo sapiens
caaacatgaagt

SEQ ID NO: 3734019 - DNA, 14 bp, Homo sapiens
caaacatgaagtgt

SEQ ID NO: 3734020 - DNA, 22 bp, Homo sapiens
caaacatgaagtgtgtttcctt

SEQ ID NO: 3734021 - DNA, 20 bp, Homo sapiens
caaacatggggttggctggg

SEQ ID NO: 3734022 - DNA, 23 bp, Homo sapiens
caaacatggggttggctgggccc

SEQ ID NO: 3734023 - DNA, 15 bp, Homo sapiens
caaacatttcaaagt

SEQ ID NO: 3734024 - DNA, 21 bp, Homo sapiens
caaaccccgaccacctgccca

SEQ ID NO: 3734025 - DNA, 13 bp, Homo sapiens
caaacctggagat

SEQ ID NO: 3734026 - DNA, 20 bp, Homo sapiens
caaacctttattttagaatt

SEQ ID NO: 3734027 - DNA, 14 bp, Homo sapiens
caaacggtacacag

SEQ ID NO: 3734028 - DNA, 16 bp, Homo sapiens
caaactctgccagcca

SEQ ID NO: 3734029 - DNA, 17 bp, Homo sapiens
caaactcttgacctcag

SEQ ID NO: 3734030 - DNA, 21 bp, Homo sapiens
caaactcttgacctcaggtga

SEQ ID NO: 3734031 - DNA, 17 bp, Homo sapiens
caaactgcctaagccct

SEQ ID NO: 3734032 - DNA, 23 bp, Homo sapiens
caaactgcctaagccctccgcca

SEQ ID NO: 3734033 - DNA, 19 bp, Homo sapiens
caaactgccttggcttcag

SEQ ID NO: 3734034 - DNA, 19 bp, Homo sapiens
caaactggcaaacttcaga

SEQ ID NO: 3734035 - DNA, 17 bp, Homo sapiens
caaacttaagaaacact

SEQ ID NO: 3734036 - DNA, 13 bp, Homo sapiens
caaagaaacccaa

SEQ ID NO: 3734037 - DNA, 14 bp, Homo sapiens
caaagaagacaaca

SEQ ID NO: 3734038 - DNA, 20 bp, Homo sapiens
caaagacaaattctgtttct

SEQ ID NO: 3734039 - DNA, 21 bp, Homo sapiens
caaagacaaattctgtttctt

SEQ ID NO: 3734040 - DNA, 14 bp, Homo sapiens
caaagagctgccta

SEQ ID NO: 3734041 - DNA, 13 bp, Homo sapiens
caaagaggtattt

SEQ ID NO: 3734042 - DNA, 14 bp, Homo sapiens
caaagaggttttaa

SEQ ID NO: 3734043 - DNA, 16 bp, Homo sapiens
caaagataatctctca

SEQ ID NO: 3734044 - DNA, 22 bp, Homo sapiens
caaagatgtttgtcagatatga

SEQ ID NO: 3734045 - DNA, 17 bp, Homo sapiens
caaagccaaactctgcc

SEQ ID NO: 3734046 - DNA, 18 bp, Homo sapiens
caaagccaaactctgcca

SEQ ID NO: 3734047 - DNA, 22 bp, Homo sapiens
caaagccaaagctaggcctggc

SEQ ID NO: 3734048 - DNA, 22 bp, Homo sapiens
caaagccaacagtcaaaacaga

SEQ ID NO: 3734049 - DNA, 13 bp, Homo sapiens
caaagccagaagc

SEQ ID NO: 3734050 - DNA, 18 bp, Homo sapiens
caaagccagaagctgagc

SEQ ID NO: 3734051 - DNA, 23 bp, Homo sapiens
caaagccccttgctctcccctgc

SEQ ID NO: 3734052 - DNA, 18 bp, Homo sapiens
caaagcctcctccagccg

SEQ ID NO: 3734053 - DNA, 14 bp, Homo sapiens
caaagctaggcctg

SEQ ID NO: 3734054 - DNA, 16 bp, Homo sapiens
caaagctaggcctggc

SEQ ID NO: 3734055 - DNA, 22 bp, Homo sapiens
caaagctgaagccgccaggacc

SEQ ID NO: 3734056 - DNA, 16 bp, Homo sapiens
caaagctgctaaatct

SEQ ID NO: 3734057 - DNA, 23 bp, Homo sapiens
caaagctgctaaatctcctattt

SEQ ID NO: 3734058 - DNA, 14 bp, Homo sapiens
caaagcttgaagat

SEQ ID NO: 3734059 - DNA, 16 bp, Homo sapiens
caaagcttgttaagat

SEQ ID NO: 3734060 - DNA, 16 bp, Homo sapiens
caaagctttcctggag

SEQ ID NO: 3734061 - DNA, 19 bp, Homo sapiens
caaaggaaaaagtatcatg

SEQ ID NO: 3734062 - DNA, 23 bp, Homo sapiens
caaaggaagctttctctgcttca

SEQ ID NO: 3734063 - DNA, 19 bp, Homo sapiens
caaaggaatctccagtttt

SEQ ID NO: 3734064 - DNA, 22 bp, Homo sapiens
caaaggaatctccagttttcag

SEQ ID NO: 3734065 - DNA, 21 bp, Homo sapiens
caaaggaatggaggctctaat

SEQ ID NO: 3734066 - DNA, 16 bp, Homo sapiens
caaaggagtagaaaga

SEQ ID NO: 3734067 - DNA, 22 bp, Homo sapiens
caaaggatagtgcgatgtttca

SEQ ID NO: 3734068 - DNA, 20 bp, Homo sapiens
caaaggcacagtgaaggctg

SEQ ID NO: 3734069 - DNA, 12 bp, Homo sapiens
caaagggccagg

SEQ ID NO: 3734070 - DNA, 18 bp, Homo sapiens
caaagggtatcaggtgct

SEQ ID NO: 3734071 - DNA, 23 bp, Homo sapiens
caaagggtgaagctatttatctg

SEQ ID NO: 3734072 - DNA, 13 bp, Homo sapiens
caaagggtggaat

SEQ ID NO: 3734073 - DNA, 14 bp, Homo sapiens
caaaggtataattt

SEQ ID NO: 3734074 - DNA, 15 bp, Homo sapiens
caaaggttgagatgt

SEQ ID NO: 3734075 - DNA, 19 bp, Homo sapiens
caaaggttttcctcttcta

SEQ ID NO: 3734076 - DNA, 14 bp, Homo sapiens
caaagtagaagtct

SEQ ID NO: 3734077 - DNA, 21 bp, Homo sapiens
caaagtagaagtcttagatgt

SEQ ID NO: 3734078 - DNA, 13 bp, Homo sapiens
caaagtctccagc

SEQ ID NO: 3734079 - DNA, 14 bp, Homo sapiens
caaagtctccagcc

SEQ ID NO: 3734080 - DNA, 19 bp, Homo sapiens
caaagtgctgggattacaa

SEQ ID NO: 3734081 - DNA, 14 bp, Homo sapiens
caaagtggaaggaa

SEQ ID NO: 3734082 - DNA, 15 bp, Homo sapiens
caaagtggaaggaaa

SEQ ID NO: 3734083 - DNA, 23 bp, Homo sapiens
caaagtggaaggaaagatgctca

SEQ ID NO: 3734084 - DNA, 11 bp, Homo sapiens
caaagtgttaa

SEQ ID NO: 3734085 - DNA, 16 bp, Homo sapiens
caaagttaacctacct

SEQ ID NO: 3734086 - DNA, 20 bp, Homo sapiens
caaagttaacctacctgtaa

SEQ ID NO: 3734087 - DNA, 21 bp, Homo sapiens
caaagttaacctacctgtaac

SEQ ID NO: 3734088 - DNA, 14 bp, Homo sapiens
caaataataagcaa

SEQ ID NO: 3734089 - DNA, 20 bp, Homo sapiens
caaataatttttcacttcaa

SEQ ID NO: 3734090 - DNA, 18 bp, Homo sapiens
caaatacttattcattgt

SEQ ID NO: 3734091 - DNA, 13 bp, Homo sapiens
caaatagaaaaca

SEQ ID NO: 3734092 - DNA, 15 bp, Homo sapiens
caaatagcataagtt

SEQ ID NO: 3734093 - DNA, 12 bp, Homo sapiens
caaatatttatt

SEQ ID NO: 3734094 - DNA, 14 bp, Homo sapiens
caaatatttatttt

SEQ ID NO: 3734095 - DNA, 20 bp, Homo sapiens
caaatatttattttctttct

SEQ ID NO: 3734096 - DNA, 22 bp, Homo sapiens
caaatcaagtttccaagcaaat

SEQ ID NO: 3734097 - DNA, 23 bp, Homo sapiens
caaatcaagtttccaagcaaatg

SEQ ID NO: 3734098 - DNA, 16 bp, Homo sapiens
caaatcagctgctact

SEQ ID NO: 3734099 - DNA, 21 bp, Homo sapiens
caaatggtggttgtttcttcc

SEQ ID NO: 3734100 - DNA, 15 bp, Homo sapiens
caagtgagaccctgt

SEQ ID NO: 3734101 - DNA, 19 bp, Homo sapiens
caagtgagaccctgtctca

SEQ ID NO: 3734102 - DNA, 15 bp, Homo sapiens
caagtgagagctggg

SEQ ID NO: 3734103 - DNA, 14 bp, Homo sapiens
caagtgcaggctgg

SEQ ID NO: 3734104 - DNA, 19 bp, Homo sapiens
caagtggctcccacaccct

SEQ ID NO: 3734105 - DNA, 14 bp, Homo sapiens
caagtgggggcaga

SEQ ID NO: 3734106 - DNA, 11 bp, Homo sapiens
caagtgtgtgc

SEQ ID NO: 3734107 - DNA, 13 bp, Homo sapiens
caagttagctcag

SEQ ID NO: 3734108 - DNA, 16 bp, Homo sapiens
caagttagctcaggag

SEQ ID NO: 3734109 - DNA, 16 bp, Homo sapiens
caagttataaatcaat

SEQ ID NO: 3734110 - DNA, 21 bp, Homo sapiens
caagttatataaagagaaaat

SEQ ID NO: 3734111 - DNA, 15 bp, Homo sapiens
caagttattaatttc

SEQ ID NO: 3734112 - DNA, 21 bp, Homo sapiens
caagttattaatttcttcaca

SEQ ID NO: 3734113 - DNA, 12 bp, Homo sapiens
caagttcaagga

SEQ ID NO: 3734114 - DNA, 13 bp, Homo sapiens
caagttctattta

SEQ ID NO: 3734115 - DNA, 23 bp, Homo sapiens
caagttgcgacggagagaaaaaa

SEQ ID NO: 3734116 - DNA, 15 bp, Homo sapiens
caagtttcagacagg

SEQ ID NO: 3734117 - DNA, 17 bp, Homo sapiens
caagtttccaagcaaat

SEQ ID NO: 3734118 - DNA, 20 bp, Homo sapiens
caataaaagttttctccaac

SEQ ID NO: 3734119 - DNA, 20 bp, Homo sapiens
caataaaatcatgtacattt

SEQ ID NO: 3734120 - DNA, 11 bp, Homo sapiens
caataaagtat

SEQ ID NO: 3734121 - DNA, 12 bp, Homo sapiens
caataaataaca

SEQ ID NO: 3734122 - DNA, 16 bp, Homo sapiens
caataaatagaccatt

SEQ ID NO: 3734123 - DNA, 12 bp, Homo sapiens
caataaatgaat

SEQ ID NO: 3734124 - DNA, 17 bp, Homo sapiens
caataaatgtgcttatg

SEQ ID NO: 3734125 - DNA, 22 bp, Homo sapiens
caataactactgtgttcctggc

SEQ ID NO: 3734126 - DNA, 21 bp, Homo sapiens
caataagagcgtttgcccaaa

SEQ ID NO: 3734127 - DNA, 22 bp, Homo sapiens
caataatttcaggttttgtaaa

SEQ ID NO: 3734128 - DNA, 16 bp, Homo sapiens
caatagagactgtaga

SEQ ID NO: 3734129 - DNA, 17 bp, Homo sapiens
caatagtgtgttctgat

SEQ ID NO: 3734130 - DNA, 23 bp, Homo sapiens
caatagtgtgttctgattagaaa

SEQ ID NO: 3734131 - DNA, 12 bp, Homo sapiens
caatatagcaag

SEQ ID NO: 3734132 - DNA, 13 bp, Homo sapiens
caatatagcaaga

SEQ ID NO: 3734133 - DNA, 13 bp, Homo sapiens
caatattataatt

SEQ ID NO: 3734134 - DNA, 18 bp, Homo sapiens
caatattatactaagaaa

SEQ ID NO: 3734135 - DNA, 21 bp, Homo sapiens
caatattcctgaatgaaatat

SEQ ID NO: 3734136 - DNA, 15 bp, Homo sapiens
caatatttaaggaga

SEQ ID NO: 3734137 - DNA, 14 bp, Homo sapiens
caatatttattatt

SEQ ID NO: 3734138 - DNA, 11 bp, Homo sapiens
caatattttaa

SEQ ID NO: 3734139 - DNA, 13 bp, Homo sapiens
caatattttaagc

SEQ ID NO: 3734140 - DNA, 16 bp, Homo sapiens
caatattttccatgaa

SEQ ID NO: 3734141 - DNA, 19 bp, Homo sapiens
caatattttccatgaaaat

SEQ ID NO: 3734142 - DNA, 15 bp, Homo sapiens
caatcaactctaata

SEQ ID NO: 3734143 - DNA, 16 bp, Homo sapiens
caatcagattttcctg

SEQ ID NO: 3734144 - DNA, 22 bp, Homo sapiens
caatccatgttagtttttactt

SEQ ID NO: 3734145 - DNA, 14 bp, Homo sapiens
caatcctcactggg

SEQ ID NO: 3734146 - DNA, 13 bp, Homo sapiens
caatcctcctgag

SEQ ID NO: 3734147 - DNA, 12 bp, Homo sapiens
caatcctggctc

SEQ ID NO: 3734148 - DNA, 13 bp, Homo sapiens
caatctatttatt

SEQ ID NO: 3734149 - DNA, 19 bp, Homo sapiens
caatctatttattggacat

SEQ ID NO: 3734150 - DNA, 20 bp, Homo sapiens
caatctgaagatacatgtct

SEQ ID NO: 3734151 - DNA, 12 bp, Homo sapiens
caatcttgtttc

SEQ ID NO: 3734152 - DNA, 16 bp, Homo sapiens
caatgaacggccttgc

SEQ ID NO: 3734153 - DNA, 19 bp, Homo sapiens
caatgagatagaagatgtt

SEQ ID NO: 3734154 - DNA, 17 bp, Homo sapiens
caatgaggtctgaaatg

SEQ ID NO: 3734155 - DNA, 19 bp, Homo sapiens
caatgaggtctgaaatgga

SEQ ID NO: 3734156 - DNA, 24 bp, Homo sapiens
caatgatggcaattttgtaacgaa

SEQ ID NO: 3734157 - DNA, 15 bp, Homo sapiens
caatgattgttaatt

SEQ ID NO: 3734158 - DNA, 18 bp, Homo sapiens
caatgcagatgccagagc

SEQ ID NO: 3734159 - DNA, 15 bp, Homo sapiens
caatgcgaatggtag

SEQ ID NO: 3734160 - DNA, 18 bp, Homo sapiens
caatgctgcgtctcccat

SEQ ID NO: 3734161 - DNA, 13 bp, Homo sapiens
caatggaagattt

SEQ ID NO: 3734162 - DNA, 11 bp, Homo sapiens
caatggcagcc

SEQ ID NO: 3734163 - DNA, 18 bp, Homo sapiens
caatggcttactccagga

SEQ ID NO: 3734164 - DNA, 13 bp, Homo sapiens
caatggtttgcaa

SEQ ID NO: 3734165 - DNA, 16 bp, Homo sapiens
caatggtttgcaagga

SEQ ID NO: 3734166 - DNA, 15 bp, Homo sapiens
caatgtcaaggtgct

SEQ ID NO: 3734167 - DNA, 22 bp, Homo sapiens
caatgtcacaacctctctgatc

SEQ ID NO: 3734168 - DNA, 19 bp, Homo sapiens
caatgtcttggtacttgct

SEQ ID NO: 3734169 - DNA, 23 bp, Homo sapiens
caatgtcttggtacttgctgcta

SEQ ID NO: 3734170 - DNA, 22 bp, Homo sapiens
caatgtgaaaagaaaaatgagc

SEQ ID NO: 3734171 - DNA, 14 bp, Homo sapiens
caatgtgaatcaga

SEQ ID NO: 3734172 - DNA, 12 bp, Homo sapiens
caatgttcattg

SEQ ID NO: 3734173 - DNA, 13 bp, Homo sapiens
caatgttcattgt

SEQ ID NO: 3734174 - DNA, 14 bp, Homo sapiens
caatgttcattgta

SEQ ID NO: 3734175 - DNA, 22 bp, Homo sapiens
caatgttcattgtaatgttact

SEQ ID NO: 3734176 - DNA, 23 bp, Homo sapiens
caatgtttaaaaaagtttaaaat

SEQ ID NO: 3734177 - DNA, 18 bp, Homo sapiens
caattagtaacattcatg

SEQ ID NO: 3734178 - DNA, 16 bp, Homo sapiens
caattcaaaaatgtac

SEQ ID NO: 3734179 - DNA, 15 bp, Homo sapiens
caattccaaaggaat

SEQ ID NO: 3734180 - DNA, 13 bp, Homo sapiens
caattccacctgc

SEQ ID NO: 3734181 - DNA, 18 bp, Homo sapiens
caattcctagataaaaag

SEQ ID NO: 3734182 - DNA, 18 bp, Homo sapiens
caattcttacaaacatgt

SEQ ID NO: 3734183 - DNA, 19 bp, Homo sapiens
caattcttacaaacatgtg

SEQ ID NO: 3734184 - DNA, 18 bp, Homo sapiens
caattgtgagccaccacg

SEQ ID NO: 3734185 - DNA, 21 bp, Homo sapiens
caattgtgagccaccacgtcc

SEQ ID NO: 3734186 - DNA, 17 bp, Homo sapiens
caattgtgtggtcagtg

SEQ ID NO: 3734187 - DNA, 17 bp, Homo sapiens
caatttattcaagaaaa

SEQ ID NO: 3734188 - DNA, 16 bp, Homo sapiens
caatttattgcacaaa

SEQ ID NO: 3734189 - DNA, 13 bp, Homo sapiens
caatttattttat

SEQ ID NO: 3734190 - DNA, 19 bp, Homo sapiens
caatttattttattttagc

SEQ ID NO: 3734191 - DNA, 19 bp, Homo sapiens
caatttgtaaaaacagcat

SEQ ID NO: 3734192 - DNA, 16 bp, Homo sapiens
caatttgtcattttga

SEQ ID NO: 3734193 - DNA, 18 bp, Homo sapiens
caatttgtcattttgaag

SEQ ID NO: 3734194 - DNA, 23 bp, Homo sapiens
caatttgtcattttgaagctaat

SEQ ID NO: 3734195 - DNA, 19 bp, Homo sapiens
caattttctttaaccagtc

SEQ ID NO: 3734196 - DNA, 11 bp, Homo sapiens
caattttgtaa

SEQ ID NO: 3734197 - DNA, 12 bp, Homo sapiens
caattttgtaac

SEQ ID NO: 3734198 - DNA, 15 bp, Homo sapiens
cacaaaacatttttg

SEQ ID NO: 3734199 - DNA, 15 bp, Homo sapiens
cacaaaatctgtcca

SEQ ID NO: 3734200 - DNA, 16 bp, Homo sapiens
cacaaaattgggaaag

SEQ ID NO: 3734201 - DNA, 19 bp, Homo sapiens
cacaaacaaacaagctagg

SEQ ID NO: 3734202 - DNA, 12 bp, Homo sapiens
cacaaagagagt

SEQ ID NO: 3734203 - DNA, 13 bp, Homo sapiens
cacaaatatttat

SEQ ID NO: 3734204 - DNA, 11 bp, Homo sapiens
cacaacaaaaa

SEQ ID NO: 3734205 - DNA, 15 bp, Homo sapiens
cacaagattcccaga

SEQ ID NO: 3734206 - DNA, 18 bp, Homo sapiens
cacaagattcccagagac

SEQ ID NO: 3734207 - DNA, 19 bp, Homo sapiens
cacaaggctgaccaagaga

SEQ ID NO: 3734208 - DNA, 21 bp, Homo sapiens
cacaaggctgaccaagagaga

SEQ ID NO: 3734209 - DNA, 17 bp, Homo sapiens
cacaaggtgcaaatcaa

SEQ ID NO: 3734210 - DNA, 15 bp, Homo sapiens
cacaaggtgggcagg

SEQ ID NO: 3734211 - DNA, 16 bp, Homo sapiens
cacaagtgaaaaacat

SEQ ID NO: 3734212 - DNA, 14 bp, Homo sapiens
cacaagttgtgttt

SEQ ID NO: 3734213 - DNA, 21 bp, Homo sapiens
cacaatattcaatcaaaattt

SEQ ID NO: 3734214 - DNA, 21 bp, Homo sapiens
cacctactacatcgccctcca

SEQ ID NO: 3734215 - DNA, 12 bp, Homo sapiens
cacctattttag

SEQ ID NO: 3734216 - DNA, 15 bp, Homo sapiens
cacctcagagccccg

SEQ ID NO: 3734217 - DNA, 16 bp, Homo sapiens
cacctcagagccccgc

SEQ ID NO: 3734218 - DNA, 11 bp, Homo sapiens
cacctcagcct

SEQ ID NO: 3734219 - DNA, 14 bp, Homo sapiens
cacctcagcctccc

SEQ ID NO: 3734220 - DNA, 18 bp, Homo sapiens
cacctcagcctcctgtgt

SEQ ID NO: 3734221 - DNA, 12 bp, Homo sapiens
cacctcagcctt

SEQ ID NO: 3734222 - DNA, 13 bp, Homo sapiens
cacctcagccttg

SEQ ID NO: 3734223 - DNA, 15 bp, Homo sapiens
cacctcaggccaggt

SEQ ID NO: 3734224 - DNA, 17 bp, Homo sapiens
cacctcagttcccttgg

SEQ ID NO: 3734225 - DNA, 20 bp, Homo sapiens
cacctcagttcccttggcct

SEQ ID NO: 3734226 - DNA, 22 bp, Homo sapiens
cacctcagttcccttggcctca

SEQ ID NO: 3734227 - DNA, 15 bp, Homo sapiens
cacctccccaggccg

SEQ ID NO: 3734228 - DNA, 21 bp, Homo sapiens
cacctccccaggccgtggctg

SEQ ID NO: 3734229 - DNA, 14 bp, Homo sapiens
cacctccccccact

SEQ ID NO: 3734230 - DNA, 15 bp, Homo sapiens
cacctccccccactg

SEQ ID NO: 3734231 - DNA, 18 bp, Homo sapiens
cacctccccccactgcag

SEQ ID NO: 3734232 - DNA, 19 bp, Homo sapiens
cacctcccctatccaccca

SEQ ID NO: 3734233 - DNA, 15 bp, Homo sapiens
cacctcccctccttg

SEQ ID NO: 3734234 - DNA, 19 bp, Homo sapiens
cacctccctgaaccatccc

SEQ ID NO: 3734235 - DNA, 11 bp, Homo sapiens
cacctcctgcc

SEQ ID NO: 3734236 - DNA, 13 bp, Homo sapiens
cacctcctgcctc

SEQ ID NO: 3734237 - DNA, 18 bp, Homo sapiens
cacctctgcacaagctgc

SEQ ID NO: 3734238 - DNA, 19 bp, Homo sapiens
cacctctgcacaagctgca

SEQ ID NO: 3734239 - DNA, 13 bp, Homo sapiens
cacctctgcctca

SEQ ID NO: 3734240 - DNA, 13 bp, Homo sapiens
cacctctggactg

SEQ ID NO: 3734241 - DNA, 18 bp, Homo sapiens
cacctgagctttggacac

SEQ ID NO: 3734242 - DNA, 11 bp, Homo sapiens
cacctgcacct

SEQ ID NO: 3734243 - DNA, 20 bp, Homo sapiens
cacctgccagcctggcttct

SEQ ID NO: 3734244 - DNA, 17 bp, Homo sapiens
cacctgccatttgcacc

SEQ ID NO: 3734245 - DNA, 19 bp, Homo sapiens
cacctgcccaacctgctct

SEQ ID NO: 3734246 - DNA, 19 bp, Homo sapiens
cacctgcccccttctccca

SEQ ID NO: 3734247 - DNA, 13 bp, Homo sapiens
cacctgctgctgc

SEQ ID NO: 3734248 - DNA, 16 bp, Homo sapiens
cacctgctggcccctc

SEQ ID NO: 3734249 - DNA, 18 bp, Homo sapiens
cacctgctggcccctcac

SEQ ID NO: 3734250 - DNA, 22 bp, Homo sapiens
cacctggaagccctctctggct

SEQ ID NO: 3734251 - DNA, 16 bp, Homo sapiens
cacctggccccatgtc

SEQ ID NO: 3734252 - DNA, 17 bp, Homo sapiens
cacctggccctggggcc

SEQ ID NO: 3734253 - DNA, 12 bp, Homo sapiens
cacctgggcacc

SEQ ID NO: 3734254 - DNA, 22 bp, Homo sapiens
cacctggggagtgggacagagt

SEQ ID NO: 3734255 - DNA, 15 bp, Homo sapiens
cacctggggcagtca

SEQ ID NO: 3734256 - DNA, 22 bp, Homo sapiens
cacctggggtgtgggaggcccg

SEQ ID NO: 3734257 - DNA, 16 bp, Homo sapiens
cacctggttccggaat

SEQ ID NO: 3734258 - DNA, 22 bp, Homo sapiens
cacctgtactcaggaggctgag

SEQ ID NO: 3734259 - DNA, 17 bp, Homo sapiens
cacctgtactggagagc

SEQ ID NO: 3734260 - DNA, 15 bp, Homo sapiens
cacctgtagtcccag

SEQ ID NO: 3734261 - DNA, 18 bp, Homo sapiens
cacctgtagtcccagcta

SEQ ID NO: 3734262 - DNA, 20 bp, Homo sapiens
cacctgtagtcccagctact

SEQ ID NO: 3734263 - DNA, 16 bp, Homo sapiens
cacctgtcccacctca

SEQ ID NO: 3734264 - DNA, 18 bp, Homo sapiens
cacctgtcgcccagtgcc

SEQ ID NO: 3734265 - DNA, 19 bp, Homo sapiens
cacctgtgagtttaaagca

SEQ ID NO: 3734266 - DNA, 19 bp, Homo sapiens
cacctgtttttaagctgtt

SEQ ID NO: 3734267 - DNA, 13 bp, Homo sapiens
caccttaaattaa

SEQ ID NO: 3734268 - DNA, 14 bp, Homo sapiens
caccttaaattaaa

SEQ ID NO: 3734269 - DNA, 13 bp, Homo sapiens
caccttagctggc

SEQ ID NO: 3734270 - DNA, 17 bp, Homo sapiens
caccttaggcagggaag

SEQ ID NO: 3734271 - DNA, 18 bp, Homo sapiens
caccttaggcagggaagt

SEQ ID NO: 3734272 - DNA, 15 bp, Homo sapiens
caccttatatttacg

SEQ ID NO: 3734273 - DNA, 15 bp, Homo sapiens
caccttatcttaaag

SEQ ID NO: 3734274 - DNA, 12 bp, Homo sapiens
caccttcccagc

SEQ ID NO: 3734275 - DNA, 19 bp, Homo sapiens
caccttcccagctctccct

SEQ ID NO: 3734276 - DNA, 13 bp, Homo sapiens
caccttcccatgc

SEQ ID NO: 3734277 - DNA, 16 bp, Homo sapiens
caccttgacagggcac

SEQ ID NO: 3734278 - DNA, 15 bp, Homo sapiens
caccttggctcaagt

SEQ ID NO: 3734279 - DNA, 13 bp, Homo sapiens
caccttggctgca

SEQ ID NO: 3734280 - DNA, 14 bp, Homo sapiens
caccttggctgcag

SEQ ID NO: 3734281 - DNA, 18 bp, Homo sapiens
caccttggctgcagggag

SEQ ID NO: 3734282 - DNA, 18 bp, Homo sapiens
cacctttattaaaatctt

SEQ ID NO: 3734283 - DNA, 14 bp, Homo sapiens
cacctttcccatct

SEQ ID NO: 3734284 - DNA, 11 bp, Homo sapiens
caccttttaaa

SEQ ID NO: 3734285 - DNA, 15 bp, Homo sapiens
caccttttaaatcct

SEQ ID NO: 3734286 - DNA, 23 bp, Homo sapiens
caccttttaaatcctgttgaaaa

SEQ ID NO: 3734287 - DNA, 14 bp, Homo sapiens
cacgaacccacctg

SEQ ID NO: 3734288 - DNA, 16 bp, Homo sapiens
cacgaacccacctgct

SEQ ID NO: 3734289 - DNA, 17 bp, Homo sapiens
cacgactgcccggcagg

SEQ ID NO: 3734290 - DNA, 15 bp, Homo sapiens
cacgatgtggccctg

SEQ ID NO: 3734291 - DNA, 18 bp, Homo sapiens
cacgatgtggccctggcc

SEQ ID NO: 3734292 - DNA, 13 bp, Homo sapiens
cacgccactgcac

SEQ ID NO: 3734293 - DNA, 22 bp, Homo sapiens
cacgccactgcactccagcctg

SEQ ID NO: 3734294 - DNA, 18 bp, Homo sapiens
cacgcctatgatcccagc

SEQ ID NO: 3734295 - DNA, 22 bp, Homo sapiens
cacgcctatgatcccagcactt

SEQ ID NO: 3734296 - DNA, 16 bp, Homo sapiens
cacgcctgtaatccca

SEQ ID NO: 3734297 - DNA, 20 bp, Homo sapiens
cacgcctgtaatcctagcac

SEQ ID NO: 3734298 - DNA, 22 bp, Homo sapiens
cacgctaatcccgattcaccct

SEQ ID NO: 3734299 - DNA, 17 bp, Homo sapiens
cacgctggagtgcagtg

SEQ ID NO: 3734300 - DNA, 16 bp, Homo sapiens
cacgctgtctccagac

SEQ ID NO: 3734301 - DNA, 23 bp, Homo sapiens
cacgctgtctccagacccccacc

SEQ ID NO: 3734302 - DNA, 22 bp, Homo sapiens
cacgcttgacaggacagcatgg

SEQ ID NO: 3734303 - DNA, 21 bp, Homo sapiens
cacggcaggacaacgaggaag

SEQ ID NO: 3734304 - DNA, 22 bp, Homo sapiens
cacggcaggacaacgaggaagc

SEQ ID NO: 3734305 - DNA, 12 bp, Homo sapiens
cacggccaggcc

SEQ ID NO: 3734306 - DNA, 13 bp, Homo sapiens
cacggccaggcca

SEQ ID NO: 3734307 - DNA, 15 bp, Homo sapiens
cacggccaggccaga

SEQ ID NO: 3734308 - DNA, 14 bp, Homo sapiens
cacggccatgacca

SEQ ID NO: 3734309 - DNA, 14 bp, Homo sapiens
cacggctcactgca

SEQ ID NO: 3734310 - DNA, 16 bp, Homo sapiens
cacggctcactgcagc

SEQ ID NO: 3734311 - DNA, 17 bp, Homo sapiens
cacggctcactgcagcc

SEQ ID NO: 3734312 - DNA, 20 bp, Homo sapiens
cacggctcactgcagcctca

SEQ ID NO: 3734313 - DNA, 23 bp, Homo sapiens
cacgtagtagggtcaggccacgg

SEQ ID NO: 3734314 - DNA, 17 bp, Homo sapiens
cacgtcatgtttcttca

SEQ ID NO: 3734315 - DNA, 16 bp, Homo sapiens
cacgtctgaccctctc

SEQ ID NO: 3734316 - DNA, 18 bp, Homo sapiens
cacgtctgaccctctcca

SEQ ID NO: 3734317 - DNA, 13 bp, Homo sapiens
cacgtgccaggcc

SEQ ID NO: 3734318 - DNA, 15 bp, Homo sapiens
cacgtgccaggcccg

SEQ ID NO: 3734319 - DNA, 11 bp, Homo sapiens
cacgtgtgtga

SEQ ID NO: 3734320 - DNA, 12 bp, Homo sapiens
cacgtgtgtgac

SEQ ID NO: 3734321 - DNA, 13 bp, Homo sapiens
cacgttcacccct

SEQ ID NO: 3734322 - DNA, 20 bp, Homo sapiens
cacgttccttcccccgcaat

SEQ ID NO: 3734323 - DNA, 13 bp, Homo sapiens
cactaaagcagtg

SEQ ID NO: 3734324 - DNA, 20 bp, Homo sapiens
cactaacattatattgcaat

SEQ ID NO: 3734325 - DNA, 15 bp, Homo sapiens
cactaaccacgctgg

SEQ ID NO: 3734326 - DNA, 18 bp, Homo sapiens
cactacactccagcctga

SEQ ID NO: 3734327 - DNA, 23 bp, Homo sapiens
cactacatgcagcccatgcccac

SEQ ID NO: 3734328 - DNA, 18 bp, Homo sapiens
cagatgcaaagaggcaag

SEQ ID NO: 3734329 - DNA, 13 bp, Homo sapiens
cagatgcaccagc

SEQ ID NO: 3734330 - DNA, 22 bp, Homo sapiens
cagatgcaccagcccttagcag

SEQ ID NO: 3734331 - DNA, 18 bp, Homo sapiens
cagatgccagagcaaagg

SEQ ID NO: 3734332 - DNA, 15 bp, Homo sapiens
cagatgcccagaggg

SEQ ID NO: 3734333 - DNA, 18 bp, Homo sapiens
cagatgccccagagctgt

SEQ ID NO: 3734334 - DNA, 22 bp, Homo sapiens
cagatggaaccgcaggaagctg

SEQ ID NO: 3734335 - DNA, 22 bp, Homo sapiens
cagatggatttgcctgtgccac

SEQ ID NO: 3734336 - DNA, 21 bp, Homo sapiens
cagattcccagagcaaaataa

SEQ ID NO: 3734337 - DNA, 17 bp, Homo sapiens
cagattgcaacaggctg

SEQ ID NO: 3734338 - DNA, 19 bp, Homo sapiens
cagattgcaacaggctggg

SEQ ID NO: 3734339 - DNA, 17 bp, Homo sapiens
cagatttagtgaaagct

SEQ ID NO: 3734340 - DNA, 22 bp, Homo sapiens
cagatttagtgaaagctagaga

SEQ ID NO: 3734341 - DNA, 14 bp, Homo sapiens
cagattttacaaaa

SEQ ID NO: 3734342 - DNA, 19 bp, Homo sapiens
cagattttttacagctgcc

SEQ ID NO: 3734343 - DNA, 18 bp, Homo sapiens
cagcaaaagatgcttctc

SEQ ID NO: 3734344 - DNA, 17 bp, Homo sapiens
cagcaaatttataattt

SEQ ID NO: 3734345 - DNA, 13 bp, Homo sapiens
cagcaacctgtaa

SEQ ID NO: 3734346 - DNA, 14 bp, Homo sapiens
cagcaaggggctct

SEQ ID NO: 3734347 - DNA, 16 bp, Homo sapiens
cagcaaggggctctgc

SEQ ID NO: 3734348 - DNA, 17 bp, Homo sapiens
cagcaagtgagagctgg

SEQ ID NO: 3734349 - DNA, 13 bp, Homo sapiens
cagcacagagagg

SEQ ID NO: 3734350 - DNA, 13 bp, Homo sapiens
cagcaccacccta

SEQ ID NO: 3734351 - DNA, 21 bp, Homo sapiens
cagcaccaccctagtcccttc

SEQ ID NO: 3734352 - DNA, 22 bp, Homo sapiens
cagcacccccttctctgcccat

SEQ ID NO: 3734353 - DNA, 15 bp, Homo sapiens
cagcactttgggagg

SEQ ID NO: 3734354 - DNA, 18 bp, Homo sapiens
cagcactttgggaggcca

SEQ ID NO: 3734355 - DNA, 20 bp, Homo sapiens
cagcactttgggaggccaag

SEQ ID NO: 3734356 - DNA, 13 bp, Homo sapiens
cagcagagtgtgg

SEQ ID NO: 3734357 - DNA, 16 bp, Homo sapiens
cagcagatcccagctc

SEQ ID NO: 3734358 - DNA, 12 bp, Homo sapiens
cagcagatctgt

SEQ ID NO: 3734359 - DNA, 19 bp, Homo sapiens
cagcagccagctctcagcc

SEQ ID NO: 3734360 - DNA, 20 bp, Homo sapiens
cagcagccagctctcagcca

SEQ ID NO: 3734361 - DNA, 13 bp, Homo sapiens
cagcagcccctgc

SEQ ID NO: 3734362 - DNA, 16 bp, Homo sapiens
cagcagcccctgcaca

SEQ ID NO: 3734363 - DNA, 11 bp, Homo sapiens
cagcagccctc

SEQ ID NO: 3734364 - DNA, 19 bp, Homo sapiens
cagcagccctcctcacccc

SEQ ID NO: 3734365 - DNA, 23 bp, Homo sapiens
cagcagcctctgaagttggacag

SEQ ID NO: 3734366 - DNA, 14 bp, Homo sapiens
cagcagcctggacc

SEQ ID NO: 3734367 - DNA, 13 bp, Homo sapiens
cagcagctcaggc

SEQ ID NO: 3734368 - DNA, 14 bp, Homo sapiens
cagcaggcccacct

SEQ ID NO: 3734369 - DNA, 18 bp, Homo sapiens
cagcaggcccacctacct

SEQ ID NO: 3734370 - DNA, 13 bp, Homo sapiens
cagcaggcctgtt

SEQ ID NO: 3734371 - DNA, 18 bp, Homo sapiens
cagcagggagggcttctg

SEQ ID NO: 3734372 - DNA, 20 bp, Homo sapiens
cagcagggtagtctggtttc

SEQ ID NO: 3734373 - DNA, 21 bp, Homo sapiens
cagcagtgagtctcttcagaa

SEQ ID NO: 3734374 - DNA, 14 bp, Homo sapiens
cagcagttgttatt

SEQ ID NO: 3734375 - DNA, 12 bp, Homo sapiens
cagcatatttat

SEQ ID NO: 3734376 - DNA, 18 bp, Homo sapiens
cagcatatttatagcaat

SEQ ID NO: 3734377 - DNA, 20 bp, Homo sapiens
cagcatcatggaggtttgaa

SEQ ID NO: 3734378 - DNA, 16 bp, Homo sapiens
cagcatcctggcaccc

SEQ ID NO: 3734379 - DNA, 21 bp, Homo sapiens
cagcatcctggcacccggccc

SEQ ID NO: 3734380 - DNA, 19 bp, Homo sapiens
cagcattcttgtcacaata

SEQ ID NO: 3734381 - DNA, 22 bp, Homo sapiens
cagcattcttgtcacaataaat

SEQ ID NO: 3734382 - DNA, 16 bp, Homo sapiens
cagccaaacccatgag

SEQ ID NO: 3734383 - DNA, 22 bp, Homo sapiens
cagccaaatgtaattgaataaa

SEQ ID NO: 3734384 - DNA, 15 bp, Homo sapiens
cagccaacccctgtg

SEQ ID NO: 3734385 - DNA, 16 bp, Homo sapiens
cagccaacccctgtgg

SEQ ID NO: 3734386 - DNA, 18 bp, Homo sapiens
cagccaacccctgtggag

SEQ ID NO: 3734387 - DNA, 15 bp, Homo sapiens
cagccacatgggaaa

SEQ ID NO: 3734388 - DNA, 20 bp, Homo sapiens
cagccaccccgggctctctg

SEQ ID NO: 3734389 - DNA, 14 bp, Homo sapiens
cagccacggccagg

SEQ ID NO: 3734390 - DNA, 17 bp, Homo sapiens
cagccacggccaggcca

SEQ ID NO: 3734391 - DNA, 21 bp, Homo sapiens
cagccacggccaggccagagg

SEQ ID NO: 3734392 - DNA, 22 bp, Homo sapiens
cagccacggccaggccagaggg

SEQ ID NO: 3734393 - DNA, 23 bp, Homo sapiens
cagccacggccaggccagaggga

SEQ ID NO: 3734394 - DNA, 11 bp, Homo sapiens
cagccagcagc

SEQ ID NO: 3734395 - DNA, 15 bp, Homo sapiens
cagccagcccagccc

SEQ ID NO: 3734396 - DNA, 17 bp, Homo sapiens
cagccagcccagcccag

SEQ ID NO: 3734397 - DNA, 19 bp, Homo sapiens
cagccagcccagcccagct

SEQ ID NO: 3734398 - DNA, 15 bp, Homo sapiens
cagccagctctcagc

SEQ ID NO: 3734399 - DNA, 14 bp, Homo sapiens
cagccaggagctgg

SEQ ID NO: 3734400 - DNA, 15 bp, Homo sapiens
cagccaggagctggg

SEQ ID NO: 3734401 - DNA, 22 bp, Homo sapiens
cagccaggagctgggcagaagg

SEQ ID NO: 3734402 - DNA, 19 bp, Homo sapiens
cagccaggctcaggccatg

SEQ ID NO: 3734403 - DNA, 16 bp, Homo sapiens
cagccaggctgccaag

SEQ ID NO: 3734404 - DNA, 20 bp, Homo sapiens
cagccagtgacctgaggaag

SEQ ID NO: 3734405 - DNA, 18 bp, Homo sapiens
cagccatgaggagttgct

SEQ ID NO: 3734406 - DNA, 19 bp, Homo sapiens
cagcccacatagtgatggt

SEQ ID NO: 3734407 - DNA, 19 bp, Homo sapiens
cagcccacccccctcattt

SEQ ID NO: 3734408 - DNA, 15 bp, Homo sapiens
cagcccacccctcaa

SEQ ID NO: 3734409 - DNA, 16 bp, Homo sapiens
cagcccactgagaagt

SEQ ID NO: 3734410 - DNA, 15 bp, Homo sapiens
cagcccactggatca

SEQ ID NO: 3734411 - DNA, 11 bp, Homo sapiens
cagcccagctg

SEQ ID NO: 3734412 - DNA, 13 bp, Homo sapiens
cagcccagctgct

SEQ ID NO: 3734413 - DNA, 16 bp, Homo sapiens
cagcccagctgctctg

SEQ ID NO: 3734414 - DNA, 12 bp, Homo sapiens
cagcccaggcct

SEQ ID NO: 3734415 - DNA, 17 bp, Homo sapiens
cagcccaggcctccagc

SEQ ID NO: 3734416 - DNA, 11 bp, Homo sapiens
cagcccagggt

SEQ ID NO: 3734417 - DNA, 20 bp, Homo sapiens
cagcccattctctctcctgt

SEQ ID NO: 3734418 - DNA, 22 bp, Homo sapiens
cagcccattctctctcctgtcc

SEQ ID NO: 3734419 - DNA, 12 bp, Homo sapiens
cagccccaccca

SEQ ID NO: 3734420 - DNA, 21 bp, Homo sapiens
cagccccacccaggagggagg

SEQ ID NO: 3734421 - DNA, 22 bp, Homo sapiens
cagccccacccaggagggaggg

SEQ ID NO: 3734422 - DNA, 12 bp, Homo sapiens
cagccccagccc

SEQ ID NO: 3734423 - DNA, 13 bp, Homo sapiens
cagccccagccca

SEQ ID NO: 3734424 - DNA, 15 bp, Homo sapiens
cagccccagcccagc

SEQ ID NO: 3734425 - DNA, 16 bp, Homo sapiens
cagccccagcccagcc

SEQ ID NO: 3734426 - DNA, 21 bp, Homo sapiens
cagccccagcccagcccagct

SEQ ID NO: 3734427 - DNA, 13 bp, Homo sapiens
cagcccctcccac

SEQ ID NO: 3734428 - DNA, 15 bp, Homo sapiens
cagcccctcccacca

SEQ ID NO: 3734429 - DNA, 22 bp, Homo sapiens
cagcccctcccaccacagcagg

SEQ ID NO: 3734430 - DNA, 20 bp, Homo sapiens
cagcccctcctctgccacct

SEQ ID NO: 3734431 - DNA, 21 bp, Homo sapiens
cagcccctcctctgccacctc

SEQ ID NO: 3734432 - DNA, 11 bp, Homo sapiens
cagcccctctt

SEQ ID NO: 3734433 - DNA, 17 bp, Homo sapiens
cagcccctcttgccccc

SEQ ID NO: 3734434 - DNA, 13 bp, Homo sapiens
cagcccctgcaca

SEQ ID NO: 3734435 - DNA, 20 bp, Homo sapiens
cagcccgtgtggccccttca

SEQ ID NO: 3734436 - DNA, 13 bp, Homo sapiens
cagccctcagaat

SEQ ID NO: 3734437 - DNA, 22 bp, Homo sapiens
cagccctccctgcccctccctt

SEQ ID NO: 3734438 - DNA, 15 bp, Homo sapiens
cagccctccctgtcc

SEQ ID NO: 3734439 - DNA, 22 bp, Homo sapiens
cagccctccctgtcctcctcgg

SEQ ID NO: 3734440 - DNA, 13 bp, Homo sapiens
cagccctcctcac

SEQ ID NO: 3734441 - DNA, 13 bp, Homo sapiens
cagccctgccctt

SEQ ID NO: 3734442 - DNA, 14 bp, Homo sapiens
caggcaaaatcctt

SEQ ID NO: 3734443 - DNA, 22 bp, Homo sapiens
caggcaacgcacaaaacagaaa

SEQ ID NO: 3734444 - DNA, 16 bp, Homo sapiens
caggcaactgaggcag

SEQ ID NO: 3734445 - DNA, 15 bp, Homo sapiens
caggcaagcacctcc

SEQ ID NO: 3734446 - DNA, 16 bp, Homo sapiens
caggcaatgctggctg

SEQ ID NO: 3734447 - DNA, 17 bp, Homo sapiens
caggcaatgctggctgt

SEQ ID NO: 3734448 - DNA, 20 bp, Homo sapiens
caggcaatgctggctgttgg

SEQ ID NO: 3734449 - DNA, 22 bp, Homo sapiens
caggcaatggcctaaacttcag

SEQ ID NO: 3734450 - DNA, 15 bp, Homo sapiens
caggcacacttcttc

SEQ ID NO: 3734451 - DNA, 23 bp, Homo sapiens
caggcacccaccatcatgtctgg

SEQ ID NO: 3734452 - DNA, 16 bp, Homo sapiens
caggcaccgagaatgt

SEQ ID NO: 3734453 - DNA, 19 bp, Homo sapiens
caggcacgaacccacctgc

SEQ ID NO: 3734454 - DNA, 23 bp, Homo sapiens
caggcagagaatcatacttagca

SEQ ID NO: 3734455 - DNA, 18 bp, Homo sapiens
caggcagatacaggaaaa

SEQ ID NO: 3734456 - DNA, 16 bp, Homo sapiens
caggcagatctgtgcc

SEQ ID NO: 3734457 - DNA, 15 bp, Homo sapiens
caggcagcacagaga

SEQ ID NO: 3734458 - DNA, 12 bp, Homo sapiens
caggcaggctgt

SEQ ID NO: 3734459 - DNA, 13 bp, Homo sapiens
caggcaggctgtg

SEQ ID NO: 3734460 - DNA, 23 bp, Homo sapiens
caggcagggctgactctaggtgc

SEQ ID NO: 3734461 - DNA, 22 bp, Homo sapiens
caggcaggtcttgaactcctgg

SEQ ID NO: 3734462 - DNA, 22 bp, Homo sapiens
caggcagtgatgctggatgctc

SEQ ID NO: 3734463 - DNA, 17 bp, Homo sapiens
caggcataggcctgggt

SEQ ID NO: 3734464 - DNA, 15 bp, Homo sapiens
caggcatgcctgtgt

SEQ ID NO: 3734465 - DNA, 16 bp, Homo sapiens
caggcatgcctgtgtg

SEQ ID NO: 3734466 - DNA, 15 bp, Homo sapiens
caggcatgttctctg

SEQ ID NO: 3734467 - DNA, 19 bp, Homo sapiens
caggccaagagcagaggca

SEQ ID NO: 3734468 - DNA, 15 bp, Homo sapiens
caggccacctgcccc

SEQ ID NO: 3734469 - DNA, 15 bp, Homo sapiens
caggccacttgatga

SEQ ID NO: 3734470 - DNA, 13 bp, Homo sapiens
caggccagaggga

SEQ ID NO: 3734471 - DNA, 12 bp, Homo sapiens
caggccaggctc

SEQ ID NO: 3734472 - DNA, 18 bp, Homo sapiens
caggccaggctccttcct

SEQ ID NO: 3734473 - DNA, 16 bp, Homo sapiens
caggccaggtgcagtg

SEQ ID NO: 3734474 - DNA, 15 bp, Homo sapiens
caggccatcagaggc

SEQ ID NO: 3734475 - DNA, 16 bp, Homo sapiens
caggccatgtgagcca

SEQ ID NO: 3734476 - DNA, 18 bp, Homo sapiens
caggcccaagagatgaag

SEQ ID NO: 3734477 - DNA, 19 bp, Homo sapiens
caggcccaagagatgaaga

SEQ ID NO: 3734478 - DNA, 23 bp, Homo sapiens
caggcccacctaccttcaaagct

SEQ ID NO: 3734479 - DNA, 23 bp, Homo sapiens
caggccccaaaaccacagccctg

SEQ ID NO: 3734480 - DNA, 14 bp, Homo sapiens
caggccccaggaag

SEQ ID NO: 3734481 - DNA, 18 bp, Homo sapiens
caggcccccaagcctgca

SEQ ID NO: 3734482 - DNA, 15 bp, Homo sapiens
caggcccccaccact

SEQ ID NO: 3734483 - DNA, 17 bp, Homo sapiens
caggccccgcttgtcca

SEQ ID NO: 3734484 - DNA, 23 bp, Homo sapiens
caggccccgcttgtccagcgcct

SEQ ID NO: 3734485 - DNA, 17 bp, Homo sapiens
caggcccctgccaccct

SEQ ID NO: 3734486 - DNA, 20 bp, Homo sapiens
caggcccctgccaccctggg

SEQ ID NO: 3734487 - DNA, 19 bp, Homo sapiens
caggcccggcgcggtggct

SEQ ID NO: 3734488 - DNA, 13 bp, Homo sapiens
caggcccggctcc

SEQ ID NO: 3734489 - DNA, 14 bp, Homo sapiens
caggcccggctcca

SEQ ID NO: 3734490 - DNA, 17 bp, Homo sapiens
caggcccggctccaggc

SEQ ID NO: 3734491 - DNA, 18 bp, Homo sapiens
caggcccggctccaggct

SEQ ID NO: 3734492 - DNA, 21 bp, Homo sapiens
caggcccggctccaggctcct

SEQ ID NO: 3734493 - DNA, 22 bp, Homo sapiens
caggcccggctccaggctcctt

SEQ ID NO: 3734494 - DNA, 16 bp, Homo sapiens
caggcccttcctctcc

SEQ ID NO: 3734495 - DNA, 21 bp, Homo sapiens
caggcccttcctctccactgc

SEQ ID NO: 3734496 - DNA, 23 bp, Homo sapiens
caggcccttcctctccactgcct

SEQ ID NO: 3734497 - DNA, 14 bp, Homo sapiens
caggccgccccagc

SEQ ID NO: 3734498 - DNA, 23 bp, Homo sapiens
caggccgccccagcctctgagcc

SEQ ID NO: 3734499 - DNA, 22 bp, Homo sapiens
caggccggtgtgggctgtgtcg

SEQ ID NO: 3734500 - DNA, 19 bp, Homo sapiens
caggccgtggctgcccaca

SEQ ID NO: 3734501 - DNA, 13 bp, Homo sapiens
caggcctccagct

SEQ ID NO: 3734502 - DNA, 14 bp, Homo sapiens
caggcctccagctc

SEQ ID NO: 3734503 - DNA, 15 bp, Homo sapiens
caggcctccctctct

SEQ ID NO: 3734504 - DNA, 14 bp, Homo sapiens
caggcctgccagac

SEQ ID NO: 3734505 - DNA, 14 bp, Homo sapiens
caggcctgggtctg

SEQ ID NO: 3734506 - DNA, 18 bp, Homo sapiens
caggcctgggtctgtgtc

SEQ ID NO: 3734507 - DNA, 16 bp, Homo sapiens
caggcctgttgctttt

SEQ ID NO: 3734508 - DNA, 16 bp, Homo sapiens
caggcgatccacctgt

SEQ ID NO: 3734509 - DNA, 15 bp, Homo sapiens
caggcgccccttccc

SEQ ID NO: 3734510 - DNA, 17 bp, Homo sapiens
caggcgccccttccccc

SEQ ID NO: 3734511 - DNA, 21 bp, Homo sapiens
caggctcctccctccctctgc

SEQ ID NO: 3734512 - DNA, 12 bp, Homo sapiens
caggctccttcc

SEQ ID NO: 3734513 - DNA, 15 bp, Homo sapiens
caggctctgccctgc

SEQ ID NO: 3734514 - DNA, 21 bp, Homo sapiens
caggctctgccctgccctagc

SEQ ID NO: 3734515 - DNA, 12 bp, Homo sapiens
caggctcttctc

SEQ ID NO: 3734516 - DNA, 14 bp, Homo sapiens
caggctcttctcct

SEQ ID NO: 3734517 - DNA, 15 bp, Homo sapiens
caggctcttctcctt

SEQ ID NO: 3734518 - DNA, 18 bp, Homo sapiens
caggctgcatagaaggag

SEQ ID NO: 3734519 - DNA, 20 bp, Homo sapiens
caggctgcctgagcacctcc

SEQ ID NO: 3734520 - DNA, 17 bp, Homo sapiens
caggctgctcagggctg

SEQ ID NO: 3734521 - DNA, 12 bp, Homo sapiens
caggctgcttgg

SEQ ID NO: 3734522 - DNA, 14 bp, Homo sapiens
caggctggacgtgg

SEQ ID NO: 3734523 - DNA, 21 bp, Homo sapiens
caggctggcaccgccttctct

SEQ ID NO: 3734524 - DNA, 17 bp, Homo sapiens
caggctgggcttcagtg

SEQ ID NO: 3734525 - DNA, 19 bp, Homo sapiens
caggctgggcttcagtggc

SEQ ID NO: 3734526 - DNA, 20 bp, Homo sapiens
caggctgggcttcagtggca

SEQ ID NO: 3734527 - DNA, 21 bp, Homo sapiens
caggctgggcttcagtggcag

SEQ ID NO: 3734528 - DNA, 19 bp, Homo sapiens
caggctggtctcaaactct

SEQ ID NO: 3734529 - DNA, 19 bp, Homo sapiens
caggctgtgcgctgacaac

SEQ ID NO: 3734530 - DNA, 15 bp, Homo sapiens
caggcttgcctgcag

SEQ ID NO: 3734531 - DNA, 16 bp, Homo sapiens
caggcttgcctgcagg

SEQ ID NO: 3734532 - DNA, 17 bp, Homo sapiens
cagggaacatatttaag

SEQ ID NO: 3734533 - DNA, 13 bp, Homo sapiens
cagggaagctggc

SEQ ID NO: 3734534 - DNA, 14 bp, Homo sapiens
cagggaagctggcc

SEQ ID NO: 3734535 - DNA, 17 bp, Homo sapiens
cagggaagtccccaggc

SEQ ID NO: 3734536 - DNA, 23 bp, Homo sapiens
cagggaatttcaggaactagaga

SEQ ID NO: 3734537 - DNA, 20 bp, Homo sapiens
cagggacagagacacctgca

SEQ ID NO: 3734538 - DNA, 22 bp, Homo sapiens
cagggacagagacacctgcacc

SEQ ID NO: 3734539 - DNA, 15 bp, Homo sapiens
cagggaccaaggacc

SEQ ID NO: 3734540 - DNA, 17 bp, Homo sapiens
cagggagcaagacagag

SEQ ID NO: 3734541 - DNA, 16 bp, Homo sapiens
cagggagcggaaagca

SEQ ID NO: 3734542 - DNA, 18 bp, Homo sapiens
cagggagcggaaagcagc

SEQ ID NO: 3734543 - DNA, 23 bp, Homo sapiens
cagggaggaggtggcagccctgt

SEQ ID NO: 3734544 - DNA, 13 bp, Homo sapiens
cagggaggcacca

SEQ ID NO: 3734545 - DNA, 16 bp, Homo sapiens
cagggagggcttctgc

SEQ ID NO: 3734546 - DNA, 16 bp, Homo sapiens
cagggaggtcattttg

SEQ ID NO: 3734547 - DNA, 14 bp, Homo sapiens
cagggaggtggctg

SEQ ID NO: 3734548 - DNA, 23 bp, Homo sapiens
cagggatgccatctgtgggcacg

SEQ ID NO: 3734549 - DNA, 18 bp, Homo sapiens
cagggatggggccacagc

SEQ ID NO: 3734550 - DNA, 19 bp, Homo sapiens
cagggatggggccacagcc

SEQ ID NO: 3734551 - DNA, 15 bp, Homo sapiens
cagggcacaccgggc

SEQ ID NO: 3734552 - DNA, 19 bp, Homo sapiens
cagggcacaccgggcactc

SEQ ID NO: 3734553 - DNA, 16 bp, Homo sapiens
cagggcaccaagccca

SEQ ID NO: 3734554 - DNA, 21 bp, Homo sapiens
cagggcaccaagcccacaggt

SEQ ID NO: 3734555 - DNA, 15 bp, Homo sapiens
cagttcccccagtac

SEQ ID NO: 3734556 - DNA, 18 bp, Homo sapiens
cagttcccccagtacctc

SEQ ID NO: 3734557 - DNA, 13 bp, Homo sapiens
cagttcccttggc

SEQ ID NO: 3734558 - DNA, 14 bp, Homo sapiens
cagttcccttggcc

SEQ ID NO: 3734559 - DNA, 19 bp, Homo sapiens
cagttcccttggcctcaga

SEQ ID NO: 3734560 - DNA, 18 bp, Homo sapiens
cagttcctcgccctgggt

SEQ ID NO: 3734561 - DNA, 21 bp, Homo sapiens
cagttcctgcagcagagcctg

SEQ ID NO: 3734562 - DNA, 17 bp, Homo sapiens
cagttctgcaaatagaa

SEQ ID NO: 3734563 - DNA, 17 bp, Homo sapiens
cagttctgggtgctccc

SEQ ID NO: 3734564 - DNA, 23 bp, Homo sapiens
cagttggtaagcttccaggaaaa

SEQ ID NO: 3734565 - DNA, 16 bp, Homo sapiens
cagttggtgtgttttt

SEQ ID NO: 3734566 - DNA, 21 bp, Homo sapiens
cagttgtcccgattgtaactc

SEQ ID NO: 3734567 - DNA, 16 bp, Homo sapiens
cagtttgagacaggag

SEQ ID NO: 3734568 - DNA, 22 bp, Homo sapiens
cagtttgcagaaaagcacctgc

SEQ ID NO: 3734569 - DNA, 12 bp, Homo sapiens
cagtttgctttg

SEQ ID NO: 3734570 - DNA, 21 bp, Homo sapiens
cagtttgtacagacgtatgct

SEQ ID NO: 3734571 - DNA, 12 bp, Homo sapiens
cagttttaaaga

SEQ ID NO: 3734572 - DNA, 15 bp, Homo sapiens
cagttttatcatttt

SEQ ID NO: 3734573 - DNA, 12 bp, Homo sapiens
cagttttccatg

SEQ ID NO: 3734574 - DNA, 13 bp, Homo sapiens
cagttttccttct

SEQ ID NO: 3734575 - DNA, 22 bp, Homo sapiens
cagttttccttctcatctgtga

SEQ ID NO: 3734576 - DNA, 16 bp, Homo sapiens
cagttttttatgctaa

SEQ ID NO: 3734577 - DNA, 19 bp, Homo sapiens
cataaaataaagtatatat

SEQ ID NO: 3734578 - DNA, 22 bp, Homo sapiens
cataaaattttctactcttttt

SEQ ID NO: 3734579 - DNA, 21 bp, Homo sapiens
cataaaggttattttctcctg

SEQ ID NO: 3734580 - DNA, 22 bp, Homo sapiens
cataaaggttattttctcctga

SEQ ID NO: 3734581 - DNA, 13 bp, Homo sapiens
cataacagaatgc

SEQ ID NO: 3734582 - DNA, 19 bp, Homo sapiens
cataacagggtaaattatt

SEQ ID NO: 3734583 - DNA, 19 bp, Homo sapiens
cataacagtgccattgtct

SEQ ID NO: 3734584 - DNA, 19 bp, Homo sapiens
cataactgacaaatcaagt

SEQ ID NO: 3734585 - DNA, 22 bp, Homo sapiens
cataaggaatgtagctggtttc

SEQ ID NO: 3734586 - DNA, 18 bp, Homo sapiens
cataataaatatctgtac

SEQ ID NO: 3734587 - DNA, 21 bp, Homo sapiens
cataatctggactcctctgtc

SEQ ID NO: 3734588 - DNA, 22 bp, Homo sapiens
cataatctggactcctctgtcc

SEQ ID NO: 3734589 - DNA, 15 bp, Homo sapiens
cataattatgacagt

SEQ ID NO: 3734590 - DNA, 20 bp, Homo sapiens
cataattttcttcatgcaat

SEQ ID NO: 3734591 - DNA, 15 bp, Homo sapiens
catacaattccaaac

SEQ ID NO: 3734592 - DNA, 22 bp, Homo sapiens
catacacccccacctcctgcaa

SEQ ID NO: 3734593 - DNA, 17 bp, Homo sapiens
catacatttataatgtt

SEQ ID NO: 3734594 - DNA, 21 bp, Homo sapiens
catacatttataatgtttgct

SEQ ID NO: 3734595 - DNA, 22 bp, Homo sapiens
catacatttataatgtttgcta

SEQ ID NO: 3734596 - DNA, 20 bp, Homo sapiens
catactccttccatcaaata

SEQ ID NO: 3734597 - DNA, 15 bp, Homo sapiens
catactctgtctccc

SEQ ID NO: 3734598 - DNA, 16 bp, Homo sapiens
catactctgtctccct

SEQ ID NO: 3734599 - DNA, 23 bp, Homo sapiens
catagaaatgtaacttttgtaag

SEQ ID NO: 3734600 - DNA, 17 bp, Homo sapiens
catagactagagaaacc

SEQ ID NO: 3734601 - DNA, 19 bp, Homo sapiens
catagactttatgcaataa

SEQ ID NO: 3734602 - DNA, 17 bp, Homo sapiens
catagaggtgagggaag

SEQ ID NO: 3734603 - DNA, 22 bp, Homo sapiens
catagattcacctgtaaaactt

SEQ ID NO: 3734604 - DNA, 14 bp, Homo sapiens
catagcaagacaca

SEQ ID NO: 3734605 - DNA, 20 bp, Homo sapiens
catagcaagacacatcccta

SEQ ID NO: 3734606 - DNA, 23 bp, Homo sapiens
catagcaagattgcttaaaatag

SEQ ID NO: 3734607 - DNA, 16 bp, Homo sapiens
catagcattaactaat

SEQ ID NO: 3734608 - DNA, 19 bp, Homo sapiens
catagcctaatccctgggc

SEQ ID NO: 3734609 - DNA, 20 bp, Homo sapiens
catagcttgataaagggcca

SEQ ID NO: 3734610 - DNA, 21 bp, Homo sapiens
catagcttgataaagggccaa

SEQ ID NO: 3734611 - DNA, 22 bp, Homo sapiens
catagtaccaatcattttaatt

SEQ ID NO: 3734612 - DNA, 21 bp, Homo sapiens
catagtactctttgtagcaaa

SEQ ID NO: 3734613 - DNA, 21 bp, Homo sapiens
catagtattccattgtgtgag

SEQ ID NO: 3734614 - DNA, 19 bp, Homo sapiens
catagtgatggttcccctg

SEQ ID NO: 3734615 - DNA, 23 bp, Homo sapiens
catataagattcatatttacttc

SEQ ID NO: 3734616 - DNA, 14 bp, Homo sapiens
catataatatatgt

SEQ ID NO: 3734617 - DNA, 15 bp, Homo sapiens
catataatatatgtt

SEQ ID NO: 3734618 - DNA, 15 bp, Homo sapiens
catataatgttgtta

SEQ ID NO: 3734619 - DNA, 17 bp, Homo sapiens
catataatgttgttatt

SEQ ID NO: 3734620 - DNA, 20 bp, Homo sapiens
catatatacacacacaaaga

SEQ ID NO: 3734621 - DNA, 17 bp, Homo sapiens
catatatatctatctta

SEQ ID NO: 3734622 - DNA, 22 bp, Homo sapiens
catatatatgttttaagaggca

SEQ ID NO: 3734623 - DNA, 16 bp, Homo sapiens
catatattttttagaa

SEQ ID NO: 3734624 - DNA, 14 bp, Homo sapiens
catatcctgagcca

SEQ ID NO: 3734625 - DNA, 23 bp, Homo sapiens
catatcctgagccatcggtgaaa

SEQ ID NO: 3734626 - DNA, 13 bp, Homo sapiens
catatctatcaga

SEQ ID NO: 3734627 - DNA, 13 bp, Homo sapiens
catatgaggatgc

SEQ ID NO: 3734628 - DNA, 23 bp, Homo sapiens
catatgattgtgcacatacttga

SEQ ID NO: 3734629 - DNA, 17 bp, Homo sapiens
catatgcttcaaactaa

SEQ ID NO: 3734630 - DNA, 22 bp, Homo sapiens
catatgtttcgctgatatatgt

SEQ ID NO: 3734631 - DNA, 17 bp, Homo sapiens
catattctgttggccag

SEQ ID NO: 3734632 - DNA, 14 bp, Homo sapiens
catattgttattat

SEQ ID NO: 3734633 - DNA, 14 bp, Homo sapiens
catatttacttctt

SEQ ID NO: 3734634 - DNA, 16 bp, Homo sapiens
catatttacttcttat

SEQ ID NO: 3734635 - DNA, 20 bp, Homo sapiens
catatttacttcttatacat

SEQ ID NO: 3734636 - DNA, 22 bp, Homo sapiens
catatttatagcaatccatgtt

SEQ ID NO: 3734637 - DNA, 14 bp, Homo sapiens
catatttgttaaat

SEQ ID NO: 3734638 - DNA, 20 bp, Homo sapiens
catatttgttaaatatttac

SEQ ID NO: 3734639 - DNA, 22 bp, Homo sapiens
catcaagttattgacaaactct

SEQ ID NO: 3734640 - DNA, 16 bp, Homo sapiens
catcaatgttcattgt

SEQ ID NO: 3734641 - DNA, 16 bp, Homo sapiens
catcaattatagaaag

SEQ ID NO: 3734642 - DNA, 19 bp, Homo sapiens
catcacagggttgggccca

SEQ ID NO: 3734643 - DNA, 16 bp, Homo sapiens
catcaccttaggcagg

SEQ ID NO: 3734644 - DNA, 18 bp, Homo sapiens
catcaccttaggcaggga

SEQ ID NO: 3734645 - DNA, 14 bp, Homo sapiens
catcacgcctgtgc

SEQ ID NO: 3734646 - DNA, 12 bp, Homo sapiens
catcacttccct

SEQ ID NO: 3734647 - DNA, 14 bp, Homo sapiens
catcacttgtacaa

SEQ ID NO: 3734648 - DNA, 18 bp, Homo sapiens
catcagaagcctattgta

SEQ ID NO: 3734649 - DNA, 14 bp, Homo sapiens
catcagacagatgg

SEQ ID NO: 3734650 - DNA, 19 bp, Homo sapiens
catcagacctgtcttccaa

SEQ ID NO: 3734651 - DNA, 22 bp, Homo sapiens
catcagacctgtcttccaagga

SEQ ID NO: 3734652 - DNA, 13 bp, Homo sapiens
catcagctagcaa

SEQ ID NO: 3734653 - DNA, 17 bp, Homo sapiens
catcagctagcaaaaga

SEQ ID NO: 3734654 - DNA, 16 bp, Homo sapiens
catcagtggcatggct

SEQ ID NO: 3734655 - DNA, 22 bp, Homo sapiens
catcagtggcatggctccagtc

SEQ ID NO: 3734656 - DNA, 17 bp, Homo sapiens
catcagtgttaaaaaat

SEQ ID NO: 3734657 - DNA, 18 bp, Homo sapiens
catcagtgttaaaaaatt

SEQ ID NO: 3734658 - DNA, 15 bp, Homo sapiens
catcagttcccccag

SEQ ID NO: 3734659 - DNA, 12 bp, Homo sapiens
catcataaaata

SEQ ID NO: 3734660 - DNA, 22 bp, Homo sapiens
catcataaaataaagtatatat

SEQ ID NO: 3734661 - DNA, 18 bp, Homo sapiens
catcatctgtagatacta

SEQ ID NO: 3734662 - DNA, 14 bp, Homo sapiens
catcatgtctggct

SEQ ID NO: 3734663 - DNA, 15 bp, Homo sapiens
catcattaaattttt

SEQ ID NO: 3734664 - DNA, 16 bp, Homo sapiens
catccaaccccccacc

SEQ ID NO: 3734665 - DNA, 15 bp, Homo sapiens
catccaactgagaaa

SEQ ID NO: 3734666 - DNA, 18 bp, Homo sapiens
catccaatcctcactggg

SEQ ID NO: 3734667 - DNA, 12 bp, Homo sapiens
catgtgggagct

SEQ ID NO: 3734668 - DNA, 20 bp, Homo sapiens
catgtgggtgagccagtgga

SEQ ID NO: 3734669 - DNA, 21 bp, Homo sapiens
catgtggtgggacagggaccc

SEQ ID NO: 3734670 - DNA, 22 bp, Homo sapiens
catgtggttaatgccatggaca

SEQ ID NO: 3734671 - DNA, 17 bp, Homo sapiens
catgtgtccatcccagc

SEQ ID NO: 3734672 - DNA, 18 bp, Homo sapiens
catgtgtccatcccagcg

SEQ ID NO: 3734673 - DNA, 17 bp, Homo sapiens
catgtgtgagtgtgtgc

SEQ ID NO: 3734674 - DNA, 19 bp, Homo sapiens
catgtgtgcgagtgtgtgc

SEQ ID NO: 3734675 - DNA, 14 bp, Homo sapiens
catgtgtgctgaac

SEQ ID NO: 3734676 - DNA, 21 bp, Homo sapiens
catgtgtgtgcaagtgtgtgc

SEQ ID NO: 3734677 - DNA, 22 bp, Homo sapiens
catgttaatcctagctgtgtgc

SEQ ID NO: 3734678 - DNA, 21 bp, Homo sapiens
catgttacataagataaatgt

SEQ ID NO: 3734679 - DNA, 14 bp, Homo sapiens
catgttaggaaaat

SEQ ID NO: 3734680 - DNA, 22 bp, Homo sapiens
catgttatgataaaaaattttg

SEQ ID NO: 3734681 - DNA, 13 bp, Homo sapiens
catgttggccagg

SEQ ID NO: 3734682 - DNA, 19 bp, Homo sapiens
catgtttaagatttaattt

SEQ ID NO: 3734683 - DNA, 10 bp, Homo sapiens
catgtttctt

SEQ ID NO: 3734684 - DNA, 16 bp, Homo sapiens
catgtttgagctcaga

SEQ ID NO: 3734685 - DNA, 18 bp, Homo sapiens
catgtttgagctcagacc

SEQ ID NO: 3734686 - DNA, 19 bp, Homo sapiens
catgtttgagctcagaccc

SEQ ID NO: 3734687 - DNA, 15 bp, Homo sapiens
catgttttgtttacg

SEQ ID NO: 3734688 - DNA, 20 bp, Homo sapiens
catgtttttcttctccctca

SEQ ID NO: 3734689 - DNA, 21 bp, Homo sapiens
cattaaaacaatattgtttct

SEQ ID NO: 3734690 - DNA, 22 bp, Homo sapiens
cattaaagcatttactttgaat

SEQ ID NO: 3734691 - DNA, 17 bp, Homo sapiens
cattaacagttttccat

SEQ ID NO: 3734692 - DNA, 15 bp, Homo sapiens
cattaagcatcacaa

SEQ ID NO: 3734693 - DNA, 19 bp, Homo sapiens
cattaagcatcacaaatga

SEQ ID NO: 3734694 - DNA, 21 bp, Homo sapiens
cattaattattattgctgttg

SEQ ID NO: 3734695 - DNA, 15 bp, Homo sapiens
cattacagagaggag

SEQ ID NO: 3734696 - DNA, 21 bp, Homo sapiens
cattacagagaggagaaacac

SEQ ID NO: 3734697 - DNA, 20 bp, Homo sapiens
cattactcttgtaagatttt

SEQ ID NO: 3734698 - DNA, 17 bp, Homo sapiens
cattagcagtttgcttt

SEQ ID NO: 3734699 - DNA, 18 bp, Homo sapiens
cattataactgaaggaga

SEQ ID NO: 3734700 - DNA, 16 bp, Homo sapiens
cattatattgcaatga

SEQ ID NO: 3734701 - DNA, 19 bp, Homo sapiens
cattatcactttaaagccc

SEQ ID NO: 3734702 - DNA, 16 bp, Homo sapiens
cattatcgggagcagt

SEQ ID NO: 3734703 - DNA, 23 bp, Homo sapiens
cattatgatgtgggtcaaggaat

SEQ ID NO: 3734704 - DNA, 20 bp, Homo sapiens
cattattggaattaacctgg

SEQ ID NO: 3734705 - DNA, 23 bp, Homo sapiens
cattattggaattaacctggtgc

SEQ ID NO: 3734706 - DNA, 19 bp, Homo sapiens
cattatttgcatgttacct

SEQ ID NO: 3734707 - DNA, 20 bp, Homo sapiens
cattcacccagacagctccc

SEQ ID NO: 3734708 - DNA, 21 bp, Homo sapiens
cattcagaacaccaagacttg

SEQ ID NO: 3734709 - DNA, 13 bp, Homo sapiens
cattcaggaaaac

SEQ ID NO: 3734710 - DNA, 23 bp, Homo sapiens
cattcaggaaaactgacagagga

SEQ ID NO: 3734711 - DNA, 15 bp, Homo sapiens
cattcaggaacctgg

SEQ ID NO: 3734712 - DNA, 15 bp, Homo sapiens
cattccaaaacgaag

SEQ ID NO: 3734713 - DNA, 23 bp, Homo sapiens
cattccaacagctcaagtcttcc

SEQ ID NO: 3734714 - DNA, 15 bp, Homo sapiens
cattccatgtgccca

SEQ ID NO: 3734715 - DNA, 13 bp, Homo sapiens
cattccccatggg

SEQ ID NO: 3734716 - DNA, 11 bp, Homo sapiens
cattccctgag

SEQ ID NO: 3734717 - DNA, 17 bp, Homo sapiens
cattccctgagtcacca

SEQ ID NO: 3734718 - DNA, 23 bp, Homo sapiens
cattcctaacacagcatgtgtat

SEQ ID NO: 3734719 - DNA, 13 bp, Homo sapiens
cattcctgcctgt

SEQ ID NO: 3734720 - DNA, 15 bp, Homo sapiens
cattcctgcctgtct

SEQ ID NO: 3734721 - DNA, 17 bp, Homo sapiens
cattcctggagcccgag

SEQ ID NO: 3734722 - DNA, 15 bp, Homo sapiens
cattccttgataatg

SEQ ID NO: 3734723 - DNA, 16 bp, Homo sapiens
cattctcaagccctgc

SEQ ID NO: 3734724 - DNA, 15 bp, Homo sapiens
cattctctctcctgt

SEQ ID NO: 3734725 - DNA, 16 bp, Homo sapiens
cattctctctcctgta

SEQ ID NO: 3734726 - DNA, 20 bp, Homo sapiens
cattctctctcctgtccaac

SEQ ID NO: 3734727 - DNA, 12 bp, Homo sapiens
cattctctgaag

SEQ ID NO: 3734728 - DNA, 16 bp, Homo sapiens
cattctgcctgcccag

SEQ ID NO: 3734729 - DNA, 20 bp, Homo sapiens
cattctgctttcatcttggt

SEQ ID NO: 3734730 - DNA, 16 bp, Homo sapiens
cattctggtctctcta

SEQ ID NO: 3734731 - DNA, 18 bp, Homo sapiens
cattctggtctctctatt

SEQ ID NO: 3734732 - DNA, 21 bp, Homo sapiens
cattcttcctagttttctcct

SEQ ID NO: 3734733 - DNA, 23 bp, Homo sapiens
cattcttctgtacgtctgacagg

SEQ ID NO: 3734734 - DNA, 12 bp, Homo sapiens
cattctttgctt

SEQ ID NO: 3734735 - DNA, 13 bp, Homo sapiens
cattctttgcttg

SEQ ID NO: 3734736 - DNA, 19 bp, Homo sapiens
cattctttgcttgaacaca

SEQ ID NO: 3734737 - DNA, 17 bp, Homo sapiens
cattgaaaataggagag

SEQ ID NO: 3734738 - DNA, 18 bp, Homo sapiens
cattgaaaatgtaagtaa

SEQ ID NO: 3734739 - DNA, 22 bp, Homo sapiens
cattgaaaatgtaagtaaatgt

SEQ ID NO: 3734740 - DNA, 19 bp, Homo sapiens
cattgaaagagaaccagtt

SEQ ID NO: 3734741 - DNA, 14 bp, Homo sapiens
cattgaagagagag

SEQ ID NO: 3734742 - DNA, 19 bp, Homo sapiens
cattgaagtaatgaatttt

SEQ ID NO: 3734743 - DNA, 18 bp, Homo sapiens
cattgaccaagaactgca

SEQ ID NO: 3734744 - DNA, 21 bp, Homo sapiens
cattgaccaagaactgcatgg

SEQ ID NO: 3734745 - DNA, 19 bp, Homo sapiens
cattgagaactgcatatgt

SEQ ID NO: 3734746 - DNA, 19 bp, Homo sapiens
cattgatatgaaaaatatg

SEQ ID NO: 3734747 - DNA, 22 bp, Homo sapiens
cattgatatgaaaaatatgata

SEQ ID NO: 3734748 - DNA, 19 bp, Homo sapiens
cattgatggggaaggaggc

SEQ ID NO: 3734749 - DNA, 16 bp, Homo sapiens
cattgattgtcagcta

SEQ ID NO: 3734750 - DNA, 17 bp, Homo sapiens
cattgattgtcagctac

SEQ ID NO: 3734751 - DNA, 18 bp, Homo sapiens
cattgattgtcagctact

SEQ ID NO: 3734752 - DNA, 16 bp, Homo sapiens
cattgcagtctgcttc

SEQ ID NO: 3734753 - DNA, 11 bp, Homo sapiens
cattgcattta

SEQ ID NO: 3734754 - DNA, 15 bp, Homo sapiens
cattgccaccaggag

SEQ ID NO: 3734755 - DNA, 17 bp, Homo sapiens
cattgccaccaggagaa

SEQ ID NO: 3734756 - DNA, 20 bp, Homo sapiens
cattgccaccaggagaacca

SEQ ID NO: 3734757 - DNA, 15 bp, Homo sapiens
cattgccagtgtctt

SEQ ID NO: 3734758 - DNA, 21 bp, Homo sapiens
cattgccagtgtctttctttg

SEQ ID NO: 3734759 - DNA, 17 bp, Homo sapiens
cattgccttaactggag

SEQ ID NO: 3734760 - DNA, 21 bp, Homo sapiens
cattgccttaactggagcccc

SEQ ID NO: 3734761 - DNA, 21 bp, Homo sapiens
cattgcgctctagcctgggca

SEQ ID NO: 3734762 - DNA, 14 bp, Homo sapiens
cattgcggacagcc

SEQ ID NO: 3734763 - DNA, 17 bp, Homo sapiens
cattgcggacagccacg

SEQ ID NO: 3734764 - DNA, 19 bp, Homo sapiens
cattgctggtcttgtaaga

SEQ ID NO: 3734765 - DNA, 11 bp, Homo sapiens
cattgcttcac

SEQ ID NO: 3734766 - DNA, 15 bp, Homo sapiens
cattgcttcactacc

SEQ ID NO: 3734767 - DNA, 14 bp, Homo sapiens
cattgctttctgaa

SEQ ID NO: 3734768 - DNA, 15 bp, Homo sapiens
cattgctttctgaaa

SEQ ID NO: 3734769 - DNA, 19 bp, Homo sapiens
cattgggtgggtaaattca

SEQ ID NO: 3734770 - DNA, 17 bp, Homo sapiens
cattggttccctttgct

SEQ ID NO: 3734771 - DNA, 15 bp, Homo sapiens
cattgtaatgttact

SEQ ID NO: 3734772 - DNA, 18 bp, Homo sapiens
cattgtaatgttactgat

SEQ ID NO: 3734773 - DNA, 21 bp, Homo sapiens
cattgtaatgttactgatcat

SEQ ID NO: 3734774 - DNA, 15 bp, Homo sapiens
cattgtagagcttct

SEQ ID NO: 3734775 - DNA, 15 bp, Homo sapiens
cattgtataaaaata

SEQ ID NO: 3734776 - DNA, 16 bp, Homo sapiens
cattgtataaaaatag

SEQ ID NO: 3734777 - DNA, 11 bp, Homo sapiens
cattgtcttta

SEQ ID NO: 3734778 - DNA, 16 bp, Homo sapiens
cattgtctttatatga

SEQ ID NO: 3734779 - DNA, 21 bp, Homo sapiens
cattgtggctgtcagcaggaa

SEQ ID NO: 3734780 - DNA, 20 bp, Homo sapiens
ccacctgcccatcacagggt

SEQ ID NO: 3734781 - DNA, 22 bp, Homo sapiens
ccacctgcccccttctcccaca

SEQ ID NO: 3734782 - DNA, 23 bp, Homo sapiens
ccacctgcccccttctcccacac

SEQ ID NO: 3734783 - DNA, 14 bp, Homo sapiens
ccacctggaagccc

SEQ ID NO: 3734784 - DNA, 22 bp, Homo sapiens
ccacctggccccatgtctctca

SEQ ID NO: 3734785 - DNA, 15 bp, Homo sapiens
ccacctggggcagtc

SEQ ID NO: 3734786 - DNA, 15 bp, Homo sapiens
ccacctggtggcctc

SEQ ID NO: 3734787 - DNA, 19 bp, Homo sapiens
ccacctgtcaaacaaagcc

SEQ ID NO: 3734788 - DNA, 12 bp, Homo sapiens
ccacctgtccca

SEQ ID NO: 3734789 - DNA, 13 bp, Homo sapiens
ccacctgtcccac

SEQ ID NO: 3734790 - DNA, 18 bp, Homo sapiens
ccacctgtcccacctcaa

SEQ ID NO: 3734791 - DNA, 20 bp, Homo sapiens
ccacctgtctcagcctccca

SEQ ID NO: 3734792 - DNA, 14 bp, Homo sapiens
ccaccttaaattaa

SEQ ID NO: 3734793 - DNA, 18 bp, Homo sapiens
ccaccttaaattaaacaa

SEQ ID NO: 3734794 - DNA, 18 bp, Homo sapiens
ccaccttcaattcctggg

SEQ ID NO: 3734795 - DNA, 14 bp, Homo sapiens
ccaccttcccagct

SEQ ID NO: 3734796 - DNA, 15 bp, Homo sapiens
ccaccttcccagctc

SEQ ID NO: 3734797 - DNA, 21 bp, Homo sapiens
ccaccttcccagctctccctc

SEQ ID NO: 3734798 - DNA, 13 bp, Homo sapiens
ccaccttggctca

SEQ ID NO: 3734799 - DNA, 14 bp, Homo sapiens
ccaccttggctcaa

SEQ ID NO: 3734800 - DNA, 15 bp, Homo sapiens
ccaccttggctcaag

SEQ ID NO: 3734801 - DNA, 12 bp, Homo sapiens
ccaccttggctg

SEQ ID NO: 3734802 - DNA, 14 bp, Homo sapiens
ccaccttggctgca

SEQ ID NO: 3734803 - DNA, 20 bp, Homo sapiens
ccacctttattaaaatctta

SEQ ID NO: 3734804 - DNA, 17 bp, Homo sapiens
ccacgatgtggccctgg

SEQ ID NO: 3734805 - DNA, 19 bp, Homo sapiens
ccacgctggagtgcagtga

SEQ ID NO: 3734806 - DNA, 15 bp, Homo sapiens
ccacgctgtctccag

SEQ ID NO: 3734807 - DNA, 21 bp, Homo sapiens
ccacgctgtctccagaccccc

SEQ ID NO: 3734808 - DNA, 13 bp, Homo sapiens
ccacggccaggcc

SEQ ID NO: 3734809 - DNA, 15 bp, Homo sapiens
ccacggccaggccag

SEQ ID NO: 3734810 - DNA, 17 bp, Homo sapiens
ccacgtgacagtgcctg

SEQ ID NO: 3734811 - DNA, 15 bp, Homo sapiens
ccacgtgccaggccc

SEQ ID NO: 3734812 - DNA, 15 bp, Homo sapiens
ccacgttccttactg

SEQ ID NO: 3734813 - DNA, 21 bp, Homo sapiens
ccacgttccttactgcagaat

SEQ ID NO: 3734814 - DNA, 23 bp, Homo sapiens
ccacgttctctctgcctgtgagc

SEQ ID NO: 3734815 - DNA, 18 bp, Homo sapiens
ccactacactccagcctg

SEQ ID NO: 3734816 - DNA, 20 bp, Homo sapiens
ccactacactccagcctgag

SEQ ID NO: 3734817 - DNA, 22 bp, Homo sapiens
ccactacactccagcctgagca

SEQ ID NO: 3734818 - DNA, 22 bp, Homo sapiens
ccactacatgcagcccatgccc

SEQ ID NO: 3734819 - DNA, 22 bp, Homo sapiens
ccactacggaatagttggctag

SEQ ID NO: 3734820 - DNA, 16 bp, Homo sapiens
ccactaggactctgag

SEQ ID NO: 3734821 - DNA, 14 bp, Homo sapiens
ccactaggctgggt

SEQ ID NO: 3734822 - DNA, 16 bp, Homo sapiens
ccactaggctgggtgc

SEQ ID NO: 3734823 - DNA, 21 bp, Homo sapiens
ccactaggctgggtgcccaca

SEQ ID NO: 3734824 - DNA, 23 bp, Homo sapiens
ccactaggctgggtgcccacagc

SEQ ID NO: 3734825 - DNA, 13 bp, Homo sapiens
ccactcaggaggc

SEQ ID NO: 3734826 - DNA, 20 bp, Homo sapiens
ccactcaggccaacaagcca

SEQ ID NO: 3734827 - DNA, 17 bp, Homo sapiens
ccactccagacccctgg

SEQ ID NO: 3734828 - DNA, 19 bp, Homo sapiens
ccactccagacccctggct

SEQ ID NO: 3734829 - DNA, 16 bp, Homo sapiens
ccactcctccaaagga

SEQ ID NO: 3734830 - DNA, 13 bp, Homo sapiens
ccactccttcctg

SEQ ID NO: 3734831 - DNA, 22 bp, Homo sapiens
ccactccttcctgccacctgct

SEQ ID NO: 3734832 - DNA, 13 bp, Homo sapiens
ccactcgcttccc

SEQ ID NO: 3734833 - DNA, 21 bp, Homo sapiens
ccactcgcttcccccatagcc

SEQ ID NO: 3734834 - DNA, 16 bp, Homo sapiens
ccactctaccctccca

SEQ ID NO: 3734835 - DNA, 12 bp, Homo sapiens
ccactctcccca

SEQ ID NO: 3734836 - DNA, 17 bp, Homo sapiens
ccactgacagcctccca

SEQ ID NO: 3734837 - DNA, 13 bp, Homo sapiens
ccactgcaccggg

SEQ ID NO: 3734838 - DNA, 20 bp, Homo sapiens
ccactgcactatagcctagg

SEQ ID NO: 3734839 - DNA, 17 bp, Homo sapiens
ccactgcactccagcct

SEQ ID NO: 3734840 - DNA, 20 bp, Homo sapiens
ccactgcactccagcctggc

SEQ ID NO: 3734841 - DNA, 21 bp, Homo sapiens
ccactgcactccagcctgggc

SEQ ID NO: 3734842 - DNA, 20 bp, Homo sapiens
ccactgcactctagccggag

SEQ ID NO: 3734843 - DNA, 13 bp, Homo sapiens
ccactgcaggccc

SEQ ID NO: 3734844 - DNA, 14 bp, Homo sapiens
ccactgcaggcccc

SEQ ID NO: 3734845 - DNA, 18 bp, Homo sapiens
ccactgcataccaacctg

SEQ ID NO: 3734846 - DNA, 19 bp, Homo sapiens
ccactgcataccaacctgg

SEQ ID NO: 3734847 - DNA, 23 bp, Homo sapiens
ccactgccacacgtctgaccctc

SEQ ID NO: 3734848 - DNA, 16 bp, Homo sapiens
ccactgcccgagctgg

SEQ ID NO: 3734849 - DNA, 17 bp, Homo sapiens
ccactgcccgagctggt

SEQ ID NO: 3734850 - DNA, 17 bp, Homo sapiens
ccactgcccttctcatt

SEQ ID NO: 3734851 - DNA, 11 bp, Homo sapiens
ccactgcctct

SEQ ID NO: 3734852 - DNA, 20 bp, Homo sapiens
ccactgcctctggaattgct

SEQ ID NO: 3734853 - DNA, 11 bp, Homo sapiens
ccactgcctgc

SEQ ID NO: 3734854 - DNA, 21 bp, Homo sapiens
ccactgccttcgatacaccgg

SEQ ID NO: 3734855 - DNA, 20 bp, Homo sapiens
ccactgcttttggtctgtgt

SEQ ID NO: 3734856 - DNA, 17 bp, Homo sapiens
ccactggatcagaaaga

SEQ ID NO: 3734857 - DNA, 15 bp, Homo sapiens
ccactggctgtgggc

SEQ ID NO: 3734858 - DNA, 20 bp, Homo sapiens
ccactggctgtgggctccct

SEQ ID NO: 3734859 - DNA, 12 bp, Homo sapiens
ccactggggaaa

SEQ ID NO: 3734860 - DNA, 14 bp, Homo sapiens
ccactgtgaagaga

SEQ ID NO: 3734861 - DNA, 19 bp, Homo sapiens
ccactgtgccatgtgccag

SEQ ID NO: 3734862 - DNA, 19 bp, Homo sapiens
ccacttaaaaaatgtccat

SEQ ID NO: 3734863 - DNA, 13 bp, Homo sapiens
ccacttaccttca

SEQ ID NO: 3734864 - DNA, 14 bp, Homo sapiens
ccacttaccttcaa

SEQ ID NO: 3734865 - DNA, 21 bp, Homo sapiens
ccacttaccttcaataaagta

SEQ ID NO: 3734866 - DNA, 21 bp, Homo sapiens
ccacttagaaattgcatttcc

SEQ ID NO: 3734867 - DNA, 14 bp, Homo sapiens
ccacttcagctgac

SEQ ID NO: 3734868 - DNA, 23 bp, Homo sapiens
ccacttcattcttgaaagctgtg

SEQ ID NO: 3734869 - DNA, 20 bp, Homo sapiens
ccactttgcacagctctccg

SEQ ID NO: 3734870 - DNA, 21 bp, Homo sapiens
ccactttggtacatggccagt

SEQ ID NO: 3734871 - DNA, 16 bp, Homo sapiens
ccagaaaaccccagca

SEQ ID NO: 3734872 - DNA, 22 bp, Homo sapiens
ccagaacacactccatcagctt

SEQ ID NO: 3734873 - DNA, 17 bp, Homo sapiens
ccagaacagtttgtaca

SEQ ID NO: 3734874 - DNA, 15 bp, Homo sapiens
ccagaacctgtcctt

SEQ ID NO: 3734875 - DNA, 12 bp, Homo sapiens
ccagaactggac

SEQ ID NO: 3734876 - DNA, 15 bp, Homo sapiens
ccagaagggggccat

SEQ ID NO: 3734877 - DNA, 21 bp, Homo sapiens
ccagaatgtcagattcctttc

SEQ ID NO: 3734878 - DNA, 22 bp, Homo sapiens
ccagaatgtcagattcctttcc

SEQ ID NO: 3734879 - DNA, 21 bp, Homo sapiens
ccagacaccttgacagggcac

SEQ ID NO: 3734880 - DNA, 21 bp, Homo sapiens
ccagacagcaacggggaggcc

SEQ ID NO: 3734881 - DNA, 20 bp, Homo sapiens
ccagacagctccctctgcct

SEQ ID NO: 3734882 - DNA, 17 bp, Homo sapiens
ccagaccagagctctgg

SEQ ID NO: 3734883 - DNA, 12 bp, Homo sapiens
ccagacccccac

SEQ ID NO: 3734884 - DNA, 16 bp, Homo sapiens
ccagacccccacccct

SEQ ID NO: 3734885 - DNA, 20 bp, Homo sapiens
ccagacccctctggccagga

SEQ ID NO: 3734886 - DNA, 22 bp, Homo sapiens
ccagacccctctggccaggatg

SEQ ID NO: 3734887 - DNA, 16 bp, Homo sapiens
ccagacccctggcttt

SEQ ID NO: 3734888 - DNA, 17 bp, Homo sapiens
ccagacccctggctttt

SEQ ID NO: 3734889 - DNA, 18 bp, Homo sapiens
ccagacccctggcttttc

SEQ ID NO: 3734890 - DNA, 24 bp, Homo sapiens
ccagacccctggcttttcactgct

SEQ ID NO: 3734891 - DNA, 15 bp, Homo sapiens
ccagacccggctgcg

SEQ ID NO: 3734892 - DNA, 15 bp, Homo sapiens
ccagacctgagctcc

SEQ ID NO: 3734893 - DNA, 20 bp, Homo sapiens
ccataattatgacagttata

SEQ ID NO: 3734894 - DNA, 21 bp, Homo sapiens
ccataattttcttcatgcaat

SEQ ID NO: 3734895 - DNA, 23 bp, Homo sapiens
ccataattttcttcatgcaatga

SEQ ID NO: 3734896 - DNA, 20 bp, Homo sapiens
ccataattttttttttcctt

SEQ ID NO: 3734897 - DNA, 18 bp, Homo sapiens
ccatagcaagattgctta

SEQ ID NO: 3734898 - DNA, 18 bp, Homo sapiens
ccatagccaccccagaaa

SEQ ID NO: 3734899 - DNA, 20 bp, Homo sapiens
ccatagtatattaaaaatgg

SEQ ID NO: 3734900 - DNA, 14 bp, Homo sapiens
ccatatgttacact

SEQ ID NO: 3734901 - DNA, 22 bp, Homo sapiens
ccatattcagtgctgtggcctg

SEQ ID NO: 3734902 - DNA, 19 bp, Homo sapiens
ccatcacgcggccgagaca

SEQ ID NO: 3734903 - DNA, 14 bp, Homo sapiens
ccatcactggagca

SEQ ID NO: 3734904 - DNA, 22 bp, Homo sapiens
ccatcagaggacacctgtactg

SEQ ID NO: 3734905 - DNA, 20 bp, Homo sapiens
ccatcagttcccccagtacc

SEQ ID NO: 3734906 - DNA, 12 bp, Homo sapiens
ccatcatgtctg

SEQ ID NO: 3734907 - DNA, 14 bp, Homo sapiens
ccatcatgtctggc

SEQ ID NO: 3734908 - DNA, 16 bp, Homo sapiens
ccatccactctaccct

SEQ ID NO: 3734909 - DNA, 16 bp, Homo sapiens
ccatcccacaccctgg

SEQ ID NO: 3734910 - DNA, 16 bp, Homo sapiens
ccatcccatcccatcc

SEQ ID NO: 3734911 - DNA, 18 bp, Homo sapiens
ccatcccatcccatccca

SEQ ID NO: 3734912 - DNA, 19 bp, Homo sapiens
ccatcccgctcttttccta

SEQ ID NO: 3734913 - DNA, 20 bp, Homo sapiens
ccatcggtcctgtctcccct

SEQ ID NO: 3734914 - DNA, 18 bp, Homo sapiens
ccatctcaggccacctgc

SEQ ID NO: 3734915 - DNA, 23 bp, Homo sapiens
ccatctcaggccacctgccccct

SEQ ID NO: 3734916 - DNA, 16 bp, Homo sapiens
ccatctcctttcaggg

SEQ ID NO: 3734917 - DNA, 14 bp, Homo sapiens
ccatctcgccaccc

SEQ ID NO: 3734918 - DNA, 20 bp, Homo sapiens
ccatctcgccacccctcctt

SEQ ID NO: 3734919 - DNA, 14 bp, Homo sapiens
ccatctggcagggt

SEQ ID NO: 3734920 - DNA, 16 bp, Homo sapiens
ccatctggcagggtgg

SEQ ID NO: 3734921 - DNA, 21 bp, Homo sapiens
ccatcttgcccgctcaggctg

SEQ ID NO: 3734922 - DNA, 16 bp, Homo sapiens
ccatgaagacaggaca

SEQ ID NO: 3734923 - DNA, 15 bp, Homo sapiens
ccatgaagccacagc

SEQ ID NO: 3734924 - DNA, 19 bp, Homo sapiens
ccatgaagccacagcccag

SEQ ID NO: 3734925 - DNA, 18 bp, Homo sapiens
ccatgaatgtatcaggaa

SEQ ID NO: 3734926 - DNA, 19 bp, Homo sapiens
ccatgaatgtatcaggaaa

SEQ ID NO: 3734927 - DNA, 22 bp, Homo sapiens
ccatgacaacttctaattgcca

SEQ ID NO: 3734928 - DNA, 15 bp, Homo sapiens
ccatgactgcatttt

SEQ ID NO: 3734929 - DNA, 17 bp, Homo sapiens
ccatgactgcattttac

SEQ ID NO: 3734930 - DNA, 13 bp, Homo sapiens
ccatgagcctcag

SEQ ID NO: 3734931 - DNA, 14 bp, Homo sapiens
ccatgagcctcagc

SEQ ID NO: 3734932 - DNA, 19 bp, Homo sapiens
ccatgagcctcagcatcct

SEQ ID NO: 3734933 - DNA, 15 bp, Homo sapiens
ccatgagctccagac

SEQ ID NO: 3734934 - DNA, 23 bp, Homo sapiens
ccatgagctccagacccccagca

SEQ ID NO: 3734935 - DNA, 17 bp, Homo sapiens
ccatgagtttgccctgg

SEQ ID NO: 3734936 - DNA, 21 bp, Homo sapiens
ccatgattaaccacttcagct

SEQ ID NO: 3734937 - DNA, 14 bp, Homo sapiens
ccatgattcgccca

SEQ ID NO: 3734938 - DNA, 13 bp, Homo sapiens
ccatgcccacctg

SEQ ID NO: 3734939 - DNA, 18 bp, Homo sapiens
ccatgcccagctcagagg

SEQ ID NO: 3734940 - DNA, 15 bp, Homo sapiens
ccatgcttgggtgta

SEQ ID NO: 3734941 - DNA, 20 bp, Homo sapiens
ccatggaggcacacagctgc

SEQ ID NO: 3734942 - DNA, 21 bp, Homo sapiens
ccatggaggcacacagctgca

SEQ ID NO: 3734943 - DNA, 20 bp, Homo sapiens
ccatggctaaggcaccagcc

SEQ ID NO: 3734944 - DNA, 21 bp, Homo sapiens
ccatgggaaatgtcaacaagt

SEQ ID NO: 3734945 - DNA, 13 bp, Homo sapiens
ccatgggcctcct

SEQ ID NO: 3734946 - DNA, 13 bp, Homo sapiens
ccatgggggcagg

SEQ ID NO: 3734947 - DNA, 14 bp, Homo sapiens
ccatgggggcaggg

SEQ ID NO: 3734948 - DNA, 14 bp, Homo sapiens
ccatgtaaaacaaa

SEQ ID NO: 3734949 - DNA, 13 bp, Homo sapiens
ccatgtactgtag

SEQ ID NO: 3734950 - DNA, 17 bp, Homo sapiens
ccatgtcgcctctgcat

SEQ ID NO: 3734951 - DNA, 16 bp, Homo sapiens
ccatgtctctcagaat

SEQ ID NO: 3734952 - DNA, 13 bp, Homo sapiens
ccatgtgagccac

SEQ ID NO: 3734953 - DNA, 18 bp, Homo sapiens
ccatgtgcctgcaccagg

SEQ ID NO: 3734954 - DNA, 18 bp, Homo sapiens
ccatgtgtgagtgtgtgc

SEQ ID NO: 3734955 - DNA, 17 bp, Homo sapiens
ccatgttggccaggctg

SEQ ID NO: 3734956 - DNA, 18 bp, Homo sapiens
ccatgttggccaggctgg

SEQ ID NO: 3734957 - DNA, 21 bp, Homo sapiens
ccatgtttgagctcagacccc

SEQ ID NO: 3734958 - DNA, 14 bp, Homo sapiens
ccattaccatggag

SEQ ID NO: 3734959 - DNA, 17 bp, Homo sapiens
ccattatgaagaagaga

SEQ ID NO: 3734960 - DNA, 12 bp, Homo sapiens
ccattcaggaac

SEQ ID NO: 3734961 - DNA, 16 bp, Homo sapiens
ccattccccagcctct

SEQ ID NO: 3734962 - DNA, 13 bp, Homo sapiens
ccattcctcaggg

SEQ ID NO: 3734963 - DNA, 16 bp, Homo sapiens
ccattcctcagggaca

SEQ ID NO: 3734964 - DNA, 18 bp, Homo sapiens
ccattctcaagccctgca

SEQ ID NO: 3734965 - DNA, 14 bp, Homo sapiens
ccattctctctcct

SEQ ID NO: 3734966 - DNA, 15 bp, Homo sapiens
ccattctgcctgccc

SEQ ID NO: 3734967 - DNA, 16 bp, Homo sapiens
ccattctgcctgccca

SEQ ID NO: 3734968 - DNA, 18 bp, Homo sapiens
ccattctgcctgcccagg

SEQ ID NO: 3734969 - DNA, 14 bp, Homo sapiens
ccattcttcctagt

SEQ ID NO: 3734970 - DNA, 19 bp, Homo sapiens
ccattcttcctagttttct

SEQ ID NO: 3734971 - DNA, 20 bp, Homo sapiens
ccattcttcctagttttctc

SEQ ID NO: 3734972 - DNA, 11 bp, Homo sapiens
ccattgctgct

SEQ ID NO: 3734973 - DNA, 20 bp, Homo sapiens
ccattgtctttatatgaaca

SEQ ID NO: 3734974 - DNA, 12 bp, Homo sapiens
ccattgtgtgag

SEQ ID NO: 3734975 - DNA, 19 bp, Homo sapiens
ccatttagttctttgttat

SEQ ID NO: 3734976 - DNA, 17 bp, Homo sapiens
ccatttcacacctgaaa

SEQ ID NO: 3734977 - DNA, 13 bp, Homo sapiens
ccatttcagagag

SEQ ID NO: 3734978 - DNA, 17 bp, Homo sapiens
ccatttctatttattta

SEQ ID NO: 3734979 - DNA, 20 bp, Homo sapiens
ccatttgtaataaagtatat

SEQ ID NO: 3734980 - DNA, 21 bp, Homo sapiens
ccattttgcaaaatttccagt

SEQ ID NO: 3734981 - DNA, 23 bp, Homo sapiens
cccaaaagtcaaaaggtgcctgt

SEQ ID NO: 3734982 - DNA, 17 bp, Homo sapiens
cccaaacaaatatgcaa

SEQ ID NO: 3734983 - DNA, 15 bp, Homo sapiens
cccaaacctggagat

SEQ ID NO: 3734984 - DNA, 16 bp, Homo sapiens
cccaaagagctgccta

SEQ ID NO: 3734985 - DNA, 23 bp, Homo sapiens
cccaaaggaagctttctctgctt

SEQ ID NO: 3734986 - DNA, 15 bp, Homo sapiens
cccaaagtgctggga

SEQ ID NO: 3734987 - DNA, 14 bp, Homo sapiens
cccaaatctgccta

SEQ ID NO: 3734988 - DNA, 21 bp, Homo sapiens
cccaaattatcaagctaataa

SEQ ID NO: 3734989 - DNA, 13 bp, Homo sapiens
cccaacccccacc

SEQ ID NO: 3734990 - DNA, 14 bp, Homo sapiens
cccaacccccaccc

SEQ ID NO: 3734991 - DNA, 13 bp, Homo sapiens
cccaaccctgccc

SEQ ID NO: 3734992 - DNA, 14 bp, Homo sapiens
cccaaccctgcccc

SEQ ID NO: 3734993 - DNA, 22 bp, Homo sapiens
cccaaccggggagcccccgccc

SEQ ID NO: 3734994 - DNA, 13 bp, Homo sapiens
cccaacctcagca

SEQ ID NO: 3734995 - DNA, 16 bp, Homo sapiens
cccaacctcctgacct

SEQ ID NO: 3734996 - DNA, 13 bp, Homo sapiens
cccaacctgctct

SEQ ID NO: 3734997 - DNA, 23 bp, Homo sapiens
cccaacctgctctcctcttgcca

SEQ ID NO: 3734998 - DNA, 16 bp, Homo sapiens
cccaacgaaaagcaca

SEQ ID NO: 3734999 - DNA, 13 bp, Homo sapiens
cccaactcctgga

SEQ ID NO: 3735000 - DNA, 15 bp, Homo sapiens
cccaactcctggaag

SEQ ID NO: 3735001 - DNA, 15 bp, Homo sapiens
cccaagaaggctggg

SEQ ID NO: 3735002 - DNA, 21 bp, Homo sapiens
cccaagaatagatgctgactg

SEQ ID NO: 3735003 - DNA, 21 bp, Homo sapiens
cccaagacagatgccccagag

SEQ ID NO: 3735004 - DNA, 21 bp, Homo sapiens
cccaagagaaggggaagcact

SEQ ID NO: 3735005 - DNA, 15 bp, Homo sapiens
cccaagagatgaaga

SEQ ID NO: 3735006 - DNA, 13 bp, Homo sapiens
cccaagctctgct

SEQ ID NO: 3735007 - DNA, 18 bp, Homo sapiens
cccgtgtggccccttcac

SEQ ID NO: 3735008 - DNA, 15 bp, Homo sapiens
ccctaaatctgagga

SEQ ID NO: 3735009 - DNA, 12 bp, Homo sapiens
ccctaatgcctg

SEQ ID NO: 3735010 - DNA, 19 bp, Homo sapiens
ccctaatttaacccagctc

SEQ ID NO: 3735011 - DNA, 14 bp, Homo sapiens
ccctaccccaccac

SEQ ID NO: 3735012 - DNA, 18 bp, Homo sapiens
ccctaccgagtctcttct

SEQ ID NO: 3735013 - DNA, 18 bp, Homo sapiens
ccctacctcaacctgtaa

SEQ ID NO: 3735014 - DNA, 19 bp, Homo sapiens
ccctacctcaacctgtaaa

SEQ ID NO: 3735015 - DNA, 22 bp, Homo sapiens
ccctacctcaacctgtaaatta

SEQ ID NO: 3735016 - DNA, 14 bp, Homo sapiens
ccctacctgtgcct

SEQ ID NO: 3735017 - DNA, 19 bp, Homo sapiens
ccctagaatcagcctaggg

SEQ ID NO: 3735018 - DNA, 13 bp, Homo sapiens
ccctagggctggg

SEQ ID NO: 3735019 - DNA, 15 bp, Homo sapiens
ccctagtaaaaatac

SEQ ID NO: 3735020 - DNA, 17 bp, Homo sapiens
ccctagtcccttcccct

SEQ ID NO: 3735021 - DNA, 18 bp, Homo sapiens
ccctataatgctggagcg

SEQ ID NO: 3735022 - DNA, 18 bp, Homo sapiens
ccctatccacccagccca

SEQ ID NO: 3735023 - DNA, 18 bp, Homo sapiens
ccctattagagaagagat

SEQ ID NO: 3735024 - DNA, 16 bp, Homo sapiens
ccctcaacacctctgc

SEQ ID NO: 3735025 - DNA, 15 bp, Homo sapiens
ccctcacctgggcac

SEQ ID NO: 3735026 - DNA, 15 bp, Homo sapiens
ccctcaggaccctcg

SEQ ID NO: 3735027 - DNA, 22 bp, Homo sapiens
ccctcaggaccctcgctggccc

SEQ ID NO: 3735028 - DNA, 21 bp, Homo sapiens
ccctcaggcataggcctgggt

SEQ ID NO: 3735029 - DNA, 19 bp, Homo sapiens
ccctcagtttccctatctc

SEQ ID NO: 3735030 - DNA, 14 bp, Homo sapiens
ccctcatctgtctg

SEQ ID NO: 3735031 - DNA, 16 bp, Homo sapiens
ccctccacagccgcag

SEQ ID NO: 3735032 - DNA, 17 bp, Homo sapiens
ccctcccaccacagcag

SEQ ID NO: 3735033 - DNA, 13 bp, Homo sapiens
ccctcccaccccc

SEQ ID NO: 3735034 - DNA, 14 bp, Homo sapiens
ccctcccagctctg

SEQ ID NO: 3735035 - DNA, 12 bp, Homo sapiens
ccctccccaggg

SEQ ID NO: 3735036 - DNA, 13 bp, Homo sapiens
ccctcccctgccc

SEQ ID NO: 3735037 - DNA, 14 bp, Homo sapiens
ccctccgccattct

SEQ ID NO: 3735038 - DNA, 21 bp, Homo sapiens
ccctccgccttcactccggtg

SEQ ID NO: 3735039 - DNA, 22 bp, Homo sapiens
ccctccgccttcactccggtgt

SEQ ID NO: 3735040 - DNA, 18 bp, Homo sapiens
ccctccgtggcatcacct

SEQ ID NO: 3735041 - DNA, 16 bp, Homo sapiens
ccctcctcacctctgg

SEQ ID NO: 3735042 - DNA, 12 bp, Homo sapiens
ccctcctctgcc

SEQ ID NO: 3735043 - DNA, 13 bp, Homo sapiens
ccctcctctgcca

SEQ ID NO: 3735044 - DNA, 13 bp, Homo sapiens
ccctcctttccca

SEQ ID NO: 3735045 - DNA, 20 bp, Homo sapiens
ccctcctttcccaacacttc

SEQ ID NO: 3735046 - DNA, 15 bp, Homo sapiens
ccctcgaagcgcgcc

SEQ ID NO: 3735047 - DNA, 22 bp, Homo sapiens
ccctcgaagcgcgccactcgct

SEQ ID NO: 3735048 - DNA, 14 bp, Homo sapiens
ccctcgctggcccc

SEQ ID NO: 3735049 - DNA, 19 bp, Homo sapiens
ccctcgctggcccccactg

SEQ ID NO: 3735050 - DNA, 15 bp, Homo sapiens
ccctcggtcttcggc

SEQ ID NO: 3735051 - DNA, 15 bp, Homo sapiens
ccctcgtggccttcc

SEQ ID NO: 3735052 - DNA, 16 bp, Homo sapiens
ccctcgtggccttccc

SEQ ID NO: 3735053 - DNA, 16 bp, Homo sapiens
ccctctcaggcatgcc

SEQ ID NO: 3735054 - DNA, 11 bp, Homo sapiens
ccctctcctgc

SEQ ID NO: 3735055 - DNA, 14 bp, Homo sapiens
ccctctctcttctg

SEQ ID NO: 3735056 - DNA, 15 bp, Homo sapiens
ccctctctcttctgc

SEQ ID NO: 3735057 - DNA, 12 bp, Homo sapiens
ccctctgccggc

SEQ ID NO: 3735058 - DNA, 15 bp, Homo sapiens
ccctctgcctgtccc

SEQ ID NO: 3735059 - DNA, 16 bp, Homo sapiens
ccctctggccctgcct

SEQ ID NO: 3735060 - DNA, 20 bp, Homo sapiens
ccctcttatgtacctctttt

SEQ ID NO: 3735061 - DNA, 22 bp, Homo sapiens
ccctcttgccccccaccccagc

SEQ ID NO: 3735062 - DNA, 24 bp, Homo sapiens
ccctgaaaatgtttttctgccagg

SEQ ID NO: 3735063 - DNA, 15 bp, Homo sapiens
ccctgaaagccctga

SEQ ID NO: 3735064 - DNA, 14 bp, Homo sapiens
ccctgaacaagaat

SEQ ID NO: 3735065 - DNA, 17 bp, Homo sapiens
ccctgactctctgtgac

SEQ ID NO: 3735066 - DNA, 17 bp, Homo sapiens
ccctgagacaaatggag

SEQ ID NO: 3735067 - DNA, 12 bp, Homo sapiens
ccctgagctcgg

SEQ ID NO: 3735068 - DNA, 22 bp, Homo sapiens
ccctgagctcggtggacccagg

SEQ ID NO: 3735069 - DNA, 16 bp, Homo sapiens
ccctgatttcttgctt

SEQ ID NO: 3735070 - DNA, 16 bp, Homo sapiens
ccctgcaaaggactgt

SEQ ID NO: 3735071 - DNA, 23 bp, Homo sapiens
ccctgcacaaagcccttccatgt

SEQ ID NO: 3735072 - DNA, 22 bp, Homo sapiens
ccctgcactggagtccagtctc

SEQ ID NO: 3735073 - DNA, 19 bp, Homo sapiens
ccctgcacttgcagactct

SEQ ID NO: 3735074 - DNA, 18 bp, Homo sapiens
ccctgccaccctggggag

SEQ ID NO: 3735075 - DNA, 14 bp, Homo sapiens
ccctgccagcaccc

SEQ ID NO: 3735076 - DNA, 23 bp, Homo sapiens
ccctgccagcacccccacgccct

SEQ ID NO: 3735077 - DNA, 20 bp, Homo sapiens
ccctgcccaccctctggaga

SEQ ID NO: 3735078 - DNA, 23 bp, Homo sapiens
ccctgccccctccccttcacacc

SEQ ID NO: 3735079 - DNA, 21 bp, Homo sapiens
ccctgccccgtcaccatctca

SEQ ID NO: 3735080 - DNA, 17 bp, Homo sapiens
ccctgcccctgccccgt

SEQ ID NO: 3735081 - DNA, 18 bp, Homo sapiens
ccctgcccctgccccgtc

SEQ ID NO: 3735082 - DNA, 11 bp, Homo sapiens
ccctgccctgc

SEQ ID NO: 3735083 - DNA, 13 bp, Homo sapiens
ccctgccctgctg

SEQ ID NO: 3735084 - DNA, 14 bp, Homo sapiens
ccctgccctggtcc

SEQ ID NO: 3735085 - DNA, 13 bp, Homo sapiens
ccctgccgcctca

SEQ ID NO: 3735086 - DNA, 17 bp, Homo sapiens
ccctgcgaaggggccct

SEQ ID NO: 3735087 - DNA, 21 bp, Homo sapiens
ccctgcgaaggggccctggtc

SEQ ID NO: 3735088 - DNA, 17 bp, Homo sapiens
ccctgctcccacagaac

SEQ ID NO: 3735089 - DNA, 23 bp, Homo sapiens
ccctgctgccgcctcccagcctg

SEQ ID NO: 3735090 - DNA, 11 bp, Homo sapiens
ccctgctgcct

SEQ ID NO: 3735091 - DNA, 19 bp, Homo sapiens
ccctgctggttcagggttg

SEQ ID NO: 3735092 - DNA, 19 bp, Homo sapiens
ccctgctttgggctgccct

SEQ ID NO: 3735093 - DNA, 21 bp, Homo sapiens
ccctggaaggacatccatgtt

SEQ ID NO: 3735094 - DNA, 19 bp, Homo sapiens
ccctggatccatcaggcca

SEQ ID NO: 3735095 - DNA, 14 bp, Homo sapiens
ccctggccagaggc

SEQ ID NO: 3735096 - DNA, 15 bp, Homo sapiens
ccctggccagaggct

SEQ ID NO: 3735097 - DNA, 15 bp, Homo sapiens
ccctggccatctctg

SEQ ID NO: 3735098 - DNA, 21 bp, Homo sapiens
ccctggcctgctgggctctcc

SEQ ID NO: 3735099 - DNA, 15 bp, Homo sapiens
ccctggctcccatga

SEQ ID NO: 3735100 - DNA, 20 bp, Homo sapiens
ccctggcttgtaactccacc

SEQ ID NO: 3735101 - DNA, 23 bp, Homo sapiens
ccctggcttgtaactccaccaac

SEQ ID NO: 3735102 - DNA, 17 bp, Homo sapiens
ccctggcttttcactgc

SEQ ID NO: 3735103 - DNA, 18 bp, Homo sapiens
ccctggcttttcactgct

SEQ ID NO: 3735104 - DNA, 21 bp, Homo sapiens
ccctggggctgatctcaggga

SEQ ID NO: 3735105 - DNA, 20 bp, Homo sapiens
ccctgggggaagccctggat

SEQ ID NO: 3735106 - DNA, 17 bp, Homo sapiens
ccctggtccttccaggc

SEQ ID NO: 3735107 - DNA, 17 bp, Homo sapiens
ccctggtggacagtcct

SEQ ID NO: 3735108 - DNA, 21 bp, Homo sapiens
ccctggtggacagtcctggga

SEQ ID NO: 3735109 - DNA, 15 bp, Homo sapiens
ccctggtggcagtgg

SEQ ID NO: 3735110 - DNA, 22 bp, Homo sapiens
ccctggtggcagtgggagctgc

SEQ ID NO: 3735111 - DNA, 20 bp, Homo sapiens
ccctggtttcactggcccaa

SEQ ID NO: 3735112 - DNA, 19 bp, Homo sapiens
ccctgtcaccaagctcaca

SEQ ID NO: 3735113 - DNA, 14 bp, Homo sapiens
ccctgtcagtgcag

SEQ ID NO: 3735114 - DNA, 21 bp, Homo sapiens
ccctgtcagtgcagcccgtgt

SEQ ID NO: 3735115 - DNA, 21 bp, Homo sapiens
ccctgtccaaactgcctaagc

SEQ ID NO: 3735116 - DNA, 14 bp, Homo sapiens
ccctgtcctcctcg

SEQ ID NO: 3735117 - DNA, 20 bp, Homo sapiens
ccctgtctcaaaaaaagaaa

SEQ ID NO: 3735118 - DNA, 14 bp, Homo sapiens
ccctgtggaaggga

SEQ ID NO: 3735119 - DNA, 21 bp, Homo sapiens
ccctgtggaagggactaggag

SEQ ID NO: 3735120 - DNA, 21 bp, Homo sapiens
cctcgtcctccccctgccagt

SEQ ID NO: 3735121 - DNA, 23 bp, Homo sapiens
cctcgtggccttccccagcctct

SEQ ID NO: 3735122 - DNA, 18 bp, Homo sapiens
cctctaacaggggctggt

SEQ ID NO: 3735123 - DNA, 14 bp, Homo sapiens
cctctaccaagctg

SEQ ID NO: 3735124 - DNA, 17 bp, Homo sapiens
cctctagaaatttttca

SEQ ID NO: 3735125 - DNA, 13 bp, Homo sapiens
cctctagtgccct

SEQ ID NO: 3735126 - DNA, 16 bp, Homo sapiens
cctctatatttgctct

SEQ ID NO: 3735127 - DNA, 20 bp, Homo sapiens
cctctcaggcatgcctgtgt

SEQ ID NO: 3735128 - DNA, 16 bp, Homo sapiens
cctctcctgcctactc

SEQ ID NO: 3735129 - DNA, 15 bp, Homo sapiens
cctctctctggaaag

SEQ ID NO: 3735130 - DNA, 16 bp, Homo sapiens
cctctctcttctgctc

SEQ ID NO: 3735131 - DNA, 18 bp, Homo sapiens
cctctctcttctgctcca

SEQ ID NO: 3735132 - DNA, 22 bp, Homo sapiens
cctctctgatcttgtgctcagc

SEQ ID NO: 3735133 - DNA, 20 bp, Homo sapiens
cctctcttatagaatattta

SEQ ID NO: 3735134 - DNA, 22 bp, Homo sapiens
cctctcttcctatcccatccca

SEQ ID NO: 3735135 - DNA, 20 bp, Homo sapiens
cctctgaagttggacagcaa

SEQ ID NO: 3735136 - DNA, 20 bp, Homo sapiens
cctctgacacacagctctgt

SEQ ID NO: 3735137 - DNA, 17 bp, Homo sapiens
cctctgacctgcaggcc

SEQ ID NO: 3735138 - DNA, 20 bp, Homo sapiens
cctctgacctgcaggccaag

SEQ ID NO: 3735139 - DNA, 15 bp, Homo sapiens
cctctgcacaagctg

SEQ ID NO: 3735140 - DNA, 14 bp, Homo sapiens
cctctgccacctcc

SEQ ID NO: 3735141 - DNA, 12 bp, Homo sapiens
cctctgccggct

SEQ ID NO: 3735142 - DNA, 11 bp, Homo sapiens
cctctgcctca

SEQ ID NO: 3735143 - DNA, 20 bp, Homo sapiens
cctctgcctctgacacacag

SEQ ID NO: 3735144 - DNA, 21 bp, Homo sapiens
cctctgcctgaaccttccatc

SEQ ID NO: 3735145 - DNA, 22 bp, Homo sapiens
cctctgcctgaagtcacacagt

SEQ ID NO: 3735146 - DNA, 12 bp, Homo sapiens
cctctgcctgtc

SEQ ID NO: 3735147 - DNA, 14 bp, Homo sapiens
cctctgctgccatg

SEQ ID NO: 3735148 - DNA, 15 bp, Homo sapiens
cctctgctgccatgg

SEQ ID NO: 3735149 - DNA, 21 bp, Homo sapiens
cctctgctggccgggcacagc

SEQ ID NO: 3735150 - DNA, 16 bp, Homo sapiens
cctctggaggcctctg

SEQ ID NO: 3735151 - DNA, 21 bp, Homo sapiens
cctctggaggcctctgggcct

SEQ ID NO: 3735152 - DNA, 22 bp, Homo sapiens
cctctggaggcctctgggcctc

SEQ ID NO: 3735153 - DNA, 12 bp, Homo sapiens
cctctggccagg

SEQ ID NO: 3735154 - DNA, 13 bp, Homo sapiens
cctctggccctgc

SEQ ID NO: 3735155 - DNA, 17 bp, Homo sapiens
cctctggccctgccttc

SEQ ID NO: 3735156 - DNA, 18 bp, Homo sapiens
cctctggccctgccttct

SEQ ID NO: 3735157 - DNA, 13 bp, Homo sapiens
cctctggctagag

SEQ ID NO: 3735158 - DNA, 23 bp, Homo sapiens
cctctggctagaggccagcccca

SEQ ID NO: 3735159 - DNA, 23 bp, Homo sapiens
cctctggctggctaactggaagc

SEQ ID NO: 3735160 - DNA, 16 bp, Homo sapiens
cctctgggcaggacct

SEQ ID NO: 3735161 - DNA, 17 bp, Homo sapiens
cctctgtccaggcactg

SEQ ID NO: 3735162 - DNA, 18 bp, Homo sapiens
cctctgtccagggccctg

SEQ ID NO: 3735163 - DNA, 21 bp, Homo sapiens
cctctgtccagggccctgagc

SEQ ID NO: 3735164 - DNA, 17 bp, Homo sapiens
cctcttaaaaaataaaa

SEQ ID NO: 3735165 - DNA, 18 bp, Homo sapiens
cctcttaaataaaccttt

SEQ ID NO: 3735166 - DNA, 20 bp, Homo sapiens
cctcttatgtacctctttta

SEQ ID NO: 3735167 - DNA, 11 bp, Homo sapiens
cctcttcccca

SEQ ID NO: 3735168 - DNA, 19 bp, Homo sapiens
cctcttcctccctcattcc

SEQ ID NO: 3735169 - DNA, 22 bp, Homo sapiens
cctcttgccactgcctcttcct

SEQ ID NO: 3735170 - DNA, 23 bp, Homo sapiens
cctcttgccactgcctcttcctc

SEQ ID NO: 3735171 - DNA, 21 bp, Homo sapiens
cctcttgccccccaccccagc

SEQ ID NO: 3735172 - DNA, 12 bp, Homo sapiens
cctctttaagag

SEQ ID NO: 3735173 - DNA, 16 bp, Homo sapiens
cctctttcagaaaaca

SEQ ID NO: 3735174 - DNA, 19 bp, Homo sapiens
cctctttgttttgttttaa

SEQ ID NO: 3735175 - DNA, 16 bp, Homo sapiens
cctgaaaacccagaga

SEQ ID NO: 3735176 - DNA, 17 bp, Homo sapiens
cctgaaaacccagagag

SEQ ID NO: 3735177 - DNA, 21 bp, Homo sapiens
cctgaaaagatgttgtgtctt

SEQ ID NO: 3735178 - DNA, 18 bp, Homo sapiens
cctgaaatagtggttctt

SEQ ID NO: 3735179 - DNA, 10 bp, Homo sapiens
cctgaaatcc

SEQ ID NO: 3735180 - DNA, 15 bp, Homo sapiens
cctgaacaagaattg

SEQ ID NO: 3735181 - DNA, 21 bp, Homo sapiens
cctgaagactcattcttctgt

SEQ ID NO: 3735182 - DNA, 15 bp, Homo sapiens
cctgaagtcacacag

SEQ ID NO: 3735183 - DNA, 22 bp, Homo sapiens
cctgaatagctcccagatttca

SEQ ID NO: 3735184 - DNA, 13 bp, Homo sapiens
cctgaatgaaata

SEQ ID NO: 3735185 - DNA, 23 bp, Homo sapiens
cctgaatgtattgaacttggaaa

SEQ ID NO: 3735186 - DNA, 21 bp, Homo sapiens
cctgaattttgttgctgtttt

SEQ ID NO: 3735187 - DNA, 13 bp, Homo sapiens
cctgaccctgcag

SEQ ID NO: 3735188 - DNA, 22 bp, Homo sapiens
cctgagaagtgtctaaaaacac

SEQ ID NO: 3735189 - DNA, 19 bp, Homo sapiens
cctgagacaaatggaggcc

SEQ ID NO: 3735190 - DNA, 15 bp, Homo sapiens
cctgagatcagagtc

SEQ ID NO: 3735191 - DNA, 17 bp, Homo sapiens
cctgagatcagagtcct

SEQ ID NO: 3735192 - DNA, 14 bp, Homo sapiens
cctgagatggccct

SEQ ID NO: 3735193 - DNA, 23 bp, Homo sapiens
cctgagcaacagagtgagaccct

SEQ ID NO: 3735194 - DNA, 23 bp, Homo sapiens
cctgagcacctcccagcccctgc

SEQ ID NO: 3735195 - DNA, 18 bp, Homo sapiens
cctgagctcggtggaccc

SEQ ID NO: 3735196 - DNA, 21 bp, Homo sapiens
cctgagctcggtggacccagg

SEQ ID NO: 3735197 - DNA, 22 bp, Homo sapiens
cctgagctcggtggacccaggg

SEQ ID NO: 3735198 - DNA, 21 bp, Homo sapiens
cctgagcttggccagaagggg

SEQ ID NO: 3735199 - DNA, 16 bp, Homo sapiens
cctgagctttctgcta

SEQ ID NO: 3735200 - DNA, 17 bp, Homo sapiens
cctgagctttggacaca

SEQ ID NO: 3735201 - DNA, 22 bp, Homo sapiens
cctgagctttggacacacacag

SEQ ID NO: 3735202 - DNA, 18 bp, Homo sapiens
cctgagctttggacgcac

SEQ ID NO: 3735203 - DNA, 15 bp, Homo sapiens
cctgaggatcagaaa

SEQ ID NO: 3735204 - DNA, 16 bp, Homo sapiens
cctgaggatcagaaag

SEQ ID NO: 3735205 - DNA, 22 bp, Homo sapiens
cctgaggggcatctgcccctcc

SEQ ID NO: 3735206 - DNA, 20 bp, Homo sapiens
cctgaggtgaaagggagcta

SEQ ID NO: 3735207 - DNA, 13 bp, Homo sapiens
cctgagtcaccag

SEQ ID NO: 3735208 - DNA, 19 bp, Homo sapiens
cctgagtgatcccatttct

SEQ ID NO: 3735209 - DNA, 19 bp, Homo sapiens
cctgagtttcaagtatcct

SEQ ID NO: 3735210 - DNA, 17 bp, Homo sapiens
cctgatgacccaggctg

SEQ ID NO: 3735211 - DNA, 13 bp, Homo sapiens
cctgatgctccct

SEQ ID NO: 3735212 - DNA, 16 bp, Homo sapiens
cctgatgctccctccc

SEQ ID NO: 3735213 - DNA, 17 bp, Homo sapiens
cctgatgttaaaattcc

SEQ ID NO: 3735214 - DNA, 23 bp, Homo sapiens
cctgcacaaagcccttccatgtc

SEQ ID NO: 3735215 - DNA, 14 bp, Homo sapiens
cctgcaccaggaga

SEQ ID NO: 3735216 - DNA, 17 bp, Homo sapiens
cctgcacttgcagactc

SEQ ID NO: 3735217 - DNA, 15 bp, Homo sapiens
cctgcagcctggagg

SEQ ID NO: 3735218 - DNA, 16 bp, Homo sapiens
cctgcagcctggaggc

SEQ ID NO: 3735219 - DNA, 15 bp, Homo sapiens
cctgcagtcacagct

SEQ ID NO: 3735220 - DNA, 19 bp, Homo sapiens
cctgcatccgtagttccct

SEQ ID NO: 3735221 - DNA, 16 bp, Homo sapiens
cctgcattcacccaga

SEQ ID NO: 3735222 - DNA, 22 bp, Homo sapiens
cctgcattctgccgtgtgccct

SEQ ID NO: 3735223 - DNA, 14 bp, Homo sapiens
cctgccaccctggg

SEQ ID NO: 3735224 - DNA, 14 bp, Homo sapiens
cctgccagcctggc

SEQ ID NO: 3735225 - DNA, 12 bp, Homo sapiens
cctgccaggcat

SEQ ID NO: 3735226 - DNA, 23 bp, Homo sapiens
cctgccagtgccttacctcctgc

SEQ ID NO: 3735227 - DNA, 23 bp, Homo sapiens
cctgccatttgcaccctccgcct

SEQ ID NO: 3735228 - DNA, 12 bp, Homo sapiens
cctgcccaggag

SEQ ID NO: 3735229 - DNA, 22 bp, Homo sapiens
cctgcccaggagagccagccct

SEQ ID NO: 3735230 - DNA, 16 bp, Homo sapiens
cctgcccaggcccctg

SEQ ID NO: 3735231 - DNA, 19 bp, Homo sapiens
cctgcccaggcccctgcca

SEQ ID NO: 3735232 - DNA, 14 bp, Homo sapiens
ccttacttagcatg

SEQ ID NO: 3735233 - DNA, 19 bp, Homo sapiens
ccttactttgtatgatatt

SEQ ID NO: 3735234 - DNA, 14 bp, Homo sapiens
ccttagaacctttc

SEQ ID NO: 3735235 - DNA, 15 bp, Homo sapiens
ccttagaacctttct

SEQ ID NO: 3735236 - DNA, 18 bp, Homo sapiens
ccttagaacctttcttac

SEQ ID NO: 3735237 - DNA, 19 bp, Homo sapiens
ccttagcagggaaacagct

SEQ ID NO: 3735238 - DNA, 20 bp, Homo sapiens
ccttagcagggaaacagcta

SEQ ID NO: 3735239 - DNA, 14 bp, Homo sapiens
ccttagcctccctg

SEQ ID NO: 3735240 - DNA, 11 bp, Homo sapiens
ccttagctgcc

SEQ ID NO: 3735241 - DNA, 20 bp, Homo sapiens
ccttagctgccaagccccat

SEQ ID NO: 3735242 - DNA, 19 bp, Homo sapiens
ccttagctggcattacagc

SEQ ID NO: 3735243 - DNA, 15 bp, Homo sapiens
ccttaggcagggaag

SEQ ID NO: 3735244 - DNA, 16 bp, Homo sapiens
ccttaggcagggaagt

SEQ ID NO: 3735245 - DNA, 14 bp, Homo sapiens
ccttagtcttctca

SEQ ID NO: 3735246 - DNA, 16 bp, Homo sapiens
ccttatcgaaactcat

SEQ ID NO: 3735247 - DNA, 16 bp, Homo sapiens
ccttattgtacgttta

SEQ ID NO: 3735248 - DNA, 15 bp, Homo sapiens
ccttatttctcatca

SEQ ID NO: 3735249 - DNA, 12 bp, Homo sapiens
ccttcaaagctg

SEQ ID NO: 3735250 - DNA, 19 bp, Homo sapiens
ccttcaagaactctgggct

SEQ ID NO: 3735251 - DNA, 19 bp, Homo sapiens
ccttcaagttagctcagga

SEQ ID NO: 3735252 - DNA, 14 bp, Homo sapiens
ccttcactccggtg

SEQ ID NO: 3735253 - DNA, 20 bp, Homo sapiens
ccttcactccggtgtgcctg

SEQ ID NO: 3735254 - DNA, 20 bp, Homo sapiens
ccttcagtcttgaatttcta

SEQ ID NO: 3735255 - DNA, 23 bp, Homo sapiens
ccttcattgccttaactggagcc

SEQ ID NO: 3735256 - DNA, 16 bp, Homo sapiens
ccttccaacaggagct

SEQ ID NO: 3735257 - DNA, 19 bp, Homo sapiens
ccttccacgctgtctccag

SEQ ID NO: 3735258 - DNA, 11 bp, Homo sapiens
ccttccataat

SEQ ID NO: 3735259 - DNA, 12 bp, Homo sapiens
ccttccatccct

SEQ ID NO: 3735260 - DNA, 17 bp, Homo sapiens
ccttcccagctctccct

SEQ ID NO: 3735261 - DNA, 19 bp, Homo sapiens
ccttcccagctctccctct

SEQ ID NO: 3735262 - DNA, 22 bp, Homo sapiens
ccttcccagctgcccctccctg

SEQ ID NO: 3735263 - DNA, 20 bp, Homo sapiens
ccttccccactgcctgccca

SEQ ID NO: 3735264 - DNA, 19 bp, Homo sapiens
ccttccccctccaatccca

SEQ ID NO: 3735265 - DNA, 15 bp, Homo sapiens
ccttcccctccctgg

SEQ ID NO: 3735266 - DNA, 16 bp, Homo sapiens
ccttcccctccttctc

SEQ ID NO: 3735267 - DNA, 22 bp, Homo sapiens
ccttccccttgcccagggctca

SEQ ID NO: 3735268 - DNA, 12 bp, Homo sapiens
ccttccctctcc

SEQ ID NO: 3735269 - DNA, 12 bp, Homo sapiens
ccttccctgcaa

SEQ ID NO: 3735270 - DNA, 20 bp, Homo sapiens
ccttcctctccactgccttc

SEQ ID NO: 3735271 - DNA, 17 bp, Homo sapiens
ccttcctgccacctgct

SEQ ID NO: 3735272 - DNA, 15 bp, Homo sapiens
ccttcgatacaccgg

SEQ ID NO: 3735273 - DNA, 20 bp, Homo sapiens
ccttcgatacaccgggcctg

SEQ ID NO: 3735274 - DNA, 22 bp, Homo sapiens
ccttcgcgtatttcaggattct

SEQ ID NO: 3735275 - DNA, 20 bp, Homo sapiens
ccttcggacaactcagtccc

SEQ ID NO: 3735276 - DNA, 22 bp, Homo sapiens
ccttctacactctcctgggccc

SEQ ID NO: 3735277 - DNA, 14 bp, Homo sapiens
ccttctactgcttc

SEQ ID NO: 3735278 - DNA, 22 bp, Homo sapiens
ccttctacttacacatcttcca

SEQ ID NO: 3735279 - DNA, 14 bp, Homo sapiens
ccttctaggaagct

SEQ ID NO: 3735280 - DNA, 18 bp, Homo sapiens
ccttctccttccaactgc

SEQ ID NO: 3735281 - DNA, 19 bp, Homo sapiens
ccttctccttccaactgct

SEQ ID NO: 3735282 - DNA, 20 bp, Homo sapiens
ccttctccttgataacagct

SEQ ID NO: 3735283 - DNA, 18 bp, Homo sapiens
ccttctctcacctcctaa

SEQ ID NO: 3735284 - DNA, 16 bp, Homo sapiens
ccttctctgaaggaca

SEQ ID NO: 3735285 - DNA, 13 bp, Homo sapiens
ccttctctgccca

SEQ ID NO: 3735286 - DNA, 14 bp, Homo sapiens
ccttctctgctcca

SEQ ID NO: 3735287 - DNA, 22 bp, Homo sapiens
ccttctctgctccaccacatcc

SEQ ID NO: 3735288 - DNA, 20 bp, Homo sapiens
ccttctgctggataaaatga

SEQ ID NO: 3735289 - DNA, 12 bp, Homo sapiens
ccttctgggaaa

SEQ ID NO: 3735290 - DNA, 22 bp, Homo sapiens
ccttctgtaaaggtttttggaa

SEQ ID NO: 3735291 - DNA, 18 bp, Homo sapiens
ccttctgtgcccagctca

SEQ ID NO: 3735292 - DNA, 14 bp, Homo sapiens
ccttctgtggctca

SEQ ID NO: 3735293 - DNA, 17 bp, Homo sapiens
ccttcttattctcactc

SEQ ID NO: 3735294 - DNA, 13 bp, Homo sapiens
ccttgaacactgg

SEQ ID NO: 3735295 - DNA, 17 bp, Homo sapiens
ccttgacagggcacacc

SEQ ID NO: 3735296 - DNA, 14 bp, Homo sapiens
ccttgagaaacctt

SEQ ID NO: 3735297 - DNA, 19 bp, Homo sapiens
ccttgagaaaccttattgt

SEQ ID NO: 3735298 - DNA, 16 bp, Homo sapiens
ccttgagaccacaggg

SEQ ID NO: 3735299 - DNA, 21 bp, Homo sapiens
ccttgagggtgcttgttccct

SEQ ID NO: 3735300 - DNA, 12 bp, Homo sapiens
ccttgaggtctt

SEQ ID NO: 3735301 - DNA, 23 bp, Homo sapiens
ccttgagttgattcagctctgca

SEQ ID NO: 3735302 - DNA, 14 bp, Homo sapiens
ccttgatctgtata

SEQ ID NO: 3735303 - DNA, 19 bp, Homo sapiens
ccttgcacactcccctgca

SEQ ID NO: 3735304 - DNA, 22 bp, Homo sapiens
ccttgcacactcccctgcactg

SEQ ID NO: 3735305 - DNA, 12 bp, Homo sapiens
ccttgcacctgc

SEQ ID NO: 3735306 - DNA, 16 bp, Homo sapiens
ccttgcacctgcatcc

SEQ ID NO: 3735307 - DNA, 20 bp, Homo sapiens
ccttgcagttcagcaccacc

SEQ ID NO: 3735308 - DNA, 23 bp, Homo sapiens
ccttgcagttcagcaccacccta

SEQ ID NO: 3735309 - DNA, 19 bp, Homo sapiens
ccttgcccagagatgcctc

SEQ ID NO: 3735310 - DNA, 23 bp, Homo sapiens
ccttgcccagagatgcctccacc

SEQ ID NO: 3735311 - DNA, 15 bp, Homo sapiens
ccttgcccagggctc

SEQ ID NO: 3735312 - DNA, 22 bp, Homo sapiens
ccttgcccagggctcagcctgg

SEQ ID NO: 3735313 - DNA, 18 bp, Homo sapiens
ccttgctcgctgtaaaat

SEQ ID NO: 3735314 - DNA, 16 bp, Homo sapiens
ccttgctgtcctaggc

SEQ ID NO: 3735315 - DNA, 22 bp, Homo sapiens
ccttggataatgctgttgcctc

SEQ ID NO: 3735316 - DNA, 15 bp, Homo sapiens
ccttggcatgccttc

SEQ ID NO: 3735317 - DNA, 20 bp, Homo sapiens
ccttggcatgccttccagca

SEQ ID NO: 3735318 - DNA, 15 bp, Homo sapiens
ccttggcctgtctca

SEQ ID NO: 3735319 - DNA, 22 bp, Homo sapiens
ccttggctcaagtcctcttttc

SEQ ID NO: 3735320 - DNA, 22 bp, Homo sapiens
ccttggctcaatcctctaagct

SEQ ID NO: 3735321 - DNA, 12 bp, Homo sapiens
ccttggctgcag

SEQ ID NO: 3735322 - DNA, 23 bp, Homo sapiens
ccttggtctaacttttgtgtgaa

SEQ ID NO: 3735323 - DNA, 16 bp, Homo sapiens
ccttggtgtccacctg

SEQ ID NO: 3735324 - DNA, 17 bp, Homo sapiens
ccttggtgtccacctgg

SEQ ID NO: 3735325 - DNA, 17 bp, Homo sapiens
ccttggttcatcagtgt

SEQ ID NO: 3735326 - DNA, 16 bp, Homo sapiens
ccttgtatttaaatat

SEQ ID NO: 3735327 - DNA, 21 bp, Homo sapiens
ccttgtatttaaatattaaat

SEQ ID NO: 3735328 - DNA, 20 bp, Homo sapiens
ccttgtgttttgttttgatt

SEQ ID NO: 3735329 - DNA, 18 bp, Homo sapiens
cctttaccctcatctgtc

SEQ ID NO: 3735330 - DNA, 14 bp, Homo sapiens
cctttagcgcccag

SEQ ID NO: 3735331 - DNA, 16 bp, Homo sapiens
cctttattaaaatctt

SEQ ID NO: 3735332 - DNA, 13 bp, Homo sapiens
cctttattttaga

SEQ ID NO: 3735333 - DNA, 15 bp, Homo sapiens
cctttcaaatttcac

SEQ ID NO: 3735334 - DNA, 16 bp, Homo sapiens
cctttcaaatttcaca

SEQ ID NO: 3735335 - DNA, 21 bp, Homo sapiens
cctttcacaaaattttattcc

SEQ ID NO: 3735336 - DNA, 22 bp, Homo sapiens
cctttcacaaaattttattcct

SEQ ID NO: 3735337 - DNA, 12 bp, Homo sapiens
cctttcagggaa

SEQ ID NO: 3735338 - DNA, 11 bp, Homo sapiens
cctttccataa

SEQ ID NO: 3735339 - DNA, 21 bp, Homo sapiens
cctttccttccttccctggct

SEQ ID NO: 3735340 - DNA, 17 bp, Homo sapiens
cctttctcccaggccag

SEQ ID NO: 3735341 - DNA, 15 bp, Homo sapiens
cctttcttggccagt

SEQ ID NO: 3735342 - DNA, 21 bp, Homo sapiens
cctttgccaccaactggccct

SEQ ID NO: 3735343 - DNA, 21 bp, Homo sapiens
cctttgccccacctttattaa

SEQ ID NO: 3735344 - DNA, 14 bp, Homo sapiens
cctttgctccaccc

SEQ ID NO: 3735345 - DNA, 23 bp, Homo sapiens
cgtctggggttcagcccctcctc

SEQ ID NO: 3735346 - DNA, 23 bp, Homo sapiens
cgtcttagaagtggaccaggaca

SEQ ID NO: 3735347 - DNA, 13 bp, Homo sapiens
cgtcttcagccta

SEQ ID NO: 3735348 - DNA, 12 bp, Homo sapiens
cgtgaaacacac

SEQ ID NO: 3735349 - DNA, 15 bp, Homo sapiens
cgtgaaacacaccag

SEQ ID NO: 3735350 - DNA, 24 bp, Homo sapiens
cgtgaaacacaccaggctgtgggc

SEQ ID NO: 3735351 - DNA, 12 bp, Homo sapiens
cgtgacaacact

SEQ ID NO: 3735352 - DNA, 14 bp, Homo sapiens
cgtgacaacacttg

SEQ ID NO: 3735353 - DNA, 13 bp, Homo sapiens
cgtgactcaccca

SEQ ID NO: 3735354 - DNA, 16 bp, Homo sapiens
cgtgactcacccaagc

SEQ ID NO: 3735355 - DNA, 16 bp, Homo sapiens
cgtgactgccccaact

SEQ ID NO: 3735356 - DNA, 17 bp, Homo sapiens
cgtgactgccccaactc

SEQ ID NO: 3735357 - DNA, 20 bp, Homo sapiens
cgtgactgccccaactcctg

SEQ ID NO: 3735358 - DNA, 23 bp, Homo sapiens
cgtgactgccccaactcctggaa

SEQ ID NO: 3735359 - DNA, 14 bp, Homo sapiens
cgtgagccactgca

SEQ ID NO: 3735360 - DNA, 20 bp, Homo sapiens
cgtgatccatccatctccag

SEQ ID NO: 3735361 - DNA, 18 bp, Homo sapiens
cgtgcacacaccagagcc

SEQ ID NO: 3735362 - DNA, 18 bp, Homo sapiens
cgtgcacgcacactgtct

SEQ ID NO: 3735363 - DNA, 22 bp, Homo sapiens
cgtgcacgtggagagctggtgc

SEQ ID NO: 3735364 - DNA, 13 bp, Homo sapiens
cgtgcactctgct

SEQ ID NO: 3735365 - DNA, 13 bp, Homo sapiens
cgtgcatgtgcac

SEQ ID NO: 3735366 - DNA, 19 bp, Homo sapiens
cgtgccgttactctccaac

SEQ ID NO: 3735367 - DNA, 16 bp, Homo sapiens
cgtgccttcagctcta

SEQ ID NO: 3735368 - DNA, 14 bp, Homo sapiens
cgtgctaaattttc

SEQ ID NO: 3735369 - DNA, 13 bp, Homo sapiens
cgtggagagggat

SEQ ID NO: 3735370 - DNA, 16 bp, Homo sapiens
cgtggagccagggagc

SEQ ID NO: 3735371 - DNA, 21 bp, Homo sapiens
cgtggcagataatcagcctct

SEQ ID NO: 3735372 - DNA, 13 bp, Homo sapiens
cgtggcatcacct

SEQ ID NO: 3735373 - DNA, 20 bp, Homo sapiens
cgtggccttccccagcctct

SEQ ID NO: 3735374 - DNA, 22 bp, Homo sapiens
cgtgggtcttcagggggccagg

SEQ ID NO: 3735375 - DNA, 20 bp, Homo sapiens
cgtgtaaccatggacccaat

SEQ ID NO: 3735376 - DNA, 15 bp, Homo sapiens
cgtgtccctctcgga

SEQ ID NO: 3735377 - DNA, 22 bp, Homo sapiens
cgtgtgtgcaagtgtctgtgtg

SEQ ID NO: 3735378 - DNA, 20 bp, Homo sapiens
cgtgtgtgtgcgtcctgtcg

SEQ ID NO: 3735379 - DNA, 22 bp, Homo sapiens
cgttaacattgaccaagaactg

SEQ ID NO: 3735380 - DNA, 19 bp, Homo sapiens
cgttaactgtgtatgtaca

SEQ ID NO: 3735381 - DNA, 21 bp, Homo sapiens
cgttactagcagtcacttgat

SEQ ID NO: 3735382 - DNA, 14 bp, Homo sapiens
cgttagggaagaga

SEQ ID NO: 3735383 - DNA, 18 bp, Homo sapiens
cgttccttactgcagaat

SEQ ID NO: 3735384 - DNA, 18 bp, Homo sapiens
cgttggaattaaaacaat

SEQ ID NO: 3735385 - DNA, 23 bp, Homo sapiens
cgttggacttttcgttaacattg

SEQ ID NO: 3735386 - DNA, 19 bp, Homo sapiens
cgtttaaagttctgtgtat

SEQ ID NO: 3735387 - DNA, 18 bp, Homo sapiens
cgtttcagtaataaaaca

SEQ ID NO: 3735388 - DNA, 12 bp, Homo sapiens
cgtttgtttgtt

SEQ ID NO: 3735389 - DNA, 17 bp, Homo sapiens
cgtttgtttgttttgtt

SEQ ID NO: 3735390 - DNA, 12 bp, Homo sapiens
cgttttattgtg

SEQ ID NO: 3735391 - DNA, 18 bp, Homo sapiens
cgttttattgtgttttta

SEQ ID NO: 3735392 - DNA, 23 bp, Homo sapiens
cgttttgtgtggtggcacctcct

SEQ ID NO: 3735393 - DNA, 13 bp, Homo sapiens
ctaaaaatacaaa

SEQ ID NO: 3735394 - DNA, 13 bp, Homo sapiens
ctaaaaatgcaac

SEQ ID NO: 3735395 - DNA, 12 bp, Homo sapiens
ctaaaagttcat

SEQ ID NO: 3735396 - DNA, 19 bp, Homo sapiens
ctaaaatagccacttacct

SEQ ID NO: 3735397 - DNA, 21 bp, Homo sapiens
ctaaagaccctaaatctgagg

SEQ ID NO: 3735398 - DNA, 19 bp, Homo sapiens
ctaaagagagaatgtagat

SEQ ID NO: 3735399 - DNA, 18 bp, Homo sapiens
ctaaataaaatataattg

SEQ ID NO: 3735400 - DNA, 19 bp, Homo sapiens
ctaaataaaatataattgt

SEQ ID NO: 3735401 - DNA, 22 bp, Homo sapiens
ctaaataaacacatagattcac

SEQ ID NO: 3735402 - DNA, 13 bp, Homo sapiens
ctaaatatttcct

SEQ ID NO: 3735403 - DNA, 17 bp, Homo sapiens
ctaaatctcctattttt

SEQ ID NO: 3735404 - DNA, 13 bp, Homo sapiens
ctaaatgaagtgc

SEQ ID NO: 3735405 - DNA, 21 bp, Homo sapiens
ctaaatgcatatcctgagcca

SEQ ID NO: 3735406 - DNA, 19 bp, Homo sapiens
ctaaatggtcgcccaggag

SEQ ID NO: 3735407 - DNA, 17 bp, Homo sapiens
ctaaatgtaagaatcat

SEQ ID NO: 3735408 - DNA, 22 bp, Homo sapiens
ctaaattatagtgtagaaaaga

SEQ ID NO: 3735409 - DNA, 14 bp, Homo sapiens
ctaacacagcatgt

SEQ ID NO: 3735410 - DNA, 16 bp, Homo sapiens
ctaacacagcatgtgt

SEQ ID NO: 3735411 - DNA, 19 bp, Homo sapiens
ctaacactagtctgtgtgc

SEQ ID NO: 3735412 - DNA, 15 bp, Homo sapiens
ctaacactggcccct

SEQ ID NO: 3735413 - DNA, 16 bp, Homo sapiens
ctaacactggccccta

SEQ ID NO: 3735414 - DNA, 17 bp, Homo sapiens
ctaacattatattgcaa

SEQ ID NO: 3735415 - DNA, 18 bp, Homo sapiens
ctaacattatattgcaat

SEQ ID NO: 3735416 - DNA, 14 bp, Homo sapiens
ctaaccaaatgcat

SEQ ID NO: 3735417 - DNA, 12 bp, Homo sapiens
ctaaccacgctg

SEQ ID NO: 3735418 - DNA, 20 bp, Homo sapiens
ctaaccacgtctgtcttcac

SEQ ID NO: 3735419 - DNA, 21 bp, Homo sapiens
ctaaccacgtctgtcttcaca

SEQ ID NO: 3735420 - DNA, 12 bp, Homo sapiens
ctaacctccttt

SEQ ID NO: 3735421 - DNA, 20 bp, Homo sapiens
ctaacgacttcagggcaggg

SEQ ID NO: 3735422 - DNA, 15 bp, Homo sapiens
ctaacgtaaatacac

SEQ ID NO: 3735423 - DNA, 14 bp, Homo sapiens
ctaactccagtgaa

SEQ ID NO: 3735424 - DNA, 14 bp, Homo sapiens
ctaactctgatgta

SEQ ID NO: 3735425 - DNA, 17 bp, Homo sapiens
ctaactctgatgtaaat

SEQ ID NO: 3735426 - DNA, 19 bp, Homo sapiens
ctaagagctagcgctgccg

SEQ ID NO: 3735427 - DNA, 12 bp, Homo sapiens
ctaagagtgtcc

SEQ ID NO: 3735428 - DNA, 17 bp, Homo sapiens
ctaagatgttcactgtg

SEQ ID NO: 3735429 - DNA, 11 bp, Homo sapiens
ctaagccaagg

SEQ ID NO: 3735430 - DNA, 18 bp, Homo sapiens
ctaagccaagggcctctt

SEQ ID NO: 3735431 - DNA, 17 bp, Homo sapiens
ctaagcctttccataag

SEQ ID NO: 3735432 - DNA, 15 bp, Homo sapiens
ctaagctaaccccct

SEQ ID NO: 3735433 - DNA, 14 bp, Homo sapiens
ctaagctaggaatg

SEQ ID NO: 3735434 - DNA, 22 bp, Homo sapiens
ctaagctaggaatgaaatcctg

SEQ ID NO: 3735435 - DNA, 21 bp, Homo sapiens
ctaagctattcagtaataact

SEQ ID NO: 3735436 - DNA, 17 bp, Homo sapiens
ctaagcttaaaaaaaac

SEQ ID NO: 3735437 - DNA, 17 bp, Homo sapiens
ctaaggacatttcccag

SEQ ID NO: 3735438 - DNA, 20 bp, Homo sapiens
ctaaggcacccacaaataaa

SEQ ID NO: 3735439 - DNA, 18 bp, Homo sapiens
ctaagggtgtaagtaatt

SEQ ID NO: 3735440 - DNA, 17 bp, Homo sapiens
ctaagtccctgccccct

SEQ ID NO: 3735441 - DNA, 18 bp, Homo sapiens
ctaagtccctgccccctc

SEQ ID NO: 3735442 - DNA, 14 bp, Homo sapiens
ctaagtctctgtga

SEQ ID NO: 3735443 - DNA, 13 bp, Homo sapiens
ctaataaaatatc

SEQ ID NO: 3735444 - DNA, 14 bp, Homo sapiens
ctaataaaatatca

SEQ ID NO: 3735445 - DNA, 16 bp, Homo sapiens
ctaataaaatatcatt

SEQ ID NO: 3735446 - DNA, 17 bp, Homo sapiens
ctaataaaatatcattc

SEQ ID NO: 3735447 - DNA, 19 bp, Homo sapiens
ctaataaaatatcattcag

SEQ ID NO: 3735448 - DNA, 21 bp, Homo sapiens
ctaataaaatatcattcagca

SEQ ID NO: 3735449 - DNA, 15 bp, Homo sapiens
ctaataatcttgttt

SEQ ID NO: 3735450 - DNA, 21 bp, Homo sapiens
ctaataatcttgtttctgaaa

SEQ ID NO: 3735451 - DNA, 16 bp, Homo sapiens
ctaatacattaaagca

SEQ ID NO: 3735452 - DNA, 19 bp, Homo sapiens
ctaatacattaaagcagtc

SEQ ID NO: 3735453 - DNA, 18 bp, Homo sapiens
ctaatatgtaacaagcca

SEQ ID NO: 3735454 - DNA, 17 bp, Homo sapiens
ctaatcagcattctcac

SEQ ID NO: 3735455 - DNA, 20 bp, Homo sapiens
ctaatcagcattctcactcc

SEQ ID NO: 3735456 - DNA, 19 bp, Homo sapiens
ctaatcagggaggtcattt

SEQ ID NO: 3735457 - DNA, 21 bp, Homo sapiens
ctaatcatgtgggtgagccag

SEQ ID NO: 3735458 - DNA, 17 bp, Homo sapiens
ctatttagtttttgtaa

SEQ ID NO: 3735459 - DNA, 20 bp, Homo sapiens
ctatttagtttttgtaattt

SEQ ID NO: 3735460 - DNA, 22 bp, Homo sapiens
ctatttagtttttgtaatttat

SEQ ID NO: 3735461 - DNA, 21 bp, Homo sapiens
ctatttatctgtagtaaacta

SEQ ID NO: 3735462 - DNA, 11 bp, Homo sapiens
ctatttatgaa

SEQ ID NO: 3735463 - DNA, 18 bp, Homo sapiens
ctatttatttactgagct

SEQ ID NO: 3735464 - DNA, 23 bp, Homo sapiens
ctatttctgagaaggtccttaat

SEQ ID NO: 3735465 - DNA, 15 bp, Homo sapiens
ctattttactgtctt

SEQ ID NO: 3735466 - DNA, 12 bp, Homo sapiens
ctattttattcc

SEQ ID NO: 3735467 - DNA, 12 bp, Homo sapiens
ctattttcagaa

SEQ ID NO: 3735468 - DNA, 18 bp, Homo sapiens
ctattttcagaatctgaa

SEQ ID NO: 3735469 - DNA, 22 bp, Homo sapiens
ctattttcagaatctgaatgta

SEQ ID NO: 3735470 - DNA, 14 bp, Homo sapiens
ctatttttcagaat

SEQ ID NO: 3735471 - DNA, 20 bp, Homo sapiens
ctatttttttaaaatcacta

SEQ ID NO: 3735472 - DNA, 17 bp, Homo sapiens
ctcaaaaaaagaaaaag

SEQ ID NO: 3735473 - DNA, 13 bp, Homo sapiens
ctcaaaatatttg

SEQ ID NO: 3735474 - DNA, 17 bp, Homo sapiens
ctcaaagttaacctacc

SEQ ID NO: 3735475 - DNA, 16 bp, Homo sapiens
ctcaacatgttactga

SEQ ID NO: 3735476 - DNA, 18 bp, Homo sapiens
ctcaaccctccctcagcc

SEQ ID NO: 3735477 - DNA, 15 bp, Homo sapiens
ctcaacctcctgggc

SEQ ID NO: 3735478 - DNA, 17 bp, Homo sapiens
ctcaacctcctgggcta

SEQ ID NO: 3735479 - DNA, 18 bp, Homo sapiens
ctcaacctgtaaattatt

SEQ ID NO: 3735480 - DNA, 21 bp, Homo sapiens
ctcaagagggcactggtggcc

SEQ ID NO: 3735481 - DNA, 16 bp, Homo sapiens
ctcaagatgaaggcaa

SEQ ID NO: 3735482 - DNA, 20 bp, Homo sapiens
ctcaagcaatcctcctgagt

SEQ ID NO: 3735483 - DNA, 23 bp, Homo sapiens
ctcaagcagtctacccacctcag

SEQ ID NO: 3735484 - DNA, 16 bp, Homo sapiens
ctcaaggacaaagtct

SEQ ID NO: 3735485 - DNA, 19 bp, Homo sapiens
ctcaaggacaaagtctcca

SEQ ID NO: 3735486 - DNA, 19 bp, Homo sapiens
ctcaaggacttgaaagcat

SEQ ID NO: 3735487 - DNA, 19 bp, Homo sapiens
ctcaaggtgggccttgcta

SEQ ID NO: 3735488 - DNA, 21 bp, Homo sapiens
ctcaagtcctcttttctgaga

SEQ ID NO: 3735489 - DNA, 17 bp, Homo sapiens
ctcaagtcttccctgat

SEQ ID NO: 3735490 - DNA, 17 bp, Homo sapiens
ctcaagtgattctcctg

SEQ ID NO: 3735491 - DNA, 19 bp, Homo sapiens
ctcaagttcaaggaccaac

SEQ ID NO: 3735492 - DNA, 23 bp, Homo sapiens
ctcaataaaatcatgtacatttc

SEQ ID NO: 3735493 - DNA, 16 bp, Homo sapiens
ctcaatattcctgaat

SEQ ID NO: 3735494 - DNA, 11 bp, Homo sapiens
ctcaatatttt

SEQ ID NO: 3735495 - DNA, 13 bp, Homo sapiens
ctcaatattttcc

SEQ ID NO: 3735496 - DNA, 19 bp, Homo sapiens
ctcaatattttccatgaaa

SEQ ID NO: 3735497 - DNA, 15 bp, Homo sapiens
ctcaatcaagaaaat

SEQ ID NO: 3735498 - DNA, 19 bp, Homo sapiens
ctcacaccgcgtctggtga

SEQ ID NO: 3735499 - DNA, 23 bp, Homo sapiens
ctcacacggacactcaaaagctg

SEQ ID NO: 3735500 - DNA, 10 bp, Homo sapiens
ctcacactcc

SEQ ID NO: 3735501 - DNA, 17 bp, Homo sapiens
ctcacagtgttgcccag

SEQ ID NO: 3735502 - DNA, 13 bp, Homo sapiens
ctcacagttcctc

SEQ ID NO: 3735503 - DNA, 18 bp, Homo sapiens
ctcacagttcctcgccct

SEQ ID NO: 3735504 - DNA, 20 bp, Homo sapiens
ctcacagttcctcgccctgg

SEQ ID NO: 3735505 - DNA, 12 bp, Homo sapiens
ctcacatttatg

SEQ ID NO: 3735506 - DNA, 22 bp, Homo sapiens
ctcacatttattctgctcacat

SEQ ID NO: 3735507 - DNA, 13 bp, Homo sapiens
ctcaccagcccca

SEQ ID NO: 3735508 - DNA, 20 bp, Homo sapiens
ctcaccagccccagtgccca

SEQ ID NO: 3735509 - DNA, 12 bp, Homo sapiens
ctcaccccatcc

SEQ ID NO: 3735510 - DNA, 21 bp, Homo sapiens
ctcaccccatcccacaccctg

SEQ ID NO: 3735511 - DNA, 17 bp, Homo sapiens
ctcacccccaaggggca

SEQ ID NO: 3735512 - DNA, 14 bp, Homo sapiens
ctcacccccagctt

SEQ ID NO: 3735513 - DNA, 17 bp, Homo sapiens
ctcacccccagctttgc

SEQ ID NO: 3735514 - DNA, 14 bp, Homo sapiens
ctcacccgaggctg

SEQ ID NO: 3735515 - DNA, 23 bp, Homo sapiens
ctcacctaatgtttatgagccag

SEQ ID NO: 3735516 - DNA, 14 bp, Homo sapiens
ctcacctctgcctc

SEQ ID NO: 3735517 - DNA, 22 bp, Homo sapiens
ctcacctctggactggctagag

SEQ ID NO: 3735518 - DNA, 20 bp, Homo sapiens
ctcaccttgaacaccacgct

SEQ ID NO: 3735519 - DNA, 20 bp, Homo sapiens
ctcaccttgcaacacacaga

SEQ ID NO: 3735520 - DNA, 21 bp, Homo sapiens
ctcacgcctgtaatcccagca

SEQ ID NO: 3735521 - DNA, 13 bp, Homo sapiens
ctcacgtgtgtga

SEQ ID NO: 3735522 - DNA, 17 bp, Homo sapiens
ctcactatgttgcccag

SEQ ID NO: 3735523 - DNA, 17 bp, Homo sapiens
ctcactcaagttcaagg

SEQ ID NO: 3735524 - DNA, 18 bp, Homo sapiens
ctcactcaagttcaagga

SEQ ID NO: 3735525 - DNA, 14 bp, Homo sapiens
ctcactccaccacc

SEQ ID NO: 3735526 - DNA, 21 bp, Homo sapiens
ctcactccaggaaggggctgg

SEQ ID NO: 3735527 - DNA, 13 bp, Homo sapiens
ctcactcctacct

SEQ ID NO: 3735528 - DNA, 22 bp, Homo sapiens
ctcactctgtcgcccagtctgg

SEQ ID NO: 3735529 - DNA, 14 bp, Homo sapiens
ctcactgcagcctc

SEQ ID NO: 3735530 - DNA, 22 bp, Homo sapiens
ctcactgccatgccagcttatc

SEQ ID NO: 3735531 - DNA, 15 bp, Homo sapiens
ctcactgttgaattt

SEQ ID NO: 3735532 - DNA, 21 bp, Homo sapiens
ctcactgttgaattttctcta

SEQ ID NO: 3735533 - DNA, 17 bp, Homo sapiens
ctcactgttgcccaggc

SEQ ID NO: 3735534 - DNA, 18 bp, Homo sapiens
ctcactgttgcccaggct

SEQ ID NO: 3735535 - DNA, 19 bp, Homo sapiens
ctcactgttgcccaggctg

SEQ ID NO: 3735536 - DNA, 21 bp, Homo sapiens
ctcactgttgcccaggctggc

SEQ ID NO: 3735537 - DNA, 15 bp, Homo sapiens
ctcacttttctccat

SEQ ID NO: 3735538 - DNA, 15 bp, Homo sapiens
ctcagaagacactga

SEQ ID NO: 3735539 - DNA, 11 bp, Homo sapiens
ctcagaagcct

SEQ ID NO: 3735540 - DNA, 14 bp, Homo sapiens
ctcagaagcctgag

SEQ ID NO: 3735541 - DNA, 17 bp, Homo sapiens
ctcagaagcctgaggct

SEQ ID NO: 3735542 - DNA, 13 bp, Homo sapiens
ctcagaaggtatt

SEQ ID NO: 3735543 - DNA, 16 bp, Homo sapiens
ctcagaaggtattcct

SEQ ID NO: 3735544 - DNA, 17 bp, Homo sapiens
ctcagaatctcaaataa

SEQ ID NO: 3735545 - DNA, 15 bp, Homo sapiens
ctcagacccccactc

SEQ ID NO: 3735546 - DNA, 14 bp, Homo sapiens
ctcagactccattt

SEQ ID NO: 3735547 - DNA, 15 bp, Homo sapiens
ctcagagccacccct

SEQ ID NO: 3735548 - DNA, 14 bp, Homo sapiens
ctcagagccccgca

SEQ ID NO: 3735549 - DNA, 21 bp, Homo sapiens
ctcagagggttgttctcctag

SEQ ID NO: 3735550 - DNA, 19 bp, Homo sapiens
ctcagaggtagggctgcca

SEQ ID NO: 3735551 - DNA, 15 bp, Homo sapiens
ctcagagtccaggcc

SEQ ID NO: 3735552 - DNA, 18 bp, Homo sapiens
ctcagagtcggaacggag

SEQ ID NO: 3735553 - DNA, 20 bp, Homo sapiens
ctcagatggaaccgcaggaa

SEQ ID NO: 3735554 - DNA, 14 bp, Homo sapiens
ctcagatttttcct

SEQ ID NO: 3735555 - DNA, 19 bp, Homo sapiens
ctcagcaaaagatgcttct

SEQ ID NO: 3735556 - DNA, 18 bp, Homo sapiens
ctcagcaaggggctctgc

SEQ ID NO: 3735557 - DNA, 20 bp, Homo sapiens
ctcagcaaggggctctgccc

SEQ ID NO: 3735558 - DNA, 18 bp, Homo sapiens
ctcagcacccccttctct

SEQ ID NO: 3735559 - DNA, 15 bp, Homo sapiens
ctcagcagccctcct

SEQ ID NO: 3735560 - DNA, 16 bp, Homo sapiens
ctcagcatcctggcac

SEQ ID NO: 3735561 - DNA, 17 bp, Homo sapiens
ctcagcatcctggcacc

SEQ ID NO: 3735562 - DNA, 18 bp, Homo sapiens
ctcagcatcctggcaccc

SEQ ID NO: 3735563 - DNA, 21 bp, Homo sapiens
ctcagcatcctggcacccggc

SEQ ID NO: 3735564 - DNA, 22 bp, Homo sapiens
ctcagcatcctggcacccggcc

SEQ ID NO: 3735565 - DNA, 15 bp, Homo sapiens
ctcagccatgaggag

SEQ ID NO: 3735566 - DNA, 21 bp, Homo sapiens
ctcagcccacatagtgatggt

SEQ ID NO: 3735567 - DNA, 19 bp, Homo sapiens
ctcagccctccctgcccct

SEQ ID NO: 3735568 - DNA, 21 bp, Homo sapiens
ctcagccctccctgcccctcc

SEQ ID NO: 3735569 - DNA, 14 bp, Homo sapiens
ctcagccctgggcc

SEQ ID NO: 3735570 - DNA, 13 bp, Homo sapiens
ctcagcctcccaa

SEQ ID NO: 3735571 - DNA, 15 bp, Homo sapiens
ctcttagaaaaacca

SEQ ID NO: 3735572 - DNA, 19 bp, Homo sapiens
ctcttaggaagagaaacca

SEQ ID NO: 3735573 - DNA, 17 bp, Homo sapiens
ctcttatgtacctcttt

SEQ ID NO: 3735574 - DNA, 20 bp, Homo sapiens
ctcttatgtacctcttttag

SEQ ID NO: 3735575 - DNA, 13 bp, Homo sapiens
ctcttattgccca

SEQ ID NO: 3735576 - DNA, 14 bp, Homo sapiens
ctcttattgcccac

SEQ ID NO: 3735577 - DNA, 14 bp, Homo sapiens
ctcttcaggcctcc

SEQ ID NO: 3735578 - DNA, 20 bp, Homo sapiens
ctcttcaggcctccctctct

SEQ ID NO: 3735579 - DNA, 14 bp, Homo sapiens
ctcttcaggttctt

SEQ ID NO: 3735580 - DNA, 22 bp, Homo sapiens
ctcttcaggttcttagtgtcac

SEQ ID NO: 3735581 - DNA, 20 bp, Homo sapiens
ctcttccccctctcccagtt

SEQ ID NO: 3735582 - DNA, 22 bp, Homo sapiens
ctcttccggagatgtagcaaaa

SEQ ID NO: 3735583 - DNA, 23 bp, Homo sapiens
ctcttccggagatgtagcaaaac

SEQ ID NO: 3735584 - DNA, 13 bp, Homo sapiens
ctcttctcctttc

SEQ ID NO: 3735585 - DNA, 16 bp, Homo sapiens
ctcttctcctttcaca

SEQ ID NO: 3735586 - DNA, 20 bp, Homo sapiens
ctcttctgccggccctgggg

SEQ ID NO: 3735587 - DNA, 13 bp, Homo sapiens
ctcttctgctcca

SEQ ID NO: 3735588 - DNA, 19 bp, Homo sapiens
ctcttctgctccacccttg

SEQ ID NO: 3735589 - DNA, 20 bp, Homo sapiens
ctcttgaagacactgaaata

SEQ ID NO: 3735590 - DNA, 21 bp, Homo sapiens
ctcttgaagacactgaaatat

SEQ ID NO: 3735591 - DNA, 15 bp, Homo sapiens
ctcttgacctcaggt

SEQ ID NO: 3735592 - DNA, 16 bp, Homo sapiens
ctcttgacctcaggtg

SEQ ID NO: 3735593 - DNA, 13 bp, Homo sapiens
ctcttgagcctgg

SEQ ID NO: 3735594 - DNA, 15 bp, Homo sapiens
ctcttgagcctggga

SEQ ID NO: 3735595 - DNA, 16 bp, Homo sapiens
ctcttgaggccaggag

SEQ ID NO: 3735596 - DNA, 14 bp, Homo sapiens
ctcttgagggagct

SEQ ID NO: 3735597 - DNA, 18 bp, Homo sapiens
ctcttgccactgcctctt

SEQ ID NO: 3735598 - DNA, 19 bp, Homo sapiens
ctcttgccactgcctcttc

SEQ ID NO: 3735599 - DNA, 20 bp, Homo sapiens
ctcttgccactgcctcttcc

SEQ ID NO: 3735600 - DNA, 13 bp, Homo sapiens
ctcttgcccccca

SEQ ID NO: 3735601 - DNA, 21 bp, Homo sapiens
ctcttgggttcaagcgattct

SEQ ID NO: 3735602 - DNA, 14 bp, Homo sapiens
ctcttgtaagattt

SEQ ID NO: 3735603 - DNA, 17 bp, Homo sapiens
ctcttgtaagattttga

SEQ ID NO: 3735604 - DNA, 19 bp, Homo sapiens
ctcttgtaagattttgaaa

SEQ ID NO: 3735605 - DNA, 21 bp, Homo sapiens
ctctttaactcaggactccag

SEQ ID NO: 3735606 - DNA, 23 bp, Homo sapiens
ctctttaactcaggactccagcc

SEQ ID NO: 3735607 - DNA, 18 bp, Homo sapiens
ctctttaatgtcacaggc

SEQ ID NO: 3735608 - DNA, 20 bp, Homo sapiens
ctctttaatgtcacaggcag

SEQ ID NO: 3735609 - DNA, 17 bp, Homo sapiens
ctctttccatctaccct

SEQ ID NO: 3735610 - DNA, 22 bp, Homo sapiens
ctctttcctgttgttgttaatg

SEQ ID NO: 3735611 - DNA, 17 bp, Homo sapiens
ctctttctggcctgcct

SEQ ID NO: 3735612 - DNA, 15 bp, Homo sapiens
ctcttttagtcattt

SEQ ID NO: 3735613 - DNA, 19 bp, Homo sapiens
ctgaaaagactcagtgttc

SEQ ID NO: 3735614 - DNA, 14 bp, Homo sapiens
ctgaaaatgtatgt

SEQ ID NO: 3735615 - DNA, 16 bp, Homo sapiens
ctgaaaatgtatgtgt

SEQ ID NO: 3735616 - DNA, 13 bp, Homo sapiens
ctgaaacaggaga

SEQ ID NO: 3735617 - DNA, 20 bp, Homo sapiens
ctgaaacttcaagcaccagg

SEQ ID NO: 3735618 - DNA, 23 bp, Homo sapiens
ctgaaagccagctgccgaccaga

SEQ ID NO: 3735619 - DNA, 21 bp, Homo sapiens
ctgaaatgccttactttgtat

SEQ ID NO: 3735620 - DNA, 23 bp, Homo sapiens
ctgaaatgccttactttgtatga

SEQ ID NO: 3735621 - DNA, 12 bp, Homo sapiens
ctgaacaagaat

SEQ ID NO: 3735622 - DNA, 22 bp, Homo sapiens
ctgaacacttattgctttgaaa

SEQ ID NO: 3735623 - DNA, 16 bp, Homo sapiens
ctgaaccatccctgat

SEQ ID NO: 3735624 - DNA, 17 bp, Homo sapiens
ctgaacggggagaaaag

SEQ ID NO: 3735625 - DNA, 20 bp, Homo sapiens
ctgaactcgcttctctgtga

SEQ ID NO: 3735626 - DNA, 20 bp, Homo sapiens
ctgaagagtgggtttcacaa

SEQ ID NO: 3735627 - DNA, 14 bp, Homo sapiens
ctgaagcagatgca

SEQ ID NO: 3735628 - DNA, 12 bp, Homo sapiens
ctgaagccgcca

SEQ ID NO: 3735629 - DNA, 15 bp, Homo sapiens
ctgaagcctgcagga

SEQ ID NO: 3735630 - DNA, 12 bp, Homo sapiens
ctgaagcttatt

SEQ ID NO: 3735631 - DNA, 16 bp, Homo sapiens
ctgaagcttattaatg

SEQ ID NO: 3735632 - DNA, 19 bp, Homo sapiens
ctgaaggacattgcggaca

SEQ ID NO: 3735633 - DNA, 18 bp, Homo sapiens
ctgaaggacccttcagag

SEQ ID NO: 3735634 - DNA, 13 bp, Homo sapiens
ctgaaggctttca

SEQ ID NO: 3735635 - DNA, 23 bp, Homo sapiens
ctgaaggctttcagggcctccag

SEQ ID NO: 3735636 - DNA, 17 bp, Homo sapiens
ctgaaggggttctcaca

SEQ ID NO: 3735637 - DNA, 15 bp, Homo sapiens
ctgaagtcacacagt

SEQ ID NO: 3735638 - DNA, 16 bp, Homo sapiens
ctgaagtcacacagtg

SEQ ID NO: 3735639 - DNA, 18 bp, Homo sapiens
ctgaagtcacacagtgag

SEQ ID NO: 3735640 - DNA, 15 bp, Homo sapiens
ctgaagtcactgcac

SEQ ID NO: 3735641 - DNA, 22 bp, Homo sapiens
ctgaagttggagtgagtgtggc

SEQ ID NO: 3735642 - DNA, 19 bp, Homo sapiens
ctgaatagtcttcagagat

SEQ ID NO: 3735643 - DNA, 21 bp, Homo sapiens
ctgaatatgaacggtgagcat

SEQ ID NO: 3735644 - DNA, 20 bp, Homo sapiens
ctgaatatttatatttcact

SEQ ID NO: 3735645 - DNA, 22 bp, Homo sapiens
ctgaatggaaggtttgtatatt

SEQ ID NO: 3735646 - DNA, 13 bp, Homo sapiens
ctgaatgtaattt

SEQ ID NO: 3735647 - DNA, 16 bp, Homo sapiens
ctgaatgtaatttgtg

SEQ ID NO: 3735648 - DNA, 17 bp, Homo sapiens
ctgaatgtaatttgtgt

SEQ ID NO: 3735649 - DNA, 22 bp, Homo sapiens
ctgaatgtaatttgtgtaataa

SEQ ID NO: 3735650 - DNA, 12 bp, Homo sapiens
ctgaatgttctg

SEQ ID NO: 3735651 - DNA, 16 bp, Homo sapiens
ctgaatgttctgacat

SEQ ID NO: 3735652 - DNA, 17 bp, Homo sapiens
ctgaatgttctgacatt

SEQ ID NO: 3735653 - DNA, 20 bp, Homo sapiens
ctgaatgttctgacattaac

SEQ ID NO: 3735654 - DNA, 23 bp, Homo sapiens
ctgaatgttctgacattaacagt

SEQ ID NO: 3735655 - DNA, 20 bp, Homo sapiens
ctgaattaatgacagagcca

SEQ ID NO: 3735656 - DNA, 15 bp, Homo sapiens
ctgacaaatcaagtt

SEQ ID NO: 3735657 - DNA, 23 bp, Homo sapiens
ctgacaaatcaagtttccaagca

SEQ ID NO: 3735658 - DNA, 13 bp, Homo sapiens
ctgacaatcaact

SEQ ID NO: 3735659 - DNA, 17 bp, Homo sapiens
ctgacacacagctctgt

SEQ ID NO: 3735660 - DNA, 18 bp, Homo sapiens
ctgacacacagctctgtc

SEQ ID NO: 3735661 - DNA, 21 bp, Homo sapiens
ctgacacacagctctgtcctg

SEQ ID NO: 3735662 - DNA, 14 bp, Homo sapiens
ctgacagaaggact

SEQ ID NO: 3735663 - DNA, 16 bp, Homo sapiens
ctgacagacacaggcc

SEQ ID NO: 3735664 - DNA, 17 bp, Homo sapiens
ctgacagacacaggccc

SEQ ID NO: 3735665 - DNA, 14 bp, Homo sapiens
ctgacagcctccca

SEQ ID NO: 3735666 - DNA, 17 bp, Homo sapiens
ctgacagcctcccaccc

SEQ ID NO: 3735667 - DNA, 20 bp, Homo sapiens
ctgacagcctcccaccccca

SEQ ID NO: 3735668 - DNA, 16 bp, Homo sapiens
ctgacaggcaatgctg

SEQ ID NO: 3735669 - DNA, 16 bp, Homo sapiens
ctgaccaacatggaga

SEQ ID NO: 3735670 - DNA, 14 bp, Homo sapiens
ctgaccaagagaga

SEQ ID NO: 3735671 - DNA, 13 bp, Homo sapiens
ctgaccacacttc

SEQ ID NO: 3735672 - DNA, 18 bp, Homo sapiens
ctgaccacacttcctgtc

SEQ ID NO: 3735673 - DNA, 19 bp, Homo sapiens
ctgaccacacttcctgtcc

SEQ ID NO: 3735674 - DNA, 21 bp, Homo sapiens
ctgaccacacttcctgtccag

SEQ ID NO: 3735675 - DNA, 22 bp, Homo sapiens
ctgaccacgctttctagctgtt

SEQ ID NO: 3735676 - DNA, 23 bp, Homo sapiens
ctgaccatccactctaccctccc

SEQ ID NO: 3735677 - DNA, 11 bp, Homo sapiens
ctgacccactg

SEQ ID NO: 3735678 - DNA, 12 bp, Homo sapiens
ctgacccagtcc

SEQ ID NO: 3735679 - DNA, 14 bp, Homo sapiens
ctgacccagtccct

SEQ ID NO: 3735680 - DNA, 16 bp, Homo sapiens
ctgacccagtccctgg

SEQ ID NO: 3735681 - DNA, 14 bp, Homo sapiens
ctgacccccctcag

SEQ ID NO: 3735682 - DNA, 15 bp, Homo sapiens
ctgacccccctcagg

SEQ ID NO: 3735683 - DNA, 18 bp, Homo sapiens
ctgaccctctccacccca

SEQ ID NO: 3735684 - DNA, 17 bp, Homo sapiens
ctgctatcaaagaggtt

SEQ ID NO: 3735685 - DNA, 14 bp, Homo sapiens
ctgctatgcttgaa

SEQ ID NO: 3735686 - DNA, 15 bp, Homo sapiens
ctgctatgcttgaat

SEQ ID NO: 3735687 - DNA, 12 bp, Homo sapiens
ctgctcatcatt

SEQ ID NO: 3735688 - DNA, 12 bp, Homo sapiens
ctgctccaccct

SEQ ID NO: 3735689 - DNA, 13 bp, Homo sapiens
ctgctccaccctt

SEQ ID NO: 3735690 - DNA, 15 bp, Homo sapiens
ctgctccacccttgg

SEQ ID NO: 3735691 - DNA, 20 bp, Homo sapiens
ctgctccacccttggcctgt

SEQ ID NO: 3735692 - DNA, 21 bp, Homo sapiens
ctgctccacccttggcctgtc

SEQ ID NO: 3735693 - DNA, 23 bp, Homo sapiens
ctgctcccccaccccctccccag

SEQ ID NO: 3735694 - DNA, 11 bp, Homo sapiens
ctgctcctcca

SEQ ID NO: 3735695 - DNA, 22 bp, Homo sapiens
ctgctcctccagggccacgtgc

SEQ ID NO: 3735696 - DNA, 20 bp, Homo sapiens
ctgctcctctccccagcaag

SEQ ID NO: 3735697 - DNA, 17 bp, Homo sapiens
ctgctctaagcacacgg

SEQ ID NO: 3735698 - DNA, 20 bp, Homo sapiens
ctgctctcctcttgccactg

SEQ ID NO: 3735699 - DNA, 17 bp, Homo sapiens
ctgctctctacccagcc

SEQ ID NO: 3735700 - DNA, 16 bp, Homo sapiens
ctgctctgaacacgaa

SEQ ID NO: 3735701 - DNA, 15 bp, Homo sapiens
ctgctctgcccagag

SEQ ID NO: 3735702 - DNA, 17 bp, Homo sapiens
ctgctctgcccagagct

SEQ ID NO: 3735703 - DNA, 17 bp, Homo sapiens
ctgctgaaggaataaat

SEQ ID NO: 3735704 - DNA, 19 bp, Homo sapiens
ctgctgaatttataaaaat

SEQ ID NO: 3735705 - DNA, 18 bp, Homo sapiens
ctgctgacagacacaggc

SEQ ID NO: 3735706 - DNA, 21 bp, Homo sapiens
ctgctgacagacacaggcccg

SEQ ID NO: 3735707 - DNA, 15 bp, Homo sapiens
ctgctgacagtgttg

SEQ ID NO: 3735708 - DNA, 18 bp, Homo sapiens
ctgctgacctccacagct

SEQ ID NO: 3735709 - DNA, 21 bp, Homo sapiens
ctgctgactgttttctcttga

SEQ ID NO: 3735710 - DNA, 16 bp, Homo sapiens
ctgctgatgctcatgg

SEQ ID NO: 3735711 - DNA, 17 bp, Homo sapiens
ctgctgatgctcatggt

SEQ ID NO: 3735712 - DNA, 16 bp, Homo sapiens
ctgctgccccaaagga

SEQ ID NO: 3735713 - DNA, 19 bp, Homo sapiens
ctgctgccccaaaggaagc

SEQ ID NO: 3735714 - DNA, 14 bp, Homo sapiens
ctgctgccccagct

SEQ ID NO: 3735715 - DNA, 15 bp, Homo sapiens
ctgctgccccagctg

SEQ ID NO: 3735716 - DNA, 14 bp, Homo sapiens
ctgctgccctccat

SEQ ID NO: 3735717 - DNA, 15 bp, Homo sapiens
ctgctgcctccccaa

SEQ ID NO: 3735718 - DNA, 13 bp, Homo sapiens
ctgctgcttctta

SEQ ID NO: 3735719 - DNA, 22 bp, Homo sapiens
ctgctggcccagccaaaccctg

SEQ ID NO: 3735720 - DNA, 23 bp, Homo sapiens
ctgctggcccctcacctgggcac

SEQ ID NO: 3735721 - DNA, 17 bp, Homo sapiens
ctgctggccgggcacag

SEQ ID NO: 3735722 - DNA, 14 bp, Homo sapiens
ctgctggtcttcaa

SEQ ID NO: 3735723 - DNA, 15 bp, Homo sapiens
ctgctggttcagggt

SEQ ID NO: 3735724 - DNA, 19 bp, Homo sapiens
ctgcttcaaatatttccct

SEQ ID NO: 3735725 - DNA, 16 bp, Homo sapiens
ctgcttcagcctcccg

SEQ ID NO: 3735726 - DNA, 19 bp, Homo sapiens
ctgcttcagtgtatggaaa

SEQ ID NO: 3735727 - DNA, 14 bp, Homo sapiens
ctgcttccctctgc

SEQ ID NO: 3735728 - DNA, 22 bp, Homo sapiens
ctgcttccctctgcctgtccct

SEQ ID NO: 3735729 - DNA, 18 bp, Homo sapiens
ctgcttctaccaactgga

SEQ ID NO: 3735730 - DNA, 20 bp, Homo sapiens
ctgcttctgcaccttatctt

SEQ ID NO: 3735731 - DNA, 20 bp, Homo sapiens
ctgcttgaggcaactcatct

SEQ ID NO: 3735732 - DNA, 19 bp, Homo sapiens
ctgcttgccgaaactggaa

SEQ ID NO: 3735733 - DNA, 20 bp, Homo sapiens
ctgcttgccgaaactggaag

SEQ ID NO: 3735734 - DNA, 21 bp, Homo sapiens
ctgcttgccgaaactggaagt

SEQ ID NO: 3735735 - DNA, 23 bp, Homo sapiens
ctgcttgccgaaactggaagtta

SEQ ID NO: 3735736 - DNA, 20 bp, Homo sapiens
ctgcttggacctcgtgcttt

SEQ ID NO: 3735737 - DNA, 22 bp, Homo sapiens
ctgcttggacctcgtgctttaa

SEQ ID NO: 3735738 - DNA, 23 bp, Homo sapiens
ctgctttaaaaaaaatccttcta

SEQ ID NO: 3735739 - DNA, 21 bp, Homo sapiens
ctgctttgactgagcagactg

SEQ ID NO: 3735740 - DNA, 22 bp, Homo sapiens
ctgctttgactgagcagactgg

SEQ ID NO: 3735741 - DNA, 16 bp, Homo sapiens
ctgctttgggctgccc

SEQ ID NO: 3735742 - DNA, 17 bp, Homo sapiens
ctgctttgggctgccct

SEQ ID NO: 3735743 - DNA, 18 bp, Homo sapiens
ctgctttgggctgccctg

SEQ ID NO: 3735744 - DNA, 23 bp, Homo sapiens
ctgctttgggctgccctggtgct

SEQ ID NO: 3735745 - DNA, 17 bp, Homo sapiens
ctgcttttggtctgtgt

SEQ ID NO: 3735746 - DNA, 19 bp, Homo sapiens
ctgcttttgtctatgggac

SEQ ID NO: 3735747 - DNA, 22 bp, Homo sapiens
ctgctttttaaagaatgctctt

SEQ ID NO: 3735748 - DNA, 13 bp, Homo sapiens
ctggaaaggctca

SEQ ID NO: 3735749 - DNA, 15 bp, Homo sapiens
ctggaaaggctcagt

SEQ ID NO: 3735750 - DNA, 17 bp, Homo sapiens
ctggaaaggctcagtct

SEQ ID NO: 3735751 - DNA, 22 bp, Homo sapiens
ctggaaaggctcagtctcagga

SEQ ID NO: 3735752 - DNA, 19 bp, Homo sapiens
ctggaagcacagaaaacta

SEQ ID NO: 3735753 - DNA, 12 bp, Homo sapiens
ctggaagctgtg

SEQ ID NO: 3735754 - DNA, 23 bp, Homo sapiens
ctggaagttatttattttttaat

SEQ ID NO: 3735755 - DNA, 23 bp, Homo sapiens
ctggaatcaagatgtcagactgg

SEQ ID NO: 3735756 - DNA, 14 bp, Homo sapiens
ctggaatgcagtgg

SEQ ID NO: 3735757 - DNA, 14 bp, Homo sapiens
ctggaatgtaatca

SEQ ID NO: 3735758 - DNA, 13 bp, Homo sapiens
ctggaatttttat

SEQ ID NO: 3735759 - DNA, 20 bp, Homo sapiens
ctggaatttttattatgcat

SEQ ID NO: 3735760 - DNA, 23 bp, Homo sapiens
ctggacaggcatgttctctgagg

SEQ ID NO: 3735761 - DNA, 14 bp, Homo sapiens
ctggacaggtctgg

SEQ ID NO: 3735762 - DNA, 13 bp, Homo sapiens
ctggaccaaagct

SEQ ID NO: 3735763 - DNA, 15 bp, Homo sapiens
ctggaccaaagctga

SEQ ID NO: 3735764 - DNA, 22 bp, Homo sapiens
ctggaccaaagctgacgaggct

SEQ ID NO: 3735765 - DNA, 15 bp, Homo sapiens
ctggaccctgtggat

SEQ ID NO: 3735766 - DNA, 13 bp, Homo sapiens
ctggacctcacca

SEQ ID NO: 3735767 - DNA, 20 bp, Homo sapiens
ctggacggcattcctgctta

SEQ ID NO: 3735768 - DNA, 19 bp, Homo sapiens
ctggactcaggatgcccag

SEQ ID NO: 3735769 - DNA, 20 bp, Homo sapiens
ctggactcaggatgcccagg

SEQ ID NO: 3735770 - DNA, 22 bp, Homo sapiens
ctggactcaggatgcccagggc

SEQ ID NO: 3735771 - DNA, 18 bp, Homo sapiens
ctggactccagatctgca

SEQ ID NO: 3735772 - DNA, 23 bp, Homo sapiens
ctggactccagatctgcaccgcc

SEQ ID NO: 3735773 - DNA, 17 bp, Homo sapiens
ctggactcctctgtcca

SEQ ID NO: 3735774 - DNA, 18 bp, Homo sapiens
ctggactcctctgtccag

SEQ ID NO: 3735775 - DNA, 19 bp, Homo sapiens
ctggactcctctgtccagg

SEQ ID NO: 3735776 - DNA, 22 bp, Homo sapiens
ctggactcctctgtccaggcac

SEQ ID NO: 3735777 - DNA, 23 bp, Homo sapiens
ctggactcctctgtccaggcact

SEQ ID NO: 3735778 - DNA, 16 bp, Homo sapiens
ctggactggctgtcct

SEQ ID NO: 3735779 - DNA, 20 bp, Homo sapiens
ctggacttgagcttggcagc

SEQ ID NO: 3735780 - DNA, 14 bp, Homo sapiens
ctggagaactagag

SEQ ID NO: 3735781 - DNA, 19 bp, Homo sapiens
ctggagaagaccctccccg

SEQ ID NO: 3735782 - DNA, 14 bp, Homo sapiens
ctggagaagcagtg

SEQ ID NO: 3735783 - DNA, 21 bp, Homo sapiens
ctggagaagcagtgagccgca

SEQ ID NO: 3735784 - DNA, 22 bp, Homo sapiens
ctggagaagtcttagacttgaa

SEQ ID NO: 3735785 - DNA, 13 bp, Homo sapiens
ctggagaataatt

SEQ ID NO: 3735786 - DNA, 21 bp, Homo sapiens
ctggagaggttataggtcact

SEQ ID NO: 3735787 - DNA, 23 bp, Homo sapiens
ctggagagtctcactcccctcct

SEQ ID NO: 3735788 - DNA, 18 bp, Homo sapiens
ctggagatggggagaaac

SEQ ID NO: 3735789 - DNA, 23 bp, Homo sapiens
ctggagcaccaggcacgaaccca

SEQ ID NO: 3735790 - DNA, 15 bp, Homo sapiens
ctggagccacctgtc

SEQ ID NO: 3735791 - DNA, 19 bp, Homo sapiens
ctggagccacctgtcccac

SEQ ID NO: 3735792 - DNA, 21 bp, Homo sapiens
ctggagccacctgtcccacct

SEQ ID NO: 3735793 - DNA, 12 bp, Homo sapiens
ctggagccccac

SEQ ID NO: 3735794 - DNA, 13 bp, Homo sapiens
ctggagccccatc

SEQ ID NO: 3735795 - DNA, 14 bp, Homo sapiens
ctggagctcctggg

SEQ ID NO: 3735796 - DNA, 15 bp, Homo sapiens
ctgtaatcccagcag

SEQ ID NO: 3735797 - DNA, 14 bp, Homo sapiens
ctgtaatcccagct

SEQ ID NO: 3735798 - DNA, 19 bp, Homo sapiens
ctgtaatcccagctactcg

SEQ ID NO: 3735799 - DNA, 20 bp, Homo sapiens
ctgtacaaaagggacatgaa

SEQ ID NO: 3735800 - DNA, 16 bp, Homo sapiens
ctgtacaatatttaaa

SEQ ID NO: 3735801 - DNA, 15 bp, Homo sapiens
ctgtacacactttat

SEQ ID NO: 3735802 - DNA, 15 bp, Homo sapiens
ctgtacgtctgacag

SEQ ID NO: 3735803 - DNA, 16 bp, Homo sapiens
ctgtacgtctgacagg

SEQ ID NO: 3735804 - DNA, 19 bp, Homo sapiens
ctgtacgtctgacaggcaa

SEQ ID NO: 3735805 - DNA, 17 bp, Homo sapiens
ctgtactggagagcaac

SEQ ID NO: 3735806 - DNA, 16 bp, Homo sapiens
ctgtacttaataaatt

SEQ ID NO: 3735807 - DNA, 20 bp, Homo sapiens
ctgtacttcaagttaaagtg

SEQ ID NO: 3735808 - DNA, 22 bp, Homo sapiens
ctgtagagcagggcaagtaaca

SEQ ID NO: 3735809 - DNA, 13 bp, Homo sapiens
ctgtagagtggga

SEQ ID NO: 3735810 - DNA, 19 bp, Homo sapiens
ctgtagattgcttctgtag

SEQ ID NO: 3735811 - DNA, 18 bp, Homo sapiens
ctgtaggaaggttaatgt

SEQ ID NO: 3735812 - DNA, 21 bp, Homo sapiens
ctgtaggaaggttaatgttca

SEQ ID NO: 3735813 - DNA, 19 bp, Homo sapiens
ctgtagtaaactatttatc

SEQ ID NO: 3735814 - DNA, 12 bp, Homo sapiens
ctgtagtcccag

SEQ ID NO: 3735815 - DNA, 22 bp, Homo sapiens
ctgtagtcccagctactcagga

SEQ ID NO: 3735816 - DNA, 22 bp, Homo sapiens
ctgtagtcccagctactcggga

SEQ ID NO: 3735817 - DNA, 20 bp, Homo sapiens
ctgtagtctcaggacctagg

SEQ ID NO: 3735818 - DNA, 17 bp, Homo sapiens
ctgtagttaggaaataa

SEQ ID NO: 3735819 - DNA, 22 bp, Homo sapiens
ctgtagttaggaaataaaacct

SEQ ID NO: 3735820 - DNA, 21 bp, Homo sapiens
ctgtataccccgtgaagcatc

SEQ ID NO: 3735821 - DNA, 23 bp, Homo sapiens
ctgtatatacaataacataattt

SEQ ID NO: 3735822 - DNA, 15 bp, Homo sapiens
ctgtatcccatgagc

SEQ ID NO: 3735823 - DNA, 21 bp, Homo sapiens
ctgtatcccatgagcctcagc

SEQ ID NO: 3735824 - DNA, 23 bp, Homo sapiens
ctgtatcccatgagcctcagcat

SEQ ID NO: 3735825 - DNA, 17 bp, Homo sapiens
ctgtatcggagacagtg

SEQ ID NO: 3735826 - DNA, 18 bp, Homo sapiens
ctgtatctgtgtagacta

SEQ ID NO: 3735827 - DNA, 19 bp, Homo sapiens
ctgtattagtcacagagat

SEQ ID NO: 3735828 - DNA, 17 bp, Homo sapiens
ctgtatttatgtgtgag

SEQ ID NO: 3735829 - DNA, 20 bp, Homo sapiens
ctgtattttgtttttgtctt

SEQ ID NO: 3735830 - DNA, 17 bp, Homo sapiens
ctgtcaaacaaagccag

SEQ ID NO: 3735831 - DNA, 19 bp, Homo sapiens
ctgtcaaacaaagccagaa

SEQ ID NO: 3735832 - DNA, 20 bp, Homo sapiens
ctgtcaagttaacaaggaat

SEQ ID NO: 3735833 - DNA, 21 bp, Homo sapiens
ctgtcaagttaacaaggaatg

SEQ ID NO: 3735834 - DNA, 14 bp, Homo sapiens
ctgtcaccaagctc

SEQ ID NO: 3735835 - DNA, 23 bp, Homo sapiens
ctgtcaccaagctcacagttcct

SEQ ID NO: 3735836 - DNA, 14 bp, Homo sapiens
ctgtcactgtttct

SEQ ID NO: 3735837 - DNA, 20 bp, Homo sapiens
ctgtcactgtttctctgctg

SEQ ID NO: 3735838 - DNA, 14 bp, Homo sapiens
ctgtcagtctgctt

SEQ ID NO: 3735839 - DNA, 18 bp, Homo sapiens
ctgtcagtgcagcccgtg

SEQ ID NO: 3735840 - DNA, 19 bp, Homo sapiens
ctgtcataagaatgaataa

SEQ ID NO: 3735841 - DNA, 14 bp, Homo sapiens
ctgtcatagaaatt

SEQ ID NO: 3735842 - DNA, 16 bp, Homo sapiens
ctgtcatagaaattac

SEQ ID NO: 3735843 - DNA, 18 bp, Homo sapiens
ctgtcatatcttcacaat

SEQ ID NO: 3735844 - DNA, 22 bp, Homo sapiens
ctgtcatatgctctgatttatc

SEQ ID NO: 3735845 - DNA, 18 bp, Homo sapiens
ctgtcatctaccttttct

SEQ ID NO: 3735846 - DNA, 15 bp, Homo sapiens
ctgtccaaactgcct

SEQ ID NO: 3735847 - DNA, 21 bp, Homo sapiens
ctgtccaaaggaggctggcag

SEQ ID NO: 3735848 - DNA, 23 bp, Homo sapiens
ctgtccaacctaacccctttcct

SEQ ID NO: 3735849 - DNA, 13 bp, Homo sapiens
ctgtccagcctgg

SEQ ID NO: 3735850 - DNA, 17 bp, Homo sapiens
ctgtccaggcactgctg

SEQ ID NO: 3735851 - DNA, 23 bp, Homo sapiens
ctgtccaggcactgctgcccagc

SEQ ID NO: 3735852 - DNA, 22 bp, Homo sapiens
ctgtccagggccctgagctcgg

SEQ ID NO: 3735853 - DNA, 17 bp, Homo sapiens
ctgtccctaggtcagct

SEQ ID NO: 3735854 - DNA, 21 bp, Homo sapiens
ctgtccctagtaaaaatacaa

SEQ ID NO: 3735855 - DNA, 13 bp, Homo sapiens
ctgtccctcactg

SEQ ID NO: 3735856 - DNA, 18 bp, Homo sapiens
ctgtccctggccatctct

SEQ ID NO: 3735857 - DNA, 12 bp, Homo sapiens
ctgtccctgtca

SEQ ID NO: 3735858 - DNA, 15 bp, Homo sapiens
ctgtccctgtcacca

SEQ ID NO: 3735859 - DNA, 16 bp, Homo sapiens
ctgtcccttctcttaa

SEQ ID NO: 3735860 - DNA, 21 bp, Homo sapiens
ctgtcccttctcttaatttaa

SEQ ID NO: 3735861 - DNA, 14 bp, Homo sapiens
ctgtcctacccacc

SEQ ID NO: 3735862 - DNA, 20 bp, Homo sapiens
ctgtcctactctgtgtcagg

SEQ ID NO: 3735863 - DNA, 16 bp, Homo sapiens
ctgtcctctttcagaa

SEQ ID NO: 3735864 - DNA, 19 bp, Homo sapiens
ctgtcctctttcagaaaac

SEQ ID NO: 3735865 - DNA, 21 bp, Homo sapiens
ctgtcctctttcagaaaacag

SEQ ID NO: 3735866 - DNA, 20 bp, Homo sapiens
ctgtcctgggagtgagctgg

SEQ ID NO: 3735867 - DNA, 17 bp, Homo sapiens
ctgtccttacccatctg

SEQ ID NO: 3735868 - DNA, 20 bp, Homo sapiens
ctgtccttctctcacctcct

SEQ ID NO: 3735869 - DNA, 17 bp, Homo sapiens
ctgtcgtgccagtcctg

SEQ ID NO: 3735870 - DNA, 19 bp, Homo sapiens
ctgtcgtgccagtcctggg

SEQ ID NO: 3735871 - DNA, 17 bp, Homo sapiens
ctgtctaccatctccct

SEQ ID NO: 3735872 - DNA, 21 bp, Homo sapiens
ctgtctaggtcagtacccacc

SEQ ID NO: 3735873 - DNA, 19 bp, Homo sapiens
ctgtctcaagagggcactg

SEQ ID NO: 3735874 - DNA, 12 bp, Homo sapiens
ctgtctcagcct

SEQ ID NO: 3735875 - DNA, 15 bp, Homo sapiens
ctgtctcagcctccc

SEQ ID NO: 3735876 - DNA, 16 bp, Homo sapiens
ctgtctcagcctccca

SEQ ID NO: 3735877 - DNA, 17 bp, Homo sapiens
ctgtctcagcctcccag

SEQ ID NO: 3735878 - DNA, 17 bp, Homo sapiens
ctgtctcagtttcactt

SEQ ID NO: 3735879 - DNA, 16 bp, Homo sapiens
ctgtctcatccccagg

SEQ ID NO: 3735880 - DNA, 17 bp, Homo sapiens
ctgtctcatccccaggg

SEQ ID NO: 3735881 - DNA, 21 bp, Homo sapiens
ctgtctcatccccaggggtcc

SEQ ID NO: 3735882 - DNA, 15 bp, Homo sapiens
ctgtctccagacccc

SEQ ID NO: 3735883 - DNA, 18 bp, Homo sapiens
ctgtctccagacccccac

SEQ ID NO: 3735884 - DNA, 16 bp, Homo sapiens
ctgtctcccctctgct

SEQ ID NO: 3735885 - DNA, 20 bp, Homo sapiens
ctgtctgacaacctcttggt

SEQ ID NO: 3735886 - DNA, 15 bp, Homo sapiens
ctgtctgccagccag

SEQ ID NO: 3735887 - DNA, 20 bp, Homo sapiens
ctgtctgccagccagcagcc

SEQ ID NO: 3735888 - DNA, 19 bp, Homo sapiens
ctgtctggaggggagctct

SEQ ID NO: 3735889 - DNA, 19 bp, Homo sapiens
ctgtcttcatagcagattt

SEQ ID NO: 3735890 - DNA, 22 bp, Homo sapiens
ctgtcttcatagcagattttaa

SEQ ID NO: 3735891 - DNA, 17 bp, Homo sapiens
ctgtcttctcaggctct

SEQ ID NO: 3735892 - DNA, 16 bp, Homo sapiens
ctgtctttaaggaaaa

SEQ ID NO: 3735893 - DNA, 15 bp, Homo sapiens
ctgtctttcagatac

SEQ ID NO: 3735894 - DNA, 18 bp, Homo sapiens
ctgtgaacgatttagaaa

SEQ ID NO: 3735895 - DNA, 20 bp, Homo sapiens
ctgtgaccagcactgtctca

SEQ ID NO: 3735896 - DNA, 23 bp, Homo sapiens
ctgtgaccaggaaggaagtcagc

SEQ ID NO: 3735897 - DNA, 19 bp, Homo sapiens
ctgtgaccatttataatgt

SEQ ID NO: 3735898 - DNA, 22 bp, Homo sapiens
ctgtgacctgccccgcccagct

SEQ ID NO: 3735899 - DNA, 14 bp, Homo sapiens
ctgtgacctgtggg

SEQ ID NO: 3735900 - DNA, 17 bp, Homo sapiens
ctgtgacttcagctctg

SEQ ID NO: 3735901 - DNA, 13 bp, Homo sapiens
ctgtgagaaaacg

SEQ ID NO: 3735902 - DNA, 17 bp, Homo sapiens
ctgtgagacccccacac

SEQ ID NO: 3735903 - DNA, 19 bp, Homo sapiens
ctgtgagacccccacacct

SEQ ID NO: 3735904 - DNA, 23 bp, Homo sapiens
ctgtgagacccccacacctcagt

SEQ ID NO: 3735905 - DNA, 17 bp, Homo sapiens
ctgtgagtttaaagcaa

SEQ ID NO: 3735906 - DNA, 13 bp, Homo sapiens
ctgtgcaataaaa

SEQ ID NO: 3735907 - DNA, 14 bp, Homo sapiens
ctgtgcatgggtga

SEQ ID NO: 3735908 - DNA, 22 bp, Homo sapiens
cttggtgaatttttttttccta

SEQ ID NO: 3735909 - DNA, 19 bp, Homo sapiens
cttggttatacatgacact

SEQ ID NO: 3735910 - DNA, 15 bp, Homo sapiens
cttgtaactccacca

SEQ ID NO: 3735911 - DNA, 17 bp, Homo sapiens
cttgtaactccaccaac

SEQ ID NO: 3735912 - DNA, 15 bp, Homo sapiens
cttgtaagattttga

SEQ ID NO: 3735913 - DNA, 16 bp, Homo sapiens
cttgtaagattttgaa

SEQ ID NO: 3735914 - DNA, 15 bp, Homo sapiens
cttgtaattctaaat

SEQ ID NO: 3735915 - DNA, 13 bp, Homo sapiens
cttgtacaaaata

SEQ ID NO: 3735916 - DNA, 17 bp, Homo sapiens
cttgtattaaagacaga

SEQ ID NO: 3735917 - DNA, 12 bp, Homo sapiens
cttgtatttaaa

SEQ ID NO: 3735918 - DNA, 15 bp, Homo sapiens
cttgtcactggtaga

SEQ ID NO: 3735919 - DNA, 23 bp, Homo sapiens
cttgtcactggtagaccaaaata

SEQ ID NO: 3735920 - DNA, 13 bp, Homo sapiens
cttgtcagagctg

SEQ ID NO: 3735921 - DNA, 15 bp, Homo sapiens
cttgtcagagctggg

SEQ ID NO: 3735922 - DNA, 14 bp, Homo sapiens
cttgtcatgtgaca

SEQ ID NO: 3735923 - DNA, 20 bp, Homo sapiens
cttgtcccctcctcactccc

SEQ ID NO: 3735924 - DNA, 15 bp, Homo sapiens
cttgtccctgcccag

SEQ ID NO: 3735925 - DNA, 16 bp, Homo sapiens
cttgtgactagtgctg

SEQ ID NO: 3735926 - DNA, 18 bp, Homo sapiens
cttgtggaattgggagct

SEQ ID NO: 3735927 - DNA, 13 bp, Homo sapiens
cttgtggacacag

SEQ ID NO: 3735928 - DNA, 16 bp, Homo sapiens
cttgtggacacagctc

SEQ ID NO: 3735929 - DNA, 13 bp, Homo sapiens
cttgtggcacatt

SEQ ID NO: 3735930 - DNA, 20 bp, Homo sapiens
cttgtgtgtgggctgtgagt

SEQ ID NO: 3735931 - DNA, 14 bp, Homo sapiens
cttgtgttggctgt

SEQ ID NO: 3735932 - DNA, 15 bp, Homo sapiens
cttgtgtttttgtct

SEQ ID NO: 3735933 - DNA, 16 bp, Homo sapiens
cttgttaatattcttt

SEQ ID NO: 3735934 - DNA, 14 bp, Homo sapiens
cttgttccctctcc

SEQ ID NO: 3735935 - DNA, 16 bp, Homo sapiens
cttgttctgttttgtt

SEQ ID NO: 3735936 - DNA, 20 bp, Homo sapiens
cttgttgctcaaaaaatgag

SEQ ID NO: 3735937 - DNA, 18 bp, Homo sapiens
cttgtttgctcacctggg

SEQ ID NO: 3735938 - DNA, 19 bp, Homo sapiens
cttgtttgctcacctgggg

SEQ ID NO: 3735939 - DNA, 15 bp, Homo sapiens
ctttaaatttcaaat

SEQ ID NO: 3735940 - DNA, 17 bp, Homo sapiens
ctttaaccagtctgaag

SEQ ID NO: 3735941 - DNA, 20 bp, Homo sapiens
ctttaactcaggactccagc

SEQ ID NO: 3735942 - DNA, 23 bp, Homo sapiens
ctttaagacatactccttccatc

SEQ ID NO: 3735943 - DNA, 21 bp, Homo sapiens
ctttaatatgtattttatgta

SEQ ID NO: 3735944 - DNA, 23 bp, Homo sapiens
ctttaatgtcacaggcaggtcca

SEQ ID NO: 3735945 - DNA, 17 bp, Homo sapiens
ctttacatatgctttaa

SEQ ID NO: 3735946 - DNA, 23 bp, Homo sapiens
ctttactgggttggaagaaatat

SEQ ID NO: 3735947 - DNA, 14 bp, Homo sapiens
ctttactgtttgtt

SEQ ID NO: 3735948 - DNA, 14 bp, Homo sapiens
ctttacttagctta

SEQ ID NO: 3735949 - DNA, 14 bp, Homo sapiens
ctttacttttaaac

SEQ ID NO: 3735950 - DNA, 16 bp, Homo sapiens
ctttagaaataaatgt

SEQ ID NO: 3735951 - DNA, 18 bp, Homo sapiens
ctttagaatgagagtgtg

SEQ ID NO: 3735952 - DNA, 21 bp, Homo sapiens
ctttagaatgttttccttcta

SEQ ID NO: 3735953 - DNA, 18 bp, Homo sapiens
ctttaggcagcagctttt

SEQ ID NO: 3735954 - DNA, 15 bp, Homo sapiens
ctttagtcgctgagg

SEQ ID NO: 3735955 - DNA, 12 bp, Homo sapiens
ctttataaactt

SEQ ID NO: 3735956 - DNA, 19 bp, Homo sapiens
ctttataattctactttga

SEQ ID NO: 3735957 - DNA, 15 bp, Homo sapiens
ctttatgcaataaat

SEQ ID NO: 3735958 - DNA, 13 bp, Homo sapiens
ctttatggtttct

SEQ ID NO: 3735959 - DNA, 18 bp, Homo sapiens
ctttattccttcatttca

SEQ ID NO: 3735960 - DNA, 22 bp, Homo sapiens
ctttatttacttcgttttggtt

SEQ ID NO: 3735961 - DNA, 22 bp, Homo sapiens
ctttattttatataataaagta

SEQ ID NO: 3735962 - DNA, 21 bp, Homo sapiens
ctttattttttaagtatttat

SEQ ID NO: 3735963 - DNA, 21 bp, Homo sapiens
ctttcaaagaaggaattctag

SEQ ID NO: 3735964 - DNA, 20 bp, Homo sapiens
ctttcaatggtttgcaagga

SEQ ID NO: 3735965 - DNA, 20 bp, Homo sapiens
ctttcacaaaattttattcc

SEQ ID NO: 3735966 - DNA, 15 bp, Homo sapiens
ctttcacacttccac

SEQ ID NO: 3735967 - DNA, 16 bp, Homo sapiens
ctttcacacttccacc

SEQ ID NO: 3735968 - DNA, 20 bp, Homo sapiens
ctttcacccacagaaagaga

SEQ ID NO: 3735969 - DNA, 13 bp, Homo sapiens
ctttcagaaaaca

SEQ ID NO: 3735970 - DNA, 14 bp, Homo sapiens
ctttcagaaaacag

SEQ ID NO: 3735971 - DNA, 11 bp, Homo sapiens
ctttcagaaag

SEQ ID NO: 3735972 - DNA, 20 bp, Homo sapiens
ctttcagggaatttcaggaa

SEQ ID NO: 3735973 - DNA, 22 bp, Homo sapiens
ctttccaaatgcccagcttaaa

SEQ ID NO: 3735974 - DNA, 19 bp, Homo sapiens
ctttccacatttgtcacag

SEQ ID NO: 3735975 - DNA, 21 bp, Homo sapiens
ctttccacatttgtcacagaa

SEQ ID NO: 3735976 - DNA, 20 bp, Homo sapiens
ctttccaccccctccctggc

SEQ ID NO: 3735977 - DNA, 15 bp, Homo sapiens
ctttccatctaccct

SEQ ID NO: 3735978 - DNA, 14 bp, Homo sapiens
ctttccatttctct

SEQ ID NO: 3735979 - DNA, 18 bp, Homo sapiens
ctttccccatactctgtc

SEQ ID NO: 3735980 - DNA, 19 bp, Homo sapiens
ctttcccccaccagctaag

SEQ ID NO: 3735981 - DNA, 17 bp, Homo sapiens
ctttccgtggcactgca

SEQ ID NO: 3735982 - DNA, 13 bp, Homo sapiens
ctttcctgttcag

SEQ ID NO: 3735983 - DNA, 18 bp, Homo sapiens
ctttcctgttcagcattc

SEQ ID NO: 3735984 - DNA, 15 bp, Homo sapiens
ctttctacccagcga

SEQ ID NO: 3735985 - DNA, 16 bp, Homo sapiens
ctttctacccagcgag

SEQ ID NO: 3735986 - DNA, 22 bp, Homo sapiens
ctttctcagccgcttctgactg

SEQ ID NO: 3735987 - DNA, 19 bp, Homo sapiens
ctttctcccaggccaggct

SEQ ID NO: 3735988 - DNA, 17 bp, Homo sapiens
ctttctctgcttcagct

SEQ ID NO: 3735989 - DNA, 20 bp, Homo sapiens
ctttctcttttcctctacca

SEQ ID NO: 3735990 - DNA, 15 bp, Homo sapiens
ctttctggcctgcct

SEQ ID NO: 3735991 - DNA, 17 bp, Homo sapiens
ctttctggcctgccttc

SEQ ID NO: 3735992 - DNA, 17 bp, Homo sapiens
ctttctgtaccatttat

SEQ ID NO: 3735993 - DNA, 19 bp, Homo sapiens
ctttctgtccttttggcac

SEQ ID NO: 3735994 - DNA, 16 bp, Homo sapiens
ctttctgttgccacaa

SEQ ID NO: 3735995 - DNA, 13 bp, Homo sapiens
ctttcttcctctg

SEQ ID NO: 3735996 - DNA, 16 bp, Homo sapiens
ctttcttcctctgctg

SEQ ID NO: 3735997 - DNA, 13 bp, Homo sapiens
ctttcttggccag

SEQ ID NO: 3735998 - DNA, 17 bp, Homo sapiens
ctttctttctaactcca

SEQ ID NO: 3735999 - DNA, 15 bp, Homo sapiens
ctttgaaactagact

SEQ ID NO: 3736000 - DNA, 21 bp, Homo sapiens
ctttgacctcaacctgtgatg

SEQ ID NO: 3736001 - DNA, 17 bp, Homo sapiens
ctttgagactgggtctc

SEQ ID NO: 3736002 - DNA, 16 bp, Homo sapiens
ctttgagtttcctcag

SEQ ID NO: 3736003 - DNA, 15 bp, Homo sapiens
ctttgatcaggtggg

SEQ ID NO: 3736004 - DNA, 21 bp, Homo sapiens
ctttgatgattaattcacctt

SEQ ID NO: 3736005 - DNA, 18 bp, Homo sapiens
ctttgatgtcatatggaa

SEQ ID NO: 3736006 - DNA, 14 bp, Homo sapiens
ctttgatttagatt

SEQ ID NO: 3736007 - DNA, 19 bp, Homo sapiens
ctttgatttagattgagta

SEQ ID NO: 3736008 - DNA, 18 bp, Homo sapiens
ctttgcacagctctccgg

SEQ ID NO: 3736009 - DNA, 15 bp, Homo sapiens
ctttgcagacaggca

SEQ ID NO: 3736010 - DNA, 16 bp, Homo sapiens
ctttgcagacaggcaa

SEQ ID NO: 3736011 - DNA, 13 bp, Homo sapiens
ctttgcaggctca

SEQ ID NO: 3736012 - DNA, 21 bp, Homo sapiens
ctttgcatggagacttgagga

SEQ ID NO: 3736013 - DNA, 18 bp, Homo sapiens
ctttgccagaaagcataa

SEQ ID NO: 3736014 - DNA, 14 bp, Homo sapiens
ctttgcccacaatg

SEQ ID NO: 3736015 - DNA, 23 bp, Homo sapiens
ctttgccccacctttattaaaat

SEQ ID NO: 3736016 - DNA, 18 bp, Homo sapiens
ctttgccttgggctgctc

SEQ ID NO: 3736017 - DNA, 19 bp, Homo sapiens
ctttgccttgggctgctcc

SEQ ID NO: 3736018 - DNA, 18 bp, Homo sapiens
ctttgctccaccccactc

SEQ ID NO: 3736019 - DNA, 11 bp, Homo sapiens
ctttgctctga

SEQ ID NO: 3736020 - DNA, 11 bp, Homo sapiens
ctttgctgcca

SEQ ID NO: 3736021 - DNA, 19 bp, Homo sapiens
ctttgcttatgaatattta

SEQ ID NO: 3736022 - DNA, 24 bp, Homo sapiens
gaagctgtgtccttgcacctgcat

SEQ ID NO: 3736023 - DNA, 14 bp, Homo sapiens
gaagcttattaatg

SEQ ID NO: 3736024 - DNA, 15 bp, Homo sapiens
gaagcttattaatgc

SEQ ID NO: 3736025 - DNA, 16 bp, Homo sapiens
gaagcttattaatgct

SEQ ID NO: 3736026 - DNA, 19 bp, Homo sapiens
gaagcttattaatgctaag

SEQ ID NO: 3736027 - DNA, 22 bp, Homo sapiens
gaagcttattaatgctaagggc

SEQ ID NO: 3736028 - DNA, 23 bp, Homo sapiens
gaagcttattaatgctaagggca

SEQ ID NO: 3736029 - DNA, 23 bp, Homo sapiens
gaagcttcttaaatgagaaggaa

SEQ ID NO: 3736030 - DNA, 16 bp, Homo sapiens
gaaggaatgtctttgg

SEQ ID NO: 3736031 - DNA, 17 bp, Homo sapiens
gaaggagactcacctct

SEQ ID NO: 3736032 - DNA, 23 bp, Homo sapiens
gaaggagactcacctctgcctca

SEQ ID NO: 3736033 - DNA, 16 bp, Homo sapiens
gaaggagagaagggga

SEQ ID NO: 3736034 - DNA, 18 bp, Homo sapiens
gaaggagagaaggggagg

SEQ ID NO: 3736035 - DNA, 15 bp, Homo sapiens
gaaggaggaggagga

SEQ ID NO: 3736036 - DNA, 14 bp, Homo sapiens
gaaggaggctggct

SEQ ID NO: 3736037 - DNA, 19 bp, Homo sapiens
gaaggagggttagggaggg

SEQ ID NO: 3736038 - DNA, 14 bp, Homo sapiens
gaaggatgctgtct

SEQ ID NO: 3736039 - DNA, 16 bp, Homo sapiens
gaaggatgtacatttc

SEQ ID NO: 3736040 - DNA, 20 bp, Homo sapiens
gaaggatgtacatttccaaa

SEQ ID NO: 3736041 - DNA, 17 bp, Homo sapiens
gaaggccgagaagcaag

SEQ ID NO: 3736042 - DNA, 22 bp, Homo sapiens
gaaggccgagaagcaagaaaga

SEQ ID NO: 3736043 - DNA, 16 bp, Homo sapiens
gaaggctggctgggca

SEQ ID NO: 3736044 - DNA, 17 bp, Homo sapiens
gaaggctgtccttaccc

SEQ ID NO: 3736045 - DNA, 17 bp, Homo sapiens
gaaggctttcagggcct

SEQ ID NO: 3736046 - DNA, 24 bp, Homo sapiens
gaaggctttcagggcctccagccc

SEQ ID NO: 3736047 - DNA, 15 bp, Homo sapiens
gaagggaagaaaagg

SEQ ID NO: 3736048 - DNA, 23 bp, Homo sapiens
gaagggcaggaaggagagcctgc

SEQ ID NO: 3736049 - DNA, 16 bp, Homo sapiens
gaagggccagtcctgc

SEQ ID NO: 3736050 - DNA, 19 bp, Homo sapiens
gaaggggaagcactcgtgt

SEQ ID NO: 3736051 - DNA, 23 bp, Homo sapiens
gaaggggccctggtccttccagg

SEQ ID NO: 3736052 - DNA, 20 bp, Homo sapiens
gaaggggctggactggctgt

SEQ ID NO: 3736053 - DNA, 17 bp, Homo sapiens
gaagggggtcaaagcaa

SEQ ID NO: 3736054 - DNA, 20 bp, Homo sapiens
gaagggttttccaccctgga

SEQ ID NO: 3736055 - DNA, 15 bp, Homo sapiens
gaaggtcttgatttg

SEQ ID NO: 3736056 - DNA, 12 bp, Homo sapiens
gaaggttgtaag

SEQ ID NO: 3736057 - DNA, 20 bp, Homo sapiens
gaaggtttactctgtggcca

SEQ ID NO: 3736058 - DNA, 15 bp, Homo sapiens
gaaggtttgtatatt

SEQ ID NO: 3736059 - DNA, 13 bp, Homo sapiens
gaagtcacacagt

SEQ ID NO: 3736060 - DNA, 18 bp, Homo sapiens
gaagtcactcaattgttt

SEQ ID NO: 3736061 - DNA, 15 bp, Homo sapiens
gaagtcatgaagccc

SEQ ID NO: 3736062 - DNA, 23 bp, Homo sapiens
gaagtccccaggccccaggaagc

SEQ ID NO: 3736063 - DNA, 15 bp, Homo sapiens
gaagtctaggagctg

SEQ ID NO: 3736064 - DNA, 18 bp, Homo sapiens
gaagtctctaggttctga

SEQ ID NO: 3736065 - DNA, 15 bp, Homo sapiens
gaagtcttagatgta

SEQ ID NO: 3736066 - DNA, 14 bp, Homo sapiens
gaagtgaacatttc

SEQ ID NO: 3736067 - DNA, 18 bp, Homo sapiens
gaagtgcccctgctgcct

SEQ ID NO: 3736068 - DNA, 22 bp, Homo sapiens
gaagtgcccctgctgcctcccc

SEQ ID NO: 3736069 - DNA, 18 bp, Homo sapiens
gaagtggaccaggacagg

SEQ ID NO: 3736070 - DNA, 22 bp, Homo sapiens
gaagtggaccaggacaggacca

SEQ ID NO: 3736071 - DNA, 16 bp, Homo sapiens
gaagtgggccaggaca

SEQ ID NO: 3736072 - DNA, 18 bp, Homo sapiens
gaagtgggccaggacagg

SEQ ID NO: 3736073 - DNA, 19 bp, Homo sapiens
gaagtgggccaggacaggc

SEQ ID NO: 3736074 - DNA, 14 bp, Homo sapiens
gaagtgtaacagct

SEQ ID NO: 3736075 - DNA, 17 bp, Homo sapiens
gaagtgtaacagctgag

SEQ ID NO: 3736076 - DNA, 15 bp, Homo sapiens
gaagtgtgtttcctt

SEQ ID NO: 3736077 - DNA, 15 bp, Homo sapiens
gaagttaacagagac

SEQ ID NO: 3736078 - DNA, 16 bp, Homo sapiens
gaagttggacagcaaa

SEQ ID NO: 3736079 - DNA, 22 bp, Homo sapiens
gaagttgggcaatataaccaat

SEQ ID NO: 3736080 - DNA, 13 bp, Homo sapiens
gaagtttcattta

SEQ ID NO: 3736081 - DNA, 21 bp, Homo sapiens
gaagtttcatttatgatacaa

SEQ ID NO: 3736082 - DNA, 21 bp, Homo sapiens
gaagtttgtgttctgtttgtt

SEQ ID NO: 3736083 - DNA, 17 bp, Homo sapiens
gaagttttgcatttatg

SEQ ID NO: 3736084 - DNA, 13 bp, Homo sapiens
gaataaaaattaa

SEQ ID NO: 3736085 - DNA, 14 bp, Homo sapiens
gaataaagacacct

SEQ ID NO: 3736086 - DNA, 13 bp, Homo sapiens
gaataaagttctg

SEQ ID NO: 3736087 - DNA, 20 bp, Homo sapiens
gaataaagttctgagtgttt

SEQ ID NO: 3736088 - DNA, 22 bp, Homo sapiens
gaataaataaatgtatcttatt

SEQ ID NO: 3736089 - DNA, 21 bp, Homo sapiens
gaataactctgtggcattatt

SEQ ID NO: 3736090 - DNA, 19 bp, Homo sapiens
gaataatatgctgccaaat

SEQ ID NO: 3736091 - DNA, 15 bp, Homo sapiens
gaataattctttgat

SEQ ID NO: 3736092 - DNA, 14 bp, Homo sapiens
gaataatttcccaa

SEQ ID NO: 3736093 - DNA, 23 bp, Homo sapiens
gaataatttcccaattaggaagt

SEQ ID NO: 3736094 - DNA, 21 bp, Homo sapiens
gaatacagaggcaactgcatt

SEQ ID NO: 3736095 - DNA, 19 bp, Homo sapiens
gaatacctctttgaaagaa

SEQ ID NO: 3736096 - DNA, 12 bp, Homo sapiens
gaatagaaggaa

SEQ ID NO: 3736097 - DNA, 18 bp, Homo sapiens
gaatagaaggaaactagc

SEQ ID NO: 3736098 - DNA, 15 bp, Homo sapiens
gaatagcatgtcact

SEQ ID NO: 3736099 - DNA, 13 bp, Homo sapiens
gaatataaacact

SEQ ID NO: 3736100 - DNA, 11 bp, Homo sapiens
gaatatattat

SEQ ID NO: 3736101 - DNA, 14 bp, Homo sapiens
gaatatgacagctg

SEQ ID NO: 3736102 - DNA, 18 bp, Homo sapiens
gaatatgattagtaaaga

SEQ ID NO: 3736103 - DNA, 21 bp, Homo sapiens
gaatattgttcctaagttctt

SEQ ID NO: 3736104 - DNA, 15 bp, Homo sapiens
gaatatttataacag

SEQ ID NO: 3736105 - DNA, 19 bp, Homo sapiens
gaatatttatatttcacta

SEQ ID NO: 3736106 - DNA, 20 bp, Homo sapiens
gaatatttatatttcactat

SEQ ID NO: 3736107 - DNA, 21 bp, Homo sapiens
gaatatttattacctctgata

SEQ ID NO: 3736108 - DNA, 12 bp, Homo sapiens
gaatattttatt

SEQ ID NO: 3736109 - DNA, 15 bp, Homo sapiens
gaatattttattcaa

SEQ ID NO: 3736110 - DNA, 16 bp, Homo sapiens
gaatattttattcaag

SEQ ID NO: 3736111 - DNA, 20 bp, Homo sapiens
gaatcaagatgtcagactgg

SEQ ID NO: 3736112 - DNA, 21 bp, Homo sapiens
gaatcaagatgtcagactggc

SEQ ID NO: 3736113 - DNA, 18 bp, Homo sapiens
gaatcagaccctacccca

SEQ ID NO: 3736114 - DNA, 23 bp, Homo sapiens
gaatcagaccctaccccaccacg

SEQ ID NO: 3736115 - DNA, 19 bp, Homo sapiens
gaatcagacttcacactgc

SEQ ID NO: 3736116 - DNA, 17 bp, Homo sapiens
gaatcattatttattaa

SEQ ID NO: 3736117 - DNA, 13 bp, Homo sapiens
gaatccatgcttg

SEQ ID NO: 3736118 - DNA, 14 bp, Homo sapiens
gaatccatgcttgg

SEQ ID NO: 3736119 - DNA, 14 bp, Homo sapiens
gaatccctgttcat

SEQ ID NO: 3736120 - DNA, 19 bp, Homo sapiens
gaatccgggctcccctttc

SEQ ID NO: 3736121 - DNA, 21 bp, Homo sapiens
gaatcgatgggggatgcttca

SEQ ID NO: 3736122 - DNA, 15 bp, Homo sapiens
gaatctagaagaaat

SEQ ID NO: 3736123 - DNA, 18 bp, Homo sapiens
gaatctagaagaaatgaa

SEQ ID NO: 3736124 - DNA, 16 bp, Homo sapiens
gaatctcaaataacta

SEQ ID NO: 3736125 - DNA, 14 bp, Homo sapiens
gaatctgaatgtaa

SEQ ID NO: 3736126 - DNA, 15 bp, Homo sapiens
gaatgaaaaaacagt

SEQ ID NO: 3736127 - DNA, 19 bp, Homo sapiens
gaatgaaaaatttaagcat

SEQ ID NO: 3736128 - DNA, 22 bp, Homo sapiens
gaatgaaaaatttaagcattgt

SEQ ID NO: 3736129 - DNA, 14 bp, Homo sapiens
gaatgaaagggccc

SEQ ID NO: 3736130 - DNA, 21 bp, Homo sapiens
gaatgaaagtcttgtgactag

SEQ ID NO: 3736131 - DNA, 13 bp, Homo sapiens
gaatgaacaacct

SEQ ID NO: 3736132 - DNA, 18 bp, Homo sapiens
gaatgaacaacctcggct

SEQ ID NO: 3736133 - DNA, 18 bp, Homo sapiens
gaatgaaccacatcttgc

SEQ ID NO: 3736134 - DNA, 22 bp, Homo sapiens
gaatgaaccacatcttgctctg

SEQ ID NO: 3736135 - DNA, 20 bp, Homo sapiens
gactggctagagtcctcact

SEQ ID NO: 3736136 - DNA, 21 bp, Homo sapiens
gactggctttgtcccacagct

SEQ ID NO: 3736137 - DNA, 18 bp, Homo sapiens
gactgtacacactttatt

SEQ ID NO: 3736138 - DNA, 17 bp, Homo sapiens
gactgtactcctcccag

SEQ ID NO: 3736139 - DNA, 18 bp, Homo sapiens
gactgtactcctcccagg

SEQ ID NO: 3736140 - DNA, 22 bp, Homo sapiens
gactgtattatacatgggtagc

SEQ ID NO: 3736141 - DNA, 13 bp, Homo sapiens
gactgtctttcag

SEQ ID NO: 3736142 - DNA, 19 bp, Homo sapiens
gactgtgatgccacacaga

SEQ ID NO: 3736143 - DNA, 14 bp, Homo sapiens
gactgtggctgcta

SEQ ID NO: 3736144 - DNA, 19 bp, Homo sapiens
gacttaaaatattcctgca

SEQ ID NO: 3736145 - DNA, 17 bp, Homo sapiens
gacttagtatattttct

SEQ ID NO: 3736146 - DNA, 13 bp, Homo sapiens
gacttcacactgc

SEQ ID NO: 3736147 - DNA, 14 bp, Homo sapiens
gacttcagctctgt

SEQ ID NO: 3736148 - DNA, 21 bp, Homo sapiens
gacttcatagatttccttccc

SEQ ID NO: 3736149 - DNA, 16 bp, Homo sapiens
gacttcatttttccta

SEQ ID NO: 3736150 - DNA, 13 bp, Homo sapiens
gacttcccagctt

SEQ ID NO: 3736151 - DNA, 20 bp, Homo sapiens
gacttccccgcattccaggc

SEQ ID NO: 3736152 - DNA, 23 bp, Homo sapiens
gacttccccgcattccaggctcc

SEQ ID NO: 3736153 - DNA, 13 bp, Homo sapiens
gactttagaaata

SEQ ID NO: 3736154 - DNA, 19 bp, Homo sapiens
gactttatagatcagccag

SEQ ID NO: 3736155 - DNA, 16 bp, Homo sapiens
gactttccaccccctc

SEQ ID NO: 3736156 - DNA, 11 bp, Homo sapiens
gactttcctct

SEQ ID NO: 3736157 - DNA, 19 bp, Homo sapiens
gacttttcgaccaattcaa

SEQ ID NO: 3736158 - DNA, 22 bp, Homo sapiens
gacttttcgaccaattcaaccc

SEQ ID NO: 3736159 - DNA, 21 bp, Homo sapiens
gacttttctgtccgagctttg

SEQ ID NO: 3736160 - DNA, 23 bp, Homo sapiens
gacttttctgtccgagctttgaa

SEQ ID NO: 3736161 - DNA, 14 bp, Homo sapiens
gagaaaaaagaagt

SEQ ID NO: 3736162 - DNA, 21 bp, Homo sapiens
gagaaaccttattgtacctct

SEQ ID NO: 3736163 - DNA, 20 bp, Homo sapiens
gagaacagatctccaaagct

SEQ ID NO: 3736164 - DNA, 21 bp, Homo sapiens
gagaacagatctccaaagctt

SEQ ID NO: 3736165 - DNA, 22 bp, Homo sapiens
gagaacctcacgcacctcccat

SEQ ID NO: 3736166 - DNA, 16 bp, Homo sapiens
gagaacgccagtctcc

SEQ ID NO: 3736167 - DNA, 22 bp, Homo sapiens
gagaacgccagtctcccaggcc

SEQ ID NO: 3736168 - DNA, 22 bp, Homo sapiens
gagaactagtggtggctctgag

SEQ ID NO: 3736169 - DNA, 19 bp, Homo sapiens
gagaagagagaaatagcct

SEQ ID NO: 3736170 - DNA, 16 bp, Homo sapiens
gagaagcagaggaagg

SEQ ID NO: 3736171 - DNA, 14 bp, Homo sapiens
gagaagcagtgagc

SEQ ID NO: 3736172 - DNA, 19 bp, Homo sapiens
gagaagcatatagaggcaa

SEQ ID NO: 3736173 - DNA, 12 bp, Homo sapiens
gagaaggaagcc

SEQ ID NO: 3736174 - DNA, 14 bp, Homo sapiens
gagaaggaaggaga

SEQ ID NO: 3736175 - DNA, 23 bp, Homo sapiens
gagaaggacccggaggggcctgg

SEQ ID NO: 3736176 - DNA, 23 bp, Homo sapiens
gagaaggcaggaatgtgtggcag

SEQ ID NO: 3736177 - DNA, 22 bp, Homo sapiens
gagaaggggaggacctctgggc

SEQ ID NO: 3736178 - DNA, 19 bp, Homo sapiens
gagaagggggtcaaagcaa

SEQ ID NO: 3736179 - DNA, 22 bp, Homo sapiens
gagaagggggtcaaagcaagga

SEQ ID NO: 3736180 - DNA, 16 bp, Homo sapiens
gagaagtgcccctgct

SEQ ID NO: 3736181 - DNA, 20 bp, Homo sapiens
gagaagtgcccctgctgcct

SEQ ID NO: 3736182 - DNA, 22 bp, Homo sapiens
gagaagtgcccctgctgcctcc

SEQ ID NO: 3736183 - DNA, 16 bp, Homo sapiens
gagaatagaaggaaac

SEQ ID NO: 3736184 - DNA, 23 bp, Homo sapiens
gagaatattagctttactgtttg

SEQ ID NO: 3736185 - DNA, 21 bp, Homo sapiens
gagaatcatacttagcaaagt

SEQ ID NO: 3736186 - DNA, 22 bp, Homo sapiens
gagaatctatatttaacaagat

SEQ ID NO: 3736187 - DNA, 17 bp, Homo sapiens
gagaatgagggccaaga

SEQ ID NO: 3736188 - DNA, 20 bp, Homo sapiens
gagaatggcgtgaacccggg

SEQ ID NO: 3736189 - DNA, 21 bp, Homo sapiens
gagaatgtagatattgtgaag

SEQ ID NO: 3736190 - DNA, 16 bp, Homo sapiens
gagaatgttatagtga

SEQ ID NO: 3736191 - DNA, 17 bp, Homo sapiens
gagaatgttatagtgaa

SEQ ID NO: 3736192 - DNA, 16 bp, Homo sapiens
gagaattcttacatgt

SEQ ID NO: 3736193 - DNA, 18 bp, Homo sapiens
gagaattcttacatgttt

SEQ ID NO: 3736194 - DNA, 18 bp, Homo sapiens
gagaattgcttgaaccca

SEQ ID NO: 3736195 - DNA, 15 bp, Homo sapiens
gagaattttaaatta

SEQ ID NO: 3736196 - DNA, 16 bp, Homo sapiens
gagacaaatggaggcc

SEQ ID NO: 3736197 - DNA, 16 bp, Homo sapiens
gagacaatgcagatgc

SEQ ID NO: 3736198 - DNA, 17 bp, Homo sapiens
gagacacctgcacctcc

SEQ ID NO: 3736199 - DNA, 19 bp, Homo sapiens
gagacacctgcacctcccc

SEQ ID NO: 3736200 - DNA, 22 bp, Homo sapiens
gagacagagaggacgtgggcgg

SEQ ID NO: 3736201 - DNA, 16 bp, Homo sapiens
gagacaggacctgact

SEQ ID NO: 3736202 - DNA, 17 bp, Homo sapiens
gagacagtgatctccat

SEQ ID NO: 3736203 - DNA, 18 bp, Homo sapiens
gagacagttcaagaaagc

SEQ ID NO: 3736204 - DNA, 22 bp, Homo sapiens
gagaccaagactctgaaatctc

SEQ ID NO: 3736205 - DNA, 19 bp, Homo sapiens
gagaccaagtcctggctac

SEQ ID NO: 3736206 - DNA, 13 bp, Homo sapiens
gagaccagcctgg

SEQ ID NO: 3736207 - DNA, 16 bp, Homo sapiens
gagaccagcctgggca

SEQ ID NO: 3736208 - DNA, 14 bp, Homo sapiens
gagacccaaggagg

SEQ ID NO: 3736209 - DNA, 15 bp, Homo sapiens
gagacccccacacct

SEQ ID NO: 3736210 - DNA, 21 bp, Homo sapiens
gagactagatttatgaataca

SEQ ID NO: 3736211 - DNA, 17 bp, Homo sapiens
gagactcacctctgcct

SEQ ID NO: 3736212 - DNA, 14 bp, Homo sapiens
gagactctgtctca

SEQ ID NO: 3736213 - DNA, 23 bp, Homo sapiens
gagactctgtggggccttggttc

SEQ ID NO: 3736214 - DNA, 19 bp, Homo sapiens
gagactgcgggatggtcct

SEQ ID NO: 3736215 - DNA, 23 bp, Homo sapiens
gagactgtagattgcttctgtag

SEQ ID NO: 3736216 - DNA, 13 bp, Homo sapiens
gagacttgtatga

SEQ ID NO: 3736217 - DNA, 16 bp, Homo sapiens
gagagaaggggaggag

SEQ ID NO: 3736218 - DNA, 18 bp, Homo sapiens
gagagaagtgcccctgct

SEQ ID NO: 3736219 - DNA, 15 bp, Homo sapiens
gagagacccaaggag

SEQ ID NO: 3736220 - DNA, 12 bp, Homo sapiens
gagagccagccc

SEQ ID NO: 3736221 - DNA, 11 bp, Homo sapiens
gagagcccagc

SEQ ID NO: 3736222 - DNA, 16 bp, Homo sapiens
gagagcccttcatttg

SEQ ID NO: 3736223 - DNA, 14 bp, Homo sapiens
gagagcctgctccc

SEQ ID NO: 3736224 - DNA, 21 bp, Homo sapiens
gagagcctgctcccccacccc

SEQ ID NO: 3736225 - DNA, 13 bp, Homo sapiens
gagagcctgctgc

SEQ ID NO: 3736226 - DNA, 17 bp, Homo sapiens
gagagcctggtgctgct

SEQ ID NO: 3736227 - DNA, 19 bp, Homo sapiens
gagagcctggtgctgctgc

SEQ ID NO: 3736228 - DNA, 16 bp, Homo sapiens
gagagcgcctgcccct

SEQ ID NO: 3736229 - DNA, 20 bp, Homo sapiens
gagagctgggtgtcaagagg

SEQ ID NO: 3736230 - DNA, 14 bp, Homo sapiens
gagagctggtgccc

SEQ ID NO: 3736231 - DNA, 17 bp, Homo sapiens
gagaggacgtgggcggc

SEQ ID NO: 3736232 - DNA, 15 bp, Homo sapiens
gagaggagaaacaca

SEQ ID NO: 3736233 - DNA, 15 bp, Homo sapiens
gagaggcagagtgcc

SEQ ID NO: 3736234 - DNA, 16 bp, Homo sapiens
gagaggcagagtgccc

SEQ ID NO: 3736235 - DNA, 12 bp, Homo sapiens
gagaggccatga

SEQ ID NO: 3736236 - DNA, 18 bp, Homo sapiens
gagaggccttttggaatg

SEQ ID NO: 3736237 - DNA, 18 bp, Homo sapiens
gagagggaaacgtgccct

SEQ ID NO: 3736238 - DNA, 13 bp, Homo sapiens
gagaggggaacag

SEQ ID NO: 3736239 - DNA, 21 bp, Homo sapiens
gagaggggaataatagaagaa

SEQ ID NO: 3736240 - DNA, 18 bp, Homo sapiens
gagaggtcaagcccagga

SEQ ID NO: 3736241 - DNA, 18 bp, Homo sapiens
gagagtagccgagagcct

SEQ ID NO: 3736242 - DNA, 20 bp, Homo sapiens
gagagtagccgagagcctgc

SEQ ID NO: 3736243 - DNA, 15 bp, Homo sapiens
gagagtcttgcagtg

SEQ ID NO: 3736244 - DNA, 13 bp, Homo sapiens
gagagtggctcct

SEQ ID NO: 3736245 - DNA, 20 bp, Homo sapiens
gagagtgtgaaatagacatt

SEQ ID NO: 3736246 - DNA, 16 bp, Homo sapiens
gagatatggcagcgaa

SEQ ID NO: 3736247 - DNA, 22 bp, Homo sapiens
gagatatttatggggggagaac

SEQ ID NO: 3736248 - DNA, 22 bp, Homo sapiens
gatagcgttggaattaaaacaa

SEQ ID NO: 3736249 - DNA, 20 bp, Homo sapiens
gatagctttattttttaagt

SEQ ID NO: 3736250 - DNA, 20 bp, Homo sapiens
gataggcacatagagaggga

SEQ ID NO: 3736251 - DNA, 12 bp, Homo sapiens
gataggctctgc

SEQ ID NO: 3736252 - DNA, 20 bp, Homo sapiens
gataggctctgcacagatgg

SEQ ID NO: 3736253 - DNA, 18 bp, Homo sapiens
gatagtagcatacattta

SEQ ID NO: 3736254 - DNA, 16 bp, Homo sapiens
gatagtcaccttttaa

SEQ ID NO: 3736255 - DNA, 15 bp, Homo sapiens
gatataaataaaaca

SEQ ID NO: 3736256 - DNA, 23 bp, Homo sapiens
gatataggtcagtgaggcccagg

SEQ ID NO: 3736257 - DNA, 22 bp, Homo sapiens
gatatatgtgtttttcacattt

SEQ ID NO: 3736258 - DNA, 17 bp, Homo sapiens
gatatccctatgctgcc

SEQ ID NO: 3736259 - DNA, 23 bp, Homo sapiens
gatatccctatgctgcctaggct

SEQ ID NO: 3736260 - DNA, 15 bp, Homo sapiens
gatatctttttattg

SEQ ID NO: 3736261 - DNA, 19 bp, Homo sapiens
gatatgtaaacataattct

SEQ ID NO: 3736262 - DNA, 23 bp, Homo sapiens
gatattattcaccatgtaaaaca

SEQ ID NO: 3736263 - DNA, 18 bp, Homo sapiens
gatattccatgaatgtat

SEQ ID NO: 3736264 - DNA, 19 bp, Homo sapiens
gatattccatgaatgtatc

SEQ ID NO: 3736265 - DNA, 21 bp, Homo sapiens
gatattccatgaatgtatcag

SEQ ID NO: 3736266 - DNA, 16 bp, Homo sapiens
gatattgtgaagtaca

SEQ ID NO: 3736267 - DNA, 13 bp, Homo sapiens
gatatttaagaaa

SEQ ID NO: 3736268 - DNA, 15 bp, Homo sapiens
gatatttaagaaaat

SEQ ID NO: 3736269 - DNA, 20 bp, Homo sapiens
gatatttaagaaaatacaat

SEQ ID NO: 3736270 - DNA, 23 bp, Homo sapiens
gatatttaagaaaatacaataaa

SEQ ID NO: 3736271 - DNA, 23 bp, Homo sapiens
gatatttatatttttattttatt

SEQ ID NO: 3736272 - DNA, 19 bp, Homo sapiens
gatattttcaacgcagccc

SEQ ID NO: 3736273 - DNA, 20 bp, Homo sapiens
gatcaaaaggttaataaagt

SEQ ID NO: 3736274 - DNA, 21 bp, Homo sapiens
gatcaaccccttcgctcctgt

SEQ ID NO: 3736275 - DNA, 20 bp, Homo sapiens
gatcaagcaataataatttt

SEQ ID NO: 3736276 - DNA, 14 bp, Homo sapiens
gatcacagcctctg

SEQ ID NO: 3736277 - DNA, 19 bp, Homo sapiens
gatcacagcttcagccagg

SEQ ID NO: 3736278 - DNA, 23 bp, Homo sapiens
gatcacgccactgcactccagcc

SEQ ID NO: 3736279 - DNA, 20 bp, Homo sapiens
gatcacggctcactgcagcc

SEQ ID NO: 3736280 - DNA, 23 bp, Homo sapiens
gatcacggctcactgcagcctca

SEQ ID NO: 3736281 - DNA, 11 bp, Homo sapiens
gatcagaacag

SEQ ID NO: 3736282 - DNA, 15 bp, Homo sapiens
gatcagaacagcaga

SEQ ID NO: 3736283 - DNA, 17 bp, Homo sapiens
gatcagatgactagaaa

SEQ ID NO: 3736284 - DNA, 18 bp, Homo sapiens
gatcagccagtgaccaac

SEQ ID NO: 3736285 - DNA, 16 bp, Homo sapiens
gatcatagatttctga

SEQ ID NO: 3736286 - DNA, 19 bp, Homo sapiens
gatcatagatttctgattt

SEQ ID NO: 3736287 - DNA, 22 bp, Homo sapiens
gatcatagatttctgattttat

SEQ ID NO: 3736288 - DNA, 17 bp, Homo sapiens
gatcatccactgtgcca

SEQ ID NO: 3736289 - DNA, 15 bp, Homo sapiens
gatcatgcattgttg

SEQ ID NO: 3736290 - DNA, 14 bp, Homo sapiens
gatcatggctcact

SEQ ID NO: 3736291 - DNA, 18 bp, Homo sapiens
gatcattttccccccact

SEQ ID NO: 3736292 - DNA, 19 bp, Homo sapiens
gatcattttccccccactc

SEQ ID NO: 3736293 - DNA, 23 bp, Homo sapiens
gatcattttccccccactctccc

SEQ ID NO: 3736294 - DNA, 17 bp, Homo sapiens
gatccaagctggtccca

SEQ ID NO: 3736295 - DNA, 19 bp, Homo sapiens
gatccaagctggtcccact

SEQ ID NO: 3736296 - DNA, 14 bp, Homo sapiens
gatccacacacaga

SEQ ID NO: 3736297 - DNA, 19 bp, Homo sapiens
gatccacacacagaggaag

SEQ ID NO: 3736298 - DNA, 19 bp, Homo sapiens
gatccacccacctcagcct

SEQ ID NO: 3736299 - DNA, 20 bp, Homo sapiens
gatccacccacctcagcctc

SEQ ID NO: 3736300 - DNA, 14 bp, Homo sapiens
gatccacctgtctc

SEQ ID NO: 3736301 - DNA, 15 bp, Homo sapiens
gatccatccatctcc

SEQ ID NO: 3736302 - DNA, 22 bp, Homo sapiens
gatcccactcctaggacatgtt

SEQ ID NO: 3736303 - DNA, 17 bp, Homo sapiens
gatcccagctcacgtca

SEQ ID NO: 3736304 - DNA, 18 bp, Homo sapiens
gatcctaagggctcaccg

SEQ ID NO: 3736305 - DNA, 23 bp, Homo sapiens
gatcctaatgaatgcataaaatg

SEQ ID NO: 3736306 - DNA, 21 bp, Homo sapiens
gatcctcccacctcagcctcc

SEQ ID NO: 3736307 - DNA, 23 bp, Homo sapiens
gatcctgggtggtctgcaggcag

SEQ ID NO: 3736308 - DNA, 16 bp, Homo sapiens
gatcctgtctttaagg

SEQ ID NO: 3736309 - DNA, 19 bp, Homo sapiens
gatcctgtctttaaggaaa

SEQ ID NO: 3736310 - DNA, 23 bp, Homo sapiens
gatcgcgccactacactccagcc

SEQ ID NO: 3736311 - DNA, 17 bp, Homo sapiens
gatcgcgccactgcact

SEQ ID NO: 3736312 - DNA, 23 bp, Homo sapiens
gatcgtgccgttactctccaacc

SEQ ID NO: 3736313 - DNA, 18 bp, Homo sapiens
gatctcagggaagcccag

SEQ ID NO: 3736314 - DNA, 21 bp, Homo sapiens
gatctcattcagtattaaagg

SEQ ID NO: 3736315 - DNA, 13 bp, Homo sapiens
gatctccaaagct

SEQ ID NO: 3736316 - DNA, 17 bp, Homo sapiens
gatctccatatgttaca

SEQ ID NO: 3736317 - DNA, 13 bp, Homo sapiens
gatctcccagggc

SEQ ID NO: 3736318 - DNA, 12 bp, Homo sapiens
gatctccctgcc

SEQ ID NO: 3736319 - DNA, 20 bp, Homo sapiens
gatctccctgccgcctcaat

SEQ ID NO: 3736320 - DNA, 12 bp, Homo sapiens
gatctcttgagc

SEQ ID NO: 3736321 - DNA, 17 bp, Homo sapiens
gatctcttgagcctggg

SEQ ID NO: 3736322 - DNA, 18 bp, Homo sapiens
gatctcttgagcctggga

SEQ ID NO: 3736323 - DNA, 19 bp, Homo sapiens
gatctcttgagcctgggag

SEQ ID NO: 3736324 - DNA, 18 bp, Homo sapiens
gatctggggctctgggat

SEQ ID NO: 3736325 - DNA, 18 bp, Homo sapiens
gatctgtgccccatgcct

SEQ ID NO: 3736326 - DNA, 23 bp, Homo sapiens
gatctgtttttaaaaatcataaa

SEQ ID NO: 3736327 - DNA, 15 bp, Homo sapiens
gatcttgtgctcagc

SEQ ID NO: 3736328 - DNA, 22 bp, Homo sapiens
gatctttcacccacagaaagag

SEQ ID NO: 3736329 - DNA, 16 bp, Homo sapiens
gatctttgcagacagg

SEQ ID NO: 3736330 - DNA, 14 bp, Homo sapiens
gatgaaaaatagca

SEQ ID NO: 3736331 - DNA, 21 bp, Homo sapiens
gatgaaatgaggtcagagcct

SEQ ID NO: 3736332 - DNA, 16 bp, Homo sapiens
gatgaaatgtaaatac

SEQ ID NO: 3736333 - DNA, 19 bp, Homo sapiens
gatgaactctttctggcct

SEQ ID NO: 3736334 - DNA, 21 bp, Homo sapiens
gatgaagagtgagagggcatg

SEQ ID NO: 3736335 - DNA, 15 bp, Homo sapiens
gatgaagcaaacaca

SEQ ID NO: 3736336 - DNA, 13 bp, Homo sapiens
gatgaatcttgcg

SEQ ID NO: 3736337 - DNA, 23 bp, Homo sapiens
gatgaatgaggtcccaggcagag

SEQ ID NO: 3736338 - DNA, 16 bp, Homo sapiens
gatgaattaaatttaa

SEQ ID NO: 3736339 - DNA, 16 bp, Homo sapiens
gatgacccctccccta

SEQ ID NO: 3736340 - DNA, 17 bp, Homo sapiens
gatgacccctcccctaa

SEQ ID NO: 3736341 - DNA, 21 bp, Homo sapiens
gatgacgacgacaacgatgat

SEQ ID NO: 3736342 - DNA, 15 bp, Homo sapiens
gatgactaaaatatt

SEQ ID NO: 3736343 - DNA, 12 bp, Homo sapiens
gatgactgagtc

SEQ ID NO: 3736344 - DNA, 22 bp, Homo sapiens
gatgactggaatttttattatg

SEQ ID NO: 3736345 - DNA, 11 bp, Homo sapiens
gatgagaaagg

SEQ ID NO: 3736346 - DNA, 23 bp, Homo sapiens
gatgagaaataaagtttctgttg

SEQ ID NO: 3736347 - DNA, 22 bp, Homo sapiens
gatgagcatttagggcaaggag

SEQ ID NO: 3736348 - DNA, 20 bp, Homo sapiens
gatgagcccagccctgttct

SEQ ID NO: 3736349 - DNA, 21 bp, Homo sapiens
gatgagcccagccctgttctg

SEQ ID NO: 3736350 - DNA, 16 bp, Homo sapiens
gatgaggtgctgggag

SEQ ID NO: 3736351 - DNA, 17 bp, Homo sapiens
gatgagtgtaacaagaa

SEQ ID NO: 3736352 - DNA, 19 bp, Homo sapiens
gatgatcagctgtttgtca

SEQ ID NO: 3736353 - DNA, 23 bp, Homo sapiens
gatgatccatgagtttgccctgg

SEQ ID NO: 3736354 - DNA, 18 bp, Homo sapiens
gatgcaaggaccaggact

SEQ ID NO: 3736355 - DNA, 14 bp, Homo sapiens
gatgcaccagccct

SEQ ID NO: 3736356 - DNA, 17 bp, Homo sapiens
gatgccacacagagtgg

SEQ ID NO: 3736357 - DNA, 17 bp, Homo sapiens
gatgccatctgtgtcct

SEQ ID NO: 3736358 - DNA, 18 bp, Homo sapiens
gatgccatctgtgtcctg

SEQ ID NO: 3736359 - DNA, 20 bp, Homo sapiens
gatgccatctgtgtcctggt

SEQ ID NO: 3736360 - DNA, 13 bp, Homo sapiens
gcagctaaaacct

SEQ ID NO: 3736361 - DNA, 14 bp, Homo sapiens
gcagctagttttct

SEQ ID NO: 3736362 - DNA, 15 bp, Homo sapiens
gcagctctccccttc

SEQ ID NO: 3736363 - DNA, 13 bp, Homo sapiens
gcagctgcttttg

SEQ ID NO: 3736364 - DNA, 14 bp, Homo sapiens
gcaggaagctcaga

SEQ ID NO: 3736365 - DNA, 16 bp, Homo sapiens
gcaggaagctgctccg

SEQ ID NO: 3736366 - DNA, 16 bp, Homo sapiens
gcaggaaggagagcct

SEQ ID NO: 3736367 - DNA, 15 bp, Homo sapiens
gcaggacctcagagt

SEQ ID NO: 3736368 - DNA, 14 bp, Homo sapiens
gcaggagcctgagc

SEQ ID NO: 3736369 - DNA, 14 bp, Homo sapiens
gcaggagctcagat

SEQ ID NO: 3736370 - DNA, 13 bp, Homo sapiens
gcaggaggggagt

SEQ ID NO: 3736371 - DNA, 21 bp, Homo sapiens
gcaggatagttgctccgcctc

SEQ ID NO: 3736372 - DNA, 20 bp, Homo sapiens
gcaggattcttcctccctcc

SEQ ID NO: 3736373 - DNA, 15 bp, Homo sapiens
gcaggcacatggagg

SEQ ID NO: 3736374 - DNA, 9 bp, Homo sapiens
gcaggcagt

SEQ ID NO: 3736375 - DNA, 22 bp, Homo sapiens
gcaggccaagagcagaggcagc

SEQ ID NO: 3736376 - DNA, 24 bp, Homo sapiens
gcaggccaagagcagaggcagcga

SEQ ID NO: 3736377 - DNA, 15 bp, Homo sapiens
gcaggctggctggcc

SEQ ID NO: 3736378 - DNA, 22 bp, Homo sapiens
gcagggaaacagctaatgggac

SEQ ID NO: 3736379 - DNA, 14 bp, Homo sapiens
gcagggaggggact

SEQ ID NO: 3736380 - DNA, 15 bp, Homo sapiens
gcagggcatctcctg

SEQ ID NO: 3736381 - DNA, 21 bp, Homo sapiens
gcagggcatctcctgtgcatg

SEQ ID NO: 3736382 - DNA, 21 bp, Homo sapiens
gcagggccttgcccagagatg

SEQ ID NO: 3736383 - DNA, 21 bp, Homo sapiens
gcagggctcagcggggacagc

SEQ ID NO: 3736384 - DNA, 23 bp, Homo sapiens
gcaggggtggaggagagcctggt

SEQ ID NO: 3736385 - DNA, 16 bp, Homo sapiens
gcagggtctcactctg

SEQ ID NO: 3736386 - DNA, 15 bp, Homo sapiens
gcagggtgggatgga

SEQ ID NO: 3736387 - DNA, 20 bp, Homo sapiens
gcaggtcttgaactcctggc

SEQ ID NO: 3736388 - DNA, 13 bp, Homo sapiens
gcaggtggggagg

SEQ ID NO: 3736389 - DNA, 17 bp, Homo sapiens
gcaggtggggagggggt

SEQ ID NO: 3736390 - DNA, 16 bp, Homo sapiens
gcagtaaagagaaact

SEQ ID NO: 3736391 - DNA, 19 bp, Homo sapiens
gcagtagaaataatatgca

SEQ ID NO: 3736392 - DNA, 20 bp, Homo sapiens
gcagtagaaataatatgcat

SEQ ID NO: 3736393 - DNA, 22 bp, Homo sapiens
gcagtcatcttgaccaagcagg

SEQ ID NO: 3736394 - DNA, 14 bp, Homo sapiens
gcagtctggagggg

SEQ ID NO: 3736395 - DNA, 22 bp, Homo sapiens
gcagtgactgtggccatggtcc

SEQ ID NO: 3736396 - DNA, 14 bp, Homo sapiens
gcagtgagctgtgt

SEQ ID NO: 3736397 - DNA, 22 bp, Homo sapiens
gcagtgattaaggtctctcttt

SEQ ID NO: 3736398 - DNA, 14 bp, Homo sapiens
gcagtgatttttat

SEQ ID NO: 3736399 - DNA, 21 bp, Homo sapiens
gcagtgcagcaaccagagcac

SEQ ID NO: 3736400 - DNA, 23 bp, Homo sapiens
gcagtgcttccaaggatggacca

SEQ ID NO: 3736401 - DNA, 16 bp, Homo sapiens
gcagtgcttctctaca

SEQ ID NO: 3736402 - DNA, 15 bp, Homo sapiens
gcagtggacaccagg

SEQ ID NO: 3736403 - DNA, 14 bp, Homo sapiens
gcagtggagaggga

SEQ ID NO: 3736404 - DNA, 16 bp, Homo sapiens
gcagtggaggtgctgc

SEQ ID NO: 3736405 - DNA, 16 bp, Homo sapiens
gcagtggctcacgcct

SEQ ID NO: 3736406 - DNA, 21 bp, Homo sapiens
gcagtggtgcgatcatggctc

SEQ ID NO: 3736407 - DNA, 19 bp, Homo sapiens
gcagtggtgcgatctgggt

SEQ ID NO: 3736408 - DNA, 22 bp, Homo sapiens
gcagtggtgcgatctgggttca

SEQ ID NO: 3736409 - DNA, 20 bp, Homo sapiens
gcagtgtcttccataatgta

SEQ ID NO: 3736410 - DNA, 17 bp, Homo sapiens
gcagttcagcaccaccc

SEQ ID NO: 3736411 - DNA, 18 bp, Homo sapiens
gcagttctgcaaatagaa

SEQ ID NO: 3736412 - DNA, 15 bp, Homo sapiens
gcataaaattggatt

SEQ ID NO: 3736413 - DNA, 14 bp, Homo sapiens
gcataactgacaaa

SEQ ID NO: 3736414 - DNA, 13 bp, Homo sapiens
gcatacaatctga

SEQ ID NO: 3736415 - DNA, 17 bp, Homo sapiens
gcatacatttataatgt

SEQ ID NO: 3736416 - DNA, 14 bp, Homo sapiens
gcatagaaggagga

SEQ ID NO: 3736417 - DNA, 12 bp, Homo sapiens
gcataggcctgg

SEQ ID NO: 3736418 - DNA, 17 bp, Homo sapiens
gcataggcctgggtgct

SEQ ID NO: 3736419 - DNA, 22 bp, Homo sapiens
gcataggcctgggtgctggctg

SEQ ID NO: 3736420 - DNA, 18 bp, Homo sapiens
gcatagttcccatgttaa

SEQ ID NO: 3736421 - DNA, 16 bp, Homo sapiens
gcatatcctgagccat

SEQ ID NO: 3736422 - DNA, 15 bp, Homo sapiens
gcatatgtatgactc

SEQ ID NO: 3736423 - DNA, 19 bp, Homo sapiens
gcatattgttattatataa

SEQ ID NO: 3736424 - DNA, 17 bp, Homo sapiens
gcatcaatcctgtgtgg

SEQ ID NO: 3736425 - DNA, 19 bp, Homo sapiens
gcatcaatcctgtgtggtt

SEQ ID NO: 3736426 - DNA, 21 bp, Homo sapiens
gcatcacagggcagagccggg

SEQ ID NO: 3736427 - DNA, 12 bp, Homo sapiens
gcatccattcct

SEQ ID NO: 3736428 - DNA, 21 bp, Homo sapiens
gcatccattcctcagggacag

SEQ ID NO: 3736429 - DNA, 14 bp, Homo sapiens
gcatcccagtggcc

SEQ ID NO: 3736430 - DNA, 23 bp, Homo sapiens
gcatcccagtggcctcaaccctc

SEQ ID NO: 3736431 - DNA, 19 bp, Homo sapiens
gcatccgtagttccctgaa

SEQ ID NO: 3736432 - DNA, 17 bp, Homo sapiens
gcatcctggcacccggc

SEQ ID NO: 3736433 - DNA, 21 bp, Homo sapiens
gcatcctggcacccggcccct

SEQ ID NO: 3736434 - DNA, 23 bp, Homo sapiens
gcatcctggcacccggcccctgc

SEQ ID NO: 3736435 - DNA, 12 bp, Homo sapiens
gcatctcagccc

SEQ ID NO: 3736436 - DNA, 14 bp, Homo sapiens
gcatctcctgagga

SEQ ID NO: 3736437 - DNA, 16 bp, Homo sapiens
gcatctcttgaggcca

SEQ ID NO: 3736438 - DNA, 20 bp, Homo sapiens
gcatctcttgaggccaggag

SEQ ID NO: 3736439 - DNA, 11 bp, Homo sapiens
gcatctggcct

SEQ ID NO: 3736440 - DNA, 15 bp, Homo sapiens
gcatctttgccttgg

SEQ ID NO: 3736441 - DNA, 18 bp, Homo sapiens
gcatctttgccttgggct

SEQ ID NO: 3736442 - DNA, 19 bp, Homo sapiens
gcatgacaagccccaggca

SEQ ID NO: 3736443 - DNA, 17 bp, Homo sapiens
gcatgacctgtgaccag

SEQ ID NO: 3736444 - DNA, 20 bp, Homo sapiens
gcatgagggatcacagggcc

SEQ ID NO: 3736445 - DNA, 14 bp, Homo sapiens
gcatgattctttaa

SEQ ID NO: 3736446 - DNA, 12 bp, Homo sapiens
gcatgcagcagc

SEQ ID NO: 3736447 - DNA, 17 bp, Homo sapiens
gcatgcagcagcttgct

SEQ ID NO: 3736448 - DNA, 14 bp, Homo sapiens
gcatgcattttgca

SEQ ID NO: 3736449 - DNA, 21 bp, Homo sapiens
gcatgcgcacaaggctgacca

SEQ ID NO: 3736450 - DNA, 18 bp, Homo sapiens
gcatgctctctgcagcca

SEQ ID NO: 3736451 - DNA, 22 bp, Homo sapiens
gcatgctctctgcagccagccc

SEQ ID NO: 3736452 - DNA, 15 bp, Homo sapiens
gcatgctggggcaag

SEQ ID NO: 3736453 - DNA, 17 bp, Homo sapiens
gcatgctggtgagccaa

SEQ ID NO: 3736454 - DNA, 16 bp, Homo sapiens
gcatggacctaacatt

SEQ ID NO: 3736455 - DNA, 14 bp, Homo sapiens
gcatggcagcaggc

SEQ ID NO: 3736456 - DNA, 17 bp, Homo sapiens
gcatggccagcagcttg

SEQ ID NO: 3736457 - DNA, 15 bp, Homo sapiens
gcatggctccagtct

SEQ ID NO: 3736458 - DNA, 22 bp, Homo sapiens
gcatgtaccctaaggtcattac

SEQ ID NO: 3736459 - DNA, 14 bp, Homo sapiens
gcatgtaggagaat

SEQ ID NO: 3736460 - DNA, 21 bp, Homo sapiens
gcatgtgtatttccagtgcaa

SEQ ID NO: 3736461 - DNA, 19 bp, Homo sapiens
gcatgtgtttggttctggg

SEQ ID NO: 3736462 - DNA, 18 bp, Homo sapiens
gcatgttacctcctataa

SEQ ID NO: 3736463 - DNA, 14 bp, Homo sapiens
gcatgttctctgag

SEQ ID NO: 3736464 - DNA, 18 bp, Homo sapiens
gcattaactaatctattg

SEQ ID NO: 3736465 - DNA, 16 bp, Homo sapiens
gcattactcttgtaag

SEQ ID NO: 3736466 - DNA, 18 bp, Homo sapiens
gcattactcttgtaagat

SEQ ID NO: 3736467 - DNA, 13 bp, Homo sapiens
gcattagaaatta

SEQ ID NO: 3736468 - DNA, 15 bp, Homo sapiens
gcattatataccatt

SEQ ID NO: 3736469 - DNA, 19 bp, Homo sapiens
gcattatataccatttatc

SEQ ID NO: 3736470 - DNA, 22 bp, Homo sapiens
gcattcaatttattcaagaaaa

SEQ ID NO: 3736471 - DNA, 12 bp, Homo sapiens
gcattccaggct

SEQ ID NO: 3736472 - DNA, 21 bp, Homo sapiens
gcattccctgagtcaccagga

SEQ ID NO: 3736473 - DNA, 16 bp, Homo sapiens
gccgagatcacgccac

SEQ ID NO: 3736474 - DNA, 18 bp, Homo sapiens
gccgagatcacgccactg

SEQ ID NO: 3736475 - DNA, 20 bp, Homo sapiens
gccgagatcacgccactgca

SEQ ID NO: 3736476 - DNA, 20 bp, Homo sapiens
gccgagggtcctggctcctg

SEQ ID NO: 3736477 - DNA, 18 bp, Homo sapiens
gccgcagcctccctctga

SEQ ID NO: 3736478 - DNA, 15 bp, Homo sapiens
gccgcattccctgag

SEQ ID NO: 3736479 - DNA, 16 bp, Homo sapiens
gccgcattccctgagt

SEQ ID NO: 3736480 - DNA, 20 bp, Homo sapiens
gccgccaggaccgccaaaga

SEQ ID NO: 3736481 - DNA, 15 bp, Homo sapiens
gccgccatgctcctg

SEQ ID NO: 3736482 - DNA, 18 bp, Homo sapiens
gccgccattgccaccagg

SEQ ID NO: 3736483 - DNA, 11 bp, Homo sapiens
gccgccctgta

SEQ ID NO: 3736484 - DNA, 12 bp, Homo sapiens
gccgcctcccag

SEQ ID NO: 3736485 - DNA, 13 bp, Homo sapiens
gccgcctcccagc

SEQ ID NO: 3736486 - DNA, 17 bp, Homo sapiens
gccgctgttcacccaca

SEQ ID NO: 3736487 - DNA, 15 bp, Homo sapiens
gccggccagctggga

SEQ ID NO: 3736488 - DNA, 22 bp, Homo sapiens
gccgggaacagacaacagaagt

SEQ ID NO: 3736489 - DNA, 13 bp, Homo sapiens
gccgggcacagct

SEQ ID NO: 3736490 - DNA, 17 bp, Homo sapiens
gccgggcacagctgtgg

SEQ ID NO: 3736491 - DNA, 17 bp, Homo sapiens
gccggggcctgcctagc

SEQ ID NO: 3736492 - DNA, 19 bp, Homo sapiens
gccgtagggagtacctgct

SEQ ID NO: 3736493 - DNA, 21 bp, Homo sapiens
gccgtagggagtacctgctgc

SEQ ID NO: 3736494 - DNA, 11 bp, Homo sapiens
gccgtctcaac

SEQ ID NO: 3736495 - DNA, 14 bp, Homo sapiens
gccgtgccctgccc

SEQ ID NO: 3736496 - DNA, 14 bp, Homo sapiens
gccgtgccttcagc

SEQ ID NO: 3736497 - DNA, 19 bp, Homo sapiens
gccgtggcttcccgctcag

SEQ ID NO: 3736498 - DNA, 23 bp, Homo sapiens
gccgtgggcctgtcgtgccagtc

SEQ ID NO: 3736499 - DNA, 20 bp, Homo sapiens
gccgtgtaaccatggaccca

SEQ ID NO: 3736500 - DNA, 22 bp, Homo sapiens
gccgtgtgtgtgcgtcctgtcg

SEQ ID NO: 3736501 - DNA, 18 bp, Homo sapiens
gccgttgaagaggaaggg

SEQ ID NO: 3736502 - DNA, 20 bp, Homo sapiens
gccgttgccaagaactgaaa

SEQ ID NO: 3736503 - DNA, 14 bp, Homo sapiens
gcctaaaaatgcaa

SEQ ID NO: 3736504 - DNA, 19 bp, Homo sapiens
gcctaatacattaaagcag

SEQ ID NO: 3736505 - DNA, 21 bp, Homo sapiens
gcctaatacattaaagcagtc

SEQ ID NO: 3736506 - DNA, 14 bp, Homo sapiens
gcctacagatgaac

SEQ ID NO: 3736507 - DNA, 16 bp, Homo sapiens
gcctacaggagtgagc

SEQ ID NO: 3736508 - DNA, 17 bp, Homo sapiens
gcctacaggagtgagca

SEQ ID NO: 3736509 - DNA, 20 bp, Homo sapiens
gcctagatccacacacagag

SEQ ID NO: 3736510 - DNA, 23 bp, Homo sapiens
gcctagatccacacacagaggaa

SEQ ID NO: 3736511 - DNA, 16 bp, Homo sapiens
gcctagccgacctcag

SEQ ID NO: 3736512 - DNA, 19 bp, Homo sapiens
gcctagccgacctcagcct

SEQ ID NO: 3736513 - DNA, 13 bp, Homo sapiens
gcctaggtgacag

SEQ ID NO: 3736514 - DNA, 22 bp, Homo sapiens
gcctagtcagccacatgggaaa

SEQ ID NO: 3736515 - DNA, 18 bp, Homo sapiens
gcctagtggggtctccct

SEQ ID NO: 3736516 - DNA, 22 bp, Homo sapiens
gcctagtggggtctccctctcc

SEQ ID NO: 3736517 - DNA, 15 bp, Homo sapiens
gcctcaaccctccct

SEQ ID NO: 3736518 - DNA, 19 bp, Homo sapiens
gcctcaaccctccctcagc

SEQ ID NO: 3736519 - DNA, 23 bp, Homo sapiens
gcctcaaccctccctcagcccct

SEQ ID NO: 3736520 - DNA, 19 bp, Homo sapiens
gcctcaacctcctgggcta

SEQ ID NO: 3736521 - DNA, 13 bp, Homo sapiens
gcctcaaggactt

SEQ ID NO: 3736522 - DNA, 15 bp, Homo sapiens
gcctcacagaagaat

SEQ ID NO: 3736523 - DNA, 16 bp, Homo sapiens
gcctcactccaggaag

SEQ ID NO: 3736524 - DNA, 17 bp, Homo sapiens
gcctcagcatcctggca

SEQ ID NO: 3736525 - DNA, 22 bp, Homo sapiens
gcctcagcctcccaaagtgctg

SEQ ID NO: 3736526 - DNA, 14 bp, Homo sapiens
gcctcagctgcctc

SEQ ID NO: 3736527 - DNA, 15 bp, Homo sapiens
gcctcagctgcctca

SEQ ID NO: 3736528 - DNA, 16 bp, Homo sapiens
gcctcagctgcctcac

SEQ ID NO: 3736529 - DNA, 20 bp, Homo sapiens
gcctcagctgcctcacttcc

SEQ ID NO: 3736530 - DNA, 12 bp, Homo sapiens
gcctcagtgcca

SEQ ID NO: 3736531 - DNA, 14 bp, Homo sapiens
gcctcagtgccact

SEQ ID NO: 3736532 - DNA, 11 bp, Homo sapiens
gcctcagtgga

SEQ ID NO: 3736533 - DNA, 22 bp, Homo sapiens
gcctcagtggactttccacccc

SEQ ID NO: 3736534 - DNA, 18 bp, Homo sapiens
gcctcatccgaggcaggg

SEQ ID NO: 3736535 - DNA, 17 bp, Homo sapiens
gcctccaagctccatct

SEQ ID NO: 3736536 - DNA, 12 bp, Homo sapiens
gcctccaccgct

SEQ ID NO: 3736537 - DNA, 17 bp, Homo sapiens
gcctccattcctggagc

SEQ ID NO: 3736538 - DNA, 17 bp, Homo sapiens
gcctccatttagttctt

SEQ ID NO: 3736539 - DNA, 17 bp, Homo sapiens
gcctcccacccccatct

SEQ ID NO: 3736540 - DNA, 14 bp, Homo sapiens
gcctcccacgactg

SEQ ID NO: 3736541 - DNA, 17 bp, Homo sapiens
gcctccccaaccctgcc

SEQ ID NO: 3736542 - DNA, 18 bp, Homo sapiens
gcctcccgaatagctggg

SEQ ID NO: 3736543 - DNA, 19 bp, Homo sapiens
gcctcccgaatagctggga

SEQ ID NO: 3736544 - DNA, 21 bp, Homo sapiens
gcctcccgaatagctgggact

SEQ ID NO: 3736545 - DNA, 23 bp, Homo sapiens
gcctcccgaatagctgggactac

SEQ ID NO: 3736546 - DNA, 17 bp, Homo sapiens
gcctcccgagtagctgg

SEQ ID NO: 3736547 - DNA, 20 bp, Homo sapiens
gcctcccgagtagctgggac

SEQ ID NO: 3736548 - DNA, 16 bp, Homo sapiens
gcctccctcccctgcc

SEQ ID NO: 3736549 - DNA, 16 bp, Homo sapiens
gcctccctctctcttc

SEQ ID NO: 3736550 - DNA, 22 bp, Homo sapiens
gcctccctctctcttctgctcc

SEQ ID NO: 3736551 - DNA, 12 bp, Homo sapiens
gcctccctctga

SEQ ID NO: 3736552 - DNA, 14 bp, Homo sapiens
gcctccctctgacc

SEQ ID NO: 3736553 - DNA, 23 bp, Homo sapiens
gcctccctgaccctgcagagatg

SEQ ID NO: 3736554 - DNA, 16 bp, Homo sapiens
gcctccgtatttcaga

SEQ ID NO: 3736555 - DNA, 19 bp, Homo sapiens
gcctcctcacccccagctt

SEQ ID NO: 3736556 - DNA, 16 bp, Homo sapiens
gcctcctctaacaggg

SEQ ID NO: 3736557 - DNA, 16 bp, Homo sapiens
gcctcctctgtccagg

SEQ ID NO: 3736558 - DNA, 13 bp, Homo sapiens
gcctcctgtgtgt

SEQ ID NO: 3736559 - DNA, 19 bp, Homo sapiens
gcctcctgtgtgtgcgcct

SEQ ID NO: 3736560 - DNA, 22 bp, Homo sapiens
gcctcgaactggctgcaaaggg

SEQ ID NO: 3736561 - DNA, 14 bp, Homo sapiens
gcctctccctggcc

SEQ ID NO: 3736562 - DNA, 19 bp, Homo sapiens
gcctctcggtggccagcag

SEQ ID NO: 3736563 - DNA, 19 bp, Homo sapiens
gcctctcttggtttccttc

SEQ ID NO: 3736564 - DNA, 18 bp, Homo sapiens
gcctctgacacacagctc

SEQ ID NO: 3736565 - DNA, 19 bp, Homo sapiens
gcctctggaggcctctggg

SEQ ID NO: 3736566 - DNA, 19 bp, Homo sapiens
gcctctgtcatatcttcac

SEQ ID NO: 3736567 - DNA, 17 bp, Homo sapiens
gcctcttctagagccgt

SEQ ID NO: 3736568 - DNA, 16 bp, Homo sapiens
gcctcttcttcttcag

SEQ ID NO: 3736569 - DNA, 21 bp, Homo sapiens
gcctcttcttcttcagaagac

SEQ ID NO: 3736570 - DNA, 14 bp, Homo sapiens
gcctgaaccttcca

SEQ ID NO: 3736571 - DNA, 15 bp, Homo sapiens
gcctgaaccttccat

SEQ ID NO: 3736572 - DNA, 22 bp, Homo sapiens
gcctgaagtcacacagtgagtc

SEQ ID NO: 3736573 - DNA, 18 bp, Homo sapiens
gcctgaagttggagtgag

SEQ ID NO: 3736574 - DNA, 15 bp, Homo sapiens
gcctgacctccccct

SEQ ID NO: 3736575 - DNA, 19 bp, Homo sapiens
gcctgacctccccctcctt

SEQ ID NO: 3736576 - DNA, 18 bp, Homo sapiens
gcctgagcacctcccagc

SEQ ID NO: 3736577 - DNA, 23 bp, Homo sapiens
gcctgagcacctcccagcccctg

SEQ ID NO: 3736578 - DNA, 16 bp, Homo sapiens
gcctgaggagcagcag

SEQ ID NO: 3736579 - DNA, 15 bp, Homo sapiens
gcctgaggctgagac

SEQ ID NO: 3736580 - DNA, 17 bp, Homo sapiens
gcctgatgctccctccc

SEQ ID NO: 3736581 - DNA, 20 bp, Homo sapiens
gcctgatgctccctcccctg

SEQ ID NO: 3736582 - DNA, 12 bp, Homo sapiens
gcctgcaccagg

SEQ ID NO: 3736583 - DNA, 11 bp, Homo sapiens
gcctgcagccc

SEQ ID NO: 3736584 - DNA, 10 bp, Homo sapiens
gcctgcccac

SEQ ID NO: 3736585 - DNA, 13 bp, Homo sapiens
gcctgcccacccg

SEQ ID NO: 3736586 - DNA, 18 bp, Homo sapiens
gctcaggggcgtgtggct

SEQ ID NO: 3736587 - DNA, 19 bp, Homo sapiens
gctcaggtacagagaagga

SEQ ID NO: 3736588 - DNA, 16 bp, Homo sapiens
gctcagtaatttgagg

SEQ ID NO: 3736589 - DNA, 20 bp, Homo sapiens
gctcagtctcaggagcatgg

SEQ ID NO: 3736590 - DNA, 21 bp, Homo sapiens
gctcagtctcaggagcatggg

SEQ ID NO: 3736591 - DNA, 23 bp, Homo sapiens
gctcagtcttccctagggctggg

SEQ ID NO: 3736592 - DNA, 22 bp, Homo sapiens
gctcatattcctgcagcctgga

SEQ ID NO: 3736593 - DNA, 17 bp, Homo sapiens
gctcatgcatagtccca

SEQ ID NO: 3736594 - DNA, 18 bp, Homo sapiens
gctcatgcatagtcccag

SEQ ID NO: 3736595 - DNA, 22 bp, Homo sapiens
gctccacaccctctcccaggac

SEQ ID NO: 3736596 - DNA, 23 bp, Homo sapiens
gctccacaccctctcccaggacc

SEQ ID NO: 3736597 - DNA, 14 bp, Homo sapiens
gctccacccttggc

SEQ ID NO: 3736598 - DNA, 19 bp, Homo sapiens
gctccacccttggcctgtc

SEQ ID NO: 3736599 - DNA, 23 bp, Homo sapiens
gctccacccttggcctgtctcat

SEQ ID NO: 3736600 - DNA, 21 bp, Homo sapiens
gctccactctgactggcacag

SEQ ID NO: 3736601 - DNA, 23 bp, Homo sapiens
gctccagacccccagcaaccctc

SEQ ID NO: 3736602 - DNA, 14 bp, Homo sapiens
gctccagccaaccc

SEQ ID NO: 3736603 - DNA, 22 bp, Homo sapiens
gctccagccaacccctgtggag

SEQ ID NO: 3736604 - DNA, 23 bp, Homo sapiens
gctccagccaacccctgtggagc

SEQ ID NO: 3736605 - DNA, 21 bp, Homo sapiens
gctccagctcaccagccccag

SEQ ID NO: 3736606 - DNA, 18 bp, Homo sapiens
gctccagtcctgctctct

SEQ ID NO: 3736607 - DNA, 19 bp, Homo sapiens
gctcccacagaacacagca

SEQ ID NO: 3736608 - DNA, 16 bp, Homo sapiens
gctcccacaggccctt

SEQ ID NO: 3736609 - DNA, 22 bp, Homo sapiens
gctcccacaggcccttcctctc

SEQ ID NO: 3736610 - DNA, 22 bp, Homo sapiens
gctcccagggccatgaactttg

SEQ ID NO: 3736611 - DNA, 13 bp, Homo sapiens
gctccccagccca

SEQ ID NO: 3736612 - DNA, 16 bp, Homo sapiens
gctccccagcccaggg

SEQ ID NO: 3736613 - DNA, 14 bp, Homo sapiens
gctcccccaccccc

SEQ ID NO: 3736614 - DNA, 15 bp, Homo sapiens
gctcccccaccccct

SEQ ID NO: 3736615 - DNA, 18 bp, Homo sapiens
gctcccccatcctcccct

SEQ ID NO: 3736616 - DNA, 20 bp, Homo sapiens
gctcccccatcctccccttc

SEQ ID NO: 3736617 - DNA, 15 bp, Homo sapiens
gctcccctccctcct

SEQ ID NO: 3736618 - DNA, 21 bp, Homo sapiens
gctcccctctatttagcatga

SEQ ID NO: 3736619 - DNA, 24 bp, Homo sapiens
gctcccgggactcactggcagccc

SEQ ID NO: 3736620 - DNA, 19 bp, Homo sapiens
gctccctcccctgccctgg

SEQ ID NO: 3736621 - DNA, 20 bp, Homo sapiens
gctccctcccctgccctggt

SEQ ID NO: 3736622 - DNA, 13 bp, Homo sapiens
gctccctctgcct

SEQ ID NO: 3736623 - DNA, 17 bp, Homo sapiens
gctccgcctctgctggc

SEQ ID NO: 3736624 - DNA, 19 bp, Homo sapiens
gctcctcatggtgggttca

SEQ ID NO: 3736625 - DNA, 23 bp, Homo sapiens
gctcctccagggccacgtgccag

SEQ ID NO: 3736626 - DNA, 16 bp, Homo sapiens
gctcctcccggtgccc

SEQ ID NO: 3736627 - DNA, 19 bp, Homo sapiens
gctcctcccggtgcccaag

SEQ ID NO: 3736628 - DNA, 16 bp, Homo sapiens
gctcctctccccagca

SEQ ID NO: 3736629 - DNA, 12 bp, Homo sapiens
gctcctctgggc

SEQ ID NO: 3736630 - DNA, 13 bp, Homo sapiens
gctcctctgggca

SEQ ID NO: 3736631 - DNA, 23 bp, Homo sapiens
gctcctgaggggcatctgcccct

SEQ ID NO: 3736632 - DNA, 21 bp, Homo sapiens
gctcctggaaaggctcagtct

SEQ ID NO: 3736633 - DNA, 19 bp, Homo sapiens
gctcctggcccactgcatc

SEQ ID NO: 3736634 - DNA, 23 bp, Homo sapiens
gctcctgggggttctttcttcct

SEQ ID NO: 3736635 - DNA, 22 bp, Homo sapiens
gctcctggtatgggtttctccc

SEQ ID NO: 3736636 - DNA, 16 bp, Homo sapiens
gctcctgtctgccagc

SEQ ID NO: 3736637 - DNA, 17 bp, Homo sapiens
gctcctgtctgccagcc

SEQ ID NO: 3736638 - DNA, 16 bp, Homo sapiens
gctccttagctgccaa

SEQ ID NO: 3736639 - DNA, 19 bp, Homo sapiens
gctccttagctgccaagcc

SEQ ID NO: 3736640 - DNA, 19 bp, Homo sapiens
gctccttcctgtcttcctg

SEQ ID NO: 3736641 - DNA, 15 bp, Homo sapiens
gctccttctgtccta

SEQ ID NO: 3736642 - DNA, 17 bp, Homo sapiens
gctcctttagcgcccag

SEQ ID NO: 3736643 - DNA, 17 bp, Homo sapiens
gctcgagcagtcctgcc

SEQ ID NO: 3736644 - DNA, 14 bp, Homo sapiens
gctcggtggaccca

SEQ ID NO: 3736645 - DNA, 19 bp, Homo sapiens
gctctactgaggtgctatg

SEQ ID NO: 3736646 - DNA, 21 bp, Homo sapiens
gctctactggtcttgtggaat

SEQ ID NO: 3736647 - DNA, 18 bp, Homo sapiens
gctctagacaaccctgca

SEQ ID NO: 3736648 - DNA, 19 bp, Homo sapiens
gctctagacaaccctgcaa

SEQ ID NO: 3736649 - DNA, 19 bp, Homo sapiens
gctctccacctcagccttg

SEQ ID NO: 3736650 - DNA, 15 bp, Homo sapiens
gctctccctctggcc

SEQ ID NO: 3736651 - DNA, 23 bp, Homo sapiens
gctctccctctggccctgccttc

SEQ ID NO: 3736652 - DNA, 17 bp, Homo sapiens
gctctccgaccagacac

SEQ ID NO: 3736653 - DNA, 22 bp, Homo sapiens
gctctcctcttgccactgcctc

SEQ ID NO: 3736654 - DNA, 17 bp, Homo sapiens
gctctctacccagccca

SEQ ID NO: 3736655 - DNA, 21 bp, Homo sapiens
gctctctacccagcccatctt

SEQ ID NO: 3736656 - DNA, 14 bp, Homo sapiens
gctctctgcagcca

SEQ ID NO: 3736657 - DNA, 18 bp, Homo sapiens
gctctctgcagccagccc

SEQ ID NO: 3736658 - DNA, 22 bp, Homo sapiens
gctctctgcagccagcccagcc

SEQ ID NO: 3736659 - DNA, 22 bp, Homo sapiens
gctctgaagtcacatcacagga

SEQ ID NO: 3736660 - DNA, 21 bp, Homo sapiens
gctctgaccgaaacagcgctg

SEQ ID NO: 3736661 - DNA, 21 bp, Homo sapiens
gctctgatattccatgaatgt

SEQ ID NO: 3736662 - DNA, 17 bp, Homo sapiens
gctctgatcatccactg

SEQ ID NO: 3736663 - DNA, 23 bp, Homo sapiens
gctctgatcatccactgtgccat

SEQ ID NO: 3736664 - DNA, 14 bp, Homo sapiens
gctctgcacagatg

SEQ ID NO: 3736665 - DNA, 12 bp, Homo sapiens
gctctgcccaga

SEQ ID NO: 3736666 - DNA, 17 bp, Homo sapiens
gctctgcccagagctgg

SEQ ID NO: 3736667 - DNA, 20 bp, Homo sapiens
gctctgcccagagctgggtg

SEQ ID NO: 3736668 - DNA, 13 bp, Homo sapiens
gctctgccccagc

SEQ ID NO: 3736669 - DNA, 19 bp, Homo sapiens
gctctgccccagctctggc

SEQ ID NO: 3736670 - DNA, 20 bp, Homo sapiens
gctctgccccagctctggct

SEQ ID NO: 3736671 - DNA, 20 bp, Homo sapiens
gctctgccctccctccttcc

SEQ ID NO: 3736672 - DNA, 15 bp, Homo sapiens
gctctgccctgccct

SEQ ID NO: 3736673 - DNA, 13 bp, Homo sapiens
gctctgctgacag

SEQ ID NO: 3736674 - DNA, 19 bp, Homo sapiens
gctctgcttgccgaaactg

SEQ ID NO: 3736675 - DNA, 20 bp, Homo sapiens
gctctgcttgccgaaactgg

SEQ ID NO: 3736676 - DNA, 14 bp, Homo sapiens
gctctggaagagag

SEQ ID NO: 3736677 - DNA, 15 bp, Homo sapiens
gctctggacaggcat

SEQ ID NO: 3736678 - DNA, 16 bp, Homo sapiens
gctctggacaggcatg

SEQ ID NO: 3736679 - DNA, 22 bp, Homo sapiens
gctctggacaggcatgttctct

SEQ ID NO: 3736680 - DNA, 15 bp, Homo sapiens
gctctggagccacct

SEQ ID NO: 3736681 - DNA, 17 bp, Homo sapiens
gctctggagccacctgt

SEQ ID NO: 3736682 - DNA, 23 bp, Homo sapiens
gctctggagccacctgtcccacc

SEQ ID NO: 3736683 - DNA, 18 bp, Homo sapiens
gctctggctcacagactg

SEQ ID NO: 3736684 - DNA, 18 bp, Homo sapiens
gctctggtgacaccagcc

SEQ ID NO: 3736685 - DNA, 14 bp, Homo sapiens
gctcttctccaggc

SEQ ID NO: 3736686 - DNA, 19 bp, Homo sapiens
gctcttggcaggtactcag

SEQ ID NO: 3736687 - DNA, 21 bp, Homo sapiens
gctctttatgaatgaaaaaac

SEQ ID NO: 3736688 - DNA, 18 bp, Homo sapiens
gctctttctgggccaagt

SEQ ID NO: 3736689 - DNA, 21 bp, Homo sapiens
gctctttgaaatagtctgtgt

SEQ ID NO: 3736690 - DNA, 16 bp, Homo sapiens
gctgaacggggagaaa

SEQ ID NO: 3736691 - DNA, 19 bp, Homo sapiens
gctgaagccgccaggaccg

SEQ ID NO: 3736692 - DNA, 21 bp, Homo sapiens
gctgaagcttattaatgctaa

SEQ ID NO: 3736693 - DNA, 17 bp, Homo sapiens
gctgaatacagaggcaa

SEQ ID NO: 3736694 - DNA, 22 bp, Homo sapiens
gctgaatacagaggcaactgca

SEQ ID NO: 3736695 - DNA, 22 bp, Homo sapiens
gctgacaaccaccgctccccag

SEQ ID NO: 3736696 - DNA, 18 bp, Homo sapiens
gctgacagacacaggccc

SEQ ID NO: 3736697 - DNA, 23 bp, Homo sapiens
ggaactcccaagaacagcaggcc

SEQ ID NO: 3736698 - DNA, 15 bp, Homo sapiens
ggaactcctggaaat

SEQ ID NO: 3736699 - DNA, 16 bp, Homo sapiens
ggaagaacatagaact

SEQ ID NO: 3736700 - DNA, 16 bp, Homo sapiens
ggaagacaatgtgaaa

SEQ ID NO: 3736701 - DNA, 13 bp, Homo sapiens
ggaagagaaaaaa

SEQ ID NO: 3736702 - DNA, 15 bp, Homo sapiens
ggaagagaaaaaata

SEQ ID NO: 3736703 - DNA, 12 bp, Homo sapiens
ggaagagaaaca

SEQ ID NO: 3736704 - DNA, 15 bp, Homo sapiens
ggaagagcaggcaca

SEQ ID NO: 3736705 - DNA, 21 bp, Homo sapiens
ggaagagcaggcacatggagg

SEQ ID NO: 3736706 - DNA, 22 bp, Homo sapiens
ggaagcaaaaacgaaagctggg

SEQ ID NO: 3736707 - DNA, 17 bp, Homo sapiens
ggaagcacagcttcatt

SEQ ID NO: 3736708 - DNA, 13 bp, Homo sapiens
ggaagcaccccat

SEQ ID NO: 3736709 - DNA, 12 bp, Homo sapiens
ggaagcagtgcc

SEQ ID NO: 3736710 - DNA, 21 bp, Homo sapiens
ggaagcatgtaggagaatcca

SEQ ID NO: 3736711 - DNA, 14 bp, Homo sapiens
ggaagcccagctcc

SEQ ID NO: 3736712 - DNA, 16 bp, Homo sapiens
ggaagcccagctccag

SEQ ID NO: 3736713 - DNA, 15 bp, Homo sapiens
ggaagccctccttcc

SEQ ID NO: 3736714 - DNA, 23 bp, Homo sapiens
ggaagccctggatttcagaaaga

SEQ ID NO: 3736715 - DNA, 16 bp, Homo sapiens
ggaagccgtgccctgc

SEQ ID NO: 3736716 - DNA, 21 bp, Homo sapiens
ggaagcgtgaaggccgagaag

SEQ ID NO: 3736717 - DNA, 11 bp, Homo sapiens
ggaagctccgc

SEQ ID NO: 3736718 - DNA, 13 bp, Homo sapiens
ggaagctcctggt

SEQ ID NO: 3736719 - DNA, 18 bp, Homo sapiens
ggaagctctgaagtcaca

SEQ ID NO: 3736720 - DNA, 17 bp, Homo sapiens
ggaagctgccctgccca

SEQ ID NO: 3736721 - DNA, 19 bp, Homo sapiens
ggaaggaaagaaagaagga

SEQ ID NO: 3736722 - DNA, 17 bp, Homo sapiens
ggaaggacctatgtttg

SEQ ID NO: 3736723 - DNA, 20 bp, Homo sapiens
ggaaggagactcacctctgc

SEQ ID NO: 3736724 - DNA, 12 bp, Homo sapiens
ggaaggagagaa

SEQ ID NO: 3736725 - DNA, 23 bp, Homo sapiens
ggaaggccacctgcaggtcactg

SEQ ID NO: 3736726 - DNA, 14 bp, Homo sapiens
ggaaggctggctgg

SEQ ID NO: 3736727 - DNA, 16 bp, Homo sapiens
ggaagggactaggagc

SEQ ID NO: 3736728 - DNA, 15 bp, Homo sapiens
ggaagggcaggaagg

SEQ ID NO: 3736729 - DNA, 17 bp, Homo sapiens
ggaaggggctggactgg

SEQ ID NO: 3736730 - DNA, 23 bp, Homo sapiens
ggaagtgaagagggagaagggat

SEQ ID NO: 3736731 - DNA, 16 bp, Homo sapiens
ggaagtgtaacagctg

SEQ ID NO: 3736732 - DNA, 21 bp, Homo sapiens
ggaagttttgtggaggagctc

SEQ ID NO: 3736733 - DNA, 23 bp, Homo sapiens
ggaatataaggaaagcaataaat

SEQ ID NO: 3736734 - DNA, 22 bp, Homo sapiens
ggaatattcccctatctctaga

SEQ ID NO: 3736735 - DNA, 17 bp, Homo sapiens
ggaatcaacagggcagc

SEQ ID NO: 3736736 - DNA, 16 bp, Homo sapiens
ggaatccagacccggc

SEQ ID NO: 3736737 - DNA, 19 bp, Homo sapiens
ggaatcgaggaaccagagc

SEQ ID NO: 3736738 - DNA, 20 bp, Homo sapiens
ggaatcgaggaaccagagcc

SEQ ID NO: 3736739 - DNA, 21 bp, Homo sapiens
ggaatcgaggaaccagagcca

SEQ ID NO: 3736740 - DNA, 17 bp, Homo sapiens
ggaatctagaagaaatg

SEQ ID NO: 3736741 - DNA, 18 bp, Homo sapiens
ggaatctagaagaaatga

SEQ ID NO: 3736742 - DNA, 23 bp, Homo sapiens
ggaatgcattatttattgctgtg

SEQ ID NO: 3736743 - DNA, 15 bp, Homo sapiens
ggaatgcctgtgcca

SEQ ID NO: 3736744 - DNA, 16 bp, Homo sapiens
ggaatgcctgtgccaa

SEQ ID NO: 3736745 - DNA, 14 bp, Homo sapiens
ggaatgcggcaaga

SEQ ID NO: 3736746 - DNA, 22 bp, Homo sapiens
ggaatgcggccgcattccctga

SEQ ID NO: 3736747 - DNA, 13 bp, Homo sapiens
ggaatgctccccc

SEQ ID NO: 3736748 - DNA, 15 bp, Homo sapiens
ggaatgcttggaata

SEQ ID NO: 3736749 - DNA, 14 bp, Homo sapiens
ggaatgtctttggt

SEQ ID NO: 3736750 - DNA, 13 bp, Homo sapiens
ggaattaaaacaa

SEQ ID NO: 3736751 - DNA, 17 bp, Homo sapiens
ggaattaacctggtgct

SEQ ID NO: 3736752 - DNA, 15 bp, Homo sapiens
ggacaaacccttctt

SEQ ID NO: 3736753 - DNA, 15 bp, Homo sapiens
ggacaaagtctccag

SEQ ID NO: 3736754 - DNA, 20 bp, Homo sapiens
ggacaaagtctccagcccac

SEQ ID NO: 3736755 - DNA, 21 bp, Homo sapiens
ggacaaagtctccagcccacg

SEQ ID NO: 3736756 - DNA, 24 bp, Homo sapiens
ggacaaagtctccagcccacgttc

SEQ ID NO: 3736757 - DNA, 16 bp, Homo sapiens
ggacaacgaggaagcc

SEQ ID NO: 3736758 - DNA, 17 bp, Homo sapiens
ggacaacgaggaagccc

SEQ ID NO: 3736759 - DNA, 21 bp, Homo sapiens
ggacacacaaggtgcaaatca

SEQ ID NO: 3736760 - DNA, 13 bp, Homo sapiens
ggacacagctctt

SEQ ID NO: 3736761 - DNA, 18 bp, Homo sapiens
ggacacagctcttctcca

SEQ ID NO: 3736762 - DNA, 13 bp, Homo sapiens
ggacaccaggagt

SEQ ID NO: 3736763 - DNA, 17 bp, Homo sapiens
ggacagagacacctgca

SEQ ID NO: 3736764 - DNA, 18 bp, Homo sapiens
ggacagagacacctgcac

SEQ ID NO: 3736765 - DNA, 15 bp, Homo sapiens
ggacagccacggcca

SEQ ID NO: 3736766 - DNA, 15 bp, Homo sapiens
ggacagctccttctg

SEQ ID NO: 3736767 - DNA, 17 bp, Homo sapiens
ggacagctccttctgtc

SEQ ID NO: 3736768 - DNA, 16 bp, Homo sapiens
ggacaggcagaaagag

SEQ ID NO: 3736769 - DNA, 17 bp, Homo sapiens
ggacagggaggtgaccc

SEQ ID NO: 3736770 - DNA, 22 bp, Homo sapiens
ggacagggcatggccaggtggc

SEQ ID NO: 3736771 - DNA, 15 bp, Homo sapiens
ggacagtcctgggag

SEQ ID NO: 3736772 - DNA, 16 bp, Homo sapiens
ggacagtcctgggaga

SEQ ID NO: 3736773 - DNA, 17 bp, Homo sapiens
ggacagtgcttcagcct

SEQ ID NO: 3736774 - DNA, 22 bp, Homo sapiens
ggaccaacaagggcagtggagg

SEQ ID NO: 3736775 - DNA, 15 bp, Homo sapiens
ggaccaaggacccct

SEQ ID NO: 3736776 - DNA, 17 bp, Homo sapiens
ggaccaaggagatgaag

SEQ ID NO: 3736777 - DNA, 14 bp, Homo sapiens
ggaccagatgctga

SEQ ID NO: 3736778 - DNA, 14 bp, Homo sapiens
ggaccatcctattt

SEQ ID NO: 3736779 - DNA, 19 bp, Homo sapiens
ggacccatcacgcctgtgc

SEQ ID NO: 3736780 - DNA, 13 bp, Homo sapiens
ggacccctcacct

SEQ ID NO: 3736781 - DNA, 15 bp, Homo sapiens
ggaccctcgctggcc

SEQ ID NO: 3736782 - DNA, 21 bp, Homo sapiens
ggaccctcgctggcccccact

SEQ ID NO: 3736783 - DNA, 21 bp, Homo sapiens
ggacccttcccttgagccctc

SEQ ID NO: 3736784 - DNA, 16 bp, Homo sapiens
ggaccctttccttcct

SEQ ID NO: 3736785 - DNA, 23 bp, Homo sapiens
ggaccctttccttccttccctgg

SEQ ID NO: 3736786 - DNA, 15 bp, Homo sapiens
ggaccgccaaagaat

SEQ ID NO: 3736787 - DNA, 22 bp, Homo sapiens
ggacctaacattcgatctcatt

SEQ ID NO: 3736788 - DNA, 19 bp, Homo sapiens
ggacctcagagtccaggcc

SEQ ID NO: 3736789 - DNA, 21 bp, Homo sapiens
ggacctcagagtccaggcccc

SEQ ID NO: 3736790 - DNA, 22 bp, Homo sapiens
ggaccttatctgtgcgtgaaac

SEQ ID NO: 3736791 - DNA, 15 bp, Homo sapiens
ggaccttgaactggg

SEQ ID NO: 3736792 - DNA, 13 bp, Homo sapiens
ggactactgaagc

SEQ ID NO: 3736793 - DNA, 16 bp, Homo sapiens
ggactcaagtttcttc

SEQ ID NO: 3736794 - DNA, 23 bp, Homo sapiens
ggactcactggcagccccagcac

SEQ ID NO: 3736795 - DNA, 13 bp, Homo sapiens
ggactcagccctg

SEQ ID NO: 3736796 - DNA, 14 bp, Homo sapiens
ggactcagccctga

SEQ ID NO: 3736797 - DNA, 17 bp, Homo sapiens
ggactcagccctgaggt

SEQ ID NO: 3736798 - DNA, 18 bp, Homo sapiens
ggactcaggatgcccagg

SEQ ID NO: 3736799 - DNA, 19 bp, Homo sapiens
ggactcaggatgcccaggg

SEQ ID NO: 3736800 - DNA, 24 bp, Homo sapiens
ggactcatttcattcctaacacag

SEQ ID NO: 3736801 - DNA, 20 bp, Homo sapiens
ggactccctcctcacctctg

SEQ ID NO: 3736802 - DNA, 22 bp, Homo sapiens
ggactccctcctcacctctgga

SEQ ID NO: 3736803 - DNA, 12 bp, Homo sapiens
ggactcctctgt

SEQ ID NO: 3736804 - DNA, 13 bp, Homo sapiens
ggactctgaggct

SEQ ID NO: 3736805 - DNA, 21 bp, Homo sapiens
ggactctgaggctctttctgg

SEQ ID NO: 3736806 - DNA, 10 bp, Homo sapiens
ggactgcatg

SEQ ID NO: 3736807 - DNA, 23 bp, Homo sapiens
ggactggctagagtcctcactcc

SEQ ID NO: 3736808 - DNA, 21 bp, Homo sapiens
ggactgttttttcctgagctt

SEQ ID NO: 3736809 - DNA, 23 bp, Homo sapiens
ggactgttttttcctgagcttgg

SEQ ID NO: 3736810 - DNA, 19 bp, Homo sapiens
ggcccggggctggcggcta

SEQ ID NO: 3736811 - DNA, 22 bp, Homo sapiens
ggcccggggctggcggctactc

SEQ ID NO: 3736812 - DNA, 15 bp, Homo sapiens
ggcccgtcatgttcc

SEQ ID NO: 3736813 - DNA, 14 bp, Homo sapiens
ggccctgagctcgg

SEQ ID NO: 3736814 - DNA, 21 bp, Homo sapiens
ggccctgagctcggtggaccc

SEQ ID NO: 3736815 - DNA, 10 bp, Homo sapiens
ggccctgcct

SEQ ID NO: 3736816 - DNA, 14 bp, Homo sapiens
ggccctggcctgct

SEQ ID NO: 3736817 - DNA, 13 bp, Homo sapiens
ggccctggctccc

SEQ ID NO: 3736818 - DNA, 22 bp, Homo sapiens
ggccctggctcccacaggccct

SEQ ID NO: 3736819 - DNA, 17 bp, Homo sapiens
ggccctggtccttccag

SEQ ID NO: 3736820 - DNA, 17 bp, Homo sapiens
ggcccttcctctccact

SEQ ID NO: 3736821 - DNA, 19 bp, Homo sapiens
ggcccttcctctccactgc

SEQ ID NO: 3736822 - DNA, 14 bp, Homo sapiens
ggcccttccttttc

SEQ ID NO: 3736823 - DNA, 12 bp, Homo sapiens
ggccgagaagca

SEQ ID NO: 3736824 - DNA, 16 bp, Homo sapiens
ggccgagggtcctggc

SEQ ID NO: 3736825 - DNA, 15 bp, Homo sapiens
ggccgcattccctga

SEQ ID NO: 3736826 - DNA, 17 bp, Homo sapiens
ggccgcattccctgagt

SEQ ID NO: 3736827 - DNA, 17 bp, Homo sapiens
ggccgcctgcgggctgc

SEQ ID NO: 3736828 - DNA, 16 bp, Homo sapiens
ggccgctgttcaccca

SEQ ID NO: 3736829 - DNA, 15 bp, Homo sapiens
ggccggtgtgggctg

SEQ ID NO: 3736830 - DNA, 19 bp, Homo sapiens
ggccgtcaggacccaccat

SEQ ID NO: 3736831 - DNA, 22 bp, Homo sapiens
ggcctcaaagttggggcaggct

SEQ ID NO: 3736832 - DNA, 22 bp, Homo sapiens
ggcctcaaccctccctcagccc

SEQ ID NO: 3736833 - DNA, 23 bp, Homo sapiens
ggcctcaaccctccctcagcccc

SEQ ID NO: 3736834 - DNA, 22 bp, Homo sapiens
ggcctcaagtgattctcctgcc

SEQ ID NO: 3736835 - DNA, 15 bp, Homo sapiens
ggcctcactccagga

SEQ ID NO: 3736836 - DNA, 22 bp, Homo sapiens
ggcctccattcctggagcccga

SEQ ID NO: 3736837 - DNA, 23 bp, Homo sapiens
ggcctccattcctggagcccgag

SEQ ID NO: 3736838 - DNA, 23 bp, Homo sapiens
ggcctcctctaacaggggctggt

SEQ ID NO: 3736839 - DNA, 19 bp, Homo sapiens
ggcctcctctgtccagggc

SEQ ID NO: 3736840 - DNA, 23 bp, Homo sapiens
ggcctctgccccgtctcatgagg

SEQ ID NO: 3736841 - DNA, 14 bp, Homo sapiens
ggcctgatgctccc

SEQ ID NO: 3736842 - DNA, 18 bp, Homo sapiens
ggcctgatgctccctccc

SEQ ID NO: 3736843 - DNA, 13 bp, Homo sapiens
ggcctgccagacg

SEQ ID NO: 3736844 - DNA, 20 bp, Homo sapiens
ggcctgctgggctctccacc

SEQ ID NO: 3736845 - DNA, 14 bp, Homo sapiens
ggcctggcagccgt

SEQ ID NO: 3736846 - DNA, 19 bp, Homo sapiens
ggcctggcatggcacctgt

SEQ ID NO: 3736847 - DNA, 16 bp, Homo sapiens
ggcctggccagatgca

SEQ ID NO: 3736848 - DNA, 17 bp, Homo sapiens
ggcctggccaggagctc

SEQ ID NO: 3736849 - DNA, 18 bp, Homo sapiens
ggcctggccaggagctct

SEQ ID NO: 3736850 - DNA, 13 bp, Homo sapiens
ggcctggctccgc

SEQ ID NO: 3736851 - DNA, 14 bp, Homo sapiens
ggcctgggtctgtg

SEQ ID NO: 3736852 - DNA, 21 bp, Homo sapiens
ggcctgggtgctggctgccca

SEQ ID NO: 3736853 - DNA, 14 bp, Homo sapiens
ggcctgtccctggc

SEQ ID NO: 3736854 - DNA, 15 bp, Homo sapiens
ggcctgtcgtgccag

SEQ ID NO: 3736855 - DNA, 18 bp, Homo sapiens
ggcctgtctcatccccag

SEQ ID NO: 3736856 - DNA, 19 bp, Homo sapiens
ggcctgtctcatccccagg

SEQ ID NO: 3736857 - DNA, 20 bp, Homo sapiens
ggcctgtctcatccccaggg

SEQ ID NO: 3736858 - DNA, 15 bp, Homo sapiens
ggccttccccagcct

SEQ ID NO: 3736859 - DNA, 15 bp, Homo sapiens
ggccttctctgaagg

SEQ ID NO: 3736860 - DNA, 22 bp, Homo sapiens
ggccttctttctagagagggaa

SEQ ID NO: 3736861 - DNA, 21 bp, Homo sapiens
ggcgaggggagggtggcaggt

SEQ ID NO: 3736862 - DNA, 16 bp, Homo sapiens
ggcgagtcactgcctc

SEQ ID NO: 3736863 - DNA, 22 bp, Homo sapiens
ggcgatccacctgtctcagcct

SEQ ID NO: 3736864 - DNA, 20 bp, Homo sapiens
ggcggagcttgcagtgagcc

SEQ ID NO: 3736865 - DNA, 20 bp, Homo sapiens
ggcggctactcagcagccct

SEQ ID NO: 3736866 - DNA, 22 bp, Homo sapiens
ggcggctactcagcagccctcc

SEQ ID NO: 3736867 - DNA, 15 bp, Homo sapiens
ggcgtgaggatggga

SEQ ID NO: 3736868 - DNA, 16 bp, Homo sapiens
ggcgtggtggcgggca

SEQ ID NO: 3736869 - DNA, 14 bp, Homo sapiens
ggctaactggaagc

SEQ ID NO: 3736870 - DNA, 19 bp, Homo sapiens
ggctaagagtgtcctagga

SEQ ID NO: 3736871 - DNA, 20 bp, Homo sapiens
ggctaagtgatcctcccacc

SEQ ID NO: 3736872 - DNA, 19 bp, Homo sapiens
ggctacatcccagcctgtg

SEQ ID NO: 3736873 - DNA, 20 bp, Homo sapiens
ggctacatcccagcctgtgg

SEQ ID NO: 3736874 - DNA, 22 bp, Homo sapiens
ggctacatcccagcctgtggtt

SEQ ID NO: 3736875 - DNA, 21 bp, Homo sapiens
ggctactcagcagccctcctc

SEQ ID NO: 3736876 - DNA, 20 bp, Homo sapiens
ggctagaggccagccccacc

SEQ ID NO: 3736877 - DNA, 18 bp, Homo sapiens
ggctagagtcctcactcc

SEQ ID NO: 3736878 - DNA, 20 bp, Homo sapiens
ggctagagtcctcactccca

SEQ ID NO: 3736879 - DNA, 15 bp, Homo sapiens
ggctagttgggcttc

SEQ ID NO: 3736880 - DNA, 22 bp, Homo sapiens
ggctatggattttctaaggaag

SEQ ID NO: 3736881 - DNA, 19 bp, Homo sapiens
ggctatgtatggaatacag

SEQ ID NO: 3736882 - DNA, 14 bp, Homo sapiens
ggctcaagcagtct

SEQ ID NO: 3736883 - DNA, 21 bp, Homo sapiens
ggctcaagtcctcttttctga

SEQ ID NO: 3736884 - DNA, 16 bp, Homo sapiens
ggctcacacctgtaat

SEQ ID NO: 3736885 - DNA, 20 bp, Homo sapiens
ggctcacgcctatgatccca

SEQ ID NO: 3736886 - DNA, 23 bp, Homo sapiens
ggctcacgcctatgatcccagca

SEQ ID NO: 3736887 - DNA, 24 bp, Homo sapiens
ggctcacgcctgtaatcccagcag

SEQ ID NO: 3736888 - DNA, 13 bp, Homo sapiens
ggctcactgcagc

SEQ ID NO: 3736889 - DNA, 17 bp, Homo sapiens
ggctcactgcagcctca

SEQ ID NO: 3736890 - DNA, 23 bp, Homo sapiens
ggctcagcaaaagatgcttctca

SEQ ID NO: 3736891 - DNA, 10 bp, Homo sapiens
ggctcagcct

SEQ ID NO: 3736892 - DNA, 13 bp, Homo sapiens
ggctcagcctggt

SEQ ID NO: 3736893 - DNA, 18 bp, Homo sapiens
ggctcagcggggacagct

SEQ ID NO: 3736894 - DNA, 20 bp, Homo sapiens
ggctcagcggggacagctcc

SEQ ID NO: 3736895 - DNA, 15 bp, Homo sapiens
ggctcagtctcagga

SEQ ID NO: 3736896 - DNA, 20 bp, Homo sapiens
ggctcatattcctgcagcct

SEQ ID NO: 3736897 - DNA, 12 bp, Homo sapiens
ggctccaggctc

SEQ ID NO: 3736898 - DNA, 18 bp, Homo sapiens
ggctccagtctgctgccc

SEQ ID NO: 3736899 - DNA, 19 bp, Homo sapiens
ggctcccacaggcccttcc

SEQ ID NO: 3736900 - DNA, 12 bp, Homo sapiens
ggctcccctcta

SEQ ID NO: 3736901 - DNA, 20 bp, Homo sapiens
ggctcccctttttcttcctc

SEQ ID NO: 3736902 - DNA, 18 bp, Homo sapiens
ggctccgtcagtatcagg

SEQ ID NO: 3736903 - DNA, 21 bp, Homo sapiens
ggctcgagcagtcctgcctca

SEQ ID NO: 3736904 - DNA, 20 bp, Homo sapiens
ggctctccacctcagccttg

SEQ ID NO: 3736905 - DNA, 18 bp, Homo sapiens
ggctctgagaaggggagg

SEQ ID NO: 3736906 - DNA, 12 bp, Homo sapiens
ggctctgcacag

SEQ ID NO: 3736907 - DNA, 21 bp, Homo sapiens
ggctctgccctccctccttcc

SEQ ID NO: 3736908 - DNA, 17 bp, Homo sapiens
ggctctggctctcccca

SEQ ID NO: 3736909 - DNA, 20 bp, Homo sapiens
ggctgaacggggagaaaagg

SEQ ID NO: 3736910 - DNA, 18 bp, Homo sapiens
ggctgacccagtccctgg

SEQ ID NO: 3736911 - DNA, 13 bp, Homo sapiens
ggctgacccccct

SEQ ID NO: 3736912 - DNA, 13 bp, Homo sapiens
ggctgagactgga

SEQ ID NO: 3736913 - DNA, 12 bp, Homo sapiens
ggctgagccctg

SEQ ID NO: 3736914 - DNA, 15 bp, Homo sapiens
ggctgagccctggca

SEQ ID NO: 3736915 - DNA, 16 bp, Homo sapiens
ggctgagccctggcag

SEQ ID NO: 3736916 - DNA, 17 bp, Homo sapiens
ggctgaggaaaggccag

SEQ ID NO: 3736917 - DNA, 22 bp, Homo sapiens
ggctgaggaaaggccagctggc

SEQ ID NO: 3736918 - DNA, 21 bp, Homo sapiens
ggctgaggatttcaagcctgc

SEQ ID NO: 3736919 - DNA, 14 bp, Homo sapiens
ggctgaggcagaag

SEQ ID NO: 3736920 - DNA, 14 bp, Homo sapiens
ggctgaggcaggag

SEQ ID NO: 3736921 - DNA, 13 bp, Homo sapiens
ggctgcagggagt

SEQ ID NO: 3736922 - DNA, 17 bp, Homo sapiens
ggctgcagggagtccga

SEQ ID NO: 3736923 - DNA, 13 bp, Homo sapiens
ggtgccctccact

SEQ ID NO: 3736924 - DNA, 12 bp, Homo sapiens
ggtgcctttcct

SEQ ID NO: 3736925 - DNA, 18 bp, Homo sapiens
ggtgcctttcctgttcag

SEQ ID NO: 3736926 - DNA, 15 bp, Homo sapiens
ggtgcgatctgggtt

SEQ ID NO: 3736927 - DNA, 22 bp, Homo sapiens
ggtgctaaatggtcgcccagga

SEQ ID NO: 3736928 - DNA, 23 bp, Homo sapiens
ggtgctaaatggtcgcccaggag

SEQ ID NO: 3736929 - DNA, 16 bp, Homo sapiens
ggtgctcagggctgac

SEQ ID NO: 3736930 - DNA, 21 bp, Homo sapiens
ggtgctgccatccaggttcag

SEQ ID NO: 3736931 - DNA, 21 bp, Homo sapiens
ggtgctgcttccctctgcctg

SEQ ID NO: 3736932 - DNA, 16 bp, Homo sapiens
ggtgctggatattttc

SEQ ID NO: 3736933 - DNA, 19 bp, Homo sapiens
ggtgcttattctcaaagca

SEQ ID NO: 3736934 - DNA, 15 bp, Homo sapiens
ggtggaacaagcaca

SEQ ID NO: 3736935 - DNA, 18 bp, Homo sapiens
ggtggaagccctccttcc

SEQ ID NO: 3736936 - DNA, 17 bp, Homo sapiens
ggtggacagtcctggga

SEQ ID NO: 3736937 - DNA, 14 bp, Homo sapiens
ggtggatgcctggt

SEQ ID NO: 3736938 - DNA, 14 bp, Homo sapiens
ggtggcaccagcag

SEQ ID NO: 3736939 - DNA, 19 bp, Homo sapiens
ggtggcagtgggagctgcc

SEQ ID NO: 3736940 - DNA, 22 bp, Homo sapiens
ggtggcagtgggagctgcctgt

SEQ ID NO: 3736941 - DNA, 13 bp, Homo sapiens
ggtggcatcccag

SEQ ID NO: 3736942 - DNA, 17 bp, Homo sapiens
ggtggcatcccagtggc

SEQ ID NO: 3736943 - DNA, 19 bp, Homo sapiens
ggtggcatgtgcctatagt

SEQ ID NO: 3736944 - DNA, 22 bp, Homo sapiens
ggtggccactccagacccctgg

SEQ ID NO: 3736945 - DNA, 19 bp, Homo sapiens
ggtggcccacgcctgtaat

SEQ ID NO: 3736946 - DNA, 18 bp, Homo sapiens
ggtggcccgacagcctgg

SEQ ID NO: 3736947 - DNA, 19 bp, Homo sapiens
ggtggcccgacagcctggc

SEQ ID NO: 3736948 - DNA, 14 bp, Homo sapiens
ggtggctaaaggtc

SEQ ID NO: 3736949 - DNA, 15 bp, Homo sapiens
ggtggctagtcagag

SEQ ID NO: 3736950 - DNA, 17 bp, Homo sapiens
ggtggctagtcagagag

SEQ ID NO: 3736951 - DNA, 14 bp, Homo sapiens
ggtggctcacgcct

SEQ ID NO: 3736952 - DNA, 18 bp, Homo sapiens
ggtggctgacccagtccc

SEQ ID NO: 3736953 - DNA, 12 bp, Homo sapiens
ggtggctgggtt

SEQ ID NO: 3736954 - DNA, 17 bp, Homo sapiens
ggtgggctgagccctgg

SEQ ID NO: 3736955 - DNA, 16 bp, Homo sapiens
ggtgggttttcttccc

SEQ ID NO: 3736956 - DNA, 17 bp, Homo sapiens
ggtgggttttcttccca

SEQ ID NO: 3736957 - DNA, 14 bp, Homo sapiens
ggtggtatgtgtgt

SEQ ID NO: 3736958 - DNA, 19 bp, Homo sapiens
ggtggtctgaatgttctga

SEQ ID NO: 3736959 - DNA, 18 bp, Homo sapiens
ggtggtctgcaggcaggg

SEQ ID NO: 3736960 - DNA, 14 bp, Homo sapiens
ggtggtgacctctg

SEQ ID NO: 3736961 - DNA, 15 bp, Homo sapiens
ggtggtgacctctgc

SEQ ID NO: 3736962 - DNA, 16 bp, Homo sapiens
ggtggtgacctctgcc

SEQ ID NO: 3736963 - DNA, 22 bp, Homo sapiens
ggtgtatttattttcctcccca

SEQ ID NO: 3736964 - DNA, 19 bp, Homo sapiens
ggtgtcaagagggtctgag

SEQ ID NO: 3736965 - DNA, 19 bp, Homo sapiens
ggtgtcacctgaagactca

SEQ ID NO: 3736966 - DNA, 17 bp, Homo sapiens
ggtgtcctttccctcca

SEQ ID NO: 3736967 - DNA, 14 bp, Homo sapiens
ggtgtgcctgcagc

SEQ ID NO: 3736968 - DNA, 15 bp, Homo sapiens
ggtgtgcctgcagcc

SEQ ID NO: 3736969 - DNA, 23 bp, Homo sapiens
ggtgtggagaagcggctggcagc

SEQ ID NO: 3736970 - DNA, 11 bp, Homo sapiens
ggtgtggggga

SEQ ID NO: 3736971 - DNA, 12 bp, Homo sapiens
ggtgtgtctgct

SEQ ID NO: 3736972 - DNA, 13 bp, Homo sapiens
ggtgtgtttttgg

SEQ ID NO: 3736973 - DNA, 14 bp, Homo sapiens
ggtgttttcatgta

SEQ ID NO: 3736974 - DNA, 17 bp, Homo sapiens
ggttaactatgtacaat

SEQ ID NO: 3736975 - DNA, 22 bp, Homo sapiens
ggttaaggctgaggaaaggcca

SEQ ID NO: 3736976 - DNA, 20 bp, Homo sapiens
ggttacactgttagaacact

SEQ ID NO: 3736977 - DNA, 16 bp, Homo sapiens
ggttcagagactcagg

SEQ ID NO: 3736978 - DNA, 22 bp, Homo sapiens
ggttcagcccctcctctgccac

SEQ ID NO: 3736979 - DNA, 15 bp, Homo sapiens
ggttcccccagccct

SEQ ID NO: 3736980 - DNA, 22 bp, Homo sapiens
ggttccctttccttccatccct

SEQ ID NO: 3736981 - DNA, 12 bp, Homo sapiens
ggttctggggcc

SEQ ID NO: 3736982 - DNA, 17 bp, Homo sapiens
ggttctggggccccttt

SEQ ID NO: 3736983 - DNA, 22 bp, Homo sapiens
ggttctggttagctcagcccca

SEQ ID NO: 3736984 - DNA, 18 bp, Homo sapiens
ggttgcagtgagccaaga

SEQ ID NO: 3736985 - DNA, 14 bp, Homo sapiens
ggttgcatcagaaa

SEQ ID NO: 3736986 - DNA, 14 bp, Homo sapiens
ggttgggctggtgt

SEQ ID NO: 3736987 - DNA, 16 bp, Homo sapiens
ggtttagtgtaaaaat

SEQ ID NO: 3736988 - DNA, 20 bp, Homo sapiens
ggtttagtgtaaaaatgaga

SEQ ID NO: 3736989 - DNA, 15 bp, Homo sapiens
ggtttgaatataaac

SEQ ID NO: 3736990 - DNA, 14 bp, Homo sapiens
ggtttggcgggcca

SEQ ID NO: 3736991 - DNA, 19 bp, Homo sapiens
ggtttggggagcagagaca

SEQ ID NO: 3736992 - DNA, 13 bp, Homo sapiens
ggttttgtacaat

SEQ ID NO: 3736993 - DNA, 13 bp, Homo sapiens
gtaaaaataaaat

SEQ ID NO: 3736994 - DNA, 14 bp, Homo sapiens
gtaaaaataaaatt

SEQ ID NO: 3736995 - DNA, 12 bp, Homo sapiens
gtaaaaatacaa

SEQ ID NO: 3736996 - DNA, 15 bp, Homo sapiens
gtaaaactgaggcac

SEQ ID NO: 3736997 - DNA, 22 bp, Homo sapiens
gtaaaattctaaataaaatata

SEQ ID NO: 3736998 - DNA, 12 bp, Homo sapiens
gtaaaattgcat

SEQ ID NO: 3736999 - DNA, 20 bp, Homo sapiens
gtaaacaaactgtgtaactg

SEQ ID NO: 3737000 - DNA, 14 bp, Homo sapiens
gtaaacagtgcctg

SEQ ID NO: 3737001 - DNA, 15 bp, Homo sapiens
gtaaacagtgcctgc

SEQ ID NO: 3737002 - DNA, 17 bp, Homo sapiens
gtaaacagtgcctgctg

SEQ ID NO: 3737003 - DNA, 22 bp, Homo sapiens
gtaaacagtgcctgctgaatga

SEQ ID NO: 3737004 - DNA, 23 bp, Homo sapiens
gtaaacataattcttgtatatta

SEQ ID NO: 3737005 - DNA, 21 bp, Homo sapiens
gtaaacattagttctatttct

SEQ ID NO: 3737006 - DNA, 16 bp, Homo sapiens
gtaaactcaaaatatt

SEQ ID NO: 3737007 - DNA, 14 bp, Homo sapiens
gtaaagatattatt

SEQ ID NO: 3737008 - DNA, 18 bp, Homo sapiens
gtaaagtgataatttctg

SEQ ID NO: 3737009 - DNA, 15 bp, Homo sapiens
gtaaagtgtaacata

SEQ ID NO: 3737010 - DNA, 18 bp, Homo sapiens
gtaaatacaagttctatt

SEQ ID NO: 3737011 - DNA, 16 bp, Homo sapiens
gtaaatcctttttctt

SEQ ID NO: 3737012 - DNA, 22 bp, Homo sapiens
gtaaatgaagtaacttgtctta

SEQ ID NO: 3737013 - DNA, 21 bp, Homo sapiens
gtaaatgtctgtggccttgtt

SEQ ID NO: 3737014 - DNA, 12 bp, Homo sapiens
gtaaattatttt

SEQ ID NO: 3737015 - DNA, 15 bp, Homo sapiens
gtaaattattttaaa

SEQ ID NO: 3737016 - DNA, 12 bp, Homo sapiens
gtaacaagaaaa

SEQ ID NO: 3737017 - DNA, 16 bp, Homo sapiens
gtaacaagaaaacata

SEQ ID NO: 3737018 - DNA, 13 bp, Homo sapiens
gtaacaagaaagg

SEQ ID NO: 3737019 - DNA, 14 bp, Homo sapiens
gtaacaagaaagga

SEQ ID NO: 3737020 - DNA, 20 bp, Homo sapiens
gtaacaggaaaattttaaaa

SEQ ID NO: 3737021 - DNA, 12 bp, Homo sapiens
gtaacaggcaga

SEQ ID NO: 3737022 - DNA, 20 bp, Homo sapiens
gtaacctgagatggccctct

SEQ ID NO: 3737023 - DNA, 16 bp, Homo sapiens
gtaacttggttataca

SEQ ID NO: 3737024 - DNA, 14 bp, Homo sapiens
gtaacttttgtaag

SEQ ID NO: 3737025 - DNA, 20 bp, Homo sapiens
gtaagaaacacactgaggca

SEQ ID NO: 3737026 - DNA, 13 bp, Homo sapiens
gtaagaagagact

SEQ ID NO: 3737027 - DNA, 15 bp, Homo sapiens
gtaagaagagactgg

SEQ ID NO: 3737028 - DNA, 15 bp, Homo sapiens
gtaagagaatgttat

SEQ ID NO: 3737029 - DNA, 14 bp, Homo sapiens
gtaagattttgaaa

SEQ ID NO: 3737030 - DNA, 20 bp, Homo sapiens
gtaagctctttgaaacaact

SEQ ID NO: 3737031 - DNA, 15 bp, Homo sapiens
gtaaggaatgcttgg

SEQ ID NO: 3737032 - DNA, 17 bp, Homo sapiens
gtaagtaaatgtctgtg

SEQ ID NO: 3737033 - DNA, 18 bp, Homo sapiens
gtaagtaccactcaggcc

SEQ ID NO: 3737034 - DNA, 20 bp, Homo sapiens
gtaagtgtgagtaagagctg

SEQ ID NO: 3737035 - DNA, 23 bp, Homo sapiens
gtaagttgaatggcctgccttga

SEQ ID NO: 3737036 - DNA, 16 bp, Homo sapiens
gtaataaactgtgttt

SEQ ID NO: 3737037 - DNA, 16 bp, Homo sapiens
gtgatcaataaaatgt

SEQ ID NO: 3737038 - DNA, 18 bp, Homo sapiens
gtgatcaataaaatgtga

SEQ ID NO: 3737039 - DNA, 22 bp, Homo sapiens
gtgatccacccacctcagcctc

SEQ ID NO: 3737040 - DNA, 13 bp, Homo sapiens
gtgatccatccat

SEQ ID NO: 3737041 - DNA, 20 bp, Homo sapiens
gtgatccatccatctccagg

SEQ ID NO: 3737042 - DNA, 15 bp, Homo sapiens
gtgatcctcccacct

SEQ ID NO: 3737043 - DNA, 23 bp, Homo sapiens
gtgatcctcccacctcagcctcc

SEQ ID NO: 3737044 - DNA, 15 bp, Homo sapiens
gtgatctgaacagaa

SEQ ID NO: 3737045 - DNA, 22 bp, Homo sapiens
gtgatgatcagctgtttgtcat

SEQ ID NO: 3737046 - DNA, 17 bp, Homo sapiens
gtgatgccacacagagt

SEQ ID NO: 3737047 - DNA, 22 bp, Homo sapiens
gtgatgctaaaggttgtattgc

SEQ ID NO: 3737048 - DNA, 22 bp, Homo sapiens
gtgatggttcccctgttcactc

SEQ ID NO: 3737049 - DNA, 18 bp, Homo sapiens
gtgattcgagctatattt

SEQ ID NO: 3737050 - DNA, 18 bp, Homo sapiens
gtgcaaaaatttttggat

SEQ ID NO: 3737051 - DNA, 13 bp, Homo sapiens
gtgcaacagacaa

SEQ ID NO: 3737052 - DNA, 15 bp, Homo sapiens
gtgcaacagacaagt

SEQ ID NO: 3737053 - DNA, 22 bp, Homo sapiens
gtgcaagtgtatgcacgtgtgc

SEQ ID NO: 3737054 - DNA, 17 bp, Homo sapiens
gtgcaagtgtctgtgtg

SEQ ID NO: 3737055 - DNA, 14 bp, Homo sapiens
gtgcaagtgtgtgc

SEQ ID NO: 3737056 - DNA, 20 bp, Homo sapiens
gtgcacagacgtccctccac

SEQ ID NO: 3737057 - DNA, 21 bp, Homo sapiens
gtgcacatgcacgtgtgtgca

SEQ ID NO: 3737058 - DNA, 15 bp, Homo sapiens
gtgcacccactctgc

SEQ ID NO: 3737059 - DNA, 21 bp, Homo sapiens
gtgcacctgtactcaggaggc

SEQ ID NO: 3737060 - DNA, 18 bp, Homo sapiens
gtgcacgcacactgtctg

SEQ ID NO: 3737061 - DNA, 18 bp, Homo sapiens
gtgcacgtggagagctgg

SEQ ID NO: 3737062 - DNA, 21 bp, Homo sapiens
gtgcacgtggagagctggtgc

SEQ ID NO: 3737063 - DNA, 13 bp, Homo sapiens
gtgcactctgcta

SEQ ID NO: 3737064 - DNA, 13 bp, Homo sapiens
gtgcagacaggcc

SEQ ID NO: 3737065 - DNA, 15 bp, Homo sapiens
gtgcagactggaggg

SEQ ID NO: 3737066 - DNA, 23 bp, Homo sapiens
gtgcagactggaggggacgctgg

SEQ ID NO: 3737067 - DNA, 18 bp, Homo sapiens
gtgcagagtgcccagaac

SEQ ID NO: 3737068 - DNA, 19 bp, Homo sapiens
gtgcagcccgtgtggcccc

SEQ ID NO: 3737069 - DNA, 14 bp, Homo sapiens
gtgcagctgatttt

SEQ ID NO: 3737070 - DNA, 13 bp, Homo sapiens
gtgcatctcagcc

SEQ ID NO: 3737071 - DNA, 23 bp, Homo sapiens
gtgcattacagagaggagaaaca

SEQ ID NO: 3737072 - DNA, 22 bp, Homo sapiens
gtgcatttttgtgaaatgaaaa

SEQ ID NO: 3737073 - DNA, 17 bp, Homo sapiens
gtgccaagcacagtgcc

SEQ ID NO: 3737074 - DNA, 17 bp, Homo sapiens
gtgccactgcccgagct

SEQ ID NO: 3737075 - DNA, 19 bp, Homo sapiens
gtgccactgcccgagctgg

SEQ ID NO: 3737076 - DNA, 13 bp, Homo sapiens
gtgccaggcccgg

SEQ ID NO: 3737077 - DNA, 14 bp, Homo sapiens
gtgccatgtgccag

SEQ ID NO: 3737078 - DNA, 16 bp, Homo sapiens
gtgccatgtgccaggt

SEQ ID NO: 3737079 - DNA, 20 bp, Homo sapiens
gtgcccaagaatagatgctg

SEQ ID NO: 3737080 - DNA, 23 bp, Homo sapiens
gtgcccaagaatagatgctgact

SEQ ID NO: 3737081 - DNA, 12 bp, Homo sapiens
gtgcccacagcc

SEQ ID NO: 3737082 - DNA, 14 bp, Homo sapiens
gtgcccacagcccg

SEQ ID NO: 3737083 - DNA, 22 bp, Homo sapiens
gtgcccacagcccgcatgcagc

SEQ ID NO: 3737084 - DNA, 21 bp, Homo sapiens
gtgcccacatgtgtccatccc

SEQ ID NO: 3737085 - DNA, 23 bp, Homo sapiens
gtgcccacatgtgtccatcccag

SEQ ID NO: 3737086 - DNA, 12 bp, Homo sapiens
gtgcccagctca

SEQ ID NO: 3737087 - DNA, 13 bp, Homo sapiens
gtgccccacctgc

SEQ ID NO: 3737088 - DNA, 15 bp, Homo sapiens
gtgccccacctgcca

SEQ ID NO: 3737089 - DNA, 16 bp, Homo sapiens
gtgccccatgcctgtc

SEQ ID NO: 3737090 - DNA, 12 bp, Homo sapiens
gtgcccccagac

SEQ ID NO: 3737091 - DNA, 20 bp, Homo sapiens
gtgccctccacagccgcagc

SEQ ID NO: 3737092 - DNA, 22 bp, Homo sapiens
gtgccgagaaggaagcctccca

SEQ ID NO: 3737093 - DNA, 23 bp, Homo sapiens
gtgccgtagggagtacctgctgc

SEQ ID NO: 3737094 - DNA, 21 bp, Homo sapiens
gtgccgttactctccaacctg

SEQ ID NO: 3737095 - DNA, 12 bp, Homo sapiens
gtgcctctgcct

SEQ ID NO: 3737096 - DNA, 12 bp, Homo sapiens
gtgcctgagagt

SEQ ID NO: 3737097 - DNA, 15 bp, Homo sapiens
gtgcctgcaccagga

SEQ ID NO: 3737098 - DNA, 18 bp, Homo sapiens
gtgcctgcaccaggagac

SEQ ID NO: 3737099 - DNA, 12 bp, Homo sapiens
gtgcctggagct

SEQ ID NO: 3737100 - DNA, 23 bp, Homo sapiens
gtgcctgggaaccttcctgtctt

SEQ ID NO: 3737101 - DNA, 15 bp, Homo sapiens
gtgcctgggaatgta

SEQ ID NO: 3737102 - DNA, 16 bp, Homo sapiens
gtgcctgggaatgtat

SEQ ID NO: 3737103 - DNA, 15 bp, Homo sapiens
gtgccttacctcctg

SEQ ID NO: 3737104 - DNA, 18 bp, Homo sapiens
gtgccttacctcctgccc

SEQ ID NO: 3737105 - DNA, 21 bp, Homo sapiens
gtgccttacctcctgcccagg

SEQ ID NO: 3737106 - DNA, 12 bp, Homo sapiens
gtgccttccata

SEQ ID NO: 3737107 - DNA, 15 bp, Homo sapiens
gtgccttccataatt

SEQ ID NO: 3737108 - DNA, 17 bp, Homo sapiens
gtgcctttcctgttcag

SEQ ID NO: 3737109 - DNA, 18 bp, Homo sapiens
gtgcctttcctgttcagc

SEQ ID NO: 3737110 - DNA, 22 bp, Homo sapiens
gtgcctttcctgttcagcattc

SEQ ID NO: 3737111 - DNA, 23 bp, Homo sapiens
gtgcgagtgtgtgcatgtgtgtg

SEQ ID NO: 3737112 - DNA, 23 bp, Homo sapiens
gtgcgatcatggctcactgcagc

SEQ ID NO: 3737113 - DNA, 14 bp, Homo sapiens
gtgcgcctacagga

SEQ ID NO: 3737114 - DNA, 15 bp, Homo sapiens
gtgcgtgaaacacac

SEQ ID NO: 3737115 - DNA, 21 bp, Homo sapiens
gtgcgtgaaacacaccaggct

SEQ ID NO: 3737116 - DNA, 12 bp, Homo sapiens
gtgcgtgggtga

SEQ ID NO: 3737117 - DNA, 13 bp, Homo sapiens
gtgcgtgtgtcca

SEQ ID NO: 3737118 - DNA, 12 bp, Homo sapiens
gtgctatgttct

SEQ ID NO: 3737119 - DNA, 22 bp, Homo sapiens
gtgctgaacaaaaaataaaaat

SEQ ID NO: 3737120 - DNA, 15 bp, Homo sapiens
gtgctgaagcttatt

SEQ ID NO: 3737121 - DNA, 23 bp, Homo sapiens
gtgctgaatggttttcaaaataa

SEQ ID NO: 3737122 - DNA, 12 bp, Homo sapiens
gtgctgccacac

SEQ ID NO: 3737123 - DNA, 15 bp, Homo sapiens
gtgctggctgcccag

SEQ ID NO: 3737124 - DNA, 20 bp, Homo sapiens
gtgctgggattacaggtgtg

SEQ ID NO: 3737125 - DNA, 17 bp, Homo sapiens
gtgctgtggcctgggca

SEQ ID NO: 3737126 - DNA, 19 bp, Homo sapiens
gtgctgtggcctgggcaag

SEQ ID NO: 3737127 - DNA, 20 bp, Homo sapiens
gtgctgttgtcattgcttta

SEQ ID NO: 3737128 - DNA, 21 bp, Homo sapiens
gtgcttatcccatagccagga

SEQ ID NO: 3737129 - DNA, 18 bp, Homo sapiens
gtgcttcagcctgaggct

SEQ ID NO: 3737130 - DNA, 12 bp, Homo sapiens
gtgctttaagtg

SEQ ID NO: 3737131 - DNA, 23 bp, Homo sapiens
gtgctttcttctcccaattcatc

SEQ ID NO: 3737132 - DNA, 15 bp, Homo sapiens
gtggaaagcctctgc

SEQ ID NO: 3737133 - DNA, 22 bp, Homo sapiens
gtggaaagggtgctgcttccct

SEQ ID NO: 3737134 - DNA, 13 bp, Homo sapiens
gtggaagccctcc

SEQ ID NO: 3737135 - DNA, 13 bp, Homo sapiens
gtggaatataaag

SEQ ID NO: 3737136 - DNA, 15 bp, Homo sapiens
gtggacacagctctt

SEQ ID NO: 3737137 - DNA, 17 bp, Homo sapiens
gtggacacagctcttct

SEQ ID NO: 3737138 - DNA, 24 bp, Homo sapiens
gtggacacagctcttctccaggct

SEQ ID NO: 3737139 - DNA, 15 bp, Homo sapiens
gtggacaccaggagt

SEQ ID NO: 3737140 - DNA, 15 bp, Homo sapiens
gtggacagtcctggg

SEQ ID NO: 3737141 - DNA, 18 bp, Homo sapiens
gtggaccaggacaggacc

SEQ ID NO: 3737142 - DNA, 22 bp, Homo sapiens
gtggacccagggatgacatgtc

SEQ ID NO: 3737143 - DNA, 16 bp, Homo sapiens
gtggactttccacccc

SEQ ID NO: 3737144 - DNA, 20 bp, Homo sapiens
gtggagaagcggctggcagc

SEQ ID NO: 3737145 - DNA, 16 bp, Homo sapiens
gtggaggagagcctgg

SEQ ID NO: 3737146 - DNA, 23 bp, Homo sapiens
gtggaggagctcaggacactaat

SEQ ID NO: 3737147 - DNA, 13 bp, Homo sapiens
gtggaggtgctgc

SEQ ID NO: 3737148 - DNA, 21 bp, Homo sapiens
gtggaggttaaggctgaggaa

SEQ ID NO: 3737149 - DNA, 23 bp, Homo sapiens
gtggaggttgcagtgagccaaga

SEQ ID NO: 3737150 - DNA, 12 bp, Homo sapiens
taaataaataca

SEQ ID NO: 3737151 - DNA, 16 bp, Homo sapiens
taaataaatgtcatta

SEQ ID NO: 3737152 - DNA, 19 bp, Homo sapiens
taaataaccccattctttg

SEQ ID NO: 3737153 - DNA, 21 bp, Homo sapiens
taaataaccccattctttgct

SEQ ID NO: 3737154 - DNA, 19 bp, Homo sapiens
taaatacaagttctattta

SEQ ID NO: 3737155 - DNA, 19 bp, Homo sapiens
taaatacacatagcatgta

SEQ ID NO: 3737156 - DNA, 22 bp, Homo sapiens
taaatacctcaacctatggtat

SEQ ID NO: 3737157 - DNA, 14 bp, Homo sapiens
taaatagctatatc

SEQ ID NO: 3737158 - DNA, 19 bp, Homo sapiens
taaatagtaaaaataaaat

SEQ ID NO: 3737159 - DNA, 13 bp, Homo sapiens
taaatatatgtat

SEQ ID NO: 3737160 - DNA, 14 bp, Homo sapiens
taaatatatgtatg

SEQ ID NO: 3737161 - DNA, 20 bp, Homo sapiens
taaatatatgtatgtaaaaa

SEQ ID NO: 3737162 - DNA, 17 bp, Homo sapiens
taaatatatttaagata

SEQ ID NO: 3737163 - DNA, 16 bp, Homo sapiens
taaatatcaatcattt

SEQ ID NO: 3737164 - DNA, 18 bp, Homo sapiens
taaatatgttagcaaaga

SEQ ID NO: 3737165 - DNA, 11 bp, Homo sapiens
taaatatttac

SEQ ID NO: 3737166 - DNA, 18 bp, Homo sapiens
taaatatttacatatgaa

SEQ ID NO: 3737167 - DNA, 19 bp, Homo sapiens
taaatatttacatatgaaa

SEQ ID NO: 3737168 - DNA, 15 bp, Homo sapiens
taaatatttccttaa

SEQ ID NO: 3737169 - DNA, 19 bp, Homo sapiens
taaatcaagttggcttcta

SEQ ID NO: 3737170 - DNA, 19 bp, Homo sapiens
taaatcagccgtgtaacca

SEQ ID NO: 3737171 - DNA, 22 bp, Homo sapiens
taaatcatgttaatcctagctg

SEQ ID NO: 3737172 - DNA, 15 bp, Homo sapiens
taaatcccattcata

SEQ ID NO: 3737173 - DNA, 11 bp, Homo sapiens
taaatcctgtt

SEQ ID NO: 3737174 - DNA, 14 bp, Homo sapiens
taaatcctgttgaa

SEQ ID NO: 3737175 - DNA, 15 bp, Homo sapiens
taaatcctgttgaaa

SEQ ID NO: 3737176 - DNA, 18 bp, Homo sapiens
taaatcctgttgaaaagc

SEQ ID NO: 3737177 - DNA, 23 bp, Homo sapiens
taaatcctgttgaaaagccatgt

SEQ ID NO: 3737178 - DNA, 18 bp, Homo sapiens
taaatgcaatatgtatta

SEQ ID NO: 3737179 - DNA, 17 bp, Homo sapiens
taaatggtcgcccagga

SEQ ID NO: 3737180 - DNA, 16 bp, Homo sapiens
taaatgtaggtatgaa

SEQ ID NO: 3737181 - DNA, 13 bp, Homo sapiens
taaatgtatacct

SEQ ID NO: 3737182 - DNA, 13 bp, Homo sapiens
taaatgtggtaaa

SEQ ID NO: 3737183 - DNA, 17 bp, Homo sapiens
taaatgttaccaaaaat

SEQ ID NO: 3737184 - DNA, 15 bp, Homo sapiens
taaatgttgaaagat

SEQ ID NO: 3737185 - DNA, 13 bp, Homo sapiens
taaattaaacaat

SEQ ID NO: 3737186 - DNA, 15 bp, Homo sapiens
taaattaaacaattt

SEQ ID NO: 3737187 - DNA, 22 bp, Homo sapiens
taaattaggaataaataaaaat

SEQ ID NO: 3737188 - DNA, 16 bp, Homo sapiens
taaattataaggactg

SEQ ID NO: 3737189 - DNA, 17 bp, Homo sapiens
taaattataaggactgc

SEQ ID NO: 3737190 - DNA, 19 bp, Homo sapiens
taaattataaggactgcat

SEQ ID NO: 3737191 - DNA, 21 bp, Homo sapiens
taaattataaggactgcatgg

SEQ ID NO: 3737192 - DNA, 14 bp, Homo sapiens
taaattattcagtt

SEQ ID NO: 3737193 - DNA, 22 bp, Homo sapiens
taaattattcagttaagaaaaa

SEQ ID NO: 3737194 - DNA, 11 bp, Homo sapiens
taaattatttt

SEQ ID NO: 3737195 - DNA, 16 bp, Homo sapiens
taaattattttaaatt

SEQ ID NO: 3737196 - DNA, 17 bp, Homo sapiens
taaattcacaatagaaa

SEQ ID NO: 3737197 - DNA, 22 bp, Homo sapiens
taaattcttttttaaattttct

SEQ ID NO: 3737198 - DNA, 13 bp, Homo sapiens
taaattgaaatat

SEQ ID NO: 3737199 - DNA, 16 bp, Homo sapiens
taaattgatgttgctg

SEQ ID NO: 3737200 - DNA, 15 bp, Homo sapiens
taaattgctccttga

SEQ ID NO: 3737201 - DNA, 12 bp, Homo sapiens
taaatttcaaat

SEQ ID NO: 3737202 - DNA, 15 bp, Homo sapiens
taaattttaatttat

SEQ ID NO: 3737203 - DNA, 14 bp, Homo sapiens
taaattttcttcag

SEQ ID NO: 3737204 - DNA, 15 bp, Homo sapiens
taacaaccaaagact

SEQ ID NO: 3737205 - DNA, 21 bp, Homo sapiens
taacaactatgatttggaaaa

SEQ ID NO: 3737206 - DNA, 19 bp, Homo sapiens
taacaagagtgattcttgc

SEQ ID NO: 3737207 - DNA, 16 bp, Homo sapiens
taacaataactactgt

SEQ ID NO: 3737208 - DNA, 23 bp, Homo sapiens
taacaataactactgtgttcctg

SEQ ID NO: 3737209 - DNA, 16 bp, Homo sapiens
taacacacataaagga

SEQ ID NO: 3737210 - DNA, 15 bp, Homo sapiens
taacacatttttaaa

SEQ ID NO: 3737211 - DNA, 15 bp, Homo sapiens
taacagatgcaatgt

SEQ ID NO: 3737212 - DNA, 21 bp, Homo sapiens
taacagatgcaatgtgctact

SEQ ID NO: 3737213 - DNA, 15 bp, Homo sapiens
taacagctgaggtct

SEQ ID NO: 3737214 - DNA, 15 bp, Homo sapiens
taacaggatgaaagt

SEQ ID NO: 3737215 - DNA, 16 bp, Homo sapiens
taacaggattagacag

SEQ ID NO: 3737216 - DNA, 19 bp, Homo sapiens
taacaggcagatacaggaa

SEQ ID NO: 3737217 - DNA, 17 bp, Homo sapiens
taacagggccttgctaa

SEQ ID NO: 3737218 - DNA, 18 bp, Homo sapiens
taacagggccttgctaat

SEQ ID NO: 3737219 - DNA, 16 bp, Homo sapiens
taacaggtctcctctt

SEQ ID NO: 3737220 - DNA, 18 bp, Homo sapiens
taacaggtctcctcttaa

SEQ ID NO: 3737221 - DNA, 22 bp, Homo sapiens
taacagtgccattgtctttata

SEQ ID NO: 3737222 - DNA, 16 bp, Homo sapiens
taacagtgtggtagtt

SEQ ID NO: 3737223 - DNA, 13 bp, Homo sapiens
taacagttttcca

SEQ ID NO: 3737224 - DNA, 16 bp, Homo sapiens
taacagttttccatga

SEQ ID NO: 3737225 - DNA, 19 bp, Homo sapiens
taacagttttccatgaaaa

SEQ ID NO: 3737226 - DNA, 23 bp, Homo sapiens
taacatccaataggaatgctaac

SEQ ID NO: 3737227 - DNA, 24 bp, Homo sapiens
taacatccaataggaatgctaaca

SEQ ID NO: 3737228 - DNA, 18 bp, Homo sapiens
taacatggacatgatctt

SEQ ID NO: 3737229 - DNA, 13 bp, Homo sapiens
taacattatattg

SEQ ID NO: 3737230 - DNA, 23 bp, Homo sapiens
taacattcgatctcattcagtat

SEQ ID NO: 3737231 - DNA, 16 bp, Homo sapiens
taacattgaccaagaa

SEQ ID NO: 3737232 - DNA, 18 bp, Homo sapiens
taacattgaccaagaact

SEQ ID NO: 3737233 - DNA, 22 bp, Homo sapiens
taacattgaccaagaactgcat

SEQ ID NO: 3737234 - DNA, 20 bp, Homo sapiens
taacattgggaaatcttata

SEQ ID NO: 3737235 - DNA, 18 bp, Homo sapiens
taacatttctaactctga

SEQ ID NO: 3737236 - DNA, 18 bp, Homo sapiens
taacatttgagtcccttc

SEQ ID NO: 3737237 - DNA, 13 bp, Homo sapiens
taaccaaatgcat

SEQ ID NO: 3737238 - DNA, 14 bp, Homo sapiens
taaccaaatgcatc

SEQ ID NO: 3737239 - DNA, 14 bp, Homo sapiens
taaccaatgtttaa

SEQ ID NO: 3737240 - DNA, 13 bp, Homo sapiens
taaccacggaaaa

SEQ ID NO: 3737241 - DNA, 15 bp, Homo sapiens
taaccacggaaaaga

SEQ ID NO: 3737242 - DNA, 12 bp, Homo sapiens
taaccactgctt

SEQ ID NO: 3737243 - DNA, 19 bp, Homo sapiens
taaccacttaaaaaatgtc

SEQ ID NO: 3737244 - DNA, 16 bp, Homo sapiens
taaccacttcagctga

SEQ ID NO: 3737245 - DNA, 21 bp, Homo sapiens
taaccagagcaagctttttta

SEQ ID NO: 3737246 - DNA, 23 bp, Homo sapiens
taaccagtctgaagtttcattta

SEQ ID NO: 3737247 - DNA, 19 bp, Homo sapiens
taaccccagctccctagga

SEQ ID NO: 3737248 - DNA, 23 bp, Homo sapiens
taacctggtgctggatattttca

SEQ ID NO: 3737249 - DNA, 19 bp, Homo sapiens
taacgaagttgggcaatat

SEQ ID NO: 3737250 - DNA, 15 bp, Homo sapiens
taacgtaaatacaca

SEQ ID NO: 3737251 - DNA, 14 bp, Homo sapiens
taactaaattaaca

SEQ ID NO: 3737252 - DNA, 19 bp, Homo sapiens
taactaatctattgggttc

SEQ ID NO: 3737253 - DNA, 12 bp, Homo sapiens
taactactgtgt

SEQ ID NO: 3737254 - DNA, 17 bp, Homo sapiens
taactagtcctttacta

SEQ ID NO: 3737255 - DNA, 14 bp, Homo sapiens
taactatgtacaat

SEQ ID NO: 3737256 - DNA, 17 bp, Homo sapiens
taactatgtacaatatt

SEQ ID NO: 3737257 - DNA, 18 bp, Homo sapiens
taactatgtacaatattt

SEQ ID NO: 3737258 - DNA, 22 bp, Homo sapiens
taactatgtacaatattttaag

SEQ ID NO: 3737259 - DNA, 16 bp, Homo sapiens
taactcaggactccag

SEQ ID NO: 3737260 - DNA, 14 bp, Homo sapiens
taactcatcataaa

SEQ ID NO: 3737261 - DNA, 15 bp, Homo sapiens
taactctgatgtaaa

SEQ ID NO: 3737262 - DNA, 12 bp, Homo sapiens
taactctttgga

SEQ ID NO: 3737263 - DNA, 12 bp, Homo sapiens
taactgacaaat

SEQ ID NO: 3737264 - DNA, 22 bp, Homo sapiens
tactctttgagatagaagaact

SEQ ID NO: 3737265 - DNA, 18 bp, Homo sapiens
tactgagcttctctgtga

SEQ ID NO: 3737266 - DNA, 17 bp, Homo sapiens
tactgcagcctccagag

SEQ ID NO: 3737267 - DNA, 17 bp, Homo sapiens
tactgcatatgaaagga

SEQ ID NO: 3737268 - DNA, 22 bp, Homo sapiens
tactgcccaggcctgcctgttc

SEQ ID NO: 3737269 - DNA, 18 bp, Homo sapiens
tactggaagttttgcatt

SEQ ID NO: 3737270 - DNA, 18 bp, Homo sapiens
tactggatttgttgttct

SEQ ID NO: 3737271 - DNA, 22 bp, Homo sapiens
tactgtatttttacctttttcc

SEQ ID NO: 3737272 - DNA, 13 bp, Homo sapiens
tactgtcttaatt

SEQ ID NO: 3737273 - DNA, 14 bp, Homo sapiens
tactgtcttaatta

SEQ ID NO: 3737274 - DNA, 20 bp, Homo sapiens
tactgtcttaattaagtaaa

SEQ ID NO: 3737275 - DNA, 21 bp, Homo sapiens
tactgtcttcagtaagccgtg

SEQ ID NO: 3737276 - DNA, 16 bp, Homo sapiens
tactgtggaaaaatat

SEQ ID NO: 3737277 - DNA, 19 bp, Homo sapiens
tactgtggaaaaatattta

SEQ ID NO: 3737278 - DNA, 22 bp, Homo sapiens
tactgtgtacagaattctgcta

SEQ ID NO: 3737279 - DNA, 23 bp, Homo sapiens
tactgtgtacagaattctgctac

SEQ ID NO: 3737280 - DNA, 14 bp, Homo sapiens
tactgtgttcctgg

SEQ ID NO: 3737281 - DNA, 19 bp, Homo sapiens
tactgtgttcctggcaata

SEQ ID NO: 3737282 - DNA, 22 bp, Homo sapiens
tactgtgttcctggcaatagtg

SEQ ID NO: 3737283 - DNA, 19 bp, Homo sapiens
tacttaataaattcagata

SEQ ID NO: 3737284 - DNA, 16 bp, Homo sapiens
tacttagcttatcaat

SEQ ID NO: 3737285 - DNA, 18 bp, Homo sapiens
tacttagcttatcaattt

SEQ ID NO: 3737286 - DNA, 19 bp, Homo sapiens
tacttagcttatcaatttg

SEQ ID NO: 3737287 - DNA, 17 bp, Homo sapiens
tacttagtggtgtatat

SEQ ID NO: 3737288 - DNA, 18 bp, Homo sapiens
tacttcaagttaaagtga

SEQ ID NO: 3737289 - DNA, 23 bp, Homo sapiens
tacttcccattttggaagttttc

SEQ ID NO: 3737290 - DNA, 15 bp, Homo sapiens
tacttcttatacatt

SEQ ID NO: 3737291 - DNA, 18 bp, Homo sapiens
tacttcttcattcaatac

SEQ ID NO: 3737292 - DNA, 21 bp, Homo sapiens
tacttgggagacctgtaatca

SEQ ID NO: 3737293 - DNA, 12 bp, Homo sapiens
tacttgggaggc

SEQ ID NO: 3737294 - DNA, 18 bp, Homo sapiens
tacttgtggacacagctc

SEQ ID NO: 3737295 - DNA, 19 bp, Homo sapiens
tacttgtggacacagctct

SEQ ID NO: 3737296 - DNA, 13 bp, Homo sapiens
tacttgttcaaaa

SEQ ID NO: 3737297 - DNA, 14 bp, Homo sapiens
tacttgtttcagag

SEQ ID NO: 3737298 - DNA, 22 bp, Homo sapiens
tactttgtatgatattccatag

SEQ ID NO: 3737299 - DNA, 20 bp, Homo sapiens
tactttgtcctttttgttat

SEQ ID NO: 3737300 - DNA, 11 bp, Homo sapiens
tacttttggaa

SEQ ID NO: 3737301 - DNA, 13 bp, Homo sapiens
tacttttggaatc

SEQ ID NO: 3737302 - DNA, 18 bp, Homo sapiens
tactttttcaagattgat

SEQ ID NO: 3737303 - DNA, 14 bp, Homo sapiens
tacttttttcttat

SEQ ID NO: 3737304 - DNA, 13 bp, Homo sapiens
tagaaaaagcagt

SEQ ID NO: 3737305 - DNA, 21 bp, Homo sapiens
tagaaaaggctaggtacacag

SEQ ID NO: 3737306 - DNA, 17 bp, Homo sapiens
tagaaaatttaaaacat

SEQ ID NO: 3737307 - DNA, 22 bp, Homo sapiens
tagaaacttatcttacaaagtg

SEQ ID NO: 3737308 - DNA, 18 bp, Homo sapiens
tagaaagagatacagagg

SEQ ID NO: 3737309 - DNA, 20 bp, Homo sapiens
tagaaagtgaataaaaatta

SEQ ID NO: 3737310 - DNA, 21 bp, Homo sapiens
tagaaagtgaataaaaattaa

SEQ ID NO: 3737311 - DNA, 19 bp, Homo sapiens
tagaaataaatagctatat

SEQ ID NO: 3737312 - DNA, 22 bp, Homo sapiens
tagaaatccccctttctctaat

SEQ ID NO: 3737313 - DNA, 18 bp, Homo sapiens
tagaaatgaccaatatta

SEQ ID NO: 3737314 - DNA, 19 bp, Homo sapiens
tagaaatgatgatgtggaa

SEQ ID NO: 3737315 - DNA, 19 bp, Homo sapiens
tagaaatgtaacttttgta

SEQ ID NO: 3737316 - DNA, 19 bp, Homo sapiens
tagaaattacacccaaaga

SEQ ID NO: 3737317 - DNA, 18 bp, Homo sapiens
tagaaattagctgtgtga

SEQ ID NO: 3737318 - DNA, 12 bp, Homo sapiens
tagaacactatt

SEQ ID NO: 3737319 - DNA, 18 bp, Homo sapiens
tagaacactattttcaga

SEQ ID NO: 3737320 - DNA, 21 bp, Homo sapiens
tagaacagaaaacaacaaaaa

SEQ ID NO: 3737321 - DNA, 16 bp, Homo sapiens
tagaaccactatgaag

SEQ ID NO: 3737322 - DNA, 19 bp, Homo sapiens
tagaactcagttttaacta

SEQ ID NO: 3737323 - DNA, 18 bp, Homo sapiens
tagaagaaaaaagaatgt

SEQ ID NO: 3737324 - DNA, 12 bp, Homo sapiens
tagaagaaatga

SEQ ID NO: 3737325 - DNA, 14 bp, Homo sapiens
tagaagaaatgaaa

SEQ ID NO: 3737326 - DNA, 22 bp, Homo sapiens
tagaagaaatgaaattttacca

SEQ ID NO: 3737327 - DNA, 21 bp, Homo sapiens
tagaagaatacaaacatattt

SEQ ID NO: 3737328 - DNA, 17 bp, Homo sapiens
tagaaggagacagagct

SEQ ID NO: 3737329 - DNA, 20 bp, Homo sapiens
tagaagtaggaagtgaaaat

SEQ ID NO: 3737330 - DNA, 15 bp, Homo sapiens
tagaagtcacacagt

SEQ ID NO: 3737331 - DNA, 20 bp, Homo sapiens
tagaagtcttagatgtatat

SEQ ID NO: 3737332 - DNA, 18 bp, Homo sapiens
tagaatataattatcgga

SEQ ID NO: 3737333 - DNA, 13 bp, Homo sapiens
tagaatctgtgta

SEQ ID NO: 3737334 - DNA, 14 bp, Homo sapiens
tagaatgttttcct

SEQ ID NO: 3737335 - DNA, 16 bp, Homo sapiens
tagaattttaagtgct

SEQ ID NO: 3737336 - DNA, 22 bp, Homo sapiens
tagacaagtccagcctggcaag

SEQ ID NO: 3737337 - DNA, 14 bp, Homo sapiens
tagaccaagcttgt

SEQ ID NO: 3737338 - DNA, 21 bp, Homo sapiens
tagacctcagcctgtgctgcc

SEQ ID NO: 3737339 - DNA, 22 bp, Homo sapiens
tagacctcagcctgtgctgccc

SEQ ID NO: 3737340 - DNA, 16 bp, Homo sapiens
tagacctccagctgtt

SEQ ID NO: 3737341 - DNA, 15 bp, Homo sapiens
tagacttgaaatact

SEQ ID NO: 3737342 - DNA, 22 bp, Homo sapiens
tagagaaaccgtcctctttttc

SEQ ID NO: 3737343 - DNA, 14 bp, Homo sapiens
tagagactgtagat

SEQ ID NO: 3737344 - DNA, 17 bp, Homo sapiens
tagagatagtacataaa

SEQ ID NO: 3737345 - DNA, 14 bp, Homo sapiens
tagagatgcctccc

SEQ ID NO: 3737346 - DNA, 16 bp, Homo sapiens
tagagcacactgtagc

SEQ ID NO: 3737347 - DNA, 19 bp, Homo sapiens
tagagcagatgacccctcc

SEQ ID NO: 3737348 - DNA, 17 bp, Homo sapiens
tagagctagtctttcac

SEQ ID NO: 3737349 - DNA, 18 bp, Homo sapiens
tagaggaaaaaaatgact

SEQ ID NO: 3737350 - DNA, 19 bp, Homo sapiens
tagagtccaacgtggggca

SEQ ID NO: 3737351 - DNA, 14 bp, Homo sapiens
tagagtcctcactc

SEQ ID NO: 3737352 - DNA, 15 bp, Homo sapiens
tagataactctttgg

SEQ ID NO: 3737353 - DNA, 12 bp, Homo sapiens
tagatagaaata

SEQ ID NO: 3737354 - DNA, 23 bp, Homo sapiens
tagatagaaataaatagctatat

SEQ ID NO: 3737355 - DNA, 21 bp, Homo sapiens
tagatatctttttattgatgt

SEQ ID NO: 3737356 - DNA, 22 bp, Homo sapiens
tagatatctttttattgatgtg

SEQ ID NO: 3737357 - DNA, 16 bp, Homo sapiens
tagatccacacacaga

SEQ ID NO: 3737358 - DNA, 20 bp, Homo sapiens
tagatgagaattcagctgcc

SEQ ID NO: 3737359 - DNA, 22 bp, Homo sapiens
tagatgagaattcagctgcccc

SEQ ID NO: 3737360 - DNA, 16 bp, Homo sapiens
tagatgcctgaacttg

SEQ ID NO: 3737361 - DNA, 18 bp, Homo sapiens
tagatgtccctttcttgg

SEQ ID NO: 3737362 - DNA, 23 bp, Homo sapiens
tagatgtccctttcttggccagt

SEQ ID NO: 3737363 - DNA, 21 bp, Homo sapiens
tagattaccccctcattgttt

SEQ ID NO: 3737364 - DNA, 18 bp, Homo sapiens
tagattatattgagacaa

SEQ ID NO: 3737365 - DNA, 17 bp, Homo sapiens
tagattcacctgtaaaa

SEQ ID NO: 3737366 - DNA, 13 bp, Homo sapiens
tagatttctgatt

SEQ ID NO: 3737367 - DNA, 14 bp, Homo sapiens
tagatttctgattt

SEQ ID NO: 3737368 - DNA, 15 bp, Homo sapiens
tagatttgttttgtg

SEQ ID NO: 3737369 - DNA, 16 bp, Homo sapiens
tagattttaatcaaat

SEQ ID NO: 3737370 - DNA, 23 bp, Homo sapiens
tagcaaaacgcatggagtgtgta

SEQ ID NO: 3737371 - DNA, 22 bp, Homo sapiens
tagcaagtgaatttttctctaa

SEQ ID NO: 3737372 - DNA, 18 bp, Homo sapiens
tagcaagttacagtgatg

SEQ ID NO: 3737373 - DNA, 13 bp, Homo sapiens
tagcacaaaaaaa

SEQ ID NO: 3737374 - DNA, 18 bp, Homo sapiens
tagcacgtttaaagttct

SEQ ID NO: 3737375 - DNA, 19 bp, Homo sapiens
tagcacgtttaaagttctg

SEQ ID NO: 3737376 - DNA, 19 bp, Homo sapiens
tattttattccctttcaca

SEQ ID NO: 3737377 - DNA, 12 bp, Homo sapiens
tattttcagaat

SEQ ID NO: 3737378 - DNA, 14 bp, Homo sapiens
tattttcagaatct

SEQ ID NO: 3737379 - DNA, 21 bp, Homo sapiens
tattttcagaatctgaatgta

SEQ ID NO: 3737380 - DNA, 22 bp, Homo sapiens
tattttcagaatctgaatgtaa

SEQ ID NO: 3737381 - DNA, 23 bp, Homo sapiens
tattttcagaatctgaatgtaat

SEQ ID NO: 3737382 - DNA, 20 bp, Homo sapiens
tattttccatgaaaatgcaa

SEQ ID NO: 3737383 - DNA, 23 bp, Homo sapiens
tattttcccaatagcactttcat

SEQ ID NO: 3737384 - DNA, 16 bp, Homo sapiens
tattttcctccccagc

SEQ ID NO: 3737385 - DNA, 16 bp, Homo sapiens
tattttcttttgtaaa

SEQ ID NO: 3737386 - DNA, 17 bp, Homo sapiens
tatttttaattaaataa

SEQ ID NO: 3737387 - DNA, 13 bp, Homo sapiens
tatttttagatgg

SEQ ID NO: 3737388 - DNA, 19 bp, Homo sapiens
tatttttatatagcttgaa

SEQ ID NO: 3737389 - DNA, 15 bp, Homo sapiens
tatttttcacagttt

SEQ ID NO: 3737390 - DNA, 23 bp, Homo sapiens
tatttttgttggagccactctgt

SEQ ID NO: 3737391 - DNA, 19 bp, Homo sapiens
tatttttgttgtgttctgt

SEQ ID NO: 3737392 - DNA, 14 bp, Homo sapiens
tatttttgtttgtt

SEQ ID NO: 3737393 - DNA, 15 bp, Homo sapiens
tattttttaagtatt

SEQ ID NO: 3737394 - DNA, 13 bp, Homo sapiens
tattttttataca

SEQ ID NO: 3737395 - DNA, 14 bp, Homo sapiens
tattttttatacag

SEQ ID NO: 3737396 - DNA, 12 bp, Homo sapiens
tattttttatga

SEQ ID NO: 3737397 - DNA, 14 bp, Homo sapiens
tatttttttctacc

SEQ ID NO: 3737398 - DNA, 23 bp, Homo sapiens
tcaaaaatgtacaaaataaagtt

SEQ ID NO: 3737399 - DNA, 16 bp, Homo sapiens
tcaaaagctgggcagg

SEQ ID NO: 3737400 - DNA, 14 bp, Homo sapiens
tcaaaagttgaaat

SEQ ID NO: 3737401 - DNA, 15 bp, Homo sapiens
tcaaaagttgaaatt

SEQ ID NO: 3737402 - DNA, 20 bp, Homo sapiens
tcaaaataaaaaccaagaag

SEQ ID NO: 3737403 - DNA, 15 bp, Homo sapiens
tcaaaatatgttctt

SEQ ID NO: 3737404 - DNA, 16 bp, Homo sapiens
tcaaaatatttgtaca

SEQ ID NO: 3737405 - DNA, 18 bp, Homo sapiens
tcaaaatatttgtacata

SEQ ID NO: 3737406 - DNA, 19 bp, Homo sapiens
tcaaaatatttgtacatag

SEQ ID NO: 3737407 - DNA, 17 bp, Homo sapiens
tcaaacaaagccagaag

SEQ ID NO: 3737408 - DNA, 21 bp, Homo sapiens
tcaaacaaagccagaagctga

SEQ ID NO: 3737409 - DNA, 21 bp, Homo sapiens
tcaaaccagtatacaagataa

SEQ ID NO: 3737410 - DNA, 14 bp, Homo sapiens
tcaaactaacacat

SEQ ID NO: 3737411 - DNA, 22 bp, Homo sapiens
tcaaactcttgacctcaggtga

SEQ ID NO: 3737412 - DNA, 12 bp, Homo sapiens
tcaaagaaggaa

SEQ ID NO: 3737413 - DNA, 10 bp, Homo sapiens
tcaaagcaag

SEQ ID NO: 3737414 - DNA, 20 bp, Homo sapiens
tcaaagcttgaagatcgtta

SEQ ID NO: 3737415 - DNA, 19 bp, Homo sapiens
tcaaaggcacagtgaaggc

SEQ ID NO: 3737416 - DNA, 19 bp, Homo sapiens
tcaaaggtagccatcatgg

SEQ ID NO: 3737417 - DNA, 14 bp, Homo sapiens
tcaaagtaaaactt

SEQ ID NO: 3737418 - DNA, 19 bp, Homo sapiens
tcaaagtaaaacttgctgc

SEQ ID NO: 3737419 - DNA, 13 bp, Homo sapiens
tcaaatacatctt

SEQ ID NO: 3737420 - DNA, 12 bp, Homo sapiens
tcaaattgtatc

SEQ ID NO: 3737421 - DNA, 13 bp, Homo sapiens
tcaaattgtatct

SEQ ID NO: 3737422 - DNA, 12 bp, Homo sapiens
tcaacagagaag

SEQ ID NO: 3737423 - DNA, 15 bp, Homo sapiens
tcaacatcaatgttc

SEQ ID NO: 3737424 - DNA, 17 bp, Homo sapiens
tcaacatcaatgttcat

SEQ ID NO: 3737425 - DNA, 20 bp, Homo sapiens
tcaacatcaatgttcattgt

SEQ ID NO: 3737426 - DNA, 15 bp, Homo sapiens
tcaacatcttttaca

SEQ ID NO: 3737427 - DNA, 15 bp, Homo sapiens
tcaacccagaaacac

SEQ ID NO: 3737428 - DNA, 18 bp, Homo sapiens
tcaaccctccctcagccc

SEQ ID NO: 3737429 - DNA, 13 bp, Homo sapiens
tcaacctcctggg

SEQ ID NO: 3737430 - DNA, 12 bp, Homo sapiens
tcaacctgtaaa

SEQ ID NO: 3737431 - DNA, 18 bp, Homo sapiens
tcaacctgtaaattattt

SEQ ID NO: 3737432 - DNA, 15 bp, Homo sapiens
tcaacctgtgatgag

SEQ ID NO: 3737433 - DNA, 19 bp, Homo sapiens
tcaactcacctaatgttta

SEQ ID NO: 3737434 - DNA, 23 bp, Homo sapiens
tcaactgaaaagactcagtgttc

SEQ ID NO: 3737435 - DNA, 20 bp, Homo sapiens
tcaagaaagccagtcttaac

SEQ ID NO: 3737436 - DNA, 16 bp, Homo sapiens
tcaagaccagcctggc

SEQ ID NO: 3737437 - DNA, 16 bp, Homo sapiens
tcaagaccttctcccc

SEQ ID NO: 3737438 - DNA, 20 bp, Homo sapiens
tcaagagggcactggtggcc

SEQ ID NO: 3737439 - DNA, 21 bp, Homo sapiens
tcaagagggcactggtggccc

SEQ ID NO: 3737440 - DNA, 17 bp, Homo sapiens
tcaagataaaggacagt

SEQ ID NO: 3737441 - DNA, 18 bp, Homo sapiens
tcaagatgtcagactggc

SEQ ID NO: 3737442 - DNA, 14 bp, Homo sapiens
tcaagcaccaggga

SEQ ID NO: 3737443 - DNA, 14 bp, Homo sapiens
tcaagcatctcctg

SEQ ID NO: 3737444 - DNA, 15 bp, Homo sapiens
tcaagccaagcagcc

SEQ ID NO: 3737445 - DNA, 16 bp, Homo sapiens
tcaagccaagcagcca

SEQ ID NO: 3737446 - DNA, 17 bp, Homo sapiens
tcaagccaagcagccaa

SEQ ID NO: 3737447 - DNA, 19 bp, Homo sapiens
tcaagccaagcagccaagc

SEQ ID NO: 3737448 - DNA, 13 bp, Homo sapiens
tcaagcccaggag

SEQ ID NO: 3737449 - DNA, 16 bp, Homo sapiens
tcaagcccaggaggac

SEQ ID NO: 3737450 - DNA, 19 bp, Homo sapiens
tcaagcccaggaggactgc

SEQ ID NO: 3737451 - DNA, 19 bp, Homo sapiens
tcaagctaataaaatatca

SEQ ID NO: 3737452 - DNA, 14 bp, Homo sapiens
tcaagctgcttgga

SEQ ID NO: 3737453 - DNA, 19 bp, Homo sapiens
tcaaggacaaagtctccag

SEQ ID NO: 3737454 - DNA, 20 bp, Homo sapiens
tcaaggacaaagtctccagc

SEQ ID NO: 3737455 - DNA, 23 bp, Homo sapiens
tcaaggacaaagtctccagccca

SEQ ID NO: 3737456 - DNA, 22 bp, Homo sapiens
tcaaggccagcaaggtggagtg

SEQ ID NO: 3737457 - DNA, 18 bp, Homo sapiens
tcaaggcctgtccctggc

SEQ ID NO: 3737458 - DNA, 18 bp, Homo sapiens
tcaaggcgtgaggatggg

SEQ ID NO: 3737459 - DNA, 14 bp, Homo sapiens
tcaagggctgtagg

SEQ ID NO: 3737460 - DNA, 16 bp, Homo sapiens
tcaaggtaaaattcta

SEQ ID NO: 3737461 - DNA, 15 bp, Homo sapiens
tcaaggtcgtttttt

SEQ ID NO: 3737462 - DNA, 16 bp, Homo sapiens
tcaagtaagaagacat

SEQ ID NO: 3737463 - DNA, 16 bp, Homo sapiens
tcaagtaattgtgaaa

SEQ ID NO: 3737464 - DNA, 22 bp, Homo sapiens
tcaagtccttacctcttccgga

SEQ ID NO: 3737465 - DNA, 19 bp, Homo sapiens
tcaagtctctgctggccca

SEQ ID NO: 3737466 - DNA, 23 bp, Homo sapiens
tcaagtgaaaaaggaggaagaga

SEQ ID NO: 3737467 - DNA, 16 bp, Homo sapiens
tcaagtgtctcagtcc

SEQ ID NO: 3737468 - DNA, 21 bp, Homo sapiens
tcaagtgtctcagtccacctg

SEQ ID NO: 3737469 - DNA, 15 bp, Homo sapiens
tcaagttagctcagg

SEQ ID NO: 3737470 - DNA, 16 bp, Homo sapiens
tcaagttcaaggacca

SEQ ID NO: 3737471 - DNA, 21 bp, Homo sapiens
tcaataaaatcatgtacattt

SEQ ID NO: 3737472 - DNA, 18 bp, Homo sapiens
tcaataaaatgtgatttt

SEQ ID NO: 3737473 - DNA, 14 bp, Homo sapiens
tcaataaacagctt

SEQ ID NO: 3737474 - DNA, 21 bp, Homo sapiens
tcaataaagtgctttaaaaag

SEQ ID NO: 3737475 - DNA, 22 bp, Homo sapiens
tcaataacgaagttgggcaata

SEQ ID NO: 3737476 - DNA, 22 bp, Homo sapiens
tcaataagcctcagctttctaa

SEQ ID NO: 3737477 - DNA, 17 bp, Homo sapiens
tcaatacagtacaggca

SEQ ID NO: 3737478 - DNA, 18 bp, Homo sapiens
tcaatacagtacaggcag

SEQ ID NO: 3737479 - DNA, 20 bp, Homo sapiens
tcaatacagtacaggcagca

SEQ ID NO: 3737480 - DNA, 20 bp, Homo sapiens
tcaatatttattattttcac

SEQ ID NO: 3737481 - DNA, 20 bp, Homo sapiens
tcaatcctgtgtggtttagt

SEQ ID NO: 3737482 - DNA, 19 bp, Homo sapiens
tcaatggtttgcaaggaag

SEQ ID NO: 3737483 - DNA, 11 bp, Homo sapiens
tcaatgttcat

SEQ ID NO: 3737484 - DNA, 14 bp, Homo sapiens
tcaatgttcattgt

SEQ ID NO: 3737485 - DNA, 16 bp, Homo sapiens
tcaatgttcattgtaa

SEQ ID NO: 3737486 - DNA, 12 bp, Homo sapiens
tcaattaaatgt

SEQ ID NO: 3737487 - DNA, 14 bp, Homo sapiens
tcaattaaatgtag

SEQ ID NO: 3737488 - DNA, 14 bp, Homo sapiens
tcaattcatcaata

SEQ ID NO: 3737489 - DNA, 13 bp, Homo sapiens
tccacctggcccc

SEQ ID NO: 3737490 - DNA, 14 bp, Homo sapiens
tccaccttaaatta

SEQ ID NO: 3737491 - DNA, 18 bp, Homo sapiens
tccaccttaaattaaaca

SEQ ID NO: 3737492 - DNA, 22 bp, Homo sapiens
tccaccttaaattaaacaattt

SEQ ID NO: 3737493 - DNA, 18 bp, Homo sapiens
tccaccttcccatgccct

SEQ ID NO: 3737494 - DNA, 12 bp, Homo sapiens
tccacgctgtct

SEQ ID NO: 3737495 - DNA, 15 bp, Homo sapiens
tccacgctgtctcca

SEQ ID NO: 3737496 - DNA, 17 bp, Homo sapiens
tccacgtactgcagcct

SEQ ID NO: 3737497 - DNA, 18 bp, Homo sapiens
tccacgtactgcagcctc

SEQ ID NO: 3737498 - DNA, 14 bp, Homo sapiens
tccactccttcctg

SEQ ID NO: 3737499 - DNA, 12 bp, Homo sapiens
tccactgccctc

SEQ ID NO: 3737500 - DNA, 19 bp, Homo sapiens
tccactgtcactgtttctc

SEQ ID NO: 3737501 - DNA, 15 bp, Homo sapiens
tccactgtttattca

SEQ ID NO: 3737502 - DNA, 23 bp, Homo sapiens
tccacttagaaattgcatttcct

SEQ ID NO: 3737503 - DNA, 18 bp, Homo sapiens
tccactttcagtgaaagc

SEQ ID NO: 3737504 - DNA, 11 bp, Homo sapiens
tccagaaagaa

SEQ ID NO: 3737505 - DNA, 23 bp, Homo sapiens
tccagaaaggatatttaagaaaa

SEQ ID NO: 3737506 - DNA, 18 bp, Homo sapiens
tccagaagcctctggcta

SEQ ID NO: 3737507 - DNA, 18 bp, Homo sapiens
tccagaatggtctttcta

SEQ ID NO: 3737508 - DNA, 13 bp, Homo sapiens
tccagacactttt

SEQ ID NO: 3737509 - DNA, 21 bp, Homo sapiens
tccagacccccaccccttccc

SEQ ID NO: 3737510 - DNA, 16 bp, Homo sapiens
tccagacccccagcaa

SEQ ID NO: 3737511 - DNA, 13 bp, Homo sapiens
tccagacccctgg

SEQ ID NO: 3737512 - DNA, 16 bp, Homo sapiens
tccagacccctggctt

SEQ ID NO: 3737513 - DNA, 18 bp, Homo sapiens
tccagacccctggctttt

SEQ ID NO: 3737514 - DNA, 19 bp, Homo sapiens
tccagacccggctgcgtgg

SEQ ID NO: 3737515 - DNA, 23 bp, Homo sapiens
tccagactgcttccaattttctg

SEQ ID NO: 3737516 - DNA, 21 bp, Homo sapiens
tccagagagagaagtgcccct

SEQ ID NO: 3737517 - DNA, 22 bp, Homo sapiens
tccagattttttacagctgcct

SEQ ID NO: 3737518 - DNA, 20 bp, Homo sapiens
tccagccaacccctgtggag

SEQ ID NO: 3737519 - DNA, 23 bp, Homo sapiens
tccagccaacccctgtggagccc

SEQ ID NO: 3737520 - DNA, 19 bp, Homo sapiens
tccagccgccattgccacc

SEQ ID NO: 3737521 - DNA, 22 bp, Homo sapiens
tccagccgccattgccaccagg

SEQ ID NO: 3737522 - DNA, 11 bp, Homo sapiens
tccagcctggg

SEQ ID NO: 3737523 - DNA, 20 bp, Homo sapiens
tccagcctgggcgacagagc

SEQ ID NO: 3737524 - DNA, 23 bp, Homo sapiens
tccagctcaccagccccagtgcc

SEQ ID NO: 3737525 - DNA, 13 bp, Homo sapiens
tccagctcagcag

SEQ ID NO: 3737526 - DNA, 15 bp, Homo sapiens
tccagcttgctcttc

SEQ ID NO: 3737527 - DNA, 13 bp, Homo sapiens
tccaggagcctgg

SEQ ID NO: 3737528 - DNA, 21 bp, Homo sapiens
tccaggccccaaaaccacagc

SEQ ID NO: 3737529 - DNA, 22 bp, Homo sapiens
tccaggctcctttagcgcccag

SEQ ID NO: 3737530 - DNA, 14 bp, Homo sapiens
tccaggctgtatcc

SEQ ID NO: 3737531 - DNA, 20 bp, Homo sapiens
tccaggctgtctttcactga

SEQ ID NO: 3737532 - DNA, 14 bp, Homo sapiens
tccagggaagctgg

SEQ ID NO: 3737533 - DNA, 17 bp, Homo sapiens
tccagggagcaagacag

SEQ ID NO: 3737534 - DNA, 17 bp, Homo sapiens
tccagggccacgtgcca

SEQ ID NO: 3737535 - DNA, 22 bp, Homo sapiens
tccagggccacgtgccaggccc

SEQ ID NO: 3737536 - DNA, 23 bp, Homo sapiens
tccagggccacgtgccaggcccg

SEQ ID NO: 3737537 - DNA, 14 bp, Homo sapiens
tccaggtcgggctc

SEQ ID NO: 3737538 - DNA, 18 bp, Homo sapiens
tccaggtcgggctcagct

SEQ ID NO: 3737539 - DNA, 20 bp, Homo sapiens
tccaggtcgggctcagctct

SEQ ID NO: 3737540 - DNA, 17 bp, Homo sapiens
tccagtacctttgtcac

SEQ ID NO: 3737541 - DNA, 13 bp, Homo sapiens
tccagtcctgctc

SEQ ID NO: 3737542 - DNA, 13 bp, Homo sapiens
tccagtctgctgc

SEQ ID NO: 3737543 - DNA, 15 bp, Homo sapiens
tccagtctgctgccc

SEQ ID NO: 3737544 - DNA, 18 bp, Homo sapiens
tccagtctgctgccctcc

SEQ ID NO: 3737545 - DNA, 18 bp, Homo sapiens
tccagtcttccacctgga

SEQ ID NO: 3737546 - DNA, 14 bp, Homo sapiens
tccagtgcaattgt

SEQ ID NO: 3737547 - DNA, 19 bp, Homo sapiens
tccagtggaagaagaaaac

SEQ ID NO: 3737548 - DNA, 16 bp, Homo sapiens
tccagttcatgagaat

SEQ ID NO: 3737549 - DNA, 19 bp, Homo sapiens
tccagttcatgagaatcta

SEQ ID NO: 3737550 - DNA, 16 bp, Homo sapiens
tccataaggaatgtag

SEQ ID NO: 3737551 - DNA, 21 bp, Homo sapiens
tccataatctggactcctctg

SEQ ID NO: 3737552 - DNA, 12 bp, Homo sapiens
tccataattatg

SEQ ID NO: 3737553 - DNA, 21 bp, Homo sapiens
tccataattatgacagttata

SEQ ID NO: 3737554 - DNA, 18 bp, Homo sapiens
tccataattccatatgct

SEQ ID NO: 3737555 - DNA, 21 bp, Homo sapiens
tccatagcctaatccctgggc

SEQ ID NO: 3737556 - DNA, 22 bp, Homo sapiens
tccatagcctaatccctgggca

SEQ ID NO: 3737557 - DNA, 16 bp, Homo sapiens
tccatagtatattaaa

SEQ ID NO: 3737558 - DNA, 22 bp, Homo sapiens
tccatagtatattaaaaatggt

SEQ ID NO: 3737559 - DNA, 20 bp, Homo sapiens
tccatatattagcatttagt

SEQ ID NO: 3737560 - DNA, 19 bp, Homo sapiens
tccatatctaaccagtgat

SEQ ID NO: 3737561 - DNA, 13 bp, Homo sapiens
tccatctccaggg

SEQ ID NO: 3737562 - DNA, 14 bp, Homo sapiens
tccatctcgccacc

SEQ ID NO: 3737563 - DNA, 15 bp, Homo sapiens
tccatctggcagggt

SEQ ID NO: 3737564 - DNA, 11 bp, Homo sapiens
tccatgaaaac

SEQ ID NO: 3737565 - DNA, 15 bp, Homo sapiens
tccatgaaaacgttt

SEQ ID NO: 3737566 - DNA, 22 bp, Homo sapiens
tccatgaaaacgttttattgtg

SEQ ID NO: 3737567 - DNA, 15 bp, Homo sapiens
tccatgaaggcagag

SEQ ID NO: 3737568 - DNA, 17 bp, Homo sapiens
tccatgactgcatttta

SEQ ID NO: 3737569 - DNA, 18 bp, Homo sapiens
tccatgagtttgccctgg

SEQ ID NO: 3737570 - DNA, 23 bp, Homo sapiens
tccatgagttttttctcttgggc

SEQ ID NO: 3737571 - DNA, 14 bp, Homo sapiens
tccatgatggaata

SEQ ID NO: 3737572 - DNA, 12 bp, Homo sapiens
tccatgatggag

SEQ ID NO: 3737573 - DNA, 21 bp, Homo sapiens
tccatgcaccctcatacacag

SEQ ID NO: 3737574 - DNA, 15 bp, Homo sapiens
tccatgctgcctcca

SEQ ID NO: 3737575 - DNA, 14 bp, Homo sapiens
tccatggattttgg

SEQ ID NO: 3737576 - DNA, 15 bp, Homo sapiens
tccatgggggcaggg

SEQ ID NO: 3737577 - DNA, 13 bp, Homo sapiens
tccatggtgcctc

SEQ ID NO: 3737578 - DNA, 17 bp, Homo sapiens
tccatgtagcaggactg

SEQ ID NO: 3737579 - DNA, 17 bp, Homo sapiens
tccatgtgtggactcaa

SEQ ID NO: 3737580 - DNA, 20 bp, Homo sapiens
tccattaacttagcatgtgt

SEQ ID NO: 3737581 - DNA, 15 bp, Homo sapiens
tccattcctcaggga

SEQ ID NO: 3737582 - DNA, 18 bp, Homo sapiens
tccattcctggagcccga

SEQ ID NO: 3737583 - DNA, 14 bp, Homo sapiens
tccattgtgtgagt

SEQ ID NO: 3737584 - DNA, 23 bp, Homo sapiens
tccatttaatggggtgcacctgt

SEQ ID NO: 3737585 - DNA, 14 bp, Homo sapiens
tccatttagttctt

SEQ ID NO: 3737586 - DNA, 15 bp, Homo sapiens
tcccaaagtgctggg

SEQ ID NO: 3737587 - DNA, 21 bp, Homo sapiens
tcccaacacaaggtgggcagg

SEQ ID NO: 3737588 - DNA, 14 bp, Homo sapiens
tcccaactgcaagt

SEQ ID NO: 3737589 - DNA, 18 bp, Homo sapiens
tcccaagaacagcaggcc

SEQ ID NO: 3737590 - DNA, 22 bp, Homo sapiens
tcccaagaacagcaggcccacc

SEQ ID NO: 3737591 - DNA, 23 bp, Homo sapiens
tcccaagaacagcaggcccacct

SEQ ID NO: 3737592 - DNA, 20 bp, Homo sapiens
tcccaagctggagtgcagtg

SEQ ID NO: 3737593 - DNA, 18 bp, Homo sapiens
tcccaaggctctgagcaa

SEQ ID NO: 3737594 - DNA, 18 bp, Homo sapiens
tcccaatagcactttcat

SEQ ID NO: 3737595 - DNA, 20 bp, Homo sapiens
tcccaattaggaagtgtaac

SEQ ID NO: 3737596 - DNA, 20 bp, Homo sapiens
tcccaattcatcctcactca

SEQ ID NO: 3737597 - DNA, 14 bp, Homo sapiens
tcccacaaaggaga

SEQ ID NO: 3737598 - DNA, 17 bp, Homo sapiens
tcccacaggcccttcct

SEQ ID NO: 3737599 - DNA, 22 bp, Homo sapiens
tcccacaggcccttcctctcca

SEQ ID NO: 3737600 - DNA, 17 bp, Homo sapiens
tcccaccacagcaggtg

SEQ ID NO: 3737601 - DNA, 21 bp, Homo sapiens
tcccacccccttctctgctcc

SEQ ID NO: 3737602 - DNA, 18 bp, Homo sapiens
tccttcagcttccatttc

SEQ ID NO: 3737603 - DNA, 12 bp, Homo sapiens
tccttcagtgca

SEQ ID NO: 3737604 - DNA, 20 bp, Homo sapiens
tccttccaacaggagctggg

SEQ ID NO: 3737605 - DNA, 14 bp, Homo sapiens
tccttccaactgct

SEQ ID NO: 3737606 - DNA, 18 bp, Homo sapiens
tccttccaactgctgccc

SEQ ID NO: 3737607 - DNA, 16 bp, Homo sapiens
tccttccacggactca

SEQ ID NO: 3737608 - DNA, 21 bp, Homo sapiens
tccttccaggcccccaccact

SEQ ID NO: 3737609 - DNA, 15 bp, Homo sapiens
tccttccatcaaata

SEQ ID NO: 3737610 - DNA, 13 bp, Homo sapiens
tccttccatgaaa

SEQ ID NO: 3737611 - DNA, 13 bp, Homo sapiens
tccttcccagctg

SEQ ID NO: 3737612 - DNA, 14 bp, Homo sapiens
tccttcccagctgc

SEQ ID NO: 3737613 - DNA, 18 bp, Homo sapiens
tccttcccagctgcccct

SEQ ID NO: 3737614 - DNA, 22 bp, Homo sapiens
tccttccccctgtagactagtg

SEQ ID NO: 3737615 - DNA, 12 bp, Homo sapiens
tccttccctctc

SEQ ID NO: 3737616 - DNA, 14 bp, Homo sapiens
tccttccctggctt

SEQ ID NO: 3737617 - DNA, 15 bp, Homo sapiens
tccttccctggcttg

SEQ ID NO: 3737618 - DNA, 12 bp, Homo sapiens
tccttcctgtct

SEQ ID NO: 3737619 - DNA, 13 bp, Homo sapiens
tccttcctgtctt

SEQ ID NO: 3737620 - DNA, 14 bp, Homo sapiens
tccttcctgtcttc

SEQ ID NO: 3737621 - DNA, 19 bp, Homo sapiens
tccttcctgtcttcctgca

SEQ ID NO: 3737622 - DNA, 14 bp, Homo sapiens
tccttccttccctg

SEQ ID NO: 3737623 - DNA, 15 bp, Homo sapiens
tccttccttccctgg

SEQ ID NO: 3737624 - DNA, 16 bp, Homo sapiens
tccttccttccctggc

SEQ ID NO: 3737625 - DNA, 16 bp, Homo sapiens
tccttccttgaccagc

SEQ ID NO: 3737626 - DNA, 14 bp, Homo sapiens
tccttgataacagc

SEQ ID NO: 3737627 - DNA, 15 bp, Homo sapiens
tccttgataacagct

SEQ ID NO: 3737628 - DNA, 16 bp, Homo sapiens
tccttgatctgtatat

SEQ ID NO: 3737629 - DNA, 14 bp, Homo sapiens
tccttgcacctgca

SEQ ID NO: 3737630 - DNA, 17 bp, Homo sapiens
tccttgcctcctgtgta

SEQ ID NO: 3737631 - DNA, 20 bp, Homo sapiens
tccttgggaggccccactgg

SEQ ID NO: 3737632 - DNA, 15 bp, Homo sapiens
tccttggggcaggca

SEQ ID NO: 3737633 - DNA, 17 bp, Homo sapiens
tccttggggcaggcagt

SEQ ID NO: 3737634 - DNA, 21 bp, Homo sapiens
tccttgtcttggcagcctact

SEQ ID NO: 3737635 - DNA, 15 bp, Homo sapiens
tcctttagcgcccag

SEQ ID NO: 3737636 - DNA, 18 bp, Homo sapiens
tcctttcacaaccttctg

SEQ ID NO: 3737637 - DNA, 22 bp, Homo sapiens
tcctttcagggaatttcaggaa

SEQ ID NO: 3737638 - DNA, 23 bp, Homo sapiens
tcctttcagggaatttcaggaac

SEQ ID NO: 3737639 - DNA, 14 bp, Homo sapiens
tcctttccctccac

SEQ ID NO: 3737640 - DNA, 23 bp, Homo sapiens
tcctttctcagccgcttctgact

SEQ ID NO: 3737641 - DNA, 10 bp, Homo sapiens
tcctttgttc

SEQ ID NO: 3737642 - DNA, 24 bp, Homo sapiens
tcctttgttcttacctgtatgtct

SEQ ID NO: 3737643 - DNA, 15 bp, Homo sapiens
tcctttgtttttatg

SEQ ID NO: 3737644 - DNA, 14 bp, Homo sapiens
tccttttagcctag

SEQ ID NO: 3737645 - DNA, 15 bp, Homo sapiens
tccttttagcctagt

SEQ ID NO: 3737646 - DNA, 19 bp, Homo sapiens
tccttttctcctatcttca

SEQ ID NO: 3737647 - DNA, 18 bp, Homo sapiens
tccttttgtgtacagtgt

SEQ ID NO: 3737648 - DNA, 19 bp, Homo sapiens
tcctttttctttataaact

SEQ ID NO: 3737649 - DNA, 13 bp, Homo sapiens
tcctttttgttat

SEQ ID NO: 3737650 - DNA, 13 bp, Homo sapiens
tcgaacccacact

SEQ ID NO: 3737651 - DNA, 17 bp, Homo sapiens
tcgaacccacactgcaa

SEQ ID NO: 3737652 - DNA, 14 bp, Homo sapiens
tcgaactggctgca

SEQ ID NO: 3737653 - DNA, 15 bp, Homo sapiens
tcgaactggctgcaa

SEQ ID NO: 3737654 - DNA, 16 bp, Homo sapiens
tcgaagctcagcccac

SEQ ID NO: 3737655 - DNA, 19 bp, Homo sapiens
tcgaccccaaagccccttg

SEQ ID NO: 3737656 - DNA, 16 bp, Homo sapiens
tcgactgtgacctgtg

SEQ ID NO: 3737657 - DNA, 14 bp, Homo sapiens
tcgaggacagggag

SEQ ID NO: 3737658 - DNA, 23 bp, Homo sapiens
tcgaggtaggtggatcacctgag

SEQ ID NO: 3737659 - DNA, 23 bp, Homo sapiens
tcgatgaagcccaataaacctct

SEQ ID NO: 3737660 - DNA, 17 bp, Homo sapiens
tcgcaggattcttcctc

SEQ ID NO: 3737661 - DNA, 21 bp, Homo sapiens
tcgcaggattcttcctccctc

SEQ ID NO: 3737662 - DNA, 23 bp, Homo sapiens
tcgcaggattcttcctccctccc

SEQ ID NO: 3737663 - DNA, 13 bp, Homo sapiens
tcgcatttgtcaa

SEQ ID NO: 3737664 - DNA, 12 bp, Homo sapiens
tcgcccaggaga

SEQ ID NO: 3737665 - DNA, 16 bp, Homo sapiens
tcgcccagtgccctgg

SEQ ID NO: 3737666 - DNA, 14 bp, Homo sapiens
tcgccgtggctgcg

SEQ ID NO: 3737667 - DNA, 17 bp, Homo sapiens
tcgccgttgaagaggaa

SEQ ID NO: 3737668 - DNA, 13 bp, Homo sapiens
tcgctcctgtgtc

SEQ ID NO: 3737669 - DNA, 11 bp, Homo sapiens
tcgctggcccc

SEQ ID NO: 3737670 - DNA, 19 bp, Homo sapiens
tcgcttcccccatagccac

SEQ ID NO: 3737671 - DNA, 14 bp, Homo sapiens
tcgcttctctgtga

SEQ ID NO: 3737672 - DNA, 13 bp, Homo sapiens
tcggaagcagtgc

SEQ ID NO: 3737673 - DNA, 15 bp, Homo sapiens
tcggaagcagtgcct

SEQ ID NO: 3737674 - DNA, 15 bp, Homo sapiens
tcggagacagtgatc

SEQ ID NO: 3737675 - DNA, 17 bp, Homo sapiens
tcggagtatctgggaac

SEQ ID NO: 3737676 - DNA, 19 bp, Homo sapiens
tcggagtatctgggaactg

SEQ ID NO: 3737677 - DNA, 16 bp, Homo sapiens
tcggcccacagctccc

SEQ ID NO: 3737678 - DNA, 19 bp, Homo sapiens
tcggcccacagctcccacc

SEQ ID NO: 3737679 - DNA, 17 bp, Homo sapiens
tcggcctcccaaagtgt

SEQ ID NO: 3737680 - DNA, 14 bp, Homo sapiens
tcgggaacagtgtt

SEQ ID NO: 3737681 - DNA, 16 bp, Homo sapiens
tcgggagcagtgtctt

SEQ ID NO: 3737682 - DNA, 23 bp, Homo sapiens
tcgggagcagtgtcttccataat

SEQ ID NO: 3737683 - DNA, 19 bp, Homo sapiens
tcgggaggtcgaggcagga

SEQ ID NO: 3737684 - DNA, 14 bp, Homo sapiens
tcggggccagaggc

SEQ ID NO: 3737685 - DNA, 16 bp, Homo sapiens
tcggggggacagctcc

SEQ ID NO: 3737686 - DNA, 21 bp, Homo sapiens
tcggtaagttgaatggcctgc

SEQ ID NO: 3737687 - DNA, 22 bp, Homo sapiens
tcggtgtccatttatagaataa

SEQ ID NO: 3737688 - DNA, 13 bp, Homo sapiens
tcgtcctccccct

SEQ ID NO: 3737689 - DNA, 18 bp, Homo sapiens
tcgtcctccccctgccag

SEQ ID NO: 3737690 - DNA, 23 bp, Homo sapiens
tcgtcctccccctgccagtgcct

SEQ ID NO: 3737691 - DNA, 20 bp, Homo sapiens
tcgtgccgttactctccaac

SEQ ID NO: 3737692 - DNA, 24 bp, Homo sapiens
tcgtggaaagggtgctgcttccct

SEQ ID NO: 3737693 - DNA, 22 bp, Homo sapiens
tcgtgggtgtgtgtagccaagg

SEQ ID NO: 3737694 - DNA, 17 bp, Homo sapiens
tcgtgtgcaacagacaa

SEQ ID NO: 3737695 - DNA, 19 bp, Homo sapiens
tcgtgtgcaacagacaagt

SEQ ID NO: 3737696 - DNA, 12 bp, Homo sapiens
tcgttaacattg

SEQ ID NO: 3737697 - DNA, 21 bp, Homo sapiens
tcgttagggaagagaaacagg

SEQ ID NO: 3737698 - DNA, 15 bp, Homo sapiens
tcgttcttgttagta

SEQ ID NO: 3737699 - DNA, 10 bp, Homo sapiens
tcgtttgttt

SEQ ID NO: 3737700 - DNA, 13 bp, Homo sapiens
tcgtttgtttgtt

SEQ ID NO: 3737701 - DNA, 18 bp, Homo sapiens
tctaaaaaacagaggcca

SEQ ID NO: 3737702 - DNA, 13 bp, Homo sapiens
tctaaaatgagtt

SEQ ID NO: 3737703 - DNA, 18 bp, Homo sapiens
tctaaaggtggtgaggca

SEQ ID NO: 3737704 - DNA, 23 bp, Homo sapiens
tctaaatatttccttaaactgtg

SEQ ID NO: 3737705 - DNA, 14 bp, Homo sapiens
tctaaatgcatatc

SEQ ID NO: 3737706 - DNA, 23 bp, Homo sapiens
tctaaatgcatatcctgagccat

SEQ ID NO: 3737707 - DNA, 20 bp, Homo sapiens
tctaacactagtctgtgtgc

SEQ ID NO: 3737708 - DNA, 24 bp, Homo sapiens
tctaacaggggctggtgggcacca

SEQ ID NO: 3737709 - DNA, 15 bp, Homo sapiens
tctaaccaaatgcat

SEQ ID NO: 3737710 - DNA, 19 bp, Homo sapiens
tctaaccagagcaagcttt

SEQ ID NO: 3737711 - DNA, 15 bp, Homo sapiens
tctaactcagaaaca

SEQ ID NO: 3737712 - DNA, 17 bp, Homo sapiens
tctaactctgatgtaaa

SEQ ID NO: 3737713 - DNA, 21 bp, Homo sapiens
tctaactctgatgtaaatgaa

SEQ ID NO: 3737714 - DNA, 21 bp, Homo sapiens
tctaactgtgctcaagaggtt

SEQ ID NO: 3737715 - DNA, 18 bp, Homo sapiens
tctaagcctttccataag

SEQ ID NO: 3737716 - DNA, 19 bp, Homo sapiens
tctgtcctactctgtgtca

SEQ ID NO: 3737717 - DNA, 12 bp, Homo sapiens
tctgtcctggga

SEQ ID NO: 3737718 - DNA, 19 bp, Homo sapiens
tctgtccttttggcactga

SEQ ID NO: 3737719 - DNA, 20 bp, Homo sapiens
tctgtgaaatgctggcattt

SEQ ID NO: 3737720 - DNA, 17 bp, Homo sapiens
tctgtgaacgatttaga

SEQ ID NO: 3737721 - DNA, 14 bp, Homo sapiens
tctgtgcaataaaa

SEQ ID NO: 3737722 - DNA, 15 bp, Homo sapiens
tctgtgccccatgcc

SEQ ID NO: 3737723 - DNA, 22 bp, Homo sapiens
tctgtgccccatgcctgtccag

SEQ ID NO: 3737724 - DNA, 20 bp, Homo sapiens
tctgtgcctggagctcctgg

SEQ ID NO: 3737725 - DNA, 22 bp, Homo sapiens
tctgtggccttgttctctctat

SEQ ID NO: 3737726 - DNA, 22 bp, Homo sapiens
tctgtgtatttaattgtaaact

SEQ ID NO: 3737727 - DNA, 11 bp, Homo sapiens
tctgtgtctct

SEQ ID NO: 3737728 - DNA, 14 bp, Homo sapiens
tctgtgtgcacaaa

SEQ ID NO: 3737729 - DNA, 21 bp, Homo sapiens
tctgtgtgcacaaatatttat

SEQ ID NO: 3737730 - DNA, 19 bp, Homo sapiens
tctgtgtgggactgtacac

SEQ ID NO: 3737731 - DNA, 16 bp, Homo sapiens
tctgtgtttttgaaat

SEQ ID NO: 3737732 - DNA, 22 bp, Homo sapiens
tctgttcagtaacagggccttg

SEQ ID NO: 3737733 - DNA, 21 bp, Homo sapiens
tctgttcatttgttattctta

SEQ ID NO: 3737734 - DNA, 13 bp, Homo sapiens
tctgttcctggct

SEQ ID NO: 3737735 - DNA, 15 bp, Homo sapiens
tctgttccttcacat

SEQ ID NO: 3737736 - DNA, 18 bp, Homo sapiens
tctgttgccacaaccctg

SEQ ID NO: 3737737 - DNA, 12 bp, Homo sapiens
tctgttggccag

SEQ ID NO: 3737738 - DNA, 15 bp, Homo sapiens
tctgttgtgttcgtt

SEQ ID NO: 3737739 - DNA, 22 bp, Homo sapiens
tctgtttctattctctcctcag

SEQ ID NO: 3737740 - DNA, 12 bp, Homo sapiens
tcttaaaactcc

SEQ ID NO: 3737741 - DNA, 16 bp, Homo sapiens
tcttaaagctgcctgt

SEQ ID NO: 3737742 - DNA, 23 bp, Homo sapiens
tcttaaagctgcctgtagttagg

SEQ ID NO: 3737743 - DNA, 13 bp, Homo sapiens
tcttaaataaaag

SEQ ID NO: 3737744 - DNA, 23 bp, Homo sapiens
tcttaaggattgtgatattttta

SEQ ID NO: 3737745 - DNA, 15 bp, Homo sapiens
tcttaatataactgc

SEQ ID NO: 3737746 - DNA, 14 bp, Homo sapiens
tcttacaaacatgt

SEQ ID NO: 3737747 - DNA, 13 bp, Homo sapiens
tcttacaaagtgt

SEQ ID NO: 3737748 - DNA, 16 bp, Homo sapiens
tcttacaaagtgtatt

SEQ ID NO: 3737749 - DNA, 15 bp, Homo sapiens
tcttacatgttttct

SEQ ID NO: 3737750 - DNA, 15 bp, Homo sapiens
tcttacccttctgtg

SEQ ID NO: 3737751 - DNA, 21 bp, Homo sapiens
tcttacccttctgtgcccagc

SEQ ID NO: 3737752 - DNA, 22 bp, Homo sapiens
tcttacccttctgtgcccagct

SEQ ID NO: 3737753 - DNA, 21 bp, Homo sapiens
tcttactattaagcagtaaaa

SEQ ID NO: 3737754 - DNA, 21 bp, Homo sapiens
tcttagaagtggaccaggaca

SEQ ID NO: 3737755 - DNA, 18 bp, Homo sapiens
tcttagacttgaaatact

SEQ ID NO: 3737756 - DNA, 14 bp, Homo sapiens
tcttagatatcttt

SEQ ID NO: 3737757 - DNA, 23 bp, Homo sapiens
tcttagatatctttttattgatg

SEQ ID NO: 3737758 - DNA, 14 bp, Homo sapiens
tcttagatgtatat

SEQ ID NO: 3737759 - DNA, 15 bp, Homo sapiens
tcttagatgtatata

SEQ ID NO: 3737760 - DNA, 18 bp, Homo sapiens
tcttagcagtgattttta

SEQ ID NO: 3737761 - DNA, 15 bp, Homo sapiens
tcttagcctgtggca

SEQ ID NO: 3737762 - DNA, 23 bp, Homo sapiens
tcttagctgtctgctcagacaga

SEQ ID NO: 3737763 - DNA, 19 bp, Homo sapiens
tcttaggcaatcacatagt

SEQ ID NO: 3737764 - DNA, 23 bp, Homo sapiens
tcttaggttggcaaaaaggcagg

SEQ ID NO: 3737765 - DNA, 18 bp, Homo sapiens
tcttagtgcctgagagta

SEQ ID NO: 3737766 - DNA, 17 bp, Homo sapiens
tcttatgtacctctttt

SEQ ID NO: 3737767 - DNA, 18 bp, Homo sapiens
tcttatgtatgtgaaagt

SEQ ID NO: 3737768 - DNA, 15 bp, Homo sapiens
tcttattctcactcc

SEQ ID NO: 3737769 - DNA, 14 bp, Homo sapiens
tcttattgcccacg

SEQ ID NO: 3737770 - DNA, 14 bp, Homo sapiens
tcttatttaactta

SEQ ID NO: 3737771 - DNA, 13 bp, Homo sapiens
tcttatttattat

SEQ ID NO: 3737772 - DNA, 11 bp, Homo sapiens
tcttcaacaga

SEQ ID NO: 3737773 - DNA, 22 bp, Homo sapiens
tcttcacaatggtgctcatttc

SEQ ID NO: 3737774 - DNA, 18 bp, Homo sapiens
tcttcacagctctgtgtt

SEQ ID NO: 3737775 - DNA, 14 bp, Homo sapiens
tcttcactcgcccc

SEQ ID NO: 3737776 - DNA, 13 bp, Homo sapiens
tcttcagaagaca

SEQ ID NO: 3737777 - DNA, 12 bp, Homo sapiens
tcttcagcctag

SEQ ID NO: 3737778 - DNA, 14 bp, Homo sapiens
tcttcaggcctccc

SEQ ID NO: 3737779 - DNA, 15 bp, Homo sapiens
tcttcaggcctccct

SEQ ID NO: 3737780 - DNA, 16 bp, Homo sapiens
tcttcaggtggaaaaa

SEQ ID NO: 3737781 - DNA, 12 bp, Homo sapiens
tcttcagtttta

SEQ ID NO: 3737782 - DNA, 14 bp, Homo sapiens
tcttccaaagcaca

SEQ ID NO: 3737783 - DNA, 21 bp, Homo sapiens
tcttccaagactccagccctg

SEQ ID NO: 3737784 - DNA, 16 bp, Homo sapiens
tcttccataatgtata

SEQ ID NO: 3737785 - DNA, 17 bp, Homo sapiens
tcttccccctctcccag

SEQ ID NO: 3737786 - DNA, 18 bp, Homo sapiens
tcttcccgaaccccaagg

SEQ ID NO: 3737787 - DNA, 22 bp, Homo sapiens
tcttccctacagttgaaaaaca

SEQ ID NO: 3737788 - DNA, 21 bp, Homo sapiens
tcttccctacctcaggcagga

SEQ ID NO: 3737789 - DNA, 15 bp, Homo sapiens
tcttcccttcaaggt

SEQ ID NO: 3737790 - DNA, 21 bp, Homo sapiens
tcttcccttttacatactgct

SEQ ID NO: 3737791 - DNA, 15 bp, Homo sapiens
tcttccggagatgta

SEQ ID NO: 3737792 - DNA, 19 bp, Homo sapiens
tcttccggagatgtagcaa

SEQ ID NO: 3737793 - DNA, 14 bp, Homo sapiens
tcttcctccctccc

SEQ ID NO: 3737794 - DNA, 14 bp, Homo sapiens
tcttcctctgctga

SEQ ID NO: 3737795 - DNA, 15 bp, Homo sapiens
tcttccttaaactcc

SEQ ID NO: 3737796 - DNA, 19 bp, Homo sapiens
tcttcggggaactcctgga

SEQ ID NO: 3737797 - DNA, 16 bp, Homo sapiens
tcttctaaaaaaaaac

SEQ ID NO: 3737798 - DNA, 17 bp, Homo sapiens
tcttctcactcccttct

SEQ ID NO: 3737799 - DNA, 19 bp, Homo sapiens
tcttctcatagcattaact

SEQ ID NO: 3737800 - DNA, 12 bp, Homo sapiens
tcttctccactg

SEQ ID NO: 3737801 - DNA, 12 bp, Homo sapiens
tcttctccaggc

SEQ ID NO: 3737802 - DNA, 21 bp, Homo sapiens
tcttctctggcgacagttttc

SEQ ID NO: 3737803 - DNA, 21 bp, Homo sapiens
tcttctgtacgtctgacaggc

SEQ ID NO: 3737804 - DNA, 19 bp, Homo sapiens
tcttctgtatactgtggag

SEQ ID NO: 3737805 - DNA, 14 bp, Homo sapiens
tcttctgtcatcta

SEQ ID NO: 3737806 - DNA, 17 bp, Homo sapiens
tcttctgtcatctacct

SEQ ID NO: 3737807 - DNA, 14 bp, Homo sapiens
tcttcttccaggta

SEQ ID NO: 3737808 - DNA, 18 bp, Homo sapiens
tcttctttttttgtgatg

SEQ ID NO: 3737809 - DNA, 21 bp, Homo sapiens
tcttgaccaagcaggaagctc

SEQ ID NO: 3737810 - DNA, 13 bp, Homo sapiens
tcttgactattgg

SEQ ID NO: 3737811 - DNA, 19 bp, Homo sapiens
tcttgatgactggaatttt

SEQ ID NO: 3737812 - DNA, 20 bp, Homo sapiens
tcttgatgactggaattttt

SEQ ID NO: 3737813 - DNA, 20 bp, Homo sapiens
tcttgatttgttttagaatg

SEQ ID NO: 3737814 - DNA, 16 bp, Homo sapiens
tcttgcaatggcagcc

SEQ ID NO: 3737815 - DNA, 17 bp, Homo sapiens
tcttgcaatggcagcct

SEQ ID NO: 3737816 - DNA, 18 bp, Homo sapiens
tcttgcaatggcagcctt

SEQ ID NO: 3737817 - DNA, 22 bp, Homo sapiens
tcttgcaatggcagccttggca

SEQ ID NO: 3737818 - DNA, 18 bp, Homo sapiens
tcttgcagagaagccttg

SEQ ID NO: 3737819 - DNA, 13 bp, Homo sapiens
tcttgcagtgatt

SEQ ID NO: 3737820 - DNA, 22 bp, Homo sapiens
tcttgctggttgtcatttttgc

SEQ ID NO: 3737821 - DNA, 14 bp, Homo sapiens
tcttgctgtggtct

SEQ ID NO: 3737822 - DNA, 13 bp, Homo sapiens
tcttgggccctcc

SEQ ID NO: 3737823 - DNA, 13 bp, Homo sapiens
tcttgtaagattt

SEQ ID NO: 3737824 - DNA, 15 bp, Homo sapiens
tcttgtctctgggct

SEQ ID NO: 3737825 - DNA, 21 bp, Homo sapiens
tcttgtgacatattatgtctt

SEQ ID NO: 3737826 - DNA, 11 bp, Homo sapiens
tcttgtgacta

SEQ ID NO: 3737827 - DNA, 21 bp, Homo sapiens
tcttgtgactagtgctgaagc

SEQ ID NO: 3737828 - DNA, 13 bp, Homo sapiens
tcttgtgttggct

SEQ ID NO: 3737829 - DNA, 13 bp, Homo sapiens
tcttgttaatatt

SEQ ID NO: 3737830 - DNA, 20 bp, Homo sapiens
tgaactctttctggcctgcc

SEQ ID NO: 3737831 - DNA, 16 bp, Homo sapiens
tgaactggaggccagg

SEQ ID NO: 3737832 - DNA, 17 bp, Homo sapiens
tgaacttaaataaatgt

SEQ ID NO: 3737833 - DNA, 18 bp, Homo sapiens
tgaacttcagctagagct

SEQ ID NO: 3737834 - DNA, 15 bp, Homo sapiens
tgaagaaaagtgggc

SEQ ID NO: 3737835 - DNA, 20 bp, Homo sapiens
tgaagaacagtaactgccat

SEQ ID NO: 3737836 - DNA, 20 bp, Homo sapiens
tgaagaattattttttttct

SEQ ID NO: 3737837 - DNA, 22 bp, Homo sapiens
tgaagacaaaaatactctaatt

SEQ ID NO: 3737838 - DNA, 14 bp, Homo sapiens
tgaagacagaggga

SEQ ID NO: 3737839 - DNA, 23 bp, Homo sapiens
tgaagagaccaagactctgaaat

SEQ ID NO: 3737840 - DNA, 13 bp, Homo sapiens
tgaagaggaaggg

SEQ ID NO: 3737841 - DNA, 18 bp, Homo sapiens
tgaagaggatcggaggct

SEQ ID NO: 3737842 - DNA, 18 bp, Homo sapiens
tgaagagggagaagcatg

SEQ ID NO: 3737843 - DNA, 16 bp, Homo sapiens
tgaagagtgagagggc

SEQ ID NO: 3737844 - DNA, 23 bp, Homo sapiens
tgaagataccatcagcaaagaat

SEQ ID NO: 3737845 - DNA, 16 bp, Homo sapiens
tgaagatagaagaaaa

SEQ ID NO: 3737846 - DNA, 16 bp, Homo sapiens
tgaagatatcttgaaa

SEQ ID NO: 3737847 - DNA, 19 bp, Homo sapiens
tgaagatcgttagtatcta

SEQ ID NO: 3737848 - DNA, 21 bp, Homo sapiens
tgaagatgctgaaacaggaga

SEQ ID NO: 3737849 - DNA, 13 bp, Homo sapiens
tgaagatgtttgc

SEQ ID NO: 3737850 - DNA, 18 bp, Homo sapiens
tgaagcaaatcagaaact

SEQ ID NO: 3737851 - DNA, 15 bp, Homo sapiens
tgaagcatccaggca

SEQ ID NO: 3737852 - DNA, 20 bp, Homo sapiens
tgaagccacagcccaggcct

SEQ ID NO: 3737853 - DNA, 19 bp, Homo sapiens
tgaagccactgaagctggg

SEQ ID NO: 3737854 - DNA, 14 bp, Homo sapiens
tgaagccatctaaa

SEQ ID NO: 3737855 - DNA, 15 bp, Homo sapiens
tgaagcccaataaac

SEQ ID NO: 3737856 - DNA, 15 bp, Homo sapiens
tgaagctaagattta

SEQ ID NO: 3737857 - DNA, 13 bp, Homo sapiens
tgaagctaattat

SEQ ID NO: 3737858 - DNA, 22 bp, Homo sapiens
tgaagctctggtgacaccagcc

SEQ ID NO: 3737859 - DNA, 20 bp, Homo sapiens
tgaagcttattaatgctaag

SEQ ID NO: 3737860 - DNA, 22 bp, Homo sapiens
tgaagcttattaatgctaaggg

SEQ ID NO: 3737861 - DNA, 23 bp, Homo sapiens
tgaaggaaataaaaaagtctcta

SEQ ID NO: 3737862 - DNA, 20 bp, Homo sapiens
tgaaggaataaattgctcct

SEQ ID NO: 3737863 - DNA, 23 bp, Homo sapiens
tgaagggaaggaagaggaagagt

SEQ ID NO: 3737864 - DNA, 15 bp, Homo sapiens
tgaaggtgtcagaat

SEQ ID NO: 3737865 - DNA, 18 bp, Homo sapiens
tgaaggtttctgaaaatt

SEQ ID NO: 3737866 - DNA, 13 bp, Homo sapiens
tgaagtacatatt

SEQ ID NO: 3737867 - DNA, 13 bp, Homo sapiens
tgaagtcacacag

SEQ ID NO: 3737868 - DNA, 21 bp, Homo sapiens
tgaagtcactgcacagtgcat

SEQ ID NO: 3737869 - DNA, 14 bp, Homo sapiens
tgaagtttatacag

SEQ ID NO: 3737870 - DNA, 15 bp, Homo sapiens
tgaagtttcatttat

SEQ ID NO: 3737871 - DNA, 21 bp, Homo sapiens
tgaagtttcatttatgataca

SEQ ID NO: 3737872 - DNA, 14 bp, Homo sapiens
tgaataaaaattaa

SEQ ID NO: 3737873 - DNA, 15 bp, Homo sapiens
tgaataaaaattaag

SEQ ID NO: 3737874 - DNA, 21 bp, Homo sapiens
tgaataaattctataggaaca

SEQ ID NO: 3737875 - DNA, 15 bp, Homo sapiens
tgaataaccacttaa

SEQ ID NO: 3737876 - DNA, 14 bp, Homo sapiens
tgaataatttccca

SEQ ID NO: 3737877 - DNA, 22 bp, Homo sapiens
tgaataatttcccaattaggaa

SEQ ID NO: 3737878 - DNA, 14 bp, Homo sapiens
tgaatataaacact

SEQ ID NO: 3737879 - DNA, 21 bp, Homo sapiens
tgaatatggactcagttttct

SEQ ID NO: 3737880 - DNA, 18 bp, Homo sapiens
tgaatatgtacataggca

SEQ ID NO: 3737881 - DNA, 16 bp, Homo sapiens
tgaatcagaccctacc

SEQ ID NO: 3737882 - DNA, 18 bp, Homo sapiens
tgaatcagaccctacccc

SEQ ID NO: 3737883 - DNA, 22 bp, Homo sapiens
tgaatcagaccctaccccacca

SEQ ID NO: 3737884 - DNA, 14 bp, Homo sapiens
tgaatccatgcttg

SEQ ID NO: 3737885 - DNA, 18 bp, Homo sapiens
tgaatgaaaaatttaagc

SEQ ID NO: 3737886 - DNA, 23 bp, Homo sapiens
tgaatgaaagtcttgtgactagt

SEQ ID NO: 3737887 - DNA, 17 bp, Homo sapiens
tgaatgaggtcccaggc

SEQ ID NO: 3737888 - DNA, 15 bp, Homo sapiens
tgaatgatctctctg

SEQ ID NO: 3737889 - DNA, 17 bp, Homo sapiens
tgaatggcctgccttga

SEQ ID NO: 3737890 - DNA, 20 bp, Homo sapiens
tgaatggtatggaactctct

SEQ ID NO: 3737891 - DNA, 20 bp, Homo sapiens
tgaatggttttcaaaataaa

SEQ ID NO: 3737892 - DNA, 18 bp, Homo sapiens
tgaatgtaatttgtgtaa

SEQ ID NO: 3737893 - DNA, 16 bp, Homo sapiens
tgaatgtattgaactt

SEQ ID NO: 3737894 - DNA, 18 bp, Homo sapiens
tgaatgttctgacattaa

SEQ ID NO: 3737895 - DNA, 20 bp, Homo sapiens
tgaatgttctgacattaaca

SEQ ID NO: 3737896 - DNA, 11 bp, Homo sapiens
tgaattaaatt

SEQ ID NO: 3737897 - DNA, 17 bp, Homo sapiens
tgaattgataataaact

SEQ ID NO: 3737898 - DNA, 21 bp, Homo sapiens
tgaattgcattttttaaaaca

SEQ ID NO: 3737899 - DNA, 17 bp, Homo sapiens
tgaattgtgaccaagtt

SEQ ID NO: 3737900 - DNA, 18 bp, Homo sapiens
tgaatttaacaatgcgaa

SEQ ID NO: 3737901 - DNA, 11 bp, Homo sapiens
tgaatttcatc

SEQ ID NO: 3737902 - DNA, 15 bp, Homo sapiens
tgaatttctctacag

SEQ ID NO: 3737903 - DNA, 19 bp, Homo sapiens
tgaatttgaatgaaaaatt

SEQ ID NO: 3737904 - DNA, 15 bp, Homo sapiens
tgaatttggagactc

SEQ ID NO: 3737905 - DNA, 17 bp, Homo sapiens
tgaatttggagactctg

SEQ ID NO: 3737906 - DNA, 20 bp, Homo sapiens
tgaatttggcctgcactaat

SEQ ID NO: 3737907 - DNA, 23 bp, Homo sapiens
tgaattttctttttaataaaaag

SEQ ID NO: 3737908 - DNA, 15 bp, Homo sapiens
tgaatttttctctaa

SEQ ID NO: 3737909 - DNA, 17 bp, Homo sapiens
tgacaaagaaacccaag

SEQ ID NO: 3737910 - DNA, 23 bp, Homo sapiens
tgacaaatgtgtatcggatgctt

SEQ ID NO: 3737911 - DNA, 16 bp, Homo sapiens
tgacaaccaccgctcc

SEQ ID NO: 3737912 - DNA, 23 bp, Homo sapiens
tgacaaccaccgctccccagccc

SEQ ID NO: 3737913 - DNA, 15 bp, Homo sapiens
tgacaacttctaatt

SEQ ID NO: 3737914 - DNA, 22 bp, Homo sapiens
tgacaacttctaattgccatgt

SEQ ID NO: 3737915 - DNA, 18 bp, Homo sapiens
tgacaaggattgctactg

SEQ ID NO: 3737916 - DNA, 23 bp, Homo sapiens
tgacaaggattgctactgtccta

SEQ ID NO: 3737917 - DNA, 13 bp, Homo sapiens
tgacaaggcccca

SEQ ID NO: 3737918 - DNA, 22 bp, Homo sapiens
tgacaaggccccagagactcag

SEQ ID NO: 3737919 - DNA, 14 bp, Homo sapiens
tgacaataaatgtg

SEQ ID NO: 3737920 - DNA, 13 bp, Homo sapiens
tgacaatgatgat

SEQ ID NO: 3737921 - DNA, 17 bp, Homo sapiens
tgacacaaaaaaagttg

SEQ ID NO: 3737922 - DNA, 15 bp, Homo sapiens
tgacacacagctctg

SEQ ID NO: 3737923 - DNA, 19 bp, Homo sapiens
tgacacacagctctgtcct

SEQ ID NO: 3737924 - DNA, 16 bp, Homo sapiens
tgacaccagcctttct

SEQ ID NO: 3737925 - DNA, 22 bp, Homo sapiens
tgacaccagcctttctcccagg

SEQ ID NO: 3737926 - DNA, 17 bp, Homo sapiens
tgacactgaaatgcctt

SEQ ID NO: 3737927 - DNA, 16 bp, Homo sapiens
tgacacttcagagagc

SEQ ID NO: 3737928 - DNA, 23 bp, Homo sapiens
tgacacttcagagagctggtagt

SEQ ID NO: 3737929 - DNA, 24 bp, Homo sapiens
tgacacttcagagagctggtagtt

SEQ ID NO: 3737930 - DNA, 14 bp, Homo sapiens
tgacagaacactgt

SEQ ID NO: 3737931 - DNA, 15 bp, Homo sapiens
tgacagaacactgtc

SEQ ID NO: 3737932 - DNA, 17 bp, Homo sapiens
tgacagaacactgtctt

SEQ ID NO: 3737933 - DNA, 17 bp, Homo sapiens
tgacagacacaggcccg

SEQ ID NO: 3737934 - DNA, 23 bp, Homo sapiens
tgacagacacaggcccggctcca

SEQ ID NO: 3737935 - DNA, 21 bp, Homo sapiens
tgacagagcaagactctgtct

SEQ ID NO: 3737936 - DNA, 12 bp, Homo sapiens
tgacagagccag

SEQ ID NO: 3737937 - DNA, 22 bp, Homo sapiens
tgacagagtgagactctgtctc

SEQ ID NO: 3737938 - DNA, 11 bp, Homo sapiens
tgacagcctcc

SEQ ID NO: 3737939 - DNA, 22 bp, Homo sapiens
tgacagcctcccacccccatct

SEQ ID NO: 3737940 - DNA, 12 bp, Homo sapiens
tgacagctgtcc

SEQ ID NO: 3737941 - DNA, 16 bp, Homo sapiens
tgacagctgtccctgt

SEQ ID NO: 3737942 - DNA, 19 bp, Homo sapiens
tgcaatgtcacaacctctc

SEQ ID NO: 3737943 - DNA, 20 bp, Homo sapiens
tgcaatgtcacaacctctct

SEQ ID NO: 3737944 - DNA, 21 bp, Homo sapiens
tgcaattgtaggggtgtgtgt

SEQ ID NO: 3737945 - DNA, 18 bp, Homo sapiens
tgcaattttaacacacat

SEQ ID NO: 3737946 - DNA, 15 bp, Homo sapiens
tgcacaaagcccttc

SEQ ID NO: 3737947 - DNA, 17 bp, Homo sapiens
tgcacaaagcccttcca

SEQ ID NO: 3737948 - DNA, 14 bp, Homo sapiens
tgcacaagctgcac

SEQ ID NO: 3737949 - DNA, 18 bp, Homo sapiens
tgcacaagctgcaccctc

SEQ ID NO: 3737950 - DNA, 15 bp, Homo sapiens
tgcacacaccagagc

SEQ ID NO: 3737951 - DNA, 18 bp, Homo sapiens
tgcacacaccagagccca

SEQ ID NO: 3737952 - DNA, 14 bp, Homo sapiens
tgcacacagtgctt

SEQ ID NO: 3737953 - DNA, 23 bp, Homo sapiens
tgcacagatggatttgcctgtgc

SEQ ID NO: 3737954 - DNA, 17 bp, Homo sapiens
tgcacagtgcatctcag

SEQ ID NO: 3737955 - DNA, 19 bp, Homo sapiens
tgcacagtgcatctcagcc

SEQ ID NO: 3737956 - DNA, 13 bp, Homo sapiens
tgcacatgtgtgc

SEQ ID NO: 3737957 - DNA, 23 bp, Homo sapiens
tgcaccattgcgctctagcctgg

SEQ ID NO: 3737958 - DNA, 17 bp, Homo sapiens
tgcacccacccaggagt

SEQ ID NO: 3737959 - DNA, 18 bp, Homo sapiens
tgcacccacccaggagtg

SEQ ID NO: 3737960 - DNA, 19 bp, Homo sapiens
tgcacctccccccactgca

SEQ ID NO: 3737961 - DNA, 17 bp, Homo sapiens
tgcacctgccagcctgg

SEQ ID NO: 3737962 - DNA, 17 bp, Homo sapiens
tgcacctgtactcagga

SEQ ID NO: 3737963 - DNA, 19 bp, Homo sapiens
tgcacgcccatgtgtgagt

SEQ ID NO: 3737964 - DNA, 22 bp, Homo sapiens
tgcacgcccatgtgtgagtgtg

SEQ ID NO: 3737965 - DNA, 19 bp, Homo sapiens
tgcacgtacacacacatac

SEQ ID NO: 3737966 - DNA, 17 bp, Homo sapiens
tgcacgtggagagctgg

SEQ ID NO: 3737967 - DNA, 16 bp, Homo sapiens
tgcacgtggcttctga

SEQ ID NO: 3737968 - DNA, 23 bp, Homo sapiens
tgcactatagcctaggtgacaga

SEQ ID NO: 3737969 - DNA, 14 bp, Homo sapiens
tgcactccaatctg

SEQ ID NO: 3737970 - DNA, 18 bp, Homo sapiens
tgcactccagcctgggca

SEQ ID NO: 3737971 - DNA, 14 bp, Homo sapiens
tgcactctgctaat

SEQ ID NO: 3737972 - DNA, 18 bp, Homo sapiens
tgcactggagtccagtct

SEQ ID NO: 3737973 - DNA, 17 bp, Homo sapiens
tgcacttaaatatcaat

SEQ ID NO: 3737974 - DNA, 17 bp, Homo sapiens
tgcagaaaagcacctgc

SEQ ID NO: 3737975 - DNA, 21 bp, Homo sapiens
tgcagaaaagcacctgccgac

SEQ ID NO: 3737976 - DNA, 12 bp, Homo sapiens
tgcagacaggca

SEQ ID NO: 3737977 - DNA, 21 bp, Homo sapiens
tgcagacaggcaagcacctcc

SEQ ID NO: 3737978 - DNA, 16 bp, Homo sapiens
tgcagactcaataaaa

SEQ ID NO: 3737979 - DNA, 19 bp, Homo sapiens
tgcagactcagtttgtcag

SEQ ID NO: 3737980 - DNA, 20 bp, Homo sapiens
tgcagactcagtttgtcaga

SEQ ID NO: 3737981 - DNA, 17 bp, Homo sapiens
tgcagactctacagagg

SEQ ID NO: 3737982 - DNA, 18 bp, Homo sapiens
tgcagactctacagaggc

SEQ ID NO: 3737983 - DNA, 17 bp, Homo sapiens
tgcagactggaggggac

SEQ ID NO: 3737984 - DNA, 24 bp, Homo sapiens
tgcagagacagagaggacgtgggc

SEQ ID NO: 3737985 - DNA, 17 bp, Homo sapiens
tgcagagacaggacctg

SEQ ID NO: 3737986 - DNA, 19 bp, Homo sapiens
tgcagagatgcggtggcta

SEQ ID NO: 3737987 - DNA, 20 bp, Homo sapiens
tgcagaggggctttctggag

SEQ ID NO: 3737988 - DNA, 14 bp, Homo sapiens
tgcagagtcagcag

SEQ ID NO: 3737989 - DNA, 15 bp, Homo sapiens
tgcagagtcagcaga

SEQ ID NO: 3737990 - DNA, 15 bp, Homo sapiens
tgcagagtgcccaga

SEQ ID NO: 3737991 - DNA, 18 bp, Homo sapiens
tgcagagtgcccagaact

SEQ ID NO: 3737992 - DNA, 13 bp, Homo sapiens
tgcagattcattt

SEQ ID NO: 3737993 - DNA, 18 bp, Homo sapiens
tgcagcaaccagagcact

SEQ ID NO: 3737994 - DNA, 22 bp, Homo sapiens
tgcagcagcaacacaatgttat

SEQ ID NO: 3737995 - DNA, 22 bp, Homo sapiens
tgcagcagttcacctatttcaa

SEQ ID NO: 3737996 - DNA, 20 bp, Homo sapiens
tgcagcatatgaggatgcag

SEQ ID NO: 3737997 - DNA, 14 bp, Homo sapiens
tgcagccagcccag

SEQ ID NO: 3737998 - DNA, 17 bp, Homo sapiens
tgcagccagcccagccc

SEQ ID NO: 3737999 - DNA, 21 bp, Homo sapiens
tgcagccagcccagcccagct

SEQ ID NO: 3738000 - DNA, 22 bp, Homo sapiens
tgcagccagcccagcccagctg

SEQ ID NO: 3738001 - DNA, 12 bp, Homo sapiens
tgcagcccatgc

SEQ ID NO: 3738002 - DNA, 13 bp, Homo sapiens
tgcagcccatgcc

SEQ ID NO: 3738003 - DNA, 18 bp, Homo sapiens
tgcagcccatgcccacct

SEQ ID NO: 3738004 - DNA, 21 bp, Homo sapiens
tgcagccccgcgcctccttcc

SEQ ID NO: 3738005 - DNA, 20 bp, Homo sapiens
tgcagcctcaacctcctggg

SEQ ID NO: 3738006 - DNA, 21 bp, Homo sapiens
tgcagcctcaacctcctgggc

SEQ ID NO: 3738007 - DNA, 22 bp, Homo sapiens
tgcagcctcaacctcctgggct

SEQ ID NO: 3738008 - DNA, 15 bp, Homo sapiens
tgcagctgattttaa

SEQ ID NO: 3738009 - DNA, 22 bp, Homo sapiens
tgcagcttccttttgagggaca

SEQ ID NO: 3738010 - DNA, 21 bp, Homo sapiens
tgcaggccaagagcagaggca

SEQ ID NO: 3738011 - DNA, 21 bp, Homo sapiens
tgcaggctggcaccgccttct

SEQ ID NO: 3738012 - DNA, 13 bp, Homo sapiens
tgcagggcctcca

SEQ ID NO: 3738013 - DNA, 22 bp, Homo sapiens
tgcaggggcaaacacctgctga

SEQ ID NO: 3738014 - DNA, 18 bp, Homo sapiens
tgcagtactttacctcct

SEQ ID NO: 3738015 - DNA, 19 bp, Homo sapiens
tgcagtctgcttctgcacc

SEQ ID NO: 3738016 - DNA, 13 bp, Homo sapiens
tgcagtgaattgt

SEQ ID NO: 3738017 - DNA, 13 bp, Homo sapiens
tgcagtgagctga

SEQ ID NO: 3738018 - DNA, 22 bp, Homo sapiens
tgcagtgattaaggtctctctt

SEQ ID NO: 3738019 - DNA, 22 bp, Homo sapiens
tgcagtggtatgatcacggctc

SEQ ID NO: 3738020 - DNA, 20 bp, Homo sapiens
tgcagtggtgcgatctgggt

SEQ ID NO: 3738021 - DNA, 21 bp, Homo sapiens
tgcagtggtgcgatctgggtt

SEQ ID NO: 3738022 - DNA, 22 bp, Homo sapiens
tgcataataagctaaagaggct

SEQ ID NO: 3738023 - DNA, 17 bp, Homo sapiens
tgcatagaaggaggaga

SEQ ID NO: 3738024 - DNA, 20 bp, Homo sapiens
tgcatagtaccaatcatttt

SEQ ID NO: 3738025 - DNA, 22 bp, Homo sapiens
tgcatagtaccaatcattttaa

SEQ ID NO: 3738026 - DNA, 16 bp, Homo sapiens
tgcatagtcccagcta

SEQ ID NO: 3738027 - DNA, 20 bp, Homo sapiens
tgcatagtcccagctaccca

SEQ ID NO: 3738028 - DNA, 13 bp, Homo sapiens
tgcatatcctgag

SEQ ID NO: 3738029 - DNA, 12 bp, Homo sapiens
tgcatatgtatg

SEQ ID NO: 3738030 - DNA, 15 bp, Homo sapiens
tgcatatgtatgact

SEQ ID NO: 3738031 - DNA, 16 bp, Homo sapiens
tgcatccattcctcag

SEQ ID NO: 3738032 - DNA, 17 bp, Homo sapiens
tgcatccattcctcagg

SEQ ID NO: 3738033 - DNA, 19 bp, Homo sapiens
tgcatccattcctcaggga

SEQ ID NO: 3738034 - DNA, 21 bp, Homo sapiens
tgcatccattcctcagggaca

SEQ ID NO: 3738035 - DNA, 16 bp, Homo sapiens
tgcatctactcaggcc

SEQ ID NO: 3738036 - DNA, 21 bp, Homo sapiens
tgcatctcactggatgcaaag

SEQ ID NO: 3738037 - DNA, 15 bp, Homo sapiens
tgcatctcagcccac

SEQ ID NO: 3738038 - DNA, 22 bp, Homo sapiens
tgcatcttactgaaggtaaaat

SEQ ID NO: 3738039 - DNA, 23 bp, Homo sapiens
tgcatgctgctttaattgtgaat

SEQ ID NO: 3738040 - DNA, 20 bp, Homo sapiens
tgcatggacctaacattcga

SEQ ID NO: 3738041 - DNA, 15 bp, Homo sapiens
tgcatggcagcaggc

SEQ ID NO: 3738042 - DNA, 22 bp, Homo sapiens
tgcatggcagcaggcctgttgc

SEQ ID NO: 3738043 - DNA, 19 bp, Homo sapiens
tgcatggtaatttatagtt

SEQ ID NO: 3738044 - DNA, 15 bp, Homo sapiens
tgcatgtataaatga

SEQ ID NO: 3738045 - DNA, 13 bp, Homo sapiens
tgcatgtgtgtgc

SEQ ID NO: 3738046 - DNA, 12 bp, Homo sapiens
tgcattacagag

SEQ ID NO: 3738047 - DNA, 23 bp, Homo sapiens
tgcattacagagaggagaaacac

SEQ ID NO: 3738048 - DNA, 23 bp, Homo sapiens
tgcattagaaattagctgtgtga

SEQ ID NO: 3738049 - DNA, 13 bp, Homo sapiens
tgcattgaatata

SEQ ID NO: 3738050 - DNA, 14 bp, Homo sapiens
tgcatttagcacaa

SEQ ID NO: 3738051 - DNA, 20 bp, Homo sapiens
tgcattttctgaaactaatg

SEQ ID NO: 3738052 - DNA, 14 bp, Homo sapiens
tgcatttttgtgaa

SEQ ID NO: 3738053 - DNA, 17 bp, Homo sapiens
tgcatttttgtgaaatg

SEQ ID NO: 3738054 - DNA, 22 bp, Homo sapiens
tggacaggcatgttctctgagg

SEQ ID NO: 3738055 - DNA, 13 bp, Homo sapiens
tggacaggtctgg

SEQ ID NO: 3738056 - DNA, 12 bp, Homo sapiens
tggacagtcctg

SEQ ID NO: 3738057 - DNA, 23 bp, Homo sapiens
tggacattaagcatcacaaatga

SEQ ID NO: 3738058 - DNA, 13 bp, Homo sapiens
tggaccagatgct

SEQ ID NO: 3738059 - DNA, 19 bp, Homo sapiens
tggaccaggacaggaccag

SEQ ID NO: 3738060 - DNA, 17 bp, Homo sapiens
tggaccagtggtgcctt

SEQ ID NO: 3738061 - DNA, 13 bp, Homo sapiens
tggacctaacatt

SEQ ID NO: 3738062 - DNA, 17 bp, Homo sapiens
tggacctaacattcgat

SEQ ID NO: 3738063 - DNA, 15 bp, Homo sapiens
tggacctcaccaagc

SEQ ID NO: 3738064 - DNA, 17 bp, Homo sapiens
tggacctcgtgctttaa

SEQ ID NO: 3738065 - DNA, 16 bp, Homo sapiens
tggactcaggatgccc

SEQ ID NO: 3738066 - DNA, 15 bp, Homo sapiens
tggactccagatctg

SEQ ID NO: 3738067 - DNA, 13 bp, Homo sapiens
tggactcctctgt

SEQ ID NO: 3738068 - DNA, 15 bp, Homo sapiens
tggactcctctgtcc

SEQ ID NO: 3738069 - DNA, 15 bp, Homo sapiens
tggactgaagcctgc

SEQ ID NO: 3738070 - DNA, 13 bp, Homo sapiens
tggactgacattt

SEQ ID NO: 3738071 - DNA, 22 bp, Homo sapiens
tggactggctagagtcctcact

SEQ ID NO: 3738072 - DNA, 23 bp, Homo sapiens
tggactggctgtcctttccagtg

SEQ ID NO: 3738073 - DNA, 17 bp, Homo sapiens
tggactggtggcccctg

SEQ ID NO: 3738074 - DNA, 17 bp, Homo sapiens
tggacttaaccggagtt

SEQ ID NO: 3738075 - DNA, 16 bp, Homo sapiens
tggactttccaccccc

SEQ ID NO: 3738076 - DNA, 18 bp, Homo sapiens
tggactttccaccccctc

SEQ ID NO: 3738077 - DNA, 18 bp, Homo sapiens
tggacttttcgttaacat

SEQ ID NO: 3738078 - DNA, 18 bp, Homo sapiens
tggagaacgccagtctcc

SEQ ID NO: 3738079 - DNA, 14 bp, Homo sapiens
tggagaactagaga

SEQ ID NO: 3738080 - DNA, 17 bp, Homo sapiens
tggagaactcctagggt

SEQ ID NO: 3738081 - DNA, 17 bp, Homo sapiens
tggagaagaccctcccc

SEQ ID NO: 3738082 - DNA, 21 bp, Homo sapiens
tggagaagctccctgaagtaa

SEQ ID NO: 3738083 - DNA, 22 bp, Homo sapiens
tggagaagtcttagacttgaaa

SEQ ID NO: 3738084 - DNA, 14 bp, Homo sapiens
tggagactctgtgg

SEQ ID NO: 3738085 - DNA, 14 bp, Homo sapiens
tggagactgtctca

SEQ ID NO: 3738086 - DNA, 14 bp, Homo sapiens
tggagagctggtgc

SEQ ID NO: 3738087 - DNA, 16 bp, Homo sapiens
tggagagctggtgccc

SEQ ID NO: 3738088 - DNA, 19 bp, Homo sapiens
tggagagctggtgcccgga

SEQ ID NO: 3738089 - DNA, 21 bp, Homo sapiens
tggagaggagggatgctgcct

SEQ ID NO: 3738090 - DNA, 22 bp, Homo sapiens
tggagaggttataggtcactcc

SEQ ID NO: 3738091 - DNA, 19 bp, Homo sapiens
tggagatatttatgggggg

SEQ ID NO: 3738092 - DNA, 16 bp, Homo sapiens
tggagatgggatgctt

SEQ ID NO: 3738093 - DNA, 15 bp, Homo sapiens
tggagccactctgtt

SEQ ID NO: 3738094 - DNA, 16 bp, Homo sapiens
tggagccactctgttc

SEQ ID NO: 3738095 - DNA, 18 bp, Homo sapiens
tggagccccactgccctt

SEQ ID NO: 3738096 - DNA, 16 bp, Homo sapiens
tggagcgcacctgccc

SEQ ID NO: 3738097 - DNA, 14 bp, Homo sapiens
tggagctcctggga

SEQ ID NO: 3738098 - DNA, 17 bp, Homo sapiens
tggagctcctgggaagg

SEQ ID NO: 3738099 - DNA, 20 bp, Homo sapiens
tggagctcctgggaaggcta

SEQ ID NO: 3738100 - DNA, 20 bp, Homo sapiens
tggaggaccaaaaaaataag

SEQ ID NO: 3738101 - DNA, 14 bp, Homo sapiens
tggaggagaaggac

SEQ ID NO: 3738102 - DNA, 11 bp, Homo sapiens
tggaggagagc

SEQ ID NO: 3738103 - DNA, 18 bp, Homo sapiens
tggaggcacacagctgca

SEQ ID NO: 3738104 - DNA, 19 bp, Homo sapiens
tggaggcacacagctgcag

SEQ ID NO: 3738105 - DNA, 19 bp, Homo sapiens
tggaggccgggtgctcagg

SEQ ID NO: 3738106 - DNA, 22 bp, Homo sapiens
tggaggctgtcttctcaggctc

SEQ ID NO: 3738107 - DNA, 15 bp, Homo sapiens
tggaggggagctctg

SEQ ID NO: 3738108 - DNA, 20 bp, Homo sapiens
tggaggggcatggccagcag

SEQ ID NO: 3738109 - DNA, 21 bp, Homo sapiens
tggaggttgcagtgagccaag

SEQ ID NO: 3738110 - DNA, 20 bp, Homo sapiens
tggaggttgcagtgagctga

SEQ ID NO: 3738111 - DNA, 20 bp, Homo sapiens
tggagtagacccctggctgg

SEQ ID NO: 3738112 - DNA, 22 bp, Homo sapiens
tggagtcatggtccggtgtcct

SEQ ID NO: 3738113 - DNA, 14 bp, Homo sapiens
tggagtccagtctc

SEQ ID NO: 3738114 - DNA, 14 bp, Homo sapiens
tggagtgcagtgag

SEQ ID NO: 3738115 - DNA, 22 bp, Homo sapiens
tggagttgaaagagttaagaat

SEQ ID NO: 3738116 - DNA, 21 bp, Homo sapiens
tggataattttgcataaaatt

SEQ ID NO: 3738117 - DNA, 14 bp, Homo sapiens
tggatagatgccct

SEQ ID NO: 3738118 - DNA, 16 bp, Homo sapiens
tggatctcccagggct

SEQ ID NO: 3738119 - DNA, 23 bp, Homo sapiens
tggatctgggaccctttccttcc

SEQ ID NO: 3738120 - DNA, 22 bp, Homo sapiens
tggatgaagttatctggcttca

SEQ ID NO: 3738121 - DNA, 14 bp, Homo sapiens
tggatgcctcagaa

SEQ ID NO: 3738122 - DNA, 23 bp, Homo sapiens
tggatgcctggtggcagctgcgg

SEQ ID NO: 3738123 - DNA, 23 bp, Homo sapiens
tggatgcggaacccaaattacgt

SEQ ID NO: 3738124 - DNA, 19 bp, Homo sapiens
tggattctcagatatttat

SEQ ID NO: 3738125 - DNA, 20 bp, Homo sapiens
tggattgacagtaacttggt

SEQ ID NO: 3738126 - DNA, 17 bp, Homo sapiens
tggattggtgtaaaagg

SEQ ID NO: 3738127 - DNA, 21 bp, Homo sapiens
tggatttatgttgtatagatt

SEQ ID NO: 3738128 - DNA, 14 bp, Homo sapiens
tggatttcagaaag

SEQ ID NO: 3738129 - DNA, 16 bp, Homo sapiens
tggcaaaaaggcagga

SEQ ID NO: 3738130 - DNA, 13 bp, Homo sapiens
tggcaaagacaga

SEQ ID NO: 3738131 - DNA, 17 bp, Homo sapiens
tggcaaagacagaagcc

SEQ ID NO: 3738132 - DNA, 21 bp, Homo sapiens
tggcaaagccttcattgcctt

SEQ ID NO: 3738133 - DNA, 16 bp, Homo sapiens
tggcaaccagaccatt

SEQ ID NO: 3738134 - DNA, 22 bp, Homo sapiens
tggcaaccttgtctctatgcca

SEQ ID NO: 3738135 - DNA, 16 bp, Homo sapiens
tggcacagggcagtgg

SEQ ID NO: 3738136 - DNA, 15 bp, Homo sapiens
tggcacccggcccct

SEQ ID NO: 3738137 - DNA, 20 bp, Homo sapiens
tggcacctgtcgcccagtgc

SEQ ID NO: 3738138 - DNA, 20 bp, Homo sapiens
tggcacggtggctcaggcct

SEQ ID NO: 3738139 - DNA, 16 bp, Homo sapiens
tggcactataatgtaa

SEQ ID NO: 3738140 - DNA, 22 bp, Homo sapiens
tggcactgagatatttattgtt

SEQ ID NO: 3738141 - DNA, 19 bp, Homo sapiens
tggcactgcatacaatctg

SEQ ID NO: 3738142 - DNA, 14 bp, Homo sapiens
tggcagaactgagc

SEQ ID NO: 3738143 - DNA, 16 bp, Homo sapiens
tggcagaactgagctc

SEQ ID NO: 3738144 - DNA, 20 bp, Homo sapiens
tggcagaactgagctcctct

SEQ ID NO: 3738145 - DNA, 21 bp, Homo sapiens
tggcagaactgagctcctctg

SEQ ID NO: 3738146 - DNA, 19 bp, Homo sapiens
tggcagaataatctttggg

SEQ ID NO: 3738147 - DNA, 22 bp, Homo sapiens
tggcagaatggggtgcatgaag

SEQ ID NO: 3738148 - DNA, 17 bp, Homo sapiens
tggcagattttacaaaa

SEQ ID NO: 3738149 - DNA, 22 bp, Homo sapiens
tggcagcaggcctgttgctttt

SEQ ID NO: 3738150 - DNA, 14 bp, Homo sapiens
tggcagccccagca

SEQ ID NO: 3738151 - DNA, 15 bp, Homo sapiens
tggcagccccagcac

SEQ ID NO: 3738152 - DNA, 12 bp, Homo sapiens
tggcagccctgt

SEQ ID NO: 3738153 - DNA, 14 bp, Homo sapiens
tggcagccctgtag

SEQ ID NO: 3738154 - DNA, 18 bp, Homo sapiens
tggcagccgtgccttcag

SEQ ID NO: 3738155 - DNA, 22 bp, Homo sapiens
tggcagccgtgccttcagctct

SEQ ID NO: 3738156 - DNA, 13 bp, Homo sapiens
tggcagccttggc

SEQ ID NO: 3738157 - DNA, 17 bp, Homo sapiens
tggcagccttggcaaac

SEQ ID NO: 3738158 - DNA, 19 bp, Homo sapiens
tggcagctgcggtccaccc

SEQ ID NO: 3738159 - DNA, 21 bp, Homo sapiens
tggcagctgcggtccacccag

SEQ ID NO: 3738160 - DNA, 21 bp, Homo sapiens
tggcaggggtggaggagagcc

SEQ ID NO: 3738161 - DNA, 13 bp, Homo sapiens
tggcagtgggagc

SEQ ID NO: 3738162 - DNA, 14 bp, Homo sapiens
tggcagtgggagct

SEQ ID NO: 3738163 - DNA, 15 bp, Homo sapiens
tggcagtgggagctg

SEQ ID NO: 3738164 - DNA, 16 bp, Homo sapiens
tggcagtgggagctgc

SEQ ID NO: 3738165 - DNA, 20 bp, Homo sapiens
tggcagtgggagctgcctgt

SEQ ID NO: 3738166 - DNA, 18 bp, Homo sapiens
tggcatcacagggcagag

SEQ ID NO: 3738167 - DNA, 15 bp, Homo sapiens
tggttttcaaaataa

SEQ ID NO: 3738168 - DNA, 21 bp, Homo sapiens
tggtttttaaaaaactgctga

SEQ ID NO: 3738169 - DNA, 23 bp, Homo sapiens
tggtttttaaaaaactgctgact

SEQ ID NO: 3738170 - DNA, 23 bp, Homo sapiens
tgtaaaaacagcattgctttctg

SEQ ID NO: 3738171 - DNA, 24 bp, Homo sapiens
tgtaaaaacagcattgctttctga

SEQ ID NO: 3738172 - DNA, 14 bp, Homo sapiens
tgtaaaaactgtgg

SEQ ID NO: 3738173 - DNA, 11 bp, Homo sapiens
tgtaaaaatga

SEQ ID NO: 3738174 - DNA, 11 bp, Homo sapiens
tgtaaaacaaa

SEQ ID NO: 3738175 - DNA, 15 bp, Homo sapiens
tgtaaaacaaaaaac

SEQ ID NO: 3738176 - DNA, 16 bp, Homo sapiens
tgtaaaactgaggcac

SEQ ID NO: 3738177 - DNA, 12 bp, Homo sapiens
tgtaaaacttta

SEQ ID NO: 3738178 - DNA, 13 bp, Homo sapiens
tgtaaaactttat

SEQ ID NO: 3738179 - DNA, 14 bp, Homo sapiens
tgtaaaactttatt

SEQ ID NO: 3738180 - DNA, 16 bp, Homo sapiens
tgtaaaactttatttt

SEQ ID NO: 3738181 - DNA, 15 bp, Homo sapiens
tgtaaaatgaaatta

SEQ ID NO: 3738182 - DNA, 16 bp, Homo sapiens
tgtaaagtgtaaatcc

SEQ ID NO: 3738183 - DNA, 21 bp, Homo sapiens
tgtaaataaccccattctttg

SEQ ID NO: 3738184 - DNA, 12 bp, Homo sapiens
tgtaaataagag

SEQ ID NO: 3738185 - DNA, 12 bp, Homo sapiens
tgtaaatccttt

SEQ ID NO: 3738186 - DNA, 20 bp, Homo sapiens
tgtaaatcctttttctttat

SEQ ID NO: 3738187 - DNA, 22 bp, Homo sapiens
tgtaaatcctttttctttataa

SEQ ID NO: 3738188 - DNA, 21 bp, Homo sapiens
tgtaaattaccagtaaagtgt

SEQ ID NO: 3738189 - DNA, 12 bp, Homo sapiens
tgtaaattattt

SEQ ID NO: 3738190 - DNA, 14 bp, Homo sapiens
tgtaacaagaaagg

SEQ ID NO: 3738191 - DNA, 14 bp, Homo sapiens
tgtaacaagccacc

SEQ ID NO: 3738192 - DNA, 11 bp, Homo sapiens
tgtaacagctg

SEQ ID NO: 3738193 - DNA, 15 bp, Homo sapiens
tgtaacagctgaggt

SEQ ID NO: 3738194 - DNA, 21 bp, Homo sapiens
tgtaacaggtctcctcttaaa

SEQ ID NO: 3738195 - DNA, 16 bp, Homo sapiens
tgtaacatatgcaaac

SEQ ID NO: 3738196 - DNA, 14 bp, Homo sapiens
tgtaacgcctgctt

SEQ ID NO: 3738197 - DNA, 12 bp, Homo sapiens
tgtaactccacc

SEQ ID NO: 3738198 - DNA, 13 bp, Homo sapiens
tgtaactccacca

SEQ ID NO: 3738199 - DNA, 13 bp, Homo sapiens
tgtaactgcccaa

SEQ ID NO: 3738200 - DNA, 16 bp, Homo sapiens
tgtaacttttgtaaga

SEQ ID NO: 3738201 - DNA, 22 bp, Homo sapiens
tgtaagaaaccaatcaagataa

SEQ ID NO: 3738202 - DNA, 17 bp, Homo sapiens
tgtaagaagagactggg

SEQ ID NO: 3738203 - DNA, 21 bp, Homo sapiens
tgtaagaagagactgggaaga

SEQ ID NO: 3738204 - DNA, 15 bp, Homo sapiens
tgtaagaatcattgt

SEQ ID NO: 3738205 - DNA, 21 bp, Homo sapiens
tgtaagacaaaggttttcctc

SEQ ID NO: 3738206 - DNA, 17 bp, Homo sapiens
tgtaagagaatgttgaa

SEQ ID NO: 3738207 - DNA, 21 bp, Homo sapiens
tgtaagagctttacaaaaaga

SEQ ID NO: 3738208 - DNA, 13 bp, Homo sapiens
tgtaagataaaaa

SEQ ID NO: 3738209 - DNA, 16 bp, Homo sapiens
tgtaagattttgaaaa

SEQ ID NO: 3738210 - DNA, 20 bp, Homo sapiens
tgtaataaactcatttctag

SEQ ID NO: 3738211 - DNA, 13 bp, Homo sapiens
tgtaataaagtat

SEQ ID NO: 3738212 - DNA, 19 bp, Homo sapiens
tgtaataaagtatataatt

SEQ ID NO: 3738213 - DNA, 13 bp, Homo sapiens
tgtaataaagtgt

SEQ ID NO: 3738214 - DNA, 14 bp, Homo sapiens
tgtaataaagtgtt

SEQ ID NO: 3738215 - DNA, 22 bp, Homo sapiens
tgtaatcccagcactttgggag

SEQ ID NO: 3738216 - DNA, 23 bp, Homo sapiens
tgtaatcccagctactcaggagg

SEQ ID NO: 3738217 - DNA, 13 bp, Homo sapiens
tgtaatgtcacca

SEQ ID NO: 3738218 - DNA, 20 bp, Homo sapiens
tgtaatgtcaccaccttccc

SEQ ID NO: 3738219 - DNA, 23 bp, Homo sapiens
tgtaatgtcaccaccttcccagc

SEQ ID NO: 3738220 - DNA, 13 bp, Homo sapiens
tgtaatgttactg

SEQ ID NO: 3738221 - DNA, 14 bp, Homo sapiens
tgtaatgttactga

SEQ ID NO: 3738222 - DNA, 14 bp, Homo sapiens
tgtaattctaaatg

SEQ ID NO: 3738223 - DNA, 13 bp, Homo sapiens
tgtaatttgtgta

SEQ ID NO: 3738224 - DNA, 15 bp, Homo sapiens
tgtaatttgtgtaat

SEQ ID NO: 3738225 - DNA, 12 bp, Homo sapiens
tgtaattttctt

SEQ ID NO: 3738226 - DNA, 15 bp, Homo sapiens
tgtaattttcttgat

SEQ ID NO: 3738227 - DNA, 17 bp, Homo sapiens
tgtaattttcttgatga

SEQ ID NO: 3738228 - DNA, 17 bp, Homo sapiens
tgtacaaaataaacaaa

SEQ ID NO: 3738229 - DNA, 17 bp, Homo sapiens
tgtacaaaataaagtta

SEQ ID NO: 3738230 - DNA, 14 bp, Homo sapiens
tgtacaaaatggaa

SEQ ID NO: 3738231 - DNA, 23 bp, Homo sapiens
tgtacaaagtagaagtcttagat

SEQ ID NO: 3738232 - DNA, 17 bp, Homo sapiens
tgtacaacctgtgatca

SEQ ID NO: 3738233 - DNA, 14 bp, Homo sapiens
tgtacaatatttaa

SEQ ID NO: 3738234 - DNA, 18 bp, Homo sapiens
tgtacaatattttaagca

SEQ ID NO: 3738235 - DNA, 13 bp, Homo sapiens
tgtacacacttta

SEQ ID NO: 3738236 - DNA, 14 bp, Homo sapiens
tgtacacactttat

SEQ ID NO: 3738237 - DNA, 19 bp, Homo sapiens
tgtacacactttatttact

SEQ ID NO: 3738238 - DNA, 16 bp, Homo sapiens
tgtacactgaatattt

SEQ ID NO: 3738239 - DNA, 18 bp, Homo sapiens
tgtacagaattctgctac

SEQ ID NO: 3738240 - DNA, 20 bp, Homo sapiens
tgtacagacgtatgcttatt

SEQ ID NO: 3738241 - DNA, 18 bp, Homo sapiens
tgtacagtatgttcaaag

SEQ ID NO: 3738242 - DNA, 17 bp, Homo sapiens
tgtacagtgtgtaaagt

SEQ ID NO: 3738243 - DNA, 19 bp, Homo sapiens
tgtacatactttttcaaga

SEQ ID NO: 3738244 - DNA, 21 bp, Homo sapiens
tgtacatatgtaaaataaaat

SEQ ID NO: 3738245 - DNA, 20 bp, Homo sapiens
tgtacatatttgagactagt

SEQ ID NO: 3738246 - DNA, 22 bp, Homo sapiens
tgtacatgaagaagctaaatcc

SEQ ID NO: 3738247 - DNA, 14 bp, Homo sapiens
tgtacattaattac

SEQ ID NO: 3738248 - DNA, 21 bp, Homo sapiens
tgtaccgggctggcctgtgcc

SEQ ID NO: 3738249 - DNA, 21 bp, Homo sapiens
tgtacctcttttagtcatttt

SEQ ID NO: 3738250 - DNA, 12 bp, Homo sapiens
tgtacgtggaga

SEQ ID NO: 3738251 - DNA, 19 bp, Homo sapiens
tgtactagtctgtgtggga

SEQ ID NO: 3738252 - DNA, 12 bp, Homo sapiens
tgtactcctccc

SEQ ID NO: 3738253 - DNA, 13 bp, Homo sapiens
tgtactcctccca

SEQ ID NO: 3738254 - DNA, 12 bp, Homo sapiens
tgtactctggcc

SEQ ID NO: 3738255 - DNA, 17 bp, Homo sapiens
tgtactgagccttgtaa

SEQ ID NO: 3738256 - DNA, 19 bp, Homo sapiens
tgtactggagagcaacaca

SEQ ID NO: 3738257 - DNA, 21 bp, Homo sapiens
tgtacttaataaattcagata

SEQ ID NO: 3738258 - DNA, 22 bp, Homo sapiens
tgtacttaataaattcagatat

SEQ ID NO: 3738259 - DNA, 14 bp, Homo sapiens
tgtacttcaagtta

SEQ ID NO: 3738260 - DNA, 16 bp, Homo sapiens
tgtacttttaaggcag

SEQ ID NO: 3738261 - DNA, 15 bp, Homo sapiens
tgtactttttccaga

SEQ ID NO: 3738262 - DNA, 20 bp, Homo sapiens
tgtagaaaagaactggaaac

SEQ ID NO: 3738263 - DNA, 16 bp, Homo sapiens
tgtagaatgatttcat

SEQ ID NO: 3738264 - DNA, 12 bp, Homo sapiens
tgtagagccagg

SEQ ID NO: 3738265 - DNA, 16 bp, Homo sapiens
tgtagagccagggtct

SEQ ID NO: 3738266 - DNA, 14 bp, Homo sapiens
tgtagagcttctgg

SEQ ID NO: 3738267 - DNA, 22 bp, Homo sapiens
tgtagcaaaattcttaagtatg

SEQ ID NO: 3738268 - DNA, 17 bp, Homo sapiens
tgtagcaatcagatttt

SEQ ID NO: 3738269 - DNA, 17 bp, Homo sapiens
tgtagccttgcccggat

SEQ ID NO: 3738270 - DNA, 13 bp, Homo sapiens
tgtagctttgctc

SEQ ID NO: 3738271 - DNA, 20 bp, Homo sapiens
tgtaggaaggttaatgttca

SEQ ID NO: 3738272 - DNA, 11 bp, Homo sapiens
tgtaggagaat

SEQ ID NO: 3738273 - DNA, 20 bp, Homo sapiens
tgtaggagaggttgtctgtg

SEQ ID NO: 3738274 - DNA, 17 bp, Homo sapiens
tgtaggtatgaataagt

SEQ ID NO: 3738275 - DNA, 17 bp, Homo sapiens
tgtagtcccagctactc

SEQ ID NO: 3738276 - DNA, 23 bp, Homo sapiens
tgtagtcctagccactcaggagg

SEQ ID NO: 3738277 - DNA, 14 bp, Homo sapiens
tgtagtctcaggac

SEQ ID NO: 3738278 - DNA, 23 bp, Homo sapiens
tgtagttaggaaataaaaccttt

SEQ ID NO: 3738279 - DNA, 23 bp, Homo sapiens
tgtataccccgtgaagcatccag

SEQ ID NO: 3738280 - DNA, 21 bp, Homo sapiens
tgtatagtactggcatggtac

SEQ ID NO: 3738281 - DNA, 22 bp, Homo sapiens
tgtttgacaaagaaacccaagt

SEQ ID NO: 3738282 - DNA, 14 bp, Homo sapiens
tgtttgagctcaga

SEQ ID NO: 3738283 - DNA, 23 bp, Homo sapiens
tgtttgctcagaacacattcttt

SEQ ID NO: 3738284 - DNA, 15 bp, Homo sapiens
tgtttgcttcaactg

SEQ ID NO: 3738285 - DNA, 12 bp, Homo sapiens
tgtttggctggg

SEQ ID NO: 3738286 - DNA, 19 bp, Homo sapiens
tgtttggggatgagaaagg

SEQ ID NO: 3738287 - DNA, 18 bp, Homo sapiens
tgtttgggtatcctgccc

SEQ ID NO: 3738288 - DNA, 23 bp, Homo sapiens
tgtttgggtatcctgcccagtgt

SEQ ID NO: 3738289 - DNA, 16 bp, Homo sapiens
tgtttggttctggggc

SEQ ID NO: 3738290 - DNA, 20 bp, Homo sapiens
tgtttggttctggggcccct

SEQ ID NO: 3738291 - DNA, 15 bp, Homo sapiens
tgtttgtaaataaga

SEQ ID NO: 3738292 - DNA, 17 bp, Homo sapiens
tgtttgtctgtcttcat

SEQ ID NO: 3738293 - DNA, 19 bp, Homo sapiens
tgtttgtctgtcttcatag

SEQ ID NO: 3738294 - DNA, 15 bp, Homo sapiens
tgtttgtggcctcag

SEQ ID NO: 3738295 - DNA, 12 bp, Homo sapiens
tgtttgttatgg

SEQ ID NO: 3738296 - DNA, 17 bp, Homo sapiens
tgtttgtttcctttgtt

SEQ ID NO: 3738297 - DNA, 22 bp, Homo sapiens
tgtttgtttctccccctgggct

SEQ ID NO: 3738298 - DNA, 12 bp, Homo sapiens
tgtttgttttgt

SEQ ID NO: 3738299 - DNA, 16 bp, Homo sapiens
tgttttaagaggcagg

SEQ ID NO: 3738300 - DNA, 17 bp, Homo sapiens
tgttttaagaggcaggg

SEQ ID NO: 3738301 - DNA, 16 bp, Homo sapiens
tgttttactgctttta

SEQ ID NO: 3738302 - DNA, 19 bp, Homo sapiens
tgttttcatgtaaataaat

SEQ ID NO: 3738303 - DNA, 11 bp, Homo sapiens
tgttttcttct

SEQ ID NO: 3738304 - DNA, 13 bp, Homo sapiens
tgttttgtttctg

SEQ ID NO: 3738305 - DNA, 13 bp, Homo sapiens
tgttttgttttaa

SEQ ID NO: 3738306 - DNA, 16 bp, Homo sapiens
tgtttttaaaaatcat

SEQ ID NO: 3738307 - DNA, 20 bp, Homo sapiens
tgtttttaaaaatcataaac

SEQ ID NO: 3738308 - DNA, 12 bp, Homo sapiens
tgtttttaactc

SEQ ID NO: 3738309 - DNA, 14 bp, Homo sapiens
tgtttttaagctgt

SEQ ID NO: 3738310 - DNA, 15 bp, Homo sapiens
tgtttttaagctgtt

SEQ ID NO: 3738311 - DNA, 17 bp, Homo sapiens
tgtttttaagctgtttc

SEQ ID NO: 3738312 - DNA, 22 bp, Homo sapiens
tgtttttaagctgtttccatag

SEQ ID NO: 3738313 - DNA, 14 bp, Homo sapiens
tgtttttgggatgt

SEQ ID NO: 3738314 - DNA, 18 bp, Homo sapiens
tgtttttgggatgtctta

SEQ ID NO: 3738315 - DNA, 13 bp, Homo sapiens
tgtttttgttgtg

SEQ ID NO: 3738316 - DNA, 15 bp, Homo sapiens
tgttttttaaagtct

SEQ ID NO: 3738317 - DNA, 17 bp, Homo sapiens
ttaaaaagtctgcatta

SEQ ID NO: 3738318 - DNA, 18 bp, Homo sapiens
ttaaaaagtggaaaaata

SEQ ID NO: 3738319 - DNA, 14 bp, Homo sapiens
ttaaaaatggtaaa

SEQ ID NO: 3738320 - DNA, 20 bp, Homo sapiens
ttaaaacaagaaagtttccc

SEQ ID NO: 3738321 - DNA, 19 bp, Homo sapiens
ttaaaagaaatctctagct

SEQ ID NO: 3738322 - DNA, 19 bp, Homo sapiens
ttaaaagccatcatgtaaa

SEQ ID NO: 3738323 - DNA, 22 bp, Homo sapiens
ttaaaatagcaacactctatat

SEQ ID NO: 3738324 - DNA, 19 bp, Homo sapiens
ttaaaatattcctgcattt

SEQ ID NO: 3738325 - DNA, 11 bp, Homo sapiens
ttaaaatctta

SEQ ID NO: 3738326 - DNA, 23 bp, Homo sapiens
ttaaacagtgagcctgaattttg

SEQ ID NO: 3738327 - DNA, 13 bp, Homo sapiens
ttaaacattgaag

SEQ ID NO: 3738328 - DNA, 14 bp, Homo sapiens
ttaaacctatactc

SEQ ID NO: 3738329 - DNA, 14 bp, Homo sapiens
ttaaagcaaaggag

SEQ ID NO: 3738330 - DNA, 21 bp, Homo sapiens
ttaaagcagagggactttgta

SEQ ID NO: 3738331 - DNA, 22 bp, Homo sapiens
ttaaagcagagggactttgtat

SEQ ID NO: 3738332 - DNA, 17 bp, Homo sapiens
ttaaagcatttactttg

SEQ ID NO: 3738333 - DNA, 15 bp, Homo sapiens
ttaaagctgcctgta

SEQ ID NO: 3738334 - DNA, 17 bp, Homo sapiens
ttaaaggctaccttatt

SEQ ID NO: 3738335 - DNA, 15 bp, Homo sapiens
ttaaaggctgtggta

SEQ ID NO: 3738336 - DNA, 21 bp, Homo sapiens
ttaaaggggcagaaaaactct

SEQ ID NO: 3738337 - DNA, 18 bp, Homo sapiens
ttaaagtcaggtccaatt

SEQ ID NO: 3738338 - DNA, 11 bp, Homo sapiens
ttaaagttctg

SEQ ID NO: 3738339 - DNA, 18 bp, Homo sapiens
ttaaagttctgtgtattt

SEQ ID NO: 3738340 - DNA, 22 bp, Homo sapiens
ttaaataaaagaaatgcacaat

SEQ ID NO: 3738341 - DNA, 12 bp, Homo sapiens
ttaaataaaata

SEQ ID NO: 3738342 - DNA, 21 bp, Homo sapiens
ttaaataaatgtcattaaaat

SEQ ID NO: 3738343 - DNA, 18 bp, Homo sapiens
ttaaatagtaaaaataaa

SEQ ID NO: 3738344 - DNA, 15 bp, Homo sapiens
ttaaatataatatgc

SEQ ID NO: 3738345 - DNA, 19 bp, Homo sapiens
ttaaatatatgtatgtaaa

SEQ ID NO: 3738346 - DNA, 13 bp, Homo sapiens
ttaaatatatttt

SEQ ID NO: 3738347 - DNA, 22 bp, Homo sapiens
ttaaatatattttcaaagtaca

SEQ ID NO: 3738348 - DNA, 16 bp, Homo sapiens
ttaaatatcaatcatt

SEQ ID NO: 3738349 - DNA, 20 bp, Homo sapiens
ttaaatcccattcataactt

SEQ ID NO: 3738350 - DNA, 12 bp, Homo sapiens
ttaaatcctgtt

SEQ ID NO: 3738351 - DNA, 18 bp, Homo sapiens
ttaaatcctgttgaaaag

SEQ ID NO: 3738352 - DNA, 23 bp, Homo sapiens
ttaaatgagaaggaatttgagtt

SEQ ID NO: 3738353 - DNA, 14 bp, Homo sapiens
ttaaattaaacaat

SEQ ID NO: 3738354 - DNA, 21 bp, Homo sapiens
ttaaattataacttaaaatat

SEQ ID NO: 3738355 - DNA, 12 bp, Homo sapiens
ttaaattataag

SEQ ID NO: 3738356 - DNA, 18 bp, Homo sapiens
ttaaattataaggactgc

SEQ ID NO: 3738357 - DNA, 22 bp, Homo sapiens
ttaaattcttttttaaattttc

SEQ ID NO: 3738358 - DNA, 15 bp, Homo sapiens
ttaaattttaattta

SEQ ID NO: 3738359 - DNA, 17 bp, Homo sapiens
ttaaattttcttcagtt

SEQ ID NO: 3738360 - DNA, 20 bp, Homo sapiens
ttaacaaggaatgcctgtgc

SEQ ID NO: 3738361 - DNA, 21 bp, Homo sapiens
ttaacaataactactgtgttc

SEQ ID NO: 3738362 - DNA, 21 bp, Homo sapiens
ttaacaatgtcttgtaagcaa

SEQ ID NO: 3738363 - DNA, 14 bp, Homo sapiens
ttaacacacataaa

SEQ ID NO: 3738364 - DNA, 18 bp, Homo sapiens
ttaacacacataaaggat

SEQ ID NO: 3738365 - DNA, 21 bp, Homo sapiens
ttaacagttttccatgaaaac

SEQ ID NO: 3738366 - DNA, 16 bp, Homo sapiens
ttaacatggaactcta

SEQ ID NO: 3738367 - DNA, 15 bp, Homo sapiens
ttaacattcatagag

SEQ ID NO: 3738368 - DNA, 14 bp, Homo sapiens
ttaacattctgtaa

SEQ ID NO: 3738369 - DNA, 21 bp, Homo sapiens
ttaacattgaccaagaactgc

SEQ ID NO: 3738370 - DNA, 22 bp, Homo sapiens
ttaacattgaccaagaactgca

SEQ ID NO: 3738371 - DNA, 15 bp, Homo sapiens
ttaacctacctgtaa

SEQ ID NO: 3738372 - DNA, 15 bp, Homo sapiens
ttaacctcagtgtca

SEQ ID NO: 3738373 - DNA, 13 bp, Homo sapiens
ttaacctggtgct

SEQ ID NO: 3738374 - DNA, 14 bp, Homo sapiens
ttaactagaattta

SEQ ID NO: 3738375 - DNA, 14 bp, Homo sapiens
ttaactatgtacaa

SEQ ID NO: 3738376 - DNA, 18 bp, Homo sapiens
ttaactatgtacaatatt

SEQ ID NO: 3738377 - DNA, 19 bp, Homo sapiens
ttaactcaggactccagcc

SEQ ID NO: 3738378 - DNA, 18 bp, Homo sapiens
ttaacttaacattctgta

SEQ ID NO: 3738379 - DNA, 23 bp, Homo sapiens
ttaactttatcacattatttgca

SEQ ID NO: 3738380 - DNA, 16 bp, Homo sapiens
ttaacttttttcttta

SEQ ID NO: 3738381 - DNA, 23 bp, Homo sapiens
ttaagaaaaaaataattttatga

SEQ ID NO: 3738382 - DNA, 19 bp, Homo sapiens
ttaagaaaatacaataaac

SEQ ID NO: 3738383 - DNA, 14 bp, Homo sapiens
ttaagataattata

SEQ ID NO: 3738384 - DNA, 16 bp, Homo sapiens
ttaagataattataat

SEQ ID NO: 3738385 - DNA, 14 bp, Homo sapiens
ttaagatggattct

SEQ ID NO: 3738386 - DNA, 18 bp, Homo sapiens
ttaagatggattctcaga

SEQ ID NO: 3738387 - DNA, 23 bp, Homo sapiens
ttaagatggattctcagatattt

SEQ ID NO: 3738388 - DNA, 21 bp, Homo sapiens
ttaagatgtgtcttcaatttg

SEQ ID NO: 3738389 - DNA, 19 bp, Homo sapiens
ttaagattccttttcttgt

SEQ ID NO: 3738390 - DNA, 11 bp, Homo sapiens
ttaagatttaa

SEQ ID NO: 3738391 - DNA, 14 bp, Homo sapiens
ttaagcatcacaaa

SEQ ID NO: 3738392 - DNA, 18 bp, Homo sapiens
ttaagcatcacaaatgat

SEQ ID NO: 3738393 - DNA, 20 bp, Homo sapiens
ttaagcattactcttgtaag

SEQ ID NO: 3738394 - DNA, 23 bp, Homo sapiens
ttcaggaacctggaccaaagctg

SEQ ID NO: 3738395 - DNA, 17 bp, Homo sapiens
ttcaggatactctgtca

SEQ ID NO: 3738396 - DNA, 18 bp, Homo sapiens
ttcagggaatttcaggaa

SEQ ID NO: 3738397 - DNA, 20 bp, Homo sapiens
ttcaggggactcagccctga

SEQ ID NO: 3738398 - DNA, 22 bp, Homo sapiens
ttcagggggccaggtgcacaga

SEQ ID NO: 3738399 - DNA, 16 bp, Homo sapiens
ttcagggttggcccct

SEQ ID NO: 3738400 - DNA, 19 bp, Homo sapiens
ttcaggtagctgcccctgg

SEQ ID NO: 3738401 - DNA, 15 bp, Homo sapiens
ttcaggttttgtaaa

SEQ ID NO: 3738402 - DNA, 18 bp, Homo sapiens
ttcagtaataaaacatct

SEQ ID NO: 3738403 - DNA, 14 bp, Homo sapiens
ttcagtaataactc

SEQ ID NO: 3738404 - DNA, 20 bp, Homo sapiens
ttcagtataatttaacttca

SEQ ID NO: 3738405 - DNA, 23 bp, Homo sapiens
ttcagtataatttaacttcagag

SEQ ID NO: 3738406 - DNA, 13 bp, Homo sapiens
ttcagtcttttcc

SEQ ID NO: 3738407 - DNA, 19 bp, Homo sapiens
ttcagtgctgtggcctggg

SEQ ID NO: 3738408 - DNA, 14 bp, Homo sapiens
ttcagtggcagctg

SEQ ID NO: 3738409 - DNA, 19 bp, Homo sapiens
ttcagtttcaattcagtgc

SEQ ID NO: 3738410 - DNA, 21 bp, Homo sapiens
ttcataacagtgccattgtct

SEQ ID NO: 3738411 - DNA, 13 bp, Homo sapiens
ttcataggagaca

SEQ ID NO: 3738412 - DNA, 16 bp, Homo sapiens
ttcataggagacacat

SEQ ID NO: 3738413 - DNA, 18 bp, Homo sapiens
ttcatatatgaggacttg

SEQ ID NO: 3738414 - DNA, 17 bp, Homo sapiens
ttcatatgcttcaaact

SEQ ID NO: 3738415 - DNA, 16 bp, Homo sapiens
ttcatcagtgttaaaa

SEQ ID NO: 3738416 - DNA, 18 bp, Homo sapiens
ttcatcatcctaagctat

SEQ ID NO: 3738417 - DNA, 21 bp, Homo sapiens
ttcatcatcctaagctattca

SEQ ID NO: 3738418 - DNA, 18 bp, Homo sapiens
ttcatccaatcctcactg

SEQ ID NO: 3738419 - DNA, 18 bp, Homo sapiens
ttcatccggcagcctgga

SEQ ID NO: 3738420 - DNA, 17 bp, Homo sapiens
ttcatgatttcatttca

SEQ ID NO: 3738421 - DNA, 21 bp, Homo sapiens
ttcatgccaattagcaattga

SEQ ID NO: 3738422 - DNA, 18 bp, Homo sapiens
ttcatgcctttgtaagtt

SEQ ID NO: 3738423 - DNA, 14 bp, Homo sapiens
ttcatgtaaataaa

SEQ ID NO: 3738424 - DNA, 13 bp, Homo sapiens
ttcatgtttctta

SEQ ID NO: 3738425 - DNA, 16 bp, Homo sapiens
ttcattgactatcaaa

SEQ ID NO: 3738426 - DNA, 18 bp, Homo sapiens
ttcattgatatgaaaaat

SEQ ID NO: 3738427 - DNA, 13 bp, Homo sapiens
ttcattgggctgt

SEQ ID NO: 3738428 - DNA, 20 bp, Homo sapiens
ttcattgtaatgttactgat

SEQ ID NO: 3738429 - DNA, 12 bp, Homo sapiens
ttcattgtggtt

SEQ ID NO: 3738430 - DNA, 19 bp, Homo sapiens
ttcattgtggttattttta

SEQ ID NO: 3738431 - DNA, 15 bp, Homo sapiens
ttcatttcaactgtt

SEQ ID NO: 3738432 - DNA, 18 bp, Homo sapiens
ttcatttgttattcttaa

SEQ ID NO: 3738433 - DNA, 13 bp, Homo sapiens
ttccaagacattg

SEQ ID NO: 3738434 - DNA, 20 bp, Homo sapiens
ttccaagacattgtcaataa

SEQ ID NO: 3738435 - DNA, 18 bp, Homo sapiens
ttccaagactccagccct

SEQ ID NO: 3738436 - DNA, 13 bp, Homo sapiens
ttccaaggagctg

SEQ ID NO: 3738437 - DNA, 23 bp, Homo sapiens
ttccaaggagctgagaatagaag

SEQ ID NO: 3738438 - DNA, 15 bp, Homo sapiens
ttccaagggtactaa

SEQ ID NO: 3738439 - DNA, 22 bp, Homo sapiens
ttccaatttacatactctgctt

SEQ ID NO: 3738440 - DNA, 13 bp, Homo sapiens
ttccaatttggaa

SEQ ID NO: 3738441 - DNA, 21 bp, Homo sapiens
ttccaattttctggaatacat

SEQ ID NO: 3738442 - DNA, 19 bp, Homo sapiens
ttccacaagattcccagag

SEQ ID NO: 3738443 - DNA, 20 bp, Homo sapiens
ttccacaagattcccagaga

SEQ ID NO: 3738444 - DNA, 21 bp, Homo sapiens
ttccacaagattcccagagac

SEQ ID NO: 3738445 - DNA, 18 bp, Homo sapiens
ttccacactcacctctaa

SEQ ID NO: 3738446 - DNA, 17 bp, Homo sapiens
ttccacaggtctcagaa

SEQ ID NO: 3738447 - DNA, 13 bp, Homo sapiens
ttccacatttgtc

SEQ ID NO: 3738448 - DNA, 13 bp, Homo sapiens
ttccaccccctcc

SEQ ID NO: 3738449 - DNA, 11 bp, Homo sapiens
ttccaccctgg

SEQ ID NO: 3738450 - DNA, 16 bp, Homo sapiens
ttccaccttaaattaa

SEQ ID NO: 3738451 - DNA, 15 bp, Homo sapiens
ttccaccttcccatg

SEQ ID NO: 3738452 - DNA, 15 bp, Homo sapiens
ttccacgctgtctcc

SEQ ID NO: 3738453 - DNA, 19 bp, Homo sapiens
ttccacgctgtctccagac

SEQ ID NO: 3738454 - DNA, 19 bp, Homo sapiens
ttccacgtactgcagcctc

SEQ ID NO: 3738455 - DNA, 23 bp, Homo sapiens
ttccactgatggaaacaaagtgg

SEQ ID NO: 3738456 - DNA, 20 bp, Homo sapiens
ttccactgtcaagaaagagc

SEQ ID NO: 3738457 - DNA, 21 bp, Homo sapiens
ttccacttagaaattgcattt

SEQ ID NO: 3738458 - DNA, 18 bp, Homo sapiens
ttccagaaaaccccagca

SEQ ID NO: 3738459 - DNA, 14 bp, Homo sapiens
ttccagaaaggata

SEQ ID NO: 3738460 - DNA, 19 bp, Homo sapiens
ttccagagagtggctcctc

SEQ ID NO: 3738461 - DNA, 16 bp, Homo sapiens
ttccaggctgcataga

SEQ ID NO: 3738462 - DNA, 20 bp, Homo sapiens
ttccaggctgcatagaagga

SEQ ID NO: 3738463 - DNA, 23 bp, Homo sapiens
ttccaggttctggttagctcagc

SEQ ID NO: 3738464 - DNA, 17 bp, Homo sapiens
ttccaggtttaagctgt

SEQ ID NO: 3738465 - DNA, 18 bp, Homo sapiens
ttccaggtttaagctgtt

SEQ ID NO: 3738466 - DNA, 21 bp, Homo sapiens
ttccagtgcaacactgaagct

SEQ ID NO: 3738467 - DNA, 11 bp, Homo sapiens
ttccagttccc

SEQ ID NO: 3738468 - DNA, 19 bp, Homo sapiens
ttccataaggaatgtagct

SEQ ID NO: 3738469 - DNA, 19 bp, Homo sapiens
ttccataatctggactcct

SEQ ID NO: 3738470 - DNA, 12 bp, Homo sapiens
ttccataattat

SEQ ID NO: 3738471 - DNA, 13 bp, Homo sapiens
ttccataattatg

SEQ ID NO: 3738472 - DNA, 22 bp, Homo sapiens
ttccataattatgacagttata

SEQ ID NO: 3738473 - DNA, 22 bp, Homo sapiens
ttccatagtatattaaaaatgg

SEQ ID NO: 3738474 - DNA, 15 bp, Homo sapiens
ttccatccctacccc

SEQ ID NO: 3738475 - DNA, 21 bp, Homo sapiens
ttccatccctaccccctaaga

SEQ ID NO: 3738476 - DNA, 23 bp, Homo sapiens
ttccatctcgccacccctccttc

SEQ ID NO: 3738477 - DNA, 20 bp, Homo sapiens
ttccatgaatgtatcaggaa

SEQ ID NO: 3738478 - DNA, 14 bp, Homo sapiens
ttccatggattttg

SEQ ID NO: 3738479 - DNA, 17 bp, Homo sapiens
ttccatgtcgcctctgc

SEQ ID NO: 3738480 - DNA, 15 bp, Homo sapiens
ttccatgtgcccagt

SEQ ID NO: 3738481 - DNA, 15 bp, Homo sapiens
ttccatttctctctc

SEQ ID NO: 3738482 - DNA, 16 bp, Homo sapiens
ttcccaagctctgctc

SEQ ID NO: 3738483 - DNA, 19 bp, Homo sapiens
ttcccagagacaggaaaat

SEQ ID NO: 3738484 - DNA, 16 bp, Homo sapiens
ttcccagctctccctc

SEQ ID NO: 3738485 - DNA, 15 bp, Homo sapiens
ttcccagctgcccct

SEQ ID NO: 3738486 - DNA, 15 bp, Homo sapiens
ttcccataattttct

SEQ ID NO: 3738487 - DNA, 14 bp, Homo sapiens
ttcccattttgcaa

SEQ ID NO: 3738488 - DNA, 17 bp, Homo sapiens
ttcccattttgcaaaat

SEQ ID NO: 3738489 - DNA, 13 bp, Homo sapiens
ttcccattttgga

SEQ ID NO: 3738490 - DNA, 16 bp, Homo sapiens
ttccccaacgaaaagc

SEQ ID NO: 3738491 - DNA, 21 bp, Homo sapiens
ttccccaccagtgaatgaaag

SEQ ID NO: 3738492 - DNA, 17 bp, Homo sapiens
ttccccactgacagcct

SEQ ID NO: 3738493 - DNA, 14 bp, Homo sapiens
ttccccactgcctg

SEQ ID NO: 3738494 - DNA, 22 bp, Homo sapiens
ttccccacttgagaattaccct

SEQ ID NO: 3738495 - DNA, 14 bp, Homo sapiens
ttcccccaaagtgg

SEQ ID NO: 3738496 - DNA, 18 bp, Homo sapiens
ttcccccaccagctaagg

SEQ ID NO: 3738497 - DNA, 14 bp, Homo sapiens
ttcccccatagcca

SEQ ID NO: 3738498 - DNA, 17 bp, Homo sapiens
ttcccccatagccaccc

SEQ ID NO: 3738499 - DNA, 12 bp, Homo sapiens
ttccccccactc

SEQ ID NO: 3738500 - DNA, 18 bp, Homo sapiens
ttccccccactctcccca

SEQ ID NO: 3738501 - DNA, 18 bp, Homo sapiens
ttccccctctcccagttg

SEQ ID NO: 3738502 - DNA, 13 bp, Homo sapiens
ttcccctccctgg

SEQ ID NO: 3738503 - DNA, 16 bp, Homo sapiens
ttcccctccctggctc

SEQ ID NO: 3738504 - DNA, 17 bp, Homo sapiens
ttcccctccctggctcc

SEQ ID NO: 3738505 - DNA, 17 bp, Homo sapiens
ttcccctccttctccct

SEQ ID NO: 3738506 - DNA, 23 bp, Homo sapiens
ttcccgaaccccaaggagggaga

SEQ ID NO: 3738507 - DNA, 22 bp, Homo sapiens
ttgctacttcctgcctggtctc

SEQ ID NO: 3738508 - DNA, 21 bp, Homo sapiens
ttgctatcaaaataaattgaa

SEQ ID NO: 3738509 - DNA, 17 bp, Homo sapiens
ttgctcaaaaaatgagc

SEQ ID NO: 3738510 - DNA, 15 bp, Homo sapiens
ttgctcacagctgta

SEQ ID NO: 3738511 - DNA, 12 bp, Homo sapiens
ttgctccacccc

SEQ ID NO: 3738512 - DNA, 16 bp, Homo sapiens
ttgctccaccccactc

SEQ ID NO: 3738513 - DNA, 17 bp, Homo sapiens
ttgctccaccccactca

SEQ ID NO: 3738514 - DNA, 13 bp, Homo sapiens
ttgctccgcctct

SEQ ID NO: 3738515 - DNA, 16 bp, Homo sapiens
ttgctcgtcacagtgt

SEQ ID NO: 3738516 - DNA, 21 bp, Homo sapiens
ttgctctcccctgccctgctg

SEQ ID NO: 3738517 - DNA, 19 bp, Homo sapiens
ttgctcttaagttgtggag

SEQ ID NO: 3738518 - DNA, 22 bp, Homo sapiens
ttgctcttgcagagaagccttg

SEQ ID NO: 3738519 - DNA, 19 bp, Homo sapiens
ttgctgaatacagaggcaa

SEQ ID NO: 3738520 - DNA, 23 bp, Homo sapiens
ttgctggactgtcatagaaatta

SEQ ID NO: 3738521 - DNA, 23 bp, Homo sapiens
ttgctggtcttgtaagagctata

SEQ ID NO: 3738522 - DNA, 21 bp, Homo sapiens
ttgctgtcataagaatgaata

SEQ ID NO: 3738523 - DNA, 17 bp, Homo sapiens
ttgctgtggtctctttg

SEQ ID NO: 3738524 - DNA, 19 bp, Homo sapiens
ttgctgtgtccaactccag

SEQ ID NO: 3738525 - DNA, 20 bp, Homo sapiens
ttgctgtgtccaactccagt

SEQ ID NO: 3738526 - DNA, 13 bp, Homo sapiens
ttgctgtttcctt

SEQ ID NO: 3738527 - DNA, 13 bp, Homo sapiens
ttgcttatgacat

SEQ ID NO: 3738528 - DNA, 22 bp, Homo sapiens
ttgcttattgttccaagacatt

SEQ ID NO: 3738529 - DNA, 23 bp, Homo sapiens
ttgcttattgttccaagacattg

SEQ ID NO: 3738530 - DNA, 13 bp, Homo sapiens
ttgcttgaacaca

SEQ ID NO: 3738531 - DNA, 17 bp, Homo sapiens
ttgcttgagcccaggag

SEQ ID NO: 3738532 - DNA, 12 bp, Homo sapiens
ttgctttactgg

SEQ ID NO: 3738533 - DNA, 13 bp, Homo sapiens
ttgctttctgaaa

SEQ ID NO: 3738534 - DNA, 14 bp, Homo sapiens
ttgctttctgaaat

SEQ ID NO: 3738535 - DNA, 21 bp, Homo sapiens
ttgctttgaaactagacttga

SEQ ID NO: 3738536 - DNA, 15 bp, Homo sapiens
ttgctttttcaccag

SEQ ID NO: 3738537 - DNA, 21 bp, Homo sapiens
ttggaaaaatccagaaagaaa

SEQ ID NO: 3738538 - DNA, 20 bp, Homo sapiens
ttggaaagcatcacctcagg

SEQ ID NO: 3738539 - DNA, 14 bp, Homo sapiens
ttggaaaggaccag

SEQ ID NO: 3738540 - DNA, 17 bp, Homo sapiens
ttggaatctagaagaaa

SEQ ID NO: 3738541 - DNA, 19 bp, Homo sapiens
ttggaatctagaagaaatg

SEQ ID NO: 3738542 - DNA, 23 bp, Homo sapiens
ttggaatctagaagaaatgaaat

SEQ ID NO: 3738543 - DNA, 15 bp, Homo sapiens
ttggaattaaaacaa

SEQ ID NO: 3738544 - DNA, 17 bp, Homo sapiens
ttggaattaacctggtg

SEQ ID NO: 3738545 - DNA, 18 bp, Homo sapiens
ttggaattaacctggtgc

SEQ ID NO: 3738546 - DNA, 19 bp, Homo sapiens
ttggaattaacctggtgct

SEQ ID NO: 3738547 - DNA, 20 bp, Homo sapiens
ttggacctcattttattaaa

SEQ ID NO: 3738548 - DNA, 16 bp, Homo sapiens
ttggacgcacacagct

SEQ ID NO: 3738549 - DNA, 18 bp, Homo sapiens
ttggactctcccctctta

SEQ ID NO: 3738550 - DNA, 14 bp, Homo sapiens
ttggactgacattt

SEQ ID NO: 3738551 - DNA, 15 bp, Homo sapiens
ttggactgacattta

SEQ ID NO: 3738552 - DNA, 22 bp, Homo sapiens
ttggacttttcgttaacattga

SEQ ID NO: 3738553 - DNA, 20 bp, Homo sapiens
ttggagactctgtggggcct

SEQ ID NO: 3738554 - DNA, 17 bp, Homo sapiens
ttggagagtaaaaactg

SEQ ID NO: 3738555 - DNA, 16 bp, Homo sapiens
ttggagggtgtcccaa

SEQ ID NO: 3738556 - DNA, 20 bp, Homo sapiens
ttggagtgagtgtggctccc

SEQ ID NO: 3738557 - DNA, 22 bp, Homo sapiens
ttggagtgagtgtggctcccct

SEQ ID NO: 3738558 - DNA, 17 bp, Homo sapiens
ttggattgacagtaact

SEQ ID NO: 3738559 - DNA, 15 bp, Homo sapiens
ttggcacagaaacac

SEQ ID NO: 3738560 - DNA, 20 bp, Homo sapiens
ttggcagcctactagggacc

SEQ ID NO: 3738561 - DNA, 15 bp, Homo sapiens
ttggcattaaaactt

SEQ ID NO: 3738562 - DNA, 15 bp, Homo sapiens
ttggccaaagtgtta

SEQ ID NO: 3738563 - DNA, 15 bp, Homo sapiens
ttggcccccgagctg

SEQ ID NO: 3738564 - DNA, 12 bp, Homo sapiens
ttggcctcagaa

SEQ ID NO: 3738565 - DNA, 23 bp, Homo sapiens
ttggcctgtctcatccccagggg

SEQ ID NO: 3738566 - DNA, 16 bp, Homo sapiens
ttggctgggcccagaa

SEQ ID NO: 3738567 - DNA, 17 bp, Homo sapiens
ttggcttactgcagcct

SEQ ID NO: 3738568 - DNA, 16 bp, Homo sapiens
ttggcttctgtttcta

SEQ ID NO: 3738569 - DNA, 18 bp, Homo sapiens
ttggcttctgtttctagt

SEQ ID NO: 3738570 - DNA, 18 bp, Homo sapiens
ttgggaatggatcctgga

SEQ ID NO: 3738571 - DNA, 19 bp, Homo sapiens
ttgggatgtcttattttta

SEQ ID NO: 3738572 - DNA, 14 bp, Homo sapiens
ttgggcaatataac

SEQ ID NO: 3738573 - DNA, 15 bp, Homo sapiens
ttgggctgagactgg

SEQ ID NO: 3738574 - DNA, 21 bp, Homo sapiens
ttggggtagctagaggaacca

SEQ ID NO: 3738575 - DNA, 19 bp, Homo sapiens
ttgggtgtaacaggtctcc

SEQ ID NO: 3738576 - DNA, 20 bp, Homo sapiens
ttggtacatggccagtgtga

SEQ ID NO: 3738577 - DNA, 16 bp, Homo sapiens
ttggtatttatctatt

SEQ ID NO: 3738578 - DNA, 23 bp, Homo sapiens
ttggtatttatctattgtaagat

SEQ ID NO: 3738579 - DNA, 20 bp, Homo sapiens
ttggtcagagtaagctgctt

SEQ ID NO: 3738580 - DNA, 22 bp, Homo sapiens
ttggtcagagtaagctgctttt

SEQ ID NO: 3738581 - DNA, 21 bp, Homo sapiens
ttggtcctaagtccctgcccc

SEQ ID NO: 3738582 - DNA, 21 bp, Homo sapiens
ttggtgcaacccttacccctt

SEQ ID NO: 3738583 - DNA, 16 bp, Homo sapiens
ttggtgcctttcctgt

SEQ ID NO: 3738584 - DNA, 21 bp, Homo sapiens
ttggtggcagattttacaaaa

SEQ ID NO: 3738585 - DNA, 18 bp, Homo sapiens
ttggtggctcacgcctgt

SEQ ID NO: 3738586 - DNA, 13 bp, Homo sapiens
ttggtgttgacat

SEQ ID NO: 3738587 - DNA, 17 bp, Homo sapiens
ttggttcatcagtgtta

SEQ ID NO: 3738588 - DNA, 16 bp, Homo sapiens
ttggttccctttgctc

SEQ ID NO: 3738589 - DNA, 19 bp, Homo sapiens
ttggttctaatagaactca

SEQ ID NO: 3738590 - DNA, 22 bp, Homo sapiens
ttgtaaaaattaaaagttatgg

SEQ ID NO: 3738591 - DNA, 22 bp, Homo sapiens
ttgtaaacaaactgtgtaactg

SEQ ID NO: 3738592 - DNA, 22 bp, Homo sapiens
ttgtaaacattagttctatttc

SEQ ID NO: 3738593 - DNA, 18 bp, Homo sapiens
ttgtaaacgtttcagtaa

SEQ ID NO: 3738594 - DNA, 15 bp, Homo sapiens
ttgtaaactgtacta

SEQ ID NO: 3738595 - DNA, 15 bp, Homo sapiens
ttgtaaataagagat

SEQ ID NO: 3738596 - DNA, 16 bp, Homo sapiens
ttgtaaataagagatt

SEQ ID NO: 3738597 - DNA, 22 bp, Homo sapiens
ttgtaaatacaagttctattta

SEQ ID NO: 3738598 - DNA, 12 bp, Homo sapiens
ttgtaaatattt

SEQ ID NO: 3738599 - DNA, 16 bp, Homo sapiens
ttgtaaatatttatgt

SEQ ID NO: 3738600 - DNA, 16 bp, Homo sapiens
ttgtaacaagaaaaca

SEQ ID NO: 3738601 - DNA, 17 bp, Homo sapiens
ttgtaacaagaaaacat

SEQ ID NO: 3738602 - DNA, 20 bp, Homo sapiens
ttgtaagaaaccaatcaaga

SEQ ID NO: 3738603 - DNA, 17 bp, Homo sapiens
ttgtaagagctatacag

SEQ ID NO: 3738604 - DNA, 14 bp, Homo sapiens
ttgtaagattttga

SEQ ID NO: 3738605 - DNA, 19 bp, Homo sapiens
ttgtaagattttgaaaact

SEQ ID NO: 3738606 - DNA, 14 bp, Homo sapiens
ttgtaatgtcacca

SEQ ID NO: 3738607 - DNA, 13 bp, Homo sapiens
ttgtaattttctt

SEQ ID NO: 3738608 - DNA, 16 bp, Homo sapiens
ttgtaattttcttgat

SEQ ID NO: 3738609 - DNA, 19 bp, Homo sapiens
ttgtaattttcttgatgac

SEQ ID NO: 3738610 - DNA, 23 bp, Homo sapiens
ttgtacaattgaacttaaataaa

SEQ ID NO: 3738611 - DNA, 22 bp, Homo sapiens
ttgtagaagtaggaagtgaaaa

SEQ ID NO: 3738612 - DNA, 16 bp, Homo sapiens
ttgtaggtacttttgg

SEQ ID NO: 3738613 - DNA, 18 bp, Homo sapiens
ttgtaggtacttttggaa

SEQ ID NO: 3738614 - DNA, 18 bp, Homo sapiens
ttgtatattatggaagat

SEQ ID NO: 3738615 - DNA, 19 bp, Homo sapiens
ttgtatcatttgaacaact

SEQ ID NO: 3738616 - DNA, 17 bp, Homo sapiens
ttgtatctagtgcagct

SEQ ID NO: 3738617 - DNA, 13 bp, Homo sapiens
ttgtatctctttt

SEQ ID NO: 3738618 - DNA, 14 bp, Homo sapiens
ttgtatctcttttg

SEQ ID NO: 3738619 - DNA, 16 bp, Homo sapiens
tttgtatgatgtagtt

SEQ ID NO: 3738620 - DNA, 16 bp, Homo sapiens
tttgtatgcactttgt

SEQ ID NO: 3738621 - DNA, 22 bp, Homo sapiens
tttgtatgccaagtgagaagat

SEQ ID NO: 3738622 - DNA, 17 bp, Homo sapiens
tttgtcaaactgtagaa

SEQ ID NO: 3738623 - DNA, 11 bp, Homo sapiens
tttgtcaatga

SEQ ID NO: 3738624 - DNA, 12 bp, Homo sapiens
tttgtcattttg

SEQ ID NO: 3738625 - DNA, 14 bp, Homo sapiens
tttgtcattttgaa

SEQ ID NO: 3738626 - DNA, 12 bp, Homo sapiens
tttgtcccaggt

SEQ ID NO: 3738627 - DNA, 22 bp, Homo sapiens
tttgtcgatatttccatcatta

SEQ ID NO: 3738628 - DNA, 14 bp, Homo sapiens
tttgtggcctcaga

SEQ ID NO: 3738629 - DNA, 16 bp, Homo sapiens
tttgtgtaataaagtg

SEQ ID NO: 3738630 - DNA, 17 bp, Homo sapiens
tttgtgtaataaagtgt

SEQ ID NO: 3738631 - DNA, 15 bp, Homo sapiens
tttgtgtgaaataat

SEQ ID NO: 3738632 - DNA, 17 bp, Homo sapiens
tttgttaaatatttaca

SEQ ID NO: 3738633 - DNA, 18 bp, Homo sapiens
tttgttaaatatttacat

SEQ ID NO: 3738634 - DNA, 16 bp, Homo sapiens
tttgttattcttaaga

SEQ ID NO: 3738635 - DNA, 12 bp, Homo sapiens
tttgttgtaaaa

SEQ ID NO: 3738636 - DNA, 16 bp, Homo sapiens
tttgttgtaaagagtt

SEQ ID NO: 3738637 - DNA, 19 bp, Homo sapiens
tttgttgttctttcagaaa

SEQ ID NO: 3738638 - DNA, 14 bp, Homo sapiens
tttgtttttatgaa

SEQ ID NO: 3738639 - DNA, 15 bp, Homo sapiens
ttttaaaaatcataa

SEQ ID NO: 3738640 - DNA, 16 bp, Homo sapiens
ttttaaaacacttcca

SEQ ID NO: 3738641 - DNA, 16 bp, Homo sapiens
ttttaaaagttattaa

SEQ ID NO: 3738642 - DNA, 17 bp, Homo sapiens
ttttaaaataaggattt

SEQ ID NO: 3738643 - DNA, 20 bp, Homo sapiens
ttttaaaccctattggtaaa

SEQ ID NO: 3738644 - DNA, 18 bp, Homo sapiens
ttttaaagctttccccca

SEQ ID NO: 3738645 - DNA, 17 bp, Homo sapiens
ttttaaataaaagtgat

SEQ ID NO: 3738646 - DNA, 13 bp, Homo sapiens
ttttaaatatatt

SEQ ID NO: 3738647 - DNA, 19 bp, Homo sapiens
ttttaaatcctgttgaaaa

SEQ ID NO: 3738648 - DNA, 19 bp, Homo sapiens
ttttaaattataaggactg

SEQ ID NO: 3738649 - DNA, 23 bp, Homo sapiens
ttttaaattataaggactgcatg

SEQ ID NO: 3738650 - DNA, 19 bp, Homo sapiens
ttttaaattttcttcagtt

SEQ ID NO: 3738651 - DNA, 19 bp, Homo sapiens
ttttaacaataactactgt

SEQ ID NO: 3738652 - DNA, 12 bp, Homo sapiens
ttttaactagaa

SEQ ID NO: 3738653 - DNA, 13 bp, Homo sapiens
ttttaactcaata

SEQ ID NO: 3738654 - DNA, 16 bp, Homo sapiens
ttttaagaggcagggt

SEQ ID NO: 3738655 - DNA, 21 bp, Homo sapiens
ttttaagattccttttcttgt

SEQ ID NO: 3738656 - DNA, 22 bp, Homo sapiens
ttttaagattccttttcttgtt

SEQ ID NO: 3738657 - DNA, 15 bp, Homo sapiens
ttttaagcaaaatat

SEQ ID NO: 3738658 - DNA, 12 bp, Homo sapiens
ttttaagcatta

SEQ ID NO: 3738659 - DNA, 22 bp, Homo sapiens
ttttaagcattactcttgtaag

SEQ ID NO: 3738660 - DNA, 23 bp, Homo sapiens
ttttaagcccatcaattatagaa

SEQ ID NO: 3738661 - DNA, 12 bp, Homo sapiens
ttttaagctgtt

SEQ ID NO: 3738662 - DNA, 17 bp, Homo sapiens
ttttaaggaagaaaaat

SEQ ID NO: 3738663 - DNA, 15 bp, Homo sapiens
ttttaagtatttagg

SEQ ID NO: 3738664 - DNA, 17 bp, Homo sapiens
ttttaagtatttatata

SEQ ID NO: 3738665 - DNA, 19 bp, Homo sapiens
ttttaagtgctttgtaatg

SEQ ID NO: 3738666 - DNA, 14 bp, Homo sapiens
ttttaagttgctga

SEQ ID NO: 3738667 - DNA, 13 bp, Homo sapiens
ttttaatatgtaa

SEQ ID NO: 3738668 - DNA, 11 bp, Homo sapiens
ttttaattatt

SEQ ID NO: 3738669 - DNA, 16 bp, Homo sapiens
ttttaattattattct

SEQ ID NO: 3738670 - DNA, 17 bp, Homo sapiens
ttttaattattattctt

SEQ ID NO: 3738671 - DNA, 21 bp, Homo sapiens
ttttaatttatttatactatt

SEQ ID NO: 3738672 - DNA, 13 bp, Homo sapiens
ttttaatttgata

SEQ ID NO: 3738673 - DNA, 12 bp, Homo sapiens
ttttaattttgt

SEQ ID NO: 3738674 - DNA, 19 bp, Homo sapiens
ttttacaaaaaagaaaaga

SEQ ID NO: 3738675 - DNA, 23 bp, Homo sapiens
ttttacaaattggagcagggaca

SEQ ID NO: 3738676 - DNA, 17 bp, Homo sapiens
ttttacaataaaatctt

SEQ ID NO: 3738677 - DNA, 19 bp, Homo sapiens
ttttacctaccacagtgtc

SEQ ID NO: 3738678 - DNA, 21 bp, Homo sapiens
ttttacctaccacagtgtctg

SEQ ID NO: 3738679 - DNA, 14 bp, Homo sapiens
ttttacttagcaat

SEQ ID NO: 3738680 - DNA, 22 bp, Homo sapiens
ttttacttgcattgaatatatt

SEQ ID NO: 3738681 - DNA, 18 bp, Homo sapiens
ttttagaacagaaaacaa

SEQ ID NO: 3738682 - DNA, 21 bp, Homo sapiens
ttttagcaatttatacaatat

SEQ ID NO: 3738683 - DNA, 22 bp, Homo sapiens
ttttagcatgtgtttggttctg

SEQ ID NO: 3738684 - DNA, 15 bp, Homo sapiens
ttttagtacccacct

SEQ ID NO: 3738685 - DNA, 19 bp, Homo sapiens
ttttataaaaaaaatgaaa

SEQ ID NO: 3738686 - DNA, 22 bp, Homo sapiens
ttttataaaattaaagaaaata

SEQ ID NO: 3738687 - DNA, 16 bp, Homo sapiens
ttttataaattaaata

SEQ ID NO: 3738688 - DNA, 15 bp, Homo sapiens
ttttatacaggggaa

SEQ ID NO: 3738689 - DNA, 22 bp, Homo sapiens
ttttatataataaagtattcca

SEQ ID NO: 3738690 - DNA, 19 bp, Homo sapiens
ttttatcattttcaaaatg

SEQ ID NO: 3738691 - DNA, 13 bp, Homo sapiens
ttttatcttttct

SEQ ID NO: 3738692 - DNA, 19 bp, Homo sapiens
ttttatgccttttatttct

SEQ ID NO: 3738693 - DNA, 12 bp, Homo sapiens
ttttattaaatt

SEQ ID NO: 3738694 - DNA, 14 bp, Homo sapiens
ttttattcaaggta

SEQ ID NO: 3738695 - DNA, 23 bp, Homo sapiens
ttttattcaaggtaaaattctaa

SEQ ID NO: 3738696 - DNA, 12 bp, Homo sapiens
ttttattcttgt

SEQ ID NO: 3738697 - DNA, 19 bp, Homo sapiens
ttttattgagaattttaaa

SEQ ID NO: 3738698 - DNA, 11 bp, Homo sapiens
ttttattgtgt

SEQ ID NO: 3738699 - DNA, 18 bp, Homo sapiens
ttttatttttagacagag

SEQ ID NO: 3738700 - DNA, 16 bp, Homo sapiens
ttttattttttataca

SEQ ID NO: 3738701 - DNA, 17 bp, Homo sapiens
ttttatttttttctacc

SEQ ID NO: 3738702 - DNA, 21 bp, Homo sapiens
ttttcaacgcagccctgcttt

SEQ ID NO: 3738703 - DNA, 22 bp, Homo sapiens
ttttcaacgcagccctgctttg

SEQ ID NO: 3738704 - DNA, 18 bp, Homo sapiens
ttttcaagcatctcctga

SEQ ID NO: 3738705 - DNA, 18 bp, Homo sapiens
ttttcaattcaaaaatgt

SEQ ID NO: 3738706 - DNA, 23 bp, Homo sapiens
ttttcacctgtttttaagctgtt

SEQ ID NO: 3738707 - DNA, 20 bp, Homo sapiens
ttttcactgctggctgcctt

SEQ ID NO: 3738708 - DNA, 17 bp, Homo sapiens
ttttcagaacctcttcc

SEQ ID NO: 3738709 - DNA, 11 bp, Homo sapiens
ttttcagaatc

SEQ ID NO: 3738710 - DNA, 17 bp, Homo sapiens
ttttcagaatctgaatg

SEQ ID NO: 3738711 - DNA, 20 bp, Homo sapiens
ttttcagaatctgaatgtaa

SEQ ID NO: 3738712 - DNA, 11 bp, Homo sapiens
ttttcagaccc

SEQ ID NO: 3738713 - DNA, 15 bp, Homo sapiens
ttttccaccctggaa

SEQ ID NO: 3738714 - DNA, 13 bp, Homo sapiens
ttttccactactg

SEQ ID NO: 3738715 - DNA, 19 bp, Homo sapiens
ttttccaggtttaagctgt

SEQ ID NO: 3738716 - DNA, 11 bp, Homo sapiens
ttttccatgaa

SEQ ID NO: 3738717 - DNA, 16 bp, Homo sapiens
ttttccatgaaaacgt

SEQ ID NO: 3738718 - DNA, 22 bp, Homo sapiens
ttttccctattagagaagagat

SEQ ID NO: 3738719 - DNA, 16 bp, Homo sapiens
ttttcgttaacattga

SEQ ID NO: 3738720 - DNA, 21 bp, Homo sapiens
ttttctacagcaaatttataa

SEQ ID NO: 3738721 - DNA, 13 bp, Homo sapiens
ttttctacagtta

SEQ ID NO: 3738722 - DNA, 22 bp, Homo sapiens
ttttctcttgggctgagactgg

SEQ ID NO: 3738723 - DNA, 15 bp, Homo sapiens
ttttctgaaactaat

SEQ ID NO: 3738724 - DNA, 21 bp, Homo sapiens
ttttctgcatcatctgtagat

SEQ ID NO: 3738725 - DNA, 20 bp, Homo sapiens
ttttctggtagatagaaata

SEQ ID NO: 3738726 - DNA, 22 bp, Homo sapiens
ttttcttcaacatcaatgttca

SEQ ID NO: 3738727 - DNA, 14 bp, Homo sapiens
ttttcttctccctc

SEQ ID NO: 3738728 - DNA, 21 bp, Homo sapiens
ttttcttgccaatgaggtctg

SEQ ID NO: 3738729 - DNA, 22 bp, Homo sapiens
ttttgaagctaattattttaat

SEQ ID NO: 3738730 - DNA, 17 bp, Homo sapiens
ttttgatccaagctggt

SEQ ID NO: 3738731 - DNA, 22 bp, Homo sapiens
ttttgatgtttgtggcctcaga

SEQ ID NO: 3738732 - DNA, 15 bp, Homo sapiens
aaaactgacagagga

SEQ ID NO: 3738733 - DNA, 13 bp, Homo sapiens
aaaactttatttt

SEQ ID NO: 3738734 - DNA, 20 bp, Homo sapiens
aaaactttattttatataat

SEQ ID NO: 3738735 - DNA, 20 bp, Homo sapiens
aaaactttttatattttata

SEQ ID NO: 3738736 - DNA, 15 bp, Homo sapiens
aaaagaggggctggg

SEQ ID NO: 3738737 - DNA, 18 bp, Homo sapiens
aaaagatacatttgtatg

SEQ ID NO: 3738738 - DNA, 13 bp, Homo sapiens
aaaagatcgcagt

SEQ ID NO: 3738739 - DNA, 13 bp, Homo sapiens
aaaagatgcttct

SEQ ID NO: 3738740 - DNA, 15 bp, Homo sapiens
aaaagccatgtttaa

SEQ ID NO: 3738741 - DNA, 15 bp, Homo sapiens
aaaagcttttatgag

SEQ ID NO: 3738742 - DNA, 14 bp, Homo sapiens
aaaaggaagactag

SEQ ID NO: 3738743 - DNA, 19 bp, Homo sapiens
aaaaggacaggcagaaaga

SEQ ID NO: 3738744 - DNA, 21 bp, Homo sapiens
aaaaggacaggcagaaagagt

SEQ ID NO: 3738745 - DNA, 23 bp, Homo sapiens
aaaagtaagtaccactcaggcca

SEQ ID NO: 3738746 - DNA, 14 bp, Homo sapiens
aaaagtatatgtta

SEQ ID NO: 3738747 - DNA, 21 bp, Homo sapiens
aaaagtatcgggggctggggc

SEQ ID NO: 3738748 - DNA, 19 bp, Homo sapiens
aaaagtcagactgctggga

SEQ ID NO: 3738749 - DNA, 20 bp, Homo sapiens
aaaagtctctatttaaattc

SEQ ID NO: 3738750 - DNA, 17 bp, Homo sapiens
aaaagtctgcattacat

SEQ ID NO: 3738751 - DNA, 16 bp, Homo sapiens
aaaagttaaaaaaaat

SEQ ID NO: 3738752 - DNA, 18 bp, Homo sapiens
aaaagttaaaaaaaataa

SEQ ID NO: 3738753 - DNA, 22 bp, Homo sapiens
aaaagttcataacagtgccatt

SEQ ID NO: 3738754 - DNA, 15 bp, Homo sapiens
aaaagtttaaaatgt

SEQ ID NO: 3738755 - DNA, 12 bp, Homo sapiens
aaaataaaatta

SEQ ID NO: 3738756 - DNA, 16 bp, Homo sapiens
aaaataaaattaagaa

SEQ ID NO: 3738757 - DNA, 16 bp, Homo sapiens
aaaataaccccaaaat

SEQ ID NO: 3738758 - DNA, 12 bp, Homo sapiens
aaaataataaat

SEQ ID NO: 3738759 - DNA, 13 bp, Homo sapiens
aaaataataaatt

SEQ ID NO: 3738760 - DNA, 16 bp, Homo sapiens
aaaataataaattgca

SEQ ID NO: 3738761 - DNA, 23 bp, Homo sapiens
aaaataatgtcttgttaatattc

SEQ ID NO: 3738762 - DNA, 12 bp, Homo sapiens
aaaataatttta

SEQ ID NO: 3738763 - DNA, 13 bp, Homo sapiens
aaaatacaaacaa

SEQ ID NO: 3738764 - DNA, 15 bp, Homo sapiens
aaaatacaataaact

SEQ ID NO: 3738765 - DNA, 13 bp, Homo sapiens
aaaatactctaat

SEQ ID NO: 3738766 - DNA, 14 bp, Homo sapiens
aaaatactctaatt

SEQ ID NO: 3738767 - DNA, 17 bp, Homo sapiens
aaaatactctaattcta

SEQ ID NO: 3738768 - DNA, 23 bp, Homo sapiens
aaaatactctaattctaaccaga

SEQ ID NO: 3738769 - DNA, 22 bp, Homo sapiens
aaaatagcaacactctatattt

SEQ ID NO: 3738770 - DNA, 22 bp, Homo sapiens
aaaatataattgttttttatct

SEQ ID NO: 3738771 - DNA, 21 bp, Homo sapiens
aaaatatatatgttgatttct

SEQ ID NO: 3738772 - DNA, 14 bp, Homo sapiens
aaaatatgttcttt

SEQ ID NO: 3738773 - DNA, 11 bp, Homo sapiens
aaaatattatc

SEQ ID NO: 3738774 - DNA, 17 bp, Homo sapiens
aaaatattttataattt

SEQ ID NO: 3738775 - DNA, 18 bp, Homo sapiens
aaaatattttataatttt

SEQ ID NO: 3738776 - DNA, 15 bp, Homo sapiens
aaaatcatgtacatt

SEQ ID NO: 3738777 - DNA, 18 bp, Homo sapiens
aaaatcctaccaacctct

SEQ ID NO: 3738778 - DNA, 12 bp, Homo sapiens
aaaatctgtcca

SEQ ID NO: 3738779 - DNA, 12 bp, Homo sapiens
aaaatgaagatt

SEQ ID NO: 3738780 - DNA, 13 bp, Homo sapiens
aaaatgacaatga

SEQ ID NO: 3738781 - DNA, 13 bp, Homo sapiens
aaaatgacagatg

SEQ ID NO: 3738782 - DNA, 21 bp, Homo sapiens
aaaatgactaaaaatattata

SEQ ID NO: 3738783 - DNA, 23 bp, Homo sapiens
aaaatgagaacatgttggtattt

SEQ ID NO: 3738784 - DNA, 18 bp, Homo sapiens
aaaatgaggttcaactgt

SEQ ID NO: 3738785 - DNA, 18 bp, Homo sapiens
aaaatgcaacaacatgta

SEQ ID NO: 3738786 - DNA, 15 bp, Homo sapiens
aaaatgccaatctct

SEQ ID NO: 3738787 - DNA, 17 bp, Homo sapiens
aaaatgcccttaaatca

SEQ ID NO: 3738788 - DNA, 16 bp, Homo sapiens
aaaatggtaaaattgc

SEQ ID NO: 3738789 - DNA, 17 bp, Homo sapiens
aaaatggtgttttcatg

SEQ ID NO: 3738790 - DNA, 20 bp, Homo sapiens
aaaatggtgttttcatgtaa

SEQ ID NO: 3738791 - DNA, 12 bp, Homo sapiens
aaaatgtacaaa

SEQ ID NO: 3738792 - DNA, 21 bp, Homo sapiens
aaaatgtacaaaataaagtta

SEQ ID NO: 3738793 - DNA, 17 bp, Homo sapiens
aaaatgtataagttgag

SEQ ID NO: 3738794 - DNA, 21 bp, Homo sapiens
aaaatgtataagttgaggcat

SEQ ID NO: 3738795 - DNA, 18 bp, Homo sapiens
aaaatgtctgttaactta

SEQ ID NO: 3738796 - DNA, 13 bp, Homo sapiens
aaaatgtgatttt

SEQ ID NO: 3738797 - DNA, 16 bp, Homo sapiens
aaaatgttcagaaggt

SEQ ID NO: 3738798 - DNA, 17 bp, Homo sapiens
aaaatgttttgtaagaa

SEQ ID NO: 3738799 - DNA, 21 bp, Homo sapiens
aaaatgttttgtaagaaacca

SEQ ID NO: 3738800 - DNA, 11 bp, Homo sapiens
aaaattaaagc

SEQ ID NO: 3738801 - DNA, 14 bp, Homo sapiens
aaaattaacactgc

SEQ ID NO: 3738802 - DNA, 14 bp, Homo sapiens
aaaattaagaatgt

SEQ ID NO: 3738803 - DNA, 20 bp, Homo sapiens
aaaattagaaattggctgga

SEQ ID NO: 3738804 - DNA, 19 bp, Homo sapiens
aaaattaggatttcatgat

SEQ ID NO: 3738805 - DNA, 14 bp, Homo sapiens
aaaattatctattt

SEQ ID NO: 3738806 - DNA, 18 bp, Homo sapiens
aaaattatctatttgtat

SEQ ID NO: 3738807 - DNA, 14 bp, Homo sapiens
aaaattgaatttaa

SEQ ID NO: 3738808 - DNA, 19 bp, Homo sapiens
aaaattgaatttaacaatg

SEQ ID NO: 3738809 - DNA, 20 bp, Homo sapiens
aaaattgaatttaacaatgc

SEQ ID NO: 3738810 - DNA, 21 bp, Homo sapiens
aaaattgaatttaacaatgcg

SEQ ID NO: 3738811 - DNA, 22 bp, Homo sapiens
aaaattggacattaagcatcac

SEQ ID NO: 3738812 - DNA, 23 bp, Homo sapiens
aaaatttaagcattgtttgctta

SEQ ID NO: 3738813 - DNA, 19 bp, Homo sapiens
aaaatttagaaatataatt

SEQ ID NO: 3738814 - DNA, 10 bp, Homo sapiens
aaaatttata

SEQ ID NO: 3738815 - DNA, 13 bp, Homo sapiens
aaaatttatatgt

SEQ ID NO: 3738816 - DNA, 20 bp, Homo sapiens
aaaatttcacattaatattt

SEQ ID NO: 3738817 - DNA, 17 bp, Homo sapiens
aaaatttccagtacctt

SEQ ID NO: 3738818 - DNA, 15 bp, Homo sapiens
aaaatttgaaccaaa

SEQ ID NO: 3738819 - DNA, 20 bp, Homo sapiens
aaaatttgaaccaaaacatt

SEQ ID NO: 3738820 - DNA, 14 bp, Homo sapiens
aaaatttggaattc

SEQ ID NO: 3738821 - DNA, 16 bp, Homo sapiens
aaaattttgcctaata

SEQ ID NO: 3738822 - DNA, 22 bp, Homo sapiens
aaaattttgctccccagtgaag

SEQ ID NO: 3738823 - DNA, 13 bp, Homo sapiens
aaaattttgtaat

SEQ ID NO: 3738824 - DNA, 15 bp, Homo sapiens
aaaattttgtaattt

SEQ ID NO: 3738825 - DNA, 17 bp, Homo sapiens
aaaattttgtaattttc

SEQ ID NO: 3738826 - DNA, 19 bp, Homo sapiens
aaaattttgtaattttctt

SEQ ID NO: 3738827 - DNA, 14 bp, Homo sapiens
aaaatttttggatt

SEQ ID NO: 3738828 - DNA, 17 bp, Homo sapiens
aaacaaaggttgagatg

SEQ ID NO: 3738829 - DNA, 13 bp, Homo sapiens
aaacaaatatgca

SEQ ID NO: 3738830 - DNA, 18 bp, Homo sapiens
aaacaactttctcttgta

SEQ ID NO: 3738831 - DNA, 16 bp, Homo sapiens
aaacaagaaagtttcc

SEQ ID NO: 3738832 - DNA, 14 bp, Homo sapiens
aaacaatattgttt

SEQ ID NO: 3738833 - DNA, 15 bp, Homo sapiens
aaacaatattgtttc

SEQ ID NO: 3738834 - DNA, 16 bp, Homo sapiens
aaacaatatttattgt

SEQ ID NO: 3738835 - DNA, 22 bp, Homo sapiens
aaacaatatttattgtatttta

SEQ ID NO: 3738836 - DNA, 16 bp, Homo sapiens
aaacaatttattttat

SEQ ID NO: 3738837 - DNA, 17 bp, Homo sapiens
aaacaatttattttatt

SEQ ID NO: 3738838 - DNA, 19 bp, Homo sapiens
aaacacaaacgggctcagc

SEQ ID NO: 3738839 - DNA, 16 bp, Homo sapiens
aaacacaccaggctgt

SEQ ID NO: 3738840 - DNA, 16 bp, Homo sapiens
aaacacactgaggcag

SEQ ID NO: 3738841 - DNA, 17 bp, Homo sapiens
aaacacactgaggcagg

SEQ ID NO: 3738842 - DNA, 21 bp, Homo sapiens
aaacacagacattctgccagg

SEQ ID NO: 3738843 - DNA, 14 bp, Homo sapiens
aaacacatagattc

SEQ ID NO: 3738844 - DNA, 15 bp, Homo sapiens
aaacagaaaaaaaac

SEQ ID NO: 3738845 - DNA, 15 bp, Homo sapiens
aaacagagacaggcc

SEQ ID NO: 3738846 - DNA, 23 bp, Homo sapiens
aaacagatttggtgaatttgaat

SEQ ID NO: 3738847 - DNA, 21 bp, Homo sapiens
aaacagcattgctttctgaaa

SEQ ID NO: 3738848 - DNA, 18 bp, Homo sapiens
aaacagcttcatgccttt

SEQ ID NO: 3738849 - DNA, 14 bp, Homo sapiens
aaacaggaaaaaaa

SEQ ID NO: 3738850 - DNA, 18 bp, Homo sapiens
aaacaggaaaaaaacttt

SEQ ID NO: 3738851 - DNA, 11 bp, Homo sapiens
aaacaggacca

SEQ ID NO: 3738852 - DNA, 12 bp, Homo sapiens
aaacaggagaga

SEQ ID NO: 3738853 - DNA, 13 bp, Homo sapiens
aaacataaaaagt

SEQ ID NO: 3738854 - DNA, 13 bp, Homo sapiens
aaacataattctt

SEQ ID NO: 3738855 - DNA, 23 bp, Homo sapiens
aaacatcagttactctgaagggc

SEQ ID NO: 3738856 - DNA, 20 bp, Homo sapiens
aaacatccttcaagaactct

SEQ ID NO: 3738857 - DNA, 17 bp, Homo sapiens
aaacatgttagaagcaa

SEQ ID NO: 3738858 - DNA, 23 bp, Homo sapiens
aaacattgttttgtgtaacatat

SEQ ID NO: 3738859 - DNA, 13 bp, Homo sapiens
aaacattttcaca

SEQ ID NO: 3738860 - DNA, 23 bp, Homo sapiens
aaaccaagtcaagtgaaaaagga

SEQ ID NO: 3738861 - DNA, 16 bp, Homo sapiens
aaaccaatcaagataa

SEQ ID NO: 3738862 - DNA, 15 bp, Homo sapiens
aaaccacagccctgt

SEQ ID NO: 3738863 - DNA, 16 bp, Homo sapiens
aaaccacagccctgtc

SEQ ID NO: 3738864 - DNA, 12 bp, Homo sapiens
aaaccagggagc

SEQ ID NO: 3738865 - DNA, 17 bp, Homo sapiens
aaaccatatgaacatat

SEQ ID NO: 3738866 - DNA, 20 bp, Homo sapiens
aaaccattatgaagaagaga

SEQ ID NO: 3738867 - DNA, 12 bp, Homo sapiens
aaaccattgctt

SEQ ID NO: 3738868 - DNA, 13 bp, Homo sapiens
aaaccattgcttc

SEQ ID NO: 3738869 - DNA, 14 bp, Homo sapiens
aaaccattgcttca

SEQ ID NO: 3738870 - DNA, 16 bp, Homo sapiens
aaaccattgcttcact

SEQ ID NO: 3738871 - DNA, 12 bp, Homo sapiens
aaacccagagag

SEQ ID NO: 3738872 - DNA, 13 bp, Homo sapiens
aaaccccatctct

SEQ ID NO: 3738873 - DNA, 19 bp, Homo sapiens
aaacccgacagagggaaga

SEQ ID NO: 3738874 - DNA, 23 bp, Homo sapiens
aaaccctcgtttctgattaatgc

SEQ ID NO: 3738875 - DNA, 15 bp, Homo sapiens
aaaccgtcctctttt

SEQ ID NO: 3738876 - DNA, 22 bp, Homo sapiens
aaacctcacccgaggctgccca

SEQ ID NO: 3738877 - DNA, 19 bp, Homo sapiens
aaacctgatgttaaaattc

SEQ ID NO: 3738878 - DNA, 15 bp, Homo sapiens
aaacctggatgtcac

SEQ ID NO: 3738879 - DNA, 18 bp, Homo sapiens
aaaccttattgtacctct

SEQ ID NO: 3738880 - DNA, 17 bp, Homo sapiens
aaacctttcaaatttca

SEQ ID NO: 3738881 - DNA, 15 bp, Homo sapiens
aaacgggctcagcaa

SEQ ID NO: 3738882 - DNA, 15 bp, Homo sapiens
aaacggttaaaactg

SEQ ID NO: 3738883 - DNA, 17 bp, Homo sapiens
aaacggttaaaactgtc

SEQ ID NO: 3738884 - DNA, 12 bp, Homo sapiens
aaactaatgagt

SEQ ID NO: 3738885 - DNA, 16 bp, Homo sapiens
aaactacattttaaca

SEQ ID NO: 3738886 - DNA, 21 bp, Homo sapiens
aaactagacttgaggaaacca

SEQ ID NO: 3738887 - DNA, 17 bp, Homo sapiens
aaactaggaaaattgga

SEQ ID NO: 3738888 - DNA, 17 bp, Homo sapiens
aaactaggaaatttttt

SEQ ID NO: 3738889 - DNA, 20 bp, Homo sapiens
aaactattggaaagtactcc

SEQ ID NO: 3738890 - DNA, 11 bp, Homo sapiens
aaactatttat

SEQ ID NO: 3738891 - DNA, 16 bp, Homo sapiens
aaactcaccatgtaaa

SEQ ID NO: 3738892 - DNA, 15 bp, Homo sapiens
aaactcatttcctat

SEQ ID NO: 3738893 - DNA, 12 bp, Homo sapiens
aaactcttaaaa

SEQ ID NO: 3738894 - DNA, 21 bp, Homo sapiens
aaactgagactcagacaggaa

SEQ ID NO: 3738895 - DNA, 19 bp, Homo sapiens
aaactgaggaattttcttt

SEQ ID NO: 3738896 - DNA, 12 bp, Homo sapiens
aaactgcaatag

SEQ ID NO: 3738897 - DNA, 16 bp, Homo sapiens
aaactgcaatagagac

SEQ ID NO: 3738898 - DNA, 21 bp, Homo sapiens
aaactgcaatagagactgtag

SEQ ID NO: 3738899 - DNA, 17 bp, Homo sapiens
aaactgcattagaaatt

SEQ ID NO: 3738900 - DNA, 19 bp, Homo sapiens
aaactgctctaagcacacg

SEQ ID NO: 3738901 - DNA, 22 bp, Homo sapiens
aaactggtttgttgcagccaaa

SEQ ID NO: 3738902 - DNA, 16 bp, Homo sapiens
aaactgtagaaatgat

SEQ ID NO: 3738903 - DNA, 18 bp, Homo sapiens
aaactgtagaaatgatga

SEQ ID NO: 3738904 - DNA, 16 bp, Homo sapiens
aaactgtagtctcagg

SEQ ID NO: 3738905 - DNA, 18 bp, Homo sapiens
aaactgtcctctttcaga

SEQ ID NO: 3738906 - DNA, 21 bp, Homo sapiens
aaactgtcctctttcagaaaa

SEQ ID NO: 3738907 - DNA, 20 bp, Homo sapiens
aaacttaaccgcatcagaag

SEQ ID NO: 3738908 - DNA, 16 bp, Homo sapiens
aaacttatcttacaaa

SEQ ID NO: 3738909 - DNA, 22 bp, Homo sapiens
aaacttccagtgcaacactgaa

SEQ ID NO: 3738910 - DNA, 23 bp, Homo sapiens
aaacttccagtgcaacactgaag

SEQ ID NO: 3738911 - DNA, 13 bp, Homo sapiens
aaacttttataaa

SEQ ID NO: 3738912 - DNA, 18 bp, Homo sapiens
aaagaaaaaataattgat

SEQ ID NO: 3738913 - DNA, 14 bp, Homo sapiens
aaagaaagaaggaa

SEQ ID NO: 3738914 - DNA, 17 bp, Homo sapiens
aaagaaagcctcagaga

SEQ ID NO: 3738915 - DNA, 18 bp, Homo sapiens
aaagaaagcctcagagaa

SEQ ID NO: 3738916 - DNA, 13 bp, Homo sapiens
aaagaaatcatgt

SEQ ID NO: 3738917 - DNA, 18 bp, Homo sapiens
aaagaagtggggacagag

SEQ ID NO: 3738918 - DNA, 19 bp, Homo sapiens
aaagaagtgtccgagaact

SEQ ID NO: 3738919 - DNA, 15 bp, Homo sapiens
aaagaatacagaaag

SEQ ID NO: 3738920 - DNA, 17 bp, Homo sapiens
aaagaatacagaaagat

SEQ ID NO: 3738921 - DNA, 21 bp, Homo sapiens
aaagaatccctgttcattgta

SEQ ID NO: 3738922 - DNA, 17 bp, Homo sapiens
aaagaatggaaggtgga

SEQ ID NO: 3738923 - DNA, 18 bp, Homo sapiens
aaagaattcctacaatat

SEQ ID NO: 3738924 - DNA, 18 bp, Homo sapiens
aaagacacagaacacaga

SEQ ID NO: 3738925 - DNA, 13 bp, Homo sapiens
aaagacacctact

SEQ ID NO: 3738926 - DNA, 15 bp, Homo sapiens
aaagactgtacaaag

SEQ ID NO: 3738927 - DNA, 18 bp, Homo sapiens
aaagagaaaaaaagtttg

SEQ ID NO: 3738928 - DNA, 22 bp, Homo sapiens
aaagagaaaattgaatttaaca

SEQ ID NO: 3738929 - DNA, 13 bp, Homo sapiens
aaagagagaatgt

SEQ ID NO: 3738930 - DNA, 18 bp, Homo sapiens
aaagagagaatgtagata

SEQ ID NO: 3738931 - DNA, 13 bp, Homo sapiens
aaagagagcactg

SEQ ID NO: 3738932 - DNA, 14 bp, Homo sapiens
aaagagatacagag

SEQ ID NO: 3738933 - DNA, 21 bp, Homo sapiens
aaagagataccaagatgccat

SEQ ID NO: 3738934 - DNA, 11 bp, Homo sapiens
aaagagctgcc

SEQ ID NO: 3738935 - DNA, 13 bp, Homo sapiens
aaagagctgccta

SEQ ID NO: 3738936 - DNA, 22 bp, Homo sapiens
aaagagctttcttcccgaaccc

SEQ ID NO: 3738937 - DNA, 16 bp, Homo sapiens
aaagaggctgaaagag

SEQ ID NO: 3738938 - DNA, 18 bp, Homo sapiens
aaagagtttgagacctga

SEQ ID NO: 3738939 - DNA, 19 bp, Homo sapiens
aaagagtttgagacctgaa

SEQ ID NO: 3738940 - DNA, 20 bp, Homo sapiens
aaagataacaagatctttca

SEQ ID NO: 3738941 - DNA, 22 bp, Homo sapiens
aaagataacaagatctttcagg

SEQ ID NO: 3738942 - DNA, 19 bp, Homo sapiens
aaagataatctctcagctt

SEQ ID NO: 3738943 - DNA, 19 bp, Homo sapiens
aaagatacatttgtatgtt

SEQ ID NO: 3738944 - DNA, 12 bp, Homo sapiens
aaagatattatt

SEQ ID NO: 3738945 - DNA, 22 bp, Homo sapiens
aaagatgccgggttttatattt

SEQ ID NO: 3738946 - DNA, 24 bp, Homo sapiens
aaagatgctcaggtacagagaagg

SEQ ID NO: 3738947 - DNA, 19 bp, Homo sapiens
aaagatgcttctcactgcc

SEQ ID NO: 3738948 - DNA, 16 bp, Homo sapiens
aaagatggatgtgctt

SEQ ID NO: 3738949 - DNA, 21 bp, Homo sapiens
aaagatggctgtgcctctgcc

SEQ ID NO: 3738950 - DNA, 23 bp, Homo sapiens
aaagatggctgtgcctctgcctg

SEQ ID NO: 3738951 - DNA, 23 bp, Homo sapiens
aaagcaaacttaagaaacactga

SEQ ID NO: 3738952 - DNA, 12 bp, Homo sapiens
aaagcacctgcc

SEQ ID NO: 3738953 - DNA, 22 bp, Homo sapiens
aaagcactcctccctgatgtac

SEQ ID NO: 3738954 - DNA, 18 bp, Homo sapiens
aaagcagctcaaaggcac

SEQ ID NO: 3738955 - DNA, 22 bp, Homo sapiens
aaagcagtagaaataatatgca

SEQ ID NO: 3738956 - DNA, 18 bp, Homo sapiens
aaagcagtcacttttcct

SEQ ID NO: 3738957 - DNA, 16 bp, Homo sapiens
aaagcatttactttga

SEQ ID NO: 3738958 - DNA, 16 bp, Homo sapiens
aaagccaaaggtctag

SEQ ID NO: 3738959 - DNA, 19 bp, Homo sapiens
aaagccaaaggtctagaaa

SEQ ID NO: 3738960 - DNA, 18 bp, Homo sapiens
aaagccacgttccttact

SEQ ID NO: 3738961 - DNA, 13 bp, Homo sapiens
aaagccatgttta

SEQ ID NO: 3738962 - DNA, 14 bp, Homo sapiens
aaagccatgtttaa

SEQ ID NO: 3738963 - DNA, 16 bp, Homo sapiens
aaagccatgtttaaga

SEQ ID NO: 3738964 - DNA, 17 bp, Homo sapiens
aaagccatgtttaagat

SEQ ID NO: 3738965 - DNA, 18 bp, Homo sapiens
aaagccatgtttaagatt

SEQ ID NO: 3738966 - DNA, 19 bp, Homo sapiens
aaagccatgtttaagattt

SEQ ID NO: 3738967 - DNA, 19 bp, Homo sapiens
aaagcccttaggaagaatt

SEQ ID NO: 3738968 - DNA, 23 bp, Homo sapiens
aaagcccttccatgtcgcctctg

SEQ ID NO: 3738969 - DNA, 16 bp, Homo sapiens
aaagcctcctccagcc

SEQ ID NO: 3738970 - DNA, 16 bp, Homo sapiens
aaagcggggggagggt

SEQ ID NO: 3738971 - DNA, 18 bp, Homo sapiens
aaagcggggggagggttg

SEQ ID NO: 3738972 - DNA, 18 bp, Homo sapiens
aaagctaaagtatctgta

SEQ ID NO: 3738973 - DNA, 16 bp, Homo sapiens
aaagctgctaaatctc

SEQ ID NO: 3738974 - DNA, 17 bp, Homo sapiens
aaagctgctaaatctcc

SEQ ID NO: 3738975 - DNA, 18 bp, Homo sapiens
aaagctgctaaatctcct

SEQ ID NO: 3738976 - DNA, 22 bp, Homo sapiens
aaagctgctaaatctcctattt

SEQ ID NO: 3738977 - DNA, 23 bp, Homo sapiens
aaagctgtggccagcttgttatt

SEQ ID NO: 3738978 - DNA, 21 bp, Homo sapiens
aaagctttgcttatggtaata

SEQ ID NO: 3738979 - DNA, 23 bp, Homo sapiens
aaagcttttatgagctcatgtag

SEQ ID NO: 3738980 - DNA, 15 bp, Homo sapiens
aaaggaaaaagtatc

SEQ ID NO: 3738981 - DNA, 13 bp, Homo sapiens
aaaggaagctttc

SEQ ID NO: 3738982 - DNA, 19 bp, Homo sapiens
aaaggagagaagagagaaa

SEQ ID NO: 3738983 - DNA, 21 bp, Homo sapiens
aaaggagagctagcagcaggg

SEQ ID NO: 3738984 - DNA, 19 bp, Homo sapiens
aaaggataaacttttagaa

SEQ ID NO: 3738985 - DNA, 13 bp, Homo sapiens
aaaggatatttaa

SEQ ID NO: 3738986 - DNA, 12 bp, Homo sapiens
aaaggatatttt

SEQ ID NO: 3738987 - DNA, 20 bp, Homo sapiens
aaaggatgtaaacagtgcct

SEQ ID NO: 3738988 - DNA, 14 bp, Homo sapiens
aaaggatttctaga

SEQ ID NO: 3738989 - DNA, 21 bp, Homo sapiens
aaaggcacctataaaacaggt

SEQ ID NO: 3738990 - DNA, 19 bp, Homo sapiens
aaaggcagtggggctgggg

SEQ ID NO: 3738991 - DNA, 11 bp, Homo sapiens
aaaggcctctt

SEQ ID NO: 3738992 - DNA, 20 bp, Homo sapiens
aaagggaacaggaaaagaaa

SEQ ID NO: 3738993 - DNA, 23 bp, Homo sapiens
aaagggagcactgggttgacttt

SEQ ID NO: 3738994 - DNA, 20 bp, Homo sapiens
aaagggcagggcatctcctg

SEQ ID NO: 3738995 - DNA, 14 bp, Homo sapiens
aaagggtgaagcta

SEQ ID NO: 3738996 - DNA, 18 bp, Homo sapiens
aaagggtgctgcttccct

SEQ ID NO: 3738997 - DNA, 21 bp, Homo sapiens
aaaggtgcctgtgaggcaggg

SEQ ID NO: 3738998 - DNA, 19 bp, Homo sapiens
aaaggtggtatgtgtgtgt

SEQ ID NO: 3738999 - DNA, 18 bp, Homo sapiens
aaaggtggtgaggcaata

SEQ ID NO: 3739000 - DNA, 21 bp, Homo sapiens
aaagtacttctccaccctgct

SEQ ID NO: 3739001 - DNA, 20 bp, Homo sapiens
aaagtagaagtcttagatgt

SEQ ID NO: 3739002 - DNA, 13 bp, Homo sapiens
aaagtatatatag

SEQ ID NO: 3739003 - DNA, 14 bp, Homo sapiens
aaagtatcatggaa

SEQ ID NO: 3739004 - DNA, 16 bp, Homo sapiens
aaagtattccacctta

SEQ ID NO: 3739005 - DNA, 18 bp, Homo sapiens
aaagtattccaccttaaa

SEQ ID NO: 3739006 - DNA, 21 bp, Homo sapiens
aaagtattccaccttaaatta

SEQ ID NO: 3739007 - DNA, 18 bp, Homo sapiens
aaagtcaaaaggtgcctg

SEQ ID NO: 3739008 - DNA, 12 bp, Homo sapiens
aaagtctctatt

SEQ ID NO: 3739009 - DNA, 13 bp, Homo sapiens
aaagtctctattt

SEQ ID NO: 3739010 - DNA, 15 bp, Homo sapiens
aaagtctctatttaa

SEQ ID NO: 3739011 - DNA, 17 bp, Homo sapiens
aaagtgaatttgaatga

SEQ ID NO: 3739012 - DNA, 20 bp, Homo sapiens
aaagtgaatttgaatgaaaa

SEQ ID NO: 3739013 - DNA, 17 bp, Homo sapiens
aaagtggcaagaccaaa

SEQ ID NO: 3739014 - DNA, 17 bp, Homo sapiens
aaagtggccatgccacc

SEQ ID NO: 3739015 - DNA, 20 bp, Homo sapiens
aaagtgtaaatcctttttct

SEQ ID NO: 3739016 - DNA, 20 bp, Homo sapiens
aaagtgtattttataaaatt

SEQ ID NO: 3739017 - DNA, 21 bp, Homo sapiens
aaagtgtattttataaaatta

SEQ ID NO: 3739018 - DNA, 18 bp, Homo sapiens
aaagtgtgagcaaactaa

SEQ ID NO: 3739019 - DNA, 11 bp, Homo sapiens
aaagtgttttc

SEQ ID NO: 3739020 - DNA, 16 bp, Homo sapiens
aaagttaaacattgaa

SEQ ID NO: 3739021 - DNA, 17 bp, Homo sapiens
aaagttacaaattgctt

SEQ ID NO: 3739022 - DNA, 20 bp, Homo sapiens
aaagttactttgtcagaggc

SEQ ID NO: 3739023 - DNA, 22 bp, Homo sapiens
aaagttcataacagtgccattg

SEQ ID NO: 3739024 - DNA, 22 bp, Homo sapiens
aaagttcatagggtctcttcag

SEQ ID NO: 3739025 - DNA, 21 bp, Homo sapiens
aaagttccctacttcctgtga

SEQ ID NO: 3739026 - DNA, 13 bp, Homo sapiens
aaagttctgtgta

SEQ ID NO: 3739027 - DNA, 18 bp, Homo sapiens
aaagttctgtgtatttaa

SEQ ID NO: 3739028 - DNA, 20 bp, Homo sapiens
aaagttctgtgtatttaatt

SEQ ID NO: 3739029 - DNA, 16 bp, Homo sapiens
aaagttggtgacagat

SEQ ID NO: 3739030 - DNA, 13 bp, Homo sapiens
aaagtttaaaatg

SEQ ID NO: 3739031 - DNA, 14 bp, Homo sapiens
aaagtttaaaatgt

SEQ ID NO: 3739032 - DNA, 21 bp, Homo sapiens
aaagtttctcttttcaaaaca

SEQ ID NO: 3739033 - DNA, 15 bp, Homo sapiens
aaagtttgccagaag

SEQ ID NO: 3739034 - DNA, 22 bp, Homo sapiens
aaataaaacattttcacacaat

SEQ ID NO: 3739035 - DNA, 17 bp, Homo sapiens
aaataaaacctttcaaa

SEQ ID NO: 3739036 - DNA, 12 bp, Homo sapiens
aaataaaatata

SEQ ID NO: 3739037 - DNA, 15 bp, Homo sapiens
aaataaaatataatt

SEQ ID NO: 3739038 - DNA, 15 bp, Homo sapiens
aaataaaattaagaa

SEQ ID NO: 3739039 - DNA, 13 bp, Homo sapiens
aaataaaattatg

SEQ ID NO: 3739040 - DNA, 13 bp, Homo sapiens
aaataaagtatat

SEQ ID NO: 3739041 - DNA, 15 bp, Homo sapiens
aaataaagtatatat

SEQ ID NO: 3739042 - DNA, 15 bp, Homo sapiens
aaataaagttacatt

SEQ ID NO: 3739043 - DNA, 15 bp, Homo sapiens
aaataaatgtatcat

SEQ ID NO: 3739044 - DNA, 11 bp, Homo sapiens
aaataaattat

SEQ ID NO: 3739045 - DNA, 23 bp, Homo sapiens
aaataacacagagagacagactt

SEQ ID NO: 3739046 - DNA, 18 bp, Homo sapiens
aaataaccccattctttg

SEQ ID NO: 3739047 - DNA, 12 bp, Homo sapiens
aaataagagatt

SEQ ID NO: 3739048 - DNA, 17 bp, Homo sapiens
aaataataaagatgctc

SEQ ID NO: 3739049 - DNA, 12 bp, Homo sapiens
aaataataaatt

SEQ ID NO: 3739050 - DNA, 12 bp, Homo sapiens
aaataattttaa

SEQ ID NO: 3739051 - DNA, 14 bp, Homo sapiens
aaataattttatga

SEQ ID NO: 3739052 - DNA, 22 bp, Homo sapiens
aaataattttatgaactgcatg

SEQ ID NO: 3739053 - DNA, 19 bp, Homo sapiens
aaatacaacttaaataata

SEQ ID NO: 3739054 - DNA, 22 bp, Homo sapiens
aaatacaataaactattggaaa

SEQ ID NO: 3739055 - DNA, 18 bp, Homo sapiens
aaatacacatagcatgta

SEQ ID NO: 3739056 - DNA, 21 bp, Homo sapiens
aaataccaaaattatttcaga

SEQ ID NO: 3739057 - DNA, 21 bp, Homo sapiens
aaatacgccagaactgcttta

SEQ ID NO: 3739058 - DNA, 14 bp, Homo sapiens
aaatactctaattc

SEQ ID NO: 3739059 - DNA, 14 bp, Homo sapiens
aaatacttattcat

SEQ ID NO: 3739060 - DNA, 15 bp, Homo sapiens
aaatacttattcatt

SEQ ID NO: 3739061 - DNA, 16 bp, Homo sapiens
aaatagaaccactatg

SEQ ID NO: 3739062 - DNA, 15 bp, Homo sapiens
aaatagacagtatat

SEQ ID NO: 3739063 - DNA, 19 bp, Homo sapiens
aaatagctatatccatgta

SEQ ID NO: 3739064 - DNA, 16 bp, Homo sapiens
aaataggaaagacttt

SEQ ID NO: 3739065 - DNA, 21 bp, Homo sapiens
aaatagtggttcttggaaaaa

SEQ ID NO: 3739066 - DNA, 18 bp, Homo sapiens
aaatataaagcatctaaa

SEQ ID NO: 3739067 - DNA, 20 bp, Homo sapiens
aaatataaagcatctaaact

SEQ ID NO: 3739068 - DNA, 16 bp, Homo sapiens
aaatatagaattttta

SEQ ID NO: 3739069 - DNA, 14 bp, Homo sapiens
aaatatatgtatgt

SEQ ID NO: 3739070 - DNA, 16 bp, Homo sapiens
aaatatatgtatgtaa

SEQ ID NO: 3739071 - DNA, 12 bp, Homo sapiens
aaatatatttaa

SEQ ID NO: 3739072 - DNA, 20 bp, Homo sapiens
aaatatatttaagataatta

SEQ ID NO: 3739073 - DNA, 22 bp, Homo sapiens
aaatatatttaagataattata

SEQ ID NO: 3739074 - DNA, 20 bp, Homo sapiens
aaatatcaatcattttcctt

SEQ ID NO: 3739075 - DNA, 20 bp, Homo sapiens
aaatatcagttactcagccc

SEQ ID NO: 3739076 - DNA, 16 bp, Homo sapiens
aaatatcattcagcaa

SEQ ID NO: 3739077 - DNA, 14 bp, Homo sapiens
aaatatctgaaaat

SEQ ID NO: 3739078 - DNA, 21 bp, Homo sapiens
aaatttttggattgacagtaa

SEQ ID NO: 3739079 - DNA, 19 bp, Homo sapiens
aacaaattaggttttgtac

SEQ ID NO: 3739080 - DNA, 20 bp, Homo sapiens
aacaaattaggttttgtaca

SEQ ID NO: 3739081 - DNA, 21 bp, Homo sapiens
aacaaattaggttttgtacaa

SEQ ID NO: 3739082 - DNA, 13 bp, Homo sapiens
aacaacaaaaaat

SEQ ID NO: 3739083 - DNA, 19 bp, Homo sapiens
aacaaccccccatcacaaa

SEQ ID NO: 3739084 - DNA, 18 bp, Homo sapiens
aacaacctcggctcctgg

SEQ ID NO: 3739085 - DNA, 16 bp, Homo sapiens
aacaactaggcttcag

SEQ ID NO: 3739086 - DNA, 16 bp, Homo sapiens
aacaacttctttgtaa

SEQ ID NO: 3739087 - DNA, 17 bp, Homo sapiens
aacaagaaaggagagtc

SEQ ID NO: 3739088 - DNA, 21 bp, Homo sapiens
aacaagaagccacagacctag

SEQ ID NO: 3739089 - DNA, 17 bp, Homo sapiens
aacaagatctttcagga

SEQ ID NO: 3739090 - DNA, 14 bp, Homo sapiens
aacaagtgaacaca

SEQ ID NO: 3739091 - DNA, 15 bp, Homo sapiens
aacaataaatgtgca

SEQ ID NO: 3739092 - DNA, 15 bp, Homo sapiens
aacaataactactgt

SEQ ID NO: 3739093 - DNA, 19 bp, Homo sapiens
aacaataactactgtgttc

SEQ ID NO: 3739094 - DNA, 21 bp, Homo sapiens
aacaataactactgtgttcct

SEQ ID NO: 3739095 - DNA, 20 bp, Homo sapiens
aacaataagagcgtttgccc

SEQ ID NO: 3739096 - DNA, 16 bp, Homo sapiens
aacaatattgtttcta

SEQ ID NO: 3739097 - DNA, 15 bp, Homo sapiens
aacaatatttattgt

SEQ ID NO: 3739098 - DNA, 19 bp, Homo sapiens
aacacaaagcggggggagg

SEQ ID NO: 3739099 - DNA, 15 bp, Homo sapiens
aacacacataaagga

SEQ ID NO: 3739100 - DNA, 20 bp, Homo sapiens
aacacactgaggcagggaag

SEQ ID NO: 3739101 - DNA, 16 bp, Homo sapiens
aacacagcatgtgtat

SEQ ID NO: 3739102 - DNA, 19 bp, Homo sapiens
aacacagcgagactccgtc

SEQ ID NO: 3739103 - DNA, 22 bp, Homo sapiens
aacacaggcaaaatccttgctt

SEQ ID NO: 3739104 - DNA, 21 bp, Homo sapiens
aacacatacaggaaggtagaa

SEQ ID NO: 3739105 - DNA, 17 bp, Homo sapiens
aacacatagattcacct

SEQ ID NO: 3739106 - DNA, 20 bp, Homo sapiens
aacacatagattcacctgta

SEQ ID NO: 3739107 - DNA, 22 bp, Homo sapiens
aacacatcagctagcaaaagaa

SEQ ID NO: 3739108 - DNA, 18 bp, Homo sapiens
aacacatttgattctgtg

SEQ ID NO: 3739109 - DNA, 22 bp, Homo sapiens
aacaccaagacttgaaggtgcc

SEQ ID NO: 3739110 - DNA, 18 bp, Homo sapiens
aacaccctcgaagcgcgc

SEQ ID NO: 3739111 - DNA, 13 bp, Homo sapiens
aacacctcccagg

SEQ ID NO: 3739112 - DNA, 23 bp, Homo sapiens
aacacctcccaggagacagttca

SEQ ID NO: 3739113 - DNA, 19 bp, Homo sapiens
aacacctctgcacaagctg

SEQ ID NO: 3739114 - DNA, 18 bp, Homo sapiens
aacactatatggcagtgt

SEQ ID NO: 3739115 - DNA, 20 bp, Homo sapiens
aacactatatggcagtgtct

SEQ ID NO: 3739116 - DNA, 21 bp, Homo sapiens
aacactatatggcagtgtctt

SEQ ID NO: 3739117 - DNA, 16 bp, Homo sapiens
aacactattttcagaa

SEQ ID NO: 3739118 - DNA, 17 bp, Homo sapiens
aacactattttcagaat

SEQ ID NO: 3739119 - DNA, 13 bp, Homo sapiens
aacactctatatt

SEQ ID NO: 3739120 - DNA, 16 bp, Homo sapiens
aacactgtcttgaaga

SEQ ID NO: 3739121 - DNA, 15 bp, Homo sapiens
aacacttattgcttt

SEQ ID NO: 3739122 - DNA, 12 bp, Homo sapiens
aacacttgtaat

SEQ ID NO: 3739123 - DNA, 11 bp, Homo sapiens
aacagaaaaca

SEQ ID NO: 3739124 - DNA, 13 bp, Homo sapiens
aacagaaaacaac

SEQ ID NO: 3739125 - DNA, 18 bp, Homo sapiens
aacagaaaacaacaaaaa

SEQ ID NO: 3739126 - DNA, 20 bp, Homo sapiens
aacagaaaacaacaaaaaat

SEQ ID NO: 3739127 - DNA, 16 bp, Homo sapiens
aacagaaacaaaaaca

SEQ ID NO: 3739128 - DNA, 13 bp, Homo sapiens
aacagaaggatga

SEQ ID NO: 3739129 - DNA, 16 bp, Homo sapiens
aacagacaacagaagt

SEQ ID NO: 3739130 - DNA, 17 bp, Homo sapiens
aacagacaagtgactgt

SEQ ID NO: 3739131 - DNA, 14 bp, Homo sapiens
aacagacaggagaa

SEQ ID NO: 3739132 - DNA, 13 bp, Homo sapiens
aacagactcaggt

SEQ ID NO: 3739133 - DNA, 18 bp, Homo sapiens
aacagactggcctgagga

SEQ ID NO: 3739134 - DNA, 13 bp, Homo sapiens
aacagagatgtga

SEQ ID NO: 3739135 - DNA, 23 bp, Homo sapiens
aacagatactggaagttttgcat

SEQ ID NO: 3739136 - DNA, 18 bp, Homo sapiens
aacagatctccaaagctt

SEQ ID NO: 3739137 - DNA, 20 bp, Homo sapiens
aacagatctccaaagctttc

SEQ ID NO: 3739138 - DNA, 21 bp, Homo sapiens
aacagcagaggttcttttaaa

SEQ ID NO: 3739139 - DNA, 21 bp, Homo sapiens
aacagcagggtagtctggttt

SEQ ID NO: 3739140 - DNA, 23 bp, Homo sapiens
aacagcattcttgtcacaataaa

SEQ ID NO: 3739141 - DNA, 13 bp, Homo sapiens
aacagcgctgggt

SEQ ID NO: 3739142 - DNA, 16 bp, Homo sapiens
aacagctaatgggaca

SEQ ID NO: 3739143 - DNA, 22 bp, Homo sapiens
aacagctatgggagccccaggg

SEQ ID NO: 3739144 - DNA, 18 bp, Homo sapiens
aacagctcaagtcttccc

SEQ ID NO: 3739145 - DNA, 20 bp, Homo sapiens
aacagctgaggtctcttgag

SEQ ID NO: 3739146 - DNA, 22 bp, Homo sapiens
aacagcttcatgcctttgtaag

SEQ ID NO: 3739147 - DNA, 16 bp, Homo sapiens
aacaggaaaaaaactt

SEQ ID NO: 3739148 - DNA, 17 bp, Homo sapiens
aacaggaaaaaaacttt

SEQ ID NO: 3739149 - DNA, 22 bp, Homo sapiens
aacaggaaaaaaacttttataa

SEQ ID NO: 3739150 - DNA, 19 bp, Homo sapiens
aacaggagctgggatccta

SEQ ID NO: 3739151 - DNA, 21 bp, Homo sapiens
aacaggctcaatattcctgaa

SEQ ID NO: 3739152 - DNA, 13 bp, Homo sapiens
aacaggctgggct

SEQ ID NO: 3739153 - DNA, 13 bp, Homo sapiens
aacaggggctggt

SEQ ID NO: 3739154 - DNA, 15 bp, Homo sapiens
aacaggggctggtgg

SEQ ID NO: 3739155 - DNA, 15 bp, Homo sapiens
aacagggtaaattat

SEQ ID NO: 3739156 - DNA, 16 bp, Homo sapiens
aacagggtaaattatt

SEQ ID NO: 3739157 - DNA, 12 bp, Homo sapiens
aacagtagcata

SEQ ID NO: 3739158 - DNA, 17 bp, Homo sapiens
aacagtcaaaacagaga

SEQ ID NO: 3739159 - DNA, 20 bp, Homo sapiens
aacagttaactttcagaaga

SEQ ID NO: 3739160 - DNA, 13 bp, Homo sapiens
aacagttttccat

SEQ ID NO: 3739161 - DNA, 16 bp, Homo sapiens
aacagttttccatgaa

SEQ ID NO: 3739162 - DNA, 17 bp, Homo sapiens
aacataaattgtactgt

SEQ ID NO: 3739163 - DNA, 21 bp, Homo sapiens
aacatagtgagacccctgtct

SEQ ID NO: 3739164 - DNA, 14 bp, Homo sapiens
aacatataatatat

SEQ ID NO: 3739165 - DNA, 13 bp, Homo sapiens
aacatcacacaca

SEQ ID NO: 3739166 - DNA, 17 bp, Homo sapiens
aacatcactgaaatgct

SEQ ID NO: 3739167 - DNA, 21 bp, Homo sapiens
aacatcagttactctgaaggg

SEQ ID NO: 3739168 - DNA, 15 bp, Homo sapiens
aacatccaataggaa

SEQ ID NO: 3739169 - DNA, 22 bp, Homo sapiens
aacatgcaattttgcatttgaa

SEQ ID NO: 3739170 - DNA, 22 bp, Homo sapiens
aacatggtaaacgctgtcccta

SEQ ID NO: 3739171 - DNA, 17 bp, Homo sapiens
aacatgtataatatttt

SEQ ID NO: 3739172 - DNA, 14 bp, Homo sapiens
aacatgttggtatt

SEQ ID NO: 3739173 - DNA, 16 bp, Homo sapiens
aacatgttggtattta

SEQ ID NO: 3739174 - DNA, 21 bp, Homo sapiens
aacatgttggtatttatctat

SEQ ID NO: 3739175 - DNA, 21 bp, Homo sapiens
aacattaaaacaatattgttt

SEQ ID NO: 3739176 - DNA, 21 bp, Homo sapiens
aacattactctgaaattgtaa

SEQ ID NO: 3739177 - DNA, 15 bp, Homo sapiens
aacattatattgcaa

SEQ ID NO: 3739178 - DNA, 19 bp, Homo sapiens
aacattccgtttacatttt

SEQ ID NO: 3739179 - DNA, 18 bp, Homo sapiens
aacattgaccaagaactg

SEQ ID NO: 3739180 - DNA, 20 bp, Homo sapiens
aacattgaccaagaactgca

SEQ ID NO: 3739181 - DNA, 18 bp, Homo sapiens
aacattgggaaatcttat

SEQ ID NO: 3739182 - DNA, 22 bp, Homo sapiens
aacatttctaactctgatgtaa

SEQ ID NO: 3739183 - DNA, 13 bp, Homo sapiens
aacattttcacac

SEQ ID NO: 3739184 - DNA, 22 bp, Homo sapiens
aacattttgtggtcattaagca

SEQ ID NO: 3739185 - DNA, 16 bp, Homo sapiens
aaccaaatattccaga

SEQ ID NO: 3739186 - DNA, 12 bp, Homo sapiens
aaccaaatgcat

SEQ ID NO: 3739187 - DNA, 19 bp, Homo sapiens
aaccaacccttccctgaaa

SEQ ID NO: 3739188 - DNA, 16 bp, Homo sapiens
aaccaagccgtggctt

SEQ ID NO: 3739189 - DNA, 15 bp, Homo sapiens
aaccaagtcaagtga

SEQ ID NO: 3739190 - DNA, 19 bp, Homo sapiens
aaccaatcaagataaagga

SEQ ID NO: 3739191 - DNA, 13 bp, Homo sapiens
aaccacagccctg

SEQ ID NO: 3739192 - DNA, 18 bp, Homo sapiens
aaatatctgaaaatgtat

SEQ ID NO: 3739193 - DNA, 22 bp, Homo sapiens
aaatatctgaaaatgtatgtgt

SEQ ID NO: 3739194 - DNA, 19 bp, Homo sapiens
aaatatgttgatgaaaaat

SEQ ID NO: 3739195 - DNA, 20 bp, Homo sapiens
aaatattataacttaaaaaa

SEQ ID NO: 3739196 - DNA, 15 bp, Homo sapiens
aaatattcctgcatt

SEQ ID NO: 3739197 - DNA, 20 bp, Homo sapiens
aaatattcctgcatttgtga

SEQ ID NO: 3739198 - DNA, 14 bp, Homo sapiens
aaatcaagtttcca

SEQ ID NO: 3739199 - DNA, 18 bp, Homo sapiens
aaatcagcctgctccagc

SEQ ID NO: 3739200 - DNA, 21 bp, Homo sapiens
aaatcccattcataactttca

SEQ ID NO: 3739201 - DNA, 18 bp, Homo sapiens
aaatcccttacctcggtg

SEQ ID NO: 3739202 - DNA, 11 bp, Homo sapiens
aaatcctctgg

SEQ ID NO: 3739203 - DNA, 17 bp, Homo sapiens
aaatcctgttgaaaagc

SEQ ID NO: 3739204 - DNA, 20 bp, Homo sapiens
aaatcctgttgaaaagccat

SEQ ID NO: 3739205 - DNA, 21 bp, Homo sapiens
aaatcctgttgaaaagccatg

SEQ ID NO: 3739206 - DNA, 15 bp, Homo sapiens
aaatccttctaatct

SEQ ID NO: 3739207 - DNA, 22 bp, Homo sapiens
aaatcggatctggggctctggg

SEQ ID NO: 3739208 - DNA, 17 bp, Homo sapiens
aaatctgaccaaaacaa

SEQ ID NO: 3739209 - DNA, 17 bp, Homo sapiens
aaatctgtaagctcttt

SEQ ID NO: 3739210 - DNA, 17 bp, Homo sapiens
aaatcttggcacagaaa

SEQ ID NO: 3739211 - DNA, 13 bp, Homo sapiens
aaatgaaatttta

SEQ ID NO: 3739212 - DNA, 17 bp, Homo sapiens
aaatgaaattttaccaa

SEQ ID NO: 3739213 - DNA, 17 bp, Homo sapiens
aaatgaagtttatacag

SEQ ID NO: 3739214 - DNA, 22 bp, Homo sapiens
aaatgactaaaaaacaaagaag

SEQ ID NO: 3739215 - DNA, 20 bp, Homo sapiens
aaatgactaaaaatattata

SEQ ID NO: 3739216 - DNA, 15 bp, Homo sapiens
aaatgagaacatgtt

SEQ ID NO: 3739217 - DNA, 20 bp, Homo sapiens
aaatgagaccctcgtggcct

SEQ ID NO: 3739218 - DNA, 13 bp, Homo sapiens
aaatgagcctggc

SEQ ID NO: 3739219 - DNA, 17 bp, Homo sapiens
aaatgaggtcagagcct

SEQ ID NO: 3739220 - DNA, 22 bp, Homo sapiens
aaatgagtttttatggggctga

SEQ ID NO: 3739221 - DNA, 11 bp, Homo sapiens
aaatgatatta

SEQ ID NO: 3739222 - DNA, 19 bp, Homo sapiens
aaatgatattaaaaattgg

SEQ ID NO: 3739223 - DNA, 16 bp, Homo sapiens
aaatgatcttttcaag

SEQ ID NO: 3739224 - DNA, 15 bp, Homo sapiens
aaatgcataaatgca

SEQ ID NO: 3739225 - DNA, 18 bp, Homo sapiens
aaatgcatcaatcctgtg

SEQ ID NO: 3739226 - DNA, 20 bp, Homo sapiens
aaatgcatccattcctcagg

SEQ ID NO: 3739227 - DNA, 13 bp, Homo sapiens
aaatgcatggagg

SEQ ID NO: 3739228 - DNA, 14 bp, Homo sapiens
aaatgccaatctct

SEQ ID NO: 3739229 - DNA, 17 bp, Homo sapiens
aaatgccttactttgta

SEQ ID NO: 3739230 - DNA, 17 bp, Homo sapiens
aaatggaagtggcaata

SEQ ID NO: 3739231 - DNA, 13 bp, Homo sapiens
aaatggccatttg

SEQ ID NO: 3739232 - DNA, 22 bp, Homo sapiens
aaatggccatttgctttttcac

SEQ ID NO: 3739233 - DNA, 22 bp, Homo sapiens
aaatgggaaatgcctaagaaga

SEQ ID NO: 3739234 - DNA, 16 bp, Homo sapiens
aaatggtcgcccagga

SEQ ID NO: 3739235 - DNA, 17 bp, Homo sapiens
aaatggtcgcccaggag

SEQ ID NO: 3739236 - DNA, 18 bp, Homo sapiens
aaatggtcgcccaggaga

SEQ ID NO: 3739237 - DNA, 20 bp, Homo sapiens
aaatggtggttgtttcttcc

SEQ ID NO: 3739238 - DNA, 18 bp, Homo sapiens
aaatggtgttttcatgta

SEQ ID NO: 3739239 - DNA, 17 bp, Homo sapiens
aaatgtaagaatcattg

SEQ ID NO: 3739240 - DNA, 20 bp, Homo sapiens
aaatgtaagaatcattgtaa

SEQ ID NO: 3739241 - DNA, 12 bp, Homo sapiens
aaatgtaattga

SEQ ID NO: 3739242 - DNA, 17 bp, Homo sapiens
aaatgtatcatagaaat

SEQ ID NO: 3739243 - DNA, 20 bp, Homo sapiens
aaatgtatcatagaaatgta

SEQ ID NO: 3739244 - DNA, 17 bp, Homo sapiens
aaatgtatcttattcac

SEQ ID NO: 3739245 - DNA, 22 bp, Homo sapiens
aaatgtcctccagaagcctctg

SEQ ID NO: 3739246 - DNA, 19 bp, Homo sapiens
aaatgtctagttgtaacac

SEQ ID NO: 3739247 - DNA, 19 bp, Homo sapiens
aaatgtctggagaataatt

SEQ ID NO: 3739248 - DNA, 16 bp, Homo sapiens
aaatgtctgtggcctt

SEQ ID NO: 3739249 - DNA, 23 bp, Homo sapiens
aaatgtctgtggccttgttctct

SEQ ID NO: 3739250 - DNA, 22 bp, Homo sapiens
aaatgtctttccttttgctctt

SEQ ID NO: 3739251 - DNA, 15 bp, Homo sapiens
aaatgtgatttttct

SEQ ID NO: 3739252 - DNA, 16 bp, Homo sapiens
aaatgtgatttttctg

SEQ ID NO: 3739253 - DNA, 17 bp, Homo sapiens
aaatgtgatttttctga

SEQ ID NO: 3739254 - DNA, 12 bp, Homo sapiens
aaatgttacata

SEQ ID NO: 3739255 - DNA, 17 bp, Homo sapiens
aaatgttacatagtgta

SEQ ID NO: 3739256 - DNA, 18 bp, Homo sapiens
aaatgttacatagtgtag

SEQ ID NO: 3739257 - DNA, 20 bp, Homo sapiens
aaatgttattttttaattat

SEQ ID NO: 3739258 - DNA, 21 bp, Homo sapiens
aaatgttattttttaattatt

SEQ ID NO: 3739259 - DNA, 13 bp, Homo sapiens
aaattaaagctga

SEQ ID NO: 3739260 - DNA, 12 bp, Homo sapiens
aaattaaatata

SEQ ID NO: 3739261 - DNA, 16 bp, Homo sapiens
aaattaaatatatgta

SEQ ID NO: 3739262 - DNA, 19 bp, Homo sapiens
aaattaaatatatgtatgt

SEQ ID NO: 3739263 - DNA, 12 bp, Homo sapiens
aaattaacactg

SEQ ID NO: 3739264 - DNA, 16 bp, Homo sapiens
aaattaagaatgttct

SEQ ID NO: 3739265 - DNA, 22 bp, Homo sapiens
aaattaaggcaactgaacaaaa

SEQ ID NO: 3739266 - DNA, 16 bp, Homo sapiens
aaattaccagtaaagt

SEQ ID NO: 3739267 - DNA, 16 bp, Homo sapiens
aaattaggaataaata

SEQ ID NO: 3739268 - DNA, 18 bp, Homo sapiens
aaattaggatttcatgat

SEQ ID NO: 3739269 - DNA, 19 bp, Homo sapiens
aaattataacttaaaatat

SEQ ID NO: 3739270 - DNA, 13 bp, Homo sapiens
aaattatagaagt

SEQ ID NO: 3739271 - DNA, 16 bp, Homo sapiens
aaattatcaagctaat

SEQ ID NO: 3739272 - DNA, 20 bp, Homo sapiens
aaattatctatttgtatata

SEQ ID NO: 3739273 - DNA, 14 bp, Homo sapiens
aaattattcagtta

SEQ ID NO: 3739274 - DNA, 20 bp, Homo sapiens
aaattattcagttaagaaaa

SEQ ID NO: 3739275 - DNA, 21 bp, Homo sapiens
aaattattcagttaagaaaaa

SEQ ID NO: 3739276 - DNA, 13 bp, Homo sapiens
aaattatttcaga

SEQ ID NO: 3739277 - DNA, 16 bp, Homo sapiens
aaattattttaaatta

SEQ ID NO: 3739278 - DNA, 13 bp, Homo sapiens
aaattccactgga

SEQ ID NO: 3739279 - DNA, 17 bp, Homo sapiens
aaattccagaaaggata

SEQ ID NO: 3739280 - DNA, 20 bp, Homo sapiens
aaattccctggaccagatgc

SEQ ID NO: 3739281 - DNA, 23 bp, Homo sapiens
aaattccttagcttagacctcag

SEQ ID NO: 3739282 - DNA, 19 bp, Homo sapiens
aaattctataggaacatat

SEQ ID NO: 3739283 - DNA, 21 bp, Homo sapiens
aaattcttttttaaattttct

SEQ ID NO: 3739284 - DNA, 20 bp, Homo sapiens
aaattgaaaggcattctctg

SEQ ID NO: 3739285 - DNA, 18 bp, Homo sapiens
aaattgaatttaacaatg

SEQ ID NO: 3739286 - DNA, 18 bp, Homo sapiens
aaattgcatgctgcttta

SEQ ID NO: 3739287 - DNA, 13 bp, Homo sapiens
aaattgctccttg

SEQ ID NO: 3739288 - DNA, 13 bp, Homo sapiens
aaattgcttgaaa

SEQ ID NO: 3739289 - DNA, 22 bp, Homo sapiens
aaattgtatctagtgcagctga

SEQ ID NO: 3739290 - DNA, 18 bp, Homo sapiens
aaatttaaaacaaacaac

SEQ ID NO: 3739291 - DNA, 12 bp, Homo sapiens
aaatttaagcat

SEQ ID NO: 3739292 - DNA, 14 bp, Homo sapiens
aaatttaagcattg

SEQ ID NO: 3739293 - DNA, 17 bp, Homo sapiens
aaatttaagcattgttt

SEQ ID NO: 3739294 - DNA, 20 bp, Homo sapiens
aaatttatatgtatccagta

SEQ ID NO: 3739295 - DNA, 22 bp, Homo sapiens
aaatttccagtacctttgtcac

SEQ ID NO: 3739296 - DNA, 23 bp, Homo sapiens
aaatttccagtacctttgtcaca

SEQ ID NO: 3739297 - DNA, 20 bp, Homo sapiens
aaatttgaatgggtccattt

SEQ ID NO: 3739298 - DNA, 16 bp, Homo sapiens
aaatttggttctaata

SEQ ID NO: 3739299 - DNA, 14 bp, Homo sapiens
aaattttaccaagt

SEQ ID NO: 3739300 - DNA, 22 bp, Homo sapiens
aaattttaccaagttatataaa

SEQ ID NO: 3739301 - DNA, 17 bp, Homo sapiens
aaattttatctcttatt

SEQ ID NO: 3739302 - DNA, 13 bp, Homo sapiens
aaattttattcct

SEQ ID NO: 3739303 - DNA, 18 bp, Homo sapiens
aaattttcttcagttggt

SEQ ID NO: 3739304 - DNA, 23 bp, Homo sapiens
aaattttgcctaatacattaaag

SEQ ID NO: 3739305 - DNA, 18 bp, Homo sapiens
aaatttttcagatgcttc

SEQ ID NO: 3739306 - DNA, 12 bp, Homo sapiens
aaaaaaaacaaa

SEQ ID NO: 3739307 - DNA, 12 bp, Homo sapiens
aaaaaaatgaca

SEQ ID NO: 3739308 - DNA, 12 bp, Homo sapiens
aaaaaaattggc

SEQ ID NO: 3739309 - DNA, 11 bp, Homo sapiens
aaaaaactttt

SEQ ID NO: 3739310 - DNA, 11 bp, Homo sapiens
aaaaaagtctc

SEQ ID NO: 3739311 - DNA, 15 bp, Homo sapiens
aaaaaatattttcct

SEQ ID NO: 3739312 - DNA, 19 bp, Homo sapiens
aaaaacagcctcacagaag

SEQ ID NO: 3739313 - DNA, 19 bp, Homo sapiens
aaaaacttcagtaagtacg

SEQ ID NO: 3739314 - DNA, 12 bp, Homo sapiens
aaaaacttgtaa

SEQ ID NO: 3739315 - DNA, 23 bp, Homo sapiens
aaaaacttttataaattaaatat

SEQ ID NO: 3739316 - DNA, 13 bp, Homo sapiens
aaaaagaatgtca

SEQ ID NO: 3739317 - DNA, 12 bp, Homo sapiens
aaaaaggcagga

SEQ ID NO: 3739318 - DNA, 22 bp, Homo sapiens
aaaaagtctacgctctcctttc

SEQ ID NO: 3739319 - DNA, 18 bp, Homo sapiens
aaaaagtctctatttaaa

SEQ ID NO: 3739320 - DNA, 14 bp, Homo sapiens
aaaaagtttaaaat

SEQ ID NO: 3739321 - DNA, 22 bp, Homo sapiens
aaaaataaccccaaaatgaaga

SEQ ID NO: 3739322 - DNA, 11 bp, Homo sapiens
aaaaataaggt

SEQ ID NO: 3739323 - DNA, 12 bp, Homo sapiens
aaaaataataaa

SEQ ID NO: 3739324 - DNA, 14 bp, Homo sapiens
aaaaatacatgcat

SEQ ID NO: 3739325 - DNA, 17 bp, Homo sapiens
aaaaatactctaattct

SEQ ID NO: 3739326 - DNA, 11 bp, Homo sapiens
aaaaatattta

SEQ ID NO: 3739327 - DNA, 17 bp, Homo sapiens
aaaaatcataaactgtg

SEQ ID NO: 3739328 - DNA, 20 bp, Homo sapiens
aaaaatccttctaatctgct

SEQ ID NO: 3739329 - DNA, 15 bp, Homo sapiens
aaaaatggtaaaatt

SEQ ID NO: 3739330 - DNA, 16 bp, Homo sapiens
aaaaatggtaaaattg

SEQ ID NO: 3739331 - DNA, 19 bp, Homo sapiens
aaaaatggtaaaattgcat

SEQ ID NO: 3739332 - DNA, 14 bp, Homo sapiens
aaaaatttaagcat

SEQ ID NO: 3739333 - DNA, 21 bp, Homo sapiens
aaaaatttaagcattgtttgc

SEQ ID NO: 3739334 - DNA, 22 bp, Homo sapiens
aaaaatttaagcattgtttgct

SEQ ID NO: 3739335 - DNA, 20 bp, Homo sapiens
aaaaatttgaaccaaaacat

SEQ ID NO: 3739336 - DNA, 23 bp, Homo sapiens
aaaaatttggaattctgttcatt

SEQ ID NO: 3739337 - DNA, 22 bp, Homo sapiens
aaaaatttttggattgacagta

SEQ ID NO: 3739338 - DNA, 15 bp, Homo sapiens
aaaacaaaaaacaat

SEQ ID NO: 3739339 - DNA, 18 bp, Homo sapiens
aaaacaagaaagtttccc

SEQ ID NO: 3739340 - DNA, 21 bp, Homo sapiens
aaaacactatttttttttctt

SEQ ID NO: 3739341 - DNA, 15 bp, Homo sapiens
aaaacagactcaggt

SEQ ID NO: 3739342 - DNA, 16 bp, Homo sapiens
aaaacagcattgcttt

SEQ ID NO: 3739343 - DNA, 20 bp, Homo sapiens
aaaacattccgtttacattt

SEQ ID NO: 3739344 - DNA, 21 bp, Homo sapiens
aaaacattccgtttacatttt

SEQ ID NO: 3739345 - DNA, 22 bp, Homo sapiens
aaaacattgaagagagagctga

SEQ ID NO: 3739346 - DNA, 14 bp, Homo sapiens
aaaaccaagaagat

SEQ ID NO: 3739347 - DNA, 19 bp, Homo sapiens
aaaaccaagccgtggcttc

SEQ ID NO: 3739348 - DNA, 22 bp, Homo sapiens
aaaacctcacccgaggctgccc

SEQ ID NO: 3739349 - DNA, 18 bp, Homo sapiens
aaaacgcatggagtgtgt

SEQ ID NO: 3739350 - DNA, 18 bp, Homo sapiens
aaaacggttaaaactgtc

SEQ ID NO: 3739351 - DNA, 16 bp, Homo sapiens
aaaacgttttattgtg

SEQ ID NO: 3739352 - DNA, 17 bp, Homo sapiens
aaaacgttttattgtgt

SEQ ID NO: 3739353 - DNA, 22 bp, Homo sapiens
aaccacatcttgctctgctgac

SEQ ID NO: 3739354 - DNA, 15 bp, Homo sapiens
aaccaccgctcccca

SEQ ID NO: 3739355 - DNA, 17 bp, Homo sapiens
aaccaccgctccccagc

SEQ ID NO: 3739356 - DNA, 20 bp, Homo sapiens
aaccaccgctccccagccca

SEQ ID NO: 3739357 - DNA, 13 bp, Homo sapiens
aaccactgcttcc

SEQ ID NO: 3739358 - DNA, 20 bp, Homo sapiens
aaccactgtaaaatgaaatt

SEQ ID NO: 3739359 - DNA, 17 bp, Homo sapiens
aaccagaagcaacagaa

SEQ ID NO: 3739360 - DNA, 21 bp, Homo sapiens
aaccagaagcaacagaaaaaa

SEQ ID NO: 3739361 - DNA, 16 bp, Homo sapiens
aaccagagcaagcttt

SEQ ID NO: 3739362 - DNA, 19 bp, Homo sapiens
aaccagtatacaagataag

SEQ ID NO: 3739363 - DNA, 14 bp, Homo sapiens
aaccagttatgtga

SEQ ID NO: 3739364 - DNA, 16 bp, Homo sapiens
aaccatcattataaac

SEQ ID NO: 3739365 - DNA, 19 bp, Homo sapiens
aaccatgcaaatgctatga

SEQ ID NO: 3739366 - DNA, 16 bp, Homo sapiens
aacccaaacctggaga

SEQ ID NO: 3739367 - DNA, 16 bp, Homo sapiens
aacccaagtgggggca

SEQ ID NO: 3739368 - DNA, 12 bp, Homo sapiens
aacccaggaggt

SEQ ID NO: 3739369 - DNA, 21 bp, Homo sapiens
aacccatctacccctggatga

SEQ ID NO: 3739370 - DNA, 22 bp, Homo sapiens
aaccccaaaatgaagattattt

SEQ ID NO: 3739371 - DNA, 12 bp, Homo sapiens
aaccccagctcc

SEQ ID NO: 3739372 - DNA, 10 bp, Homo sapiens
aacccccacc

SEQ ID NO: 3739373 - DNA, 13 bp, Homo sapiens
aacccccacccca

SEQ ID NO: 3739374 - DNA, 19 bp, Homo sapiens
aacccccaccccacacttg

SEQ ID NO: 3739375 - DNA, 13 bp, Homo sapiens
aacccccagcctg

SEQ ID NO: 3739376 - DNA, 20 bp, Homo sapiens
aacccgacagagggaagaaa

SEQ ID NO: 3739377 - DNA, 19 bp, Homo sapiens
aaccctcagagccacccct

SEQ ID NO: 3739378 - DNA, 16 bp, Homo sapiens
aaccctccctcagccc

SEQ ID NO: 3739379 - DNA, 21 bp, Homo sapiens
aaccctccctcagcccctctt

SEQ ID NO: 3739380 - DNA, 15 bp, Homo sapiens
aaccctcgtttctga

SEQ ID NO: 3739381 - DNA, 12 bp, Homo sapiens
aaccctgcccct

SEQ ID NO: 3739382 - DNA, 19 bp, Homo sapiens
aaccctgcccctgccccgt

SEQ ID NO: 3739383 - DNA, 16 bp, Homo sapiens
aaccctgttttatact

SEQ ID NO: 3739384 - DNA, 20 bp, Homo sapiens
aaccctgttttatactgtac

SEQ ID NO: 3739385 - DNA, 22 bp, Homo sapiens
aaccctgttttatactgtactt

SEQ ID NO: 3739386 - DNA, 13 bp, Homo sapiens
aacccttctttta

SEQ ID NO: 3739387 - DNA, 14 bp, Homo sapiens
aacccttcttttaa

SEQ ID NO: 3739388 - DNA, 14 bp, Homo sapiens
aacccttgaaaaga

SEQ ID NO: 3739389 - DNA, 15 bp, Homo sapiens
aacccttgaaaagac

SEQ ID NO: 3739390 - DNA, 21 bp, Homo sapiens
aacccttggagccaatggaga

SEQ ID NO: 3739391 - DNA, 16 bp, Homo sapiens
aacccttttggccccc

SEQ ID NO: 3739392 - DNA, 13 bp, Homo sapiens
aaccgatgctcca

SEQ ID NO: 3739393 - DNA, 13 bp, Homo sapiens
aaccgtcctcttt

SEQ ID NO: 3739394 - DNA, 18 bp, Homo sapiens
aacctacctgtaactttt

SEQ ID NO: 3739395 - DNA, 21 bp, Homo sapiens
aacctcacccgaggctgccca

SEQ ID NO: 3739396 - DNA, 19 bp, Homo sapiens
aacctcacgcacctcccat

SEQ ID NO: 3739397 - DNA, 18 bp, Homo sapiens
aacctcaggcttccttgg

SEQ ID NO: 3739398 - DNA, 18 bp, Homo sapiens
aacctcagtgtcatttat

SEQ ID NO: 3739399 - DNA, 16 bp, Homo sapiens
aacctccccggctcaa

SEQ ID NO: 3739400 - DNA, 16 bp, Homo sapiens
aacctcttttctgcat

SEQ ID NO: 3739401 - DNA, 18 bp, Homo sapiens
aacctcttttctgcatca

SEQ ID NO: 3739402 - DNA, 22 bp, Homo sapiens
aacctgaaaagatgttgtgtct

SEQ ID NO: 3739403 - DNA, 16 bp, Homo sapiens
aacctgagatggccct

SEQ ID NO: 3739404 - DNA, 15 bp, Homo sapiens
aacctgctctcctct

SEQ ID NO: 3739405 - DNA, 18 bp, Homo sapiens
aacctggaccaaagctga

SEQ ID NO: 3739406 - DNA, 11 bp, Homo sapiens
aacctggagat

SEQ ID NO: 3739407 - DNA, 11 bp, Homo sapiens
aacctggtgct

SEQ ID NO: 3739408 - DNA, 16 bp, Homo sapiens
aacctgtaaattattt

SEQ ID NO: 3739409 - DNA, 15 bp, Homo sapiens
aacctgtacttcaag

SEQ ID NO: 3739410 - DNA, 21 bp, Homo sapiens
aacctgttgatagcaagtgaa

SEQ ID NO: 3739411 - DNA, 13 bp, Homo sapiens
aaccttccatctc

SEQ ID NO: 3739412 - DNA, 13 bp, Homo sapiens
aaccttcctgtct

SEQ ID NO: 3739413 - DNA, 19 bp, Homo sapiens
aaccttgtctctatgccag

SEQ ID NO: 3739414 - DNA, 15 bp, Homo sapiens
aacctttaagaattt

SEQ ID NO: 3739415 - DNA, 14 bp, Homo sapiens
aacctttcaaattt

SEQ ID NO: 3739416 - DNA, 13 bp, Homo sapiens
aacgaagaaaaaa

SEQ ID NO: 3739417 - DNA, 14 bp, Homo sapiens
aacgaagaaaaaaa

SEQ ID NO: 3739418 - DNA, 11 bp, Homo sapiens
aacgaatgaag

SEQ ID NO: 3739419 - DNA, 16 bp, Homo sapiens
aacgagtcaatcccct

SEQ ID NO: 3739420 - DNA, 22 bp, Homo sapiens
aacgatgatgcttgtaacaaga

SEQ ID NO: 3739421 - DNA, 12 bp, Homo sapiens
aacgatttagaa

SEQ ID NO: 3739422 - DNA, 18 bp, Homo sapiens
aacgcatggagtgtgtat

SEQ ID NO: 3739423 - DNA, 23 bp, Homo sapiens
aacgcatggagtgtgtattgttc

SEQ ID NO: 3739424 - DNA, 21 bp, Homo sapiens
aacgcctgcttgtccctgccc

SEQ ID NO: 3739425 - DNA, 17 bp, Homo sapiens
aacggaacgttggactt

SEQ ID NO: 3739426 - DNA, 19 bp, Homo sapiens
aacggagagcgcctgcccc

SEQ ID NO: 3739427 - DNA, 22 bp, Homo sapiens
aacggtacacagactattgaca

SEQ ID NO: 3739428 - DNA, 14 bp, Homo sapiens
aacggttaaaactg

SEQ ID NO: 3739429 - DNA, 13 bp, Homo sapiens
aacgtggcccaga

SEQ ID NO: 3739430 - DNA, 23 bp, Homo sapiens
aacgtgggagttcagctgcttct

SEQ ID NO: 3739431 - DNA, 22 bp, Homo sapiens
aacgtggggcagcacagagagg

SEQ ID NO: 3739432 - DNA, 18 bp, Homo sapiens
aacgttaagaattgttaa

SEQ ID NO: 3739433 - DNA, 13 bp, Homo sapiens
aacgttggacttt

SEQ ID NO: 3739434 - DNA, 15 bp, Homo sapiens
aacgttttgaactaa

SEQ ID NO: 3739435 - DNA, 15 bp, Homo sapiens
aactaataaaagcat

SEQ ID NO: 3739436 - DNA, 20 bp, Homo sapiens
aactaatctattgggttcat

SEQ ID NO: 3739437 - DNA, 12 bp, Homo sapiens
aactacatttta

SEQ ID NO: 3739438 - DNA, 15 bp, Homo sapiens
aactacattttaaca

SEQ ID NO: 3739439 - DNA, 16 bp, Homo sapiens
aactacattttaacat

SEQ ID NO: 3739440 - DNA, 13 bp, Homo sapiens
aactactgtgttc

SEQ ID NO: 3739441 - DNA, 19 bp, Homo sapiens
aactagaatttattcaatt

SEQ ID NO: 3739442 - DNA, 20 bp, Homo sapiens
aactagagatgactgagtcc

SEQ ID NO: 3739443 - DNA, 20 bp, Homo sapiens
aactagtggtggctctgaga

SEQ ID NO: 3739444 - DNA, 18 bp, Homo sapiens
aactatgatatggtaaaa

SEQ ID NO: 3739445 - DNA, 16 bp, Homo sapiens
aactatgatttggaaa

SEQ ID NO: 3739446 - DNA, 19 bp, Homo sapiens
aactatgtacaatatttta

SEQ ID NO: 3739447 - DNA, 13 bp, Homo sapiens
aactatttatctg

SEQ ID NO: 3739448 - DNA, 16 bp, Homo sapiens
aactcaaacacagaga

SEQ ID NO: 3739449 - DNA, 13 bp, Homo sapiens
aactcaatatttt

SEQ ID NO: 3739450 - DNA, 20 bp, Homo sapiens
aactcacctgctggcccctc

SEQ ID NO: 3739451 - DNA, 22 bp, Homo sapiens
aactcacctgctggcccctcac

SEQ ID NO: 3739452 - DNA, 16 bp, Homo sapiens
aactcatcataaaata

SEQ ID NO: 3739453 - DNA, 17 bp, Homo sapiens
aactcatcataaaataa

SEQ ID NO: 3739454 - DNA, 15 bp, Homo sapiens
aactcattcctgcct

SEQ ID NO: 3739455 - DNA, 18 bp, Homo sapiens
aactccagtactggagct

SEQ ID NO: 3739456 - DNA, 19 bp, Homo sapiens
aactccagtactggagctt

SEQ ID NO: 3739457 - DNA, 15 bp, Homo sapiens
aactctaatagtgct

SEQ ID NO: 3739458 - DNA, 20 bp, Homo sapiens
aactctgatgtaaatgaagt

SEQ ID NO: 3739459 - DNA, 16 bp, Homo sapiens
aactctgcattctagt

SEQ ID NO: 3739460 - DNA, 22 bp, Homo sapiens
aactctgggctgctacccagaa

SEQ ID NO: 3739461 - DNA, 21 bp, Homo sapiens
aactcttcaatctcttgcact

SEQ ID NO: 3739462 - DNA, 12 bp, Homo sapiens
aactgaaaacat

SEQ ID NO: 3739463 - DNA, 15 bp, Homo sapiens
aactgaaaacataaa

SEQ ID NO: 3739464 - DNA, 12 bp, Homo sapiens
aactgaaaagac

SEQ ID NO: 3739465 - DNA, 13 bp, Homo sapiens
aactgaagccaga

SEQ ID NO: 3739466 - DNA, 19 bp, Homo sapiens
aactgaccagcctccatgc

SEQ ID NO: 3739467 - DNA, 22 bp, Homo sapiens
aactgaccctcccttcctgtcc

SEQ ID NO: 3739468 - DNA, 12 bp, Homo sapiens
aactgaggaatt

SEQ ID NO: 3739469 - DNA, 16 bp, Homo sapiens
aactgaggaattttct

SEQ ID NO: 3739470 - DNA, 20 bp, Homo sapiens
aactgaggaattttctttgt

SEQ ID NO: 3739471 - DNA, 12 bp, Homo sapiens
aactgaggcaga

SEQ ID NO: 3739472 - DNA, 17 bp, Homo sapiens
aactgcaagtcacaaag

SEQ ID NO: 3739473 - DNA, 18 bp, Homo sapiens
aactgcaagtcacaaagg

SEQ ID NO: 3739474 - DNA, 23 bp, Homo sapiens
aactgcaagtcacaaaggaatgg

SEQ ID NO: 3739475 - DNA, 13 bp, Homo sapiens
aactgcaatagag

SEQ ID NO: 3739476 - DNA, 16 bp, Homo sapiens
aactgcaatagagact

SEQ ID NO: 3739477 - DNA, 23 bp, Homo sapiens
aactgcaatagagactgtagatt

SEQ ID NO: 3739478 - DNA, 15 bp, Homo sapiens
aactgcctctttcct

SEQ ID NO: 3739479 - DNA, 19 bp, Homo sapiens
aactgctgatgctcatggt

SEQ ID NO: 3739480 - DNA, 20 bp, Homo sapiens
aactgctgatgctcatggtc

SEQ ID NO: 3739481 - DNA, 13 bp, Homo sapiens
aactgctgcccca

SEQ ID NO: 3739482 - DNA, 22 bp, Homo sapiens
aactgctgccccaaaggaagct

SEQ ID NO: 3739483 - DNA, 13 bp, Homo sapiens
aactggaagcaca

SEQ ID NO: 3739484 - DNA, 15 bp, Homo sapiens
aactggaagttattt

SEQ ID NO: 3739485 - DNA, 21 bp, Homo sapiens
aactgggtacttgtggacaca

SEQ ID NO: 3739486 - DNA, 14 bp, Homo sapiens
aactgtagaaatga

SEQ ID NO: 3739487 - DNA, 16 bp, Homo sapiens
aactgtagaaatgatg

SEQ ID NO: 3739488 - DNA, 20 bp, Homo sapiens
aactgtcctctttcagaaaa

SEQ ID NO: 3739489 - DNA, 21 bp, Homo sapiens
aactgttctctattagacttt

SEQ ID NO: 3739490 - DNA, 17 bp, Homo sapiens
aactgttgccagagatg

SEQ ID NO: 3739491 - DNA, 14 bp, Homo sapiens
aacttaaaatattt

SEQ ID NO: 3739492 - DNA, 14 bp, Homo sapiens
aacttaaataataa

SEQ ID NO: 3739493 - DNA, 16 bp, Homo sapiens
aacttaacattctgta

SEQ ID NO: 3739494 - DNA, 17 bp, Homo sapiens
aacttaacattctgtaa

SEQ ID NO: 3739495 - DNA, 21 bp, Homo sapiens
aacttaacattctgtaaaatg

SEQ ID NO: 3739496 - DNA, 18 bp, Homo sapiens
aacttaaccgcatcagaa

SEQ ID NO: 3739497 - DNA, 18 bp, Homo sapiens
aacttaatagtatttatg

SEQ ID NO: 3739498 - DNA, 12 bp, Homo sapiens
aacttacacaca

SEQ ID NO: 3739499 - DNA, 13 bp, Homo sapiens
aacttacacacaa

SEQ ID NO: 3739500 - DNA, 21 bp, Homo sapiens
aacttaggcatgcacagctgt

SEQ ID NO: 3739501 - DNA, 22 bp, Homo sapiens
aacttagtgcggacaagtttta

SEQ ID NO: 3739502 - DNA, 17 bp, Homo sapiens
aacttatcttacaaagt

SEQ ID NO: 3739503 - DNA, 19 bp, Homo sapiens
aacttatcttacaaagtgt

SEQ ID NO: 3739504 - DNA, 14 bp, Homo sapiens
aacttcatttgatg

SEQ ID NO: 3739505 - DNA, 20 bp, Homo sapiens
aacttccaagacctgactca

SEQ ID NO: 3739506 - DNA, 13 bp, Homo sapiens
aacttccaattta

SEQ ID NO: 3739507 - DNA, 16 bp, Homo sapiens
aacttctaattgccat

SEQ ID NO: 3739508 - DNA, 15 bp, Homo sapiens
aacttgagcatgtta

SEQ ID NO: 3739509 - DNA, 22 bp, Homo sapiens
aacttgagcgtgaatctgtatc

SEQ ID NO: 3739510 - DNA, 15 bp, Homo sapiens
aacttggagccccag

SEQ ID NO: 3739511 - DNA, 13 bp, Homo sapiens
aacttggggaaca

SEQ ID NO: 3739512 - DNA, 14 bp, Homo sapiens
aacttggttataca

SEQ ID NO: 3739513 - DNA, 15 bp, Homo sapiens
aacttggttatacat

SEQ ID NO: 3739514 - DNA, 21 bp, Homo sapiens
aacttggttatacatgacact

SEQ ID NO: 3739515 - DNA, 15 bp, Homo sapiens
aacttgtaaatgtgg

SEQ ID NO: 3739516 - DNA, 12 bp, Homo sapiens
aacttgtcttaa

SEQ ID NO: 3739517 - DNA, 13 bp, Homo sapiens
aacttgtcttaaa

SEQ ID NO: 3739518 - DNA, 17 bp, Homo sapiens
aacttgtcttaaataaa

SEQ ID NO: 3739519 - DNA, 15 bp, Homo sapiens
aactttaatatgtat

SEQ ID NO: 3739520 - DNA, 16 bp, Homo sapiens
aactttaatatgtatt

SEQ ID NO: 3739521 - DNA, 19 bp, Homo sapiens
aacttttataaattaaata

SEQ ID NO: 3739522 - DNA, 22 bp, Homo sapiens
aacttttataaattaaatatat

SEQ ID NO: 3739523 - DNA, 15 bp, Homo sapiens
aacttttgtgtgaaa

SEQ ID NO: 3739524 - DNA, 19 bp, Homo sapiens
aacttttttgaaataataa

SEQ ID NO: 3739525 - DNA, 20 bp, Homo sapiens
aagaaaaaaaataacacaga

SEQ ID NO: 3739526 - DNA, 14 bp, Homo sapiens
aagaaaaaaataat

SEQ ID NO: 3739527 - DNA, 24 bp, Homo sapiens
aagaaaaaaataattttatgaact

SEQ ID NO: 3739528 - DNA, 15 bp, Homo sapiens
aagaaaaaagaatgt

SEQ ID NO: 3739529 - DNA, 12 bp, Homo sapiens
aagaaaaaatac

SEQ ID NO: 3739530 - DNA, 14 bp, Homo sapiens
aagaaaaaatacat

SEQ ID NO: 3739531 - DNA, 16 bp, Homo sapiens
aagaaaaaatacattt

SEQ ID NO: 3739532 - DNA, 12 bp, Homo sapiens
aagaaaagaatc

SEQ ID NO: 3739533 - DNA, 22 bp, Homo sapiens
aagaaaagtaggtttacattca

SEQ ID NO: 3739534 - DNA, 15 bp, Homo sapiens
aagaaaagtgggcca

SEQ ID NO: 3739535 - DNA, 22 bp, Homo sapiens
aagaaaataaaattaagaatgt

SEQ ID NO: 3739536 - DNA, 13 bp, Homo sapiens
aagaaaatatgca

SEQ ID NO: 3739537 - DNA, 23 bp, Homo sapiens
aagaaaatcagatggagcatgaa

SEQ ID NO: 3739538 - DNA, 16 bp, Homo sapiens
aagaaacaaacccgtt

SEQ ID NO: 3739539 - DNA, 11 bp, Homo sapiens
aagaaacccaa

SEQ ID NO: 3739540 - DNA, 16 bp, Homo sapiens
aagaaactgaggaatt

SEQ ID NO: 3739541 - DNA, 19 bp, Homo sapiens
aagaaactgaggaattttc

SEQ ID NO: 3739542 - DNA, 20 bp, Homo sapiens
aagaaactgaggaattttct

SEQ ID NO: 3739543 - DNA, 14 bp, Homo sapiens
aagaaagaaggaag

SEQ ID NO: 3739544 - DNA, 20 bp, Homo sapiens
aagaaagactatctaaatgt

SEQ ID NO: 3739545 - DNA, 19 bp, Homo sapiens
aagaaagccagtcttaaca

SEQ ID NO: 3739546 - DNA, 13 bp, Homo sapiens
aagaaagtttccc

SEQ ID NO: 3739547 - DNA, 15 bp, Homo sapiens
aagaaagtttcccca

SEQ ID NO: 3739548 - DNA, 15 bp, Homo sapiens
aagaaatcatgttat

SEQ ID NO: 3739549 - DNA, 16 bp, Homo sapiens
aagaaatgaaatttta

SEQ ID NO: 3739550 - DNA, 20 bp, Homo sapiens
aagaaatgaaattttaccaa

SEQ ID NO: 3739551 - DNA, 13 bp, Homo sapiens
aagaaatgcacaa

SEQ ID NO: 3739552 - DNA, 19 bp, Homo sapiens
aagaaatgcacaatgtctt

SEQ ID NO: 3739553 - DNA, 17 bp, Homo sapiens
aagaaatttaaaagaca

SEQ ID NO: 3739554 - DNA, 14 bp, Homo sapiens
aagaactgaaaaca

SEQ ID NO: 3739555 - DNA, 16 bp, Homo sapiens
aagaactgaaaacata

SEQ ID NO: 3739556 - DNA, 19 bp, Homo sapiens
aagaactgaaaacataaaa

SEQ ID NO: 3739557 - DNA, 12 bp, Homo sapiens
aagaagacatga

SEQ ID NO: 3739558 - DNA, 19 bp, Homo sapiens
aagaagccacagacctagg

SEQ ID NO: 3739559 - DNA, 14 bp, Homo sapiens
aagaagctctctcc

SEQ ID NO: 3739560 - DNA, 19 bp, Homo sapiens
aagaaggcagcaggtggca

SEQ ID NO: 3739561 - DNA, 19 bp, Homo sapiens
aagaagtgaccaaggagga

SEQ ID NO: 3739562 - DNA, 13 bp, Homo sapiens
aagaatacagaaa

SEQ ID NO: 3739563 - DNA, 14 bp, Homo sapiens
aagaatacagaaag

SEQ ID NO: 3739564 - DNA, 15 bp, Homo sapiens
aagaatgtcagaaaa

SEQ ID NO: 3739565 - DNA, 18 bp, Homo sapiens
aagaatgtcgattaaaat

SEQ ID NO: 3739566 - DNA, 19 bp, Homo sapiens
aagaattctccaaaacaat

SEQ ID NO: 3739567 - DNA, 20 bp, Homo sapiens
aagaattctccaaaacaatt

SEQ ID NO: 3739568 - DNA, 16 bp, Homo sapiens
aagaattgaacccagg

SEQ ID NO: 3739569 - DNA, 15 bp, Homo sapiens
aagaatttcaatttg

SEQ ID NO: 3739570 - DNA, 20 bp, Homo sapiens
aagaattttcagaccccagc

SEQ ID NO: 3739571 - DNA, 14 bp, Homo sapiens
aagacaaaaatact

SEQ ID NO: 3739572 - DNA, 17 bp, Homo sapiens
aagacaaaggttttcct

SEQ ID NO: 3739573 - DNA, 16 bp, Homo sapiens
aagacaaattctgttt

SEQ ID NO: 3739574 - DNA, 12 bp, Homo sapiens
aagacaacatta

SEQ ID NO: 3739575 - DNA, 21 bp, Homo sapiens
aagacactgaaatatacacac

SEQ ID NO: 3739576 - DNA, 16 bp, Homo sapiens
aagacagagctgggat

SEQ ID NO: 3739577 - DNA, 20 bp, Homo sapiens
aagacagatgccccagagct

SEQ ID NO: 3739578 - DNA, 22 bp, Homo sapiens
aagacagatgccccagagctgt

SEQ ID NO: 3739579 - DNA, 23 bp, Homo sapiens
aagacaggacagtgcttcagcct

SEQ ID NO: 3739580 - DNA, 19 bp, Homo sapiens
aagacatggggaggaagga

SEQ ID NO: 3739581 - DNA, 17 bp, Homo sapiens
aagacattgtcaataaa

SEQ ID NO: 3739582 - DNA, 18 bp, Homo sapiens
aagaccaaaatgacaatg

SEQ ID NO: 3739583 - DNA, 18 bp, Homo sapiens
aagacgtcccttttttct

SEQ ID NO: 3739584 - DNA, 18 bp, Homo sapiens
aagactatctaaatgttg

SEQ ID NO: 3739585 - DNA, 16 bp, Homo sapiens
aagactgtacaaagta

SEQ ID NO: 3739586 - DNA, 17 bp, Homo sapiens
aagactgtacaaagtag

SEQ ID NO: 3739587 - DNA, 12 bp, Homo sapiens
aagacttgtttt

SEQ ID NO: 3739588 - DNA, 18 bp, Homo sapiens
aagagaaaattgaattta

SEQ ID NO: 3739589 - DNA, 12 bp, Homo sapiens
aagagaaacagg

SEQ ID NO: 3739590 - DNA, 12 bp, Homo sapiens
aagagaaacttt

SEQ ID NO: 3739591 - DNA, 20 bp, Homo sapiens
aagagaaactttgtgctaca

SEQ ID NO: 3739592 - DNA, 19 bp, Homo sapiens
aagagaatgccattctctt

SEQ ID NO: 3739593 - DNA, 13 bp, Homo sapiens
aagagaatgtaga

SEQ ID NO: 3739594 - DNA, 13 bp, Homo sapiens
aagagaatgttat

SEQ ID NO: 3739595 - DNA, 22 bp, Homo sapiens
aagagaatgttatagtgaatta

SEQ ID NO: 3739596 - DNA, 13 bp, Homo sapiens
aagagaatgttga

SEQ ID NO: 3739597 - DNA, 21 bp, Homo sapiens
aagagacaaacacctcccagg

SEQ ID NO: 3739598 - DNA, 12 bp, Homo sapiens
aagagagaatgt

SEQ ID NO: 3739599 - DNA, 13 bp, Homo sapiens
aagagagaatgta

SEQ ID NO: 3739600 - DNA, 22 bp, Homo sapiens
aagagagttaatcaactgaaag

SEQ ID NO: 3739601 - DNA, 14 bp, Homo sapiens
aagagatacagagg

SEQ ID NO: 3739602 - DNA, 19 bp, Homo sapiens
aagagcagcctgtggcatc

SEQ ID NO: 3739603 - DNA, 14 bp, Homo sapiens
aagagccaatggag

SEQ ID NO: 3739604 - DNA, 21 bp, Homo sapiens
aagagccttggtgtccacctg

SEQ ID NO: 3739605 - DNA, 18 bp, Homo sapiens
aagagctttacaaaaaga

SEQ ID NO: 3739606 - DNA, 15 bp, Homo sapiens
aagaggaactgggcc

SEQ ID NO: 3739607 - DNA, 16 bp, Homo sapiens
aagaggaactgggcct

SEQ ID NO: 3739608 - DNA, 16 bp, Homo sapiens
aagaggatcggaggct

SEQ ID NO: 3739609 - DNA, 14 bp, Homo sapiens
aagaggcaagaggc

SEQ ID NO: 3739610 - DNA, 15 bp, Homo sapiens
aagaggccaatgccc

SEQ ID NO: 3739611 - DNA, 17 bp, Homo sapiens
aagagggagaagcatga

SEQ ID NO: 3739612 - DNA, 19 bp, Homo sapiens
aagaggggaccagaagcca

SEQ ID NO: 3739613 - DNA, 22 bp, Homo sapiens
aagagggtctgaggaatccaga

SEQ ID NO: 3739614 - DNA, 22 bp, Homo sapiens
aagagtgacagtggattgcatt

SEQ ID NO: 3739615 - DNA, 17 bp, Homo sapiens
aagagtgcaaaacattg

SEQ ID NO: 3739616 - DNA, 19 bp, Homo sapiens
aagagttgtgttgttcttt

SEQ ID NO: 3739617 - DNA, 21 bp, Homo sapiens
aagagtttgagacctgaatag

SEQ ID NO: 3739618 - DNA, 11 bp, Homo sapiens
aagataaagga

SEQ ID NO: 3739619 - DNA, 14 bp, Homo sapiens
aagataaatgtgct

SEQ ID NO: 3739620 - DNA, 21 bp, Homo sapiens
aagataatcttagctgccaag

SEQ ID NO: 3739621 - DNA, 12 bp, Homo sapiens
aagataattata

SEQ ID NO: 3739622 - DNA, 18 bp, Homo sapiens
aagataccatcagcaaag

SEQ ID NO: 3739623 - DNA, 14 bp, Homo sapiens
aagatacgacttta

SEQ ID NO: 3739624 - DNA, 15 bp, Homo sapiens
aagatacgactttat

SEQ ID NO: 3739625 - DNA, 13 bp, Homo sapiens
aagatagaagaaa

SEQ ID NO: 3739626 - DNA, 14 bp, Homo sapiens
aagatagaagaaaa

SEQ ID NO: 3739627 - DNA, 13 bp, Homo sapiens
aagataggctctg

SEQ ID NO: 3739628 - DNA, 14 bp, Homo sapiens
aagataggctctgc

SEQ ID NO: 3739629 - DNA, 17 bp, Homo sapiens
aagataggctctgcaca

SEQ ID NO: 3739630 - DNA, 20 bp, Homo sapiens
aagatcaaaaggttaataaa

SEQ ID NO: 3739631 - DNA, 20 bp, Homo sapiens
aagatgcaaggaccaggact

SEQ ID NO: 3739632 - DNA, 22 bp, Homo sapiens
aagatgctcaggtacagagaag

SEQ ID NO: 3739633 - DNA, 15 bp, Homo sapiens
aagatgctcttttaa

SEQ ID NO: 3739634 - DNA, 14 bp, Homo sapiens
aagatgcttttcaa

SEQ ID NO: 3739635 - DNA, 15 bp, Homo sapiens
aagatgcttttcaaa

SEQ ID NO: 3739636 - DNA, 15 bp, Homo sapiens
aagatggatgtgctt

SEQ ID NO: 3739637 - DNA, 21 bp, Homo sapiens
aagatggattggtgtaaaagg

SEQ ID NO: 3739638 - DNA, 20 bp, Homo sapiens
aagatggctgtgcctctgcc

SEQ ID NO: 3739639 - DNA, 21 bp, Homo sapiens
aagatgggaacgcagatgatc

SEQ ID NO: 3739640 - DNA, 14 bp, Homo sapiens
aagatgggtgggga

SEQ ID NO: 3739641 - DNA, 20 bp, Homo sapiens
aagatgtcctccttgttcta

SEQ ID NO: 3739642 - DNA, 15 bp, Homo sapiens
aagatgtgtcttcaa

SEQ ID NO: 3739643 - DNA, 15 bp, Homo sapiens
aagatttgcccattt

SEQ ID NO: 3739644 - DNA, 16 bp, Homo sapiens
aagatttgctttaatt

SEQ ID NO: 3739645 - DNA, 17 bp, Homo sapiens
aagatttggaataaagt

SEQ ID NO: 3739646 - DNA, 11 bp, Homo sapiens
aagattttgaa

SEQ ID NO: 3739647 - DNA, 15 bp, Homo sapiens
aagattttgaatgct

SEQ ID NO: 3739648 - DNA, 22 bp, Homo sapiens
aagcaaaattatagaagtttag

SEQ ID NO: 3739649 - DNA, 13 bp, Homo sapiens
aagcaaacacatt

SEQ ID NO: 3739650 - DNA, 19 bp, Homo sapiens
aagcacagaaggaggagga

SEQ ID NO: 3739651 - DNA, 12 bp, Homo sapiens
aagcacccttga

SEQ ID NO: 3739652 - DNA, 13 bp, Homo sapiens
aagcacctgccga

SEQ ID NO: 3739653 - DNA, 20 bp, Homo sapiens
aagcacctgccgacctcgtc

SEQ ID NO: 3739654 - DNA, 19 bp, Homo sapiens
aagcaccttagctggcatt

SEQ ID NO: 3739655 - DNA, 21 bp, Homo sapiens
aagcagatgcaaagaggcaag

SEQ ID NO: 3739656 - DNA, 13 bp, Homo sapiens
aagcaggaagctc

SEQ ID NO: 3739657 - DNA, 21 bp, Homo sapiens
aagcagtagaaataatatgca

SEQ ID NO: 3739658 - DNA, 17 bp, Homo sapiens
aagcagtcacttttcct

SEQ ID NO: 3739659 - DNA, 19 bp, Homo sapiens
aagcagtctacccacctca

SEQ ID NO: 3739660 - DNA, 15 bp, Homo sapiens
aagcagtgccttcca

SEQ ID NO: 3739661 - DNA, 17 bp, Homo sapiens
aagcagtgccttccata

SEQ ID NO: 3739662 - DNA, 15 bp, Homo sapiens
aagcatcacctcagg

SEQ ID NO: 3739663 - DNA, 17 bp, Homo sapiens
aagcatccatgtgtgga

SEQ ID NO: 3739664 - DNA, 20 bp, Homo sapiens
aagcatccatgtgtggactc

SEQ ID NO: 3739665 - DNA, 12 bp, Homo sapiens
aagcatctaaac

SEQ ID NO: 3739666 - DNA, 13 bp, Homo sapiens
aagcatctaaact

SEQ ID NO: 3739667 - DNA, 20 bp, Homo sapiens
aagcatctaaactttaatat

SEQ ID NO: 3739668 - DNA, 16 bp, Homo sapiens
aagcatggagaacagt

SEQ ID NO: 3739669 - DNA, 19 bp, Homo sapiens
aagcatgtggcatgttcat

SEQ ID NO: 3739670 - DNA, 19 bp, Homo sapiens
aagcattactcttgtaaga

SEQ ID NO: 3739671 - DNA, 22 bp, Homo sapiens
aagcattactcttgtaagattt

SEQ ID NO: 3739672 - DNA, 22 bp, Homo sapiens
aagcattcaatttattcaagaa

SEQ ID NO: 3739673 - DNA, 22 bp, Homo sapiens
aagcattgtttgcttattgttc

SEQ ID NO: 3739674 - DNA, 16 bp, Homo sapiens
aagcatttactttgtg

SEQ ID NO: 3739675 - DNA, 17 bp, Homo sapiens
aagccaacagtcaaaac

SEQ ID NO: 3739676 - DNA, 16 bp, Homo sapiens
aagccaagggcctctt

SEQ ID NO: 3739677 - DNA, 14 bp, Homo sapiens
aagccacagcccag

SEQ ID NO: 3739678 - DNA, 12 bp, Homo sapiens
aagccagaagct

SEQ ID NO: 3739679 - DNA, 22 bp, Homo sapiens
aagccagggatggggccacagc

SEQ ID NO: 3739680 - DNA, 14 bp, Homo sapiens
aagccatgtttaag

SEQ ID NO: 3739681 - DNA, 18 bp, Homo sapiens
aagccatgtttaagattt

SEQ ID NO: 3739682 - DNA, 22 bp, Homo sapiens
aagccatgtttaagatttaatt

SEQ ID NO: 3739683 - DNA, 22 bp, Homo sapiens
aagcccaacctcctgacctgtc

SEQ ID NO: 3739684 - DNA, 12 bp, Homo sapiens
aagcccagctcc

SEQ ID NO: 3739685 - DNA, 13 bp, Homo sapiens
aagcccagctcca

SEQ ID NO: 3739686 - DNA, 21 bp, Homo sapiens
aagccccaggcaggctgtgcg

SEQ ID NO: 3739687 - DNA, 17 bp, Homo sapiens
aagccctaactcagcca

SEQ ID NO: 3739688 - DNA, 14 bp, Homo sapiens
aagccctccttcca

SEQ ID NO: 3739689 - DNA, 13 bp, Homo sapiens
aagccgctgctgg

SEQ ID NO: 3739690 - DNA, 21 bp, Homo sapiens
aagccgtgattttcattgctg

SEQ ID NO: 3739691 - DNA, 14 bp, Homo sapiens
aagccgtggcttcc

SEQ ID NO: 3739692 - DNA, 18 bp, Homo sapiens
aagcctattgtaaataca

SEQ ID NO: 3739693 - DNA, 13 bp, Homo sapiens
aagcctcagagaa

SEQ ID NO: 3739694 - DNA, 20 bp, Homo sapiens
aagcctccatttagttcttt

SEQ ID NO: 3739695 - DNA, 22 bp, Homo sapiens
aagcctccatttagttctttgt

SEQ ID NO: 3739696 - DNA, 15 bp, Homo sapiens
aagcctcctccagcc

SEQ ID NO: 3739697 - DNA, 19 bp, Homo sapiens
aagcctcctccagccgcca

SEQ ID NO: 3739698 - DNA, 11 bp, Homo sapiens
aagcctctgct

SEQ ID NO: 3739699 - DNA, 14 bp, Homo sapiens
aagcctctgctgcc

SEQ ID NO: 3739700 - DNA, 13 bp, Homo sapiens
accctcaggcagg

SEQ ID NO: 3739701 - DNA, 15 bp, Homo sapiens
accctcaggcaggtg

SEQ ID NO: 3739702 - DNA, 16 bp, Homo sapiens
accctcaggcaggtgg

SEQ ID NO: 3739703 - DNA, 20 bp, Homo sapiens
accctcaggcataggcctgg

SEQ ID NO: 3739704 - DNA, 22 bp, Homo sapiens
accctcaggcataggcctgggt

SEQ ID NO: 3739705 - DNA, 23 bp, Homo sapiens
accctcaggcataggcctgggtg

SEQ ID NO: 3739706 - DNA, 23 bp, Homo sapiens
accctccccgcaccccccaagct

SEQ ID NO: 3739707 - DNA, 12 bp, Homo sapiens
accctccctcag

SEQ ID NO: 3739708 - DNA, 23 bp, Homo sapiens
accctccctcagcccctcttgcc

SEQ ID NO: 3739709 - DNA, 21 bp, Homo sapiens
accctcctatcacctcccctc

SEQ ID NO: 3739710 - DNA, 21 bp, Homo sapiens
accctcctttcaccacatgtg

SEQ ID NO: 3739711 - DNA, 21 bp, Homo sapiens
accctcgaagcgcgccactcg

SEQ ID NO: 3739712 - DNA, 22 bp, Homo sapiens
accctcgctggcccccactggc

SEQ ID NO: 3739713 - DNA, 20 bp, Homo sapiens
accctcgtggccttccccag

SEQ ID NO: 3739714 - DNA, 14 bp, Homo sapiens
accctctccacccc

SEQ ID NO: 3739715 - DNA, 14 bp, Homo sapiens
accctctcccagga

SEQ ID NO: 3739716 - DNA, 15 bp, Homo sapiens
accctctgaccctag

SEQ ID NO: 3739717 - DNA, 18 bp, Homo sapiens
accctgaaagccctgagc

SEQ ID NO: 3739718 - DNA, 21 bp, Homo sapiens
accctgaatttggcctgcact

SEQ ID NO: 3739719 - DNA, 18 bp, Homo sapiens
accctgcaaaggactgtt

SEQ ID NO: 3739720 - DNA, 12 bp, Homo sapiens
accctgcccctg

SEQ ID NO: 3739721 - DNA, 15 bp, Homo sapiens
accctgcccctgccc

SEQ ID NO: 3739722 - DNA, 18 bp, Homo sapiens
accctgcccctgccccgt

SEQ ID NO: 3739723 - DNA, 19 bp, Homo sapiens
accctgcgaaggggccctg

SEQ ID NO: 3739724 - DNA, 13 bp, Homo sapiens
accctggagccca

SEQ ID NO: 3739725 - DNA, 16 bp, Homo sapiens
accctggggagaaagt

SEQ ID NO: 3739726 - DNA, 22 bp, Homo sapiens
accctgtcaagttaacaaggaa

SEQ ID NO: 3739727 - DNA, 19 bp, Homo sapiens
accctgtccaaactgccta

SEQ ID NO: 3739728 - DNA, 21 bp, Homo sapiens
accctgtggtttccaaggagc

SEQ ID NO: 3739729 - DNA, 22 bp, Homo sapiens
acccttaccccttagcctccct

SEQ ID NO: 3739730 - DNA, 18 bp, Homo sapiens
acccttctgtgcccagct

SEQ ID NO: 3739731 - DNA, 19 bp, Homo sapiens
accctttccttccttccct

SEQ ID NO: 3739732 - DNA, 21 bp, Homo sapiens
accctttccttccttccctgg

SEQ ID NO: 3739733 - DNA, 12 bp, Homo sapiens
accctttgcccc

SEQ ID NO: 3739734 - DNA, 12 bp, Homo sapiens
accctttggggg

SEQ ID NO: 3739735 - DNA, 19 bp, Homo sapiens
acccttttgggtttctgcc

SEQ ID NO: 3739736 - DNA, 21 bp, Homo sapiens
acccttttgggtttctgccct

SEQ ID NO: 3739737 - DNA, 12 bp, Homo sapiens
accgaaacagcg

SEQ ID NO: 3739738 - DNA, 18 bp, Homo sapiens
accgaggctggagctggc

SEQ ID NO: 3739739 - DNA, 16 bp, Homo sapiens
accgagtctcttctcc

SEQ ID NO: 3739740 - DNA, 20 bp, Homo sapiens
accgagtctcttctccactg

SEQ ID NO: 3739741 - DNA, 21 bp, Homo sapiens
accgagtctcttctccactgg

SEQ ID NO: 3739742 - DNA, 23 bp, Homo sapiens
accgatgctccagccaacccctg

SEQ ID NO: 3739743 - DNA, 12 bp, Homo sapiens
accgcaggaagc

SEQ ID NO: 3739744 - DNA, 13 bp, Homo sapiens
accgcaggaagct

SEQ ID NO: 3739745 - DNA, 14 bp, Homo sapiens
accgcaggaagctg

SEQ ID NO: 3739746 - DNA, 16 bp, Homo sapiens
accgcaggaagctgct

SEQ ID NO: 3739747 - DNA, 19 bp, Homo sapiens
accgcaggaagctgctccg

SEQ ID NO: 3739748 - DNA, 17 bp, Homo sapiens
accgccaaggctggggg

SEQ ID NO: 3739749 - DNA, 15 bp, Homo sapiens
accgcgtctggtgac

SEQ ID NO: 3739750 - DNA, 15 bp, Homo sapiens
accgctccccagccc

SEQ ID NO: 3739751 - DNA, 19 bp, Homo sapiens
accgctccccagcccaggg

SEQ ID NO: 3739752 - DNA, 16 bp, Homo sapiens
accggaagctcctggt

SEQ ID NO: 3739753 - DNA, 17 bp, Homo sapiens
accggaagctcctggta

SEQ ID NO: 3739754 - DNA, 14 bp, Homo sapiens
accgggcactcaga

SEQ ID NO: 3739755 - DNA, 20 bp, Homo sapiens
accgggcactcagaagacac

SEQ ID NO: 3739756 - DNA, 19 bp, Homo sapiens
accgggccacagagaaagt

SEQ ID NO: 3739757 - DNA, 22 bp, Homo sapiens
accggggagcccccgccccgcc

SEQ ID NO: 3739758 - DNA, 16 bp, Homo sapiens
accgtcgggggctgag

SEQ ID NO: 3739759 - DNA, 15 bp, Homo sapiens
acctaagtctctgtg

SEQ ID NO: 3739760 - DNA, 18 bp, Homo sapiens
acctaagtctctgtgaat

SEQ ID NO: 3739761 - DNA, 20 bp, Homo sapiens
acctaagtttcagttgattt

SEQ ID NO: 3739762 - DNA, 16 bp, Homo sapiens
acctaccacagtgtct

SEQ ID NO: 3739763 - DNA, 24 bp, Homo sapiens
acctagggaggaccttatctgtgc

SEQ ID NO: 3739764 - DNA, 15 bp, Homo sapiens
acctagtagtcattt

SEQ ID NO: 3739765 - DNA, 15 bp, Homo sapiens
acctcaaatttaaag

SEQ ID NO: 3739766 - DNA, 19 bp, Homo sapiens
acctcaacccccatttcta

SEQ ID NO: 3739767 - DNA, 15 bp, Homo sapiens
acctcaacctgtaaa

SEQ ID NO: 3739768 - DNA, 16 bp, Homo sapiens
acctcaacctgtaaat

SEQ ID NO: 3739769 - DNA, 23 bp, Homo sapiens
acctcaacctgtaaattatttta

SEQ ID NO: 3739770 - DNA, 15 bp, Homo sapiens
acctcaagggggact

SEQ ID NO: 3739771 - DNA, 15 bp, Homo sapiens
acctcacgcacctcc

SEQ ID NO: 3739772 - DNA, 17 bp, Homo sapiens
acctcacgcacctccca

SEQ ID NO: 3739773 - DNA, 22 bp, Homo sapiens
acctcacgcacctcccatccta

SEQ ID NO: 3739774 - DNA, 17 bp, Homo sapiens
acctcagagtccaggcc

SEQ ID NO: 3739775 - DNA, 19 bp, Homo sapiens
acctcagagtccaggcccc

SEQ ID NO: 3739776 - DNA, 20 bp, Homo sapiens
acctcagagtccaggcccca

SEQ ID NO: 3739777 - DNA, 15 bp, Homo sapiens
acctcagcaacctgt

SEQ ID NO: 3739778 - DNA, 22 bp, Homo sapiens
acctcagccatgaggagttgct

SEQ ID NO: 3739779 - DNA, 10 bp, Homo sapiens
acctcagcct

SEQ ID NO: 3739780 - DNA, 13 bp, Homo sapiens
acctcagcctaga

SEQ ID NO: 3739781 - DNA, 12 bp, Homo sapiens
acctcagcctcc

SEQ ID NO: 3739782 - DNA, 16 bp, Homo sapiens
acctcagcctgtgctg

SEQ ID NO: 3739783 - DNA, 17 bp, Homo sapiens
acctcagcctgtgctgc

SEQ ID NO: 3739784 - DNA, 20 bp, Homo sapiens
acctcagccttccccttgcc

SEQ ID NO: 3739785 - DNA, 12 bp, Homo sapiens
acctcaggcagg

SEQ ID NO: 3739786 - DNA, 13 bp, Homo sapiens
acctcaggccagg

SEQ ID NO: 3739787 - DNA, 19 bp, Homo sapiens
acctcaggcttccttggca

SEQ ID NO: 3739788 - DNA, 16 bp, Homo sapiens
acctcagtgtcattta

SEQ ID NO: 3739789 - DNA, 19 bp, Homo sapiens
acctcagtgtcatttatga

SEQ ID NO: 3739790 - DNA, 16 bp, Homo sapiens
acctcagttcccttgg

SEQ ID NO: 3739791 - DNA, 17 bp, Homo sapiens
acctcagttcccttggc

SEQ ID NO: 3739792 - DNA, 18 bp, Homo sapiens
acctcagttcccttggcc

SEQ ID NO: 3739793 - DNA, 18 bp, Homo sapiens
acctcagttttatcattt

SEQ ID NO: 3739794 - DNA, 21 bp, Homo sapiens
acctccaagcaagtagctttc

SEQ ID NO: 3739795 - DNA, 14 bp, Homo sapiens
acctcccacctttg

SEQ ID NO: 3739796 - DNA, 16 bp, Homo sapiens
acctcccacctttggt

SEQ ID NO: 3739797 - DNA, 14 bp, Homo sapiens
acctccccaggccg

SEQ ID NO: 3739798 - DNA, 13 bp, Homo sapiens
acctccccccact

SEQ ID NO: 3739799 - DNA, 16 bp, Homo sapiens
acctccccccactgca

SEQ ID NO: 3739800 - DNA, 17 bp, Homo sapiens
acctccccccactgcag

SEQ ID NO: 3739801 - DNA, 14 bp, Homo sapiens
acctccccctcctt

SEQ ID NO: 3739802 - DNA, 15 bp, Homo sapiens
acctccccctccttc

SEQ ID NO: 3739803 - DNA, 20 bp, Homo sapiens
acctcccctatccacccagc

SEQ ID NO: 3739804 - DNA, 21 bp, Homo sapiens
acctcccctatccacccagcc

SEQ ID NO: 3739805 - DNA, 20 bp, Homo sapiens
acctcccctccttgcctcct

SEQ ID NO: 3739806 - DNA, 21 bp, Homo sapiens
acctcccctccttgcctcctg

SEQ ID NO: 3739807 - DNA, 20 bp, Homo sapiens
acctccctgaaccatccctg

SEQ ID NO: 3739808 - DNA, 12 bp, Homo sapiens
acctcctgccca

SEQ ID NO: 3739809 - DNA, 17 bp, Homo sapiens
acctcctgcccaggaga

SEQ ID NO: 3739810 - DNA, 19 bp, Homo sapiens
acctcctttaccctcatct

SEQ ID NO: 3739811 - DNA, 21 bp, Homo sapiens
acctcgtcctccccctgccag

SEQ ID NO: 3739812 - DNA, 22 bp, Homo sapiens
acctcgtcctccccctgccagt

SEQ ID NO: 3739813 - DNA, 14 bp, Homo sapiens
acctctctttttca

SEQ ID NO: 3739814 - DNA, 15 bp, Homo sapiens
acctctgaagtctct

SEQ ID NO: 3739815 - DNA, 19 bp, Homo sapiens
aagtgggggcagagggcag

SEQ ID NO: 3739816 - DNA, 21 bp, Homo sapiens
aagtgtaacagctgaggtctc

SEQ ID NO: 3739817 - DNA, 12 bp, Homo sapiens
aagtgtaactgg

SEQ ID NO: 3739818 - DNA, 17 bp, Homo sapiens
aagtgtactaattaaca

SEQ ID NO: 3739819 - DNA, 17 bp, Homo sapiens
aagtgtattataacagt

SEQ ID NO: 3739820 - DNA, 19 bp, Homo sapiens
aagtgtattttataaaatt

SEQ ID NO: 3739821 - DNA, 20 bp, Homo sapiens
aagtgtattttataaaatta

SEQ ID NO: 3739822 - DNA, 19 bp, Homo sapiens
aagtgtctcagtccacctg

SEQ ID NO: 3739823 - DNA, 14 bp, Homo sapiens
aagtgtctgtgtgc

SEQ ID NO: 3739824 - DNA, 20 bp, Homo sapiens
aagtgtgagtaagagctggt

SEQ ID NO: 3739825 - DNA, 21 bp, Homo sapiens
aagtgtgagtaagagctggtg

SEQ ID NO: 3739826 - DNA, 18 bp, Homo sapiens
aagtgttgtaaatattta

SEQ ID NO: 3739827 - DNA, 20 bp, Homo sapiens
aagtgttgtaaatatttatg

SEQ ID NO: 3739828 - DNA, 22 bp, Homo sapiens
aagtgttgtaaatatttatgta

SEQ ID NO: 3739829 - DNA, 20 bp, Homo sapiens
aagttaaaaaaaataataaa

SEQ ID NO: 3739830 - DNA, 16 bp, Homo sapiens
aagttacttattctag

SEQ ID NO: 3739831 - DNA, 12 bp, Homo sapiens
aagttactttgt

SEQ ID NO: 3739832 - DNA, 19 bp, Homo sapiens
aagttactttgtcagaggc

SEQ ID NO: 3739833 - DNA, 14 bp, Homo sapiens
aagttagctcagga

SEQ ID NO: 3739834 - DNA, 19 bp, Homo sapiens
aagttataaatcaatgtca

SEQ ID NO: 3739835 - DNA, 14 bp, Homo sapiens
aagttattaatatt

SEQ ID NO: 3739836 - DNA, 14 bp, Homo sapiens
aagttattgacaaa

SEQ ID NO: 3739837 - DNA, 14 bp, Homo sapiens
aagttatttatttt

SEQ ID NO: 3739838 - DNA, 20 bp, Homo sapiens
aagttcataacagtgccatt

SEQ ID NO: 3739839 - DNA, 14 bp, Homo sapiens
aagttcatagggtc

SEQ ID NO: 3739840 - DNA, 14 bp, Homo sapiens
aagttcctctagtg

SEQ ID NO: 3739841 - DNA, 12 bp, Homo sapiens
aagttctattta

SEQ ID NO: 3739842 - DNA, 13 bp, Homo sapiens
aagttcttagata

SEQ ID NO: 3739843 - DNA, 21 bp, Homo sapiens
aagttgaatggcctgccttga

SEQ ID NO: 3739844 - DNA, 16 bp, Homo sapiens
aagttgcagtgagctg

SEQ ID NO: 3739845 - DNA, 17 bp, Homo sapiens
aagttgttaactaaatt

SEQ ID NO: 3739846 - DNA, 15 bp, Homo sapiens
aagtttatacagtac

SEQ ID NO: 3739847 - DNA, 14 bp, Homo sapiens
aagtttcagacagg

SEQ ID NO: 3739848 - DNA, 16 bp, Homo sapiens
aagtttcagttgattt

SEQ ID NO: 3739849 - DNA, 16 bp, Homo sapiens
aagtttgatttcatta

SEQ ID NO: 3739850 - DNA, 14 bp, Homo sapiens
aagtttgcactgta

SEQ ID NO: 3739851 - DNA, 13 bp, Homo sapiens
aataaaaatggat

SEQ ID NO: 3739852 - DNA, 19 bp, Homo sapiens
aataaaacattttcacaca

SEQ ID NO: 3739853 - DNA, 16 bp, Homo sapiens
aataaaacctttcaaa

SEQ ID NO: 3739854 - DNA, 21 bp, Homo sapiens
aataaaacctttcaaatttca

SEQ ID NO: 3739855 - DNA, 23 bp, Homo sapiens
aataaaacctttcaaatttcaca

SEQ ID NO: 3739856 - DNA, 21 bp, Homo sapiens
aataaaagcagcatctgctaa

SEQ ID NO: 3739857 - DNA, 13 bp, Homo sapiens
aataaaaggtcta

SEQ ID NO: 3739858 - DNA, 14 bp, Homo sapiens
aataaaatataatt

SEQ ID NO: 3739859 - DNA, 18 bp, Homo sapiens
aataaaatcatgtacatt

SEQ ID NO: 3739860 - DNA, 12 bp, Homo sapiens
aataaaattaag

SEQ ID NO: 3739861 - DNA, 14 bp, Homo sapiens
aataaaattaagaa

SEQ ID NO: 3739862 - DNA, 18 bp, Homo sapiens
aataaagccttcaaactc

SEQ ID NO: 3739863 - DNA, 9 bp, Homo sapiens
aataaagta

SEQ ID NO: 3739864 - DNA, 14 bp, Homo sapiens
aataaagtatataa

SEQ ID NO: 3739865 - DNA, 15 bp, Homo sapiens
aataaagtatatata

SEQ ID NO: 3739866 - DNA, 15 bp, Homo sapiens
aataaagtatctaca

SEQ ID NO: 3739867 - DNA, 15 bp, Homo sapiens
aataaagtattccac

SEQ ID NO: 3739868 - DNA, 18 bp, Homo sapiens
aataaagtgttttcagag

SEQ ID NO: 3739869 - DNA, 21 bp, Homo sapiens
aataaatagctatatccatgt

SEQ ID NO: 3739870 - DNA, 15 bp, Homo sapiens
aataaatatctgtac

SEQ ID NO: 3739871 - DNA, 16 bp, Homo sapiens
aataaatcataaaact

SEQ ID NO: 3739872 - DNA, 17 bp, Homo sapiens
aataaatgtcattaaaa

SEQ ID NO: 3739873 - DNA, 12 bp, Homo sapiens
aataaattattt

SEQ ID NO: 3739874 - DNA, 14 bp, Homo sapiens
aataaattcagata

SEQ ID NO: 3739875 - DNA, 16 bp, Homo sapiens
aataaattgctccttg

SEQ ID NO: 3739876 - DNA, 13 bp, Homo sapiens
aataacaatgtgc

SEQ ID NO: 3739877 - DNA, 23 bp, Homo sapiens
aataaccaacccttccctgaaaa

SEQ ID NO: 3739878 - DNA, 21 bp, Homo sapiens
aataaccacttaaaaaatgtc

SEQ ID NO: 3739879 - DNA, 22 bp, Homo sapiens
aataaccacttaaaaaatgtcc

SEQ ID NO: 3739880 - DNA, 15 bp, Homo sapiens
aataactactgtgtt

SEQ ID NO: 3739881 - DNA, 18 bp, Homo sapiens
aataactactgtgttcct

SEQ ID NO: 3739882 - DNA, 19 bp, Homo sapiens
aataactcctcattgtaaa

SEQ ID NO: 3739883 - DNA, 13 bp, Homo sapiens
aataagctaaaga

SEQ ID NO: 3739884 - DNA, 14 bp, Homo sapiens
aataagctaaagag

SEQ ID NO: 3739885 - DNA, 18 bp, Homo sapiens
aataataaagatgctctt

SEQ ID NO: 3739886 - DNA, 19 bp, Homo sapiens
aataataaagatgctcttt

SEQ ID NO: 3739887 - DNA, 21 bp, Homo sapiens
aataataaattgcatgctgct

SEQ ID NO: 3739888 - DNA, 21 bp, Homo sapiens
aataataattatccagagttt

SEQ ID NO: 3739889 - DNA, 17 bp, Homo sapiens
aataatatgcattgtca

SEQ ID NO: 3739890 - DNA, 16 bp, Homo sapiens
aataatcggcccacag

SEQ ID NO: 3739891 - DNA, 19 bp, Homo sapiens
aataatgtacatctggcct

SEQ ID NO: 3739892 - DNA, 20 bp, Homo sapiens
aataatgtcttgttaatatt

SEQ ID NO: 3739893 - DNA, 23 bp, Homo sapiens
aataatgtcttgttaatattctt

SEQ ID NO: 3739894 - DNA, 22 bp, Homo sapiens
aataattttatgaactgcatgt

SEQ ID NO: 3739895 - DNA, 22 bp, Homo sapiens
aataatttttcacttcaaaaca

SEQ ID NO: 3739896 - DNA, 11 bp, Homo sapiens
aatacaaacaa

SEQ ID NO: 3739897 - DNA, 17 bp, Homo sapiens
aatacaaacatatttgt

SEQ ID NO: 3739898 - DNA, 11 bp, Homo sapiens
aatacaataaa

SEQ ID NO: 3739899 - DNA, 13 bp, Homo sapiens
aatacaataaact

SEQ ID NO: 3739900 - DNA, 14 bp, Homo sapiens
aatacaataagtta

SEQ ID NO: 3739901 - DNA, 21 bp, Homo sapiens
aatacaccaggtagaacacaa

SEQ ID NO: 3739902 - DNA, 16 bp, Homo sapiens
aatacacgaggtatga

SEQ ID NO: 3739903 - DNA, 13 bp, Homo sapiens
aatacagaggcaa

SEQ ID NO: 3739904 - DNA, 16 bp, Homo sapiens
aatacagggcatgcat

SEQ ID NO: 3739905 - DNA, 17 bp, Homo sapiens
aatacagtacaggcagc

SEQ ID NO: 3739906 - DNA, 20 bp, Homo sapiens
aatacagtatctcagggcct

SEQ ID NO: 3739907 - DNA, 15 bp, Homo sapiens
aatacagtattctgt

SEQ ID NO: 3739908 - DNA, 12 bp, Homo sapiens
aatacagtgtta

SEQ ID NO: 3739909 - DNA, 14 bp, Homo sapiens
aatacattaaagca

SEQ ID NO: 3739910 - DNA, 12 bp, Homo sapiens
aatacattcttg

SEQ ID NO: 3739911 - DNA, 13 bp, Homo sapiens
aatactagccaga

SEQ ID NO: 3739912 - DNA, 13 bp, Homo sapiens
aatacttattcat

SEQ ID NO: 3739913 - DNA, 21 bp, Homo sapiens
aatagaaactcaccatgtaaa

SEQ ID NO: 3739914 - DNA, 20 bp, Homo sapiens
aatagaaggatgtacatttc

SEQ ID NO: 3739915 - DNA, 15 bp, Homo sapiens
aatagacagtatatt

SEQ ID NO: 3739916 - DNA, 16 bp, Homo sapiens
aatagatgctgactgt

SEQ ID NO: 3739917 - DNA, 12 bp, Homo sapiens
aatagcatgtca

SEQ ID NO: 3739918 - DNA, 15 bp, Homo sapiens
aatagcatgtcacta

SEQ ID NO: 3739919 - DNA, 20 bp, Homo sapiens
aatagccacttaccttcaat

SEQ ID NO: 3739920 - DNA, 22 bp, Homo sapiens
aatagccacttaccttcaataa

SEQ ID NO: 3739921 - DNA, 20 bp, Homo sapiens
aatagcctgcctcttctcta

SEQ ID NO: 3739922 - DNA, 15 bp, Homo sapiens
aatagctatatccat

SEQ ID NO: 3739923 - DNA, 23 bp, Homo sapiens
aatagctatatccatgtactgta

SEQ ID NO: 3739924 - DNA, 20 bp, Homo sapiens
aatagctcccagatttcagt

SEQ ID NO: 3739925 - DNA, 13 bp, Homo sapiens
aataggcaaaggg

SEQ ID NO: 3739926 - DNA, 18 bp, Homo sapiens
aatagtatttatgaaatg

SEQ ID NO: 3739927 - DNA, 15 bp, Homo sapiens
aatagtctatatttt

SEQ ID NO: 3739928 - DNA, 22 bp, Homo sapiens
aatagtgtgttctgattagaaa

SEQ ID NO: 3739929 - DNA, 21 bp, Homo sapiens
aatagttcaggtaacaggcag

SEQ ID NO: 3739930 - DNA, 14 bp, Homo sapiens
aatagttgttgatt

SEQ ID NO: 3739931 - DNA, 19 bp, Homo sapiens
acagtattacttctgctac

SEQ ID NO: 3739932 - DNA, 14 bp, Homo sapiens
acagtattttccca

SEQ ID NO: 3739933 - DNA, 16 bp, Homo sapiens
acagtcaaaacagaga

SEQ ID NO: 3739934 - DNA, 23 bp, Homo sapiens
acagtcctgggagaacctcaggc

SEQ ID NO: 3739935 - DNA, 17 bp, Homo sapiens
acagtgaaggctgtcct

SEQ ID NO: 3739936 - DNA, 18 bp, Homo sapiens
acagtgagcctgaatttt

SEQ ID NO: 3739937 - DNA, 19 bp, Homo sapiens
acagtgaggtcctgggggc

SEQ ID NO: 3739938 - DNA, 20 bp, Homo sapiens
acagtgaggtcctgggggcc

SEQ ID NO: 3739939 - DNA, 14 bp, Homo sapiens
acagtgatctccat

SEQ ID NO: 3739940 - DNA, 24 bp, Homo sapiens
acagtgatgctgtgctatgaattt

SEQ ID NO: 3739941 - DNA, 22 bp, Homo sapiens
acagtgatttttttttagaaca

SEQ ID NO: 3739942 - DNA, 23 bp, Homo sapiens
acagtgatttttttttagaacag

SEQ ID NO: 3739943 - DNA, 16 bp, Homo sapiens
acagtgccattgtctt

SEQ ID NO: 3739944 - DNA, 18 bp, Homo sapiens
acagtgcctgggaatgta

SEQ ID NO: 3739945 - DNA, 20 bp, Homo sapiens
acagtgcctgggaatgtatt

SEQ ID NO: 3739946 - DNA, 14 bp, Homo sapiens
acagtgcttcagcc

SEQ ID NO: 3739947 - DNA, 17 bp, Homo sapiens
acagtggattgcatttc

SEQ ID NO: 3739948 - DNA, 17 bp, Homo sapiens
acagtgggagccagggc

SEQ ID NO: 3739949 - DNA, 24 bp, Homo sapiens
acagtgtctgtatcggagacagtg

SEQ ID NO: 3739950 - DNA, 19 bp, Homo sapiens
acagtgttgaaaatgttca

SEQ ID NO: 3739951 - DNA, 22 bp, Homo sapiens
acagtgtttcccataattttct

SEQ ID NO: 3739952 - DNA, 19 bp, Homo sapiens
acagtgtttcgacagctga

SEQ ID NO: 3739953 - DNA, 21 bp, Homo sapiens
acagttaaatgagaacatgaa

SEQ ID NO: 3739954 - DNA, 13 bp, Homo sapiens
acagttaactttc

SEQ ID NO: 3739955 - DNA, 15 bp, Homo sapiens
acagttcatatgtac

SEQ ID NO: 3739956 - DNA, 13 bp, Homo sapiens
acagttccttcag

SEQ ID NO: 3739957 - DNA, 16 bp, Homo sapiens
acagttgaaaaacagc

SEQ ID NO: 3739958 - DNA, 22 bp, Homo sapiens
acagttgctgtcataagaatga

SEQ ID NO: 3739959 - DNA, 14 bp, Homo sapiens
acagtttcttccat

SEQ ID NO: 3739960 - DNA, 13 bp, Homo sapiens
acagttttaaaga

SEQ ID NO: 3739961 - DNA, 19 bp, Homo sapiens
acagttttccatgaaaacg

SEQ ID NO: 3739962 - DNA, 23 bp, Homo sapiens
acagttttccatgaaaacgtttt

SEQ ID NO: 3739963 - DNA, 13 bp, Homo sapiens
acataaaaagtta

SEQ ID NO: 3739964 - DNA, 22 bp, Homo sapiens
acataaaggttattttctcctg

SEQ ID NO: 3739965 - DNA, 23 bp, Homo sapiens
acataaataaattaaataaaata

SEQ ID NO: 3739966 - DNA, 17 bp, Homo sapiens
acataacaaaatcactt

SEQ ID NO: 3739967 - DNA, 15 bp, Homo sapiens
acataacagaatgca

SEQ ID NO: 3739968 - DNA, 15 bp, Homo sapiens
acataagataaatgt

SEQ ID NO: 3739969 - DNA, 16 bp, Homo sapiens
acatacaattccaaac

SEQ ID NO: 3739970 - DNA, 15 bp, Homo sapiens
acataccagcttaga

SEQ ID NO: 3739971 - DNA, 14 bp, Homo sapiens
acatactctgctta

SEQ ID NO: 3739972 - DNA, 15 bp, Homo sapiens
acatagatgtccctt

SEQ ID NO: 3739973 - DNA, 17 bp, Homo sapiens
acatagattcacctgta

SEQ ID NO: 3739974 - DNA, 20 bp, Homo sapiens
acatagattcacctgtaaaa

SEQ ID NO: 3739975 - DNA, 22 bp, Homo sapiens
acatagcttgataaagggccaa

SEQ ID NO: 3739976 - DNA, 16 bp, Homo sapiens
acatagtgaaagttta

SEQ ID NO: 3739977 - DNA, 16 bp, Homo sapiens
acatagtgatggttcc

SEQ ID NO: 3739978 - DNA, 15 bp, Homo sapiens
acatatgaaatttaa

SEQ ID NO: 3739979 - DNA, 20 bp, Homo sapiens
acatatgctttaagaatcga

SEQ ID NO: 3739980 - DNA, 13 bp, Homo sapiens
acatatgtaaaat

SEQ ID NO: 3739981 - DNA, 12 bp, Homo sapiens
acatattcattt

SEQ ID NO: 3739982 - DNA, 20 bp, Homo sapiens
acatatttgttaaatattta

SEQ ID NO: 3739983 - DNA, 18 bp, Homo sapiens
acatcaagcacagaagga

SEQ ID NO: 3739984 - DNA, 13 bp, Homo sapiens
acatcaatgttca

SEQ ID NO: 3739985 - DNA, 14 bp, Homo sapiens
acatcaatgttcat

SEQ ID NO: 3739986 - DNA, 20 bp, Homo sapiens
acatcaatgttcattgtaat

SEQ ID NO: 3739987 - DNA, 13 bp, Homo sapiens
acatcacaggaca

SEQ ID NO: 3739988 - DNA, 15 bp, Homo sapiens
acatcacttgtacaa

SEQ ID NO: 3739989 - DNA, 16 bp, Homo sapiens
acatcagacctgtctt

SEQ ID NO: 3739990 - DNA, 20 bp, Homo sapiens
acatcagacctgtcttccaa

SEQ ID NO: 3739991 - DNA, 20 bp, Homo sapiens
acatcagttactctgaaggg

SEQ ID NO: 3739992 - DNA, 22 bp, Homo sapiens
acatccaaggagaaacagagac

SEQ ID NO: 3739993 - DNA, 13 bp, Homo sapiens
acatcccagcctg

SEQ ID NO: 3739994 - DNA, 14 bp, Homo sapiens
acatcccagcctgt

SEQ ID NO: 3739995 - DNA, 16 bp, Homo sapiens
acatcccattgccctg

SEQ ID NO: 3739996 - DNA, 17 bp, Homo sapiens
acatccccgctggctgg

SEQ ID NO: 3739997 - DNA, 19 bp, Homo sapiens
acatccccgctggctgggg

SEQ ID NO: 3739998 - DNA, 16 bp, Homo sapiens
acatccggaggagaag

SEQ ID NO: 3739999 - DNA, 16 bp, Homo sapiens
acatcctgtgtttcta

SEQ ID NO: 3740000 - DNA, 15 bp, Homo sapiens
acatccttgtggcac

SEQ ID NO: 3740001 - DNA, 14 bp, Homo sapiens
acatcgccctccac

SEQ ID NO: 3740002 - DNA, 16 bp, Homo sapiens
acatctcatccatcaa

SEQ ID NO: 3740003 - DNA, 13 bp, Homo sapiens
acatctgaaagcc

SEQ ID NO: 3740004 - DNA, 22 bp, Homo sapiens
acatctggaaaataaaaggtct

SEQ ID NO: 3740005 - DNA, 14 bp, Homo sapiens
acatcttagtattt

SEQ ID NO: 3740006 - DNA, 23 bp, Homo sapiens
acatcttccctagagggttcctg

SEQ ID NO: 3740007 - DNA, 13 bp, Homo sapiens
acatcttgctctg

SEQ ID NO: 3740008 - DNA, 14 bp, Homo sapiens
acatcttgctctgc

SEQ ID NO: 3740009 - DNA, 15 bp, Homo sapiens
acatcttgctctgct

SEQ ID NO: 3740010 - DNA, 16 bp, Homo sapiens
acatcttgctctgctg

SEQ ID NO: 3740011 - DNA, 18 bp, Homo sapiens
acatcttgctctgctgac

SEQ ID NO: 3740012 - DNA, 13 bp, Homo sapiens
acatcttggcagg

SEQ ID NO: 3740013 - DNA, 12 bp, Homo sapiens
acatctttcaca

SEQ ID NO: 3740014 - DNA, 15 bp, Homo sapiens
acatctttcacactt

SEQ ID NO: 3740015 - DNA, 13 bp, Homo sapiens
acatgaagaagct

SEQ ID NO: 3740016 - DNA, 16 bp, Homo sapiens
acatgaagaagctaaa

SEQ ID NO: 3740017 - DNA, 15 bp, Homo sapiens
acatgaatgcacact

SEQ ID NO: 3740018 - DNA, 14 bp, Homo sapiens
acatgacactgaaa

SEQ ID NO: 3740019 - DNA, 17 bp, Homo sapiens
acatgacactgaaatgc

SEQ ID NO: 3740020 - DNA, 13 bp, Homo sapiens
acatgagaacaga

SEQ ID NO: 3740021 - DNA, 15 bp, Homo sapiens
acatgatcttcttta

SEQ ID NO: 3740022 - DNA, 15 bp, Homo sapiens
acatgcctgccccaa

SEQ ID NO: 3740023 - DNA, 22 bp, Homo sapiens
acatgcctgccccaaacaaata

SEQ ID NO: 3740024 - DNA, 14 bp, Homo sapiens
acatgcgggctggg

SEQ ID NO: 3740025 - DNA, 20 bp, Homo sapiens
acatgcttcatgaaaatcct

SEQ ID NO: 3740026 - DNA, 14 bp, Homo sapiens
acatggaagggaag

SEQ ID NO: 3740027 - DNA, 18 bp, Homo sapiens
acatggaataacatgtaa

SEQ ID NO: 3740028 - DNA, 16 bp, Homo sapiens
acatggacccggagct

SEQ ID NO: 3740029 - DNA, 19 bp, Homo sapiens
acatggacccggagctaac

SEQ ID NO: 3740030 - DNA, 15 bp, Homo sapiens
acatggccagtgtga

SEQ ID NO: 3740031 - DNA, 13 bp, Homo sapiens
acatgggagttta

SEQ ID NO: 3740032 - DNA, 16 bp, Homo sapiens
acatgggtagcttctg

SEQ ID NO: 3740033 - DNA, 21 bp, Homo sapiens
acatggtaaacgctgtcccta

SEQ ID NO: 3740034 - DNA, 21 bp, Homo sapiens
acatggtgaaacctcatctct

SEQ ID NO: 3740035 - DNA, 19 bp, Homo sapiens
acatgtaattaagtactat

SEQ ID NO: 3740036 - DNA, 22 bp, Homo sapiens
acatgtaattaagtactatgta

SEQ ID NO: 3740037 - DNA, 23 bp, Homo sapiens
acatgtaattaagtactatgtat

SEQ ID NO: 3740038 - DNA, 14 bp, Homo sapiens
acatgtataatatt

SEQ ID NO: 3740039 - DNA, 19 bp, Homo sapiens
acatgtataatatttttaa

SEQ ID NO: 3740040 - DNA, 13 bp, Homo sapiens
acatgtgtcaagc

SEQ ID NO: 3740041 - DNA, 20 bp, Homo sapiens
acatgtgtcaagctgcttgg

SEQ ID NO: 3740042 - DNA, 22 bp, Homo sapiens
acattaaaacaatattgtttct

SEQ ID NO: 3740043 - DNA, 16 bp, Homo sapiens
acattaacagttttcc

SEQ ID NO: 3740044 - DNA, 22 bp, Homo sapiens
acattaacagttttccatgaaa

SEQ ID NO: 3740045 - DNA, 19 bp, Homo sapiens
acattaagcatcacaaatg

SEQ ID NO: 3740046 - DNA, 14 bp, Homo sapiens
aagcctctggctag

SEQ ID NO: 3740047 - DNA, 15 bp, Homo sapiens
aagcctgaggctggg

SEQ ID NO: 3740048 - DNA, 21 bp, Homo sapiens
aagcctgcctaggaattccca

SEQ ID NO: 3740049 - DNA, 17 bp, Homo sapiens
aagcctgtaatcccagc

SEQ ID NO: 3740050 - DNA, 16 bp, Homo sapiens
aagccttcattgcctt

SEQ ID NO: 3740051 - DNA, 15 bp, Homo sapiens
aagcctttccataag

SEQ ID NO: 3740052 - DNA, 20 bp, Homo sapiens
aagcgatgaatttggagact

SEQ ID NO: 3740053 - DNA, 21 bp, Homo sapiens
aagcgatgaatttggagactc

SEQ ID NO: 3740054 - DNA, 15 bp, Homo sapiens
aagcgattcttctgc

SEQ ID NO: 3740055 - DNA, 22 bp, Homo sapiens
aagcgctagaggaagcagccaa

SEQ ID NO: 3740056 - DNA, 13 bp, Homo sapiens
aagcggggggagg

SEQ ID NO: 3740057 - DNA, 21 bp, Homo sapiens
aagctaaatcctttactgtta

SEQ ID NO: 3740058 - DNA, 17 bp, Homo sapiens
aagctaataaaatatca

SEQ ID NO: 3740059 - DNA, 20 bp, Homo sapiens
aagctaataaaatatcattc

SEQ ID NO: 3740060 - DNA, 15 bp, Homo sapiens
aagctaattatttta

SEQ ID NO: 3740061 - DNA, 16 bp, Homo sapiens
aagctaattattttaa

SEQ ID NO: 3740062 - DNA, 17 bp, Homo sapiens
aagctaattattttaat

SEQ ID NO: 3740063 - DNA, 19 bp, Homo sapiens
aagctacctcaaacttcca

SEQ ID NO: 3740064 - DNA, 14 bp, Homo sapiens
aagctagagatatg

SEQ ID NO: 3740065 - DNA, 14 bp, Homo sapiens
aagctaggaatgaa

SEQ ID NO: 3740066 - DNA, 16 bp, Homo sapiens
aagctaggcctggcca

SEQ ID NO: 3740067 - DNA, 22 bp, Homo sapiens
aagctaggcctggccagatgca

SEQ ID NO: 3740068 - DNA, 15 bp, Homo sapiens
aagctaggtgctaat

SEQ ID NO: 3740069 - DNA, 22 bp, Homo sapiens
aagctattcagtaataactcta

SEQ ID NO: 3740070 - DNA, 19 bp, Homo sapiens
aagctcacagttcctcgcc

SEQ ID NO: 3740071 - DNA, 20 bp, Homo sapiens
aagctcacagttcctcgccc

SEQ ID NO: 3740072 - DNA, 22 bp, Homo sapiens
aagctcacagttcctcgccctg

SEQ ID NO: 3740073 - DNA, 14 bp, Homo sapiens
aagctcagcccacc

SEQ ID NO: 3740074 - DNA, 16 bp, Homo sapiens
aagctcagcccacccc

SEQ ID NO: 3740075 - DNA, 21 bp, Homo sapiens
aagctccagtcctgctctcta

SEQ ID NO: 3740076 - DNA, 20 bp, Homo sapiens
aagctccatctccactccag

SEQ ID NO: 3740077 - DNA, 16 bp, Homo sapiens
aagctctgaagtcaca

SEQ ID NO: 3740078 - DNA, 20 bp, Homo sapiens
aagctctggtgacaccagcc

SEQ ID NO: 3740079 - DNA, 21 bp, Homo sapiens
aagctctggtgacaccagcct

SEQ ID NO: 3740080 - DNA, 13 bp, Homo sapiens
aagctgaatacat

SEQ ID NO: 3740081 - DNA, 23 bp, Homo sapiens
aagctgaatacattctgctttca

SEQ ID NO: 3740082 - DNA, 16 bp, Homo sapiens
aagctgattactgtca

SEQ ID NO: 3740083 - DNA, 19 bp, Homo sapiens
aagctgattactgtcaata

SEQ ID NO: 3740084 - DNA, 17 bp, Homo sapiens
aagctgcctccctgtcc

SEQ ID NO: 3740085 - DNA, 14 bp, Homo sapiens
aagctgcctgtagt

SEQ ID NO: 3740086 - DNA, 22 bp, Homo sapiens
aagctgcctgtagttaggaaat

SEQ ID NO: 3740087 - DNA, 23 bp, Homo sapiens
aagctgcttggacctcgtgcttt

SEQ ID NO: 3740088 - DNA, 14 bp, Homo sapiens
aagctgcttttgac

SEQ ID NO: 3740089 - DNA, 18 bp, Homo sapiens
aagctggtcccactcagt

SEQ ID NO: 3740090 - DNA, 23 bp, Homo sapiens
aagctgtttccatagggtgacac

SEQ ID NO: 3740091 - DNA, 15 bp, Homo sapiens
aagcttattaatgct

SEQ ID NO: 3740092 - DNA, 19 bp, Homo sapiens
aagcttattaatgctaagg

SEQ ID NO: 3740093 - DNA, 20 bp, Homo sapiens
aagcttattaatgctaaggg

SEQ ID NO: 3740094 - DNA, 16 bp, Homo sapiens
aagcttccaggaaaaa

SEQ ID NO: 3740095 - DNA, 22 bp, Homo sapiens
aagcttcgaggcccagcgacct

SEQ ID NO: 3740096 - DNA, 22 bp, Homo sapiens
aagcttcttaaatgagaaggaa

SEQ ID NO: 3740097 - DNA, 11 bp, Homo sapiens
aagctttctct

SEQ ID NO: 3740098 - DNA, 17 bp, Homo sapiens
aagctttctctgcttca

SEQ ID NO: 3740099 - DNA, 23 bp, Homo sapiens
aagctttctctgcttcagcttgc

SEQ ID NO: 3740100 - DNA, 23 bp, Homo sapiens
aagctttgcttatggtaataaaa

SEQ ID NO: 3740101 - DNA, 12 bp, Homo sapiens
aagcttttatga

SEQ ID NO: 3740102 - DNA, 16 bp, Homo sapiens
aaggaaagcaataaat

SEQ ID NO: 3740103 - DNA, 22 bp, Homo sapiens
aaggaaataaaaaagtctctat

SEQ ID NO: 3740104 - DNA, 12 bp, Homo sapiens
aaggaagaaaaa

SEQ ID NO: 3740105 - DNA, 13 bp, Homo sapiens
aaggaagaaaaat

SEQ ID NO: 3740106 - DNA, 15 bp, Homo sapiens
aaggaagaaaaatca

SEQ ID NO: 3740107 - DNA, 22 bp, Homo sapiens
aaggaaggagactcacctctgc

SEQ ID NO: 3740108 - DNA, 14 bp, Homo sapiens
aaggaagtgaagag

SEQ ID NO: 3740109 - DNA, 17 bp, Homo sapiens
aaggaatgcttggaata

SEQ ID NO: 3740110 - DNA, 21 bp, Homo sapiens
aaggaatgtagctggtttcct

SEQ ID NO: 3740111 - DNA, 16 bp, Homo sapiens
aaggaatgtctttggt

SEQ ID NO: 3740112 - DNA, 20 bp, Homo sapiens
aaggaattctaggcatccca

SEQ ID NO: 3740113 - DNA, 15 bp, Homo sapiens
aaggacaggcagaaa

SEQ ID NO: 3740114 - DNA, 19 bp, Homo sapiens
aaggaccaacaagggcagt

SEQ ID NO: 3740115 - DNA, 15 bp, Homo sapiens
aaggacccctcacct

SEQ ID NO: 3740116 - DNA, 20 bp, Homo sapiens
aaggacccctcaccttgcaa

SEQ ID NO: 3740117 - DNA, 16 bp, Homo sapiens
aaggacctatgtttgc

SEQ ID NO: 3740118 - DNA, 13 bp, Homo sapiens
aaggacctcctga

SEQ ID NO: 3740119 - DNA, 21 bp, Homo sapiens
aaggacggccttcaactgaaa

SEQ ID NO: 3740120 - DNA, 22 bp, Homo sapiens
aaggactgccgaccgaggctgg

SEQ ID NO: 3740121 - DNA, 15 bp, Homo sapiens
aaggagaaggaagga

SEQ ID NO: 3740122 - DNA, 18 bp, Homo sapiens
aaggagagaaggggagga

SEQ ID NO: 3740123 - DNA, 14 bp, Homo sapiens
aaggagagcctgct

SEQ ID NO: 3740124 - DNA, 15 bp, Homo sapiens
aaggagatgtaagag

SEQ ID NO: 3740125 - DNA, 18 bp, Homo sapiens
aaggaggaagagaaaaaa

SEQ ID NO: 3740126 - DNA, 16 bp, Homo sapiens
aaggaggaaggagcct

SEQ ID NO: 3740127 - DNA, 12 bp, Homo sapiens
aaggatctttca

SEQ ID NO: 3740128 - DNA, 22 bp, Homo sapiens
aaggatctttcacccacagaaa

SEQ ID NO: 3740129 - DNA, 23 bp, Homo sapiens
aaggatgtaaacagtgcctgctg

SEQ ID NO: 3740130 - DNA, 16 bp, Homo sapiens
aaggatgtacatttcc

SEQ ID NO: 3740131 - DNA, 15 bp, Homo sapiens
aaggcacaatatggg

SEQ ID NO: 3740132 - DNA, 16 bp, Homo sapiens
aaggcaggaatgtgtg

SEQ ID NO: 3740133 - DNA, 19 bp, Homo sapiens
aaggcaggaatgtgtggca

SEQ ID NO: 3740134 - DNA, 20 bp, Homo sapiens
aaggcagggagcgagggaga

SEQ ID NO: 3740135 - DNA, 18 bp, Homo sapiens
aaggccaggggcttttgc

SEQ ID NO: 3740136 - DNA, 14 bp, Homo sapiens
aaggccccagagac

SEQ ID NO: 3740137 - DNA, 18 bp, Homo sapiens
aaggccgagaagcaagaa

SEQ ID NO: 3740138 - DNA, 18 bp, Homo sapiens
aaggcgggagcatctctt

SEQ ID NO: 3740139 - DNA, 15 bp, Homo sapiens
aaggctactcacctt

SEQ ID NO: 3740140 - DNA, 17 bp, Homo sapiens
aaggctcagtctcagga

SEQ ID NO: 3740141 - DNA, 18 bp, Homo sapiens
aaggctctgaaagccagc

SEQ ID NO: 3740142 - DNA, 17 bp, Homo sapiens
aaggctgaggaaaggcc

SEQ ID NO: 3740143 - DNA, 20 bp, Homo sapiens
aaggctgaggaaaggccagc

SEQ ID NO: 3740144 - DNA, 23 bp, Homo sapiens
aaggctgaggaaaggccagctgg

SEQ ID NO: 3740145 - DNA, 16 bp, Homo sapiens
aaggctggctgggcat

SEQ ID NO: 3740146 - DNA, 14 bp, Homo sapiens
aaggctgggggaag

SEQ ID NO: 3740147 - DNA, 19 bp, Homo sapiens
aaggcttcaatttattgca

SEQ ID NO: 3740148 - DNA, 16 bp, Homo sapiens
aaggctttcagggcct

SEQ ID NO: 3740149 - DNA, 16 bp, Homo sapiens
aagggaagatttatgt

SEQ ID NO: 3740150 - DNA, 23 bp, Homo sapiens
aagggaaggccccacagacaagg

SEQ ID NO: 3740151 - DNA, 20 bp, Homo sapiens
aagggacttggaagctccgc

SEQ ID NO: 3740152 - DNA, 20 bp, Homo sapiens
aagggatggaaaaggaagac

SEQ ID NO: 3740153 - DNA, 21 bp, Homo sapiens
aagggattttcagccctcaga

SEQ ID NO: 3740154 - DNA, 21 bp, Homo sapiens
aagggcaggaaggagagcctg

SEQ ID NO: 3740155 - DNA, 14 bp, Homo sapiens
aagggccagtcctg

SEQ ID NO: 3740156 - DNA, 16 bp, Homo sapiens
aagggccagtcctgcc

SEQ ID NO: 3740157 - DNA, 14 bp, Homo sapiens
aaggggaggcagcc

SEQ ID NO: 3740158 - DNA, 18 bp, Homo sapiens
aagggggcatctggcctt

SEQ ID NO: 3740159 - DNA, 13 bp, Homo sapiens
aaggggggagggg

SEQ ID NO: 3740160 - DNA, 16 bp, Homo sapiens
aaggggggagggggag

SEQ ID NO: 3740161 - DNA, 20 bp, Homo sapiens
aaggggttggttgaggtgga

SEQ ID NO: 3740162 - DNA, 14 bp, Homo sapiens
aaggggtttctaac

SEQ ID NO: 3740163 - DNA, 16 bp, Homo sapiens
aagggtatcaggtgct

SEQ ID NO: 3740164 - DNA, 16 bp, Homo sapiens
aagggtctagggagag

SEQ ID NO: 3740165 - DNA, 20 bp, Homo sapiens
aagggtctagggagagaccc

SEQ ID NO: 3740166 - DNA, 20 bp, Homo sapiens
aagggtttgtggctgggggc

SEQ ID NO: 3740167 - DNA, 17 bp, Homo sapiens
aaggtaaaattctaaat

SEQ ID NO: 3740168 - DNA, 20 bp, Homo sapiens
aaggtagaaatatctgaaaa

SEQ ID NO: 3740169 - DNA, 18 bp, Homo sapiens
aaggtattccttttgtgt

SEQ ID NO: 3740170 - DNA, 22 bp, Homo sapiens
aaggtattccttttgtgtacag

SEQ ID NO: 3740171 - DNA, 13 bp, Homo sapiens
aaggtcatcatcg

SEQ ID NO: 3740172 - DNA, 18 bp, Homo sapiens
aaggtcgtttttttcatt

SEQ ID NO: 3740173 - DNA, 12 bp, Homo sapiens
aaggtctctctt

SEQ ID NO: 3740174 - DNA, 16 bp, Homo sapiens
aaggtctctctttgga

SEQ ID NO: 3740175 - DNA, 21 bp, Homo sapiens
aaggtgctgttgtcattgctt

SEQ ID NO: 3740176 - DNA, 23 bp, Homo sapiens
aaggtgctgttgtcattgcttta

SEQ ID NO: 3740177 - DNA, 20 bp, Homo sapiens
aaggtggactggaaggggcc

SEQ ID NO: 3740178 - DNA, 14 bp, Homo sapiens
aaggtggagtggat

SEQ ID NO: 3740179 - DNA, 17 bp, Homo sapiens
aaggtgggccttgctac

SEQ ID NO: 3740180 - DNA, 16 bp, Homo sapiens
aaggtgggctgagccc

SEQ ID NO: 3740181 - DNA, 20 bp, Homo sapiens
aaggtgggctgagccctggc

SEQ ID NO: 3740182 - DNA, 20 bp, Homo sapiens
aaggtgggggttggctgggt

SEQ ID NO: 3740183 - DNA, 21 bp, Homo sapiens
aaggtggggtctttgtgagag

SEQ ID NO: 3740184 - DNA, 20 bp, Homo sapiens
aaggtgtctggacattcaga

SEQ ID NO: 3740185 - DNA, 16 bp, Homo sapiens
aaggttaataaagtaa

SEQ ID NO: 3740186 - DNA, 22 bp, Homo sapiens
aaggttccaatcagatctttat

SEQ ID NO: 3740187 - DNA, 23 bp, Homo sapiens
aaggtttcagaaagaagtgggga

SEQ ID NO: 3740188 - DNA, 16 bp, Homo sapiens
aaggtttctgaaaatt

SEQ ID NO: 3740189 - DNA, 12 bp, Homo sapiens
aagtaaaacttg

SEQ ID NO: 3740190 - DNA, 15 bp, Homo sapiens
aagtaaatagcaaca

SEQ ID NO: 3740191 - DNA, 17 bp, Homo sapiens
aagtaacaagagtgatt

SEQ ID NO: 3740192 - DNA, 22 bp, Homo sapiens
aagtaacttgtcttaaataaaa

SEQ ID NO: 3740193 - DNA, 18 bp, Homo sapiens
aagtaagaaagtgaagca

SEQ ID NO: 3740194 - DNA, 13 bp, Homo sapiens
aagtaagcaaaga

SEQ ID NO: 3740195 - DNA, 21 bp, Homo sapiens
aagtaagtaccactcaggcca

SEQ ID NO: 3740196 - DNA, 21 bp, Homo sapiens
aagtaatgaatttttatgata

SEQ ID NO: 3740197 - DNA, 23 bp, Homo sapiens
aagtaattatcgggaacagtgtt

SEQ ID NO: 3740198 - DNA, 22 bp, Homo sapiens
aagtaatttcttctcaaagggt

SEQ ID NO: 3740199 - DNA, 17 bp, Homo sapiens
aagtaccactcaggcca

SEQ ID NO: 3740200 - DNA, 19 bp, Homo sapiens
aagtactaagcgctagagg

SEQ ID NO: 3740201 - DNA, 19 bp, Homo sapiens
aagtacttctccaccctgc

SEQ ID NO: 3740202 - DNA, 23 bp, Homo sapiens
aagtacttctccaccctgctctc

SEQ ID NO: 3740203 - DNA, 19 bp, Homo sapiens
aagtagaagtcttagatgt

SEQ ID NO: 3740204 - DNA, 12 bp, Homo sapiens
aagtatactgta

SEQ ID NO: 3740205 - DNA, 11 bp, Homo sapiens
aagtatatata

SEQ ID NO: 3740206 - DNA, 13 bp, Homo sapiens
aagtatcagaaag

SEQ ID NO: 3740207 - DNA, 17 bp, Homo sapiens
aagtatctacatgcggt

SEQ ID NO: 3740208 - DNA, 17 bp, Homo sapiens
aagtatgagggaaaatg

SEQ ID NO: 3740209 - DNA, 21 bp, Homo sapiens
aagtatgagggaaaatgagta

SEQ ID NO: 3740210 - DNA, 14 bp, Homo sapiens
aagtattctgcctt

SEQ ID NO: 3740211 - DNA, 23 bp, Homo sapiens
aagtattcttatttaatgaaaga

SEQ ID NO: 3740212 - DNA, 12 bp, Homo sapiens
aagtatttatat

SEQ ID NO: 3740213 - DNA, 14 bp, Homo sapiens
aagtatttatatat

SEQ ID NO: 3740214 - DNA, 15 bp, Homo sapiens
aagtatttatatatt

SEQ ID NO: 3740215 - DNA, 18 bp, Homo sapiens
aagtatttatatatttat

SEQ ID NO: 3740216 - DNA, 22 bp, Homo sapiens
aagtcaaagtaaaacttgctgc

SEQ ID NO: 3740217 - DNA, 16 bp, Homo sapiens
aagtcaaccaatgtag

SEQ ID NO: 3740218 - DNA, 13 bp, Homo sapiens
aagtcacaaagga

SEQ ID NO: 3740219 - DNA, 15 bp, Homo sapiens
aagtcacaaaggaat

SEQ ID NO: 3740220 - DNA, 16 bp, Homo sapiens
aagtcacccggccccc

SEQ ID NO: 3740221 - DNA, 16 bp, Homo sapiens
aagtcactcaattgtt

SEQ ID NO: 3740222 - DNA, 14 bp, Homo sapiens
aagtcactgcacag

SEQ ID NO: 3740223 - DNA, 22 bp, Homo sapiens
aagtcactgcacagtgcatctc

SEQ ID NO: 3740224 - DNA, 17 bp, Homo sapiens
aagtcagactgctggga

SEQ ID NO: 3740225 - DNA, 20 bp, Homo sapiens
aagtcagactgctgggactg

SEQ ID NO: 3740226 - DNA, 21 bp, Homo sapiens
aagtcaggcccttattttcaa

SEQ ID NO: 3740227 - DNA, 11 bp, Homo sapiens
aagtcatgagc

SEQ ID NO: 3740228 - DNA, 22 bp, Homo sapiens
aagtcattttaactttatcaca

SEQ ID NO: 3740229 - DNA, 20 bp, Homo sapiens
aagtcccaccggttgcttct

SEQ ID NO: 3740230 - DNA, 14 bp, Homo sapiens
aagtccccaggccc

SEQ ID NO: 3740231 - DNA, 11 bp, Homo sapiens
aagtccctgcc

SEQ ID NO: 3740232 - DNA, 22 bp, Homo sapiens
aagtcctcttttctgagaggac

SEQ ID NO: 3740233 - DNA, 23 bp, Homo sapiens
aagtcctggctacatcccagcct

SEQ ID NO: 3740234 - DNA, 19 bp, Homo sapiens
aagtctaggagctgggagg

SEQ ID NO: 3740235 - DNA, 13 bp, Homo sapiens
aagtctccagccc

SEQ ID NO: 3740236 - DNA, 16 bp, Homo sapiens
aagtctccagcccacg

SEQ ID NO: 3740237 - DNA, 17 bp, Homo sapiens
aagtctctaggttctga

SEQ ID NO: 3740238 - DNA, 15 bp, Homo sapiens
aagtctctatttaaa

SEQ ID NO: 3740239 - DNA, 21 bp, Homo sapiens
aagtctctgctggcccagcca

SEQ ID NO: 3740240 - DNA, 11 bp, Homo sapiens
aagtctctgtg

SEQ ID NO: 3740241 - DNA, 22 bp, Homo sapiens
aagtctgtgcctggagctcctg

SEQ ID NO: 3740242 - DNA, 19 bp, Homo sapiens
aagtcttagatgtatatat

SEQ ID NO: 3740243 - DNA, 22 bp, Homo sapiens
aagtcttcaagggctgcttcaa

SEQ ID NO: 3740244 - DNA, 22 bp, Homo sapiens
aagtcttccctgatcaagtcac

SEQ ID NO: 3740245 - DNA, 17 bp, Homo sapiens
aagtcttgctgtggtct

SEQ ID NO: 3740246 - DNA, 23 bp, Homo sapiens
aagtcttgtgactagtgctgaag

SEQ ID NO: 3740247 - DNA, 16 bp, Homo sapiens
aagtgaaatcaaaggt

SEQ ID NO: 3740248 - DNA, 20 bp, Homo sapiens
aagtgaaatctgtgcaataa

SEQ ID NO: 3740249 - DNA, 21 bp, Homo sapiens
aagtgaaatctgtgcaataaa

SEQ ID NO: 3740250 - DNA, 16 bp, Homo sapiens
aagtgaataaaaatta

SEQ ID NO: 3740251 - DNA, 23 bp, Homo sapiens
aagtgaatttgaatgaaaaattt

SEQ ID NO: 3740252 - DNA, 14 bp, Homo sapiens
aagtgaatttttct

SEQ ID NO: 3740253 - DNA, 19 bp, Homo sapiens
aagtgaatttttctctaac

SEQ ID NO: 3740254 - DNA, 16 bp, Homo sapiens
aagtgacaaggcccca

SEQ ID NO: 3740255 - DNA, 17 bp, Homo sapiens
aagtgactgtatctgtg

SEQ ID NO: 3740256 - DNA, 17 bp, Homo sapiens
aagtgagagagacaaga

SEQ ID NO: 3740257 - DNA, 15 bp, Homo sapiens
aagtgagagctgggt

SEQ ID NO: 3740258 - DNA, 19 bp, Homo sapiens
aagtgagcaaacctgcccc

SEQ ID NO: 3740259 - DNA, 18 bp, Homo sapiens
aagtgagggtcagagagg

SEQ ID NO: 3740260 - DNA, 22 bp, Homo sapiens
aagtgatcaataaaatgtgatt

SEQ ID NO: 3740261 - DNA, 23 bp, Homo sapiens
aagtgatcaataaaatgtgattt

SEQ ID NO: 3740262 - DNA, 19 bp, Homo sapiens
aagtgatcctcccacctca

SEQ ID NO: 3740263 - DNA, 23 bp, Homo sapiens
aagtgatcctcccacctcagcct

SEQ ID NO: 3740264 - DNA, 16 bp, Homo sapiens
aagtgatgttgtttaa

SEQ ID NO: 3740265 - DNA, 21 bp, Homo sapiens
aagtgcaggctggcaccgcct

SEQ ID NO: 3740266 - DNA, 13 bp, Homo sapiens
aagtgcccctgct

SEQ ID NO: 3740267 - DNA, 22 bp, Homo sapiens
aagtgctgggattacaggtgtg

SEQ ID NO: 3740268 - DNA, 13 bp, Homo sapiens
aagtgctttcttc

SEQ ID NO: 3740269 - DNA, 21 bp, Homo sapiens
aagtggaaaaatagcctgcct

SEQ ID NO: 3740270 - DNA, 14 bp, Homo sapiens
aagtggaaggaaag

SEQ ID NO: 3740271 - DNA, 15 bp, Homo sapiens
aagtggaaggaaaga

SEQ ID NO: 3740272 - DNA, 17 bp, Homo sapiens
aagtggcatgtgctgtg

SEQ ID NO: 3740273 - DNA, 15 bp, Homo sapiens
aagtggggacagagc

SEQ ID NO: 3740274 - DNA, 17 bp, Homo sapiens
aatataaccaatgttta

SEQ ID NO: 3740275 - DNA, 13 bp, Homo sapiens
aatataactgcct

SEQ ID NO: 3740276 - DNA, 18 bp, Homo sapiens
aatataattttttagaga

SEQ ID NO: 3740277 - DNA, 19 bp, Homo sapiens
aatatacattcaaacttaa

SEQ ID NO: 3740278 - DNA, 13 bp, Homo sapiens
aatatagctattt

SEQ ID NO: 3740279 - DNA, 13 bp, Homo sapiens
aatatatattctg

SEQ ID NO: 3740280 - DNA, 14 bp, Homo sapiens
aatatatgtatgta

SEQ ID NO: 3740281 - DNA, 23 bp, Homo sapiens
aatatatgttttaaatatagaat

SEQ ID NO: 3740282 - DNA, 16 bp, Homo sapiens
aatatattataatctt

SEQ ID NO: 3740283 - DNA, 19 bp, Homo sapiens
aatatatttaagataatta

SEQ ID NO: 3740284 - DNA, 14 bp, Homo sapiens
aatatcaatcattt

SEQ ID NO: 3740285 - DNA, 22 bp, Homo sapiens
aatatcagttactcagccctgg

SEQ ID NO: 3740286 - DNA, 13 bp, Homo sapiens
aatatcattcagc

SEQ ID NO: 3740287 - DNA, 15 bp, Homo sapiens
aatatcattcagcaa

SEQ ID NO: 3740288 - DNA, 16 bp, Homo sapiens
aatatctgctgtatgt

SEQ ID NO: 3740289 - DNA, 18 bp, Homo sapiens
aatatgaatacagggcat

SEQ ID NO: 3740290 - DNA, 22 bp, Homo sapiens
aatatgacagctgtccctgtca

SEQ ID NO: 3740291 - DNA, 17 bp, Homo sapiens
aatatgatattgcatat

SEQ ID NO: 3740292 - DNA, 22 bp, Homo sapiens
aatatgattagtaaagaaatga

SEQ ID NO: 3740293 - DNA, 19 bp, Homo sapiens
aatatgctgccaaattttg

SEQ ID NO: 3740294 - DNA, 11 bp, Homo sapiens
aatatgtattt

SEQ ID NO: 3740295 - DNA, 12 bp, Homo sapiens
aatatgtatttt

SEQ ID NO: 3740296 - DNA, 20 bp, Homo sapiens
aatatgtattttatgtatgt

SEQ ID NO: 3740297 - DNA, 22 bp, Homo sapiens
aatatgttaacctcagtgtcat

SEQ ID NO: 3740298 - DNA, 15 bp, Homo sapiens
aatattatactaaga

SEQ ID NO: 3740299 - DNA, 22 bp, Homo sapiens
aatattatactaagaaaagata

SEQ ID NO: 3740300 - DNA, 19 bp, Homo sapiens
aatattatgcaaattccca

SEQ ID NO: 3740301 - DNA, 15 bp, Homo sapiens
aatattcctgaatga

SEQ ID NO: 3740302 - DNA, 15 bp, Homo sapiens
aatattcctgcattt

SEQ ID NO: 3740303 - DNA, 19 bp, Homo sapiens
aatattctttcaataacga

SEQ ID NO: 3740304 - DNA, 23 bp, Homo sapiens
aatattgtgaagaaaaataaagt

SEQ ID NO: 3740305 - DNA, 14 bp, Homo sapiens
aatattgttcctaa

SEQ ID NO: 3740306 - DNA, 24 bp, Homo sapiens
aatattgttcctaagttcttagat

SEQ ID NO: 3740307 - DNA, 17 bp, Homo sapiens
aatatttaaggagatgt

SEQ ID NO: 3740308 - DNA, 17 bp, Homo sapiens
aatatttataacagcat

SEQ ID NO: 3740309 - DNA, 18 bp, Homo sapiens
aatatttatatttcacta

SEQ ID NO: 3740310 - DNA, 12 bp, Homo sapiens
aatatttattac

SEQ ID NO: 3740311 - DNA, 16 bp, Homo sapiens
aatatttattacctct

SEQ ID NO: 3740312 - DNA, 12 bp, Homo sapiens
aatatttgctga

SEQ ID NO: 3740313 - DNA, 14 bp, Homo sapiens
aatatttgtacata

SEQ ID NO: 3740314 - DNA, 13 bp, Homo sapiens
aatattttattca

SEQ ID NO: 3740315 - DNA, 14 bp, Homo sapiens
aatattttattcaa

SEQ ID NO: 3740316 - DNA, 21 bp, Homo sapiens
aatattttccatgaaaatgca

SEQ ID NO: 3740317 - DNA, 13 bp, Homo sapiens
aatcaaaatatgt

SEQ ID NO: 3740318 - DNA, 16 bp, Homo sapiens
aatcaactgaaagtgt

SEQ ID NO: 3740319 - DNA, 17 bp, Homo sapiens
aatcaactgaaagtgtt

SEQ ID NO: 3740320 - DNA, 20 bp, Homo sapiens
aatcaactgaaagtgtttcc

SEQ ID NO: 3740321 - DNA, 15 bp, Homo sapiens
aatcaagataaagga

SEQ ID NO: 3740322 - DNA, 20 bp, Homo sapiens
aatcagaccctaccccacca

SEQ ID NO: 3740323 - DNA, 14 bp, Homo sapiens
aatcagaggagaga

SEQ ID NO: 3740324 - DNA, 19 bp, Homo sapiens
aatcagcattctcactcct

SEQ ID NO: 3740325 - DNA, 16 bp, Homo sapiens
aatcagcctcttaaag

SEQ ID NO: 3740326 - DNA, 19 bp, Homo sapiens
aatcagggaggtcattttg

SEQ ID NO: 3740327 - DNA, 19 bp, Homo sapiens
aatcatgtacatttctgaa

SEQ ID NO: 3740328 - DNA, 21 bp, Homo sapiens
aatcatgtgggtgagccagtg

SEQ ID NO: 3740329 - DNA, 17 bp, Homo sapiens
aatcattaagacaactg

SEQ ID NO: 3740330 - DNA, 20 bp, Homo sapiens
aatcattatttattaaattt

SEQ ID NO: 3740331 - DNA, 12 bp, Homo sapiens
aatcattgctta

SEQ ID NO: 3740332 - DNA, 21 bp, Homo sapiens
aatcatttcttgggccctcct

SEQ ID NO: 3740333 - DNA, 15 bp, Homo sapiens
aatcattttaattat

SEQ ID NO: 3740334 - DNA, 13 bp, Homo sapiens
aatccacacatca

SEQ ID NO: 3740335 - DNA, 18 bp, Homo sapiens
aatccagcggttctcaaa

SEQ ID NO: 3740336 - DNA, 18 bp, Homo sapiens
aatcccagctactcagga

SEQ ID NO: 3740337 - DNA, 17 bp, Homo sapiens
aatccctgggcattgct

SEQ ID NO: 3740338 - DNA, 17 bp, Homo sapiens
aatcctaagttaccttt

SEQ ID NO: 3740339 - DNA, 16 bp, Homo sapiens
aatcctaccaacctct

SEQ ID NO: 3740340 - DNA, 15 bp, Homo sapiens
aatcctcactgggtg

SEQ ID NO: 3740341 - DNA, 21 bp, Homo sapiens
aatcctggggaacatagaact

SEQ ID NO: 3740342 - DNA, 14 bp, Homo sapiens
aatcctgtgtggtt

SEQ ID NO: 3740343 - DNA, 21 bp, Homo sapiens
aatcctgtgtggtttagtgta

SEQ ID NO: 3740344 - DNA, 14 bp, Homo sapiens
aatcctgttgaaaa

SEQ ID NO: 3740345 - DNA, 18 bp, Homo sapiens
aatccttgcttatgacat

SEQ ID NO: 3740346 - DNA, 22 bp, Homo sapiens
aatcggcccacagctcccaccc

SEQ ID NO: 3740347 - DNA, 16 bp, Homo sapiens
aatctaacaatggaag

SEQ ID NO: 3740348 - DNA, 13 bp, Homo sapiens
aatctagaagaaa

SEQ ID NO: 3740349 - DNA, 16 bp, Homo sapiens
aatctagaagaaatga

SEQ ID NO: 3740350 - DNA, 17 bp, Homo sapiens
aatctattgggttcatt

SEQ ID NO: 3740351 - DNA, 16 bp, Homo sapiens
aatctatttattggac

SEQ ID NO: 3740352 - DNA, 23 bp, Homo sapiens
aatctatttattggacatgtcca

SEQ ID NO: 3740353 - DNA, 23 bp, Homo sapiens
aatctcagaggtagggctgccac

SEQ ID NO: 3740354 - DNA, 15 bp, Homo sapiens
aatctgaatgtaatt

SEQ ID NO: 3740355 - DNA, 18 bp, Homo sapiens
aatctgaatgtaatttgt

SEQ ID NO: 3740356 - DNA, 21 bp, Homo sapiens
aatctgatcgttctttctagc

SEQ ID NO: 3740357 - DNA, 17 bp, Homo sapiens
aatctgcatttagcaca

SEQ ID NO: 3740358 - DNA, 20 bp, Homo sapiens
aatctgcatttagcacaaaa

SEQ ID NO: 3740359 - DNA, 16 bp, Homo sapiens
aatctggactcctctg

SEQ ID NO: 3740360 - DNA, 20 bp, Homo sapiens
aatctgtccaaaggaggctg

SEQ ID NO: 3740361 - DNA, 13 bp, Homo sapiens
aatctgtgcaata

SEQ ID NO: 3740362 - DNA, 18 bp, Homo sapiens
aatctgtgtagacgaagg

SEQ ID NO: 3740363 - DNA, 16 bp, Homo sapiens
aatcttagctgccaag

SEQ ID NO: 3740364 - DNA, 19 bp, Homo sapiens
aatcttaggggagagcttt

SEQ ID NO: 3740365 - DNA, 18 bp, Homo sapiens
aatcttgctttctttgtt

SEQ ID NO: 3740366 - DNA, 14 bp, Homo sapiens
aatcttgtttccaa

SEQ ID NO: 3740367 - DNA, 17 bp, Homo sapiens
aatcttgtttctgaaaa

SEQ ID NO: 3740368 - DNA, 19 bp, Homo sapiens
aatcttgtttctgaaaaga

SEQ ID NO: 3740369 - DNA, 17 bp, Homo sapiens
aatgaaaaatttaagca

SEQ ID NO: 3740370 - DNA, 13 bp, Homo sapiens
aatgaaaatgtca

SEQ ID NO: 3740371 - DNA, 20 bp, Homo sapiens
aatgaaaatgtcagaaacca

SEQ ID NO: 3740372 - DNA, 18 bp, Homo sapiens
aatgaaagactgtacaaa

SEQ ID NO: 3740373 - DNA, 17 bp, Homo sapiens
aatgaaagcatgtctca

SEQ ID NO: 3740374 - DNA, 19 bp, Homo sapiens
aatgaaagtataactgagt

SEQ ID NO: 3740375 - DNA, 20 bp, Homo sapiens
aatgaaagtcttgtgactag

SEQ ID NO: 3740376 - DNA, 21 bp, Homo sapiens
aatgaaagtcttgtgactagt

SEQ ID NO: 3740377 - DNA, 21 bp, Homo sapiens
aatgaaataatgtacatctgg

SEQ ID NO: 3740378 - DNA, 13 bp, Homo sapiens
aatgaaatgtttt

SEQ ID NO: 3740379 - DNA, 14 bp, Homo sapiens
aatgaaatgtttta

SEQ ID NO: 3740380 - DNA, 23 bp, Homo sapiens
aatgaaattactacaaaatttga

SEQ ID NO: 3740381 - DNA, 16 bp, Homo sapiens
aatgaaccacatcttg

SEQ ID NO: 3740382 - DNA, 23 bp, Homo sapiens
aatgaaggaaataaaaaagtctc

SEQ ID NO: 3740383 - DNA, 17 bp, Homo sapiens
aatgaagtttatacagt

SEQ ID NO: 3740384 - DNA, 17 bp, Homo sapiens
aatgaattaaataaacc

SEQ ID NO: 3740385 - DNA, 17 bp, Homo sapiens
aatgaatttttatgata

SEQ ID NO: 3740386 - DNA, 18 bp, Homo sapiens
aatgacatcttcaaagct

SEQ ID NO: 3740387 - DNA, 17 bp, Homo sapiens
aatgactaaaaaacaaa

SEQ ID NO: 3740388 - DNA, 24 bp, Homo sapiens
aatgactaaaaatattataactta

SEQ ID NO: 3740389 - DNA, 21 bp, Homo sapiens
aatgagaacatgttggtattt

SEQ ID NO: 3740390 - DNA, 15 bp, Homo sapiens
aatgagcctggcaag

SEQ ID NO: 3740391 - DNA, 18 bp, Homo sapiens
aatgagggccaagaaaga

SEQ ID NO: 3740392 - DNA, 18 bp, Homo sapiens
aatgatgcacatttcatg

SEQ ID NO: 3740393 - DNA, 22 bp, Homo sapiens
aatgatttcatgctatctctgt

SEQ ID NO: 3740394 - DNA, 20 bp, Homo sapiens
aatgcaaacacacaaaggta

SEQ ID NO: 3740395 - DNA, 16 bp, Homo sapiens
aatgcaaattctcaag

SEQ ID NO: 3740396 - DNA, 15 bp, Homo sapiens
aatgcaacaacatgt

SEQ ID NO: 3740397 - DNA, 17 bp, Homo sapiens
aatgcacaatgtcttgg

SEQ ID NO: 3740398 - DNA, 22 bp, Homo sapiens
aatgcattataggatcatttgt

SEQ ID NO: 3740399 - DNA, 23 bp, Homo sapiens
aatgcattataggatcatttgtt

SEQ ID NO: 3740400 - DNA, 13 bp, Homo sapiens
aatgccattctct

SEQ ID NO: 3740401 - DNA, 16 bp, Homo sapiens
aatgcccttaaatcat

SEQ ID NO: 3740402 - DNA, 15 bp, Homo sapiens
aatgcctaagaagat

SEQ ID NO: 3740403 - DNA, 15 bp, Homo sapiens
aatgcctcctccctg

SEQ ID NO: 3740404 - DNA, 13 bp, Homo sapiens
aatgcctgtgcca

SEQ ID NO: 3740405 - DNA, 16 bp, Homo sapiens
aatgccttactttgta

SEQ ID NO: 3740406 - DNA, 18 bp, Homo sapiens
aatgccttactttgtatg

SEQ ID NO: 3740407 - DNA, 20 bp, Homo sapiens
aatgcgaatggtagtctaac

SEQ ID NO: 3740408 - DNA, 20 bp, Homo sapiens
aatgcggccgcattccctga

SEQ ID NO: 3740409 - DNA, 14 bp, Homo sapiens
aatgctcccccatc

SEQ ID NO: 3740410 - DNA, 20 bp, Homo sapiens
aatgctcccccatcctcccc

SEQ ID NO: 3740411 - DNA, 23 bp, Homo sapiens
aatgctctttacttcatggactt

SEQ ID NO: 3740412 - DNA, 21 bp, Homo sapiens
aatgctggctgttggctgggg

SEQ ID NO: 3740413 - DNA, 22 bp, Homo sapiens
aatgctggctgttggctggggg

SEQ ID NO: 3740414 - DNA, 22 bp, Homo sapiens
aatgctggttttcctaaatgca

SEQ ID NO: 3740415 - DNA, 23 bp, Homo sapiens
aatgctggttttcctaaatgcag

SEQ ID NO: 3740416 - DNA, 21 bp, Homo sapiens
aatgcttcctgacaatcaact

SEQ ID NO: 3740417 - DNA, 19 bp, Homo sapiens
aatggaaaacagactcagg

SEQ ID NO: 3740418 - DNA, 15 bp, Homo sapiens
aatggaagatttgcc

SEQ ID NO: 3740419 - DNA, 21 bp, Homo sapiens
aatggaagatttgcccattta

SEQ ID NO: 3740420 - DNA, 20 bp, Homo sapiens
aatggaaggtttgtatattg

SEQ ID NO: 3740421 - DNA, 19 bp, Homo sapiens
aatggagtagacccctggc

SEQ ID NO: 3740422 - DNA, 21 bp, Homo sapiens
aatggagtagacccctggctg

SEQ ID NO: 3740423 - DNA, 20 bp, Homo sapiens
aatggcacagcccaaagaag

SEQ ID NO: 3740424 - DNA, 16 bp, Homo sapiens
aatggcagccttggca

SEQ ID NO: 3740425 - DNA, 22 bp, Homo sapiens
aatggcctgccttgaagccact

SEQ ID NO: 3740426 - DNA, 21 bp, Homo sapiens
aatggctttggtctcttgctt

SEQ ID NO: 3740427 - DNA, 22 bp, Homo sapiens
aatgggaactgcctctttcctg

SEQ ID NO: 3740428 - DNA, 13 bp, Homo sapiens
aatgggacactaa

SEQ ID NO: 3740429 - DNA, 15 bp, Homo sapiens
aatggtaaaattgca

SEQ ID NO: 3740430 - DNA, 16 bp, Homo sapiens
aatggtataaatttca

SEQ ID NO: 3740431 - DNA, 16 bp, Homo sapiens
aatggtatggaactct

SEQ ID NO: 3740432 - DNA, 16 bp, Homo sapiens
aatggtcgcccaggag

SEQ ID NO: 3740433 - DNA, 16 bp, Homo sapiens
aatggtgctcatttca

SEQ ID NO: 3740434 - DNA, 23 bp, Homo sapiens
aatggtggttgtttcttccaaga

SEQ ID NO: 3740435 - DNA, 17 bp, Homo sapiens
aatggtgtttttttaat

SEQ ID NO: 3740436 - DNA, 23 bp, Homo sapiens
aatggtttgaatataaacactat

SEQ ID NO: 3740437 - DNA, 19 bp, Homo sapiens
aatggtttgcaaggaagcc

SEQ ID NO: 3740438 - DNA, 18 bp, Homo sapiens
aatgtactgcatatgaaa

SEQ ID NO: 3740439 - DNA, 13 bp, Homo sapiens
aatgtatacctgt

SEQ ID NO: 3740440 - DNA, 16 bp, Homo sapiens
aatgtatcatagaaat

SEQ ID NO: 3740441 - DNA, 13 bp, Homo sapiens
aatgtatcttatt

SEQ ID NO: 3740442 - DNA, 14 bp, Homo sapiens
aatgtatgtgtaag

SEQ ID NO: 3740443 - DNA, 19 bp, Homo sapiens
aatgtatgtgtaagtattc

SEQ ID NO: 3740444 - DNA, 20 bp, Homo sapiens
aatgtatgtgtaagtattct

SEQ ID NO: 3740445 - DNA, 17 bp, Homo sapiens
aatgtattattctgcag

SEQ ID NO: 3740446 - DNA, 22 bp, Homo sapiens
aatgtattattctgcagcatga

SEQ ID NO: 3740447 - DNA, 13 bp, Homo sapiens
aatgtattcaaat

SEQ ID NO: 3740448 - DNA, 18 bp, Homo sapiens
aatgtattgaacttggaa

SEQ ID NO: 3740449 - DNA, 19 bp, Homo sapiens
aatgtattgaacttggaaa

SEQ ID NO: 3740450 - DNA, 18 bp, Homo sapiens
aatgtcacaacctctctg

SEQ ID NO: 3740451 - DNA, 16 bp, Homo sapiens
aatgtcacaggcaggt

SEQ ID NO: 3740452 - DNA, 20 bp, Homo sapiens
aatgtcaccaccttcccagc

SEQ ID NO: 3740453 - DNA, 23 bp, Homo sapiens
aatgtcaccaccttcccagctct

SEQ ID NO: 3740454 - DNA, 17 bp, Homo sapiens
aatgtcagaaaaacaat

SEQ ID NO: 3740455 - DNA, 21 bp, Homo sapiens
aatgtcagaaaaacaataaga

SEQ ID NO: 3740456 - DNA, 20 bp, Homo sapiens
aatgtcaggaacagaaggat

SEQ ID NO: 3740457 - DNA, 18 bp, Homo sapiens
aatgtccatgatggaata

SEQ ID NO: 3740458 - DNA, 18 bp, Homo sapiens
aatgtcctccagaagcct

SEQ ID NO: 3740459 - DNA, 22 bp, Homo sapiens
aatgtctagttgtaacaccatg

SEQ ID NO: 3740460 - DNA, 13 bp, Homo sapiens
aatgtcttgttaa

SEQ ID NO: 3740461 - DNA, 17 bp, Homo sapiens
aatgtctttggtcctct

SEQ ID NO: 3740462 - DNA, 22 bp, Homo sapiens
aatgtctttgttggaaaagaat

SEQ ID NO: 3740463 - DNA, 17 bp, Homo sapiens
aatgtgaactagctgga

SEQ ID NO: 3740464 - DNA, 17 bp, Homo sapiens
aatgtgcctagttcttt

SEQ ID NO: 3740465 - DNA, 21 bp, Homo sapiens
aatgtggcccctgaacaagaa

SEQ ID NO: 3740466 - DNA, 20 bp, Homo sapiens
aatgtggcctaaaaatgcaa

SEQ ID NO: 3740467 - DNA, 14 bp, Homo sapiens
aatgtggctcctgg

SEQ ID NO: 3740468 - DNA, 21 bp, Homo sapiens
aatgtgggaagaaacaaaccc

SEQ ID NO: 3740469 - DNA, 19 bp, Homo sapiens
aatgtgtatcggatgcttt

SEQ ID NO: 3740470 - DNA, 15 bp, Homo sapiens
aatgttaaagtcagt

SEQ ID NO: 3740471 - DNA, 16 bp, Homo sapiens
aatgttacattattat

SEQ ID NO: 3740472 - DNA, 19 bp, Homo sapiens
aatgttattttttaattat

SEQ ID NO: 3740473 - DNA, 11 bp, Homo sapiens
aatgttcattg

SEQ ID NO: 3740474 - DNA, 22 bp, Homo sapiens
aatgttcattgtaatgttactg

SEQ ID NO: 3740475 - DNA, 17 bp, Homo sapiens
aatgttctgacattaac

SEQ ID NO: 3740476 - DNA, 20 bp, Homo sapiens
aatgttctgacattaacagt

SEQ ID NO: 3740477 - DNA, 17 bp, Homo sapiens
aatgttgtggtttgttg

SEQ ID NO: 3740478 - DNA, 19 bp, Homo sapiens
aatgtttaaaaaagtttaa

SEQ ID NO: 3740479 - DNA, 14 bp, Homo sapiens
aatgtttaatgctg

SEQ ID NO: 3740480 - DNA, 20 bp, Homo sapiens
aatgtttacactctttgtaa

SEQ ID NO: 3740481 - DNA, 23 bp, Homo sapiens
aatgtttacactctttgtaagag

SEQ ID NO: 3740482 - DNA, 18 bp, Homo sapiens
aatgtttatgagccagac

SEQ ID NO: 3740483 - DNA, 22 bp, Homo sapiens
aatgtttatgagccagacaaat

SEQ ID NO: 3740484 - DNA, 22 bp, Homo sapiens
aatgtttatgcaaggaaggaaa

SEQ ID NO: 3740485 - DNA, 22 bp, Homo sapiens
aatgtttcttctaggttctaaa

SEQ ID NO: 3740486 - DNA, 19 bp, Homo sapiens
acaggaaaagctgctgaca

SEQ ID NO: 3740487 - DNA, 21 bp, Homo sapiens
acaggaaaagctgctgacagt

SEQ ID NO: 3740488 - DNA, 16 bp, Homo sapiens
acaggaaaatcctctg

SEQ ID NO: 3740489 - DNA, 20 bp, Homo sapiens
acaggaagcaccccatgcca

SEQ ID NO: 3740490 - DNA, 14 bp, Homo sapiens
acaggaccagattt

SEQ ID NO: 3740491 - DNA, 14 bp, Homo sapiens
acaggactctgcct

SEQ ID NO: 3740492 - DNA, 20 bp, Homo sapiens
acaggatagataactctttg

SEQ ID NO: 3740493 - DNA, 14 bp, Homo sapiens
acaggatcagtctg

SEQ ID NO: 3740494 - DNA, 12 bp, Homo sapiens
acaggcaagcac

SEQ ID NO: 3740495 - DNA, 20 bp, Homo sapiens
acaggcaagcacctcctgcc

SEQ ID NO: 3740496 - DNA, 14 bp, Homo sapiens
acaggcaatgctgg

SEQ ID NO: 3740497 - DNA, 15 bp, Homo sapiens
acaggcaatgctggc

SEQ ID NO: 3740498 - DNA, 14 bp, Homo sapiens
acaggcacccacca

SEQ ID NO: 3740499 - DNA, 13 bp, Homo sapiens
acaggcagaaaga

SEQ ID NO: 3740500 - DNA, 15 bp, Homo sapiens
acaggcagaaagagt

SEQ ID NO: 3740501 - DNA, 14 bp, Homo sapiens
acaggcagcattta

SEQ ID NO: 3740502 - DNA, 17 bp, Homo sapiens
acaggcccggctccagg

SEQ ID NO: 3740503 - DNA, 18 bp, Homo sapiens
acaggcccggctccaggc

SEQ ID NO: 3740504 - DNA, 17 bp, Homo sapiens
acaggctgggcttcagt

SEQ ID NO: 3740505 - DNA, 12 bp, Homo sapiens
acagggacccac

SEQ ID NO: 3740506 - DNA, 22 bp, Homo sapiens
acagggctaagagctagcgctg

SEQ ID NO: 3740507 - DNA, 19 bp, Homo sapiens
acaggggaatattttattc

SEQ ID NO: 3740508 - DNA, 20 bp, Homo sapiens
acaggggaatattttattca

SEQ ID NO: 3740509 - DNA, 19 bp, Homo sapiens
acaggggctggtgggcacc

SEQ ID NO: 3740510 - DNA, 17 bp, Homo sapiens
acagggtaaattattca

SEQ ID NO: 3740511 - DNA, 16 bp, Homo sapiens
acaggtctcagaatct

SEQ ID NO: 3740512 - DNA, 19 bp, Homo sapiens
acaggtctgggagaggcag

SEQ ID NO: 3740513 - DNA, 20 bp, Homo sapiens
acaggtgtgaaccaccacac

SEQ ID NO: 3740514 - DNA, 15 bp, Homo sapiens
acagtaacttggtta

SEQ ID NO: 3740515 - DNA, 21 bp, Homo sapiens
acagtagtgagaagaatattg

SEQ ID NO: 3740516 - DNA, 15 bp, Homo sapiens
acagtattacttctg

SEQ ID NO: 3740517 - DNA, 17 bp, Homo sapiens
acagtattacttctgct

SEQ ID NO: 3740518 - DNA, 23 bp, Homo sapiens
atattcttatgtatgtgaaagtt

SEQ ID NO: 3740519 - DNA, 15 bp, Homo sapiens
atattgagacaaaaa

SEQ ID NO: 3740520 - DNA, 16 bp, Homo sapiens
atattgagacaaaaat

SEQ ID NO: 3740521 - DNA, 15 bp, Homo sapiens
atattgatatgctta

SEQ ID NO: 3740522 - DNA, 12 bp, Homo sapiens
atattgtcagat

SEQ ID NO: 3740523 - DNA, 17 bp, Homo sapiens
atattgtcagatatttt

SEQ ID NO: 3740524 - DNA, 13 bp, Homo sapiens
atattgtgaagta

SEQ ID NO: 3740525 - DNA, 14 bp, Homo sapiens
atattgttcctaag

SEQ ID NO: 3740526 - DNA, 12 bp, Homo sapiens
atattgtttcta

SEQ ID NO: 3740527 - DNA, 15 bp, Homo sapiens
atatttaaaagaaag

SEQ ID NO: 3740528 - DNA, 21 bp, Homo sapiens
atatttaaatgtaaagacaaa

SEQ ID NO: 3740529 - DNA, 14 bp, Homo sapiens
atatttaagaaaat

SEQ ID NO: 3740530 - DNA, 16 bp, Homo sapiens
atatttaagaaaatac

SEQ ID NO: 3740531 - DNA, 20 bp, Homo sapiens
atatttaagaaaatacaata

SEQ ID NO: 3740532 - DNA, 14 bp, Homo sapiens
atatttaaggagat

SEQ ID NO: 3740533 - DNA, 22 bp, Homo sapiens
atatttaaggtatacaacatga

SEQ ID NO: 3740534 - DNA, 15 bp, Homo sapiens
atatttacatatgaa

SEQ ID NO: 3740535 - DNA, 19 bp, Homo sapiens
atatttacatatgaaattt

SEQ ID NO: 3740536 - DNA, 14 bp, Homo sapiens
atatttacgtatga

SEQ ID NO: 3740537 - DNA, 11 bp, Homo sapiens
atatttataac

SEQ ID NO: 3740538 - DNA, 20 bp, Homo sapiens
atatttataactcatcataa

SEQ ID NO: 3740539 - DNA, 21 bp, Homo sapiens
atatttataactcatcataaa

SEQ ID NO: 3740540 - DNA, 14 bp, Homo sapiens
atatttatgtagat

SEQ ID NO: 3740541 - DNA, 23 bp, Homo sapiens
atatttattattttcacctgttt

SEQ ID NO: 3740542 - DNA, 22 bp, Homo sapiens
atatttattgtttatttatcag

SEQ ID NO: 3740543 - DNA, 19 bp, Homo sapiens
atatttattttttttaagt

SEQ ID NO: 3740544 - DNA, 12 bp, Homo sapiens
atatttgtagaa

SEQ ID NO: 3740545 - DNA, 20 bp, Homo sapiens
atatttgtcgatatttccat

SEQ ID NO: 3740546 - DNA, 21 bp, Homo sapiens
atatttgttaaatatttacat

SEQ ID NO: 3740547 - DNA, 16 bp, Homo sapiens
atattttaacctgcat

SEQ ID NO: 3740548 - DNA, 19 bp, Homo sapiens
atattttattcaaggtaaa

SEQ ID NO: 3740549 - DNA, 19 bp, Homo sapiens
atattttcaacgcagccct

SEQ ID NO: 3740550 - DNA, 20 bp, Homo sapiens
atattttcaacgcagccctg

SEQ ID NO: 3740551 - DNA, 21 bp, Homo sapiens
atattttcaattcaaaaatgt

SEQ ID NO: 3740552 - DNA, 23 bp, Homo sapiens
atattttcttccaagcaaaggtg

SEQ ID NO: 3740553 - DNA, 14 bp, Homo sapiens
atatttttatagac

SEQ ID NO: 3740554 - DNA, 18 bp, Homo sapiens
atattttttcagaaatat

SEQ ID NO: 3740555 - DNA, 16 bp, Homo sapiens
atatttttttctaaga

SEQ ID NO: 3740556 - DNA, 21 bp, Homo sapiens
atcaaaactttcttttctgga

SEQ ID NO: 3740557 - DNA, 16 bp, Homo sapiens
atcaaaataaattgaa

SEQ ID NO: 3740558 - DNA, 13 bp, Homo sapiens
atcaaaatgacct

SEQ ID NO: 3740559 - DNA, 22 bp, Homo sapiens
atcaaacccggcggtcccctcc

SEQ ID NO: 3740560 - DNA, 17 bp, Homo sapiens
atcaaactgaagccaga

SEQ ID NO: 3740561 - DNA, 23 bp, Homo sapiens
atcaaagaggttttaaaaaaatc

SEQ ID NO: 3740562 - DNA, 21 bp, Homo sapiens
atcaaaggaaaatagtaatgt

SEQ ID NO: 3740563 - DNA, 19 bp, Homo sapiens
atcaaccccttcgctcctg

SEQ ID NO: 3740564 - DNA, 22 bp, Homo sapiens
atcaaccccttcgctcctgtgt

SEQ ID NO: 3740565 - DNA, 17 bp, Homo sapiens
atcaagataaaggacag

SEQ ID NO: 3740566 - DNA, 18 bp, Homo sapiens
atcaagataaaggacagt

SEQ ID NO: 3740567 - DNA, 22 bp, Homo sapiens
atcaagatgagagaactggagg

SEQ ID NO: 3740568 - DNA, 15 bp, Homo sapiens
atcaaggtcgttttt

SEQ ID NO: 3740569 - DNA, 12 bp, Homo sapiens
atcaagtcaccg

SEQ ID NO: 3740570 - DNA, 15 bp, Homo sapiens
atcaagtttccaagc

SEQ ID NO: 3740571 - DNA, 18 bp, Homo sapiens
atcaagtttccaagcaaa

SEQ ID NO: 3740572 - DNA, 13 bp, Homo sapiens
atcaatcaaaccc

SEQ ID NO: 3740573 - DNA, 20 bp, Homo sapiens
atcaatccagcggttctcaa

SEQ ID NO: 3740574 - DNA, 16 bp, Homo sapiens
atcaatgttcattgta

SEQ ID NO: 3740575 - DNA, 14 bp, Homo sapiens
atcaatttgtcatt

SEQ ID NO: 3740576 - DNA, 18 bp, Homo sapiens
atcaatttgtcattttga

SEQ ID NO: 3740577 - DNA, 22 bp, Homo sapiens
atcaatttgtcattttgaagct

SEQ ID NO: 3740578 - DNA, 13 bp, Homo sapiens
atcacacaaagca

SEQ ID NO: 3740579 - DNA, 14 bp, Homo sapiens
atcacacttctgtg

SEQ ID NO: 3740580 - DNA, 14 bp, Homo sapiens
atcacagaggcttc

SEQ ID NO: 3740581 - DNA, 15 bp, Homo sapiens
atcacagaggcttct

SEQ ID NO: 3740582 - DNA, 14 bp, Homo sapiens
atcacagcttcagc

SEQ ID NO: 3740583 - DNA, 18 bp, Homo sapiens
atcacagcttcagccagg

SEQ ID NO: 3740584 - DNA, 22 bp, Homo sapiens
atcacagcttcagccaggagct

SEQ ID NO: 3740585 - DNA, 12 bp, Homo sapiens
atcacagggccc

SEQ ID NO: 3740586 - DNA, 16 bp, Homo sapiens
atcacattatttgcat

SEQ ID NO: 3740587 - DNA, 12 bp, Homo sapiens
atcacctcaggc

SEQ ID NO: 3740588 - DNA, 12 bp, Homo sapiens
atcacctcccct

SEQ ID NO: 3740589 - DNA, 16 bp, Homo sapiens
atcaccttaggcaggg

SEQ ID NO: 3740590 - DNA, 20 bp, Homo sapiens
atcacgccactgcactccag

SEQ ID NO: 3740591 - DNA, 15 bp, Homo sapiens
atcactatgcatttt

SEQ ID NO: 3740592 - DNA, 17 bp, Homo sapiens
atcactggagcaccagg

SEQ ID NO: 3740593 - DNA, 12 bp, Homo sapiens
atcactggagcc

SEQ ID NO: 3740594 - DNA, 13 bp, Homo sapiens
atcactggagccc

SEQ ID NO: 3740595 - DNA, 14 bp, Homo sapiens
atcagaaagtaatt

SEQ ID NO: 3740596 - DNA, 11 bp, Homo sapiens
atcagaaatgt

SEQ ID NO: 3740597 - DNA, 23 bp, Homo sapiens
atcagaagcctattgtaaataca

SEQ ID NO: 3740598 - DNA, 12 bp, Homo sapiens
atcagaaggaga

SEQ ID NO: 3740599 - DNA, 16 bp, Homo sapiens
atcagaccataatgtt

SEQ ID NO: 3740600 - DNA, 20 bp, Homo sapiens
atcagaccctaccccaccac

SEQ ID NO: 3740601 - DNA, 21 bp, Homo sapiens
atcagacctgtcttccaagga

SEQ ID NO: 3740602 - DNA, 22 bp, Homo sapiens
atcagactagtgacaagctcct

SEQ ID NO: 3740603 - DNA, 20 bp, Homo sapiens
atcagcctaggggtcaggga

SEQ ID NO: 3740604 - DNA, 13 bp, Homo sapiens
atcagcctcttaa

SEQ ID NO: 3740605 - DNA, 19 bp, Homo sapiens
atcagcctgctccagctgt

SEQ ID NO: 3740606 - DNA, 16 bp, Homo sapiens
atcagctagcaaaaga

SEQ ID NO: 3740607 - DNA, 14 bp, Homo sapiens
atcagctatttact

SEQ ID NO: 3740608 - DNA, 15 bp, Homo sapiens
atcagctatttactg

SEQ ID NO: 3740609 - DNA, 12 bp, Homo sapiens
atcagctgctac

SEQ ID NO: 3740610 - DNA, 21 bp, Homo sapiens
atcaggaaatatatatgtgtg

SEQ ID NO: 3740611 - DNA, 14 bp, Homo sapiens
atcagtcctttgat

SEQ ID NO: 3740612 - DNA, 19 bp, Homo sapiens
atcagtctgattcccaagc

SEQ ID NO: 3740613 - DNA, 12 bp, Homo sapiens
atcagtgttaaa

SEQ ID NO: 3740614 - DNA, 13 bp, Homo sapiens
atcagtgttaaaa

SEQ ID NO: 3740615 - DNA, 14 bp, Homo sapiens
atcagtgttaaaaa

SEQ ID NO: 3740616 - DNA, 16 bp, Homo sapiens
atcagttactcagccc

SEQ ID NO: 3740617 - DNA, 20 bp, Homo sapiens
atcagttgcgcgttctgaaa

SEQ ID NO: 3740618 - DNA, 22 bp, Homo sapiens
atcagtttgctagcagaaatct

SEQ ID NO: 3740619 - DNA, 16 bp, Homo sapiens
atcatataataaatgt

SEQ ID NO: 3740620 - DNA, 20 bp, Homo sapiens
atcatataataaatgtacat

SEQ ID NO: 3740621 - DNA, 20 bp, Homo sapiens
atcatatatatacatacatg

SEQ ID NO: 3740622 - DNA, 19 bp, Homo sapiens
atcatggaaatattatgca

SEQ ID NO: 3740623 - DNA, 21 bp, Homo sapiens
atcatggctaagcttaaaaaa

SEQ ID NO: 3740624 - DNA, 13 bp, Homo sapiens
atcatgtacattt

SEQ ID NO: 3740625 - DNA, 15 bp, Homo sapiens
atcatgtacatttct

SEQ ID NO: 3740626 - DNA, 19 bp, Homo sapiens
atcatgttaatcctagctg

SEQ ID NO: 3740627 - DNA, 15 bp, Homo sapiens
atcatgttatgataa

SEQ ID NO: 3740628 - DNA, 18 bp, Homo sapiens
atcatgttatgataaaaa

SEQ ID NO: 3740629 - DNA, 15 bp, Homo sapiens
atcattaagacaact

SEQ ID NO: 3740630 - DNA, 23 bp, Homo sapiens
atcattataaacgtgatgatcag

SEQ ID NO: 3740631 - DNA, 13 bp, Homo sapiens
atcattcagcaac

SEQ ID NO: 3740632 - DNA, 16 bp, Homo sapiens
atcattgtaaacatta

SEQ ID NO: 3740633 - DNA, 16 bp, Homo sapiens
atcatttcaggagtta

SEQ ID NO: 3740634 - DNA, 18 bp, Homo sapiens
atcatttgttggaatgaa

SEQ ID NO: 3740635 - DNA, 15 bp, Homo sapiens
atcattttaattatt

SEQ ID NO: 3740636 - DNA, 14 bp, Homo sapiens
atcattttcccccc

SEQ ID NO: 3740637 - DNA, 15 bp, Homo sapiens
atcatttttataacc

SEQ ID NO: 3740638 - DNA, 16 bp, Homo sapiens
atcatttttataacca

SEQ ID NO: 3740639 - DNA, 22 bp, Homo sapiens
atcatttttataaccatggttt

SEQ ID NO: 3740640 - DNA, 18 bp, Homo sapiens
atccaagctggtcccact

SEQ ID NO: 3740641 - DNA, 14 bp, Homo sapiens
atccaaggagaaac

SEQ ID NO: 3740642 - DNA, 19 bp, Homo sapiens
atccaaggagaaacagaga

SEQ ID NO: 3740643 - DNA, 16 bp, Homo sapiens
atccaataggaatgct

SEQ ID NO: 3740644 - DNA, 17 bp, Homo sapiens
atccaatcctcactggg

SEQ ID NO: 3740645 - DNA, 19 bp, Homo sapiens
atccaatcctcactgggtg

SEQ ID NO: 3740646 - DNA, 20 bp, Homo sapiens
atccaatcctcactgggtgg

SEQ ID NO: 3740647 - DNA, 19 bp, Homo sapiens
atccaatcttgtttccaaa

SEQ ID NO: 3740648 - DNA, 15 bp, Homo sapiens
atccacacacagagg

SEQ ID NO: 3740649 - DNA, 20 bp, Homo sapiens
atccacacacagaggaagag

SEQ ID NO: 3740650 - DNA, 20 bp, Homo sapiens
atccacagaactagccttat

SEQ ID NO: 3740651 - DNA, 18 bp, Homo sapiens
atccacctgtctcagcct

SEQ ID NO: 3740652 - DNA, 15 bp, Homo sapiens
atccagacccggctg

SEQ ID NO: 3740653 - DNA, 19 bp, Homo sapiens
atccagacccggctgcgtg

SEQ ID NO: 3740654 - DNA, 15 bp, Homo sapiens
atccaggcaatggcc

SEQ ID NO: 3740655 - DNA, 18 bp, Homo sapiens
atccagggatgccatctg

SEQ ID NO: 3740656 - DNA, 15 bp, Homo sapiens
atccaggttcagctt

SEQ ID NO: 3740657 - DNA, 16 bp, Homo sapiens
atccatccatctccag

SEQ ID NO: 3740658 - DNA, 14 bp, Homo sapiens
atccatgtactgta

SEQ ID NO: 3740659 - DNA, 18 bp, Homo sapiens
atccattcctcagggaca

SEQ ID NO: 3740660 - DNA, 15 bp, Homo sapiens
atcccaccaaccctc

SEQ ID NO: 3740661 - DNA, 18 bp, Homo sapiens
atcccactcacaacagct

SEQ ID NO: 3740662 - DNA, 12 bp, Homo sapiens
atcccactccta

SEQ ID NO: 3740663 - DNA, 23 bp, Homo sapiens
atcccagccctttgggaggctga

SEQ ID NO: 3740664 - DNA, 18 bp, Homo sapiens
atcccagcggctggtgca

SEQ ID NO: 3740665 - DNA, 23 bp, Homo sapiens
atcccagcggctggtgcagggcc

SEQ ID NO: 3740666 - DNA, 22 bp, Homo sapiens
atcccagctacttgggaggctg

SEQ ID NO: 3740667 - DNA, 16 bp, Homo sapiens
atcccatcccatccca

SEQ ID NO: 3740668 - DNA, 19 bp, Homo sapiens
atcccatcccatcccatcc

SEQ ID NO: 3740669 - DNA, 16 bp, Homo sapiens
atcccatgagcctcag

SEQ ID NO: 3740670 - DNA, 21 bp, Homo sapiens
atcccattgtcttctgacctc

SEQ ID NO: 3740671 - DNA, 15 bp, Homo sapiens
atcccatttaaaaaa

SEQ ID NO: 3740672 - DNA, 23 bp, Homo sapiens
atccccaaaacaggccaggtgtg

SEQ ID NO: 3740673 - DNA, 13 bp, Homo sapiens
atccccgctggct

SEQ ID NO: 3740674 - DNA, 14 bp, Homo sapiens
atccctatgctgcc

SEQ ID NO: 3740675 - DNA, 17 bp, Homo sapiens
atccctatgggattcag

SEQ ID NO: 3740676 - DNA, 17 bp, Homo sapiens
atccctgggcattgctt

SEQ ID NO: 3740677 - DNA, 18 bp, Homo sapiens
atccctgggcattgcttt

SEQ ID NO: 3740678 - DNA, 16 bp, Homo sapiens
atccctgttcattgta

SEQ ID NO: 3740679 - DNA, 12 bp, Homo sapiens
atccgaggcagg

SEQ ID NO: 3740680 - DNA, 14 bp, Homo sapiens
atccggaggagaag

SEQ ID NO: 3740681 - DNA, 14 bp, Homo sapiens
atcctaaaacaaat

SEQ ID NO: 3740682 - DNA, 16 bp, Homo sapiens
atcctaggcatttgct

SEQ ID NO: 3740683 - DNA, 21 bp, Homo sapiens
atcctaggcatttgctgaata

SEQ ID NO: 3740684 - DNA, 19 bp, Homo sapiens
atcctatcaacaacaaggt

SEQ ID NO: 3740685 - DNA, 14 bp, Homo sapiens
atcctcactgggtg

SEQ ID NO: 3740686 - DNA, 14 bp, Homo sapiens
atcctcagttcctg

SEQ ID NO: 3740687 - DNA, 23 bp, Homo sapiens
atcctcatttggggtagctagag

SEQ ID NO: 3740688 - DNA, 13 bp, Homo sapiens
atcctccccttcc

SEQ ID NO: 3740689 - DNA, 15 bp, Homo sapiens
atcctccgtccagcc

SEQ ID NO: 3740690 - DNA, 15 bp, Homo sapiens
atcctcctgcctcag

SEQ ID NO: 3740691 - DNA, 14 bp, Homo sapiens
atcctgaaatttca

SEQ ID NO: 3740692 - DNA, 21 bp, Homo sapiens
atcctgcccagtgttgtttgt

SEQ ID NO: 3740693 - DNA, 14 bp, Homo sapiens
atcctgcttcagtg

SEQ ID NO: 3740694 - DNA, 23 bp, Homo sapiens
atcctgtctttaaggaaaaaaag

SEQ ID NO: 3740695 - DNA, 13 bp, Homo sapiens
atcctgtgggtga

SEQ ID NO: 3740696 - DNA, 14 bp, Homo sapiens
atcctgtgtttcta

SEQ ID NO: 3740697 - DNA, 18 bp, Homo sapiens
atcctgtgtttctaggga

SEQ ID NO: 3740698 - DNA, 14 bp, Homo sapiens
atcctgttgaaaag

SEQ ID NO: 3740699 - DNA, 17 bp, Homo sapiens
atcctgttgaaaagcca

SEQ ID NO: 3740700 - DNA, 15 bp, Homo sapiens
atccttagcaacagc

SEQ ID NO: 3740701 - DNA, 19 bp, Homo sapiens
atccttctaatctgctatg

SEQ ID NO: 3740702 - DNA, 21 bp, Homo sapiens
atccttgttttgtgacatttt

SEQ ID NO: 3740703 - DNA, 18 bp, Homo sapiens
atcctttttctttataaa

SEQ ID NO: 3740704 - DNA, 15 bp, Homo sapiens
atcgaggaaccagag

SEQ ID NO: 3740705 - DNA, 14 bp, Homo sapiens
atcggaagcagtgc

SEQ ID NO: 3740706 - DNA, 22 bp, Homo sapiens
atcggaagcagtgccttccata

SEQ ID NO: 3740707 - DNA, 18 bp, Homo sapiens
atcggaggcttgtcagag

SEQ ID NO: 3740708 - DNA, 23 bp, Homo sapiens
atcggaggcttgtcagagctggg

SEQ ID NO: 3740709 - DNA, 17 bp, Homo sapiens
atcgggaacagtgtttc

SEQ ID NO: 3740710 - DNA, 18 bp, Homo sapiens
atcgggagcagtgtcttc

SEQ ID NO: 3740711 - DNA, 16 bp, Homo sapiens
atcggggtagaaatgc

SEQ ID NO: 3740712 - DNA, 19 bp, Homo sapiens
atcggtgaaactaacagat

SEQ ID NO: 3740713 - DNA, 15 bp, Homo sapiens
atcggtgtccattta

SEQ ID NO: 3740714 - DNA, 17 bp, Homo sapiens
atcggtgtccatttata

SEQ ID NO: 3740715 - DNA, 23 bp, Homo sapiens
atcggtgtccatttatagaataa

SEQ ID NO: 3740716 - DNA, 23 bp, Homo sapiens
atcgtctctccctccctttgaaa

SEQ ID NO: 3740717 - DNA, 23 bp, Homo sapiens
atcgtgccgttactctccaacct

SEQ ID NO: 3740718 - DNA, 15 bp, Homo sapiens
atcgtgctaaatttt

SEQ ID NO: 3740719 - DNA, 16 bp, Homo sapiens
atcgtgctaaattttc

SEQ ID NO: 3740720 - DNA, 17 bp, Homo sapiens
atcgtgctaaattttca

SEQ ID NO: 3740721 - DNA, 16 bp, Homo sapiens
atcgttatgtgtgtat

SEQ ID NO: 3740722 - DNA, 18 bp, Homo sapiens
atcgttatgtgtgtatat

SEQ ID NO: 3740723 - DNA, 15 bp, Homo sapiens
atcgttccagttccc

SEQ ID NO: 3740724 - DNA, 21 bp, Homo sapiens
atctaaactttaatatgtatt

SEQ ID NO: 3740725 - DNA, 15 bp, Homo sapiens
atctaaatgttgaaa

SEQ ID NO: 3740726 - DNA, 16 bp, Homo sapiens
atctaacaatggaaga

SEQ ID NO: 3740727 - DNA, 21 bp, Homo sapiens
atctagaacacaggcaaaatc

SEQ ID NO: 3740728 - DNA, 14 bp, Homo sapiens
atctagaagaaatg

SEQ ID NO: 3740729 - DNA, 12 bp, Homo sapiens
atctagaagact

SEQ ID NO: 3740730 - DNA, 18 bp, Homo sapiens
atctagtgcagctgattt

SEQ ID NO: 3740731 - DNA, 21 bp, Homo sapiens
atctagtgcagctgattttaa

SEQ ID NO: 3740732 - DNA, 21 bp, Homo sapiens
atctatatagtacctttgctc

SEQ ID NO: 3740733 - DNA, 18 bp, Homo sapiens
atctatcttatatagttt

SEQ ID NO: 3740734 - DNA, 16 bp, Homo sapiens
atctattgggttcatt

SEQ ID NO: 3740735 - DNA, 13 bp, Homo sapiens
atctattgtaaga

SEQ ID NO: 3740736 - DNA, 21 bp, Homo sapiens
atctattgtaagataaaaaag

SEQ ID NO: 3740737 - DNA, 14 bp, Homo sapiens
atctatttctgaga

SEQ ID NO: 3740738 - DNA, 14 bp, Homo sapiens
atctcaaaaaataa

SEQ ID NO: 3740739 - DNA, 19 bp, Homo sapiens
atctcaataaagtgcttta

SEQ ID NO: 3740740 - DNA, 16 bp, Homo sapiens
atctcaccccatccca

SEQ ID NO: 3740741 - DNA, 19 bp, Homo sapiens
atctcaggccacctgcccc

SEQ ID NO: 3740742 - DNA, 20 bp, Homo sapiens
atctcaggccacctgccccc

SEQ ID NO: 3740743 - DNA, 20 bp, Homo sapiens
atctcagggaagcccagctc

SEQ ID NO: 3740744 - DNA, 16 bp, Homo sapiens
atctcattcagtatta

SEQ ID NO: 3740745 - DNA, 22 bp, Homo sapiens
atctccaaagctttcctggaga

SEQ ID NO: 3740746 - DNA, 23 bp, Homo sapiens
atctccagggagcaagacagaga

SEQ ID NO: 3740747 - DNA, 19 bp, Homo sapiens
atctccctgccgcctcaat

SEQ ID NO: 3740748 - DNA, 14 bp, Homo sapiens
atctcctgtgcatg

SEQ ID NO: 3740749 - DNA, 15 bp, Homo sapiens
atctcctttcaggga

SEQ ID NO: 3740750 - DNA, 21 bp, Homo sapiens
atctcgccacccctccttcct

SEQ ID NO: 3740751 - DNA, 15 bp, Homo sapiens
atctctagaatttta

SEQ ID NO: 3740752 - DNA, 18 bp, Homo sapiens
atctctagaattttaagt

SEQ ID NO: 3740753 - DNA, 17 bp, Homo sapiens
atctctctctgttgtgt

SEQ ID NO: 3740754 - DNA, 21 bp, Homo sapiens
atctctctctgttgtgttcgt

SEQ ID NO: 3740755 - DNA, 16 bp, Homo sapiens
atctctgaacttcagc

SEQ ID NO: 3740756 - DNA, 19 bp, Homo sapiens
atctctgtctaccatctcc

SEQ ID NO: 3740757 - DNA, 20 bp, Homo sapiens
atctctgtctaccatctccc

SEQ ID NO: 3740758 - DNA, 17 bp, Homo sapiens
atctctgtgtgcacaaa

SEQ ID NO: 3740759 - DNA, 15 bp, Homo sapiens
atctcttgaggccag

SEQ ID NO: 3740760 - DNA, 17 bp, Homo sapiens
atctgaatacctctttg

SEQ ID NO: 3740761 - DNA, 22 bp, Homo sapiens
atctgaatacctctttgaaaga

SEQ ID NO: 3740762 - DNA, 15 bp, Homo sapiens
atctgaatgtaattt

SEQ ID NO: 3740763 - DNA, 18 bp, Homo sapiens
atctgaatgtaatttgtg

SEQ ID NO: 3740764 - DNA, 22 bp, Homo sapiens
atctgaggaatcaacagggcag

SEQ ID NO: 3740765 - DNA, 17 bp, Homo sapiens
atctgcacccccctggg

SEQ ID NO: 3740766 - DNA, 19 bp, Homo sapiens
atctgcacccccctgggct

SEQ ID NO: 3740767 - DNA, 20 bp, Homo sapiens
atctgcagggggtgtgtctg

SEQ ID NO: 3740768 - DNA, 17 bp, Homo sapiens
atctgcatttagcacaa

SEQ ID NO: 3740769 - DNA, 19 bp, Homo sapiens
atctgcattttcaccccac

SEQ ID NO: 3740770 - DNA, 17 bp, Homo sapiens
atctgcccctcccccaa

SEQ ID NO: 3740771 - DNA, 14 bp, Homo sapiens
atctgctaataaaa

SEQ ID NO: 3740772 - DNA, 22 bp, Homo sapiens
atctgctttttaaagaatgctc

SEQ ID NO: 3740773 - DNA, 16 bp, Homo sapiens
atctggactcctctgt

SEQ ID NO: 3740774 - DNA, 17 bp, Homo sapiens
atctggactcctctgtc

SEQ ID NO: 3740775 - DNA, 18 bp, Homo sapiens
atctggactcctctgtcc

SEQ ID NO: 3740776 - DNA, 20 bp, Homo sapiens
atctgggaccctttccttcc

SEQ ID NO: 3740777 - DNA, 23 bp, Homo sapiens
atctgggaccctttccttccttc

SEQ ID NO: 3740778 - DNA, 16 bp, Homo sapiens
atctggggctctggga

SEQ ID NO: 3740779 - DNA, 15 bp, Homo sapiens
atctgggtgactgag

SEQ ID NO: 3740780 - DNA, 17 bp, Homo sapiens
atctggtcccttgcagc

SEQ ID NO: 3740781 - DNA, 16 bp, Homo sapiens
atctgtacatactttt

SEQ ID NO: 3740782 - DNA, 19 bp, Homo sapiens
atctgtacatactttttca

SEQ ID NO: 3740783 - DNA, 12 bp, Homo sapiens
atctgtagatac

SEQ ID NO: 3740784 - DNA, 21 bp, Homo sapiens
atctgtatatacaataacata

SEQ ID NO: 3740785 - DNA, 17 bp, Homo sapiens
atctgtcatttgagcag

SEQ ID NO: 3740786 - DNA, 22 bp, Homo sapiens
atctgtcatttgagcagggctc

SEQ ID NO: 3740787 - DNA, 21 bp, Homo sapiens
atctgtccaaaggaggctggc

SEQ ID NO: 3740788 - DNA, 17 bp, Homo sapiens
atctgtgcccagagatg

SEQ ID NO: 3740789 - DNA, 15 bp, Homo sapiens
atctgtgccccatgc

SEQ ID NO: 3740790 - DNA, 23 bp, Homo sapiens
atctgtgccccatgcctgtccag

SEQ ID NO: 3740791 - DNA, 19 bp, Homo sapiens
atctgtgggcatggtcaaa

SEQ ID NO: 3740792 - DNA, 13 bp, Homo sapiens
atctgtgtcctgg

SEQ ID NO: 3740793 - DNA, 23 bp, Homo sapiens
atctgttgtgtacgtggagaggg

SEQ ID NO: 3740794 - DNA, 16 bp, Homo sapiens
atctgtttatttacaa

SEQ ID NO: 3740795 - DNA, 14 bp, Homo sapiens
atctgttttaaatt

SEQ ID NO: 3740796 - DNA, 17 bp, Homo sapiens
atctgttttactgcttt

SEQ ID NO: 3740797 - DNA, 19 bp, Homo sapiens
atctgtttttaaaaatcat

SEQ ID NO: 3740798 - DNA, 18 bp, Homo sapiens
atcttacaaagtgtattt

SEQ ID NO: 3740799 - DNA, 15 bp, Homo sapiens
atcttagctgccaag

SEQ ID NO: 3740800 - DNA, 16 bp, Homo sapiens
atcttagctgccaagt

SEQ ID NO: 3740801 - DNA, 20 bp, Homo sapiens
atcttaggggagagctttct

SEQ ID NO: 3740802 - DNA, 16 bp, Homo sapiens
atcttattttcatgta

SEQ ID NO: 3740803 - DNA, 21 bp, Homo sapiens
atcttcacaatggtgctcatt

SEQ ID NO: 3740804 - DNA, 22 bp, Homo sapiens
atcttcagttttatctttaatc

SEQ ID NO: 3740805 - DNA, 19 bp, Homo sapiens
atcttccaactcaaactct

SEQ ID NO: 3740806 - DNA, 21 bp, Homo sapiens
atcttccccaacgaaaagcac

SEQ ID NO: 3740807 - DNA, 18 bp, Homo sapiens
atcttcgttcttgttagt

SEQ ID NO: 3740808 - DNA, 16 bp, Homo sapiens
atcttctcactccctt

SEQ ID NO: 3740809 - DNA, 19 bp, Homo sapiens
atcttctccatctggcagg

SEQ ID NO: 3740810 - DNA, 22 bp, Homo sapiens
atcttctccatctggcagggtg

SEQ ID NO: 3740811 - DNA, 17 bp, Homo sapiens
atcttctctttgacaat

SEQ ID NO: 3740812 - DNA, 20 bp, Homo sapiens
atcttcttatgcaatttcct

SEQ ID NO: 3740813 - DNA, 17 bp, Homo sapiens
atcttgatgtctttgtt

SEQ ID NO: 3740814 - DNA, 16 bp, Homo sapiens
atcttgctctatctca

SEQ ID NO: 3740815 - DNA, 21 bp, Homo sapiens
atcttgctctatctcacagca

SEQ ID NO: 3740816 - DNA, 17 bp, Homo sapiens
atcttgctctgctgaca

SEQ ID NO: 3740817 - DNA, 23 bp, Homo sapiens
atcttgctttctttgtttggctg

SEQ ID NO: 3740818 - DNA, 23 bp, Homo sapiens
atcttgctttttttcaccaatat

SEQ ID NO: 3740819 - DNA, 14 bp, Homo sapiens
atcttggactgaca

SEQ ID NO: 3740820 - DNA, 15 bp, Homo sapiens
atcttgtttctgaaa

SEQ ID NO: 3740821 - DNA, 15 bp, Homo sapiens
atcttgtttttccac

SEQ ID NO: 3740822 - DNA, 17 bp, Homo sapiens
atctttcacacttccac

SEQ ID NO: 3740823 - DNA, 20 bp, Homo sapiens
atctttcacccacagaaaga

SEQ ID NO: 3740824 - DNA, 17 bp, Homo sapiens
atctttgcagacaggca

SEQ ID NO: 3740825 - DNA, 18 bp, Homo sapiens
atctttgcagacaggcaa

SEQ ID NO: 3740826 - DNA, 14 bp, Homo sapiens
atctttgccttggg

SEQ ID NO: 3740827 - DNA, 20 bp, Homo sapiens
atctttgccttgggctgctc

SEQ ID NO: 3740828 - DNA, 14 bp, Homo sapiens
atcttttctacagc

SEQ ID NO: 3740829 - DNA, 17 bp, Homo sapiens
atcttttctacagcaaa

SEQ ID NO: 3740830 - DNA, 18 bp, Homo sapiens
atctttttattgatgtgc

SEQ ID NO: 3740831 - DNA, 14 bp, Homo sapiens
atctttttctctaa

SEQ ID NO: 3740832 - DNA, 13 bp, Homo sapiens
atgaaaaatagca

SEQ ID NO: 3740833 - DNA, 13 bp, Homo sapiens
atgaaaaattctc

SEQ ID NO: 3740834 - DNA, 19 bp, Homo sapiens
atgaaaaatttaagcattg

SEQ ID NO: 3740835 - DNA, 22 bp, Homo sapiens
atgaaaaatttaagcattgttt

SEQ ID NO: 3740836 - DNA, 18 bp, Homo sapiens
atgaaaacgttttattgt

SEQ ID NO: 3740837 - DNA, 20 bp, Homo sapiens
atgaaaacgttttattgtgt

SEQ ID NO: 3740838 - DNA, 17 bp, Homo sapiens
atgaaaatacaacttaa

SEQ ID NO: 3740839 - DNA, 12 bp, Homo sapiens
atgaaaatgtca

SEQ ID NO: 3740840 - DNA, 13 bp, Homo sapiens
atgaaagactgta

SEQ ID NO: 3740841 - DNA, 17 bp, Homo sapiens
atgaaagactgtacaaa

SEQ ID NO: 3740842 - DNA, 23 bp, Homo sapiens
atgaaagctgattactgtcaata

SEQ ID NO: 3740843 - DNA, 19 bp, Homo sapiens
atgaaagggcccagagagg

SEQ ID NO: 3740844 - DNA, 16 bp, Homo sapiens
atgaaaggtttacatt

SEQ ID NO: 3740845 - DNA, 19 bp, Homo sapiens
atgaaagtcttgtgactag

SEQ ID NO: 3740846 - DNA, 20 bp, Homo sapiens
atgaaagtcttgtgactagt

SEQ ID NO: 3740847 - DNA, 13 bp, Homo sapiens
atgaaatatcaga

SEQ ID NO: 3740848 - DNA, 13 bp, Homo sapiens
atgaaatatgcat

SEQ ID NO: 3740849 - DNA, 16 bp, Homo sapiens
atgaaatggttaagaa

SEQ ID NO: 3740850 - DNA, 23 bp, Homo sapiens
atgaaattgtctagcagagcagg

SEQ ID NO: 3740851 - DNA, 20 bp, Homo sapiens
atgaaattttaccaagttat

SEQ ID NO: 3740852 - DNA, 18 bp, Homo sapiens
atgaactgcatgtataaa

SEQ ID NO: 3740853 - DNA, 20 bp, Homo sapiens
atgaactgcatgtataaatg

SEQ ID NO: 3740854 - DNA, 12 bp, Homo sapiens
atgaactggagg

SEQ ID NO: 3740855 - DNA, 18 bp, Homo sapiens
atgaactggaggccagga

SEQ ID NO: 3740856 - DNA, 15 bp, Homo sapiens
atgaagaaaaaatac

SEQ ID NO: 3740857 - DNA, 16 bp, Homo sapiens
atgaagacaggacagt

SEQ ID NO: 3740858 - DNA, 18 bp, Homo sapiens
atgaagagtgagagggca

SEQ ID NO: 3740859 - DNA, 18 bp, Homo sapiens
atgaagataccatcagca

SEQ ID NO: 3740860 - DNA, 23 bp, Homo sapiens
atgaagccacagcccaggcctcc

SEQ ID NO: 3740861 - DNA, 17 bp, Homo sapiens
atgaagcccaagtgaaa

SEQ ID NO: 3740862 - DNA, 17 bp, Homo sapiens
atagcctaggtgacaga

SEQ ID NO: 3740863 - DNA, 17 bp, Homo sapiens
atagctatatccatgta

SEQ ID NO: 3740864 - DNA, 20 bp, Homo sapiens
atagctatatccatgtactg

SEQ ID NO: 3740865 - DNA, 18 bp, Homo sapiens
atagctatttttatggaa

SEQ ID NO: 3740866 - DNA, 22 bp, Homo sapiens
atagctcagtttatccaaggtg

SEQ ID NO: 3740867 - DNA, 21 bp, Homo sapiens
atagctgagattcctggttcg

SEQ ID NO: 3740868 - DNA, 12 bp, Homo sapiens
atagctgggact

SEQ ID NO: 3740869 - DNA, 10 bp, Homo sapiens
atagctttat

SEQ ID NO: 3740870 - DNA, 18 bp, Homo sapiens
atagctttattttttaag

SEQ ID NO: 3740871 - DNA, 19 bp, Homo sapiens
atagctttattttttaagt

SEQ ID NO: 3740872 - DNA, 23 bp, Homo sapiens
atagctttattttttaagtattt

SEQ ID NO: 3740873 - DNA, 21 bp, Homo sapiens
ataggaacatatgaaaataca

SEQ ID NO: 3740874 - DNA, 23 bp, Homo sapiens
ataggatcatttgttggaatgaa

SEQ ID NO: 3740875 - DNA, 12 bp, Homo sapiens
ataggctctgca

SEQ ID NO: 3740876 - DNA, 13 bp, Homo sapiens
ataggctctgcac

SEQ ID NO: 3740877 - DNA, 14 bp, Homo sapiens
ataggctctgcaca

SEQ ID NO: 3740878 - DNA, 19 bp, Homo sapiens
ataggctctgcacagatgg

SEQ ID NO: 3740879 - DNA, 16 bp, Homo sapiens
ataggcttttgttctt

SEQ ID NO: 3740880 - DNA, 22 bp, Homo sapiens
atagggcctggtccctgggagg

SEQ ID NO: 3740881 - DNA, 16 bp, Homo sapiens
atagggtctcttcagg

SEQ ID NO: 3740882 - DNA, 22 bp, Homo sapiens
ataggtgcttattctcaaagca

SEQ ID NO: 3740883 - DNA, 18 bp, Homo sapiens
atagtaaaagataacaag

SEQ ID NO: 3740884 - DNA, 17 bp, Homo sapiens
atagtaccaatcatttt

SEQ ID NO: 3740885 - DNA, 20 bp, Homo sapiens
atagtatattaaaaatggta

SEQ ID NO: 3740886 - DNA, 15 bp, Homo sapiens
atagtatggtggctg

SEQ ID NO: 3740887 - DNA, 21 bp, Homo sapiens
atagtattccattgtgtgagt

SEQ ID NO: 3740888 - DNA, 18 bp, Homo sapiens
atagtatttttatattta

SEQ ID NO: 3740889 - DNA, 15 bp, Homo sapiens
atagtcaccttttaa

SEQ ID NO: 3740890 - DNA, 16 bp, Homo sapiens
atagtcaccttttaaa

SEQ ID NO: 3740891 - DNA, 17 bp, Homo sapiens
atagtggcttaaaacaa

SEQ ID NO: 3740892 - DNA, 21 bp, Homo sapiens
atagtggtgttttaaagagaa

SEQ ID NO: 3740893 - DNA, 21 bp, Homo sapiens
atagtggttcttggaaaaatg

SEQ ID NO: 3740894 - DNA, 15 bp, Homo sapiens
atagtgtaggcttta

SEQ ID NO: 3740895 - DNA, 17 bp, Homo sapiens
atagtgtaggctttact

SEQ ID NO: 3740896 - DNA, 13 bp, Homo sapiens
atagtgtgttctg

SEQ ID NO: 3740897 - DNA, 15 bp, Homo sapiens
atagtgtgttctgat

SEQ ID NO: 3740898 - DNA, 17 bp, Homo sapiens
atagtgtgttctgatta

SEQ ID NO: 3740899 - DNA, 22 bp, Homo sapiens
atagttaagcgtgcataagtta

SEQ ID NO: 3740900 - DNA, 16 bp, Homo sapiens
atagtttactatttta

SEQ ID NO: 3740901 - DNA, 14 bp, Homo sapiens
atagtttattgaca

SEQ ID NO: 3740902 - DNA, 23 bp, Homo sapiens
atataaaaaccccaaactgttga

SEQ ID NO: 3740903 - DNA, 22 bp, Homo sapiens
atataaagagaaaattgaattt

SEQ ID NO: 3740904 - DNA, 15 bp, Homo sapiens
atataaataaaacat

SEQ ID NO: 3740905 - DNA, 16 bp, Homo sapiens
atataaccaatgttta

SEQ ID NO: 3740906 - DNA, 20 bp, Homo sapiens
atataaccaatgtttaaaaa

SEQ ID NO: 3740907 - DNA, 23 bp, Homo sapiens
atataaggaaagcaataaatgaa

SEQ ID NO: 3740908 - DNA, 15 bp, Homo sapiens
atataataaagtatt

SEQ ID NO: 3740909 - DNA, 19 bp, Homo sapiens
atataattatgttattgaa

SEQ ID NO: 3740910 - DNA, 23 bp, Homo sapiens
atataatttttttatgttttgtt

SEQ ID NO: 3740911 - DNA, 14 bp, Homo sapiens
atataccatttatc

SEQ ID NO: 3740912 - DNA, 21 bp, Homo sapiens
atatatacacacacaaagaga

SEQ ID NO: 3740913 - DNA, 12 bp, Homo sapiens
atatatgtattt

SEQ ID NO: 3740914 - DNA, 19 bp, Homo sapiens
atatatgtgtgtgtatgtt

SEQ ID NO: 3740915 - DNA, 23 bp, Homo sapiens
atatatgtgtttttcacatttgc

SEQ ID NO: 3740916 - DNA, 20 bp, Homo sapiens
atatatgttgatttcttgta

SEQ ID NO: 3740917 - DNA, 23 bp, Homo sapiens
atatatttataactcatcataaa

SEQ ID NO: 3740918 - DNA, 17 bp, Homo sapiens
atatattttttaatttg

SEQ ID NO: 3740919 - DNA, 23 bp, Homo sapiens
atatattttttaatttgatgaaa

SEQ ID NO: 3740920 - DNA, 18 bp, Homo sapiens
atatcagttactcagccc

SEQ ID NO: 3740921 - DNA, 20 bp, Homo sapiens
atatcagttactcagccctg

SEQ ID NO: 3740922 - DNA, 22 bp, Homo sapiens
atatcagttactcagccctggg

SEQ ID NO: 3740923 - DNA, 23 bp, Homo sapiens
atatcattataactgaaggagaa

SEQ ID NO: 3740924 - DNA, 15 bp, Homo sapiens
atatccatgtactgt

SEQ ID NO: 3740925 - DNA, 17 bp, Homo sapiens
atatccatgtactgtag

SEQ ID NO: 3740926 - DNA, 18 bp, Homo sapiens
atatccatgtactgtagt

SEQ ID NO: 3740927 - DNA, 13 bp, Homo sapiens
atatcctgagcca

SEQ ID NO: 3740928 - DNA, 14 bp, Homo sapiens
atatcctgagccat

SEQ ID NO: 3740929 - DNA, 13 bp, Homo sapiens
atatctgctgtat

SEQ ID NO: 3740930 - DNA, 15 bp, Homo sapiens
atatctgctgtatgt

SEQ ID NO: 3740931 - DNA, 16 bp, Homo sapiens
atatctgctgtatgtc

SEQ ID NO: 3740932 - DNA, 16 bp, Homo sapiens
atatctgttttactgc

SEQ ID NO: 3740933 - DNA, 12 bp, Homo sapiens
atatcttcacaa

SEQ ID NO: 3740934 - DNA, 14 bp, Homo sapiens
atatctttttattg

SEQ ID NO: 3740935 - DNA, 19 bp, Homo sapiens
atatgaaaaatatgatatt

SEQ ID NO: 3740936 - DNA, 19 bp, Homo sapiens
atatgaaggaaatgaacca

SEQ ID NO: 3740937 - DNA, 15 bp, Homo sapiens
atatgacagctgtcc

SEQ ID NO: 3740938 - DNA, 14 bp, Homo sapiens
atatgatatgtaaa

SEQ ID NO: 3740939 - DNA, 15 bp, Homo sapiens
atatgatattgcata

SEQ ID NO: 3740940 - DNA, 20 bp, Homo sapiens
atatgatttaaatcagccgt

SEQ ID NO: 3740941 - DNA, 18 bp, Homo sapiens
atatgcaaacataacaaa

SEQ ID NO: 3740942 - DNA, 20 bp, Homo sapiens
atatgctctgatttatctga

SEQ ID NO: 3740943 - DNA, 14 bp, Homo sapiens
atatgcttatacac

SEQ ID NO: 3740944 - DNA, 16 bp, Homo sapiens
atatgcttatacactt

SEQ ID NO: 3740945 - DNA, 19 bp, Homo sapiens
atatgcttatacacttaca

SEQ ID NO: 3740946 - DNA, 21 bp, Homo sapiens
atatgcttatacacttacact

SEQ ID NO: 3740947 - DNA, 18 bp, Homo sapiens
atatgcttcaaactaaca

SEQ ID NO: 3740948 - DNA, 20 bp, Homo sapiens
atatggggatgcagcattat

SEQ ID NO: 3740949 - DNA, 18 bp, Homo sapiens
atatggggggccaacacc

SEQ ID NO: 3740950 - DNA, 17 bp, Homo sapiens
atatgtaacaagccacc

SEQ ID NO: 3740951 - DNA, 19 bp, Homo sapiens
atatgtagtataaagaaaa

SEQ ID NO: 3740952 - DNA, 15 bp, Homo sapiens
atatgtatgtgtgta

SEQ ID NO: 3740953 - DNA, 16 bp, Homo sapiens
atatgtattaatattc

SEQ ID NO: 3740954 - DNA, 22 bp, Homo sapiens
atatgtgtttttcacatttgcg

SEQ ID NO: 3740955 - DNA, 12 bp, Homo sapiens
atatgttcaact

SEQ ID NO: 3740956 - DNA, 16 bp, Homo sapiens
atatgttcaactggag

SEQ ID NO: 3740957 - DNA, 18 bp, Homo sapiens
atatgttttaagaggcag

SEQ ID NO: 3740958 - DNA, 21 bp, Homo sapiens
atattaaaaatggtaaaattg

SEQ ID NO: 3740959 - DNA, 23 bp, Homo sapiens
atattaaatatgttagcaaagag

SEQ ID NO: 3740960 - DNA, 16 bp, Homo sapiens
atattaagaaagacta

SEQ ID NO: 3740961 - DNA, 22 bp, Homo sapiens
atattaagaaagactatctaaa

SEQ ID NO: 3740962 - DNA, 24 bp, Homo sapiens
atattaagaaagactatctaaatg

SEQ ID NO: 3740963 - DNA, 22 bp, Homo sapiens
atattacacaaatacttattca

SEQ ID NO: 3740964 - DNA, 14 bp, Homo sapiens
atattagaagtgtt

SEQ ID NO: 3740965 - DNA, 15 bp, Homo sapiens
atattagcatttagt

SEQ ID NO: 3740966 - DNA, 20 bp, Homo sapiens
atattagctttactgtttgt

SEQ ID NO: 3740967 - DNA, 15 bp, Homo sapiens
atattaggaaaatat

SEQ ID NO: 3740968 - DNA, 17 bp, Homo sapiens
atattataacttaaaaa

SEQ ID NO: 3740969 - DNA, 17 bp, Homo sapiens
atattatgcaaattccc

SEQ ID NO: 3740970 - DNA, 19 bp, Homo sapiens
atattatgcaaattcccag

SEQ ID NO: 3740971 - DNA, 14 bp, Homo sapiens
atattcattgtata

SEQ ID NO: 3740972 - DNA, 16 bp, Homo sapiens
atattccatagtatat

SEQ ID NO: 3740973 - DNA, 17 bp, Homo sapiens
atattccatagtatatt

SEQ ID NO: 3740974 - DNA, 15 bp, Homo sapiens
atattccatgaatgt

SEQ ID NO: 3740975 - DNA, 22 bp, Homo sapiens
atattcctgaatgaaatatcag

SEQ ID NO: 3740976 - DNA, 17 bp, Homo sapiens
agttggactgggttgcg

SEQ ID NO: 3740977 - DNA, 13 bp, Homo sapiens
agttggcttctaa

SEQ ID NO: 3740978 - DNA, 22 bp, Homo sapiens
agttggcttctgtttctagttg

SEQ ID NO: 3740979 - DNA, 19 bp, Homo sapiens
agttgggcttcctcatagt

SEQ ID NO: 3740980 - DNA, 13 bp, Homo sapiens
agttggtgacaga

SEQ ID NO: 3740981 - DNA, 17 bp, Homo sapiens
agttgtatctcttttga

SEQ ID NO: 3740982 - DNA, 19 bp, Homo sapiens
agttgtcaagtctctgctg

SEQ ID NO: 3740983 - DNA, 18 bp, Homo sapiens
agttgtggaaagcctctg

SEQ ID NO: 3740984 - DNA, 21 bp, Homo sapiens
agttgtggaaagcctctgctg

SEQ ID NO: 3740985 - DNA, 20 bp, Homo sapiens
agttgtgtactctggcctct

SEQ ID NO: 3740986 - DNA, 19 bp, Homo sapiens
agttgtttcattgactatc

SEQ ID NO: 3740987 - DNA, 14 bp, Homo sapiens
agtttaaaatgtat

SEQ ID NO: 3740988 - DNA, 15 bp, Homo sapiens
agtttaaaatgtata

SEQ ID NO: 3740989 - DNA, 13 bp, Homo sapiens
agtttaccatttg

SEQ ID NO: 3740990 - DNA, 14 bp, Homo sapiens
agtttaccatttgt

SEQ ID NO: 3740991 - DNA, 21 bp, Homo sapiens
agtttaccatttgtaataaag

SEQ ID NO: 3740992 - DNA, 22 bp, Homo sapiens
agtttattgacaataatttcag

SEQ ID NO: 3740993 - DNA, 15 bp, Homo sapiens
agtttcactgactta

SEQ ID NO: 3740994 - DNA, 15 bp, Homo sapiens
agtttcagacagggt

SEQ ID NO: 3740995 - DNA, 18 bp, Homo sapiens
agtttcaggtgtttagtt

SEQ ID NO: 3740996 - DNA, 13 bp, Homo sapiens
agtttcatttatg

SEQ ID NO: 3740997 - DNA, 15 bp, Homo sapiens
agtttccaagcaaat

SEQ ID NO: 3740998 - DNA, 17 bp, Homo sapiens
agtttccccaccagtga

SEQ ID NO: 3740999 - DNA, 22 bp, Homo sapiens
agtttccccaccagtgaatgaa

SEQ ID NO: 3741000 - DNA, 22 bp, Homo sapiens
agtttccgtttccaggtgttta

SEQ ID NO: 3741001 - DNA, 20 bp, Homo sapiens
agtttcctcaggctgctgga

SEQ ID NO: 3741002 - DNA, 14 bp, Homo sapiens
agtttctcttttca

SEQ ID NO: 3741003 - DNA, 19 bp, Homo sapiens
agtttgagatcagcctggg

SEQ ID NO: 3741004 - DNA, 20 bp, Homo sapiens
agtttgagatcagcctgggc

SEQ ID NO: 3741005 - DNA, 17 bp, Homo sapiens
agtttgaggctgcagcg

SEQ ID NO: 3741006 - DNA, 21 bp, Homo sapiens
agtttgcagaaaagcacctgc

SEQ ID NO: 3741007 - DNA, 22 bp, Homo sapiens
agtttgcagaaaagcacctgcc

SEQ ID NO: 3741008 - DNA, 13 bp, Homo sapiens
agtttgccagaag

SEQ ID NO: 3741009 - DNA, 23 bp, Homo sapiens
agtttgctagcagaaatctagaa

SEQ ID NO: 3741010 - DNA, 13 bp, Homo sapiens
agtttgtgagaaa

SEQ ID NO: 3741011 - DNA, 14 bp, Homo sapiens
agtttgtgagaaac

SEQ ID NO: 3741012 - DNA, 12 bp, Homo sapiens
agttttatcatt

SEQ ID NO: 3741013 - DNA, 14 bp, Homo sapiens
agttttatcatttt

SEQ ID NO: 3741014 - DNA, 20 bp, Homo sapiens
agttttatcattttcaaaat

SEQ ID NO: 3741015 - DNA, 16 bp, Homo sapiens
agttttcagaacctct

SEQ ID NO: 3741016 - DNA, 21 bp, Homo sapiens
agttttccatgaaaacgtttt

SEQ ID NO: 3741017 - DNA, 22 bp, Homo sapiens
agttttccttctcatctgtgat

SEQ ID NO: 3741018 - DNA, 23 bp, Homo sapiens
agttttccttctcatctgtgatt

SEQ ID NO: 3741019 - DNA, 21 bp, Homo sapiens
agtttttacctaccacagtgt

SEQ ID NO: 3741020 - DNA, 16 bp, Homo sapiens
agtttttgtaatttat

SEQ ID NO: 3741021 - DNA, 17 bp, Homo sapiens
agttttttctcttgggc

SEQ ID NO: 3741022 - DNA, 18 bp, Homo sapiens
ataaaaaagtctctattt

SEQ ID NO: 3741023 - DNA, 20 bp, Homo sapiens
ataaaaaataataatacaag

SEQ ID NO: 3741024 - DNA, 13 bp, Homo sapiens
ataaaaaattttg

SEQ ID NO: 3741025 - DNA, 19 bp, Homo sapiens
ataaaaaattttgtaattt

SEQ ID NO: 3741026 - DNA, 21 bp, Homo sapiens
ataaaaaattttgtaattttc

SEQ ID NO: 3741027 - DNA, 12 bp, Homo sapiens
ataaaaatggat

SEQ ID NO: 3741028 - DNA, 16 bp, Homo sapiens
ataaaacatctttcca

SEQ ID NO: 3741029 - DNA, 11 bp, Homo sapiens
ataaaaccttt

SEQ ID NO: 3741030 - DNA, 14 bp, Homo sapiens
ataaaacctttcaa

SEQ ID NO: 3741031 - DNA, 15 bp, Homo sapiens
ataaaacctttcaaa

SEQ ID NO: 3741032 - DNA, 17 bp, Homo sapiens
ataaaagaaatgcacaa

SEQ ID NO: 3741033 - DNA, 22 bp, Homo sapiens
ataaaagaaatgcacaatgtct

SEQ ID NO: 3741034 - DNA, 18 bp, Homo sapiens
ataaaagcataaatgcaa

SEQ ID NO: 3741035 - DNA, 13 bp, Homo sapiens
ataaaagtgatca

SEQ ID NO: 3741036 - DNA, 18 bp, Homo sapiens
ataaaagtgatcaataaa

SEQ ID NO: 3741037 - DNA, 22 bp, Homo sapiens
ataaaagtgatcaataaaatgt

SEQ ID NO: 3741038 - DNA, 16 bp, Homo sapiens
ataaaataaagtatat

SEQ ID NO: 3741039 - DNA, 20 bp, Homo sapiens
ataaaatcatgtacatttct

SEQ ID NO: 3741040 - DNA, 13 bp, Homo sapiens
ataaaatgtgatt

SEQ ID NO: 3741041 - DNA, 16 bp, Homo sapiens
ataaaattaagaatgt

SEQ ID NO: 3741042 - DNA, 15 bp, Homo sapiens
ataaacacatagatt

SEQ ID NO: 3741043 - DNA, 23 bp, Homo sapiens
ataaacacatagattcacctgta

SEQ ID NO: 3741044 - DNA, 16 bp, Homo sapiens
ataaacatcacacaca

SEQ ID NO: 3741045 - DNA, 17 bp, Homo sapiens
ataaacatcacacacac

SEQ ID NO: 3741046 - DNA, 18 bp, Homo sapiens
ataaactattggaaagta

SEQ ID NO: 3741047 - DNA, 14 bp, Homo sapiens
ataaactgtgtgca

SEQ ID NO: 3741048 - DNA, 23 bp, Homo sapiens
ataaacttagtgcggacaagttt

SEQ ID NO: 3741049 - DNA, 16 bp, Homo sapiens
ataaagacctataaat

SEQ ID NO: 3741050 - DNA, 13 bp, Homo sapiens
ataaagagaaaat

SEQ ID NO: 3741051 - DNA, 16 bp, Homo sapiens
ataaagagaaaattga

SEQ ID NO: 3741052 - DNA, 18 bp, Homo sapiens
ataaagatggctgacttt

SEQ ID NO: 3741053 - DNA, 17 bp, Homo sapiens
ataaagcatctaaactt

SEQ ID NO: 3741054 - DNA, 19 bp, Homo sapiens
ataaaggtggtatgtgtgt

SEQ ID NO: 3741055 - DNA, 18 bp, Homo sapiens
ataaagtattccacctta

SEQ ID NO: 3741056 - DNA, 20 bp, Homo sapiens
ataaagtattccaccttaaa

SEQ ID NO: 3741057 - DNA, 16 bp, Homo sapiens
ataaagtgttttcaga

SEQ ID NO: 3741058 - DNA, 17 bp, Homo sapiens
ataaagttggtgacaga

SEQ ID NO: 3741059 - DNA, 11 bp, Homo sapiens
ataaatagcta

SEQ ID NO: 3741060 - DNA, 22 bp, Homo sapiens
ataaatgaagtttatacagtac

SEQ ID NO: 3741061 - DNA, 20 bp, Homo sapiens
ataaatgcaatatgtattaa

SEQ ID NO: 3741062 - DNA, 15 bp, Homo sapiens
ataaatgtatcttat

SEQ ID NO: 3741063 - DNA, 17 bp, Homo sapiens
ataaatgtcattaaaat

SEQ ID NO: 3741064 - DNA, 11 bp, Homo sapiens
ataaattaaat

SEQ ID NO: 3741065 - DNA, 12 bp, Homo sapiens
ataaattaaata

SEQ ID NO: 3741066 - DNA, 12 bp, Homo sapiens
ataaattcagat

SEQ ID NO: 3741067 - DNA, 12 bp, Homo sapiens
ataaattgcatg

SEQ ID NO: 3741068 - DNA, 18 bp, Homo sapiens
ataaattgctccttgaca

SEQ ID NO: 3741069 - DNA, 20 bp, Homo sapiens
ataaatttggttctaataga

SEQ ID NO: 3741070 - DNA, 16 bp, Homo sapiens
ataacaaataaccaac

SEQ ID NO: 3741071 - DNA, 14 bp, Homo sapiens
ataacaacttcata

SEQ ID NO: 3741072 - DNA, 16 bp, Homo sapiens
ataacaagatctttca

SEQ ID NO: 3741073 - DNA, 17 bp, Homo sapiens
ataacaagatctttcag

SEQ ID NO: 3741074 - DNA, 13 bp, Homo sapiens
ataacacagagag

SEQ ID NO: 3741075 - DNA, 14 bp, Homo sapiens
ataacacagagaga

SEQ ID NO: 3741076 - DNA, 22 bp, Homo sapiens
ataacacagagagacagacttg

SEQ ID NO: 3741077 - DNA, 16 bp, Homo sapiens
ataacagaatgcacca

SEQ ID NO: 3741078 - DNA, 18 bp, Homo sapiens
ataacagggtaaattatt

SEQ ID NO: 3741079 - DNA, 21 bp, Homo sapiens
ataacagtgccattgtcttta

SEQ ID NO: 3741080 - DNA, 12 bp, Homo sapiens
ataacatgtaat

SEQ ID NO: 3741081 - DNA, 18 bp, Homo sapiens
ataacatgtaattaagta

SEQ ID NO: 3741082 - DNA, 20 bp, Homo sapiens
ataaccccagctccctagga

SEQ ID NO: 3741083 - DNA, 16 bp, Homo sapiens
ataaccccattctttg

SEQ ID NO: 3741084 - DNA, 14 bp, Homo sapiens
ataacgaagttggg

SEQ ID NO: 3741085 - DNA, 13 bp, Homo sapiens
ataactactgtgt

SEQ ID NO: 3741086 - DNA, 18 bp, Homo sapiens
ataactactgtgttcctg

SEQ ID NO: 3741087 - DNA, 15 bp, Homo sapiens
ataactcatcataaa

SEQ ID NO: 3741088 - DNA, 19 bp, Homo sapiens
ataactcatcataaaataa

SEQ ID NO: 3741089 - DNA, 13 bp, Homo sapiens
ataactctttgga

SEQ ID NO: 3741090 - DNA, 22 bp, Homo sapiens
ataactctttggatagcatgtc

SEQ ID NO: 3741091 - DNA, 20 bp, Homo sapiens
agtctgctgccctccatccc

SEQ ID NO: 3741092 - DNA, 19 bp, Homo sapiens
agtctgcttatccttccac

SEQ ID NO: 3741093 - DNA, 14 bp, Homo sapiens
agtctgcttctgca

SEQ ID NO: 3741094 - DNA, 13 bp, Homo sapiens
agtctggaggggc

SEQ ID NO: 3741095 - DNA, 15 bp, Homo sapiens
agtctggatctggga

SEQ ID NO: 3741096 - DNA, 14 bp, Homo sapiens
agtctgtgcctgga

SEQ ID NO: 3741097 - DNA, 16 bp, Homo sapiens
agtctgtgcctggagc

SEQ ID NO: 3741098 - DNA, 17 bp, Homo sapiens
agtctgtgcctggagct

SEQ ID NO: 3741099 - DNA, 11 bp, Homo sapiens
agtctgtgtga

SEQ ID NO: 3741100 - DNA, 12 bp, Homo sapiens
agtctgtgtgaa

SEQ ID NO: 3741101 - DNA, 17 bp, Homo sapiens
agtcttccacctggaag

SEQ ID NO: 3741102 - DNA, 17 bp, Homo sapiens
agtcttccctagggctg

SEQ ID NO: 3741103 - DNA, 18 bp, Homo sapiens
agtcttccctagggctgg

SEQ ID NO: 3741104 - DNA, 20 bp, Homo sapiens
agtcttctcatagcattaac

SEQ ID NO: 3741105 - DNA, 19 bp, Homo sapiens
agtcttgcagtgattaagg

SEQ ID NO: 3741106 - DNA, 21 bp, Homo sapiens
agtcttgctgtggtctctttg

SEQ ID NO: 3741107 - DNA, 17 bp, Homo sapiens
agtcttgtgactagtgc

SEQ ID NO: 3741108 - DNA, 20 bp, Homo sapiens
agtcttgtgactagtgctga

SEQ ID NO: 3741109 - DNA, 21 bp, Homo sapiens
agtcttgtgactagtgctgaa

SEQ ID NO: 3741110 - DNA, 23 bp, Homo sapiens
agtcttgtgactagtgctgaagc

SEQ ID NO: 3741111 - DNA, 11 bp, Homo sapiens
agtgaaaaagg

SEQ ID NO: 3741112 - DNA, 17 bp, Homo sapiens
agtgaaaaaggaggaag

SEQ ID NO: 3741113 - DNA, 20 bp, Homo sapiens
agtgaaatctgtgcaataaa

SEQ ID NO: 3741114 - DNA, 18 bp, Homo sapiens
agtgaacacattgtgtca

SEQ ID NO: 3741115 - DNA, 16 bp, Homo sapiens
agtgaacttgggccac

SEQ ID NO: 3741116 - DNA, 19 bp, Homo sapiens
agtgaagagggagaaggga

SEQ ID NO: 3741117 - DNA, 21 bp, Homo sapiens
agtgaattgtgaccaagttat

SEQ ID NO: 3741118 - DNA, 13 bp, Homo sapiens
agtgaatttgaat

SEQ ID NO: 3741119 - DNA, 19 bp, Homo sapiens
agtgaatttgaatgaaaaa

SEQ ID NO: 3741120 - DNA, 16 bp, Homo sapiens
agtgaatttttctcta

SEQ ID NO: 3741121 - DNA, 20 bp, Homo sapiens
agtgaatttttctctaactc

SEQ ID NO: 3741122 - DNA, 16 bp, Homo sapiens
agtgacaaggccccag

SEQ ID NO: 3741123 - DNA, 21 bp, Homo sapiens
agtgacaaggccccagagact

SEQ ID NO: 3741124 - DNA, 23 bp, Homo sapiens
agtgacaaggccccagagactca

SEQ ID NO: 3741125 - DNA, 23 bp, Homo sapiens
agtgacacttcagagagctggta

SEQ ID NO: 3741126 - DNA, 14 bp, Homo sapiens
agtgacagaggcag

SEQ ID NO: 3741127 - DNA, 20 bp, Homo sapiens
agtgacagtggattgcattt

SEQ ID NO: 3741128 - DNA, 22 bp, Homo sapiens
agtgacatctctttgatgtcat

SEQ ID NO: 3741129 - DNA, 16 bp, Homo sapiens
agtgacctgaggaagc

SEQ ID NO: 3741130 - DNA, 18 bp, Homo sapiens
agtgacctgaggaagcgt

SEQ ID NO: 3741131 - DNA, 17 bp, Homo sapiens
agtgagaagaatattgt

SEQ ID NO: 3741132 - DNA, 23 bp, Homo sapiens
agtgagaagaatattgttcctaa

SEQ ID NO: 3741133 - DNA, 21 bp, Homo sapiens
agtgagaccctgtctcaaaaa

SEQ ID NO: 3741134 - DNA, 13 bp, Homo sapiens
agtgagagagaca

SEQ ID NO: 3741135 - DNA, 21 bp, Homo sapiens
agtgagcatgctttctgaact

SEQ ID NO: 3741136 - DNA, 21 bp, Homo sapiens
agtgagcttggaaaggaccag

SEQ ID NO: 3741137 - DNA, 13 bp, Homo sapiens
agtgagggtcaga

SEQ ID NO: 3741138 - DNA, 17 bp, Homo sapiens
agtgaggtcctgggggc

SEQ ID NO: 3741139 - DNA, 20 bp, Homo sapiens
agtgatcaataaaatgtgat

SEQ ID NO: 3741140 - DNA, 14 bp, Homo sapiens
agtgatcctcccac

SEQ ID NO: 3741141 - DNA, 15 bp, Homo sapiens
agtgatcctcccacc

SEQ ID NO: 3741142 - DNA, 18 bp, Homo sapiens
agtgatcctcccacctca

SEQ ID NO: 3741143 - DNA, 23 bp, Homo sapiens
agtgatcctcccacctcagcctc

SEQ ID NO: 3741144 - DNA, 21 bp, Homo sapiens
agtgattaaggtctctctttg

SEQ ID NO: 3741145 - DNA, 14 bp, Homo sapiens
agtgattctcctgc

SEQ ID NO: 3741146 - DNA, 23 bp, Homo sapiens
agtgatttttatccaatcttgtt

SEQ ID NO: 3741147 - DNA, 18 bp, Homo sapiens
agtgcagcaaccagagca

SEQ ID NO: 3741148 - DNA, 20 bp, Homo sapiens
agtgcagcaaccagagcact

SEQ ID NO: 3741149 - DNA, 15 bp, Homo sapiens
agtgcagctgatttt

SEQ ID NO: 3741150 - DNA, 18 bp, Homo sapiens
agtgcagctgattttaac

SEQ ID NO: 3741151 - DNA, 20 bp, Homo sapiens
agtgcagctgattttaacaa

SEQ ID NO: 3741152 - DNA, 15 bp, Homo sapiens
agtgcaggctggcac

SEQ ID NO: 3741153 - DNA, 15 bp, Homo sapiens
agtgcatgctctctg

SEQ ID NO: 3741154 - DNA, 17 bp, Homo sapiens
agtgcatgctctctgca

SEQ ID NO: 3741155 - DNA, 15 bp, Homo sapiens
agtgcattttcccag

SEQ ID NO: 3741156 - DNA, 17 bp, Homo sapiens
agtgcattttcccagat

SEQ ID NO: 3741157 - DNA, 14 bp, Homo sapiens
agtgccaagcacag

SEQ ID NO: 3741158 - DNA, 19 bp, Homo sapiens
agtgccaagcacagtgcct

SEQ ID NO: 3741159 - DNA, 22 bp, Homo sapiens
agtgccactgcccgagctggtg

SEQ ID NO: 3741160 - DNA, 15 bp, Homo sapiens
agtgccattgtcttt

SEQ ID NO: 3741161 - DNA, 16 bp, Homo sapiens
agtgccattgtcttta

SEQ ID NO: 3741162 - DNA, 17 bp, Homo sapiens
agtgccattgtctttat

SEQ ID NO: 3741163 - DNA, 14 bp, Homo sapiens
agtgcccaactgtt

SEQ ID NO: 3741164 - DNA, 14 bp, Homo sapiens
agtgcccacaggat

SEQ ID NO: 3741165 - DNA, 23 bp, Homo sapiens
agtgcccagaactggactcagga

SEQ ID NO: 3741166 - DNA, 13 bp, Homo sapiens
agtgccccacctg

SEQ ID NO: 3741167 - DNA, 15 bp, Homo sapiens
agtgccccacctgcc

SEQ ID NO: 3741168 - DNA, 20 bp, Homo sapiens
agtgcccctgctgcctcccc

SEQ ID NO: 3741169 - DNA, 21 bp, Homo sapiens
agtgccctccacagccgcagc

SEQ ID NO: 3741170 - DNA, 15 bp, Homo sapiens
agtgccgtagggagt

SEQ ID NO: 3741171 - DNA, 22 bp, Homo sapiens
agtgcctgggaatgtattattc

SEQ ID NO: 3741172 - DNA, 16 bp, Homo sapiens
agtgccttacctcctg

SEQ ID NO: 3741173 - DNA, 18 bp, Homo sapiens
agtgccttacctcctgcc

SEQ ID NO: 3741174 - DNA, 20 bp, Homo sapiens
agtgccttacctcctgccca

SEQ ID NO: 3741175 - DNA, 23 bp, Homo sapiens
agtgccttacctcctgcccagga

SEQ ID NO: 3741176 - DNA, 13 bp, Homo sapiens
agtgctgaagctt

SEQ ID NO: 3741177 - DNA, 16 bp, Homo sapiens
agtgctgaagcttatt

SEQ ID NO: 3741178 - DNA, 23 bp, Homo sapiens
agtgctgaagcttattaatgcta

SEQ ID NO: 3741179 - DNA, 20 bp, Homo sapiens
agtgctgggattacaggtgt

SEQ ID NO: 3741180 - DNA, 21 bp, Homo sapiens
agtgctgggattacaggtgtg

SEQ ID NO: 3741181 - DNA, 16 bp, Homo sapiens
agtgctgtggcctggg

SEQ ID NO: 3741182 - DNA, 17 bp, Homo sapiens
agtgcttcagcctgagg

SEQ ID NO: 3741183 - DNA, 18 bp, Homo sapiens
agtgcttcagcctgaggc

SEQ ID NO: 3741184 - DNA, 14 bp, Homo sapiens
agtgcttctctaca

SEQ ID NO: 3741185 - DNA, 21 bp, Homo sapiens
agtgcttcttaaagagttctt

SEQ ID NO: 3741186 - DNA, 19 bp, Homo sapiens
agtgcttgagtttggggaa

SEQ ID NO: 3741187 - DNA, 15 bp, Homo sapiens
agtggaaatgttcta

SEQ ID NO: 3741188 - DNA, 22 bp, Homo sapiens
agtggacaccaggagtccctgg

SEQ ID NO: 3741189 - DNA, 13 bp, Homo sapiens
agtggaccaggac

SEQ ID NO: 3741190 - DNA, 14 bp, Homo sapiens
agtggaccaggaca

SEQ ID NO: 3741191 - DNA, 15 bp, Homo sapiens
agtggaccaggacag

SEQ ID NO: 3741192 - DNA, 20 bp, Homo sapiens
agtggaccaggacaggacca

SEQ ID NO: 3741193 - DNA, 18 bp, Homo sapiens
agtggactttccaccccc

SEQ ID NO: 3741194 - DNA, 20 bp, Homo sapiens
agtggactttccaccccctc

SEQ ID NO: 3741195 - DNA, 14 bp, Homo sapiens
agtggaggtgctgc

SEQ ID NO: 3741196 - DNA, 22 bp, Homo sapiens
agtggaggttaaggctgaggaa

SEQ ID NO: 3741197 - DNA, 23 bp, Homo sapiens
agtggcaagaccaaaatgacaat

SEQ ID NO: 3741198 - DNA, 11 bp, Homo sapiens
agtggccagac

SEQ ID NO: 3741199 - DNA, 14 bp, Homo sapiens
agtggccagaccag

SEQ ID NO: 3741200 - DNA, 17 bp, Homo sapiens
agtggccagaccagagc

SEQ ID NO: 3741201 - DNA, 16 bp, Homo sapiens
agtggcccccacagaa

SEQ ID NO: 3741202 - DNA, 15 bp, Homo sapiens
agtggcctcaaccct

SEQ ID NO: 3741203 - DNA, 21 bp, Homo sapiens
agtggcctcaaccctccctca

SEQ ID NO: 3741204 - DNA, 20 bp, Homo sapiens
agtggcctggccaggagctc

SEQ ID NO: 3741205 - DNA, 14 bp, Homo sapiens
agtggctcacgcct

SEQ ID NO: 3741206 - DNA, 13 bp, Homo sapiens
agtggctcctccc

SEQ ID NO: 3741207 - DNA, 17 bp, Homo sapiens
agtggctcctcccggtg

SEQ ID NO: 3741208 - DNA, 11 bp, Homo sapiens
agtggctgctg

SEQ ID NO: 3741209 - DNA, 17 bp, Homo sapiens
agtggctgtcatcagcc

SEQ ID NO: 3741210 - DNA, 20 bp, Homo sapiens
agtgggaaggacttggcgcg

SEQ ID NO: 3741211 - DNA, 19 bp, Homo sapiens
agtgggacagggcatggcc

SEQ ID NO: 3741212 - DNA, 17 bp, Homo sapiens
agtgggagaaaacactt

SEQ ID NO: 3741213 - DNA, 22 bp, Homo sapiens
agtgggataaaggcccagactc

SEQ ID NO: 3741214 - DNA, 15 bp, Homo sapiens
agtgggccaggacag

SEQ ID NO: 3741215 - DNA, 16 bp, Homo sapiens
agtgggccaggacagg

SEQ ID NO: 3741216 - DNA, 20 bp, Homo sapiens
agtgggccaggacaggcccg

SEQ ID NO: 3741217 - DNA, 15 bp, Homo sapiens
agtggggacagagca

SEQ ID NO: 3741218 - DNA, 12 bp, Homo sapiens
agtggggctggg

SEQ ID NO: 3741219 - DNA, 15 bp, Homo sapiens
agtggtctttctgga

SEQ ID NO: 3741220 - DNA, 16 bp, Homo sapiens
agtggtgcgatctggg

SEQ ID NO: 3741221 - DNA, 22 bp, Homo sapiens
agtggtggcagtgcagcaacca

SEQ ID NO: 3741222 - DNA, 16 bp, Homo sapiens
agtggtggctctgaga

SEQ ID NO: 3741223 - DNA, 20 bp, Homo sapiens
agtggttctacaatctattt

SEQ ID NO: 3741224 - DNA, 13 bp, Homo sapiens
agtgtaaaaatga

SEQ ID NO: 3741225 - DNA, 15 bp, Homo sapiens
agtgtaacaagaaag

SEQ ID NO: 3741226 - DNA, 15 bp, Homo sapiens
agtgtaacagctgag

SEQ ID NO: 3741227 - DNA, 16 bp, Homo sapiens
agtgtaacagctgagg

SEQ ID NO: 3741228 - DNA, 22 bp, Homo sapiens
agtgtacatggaataacatgta

SEQ ID NO: 3741229 - DNA, 13 bp, Homo sapiens
agtgtaccataat

SEQ ID NO: 3741230 - DNA, 16 bp, Homo sapiens
agtgtactaattaaca

SEQ ID NO: 3741231 - DNA, 16 bp, Homo sapiens
agtgtagccccaagaa

SEQ ID NO: 3741232 - DNA, 17 bp, Homo sapiens
agtgtagccccaagaag

SEQ ID NO: 3741233 - DNA, 22 bp, Homo sapiens
agtgtagccccaagaaggctgg

SEQ ID NO: 3741234 - DNA, 18 bp, Homo sapiens
agtgtagccttgcccgga

SEQ ID NO: 3741235 - DNA, 22 bp, Homo sapiens
agtgtaggctttacttagctta

SEQ ID NO: 3741236 - DNA, 16 bp, Homo sapiens
agtgtatggaaataaa

SEQ ID NO: 3741237 - DNA, 20 bp, Homo sapiens
agtgtatggaaataaatgta

SEQ ID NO: 3741238 - DNA, 18 bp, Homo sapiens
agtgtattttataaaatt

SEQ ID NO: 3741239 - DNA, 22 bp, Homo sapiens
agtgtattttataaaattaaag

SEQ ID NO: 3741240 - DNA, 21 bp, Homo sapiens
agtgtcacttacctagattta

SEQ ID NO: 3741241 - DNA, 16 bp, Homo sapiens
agtgtccgagaactaa

SEQ ID NO: 3741242 - DNA, 21 bp, Homo sapiens
agtgtcctcccctcaaggaca

SEQ ID NO: 3741243 - DNA, 19 bp, Homo sapiens
agtgtctcagtccacctga

SEQ ID NO: 3741244 - DNA, 22 bp, Homo sapiens
agtgtctcagtccacctgagct

SEQ ID NO: 3741245 - DNA, 13 bp, Homo sapiens
agtgtctgtgtgc

SEQ ID NO: 3741246 - DNA, 13 bp, Homo sapiens
agtgtcttccata

SEQ ID NO: 3741247 - DNA, 15 bp, Homo sapiens
agtgtcttccataat

SEQ ID NO: 3741248 - DNA, 15 bp, Homo sapiens
agtgtctttctttgg

SEQ ID NO: 3741249 - DNA, 23 bp, Homo sapiens
agtgtctttctttggtgcctttc

SEQ ID NO: 3741250 - DNA, 12 bp, Homo sapiens
agtgtgagtaag

SEQ ID NO: 3741251 - DNA, 16 bp, Homo sapiens
agtgtgagtaagagct

SEQ ID NO: 3741252 - DNA, 17 bp, Homo sapiens
agtgtggctcccctcta

SEQ ID NO: 3741253 - DNA, 11 bp, Homo sapiens
agtgtgtaaag

SEQ ID NO: 3741254 - DNA, 16 bp, Homo sapiens
agtgtgtatgtgcgtg

SEQ ID NO: 3741255 - DNA, 15 bp, Homo sapiens
agtgtgtattgttcc

SEQ ID NO: 3741256 - DNA, 19 bp, Homo sapiens
agtgtgtgcacatgtgtgc

SEQ ID NO: 3741257 - DNA, 21 bp, Homo sapiens
agtgtgtggctttcagagcct

SEQ ID NO: 3741258 - DNA, 12 bp, Homo sapiens
agtgtgttctga

SEQ ID NO: 3741259 - DNA, 20 bp, Homo sapiens
agtgtgttctgattagaaat

SEQ ID NO: 3741260 - DNA, 21 bp, Homo sapiens
agtgttaaaaaatttttgaaa

SEQ ID NO: 3741261 - DNA, 14 bp, Homo sapiens
agtgttgtttgtaa

SEQ ID NO: 3741262 - DNA, 15 bp, Homo sapiens
agtgttgtttgtaaa

SEQ ID NO: 3741263 - DNA, 14 bp, Homo sapiens
agtgtttcatgggt

SEQ ID NO: 3741264 - DNA, 15 bp, Homo sapiens
agtgtttcccataat

SEQ ID NO: 3741265 - DNA, 16 bp, Homo sapiens
agtgtttcccataatt

SEQ ID NO: 3741266 - DNA, 21 bp, Homo sapiens
agtgtttgggtatattcattt

SEQ ID NO: 3741267 - DNA, 14 bp, Homo sapiens
agtgttttcagagc

SEQ ID NO: 3741268 - DNA, 15 bp, Homo sapiens
agtgttttctgggat

SEQ ID NO: 3741269 - DNA, 13 bp, Homo sapiens
agttaaaaaaaat

SEQ ID NO: 3741270 - DNA, 14 bp, Homo sapiens
agttaaaaaaaata

SEQ ID NO: 3741271 - DNA, 18 bp, Homo sapiens
agttaaaaaaaataataa

SEQ ID NO: 3741272 - DNA, 23 bp, Homo sapiens
agttaaatagagtatatgcactt

SEQ ID NO: 3741273 - DNA, 20 bp, Homo sapiens
agttaacaaggaatgcctgt

SEQ ID NO: 3741274 - DNA, 23 bp, Homo sapiens
agttaacaaggaatgcctgtgcc

SEQ ID NO: 3741275 - DNA, 16 bp, Homo sapiens
agttaactattttatt

SEQ ID NO: 3741276 - DNA, 17 bp, Homo sapiens
agttaagaaaaaaataa

SEQ ID NO: 3741277 - DNA, 20 bp, Homo sapiens
agttaagaaaaaaataattt

SEQ ID NO: 3741278 - DNA, 16 bp, Homo sapiens
agttaatcttgctttc

SEQ ID NO: 3741279 - DNA, 23 bp, Homo sapiens
agttactcagccctgggccccac

SEQ ID NO: 3741280 - DNA, 16 bp, Homo sapiens
agttactctgaagggc

SEQ ID NO: 3741281 - DNA, 15 bp, Homo sapiens
agttacttcctatca

SEQ ID NO: 3741282 - DNA, 12 bp, Homo sapiens
agttaggaaata

SEQ ID NO: 3741283 - DNA, 17 bp, Homo sapiens
agttagtttctttggga

SEQ ID NO: 3741284 - DNA, 21 bp, Homo sapiens
agttataagtagcaggccaag

SEQ ID NO: 3741285 - DNA, 20 bp, Homo sapiens
agttatataaagagaaaatt

SEQ ID NO: 3741286 - DNA, 13 bp, Homo sapiens
agttatgtgaatg

SEQ ID NO: 3741287 - DNA, 21 bp, Homo sapiens
agttatttatttattggagat

SEQ ID NO: 3741288 - DNA, 15 bp, Homo sapiens
agttcaaggaccaac

SEQ ID NO: 3741289 - DNA, 22 bp, Homo sapiens
agttcacgtaagatacaagttt

SEQ ID NO: 3741290 - DNA, 16 bp, Homo sapiens
agttcactataaatgg

SEQ ID NO: 3741291 - DNA, 18 bp, Homo sapiens
agttcagcaccaccctag

SEQ ID NO: 3741292 - DNA, 17 bp, Homo sapiens
agttcagcctttaagat

SEQ ID NO: 3741293 - DNA, 19 bp, Homo sapiens
agttcaggagtcccaagga

SEQ ID NO: 3741294 - DNA, 18 bp, Homo sapiens
agttcaggtaacaggcag

SEQ ID NO: 3741295 - DNA, 22 bp, Homo sapiens
agttcataacagtgccattgtc

SEQ ID NO: 3741296 - DNA, 18 bp, Homo sapiens
agttcatatgtaccatgt

SEQ ID NO: 3741297 - DNA, 18 bp, Homo sapiens
agttcatccaatcctcac

SEQ ID NO: 3741298 - DNA, 13 bp, Homo sapiens
agttcatgagaat

SEQ ID NO: 3741299 - DNA, 21 bp, Homo sapiens
agttcatgagaatctatattt

SEQ ID NO: 3741300 - DNA, 22 bp, Homo sapiens
agttcccccagtacctccaagc

SEQ ID NO: 3741301 - DNA, 13 bp, Homo sapiens
agttcccttggcc

SEQ ID NO: 3741302 - DNA, 18 bp, Homo sapiens
agttcccttggcctcaga

SEQ ID NO: 3741303 - DNA, 18 bp, Homo sapiens
agttcctctagtgccctc

SEQ ID NO: 3741304 - DNA, 20 bp, Homo sapiens
agttcctgtcccttctctta

SEQ ID NO: 3741305 - DNA, 14 bp, Homo sapiens
agttccttatgtat

SEQ ID NO: 3741306 - DNA, 21 bp, Homo sapiens
agttcgagaccagcctggcca

SEQ ID NO: 3741307 - DNA, 15 bp, Homo sapiens
agttctgagtgtttt

SEQ ID NO: 3741308 - DNA, 19 bp, Homo sapiens
agttctgggtgctccctac

SEQ ID NO: 3741309 - DNA, 22 bp, Homo sapiens
agttctgtgtatttaattgtaa

SEQ ID NO: 3741310 - DNA, 18 bp, Homo sapiens
agttgaaaaacagctgag

SEQ ID NO: 3741311 - DNA, 20 bp, Homo sapiens
agttgaatggcctgccttga

SEQ ID NO: 3741312 - DNA, 13 bp, Homo sapiens
agttgattcagct

SEQ ID NO: 3741313 - DNA, 15 bp, Homo sapiens
agttgattcagctct

SEQ ID NO: 3741314 - DNA, 17 bp, Homo sapiens
agttgattcagctctgc

SEQ ID NO: 3741315 - DNA, 21 bp, Homo sapiens
agttgattttacaattgaaat

SEQ ID NO: 3741316 - DNA, 23 bp, Homo sapiens
agttgattttacaattgaaatga

SEQ ID NO: 3741317 - DNA, 17 bp, Homo sapiens
agttgcacactcactgg

SEQ ID NO: 3741318 - DNA, 17 bp, Homo sapiens
agttgcagactcagttt

SEQ ID NO: 3741319 - DNA, 21 bp, Homo sapiens
agttgctccgcctctgctggc

SEQ ID NO: 3741320 - DNA, 17 bp, Homo sapiens
agtactccttaagaaca

SEQ ID NO: 3741321 - DNA, 19 bp, Homo sapiens
agtactccttaagaacaca

SEQ ID NO: 3741322 - DNA, 20 bp, Homo sapiens
agtacttctccaccctgctc

SEQ ID NO: 3741323 - DNA, 12 bp, Homo sapiens
agtacttctttt

SEQ ID NO: 3741324 - DNA, 20 bp, Homo sapiens
agtagaaagacagagctggg

SEQ ID NO: 3741325 - DNA, 19 bp, Homo sapiens
agtagaaataatatgcatt

SEQ ID NO: 3741326 - DNA, 14 bp, Homo sapiens
agtagaaattttac

SEQ ID NO: 3741327 - DNA, 20 bp, Homo sapiens
agtagaagtcttagatgtat

SEQ ID NO: 3741328 - DNA, 23 bp, Homo sapiens
agtagagtcatctccatcagctg

SEQ ID NO: 3741329 - DNA, 14 bp, Homo sapiens
agtagcatgagaga

SEQ ID NO: 3741330 - DNA, 19 bp, Homo sapiens
agtagctgggactacaggc

SEQ ID NO: 3741331 - DNA, 15 bp, Homo sapiens
agtagctttccacat

SEQ ID NO: 3741332 - DNA, 12 bp, Homo sapiens
agtagtcatttc

SEQ ID NO: 3741333 - DNA, 20 bp, Homo sapiens
agtagtgagaagaatattgt

SEQ ID NO: 3741334 - DNA, 21 bp, Homo sapiens
agtagtgagaagaatattgtt

SEQ ID NO: 3741335 - DNA, 16 bp, Homo sapiens
agtatattaaaaatgg

SEQ ID NO: 3741336 - DNA, 19 bp, Homo sapiens
agtatattaaaaatggtaa

SEQ ID NO: 3741337 - DNA, 18 bp, Homo sapiens
agtatatttatagtcaca

SEQ ID NO: 3741338 - DNA, 19 bp, Homo sapiens
agtatattttcttttcctc

SEQ ID NO: 3741339 - DNA, 15 bp, Homo sapiens
agtatctcagggcct

SEQ ID NO: 3741340 - DNA, 19 bp, Homo sapiens
agtatctcctcgcaagctg

SEQ ID NO: 3741341 - DNA, 14 bp, Homo sapiens
agtatctgggaact

SEQ ID NO: 3741342 - DNA, 20 bp, Homo sapiens
agtatgcttggactgaaggg

SEQ ID NO: 3741343 - DNA, 13 bp, Homo sapiens
agtatgtatgtgt

SEQ ID NO: 3741344 - DNA, 16 bp, Homo sapiens
agtatgttttagcatg

SEQ ID NO: 3741345 - DNA, 18 bp, Homo sapiens
agtatgttttagcatgtg

SEQ ID NO: 3741346 - DNA, 19 bp, Homo sapiens
agtatgttttagcatgtgt

SEQ ID NO: 3741347 - DNA, 15 bp, Homo sapiens
agtattaaagggggg

SEQ ID NO: 3741348 - DNA, 15 bp, Homo sapiens
agtattacttctgct

SEQ ID NO: 3741349 - DNA, 21 bp, Homo sapiens
agtattccaccttaaattaaa

SEQ ID NO: 3741350 - DNA, 22 bp, Homo sapiens
agtattccaccttaaattaaac

SEQ ID NO: 3741351 - DNA, 20 bp, Homo sapiens
agtattccattgtgtgagtg

SEQ ID NO: 3741352 - DNA, 22 bp, Homo sapiens
agtattccattgtgtgagtgta

SEQ ID NO: 3741353 - DNA, 23 bp, Homo sapiens
agtattctgcctttgcagaaaca

SEQ ID NO: 3741354 - DNA, 19 bp, Homo sapiens
agtattcttatttaatgaa

SEQ ID NO: 3741355 - DNA, 12 bp, Homo sapiens
agtatttatata

SEQ ID NO: 3741356 - DNA, 13 bp, Homo sapiens
agtatttatatat

SEQ ID NO: 3741357 - DNA, 15 bp, Homo sapiens
agtatttatatattt

SEQ ID NO: 3741358 - DNA, 15 bp, Homo sapiens
agtatttatttaatg

SEQ ID NO: 3741359 - DNA, 17 bp, Homo sapiens
agtatttcagatgcttt

SEQ ID NO: 3741360 - DNA, 19 bp, Homo sapiens
agtatttcagatgctttag

SEQ ID NO: 3741361 - DNA, 19 bp, Homo sapiens
agtatttttatatttaaat

SEQ ID NO: 3741362 - DNA, 18 bp, Homo sapiens
agtcaaaaggtgcctgtg

SEQ ID NO: 3741363 - DNA, 13 bp, Homo sapiens
agtcaaagacatt

SEQ ID NO: 3741364 - DNA, 20 bp, Homo sapiens
agtcaagtgaaaaaggagga

SEQ ID NO: 3741365 - DNA, 15 bp, Homo sapiens
agtcacacagtgagt

SEQ ID NO: 3741366 - DNA, 22 bp, Homo sapiens
agtcacagagataattctagct

SEQ ID NO: 3741367 - DNA, 15 bp, Homo sapiens
agtcacatcacagga

SEQ ID NO: 3741368 - DNA, 16 bp, Homo sapiens
agtcaccttttaaatc

SEQ ID NO: 3741369 - DNA, 20 bp, Homo sapiens
agtcaccttttaaatcctgt

SEQ ID NO: 3741370 - DNA, 17 bp, Homo sapiens
agtcactcaattgtttt

SEQ ID NO: 3741371 - DNA, 17 bp, Homo sapiens
agtcactgcctctccct

SEQ ID NO: 3741372 - DNA, 21 bp, Homo sapiens
agtcactgcctctccctggcc

SEQ ID NO: 3741373 - DNA, 17 bp, Homo sapiens
agtcagagagagtgttt

SEQ ID NO: 3741374 - DNA, 22 bp, Homo sapiens
agtcagccttccccctcccagg

SEQ ID NO: 3741375 - DNA, 22 bp, Homo sapiens
agtcaggccttaattttcagta

SEQ ID NO: 3741376 - DNA, 22 bp, Homo sapiens
agtcagtgggaacgtgactgcc

SEQ ID NO: 3741377 - DNA, 16 bp, Homo sapiens
agtcatagaagaacta

SEQ ID NO: 3741378 - DNA, 18 bp, Homo sapiens
agtcatcgtaggtgattt

SEQ ID NO: 3741379 - DNA, 22 bp, Homo sapiens
agtcatcgtaggtgatttgaag

SEQ ID NO: 3741380 - DNA, 22 bp, Homo sapiens
agtcatgaacacatcagctagc

SEQ ID NO: 3741381 - DNA, 16 bp, Homo sapiens
agtcatgagctgagca

SEQ ID NO: 3741382 - DNA, 20 bp, Homo sapiens
agtcatgatctccctgccgc

SEQ ID NO: 3741383 - DNA, 21 bp, Homo sapiens
agtcatgatctccctgccgcc

SEQ ID NO: 3741384 - DNA, 22 bp, Homo sapiens
agtcatttgcgcacaacttaaa

SEQ ID NO: 3741385 - DNA, 19 bp, Homo sapiens
agtcatttgctgagcatgt

SEQ ID NO: 3741386 - DNA, 22 bp, Homo sapiens
agtcatttgctgagcatgtact

SEQ ID NO: 3741387 - DNA, 21 bp, Homo sapiens
agtcattttaactttatcaca

SEQ ID NO: 3741388 - DNA, 19 bp, Homo sapiens
agtccaacgtggggcagca

SEQ ID NO: 3741389 - DNA, 22 bp, Homo sapiens
agtccaacgtggggcagcacag

SEQ ID NO: 3741390 - DNA, 17 bp, Homo sapiens
agtccacctgagctgcc

SEQ ID NO: 3741391 - DNA, 18 bp, Homo sapiens
agtccaggtcgggctcag

SEQ ID NO: 3741392 - DNA, 21 bp, Homo sapiens
agtccaggtcgggctcagctc

SEQ ID NO: 3741393 - DNA, 21 bp, Homo sapiens
agtccatatttcaatttccaa

SEQ ID NO: 3741394 - DNA, 20 bp, Homo sapiens
agtcccaaggaaagccccag

SEQ ID NO: 3741395 - DNA, 21 bp, Homo sapiens
agtcccaaggaaagccccagc

SEQ ID NO: 3741396 - DNA, 23 bp, Homo sapiens
agtcccaccggttgcttctggga

SEQ ID NO: 3741397 - DNA, 18 bp, Homo sapiens
agtcccaccttggctgca

SEQ ID NO: 3741398 - DNA, 23 bp, Homo sapiens
agtcccaccttggctgcagggag

SEQ ID NO: 3741399 - DNA, 17 bp, Homo sapiens
agtccccaggccccagg

SEQ ID NO: 3741400 - DNA, 21 bp, Homo sapiens
agtccccaggccccaggaagc

SEQ ID NO: 3741401 - DNA, 12 bp, Homo sapiens
agtccctgcccc

SEQ ID NO: 3741402 - DNA, 22 bp, Homo sapiens
agtccctgggggaagccctgga

SEQ ID NO: 3741403 - DNA, 17 bp, Homo sapiens
agtcccttcccctccct

SEQ ID NO: 3741404 - DNA, 19 bp, Homo sapiens
agtcccttcccctccctgg

SEQ ID NO: 3741405 - DNA, 21 bp, Homo sapiens
agtcccttcccctccctggct

SEQ ID NO: 3741406 - DNA, 23 bp, Homo sapiens
agtcccttcccctccctggctcc

SEQ ID NO: 3741407 - DNA, 22 bp, Homo sapiens
agtcctactttacatatgcttt

SEQ ID NO: 3741408 - DNA, 17 bp, Homo sapiens
agtcctagccactcagg

SEQ ID NO: 3741409 - DNA, 16 bp, Homo sapiens
agtcctcactcccagt

SEQ ID NO: 3741410 - DNA, 15 bp, Homo sapiens
agtcctcgtagccat

SEQ ID NO: 3741411 - DNA, 22 bp, Homo sapiens
agtcctcttttctgagaggact

SEQ ID NO: 3741412 - DNA, 14 bp, Homo sapiens
agtcctgcctggcc

SEQ ID NO: 3741413 - DNA, 16 bp, Homo sapiens
agtcctgcctggccag

SEQ ID NO: 3741414 - DNA, 15 bp, Homo sapiens
agtccttacctcttc

SEQ ID NO: 3741415 - DNA, 16 bp, Homo sapiens
agtctaaccaaatgca

SEQ ID NO: 3741416 - DNA, 15 bp, Homo sapiens
agtctacgctctcct

SEQ ID NO: 3741417 - DNA, 21 bp, Homo sapiens
agtctcactcccctcctttcc

SEQ ID NO: 3741418 - DNA, 17 bp, Homo sapiens
agtctcactgttgccca

SEQ ID NO: 3741419 - DNA, 18 bp, Homo sapiens
agtctcactgttgcccag

SEQ ID NO: 3741420 - DNA, 20 bp, Homo sapiens
agtctcactgttgcccaggc

SEQ ID NO: 3741421 - DNA, 12 bp, Homo sapiens
agtctccagccc

SEQ ID NO: 3741422 - DNA, 18 bp, Homo sapiens
agtctccagcccacgttc

SEQ ID NO: 3741423 - DNA, 16 bp, Homo sapiens
agtctctgctggccca

SEQ ID NO: 3741424 - DNA, 12 bp, Homo sapiens
agtctcttcaga

SEQ ID NO: 3741425 - DNA, 15 bp, Homo sapiens
agtctcttctccact

SEQ ID NO: 3741426 - DNA, 15 bp, Homo sapiens
agtctctttaatctt

SEQ ID NO: 3741427 - DNA, 21 bp, Homo sapiens
agtctgattcccaagctctgc

SEQ ID NO: 3741428 - DNA, 13 bp, Homo sapiens
agtctgcattaca

SEQ ID NO: 3741429 - DNA, 18 bp, Homo sapiens
agtctgcattacattcct

SEQ ID NO: 3741430 - DNA, 13 bp, Homo sapiens
agtctgctgccct

SEQ ID NO: 3741431 - DNA, 15 bp, Homo sapiens
agtctgctgccctcc

SEQ ID NO: 3741432 - DNA, 17 bp, Homo sapiens
agtctgctgccctccat

SEQ ID NO: 3741433 - DNA, 14 bp, Homo sapiens
aggtatttatcttt

SEQ ID NO: 3741434 - DNA, 17 bp, Homo sapiens
aggtcaacagagaaggc

SEQ ID NO: 3741435 - DNA, 19 bp, Homo sapiens
aggtcaagaagaagatgga

SEQ ID NO: 3741436 - DNA, 18 bp, Homo sapiens
aggtcaagcccaggagga

SEQ ID NO: 3741437 - DNA, 20 bp, Homo sapiens
aggtcaaggcctgtccctgg

SEQ ID NO: 3741438 - DNA, 17 bp, Homo sapiens
aggtcaagtaagaagac

SEQ ID NO: 3741439 - DNA, 21 bp, Homo sapiens
aggtcaatacagtacaggcag

SEQ ID NO: 3741440 - DNA, 19 bp, Homo sapiens
aggtcactcctggggcctc

SEQ ID NO: 3741441 - DNA, 13 bp, Homo sapiens
aggtcagagcctg

SEQ ID NO: 3741442 - DNA, 14 bp, Homo sapiens
aggtcagagcctgc

SEQ ID NO: 3741443 - DNA, 17 bp, Homo sapiens
aggtcagagcctgcagt

SEQ ID NO: 3741444 - DNA, 21 bp, Homo sapiens
aggtcaggagttagaggccag

SEQ ID NO: 3741445 - DNA, 15 bp, Homo sapiens
aggtcaggagttcga

SEQ ID NO: 3741446 - DNA, 18 bp, Homo sapiens
aggtcagtacccacctga

SEQ ID NO: 3741447 - DNA, 23 bp, Homo sapiens
aggtcatctcctttcatccccac

SEQ ID NO: 3741448 - DNA, 11 bp, Homo sapiens
aggtcccaggc

SEQ ID NO: 3741449 - DNA, 15 bp, Homo sapiens
aggtcctcagagaat

SEQ ID NO: 3741450 - DNA, 21 bp, Homo sapiens
aggtcctctacttaatgagat

SEQ ID NO: 3741451 - DNA, 16 bp, Homo sapiens
aggtcctgggggcctg

SEQ ID NO: 3741452 - DNA, 19 bp, Homo sapiens
aggtcctgggggcctgacc

SEQ ID NO: 3741453 - DNA, 13 bp, Homo sapiens
aggtcgggctcag

SEQ ID NO: 3741454 - DNA, 18 bp, Homo sapiens
aggtcgggctcagctctg

SEQ ID NO: 3741455 - DNA, 13 bp, Homo sapiens
aggtctagaaaag

SEQ ID NO: 3741456 - DNA, 19 bp, Homo sapiens
aggtctcagaatctttcct

SEQ ID NO: 3741457 - DNA, 16 bp, Homo sapiens
aggtctcccgggaagc

SEQ ID NO: 3741458 - DNA, 23 bp, Homo sapiens
aggtctcctcttaaaaaataaaa

SEQ ID NO: 3741459 - DNA, 13 bp, Homo sapiens
aggtctgaaatgg

SEQ ID NO: 3741460 - DNA, 18 bp, Homo sapiens
aggtcttgaactcctggc

SEQ ID NO: 3741461 - DNA, 15 bp, Homo sapiens
aggtcttttgacatg

SEQ ID NO: 3741462 - DNA, 18 bp, Homo sapiens
aggtcttttgacatgtgg

SEQ ID NO: 3741463 - DNA, 21 bp, Homo sapiens
aggtcttttgacatgtggaaa

SEQ ID NO: 3741464 - DNA, 21 bp, Homo sapiens
aggtgaaaaaagcttttatga

SEQ ID NO: 3741465 - DNA, 21 bp, Homo sapiens
aggtgagaagcagaggaagga

SEQ ID NO: 3741466 - DNA, 13 bp, Homo sapiens
aggtgagggaagc

SEQ ID NO: 3741467 - DNA, 20 bp, Homo sapiens
aggtgatccacccacctcag

SEQ ID NO: 3741468 - DNA, 21 bp, Homo sapiens
aggtgatccacccacctcagc

SEQ ID NO: 3741469 - DNA, 22 bp, Homo sapiens
aggtgcacagacgtccctccac

SEQ ID NO: 3741470 - DNA, 23 bp, Homo sapiens
aggtgcacagacgtccctccacg

SEQ ID NO: 3741471 - DNA, 19 bp, Homo sapiens
aggtgcccttggaggccag

SEQ ID NO: 3741472 - DNA, 21 bp, Homo sapiens
aggtgcccttggaggccagcc

SEQ ID NO: 3741473 - DNA, 22 bp, Homo sapiens
aggtgcccttggaggccagcca

SEQ ID NO: 3741474 - DNA, 12 bp, Homo sapiens
aggtgctgggag

SEQ ID NO: 3741475 - DNA, 14 bp, Homo sapiens
aggtgctgtagatg

SEQ ID NO: 3741476 - DNA, 21 bp, Homo sapiens
aggtgctgttgtcattgcttt

SEQ ID NO: 3741477 - DNA, 18 bp, Homo sapiens
aggtggaaaaacatctga

SEQ ID NO: 3741478 - DNA, 16 bp, Homo sapiens
aggtggaagccctcct

SEQ ID NO: 3741479 - DNA, 17 bp, Homo sapiens
aggtggaagccctcctt

SEQ ID NO: 3741480 - DNA, 20 bp, Homo sapiens
aggtggaagccctccttcca

SEQ ID NO: 3741481 - DNA, 15 bp, Homo sapiens
aggtggagtggatgc

SEQ ID NO: 3741482 - DNA, 17 bp, Homo sapiens
aggtggatcacctgagg

SEQ ID NO: 3741483 - DNA, 14 bp, Homo sapiens
aggtggccactcca

SEQ ID NO: 3741484 - DNA, 12 bp, Homo sapiens
aggtggctgcct

SEQ ID NO: 3741485 - DNA, 13 bp, Homo sapiens
aggtggctgcctg

SEQ ID NO: 3741486 - DNA, 13 bp, Homo sapiens
aggtgggagcttg

SEQ ID NO: 3741487 - DNA, 12 bp, Homo sapiens
aggtgggaggat

SEQ ID NO: 3741488 - DNA, 15 bp, Homo sapiens
aggtgggccttgcta

SEQ ID NO: 3741489 - DNA, 16 bp, Homo sapiens
aggtgggctgagccct

SEQ ID NO: 3741490 - DNA, 20 bp, Homo sapiens
aggtgggctgagccctggca

SEQ ID NO: 3741491 - DNA, 23 bp, Homo sapiens
aggtggggagggggtttgggggc

SEQ ID NO: 3741492 - DNA, 14 bp, Homo sapiens
aggtggggcagctt

SEQ ID NO: 3741493 - DNA, 22 bp, Homo sapiens
aggtggtctgaatgttctgaca

SEQ ID NO: 3741494 - DNA, 23 bp, Homo sapiens
aggtggtctgaatgttctgacat

SEQ ID NO: 3741495 - DNA, 15 bp, Homo sapiens
aggtgtcatttccat

SEQ ID NO: 3741496 - DNA, 16 bp, Homo sapiens
aggtgtccccagccca

SEQ ID NO: 3741497 - DNA, 16 bp, Homo sapiens
aggtgtccctgcactt

SEQ ID NO: 3741498 - DNA, 23 bp, Homo sapiens
aggtgtgaaccaccacacccagc

SEQ ID NO: 3741499 - DNA, 23 bp, Homo sapiens
aggtgtttaacggcactgtggcc

SEQ ID NO: 3741500 - DNA, 12 bp, Homo sapiens
aggtgtttatac

SEQ ID NO: 3741501 - DNA, 14 bp, Homo sapiens
aggttaatgttcat

SEQ ID NO: 3741502 - DNA, 19 bp, Homo sapiens
aggttataggtcactcctg

SEQ ID NO: 3741503 - DNA, 15 bp, Homo sapiens
aggttcatgcccaag

SEQ ID NO: 3741504 - DNA, 14 bp, Homo sapiens
aggttgaagcacca

SEQ ID NO: 3741505 - DNA, 20 bp, Homo sapiens
aggttggcaaaaaggcagga

SEQ ID NO: 3741506 - DNA, 19 bp, Homo sapiens
aggttggggtgtactagtt

SEQ ID NO: 3741507 - DNA, 12 bp, Homo sapiens
aggttgtctgtg

SEQ ID NO: 3741508 - DNA, 14 bp, Homo sapiens
aggtttaacataaa

SEQ ID NO: 3741509 - DNA, 14 bp, Homo sapiens
aggtttctgaaaat

SEQ ID NO: 3741510 - DNA, 12 bp, Homo sapiens
aggtttgtatat

SEQ ID NO: 3741511 - DNA, 13 bp, Homo sapiens
aggtttgtatatt

SEQ ID NO: 3741512 - DNA, 15 bp, Homo sapiens
aggttttatgatatt

SEQ ID NO: 3741513 - DNA, 13 bp, Homo sapiens
aggttttgtaaag

SEQ ID NO: 3741514 - DNA, 15 bp, Homo sapiens
aggttttgtaaagat

SEQ ID NO: 3741515 - DNA, 13 bp, Homo sapiens
aggttttgtacaa

SEQ ID NO: 3741516 - DNA, 15 bp, Homo sapiens
agtaaagaaatgaca

SEQ ID NO: 3741517 - DNA, 12 bp, Homo sapiens
agtaaagaaatt

SEQ ID NO: 3741518 - DNA, 13 bp, Homo sapiens
agtaaagaaattt

SEQ ID NO: 3741519 - DNA, 18 bp, Homo sapiens
agtaaagtgataatttct

SEQ ID NO: 3741520 - DNA, 21 bp, Homo sapiens
agtaaagtgtaacatatgcaa

SEQ ID NO: 3741521 - DNA, 15 bp, Homo sapiens
agtaacaagagtgat

SEQ ID NO: 3741522 - DNA, 18 bp, Homo sapiens
agtaacaagagtgattct

SEQ ID NO: 3741523 - DNA, 20 bp, Homo sapiens
agtaacttggttatacatga

SEQ ID NO: 3741524 - DNA, 22 bp, Homo sapiens
agtaacttggttatacatgaca

SEQ ID NO: 3741525 - DNA, 23 bp, Homo sapiens
agtaacttgtcttaaataaaaga

SEQ ID NO: 3741526 - DNA, 20 bp, Homo sapiens
agtaagaaagtgaagcaaat

SEQ ID NO: 3741527 - DNA, 16 bp, Homo sapiens
agtaagaagacatgaa

SEQ ID NO: 3741528 - DNA, 19 bp, Homo sapiens
agtaagaccggaagctcct

SEQ ID NO: 3741529 - DNA, 14 bp, Homo sapiens
agtaagagctggtg

SEQ ID NO: 3741530 - DNA, 23 bp, Homo sapiens
agtaagtatcttcgttcttgtta

SEQ ID NO: 3741531 - DNA, 16 bp, Homo sapiens
agtaataaactgtgtt

SEQ ID NO: 3741532 - DNA, 21 bp, Homo sapiens
agtaatgaatttttatgatat

SEQ ID NO: 3741533 - DNA, 13 bp, Homo sapiens
agtaattatcggg

SEQ ID NO: 3741534 - DNA, 14 bp, Homo sapiens
agtaatttcttctc

SEQ ID NO: 3741535 - DNA, 19 bp, Homo sapiens
agtacagtggttctacaat

SEQ ID NO: 3741536 - DNA, 22 bp, Homo sapiens
agtacagtggttctacaatcta

SEQ ID NO: 3741537 - DNA, 17 bp, Homo sapiens
agtacatattaggaaaa

SEQ ID NO: 3741538 - DNA, 15 bp, Homo sapiens
agtaccaatcatttt

SEQ ID NO: 3741539 - DNA, 15 bp, Homo sapiens
agtaccactcaggcc

SEQ ID NO: 3741540 - DNA, 15 bp, Homo sapiens
agtacccacctgagc

SEQ ID NO: 3741541 - DNA, 13 bp, Homo sapiens
agtacctccaagc

SEQ ID NO: 3741542 - DNA, 15 bp, Homo sapiens
agtacctgctgcccc

SEQ ID NO: 3741543 - DNA, 19 bp, Homo sapiens
agtacctgctgccccagct

SEQ ID NO: 3741544 - DNA, 13 bp, Homo sapiens
agtacctttgctc

SEQ ID NO: 3741545 - DNA, 14 bp, Homo sapiens
agtacctttgctct

SEQ ID NO: 3741546 - DNA, 13 bp, Homo sapiens
agtacctttgtca

SEQ ID NO: 3741547 - DNA, 14 bp, Homo sapiens
agtactatatctgt

SEQ ID NO: 3741548 - DNA, 22 bp, Homo sapiens
agagaatattagctttactgtt

SEQ ID NO: 3741549 - DNA, 15 bp, Homo sapiens
agagaatcatactta

SEQ ID NO: 3741550 - DNA, 22 bp, Homo sapiens
agagaatgaaattgctgaaaga

SEQ ID NO: 3741551 - DNA, 15 bp, Homo sapiens
agagaatggaaaaca

SEQ ID NO: 3741552 - DNA, 17 bp, Homo sapiens
agagaatgtagatattg

SEQ ID NO: 3741553 - DNA, 18 bp, Homo sapiens
agagaatgttatagtgaa

SEQ ID NO: 3741554 - DNA, 20 bp, Homo sapiens
agagaatgttatagtgaatt

SEQ ID NO: 3741555 - DNA, 22 bp, Homo sapiens
agagaatttctaccatttcaga

SEQ ID NO: 3741556 - DNA, 15 bp, Homo sapiens
agagacacctgcacc

SEQ ID NO: 3741557 - DNA, 22 bp, Homo sapiens
agagacacctgcacctcccccc

SEQ ID NO: 3741558 - DNA, 17 bp, Homo sapiens
agagacagacttgagaa

SEQ ID NO: 3741559 - DNA, 14 bp, Homo sapiens
agagacccaaggag

SEQ ID NO: 3741560 - DNA, 21 bp, Homo sapiens
agagacccaaggaggaaaaac

SEQ ID NO: 3741561 - DNA, 19 bp, Homo sapiens
agagactcagggccccagc

SEQ ID NO: 3741562 - DNA, 20 bp, Homo sapiens
agagactcagggccccagca

SEQ ID NO: 3741563 - DNA, 16 bp, Homo sapiens
agagactccagctggg

SEQ ID NO: 3741564 - DNA, 13 bp, Homo sapiens
agagactgggaag

SEQ ID NO: 3741565 - DNA, 13 bp, Homo sapiens
agagactgtagat

SEQ ID NO: 3741566 - DNA, 17 bp, Homo sapiens
agagagctgttcccaaa

SEQ ID NO: 3741567 - DNA, 14 bp, Homo sapiens
agagaggaatcaga

SEQ ID NO: 3741568 - DNA, 18 bp, Homo sapiens
agagaggacgtgggcggc

SEQ ID NO: 3741569 - DNA, 16 bp, Homo sapiens
agagaggagaaacaca

SEQ ID NO: 3741570 - DNA, 20 bp, Homo sapiens
agagaggccttttggaatgt

SEQ ID NO: 3741571 - DNA, 20 bp, Homo sapiens
agagagggtggtgacctctg

SEQ ID NO: 3741572 - DNA, 22 bp, Homo sapiens
agagagggtggtgacctctgcc

SEQ ID NO: 3741573 - DNA, 23 bp, Homo sapiens
agagagggtggtgacctctgcct

SEQ ID NO: 3741574 - DNA, 23 bp, Homo sapiens
agagaggtcaagcccaggaggac

SEQ ID NO: 3741575 - DNA, 14 bp, Homo sapiens
agagagtggctcct

SEQ ID NO: 3741576 - DNA, 15 bp, Homo sapiens
agagagttaatcaac

SEQ ID NO: 3741577 - DNA, 20 bp, Homo sapiens
agagatatgtagaaggcaca

SEQ ID NO: 3741578 - DNA, 12 bp, Homo sapiens
agagatgaatta

SEQ ID NO: 3741579 - DNA, 17 bp, Homo sapiens
agagatgactgagtcct

SEQ ID NO: 3741580 - DNA, 14 bp, Homo sapiens
agagatgcctccac

SEQ ID NO: 3741581 - DNA, 17 bp, Homo sapiens
agagatgcctccaccgc

SEQ ID NO: 3741582 - DNA, 12 bp, Homo sapiens
agagatggagga

SEQ ID NO: 3741583 - DNA, 15 bp, Homo sapiens
agagatggaggagga

SEQ ID NO: 3741584 - DNA, 15 bp, Homo sapiens
agagcaaagggccag

SEQ ID NO: 3741585 - DNA, 17 bp, Homo sapiens
agagcaagcttttttat

SEQ ID NO: 3741586 - DNA, 14 bp, Homo sapiens
agagcacactgtag

SEQ ID NO: 3741587 - DNA, 18 bp, Homo sapiens
agagcaggtgctggctct

SEQ ID NO: 3741588 - DNA, 21 bp, Homo sapiens
agagcagtttggtttctagca

SEQ ID NO: 3741589 - DNA, 12 bp, Homo sapiens
agagccagccct

SEQ ID NO: 3741590 - DNA, 17 bp, Homo sapiens
agagccagccctccctg

SEQ ID NO: 3741591 - DNA, 20 bp, Homo sapiens
agagccagccctccctgtcc

SEQ ID NO: 3741592 - DNA, 21 bp, Homo sapiens
agagcccagcagggcctcaaa

SEQ ID NO: 3741593 - DNA, 21 bp, Homo sapiens
agagccccgcaaaacccactg

SEQ ID NO: 3741594 - DNA, 22 bp, Homo sapiens
agagccccgcaaaacccactga

SEQ ID NO: 3741595 - DNA, 16 bp, Homo sapiens
agagcctgctccccca

SEQ ID NO: 3741596 - DNA, 18 bp, Homo sapiens
agagcctgctcccccacc

SEQ ID NO: 3741597 - DNA, 19 bp, Homo sapiens
agagcctgctcccccaccc

SEQ ID NO: 3741598 - DNA, 17 bp, Homo sapiens
agagcctgctgcatggg

SEQ ID NO: 3741599 - DNA, 16 bp, Homo sapiens
agagcctgctggatct

SEQ ID NO: 3741600 - DNA, 22 bp, Homo sapiens
agagccttggtgtccacctggc

SEQ ID NO: 3741601 - DNA, 14 bp, Homo sapiens
agagcgaggctgag

SEQ ID NO: 3741602 - DNA, 14 bp, Homo sapiens
agagcgcctgcccc

SEQ ID NO: 3741603 - DNA, 21 bp, Homo sapiens
agagcgcctgcccctcccaga

SEQ ID NO: 3741604 - DNA, 20 bp, Homo sapiens
agagctagcagcagggaggg

SEQ ID NO: 3741605 - DNA, 19 bp, Homo sapiens
agagctatacagttttcct

SEQ ID NO: 3741606 - DNA, 23 bp, Homo sapiens
agagctcctccttgtcttggcag

SEQ ID NO: 3741607 - DNA, 14 bp, Homo sapiens
agagctctggagcc

SEQ ID NO: 3741608 - DNA, 22 bp, Homo sapiens
agagctctggagccacctgtcc

SEQ ID NO: 3741609 - DNA, 15 bp, Homo sapiens
agagctgagtgagct

SEQ ID NO: 3741610 - DNA, 21 bp, Homo sapiens
agagctgcctaagaggcaatg

SEQ ID NO: 3741611 - DNA, 14 bp, Homo sapiens
agagctgcctctcg

SEQ ID NO: 3741612 - DNA, 17 bp, Homo sapiens
agagctggaccagtggt

SEQ ID NO: 3741613 - DNA, 21 bp, Homo sapiens
agagctggtagttagtagcat

SEQ ID NO: 3741614 - DNA, 15 bp, Homo sapiens
agagctggtgcccgg

SEQ ID NO: 3741615 - DNA, 17 bp, Homo sapiens
agagctggtgtctgatt

SEQ ID NO: 3741616 - DNA, 16 bp, Homo sapiens
agagctggttgggaag

SEQ ID NO: 3741617 - DNA, 19 bp, Homo sapiens
agagctgtttatggcctca

SEQ ID NO: 3741618 - DNA, 21 bp, Homo sapiens
agagctgtttatggcctcagc

SEQ ID NO: 3741619 - DNA, 16 bp, Homo sapiens
agagctttacaaaaag

SEQ ID NO: 3741620 - DNA, 16 bp, Homo sapiens
agaggaaaaaaatgac

SEQ ID NO: 3741621 - DNA, 16 bp, Homo sapiens
agaggaaggagaggag

SEQ ID NO: 3741622 - DNA, 21 bp, Homo sapiens
agaggacacctgtactggaga

SEQ ID NO: 3741623 - DNA, 16 bp, Homo sapiens
agaggacgtgggcggc

SEQ ID NO: 3741624 - DNA, 17 bp, Homo sapiens
agaggagggatgctgcc

SEQ ID NO: 3741625 - DNA, 24 bp, Homo sapiens
agaggcaccactaaaagatcgcag

SEQ ID NO: 3741626 - DNA, 16 bp, Homo sapiens
agaggcagaaccctgg

SEQ ID NO: 3741627 - DNA, 22 bp, Homo sapiens
agaggcagagtgccccacctgc

SEQ ID NO: 3741628 - DNA, 19 bp, Homo sapiens
agaggcagccccattctgc

SEQ ID NO: 3741629 - DNA, 21 bp, Homo sapiens
agaggcagccccattctgcct

SEQ ID NO: 3741630 - DNA, 13 bp, Homo sapiens
agaggcagggtct

SEQ ID NO: 3741631 - DNA, 21 bp, Homo sapiens
agaggcagggtctcactctgt

SEQ ID NO: 3741632 - DNA, 14 bp, Homo sapiens
agaggccagcctgg

SEQ ID NO: 3741633 - DNA, 14 bp, Homo sapiens
agaggccatggcag

SEQ ID NO: 3741634 - DNA, 15 bp, Homo sapiens
agaggccatggcaga

SEQ ID NO: 3741635 - DNA, 21 bp, Homo sapiens
agaggcttcttcagatcagtg

SEQ ID NO: 3741636 - DNA, 13 bp, Homo sapiens
agagggaaaatgt

SEQ ID NO: 3741637 - DNA, 20 bp, Homo sapiens
agagggaaacgtgccctctg

SEQ ID NO: 3741638 - DNA, 14 bp, Homo sapiens
agagggaagaaaag

SEQ ID NO: 3741639 - DNA, 17 bp, Homo sapiens
agagggaagagtgcatt

SEQ ID NO: 3741640 - DNA, 19 bp, Homo sapiens
agagggagaagcatgaaaa

SEQ ID NO: 3741641 - DNA, 19 bp, Homo sapiens
agagggagaagggatggag

SEQ ID NO: 3741642 - DNA, 24 bp, Homo sapiens
agagggaggagaatgagcctcggc

SEQ ID NO: 3741643 - DNA, 14 bp, Homo sapiens
agagggcagaggct

SEQ ID NO: 3741644 - DNA, 21 bp, Homo sapiens
agagggcccaggcaggccacc

SEQ ID NO: 3741645 - DNA, 12 bp, Homo sapiens
agagggggccac

SEQ ID NO: 3741646 - DNA, 14 bp, Homo sapiens
agaggggggctgcc

SEQ ID NO: 3741647 - DNA, 14 bp, Homo sapiens
agagggtgctgccc

SEQ ID NO: 3741648 - DNA, 20 bp, Homo sapiens
agagggtggtgacctctgcc

SEQ ID NO: 3741649 - DNA, 22 bp, Homo sapiens
agagggtggtgacctctgcctg

SEQ ID NO: 3741650 - DNA, 23 bp, Homo sapiens
agagggtggtgacctctgcctga

SEQ ID NO: 3741651 - DNA, 20 bp, Homo sapiens
agaggtcaagcccaggagga

SEQ ID NO: 3741652 - DNA, 12 bp, Homo sapiens
agaggtcttttt

SEQ ID NO: 3741653 - DNA, 15 bp, Homo sapiens
agagtaagctgcttt

SEQ ID NO: 3741654 - DNA, 19 bp, Homo sapiens
agagtagccgagagcctgc

SEQ ID NO: 3741655 - DNA, 18 bp, Homo sapiens
agagtcagccttccccct

SEQ ID NO: 3741656 - DNA, 14 bp, Homo sapiens
agagtcctcactcc

SEQ ID NO: 3741657 - DNA, 22 bp, Homo sapiens
agagtcggaacggagaaaggtg

SEQ ID NO: 3741658 - DNA, 18 bp, Homo sapiens
agagtctcactcccctcc

SEQ ID NO: 3741659 - DNA, 20 bp, Homo sapiens
agagtctcactgttgcccag

SEQ ID NO: 3741660 - DNA, 18 bp, Homo sapiens
agagtcttgcagtgatta

SEQ ID NO: 3741661 - DNA, 22 bp, Homo sapiens
agagtctttgtaagtaaactgc

SEQ ID NO: 3741662 - DNA, 18 bp, Homo sapiens
agctgcctgttcagctcc

SEQ ID NO: 3741663 - DNA, 19 bp, Homo sapiens
agctgcctgttcagctcca

SEQ ID NO: 3741664 - DNA, 20 bp, Homo sapiens
agctgcctgttcagctccag

SEQ ID NO: 3741665 - DNA, 22 bp, Homo sapiens
agctgcctgttcagctccagct

SEQ ID NO: 3741666 - DNA, 22 bp, Homo sapiens
agctgccttgagccttaaaacc

SEQ ID NO: 3741667 - DNA, 16 bp, Homo sapiens
agctgcggtccaccca

SEQ ID NO: 3741668 - DNA, 12 bp, Homo sapiens
agctgctctgcc

SEQ ID NO: 3741669 - DNA, 20 bp, Homo sapiens
agctgctctgcccagagctg

SEQ ID NO: 3741670 - DNA, 21 bp, Homo sapiens
agctgctctgcccagagctgg

SEQ ID NO: 3741671 - DNA, 16 bp, Homo sapiens
agctgctctgtcttct

SEQ ID NO: 3741672 - DNA, 21 bp, Homo sapiens
agctgcttttgtctatgggac

SEQ ID NO: 3741673 - DNA, 23 bp, Homo sapiens
agctgcttttgtctatgggactc

SEQ ID NO: 3741674 - DNA, 21 bp, Homo sapiens
agctggaattttttattcttg

SEQ ID NO: 3741675 - DNA, 15 bp, Homo sapiens
agctggagaagaccc

SEQ ID NO: 3741676 - DNA, 20 bp, Homo sapiens
agctggccgagggtcctggc

SEQ ID NO: 3741677 - DNA, 15 bp, Homo sapiens
agctggcgtctgtct

SEQ ID NO: 3741678 - DNA, 20 bp, Homo sapiens
agctgggactacaggcaccc

SEQ ID NO: 3741679 - DNA, 13 bp, Homo sapiens
agctgggagaagg

SEQ ID NO: 3741680 - DNA, 13 bp, Homo sapiens
agctgggaggaaa

SEQ ID NO: 3741681 - DNA, 18 bp, Homo sapiens
agctgggaggaaaagaaa

SEQ ID NO: 3741682 - DNA, 19 bp, Homo sapiens
agctgggatctgactgcac

SEQ ID NO: 3741683 - DNA, 21 bp, Homo sapiens
agctgggatctgactgcacgt

SEQ ID NO: 3741684 - DNA, 18 bp, Homo sapiens
agctgggcagaaggccaa

SEQ ID NO: 3741685 - DNA, 18 bp, Homo sapiens
agctgggggccatgagct

SEQ ID NO: 3741686 - DNA, 20 bp, Homo sapiens
agctgggggccatgagctcc

SEQ ID NO: 3741687 - DNA, 22 bp, Homo sapiens
agctgggtgagtggggagacac

SEQ ID NO: 3741688 - DNA, 16 bp, Homo sapiens
agctggtcccactcag

SEQ ID NO: 3741689 - DNA, 19 bp, Homo sapiens
agctggtcccactcagtcc

SEQ ID NO: 3741690 - DNA, 13 bp, Homo sapiens
agctggtgcatta

SEQ ID NO: 3741691 - DNA, 22 bp, Homo sapiens
agctggtgcattacagagagga

SEQ ID NO: 3741692 - DNA, 14 bp, Homo sapiens
agctggtgcccgga

SEQ ID NO: 3741693 - DNA, 15 bp, Homo sapiens
agctggtgggaagcg

SEQ ID NO: 3741694 - DNA, 15 bp, Homo sapiens
agctggttagaaatg

SEQ ID NO: 3741695 - DNA, 19 bp, Homo sapiens
agctggttcctgctagaaa

SEQ ID NO: 3741696 - DNA, 22 bp, Homo sapiens
agctggttcctgctagaaatgg

SEQ ID NO: 3741697 - DNA, 15 bp, Homo sapiens
agctggtttcctcat

SEQ ID NO: 3741698 - DNA, 22 bp, Homo sapiens
agctggtttttagcggagacgg

SEQ ID NO: 3741699 - DNA, 23 bp, Homo sapiens
agctgtaagaagagactgggaag

SEQ ID NO: 3741700 - DNA, 17 bp, Homo sapiens
agctgtctgctcagaca

SEQ ID NO: 3741701 - DNA, 21 bp, Homo sapiens
agctgtgggtacagagaggtc

SEQ ID NO: 3741702 - DNA, 22 bp, Homo sapiens
agctgtggttttcttttgccat

SEQ ID NO: 3741703 - DNA, 13 bp, Homo sapiens
agctgtgtgaaat

SEQ ID NO: 3741704 - DNA, 14 bp, Homo sapiens
agctgtgtgaaata

SEQ ID NO: 3741705 - DNA, 14 bp, Homo sapiens
agctgttactgtct

SEQ ID NO: 3741706 - DNA, 13 bp, Homo sapiens
agctgtttgtcat

SEQ ID NO: 3741707 - DNA, 18 bp, Homo sapiens
agctgttttccctgacct

SEQ ID NO: 3741708 - DNA, 12 bp, Homo sapiens
agcttaaaaaaa

SEQ ID NO: 3741709 - DNA, 15 bp, Homo sapiens
agcttatcaatttgt

SEQ ID NO: 3741710 - DNA, 16 bp, Homo sapiens
agcttatcaatttgtc

SEQ ID NO: 3741711 - DNA, 23 bp, Homo sapiens
agcttatcaatttgtcattttga

SEQ ID NO: 3741712 - DNA, 17 bp, Homo sapiens
agcttattaatgctaag

SEQ ID NO: 3741713 - DNA, 18 bp, Homo sapiens
agcttattaatgctaagg

SEQ ID NO: 3741714 - DNA, 17 bp, Homo sapiens
agcttcaagtctgtgcc

SEQ ID NO: 3741715 - DNA, 19 bp, Homo sapiens
agcttcaagtctgtgcctg

SEQ ID NO: 3741716 - DNA, 24 bp, Homo sapiens
agcttcaagtctgtgcctggagct

SEQ ID NO: 3741717 - DNA, 15 bp, Homo sapiens
agcttcagccaggag

SEQ ID NO: 3741718 - DNA, 19 bp, Homo sapiens
agcttcagccaggagctgg

SEQ ID NO: 3741719 - DNA, 18 bp, Homo sapiens
agcttcatgcctttgtaa

SEQ ID NO: 3741720 - DNA, 21 bp, Homo sapiens
agcttcatgcctttgtaagtt

SEQ ID NO: 3741721 - DNA, 22 bp, Homo sapiens
agcttcatgcctttgtaagtta

SEQ ID NO: 3741722 - DNA, 17 bp, Homo sapiens
agcttcccctctctcct

SEQ ID NO: 3741723 - DNA, 13 bp, Homo sapiens
agcttctctgtga

SEQ ID NO: 3741724 - DNA, 14 bp, Homo sapiens
agcttctctgtgaa

SEQ ID NO: 3741725 - DNA, 18 bp, Homo sapiens
agcttctctttaactcag

SEQ ID NO: 3741726 - DNA, 23 bp, Homo sapiens
agcttctctttaactcaggactc

SEQ ID NO: 3741727 - DNA, 15 bp, Homo sapiens
agcttctgacctcag

SEQ ID NO: 3741728 - DNA, 17 bp, Homo sapiens
agcttctgacctcagca

SEQ ID NO: 3741729 - DNA, 16 bp, Homo sapiens
agcttcttaaatgaga

SEQ ID NO: 3741730 - DNA, 16 bp, Homo sapiens
agcttgaaagttttca

SEQ ID NO: 3741731 - DNA, 17 bp, Homo sapiens
agcttgaaagttttcag

SEQ ID NO: 3741732 - DNA, 20 bp, Homo sapiens
agcttgctgcaccccaagtc

SEQ ID NO: 3741733 - DNA, 20 bp, Homo sapiens
agcttgctgccctaggctcc

SEQ ID NO: 3741734 - DNA, 19 bp, Homo sapiens
agcttgcttcattgggctg

SEQ ID NO: 3741735 - DNA, 20 bp, Homo sapiens
agcttgcttcattgggctgt

SEQ ID NO: 3741736 - DNA, 16 bp, Homo sapiens
agcttggctgtagaag

SEQ ID NO: 3741737 - DNA, 20 bp, Homo sapiens
agcttgtaaatagctcaggt

SEQ ID NO: 3741738 - DNA, 17 bp, Homo sapiens
agctttcaaagaaggaa

SEQ ID NO: 3741739 - DNA, 20 bp, Homo sapiens
agctttccacatttgtcaca

SEQ ID NO: 3741740 - DNA, 13 bp, Homo sapiens
agctttctctgct

SEQ ID NO: 3741741 - DNA, 16 bp, Homo sapiens
agctttctctgcttca

SEQ ID NO: 3741742 - DNA, 22 bp, Homo sapiens
agctttctgtccttttggcact

SEQ ID NO: 3741743 - DNA, 16 bp, Homo sapiens
agctttgaaaattcag

SEQ ID NO: 3741744 - DNA, 18 bp, Homo sapiens
agctttgaaaattcagtg

SEQ ID NO: 3741745 - DNA, 19 bp, Homo sapiens
agctttgaaaattcagtgg

SEQ ID NO: 3741746 - DNA, 19 bp, Homo sapiens
agctttgatttagattgag

SEQ ID NO: 3741747 - DNA, 21 bp, Homo sapiens
agctttgctaccaaagcacct

SEQ ID NO: 3741748 - DNA, 23 bp, Homo sapiens
agctttgctctttggtagaaaag

SEQ ID NO: 3741749 - DNA, 12 bp, Homo sapiens
agctttggacac

SEQ ID NO: 3741750 - DNA, 20 bp, Homo sapiens
agctttggacacacacagct

SEQ ID NO: 3741751 - DNA, 20 bp, Homo sapiens
agctttggacgcacacagct

SEQ ID NO: 3741752 - DNA, 21 bp, Homo sapiens
agctttgtttgttgtcagctg

SEQ ID NO: 3741753 - DNA, 18 bp, Homo sapiens
agcttttagtacccacct

SEQ ID NO: 3741754 - DNA, 13 bp, Homo sapiens
agcttttgctttt

SEQ ID NO: 3741755 - DNA, 18 bp, Homo sapiens
agcttttttacacaaatg

SEQ ID NO: 3741756 - DNA, 20 bp, Homo sapiens
agcttttttattttttatac

SEQ ID NO: 3741757 - DNA, 22 bp, Homo sapiens
agcttttttattttttatacag

SEQ ID NO: 3741758 - DNA, 16 bp, Homo sapiens
aggaaaaaaactttta

SEQ ID NO: 3741759 - DNA, 12 bp, Homo sapiens
aggaaaaaggac

SEQ ID NO: 3741760 - DNA, 14 bp, Homo sapiens
aggaaaaaggacag

SEQ ID NO: 3741761 - DNA, 22 bp, Homo sapiens
aggaaaaaggacaggcagaaag

SEQ ID NO: 3741762 - DNA, 13 bp, Homo sapiens
aggaaaagaaaag

SEQ ID NO: 3741763 - DNA, 16 bp, Homo sapiens
aggaaaagctgctgac

SEQ ID NO: 3741764 - DNA, 13 bp, Homo sapiens
aggaaaatttcac

SEQ ID NO: 3741765 - DNA, 17 bp, Homo sapiens
aggaaactcacctgctg

SEQ ID NO: 3741766 - DNA, 20 bp, Homo sapiens
aggaaactcacctgctggcc

SEQ ID NO: 3741767 - DNA, 21 bp, Homo sapiens
aggaaactctgcattctagta

SEQ ID NO: 3741768 - DNA, 15 bp, Homo sapiens
aggaaagatttgtac

SEQ ID NO: 3741769 - DNA, 18 bp, Homo sapiens
aggaaagcaataaatgaa

SEQ ID NO: 3741770 - DNA, 19 bp, Homo sapiens
aggaaagcaataaatgaat

SEQ ID NO: 3741771 - DNA, 13 bp, Homo sapiens
aggaaaggccagc

SEQ ID NO: 3741772 - DNA, 14 bp, Homo sapiens
aggaaaggccagct

SEQ ID NO: 3741773 - DNA, 15 bp, Homo sapiens
aggaaaggccagctg

SEQ ID NO: 3741774 - DNA, 24 bp, Homo sapiens
aggaaaggccagctggcagcagag

SEQ ID NO: 3741775 - DNA, 18 bp, Homo sapiens
aggaaagtgatatgcatt

SEQ ID NO: 3741776 - DNA, 23 bp, Homo sapiens
aggccccaaaaccacagccctgt

SEQ ID NO: 3741777 - DNA, 12 bp, Homo sapiens
aggccccaggaa

SEQ ID NO: 3741778 - DNA, 13 bp, Homo sapiens
aggccccaggaag

SEQ ID NO: 3741779 - DNA, 15 bp, Homo sapiens
aggccccaggaagcc

SEQ ID NO: 3741780 - DNA, 18 bp, Homo sapiens
aggccccgcttgtccagc

SEQ ID NO: 3741781 - DNA, 22 bp, Homo sapiens
aggccccgcttgtccagcgcct

SEQ ID NO: 3741782 - DNA, 13 bp, Homo sapiens
aggcccctgccac

SEQ ID NO: 3741783 - DNA, 15 bp, Homo sapiens
aggcccctgccaccc

SEQ ID NO: 3741784 - DNA, 18 bp, Homo sapiens
aggcccctgccaccctgg

SEQ ID NO: 3741785 - DNA, 14 bp, Homo sapiens
aggcccggctccag

SEQ ID NO: 3741786 - DNA, 15 bp, Homo sapiens
aggcccggctccagg

SEQ ID NO: 3741787 - DNA, 20 bp, Homo sapiens
aggcccggctccaggctcct

SEQ ID NO: 3741788 - DNA, 15 bp, Homo sapiens
aggcccggggctggc

SEQ ID NO: 3741789 - DNA, 15 bp, Homo sapiens
aggcccgtccggcag

SEQ ID NO: 3741790 - DNA, 22 bp, Homo sapiens
aggcccttattttcaagaaact

SEQ ID NO: 3741791 - DNA, 13 bp, Homo sapiens
aggcccttcctct

SEQ ID NO: 3741792 - DNA, 18 bp, Homo sapiens
aggcccttcctctccact

SEQ ID NO: 3741793 - DNA, 15 bp, Homo sapiens
aggccgagaagcaag

SEQ ID NO: 3741794 - DNA, 17 bp, Homo sapiens
aggccgctgttcaccca

SEQ ID NO: 3741795 - DNA, 12 bp, Homo sapiens
aggccgtggctg

SEQ ID NO: 3741796 - DNA, 15 bp, Homo sapiens
aggcctccagctcag

SEQ ID NO: 3741797 - DNA, 16 bp, Homo sapiens
aggcctccagctcagc

SEQ ID NO: 3741798 - DNA, 13 bp, Homo sapiens
aggcctccctcaa

SEQ ID NO: 3741799 - DNA, 23 bp, Homo sapiens
aggcctgccagacggcacccacc

SEQ ID NO: 3741800 - DNA, 12 bp, Homo sapiens
aggcctggccag

SEQ ID NO: 3741801 - DNA, 16 bp, Homo sapiens
aggcctggccagatgc

SEQ ID NO: 3741802 - DNA, 16 bp, Homo sapiens
aggcctgggtctgtgt

SEQ ID NO: 3741803 - DNA, 23 bp, Homo sapiens
aggcctgggtgctggctgcccag

SEQ ID NO: 3741804 - DNA, 15 bp, Homo sapiens
aggcctgtccctggc

SEQ ID NO: 3741805 - DNA, 16 bp, Homo sapiens
aggcctgtccctggcc

SEQ ID NO: 3741806 - DNA, 14 bp, Homo sapiens
aggccttcttgtga

SEQ ID NO: 3741807 - DNA, 13 bp, Homo sapiens
aggcgtgaggatg

SEQ ID NO: 3741808 - DNA, 18 bp, Homo sapiens
aggcgttcttcgaggtgg

SEQ ID NO: 3741809 - DNA, 13 bp, Homo sapiens
aggctactcacct

SEQ ID NO: 3741810 - DNA, 18 bp, Homo sapiens
aggctattattttcactg

SEQ ID NO: 3741811 - DNA, 16 bp, Homo sapiens
aggctcagtctcagga

SEQ ID NO: 3741812 - DNA, 21 bp, Homo sapiens
aggctcatagggaagacctgc

SEQ ID NO: 3741813 - DNA, 22 bp, Homo sapiens
aggctcatagggaagacctgct

SEQ ID NO: 3741814 - DNA, 13 bp, Homo sapiens
aggctccttcctg

SEQ ID NO: 3741815 - DNA, 16 bp, Homo sapiens
aggctccttcctgtct

SEQ ID NO: 3741816 - DNA, 18 bp, Homo sapiens
aggctctaaccacacagc

SEQ ID NO: 3741817 - DNA, 13 bp, Homo sapiens
aggctctgcacag

SEQ ID NO: 3741818 - DNA, 23 bp, Homo sapiens
aggctctgccctgccctagctcc

SEQ ID NO: 3741819 - DNA, 14 bp, Homo sapiens
aggctcttctcctt

SEQ ID NO: 3741820 - DNA, 15 bp, Homo sapiens
aggctctttctgggc

SEQ ID NO: 3741821 - DNA, 16 bp, Homo sapiens
aggctgaaagaggcca

SEQ ID NO: 3741822 - DNA, 16 bp, Homo sapiens
aggctgagactgcggg

SEQ ID NO: 3741823 - DNA, 20 bp, Homo sapiens
aggctgaggaaaggccagct

SEQ ID NO: 3741824 - DNA, 13 bp, Homo sapiens
aggctgaggactt

SEQ ID NO: 3741825 - DNA, 15 bp, Homo sapiens
aggctgaggcagaag

SEQ ID NO: 3741826 - DNA, 17 bp, Homo sapiens
aggctgaggcagaagaa

SEQ ID NO: 3741827 - DNA, 14 bp, Homo sapiens
aggctgaggcagga

SEQ ID NO: 3741828 - DNA, 15 bp, Homo sapiens
aggctgaggcaggag

SEQ ID NO: 3741829 - DNA, 21 bp, Homo sapiens
aggctgcagtcagtcatgatg

SEQ ID NO: 3741830 - DNA, 19 bp, Homo sapiens
aggctgcagtgagccgaga

SEQ ID NO: 3741831 - DNA, 19 bp, Homo sapiens
aggctgcatagaaggagga

SEQ ID NO: 3741832 - DNA, 21 bp, Homo sapiens
aggctggactccagatctgca

SEQ ID NO: 3741833 - DNA, 12 bp, Homo sapiens
aggctggagctg

SEQ ID NO: 3741834 - DNA, 14 bp, Homo sapiens
aggctggaggcagg

SEQ ID NO: 3741835 - DNA, 17 bp, Homo sapiens
aggctggaggcagggcc

SEQ ID NO: 3741836 - DNA, 19 bp, Homo sapiens
aggctggaggcagggcctt

SEQ ID NO: 3741837 - DNA, 20 bp, Homo sapiens
aggctggcaccgccttctct

SEQ ID NO: 3741838 - DNA, 14 bp, Homo sapiens
aggctggcctcaga

SEQ ID NO: 3741839 - DNA, 15 bp, Homo sapiens
aggctggcctcagac

SEQ ID NO: 3741840 - DNA, 17 bp, Homo sapiens
aggctggcgtgcagtgg

SEQ ID NO: 3741841 - DNA, 20 bp, Homo sapiens
aggctggcttgtcccctcct

SEQ ID NO: 3741842 - DNA, 12 bp, Homo sapiens
aggctgggccaa

SEQ ID NO: 3741843 - DNA, 20 bp, Homo sapiens
aggctgggccaagccaggga

SEQ ID NO: 3741844 - DNA, 14 bp, Homo sapiens
aggctgggcccaga

SEQ ID NO: 3741845 - DNA, 18 bp, Homo sapiens
aggctgggcccagaggca

SEQ ID NO: 3741846 - DNA, 20 bp, Homo sapiens
aggctgggcccagaggcaca

SEQ ID NO: 3741847 - DNA, 19 bp, Homo sapiens
aggctgggcttcagtggca

SEQ ID NO: 3741848 - DNA, 22 bp, Homo sapiens
aggctgggcttcagtggcagct

SEQ ID NO: 3741849 - DNA, 22 bp, Homo sapiens
aggctgggggaagaagctctct

SEQ ID NO: 3741850 - DNA, 19 bp, Homo sapiens
aggctgggtgcccacagcc

SEQ ID NO: 3741851 - DNA, 13 bp, Homo sapiens
aggctgtatccca

SEQ ID NO: 3741852 - DNA, 23 bp, Homo sapiens
aggctgtcttctcaggctctgcc

SEQ ID NO: 3741853 - DNA, 15 bp, Homo sapiens
aggctgtgggcctca

SEQ ID NO: 3741854 - DNA, 14 bp, Homo sapiens
aggcttacacccac

SEQ ID NO: 3741855 - DNA, 15 bp, Homo sapiens
aggcttgtcagagct

SEQ ID NO: 3741856 - DNA, 16 bp, Homo sapiens
aggcttgtcagagctg

SEQ ID NO: 3741857 - DNA, 18 bp, Homo sapiens
aggcttgtcagagctggg

SEQ ID NO: 3741858 - DNA, 20 bp, Homo sapiens
aggcttgtcagagctgggag

SEQ ID NO: 3741859 - DNA, 17 bp, Homo sapiens
agggaacagacaggaga

SEQ ID NO: 3741860 - DNA, 18 bp, Homo sapiens
agggaacagacaggagaa

SEQ ID NO: 3741861 - DNA, 19 bp, Homo sapiens
agggaacagacaggagaaa

SEQ ID NO: 3741862 - DNA, 14 bp, Homo sapiens
agggaacaggaaaa

SEQ ID NO: 3741863 - DNA, 23 bp, Homo sapiens
agggaagcccagctccagggcca

SEQ ID NO: 3741864 - DNA, 16 bp, Homo sapiens
agggaaggccacctgc

SEQ ID NO: 3741865 - DNA, 15 bp, Homo sapiens
agggaatggcacagc

SEQ ID NO: 3741866 - DNA, 16 bp, Homo sapiens
agggaattgcagagta

SEQ ID NO: 3741867 - DNA, 15 bp, Homo sapiens
agggaatttcaggaa

SEQ ID NO: 3741868 - DNA, 20 bp, Homo sapiens
agggacagagacacctgcac

SEQ ID NO: 3741869 - DNA, 20 bp, Homo sapiens
agggacagcccactgagaag

SEQ ID NO: 3741870 - DNA, 21 bp, Homo sapiens
agggaccaaggacccctcacc

SEQ ID NO: 3741871 - DNA, 20 bp, Homo sapiens
agggaccagccaagagggct

SEQ ID NO: 3741872 - DNA, 13 bp, Homo sapiens
agggacctgggga

SEQ ID NO: 3741873 - DNA, 14 bp, Homo sapiens
agggacctggggaa

SEQ ID NO: 3741874 - DNA, 13 bp, Homo sapiens
agggacttaaaaa

SEQ ID NO: 3741875 - DNA, 19 bp, Homo sapiens
agggacttggaagctccgc

SEQ ID NO: 3741876 - DNA, 20 bp, Homo sapiens
agggacttggaagctccgct

SEQ ID NO: 3741877 - DNA, 16 bp, Homo sapiens
agggagagcggggcag

SEQ ID NO: 3741878 - DNA, 17 bp, Homo sapiens
agggagcaagacagaga

SEQ ID NO: 3741879 - DNA, 23 bp, Homo sapiens
agggagcagagaaggccaggggc

SEQ ID NO: 3741880 - DNA, 17 bp, Homo sapiens
agggagcggaaagcagc

SEQ ID NO: 3741881 - DNA, 18 bp, Homo sapiens
agggaggtttgtgagagc

SEQ ID NO: 3741882 - DNA, 15 bp, Homo sapiens
agggagtacctgctg

SEQ ID NO: 3741883 - DNA, 16 bp, Homo sapiens
agggagtacctgctgc

SEQ ID NO: 3741884 - DNA, 17 bp, Homo sapiens
agggagtgacagaggca

SEQ ID NO: 3741885 - DNA, 18 bp, Homo sapiens
agggagtgacagaggcag

SEQ ID NO: 3741886 - DNA, 19 bp, Homo sapiens
agggagtgacagaggcagc

SEQ ID NO: 3741887 - DNA, 14 bp, Homo sapiens
agggatacactgaa

SEQ ID NO: 3741888 - DNA, 22 bp, Homo sapiens
agggatagtcaccttttaaatc

SEQ ID NO: 3741889 - DNA, 16 bp, Homo sapiens
agggatattttttagt

SEQ ID NO: 3741890 - DNA, 13 bp, Homo sapiens
agggatcacaggg

SEQ ID NO: 3741891 - DNA, 14 bp, Homo sapiens
agggatcacagggc

SEQ ID NO: 3741892 - DNA, 16 bp, Homo sapiens
agggatgaggtgctgg

SEQ ID NO: 3741893 - DNA, 19 bp, Homo sapiens
agggatgaggtgctgggag

SEQ ID NO: 3741894 - DNA, 18 bp, Homo sapiens
agggatgccatctgtggg

SEQ ID NO: 3741895 - DNA, 15 bp, Homo sapiens
agggattcaggctgc

SEQ ID NO: 3741896 - DNA, 22 bp, Homo sapiens
agggattttcagccctcagaat

SEQ ID NO: 3741897 - DNA, 17 bp, Homo sapiens
agggcactggtggcccg

SEQ ID NO: 3741898 - DNA, 20 bp, Homo sapiens
agggcagaggctggaggcag

SEQ ID NO: 3741899 - DNA, 16 bp, Homo sapiens
agggcagcctgcctgg

SEQ ID NO: 3741900 - DNA, 17 bp, Homo sapiens
agggcagcctgcctgga

SEQ ID NO: 3741901 - DNA, 18 bp, Homo sapiens
agggcagcctgcctggag

SEQ ID NO: 3741902 - DNA, 21 bp, Homo sapiens
agggcaggaaggagagcctgc

SEQ ID NO: 3741903 - DNA, 17 bp, Homo sapiens
agggcagggcatctcct

SEQ ID NO: 3741904 - DNA, 13 bp, Homo sapiens
agggcagtggagg

SEQ ID NO: 3741905 - DNA, 14 bp, Homo sapiens
agggcagtggaggt

SEQ ID NO: 3741906 - DNA, 13 bp, Homo sapiens
agggcatctcctg

SEQ ID NO: 3741907 - DNA, 14 bp, Homo sapiens
agggcatctcctgt

SEQ ID NO: 3741908 - DNA, 16 bp, Homo sapiens
agggcattcaaatggg

SEQ ID NO: 3741909 - DNA, 19 bp, Homo sapiens
agggccacgtgccaggccc

SEQ ID NO: 3741910 - DNA, 20 bp, Homo sapiens
agggccacgtgccaggcccg

SEQ ID NO: 3741911 - DNA, 15 bp, Homo sapiens
agggccactctgcct

SEQ ID NO: 3741912 - DNA, 19 bp, Homo sapiens
agggccagggccctgcaga

SEQ ID NO: 3741913 - DNA, 13 bp, Homo sapiens
agggccagtcctg

SEQ ID NO: 3741914 - DNA, 23 bp, Homo sapiens
agggcccacttgtatcctctggt

SEQ ID NO: 3741915 - DNA, 14 bp, Homo sapiens
agggcccagagagg

SEQ ID NO: 3741916 - DNA, 14 bp, Homo sapiens
agggcccaggcagg

SEQ ID NO: 3741917 - DNA, 13 bp, Homo sapiens
agggccctacctg

SEQ ID NO: 3741918 - DNA, 22 bp, Homo sapiens
agggcctcactctgttgctcag

SEQ ID NO: 3741919 - DNA, 16 bp, Homo sapiens
agggccttaaaagcca

SEQ ID NO: 3741920 - DNA, 18 bp, Homo sapiens
agggccttaaaagccatc

SEQ ID NO: 3741921 - DNA, 13 bp, Homo sapiens
agggcgaggggag

SEQ ID NO: 3741922 - DNA, 14 bp, Homo sapiens
agggctaagagcta

SEQ ID NO: 3741923 - DNA, 21 bp, Homo sapiens
agggctaagagctagcgctgc

SEQ ID NO: 3741924 - DNA, 13 bp, Homo sapiens
agggctcagcctg

SEQ ID NO: 3741925 - DNA, 15 bp, Homo sapiens
agggctcagcctggt

SEQ ID NO: 3741926 - DNA, 19 bp, Homo sapiens
agggctcagcggggacagc

SEQ ID NO: 3741927 - DNA, 15 bp, Homo sapiens
agggctctaaaaaaa

SEQ ID NO: 3741928 - DNA, 23 bp, Homo sapiens
agggctctaaaaaaagccccaaa

SEQ ID NO: 3741929 - DNA, 21 bp, Homo sapiens
agggctctgatattccatgaa

SEQ ID NO: 3741930 - DNA, 16 bp, Homo sapiens
agggctggtctctgct

SEQ ID NO: 3741931 - DNA, 17 bp, Homo sapiens
aggggaataatagaaga

SEQ ID NO: 3741932 - DNA, 19 bp, Homo sapiens
aggggactatttatgaagg

SEQ ID NO: 3741933 - DNA, 17 bp, Homo sapiens
aggggagagggtctgga

SEQ ID NO: 3741934 - DNA, 16 bp, Homo sapiens
aggggagggtggcagg

SEQ ID NO: 3741935 - DNA, 16 bp, Homo sapiens
aggggatagagagaga

SEQ ID NO: 3741936 - DNA, 19 bp, Homo sapiens
aggggcaaacacctgctga

SEQ ID NO: 3741937 - DNA, 12 bp, Homo sapiens
aggggcaggagc

SEQ ID NO: 3741938 - DNA, 20 bp, Homo sapiens
aggggcagtctggaggggca

SEQ ID NO: 3741939 - DNA, 16 bp, Homo sapiens
aggggcatctgcccct

SEQ ID NO: 3741940 - DNA, 21 bp, Homo sapiens
aggggcatctgcccctccccc

SEQ ID NO: 3741941 - DNA, 22 bp, Homo sapiens
aggggcccaaattctttcagtg

SEQ ID NO: 3741942 - DNA, 12 bp, Homo sapiens
aggggccctggt

SEQ ID NO: 3741943 - DNA, 12 bp, Homo sapiens
aggggcctggca

SEQ ID NO: 3741944 - DNA, 15 bp, Homo sapiens
aggggcctggcagcc

SEQ ID NO: 3741945 - DNA, 14 bp, Homo sapiens
aggggcgtgtggct

SEQ ID NO: 3741946 - DNA, 11 bp, Homo sapiens
aggggctctgc

SEQ ID NO: 3741947 - DNA, 22 bp, Homo sapiens
aggggctgctgacctccacagc

SEQ ID NO: 3741948 - DNA, 18 bp, Homo sapiens
aggggctggactggctgt

SEQ ID NO: 3741949 - DNA, 17 bp, Homo sapiens
aggggctttctggagag

SEQ ID NO: 3741950 - DNA, 20 bp, Homo sapiens
aggggctttctggagaggag

SEQ ID NO: 3741951 - DNA, 20 bp, Homo sapiens
agggggagggggttacaaac

SEQ ID NO: 3741952 - DNA, 17 bp, Homo sapiens
agggggcatctggcctt

SEQ ID NO: 3741953 - DNA, 12 bp, Homo sapiens
aggggggagggg

SEQ ID NO: 3741954 - DNA, 23 bp, Homo sapiens
agggggtgattagagggaggaga

SEQ ID NO: 3741955 - DNA, 20 bp, Homo sapiens
agggggttacaaactgcaat

SEQ ID NO: 3741956 - DNA, 18 bp, Homo sapiens
aggggtctccaggaggag

SEQ ID NO: 3741957 - DNA, 21 bp, Homo sapiens
aggggtggaggagagcctggt

SEQ ID NO: 3741958 - DNA, 13 bp, Homo sapiens
aggggtggtcctg

SEQ ID NO: 3741959 - DNA, 18 bp, Homo sapiens
aggggtggtcctgactca

SEQ ID NO: 3741960 - DNA, 20 bp, Homo sapiens
aggggttggttgaggtggaa

SEQ ID NO: 3741961 - DNA, 14 bp, Homo sapiens
agggtaaattattc

SEQ ID NO: 3741962 - DNA, 15 bp, Homo sapiens
agggtaaattattca

SEQ ID NO: 3741963 - DNA, 14 bp, Homo sapiens
agggtaaggtgcct

SEQ ID NO: 3741964 - DNA, 19 bp, Homo sapiens
agggtactaaggaatcttt

SEQ ID NO: 3741965 - DNA, 17 bp, Homo sapiens
agggtagtctggtttct

SEQ ID NO: 3741966 - DNA, 18 bp, Homo sapiens
agggtatcaggtgctgcc

SEQ ID NO: 3741967 - DNA, 20 bp, Homo sapiens
agggtatccaagttggactg

SEQ ID NO: 3741968 - DNA, 22 bp, Homo sapiens
agggtatccaagttggactggg

SEQ ID NO: 3741969 - DNA, 21 bp, Homo sapiens
agggtcagagaggagtcagag

SEQ ID NO: 3741970 - DNA, 14 bp, Homo sapiens
agggtcctggctcc

SEQ ID NO: 3741971 - DNA, 16 bp, Homo sapiens
agggtcctggctcctg

SEQ ID NO: 3741972 - DNA, 16 bp, Homo sapiens
agggtctagggagaga

SEQ ID NO: 3741973 - DNA, 19 bp, Homo sapiens
agggtctagggagagaccc

SEQ ID NO: 3741974 - DNA, 23 bp, Homo sapiens
agggtctcactatgttgcccagg

SEQ ID NO: 3741975 - DNA, 14 bp, Homo sapiens
agggtctggagaag

SEQ ID NO: 3741976 - DNA, 22 bp, Homo sapiens
agggtgctgccccatgaagcca

SEQ ID NO: 3741977 - DNA, 17 bp, Homo sapiens
agggtgctgcttccctc

SEQ ID NO: 3741978 - DNA, 14 bp, Homo sapiens
agggtggcaggtga

SEQ ID NO: 3741979 - DNA, 21 bp, Homo sapiens
agggtggcatcccagtggcct

SEQ ID NO: 3741980 - DNA, 11 bp, Homo sapiens
agggtggccct

SEQ ID NO: 3741981 - DNA, 19 bp, Homo sapiens
agggtgggagagcccagcc

SEQ ID NO: 3741982 - DNA, 18 bp, Homo sapiens
agggttactatgcacaat

SEQ ID NO: 3741983 - DNA, 15 bp, Homo sapiens
agggttagggagggg

SEQ ID NO: 3741984 - DNA, 16 bp, Homo sapiens
agggttagggaggggt

SEQ ID NO: 3741985 - DNA, 21 bp, Homo sapiens
agggttcctgtagacctaggg

SEQ ID NO: 3741986 - DNA, 15 bp, Homo sapiens
agggttgggcccaga

SEQ ID NO: 3741987 - DNA, 13 bp, Homo sapiens
agggttgggctgg

SEQ ID NO: 3741988 - DNA, 21 bp, Homo sapiens
agggttgttaatggtgcaaat

SEQ ID NO: 3741989 - DNA, 19 bp, Homo sapiens
agggttttccaccctggaa

SEQ ID NO: 3741990 - DNA, 13 bp, Homo sapiens
aggtaaaattcta

SEQ ID NO: 3741991 - DNA, 14 bp, Homo sapiens
aggtaaaattctaa

SEQ ID NO: 3741992 - DNA, 16 bp, Homo sapiens
aggtaaaattctaaat

SEQ ID NO: 3741993 - DNA, 13 bp, Homo sapiens
aggtaacaggcag

SEQ ID NO: 3741994 - DNA, 15 bp, Homo sapiens
aggtacagagaagga

SEQ ID NO: 3741995 - DNA, 20 bp, Homo sapiens
aggtaccccagctctgcttg

SEQ ID NO: 3741996 - DNA, 15 bp, Homo sapiens
aggtactaaatacct

SEQ ID NO: 3741997 - DNA, 14 bp, Homo sapiens
aggtactctcctgg

SEQ ID NO: 3741998 - DNA, 23 bp, Homo sapiens
aggtagaaatatctgaaaatgta

SEQ ID NO: 3741999 - DNA, 19 bp, Homo sapiens
aggtagccctggccagagg

SEQ ID NO: 3742000 - DNA, 14 bp, Homo sapiens
aggtagctgcccct

SEQ ID NO: 3742001 - DNA, 19 bp, Homo sapiens
aggtaggagaattgcttga

SEQ ID NO: 3742002 - DNA, 20 bp, Homo sapiens
aggtaggtggatcacctgag

SEQ ID NO: 3742003 - DNA, 15 bp, Homo sapiens
aggtataattttatg

SEQ ID NO: 3742004 - DNA, 13 bp, Homo sapiens
aggtatgaataag

SEQ ID NO: 3742005 - DNA, 22 bp, Homo sapiens
aggtatgaccttctaggaagct

SEQ ID NO: 3742006 - DNA, 20 bp, Homo sapiens
aggtatggaagggtttgtgg

SEQ ID NO: 3742007 - DNA, 19 bp, Homo sapiens
aggaaataaaacctttcaa

SEQ ID NO: 3742008 - DNA, 13 bp, Homo sapiens
aggaacagaagga

SEQ ID NO: 3742009 - DNA, 21 bp, Homo sapiens
aggaacagaaggatgaatgag

SEQ ID NO: 3742010 - DNA, 21 bp, Homo sapiens
aggaacagctatgggagcccc

SEQ ID NO: 3742011 - DNA, 13 bp, Homo sapiens
aggaacctggacc

SEQ ID NO: 3742012 - DNA, 17 bp, Homo sapiens
aggaagagcaggcacat

SEQ ID NO: 3742013 - DNA, 20 bp, Homo sapiens
aggaagatcactttgctctg

SEQ ID NO: 3742014 - DNA, 21 bp, Homo sapiens
aggaagatcactttgctctga

SEQ ID NO: 3742015 - DNA, 18 bp, Homo sapiens
aggaagcaccccatgcca

SEQ ID NO: 3742016 - DNA, 14 bp, Homo sapiens
aggaagcagccaag

SEQ ID NO: 3742017 - DNA, 21 bp, Homo sapiens
aggaagccgtgccctgccccc

SEQ ID NO: 3742018 - DNA, 16 bp, Homo sapiens
aggaagctcagactgg

SEQ ID NO: 3742019 - DNA, 20 bp, Homo sapiens
aggaagctcagactggttga

SEQ ID NO: 3742020 - DNA, 17 bp, Homo sapiens
aggaagctgctccgtgc

SEQ ID NO: 3742021 - DNA, 13 bp, Homo sapiens
aggaagctttctc

SEQ ID NO: 3742022 - DNA, 19 bp, Homo sapiens
aggaagctttctctgcttc

SEQ ID NO: 3742023 - DNA, 20 bp, Homo sapiens
aggaagctttctctgcttca

SEQ ID NO: 3742024 - DNA, 21 bp, Homo sapiens
aggaagctttctctgcttcag

SEQ ID NO: 3742025 - DNA, 22 bp, Homo sapiens
aggaagctttctctgcttcagc

SEQ ID NO: 3742026 - DNA, 17 bp, Homo sapiens
aggaaggatgagcattt

SEQ ID NO: 3742027 - DNA, 12 bp, Homo sapiens
aggaagggcaaa

SEQ ID NO: 3742028 - DNA, 12 bp, Homo sapiens
aggaaggggctg

SEQ ID NO: 3742029 - DNA, 14 bp, Homo sapiens
aggaaggggctgga

SEQ ID NO: 3742030 - DNA, 17 bp, Homo sapiens
aggaaggggctggactg

SEQ ID NO: 3742031 - DNA, 19 bp, Homo sapiens
aggaaggggggttgcagtg

SEQ ID NO: 3742032 - DNA, 17 bp, Homo sapiens
aggaagtgtaacagctg

SEQ ID NO: 3742033 - DNA, 18 bp, Homo sapiens
aggaagtgtaacagctga

SEQ ID NO: 3742034 - DNA, 17 bp, Homo sapiens
aggaatcaacagggcag

SEQ ID NO: 3742035 - DNA, 15 bp, Homo sapiens
aggaatcagacttca

SEQ ID NO: 3742036 - DNA, 20 bp, Homo sapiens
aggaatccagacccggctgc

SEQ ID NO: 3742037 - DNA, 23 bp, Homo sapiens
aggaatccagacccggctgcgtg

SEQ ID NO: 3742038 - DNA, 13 bp, Homo sapiens
aggaatgaagata

SEQ ID NO: 3742039 - DNA, 24 bp, Homo sapiens
aggaatgcctcctccctgggcaga

SEQ ID NO: 3742040 - DNA, 13 bp, Homo sapiens
aggaatgcctgtg

SEQ ID NO: 3742041 - DNA, 14 bp, Homo sapiens
aggaatgcctgtgc

SEQ ID NO: 3742042 - DNA, 15 bp, Homo sapiens
aggaatgcctgtgcc

SEQ ID NO: 3742043 - DNA, 20 bp, Homo sapiens
aggaatgctcccccatcctc

SEQ ID NO: 3742044 - DNA, 20 bp, Homo sapiens
aggaatgcttggaatatctg

SEQ ID NO: 3742045 - DNA, 23 bp, Homo sapiens
aggaattcccagcccaaagctgt

SEQ ID NO: 3742046 - DNA, 15 bp, Homo sapiens
aggaatttctgagtg

SEQ ID NO: 3742047 - DNA, 18 bp, Homo sapiens
aggacaacgaggaagccc

SEQ ID NO: 3742048 - DNA, 18 bp, Homo sapiens
aggacacctgtactggag

SEQ ID NO: 3742049 - DNA, 20 bp, Homo sapiens
aggacacctgtactggagag

SEQ ID NO: 3742050 - DNA, 19 bp, Homo sapiens
aggacactaaccacgctgg

SEQ ID NO: 3742051 - DNA, 23 bp, Homo sapiens
aggacactaaccacgctggacct

SEQ ID NO: 3742052 - DNA, 23 bp, Homo sapiens
aggacagcctgtggcggtgcctg

SEQ ID NO: 3742053 - DNA, 18 bp, Homo sapiens
aggacaggaccagatttt

SEQ ID NO: 3742054 - DNA, 22 bp, Homo sapiens
aggacagggaggtgaccccagg

SEQ ID NO: 3742055 - DNA, 18 bp, Homo sapiens
aggacagtgcttcagcct

SEQ ID NO: 3742056 - DNA, 20 bp, Homo sapiens
aggacagtgcttcagcctga

SEQ ID NO: 3742057 - DNA, 15 bp, Homo sapiens
aggacattgcggaca

SEQ ID NO: 3742058 - DNA, 19 bp, Homo sapiens
aggacattgcggacagcca

SEQ ID NO: 3742059 - DNA, 23 bp, Homo sapiens
aggacattgcggacagccacggc

SEQ ID NO: 3742060 - DNA, 15 bp, Homo sapiens
aggacatttcccagg

SEQ ID NO: 3742061 - DNA, 12 bp, Homo sapiens
aggaccactcct

SEQ ID NO: 3742062 - DNA, 16 bp, Homo sapiens
aggaccactcctgtac

SEQ ID NO: 3742063 - DNA, 12 bp, Homo sapiens
aggaccaggact

SEQ ID NO: 3742064 - DNA, 21 bp, Homo sapiens
aggaccaggactccctcctca

SEQ ID NO: 3742065 - DNA, 18 bp, Homo sapiens
aggacccatcacgcctgt

SEQ ID NO: 3742066 - DNA, 20 bp, Homo sapiens
aggacccatcacgcctgtgc

SEQ ID NO: 3742067 - DNA, 13 bp, Homo sapiens
aggacccctcacc

SEQ ID NO: 3742068 - DNA, 15 bp, Homo sapiens
aggacccctcacctt

SEQ ID NO: 3742069 - DNA, 20 bp, Homo sapiens
aggacccggaggggcctggc

SEQ ID NO: 3742070 - DNA, 16 bp, Homo sapiens
aggaccctcgctggcc

SEQ ID NO: 3742071 - DNA, 19 bp, Homo sapiens
aggaccctcgctggccccc

SEQ ID NO: 3742072 - DNA, 19 bp, Homo sapiens
aggacccttcagaggtggc

SEQ ID NO: 3742073 - DNA, 20 bp, Homo sapiens
aggacccttcccttgagccc

SEQ ID NO: 3742074 - DNA, 22 bp, Homo sapiens
aggacccttcccttgagccctc

SEQ ID NO: 3742075 - DNA, 16 bp, Homo sapiens
aggaccgccaaagaat

SEQ ID NO: 3742076 - DNA, 16 bp, Homo sapiens
aggacctatgtttgct

SEQ ID NO: 3742077 - DNA, 21 bp, Homo sapiens
aggacctatgtttgctcagaa

SEQ ID NO: 3742078 - DNA, 11 bp, Homo sapiens
aggactccagc

SEQ ID NO: 3742079 - DNA, 12 bp, Homo sapiens
aggactccctcc

SEQ ID NO: 3742080 - DNA, 15 bp, Homo sapiens
aggactccctcctca

SEQ ID NO: 3742081 - DNA, 16 bp, Homo sapiens
aggactccctcctcac

SEQ ID NO: 3742082 - DNA, 23 bp, Homo sapiens
aggactccctcctcacctctgga

SEQ ID NO: 3742083 - DNA, 13 bp, Homo sapiens
aggactctgcctc

SEQ ID NO: 3742084 - DNA, 19 bp, Homo sapiens
aggactgaattgtccccag

SEQ ID NO: 3742085 - DNA, 21 bp, Homo sapiens
aggactgcaccattgctgctc

SEQ ID NO: 3742086 - DNA, 21 bp, Homo sapiens
aggactgcatggtaatttata

SEQ ID NO: 3742087 - DNA, 22 bp, Homo sapiens
aggactgccgaccgaggctgga

SEQ ID NO: 3742088 - DNA, 22 bp, Homo sapiens
aggactgttttttcctgagctt

SEQ ID NO: 3742089 - DNA, 16 bp, Homo sapiens
aggacttgaaagcatc

SEQ ID NO: 3742090 - DNA, 21 bp, Homo sapiens
aggacttgaaagcatccatgt

SEQ ID NO: 3742091 - DNA, 23 bp, Homo sapiens
aggacttgccctcgtggtggaaa

SEQ ID NO: 3742092 - DNA, 22 bp, Homo sapiens
aggacttttctttgtggcttcc

SEQ ID NO: 3742093 - DNA, 23 bp, Homo sapiens
aggacttttctttgtggcttcct

SEQ ID NO: 3742094 - DNA, 14 bp, Homo sapiens
aggagaaacagaga

SEQ ID NO: 3742095 - DNA, 16 bp, Homo sapiens
aggagaaacagagaca

SEQ ID NO: 3742096 - DNA, 16 bp, Homo sapiens
aggagaaggaaggaga

SEQ ID NO: 3742097 - DNA, 18 bp, Homo sapiens
aggagaatccaagcgagg

SEQ ID NO: 3742098 - DNA, 20 bp, Homo sapiens
aggagaatcgcttgaaccca

SEQ ID NO: 3742099 - DNA, 14 bp, Homo sapiens
aggagacccacagg

SEQ ID NO: 3742100 - DNA, 21 bp, Homo sapiens
aggagacctggcactggatgc

SEQ ID NO: 3742101 - DNA, 13 bp, Homo sapiens
aggagactcacct

SEQ ID NO: 3742102 - DNA, 14 bp, Homo sapiens
aggagactcacctc

SEQ ID NO: 3742103 - DNA, 18 bp, Homo sapiens
aggagactcacctctgcc

SEQ ID NO: 3742104 - DNA, 20 bp, Homo sapiens
aggagagcctgctgcatggg

SEQ ID NO: 3742105 - DNA, 19 bp, Homo sapiens
aggagagggaaaatgtttt

SEQ ID NO: 3742106 - DNA, 13 bp, Homo sapiens
aggagaggggcag

SEQ ID NO: 3742107 - DNA, 19 bp, Homo sapiens
aggagaggggcagaacagc

SEQ ID NO: 3742108 - DNA, 20 bp, Homo sapiens
aggagatggaagttgcagtg

SEQ ID NO: 3742109 - DNA, 17 bp, Homo sapiens
aggagatgtaagagctt

SEQ ID NO: 3742110 - DNA, 22 bp, Homo sapiens
aggagatgtaagagctttacaa

SEQ ID NO: 3742111 - DNA, 11 bp, Homo sapiens
aggagcctggc

SEQ ID NO: 3742112 - DNA, 17 bp, Homo sapiens
aggagctcttcaggcct

SEQ ID NO: 3742113 - DNA, 13 bp, Homo sapiens
aggagctgagaat

SEQ ID NO: 3742114 - DNA, 14 bp, Homo sapiens
aggagctgagaata

SEQ ID NO: 3742115 - DNA, 16 bp, Homo sapiens
aggagctgctggcttg

SEQ ID NO: 3742116 - DNA, 21 bp, Homo sapiens
aggagctgctggcttgcagtg

SEQ ID NO: 3742117 - DNA, 16 bp, Homo sapiens
aggagctgggaggaaa

SEQ ID NO: 3742118 - DNA, 19 bp, Homo sapiens
aggagctgggggcagcctg

SEQ ID NO: 3742119 - DNA, 18 bp, Homo sapiens
aggagcttacctcccacc

SEQ ID NO: 3742120 - DNA, 16 bp, Homo sapiens
aggaggagagggaaaa

SEQ ID NO: 3742121 - DNA, 21 bp, Homo sapiens
aggaggaggtttaggtcaaga

SEQ ID NO: 3742122 - DNA, 21 bp, Homo sapiens
aggaggattgcttgagcccag

SEQ ID NO: 3742123 - DNA, 17 bp, Homo sapiens
aggaggctgaggcagga

SEQ ID NO: 3742124 - DNA, 13 bp, Homo sapiens
aggaggctgaggg

SEQ ID NO: 3742125 - DNA, 12 bp, Homo sapiens
aggaggctggag

SEQ ID NO: 3742126 - DNA, 21 bp, Homo sapiens
aggaggctggaggaagggggg

SEQ ID NO: 3742127 - DNA, 16 bp, Homo sapiens
aggaggctggcaggta

SEQ ID NO: 3742128 - DNA, 23 bp, Homo sapiens
aggagggaggtattcgtgcagca

SEQ ID NO: 3742129 - DNA, 19 bp, Homo sapiens
aggagggatgctgcctgag

SEQ ID NO: 3742130 - DNA, 14 bp, Homo sapiens
aggaggtggcagcc

SEQ ID NO: 3742131 - DNA, 17 bp, Homo sapiens
aggaggtggcagccctg

SEQ ID NO: 3742132 - DNA, 18 bp, Homo sapiens
aggaggtggcagccctgt

SEQ ID NO: 3742133 - DNA, 18 bp, Homo sapiens
aggaggtttaggtcaaga

SEQ ID NO: 3742134 - DNA, 17 bp, Homo sapiens
aggagtcccaaggaaag

SEQ ID NO: 3742135 - DNA, 12 bp, Homo sapiens
aggagtccctgg

SEQ ID NO: 3742136 - DNA, 12 bp, Homo sapiens
aggagtgagcac

SEQ ID NO: 3742137 - DNA, 14 bp, Homo sapiens
aggagtgagcacta

SEQ ID NO: 3742138 - DNA, 22 bp, Homo sapiens
aggagttcgagaccagcctggc

SEQ ID NO: 3742139 - DNA, 21 bp, Homo sapiens
aggagttgctgtttgtttgac

SEQ ID NO: 3742140 - DNA, 24 bp, Homo sapiens
aggagtttgaggctgcagcgagct

SEQ ID NO: 3742141 - DNA, 18 bp, Homo sapiens
aggataaacttttagaaa

SEQ ID NO: 3742142 - DNA, 21 bp, Homo sapiens
aggataaacttttagaaactt

SEQ ID NO: 3742143 - DNA, 16 bp, Homo sapiens
aggatactctgtcaga

SEQ ID NO: 3742144 - DNA, 17 bp, Homo sapiens
aggatatttaagaaaat

SEQ ID NO: 3742145 - DNA, 19 bp, Homo sapiens
aggatatttaagaaaatac

SEQ ID NO: 3742146 - DNA, 15 bp, Homo sapiens
aggatcaagaaagtg

SEQ ID NO: 3742147 - DNA, 18 bp, Homo sapiens
aggatcactggagcccag

SEQ ID NO: 3742148 - DNA, 17 bp, Homo sapiens
aggatctcttgagcctg

SEQ ID NO: 3742149 - DNA, 19 bp, Homo sapiens
aggatctcttgagcctggg

SEQ ID NO: 3742150 - DNA, 23 bp, Homo sapiens
aggatctgtttttaaaaatcata

SEQ ID NO: 3742151 - DNA, 23 bp, Homo sapiens
aggatctttcacccacagaaaga

SEQ ID NO: 3742152 - DNA, 13 bp, Homo sapiens
aggatgcccaggg

SEQ ID NO: 3742153 - DNA, 15 bp, Homo sapiens
aggatggagagaggg

SEQ ID NO: 3742154 - DNA, 12 bp, Homo sapiens
aggatggagggg

SEQ ID NO: 3742155 - DNA, 18 bp, Homo sapiens
aggatgtaaacagtgcct

SEQ ID NO: 3742156 - DNA, 12 bp, Homo sapiens
aggattcttcct

SEQ ID NO: 3742157 - DNA, 19 bp, Homo sapiens
aggattcttcctccctccc

SEQ ID NO: 3742158 - DNA, 18 bp, Homo sapiens
aggattgcttgagcccag

SEQ ID NO: 3742159 - DNA, 12 bp, Homo sapiens
aggatttcaagc

SEQ ID NO: 3742160 - DNA, 17 bp, Homo sapiens
aggcaactgaacaaaaa

SEQ ID NO: 3742161 - DNA, 16 bp, Homo sapiens
aggcaactgaggcaga

SEQ ID NO: 3742162 - DNA, 18 bp, Homo sapiens
aggcaagcacctcctgcc

SEQ ID NO: 3742163 - DNA, 19 bp, Homo sapiens
aggcaaggggtgcctggga

SEQ ID NO: 3742164 - DNA, 14 bp, Homo sapiens
aggcaatgctggct

SEQ ID NO: 3742165 - DNA, 17 bp, Homo sapiens
aggcaatgtcaggaaca

SEQ ID NO: 3742166 - DNA, 18 bp, Homo sapiens
aggcacacagctgcagag

SEQ ID NO: 3742167 - DNA, 16 bp, Homo sapiens
aggcacacttcttctt

SEQ ID NO: 3742168 - DNA, 13 bp, Homo sapiens
aggcacatggagg

SEQ ID NO: 3742169 - DNA, 14 bp, Homo sapiens
aggcacatggagga

SEQ ID NO: 3742170 - DNA, 17 bp, Homo sapiens
aggcacatggaggagct

SEQ ID NO: 3742171 - DNA, 16 bp, Homo sapiens
aggcacatgtcagcaa

SEQ ID NO: 3742172 - DNA, 19 bp, Homo sapiens
aggcaccattcaggaacct

SEQ ID NO: 3742173 - DNA, 15 bp, Homo sapiens
aggcacccaccatca

SEQ ID NO: 3742174 - DNA, 21 bp, Homo sapiens
aggcacccaccatcatgtctg

SEQ ID NO: 3742175 - DNA, 22 bp, Homo sapiens
aggcacccaccatcatgtctgg

SEQ ID NO: 3742176 - DNA, 22 bp, Homo sapiens
aggcacccatcctagagaaaac

SEQ ID NO: 3742177 - DNA, 19 bp, Homo sapiens
aggcacgaacccacctgct

SEQ ID NO: 3742178 - DNA, 21 bp, Homo sapiens
aggcacgaacccacctgctga

SEQ ID NO: 3742179 - DNA, 16 bp, Homo sapiens
aggcactgtactaggc

SEQ ID NO: 3742180 - DNA, 13 bp, Homo sapiens
aggcagaaagagt

SEQ ID NO: 3742181 - DNA, 16 bp, Homo sapiens
aggcagaaagcagagg

SEQ ID NO: 3742182 - DNA, 19 bp, Homo sapiens
aggcagaaagcagaggctg

SEQ ID NO: 3742183 - DNA, 18 bp, Homo sapiens
aggcagacagcagctcag

SEQ ID NO: 3742184 - DNA, 21 bp, Homo sapiens
aggcagacagcagctcaggca

SEQ ID NO: 3742185 - DNA, 19 bp, Homo sapiens
aggcagagtgccccacctg

SEQ ID NO: 3742186 - DNA, 20 bp, Homo sapiens
aggcagagtgccccacctgc

SEQ ID NO: 3742187 - DNA, 21 bp, Homo sapiens
aggcagagtgccccacctgcc

SEQ ID NO: 3742188 - DNA, 21 bp, Homo sapiens
aggcagatctgtgccccatgc

SEQ ID NO: 3742189 - DNA, 22 bp, Homo sapiens
aggcagatctgtgccccatgcc

SEQ ID NO: 3742190 - DNA, 16 bp, Homo sapiens
aggcagattcaatttt

SEQ ID NO: 3742191 - DNA, 15 bp, Homo sapiens
aggcagattgaaaag

SEQ ID NO: 3742192 - DNA, 19 bp, Homo sapiens
aggcagccccattctgcct

SEQ ID NO: 3742193 - DNA, 21 bp, Homo sapiens
aggcagccccattctgcctgc

SEQ ID NO: 3742194 - DNA, 22 bp, Homo sapiens
aggcagccccattctgcctgcc

SEQ ID NO: 3742195 - DNA, 12 bp, Homo sapiens
aggcagggaagt

SEQ ID NO: 3742196 - DNA, 20 bp, Homo sapiens
aggcagggccttgcccagag

SEQ ID NO: 3742197 - DNA, 23 bp, Homo sapiens
aggcagggccttgcccagagatg

SEQ ID NO: 3742198 - DNA, 17 bp, Homo sapiens
aggcagggtcaggagag

SEQ ID NO: 3742199 - DNA, 23 bp, Homo sapiens
aggcagggtcaggagaggggcag

SEQ ID NO: 3742200 - DNA, 12 bp, Homo sapiens
aggcagggtctc

SEQ ID NO: 3742201 - DNA, 16 bp, Homo sapiens
aggcataggcctgggt

SEQ ID NO: 3742202 - DNA, 20 bp, Homo sapiens
aggcataggcctgggtgctg

SEQ ID NO: 3742203 - DNA, 17 bp, Homo sapiens
aggcatcccaggggacc

SEQ ID NO: 3742204 - DNA, 20 bp, Homo sapiens
aggcatccttcctcacacca

SEQ ID NO: 3742205 - DNA, 19 bp, Homo sapiens
aggcatctgtgggcatggt

SEQ ID NO: 3742206 - DNA, 23 bp, Homo sapiens
aggcatgagggatcacagggccc

SEQ ID NO: 3742207 - DNA, 15 bp, Homo sapiens
aggcatggtggccca

SEQ ID NO: 3742208 - DNA, 17 bp, Homo sapiens
aggcatgttctctgagg

SEQ ID NO: 3742209 - DNA, 18 bp, Homo sapiens
aggcatgttctctgagga

SEQ ID NO: 3742210 - DNA, 19 bp, Homo sapiens
aggcatgttctctgaggac

SEQ ID NO: 3742211 - DNA, 21 bp, Homo sapiens
aggccaagtgcaggctggcac

SEQ ID NO: 3742212 - DNA, 15 bp, Homo sapiens
aggccacctgccccc

SEQ ID NO: 3742213 - DNA, 17 bp, Homo sapiens
aggccacctgccccctt

SEQ ID NO: 3742214 - DNA, 21 bp, Homo sapiens
aggccacctgcccccttctcc

SEQ ID NO: 3742215 - DNA, 13 bp, Homo sapiens
aggccactcctcc

SEQ ID NO: 3742216 - DNA, 20 bp, Homo sapiens
aggccagagtggcctggcca

SEQ ID NO: 3742217 - DNA, 15 bp, Homo sapiens
aggccagcaaggtgg

SEQ ID NO: 3742218 - DNA, 22 bp, Homo sapiens
aggccagcaaggtggagtggat

SEQ ID NO: 3742219 - DNA, 13 bp, Homo sapiens
aggccagccagtg

SEQ ID NO: 3742220 - DNA, 22 bp, Homo sapiens
aggccagccagtgacctgagga

SEQ ID NO: 3742221 - DNA, 13 bp, Homo sapiens
aggccagccccac

SEQ ID NO: 3742222 - DNA, 14 bp, Homo sapiens
aggccagccccacc

SEQ ID NO: 3742223 - DNA, 18 bp, Homo sapiens
aggccagccccacccagg

SEQ ID NO: 3742224 - DNA, 13 bp, Homo sapiens
aggccagcctggc

SEQ ID NO: 3742225 - DNA, 15 bp, Homo sapiens
aggccagctggcagc

SEQ ID NO: 3742226 - DNA, 19 bp, Homo sapiens
aggccagctggcagcagag

SEQ ID NO: 3742227 - DNA, 16 bp, Homo sapiens
aggccagctgtggttt

SEQ ID NO: 3742228 - DNA, 23 bp, Homo sapiens
aggccagctgtggttttcttttg

SEQ ID NO: 3742229 - DNA, 11 bp, Homo sapiens
aggccaggctc

SEQ ID NO: 3742230 - DNA, 14 bp, Homo sapiens
aggccaggtgcagt

SEQ ID NO: 3742231 - DNA, 17 bp, Homo sapiens
aggccatgggcctcctg

SEQ ID NO: 3742232 - DNA, 20 bp, Homo sapiens
aggccatgtgagccaccgct

SEQ ID NO: 3742233 - DNA, 22 bp, Homo sapiens
aggcccaaattatcaagctaat

SEQ ID NO: 3742234 - DNA, 23 bp, Homo sapiens
aggcccacctaccttcaaagctg

SEQ ID NO: 3742235 - DNA, 15 bp, Homo sapiens
agagtgagactctgt

SEQ ID NO: 3742236 - DNA, 16 bp, Homo sapiens
agagtgagactctgtc

SEQ ID NO: 3742237 - DNA, 14 bp, Homo sapiens
agagtgcaaaacat

SEQ ID NO: 3742238 - DNA, 22 bp, Homo sapiens
agagtgcaacagtagcatagga

SEQ ID NO: 3742239 - DNA, 18 bp, Homo sapiens
agagtgccccacctgcca

SEQ ID NO: 3742240 - DNA, 16 bp, Homo sapiens
agagtggcctggccag

SEQ ID NO: 3742241 - DNA, 17 bp, Homo sapiens
agagtggcctggccagg

SEQ ID NO: 3742242 - DNA, 15 bp, Homo sapiens
agagtggctcctccc

SEQ ID NO: 3742243 - DNA, 23 bp, Homo sapiens
agagtggctcctcccggtgccca

SEQ ID NO: 3742244 - DNA, 20 bp, Homo sapiens
agagtgtgggaagggagagc

SEQ ID NO: 3742245 - DNA, 23 bp, Homo sapiens
agagttaaatagagtatatgcac

SEQ ID NO: 3742246 - DNA, 16 bp, Homo sapiens
agagttaggtttaaca

SEQ ID NO: 3742247 - DNA, 18 bp, Homo sapiens
agagttaggtttaacata

SEQ ID NO: 3742248 - DNA, 16 bp, Homo sapiens
agagttcactataaat

SEQ ID NO: 3742249 - DNA, 14 bp, Homo sapiens
agagttgtgttgtt

SEQ ID NO: 3742250 - DNA, 17 bp, Homo sapiens
agataaagatttcttga

SEQ ID NO: 3742251 - DNA, 17 bp, Homo sapiens
agataagcaagagagat

SEQ ID NO: 3742252 - DNA, 18 bp, Homo sapiens
agataatattaaggaaga

SEQ ID NO: 3742253 - DNA, 13 bp, Homo sapiens
agataatccctgt

SEQ ID NO: 3742254 - DNA, 15 bp, Homo sapiens
agataatctctcagc

SEQ ID NO: 3742255 - DNA, 12 bp, Homo sapiens
agataattataa

SEQ ID NO: 3742256 - DNA, 17 bp, Homo sapiens
agatacatcacagtcac

SEQ ID NO: 3742257 - DNA, 19 bp, Homo sapiens
agataccaggttgaaagac

SEQ ID NO: 3742258 - DNA, 15 bp, Homo sapiens
agataccatcagcaa

SEQ ID NO: 3742259 - DNA, 16 bp, Homo sapiens
agatacgactttattt

SEQ ID NO: 3742260 - DNA, 19 bp, Homo sapiens
agatacgactttattttct

SEQ ID NO: 3742261 - DNA, 20 bp, Homo sapiens
agatactggaagttttgcat

SEQ ID NO: 3742262 - DNA, 21 bp, Homo sapiens
agatagaagaaaaaagaatgt

SEQ ID NO: 3742263 - DNA, 13 bp, Homo sapiens
agatagaagaact

SEQ ID NO: 3742264 - DNA, 16 bp, Homo sapiens
agatagaagaactgca

SEQ ID NO: 3742265 - DNA, 17 bp, Homo sapiens
agatagaagatgtttgc

SEQ ID NO: 3742266 - DNA, 18 bp, Homo sapiens
agataggccttcttgtga

SEQ ID NO: 3742267 - DNA, 14 bp, Homo sapiens
agataggctctgca

SEQ ID NO: 3742268 - DNA, 22 bp, Homo sapiens
agataggctctgcacagatgga

SEQ ID NO: 3742269 - DNA, 15 bp, Homo sapiens
agatatatttttcac

SEQ ID NO: 3742270 - DNA, 14 bp, Homo sapiens
agatatctttttat

SEQ ID NO: 3742271 - DNA, 18 bp, Homo sapiens
agatatctttttattgat

SEQ ID NO: 3742272 - DNA, 15 bp, Homo sapiens
agatatgagttgttt

SEQ ID NO: 3742273 - DNA, 16 bp, Homo sapiens
agatatgatatgtaaa

SEQ ID NO: 3742274 - DNA, 17 bp, Homo sapiens
agatatgatatgtaaac

SEQ ID NO: 3742275 - DNA, 19 bp, Homo sapiens
agatattgtgaagtacata

SEQ ID NO: 3742276 - DNA, 21 bp, Homo sapiens
agatattttttcagaaatatg

SEQ ID NO: 3742277 - DNA, 23 bp, Homo sapiens
agatcaaatttcacgtcgtcttc

SEQ ID NO: 3742278 - DNA, 21 bp, Homo sapiens
agatcaaccccttcgctcctg

SEQ ID NO: 3742279 - DNA, 15 bp, Homo sapiens
agatcacgccactgc

SEQ ID NO: 3742280 - DNA, 16 bp, Homo sapiens
agatcacgccactgca

SEQ ID NO: 3742281 - DNA, 22 bp, Homo sapiens
agatcacgccactgcactccag

SEQ ID NO: 3742282 - DNA, 18 bp, Homo sapiens
agatcacgttccttcccc

SEQ ID NO: 3742283 - DNA, 14 bp, Homo sapiens
agatcactttgctc

SEQ ID NO: 3742284 - DNA, 13 bp, Homo sapiens
agatcagcctggg

SEQ ID NO: 3742285 - DNA, 18 bp, Homo sapiens
agatccacacacagagga

SEQ ID NO: 3742286 - DNA, 19 bp, Homo sapiens
agatcccgcctcttcttct

SEQ ID NO: 3742287 - DNA, 15 bp, Homo sapiens
agatcctacccctga

SEQ ID NO: 3742288 - DNA, 20 bp, Homo sapiens
agatcctttaaatccttcca

SEQ ID NO: 3742289 - DNA, 15 bp, Homo sapiens
agatcgcagtttgcc

SEQ ID NO: 3742290 - DNA, 14 bp, Homo sapiens
agatcggggccaga

SEQ ID NO: 3742291 - DNA, 15 bp, Homo sapiens
agatcggggccagag

SEQ ID NO: 3742292 - DNA, 18 bp, Homo sapiens
agatcggggccagaggca

SEQ ID NO: 3742293 - DNA, 14 bp, Homo sapiens
agatcgtcaggacc

SEQ ID NO: 3742294 - DNA, 21 bp, Homo sapiens
agatcgtgccgttactctcca

SEQ ID NO: 3742295 - DNA, 14 bp, Homo sapiens
agatctgcaccgcc

SEQ ID NO: 3742296 - DNA, 14 bp, Homo sapiens
agatgcaaagaggc

SEQ ID NO: 3742297 - DNA, 15 bp, Homo sapiens
agatgcaaagaggca

SEQ ID NO: 3742298 - DNA, 18 bp, Homo sapiens
agatgcaaagaggcaaga

SEQ ID NO: 3742299 - DNA, 17 bp, Homo sapiens
agatgcaaggaccagga

SEQ ID NO: 3742300 - DNA, 19 bp, Homo sapiens
agatgcaatgtgctactga

SEQ ID NO: 3742301 - DNA, 14 bp, Homo sapiens
agatgcaccagccc

SEQ ID NO: 3742302 - DNA, 15 bp, Homo sapiens
agatgcaccagccct

SEQ ID NO: 3742303 - DNA, 12 bp, Homo sapiens
agatgccagagc

SEQ ID NO: 3742304 - DNA, 22 bp, Homo sapiens
agatgcccagagggcccaggca

SEQ ID NO: 3742305 - DNA, 17 bp, Homo sapiens
agatgccccagagctgt

SEQ ID NO: 3742306 - DNA, 14 bp, Homo sapiens
agatgccctgctag

SEQ ID NO: 3742307 - DNA, 12 bp, Homo sapiens
agatgcctccac

SEQ ID NO: 3742308 - DNA, 22 bp, Homo sapiens
agatgcctccaccccccagaac

SEQ ID NO: 3742309 - DNA, 14 bp, Homo sapiens
agatgcctccaccg

SEQ ID NO: 3742310 - DNA, 19 bp, Homo sapiens
agatgcctccctgaccctg

SEQ ID NO: 3742311 - DNA, 21 bp, Homo sapiens
agatgcctccctgaccctgca

SEQ ID NO: 3742312 - DNA, 23 bp, Homo sapiens
agatgcctccctgaccctgcaga

SEQ ID NO: 3742313 - DNA, 20 bp, Homo sapiens
agatgctcaggtacagagaa

SEQ ID NO: 3742314 - DNA, 21 bp, Homo sapiens
agatgctcaggtacagagaag

SEQ ID NO: 3742315 - DNA, 20 bp, Homo sapiens
agatgctgactgtactcctc

SEQ ID NO: 3742316 - DNA, 23 bp, Homo sapiens
agatgctgactgtactcctccca

SEQ ID NO: 3742317 - DNA, 16 bp, Homo sapiens
agatgctgggcccagg

SEQ ID NO: 3742318 - DNA, 16 bp, Homo sapiens
agatgcttctcactgc

SEQ ID NO: 3742319 - DNA, 15 bp, Homo sapiens
agatgcttctgggag

SEQ ID NO: 3742320 - DNA, 16 bp, Homo sapiens
agatgcttctgggaga

SEQ ID NO: 3742321 - DNA, 22 bp, Homo sapiens
agatggaacccttttggccccc

SEQ ID NO: 3742322 - DNA, 17 bp, Homo sapiens
agatggaaccgcaggaa

SEQ ID NO: 3742323 - DNA, 20 bp, Homo sapiens
agatggaaccgcaggaagct

SEQ ID NO: 3742324 - DNA, 22 bp, Homo sapiens
agatggaagttgcagtgagctg

SEQ ID NO: 3742325 - DNA, 23 bp, Homo sapiens
agatggaagttgcagtgagctga

SEQ ID NO: 3742326 - DNA, 17 bp, Homo sapiens
agatggattctcagata

SEQ ID NO: 3742327 - DNA, 20 bp, Homo sapiens
agatggatttgcctgtgcca

SEQ ID NO: 3742328 - DNA, 17 bp, Homo sapiens
agatggctgtgcctctg

SEQ ID NO: 3742329 - DNA, 21 bp, Homo sapiens
agatggctgtgcctctgcctg

SEQ ID NO: 3742330 - DNA, 19 bp, Homo sapiens
agatgggcttgttttcttg

SEQ ID NO: 3742331 - DNA, 18 bp, Homo sapiens
agatggttacactgttag

SEQ ID NO: 3742332 - DNA, 21 bp, Homo sapiens
agatgtagcaaaacgcatgga

SEQ ID NO: 3742333 - DNA, 18 bp, Homo sapiens
agatgtcagactggctgg

SEQ ID NO: 3742334 - DNA, 20 bp, Homo sapiens
agatgtccctttcttggcca

SEQ ID NO: 3742335 - DNA, 13 bp, Homo sapiens
agatgtctttagg

SEQ ID NO: 3742336 - DNA, 15 bp, Homo sapiens
agatgtctttaggca

SEQ ID NO: 3742337 - DNA, 21 bp, Homo sapiens
agatgtggccttccatttata

SEQ ID NO: 3742338 - DNA, 15 bp, Homo sapiens
agatgtttgtcagat

SEQ ID NO: 3742339 - DNA, 14 bp, Homo sapiens
agattcacctgtaa

SEQ ID NO: 3742340 - DNA, 13 bp, Homo sapiens
agattcatattta

SEQ ID NO: 3742341 - DNA, 15 bp, Homo sapiens
agattcatccattta

SEQ ID NO: 3742342 - DNA, 12 bp, Homo sapiens
agattcattttt

SEQ ID NO: 3742343 - DNA, 21 bp, Homo sapiens
agattccagagagtggctcct

SEQ ID NO: 3742344 - DNA, 12 bp, Homo sapiens
agattcccagag

SEQ ID NO: 3742345 - DNA, 13 bp, Homo sapiens
agattcccagagc

SEQ ID NO: 3742346 - DNA, 16 bp, Homo sapiens
agattcgctttccatg

SEQ ID NO: 3742347 - DNA, 19 bp, Homo sapiens
agattctacatattcttta

SEQ ID NO: 3742348 - DNA, 15 bp, Homo sapiens
agattgaaaaggaag

SEQ ID NO: 3742349 - DNA, 18 bp, Homo sapiens
agattgagagaagagaca

SEQ ID NO: 3742350 - DNA, 22 bp, Homo sapiens
agacactaacgacttcagggca

SEQ ID NO: 3742351 - DNA, 13 bp, Homo sapiens
agacactgaaata

SEQ ID NO: 3742352 - DNA, 22 bp, Homo sapiens
agacactgaaatatacacacag

SEQ ID NO: 3742353 - DNA, 19 bp, Homo sapiens
agacactgaccatccactc

SEQ ID NO: 3742354 - DNA, 22 bp, Homo sapiens
agacactgtttacaagaaaaaa

SEQ ID NO: 3742355 - DNA, 18 bp, Homo sapiens
agacagagacgcaggaat

SEQ ID NO: 3742356 - DNA, 12 bp, Homo sapiens
agacagagctgg

SEQ ID NO: 3742357 - DNA, 11 bp, Homo sapiens
agacagagtct

SEQ ID NO: 3742358 - DNA, 20 bp, Homo sapiens
agacagagtctcactgttgc

SEQ ID NO: 3742359 - DNA, 23 bp, Homo sapiens
agacagagtctcactgttgccca

SEQ ID NO: 3742360 - DNA, 19 bp, Homo sapiens
agacagatgccccagagct

SEQ ID NO: 3742361 - DNA, 16 bp, Homo sapiens
agacagcagctcaggc

SEQ ID NO: 3742362 - DNA, 18 bp, Homo sapiens
agacagctccctctgcct

SEQ ID NO: 3742363 - DNA, 22 bp, Homo sapiens
agacagcttctcatcctgcagg

SEQ ID NO: 3742364 - DNA, 18 bp, Homo sapiens
agacaggaaagggaaggc

SEQ ID NO: 3742365 - DNA, 21 bp, Homo sapiens
agacaggacagtgcttcagcc

SEQ ID NO: 3742366 - DNA, 23 bp, Homo sapiens
agacaggcaagcacctcctgcct

SEQ ID NO: 3742367 - DNA, 22 bp, Homo sapiens
agacaggccatgtgagccaccg

SEQ ID NO: 3742368 - DNA, 15 bp, Homo sapiens
agacagggtcctgct

SEQ ID NO: 3742369 - DNA, 17 bp, Homo sapiens
agacagggtcctgctat

SEQ ID NO: 3742370 - DNA, 17 bp, Homo sapiens
agacagtaagtatcttc

SEQ ID NO: 3742371 - DNA, 22 bp, Homo sapiens
agacagtaagtatcttcgttct

SEQ ID NO: 3742372 - DNA, 17 bp, Homo sapiens
agacagtcaaggagtgg

SEQ ID NO: 3742373 - DNA, 22 bp, Homo sapiens
agacatactccttccatcaaat

SEQ ID NO: 3742374 - DNA, 20 bp, Homo sapiens
agacatcaagcacagaagga

SEQ ID NO: 3742375 - DNA, 17 bp, Homo sapiens
agacatgaatatgatta

SEQ ID NO: 3742376 - DNA, 14 bp, Homo sapiens
agacattaaataat

SEQ ID NO: 3742377 - DNA, 16 bp, Homo sapiens
agacattccaaaacga

SEQ ID NO: 3742378 - DNA, 18 bp, Homo sapiens
agacattccaaaacgaag

SEQ ID NO: 3742379 - DNA, 14 bp, Homo sapiens
agacattctgccag

SEQ ID NO: 3742380 - DNA, 15 bp, Homo sapiens
agacattctgccagg

SEQ ID NO: 3742381 - DNA, 13 bp, Homo sapiens
agacattgtcaat

SEQ ID NO: 3742382 - DNA, 16 bp, Homo sapiens
agacattgtcaataaa

SEQ ID NO: 3742383 - DNA, 13 bp, Homo sapiens
agaccaaaataaa

SEQ ID NO: 3742384 - DNA, 17 bp, Homo sapiens
agaccaaaatgacaatg

SEQ ID NO: 3742385 - DNA, 14 bp, Homo sapiens
agaccaacctgacc

SEQ ID NO: 3742386 - DNA, 20 bp, Homo sapiens
agaccacagggttcaaaatg

SEQ ID NO: 3742387 - DNA, 18 bp, Homo sapiens
agaccagagctctggagc

SEQ ID NO: 3742388 - DNA, 20 bp, Homo sapiens
agaccagagctctggagcca

SEQ ID NO: 3742389 - DNA, 13 bp, Homo sapiens
agaccagcctggc

SEQ ID NO: 3742390 - DNA, 15 bp, Homo sapiens
agaccagcctggcca

SEQ ID NO: 3742391 - DNA, 15 bp, Homo sapiens
agaccatagtgacca

SEQ ID NO: 3742392 - DNA, 13 bp, Homo sapiens
agacccccacacc

SEQ ID NO: 3742393 - DNA, 14 bp, Homo sapiens
agacccccacccct

SEQ ID NO: 3742394 - DNA, 13 bp, Homo sapiens
agacccccactct

SEQ ID NO: 3742395 - DNA, 14 bp, Homo sapiens
agacccctctggcc

SEQ ID NO: 3742396 - DNA, 19 bp, Homo sapiens
agacccctctggccaggat

SEQ ID NO: 3742397 - DNA, 21 bp, Homo sapiens
agacccctggcttttcactgc

SEQ ID NO: 3742398 - DNA, 23 bp, Homo sapiens
agacccctgtctttgctgagagc

SEQ ID NO: 3742399 - DNA, 17 bp, Homo sapiens
agaccctaaatctgagg

SEQ ID NO: 3742400 - DNA, 18 bp, Homo sapiens
agaccgtcgggggctgag

SEQ ID NO: 3742401 - DNA, 11 bp, Homo sapiens
agacctcagcc

SEQ ID NO: 3742402 - DNA, 18 bp, Homo sapiens
agacctcagccatgagga

SEQ ID NO: 3742403 - DNA, 13 bp, Homo sapiens
agacctcagcctg

SEQ ID NO: 3742404 - DNA, 18 bp, Homo sapiens
agacctgtcttccaagga

SEQ ID NO: 3742405 - DNA, 16 bp, Homo sapiens
agaccttctccaaatg

SEQ ID NO: 3742406 - DNA, 16 bp, Homo sapiens
agacggcacccaccca

SEQ ID NO: 3742407 - DNA, 16 bp, Homo sapiens
agacgtatgcttattt

SEQ ID NO: 3742408 - DNA, 19 bp, Homo sapiens
agacgtatgcttattttaa

SEQ ID NO: 3742409 - DNA, 21 bp, Homo sapiens
agacgtgcacgcacactgtct

SEQ ID NO: 3742410 - DNA, 19 bp, Homo sapiens
agactagattgcctttgtt

SEQ ID NO: 3742411 - DNA, 17 bp, Homo sapiens
agactatctaaatgttg

SEQ ID NO: 3742412 - DNA, 18 bp, Homo sapiens
agactatctaaatgttga

SEQ ID NO: 3742413 - DNA, 16 bp, Homo sapiens
agactattgacatcag

SEQ ID NO: 3742414 - DNA, 18 bp, Homo sapiens
agactcacctctgcctca

SEQ ID NO: 3742415 - DNA, 19 bp, Homo sapiens
agactcacctctgcctcaa

SEQ ID NO: 3742416 - DNA, 15 bp, Homo sapiens
agactcagactccat

SEQ ID NO: 3742417 - DNA, 12 bp, Homo sapiens
agactcagggcc

SEQ ID NO: 3742418 - DNA, 17 bp, Homo sapiens
agactcagggccccagc

SEQ ID NO: 3742419 - DNA, 18 bp, Homo sapiens
agactcagggccccagca

SEQ ID NO: 3742420 - DNA, 21 bp, Homo sapiens
agactcagggccccagcacta

SEQ ID NO: 3742421 - DNA, 23 bp, Homo sapiens
agactcaggttgtagtaaagaaa

SEQ ID NO: 3742422 - DNA, 17 bp, Homo sapiens
agactcagtttgtcaga

SEQ ID NO: 3742423 - DNA, 18 bp, Homo sapiens
agactcatacagaaggtg

SEQ ID NO: 3742424 - DNA, 21 bp, Homo sapiens
agactctaggacataaattag

SEQ ID NO: 3742425 - DNA, 15 bp, Homo sapiens
agactctttgcatat

SEQ ID NO: 3742426 - DNA, 17 bp, Homo sapiens
agactgaacatgtacac

SEQ ID NO: 3742427 - DNA, 21 bp, Homo sapiens
agactgcaagtgagcaaacct

SEQ ID NO: 3742428 - DNA, 23 bp, Homo sapiens
agactgcgatttgtcccaggtcc

SEQ ID NO: 3742429 - DNA, 22 bp, Homo sapiens
agactgcgggatggtcctgggg

SEQ ID NO: 3742430 - DNA, 23 bp, Homo sapiens
agactgcgggatggtcctggggc

SEQ ID NO: 3742431 - DNA, 19 bp, Homo sapiens
agactgcttccaattttct

SEQ ID NO: 3742432 - DNA, 16 bp, Homo sapiens
agactggaagcacagc

SEQ ID NO: 3742433 - DNA, 15 bp, Homo sapiens
agactggatactgcc

SEQ ID NO: 3742434 - DNA, 16 bp, Homo sapiens
agactggatagtccgt

SEQ ID NO: 3742435 - DNA, 20 bp, Homo sapiens
agactggatagtccgtctct

SEQ ID NO: 3742436 - DNA, 16 bp, Homo sapiens
agactggcctgaggag

SEQ ID NO: 3742437 - DNA, 14 bp, Homo sapiens
agactggctggctg

SEQ ID NO: 3742438 - DNA, 14 bp, Homo sapiens
agactgtacaaagt

SEQ ID NO: 3742439 - DNA, 22 bp, Homo sapiens
agactgtagattgcttctgtag

SEQ ID NO: 3742440 - DNA, 14 bp, Homo sapiens
agactgtctcaaga

SEQ ID NO: 3742441 - DNA, 14 bp, Homo sapiens
agactgtggctgct

SEQ ID NO: 3742442 - DNA, 20 bp, Homo sapiens
agactgtggctgctagcact

SEQ ID NO: 3742443 - DNA, 22 bp, Homo sapiens
agacttagtatattttcttttc

SEQ ID NO: 3742444 - DNA, 15 bp, Homo sapiens
agacttcacactgca

SEQ ID NO: 3742445 - DNA, 14 bp, Homo sapiens
agacttcccagctt

SEQ ID NO: 3742446 - DNA, 23 bp, Homo sapiens
agactttatgcaataaataacag

SEQ ID NO: 3742447 - DNA, 13 bp, Homo sapiens
agacttttctttg

SEQ ID NO: 3742448 - DNA, 21 bp, Homo sapiens
agagaaaaaaagtttgccaga

SEQ ID NO: 3742449 - DNA, 13 bp, Homo sapiens
agagaaaaaagaa

SEQ ID NO: 3742450 - DNA, 17 bp, Homo sapiens
agagaaaatgtaaataa

SEQ ID NO: 3742451 - DNA, 13 bp, Homo sapiens
agagaaaattgaa

SEQ ID NO: 3742452 - DNA, 14 bp, Homo sapiens
agagaaaattgaat

SEQ ID NO: 3742453 - DNA, 16 bp, Homo sapiens
agagaaaattgaattt

SEQ ID NO: 3742454 - DNA, 21 bp, Homo sapiens
agagaaaattgaatttaacaa

SEQ ID NO: 3742455 - DNA, 23 bp, Homo sapiens
agagaaaccgtcctctttttcca

SEQ ID NO: 3742456 - DNA, 21 bp, Homo sapiens
agagaaactctatgggtatca

SEQ ID NO: 3742457 - DNA, 19 bp, Homo sapiens
agagaaactttgtgctaca

SEQ ID NO: 3742458 - DNA, 20 bp, Homo sapiens
agagaacctcacgcacctcc

SEQ ID NO: 3742459 - DNA, 22 bp, Homo sapiens
agagaacctcacgcacctccca

SEQ ID NO: 3742460 - DNA, 14 bp, Homo sapiens
agagaagccttggt

SEQ ID NO: 3742461 - DNA, 16 bp, Homo sapiens
agagaaggaatgtctt

SEQ ID NO: 3742462 - DNA, 20 bp, Homo sapiens
agagaaggaatgtctttggt

SEQ ID NO: 3742463 - DNA, 14 bp, Homo sapiens
agagaaggcagcag

SEQ ID NO: 3742464 - DNA, 18 bp, Homo sapiens
agattgagtaagatttac

SEQ ID NO: 3742465 - DNA, 15 bp, Homo sapiens
agattgatcattttt

SEQ ID NO: 3742466 - DNA, 19 bp, Homo sapiens
agattgcaacaggctgggc

SEQ ID NO: 3742467 - DNA, 23 bp, Homo sapiens
agattgcaacaggctgggcttca

SEQ ID NO: 3742468 - DNA, 15 bp, Homo sapiens
agattgcttaaaata

SEQ ID NO: 3742469 - DNA, 14 bp, Homo sapiens
agattgcttctgta

SEQ ID NO: 3742470 - DNA, 23 bp, Homo sapiens
agattggagaaacccttgaaaag

SEQ ID NO: 3742471 - DNA, 14 bp, Homo sapiens
agattgttaaaata

SEQ ID NO: 3742472 - DNA, 13 bp, Homo sapiens
agatttaatttgc

SEQ ID NO: 3742473 - DNA, 17 bp, Homo sapiens
agatttgaactcttcaa

SEQ ID NO: 3742474 - DNA, 16 bp, Homo sapiens
agatttgcccatttac

SEQ ID NO: 3742475 - DNA, 17 bp, Homo sapiens
agatttgcccatttaca

SEQ ID NO: 3742476 - DNA, 21 bp, Homo sapiens
agatttggtgaatttgaatct

SEQ ID NO: 3742477 - DNA, 13 bp, Homo sapiens
agatttgttttgt

SEQ ID NO: 3742478 - DNA, 15 bp, Homo sapiens
agattttaatcaaat

SEQ ID NO: 3742479 - DNA, 18 bp, Homo sapiens
agattttaatcaaatttg

SEQ ID NO: 3742480 - DNA, 23 bp, Homo sapiens
agattttccacaagattcccaga

SEQ ID NO: 3742481 - DNA, 14 bp, Homo sapiens
agattttcctgtgg

SEQ ID NO: 3742482 - DNA, 13 bp, Homo sapiens
agattttgaaaac

SEQ ID NO: 3742483 - DNA, 22 bp, Homo sapiens
agcaaaaccattgcttcactac

SEQ ID NO: 3742484 - DNA, 21 bp, Homo sapiens
agcaaaataattttaaacaaa

SEQ ID NO: 3742485 - DNA, 15 bp, Homo sapiens
agcaaacctgcccca

SEQ ID NO: 3742486 - DNA, 13 bp, Homo sapiens
agcaaatgttaca

SEQ ID NO: 3742487 - DNA, 14 bp, Homo sapiens
agcaaatgttacat

SEQ ID NO: 3742488 - DNA, 19 bp, Homo sapiens
agcaaatgttacatagtgt

SEQ ID NO: 3742489 - DNA, 19 bp, Homo sapiens
agcaaattctgtttttcta

SEQ ID NO: 3742490 - DNA, 14 bp, Homo sapiens
agcaaatttataat

SEQ ID NO: 3742491 - DNA, 15 bp, Homo sapiens
agcaaatttataatt

SEQ ID NO: 3742492 - DNA, 20 bp, Homo sapiens
agcaaatttataattttaag

SEQ ID NO: 3742493 - DNA, 20 bp, Homo sapiens
agcaacagagtgagaccctg

SEQ ID NO: 3742494 - DNA, 20 bp, Homo sapiens
agcaacttgtctttttctgg

SEQ ID NO: 3742495 - DNA, 23 bp, Homo sapiens
agcaagacagagacgcaggaatg

SEQ ID NO: 3742496 - DNA, 20 bp, Homo sapiens
agcaagcatttatgtttatt

SEQ ID NO: 3742497 - DNA, 17 bp, Homo sapiens
agcaagcttttttattt

SEQ ID NO: 3742498 - DNA, 16 bp, Homo sapiens
agcaaggggctctgcc

SEQ ID NO: 3742499 - DNA, 16 bp, Homo sapiens
agcaagtgagaccctg

SEQ ID NO: 3742500 - DNA, 14 bp, Homo sapiens
agcaagtgagagct

SEQ ID NO: 3742501 - DNA, 17 bp, Homo sapiens
agcaagtgagagctggg

SEQ ID NO: 3742502 - DNA, 13 bp, Homo sapiens
agcaataaatgaa

SEQ ID NO: 3742503 - DNA, 15 bp, Homo sapiens
agcaataaatgaatg

SEQ ID NO: 3742504 - DNA, 17 bp, Homo sapiens
agcaatgttatcttggt

SEQ ID NO: 3742505 - DNA, 20 bp, Homo sapiens
agcaattccatgctataaaa

SEQ ID NO: 3742506 - DNA, 13 bp, Homo sapiens
agcacagaaggag

SEQ ID NO: 3742507 - DNA, 21 bp, Homo sapiens
agcacagagagggggccacct

SEQ ID NO: 3742508 - DNA, 21 bp, Homo sapiens
agcacagcagcccctgcacaa

SEQ ID NO: 3742509 - DNA, 21 bp, Homo sapiens
agcacagcttcatttcctgtg

SEQ ID NO: 3742510 - DNA, 15 bp, Homo sapiens
agcaccaccaggtct

SEQ ID NO: 3742511 - DNA, 13 bp, Homo sapiens
agcacctcccagc

SEQ ID NO: 3742512 - DNA, 13 bp, Homo sapiens
agcacctcctgcc

SEQ ID NO: 3742513 - DNA, 16 bp, Homo sapiens
agcactaaagcagtgg

SEQ ID NO: 3742514 - DNA, 14 bp, Homo sapiens
agcactcacatgct

SEQ ID NO: 3742515 - DNA, 14 bp, Homo sapiens
agcactgtctcagt

SEQ ID NO: 3742516 - DNA, 14 bp, Homo sapiens
agcacttggagcca

SEQ ID NO: 3742517 - DNA, 23 bp, Homo sapiens
agcacttggagccaagggttcag

SEQ ID NO: 3742518 - DNA, 15 bp, Homo sapiens
agcactttgggaggc

SEQ ID NO: 3742519 - DNA, 20 bp, Homo sapiens
agcactttgggaggccaagg

SEQ ID NO: 3742520 - DNA, 22 bp, Homo sapiens
agcactttgggaggctgaggcg

SEQ ID NO: 3742521 - DNA, 14 bp, Homo sapiens
agcagaagctctcg

SEQ ID NO: 3742522 - DNA, 19 bp, Homo sapiens
agcagaatcaaaatgacct

SEQ ID NO: 3742523 - DNA, 21 bp, Homo sapiens
agcagacagtgttttctggga

SEQ ID NO: 3742524 - DNA, 23 bp, Homo sapiens
agcagagaatgaaagggcccaga

SEQ ID NO: 3742525 - DNA, 15 bp, Homo sapiens
agcagagcaggggca

SEQ ID NO: 3742526 - DNA, 17 bp, Homo sapiens
agcagaggaaggagagg

SEQ ID NO: 3742527 - DNA, 17 bp, Homo sapiens
agcagaggctggcctca

SEQ ID NO: 3742528 - DNA, 13 bp, Homo sapiens
agcagatgcaaag

SEQ ID NO: 3742529 - DNA, 18 bp, Homo sapiens
agcagatgcaaagaggca

SEQ ID NO: 3742530 - DNA, 19 bp, Homo sapiens
agcagatgcaaagaggcaa

SEQ ID NO: 3742531 - DNA, 20 bp, Homo sapiens
agcagatgcaaagaggcaag

SEQ ID NO: 3742532 - DNA, 13 bp, Homo sapiens
agcagattttaat

SEQ ID NO: 3742533 - DNA, 22 bp, Homo sapiens
agcagattttaattttgaataa

SEQ ID NO: 3742534 - DNA, 16 bp, Homo sapiens
agcagccagctctcag

SEQ ID NO: 3742535 - DNA, 14 bp, Homo sapiens
agcagccctcctca

SEQ ID NO: 3742536 - DNA, 16 bp, Homo sapiens
agcagcctggaccctg

SEQ ID NO: 3742537 - DNA, 14 bp, Homo sapiens
agcagcctgtggca

SEQ ID NO: 3742538 - DNA, 17 bp, Homo sapiens
agcagctatctctcagt

SEQ ID NO: 3742539 - DNA, 16 bp, Homo sapiens
agcagctcaaaggcac

SEQ ID NO: 3742540 - DNA, 15 bp, Homo sapiens
agcaggaagctcaga

SEQ ID NO: 3742541 - DNA, 21 bp, Homo sapiens
agcaggatagttgctccgcct

SEQ ID NO: 3742542 - DNA, 23 bp, Homo sapiens
agcaggcccacctaccttcaaag

SEQ ID NO: 3742543 - DNA, 15 bp, Homo sapiens
agcaggcctgttgct

SEQ ID NO: 3742544 - DNA, 21 bp, Homo sapiens
agcaggccttttgatattaaa

SEQ ID NO: 3742545 - DNA, 14 bp, Homo sapiens
agcagggaaacagc

SEQ ID NO: 3742546 - DNA, 21 bp, Homo sapiens
agcagggtagtctggtttcta

SEQ ID NO: 3742547 - DNA, 13 bp, Homo sapiens
agcaggtggggag

SEQ ID NO: 3742548 - DNA, 21 bp, Homo sapiens
agcagtagaaataatatgcat

SEQ ID NO: 3742549 - DNA, 22 bp, Homo sapiens
agcagtcctgcctcagcctccg

SEQ ID NO: 3742550 - DNA, 23 bp, Homo sapiens
agcagtctacccacctcagcctc

SEQ ID NO: 3742551 - DNA, 14 bp, Homo sapiens
agcagtgagccgca

SEQ ID NO: 3742552 - DNA, 15 bp, Homo sapiens
agcagtggacaccag

SEQ ID NO: 3742553 - DNA, 22 bp, Homo sapiens
agcagtgtcttccataatgtat

SEQ ID NO: 3742554 - DNA, 16 bp, Homo sapiens
agcagtgtgtctcctg

SEQ ID NO: 3742555 - DNA, 22 bp, Homo sapiens
agcagtgtgtctcctgcatgca

SEQ ID NO: 3742556 - DNA, 20 bp, Homo sapiens
agcagttcacctatttcaaa

SEQ ID NO: 3742557 - DNA, 23 bp, Homo sapiens
agcagttctgcaaatagaaaaca

SEQ ID NO: 3742558 - DNA, 23 bp, Homo sapiens
agcagtttggtttctagcatgaa

SEQ ID NO: 3742559 - DNA, 19 bp, Homo sapiens
agcataaaaattagccaag

SEQ ID NO: 3742560 - DNA, 13 bp, Homo sapiens
agcataaatgcaa

SEQ ID NO: 3742561 - DNA, 15 bp, Homo sapiens
agcatcacaaatgat

SEQ ID NO: 3742562 - DNA, 14 bp, Homo sapiens
agcatcacctcagg

SEQ ID NO: 3742563 - DNA, 19 bp, Homo sapiens
agcatcacctcaggccagg

SEQ ID NO: 3742564 - DNA, 17 bp, Homo sapiens
agcatcacttgggatta

SEQ ID NO: 3742565 - DNA, 21 bp, Homo sapiens
agcatcattatttgcagagac

SEQ ID NO: 3742566 - DNA, 17 bp, Homo sapiens
agcatcctggcacccgg

SEQ ID NO: 3742567 - DNA, 22 bp, Homo sapiens
agcatctaaactttaatatgta

SEQ ID NO: 3742568 - DNA, 17 bp, Homo sapiens
agcatctcttgaggcca

SEQ ID NO: 3742569 - DNA, 20 bp, Homo sapiens
agcatcttcacttctaaatg

SEQ ID NO: 3742570 - DNA, 20 bp, Homo sapiens
agcatgaatttttttcatct

SEQ ID NO: 3742571 - DNA, 17 bp, Homo sapiens
agcatgacaagccccag

SEQ ID NO: 3742572 - DNA, 18 bp, Homo sapiens
agcatgacaagccccagg

SEQ ID NO: 3742573 - DNA, 19 bp, Homo sapiens
agcatgacaagccccaggc

SEQ ID NO: 3742574 - DNA, 23 bp, Homo sapiens
agcatgacctgtgaccagcactg

SEQ ID NO: 3742575 - DNA, 14 bp, Homo sapiens
agcatgcacaaagt

SEQ ID NO: 3742576 - DNA, 16 bp, Homo sapiens
agcatgcacaaagtgt

SEQ ID NO: 3742577 - DNA, 18 bp, Homo sapiens
agcatggctcaaagtgca

SEQ ID NO: 3742578 - DNA, 15 bp, Homo sapiens
agcatggtgcatgcc

SEQ ID NO: 3742579 - DNA, 15 bp, Homo sapiens
agcatgtaggagaat

SEQ ID NO: 3742580 - DNA, 16 bp, Homo sapiens
agcatgtgttgaaaaa

SEQ ID NO: 3742581 - DNA, 22 bp, Homo sapiens
agcatgtgtttggttctggggc

SEQ ID NO: 3742582 - DNA, 16 bp, Homo sapiens
agcatgttgagccagg

SEQ ID NO: 3742583 - DNA, 19 bp, Homo sapiens
agcatgttgagccaggcct

SEQ ID NO: 3742584 - DNA, 18 bp, Homo sapiens
agcattaactaatctatt

SEQ ID NO: 3742585 - DNA, 17 bp, Homo sapiens
agcattactcttgtaag

SEQ ID NO: 3742586 - DNA, 22 bp, Homo sapiens
agcattctcactcctacctggt

SEQ ID NO: 3742587 - DNA, 17 bp, Homo sapiens
agcattcttagcctgtg

SEQ ID NO: 3742588 - DNA, 18 bp, Homo sapiens
agcattcttagcctgtgg

SEQ ID NO: 3742589 - DNA, 19 bp, Homo sapiens
agcattcttagcctgtggc

SEQ ID NO: 3742590 - DNA, 16 bp, Homo sapiens
agcattcttgtcacaa

SEQ ID NO: 3742591 - DNA, 21 bp, Homo sapiens
agcattcttgtcacaataaat

SEQ ID NO: 3742592 - DNA, 22 bp, Homo sapiens
agcattcttgtcacaataaatg

SEQ ID NO: 3742593 - DNA, 16 bp, Homo sapiens
agcattgctttctgaa

SEQ ID NO: 3742594 - DNA, 21 bp, Homo sapiens
agcattgtttgcttattgttc

SEQ ID NO: 3742595 - DNA, 22 bp, Homo sapiens
agcattgtttgcttattgttcc

SEQ ID NO: 3742596 - DNA, 22 bp, Homo sapiens
agcattttgctaaatgtgaatg

SEQ ID NO: 3742597 - DNA, 18 bp, Homo sapiens
agccaaacccatgaggca

SEQ ID NO: 3742598 - DNA, 16 bp, Homo sapiens
agccaaagctaggcct

SEQ ID NO: 3742599 - DNA, 18 bp, Homo sapiens
agccaaagctaggcctgg

SEQ ID NO: 3742600 - DNA, 19 bp, Homo sapiens
agccaaagctaggcctggc

SEQ ID NO: 3742601 - DNA, 20 bp, Homo sapiens
agccaaagctaggcctggcc

SEQ ID NO: 3742602 - DNA, 20 bp, Homo sapiens
agccaaatgtaattgaataa

SEQ ID NO: 3742603 - DNA, 14 bp, Homo sapiens
agccaacccctgtg

SEQ ID NO: 3742604 - DNA, 23 bp, Homo sapiens
agccaaccttacttacagcataa

SEQ ID NO: 3742605 - DNA, 21 bp, Homo sapiens
agccaacgacaaagccaaact

SEQ ID NO: 3742606 - DNA, 13 bp, Homo sapiens
agccaagcagcca

SEQ ID NO: 3742607 - DNA, 16 bp, Homo sapiens
agccaagcagccaagc

SEQ ID NO: 3742608 - DNA, 18 bp, Homo sapiens
agccaagggttcagagac

SEQ ID NO: 3742609 - DNA, 22 bp, Homo sapiens
agccaagggttcagagactcag

SEQ ID NO: 3742610 - DNA, 22 bp, Homo sapiens
agccaaggtgggctgagccctg

SEQ ID NO: 3742611 - DNA, 23 bp, Homo sapiens
agccaaggtgggctgagccctgg

SEQ ID NO: 3742612 - DNA, 23 bp, Homo sapiens
agccaagtcagctttgccttcca

SEQ ID NO: 3742613 - DNA, 17 bp, Homo sapiens
agccacagcccaggcct

SEQ ID NO: 3742614 - DNA, 19 bp, Homo sapiens
agccacagcccaggcctcc

SEQ ID NO: 3742615 - DNA, 21 bp, Homo sapiens
agccacatgggaaacttccaa

SEQ ID NO: 3742616 - DNA, 17 bp, Homo sapiens
agccaccacgtccagct

SEQ ID NO: 3742617 - DNA, 20 bp, Homo sapiens
agccaccccagaaatggtga

SEQ ID NO: 3742618 - DNA, 14 bp, Homo sapiens
agccaccccgggct

SEQ ID NO: 3742619 - DNA, 20 bp, Homo sapiens
agccaccctcccagctctga

SEQ ID NO: 3742620 - DNA, 14 bp, Homo sapiens
agccaccgctgcca

SEQ ID NO: 3742621 - DNA, 14 bp, Homo sapiens
agccacctgtccca

SEQ ID NO: 3742622 - DNA, 16 bp, Homo sapiens
agccacctgtcccacc

SEQ ID NO: 3742623 - DNA, 18 bp, Homo sapiens
agccacctgtcccacctc

SEQ ID NO: 3742624 - DNA, 15 bp, Homo sapiens
agccacggccaggcc

SEQ ID NO: 3742625 - DNA, 16 bp, Homo sapiens
agccacggccaggcca

SEQ ID NO: 3742626 - DNA, 15 bp, Homo sapiens
agccactcaggaggc

SEQ ID NO: 3742627 - DNA, 19 bp, Homo sapiens
agccactgcaccgggccac

SEQ ID NO: 3742628 - DNA, 16 bp, Homo sapiens
agccacttaccttcaa

SEQ ID NO: 3742629 - DNA, 21 bp, Homo sapiens
agccacttaccttcaataaag

SEQ ID NO: 3742630 - DNA, 22 bp, Homo sapiens
agccacttaccttcaataaagt

SEQ ID NO: 3742631 - DNA, 13 bp, Homo sapiens
agccagccctccc

SEQ ID NO: 3742632 - DNA, 15 bp, Homo sapiens
agccagccctccctg

SEQ ID NO: 3742633 - DNA, 20 bp, Homo sapiens
agccagccctccctgtcctc

SEQ ID NO: 3742634 - DNA, 23 bp, Homo sapiens
agccagccctccctgtcctcctc

SEQ ID NO: 3742635 - DNA, 15 bp, Homo sapiens
agccagctctcagcc

SEQ ID NO: 3742636 - DNA, 16 bp, Homo sapiens
agccagctctcagcca

SEQ ID NO: 3742637 - DNA, 20 bp, Homo sapiens
agccagctgcagctgggctg

SEQ ID NO: 3742638 - DNA, 20 bp, Homo sapiens
agccagctgccgaccagagc

SEQ ID NO: 3742639 - DNA, 18 bp, Homo sapiens
agccaggctcaggccatg

SEQ ID NO: 3742640 - DNA, 23 bp, Homo sapiens
agccagggatggggccacagcca

SEQ ID NO: 3742641 - DNA, 18 bp, Homo sapiens
agccagtgacctgaggaa

SEQ ID NO: 3742642 - DNA, 19 bp, Homo sapiens
agccagtgacctgaggaag

SEQ ID NO: 3742643 - DNA, 21 bp, Homo sapiens
agccagtgacctgaggaagcg

SEQ ID NO: 3742644 - DNA, 22 bp, Homo sapiens
agccatcggtgaaactaacaga

SEQ ID NO: 3742645 - DNA, 23 bp, Homo sapiens
agccatctaaagtaaaaagggaa

SEQ ID NO: 3742646 - DNA, 22 bp, Homo sapiens
agccatctctctactcctacct

SEQ ID NO: 3742647 - DNA, 19 bp, Homo sapiens
agccatgaggagttgctgt

SEQ ID NO: 3742648 - DNA, 14 bp, Homo sapiens
agccatgtttaaga

SEQ ID NO: 3742649 - DNA, 19 bp, Homo sapiens
agccatgtttaagatttaa

SEQ ID NO: 3742650 - DNA, 13 bp, Homo sapiens
agcccaaagaagg

SEQ ID NO: 3742651 - DNA, 16 bp, Homo sapiens
agcccaaagaaggaaa

SEQ ID NO: 3742652 - DNA, 16 bp, Homo sapiens
agcccaatattataat

SEQ ID NO: 3742653 - DNA, 13 bp, Homo sapiens
agcccacccccct

SEQ ID NO: 3742654 - DNA, 15 bp, Homo sapiens
agcccacccctcaac

SEQ ID NO: 3742655 - DNA, 14 bp, Homo sapiens
agcccacttctgcc

SEQ ID NO: 3742656 - DNA, 15 bp, Homo sapiens
agcccagcagggcct

SEQ ID NO: 3742657 - DNA, 20 bp, Homo sapiens
agcccagcagggcctcaaag

SEQ ID NO: 3742658 - DNA, 15 bp, Homo sapiens
agcccagccctgttc

SEQ ID NO: 3742659 - DNA, 16 bp, Homo sapiens
agcccagctccagggc

SEQ ID NO: 3742660 - DNA, 18 bp, Homo sapiens
agcccagctccagggcca

SEQ ID NO: 3742661 - DNA, 22 bp, Homo sapiens
agcccagctgctctgcccagag

SEQ ID NO: 3742662 - DNA, 11 bp, Homo sapiens
agcccaggagt

SEQ ID NO: 3742663 - DNA, 19 bp, Homo sapiens
agcccagggagcggaaagc

SEQ ID NO: 3742664 - DNA, 10 bp, Homo sapiens
agcccagggt

SEQ ID NO: 3742665 - DNA, 11 bp, Homo sapiens
agcccatgccc

SEQ ID NO: 3742666 - DNA, 18 bp, Homo sapiens
agcccattctctctcctg

SEQ ID NO: 3742667 - DNA, 23 bp, Homo sapiens
agccccaacccaaacctggagat

SEQ ID NO: 3742668 - DNA, 19 bp, Homo sapiens
agccccaccctcagatgca

SEQ ID NO: 3742669 - DNA, 21 bp, Homo sapiens
agccccagcaccaccaggtct

SEQ ID NO: 3742670 - DNA, 15 bp, Homo sapiens
agccccagcactaac

SEQ ID NO: 3742671 - DNA, 20 bp, Homo sapiens
agccccaggcaggctgtgcg

SEQ ID NO: 3742672 - DNA, 23 bp, Homo sapiens
agccccagtgccaagcacagtgc

SEQ ID NO: 3742673 - DNA, 17 bp, Homo sapiens
agccccatcagctccag

SEQ ID NO: 3742674 - DNA, 18 bp, Homo sapiens
agccccatcctgccgccc

SEQ ID NO: 3742675 - DNA, 16 bp, Homo sapiens
agccccattctgcctg

SEQ ID NO: 3742676 - DNA, 18 bp, Homo sapiens
agccccattctgcctgcc

SEQ ID NO: 3742677 - DNA, 20 bp, Homo sapiens
agccccattctgcctgccca

SEQ ID NO: 3742678 - DNA, 21 bp, Homo sapiens
agccccattctgcctgcccag

SEQ ID NO: 3742679 - DNA, 23 bp, Homo sapiens
agccccattctgcctgcccaggc

SEQ ID NO: 3742680 - DNA, 18 bp, Homo sapiens
agcccccaggctgctgga

SEQ ID NO: 3742681 - DNA, 14 bp, Homo sapiens
agcccctcccacca

SEQ ID NO: 3742682 - DNA, 16 bp, Homo sapiens
agcccctcccaccaca

SEQ ID NO: 3742683 - DNA, 18 bp, Homo sapiens
agcccctcccaccacagc

SEQ ID NO: 3742684 - DNA, 15 bp, Homo sapiens
agcccctcctctgcc

SEQ ID NO: 3742685 - DNA, 17 bp, Homo sapiens
agcccctcctctgccac

SEQ ID NO: 3742686 - DNA, 19 bp, Homo sapiens
agcccctcctctgccacct

SEQ ID NO: 3742687 - DNA, 21 bp, Homo sapiens
agcccctcctctgccacctcc

SEQ ID NO: 3742688 - DNA, 23 bp, Homo sapiens
agcccctcctctgccacctcccc

SEQ ID NO: 3742689 - DNA, 18 bp, Homo sapiens
agcccctgcccctcatgc

SEQ ID NO: 3742690 - DNA, 17 bp, Homo sapiens
agccccttgagaaacct

SEQ ID NO: 3742691 - DNA, 23 bp, Homo sapiens
agccccttgctctcccctgccct

SEQ ID NO: 3742692 - DNA, 13 bp, Homo sapiens
agccctccctgcc

SEQ ID NO: 3742693 - DNA, 15 bp, Homo sapiens
agccctccctgcccc

SEQ ID NO: 3742694 - DNA, 22 bp, Homo sapiens
agccctccctgcccctcccttc

SEQ ID NO: 3742695 - DNA, 23 bp, Homo sapiens
agccctccctgcccctcccttca

SEQ ID NO: 3742696 - DNA, 17 bp, Homo sapiens
agccctccctgtcctcc

SEQ ID NO: 3742697 - DNA, 12 bp, Homo sapiens
agccctcctcac

SEQ ID NO: 3742698 - DNA, 11 bp, Homo sapiens
agccctccttc

SEQ ID NO: 3742699 - DNA, 12 bp, Homo sapiens
agccctccttcc

SEQ ID NO: 3742700 - DNA, 15 bp, Homo sapiens
agccctgagctttct

SEQ ID NO: 3742701 - DNA, 22 bp, Homo sapiens
agccctgaggtgaaagggagct

SEQ ID NO: 3742702 - DNA, 23 bp, Homo sapiens
agccctgagtttcaagtatcctt

SEQ ID NO: 3742703 - DNA, 17 bp, Homo sapiens
agccctgggccccacca

SEQ ID NO: 3742704 - DNA, 15 bp, Homo sapiens
agccctggtggcagt

SEQ ID NO: 3742705 - DNA, 22 bp, Homo sapiens
agccctggtggcagtgggagct

SEQ ID NO: 3742706 - DNA, 14 bp, Homo sapiens
agccctgtcagtgc

SEQ ID NO: 3742707 - DNA, 11 bp, Homo sapiens
agccctgtctc

SEQ ID NO: 3742708 - DNA, 18 bp, Homo sapiens
agccctgtctcctctctc

SEQ ID NO: 3742709 - DNA, 16 bp, Homo sapiens
agcccttagcagggaa

SEQ ID NO: 3742710 - DNA, 21 bp, Homo sapiens
agcccttagcagggaaacagc

SEQ ID NO: 3742711 - DNA, 19 bp, Homo sapiens
agcccttccatgtcgcctc

SEQ ID NO: 3742712 - DNA, 19 bp, Homo sapiens
agcccttgaagtcacccgg

SEQ ID NO: 3742713 - DNA, 15 bp, Homo sapiens
agccgacctcagcct

SEQ ID NO: 3742714 - DNA, 17 bp, Homo sapiens
agccgagagcctgctcc

SEQ ID NO: 3742715 - DNA, 17 bp, Homo sapiens
agccgagatcacgccac

SEQ ID NO: 3742716 - DNA, 19 bp, Homo sapiens
agccgagatcacgccactg

SEQ ID NO: 3742717 - DNA, 21 bp, Homo sapiens
agccgagatcacgccactgca

SEQ ID NO: 3742718 - DNA, 19 bp, Homo sapiens
agccgagattgcaccactg

SEQ ID NO: 3742719 - DNA, 20 bp, Homo sapiens
agccgagattgcaccactgc

SEQ ID NO: 3742720 - DNA, 17 bp, Homo sapiens
agccgcatcttctccat

SEQ ID NO: 3742721 - DNA, 19 bp, Homo sapiens
agccgctcctgtctgccag

SEQ ID NO: 3742722 - DNA, 22 bp, Homo sapiens
agccgctcctgtctgccagcca

SEQ ID NO: 3742723 - DNA, 16 bp, Homo sapiens
agccgtcagccaaatg

SEQ ID NO: 3742724 - DNA, 20 bp, Homo sapiens
agccgtcagccaaatgtaat

SEQ ID NO: 3742725 - DNA, 17 bp, Homo sapiens
agcctagaagagcttct

SEQ ID NO: 3742726 - DNA, 18 bp, Homo sapiens
agcctagccgacctcagc

SEQ ID NO: 3742727 - DNA, 17 bp, Homo sapiens
agcctagttcatccaat

SEQ ID NO: 3742728 - DNA, 20 bp, Homo sapiens
agcctagttcatccaatcct

SEQ ID NO: 3742729 - DNA, 22 bp, Homo sapiens
agcctagttcatccaatcctca

SEQ ID NO: 3742730 - DNA, 11 bp, Homo sapiens
agcctatggca

SEQ ID NO: 3742731 - DNA, 15 bp, Homo sapiens
agcctcaacctcctg

SEQ ID NO: 3742732 - DNA, 18 bp, Homo sapiens
agcctcaacctcctgggc

SEQ ID NO: 3742733 - DNA, 19 bp, Homo sapiens
agcctcaacctcctgggct

SEQ ID NO: 3742734 - DNA, 15 bp, Homo sapiens
agcctcacagaagaa

SEQ ID NO: 3742735 - DNA, 13 bp, Homo sapiens
agcctcagcatcc

SEQ ID NO: 3742736 - DNA, 20 bp, Homo sapiens
agcctcagcatcctggcacc

SEQ ID NO: 3742737 - DNA, 22 bp, Homo sapiens
agcctcagcatcctggcacccg

SEQ ID NO: 3742738 - DNA, 23 bp, Homo sapiens
agcctcagcatcctggcacccgg

SEQ ID NO: 3742739 - DNA, 19 bp, Homo sapiens
agcctcatccgaggcaggg

SEQ ID NO: 3742740 - DNA, 17 bp, Homo sapiens
agcctccatgctgcctc

SEQ ID NO: 3742741 - DNA, 20 bp, Homo sapiens
agcctccatgctgcctccag

SEQ ID NO: 3742742 - DNA, 21 bp, Homo sapiens
agcctccatttagttctttgt

SEQ ID NO: 3742743 - DNA, 22 bp, Homo sapiens
agcctcccacgactgcccggca

SEQ ID NO: 3742744 - DNA, 19 bp, Homo sapiens
agcctcccgaatagctggg

SEQ ID NO: 3742745 - DNA, 13 bp, Homo sapiens
agcctccctctga

SEQ ID NO: 3742746 - DNA, 14 bp, Homo sapiens
agcctccctctgac

SEQ ID NO: 3742747 - DNA, 22 bp, Homo sapiens
agcctccctctgacctgcaggc

SEQ ID NO: 3742748 - DNA, 18 bp, Homo sapiens
agcctccgtatttcagac

SEQ ID NO: 3742749 - DNA, 17 bp, Homo sapiens
agcctcgaactcctggg

SEQ ID NO: 3742750 - DNA, 14 bp, Homo sapiens
agcctctccaggaa

SEQ ID NO: 3742751 - DNA, 23 bp, Homo sapiens
agcctctccaggaatgcctcctc

SEQ ID NO: 3742752 - DNA, 17 bp, Homo sapiens
agcctctcttcctatcc

SEQ ID NO: 3742753 - DNA, 18 bp, Homo sapiens
agcctctgagcccctggg

SEQ ID NO: 3742754 - DNA, 16 bp, Homo sapiens
agcctctgcctgtgca

SEQ ID NO: 3742755 - DNA, 22 bp, Homo sapiens
agcctcttaaagctgcctgtag

SEQ ID NO: 3742756 - DNA, 20 bp, Homo sapiens
agcctgaattttgttgctgt

SEQ ID NO: 3742757 - DNA, 21 bp, Homo sapiens
agcctgaattttgttgctgtt

SEQ ID NO: 3742758 - DNA, 11 bp, Homo sapiens
agcctgaggct

SEQ ID NO: 3742759 - DNA, 19 bp, Homo sapiens
agcctgcgtggctgacccc

SEQ ID NO: 3742760 - DNA, 14 bp, Homo sapiens
agcctgctccagct

SEQ ID NO: 3742761 - DNA, 19 bp, Homo sapiens
agcctgctcccccaccccc

SEQ ID NO: 3742762 - DNA, 12 bp, Homo sapiens
agcctgctgcat

SEQ ID NO: 3742763 - DNA, 23 bp, Homo sapiens
agcctggaggccgggtgctcagg

SEQ ID NO: 3742764 - DNA, 18 bp, Homo sapiens
agcctggcacagggcagt

SEQ ID NO: 3742765 - DNA, 14 bp, Homo sapiens
agcctggccaacat

SEQ ID NO: 3742766 - DNA, 18 bp, Homo sapiens
agcctggcttctggagcc

SEQ ID NO: 3742767 - DNA, 21 bp, Homo sapiens
agcctggcttctggagccctt

SEQ ID NO: 3742768 - DNA, 12 bp, Homo sapiens
agcctgggaggt

SEQ ID NO: 3742769 - DNA, 20 bp, Homo sapiens
agcctgggaggtcaaggctg

SEQ ID NO: 3742770 - DNA, 15 bp, Homo sapiens
agcctgggcaacaga

SEQ ID NO: 3742771 - DNA, 20 bp, Homo sapiens
agcctgggcagcatagcaag

SEQ ID NO: 3742772 - DNA, 17 bp, Homo sapiens
agcctgggcagccaggc

SEQ ID NO: 3742773 - DNA, 18 bp, Homo sapiens
agcctgggcagccaggct

SEQ ID NO: 3742774 - DNA, 19 bp, Homo sapiens
agcctgggcagccaggctg

SEQ ID NO: 3742775 - DNA, 14 bp, Homo sapiens
agcctgggcgacag

SEQ ID NO: 3742776 - DNA, 22 bp, Homo sapiens
agcctgggtgacagagcaagtg

SEQ ID NO: 3742777 - DNA, 14 bp, Homo sapiens
agcctggtgctgct

SEQ ID NO: 3742778 - DNA, 15 bp, Homo sapiens
agcctggtgctgctg

SEQ ID NO: 3742779 - DNA, 14 bp, Homo sapiens
agcctggtgggcct

SEQ ID NO: 3742780 - DNA, 18 bp, Homo sapiens
agcctggtgggcctcctc

SEQ ID NO: 3742781 - DNA, 16 bp, Homo sapiens
agcctgtaatcccagc

SEQ ID NO: 3742782 - DNA, 18 bp, Homo sapiens
agcctgtaatcccagcta

SEQ ID NO: 3742783 - DNA, 18 bp, Homo sapiens
agcctgtggcggtgcctg

SEQ ID NO: 3742784 - DNA, 21 bp, Homo sapiens
agccttgcccggattctggga

SEQ ID NO: 3742785 - DNA, 20 bp, Homo sapiens
agccttggataatgctgttg

SEQ ID NO: 3742786 - DNA, 23 bp, Homo sapiens
agccttggataatgctgttgcct

SEQ ID NO: 3742787 - DNA, 19 bp, Homo sapiens
agccttggtgtccacctgg

SEQ ID NO: 3742788 - DNA, 21 bp, Homo sapiens
agccttggtgtccacctggcc

SEQ ID NO: 3742789 - DNA, 22 bp, Homo sapiens
agccttggtgtccacctggccc

SEQ ID NO: 3742790 - DNA, 18 bp, Homo sapiens
agccttgtaattctaaat

SEQ ID NO: 3742791 - DNA, 23 bp, Homo sapiens
agcctttccataaggaatgtagc

SEQ ID NO: 3742792 - DNA, 16 bp, Homo sapiens
agcctttgcctccccg

SEQ ID NO: 3742793 - DNA, 19 bp, Homo sapiens
agcgagccctggtggcagt

SEQ ID NO: 3742794 - DNA, 21 bp, Homo sapiens
agcgagttgtggaaagcctct

SEQ ID NO: 3742795 - DNA, 18 bp, Homo sapiens
agcgatgaatttggagac

SEQ ID NO: 3742796 - DNA, 14 bp, Homo sapiens
agcgcacctgcccc

SEQ ID NO: 3742797 - DNA, 21 bp, Homo sapiens
agcgcacctgccccctggtgg

SEQ ID NO: 3742798 - DNA, 14 bp, Homo sapiens
agcgcccagttggg

SEQ ID NO: 3742799 - DNA, 23 bp, Homo sapiens
agcgcctagtggggtctccctct

SEQ ID NO: 3742800 - DNA, 19 bp, Homo sapiens
agcgcctgcccctcccaga

SEQ ID NO: 3742801 - DNA, 19 bp, Homo sapiens
agcgctagaggaagcagcc

SEQ ID NO: 3742802 - DNA, 21 bp, Homo sapiens
agcgctgccgcaccccagagt

SEQ ID NO: 3742803 - DNA, 13 bp, Homo sapiens
agcggctggcagc

SEQ ID NO: 3742804 - DNA, 17 bp, Homo sapiens
agcggctggtgcagggc

SEQ ID NO: 3742805 - DNA, 14 bp, Homo sapiens
agcggtttggggag

SEQ ID NO: 3742806 - DNA, 18 bp, Homo sapiens
agcgtactcatcatcaac

SEQ ID NO: 3742807 - DNA, 14 bp, Homo sapiens
agcgtagcctctcc

SEQ ID NO: 3742808 - DNA, 15 bp, Homo sapiens
agcgtgagccactgc

SEQ ID NO: 3742809 - DNA, 20 bp, Homo sapiens
agcgttggaattaaaacaat

SEQ ID NO: 3742810 - DNA, 22 bp, Homo sapiens
agcgtttgcccaaatctgccta

SEQ ID NO: 3742811 - DNA, 13 bp, Homo sapiens
agctaaagaggct

SEQ ID NO: 3742812 - DNA, 17 bp, Homo sapiens
agctaacactggcccct

SEQ ID NO: 3742813 - DNA, 17 bp, Homo sapiens
agctaagctaggaatga

SEQ ID NO: 3742814 - DNA, 20 bp, Homo sapiens
agctaataaaatatcattca

SEQ ID NO: 3742815 - DNA, 21 bp, Homo sapiens
agctaataaaatatcattcag

SEQ ID NO: 3742816 - DNA, 23 bp, Homo sapiens
agctaataaaatatcattcagca

SEQ ID NO: 3742817 - DNA, 16 bp, Homo sapiens
agctaataattcttca

SEQ ID NO: 3742818 - DNA, 21 bp, Homo sapiens
agctaatcagcattctcactc

SEQ ID NO: 3742819 - DNA, 12 bp, Homo sapiens
agctaattattt

SEQ ID NO: 3742820 - DNA, 16 bp, Homo sapiens
agctaattattttaat

SEQ ID NO: 3742821 - DNA, 13 bp, Homo sapiens
agctaccatgaca

SEQ ID NO: 3742822 - DNA, 16 bp, Homo sapiens
agctacctcaaacttc

SEQ ID NO: 3742823 - DNA, 13 bp, Homo sapiens
agctactaatgat

SEQ ID NO: 3742824 - DNA, 14 bp, Homo sapiens
agctactcagaagc

SEQ ID NO: 3742825 - DNA, 17 bp, Homo sapiens
agctactcaggaggctg

SEQ ID NO: 3742826 - DNA, 18 bp, Homo sapiens
agctactccggaggctga

SEQ ID NO: 3742827 - DNA, 19 bp, Homo sapiens
agctactccggaggctgag

SEQ ID NO: 3742828 - DNA, 17 bp, Homo sapiens
agctacttgggaggctg

SEQ ID NO: 3742829 - DNA, 21 bp, Homo sapiens
agctagaagtgggccaggaca

SEQ ID NO: 3742830 - DNA, 14 bp, Homo sapiens
agctagcgctgccg

SEQ ID NO: 3742831 - DNA, 16 bp, Homo sapiens
agctagcgctgccgca

SEQ ID NO: 3742832 - DNA, 18 bp, Homo sapiens
agctagcgctgccgcacc

SEQ ID NO: 3742833 - DNA, 20 bp, Homo sapiens
agctagcgctgccgcacccc

SEQ ID NO: 3742834 - DNA, 12 bp, Homo sapiens
agctaggcctgg

SEQ ID NO: 3742835 - DNA, 20 bp, Homo sapiens
agctatatccatgtactgta

SEQ ID NO: 3742836 - DNA, 22 bp, Homo sapiens
agctatatccatgtactgtagt

SEQ ID NO: 3742837 - DNA, 18 bp, Homo sapiens
agctatccggacagagca

SEQ ID NO: 3742838 - DNA, 17 bp, Homo sapiens
agctatgggagccccag

SEQ ID NO: 3742839 - DNA, 22 bp, Homo sapiens
agctatgggagccccagggtct

SEQ ID NO: 3742840 - DNA, 19 bp, Homo sapiens
agctattcagtaataactc

SEQ ID NO: 3742841 - DNA, 21 bp, Homo sapiens
agctattcagttggtaagctt

SEQ ID NO: 3742842 - DNA, 17 bp, Homo sapiens
agctattgatataaata

SEQ ID NO: 3742843 - DNA, 23 bp, Homo sapiens
agctattgatataaataaaacat

SEQ ID NO: 3742844 - DNA, 10 bp, Homo sapiens
agctattttt

SEQ ID NO: 3742845 - DNA, 16 bp, Homo sapiens
agctcaaaggcacagt

SEQ ID NO: 3742846 - DNA, 18 bp, Homo sapiens
agctcaagtcttccctga

SEQ ID NO: 3742847 - DNA, 16 bp, Homo sapiens
agctcacacatgagat

SEQ ID NO: 3742848 - DNA, 20 bp, Homo sapiens
agctcacagttcctcgccct

SEQ ID NO: 3742849 - DNA, 21 bp, Homo sapiens
agctcacagttcctcgccctg

SEQ ID NO: 3742850 - DNA, 23 bp, Homo sapiens
agctcacagttcctcgccctggg

SEQ ID NO: 3742851 - DNA, 22 bp, Homo sapiens
agctcaccagccccagtgccca

SEQ ID NO: 3742852 - DNA, 16 bp, Homo sapiens
agctcagacccccact

SEQ ID NO: 3742853 - DNA, 17 bp, Homo sapiens
agctcagacccccactc

SEQ ID NO: 3742854 - DNA, 11 bp, Homo sapiens
agctcagccca

SEQ ID NO: 3742855 - DNA, 14 bp, Homo sapiens
agctcagcccaccc

SEQ ID NO: 3742856 - DNA, 16 bp, Homo sapiens
agctcagcccaccccc

SEQ ID NO: 3742857 - DNA, 23 bp, Homo sapiens
agctcagtcttccctagggctgg

SEQ ID NO: 3742858 - DNA, 21 bp, Homo sapiens
agctccacaccctctcccagg

SEQ ID NO: 3742859 - DNA, 23 bp, Homo sapiens
agctccacaccctctcccaggac

SEQ ID NO: 3742860 - DNA, 16 bp, Homo sapiens
agctccagacccccag

SEQ ID NO: 3742861 - DNA, 23 bp, Homo sapiens
agctccagtggaagaagaaaaca

SEQ ID NO: 3742862 - DNA, 13 bp, Homo sapiens
agctcccacccca

SEQ ID NO: 3742863 - DNA, 17 bp, Homo sapiens
agctcccaccccacccc

SEQ ID NO: 3742864 - DNA, 22 bp, Homo sapiens
agctccccaaaaacctcacccg

SEQ ID NO: 3742865 - DNA, 17 bp, Homo sapiens
agctccccaccacccca

SEQ ID NO: 3742866 - DNA, 21 bp, Homo sapiens
agctccccaccaccccagctg

SEQ ID NO: 3742867 - DNA, 17 bp, Homo sapiens
agctccctaggagacca

SEQ ID NO: 3742868 - DNA, 14 bp, Homo sapiens
agctccctctgcct

SEQ ID NO: 3742869 - DNA, 19 bp, Homo sapiens
agctcctctgggcaggacc

SEQ ID NO: 3742870 - DNA, 23 bp, Homo sapiens
agctccttctgtcctactctgtg

SEQ ID NO: 3742871 - DNA, 12 bp, Homo sapiens
agctccttggga

SEQ ID NO: 3742872 - DNA, 14 bp, Homo sapiens
agctcggtggaccc

SEQ ID NO: 3742873 - DNA, 17 bp, Homo sapiens
agctcggtggacccagg

SEQ ID NO: 3742874 - DNA, 20 bp, Homo sapiens
agctcggtggacccagggat

SEQ ID NO: 3742875 - DNA, 19 bp, Homo sapiens
agctctagacaaccctgca

SEQ ID NO: 3742876 - DNA, 12 bp, Homo sapiens
agctctcagcca

SEQ ID NO: 3742877 - DNA, 13 bp, Homo sapiens
agctctcagccaa

SEQ ID NO: 3742878 - DNA, 11 bp, Homo sapiens
agctctccctc

SEQ ID NO: 3742879 - DNA, 13 bp, Homo sapiens
agctctccctctg

SEQ ID NO: 3742880 - DNA, 16 bp, Homo sapiens
agctctctcctccctt

SEQ ID NO: 3742881 - DNA, 12 bp, Homo sapiens
agctctgctcct

SEQ ID NO: 3742882 - DNA, 22 bp, Homo sapiens
agctctgctcctctccccagca

SEQ ID NO: 3742883 - DNA, 22 bp, Homo sapiens
agctctgcttgccgaaactgga

SEQ ID NO: 3742884 - DNA, 23 bp, Homo sapiens
agctctgcttgccgaaactggaa

SEQ ID NO: 3742885 - DNA, 14 bp, Homo sapiens
agctctggagccac

SEQ ID NO: 3742886 - DNA, 19 bp, Homo sapiens
agctctggctcacagactg

SEQ ID NO: 3742887 - DNA, 20 bp, Homo sapiens
agctctggctcacagactgg

SEQ ID NO: 3742888 - DNA, 20 bp, Homo sapiens
agctctggtgacaccagcct

SEQ ID NO: 3742889 - DNA, 21 bp, Homo sapiens
agctctggtgacaccagcctt

SEQ ID NO: 3742890 - DNA, 14 bp, Homo sapiens
agctctgtctgtcc

SEQ ID NO: 3742891 - DNA, 13 bp, Homo sapiens
agctcttcaggcc

SEQ ID NO: 3742892 - DNA, 16 bp, Homo sapiens
agctcttcaggcctcc

SEQ ID NO: 3742893 - DNA, 17 bp, Homo sapiens
agctcttcaggcctccc

SEQ ID NO: 3742894 - DNA, 15 bp, Homo sapiens
agctcttctccaggc

SEQ ID NO: 3742895 - DNA, 20 bp, Homo sapiens
agctcttctgccggccctgg

SEQ ID NO: 3742896 - DNA, 23 bp, Homo sapiens
agctcttctgccggccctggggc

SEQ ID NO: 3742897 - DNA, 23 bp, Homo sapiens
agctgaagagtgaggatatgagt

SEQ ID NO: 3742898 - DNA, 15 bp, Homo sapiens
agctgaatacattct

SEQ ID NO: 3742899 - DNA, 19 bp, Homo sapiens
agctgacaaaattttgctc

SEQ ID NO: 3742900 - DNA, 16 bp, Homo sapiens
agctgacgaggctggg

SEQ ID NO: 3742901 - DNA, 19 bp, Homo sapiens
agctgacgaggctgggcca

SEQ ID NO: 3742902 - DNA, 15 bp, Homo sapiens
agctgagcaccaggg

SEQ ID NO: 3742903 - DNA, 18 bp, Homo sapiens
agctgaggtctcttgagg

SEQ ID NO: 3742904 - DNA, 18 bp, Homo sapiens
agctgattactgtcaata

SEQ ID NO: 3742905 - DNA, 18 bp, Homo sapiens
agctgcaagtgacatctc

SEQ ID NO: 3742906 - DNA, 21 bp, Homo sapiens
agctgcaagtgacatctcttt

SEQ ID NO: 3742907 - DNA, 18 bp, Homo sapiens
agctgcacctgccagcct

SEQ ID NO: 3742908 - DNA, 11 bp, Homo sapiens
agctgcagaac

SEQ ID NO: 3742909 - DNA, 17 bp, Homo sapiens
agctgcagagacagaga

SEQ ID NO: 3742910 - DNA, 18 bp, Homo sapiens
agctgcagagacagagag

SEQ ID NO: 3742911 - DNA, 12 bp, Homo sapiens
agctgccagaga

SEQ ID NO: 3742912 - DNA, 17 bp, Homo sapiens
agctgccatccagggat

SEQ ID NO: 3742913 - DNA, 13 bp, Homo sapiens
agctgccgaccag

SEQ ID NO: 3742914 - DNA, 13 bp, Homo sapiens
agctgcctcactt

SEQ ID NO: 3742915 - DNA, 18 bp, Homo sapiens
agctgcctccctgtccac

SEQ ID NO: 3742916 - DNA, 14 bp, Homo sapiens
agctgcctgtagtt

SEQ ID NO: 3742917 - DNA, 15 bp, Homo sapiens
agctgcctgtagtta

SEQ ID NO: 3742918 - DNA, 19 bp, Homo sapiens
agctgcctgtagttaggaa

SEQ ID NO: 3742919 - DNA, 14 bp, Homo sapiens
agctgcctgttcag

SEQ ID NO: 3742920 - DNA, 20 bp, Homo sapiens
accagggagcccctttgatg

SEQ ID NO: 3742921 - DNA, 22 bp, Homo sapiens
accagggcgaacgacaatagct

SEQ ID NO: 3742922 - DNA, 23 bp, Homo sapiens
accaggtgttctacactcatctt

SEQ ID NO: 3742923 - DNA, 19 bp, Homo sapiens
accagtcatcagctattca

SEQ ID NO: 3742924 - DNA, 14 bp, Homo sapiens
accagtctgaagtt

SEQ ID NO: 3742925 - DNA, 21 bp, Homo sapiens
accagtctgaagtttcattta

SEQ ID NO: 3742926 - DNA, 13 bp, Homo sapiens
accagtgtagcct

SEQ ID NO: 3742927 - DNA, 21 bp, Homo sapiens
accagtgtggtttgtgtttga

SEQ ID NO: 3742928 - DNA, 23 bp, Homo sapiens
accagtgtgtggctttcagagcc

SEQ ID NO: 3742929 - DNA, 15 bp, Homo sapiens
accatactgagggac

SEQ ID NO: 3742930 - DNA, 13 bp, Homo sapiens
accatcctattta

SEQ ID NO: 3742931 - DNA, 13 bp, Homo sapiens
accatctcaggcc

SEQ ID NO: 3742932 - DNA, 15 bp, Homo sapiens
accatctcaggccac

SEQ ID NO: 3742933 - DNA, 23 bp, Homo sapiens
accatgattaaccacttcagctg

SEQ ID NO: 3742934 - DNA, 20 bp, Homo sapiens
accatgtaaaacaaaaaaca

SEQ ID NO: 3742935 - DNA, 22 bp, Homo sapiens
accatgtaaaacaaaaaacaat

SEQ ID NO: 3742936 - DNA, 11 bp, Homo sapiens
accatgtacat

SEQ ID NO: 3742937 - DNA, 17 bp, Homo sapiens
accatgtacatgaagaa

SEQ ID NO: 3742938 - DNA, 12 bp, Homo sapiens
accatgtttgag

SEQ ID NO: 3742939 - DNA, 20 bp, Homo sapiens
accatgtttgagctcagacc

SEQ ID NO: 3742940 - DNA, 21 bp, Homo sapiens
accatgtttgagctcagaccc

SEQ ID NO: 3742941 - DNA, 20 bp, Homo sapiens
accattcaggaacctggacc

SEQ ID NO: 3742942 - DNA, 23 bp, Homo sapiens
accattgctgctccttagctgcc

SEQ ID NO: 3742943 - DNA, 11 bp, Homo sapiens
accattgcttc

SEQ ID NO: 3742944 - DNA, 15 bp, Homo sapiens
accattgcttcacta

SEQ ID NO: 3742945 - DNA, 18 bp, Homo sapiens
accattgtctcagagcag

SEQ ID NO: 3742946 - DNA, 15 bp, Homo sapiens
accatttgtaataaa

SEQ ID NO: 3742947 - DNA, 21 bp, Homo sapiens
accatttgtaataaagtatat

SEQ ID NO: 3742948 - DNA, 13 bp, Homo sapiens
accattttctggt

SEQ ID NO: 3742949 - DNA, 23 bp, Homo sapiens
accattttggggtacccactgct

SEQ ID NO: 3742950 - DNA, 15 bp, Homo sapiens
acccaaggaggaaaa

SEQ ID NO: 3742951 - DNA, 17 bp, Homo sapiens
acccacaagtgccactg

SEQ ID NO: 3742952 - DNA, 15 bp, Homo sapiens
acccacactgcaaca

SEQ ID NO: 3742953 - DNA, 14 bp, Homo sapiens
acccacagaaagag

SEQ ID NO: 3742954 - DNA, 13 bp, Homo sapiens
acccacctcagcc

SEQ ID NO: 3742955 - DNA, 14 bp, Homo sapiens
acccacctcagcct

SEQ ID NO: 3742956 - DNA, 16 bp, Homo sapiens
acccacctcagcctcc

SEQ ID NO: 3742957 - DNA, 13 bp, Homo sapiens
acccacctgagct

SEQ ID NO: 3742958 - DNA, 14 bp, Homo sapiens
acccacctgagctt

SEQ ID NO: 3742959 - DNA, 11 bp, Homo sapiens
acccacctgct

SEQ ID NO: 3742960 - DNA, 22 bp, Homo sapiens
acccacctgctgagagacccaa

SEQ ID NO: 3742961 - DNA, 11 bp, Homo sapiens
acccactgctc

SEQ ID NO: 3742962 - DNA, 17 bp, Homo sapiens
acccagcaactccaact

SEQ ID NO: 3742963 - DNA, 18 bp, Homo sapiens
acccagcccacttctgcc

SEQ ID NO: 3742964 - DNA, 11 bp, Homo sapiens
acccagcccat

SEQ ID NO: 3742965 - DNA, 14 bp, Homo sapiens
acccagcccatctt

SEQ ID NO: 3742966 - DNA, 14 bp, Homo sapiens
acccagcccattct

SEQ ID NO: 3742967 - DNA, 22 bp, Homo sapiens
acccagcccattctctctcctg

SEQ ID NO: 3742968 - DNA, 19 bp, Homo sapiens
acccagcgagccctggtgg

SEQ ID NO: 3742969 - DNA, 24 bp, Homo sapiens
acccagcgagccctggtggcagtg

SEQ ID NO: 3742970 - DNA, 14 bp, Homo sapiens
acccaggaggtgga

SEQ ID NO: 3742971 - DNA, 20 bp, Homo sapiens
acccaggaggtggaggttgc

SEQ ID NO: 3742972 - DNA, 23 bp, Homo sapiens
acccaggaggtggaggttgcagt

SEQ ID NO: 3742973 - DNA, 14 bp, Homo sapiens
acccatcctagaga

SEQ ID NO: 3742974 - DNA, 20 bp, Homo sapiens
acccatgaagacaggacagt

SEQ ID NO: 3742975 - DNA, 13 bp, Homo sapiens
acccatgaggcaa

SEQ ID NO: 3742976 - DNA, 11 bp, Homo sapiens
accccacactt

SEQ ID NO: 3742977 - DNA, 12 bp, Homo sapiens
accccaccccct

SEQ ID NO: 3742978 - DNA, 13 bp, Homo sapiens
accccacccttcc

SEQ ID NO: 3742979 - DNA, 16 bp, Homo sapiens
accccactcacagaga

SEQ ID NO: 3742980 - DNA, 13 bp, Homo sapiens
accccaggtttct

SEQ ID NO: 3742981 - DNA, 18 bp, Homo sapiens
accccatctctacaaaaa

SEQ ID NO: 3742982 - DNA, 12 bp, Homo sapiens
acccccacccca

SEQ ID NO: 3742983 - DNA, 12 bp, Homo sapiens
acccccaccctt

SEQ ID NO: 3742984 - DNA, 13 bp, Homo sapiens
acccccactctca

SEQ ID NO: 3742985 - DNA, 21 bp, Homo sapiens
acccccactctcattccccag

SEQ ID NO: 3742986 - DNA, 16 bp, Homo sapiens
acccccagctttgcta

SEQ ID NO: 3742987 - DNA, 17 bp, Homo sapiens
acccccatttctattta

SEQ ID NO: 3742988 - DNA, 12 bp, Homo sapiens
accccccacctg

SEQ ID NO: 3742989 - DNA, 18 bp, Homo sapiens
accccccagaacctgtcc

SEQ ID NO: 3742990 - DNA, 12 bp, Homo sapiens
accccctcccca

SEQ ID NO: 3742991 - DNA, 13 bp, Homo sapiens
accccctccccag

SEQ ID NO: 3742992 - DNA, 14 bp, Homo sapiens
accccctccccagg

SEQ ID NO: 3742993 - DNA, 16 bp, Homo sapiens
accccctccccagggg

SEQ ID NO: 3742994 - DNA, 17 bp, Homo sapiens
accccctccctggcctg

SEQ ID NO: 3742995 - DNA, 22 bp, Homo sapiens
accccctccctggcctgttctg

SEQ ID NO: 3742996 - DNA, 22 bp, Homo sapiens
acccccttctctgcccattccc

SEQ ID NO: 3742997 - DNA, 18 bp, Homo sapiens
acccccttctctgctcca

SEQ ID NO: 3742998 - DNA, 20 bp, Homo sapiens
acccccttctctgctccacc

SEQ ID NO: 3742999 - DNA, 13 bp, Homo sapiens
accccgagcccta

SEQ ID NO: 3743000 - DNA, 15 bp, Homo sapiens
accccgggctctctg

SEQ ID NO: 3743001 - DNA, 16 bp, Homo sapiens
accccgggctctctgc

SEQ ID NO: 3743002 - DNA, 21 bp, Homo sapiens
accccgggctctctgctgtac

SEQ ID NO: 3743003 - DNA, 22 bp, Homo sapiens
accccgtctggggttcagcccc

SEQ ID NO: 3743004 - DNA, 22 bp, Homo sapiens
acccctaaagagatactttgat

SEQ ID NO: 3743005 - DNA, 20 bp, Homo sapiens
acccctcaacacctctgcac

SEQ ID NO: 3743006 - DNA, 22 bp, Homo sapiens
acccctcaccttgcaacacaca

SEQ ID NO: 3743007 - DNA, 23 bp, Homo sapiens
acccctcaccttgcaacacacag

SEQ ID NO: 3743008 - DNA, 16 bp, Homo sapiens
acccctccatgtgggc

SEQ ID NO: 3743009 - DNA, 17 bp, Homo sapiens
acccctccttccttgac

SEQ ID NO: 3743010 - DNA, 13 bp, Homo sapiens
acccctctggcca

SEQ ID NO: 3743011 - DNA, 12 bp, Homo sapiens
acccctgccctg

SEQ ID NO: 3743012 - DNA, 19 bp, Homo sapiens
acccctggcttttcactgc

SEQ ID NO: 3743013 - DNA, 13 bp, Homo sapiens
acccctgtggagc

SEQ ID NO: 3743014 - DNA, 18 bp, Homo sapiens
acccctgtggagcccgca

SEQ ID NO: 3743015 - DNA, 19 bp, Homo sapiens
acccctgtggagcccgcac

SEQ ID NO: 3743016 - DNA, 16 bp, Homo sapiens
accccttacttagcat

SEQ ID NO: 3743017 - DNA, 15 bp, Homo sapiens
accccttagcctccc

SEQ ID NO: 3743018 - DNA, 16 bp, Homo sapiens
accccttagcctccct

SEQ ID NO: 3743019 - DNA, 21 bp, Homo sapiens
accccttccccactgcctgcc

SEQ ID NO: 3743020 - DNA, 17 bp, Homo sapiens
acccgaggctgcccact

SEQ ID NO: 3743021 - DNA, 22 bp, Homo sapiens
acccggagctaacactggcccc

SEQ ID NO: 3743022 - DNA, 23 bp, Homo sapiens
acccggagctaacactggcccct

SEQ ID NO: 3743023 - DNA, 15 bp, Homo sapiens
acccggaggggcctg

SEQ ID NO: 3743024 - DNA, 18 bp, Homo sapiens
acccggaggggcctggca

SEQ ID NO: 3743025 - DNA, 16 bp, Homo sapiens
acccggcccctgctgg

SEQ ID NO: 3743026 - DNA, 17 bp, Homo sapiens
acccggcccctgctggt

SEQ ID NO: 3743027 - DNA, 22 bp, Homo sapiens
acccgttttatgatttactcat

SEQ ID NO: 3743028 - DNA, 19 bp, Homo sapiens
accctaaaaagcagagctt

SEQ ID NO: 3743029 - DNA, 16 bp, Homo sapiens
accctaaatctgagga

SEQ ID NO: 3743030 - DNA, 22 bp, Homo sapiens
accctaaggtcattaccacagg

SEQ ID NO: 3743031 - DNA, 14 bp, Homo sapiens
accctaccccacca

SEQ ID NO: 3743032 - DNA, 13 bp, Homo sapiens
accctacctgtgc

SEQ ID NO: 3743033 - DNA, 14 bp, Homo sapiens
accctattgctgct

SEQ ID NO: 3743034 - DNA, 19 bp, Homo sapiens
accctattgctgcttgagg

SEQ ID NO: 3743035 - DNA, 13 bp, Homo sapiens
acctctgatacct

SEQ ID NO: 3743036 - DNA, 15 bp, Homo sapiens
acctctgatacctca

SEQ ID NO: 3743037 - DNA, 15 bp, Homo sapiens
acctctgcctcaatg

SEQ ID NO: 3743038 - DNA, 19 bp, Homo sapiens
acctctggactggctagag

SEQ ID NO: 3743039 - DNA, 10 bp, Homo sapiens
acctctgggc

SEQ ID NO: 3743040 - DNA, 22 bp, Homo sapiens
acctcttccccagaaaggagac

SEQ ID NO: 3743041 - DNA, 22 bp, Homo sapiens
acctctttgaaagaaggaagac

SEQ ID NO: 3743042 - DNA, 22 bp, Homo sapiens
acctgaaaagatgttgtgtctt

SEQ ID NO: 3743043 - DNA, 15 bp, Homo sapiens
acctgaaaatgttag

SEQ ID NO: 3743044 - DNA, 23 bp, Homo sapiens
acctgaatagctcccagatttca

SEQ ID NO: 3743045 - DNA, 17 bp, Homo sapiens
acctgaccaacatggag

SEQ ID NO: 3743046 - DNA, 23 bp, Homo sapiens
acctgagcccggatgcttctcca

SEQ ID NO: 3743047 - DNA, 12 bp, Homo sapiens
acctgagctgcc

SEQ ID NO: 3743048 - DNA, 18 bp, Homo sapiens
acctgagctgccatccag

SEQ ID NO: 3743049 - DNA, 13 bp, Homo sapiens
acctgaggaagcg

SEQ ID NO: 3743050 - DNA, 17 bp, Homo sapiens
acctgcacctcccccca

SEQ ID NO: 3743051 - DNA, 21 bp, Homo sapiens
acctgcacctccccccactgc

SEQ ID NO: 3743052 - DNA, 15 bp, Homo sapiens
acctgcaggccaaga

SEQ ID NO: 3743053 - DNA, 14 bp, Homo sapiens
acctgcataaaaag

SEQ ID NO: 3743054 - DNA, 21 bp, Homo sapiens
acctgcatccgtagttccctg

SEQ ID NO: 3743055 - DNA, 21 bp, Homo sapiens
acctgccactaggctgggtgc

SEQ ID NO: 3743056 - DNA, 14 bp, Homo sapiens
acctgccagcctgg

SEQ ID NO: 3743057 - DNA, 16 bp, Homo sapiens
acctgccagcctggct

SEQ ID NO: 3743058 - DNA, 19 bp, Homo sapiens
acctgccatttgcaccctc

SEQ ID NO: 3743059 - DNA, 13 bp, Homo sapiens
acctgccccatcc

SEQ ID NO: 3743060 - DNA, 14 bp, Homo sapiens
acctgccccatccc

SEQ ID NO: 3743061 - DNA, 13 bp, Homo sapiens
acctgccccctgg

SEQ ID NO: 3743062 - DNA, 17 bp, Homo sapiens
acctgcccccttctccc

SEQ ID NO: 3743063 - DNA, 18 bp, Homo sapiens
acctgcccccttctccca

SEQ ID NO: 3743064 - DNA, 16 bp, Homo sapiens
acctgccccgcccagc

SEQ ID NO: 3743065 - DNA, 13 bp, Homo sapiens
acctgccgacctc

SEQ ID NO: 3743066 - DNA, 18 bp, Homo sapiens
acctgccgacctcgtcct

SEQ ID NO: 3743067 - DNA, 20 bp, Homo sapiens
acctgccgacctcgtcctcc

SEQ ID NO: 3743068 - DNA, 13 bp, Homo sapiens
acctgctgatgtg

SEQ ID NO: 3743069 - DNA, 14 bp, Homo sapiens
acctgctggcccct

SEQ ID NO: 3743070 - DNA, 16 bp, Homo sapiens
acctgctggcccctca

SEQ ID NO: 3743071 - DNA, 15 bp, Homo sapiens
acctgctttcaagac

SEQ ID NO: 3743072 - DNA, 16 bp, Homo sapiens
acctggaccaaagctg

SEQ ID NO: 3743073 - DNA, 12 bp, Homo sapiens
acctggccctgg

SEQ ID NO: 3743074 - DNA, 13 bp, Homo sapiens
acctggccctggg

SEQ ID NO: 3743075 - DNA, 15 bp, Homo sapiens
acctggccctggggc

SEQ ID NO: 3743076 - DNA, 19 bp, Homo sapiens
acctgggcacctggggagt

SEQ ID NO: 3743077 - DNA, 18 bp, Homo sapiens
acctggggtgtgggaggc

SEQ ID NO: 3743078 - DNA, 11 bp, Homo sapiens
acctggtgctg

SEQ ID NO: 3743079 - DNA, 19 bp, Homo sapiens
acctgtaatcccagcactt

SEQ ID NO: 3743080 - DNA, 14 bp, Homo sapiens
acctgtagtcccag

SEQ ID NO: 3743081 - DNA, 19 bp, Homo sapiens
acctgtcaaacaaagccag

SEQ ID NO: 3743082 - DNA, 24 bp, Homo sapiens
acctgtcaaacaaagccagaagct

SEQ ID NO: 3743083 - DNA, 12 bp, Homo sapiens
acctgtcaatac

SEQ ID NO: 3743084 - DNA, 19 bp, Homo sapiens
acctgtcaccgtgagcagc

SEQ ID NO: 3743085 - DNA, 14 bp, Homo sapiens
acctgtctcagcct

SEQ ID NO: 3743086 - DNA, 14 bp, Homo sapiens
acctgtgaccagca

SEQ ID NO: 3743087 - DNA, 19 bp, Homo sapiens
acctgtgaccagcactgtc

SEQ ID NO: 3743088 - DNA, 18 bp, Homo sapiens
acctgtgagtttaaagca

SEQ ID NO: 3743089 - DNA, 20 bp, Homo sapiens
acctgtggggatttctccca

SEQ ID NO: 3743090 - DNA, 22 bp, Homo sapiens
acctgtggggatttctcccagc

SEQ ID NO: 3743091 - DNA, 23 bp, Homo sapiens
acctgtggggatttctcccagct

SEQ ID NO: 3743092 - DNA, 18 bp, Homo sapiens
acctgtttttaagctgtt

SEQ ID NO: 3743093 - DNA, 22 bp, Homo sapiens
accttaaattaaacaatttatt

SEQ ID NO: 3743094 - DNA, 22 bp, Homo sapiens
accttagctggcattacagctg

SEQ ID NO: 3743095 - DNA, 11 bp, Homo sapiens
accttatctgt

SEQ ID NO: 3743096 - DNA, 11 bp, Homo sapiens
accttatctta

SEQ ID NO: 3743097 - DNA, 14 bp, Homo sapiens
accttattgtacct

SEQ ID NO: 3743098 - DNA, 12 bp, Homo sapiens
accttcaataaa

SEQ ID NO: 3743099 - DNA, 14 bp, Homo sapiens
accttcaataaagt

SEQ ID NO: 3743100 - DNA, 19 bp, Homo sapiens
accttcaataaagtatcta

SEQ ID NO: 3743101 - DNA, 18 bp, Homo sapiens
accttcaattcctgggcc

SEQ ID NO: 3743102 - DNA, 18 bp, Homo sapiens
accttcccagctctccct

SEQ ID NO: 3743103 - DNA, 23 bp, Homo sapiens
accttctgcccatcctgtctgtt

SEQ ID NO: 3743104 - DNA, 16 bp, Homo sapiens
accttctgtggctcac

SEQ ID NO: 3743105 - DNA, 18 bp, Homo sapiens
accttgaacactggggga

SEQ ID NO: 3743106 - DNA, 17 bp, Homo sapiens
accttgacttgattagt

SEQ ID NO: 3743107 - DNA, 11 bp, Homo sapiens
accttgaggtc

SEQ ID NO: 3743108 - DNA, 12 bp, Homo sapiens
accttggctgca

SEQ ID NO: 3743109 - DNA, 21 bp, Homo sapiens
acctttaagaattttaaatat

SEQ ID NO: 3743110 - DNA, 14 bp, Homo sapiens
acctttattaaaat

SEQ ID NO: 3743111 - DNA, 17 bp, Homo sapiens
acctttattaaaatctt

SEQ ID NO: 3743112 - DNA, 23 bp, Homo sapiens
acctttgggttgcaatctgggga

SEQ ID NO: 3743113 - DNA, 21 bp, Homo sapiens
accttttaaatcctgttgaaa

SEQ ID NO: 3743114 - DNA, 22 bp, Homo sapiens
accttttaaatcctgttgaaaa

SEQ ID NO: 3743115 - DNA, 23 bp, Homo sapiens
accttttaaatcctgttgaaaag

SEQ ID NO: 3743116 - DNA, 14 bp, Homo sapiens
accttttaactcac

SEQ ID NO: 3743117 - DNA, 15 bp, Homo sapiens
acctttttccttcct

SEQ ID NO: 3743118 - DNA, 13 bp, Homo sapiens
acgaaatgttatt

SEQ ID NO: 3743119 - DNA, 14 bp, Homo sapiens
acgaacccacctgc

SEQ ID NO: 3743120 - DNA, 16 bp, Homo sapiens
acgaagggggcatctg

SEQ ID NO: 3743121 - DNA, 20 bp, Homo sapiens
acgacaacgatgatgcttgt

SEQ ID NO: 3743122 - DNA, 19 bp, Homo sapiens
acgagaccctacaggagag

SEQ ID NO: 3743123 - DNA, 14 bp, Homo sapiens
acgaggctgggcca

SEQ ID NO: 3743124 - DNA, 17 bp, Homo sapiens
acgaggctgggccaagc

SEQ ID NO: 3743125 - DNA, 14 bp, Homo sapiens
acgaggtatgaggt

SEQ ID NO: 3743126 - DNA, 17 bp, Homo sapiens
acgagtgggaaggactt

SEQ ID NO: 3743127 - DNA, 14 bp, Homo sapiens
acgatgtggccctg

SEQ ID NO: 3743128 - DNA, 17 bp, Homo sapiens
acgatgtggccctggcc

SEQ ID NO: 3743129 - DNA, 18 bp, Homo sapiens
acgatgtggccctggcct

SEQ ID NO: 3743130 - DNA, 19 bp, Homo sapiens
acgatgtggccctggcctg

SEQ ID NO: 3743131 - DNA, 21 bp, Homo sapiens
acgcacacacacacacaggag

SEQ ID NO: 3743132 - DNA, 14 bp, Homo sapiens
acgcacactgtctg

SEQ ID NO: 3743133 - DNA, 13 bp, Homo sapiens
acgcacctcccat

SEQ ID NO: 3743134 - DNA, 22 bp, Homo sapiens
acgcagccctgctttgggctgc

SEQ ID NO: 3743135 - DNA, 23 bp, Homo sapiens
acgcagccctgctttgggctgcc

SEQ ID NO: 3743136 - DNA, 22 bp, Homo sapiens
acgcatggagtgtgtattgttc

SEQ ID NO: 3743137 - DNA, 14 bp, Homo sapiens
acgccactgcactc

SEQ ID NO: 3743138 - DNA, 22 bp, Homo sapiens
acgccactgcactccagcctgg

SEQ ID NO: 3743139 - DNA, 14 bp, Homo sapiens
acgccagtctccca

SEQ ID NO: 3743140 - DNA, 15 bp, Homo sapiens
acgccagtctcccag

SEQ ID NO: 3743141 - DNA, 16 bp, Homo sapiens
acgcctatgatcccag

SEQ ID NO: 3743142 - DNA, 17 bp, Homo sapiens
acgcctgcttgtccctg

SEQ ID NO: 3743143 - DNA, 17 bp, Homo sapiens
acgcctgtaatcccagc

SEQ ID NO: 3743144 - DNA, 18 bp, Homo sapiens
acgcctgtaatcccagca

SEQ ID NO: 3743145 - DNA, 19 bp, Homo sapiens
acgcctgtaatcccagcac

SEQ ID NO: 3743146 - DNA, 20 bp, Homo sapiens
acgctggaccttgaactggg

SEQ ID NO: 3743147 - DNA, 15 bp, Homo sapiens
acgctggagtgcagt

SEQ ID NO: 3743148 - DNA, 23 bp, Homo sapiens
acgctggtagagatggaggagga

SEQ ID NO: 3743149 - DNA, 12 bp, Homo sapiens
acgctgtctcca

SEQ ID NO: 3743150 - DNA, 21 bp, Homo sapiens
acgctgtctccagacccccac

SEQ ID NO: 3743151 - DNA, 23 bp, Homo sapiens
acgctgtctccagacccccaccc

SEQ ID NO: 3743152 - DNA, 18 bp, Homo sapiens
acggaaaatgccaatctc

SEQ ID NO: 3743153 - DNA, 19 bp, Homo sapiens
acggaaggacctatgtttg

SEQ ID NO: 3743154 - DNA, 15 bp, Homo sapiens
acggaatagttggct

SEQ ID NO: 3743155 - DNA, 19 bp, Homo sapiens
acggaatagttggctagga

SEQ ID NO: 3743156 - DNA, 12 bp, Homo sapiens
acggagagaaaa

SEQ ID NO: 3743157 - DNA, 23 bp, Homo sapiens
acggagtcccaccttggctgcag

SEQ ID NO: 3743158 - DNA, 15 bp, Homo sapiens
acggcactgtggcct

SEQ ID NO: 3743159 - DNA, 21 bp, Homo sapiens
acggcaggacaacgaggaagc

SEQ ID NO: 3743160 - DNA, 20 bp, Homo sapiens
acggcctgatgctccctccc

SEQ ID NO: 3743161 - DNA, 21 bp, Homo sapiens
acggccttcaactgaaaagac

SEQ ID NO: 3743162 - DNA, 17 bp, Homo sapiens
acggcgcccccagtgtg

SEQ ID NO: 3743163 - DNA, 16 bp, Homo sapiens
acggctcactgcagcc

SEQ ID NO: 3743164 - DNA, 18 bp, Homo sapiens
acggcttttacttaaacc

SEQ ID NO: 3743165 - DNA, 14 bp, Homo sapiens
acggggtccttcaa

SEQ ID NO: 3743166 - DNA, 18 bp, Homo sapiens
acggtgggcatttgtgag

SEQ ID NO: 3743167 - DNA, 15 bp, Homo sapiens
acggttttactgcag

SEQ ID NO: 3743168 - DNA, 18 bp, Homo sapiens
acgtaaccacggaaaaga

SEQ ID NO: 3743169 - DNA, 20 bp, Homo sapiens
acgtactgcagcctccagag

SEQ ID NO: 3743170 - DNA, 16 bp, Homo sapiens
acgtattggtccagct

SEQ ID NO: 3743171 - DNA, 16 bp, Homo sapiens
acgtcaaacatgaagt

SEQ ID NO: 3743172 - DNA, 22 bp, Homo sapiens
acgtccctccacgttcacccct

SEQ ID NO: 3743173 - DNA, 14 bp, Homo sapiens
acgtctgacaggca

SEQ ID NO: 3743174 - DNA, 16 bp, Homo sapiens
acgtctgaccctctcc

SEQ ID NO: 3743175 - DNA, 13 bp, Homo sapiens
acgtctgtcttca

SEQ ID NO: 3743176 - DNA, 14 bp, Homo sapiens
acgtctgtcttcac

SEQ ID NO: 3743177 - DNA, 19 bp, Homo sapiens
acgtctgtcttcacagctc

SEQ ID NO: 3743178 - DNA, 20 bp, Homo sapiens
acgtgactgccccaactcct

SEQ ID NO: 3743179 - DNA, 15 bp, Homo sapiens
acgtgagagtgtctt

SEQ ID NO: 3743180 - DNA, 16 bp, Homo sapiens
acgtggagagctggtg

SEQ ID NO: 3743181 - DNA, 23 bp, Homo sapiens
acgtggcttctgatgaatcttgc

SEQ ID NO: 3743182 - DNA, 21 bp, Homo sapiens
acgtgggagttcagctgcttc

SEQ ID NO: 3743183 - DNA, 20 bp, Homo sapiens
acgtgggcggcagagaggac

SEQ ID NO: 3743184 - DNA, 15 bp, Homo sapiens
acgtggggcagcaca

SEQ ID NO: 3743185 - DNA, 11 bp, Homo sapiens
acgtgtgtgac

SEQ ID NO: 3743186 - DNA, 22 bp, Homo sapiens
acgtgtgtttctagagcctgct

SEQ ID NO: 3743187 - DNA, 12 bp, Homo sapiens
acgttggacttt

SEQ ID NO: 3743188 - DNA, 13 bp, Homo sapiens
acgtttaaagtgt

SEQ ID NO: 3743189 - DNA, 15 bp, Homo sapiens
acgtttaaagttctg

SEQ ID NO: 3743190 - DNA, 18 bp, Homo sapiens
acgtttaaagttctgtgt

SEQ ID NO: 3743191 - DNA, 15 bp, Homo sapiens
acgtttcctgagaag

SEQ ID NO: 3743192 - DNA, 20 bp, Homo sapiens
acgtttttaatataaagcct

SEQ ID NO: 3743193 - DNA, 13 bp, Homo sapiens
actaaaaatatta

SEQ ID NO: 3743194 - DNA, 14 bp, Homo sapiens
actaaagagagaat

SEQ ID NO: 3743195 - DNA, 17 bp, Homo sapiens
actaaagcagtagaaat

SEQ ID NO: 3743196 - DNA, 20 bp, Homo sapiens
actaaatctgtaagctcttt

SEQ ID NO: 3743197 - DNA, 15 bp, Homo sapiens
actaaatgccctgct

SEQ ID NO: 3743198 - DNA, 16 bp, Homo sapiens
actaacacatttttaa

SEQ ID NO: 3743199 - DNA, 15 bp, Homo sapiens
actaacatataatgt

SEQ ID NO: 3743200 - DNA, 17 bp, Homo sapiens
actaacatataatgttg

SEQ ID NO: 3743201 - DNA, 12 bp, Homo sapiens
actaacattata

SEQ ID NO: 3743202 - DNA, 20 bp, Homo sapiens
actaatctattgggttcatt

SEQ ID NO: 3743203 - DNA, 13 bp, Homo sapiens
actaatgatgttt

SEQ ID NO: 3743204 - DNA, 18 bp, Homo sapiens
actaatggggcggtgaga

SEQ ID NO: 3743205 - DNA, 16 bp, Homo sapiens
actaattaacatataa

SEQ ID NO: 3743206 - DNA, 14 bp, Homo sapiens
actacaaaatttga

SEQ ID NO: 3743207 - DNA, 22 bp, Homo sapiens
actacaatttaaagcaaaggag

SEQ ID NO: 3743208 - DNA, 19 bp, Homo sapiens
actacacattcaataagca

SEQ ID NO: 3743209 - DNA, 23 bp, Homo sapiens
actacaccatgtttgagctcaga

SEQ ID NO: 3743210 - DNA, 15 bp, Homo sapiens
actacactccagcct

SEQ ID NO: 3743211 - DNA, 18 bp, Homo sapiens
actacactccagcctgag

SEQ ID NO: 3743212 - DNA, 19 bp, Homo sapiens
actacactccagcctgagc

SEQ ID NO: 3743213 - DNA, 23 bp, Homo sapiens
actacaggtgtgagtcaccaagc

SEQ ID NO: 3743214 - DNA, 17 bp, Homo sapiens
actacatcgccctccac

SEQ ID NO: 3743215 - DNA, 15 bp, Homo sapiens
actacattttaacat

SEQ ID NO: 3743216 - DNA, 20 bp, Homo sapiens
actacccatcggtgtccatt

SEQ ID NO: 3743217 - DNA, 19 bp, Homo sapiens
actactagatgtctttagg

SEQ ID NO: 3743218 - DNA, 17 bp, Homo sapiens
actactcagggaatgaa

SEQ ID NO: 3743219 - DNA, 15 bp, Homo sapiens
actactgtgttcctg

SEQ ID NO: 3743220 - DNA, 16 bp, Homo sapiens
actactgtgttcctgg

SEQ ID NO: 3743221 - DNA, 21 bp, Homo sapiens
actactgtgttcctggcaata

SEQ ID NO: 3743222 - DNA, 18 bp, Homo sapiens
actagaaagtgaataaaa

SEQ ID NO: 3743223 - DNA, 19 bp, Homo sapiens
actagaaagtgaataaaaa

SEQ ID NO: 3743224 - DNA, 13 bp, Homo sapiens
actagaactctcc

SEQ ID NO: 3743225 - DNA, 15 bp, Homo sapiens
actagaactctccat

SEQ ID NO: 3743226 - DNA, 16 bp, Homo sapiens
actagaactctccatc

SEQ ID NO: 3743227 - DNA, 11 bp, Homo sapiens
actagagaaac

SEQ ID NO: 3743228 - DNA, 14 bp, Homo sapiens
actagaggcaggga

SEQ ID NO: 3743229 - DNA, 16 bp, Homo sapiens
actagaggttttatga

SEQ ID NO: 3743230 - DNA, 21 bp, Homo sapiens
actaggcagttagagatgcct

SEQ ID NO: 3743231 - DNA, 17 bp, Homo sapiens
actagggaagataatat

SEQ ID NO: 3743232 - DNA, 16 bp, Homo sapiens
actagggattcaggct

SEQ ID NO: 3743233 - DNA, 16 bp, Homo sapiens
actagtgctgaagctt

SEQ ID NO: 3743234 - DNA, 18 bp, Homo sapiens
actagtgctgaagcttat

SEQ ID NO: 3743235 - DNA, 15 bp, Homo sapiens
actagtgttgcttgg

SEQ ID NO: 3743236 - DNA, 13 bp, Homo sapiens
actagttacacat

SEQ ID NO: 3743237 - DNA, 15 bp, Homo sapiens
actagttacacatct

SEQ ID NO: 3743238 - DNA, 18 bp, Homo sapiens
actataaaggttgacaat

SEQ ID NO: 3743239 - DNA, 11 bp, Homo sapiens
actataatgta

SEQ ID NO: 3743240 - DNA, 21 bp, Homo sapiens
actataatgtaagctctactg

SEQ ID NO: 3743241 - DNA, 19 bp, Homo sapiens
actatatctgttttactgc

SEQ ID NO: 3743242 - DNA, 22 bp, Homo sapiens
actatcatgtcaaacgtgaaaa

SEQ ID NO: 3743243 - DNA, 21 bp, Homo sapiens
actatctaaatgttgaaagat

SEQ ID NO: 3743244 - DNA, 15 bp, Homo sapiens
actatgatttggaaa

SEQ ID NO: 3743245 - DNA, 15 bp, Homo sapiens
actatgtacaatatt

SEQ ID NO: 3743246 - DNA, 16 bp, Homo sapiens
actatgtacaatattt

SEQ ID NO: 3743247 - DNA, 19 bp, Homo sapiens
actatgtacaatattttaa

SEQ ID NO: 3743248 - DNA, 12 bp, Homo sapiens
actatgtatcaa

SEQ ID NO: 3743249 - DNA, 14 bp, Homo sapiens
actatgttgcccag

SEQ ID NO: 3743250 - DNA, 15 bp, Homo sapiens
actatgttgcccagg

SEQ ID NO: 3743251 - DNA, 16 bp, Homo sapiens
actatgttgcccaggc

SEQ ID NO: 3743252 - DNA, 18 bp, Homo sapiens
actatgttgcccaggcag

SEQ ID NO: 3743253 - DNA, 23 bp, Homo sapiens
actatgttgcccaggcaggtctt

SEQ ID NO: 3743254 - DNA, 14 bp, Homo sapiens
actattaagcagta

SEQ ID NO: 3743255 - DNA, 22 bp, Homo sapiens
actattaagcagtaaaaactgt

SEQ ID NO: 3743256 - DNA, 18 bp, Homo sapiens
actattgaagttgcagat

SEQ ID NO: 3743257 - DNA, 12 bp, Homo sapiens
actattgacatc

SEQ ID NO: 3743258 - DNA, 17 bp, Homo sapiens
actattgacatcagcat

SEQ ID NO: 3743259 - DNA, 14 bp, Homo sapiens
actattggaaagta

SEQ ID NO: 3743260 - DNA, 13 bp, Homo sapiens
actattggagggt

SEQ ID NO: 3743261 - DNA, 15 bp, Homo sapiens
actatttatctgtgt

SEQ ID NO: 3743262 - DNA, 18 bp, Homo sapiens
actatttttatttatatt

SEQ ID NO: 3743263 - DNA, 18 bp, Homo sapiens
actcaaaagctgggcagg

SEQ ID NO: 3743264 - DNA, 17 bp, Homo sapiens
actcaaaatatttgtac

SEQ ID NO: 3743265 - DNA, 19 bp, Homo sapiens
actcaaaatatttgtacat

SEQ ID NO: 3743266 - DNA, 13 bp, Homo sapiens
actcaaacacaga

SEQ ID NO: 3743267 - DNA, 17 bp, Homo sapiens
actcaaagggtggaata

SEQ ID NO: 3743268 - DNA, 17 bp, Homo sapiens
actcaaagtatcctccc

SEQ ID NO: 3743269 - DNA, 23 bp, Homo sapiens
actcaacatgttactgaccagca

SEQ ID NO: 3743270 - DNA, 15 bp, Homo sapiens
actcaagaggctgag

SEQ ID NO: 3743271 - DNA, 17 bp, Homo sapiens
actcaagaggctgaggc

SEQ ID NO: 3743272 - DNA, 11 bp, Homo sapiens
actcaagccaa

SEQ ID NO: 3743273 - DNA, 23 bp, Homo sapiens
actcaagtgtctcagtccacctg

SEQ ID NO: 3743274 - DNA, 23 bp, Homo sapiens
actcaatattttccatgaaaatg

SEQ ID NO: 3743275 - DNA, 14 bp, Homo sapiens
actcaatgcactga

SEQ ID NO: 3743276 - DNA, 17 bp, Homo sapiens
actcacagagacacagg

SEQ ID NO: 3743277 - DNA, 22 bp, Homo sapiens
actcacatgctggacaggtctg

SEQ ID NO: 3743278 - DNA, 16 bp, Homo sapiens
actcacatggctatgt

SEQ ID NO: 3743279 - DNA, 20 bp, Homo sapiens
actcacatggctatgtttta

SEQ ID NO: 3743280 - DNA, 21 bp, Homo sapiens
actcacatttattctgctcac

SEQ ID NO: 3743281 - DNA, 16 bp, Homo sapiens
actcacctaatgttta

SEQ ID NO: 3743282 - DNA, 20 bp, Homo sapiens
actcacctgctggcccctca

SEQ ID NO: 3743283 - DNA, 18 bp, Homo sapiens
actcactggcagccccag

SEQ ID NO: 3743284 - DNA, 18 bp, Homo sapiens
actcagaagacactgatg

SEQ ID NO: 3743285 - DNA, 13 bp, Homo sapiens
actcagaagcctg

SEQ ID NO: 3743286 - DNA, 15 bp, Homo sapiens
actcagaagcctgag

SEQ ID NO: 3743287 - DNA, 16 bp, Homo sapiens
actcagaagcctgagg

SEQ ID NO: 3743288 - DNA, 17 bp, Homo sapiens
actcagaagcctgaggc

SEQ ID NO: 3743289 - DNA, 19 bp, Homo sapiens
actcagacaggaaagggaa

SEQ ID NO: 3743290 - DNA, 13 bp, Homo sapiens
actcagcagccct

SEQ ID NO: 3743291 - DNA, 21 bp, Homo sapiens
actcagcagccctcctcaccc

SEQ ID NO: 3743292 - DNA, 22 bp, Homo sapiens
actcagcagccctcctcacccc

SEQ ID NO: 3743293 - DNA, 20 bp, Homo sapiens
actcagccaaccttacttac

SEQ ID NO: 3743294 - DNA, 11 bp, Homo sapiens
actcagccctg

SEQ ID NO: 3743295 - DNA, 12 bp, Homo sapiens
actcagccctgg

SEQ ID NO: 3743296 - DNA, 14 bp, Homo sapiens
actcagccctgggc

SEQ ID NO: 3743297 - DNA, 16 bp, Homo sapiens
actcagccctgggccc

SEQ ID NO: 3743298 - DNA, 14 bp, Homo sapiens
actcaggaggctga

SEQ ID NO: 3743299 - DNA, 16 bp, Homo sapiens
actcaggaggctgagg

SEQ ID NO: 3743300 - DNA, 17 bp, Homo sapiens
actcaggaggctgaggc

SEQ ID NO: 3743301 - DNA, 18 bp, Homo sapiens
actcaggaggctgaggca

SEQ ID NO: 3743302 - DNA, 13 bp, Homo sapiens
actcagtttgtca

SEQ ID NO: 3743303 - DNA, 22 bp, Homo sapiens
actcagtttgtcagactttaaa

SEQ ID NO: 3743304 - DNA, 12 bp, Homo sapiens
actcatcttagg

SEQ ID NO: 3743305 - DNA, 22 bp, Homo sapiens
actcatcttagtgcctgagagt

SEQ ID NO: 3743306 - DNA, 15 bp, Homo sapiens
actcatgggtaataa

SEQ ID NO: 3743307 - DNA, 15 bp, Homo sapiens
actcattcttctgta

SEQ ID NO: 3743308 - DNA, 19 bp, Homo sapiens
actcattgcttcacaaccc

SEQ ID NO: 3743309 - DNA, 15 bp, Homo sapiens
actccaccaacccat

SEQ ID NO: 3743310 - DNA, 19 bp, Homo sapiens
actccagacccctggcttt

SEQ ID NO: 3743311 - DNA, 12 bp, Homo sapiens
actccagcccat

SEQ ID NO: 3743312 - DNA, 20 bp, Homo sapiens
actccagcctgagcaacaga

SEQ ID NO: 3743313 - DNA, 13 bp, Homo sapiens
actccagcctggg

SEQ ID NO: 3743314 - DNA, 20 bp, Homo sapiens
actccagctgggttggaaaa

SEQ ID NO: 3743315 - DNA, 15 bp, Homo sapiens
actccagtactggag

SEQ ID NO: 3743316 - DNA, 19 bp, Homo sapiens
actccatctcaaaaaataa

SEQ ID NO: 3743317 - DNA, 14 bp, Homo sapiens
actccatgttggct

SEQ ID NO: 3743318 - DNA, 19 bp, Homo sapiens
actcccaaagagctgccta

SEQ ID NO: 3743319 - DNA, 22 bp, Homo sapiens
actcccaagaacagcaggccca

SEQ ID NO: 3743320 - DNA, 15 bp, Homo sapiens
actccccttgagctg

SEQ ID NO: 3743321 - DNA, 20 bp, Homo sapiens
actccctcctcacctctgga

SEQ ID NO: 3743322 - DNA, 16 bp, Homo sapiens
actccggtgtgcctgc

SEQ ID NO: 3743323 - DNA, 20 bp, Homo sapiens
actccggtgtgcctgcagcc

SEQ ID NO: 3743324 - DNA, 21 bp, Homo sapiens
actccggtgtgcctgcagccc

SEQ ID NO: 3743325 - DNA, 12 bp, Homo sapiens
actcctcccagg

SEQ ID NO: 3743326 - DNA, 12 bp, Homo sapiens
actcctggaaat

SEQ ID NO: 3743327 - DNA, 16 bp, Homo sapiens
actcctggaagctgtg

SEQ ID NO: 3743328 - DNA, 11 bp, Homo sapiens
actcctggcct

SEQ ID NO: 3743329 - DNA, 15 bp, Homo sapiens
actcctgggctcaag

SEQ ID NO: 3743330 - DNA, 21 bp, Homo sapiens
actcctggggcctcttgggtc

SEQ ID NO: 3743331 - DNA, 15 bp, Homo sapiens
actcctgtacactga

SEQ ID NO: 3743332 - DNA, 16 bp, Homo sapiens
actcctgtacactgaa

SEQ ID NO: 3743333 - DNA, 20 bp, Homo sapiens
actccttcctgccacctgct

SEQ ID NO: 3743334 - DNA, 14 bp, Homo sapiens
actcctttctcatc

SEQ ID NO: 3743335 - DNA, 15 bp, Homo sapiens
actcgcttcccccat

SEQ ID NO: 3743336 - DNA, 20 bp, Homo sapiens
actcgcttcccccatagcca

SEQ ID NO: 3743337 - DNA, 14 bp, Homo sapiens
actctaatagtgct

SEQ ID NO: 3743338 - DNA, 21 bp, Homo sapiens
actctaatagtgcttaaaaat

SEQ ID NO: 3743339 - DNA, 20 bp, Homo sapiens
actctaattcccattttgca

SEQ ID NO: 3743340 - DNA, 14 bp, Homo sapiens
actctaattctaac

SEQ ID NO: 3743341 - DNA, 19 bp, Homo sapiens
actctacccatattacaga

SEQ ID NO: 3743342 - DNA, 18 bp, Homo sapiens
actctaccctcttagaaa

SEQ ID NO: 3743343 - DNA, 22 bp, Homo sapiens
actctacctcatatcagtttgc

SEQ ID NO: 3743344 - DNA, 18 bp, Homo sapiens
actctcaggatcaagaaa

SEQ ID NO: 3743345 - DNA, 22 bp, Homo sapiens
actctcagtgcttcttactatt

SEQ ID NO: 3743346 - DNA, 21 bp, Homo sapiens
actctcattccccaggtggct

SEQ ID NO: 3743347 - DNA, 19 bp, Homo sapiens
actctccaacctggacaac

SEQ ID NO: 3743348 - DNA, 13 bp, Homo sapiens
actctccatctta

SEQ ID NO: 3743349 - DNA, 15 bp, Homo sapiens
actctccccacacta

SEQ ID NO: 3743350 - DNA, 22 bp, Homo sapiens
actctccgcggtggttgttggg

SEQ ID NO: 3743351 - DNA, 16 bp, Homo sapiens
actctcctgggcccct

SEQ ID NO: 3743352 - DNA, 20 bp, Homo sapiens
actctgaagggcatcatgca

SEQ ID NO: 3743353 - DNA, 21 bp, Homo sapiens
actctgaggctctttctgggc

SEQ ID NO: 3743354 - DNA, 17 bp, Homo sapiens
actctgatgtaaatgaa

SEQ ID NO: 3743355 - DNA, 19 bp, Homo sapiens
actctgatgtaaatgaagt

SEQ ID NO: 3743356 - DNA, 16 bp, Homo sapiens
actctgcctcctcttc

SEQ ID NO: 3743357 - DNA, 12 bp, Homo sapiens
actctgcctctg

SEQ ID NO: 3743358 - DNA, 13 bp, Homo sapiens
actctggcctctg

SEQ ID NO: 3743359 - DNA, 16 bp, Homo sapiens
actctggcctctgtca

SEQ ID NO: 3743360 - DNA, 16 bp, Homo sapiens
actctgtcagatggga

SEQ ID NO: 3743361 - DNA, 19 bp, Homo sapiens
actctgtcgcccagtctgg

SEQ ID NO: 3743362 - DNA, 19 bp, Homo sapiens
actctgtctcaaaaaaaca

SEQ ID NO: 3743363 - DNA, 19 bp, Homo sapiens
actctgtgtcaggtggggc

SEQ ID NO: 3743364 - DNA, 15 bp, Homo sapiens
actctgttcctggct

SEQ ID NO: 3743365 - DNA, 22 bp, Homo sapiens
actctgttccttcacatcctgt

SEQ ID NO: 3743366 - DNA, 18 bp, Homo sapiens
actcttaaaacccaagtg

SEQ ID NO: 3743367 - DNA, 14 bp, Homo sapiens
actcttaatcaaat

SEQ ID NO: 3743368 - DNA, 15 bp, Homo sapiens
actcttagttactca

SEQ ID NO: 3743369 - DNA, 16 bp, Homo sapiens
actcttgacctcaggt

SEQ ID NO: 3743370 - DNA, 18 bp, Homo sapiens
actcttgtaagattttga

SEQ ID NO: 3743371 - DNA, 20 bp, Homo sapiens
actcttgtaagattttgaaa

SEQ ID NO: 3743372 - DNA, 23 bp, Homo sapiens
actcttgtaagattttgaaaact

SEQ ID NO: 3743373 - DNA, 23 bp, Homo sapiens
actctttgagatagaagaactgc

SEQ ID NO: 3743374 - DNA, 13 bp, Homo sapiens
actctttgtaaga

SEQ ID NO: 3743375 - DNA, 14 bp, Homo sapiens
actctttgtaagag

SEQ ID NO: 3743376 - DNA, 13 bp, Homo sapiens
actgaaaggttac

SEQ ID NO: 3743377 - DNA, 21 bp, Homo sapiens
actgaaatgccttactttgta

SEQ ID NO: 3743378 - DNA, 22 bp, Homo sapiens
actgaaatgccttactttgtat

SEQ ID NO: 3743379 - DNA, 23 bp, Homo sapiens
actgaaatgccttactttgtatg

SEQ ID NO: 3743380 - DNA, 18 bp, Homo sapiens
actgaagatagaagaaaa

SEQ ID NO: 3743381 - DNA, 23 bp, Homo sapiens
actgaagatagaagaaaaaagaa

SEQ ID NO: 3743382 - DNA, 18 bp, Homo sapiens
actgaagccagaaataaa

SEQ ID NO: 3743383 - DNA, 21 bp, Homo sapiens
actgaaggagaaggtgcccca

SEQ ID NO: 3743384 - DNA, 15 bp, Homo sapiens
actgaatatttatat

SEQ ID NO: 3743385 - DNA, 17 bp, Homo sapiens
actgaattgtccccagt

SEQ ID NO: 3743386 - DNA, 16 bp, Homo sapiens
actgacaaatcaagtt

SEQ ID NO: 3743387 - DNA, 13 bp, Homo sapiens
actgacacatgct

SEQ ID NO: 3743388 - DNA, 17 bp, Homo sapiens
actgacattgttggcca

SEQ ID NO: 3743389 - DNA, 22 bp, Homo sapiens
actgacattgttggccaaagcc

SEQ ID NO: 3743390 - DNA, 15 bp, Homo sapiens
actgaccagcctcca

SEQ ID NO: 3743391 - DNA, 23 bp, Homo sapiens
actgaccagcctccatgctgcct

SEQ ID NO: 3743392 - DNA, 22 bp, Homo sapiens
actgaccatccactctaccctc

SEQ ID NO: 3743393 - DNA, 18 bp, Homo sapiens
actgaccctcccttcctg

SEQ ID NO: 3743394 - DNA, 16 bp, Homo sapiens
actgagagatctgctg

SEQ ID NO: 3743395 - DNA, 21 bp, Homo sapiens
actgagcaagaccctgtctct

SEQ ID NO: 3743396 - DNA, 12 bp, Homo sapiens
actgagcagact

SEQ ID NO: 3743397 - DNA, 13 bp, Homo sapiens
actgagctcctct

SEQ ID NO: 3743398 - DNA, 17 bp, Homo sapiens
actgagcttctctgtga

SEQ ID NO: 3743399 - DNA, 16 bp, Homo sapiens
actgaggaattttctt

SEQ ID NO: 3743400 - DNA, 23 bp, Homo sapiens
actgaggcagacagcagctcagg

SEQ ID NO: 3743401 - DNA, 12 bp, Homo sapiens
actgaggcaggg

SEQ ID NO: 3743402 - DNA, 20 bp, Homo sapiens
actgagggaccaactgggcc

SEQ ID NO: 3743403 - DNA, 16 bp, Homo sapiens
actgatcatgcattgt

SEQ ID NO: 3743404 - DNA, 18 bp, Homo sapiens
actgatcatgcattgttg

SEQ ID NO: 3743405 - DNA, 17 bp, Homo sapiens
actgatctctactacca

SEQ ID NO: 3743406 - DNA, 22 bp, Homo sapiens
actgatctctactaccacaagg

SEQ ID NO: 3743407 - DNA, 18 bp, Homo sapiens
actgatggaaacaaagtg

SEQ ID NO: 3743408 - DNA, 22 bp, Homo sapiens
actgatgggcaacccccagcct

SEQ ID NO: 3743409 - DNA, 20 bp, Homo sapiens
actgatgtatgaggaatttc

SEQ ID NO: 3743410 - DNA, 19 bp, Homo sapiens
actgatgttaggctgggcc

SEQ ID NO: 3743411 - DNA, 11 bp, Homo sapiens
actgcaacagg

SEQ ID NO: 3743412 - DNA, 12 bp, Homo sapiens
actgcaacagga

SEQ ID NO: 3743413 - DNA, 22 bp, Homo sapiens
actgcaacctccgcctcttggg

SEQ ID NO: 3743414 - DNA, 18 bp, Homo sapiens
actgcaagagccttggtg

SEQ ID NO: 3743415 - DNA, 15 bp, Homo sapiens
actgcaagtcacaaa

SEQ ID NO: 3743416 - DNA, 17 bp, Homo sapiens
actgcaagtcacaaagg

SEQ ID NO: 3743417 - DNA, 20 bp, Homo sapiens
actgcaagtcacaaaggaat

SEQ ID NO: 3743418 - DNA, 18 bp, Homo sapiens
actgcaatagagactgta

SEQ ID NO: 3743419 - DNA, 22 bp, Homo sapiens
actgcaatagagactgtagatt

SEQ ID NO: 3743420 - DNA, 18 bp, Homo sapiens
actgcacagtgcatctca

SEQ ID NO: 3743421 - DNA, 14 bp, Homo sapiens
actgcactccagcc

SEQ ID NO: 3743422 - DNA, 15 bp, Homo sapiens
actgcactccagcct

SEQ ID NO: 3743423 - DNA, 19 bp, Homo sapiens
actgcactccagcctgggt

SEQ ID NO: 3743424 - DNA, 17 bp, Homo sapiens
actgcactctagccgga

SEQ ID NO: 3743425 - DNA, 15 bp, Homo sapiens
actgcaggccccgct

SEQ ID NO: 3743426 - DNA, 21 bp, Homo sapiens
actgcaggccccgcttgtcca

SEQ ID NO: 3743427 - DNA, 21 bp, Homo sapiens
actgcatggacctaacattcg

SEQ ID NO: 3743428 - DNA, 14 bp, Homo sapiens
actgcatgtataaa

SEQ ID NO: 3743429 - DNA, 14 bp, Homo sapiens
actgccatgccagc

SEQ ID NO: 3743430 - DNA, 18 bp, Homo sapiens
actgccccaactcctgga

SEQ ID NO: 3743431 - DNA, 21 bp, Homo sapiens
actgccccaactcctggaagc

SEQ ID NO: 3743432 - DNA, 18 bp, Homo sapiens
actgccccgtgcagactg

SEQ ID NO: 3743433 - DNA, 19 bp, Homo sapiens
actgccccgtgcagactgg

SEQ ID NO: 3743434 - DNA, 15 bp, Homo sapiens
actgcccgagctggt

SEQ ID NO: 3743435 - DNA, 16 bp, Homo sapiens
actgcccgagctggtg

SEQ ID NO: 3743436 - DNA, 18 bp, Homo sapiens
actgcccgagctggtgca

SEQ ID NO: 3743437 - DNA, 21 bp, Homo sapiens
actgcccgagctggtgcatta

SEQ ID NO: 3743438 - DNA, 22 bp, Homo sapiens
actgcccggcagggtcctagaa

SEQ ID NO: 3743439 - DNA, 11 bp, Homo sapiens
actgccctctg

SEQ ID NO: 3743440 - DNA, 18 bp, Homo sapiens
actgcctctccctggccc

SEQ ID NO: 3743441 - DNA, 14 bp, Homo sapiens
actgcctgcccacc

SEQ ID NO: 3743442 - DNA, 16 bp, Homo sapiens
actgccttaaaacttt

SEQ ID NO: 3743443 - DNA, 21 bp, Homo sapiens
actgcgggatggtcctggggc

SEQ ID NO: 3743444 - DNA, 22 bp, Homo sapiens
actgcgggatggtcctggggct

SEQ ID NO: 3743445 - DNA, 16 bp, Homo sapiens
actgctaggtgggcca

SEQ ID NO: 3743446 - DNA, 16 bp, Homo sapiens
actgctgcccagcctc

SEQ ID NO: 3743447 - DNA, 18 bp, Homo sapiens
actgctgcccagcctcca

SEQ ID NO: 3743448 - DNA, 19 bp, Homo sapiens
actgctgccccaaaggaag

SEQ ID NO: 3743449 - DNA, 14 bp, Homo sapiens
actgctggctgcct

SEQ ID NO: 3743450 - DNA, 23 bp, Homo sapiens
actgctgtgaacaagtgaacaca

SEQ ID NO: 3743451 - DNA, 16 bp, Homo sapiens
actgcttctaccaact

SEQ ID NO: 3743452 - DNA, 16 bp, Homo sapiens
actgcttgtgttttta

SEQ ID NO: 3743453 - DNA, 18 bp, Homo sapiens
actgcttgtgtttttaac

SEQ ID NO: 3743454 - DNA, 14 bp, Homo sapiens
actggaagcacagc

SEQ ID NO: 3743455 - DNA, 19 bp, Homo sapiens
actggaagcatgtaggaga

SEQ ID NO: 3743456 - DNA, 20 bp, Homo sapiens
actggaagcatgtaggagaa

SEQ ID NO: 3743457 - DNA, 13 bp, Homo sapiens
actggaattttta

SEQ ID NO: 3743458 - DNA, 21 bp, Homo sapiens
actggaatttttattatgcat

SEQ ID NO: 3743459 - DNA, 21 bp, Homo sapiens
actggactcaggatgcccagg

SEQ ID NO: 3743460 - DNA, 21 bp, Homo sapiens
actggagacaatgcagatgcc

SEQ ID NO: 3743461 - DNA, 18 bp, Homo sapiens
actggaggaccacactca

SEQ ID NO: 3743462 - DNA, 13 bp, Homo sapiens
actggaggccagg

SEQ ID NO: 3743463 - DNA, 18 bp, Homo sapiens
actggatactgcccgggg

SEQ ID NO: 3743464 - DNA, 18 bp, Homo sapiens
actggatgcagaaacagt

SEQ ID NO: 3743465 - DNA, 23 bp, Homo sapiens
actggattggccaaacatcagac

SEQ ID NO: 3743466 - DNA, 16 bp, Homo sapiens
actggcagccccagca

SEQ ID NO: 3743467 - DNA, 18 bp, Homo sapiens
actggctagagtcctcac

SEQ ID NO: 3743468 - DNA, 22 bp, Homo sapiens
actggctcatattcctgcagcc

SEQ ID NO: 3743469 - DNA, 13 bp, Homo sapiens
actggctgtgggc

SEQ ID NO: 3743470 - DNA, 16 bp, Homo sapiens
actggctgtgggctcc

SEQ ID NO: 3743471 - DNA, 19 bp, Homo sapiens
actggctttgtcccacagc

SEQ ID NO: 3743472 - DNA, 20 bp, Homo sapiens
actggctttgtcccacagct

SEQ ID NO: 3743473 - DNA, 22 bp, Homo sapiens
actggctttgtcccacagcttg

SEQ ID NO: 3743474 - DNA, 13 bp, Homo sapiens
actgggcaatgat

SEQ ID NO: 3743475 - DNA, 18 bp, Homo sapiens
actgggcaatgatggcaa

SEQ ID NO: 3743476 - DNA, 21 bp, Homo sapiens
actgggcctgttgccctttct

SEQ ID NO: 3743477 - DNA, 20 bp, Homo sapiens
actggggtcctggggcctcg

SEQ ID NO: 3743478 - DNA, 15 bp, Homo sapiens
actgggtacttgtgg

SEQ ID NO: 3743479 - DNA, 20 bp, Homo sapiens
actgggtacttgtggacaca

SEQ ID NO: 3743480 - DNA, 23 bp, Homo sapiens
actgggtacttgtggacacagct

SEQ ID NO: 3743481 - DNA, 23 bp, Homo sapiens
actggtggcccgacagcctggca

SEQ ID NO: 3743482 - DNA, 20 bp, Homo sapiens
actggttgttgccaaacagc

SEQ ID NO: 3743483 - DNA, 22 bp, Homo sapiens
actggtttgttgcagccaaaga

SEQ ID NO: 3743484 - DNA, 16 bp, Homo sapiens
actgtaaaatgaaatt

SEQ ID NO: 3743485 - DNA, 14 bp, Homo sapiens
actgtacacacttt

SEQ ID NO: 3743486 - DNA, 15 bp, Homo sapiens
actgtacacacttta

SEQ ID NO: 3743487 - DNA, 21 bp, Homo sapiens
actgtacagattgctgcttct

SEQ ID NO: 3743488 - DNA, 22 bp, Homo sapiens
actgtacagattgctgcttctg

SEQ ID NO: 3743489 - DNA, 15 bp, Homo sapiens
actgtactcctccca

SEQ ID NO: 3743490 - DNA, 17 bp, Homo sapiens
actgtacttaataaatt

SEQ ID NO: 3743491 - DNA, 18 bp, Homo sapiens
actgtacttaataaattc

SEQ ID NO: 3743492 - DNA, 20 bp, Homo sapiens
actgtagaatgatttcatgc

SEQ ID NO: 3743493 - DNA, 18 bp, Homo sapiens
actgtagattgcttctgt

SEQ ID NO: 3743494 - DNA, 22 bp, Homo sapiens
actgtagattgcttctgtagta

SEQ ID NO: 3743495 - DNA, 15 bp, Homo sapiens
actgtagtctcagga

SEQ ID NO: 3743496 - DNA, 18 bp, Homo sapiens
actgtagtttttcttcaa

SEQ ID NO: 3743497 - DNA, 20 bp, Homo sapiens
actgtagtttttcttcaaca

SEQ ID NO: 3743498 - DNA, 14 bp, Homo sapiens
actgtatctgtgta

SEQ ID NO: 3743499 - DNA, 16 bp, Homo sapiens
actgtcaaagaatcaa

SEQ ID NO: 3743500 - DNA, 14 bp, Homo sapiens
actgtcaataaaca

SEQ ID NO: 3743501 - DNA, 21 bp, Homo sapiens
actgtcaataaacagcttcat

SEQ ID NO: 3743502 - DNA, 15 bp, Homo sapiens
actgtcactgttcct

SEQ ID NO: 3743503 - DNA, 15 bp, Homo sapiens
actgtcactgtttct

SEQ ID NO: 3743504 - DNA, 16 bp, Homo sapiens
actgtcactgtttctc

SEQ ID NO: 3743505 - DNA, 20 bp, Homo sapiens
actgtcactgtttctctgct

SEQ ID NO: 3743506 - DNA, 21 bp, Homo sapiens
actgtcactgtttctctgctg

SEQ ID NO: 3743507 - DNA, 18 bp, Homo sapiens
actgtcctacccaccctc

SEQ ID NO: 3743508 - DNA, 18 bp, Homo sapiens
actgtcctctttcagaaa

SEQ ID NO: 3743509 - DNA, 21 bp, Homo sapiens
actgtctcaagagggcactgg

SEQ ID NO: 3743510 - DNA, 12 bp, Homo sapiens
actgtctttcag

SEQ ID NO: 3743511 - DNA, 12 bp, Homo sapiens
actgtgacctgt

SEQ ID NO: 3743512 - DNA, 23 bp, Homo sapiens
actgtgcctttgagtttcctcag

SEQ ID NO: 3743513 - DNA, 15 bp, Homo sapiens
actgtggcacacgcc

SEQ ID NO: 3743514 - DNA, 12 bp, Homo sapiens
actgtggccttg

SEQ ID NO: 3743515 - DNA, 17 bp, Homo sapiens
actgtgtaactgcccaa

SEQ ID NO: 3743516 - DNA, 20 bp, Homo sapiens
actgtgtatgtacatatata

SEQ ID NO: 3743517 - DNA, 19 bp, Homo sapiens
actgtgtccctctctctgg

SEQ ID NO: 3743518 - DNA, 12 bp, Homo sapiens
actgtgttcctg

SEQ ID NO: 3743519 - DNA, 15 bp, Homo sapiens
actgtgttcctggca

SEQ ID NO: 3743520 - DNA, 14 bp, Homo sapiens
actgttagaacact

SEQ ID NO: 3743521 - DNA, 17 bp, Homo sapiens
actgttagaacactatt

SEQ ID NO: 3743522 - DNA, 23 bp, Homo sapiens
actgttagaacactattttcaga

SEQ ID NO: 3743523 - DNA, 14 bp, Homo sapiens
actgttgcccaggc

SEQ ID NO: 3743524 - DNA, 17 bp, Homo sapiens
actgttgcccaggctgg

SEQ ID NO: 3743525 - DNA, 15 bp, Homo sapiens
actgtttctctgctg

SEQ ID NO: 3743526 - DNA, 14 bp, Homo sapiens
actgttttttcctg

SEQ ID NO: 3743527 - DNA, 18 bp, Homo sapiens
actgttttttcctgagct

SEQ ID NO: 3743528 - DNA, 17 bp, Homo sapiens
acttaaaaaaatgacag

SEQ ID NO: 3743529 - DNA, 13 bp, Homo sapiens
acttaaaaaactt

SEQ ID NO: 3743530 - DNA, 23 bp, Homo sapiens
acttaaaaaacttgtaaatgctg

SEQ ID NO: 3743531 - DNA, 14 bp, Homo sapiens
acttaaaaaatgtc

SEQ ID NO: 3743532 - DNA, 15 bp, Homo sapiens
acttaaaaaatgtcc

SEQ ID NO: 3743533 - DNA, 22 bp, Homo sapiens
acttaaaatattcctgcatttg

SEQ ID NO: 3743534 - DNA, 17 bp, Homo sapiens
acttaaaggctgtggta

SEQ ID NO: 3743535 - DNA, 18 bp, Homo sapiens
acttaaatatcaatcatt

SEQ ID NO: 3743536 - DNA, 14 bp, Homo sapiens
acttaaatgttacc

SEQ ID NO: 3743537 - DNA, 17 bp, Homo sapiens
acttaaccgcatcagaa

SEQ ID NO: 3743538 - DNA, 18 bp, Homo sapiens
acttaaccgcatcagaag

SEQ ID NO: 3743539 - DNA, 16 bp, Homo sapiens
acttaccatatgtgct

SEQ ID NO: 3743540 - DNA, 20 bp, Homo sapiens
acttaccttcaataaagtat

SEQ ID NO: 3743541 - DNA, 16 bp, Homo sapiens
acttagcatgcacaaa

SEQ ID NO: 3743542 - DNA, 17 bp, Homo sapiens
acttagcatgcacaaag

SEQ ID NO: 3743543 - DNA, 21 bp, Homo sapiens
acttagcttatcaatttgtca

SEQ ID NO: 3743544 - DNA, 15 bp, Homo sapiens
acttaggtgtggggg

SEQ ID NO: 3743545 - DNA, 17 bp, Homo sapiens
acttagtatattttctt

SEQ ID NO: 3743546 - DNA, 19 bp, Homo sapiens
acttatatttttaataaaa

SEQ ID NO: 3743547 - DNA, 15 bp, Homo sapiens
acttattcattgtgg

SEQ ID NO: 3743548 - DNA, 13 bp, Homo sapiens
acttattgctttg

SEQ ID NO: 3743549 - DNA, 14 bp, Homo sapiens
acttattgctttga

SEQ ID NO: 3743550 - DNA, 16 bp, Homo sapiens
acttattgctttgaaa

SEQ ID NO: 3743551 - DNA, 13 bp, Homo sapiens
acttatttggggt

SEQ ID NO: 3743552 - DNA, 17 bp, Homo sapiens
acttcacacacaggcaa

SEQ ID NO: 3743553 - DNA, 23 bp, Homo sapiens
acttcacactgcaagagccttgg

SEQ ID NO: 3743554 - DNA, 15 bp, Homo sapiens
acttcagagagctgg

SEQ ID NO: 3743555 - DNA, 18 bp, Homo sapiens
acttcagagagctggtag

SEQ ID NO: 3743556 - DNA, 16 bp, Homo sapiens
acttcagctagagctt

SEQ ID NO: 3743557 - DNA, 16 bp, Homo sapiens
acttcagctgactttt

SEQ ID NO: 3743558 - DNA, 16 bp, Homo sapiens
acttcaggctcttctc

SEQ ID NO: 3743559 - DNA, 20 bp, Homo sapiens
acttcagggcagggctctga

SEQ ID NO: 3743560 - DNA, 23 bp, Homo sapiens
acttcagggcagggctctgatat

SEQ ID NO: 3743561 - DNA, 20 bp, Homo sapiens
acttccagtgcaacactgaa

SEQ ID NO: 3743562 - DNA, 22 bp, Homo sapiens
acttcccagttcaggagtccca

SEQ ID NO: 3743563 - DNA, 24 bp, Homo sapiens
acttcccagttcaggagtcccaag

SEQ ID NO: 3743564 - DNA, 19 bp, Homo sapiens
acttcccattttggaagtt

SEQ ID NO: 3743565 - DNA, 16 bp, Homo sapiens
acttcctgcctggtct

SEQ ID NO: 3743566 - DNA, 18 bp, Homo sapiens
acttcctgcctggtctcc

SEQ ID NO: 3743567 - DNA, 12 bp, Homo sapiens
acttcctgtcca

SEQ ID NO: 3743568 - DNA, 14 bp, Homo sapiens
acttcctgtccaga

SEQ ID NO: 3743569 - DNA, 17 bp, Homo sapiens
acttcgggaggtcgagg

SEQ ID NO: 3743570 - DNA, 22 bp, Homo sapiens
acttctccagacccaccacacc

SEQ ID NO: 3743571 - DNA, 19 bp, Homo sapiens
acttctgccatattctgtt

SEQ ID NO: 3743572 - DNA, 20 bp, Homo sapiens
acttctgccatattctgttg

SEQ ID NO: 3743573 - DNA, 13 bp, Homo sapiens
acttgaaagcatc

SEQ ID NO: 3743574 - DNA, 18 bp, Homo sapiens
acttgaaagcatccatgt

SEQ ID NO: 3743575 - DNA, 16 bp, Homo sapiens
acttgaatgtgtcact

SEQ ID NO: 3743576 - DNA, 17 bp, Homo sapiens
acttgacagaacactgt

SEQ ID NO: 3743577 - DNA, 19 bp, Homo sapiens
acttgacccccttgagggt

SEQ ID NO: 3743578 - DNA, 15 bp, Homo sapiens
acttgaggaaaccag

SEQ ID NO: 3743579 - DNA, 17 bp, Homo sapiens
acttgatacttgttttc

SEQ ID NO: 3743580 - DNA, 21 bp, Homo sapiens
acttgatgagtgtaacaagaa

SEQ ID NO: 3743581 - DNA, 23 bp, Homo sapiens
acttgatggtcagacacaaacaa

SEQ ID NO: 3743582 - DNA, 11 bp, Homo sapiens
acttgcatttc

SEQ ID NO: 3743583 - DNA, 23 bp, Homo sapiens
acttgctgcctgaagaacagtaa

SEQ ID NO: 3743584 - DNA, 23 bp, Homo sapiens
acttggaccagcatccttaagta

SEQ ID NO: 3743585 - DNA, 19 bp, Homo sapiens
acttggagccccagtgcca

SEQ ID NO: 3743586 - DNA, 14 bp, Homo sapiens
acttggcctctgga

SEQ ID NO: 3743587 - DNA, 21 bp, Homo sapiens
acttggtgtcctttccctcca

SEQ ID NO: 3743588 - DNA, 22 bp, Homo sapiens
acttggtgtcctttccctccac

SEQ ID NO: 3743589 - DNA, 15 bp, Homo sapiens
acttggttatacatg

SEQ ID NO: 3743590 - DNA, 20 bp, Homo sapiens
acttgtaaatgtggtaaaga

SEQ ID NO: 3743591 - DNA, 14 bp, Homo sapiens
acttgtaagttgct

SEQ ID NO: 3743592 - DNA, 20 bp, Homo sapiens
acttgtacaaaataaacaaa

SEQ ID NO: 3743593 - DNA, 21 bp, Homo sapiens
acttgtacgagacagaaaaag

SEQ ID NO: 3743594 - DNA, 18 bp, Homo sapiens
acttgtattaaagacaga

SEQ ID NO: 3743595 - DNA, 15 bp, Homo sapiens
acttgtctttttctg

SEQ ID NO: 3743596 - DNA, 19 bp, Homo sapiens
acttgtggacacagctctt

SEQ ID NO: 3743597 - DNA, 18 bp, Homo sapiens
acttgttttcaaaccagt

SEQ ID NO: 3743598 - DNA, 16 bp, Homo sapiens
actttaatatgtattt

SEQ ID NO: 3743599 - DNA, 14 bp, Homo sapiens
actttagaaataaa

SEQ ID NO: 3743600 - DNA, 15 bp, Homo sapiens
actttagaatgagag

SEQ ID NO: 3743601 - DNA, 15 bp, Homo sapiens
actttagagtagcat

SEQ ID NO: 3743602 - DNA, 19 bp, Homo sapiens
actttagagtagcatgaga

SEQ ID NO: 3743603 - DNA, 20 bp, Homo sapiens
actttagcagaatcaaaatg

SEQ ID NO: 3743604 - DNA, 19 bp, Homo sapiens
actttccaccccctccctg

SEQ ID NO: 3743605 - DNA, 21 bp, Homo sapiens
actttcccttttgtaagttga

SEQ ID NO: 3743606 - DNA, 21 bp, Homo sapiens
actttcctcttagtcgagcca

SEQ ID NO: 3743607 - DNA, 23 bp, Homo sapiens
actttccttcattcaacccacct

SEQ ID NO: 3743608 - DNA, 20 bp, Homo sapiens
actttcttttcgccgtggct

SEQ ID NO: 3743609 - DNA, 19 bp, Homo sapiens
actttcttttctggaatgt

SEQ ID NO: 3743610 - DNA, 15 bp, Homo sapiens
actttgctctttctt

SEQ ID NO: 3743611 - DNA, 17 bp, Homo sapiens
actttggaagtttgtgt

SEQ ID NO: 3743612 - DNA, 19 bp, Homo sapiens
actttgggaggctgaggcg

SEQ ID NO: 3743613 - DNA, 22 bp, Homo sapiens
actttggtgcgggcacaataaa

SEQ ID NO: 3743614 - DNA, 12 bp, Homo sapiens
acttttccttcc

SEQ ID NO: 3743615 - DNA, 17 bp, Homo sapiens
acttttcttaaaaagtt

SEQ ID NO: 3743616 - DNA, 14 bp, Homo sapiens
acttttctttgaag

SEQ ID NO: 3743617 - DNA, 12 bp, Homo sapiens
acttttgtaaga

SEQ ID NO: 3743618 - DNA, 19 bp, Homo sapiens
actttttggtggatgtaaa

SEQ ID NO: 3743619 - DNA, 22 bp, Homo sapiens
acttttttctttaaattttgtt

SEQ ID NO: 3743620 - DNA, 21 bp, Homo sapiens
acttttttgaaataataaatc

SEQ ID NO: 3743621 - DNA, 17 bp, Homo sapiens
agaaaaaatattttccc

SEQ ID NO: 3743622 - DNA, 13 bp, Homo sapiens
agaaaaacaataa

SEQ ID NO: 3743623 - DNA, 16 bp, Homo sapiens
agaaaaacaataagag

SEQ ID NO: 3743624 - DNA, 14 bp, Homo sapiens
agaaaaaggagctt

SEQ ID NO: 3743625 - DNA, 12 bp, Homo sapiens
agaaaaatcagt

SEQ ID NO: 3743626 - DNA, 15 bp, Homo sapiens
agaaaacagaaaaaa

SEQ ID NO: 3743627 - DNA, 22 bp, Homo sapiens
agaaaacaggaaaaaaactttt

SEQ ID NO: 3743628 - DNA, 15 bp, Homo sapiens
agaaaagcacctgcc

SEQ ID NO: 3743629 - DNA, 18 bp, Homo sapiens
agaaaagcacctgccgac

SEQ ID NO: 3743630 - DNA, 13 bp, Homo sapiens
agaaaataaaatt

SEQ ID NO: 3743631 - DNA, 18 bp, Homo sapiens
agaaaataaaattaagaa

SEQ ID NO: 3743632 - DNA, 19 bp, Homo sapiens
agaaaatgtaaataaagga

SEQ ID NO: 3743633 - DNA, 13 bp, Homo sapiens
agaaaattgaatt

SEQ ID NO: 3743634 - DNA, 17 bp, Homo sapiens
agaaaattgaatttaac

SEQ ID NO: 3743635 - DNA, 22 bp, Homo sapiens
agaaaattgaatttaacaatgc

SEQ ID NO: 3743636 - DNA, 12 bp, Homo sapiens
agaaacaaaccc

SEQ ID NO: 3743637 - DNA, 19 bp, Homo sapiens
agaaacacctagatcagaa

SEQ ID NO: 3743638 - DNA, 11 bp, Homo sapiens
agaaacactga

SEQ ID NO: 3743639 - DNA, 16 bp, Homo sapiens
agaaacatcagttact

SEQ ID NO: 3743640 - DNA, 23 bp, Homo sapiens
agaaacatcagttactctgaagg

SEQ ID NO: 3743641 - DNA, 21 bp, Homo sapiens
agaaacccgacagagggaaga

SEQ ID NO: 3743642 - DNA, 13 bp, Homo sapiens
agaaaccctgtct

SEQ ID NO: 3743643 - DNA, 18 bp, Homo sapiens
agaaaccttattgtacct

SEQ ID NO: 3743644 - DNA, 23 bp, Homo sapiens
agaaactcacccccaaggggcag

SEQ ID NO: 3743645 - DNA, 12 bp, Homo sapiens
agaaagaaggaa

SEQ ID NO: 3743646 - DNA, 14 bp, Homo sapiens
agaaagaaggaagt

SEQ ID NO: 3743647 - DNA, 20 bp, Homo sapiens
agaaagactatctaaatgtt

SEQ ID NO: 3743648 - DNA, 11 bp, Homo sapiens
agaaagagagc

SEQ ID NO: 3743649 - DNA, 19 bp, Homo sapiens
agaaagatggatgtgcttt

SEQ ID NO: 3743650 - DNA, 21 bp, Homo sapiens
agaaagccaaatcaaaatatg

SEQ ID NO: 3743651 - DNA, 22 bp, Homo sapiens
agaaagcccttaggaagaattt

SEQ ID NO: 3743652 - DNA, 15 bp, Homo sapiens
agaaagcctcagaga

SEQ ID NO: 3743653 - DNA, 18 bp, Homo sapiens
agaaagggagcagagaag

SEQ ID NO: 3743654 - DNA, 17 bp, Homo sapiens
agaaaggggcaggagct

SEQ ID NO: 3743655 - DNA, 22 bp, Homo sapiens
agaaaggggcaggagctcagat

SEQ ID NO: 3743656 - DNA, 20 bp, Homo sapiens
agaaaggtggactggaaggg

SEQ ID NO: 3743657 - DNA, 15 bp, Homo sapiens
agaaagtgaagcaaa

SEQ ID NO: 3743658 - DNA, 23 bp, Homo sapiens
agaaagtgaagcaaatcagaaac

SEQ ID NO: 3743659 - DNA, 15 bp, Homo sapiens
agaaagtgaataaaa

SEQ ID NO: 3743660 - DNA, 21 bp, Homo sapiens
agaaagtggccatgccaccct

SEQ ID NO: 3743661 - DNA, 16 bp, Homo sapiens
agaaagtgtgagcaaa

SEQ ID NO: 3743662 - DNA, 12 bp, Homo sapiens
agaaagttgatt

SEQ ID NO: 3743663 - DNA, 19 bp, Homo sapiens
agaaataaagttggtgaca

SEQ ID NO: 3743664 - DNA, 15 bp, Homo sapiens
agaaataatatgcat

SEQ ID NO: 3743665 - DNA, 16 bp, Homo sapiens
agaaataatatgcatt

SEQ ID NO: 3743666 - DNA, 18 bp, Homo sapiens
agaaataccaaaattatt

SEQ ID NO: 3743667 - DNA, 20 bp, Homo sapiens
agaaatagcctgcgctgttt

SEQ ID NO: 3743668 - DNA, 14 bp, Homo sapiens
agaaatataattga

SEQ ID NO: 3743669 - DNA, 14 bp, Homo sapiens
agaaatcagaggag

SEQ ID NO: 3743670 - DNA, 12 bp, Homo sapiens
agaaatcatgtt

SEQ ID NO: 3743671 - DNA, 17 bp, Homo sapiens
agaaatcatgttatgat

SEQ ID NO: 3743672 - DNA, 13 bp, Homo sapiens
agaaatgaaattt

SEQ ID NO: 3743673 - DNA, 19 bp, Homo sapiens
agaaatgaaattttaccaa

SEQ ID NO: 3743674 - DNA, 20 bp, Homo sapiens
agaaatgaaattttaccaag

SEQ ID NO: 3743675 - DNA, 23 bp, Homo sapiens
agaaatgaaattttaccaagtta

SEQ ID NO: 3743676 - DNA, 18 bp, Homo sapiens
agaaatgcaaattctcaa

SEQ ID NO: 3743677 - DNA, 19 bp, Homo sapiens
agaaatgcacaatgtcttg

SEQ ID NO: 3743678 - DNA, 12 bp, Homo sapiens
agaaatgcagaa

SEQ ID NO: 3743679 - DNA, 18 bp, Homo sapiens
agaaatgcatccattcct

SEQ ID NO: 3743680 - DNA, 14 bp, Homo sapiens
agaaattagccggg

SEQ ID NO: 3743681 - DNA, 17 bp, Homo sapiens
agaaattagctgtgtga

SEQ ID NO: 3743682 - DNA, 17 bp, Homo sapiens
agaaattccctggacca

SEQ ID NO: 3743683 - DNA, 18 bp, Homo sapiens
agaaattccctggaccag

SEQ ID NO: 3743684 - DNA, 20 bp, Homo sapiens
agaaattgcatttcctgaca

SEQ ID NO: 3743685 - DNA, 22 bp, Homo sapiens
agaaattttacaataggtgctt

SEQ ID NO: 3743686 - DNA, 15 bp, Homo sapiens
agaacacaaagcggg

SEQ ID NO: 3743687 - DNA, 17 bp, Homo sapiens
agaacaccaagacttga

SEQ ID NO: 3743688 - DNA, 16 bp, Homo sapiens
agaacactattttcag

SEQ ID NO: 3743689 - DNA, 20 bp, Homo sapiens
agaacactattttcagaatc

SEQ ID NO: 3743690 - DNA, 21 bp, Homo sapiens
agaacactattttcagaatct

SEQ ID NO: 3743691 - DNA, 22 bp, Homo sapiens
agaacactattttcagaatctg

SEQ ID NO: 3743692 - DNA, 23 bp, Homo sapiens
agaacactattttcagaatctga

SEQ ID NO: 3743693 - DNA, 12 bp, Homo sapiens
agaacagaaaac

SEQ ID NO: 3743694 - DNA, 22 bp, Homo sapiens
agaacagaaaacaacaaaaaat

SEQ ID NO: 3743695 - DNA, 16 bp, Homo sapiens
agaacagactggcctg

SEQ ID NO: 3743696 - DNA, 18 bp, Homo sapiens
agaacagccgctcctgtc

SEQ ID NO: 3743697 - DNA, 19 bp, Homo sapiens
agaacagccgctcctgtct

SEQ ID NO: 3743698 - DNA, 17 bp, Homo sapiens
agaacagttaagcagcc

SEQ ID NO: 3743699 - DNA, 18 bp, Homo sapiens
agaacatccctgccagct

SEQ ID NO: 3743700 - DNA, 20 bp, Homo sapiens
agaacatgttggtatttatc

SEQ ID NO: 3743701 - DNA, 22 bp, Homo sapiens
agaacatgttggtatttatcta

SEQ ID NO: 3743702 - DNA, 19 bp, Homo sapiens
agaacattgattgctgtgt

SEQ ID NO: 3743703 - DNA, 20 bp, Homo sapiens
agaaccaggcaacttgggaa

SEQ ID NO: 3743704 - DNA, 18 bp, Homo sapiens
agaaccagtttcaggtgt

SEQ ID NO: 3743705 - DNA, 22 bp, Homo sapiens
agaaccatccctattttgtatt

SEQ ID NO: 3743706 - DNA, 23 bp, Homo sapiens
agaaccccagggtcctgtagccc

SEQ ID NO: 3743707 - DNA, 22 bp, Homo sapiens
agaacctcacgcacctcccatc

SEQ ID NO: 3743708 - DNA, 14 bp, Homo sapiens
agaacctgtccttg

SEQ ID NO: 3743709 - DNA, 21 bp, Homo sapiens
agaacctgtccttgcacactc

SEQ ID NO: 3743710 - DNA, 15 bp, Homo sapiens
agaacgccagtctcc

SEQ ID NO: 3743711 - DNA, 22 bp, Homo sapiens
agaacggacgagataatgtgaa

SEQ ID NO: 3743712 - DNA, 22 bp, Homo sapiens
agaacgtattggtccagcttgc

SEQ ID NO: 3743713 - DNA, 23 bp, Homo sapiens
agaactagaggttttatgatatt

SEQ ID NO: 3743714 - DNA, 11 bp, Homo sapiens
agaactcctag

SEQ ID NO: 3743715 - DNA, 17 bp, Homo sapiens
agaactgatgacactga

SEQ ID NO: 3743716 - DNA, 15 bp, Homo sapiens
agaactgcatatgtt

SEQ ID NO: 3743717 - DNA, 22 bp, Homo sapiens
agaactggactcaggatgccca

SEQ ID NO: 3743718 - DNA, 19 bp, Homo sapiens
agaagaaaaggttcttact

SEQ ID NO: 3743719 - DNA, 13 bp, Homo sapiens
agaagaaatgaaa

SEQ ID NO: 3743720 - DNA, 14 bp, Homo sapiens
agaagaaatgaaat

SEQ ID NO: 3743721 - DNA, 18 bp, Homo sapiens
agaagaaatgaaatttta

SEQ ID NO: 3743722 - DNA, 18 bp, Homo sapiens
acattagcagtttgcttt

SEQ ID NO: 3743723 - DNA, 19 bp, Homo sapiens
acattatattgcaatgaag

SEQ ID NO: 3743724 - DNA, 18 bp, Homo sapiens
acattatcgggagcagtg

SEQ ID NO: 3743725 - DNA, 12 bp, Homo sapiens
acattcaatgtt

SEQ ID NO: 3743726 - DNA, 16 bp, Homo sapiens
acattcagaacaccaa

SEQ ID NO: 3743727 - DNA, 16 bp, Homo sapiens
acattccgtttacatt

SEQ ID NO: 3743728 - DNA, 19 bp, Homo sapiens
acattcgatctcattcagt

SEQ ID NO: 3743729 - DNA, 23 bp, Homo sapiens
acattcgatctcattcagtatta

SEQ ID NO: 3743730 - DNA, 15 bp, Homo sapiens
acattgaagtaatga

SEQ ID NO: 3743731 - DNA, 20 bp, Homo sapiens
acattgaagtaatgaatttt

SEQ ID NO: 3743732 - DNA, 17 bp, Homo sapiens
acattgaccaagaactg

SEQ ID NO: 3743733 - DNA, 20 bp, Homo sapiens
acattgaccaagaactgcat

SEQ ID NO: 3743734 - DNA, 21 bp, Homo sapiens
acattgcggacagccacggcc

SEQ ID NO: 3743735 - DNA, 21 bp, Homo sapiens
acattgctggtcttgtaagag

SEQ ID NO: 3743736 - DNA, 14 bp, Homo sapiens
acatttattctgct

SEQ ID NO: 3743737 - DNA, 14 bp, Homo sapiens
acatttcaaagttt

SEQ ID NO: 3743738 - DNA, 20 bp, Homo sapiens
acatttctaactctgatgta

SEQ ID NO: 3743739 - DNA, 19 bp, Homo sapiens
acattttaatgcacctgaa

SEQ ID NO: 3743740 - DNA, 15 bp, Homo sapiens
acatttttgatttca

SEQ ID NO: 3743741 - DNA, 18 bp, Homo sapiens
acatttttttttttaatt

SEQ ID NO: 3743742 - DNA, 16 bp, Homo sapiens
accaaaattatttcag

SEQ ID NO: 3743743 - DNA, 17 bp, Homo sapiens
accaaaattatttcaga

SEQ ID NO: 3743744 - DNA, 11 bp, Homo sapiens
accaaagctga

SEQ ID NO: 3743745 - DNA, 23 bp, Homo sapiens
accaaagctgacgaggctgggcc

SEQ ID NO: 3743746 - DNA, 16 bp, Homo sapiens
accaaatcagctgcta

SEQ ID NO: 3743747 - DNA, 13 bp, Homo sapiens
accaacaagggca

SEQ ID NO: 3743748 - DNA, 18 bp, Homo sapiens
accaacatcccattgccc

SEQ ID NO: 3743749 - DNA, 15 bp, Homo sapiens
accaacatggagaaa

SEQ ID NO: 3743750 - DNA, 23 bp, Homo sapiens
accaacatggagaaaccctgtct

SEQ ID NO: 3743751 - DNA, 24 bp, Homo sapiens
accaacatggagaaaccctgtctc

SEQ ID NO: 3743752 - DNA, 16 bp, Homo sapiens
accaacccttccctga

SEQ ID NO: 3743753 - DNA, 19 bp, Homo sapiens
accaacctgaagacaccgt

SEQ ID NO: 3743754 - DNA, 18 bp, Homo sapiens
accaactggaagcacaga

SEQ ID NO: 3743755 - DNA, 14 bp, Homo sapiens
accaactgggccca

SEQ ID NO: 3743756 - DNA, 22 bp, Homo sapiens
accaacttttctattaaaagtg

SEQ ID NO: 3743757 - DNA, 14 bp, Homo sapiens
accaagaaagcagg

SEQ ID NO: 3743758 - DNA, 12 bp, Homo sapiens
accaagaactgc

SEQ ID NO: 3743759 - DNA, 14 bp, Homo sapiens
accaagaactgcat

SEQ ID NO: 3743760 - DNA, 22 bp, Homo sapiens
accaagaattctccaaaacaat

SEQ ID NO: 3743761 - DNA, 16 bp, Homo sapiens
accaagactctgaaat

SEQ ID NO: 3743762 - DNA, 13 bp, Homo sapiens
accaagcaggaag

SEQ ID NO: 3743763 - DNA, 15 bp, Homo sapiens
accaagcaggaagct

SEQ ID NO: 3743764 - DNA, 14 bp, Homo sapiens
accaagccgtggct

SEQ ID NO: 3743765 - DNA, 13 bp, Homo sapiens
accaagtcctggc

SEQ ID NO: 3743766 - DNA, 15 bp, Homo sapiens
accaagtcctggcta

SEQ ID NO: 3743767 - DNA, 21 bp, Homo sapiens
accaagttatataaagagaaa

SEQ ID NO: 3743768 - DNA, 11 bp, Homo sapiens
accaatatttg

SEQ ID NO: 3743769 - DNA, 16 bp, Homo sapiens
accaatatttgtagaa

SEQ ID NO: 3743770 - DNA, 20 bp, Homo sapiens
accaatcaagataaaggaca

SEQ ID NO: 3743771 - DNA, 14 bp, Homo sapiens
accacaaaaatgaa

SEQ ID NO: 3743772 - DNA, 16 bp, Homo sapiens
accacacccagcccac

SEQ ID NO: 3743773 - DNA, 23 bp, Homo sapiens
accacacccagcccacttctgcc

SEQ ID NO: 3743774 - DNA, 16 bp, Homo sapiens
accacaccgcagaagc

SEQ ID NO: 3743775 - DNA, 21 bp, Homo sapiens
accacacttcctgtccagaga

SEQ ID NO: 3743776 - DNA, 22 bp, Homo sapiens
accacacttcctgtccagagag

SEQ ID NO: 3743777 - DNA, 19 bp, Homo sapiens
accacagcaggtgtcatat

SEQ ID NO: 3743778 - DNA, 13 bp, Homo sapiens
accacagccctgt

SEQ ID NO: 3743779 - DNA, 14 bp, Homo sapiens
accacagccctgtc

SEQ ID NO: 3743780 - DNA, 17 bp, Homo sapiens
accacagccctgtcagt

SEQ ID NO: 3743781 - DNA, 11 bp, Homo sapiens
accacagtgtc

SEQ ID NO: 3743782 - DNA, 22 bp, Homo sapiens
accacatcctccgtccagccgc

SEQ ID NO: 3743783 - DNA, 18 bp, Homo sapiens
accacatcttgctctgct

SEQ ID NO: 3743784 - DNA, 20 bp, Homo sapiens
accacatcttgctctgctga

SEQ ID NO: 3743785 - DNA, 24 bp, Homo sapiens
accacatcttgctctgctgacaga

SEQ ID NO: 3743786 - DNA, 18 bp, Homo sapiens
accacatgtgcacatgca

SEQ ID NO: 3743787 - DNA, 22 bp, Homo sapiens
accaccccagctgctcccctcc

SEQ ID NO: 3743788 - DNA, 20 bp, Homo sapiens
accaccctagtcccttcccc

SEQ ID NO: 3743789 - DNA, 21 bp, Homo sapiens
accaccctagtcccttcccct

SEQ ID NO: 3743790 - DNA, 15 bp, Homo sapiens
accaccgctccccag

SEQ ID NO: 3743791 - DNA, 18 bp, Homo sapiens
accaccgctccccagccc

SEQ ID NO: 3743792 - DNA, 21 bp, Homo sapiens
accaccgctccccagcccagg

SEQ ID NO: 3743793 - DNA, 18 bp, Homo sapiens
accacctaggccactcct

SEQ ID NO: 3743794 - DNA, 21 bp, Homo sapiens
accacctaggccactcctcca

SEQ ID NO: 3743795 - DNA, 15 bp, Homo sapiens
accaccttcccagct

SEQ ID NO: 3743796 - DNA, 16 bp, Homo sapiens
accaccttcccagctc

SEQ ID NO: 3743797 - DNA, 19 bp, Homo sapiens
accacgatgtggccctggc

SEQ ID NO: 3743798 - DNA, 20 bp, Homo sapiens
accacgatgtggccctggcc

SEQ ID NO: 3743799 - DNA, 18 bp, Homo sapiens
accacgctggaccttgaa

SEQ ID NO: 3743800 - DNA, 20 bp, Homo sapiens
accacgcttgacaggacagc

SEQ ID NO: 3743801 - DNA, 14 bp, Homo sapiens
accacgtccagctg

SEQ ID NO: 3743802 - DNA, 17 bp, Homo sapiens
accacgtctgtcttcac

SEQ ID NO: 3743803 - DNA, 18 bp, Homo sapiens
accacgtctgtcttcaca

SEQ ID NO: 3743804 - DNA, 19 bp, Homo sapiens
accactgctgtgaacaagt

SEQ ID NO: 3743805 - DNA, 15 bp, Homo sapiens
accacttcagctgac

SEQ ID NO: 3743806 - DNA, 15 bp, Homo sapiens
accacttcttttata

SEQ ID NO: 3743807 - DNA, 16 bp, Homo sapiens
accacttcttttataa

SEQ ID NO: 3743808 - DNA, 17 bp, Homo sapiens
accacttcttttataac

SEQ ID NO: 3743809 - DNA, 17 bp, Homo sapiens
accagacaccttgacag

SEQ ID NO: 3743810 - DNA, 20 bp, Homo sapiens
accagacggttcaccagcct

SEQ ID NO: 3743811 - DNA, 20 bp, Homo sapiens
accagagcactgtatacccc

SEQ ID NO: 3743812 - DNA, 14 bp, Homo sapiens
accagagccatgga

SEQ ID NO: 3743813 - DNA, 17 bp, Homo sapiens
accagagccatggactc

SEQ ID NO: 3743814 - DNA, 12 bp, Homo sapiens
accagagcccac

SEQ ID NO: 3743815 - DNA, 19 bp, Homo sapiens
accagagcccaccttggct

SEQ ID NO: 3743816 - DNA, 14 bp, Homo sapiens
accagagccccaca

SEQ ID NO: 3743817 - DNA, 17 bp, Homo sapiens
accagagccccacacgg

SEQ ID NO: 3743818 - DNA, 14 bp, Homo sapiens
accagagctctgga

SEQ ID NO: 3743819 - DNA, 15 bp, Homo sapiens
accagagctctggag

SEQ ID NO: 3743820 - DNA, 20 bp, Homo sapiens
accagatgctgaaagagaaa

SEQ ID NO: 3743821 - DNA, 15 bp, Homo sapiens
accagcactgtctca

SEQ ID NO: 3743822 - DNA, 16 bp, Homo sapiens
accagcactgtctcag

SEQ ID NO: 3743823 - DNA, 16 bp, Homo sapiens
accagccccagtgccc

SEQ ID NO: 3743824 - DNA, 19 bp, Homo sapiens
accagccccagtgcccaca

SEQ ID NO: 3743825 - DNA, 20 bp, Homo sapiens
accagccccagtgcccacag

SEQ ID NO: 3743826 - DNA, 11 bp, Homo sapiens
accagcctggc

SEQ ID NO: 3743827 - DNA, 15 bp, Homo sapiens
accagcctggccaac

SEQ ID NO: 3743828 - DNA, 19 bp, Homo sapiens
accagcctttctcccaggc

SEQ ID NO: 3743829 - DNA, 22 bp, Homo sapiens
accagcgtgtgactactccccc

SEQ ID NO: 3743830 - DNA, 17 bp, Homo sapiens
accaggacaggaccaga

SEQ ID NO: 3743831 - DNA, 14 bp, Homo sapiens
accaggactccctc

SEQ ID NO: 3743832 - DNA, 11 bp, Homo sapiens
accaggagaca

SEQ ID NO: 3743833 - DNA, 22 bp, Homo sapiens
accaggagtccctggtaataag

SEQ ID NO: 3743834 - DNA, 19 bp, Homo sapiens
accaggcaacttgggaact

SEQ ID NO: 3743835 - DNA, 22 bp, Homo sapiens
accaggcacgaacccacctgct

SEQ ID NO: 3743836 - DNA, 10 bp, Homo sapiens
accagggaca

SEQ ID NO: 3743837 - DNA, 23 bp, Homo sapiens
agaagaactagaggttttatgat

SEQ ID NO: 3743838 - DNA, 17 bp, Homo sapiens
agaagaaggaaatgaat

SEQ ID NO: 3743839 - DNA, 18 bp, Homo sapiens
agaagaaggaaatgaatt

SEQ ID NO: 3743840 - DNA, 13 bp, Homo sapiens
agaagaaggcagc

SEQ ID NO: 3743841 - DNA, 14 bp, Homo sapiens
agaagaatattgtt

SEQ ID NO: 3743842 - DNA, 20 bp, Homo sapiens
agaagaatattgttcctaag

SEQ ID NO: 3743843 - DNA, 22 bp, Homo sapiens
agaagaatattgttcctaagtt

SEQ ID NO: 3743844 - DNA, 17 bp, Homo sapiens
agaagaattgaacccag

SEQ ID NO: 3743845 - DNA, 13 bp, Homo sapiens
agaagacactgat

SEQ ID NO: 3743846 - DNA, 12 bp, Homo sapiens
agaagacatgaa

SEQ ID NO: 3743847 - DNA, 15 bp, Homo sapiens
agaagacatgaacca

SEQ ID NO: 3743848 - DNA, 15 bp, Homo sapiens
agaagagagaaatag

SEQ ID NO: 3743849 - DNA, 22 bp, Homo sapiens
agaagagagtccatatttcaat

SEQ ID NO: 3743850 - DNA, 17 bp, Homo sapiens
agaagaggcagattcaa

SEQ ID NO: 3743851 - DNA, 12 bp, Homo sapiens
agaagatgaaaa

SEQ ID NO: 3743852 - DNA, 16 bp, Homo sapiens
agaagatgacttccca

SEQ ID NO: 3743853 - DNA, 13 bp, Homo sapiens
agaagcagtgagc

SEQ ID NO: 3743854 - DNA, 14 bp, Homo sapiens
agaagcagtgagcc

SEQ ID NO: 3743855 - DNA, 17 bp, Homo sapiens
agaagcagtgagccgca

SEQ ID NO: 3743856 - DNA, 23 bp, Homo sapiens
agaagcagtgagccgcatcttct

SEQ ID NO: 3743857 - DNA, 17 bp, Homo sapiens
agaagccaaaagattgg

SEQ ID NO: 3743858 - DNA, 22 bp, Homo sapiens
agaagcctattgtaaatacaag

SEQ ID NO: 3743859 - DNA, 23 bp, Homo sapiens
agaagcctctggctagaggccag

SEQ ID NO: 3743860 - DNA, 14 bp, Homo sapiens
agaagcgagcactg

SEQ ID NO: 3743861 - DNA, 23 bp, Homo sapiens
agaagcgggacgagaccctacag

SEQ ID NO: 3743862 - DNA, 9 bp, Homo sapiens
agaaggaag

SEQ ID NO: 3743863 - DNA, 22 bp, Homo sapiens
agaaggaattctaggcatccca

SEQ ID NO: 3743864 - DNA, 15 bp, Homo sapiens
agaaggagaaggaag

SEQ ID NO: 3743865 - DNA, 14 bp, Homo sapiens
agaaggagacagag

SEQ ID NO: 3743866 - DNA, 22 bp, Homo sapiens
agaaggaggagagggaaaatgt

SEQ ID NO: 3743867 - DNA, 23 bp, Homo sapiens
agaaggaggagagggaaaatgtt

SEQ ID NO: 3743868 - DNA, 21 bp, Homo sapiens
agaaggatgaatgaggtccca

SEQ ID NO: 3743869 - DNA, 14 bp, Homo sapiens
agaagggaaacagt

SEQ ID NO: 3743870 - DNA, 18 bp, Homo sapiens
agaagggaaggggagagg

SEQ ID NO: 3743871 - DNA, 15 bp, Homo sapiens
agaaggggaagcact

SEQ ID NO: 3743872 - DNA, 20 bp, Homo sapiens
agaagggggtcaaagcaagg

SEQ ID NO: 3743873 - DNA, 23 bp, Homo sapiens
agaagggtccttccctctcccca

SEQ ID NO: 3743874 - DNA, 20 bp, Homo sapiens
agaagggttttccaccctgg

SEQ ID NO: 3743875 - DNA, 14 bp, Homo sapiens
agaaggtccttaat

SEQ ID NO: 3743876 - DNA, 22 bp, Homo sapiens
agaaggtgggggttggctgggt

SEQ ID NO: 3743877 - DNA, 16 bp, Homo sapiens
agaaggttgctctaga

SEQ ID NO: 3743878 - DNA, 18 bp, Homo sapiens
agaaggtttcagaaagaa

SEQ ID NO: 3743879 - DNA, 13 bp, Homo sapiens
agaagtaacaaga

SEQ ID NO: 3743880 - DNA, 14 bp, Homo sapiens
agaagtaacttact

SEQ ID NO: 3743881 - DNA, 17 bp, Homo sapiens
agaagtcaacagtgaaa

SEQ ID NO: 3743882 - DNA, 18 bp, Homo sapiens
agaagtcactcaattgtt

SEQ ID NO: 3743883 - DNA, 17 bp, Homo sapiens
agaagtcttagatgtat

SEQ ID NO: 3743884 - DNA, 19 bp, Homo sapiens
agaagtcttagatgtatat

SEQ ID NO: 3743885 - DNA, 16 bp, Homo sapiens
agaagtgcccctgctg

SEQ ID NO: 3743886 - DNA, 22 bp, Homo sapiens
agaagtgcccctgctgcctccc

SEQ ID NO: 3743887 - DNA, 23 bp, Homo sapiens
agaagtggaccaggacaggacca

SEQ ID NO: 3743888 - DNA, 19 bp, Homo sapiens
agaagtgtccgagaactaa

SEQ ID NO: 3743889 - DNA, 16 bp, Homo sapiens
agaagtgtttcatgca

SEQ ID NO: 3743890 - DNA, 23 bp, Homo sapiens
agaataatatgctgccaaatttt

SEQ ID NO: 3743891 - DNA, 15 bp, Homo sapiens
agaatacaaacatat

SEQ ID NO: 3743892 - DNA, 12 bp, Homo sapiens
agaatacagaaa

SEQ ID NO: 3743893 - DNA, 13 bp, Homo sapiens
agaatagaaggaa

SEQ ID NO: 3743894 - DNA, 15 bp, Homo sapiens
agaatagaaggaaac

SEQ ID NO: 3743895 - DNA, 20 bp, Homo sapiens
agaatattagctttactgtt

SEQ ID NO: 3743896 - DNA, 20 bp, Homo sapiens
agaatattgttcctaagttc

SEQ ID NO: 3743897 - DNA, 21 bp, Homo sapiens
agaatattgttcctaagttct

SEQ ID NO: 3743898 - DNA, 19 bp, Homo sapiens
agaatatttattacctctg

SEQ ID NO: 3743899 - DNA, 14 bp, Homo sapiens
agaatcaaaactct

SEQ ID NO: 3743900 - DNA, 17 bp, Homo sapiens
agaatcagatcatttca

SEQ ID NO: 3743901 - DNA, 13 bp, Homo sapiens
agaatcagcctag

SEQ ID NO: 3743902 - DNA, 17 bp, Homo sapiens
agaatcattatttatta

SEQ ID NO: 3743903 - DNA, 15 bp, Homo sapiens
agaatccctgttcat

SEQ ID NO: 3743904 - DNA, 21 bp, Homo sapiens
agaatcctaggctccacccca

SEQ ID NO: 3743905 - DNA, 17 bp, Homo sapiens
agaatctcaaataacta

SEQ ID NO: 3743906 - DNA, 18 bp, Homo sapiens
agaatctgaatgtaattt

SEQ ID NO: 3743907 - DNA, 16 bp, Homo sapiens
agaatgaaagggccca

SEQ ID NO: 3743908 - DNA, 13 bp, Homo sapiens
agaatgaggagga

SEQ ID NO: 3743909 - DNA, 16 bp, Homo sapiens
agaatgaggaggaagg

SEQ ID NO: 3743910 - DNA, 14 bp, Homo sapiens
agaatgagtgaatc

SEQ ID NO: 3743911 - DNA, 19 bp, Homo sapiens
agaatgatgcacatttcat

SEQ ID NO: 3743912 - DNA, 13 bp, Homo sapiens
agaatgctggttt

SEQ ID NO: 3743913 - DNA, 15 bp, Homo sapiens
agaatgtcagaaaaa

SEQ ID NO: 3743914 - DNA, 19 bp, Homo sapiens
agaatgttgaatacttata

SEQ ID NO: 3743915 - DNA, 15 bp, Homo sapiens
agaatgttgtattca

SEQ ID NO: 3743916 - DNA, 20 bp, Homo sapiens
agaattataattagttcctc

SEQ ID NO: 3743917 - DNA, 16 bp, Homo sapiens
agaattatgcatctgc

SEQ ID NO: 3743918 - DNA, 13 bp, Homo sapiens
agaattcagctgc

SEQ ID NO: 3743919 - DNA, 14 bp, Homo sapiens
agaattcagctgcc

SEQ ID NO: 3743920 - DNA, 19 bp, Homo sapiens
agaattcctacaatatata

SEQ ID NO: 3743921 - DNA, 17 bp, Homo sapiens
agaattctcttatccaa

SEQ ID NO: 3743922 - DNA, 19 bp, Homo sapiens
agaattcttacatgttttc

SEQ ID NO: 3743923 - DNA, 23 bp, Homo sapiens
agaattcttacatgttttctttg

SEQ ID NO: 3743924 - DNA, 16 bp, Homo sapiens
agaattgaacccagga

SEQ ID NO: 3743925 - DNA, 22 bp, Homo sapiens
agaattgaacccaggaggtgga

SEQ ID NO: 3743926 - DNA, 21 bp, Homo sapiens
agaattgatcattttcccccc

SEQ ID NO: 3743927 - DNA, 22 bp, Homo sapiens
agaattgctgattcttgagttt

SEQ ID NO: 3743928 - DNA, 21 bp, Homo sapiens
agaattggagagtaaaaactg

SEQ ID NO: 3743929 - DNA, 21 bp, Homo sapiens
agaatttattcaattcctctg

SEQ ID NO: 3743930 - DNA, 16 bp, Homo sapiens
agaatttctaccattt

SEQ ID NO: 3743931 - DNA, 20 bp, Homo sapiens
agaatttctaccatttcaga

SEQ ID NO: 3743932 - DNA, 21 bp, Homo sapiens
agaatttctaccatttcagag

SEQ ID NO: 3743933 - DNA, 21 bp, Homo sapiens
agaattttaagtgctttgtaa

SEQ ID NO: 3743934 - DNA, 14 bp, Homo sapiens
agaatttttaatgt

SEQ ID NO: 3743935 - DNA, 14 bp, Homo sapiens
agacaaaaatactc

SEQ ID NO: 3743936 - DNA, 12 bp, Homo sapiens
agacaaaaatta

SEQ ID NO: 3743937 - DNA, 13 bp, Homo sapiens
agacaacagaagt

SEQ ID NO: 3743938 - DNA, 21 bp, Homo sapiens
agacaaccctgcaaaggactg

SEQ ID NO: 3743939 - DNA, 15 bp, Homo sapiens
agacaagaagcaaat

SEQ ID NO: 3743940 - DNA, 16 bp, Homo sapiens
agacaaggtagccctg

SEQ ID NO: 3743941 - DNA, 23 bp, Homo sapiens
agacaagtgactgtatctgtgta

SEQ ID NO: 3743942 - DNA, 20 bp, Homo sapiens
agacacaaacaaacaagcta

SEQ ID NO: 3743943 - DNA, 17 bp, Homo sapiens
agacacacgcacacaca

SEQ ID NO: 3743944 - DNA, 16 bp, Homo sapiens
agacacaggcccggct

SEQ ID NO: 3743945 - DNA, 21 bp, Homo sapiens
agacacaggcccggctccagg

SEQ ID NO: 3743946 - DNA, 17 bp, Homo sapiens
agacacatccagcaatt

SEQ ID NO: 3743947 - DNA, 17 bp, Homo sapiens
agacaccgttcattcag

SEQ ID NO: 3743948 - DNA, 20 bp, Homo sapiens
agacacctgcacctcccccc

SEQ ID NO: 3743949 - DNA, 21 bp, Homo sapiens
agacacctgcacctcccccca

SEQ ID NO: 3743950 - DNA, 17 bp, Homo sapiens
agacaccttgacagggc

SEQ ID NO: 3743951 - DNA, 16 bp, Homo sapiens
ttacatagtgtaggct

SEQ ID NO: 3743952 - DNA, 21 bp, Homo sapiens
ttacatagtgtaggctttact

SEQ ID NO: 3743953 - DNA, 22 bp, Homo sapiens
ttacatatttgcatatgtatga

SEQ ID NO: 3743954 - DNA, 18 bp, Homo sapiens
ttacatcaaggcttcaaa

SEQ ID NO: 3743955 - DNA, 15 bp, Homo sapiens
ttacatctttcacat

SEQ ID NO: 3743956 - DNA, 17 bp, Homo sapiens
ttacatgagaacagact

SEQ ID NO: 3743957 - DNA, 12 bp, Homo sapiens
ttacatgttttc

SEQ ID NO: 3743958 - DNA, 22 bp, Homo sapiens
ttacattccttgataatgttgt

SEQ ID NO: 3743959 - DNA, 19 bp, Homo sapiens
ttacattgctggtcttgta

SEQ ID NO: 3743960 - DNA, 14 bp, Homo sapiens
ttaccaagttatat

SEQ ID NO: 3743961 - DNA, 21 bp, Homo sapiens
ttaccactgaagatagaagaa

SEQ ID NO: 3743962 - DNA, 21 bp, Homo sapiens
ttaccagacggttcaccagcc

SEQ ID NO: 3743963 - DNA, 15 bp, Homo sapiens
ttaccatttgtaata

SEQ ID NO: 3743964 - DNA, 20 bp, Homo sapiens
ttaccatttgtaataaagta

SEQ ID NO: 3743965 - DNA, 17 bp, Homo sapiens
ttacccaataagataca

SEQ ID NO: 3743966 - DNA, 16 bp, Homo sapiens
ttaccccttagcctcc

SEQ ID NO: 3743967 - DNA, 12 bp, Homo sapiens
ttacccttctgt

SEQ ID NO: 3743968 - DNA, 19 bp, Homo sapiens
ttacccttctgtgcccagc

SEQ ID NO: 3743969 - DNA, 20 bp, Homo sapiens
ttacccttctgtgcccagct

SEQ ID NO: 3743970 - DNA, 16 bp, Homo sapiens
ttacctaccacagtgt

SEQ ID NO: 3743971 - DNA, 21 bp, Homo sapiens
ttacctaccacagtgtctgta

SEQ ID NO: 3743972 - DNA, 12 bp, Homo sapiens
ttacctcctgcc

SEQ ID NO: 3743973 - DNA, 15 bp, Homo sapiens
ttacctcctgcccag

SEQ ID NO: 3743974 - DNA, 11 bp, Homo sapiens
ttacctctgat

SEQ ID NO: 3743975 - DNA, 17 bp, Homo sapiens
ttaccttcaataaagta

SEQ ID NO: 3743976 - DNA, 14 bp, Homo sapiens
ttacggctcctctc

SEQ ID NO: 3743977 - DNA, 21 bp, Homo sapiens
ttacgtagtgtagatttgttt

SEQ ID NO: 3743978 - DNA, 13 bp, Homo sapiens
ttactactgtgga

SEQ ID NO: 3743979 - DNA, 20 bp, Homo sapiens
ttactcattaaaaataatag

SEQ ID NO: 3743980 - DNA, 17 bp, Homo sapiens
ttactgagcttctctgt

SEQ ID NO: 3743981 - DNA, 19 bp, Homo sapiens
ttactgagcttctctgtga

SEQ ID NO: 3743982 - DNA, 17 bp, Homo sapiens
ttactgatcatgcattg

SEQ ID NO: 3743983 - DNA, 18 bp, Homo sapiens
ttactgatcatgcattgt

SEQ ID NO: 3743984 - DNA, 22 bp, Homo sapiens
ttactgcttttaacttctgata

SEQ ID NO: 3743985 - DNA, 13 bp, Homo sapiens
ttactgtcaataa

SEQ ID NO: 3743986 - DNA, 15 bp, Homo sapiens
ttactgtcaataaac

SEQ ID NO: 3743987 - DNA, 13 bp, Homo sapiens
ttactgtcttaat

SEQ ID NO: 3743988 - DNA, 15 bp, Homo sapiens
ttacttagcttatca

SEQ ID NO: 3743989 - DNA, 19 bp, Homo sapiens
ttacttgcattgaatatat

SEQ ID NO: 3743990 - DNA, 17 bp, Homo sapiens
ttactttaaaaggagcc

SEQ ID NO: 3743991 - DNA, 17 bp, Homo sapiens
ttacttttaaacagtga

SEQ ID NO: 3743992 - DNA, 17 bp, Homo sapiens
ttagaaataaagcatct

SEQ ID NO: 3743993 - DNA, 19 bp, Homo sapiens
ttagaaataaatgtacctg

SEQ ID NO: 3743994 - DNA, 15 bp, Homo sapiens
ttagaaatagacagt

SEQ ID NO: 3743995 - DNA, 18 bp, Homo sapiens
ttagaaatgaccaatatt

SEQ ID NO: 3743996 - DNA, 13 bp, Homo sapiens
ttagaacactatt

SEQ ID NO: 3743997 - DNA, 14 bp, Homo sapiens
ttagaacactattt

SEQ ID NO: 3743998 - DNA, 15 bp, Homo sapiens
ttagaacagaaaaca

SEQ ID NO: 3743999 - DNA, 22 bp, Homo sapiens
ttagaacagaaaacaacaaaaa

SEQ ID NO: 3744000 - DNA, 16 bp, Homo sapiens
ttagaagtcacacagt

SEQ ID NO: 3744001 - DNA, 22 bp, Homo sapiens
ttagacaaatctaagggaaaaa

SEQ ID NO: 3744002 - DNA, 20 bp, Homo sapiens
ttagacagagtctcactgtt

SEQ ID NO: 3744003 - DNA, 13 bp, Homo sapiens
ttagagatgaatt

SEQ ID NO: 3744004 - DNA, 18 bp, Homo sapiens
ttagaggaaaaaaatgac

SEQ ID NO: 3744005 - DNA, 18 bp, Homo sapiens
ttagatggttacactgtt

SEQ ID NO: 3744006 - DNA, 22 bp, Homo sapiens
ttagattatattgagacaaaaa

SEQ ID NO: 3744007 - DNA, 24 bp, Homo sapiens
ttagcatgacaagccccaggcagg

SEQ ID NO: 3744008 - DNA, 17 bp, Homo sapiens
ttagcatgtgttgaaaa

SEQ ID NO: 3744009 - DNA, 21 bp, Homo sapiens
ttagccgtggtgatttagcag

SEQ ID NO: 3744010 - DNA, 22 bp, Homo sapiens
ttagcctgtggcagtaaagaga

SEQ ID NO: 3744011 - DNA, 21 bp, Homo sapiens
ttagcgtagctaagtgaaaag

SEQ ID NO: 3744012 - DNA, 17 bp, Homo sapiens
ttagctgccaagcccca

SEQ ID NO: 3744013 - DNA, 22 bp, Homo sapiens
ttagctgccaagccccatcctg

SEQ ID NO: 3744014 - DNA, 16 bp, Homo sapiens
ttagctggcattacag

SEQ ID NO: 3744015 - DNA, 17 bp, Homo sapiens
ttagctgtctgctcaga

SEQ ID NO: 3744016 - DNA, 10 bp, Homo sapiens
ttagctgtgc

SEQ ID NO: 3744017 - DNA, 15 bp, Homo sapiens
ttagctgtgtgaaat

SEQ ID NO: 3744018 - DNA, 17 bp, Homo sapiens
ttagctgttatttctat

SEQ ID NO: 3744019 - DNA, 21 bp, Homo sapiens
ttagcttagacctcagcctgt

SEQ ID NO: 3744020 - DNA, 17 bp, Homo sapiens
ttagcttatcaatttgt

SEQ ID NO: 3744021 - DNA, 17 bp, Homo sapiens
ttagcttgcaccttgtc

SEQ ID NO: 3744022 - DNA, 16 bp, Homo sapiens
ttagctttactgtttg

SEQ ID NO: 3744023 - DNA, 12 bp, Homo sapiens
ttaggaaataaa

SEQ ID NO: 3744024 - DNA, 15 bp, Homo sapiens
ttaggaagagaaacc

SEQ ID NO: 3744025 - DNA, 19 bp, Homo sapiens
ttaggaagtgtaacagctg

SEQ ID NO: 3744026 - DNA, 20 bp, Homo sapiens
ttaggaagtgtaacagctga

SEQ ID NO: 3744027 - DNA, 12 bp, Homo sapiens
ttaggctgggcc

SEQ ID NO: 3744028 - DNA, 14 bp, Homo sapiens
ttagggaagagaaa

SEQ ID NO: 3744029 - DNA, 18 bp, Homo sapiens
ttagggaagagaaacagg

SEQ ID NO: 3744030 - DNA, 19 bp, Homo sapiens
ttaggtgtgggggaagcac

SEQ ID NO: 3744031 - DNA, 13 bp, Homo sapiens
ttaggttaactat

SEQ ID NO: 3744032 - DNA, 18 bp, Homo sapiens
ttaggttggcaaaaaggc

SEQ ID NO: 3744033 - DNA, 14 bp, Homo sapiens
ttaggttttgtaca

SEQ ID NO: 3744034 - DNA, 16 bp, Homo sapiens
ttaggttttgtacaat

SEQ ID NO: 3744035 - DNA, 20 bp, Homo sapiens
ttagtatatttatataatta

SEQ ID NO: 3744036 - DNA, 22 bp, Homo sapiens
ttagtatttatttaatgttatg

SEQ ID NO: 3744037 - DNA, 13 bp, Homo sapiens
ttagtatttgcat

SEQ ID NO: 3744038 - DNA, 18 bp, Homo sapiens
ttagtcttctcatagcat

SEQ ID NO: 3744039 - DNA, 19 bp, Homo sapiens
ttagtgcggacaagtttta

SEQ ID NO: 3744040 - DNA, 14 bp, Homo sapiens
ttagtggtgtatat

SEQ ID NO: 3744041 - DNA, 13 bp, Homo sapiens
ttagtgtaaaaat

SEQ ID NO: 3744042 - DNA, 22 bp, Homo sapiens
ttagtttgtatgccaagtgaga

SEQ ID NO: 3744043 - DNA, 17 bp, Homo sapiens
ttagttttagttgcaga

SEQ ID NO: 3744044 - DNA, 17 bp, Homo sapiens
ttagtttttgtaattta

SEQ ID NO: 3744045 - DNA, 22 bp, Homo sapiens
ttataaaaaaaatgaaatgttt

SEQ ID NO: 3744046 - DNA, 10 bp, Homo sapiens
ttataaaatt

SEQ ID NO: 3744047 - DNA, 20 bp, Homo sapiens
ttataaaattaaagaaaata

SEQ ID NO: 3744048 - DNA, 15 bp, Homo sapiens
ttataaatatattta

SEQ ID NO: 3744049 - DNA, 16 bp, Homo sapiens
ttataactcatcataa

SEQ ID NO: 3744050 - DNA, 19 bp, Homo sapiens
ttataactcatcataaaat

SEQ ID NO: 3744051 - DNA, 15 bp, Homo sapiens
ttataacttaaaaaa

SEQ ID NO: 3744052 - DNA, 16 bp, Homo sapiens
ttataaggactgcatg

SEQ ID NO: 3744053 - DNA, 17 bp, Homo sapiens
ttataaggactgcatgg

SEQ ID NO: 3744054 - DNA, 18 bp, Homo sapiens
ttataataatgttaacat

SEQ ID NO: 3744055 - DNA, 15 bp, Homo sapiens
ttataatgaatgaaa

SEQ ID NO: 3744056 - DNA, 15 bp, Homo sapiens
ttatacagttttaaa

SEQ ID NO: 3744057 - DNA, 16 bp, Homo sapiens
ttatacagttttaaag

SEQ ID NO: 3744058 - DNA, 16 bp, Homo sapiens
ttatacatgacactga

SEQ ID NO: 3744059 - DNA, 20 bp, Homo sapiens
ttatacatgacactgaaatg

SEQ ID NO: 3744060 - DNA, 22 bp, Homo sapiens
ttatacatgacactgaaatgcc

SEQ ID NO: 3744061 - DNA, 16 bp, Homo sapiens
ttatactaagaaaaga

SEQ ID NO: 3744062 - DNA, 23 bp, Homo sapiens
ttatagaatatttattacctctg

SEQ ID NO: 3744063 - DNA, 16 bp, Homo sapiens
ttataggatcatttgt

SEQ ID NO: 3744064 - DNA, 18 bp, Homo sapiens
ttataggtcactcctggg

SEQ ID NO: 3744065 - DNA, 19 bp, Homo sapiens
ttatataaagagaaaattg

SEQ ID NO: 3744066 - DNA, 22 bp, Homo sapiens
tttaagatttaatttgccaaaa

SEQ ID NO: 3744067 - DNA, 23 bp, Homo sapiens
tttaagcattactcttgtaagat

SEQ ID NO: 3744068 - DNA, 13 bp, Homo sapiens
tttaagcattgtt

SEQ ID NO: 3744069 - DNA, 21 bp, Homo sapiens
tttaagctgttactgtcttca

SEQ ID NO: 3744070 - DNA, 22 bp, Homo sapiens
tttaagcttatttaattaaaaa

SEQ ID NO: 3744071 - DNA, 20 bp, Homo sapiens
tttaaggagatgtaagagct

SEQ ID NO: 3744072 - DNA, 21 bp, Homo sapiens
tttaaggagatgtaagagctt

SEQ ID NO: 3744073 - DNA, 18 bp, Homo sapiens
tttaaggctaaaacttaa

SEQ ID NO: 3744074 - DNA, 22 bp, Homo sapiens
tttaaggcttcaatttattgca

SEQ ID NO: 3744075 - DNA, 20 bp, Homo sapiens
tttaagggtttgtggaaaat

SEQ ID NO: 3744076 - DNA, 22 bp, Homo sapiens
tttaagtgtaactggcagtttt

SEQ ID NO: 3744077 - DNA, 20 bp, Homo sapiens
tttaagttttttatagagat

SEQ ID NO: 3744078 - DNA, 14 bp, Homo sapiens
tttaatacagggta

SEQ ID NO: 3744079 - DNA, 17 bp, Homo sapiens
tttaatagaagttttat

SEQ ID NO: 3744080 - DNA, 19 bp, Homo sapiens
tttaatagaatataattat

SEQ ID NO: 3744081 - DNA, 21 bp, Homo sapiens
tttaatagaatataattatcg

SEQ ID NO: 3744082 - DNA, 23 bp, Homo sapiens
tttaatgaaagactgtacaaagt

SEQ ID NO: 3744083 - DNA, 13 bp, Homo sapiens
tttaattaaataa

SEQ ID NO: 3744084 - DNA, 19 bp, Homo sapiens
tttaattaggttaactatg

SEQ ID NO: 3744085 - DNA, 19 bp, Homo sapiens
tttaattgaaggaaagatt

SEQ ID NO: 3744086 - DNA, 15 bp, Homo sapiens
tttaattgtaaactg

SEQ ID NO: 3744087 - DNA, 16 bp, Homo sapiens
tttaattgtaaactgt

SEQ ID NO: 3744088 - DNA, 19 bp, Homo sapiens
tttaatttatttattaaga

SEQ ID NO: 3744089 - DNA, 20 bp, Homo sapiens
tttaatttgccaaaataatg

SEQ ID NO: 3744090 - DNA, 19 bp, Homo sapiens
tttacaagaaaaaatgaat

SEQ ID NO: 3744091 - DNA, 23 bp, Homo sapiens
tttacaattgtaaaactgaggca

SEQ ID NO: 3744092 - DNA, 14 bp, Homo sapiens
tttacagaattgct

SEQ ID NO: 3744093 - DNA, 15 bp, Homo sapiens
tttacagctgcctgc

SEQ ID NO: 3744094 - DNA, 18 bp, Homo sapiens
tttacatggggttttcaa

SEQ ID NO: 3744095 - DNA, 14 bp, Homo sapiens
tttaccatttgtaa

SEQ ID NO: 3744096 - DNA, 21 bp, Homo sapiens
tttacccaataagatacatca

SEQ ID NO: 3744097 - DNA, 19 bp, Homo sapiens
tttacctaccacagtgtct

SEQ ID NO: 3744098 - DNA, 16 bp, Homo sapiens
tttacctgtgaaatag

SEQ ID NO: 3744099 - DNA, 13 bp, Homo sapiens
tttactattttac

SEQ ID NO: 3744100 - DNA, 18 bp, Homo sapiens
tttactccccttgagctg

SEQ ID NO: 3744101 - DNA, 11 bp, Homo sapiens
tttacttaaac

SEQ ID NO: 3744102 - DNA, 22 bp, Homo sapiens
tttacttcttatacatttgata

SEQ ID NO: 3744103 - DNA, 17 bp, Homo sapiens
tttacttgtttcagagt

SEQ ID NO: 3744104 - DNA, 13 bp, Homo sapiens
tttactttgaatt

SEQ ID NO: 3744105 - DNA, 15 bp, Homo sapiens
tttacttttaaacag

SEQ ID NO: 3744106 - DNA, 18 bp, Homo sapiens
tttagaacagaaaacaac

SEQ ID NO: 3744107 - DNA, 22 bp, Homo sapiens
tttagaacagaaaacaacaaaa

SEQ ID NO: 3744108 - DNA, 22 bp, Homo sapiens
tttagaatgatgcacatttcat

SEQ ID NO: 3744109 - DNA, 15 bp, Homo sapiens
tttagaccatttatc

SEQ ID NO: 3744110 - DNA, 22 bp, Homo sapiens
tttagaccctattgctgcttga

SEQ ID NO: 3744111 - DNA, 21 bp, Homo sapiens
tttagagataagagttggctg

SEQ ID NO: 3744112 - DNA, 21 bp, Homo sapiens
tttagagatgaattaaattta

SEQ ID NO: 3744113 - DNA, 18 bp, Homo sapiens
tttagagtagcatgagag

SEQ ID NO: 3744114 - DNA, 20 bp, Homo sapiens
tttagatggttacactgtta

SEQ ID NO: 3744115 - DNA, 14 bp, Homo sapiens
tttagattgagtaa

SEQ ID NO: 3744116 - DNA, 14 bp, Homo sapiens
tttagcacaaaaaa

SEQ ID NO: 3744117 - DNA, 19 bp, Homo sapiens
tttagcacgtttaaagttc

SEQ ID NO: 3744118 - DNA, 22 bp, Homo sapiens
tttagcacgtttaaagttctgt

SEQ ID NO: 3744119 - DNA, 16 bp, Homo sapiens
tttagctgtatcaaac

SEQ ID NO: 3744120 - DNA, 22 bp, Homo sapiens
tttaggtcaagaagaagatgga

SEQ ID NO: 3744121 - DNA, 22 bp, Homo sapiens
tttaggtttttgtttgtttcct

SEQ ID NO: 3744122 - DNA, 16 bp, Homo sapiens
tttagtgtaaaaatga

SEQ ID NO: 3744123 - DNA, 11 bp, Homo sapiens
tttagttcttt

SEQ ID NO: 3744124 - DNA, 17 bp, Homo sapiens
tttagttgtatctcttt

SEQ ID NO: 3744125 - DNA, 17 bp, Homo sapiens
tttataaaaaaaatgaa

SEQ ID NO: 3744126 - DNA, 18 bp, Homo sapiens
tttataaaaaaaatgaaa

SEQ ID NO: 3744127 - DNA, 21 bp, Homo sapiens
tttataaaaaaaatgaaatgt

SEQ ID NO: 3744128 - DNA, 17 bp, Homo sapiens
tttataaaattaaagaa

SEQ ID NO: 3744129 - DNA, 15 bp, Homo sapiens
tttataaattaaata

SEQ ID NO: 3744130 - DNA, 17 bp, Homo sapiens
tttataaattaaatata

SEQ ID NO: 3744131 - DNA, 21 bp, Homo sapiens
tttatagaataatgtgggaag

SEQ ID NO: 3744132 - DNA, 17 bp, Homo sapiens
tttatataataaagtat

SEQ ID NO: 3744133 - DNA, 12 bp, Homo sapiens
tttatatattta

SEQ ID NO: 3744134 - DNA, 15 bp, Homo sapiens
tttatatatttataa

SEQ ID NO: 3744135 - DNA, 16 bp, Homo sapiens
tttatatatttataac

SEQ ID NO: 3744136 - DNA, 16 bp, Homo sapiens
tttatattagaagtgt

SEQ ID NO: 3744137 - DNA, 14 bp, Homo sapiens
tttatattttcaat

SEQ ID NO: 3744138 - DNA, 19 bp, Homo sapiens
tttatattttcaattcaaa

SEQ ID NO: 3744139 - DNA, 12 bp, Homo sapiens
tttatattttta

SEQ ID NO: 3744140 - DNA, 15 bp, Homo sapiens
tttatcacacttctg

SEQ ID NO: 3744141 - DNA, 12 bp, Homo sapiens
tttatcagcagt

SEQ ID NO: 3744142 - DNA, 16 bp, Homo sapiens
tttatcagcagttgtt

SEQ ID NO: 3744143 - DNA, 22 bp, Homo sapiens
tttatcagcagttgttattaca

SEQ ID NO: 3744144 - DNA, 15 bp, Homo sapiens
tttatccaatcttgt

SEQ ID NO: 3744145 - DNA, 17 bp, Homo sapiens
tttatcccacggaaaat

SEQ ID NO: 3744146 - DNA, 20 bp, Homo sapiens
tttatctattgtaagataaa

SEQ ID NO: 3744147 - DNA, 16 bp, Homo sapiens
tttatctgtagtaaac

SEQ ID NO: 3744148 - DNA, 15 bp, Homo sapiens
tttatcttttctaca

SEQ ID NO: 3744149 - DNA, 18 bp, Homo sapiens
tttatgaaaggtttacat

SEQ ID NO: 3744150 - DNA, 19 bp, Homo sapiens
tttatgaaaggtttacatt

SEQ ID NO: 3744151 - DNA, 12 bp, Homo sapiens
tttatgaagaaa

SEQ ID NO: 3744152 - DNA, 22 bp, Homo sapiens
tttatgaagaaaaaatacattt

SEQ ID NO: 3744153 - DNA, 12 bp, Homo sapiens
tttatgagccag

SEQ ID NO: 3744154 - DNA, 20 bp, Homo sapiens
tttatgagctcatgtagcaa

SEQ ID NO: 3744155 - DNA, 22 bp, Homo sapiens
tttatgatatttttttaagtct

SEQ ID NO: 3744156 - DNA, 14 bp, Homo sapiens
tttatgcaataaat

SEQ ID NO: 3744157 - DNA, 20 bp, Homo sapiens
tttatgccttttatttctta

SEQ ID NO: 3744158 - DNA, 22 bp, Homo sapiens
tttatggcctcagctgcctcac

SEQ ID NO: 3744159 - DNA, 22 bp, Homo sapiens
tttatggggctgaacggggaga

SEQ ID NO: 3744160 - DNA, 16 bp, Homo sapiens
tttatggtttctccag

SEQ ID NO: 3744161 - DNA, 16 bp, Homo sapiens
tttatgtatgtttaca

SEQ ID NO: 3744162 - DNA, 22 bp, Homo sapiens
tttatgtgtgaggagctgctgg

SEQ ID NO: 3744163 - DNA, 12 bp, Homo sapiens
tttatgttttgt

SEQ ID NO: 3744164 - DNA, 20 bp, Homo sapiens
tttatgttttgtttctgaaa

SEQ ID NO: 3744165 - DNA, 15 bp, Homo sapiens
tttattaaaatctta

SEQ ID NO: 3744166 - DNA, 18 bp, Homo sapiens
tttattaacaaattatgt

SEQ ID NO: 3744167 - DNA, 15 bp, Homo sapiens
tttattacccttctt

SEQ ID NO: 3744168 - DNA, 19 bp, Homo sapiens
tttattcaaggtaaaattc

SEQ ID NO: 3744169 - DNA, 17 bp, Homo sapiens
tttattcaattcctctg

SEQ ID NO: 3744170 - DNA, 13 bp, Homo sapiens
tttattcttgtga

SEQ ID NO: 3744171 - DNA, 14 bp, Homo sapiens
tttattgagaattt

SEQ ID NO: 3744172 - DNA, 18 bp, Homo sapiens
tttattgatgtgcaaaaa

SEQ ID NO: 3744173 - DNA, 19 bp, Homo sapiens
tttatttagttccttgagt

SEQ ID NO: 3744174 - DNA, 13 bp, Homo sapiens
tttatttcttaaa

SEQ ID NO: 3744175 - DNA, 15 bp, Homo sapiens
tttattttagcagtt

SEQ ID NO: 3744176 - DNA, 21 bp, Homo sapiens
tttattttatataataaagta

SEQ ID NO: 3744177 - DNA, 16 bp, Homo sapiens
tttattttcctcccca

SEQ ID NO: 3744178 - DNA, 20 bp, Homo sapiens
tttattttgttaaaatctct

SEQ ID NO: 3744179 - DNA, 14 bp, Homo sapiens
tttattttttaagt

SEQ ID NO: 3744180 - DNA, 20 bp, Homo sapiens
tttcaaaataaaaaccaaga

SEQ ID NO: 3744181 - DNA, 20 bp, Homo sapiens
tttcaaaccagtatacaaga

SEQ ID NO: 3744182 - DNA, 22 bp, Homo sapiens
tttcaaaccagtatacaagata

SEQ ID NO: 3744183 - DNA, 14 bp, Homo sapiens
tttcaaagaaggaa

SEQ ID NO: 3744184 - DNA, 17 bp, Homo sapiens
tttcaaagctttttcca

SEQ ID NO: 3744185 - DNA, 22 bp, Homo sapiens
tttcaagcctgcctaggaattc

SEQ ID NO: 3744186 - DNA, 18 bp, Homo sapiens
tttcaagggaattaaata

SEQ ID NO: 3744187 - DNA, 21 bp, Homo sapiens
tttcaataacgaagttgggca

SEQ ID NO: 3744188 - DNA, 22 bp, Homo sapiens
tttcaataacgaagttgggcaa

SEQ ID NO: 3744189 - DNA, 20 bp, Homo sapiens
tttcaattcaaaaatgtaca

SEQ ID NO: 3744190 - DNA, 16 bp, Homo sapiens
tttcacaaccttctgt

SEQ ID NO: 3744191 - DNA, 23 bp, Homo sapiens
tttcacacctgaaaatgttagtg

SEQ ID NO: 3744192 - DNA, 15 bp, Homo sapiens
tttcacagtttttcc

SEQ ID NO: 3744193 - DNA, 17 bp, Homo sapiens
tttcaccagatttgcta

SEQ ID NO: 3744194 - DNA, 16 bp, Homo sapiens
tttcacctactttgta

SEQ ID NO: 3744195 - DNA, 24 bp, Homo sapiens
tttcactcttattgcccacgctgg

SEQ ID NO: 3744196 - DNA, 17 bp, Homo sapiens
tttcactgctggctgcc

SEQ ID NO: 3744197 - DNA, 20 bp, Homo sapiens
tttcagaaatatgtggtttc

SEQ ID NO: 3744198 - DNA, 23 bp, Homo sapiens
tttcagaacctcttccccagaaa

SEQ ID NO: 3744199 - DNA, 14 bp, Homo sapiens
tttcagaatctgaa

SEQ ID NO: 3744200 - DNA, 20 bp, Homo sapiens
tttcagaatctgaatgtaat

SEQ ID NO: 3744201 - DNA, 11 bp, Homo sapiens
tttcagacagg

SEQ ID NO: 3744202 - DNA, 20 bp, Homo sapiens
tttcagacagggtctgaagg

SEQ ID NO: 3744203 - DNA, 14 bp, Homo sapiens
tttcagaccccagc

SEQ ID NO: 3744204 - DNA, 15 bp, Homo sapiens
tttcagatgctttag

SEQ ID NO: 3744205 - DNA, 14 bp, Homo sapiens
tttcagcagactat

SEQ ID NO: 3744206 - DNA, 22 bp, Homo sapiens
tttcaggaggctggaggaaggg

SEQ ID NO: 3744207 - DNA, 18 bp, Homo sapiens
tttcagtaataaaacatc

SEQ ID NO: 3744208 - DNA, 17 bp, Homo sapiens
tttcagtgaaagcatca

SEQ ID NO: 3744209 - DNA, 16 bp, Homo sapiens
tttcatctatttctga

SEQ ID NO: 3744210 - DNA, 19 bp, Homo sapiens
tttcatgggggtattatcc

SEQ ID NO: 3744211 - DNA, 18 bp, Homo sapiens
tttcattgccagtgtctt

SEQ ID NO: 3744212 - DNA, 12 bp, Homo sapiens
tttccaagcaaa

SEQ ID NO: 3744213 - DNA, 14 bp, Homo sapiens
tttccaagcaaatg

SEQ ID NO: 3744214 - DNA, 19 bp, Homo sapiens
tttccacaaaatctgtcca

SEQ ID NO: 3744215 - DNA, 20 bp, Homo sapiens
tttccacaagattcccagag

SEQ ID NO: 3744216 - DNA, 22 bp, Homo sapiens
tttccacaagattcccagagac

SEQ ID NO: 3744217 - DNA, 22 bp, Homo sapiens
tttccaccccctccctggcctg

SEQ ID NO: 3744218 - DNA, 19 bp, Homo sapiens
tttccacgatgaaaaactt

SEQ ID NO: 3744219 - DNA, 15 bp, Homo sapiens
tttccataaggaatg

SEQ ID NO: 3744220 - DNA, 23 bp, Homo sapiens
tttccatcattaaatttttcctt

SEQ ID NO: 3744221 - DNA, 17 bp, Homo sapiens
tttccatgaaaatgcaa

SEQ ID NO: 3744222 - DNA, 20 bp, Homo sapiens
tttccatgactgcattttac

SEQ ID NO: 3744223 - DNA, 23 bp, Homo sapiens
tttccatgcaccctcatacacag

SEQ ID NO: 3744224 - DNA, 21 bp, Homo sapiens
tttccattatttatattagtt

SEQ ID NO: 3744225 - DNA, 21 bp, Homo sapiens
tttccattggtttacctgtga

SEQ ID NO: 3744226 - DNA, 14 bp, Homo sapiens
tttcctaaaagttc

SEQ ID NO: 3744227 - DNA, 15 bp, Homo sapiens
tttcctaaatgcagt

SEQ ID NO: 3744228 - DNA, 13 bp, Homo sapiens
tttcctaaatgta

SEQ ID NO: 3744229 - DNA, 24 bp, Homo sapiens
tttcctactctcaggatcaagaaa

SEQ ID NO: 3744230 - DNA, 20 bp, Homo sapiens
tttcctacttttccttccct

SEQ ID NO: 3744231 - DNA, 19 bp, Homo sapiens
tttcctcattcctgaaaga

SEQ ID NO: 3744232 - DNA, 14 bp, Homo sapiens
tttcctccccagca

SEQ ID NO: 3744233 - DNA, 22 bp, Homo sapiens
tttcctcttagtcgagccaagt

SEQ ID NO: 3744234 - DNA, 23 bp, Homo sapiens
tttcctgacagaaggactcaggt

SEQ ID NO: 3744235 - DNA, 12 bp, Homo sapiens
tttcctgtgtct

SEQ ID NO: 3744236 - DNA, 13 bp, Homo sapiens
tttcctgttcagc

SEQ ID NO: 3744237 - DNA, 21 bp, Homo sapiens
tttcctgtttttgttaacttt

SEQ ID NO: 3744238 - DNA, 14 bp, Homo sapiens
tttccttccatccc

SEQ ID NO: 3744239 - DNA, 15 bp, Homo sapiens
tttccttccatccct

SEQ ID NO: 3744240 - DNA, 16 bp, Homo sapiens
tttccttccctcaaag

SEQ ID NO: 3744241 - DNA, 18 bp, Homo sapiens
tttccttccttccctggc

SEQ ID NO: 3744242 - DNA, 18 bp, Homo sapiens
tttccttggggcaggcag

SEQ ID NO: 3744243 - DNA, 19 bp, Homo sapiens
tttccttggggcaggcagt

SEQ ID NO: 3744244 - DNA, 17 bp, Homo sapiens
tttccttttttgttatt

SEQ ID NO: 3744245 - DNA, 18 bp, Homo sapiens
tttcgcaggattcttcct

SEQ ID NO: 3744246 - DNA, 22 bp, Homo sapiens
tttcgcaggattcttcctccct

SEQ ID NO: 3744247 - DNA, 19 bp, Homo sapiens
tttcgttaacattgaccaa

SEQ ID NO: 3744248 - DNA, 13 bp, Homo sapiens
tttctaaatgttt

SEQ ID NO: 3744249 - DNA, 21 bp, Homo sapiens
tttctaactctgatgtaaatg

SEQ ID NO: 3744250 - DNA, 22 bp, Homo sapiens
tttctaactctgatgtaaatga

SEQ ID NO: 3744251 - DNA, 20 bp, Homo sapiens
tttctacactgtattacata

SEQ ID NO: 3744252 - DNA, 14 bp, Homo sapiens
tttctacagcaaat

SEQ ID NO: 3744253 - DNA, 15 bp, Homo sapiens
tttctacagcaaatt

SEQ ID NO: 3744254 - DNA, 17 bp, Homo sapiens
tttctacagcaaattta

SEQ ID NO: 3744255 - DNA, 21 bp, Homo sapiens
tttctagctgttgagctgttt

SEQ ID NO: 3744256 - DNA, 13 bp, Homo sapiens
tttctccccctgg

SEQ ID NO: 3744257 - DNA, 19 bp, Homo sapiens
tttctccttagtcttctca

SEQ ID NO: 3744258 - DNA, 22 bp, Homo sapiens
tttctctacagatgtcccattt

SEQ ID NO: 3744259 - DNA, 22 bp, Homo sapiens
tttctctctatttgtattgtta

SEQ ID NO: 3744260 - DNA, 14 bp, Homo sapiens
tttctctgcttcag

SEQ ID NO: 3744261 - DNA, 21 bp, Homo sapiens
tttctcttgggctgagactgg

SEQ ID NO: 3744262 - DNA, 19 bp, Homo sapiens
tttctgaaactaatgaaag

SEQ ID NO: 3744263 - DNA, 19 bp, Homo sapiens
tttctgagaaggtccttaa

SEQ ID NO: 3744264 - DNA, 18 bp, Homo sapiens
tttctgaggagaaacaaa

SEQ ID NO: 3744265 - DNA, 23 bp, Homo sapiens
tttctgatctgatgcaagcaaga

SEQ ID NO: 3744266 - DNA, 15 bp, Homo sapiens
tttctggtagataga

SEQ ID NO: 3744267 - DNA, 17 bp, Homo sapiens
tttcttaaaaagttata

SEQ ID NO: 3744268 - DNA, 15 bp, Homo sapiens
tttcttaaatgggct

SEQ ID NO: 3744269 - DNA, 16 bp, Homo sapiens
tttcttcatgcaatga

SEQ ID NO: 3744270 - DNA, 19 bp, Homo sapiens
tttcttcatgcaatgacat

SEQ ID NO: 3744271 - DNA, 14 bp, Homo sapiens
tttcttcccatcac

SEQ ID NO: 3744272 - DNA, 11 bp, Homo sapiens
tttcttcctct

SEQ ID NO: 3744273 - DNA, 23 bp, Homo sapiens
tttcttgtttatcagcagttgtt

SEQ ID NO: 3744274 - DNA, 15 bp, Homo sapiens
tttctttaaattttg

SEQ ID NO: 3744275 - DNA, 17 bp, Homo sapiens
tttctttggtgcctttc

SEQ ID NO: 3744276 - DNA, 19 bp, Homo sapiens
tttctttggtgcctttcct

SEQ ID NO: 3744277 - DNA, 22 bp, Homo sapiens
tttcttttgcccttcacagtgt

SEQ ID NO: 3744278 - DNA, 19 bp, Homo sapiens
tttgaaaaattacagcttc

SEQ ID NO: 3744279 - DNA, 23 bp, Homo sapiens
tttgaaaactacattttaacatg

SEQ ID NO: 3744280 - DNA, 20 bp, Homo sapiens
tttgaaaaggcggtactagt

SEQ ID NO: 3744281 - DNA, 22 bp, Homo sapiens
tttgaacaactaggcttcagca

SEQ ID NO: 3744282 - DNA, 16 bp, Homo sapiens
tttgaaccaaaacatt

SEQ ID NO: 3744283 - DNA, 14 bp, Homo sapiens
tttgaactcttcaa

SEQ ID NO: 3744284 - DNA, 19 bp, Homo sapiens
tttgaatataaacactata

SEQ ID NO: 3744285 - DNA, 24 bp, Homo sapiens
tttgaatgaaaaatttaagcattg

SEQ ID NO: 3744286 - DNA, 16 bp, Homo sapiens
tttgaatgcttcctga

SEQ ID NO: 3744287 - DNA, 15 bp, Homo sapiens
tttgacaacaaatta

SEQ ID NO: 3744288 - DNA, 18 bp, Homo sapiens
tttgacagtgttgaaaat

SEQ ID NO: 3744289 - DNA, 12 bp, Homo sapiens
tttgactctttt

SEQ ID NO: 3744290 - DNA, 23 bp, Homo sapiens
tttgagacctgaatagctcccag

SEQ ID NO: 3744291 - DNA, 16 bp, Homo sapiens
tttgagatcagcctgg

SEQ ID NO: 3744292 - DNA, 17 bp, Homo sapiens
tttgagatcagcctggg

SEQ ID NO: 3744293 - DNA, 19 bp, Homo sapiens
tttgagcttagtgaaatta

SEQ ID NO: 3744294 - DNA, 16 bp, Homo sapiens
tttgatacatatgtga

SEQ ID NO: 3744295 - DNA, 19 bp, Homo sapiens
tttgatacatatgtgaata

SEQ ID NO: 3744296 - DNA, 17 bp, Homo sapiens
tttgatgtttgtggcct

SEQ ID NO: 3744297 - DNA, 19 bp, Homo sapiens
tttgatgtttgtggcctca

SEQ ID NO: 3744298 - DNA, 15 bp, Homo sapiens
tttgattatgactgt

SEQ ID NO: 3744299 - DNA, 17 bp, Homo sapiens
tttgatttagattgagt

SEQ ID NO: 3744300 - DNA, 13 bp, Homo sapiens
tttgatttcaggt

SEQ ID NO: 3744301 - DNA, 12 bp, Homo sapiens
tttgcaaggaag

SEQ ID NO: 3744302 - DNA, 12 bp, Homo sapiens
tttgcacagctc

SEQ ID NO: 3744303 - DNA, 19 bp, Homo sapiens
tttgcagaaaagcacctgc

SEQ ID NO: 3744304 - DNA, 22 bp, Homo sapiens
tttgcagaaaagcacctgccga

SEQ ID NO: 3744305 - DNA, 21 bp, Homo sapiens
tttgcagcagtgagtctcttc

SEQ ID NO: 3744306 - DNA, 12 bp, Homo sapiens
tttgcaggctca

SEQ ID NO: 3744307 - DNA, 21 bp, Homo sapiens
tttgcagtagagtcatctcca

SEQ ID NO: 3744308 - DNA, 19 bp, Homo sapiens
tttgccaaaataatgtctt

SEQ ID NO: 3744309 - DNA, 15 bp, Homo sapiens
tttgccagtgggaac

SEQ ID NO: 3744310 - DNA, 22 bp, Homo sapiens
tttgccatgttggccaggctgg

SEQ ID NO: 3744311 - DNA, 16 bp, Homo sapiens
tttgcccaacctcagc

SEQ ID NO: 3744312 - DNA, 22 bp, Homo sapiens
tttgcctaatacattaaagcag

SEQ ID NO: 3744313 - DNA, 14 bp, Homo sapiens
tttgcctgagggcg

SEQ ID NO: 3744314 - DNA, 13 bp, Homo sapiens
tttgctattgaca

SEQ ID NO: 3744315 - DNA, 20 bp, Homo sapiens
tttgctattgacaagtcatt

SEQ ID NO: 3744316 - DNA, 17 bp, Homo sapiens
tttgctcagaacacatt

SEQ ID NO: 3744317 - DNA, 19 bp, Homo sapiens
tttgcttattgttccaaga

SEQ ID NO: 3744318 - DNA, 22 bp, Homo sapiens
tttgcttcttcccttaaaattt

SEQ ID NO: 3744319 - DNA, 17 bp, Homo sapiens
tttgcttgaacacagta

SEQ ID NO: 3744320 - DNA, 14 bp, Homo sapiens
tttggaatctagaa

SEQ ID NO: 3744321 - DNA, 16 bp, Homo sapiens
tttggaatctagaaga

SEQ ID NO: 3744322 - DNA, 18 bp, Homo sapiens
tttggaatctagaagaaa

SEQ ID NO: 3744323 - DNA, 22 bp, Homo sapiens
tttggaatcttctctttgacaa

SEQ ID NO: 3744324 - DNA, 20 bp, Homo sapiens
tttggatataggtcagtgag

SEQ ID NO: 3744325 - DNA, 20 bp, Homo sapiens
tttggcccccgagctggggg

SEQ ID NO: 3744326 - DNA, 21 bp, Homo sapiens
tttggcccccgagctgggggc

SEQ ID NO: 3744327 - DNA, 22 bp, Homo sapiens
tttgggaggccaaggtgggagg

SEQ ID NO: 3744328 - DNA, 17 bp, Homo sapiens
tttgggaggctgaggtg

SEQ ID NO: 3744329 - DNA, 14 bp, Homo sapiens
tttgggctgccctg

SEQ ID NO: 3744330 - DNA, 20 bp, Homo sapiens
tttggtaaaatacttcttga

SEQ ID NO: 3744331 - DNA, 15 bp, Homo sapiens
tttggtctcttgctt

SEQ ID NO: 3744332 - DNA, 12 bp, Homo sapiens
tttggtgccttt

SEQ ID NO: 3744333 - DNA, 18 bp, Homo sapiens
tttggtgcctttcctgtt

SEQ ID NO: 3744334 - DNA, 17 bp, Homo sapiens
tttggtggatgtaaata

SEQ ID NO: 3744335 - DNA, 13 bp, Homo sapiens
tttggttctaata

SEQ ID NO: 3744336 - DNA, 14 bp, Homo sapiens
tttgtaaataagag

SEQ ID NO: 3744337 - DNA, 23 bp, Homo sapiens
tttgtaatgtcaccaccttccca

SEQ ID NO: 3744338 - DNA, 15 bp, Homo sapiens
tttgtaattttcttg

SEQ ID NO: 3744339 - DNA, 14 bp, Homo sapiens
tttgtactgaaaaa

SEQ ID NO: 3744340 - DNA, 12 bp, Homo sapiens
tttgtatattgt

SEQ ID NO: 3744341 - DNA, 14 bp, Homo sapiens
tttgtatcttgatg

SEQ ID NO: 3744342 - DNA, 13 bp, Homo sapiens
tttgtatgatatt

SEQ ID NO: 3744343 - DNA, 22 bp, Homo sapiens
tttgtatgttgtgaagatgttt

SEQ ID NO: 3744344 - DNA, 23 bp, Homo sapiens
tttgtattttatttttttctctc

SEQ ID NO: 3744345 - DNA, 21 bp, Homo sapiens
tttgtctacgtttagtttccg

SEQ ID NO: 3744346 - DNA, 23 bp, Homo sapiens
tttgtcttaaaaagtggaaaaat

SEQ ID NO: 3744347 - DNA, 22 bp, Homo sapiens
tttgtgaaatgatggtgaaagt

SEQ ID NO: 3744348 - DNA, 16 bp, Homo sapiens
tttgtgattttacatt

SEQ ID NO: 3744349 - DNA, 12 bp, Homo sapiens
tttgtggcctca

SEQ ID NO: 3744350 - DNA, 15 bp, Homo sapiens
tttgtggcctcagaa

SEQ ID NO: 3744351 - DNA, 14 bp, Homo sapiens
tttgtgtaacatat

SEQ ID NO: 3744352 - DNA, 20 bp, Homo sapiens
tttgtgttgttggaaaaagt

SEQ ID NO: 3744353 - DNA, 14 bp, Homo sapiens
tttgtgttgtttga

SEQ ID NO: 3744354 - DNA, 16 bp, Homo sapiens
tttgttaactttgggt

SEQ ID NO: 3744355 - DNA, 17 bp, Homo sapiens
tttgttgtaaagagttg

SEQ ID NO: 3744356 - DNA, 14 bp, Homo sapiens
tttgtttcctttgt

SEQ ID NO: 3744357 - DNA, 16 bp, Homo sapiens
tttgtttctgaaaatt

SEQ ID NO: 3744358 - DNA, 13 bp, Homo sapiens
tttgtttgtgcat

SEQ ID NO: 3744359 - DNA, 11 bp, Homo sapiens
tttgtttgttt

SEQ ID NO: 3744360 - DNA, 14 bp, Homo sapiens
tttgtttgttttgt

SEQ ID NO: 3744361 - DNA, 23 bp, Homo sapiens
tttgttttttaaagtcttgctgt

SEQ ID NO: 3744362 - DNA, 18 bp, Homo sapiens
ttttaaaaaactgctgac

SEQ ID NO: 3744363 - DNA, 21 bp, Homo sapiens
ttttaaaaaactgctgactgt

SEQ ID NO: 3744364 - DNA, 19 bp, Homo sapiens
ttttaaaatcactaacatt

SEQ ID NO: 3744365 - DNA, 16 bp, Homo sapiens
ttttaaagtatatatt

SEQ ID NO: 3744366 - DNA, 21 bp, Homo sapiens
ttttaaagtcttgctgtggtc

SEQ ID NO: 3744367 - DNA, 15 bp, Homo sapiens
ttttaaataaaagca

SEQ ID NO: 3744368 - DNA, 18 bp, Homo sapiens
ttttaaatcctgttgaaa

SEQ ID NO: 3744369 - DNA, 21 bp, Homo sapiens
ttttaaattataacttaaaat

SEQ ID NO: 3744370 - DNA, 16 bp, Homo sapiens
ttttaaattataagga

SEQ ID NO: 3744371 - DNA, 21 bp, Homo sapiens
ttttaaattataaggactgca

SEQ ID NO: 3744372 - DNA, 21 bp, Homo sapiens
ttttaacaataactactgtgt

SEQ ID NO: 3744373 - DNA, 16 bp, Homo sapiens
ttttaagcattactct

SEQ ID NO: 3744374 - DNA, 14 bp, Homo sapiens
ttttaaggcttcaa

SEQ ID NO: 3744375 - DNA, 18 bp, Homo sapiens
ttttaagtatttatatat

SEQ ID NO: 3744376 - DNA, 19 bp, Homo sapiens
ttttaagtatttatatatt

SEQ ID NO: 3744377 - DNA, 23 bp, Homo sapiens
ttttaattattatttatatatgt

SEQ ID NO: 3744378 - DNA, 23 bp, Homo sapiens
ttttaatttatgagtttttgata

SEQ ID NO: 3744379 - DNA, 15 bp, Homo sapiens
ttttaatttgatgaa

SEQ ID NO: 3744380 - DNA, 21 bp, Homo sapiens
ttttaattttgtaaaggtgaa

SEQ ID NO: 3744381 - DNA, 14 bp, Homo sapiens
ttttacaattgaaa

SEQ ID NO: 3744382 - DNA, 16 bp, Homo sapiens
ttttacaattgaaatg

SEQ ID NO: 3744383 - DNA, 16 bp, Homo sapiens
ttttacatactgctgt

SEQ ID NO: 3744384 - DNA, 21 bp, Homo sapiens
ttttaccaagttatataaaga

SEQ ID NO: 3744385 - DNA, 18 bp, Homo sapiens
ttttacctaccacagtgt

SEQ ID NO: 3744386 - DNA, 15 bp, Homo sapiens
ttttactgcttttaa

SEQ ID NO: 3744387 - DNA, 14 bp, Homo sapiens
ttttagaacagaaa

SEQ ID NO: 3744388 - DNA, 22 bp, Homo sapiens
ttttagacaaatctaagggaaa

SEQ ID NO: 3744389 - DNA, 20 bp, Homo sapiens
ttttagcagttctgcaaata

SEQ ID NO: 3744390 - DNA, 11 bp, Homo sapiens
ttttagcatgt

SEQ ID NO: 3744391 - DNA, 19 bp, Homo sapiens
ttttagcctagttcatcca

SEQ ID NO: 3744392 - DNA, 21 bp, Homo sapiens
ttttagtacccacctgagctt

SEQ ID NO: 3744393 - DNA, 16 bp, Homo sapiens
ttttagtcattttgct

SEQ ID NO: 3744394 - DNA, 15 bp, Homo sapiens
ttttataaattaaat

SEQ ID NO: 3744395 - DNA, 14 bp, Homo sapiens
ttttatacagtagt

SEQ ID NO: 3744396 - DNA, 17 bp, Homo sapiens
ttttatacagtagtgag

SEQ ID NO: 3744397 - DNA, 21 bp, Homo sapiens
ttttatgagctcatgtagcaa

SEQ ID NO: 3744398 - DNA, 22 bp, Homo sapiens
ttttatgagctcatgtagcaat

SEQ ID NO: 3744399 - DNA, 21 bp, Homo sapiens
ttttatgaggagtgaacattt

SEQ ID NO: 3744400 - DNA, 18 bp, Homo sapiens
ttttatgtgagagaaagt

SEQ ID NO: 3744401 - DNA, 12 bp, Homo sapiens
ttttattatgct

SEQ ID NO: 3744402 - DNA, 21 bp, Homo sapiens
ttttattatgctgtattttct

SEQ ID NO: 3744403 - DNA, 17 bp, Homo sapiens
ttttcaaaataaaaatg

SEQ ID NO: 3744404 - DNA, 21 bp, Homo sapiens
ttttcaaaccagtatacaaga

SEQ ID NO: 3744405 - DNA, 22 bp, Homo sapiens
ttttcaaaccagtatacaagat

SEQ ID NO: 3744406 - DNA, 17 bp, Homo sapiens
ttttcaacgcagccctg

SEQ ID NO: 3744407 - DNA, 21 bp, Homo sapiens
ttttcaagcatctcctgagga

SEQ ID NO: 3744408 - DNA, 14 bp, Homo sapiens
ttttcaatatttat

SEQ ID NO: 3744409 - DNA, 16 bp, Homo sapiens
ttttcaatatttatta

SEQ ID NO: 3744410 - DNA, 23 bp, Homo sapiens
ttttcacacaatacaataagtta

SEQ ID NO: 3744411 - DNA, 13 bp, Homo sapiens
ttttcaccccacc

SEQ ID NO: 3744412 - DNA, 19 bp, Homo sapiens
ttttcactgctggctgcct

SEQ ID NO: 3744413 - DNA, 16 bp, Homo sapiens
ttttcactgtagaatg

SEQ ID NO: 3744414 - DNA, 18 bp, Homo sapiens
ttttcagaacctcttccc

SEQ ID NO: 3744415 - DNA, 13 bp, Homo sapiens
ttttcagaatctg

SEQ ID NO: 3744416 - DNA, 16 bp, Homo sapiens
ttttcagaatctgaat

SEQ ID NO: 3744417 - DNA, 21 bp, Homo sapiens
ttttcagaatctgaatgtaat

SEQ ID NO: 3744418 - DNA, 22 bp, Homo sapiens
ttttcagaatctgaatgtaatt

SEQ ID NO: 3744419 - DNA, 16 bp, Homo sapiens
ttttcagactcagact

SEQ ID NO: 3744420 - DNA, 14 bp, Homo sapiens
ttttcagactgctt

SEQ ID NO: 3744421 - DNA, 18 bp, Homo sapiens
ttttcagactgctttaaa

SEQ ID NO: 3744422 - DNA, 23 bp, Homo sapiens
ttttcagtagggctacaaaacct

SEQ ID NO: 3744423 - DNA, 14 bp, Homo sapiens
ttttcagtgtacat

SEQ ID NO: 3744424 - DNA, 21 bp, Homo sapiens
ttttcatcttctctggcgaca

SEQ ID NO: 3744425 - DNA, 14 bp, Homo sapiens
ttttcatgtgtgat

SEQ ID NO: 3744426 - DNA, 15 bp, Homo sapiens
ttttccactactgct

SEQ ID NO: 3744427 - DNA, 16 bp, Homo sapiens
ttttccatcataattc

SEQ ID NO: 3744428 - DNA, 14 bp, Homo sapiens
ttttccatgaaaac

SEQ ID NO: 3744429 - DNA, 18 bp, Homo sapiens
ttttccatgaaaatgcaa

SEQ ID NO: 3744430 - DNA, 16 bp, Homo sapiens
ttttccattggtttac

SEQ ID NO: 3744431 - DNA, 21 bp, Homo sapiens
ttttcccaatagcactttcat

SEQ ID NO: 3744432 - DNA, 16 bp, Homo sapiens
ttttcccccaaagtgg

SEQ ID NO: 3744433 - DNA, 19 bp, Homo sapiens
ttttccccccactctcccc

SEQ ID NO: 3744434 - DNA, 19 bp, Homo sapiens
ttttccccggtcccttgag

SEQ ID NO: 3744435 - DNA, 23 bp, Homo sapiens
ttttccccggtcccttgagacct

SEQ ID NO: 3744436 - DNA, 13 bp, Homo sapiens
ttttcctccctca

SEQ ID NO: 3744437 - DNA, 19 bp, Homo sapiens
ttttcctccgggagagggg

SEQ ID NO: 3744438 - DNA, 18 bp, Homo sapiens
ttttcctcttctattttg

SEQ ID NO: 3744439 - DNA, 16 bp, Homo sapiens
ttttctacaagtattc

SEQ ID NO: 3744440 - DNA, 17 bp, Homo sapiens
ttttctacagcaaattt

SEQ ID NO: 3744441 - DNA, 17 bp, Homo sapiens
ttttctctaactcagaa

SEQ ID NO: 3744442 - DNA, 17 bp, Homo sapiens
ttttctggaatacatga

SEQ ID NO: 3744443 - DNA, 21 bp, Homo sapiens
ttttctggaatacatgaaata

SEQ ID NO: 3744444 - DNA, 19 bp, Homo sapiens
ttttctggtagatagaaat

SEQ ID NO: 3744445 - DNA, 11 bp, Homo sapiens
ttttcttcctt

SEQ ID NO: 3744446 - DNA, 12 bp, Homo sapiens
ttttgaaaaggc

SEQ ID NO: 3744447 - DNA, 22 bp, Homo sapiens
ttttgaatgcttcctgacaatc

SEQ ID NO: 3744448 - DNA, 17 bp, Homo sapiens
ttttgacttaaagcaga

SEQ ID NO: 3744449 - DNA, 14 bp, Homo sapiens
ttttgatttcaggt

SEQ ID NO: 3744450 - DNA, 13 bp, Homo sapiens
ttttgcaaaattt

SEQ ID NO: 3744451 - DNA, 15 bp, Homo sapiens
ttttgccattaaact

SEQ ID NO: 3744452 - DNA, 17 bp, Homo sapiens
ttttggaatctagaaga

SEQ ID NO: 3744453 - DNA, 20 bp, Homo sapiens
ttttggattgacagtaactt

SEQ ID NO: 3744454 - DNA, 12 bp, Homo sapiens
ttttgggatgtc

SEQ ID NO: 3744455 - DNA, 14 bp, Homo sapiens
ttttgggatgtctt

SEQ ID NO: 3744456 - DNA, 21 bp, Homo sapiens
ttttggtccaagttgtgctta

SEQ ID NO: 3744457 - DNA, 18 bp, Homo sapiens
ttttggtggatgtaaata

SEQ ID NO: 3744458 - DNA, 22 bp, Homo sapiens
ttttggttaagttggcttctgt

SEQ ID NO: 3744459 - DNA, 17 bp, Homo sapiens
ttttgtatagtaaagtg

SEQ ID NO: 3744460 - DNA, 23 bp, Homo sapiens
tttttaaaaatcataaactgtgt

SEQ ID NO: 3744461 - DNA, 18 bp, Homo sapiens
tttttaaagttactttgt

SEQ ID NO: 3744462 - DNA, 18 bp, Homo sapiens
tttttaagctgtttccat

SEQ ID NO: 3744463 - DNA, 16 bp, Homo sapiens
tttttaagtatttata

SEQ ID NO: 3744464 - DNA, 12 bp, Homo sapiens
tttttaattatt

SEQ ID NO: 3744465 - DNA, 12 bp, Homo sapiens
tttttatacagt

SEQ ID NO: 3744466 - DNA, 18 bp, Homo sapiens
tttttatatagcttgaaa

SEQ ID NO: 3744467 - DNA, 21 bp, Homo sapiens
tttttatcttttctacagcaa

SEQ ID NO: 3744468 - DNA, 14 bp, Homo sapiens
tttttattcttgtg

SEQ ID NO: 3744469 - DNA, 12 bp, Homo sapiens
tttttattgatg

SEQ ID NO: 3744470 - DNA, 13 bp, Homo sapiens
tttttattgatgt

SEQ ID NO: 3744471 - DNA, 18 bp, Homo sapiens
tttttattgatgtgcaaa

SEQ ID NO: 3744472 - DNA, 16 bp, Homo sapiens
tttttcaatatttatt

SEQ ID NO: 3744473 - DNA, 10 bp, Homo sapiens
tttttccctt

SEQ ID NO: 3744474 - DNA, 17 bp, Homo sapiens
tttttctttataaactt

SEQ ID NO: 3744475 - DNA, 17 bp, Homo sapiens
tttttggtggatgtaaa

SEQ ID NO: 3744476 - DNA, 13 bp, Homo sapiens
tttttgtaattta

SEQ ID NO: 3744477 - DNA, 22 bp, Homo sapiens
tttttgtgttttgttctttaaa

SEQ ID NO: 3744478 - DNA, 22 bp, Homo sapiens
tttttgttccacaagttaaata

SEQ ID NO: 3744479 - DNA, 23 bp, Homo sapiens
ttttttacaaattggagcaggga

SEQ ID NO: 3744480 - DNA, 13 bp, Homo sapiens
ttttttatgctaa

SEQ ID NO: 3744481 - DNA, 18 bp, Homo sapiens
ttttttcaatatttatta

SEQ ID NO: 3744482 - DNA, 12 bp, Homo sapiens
ttttttcatctt

SEQ ID NO: 3744483 - DNA, 12 bp, Homo sapiens
ttttttgaaaac

SEQ ID NO: 3744484 - DNA, 15 bp, Homo sapiens
ttgtaatgttactga

SEQ ID NO: 3744485 - DNA, 15 bp, Homo sapiens
ttgtaattttcttga

SEQ ID NO: 3744486 - DNA, 23 bp, Homo sapiens
ttgtaattttcttgatgactgga

SEQ ID NO: 3744487 - DNA, 14 bp, Homo sapiens
ttgtacaaaataaa

SEQ ID NO: 3744488 - DNA, 19 bp, Homo sapiens
ttgtacagaatcattgctt

SEQ ID NO: 3744489 - DNA, 18 bp, Homo sapiens
ttgtacagacgtatgctt

SEQ ID NO: 3744490 - DNA, 19 bp, Homo sapiens
ttgtacagacgtatgctta

SEQ ID NO: 3744491 - DNA, 16 bp, Homo sapiens
ttgtacgtttaaagtg

SEQ ID NO: 3744492 - DNA, 14 bp, Homo sapiens
ttgtagagccaggg

SEQ ID NO: 3744493 - DNA, 13 bp, Homo sapiens
ttgtagggtttct

SEQ ID NO: 3744494 - DNA, 20 bp, Homo sapiens
ttgtaggtacttttggaatc

SEQ ID NO: 3744495 - DNA, 22 bp, Homo sapiens
ttgtaggtacttttggaatcta

SEQ ID NO: 3744496 - DNA, 14 bp, Homo sapiens
ttgtatagtaaagt

SEQ ID NO: 3744497 - DNA, 20 bp, Homo sapiens
ttgtatattatggaagattt

SEQ ID NO: 3744498 - DNA, 21 bp, Homo sapiens
ttgtatattatggaagatttt

SEQ ID NO: 3744499 - DNA, 18 bp, Homo sapiens
ttgtatctagtgcagctg

SEQ ID NO: 3744500 - DNA, 22 bp, Homo sapiens
ttgtatgaaagatggctgtgcc

SEQ ID NO: 3744501 - DNA, 14 bp, Homo sapiens
ttgtattaaagaca

SEQ ID NO: 3744502 - DNA, 14 bp, Homo sapiens
ttgtattttagtat

SEQ ID NO: 3744503 - DNA, 14 bp, Homo sapiens
ttgtcacaataaat

SEQ ID NO: 3744504 - DNA, 20 bp, Homo sapiens
ttgtcacagaaatcagagga

SEQ ID NO: 3744505 - DNA, 18 bp, Homo sapiens
ttgtcagactttaaagaa

SEQ ID NO: 3744506 - DNA, 18 bp, Homo sapiens
ttgtcagatatgatatgt

SEQ ID NO: 3744507 - DNA, 21 bp, Homo sapiens
ttgtcattttgaagctaatta

SEQ ID NO: 3744508 - DNA, 13 bp, Homo sapiens
ttgtcccacagct

SEQ ID NO: 3744509 - DNA, 23 bp, Homo sapiens
ttgtcccatttctaaaggcctct

SEQ ID NO: 3744510 - DNA, 20 bp, Homo sapiens
ttgtccggtggaaggccttc

SEQ ID NO: 3744511 - DNA, 21 bp, Homo sapiens
ttgtccggtggaaggccttct

SEQ ID NO: 3744512 - DNA, 21 bp, Homo sapiens
ttgtctgaagtcactgcacag

SEQ ID NO: 3744513 - DNA, 13 bp, Homo sapiens
ttgtcttaaataa

SEQ ID NO: 3744514 - DNA, 19 bp, Homo sapiens
ttgtctttatatgaacata

SEQ ID NO: 3744515 - DNA, 17 bp, Homo sapiens
ttgtgaaatgaaaacat

SEQ ID NO: 3744516 - DNA, 23 bp, Homo sapiens
ttgtgaaatgaaaacatgtaata

SEQ ID NO: 3744517 - DNA, 14 bp, Homo sapiens
ttgtgaagtacata

SEQ ID NO: 3744518 - DNA, 23 bp, Homo sapiens
ttgtgaatatgtacataggcagc

SEQ ID NO: 3744519 - DNA, 18 bp, Homo sapiens
ttgtgaattgataataaa

SEQ ID NO: 3744520 - DNA, 17 bp, Homo sapiens
ttgtgacccaattaagt

SEQ ID NO: 3744521 - DNA, 16 bp, Homo sapiens
ttgtgactagtgctga

SEQ ID NO: 3744522 - DNA, 21 bp, Homo sapiens
ttgtgactagtgctgaagctt

SEQ ID NO: 3744523 - DNA, 23 bp, Homo sapiens
ttgtgactagtgctgaagcttat

SEQ ID NO: 3744524 - DNA, 18 bp, Homo sapiens
ttgtgagccaccacgtcc

SEQ ID NO: 3744525 - DNA, 23 bp, Homo sapiens
ttgtgatcagaccataatgttac

SEQ ID NO: 3744526 - DNA, 22 bp, Homo sapiens
ttgtgatgtcccaacttgtaaa

SEQ ID NO: 3744527 - DNA, 23 bp, Homo sapiens
ttgtgctacatgacgacaaagct

SEQ ID NO: 3744528 - DNA, 21 bp, Homo sapiens
ttgtggaattgggagcttggg

SEQ ID NO: 3744529 - DNA, 16 bp, Homo sapiens
ttgtggacacagctct

SEQ ID NO: 3744530 - DNA, 14 bp, Homo sapiens
ttgtggctgggggc

SEQ ID NO: 3744531 - DNA, 20 bp, Homo sapiens
ttgtggctgtcagcaggaag

SEQ ID NO: 3744532 - DNA, 22 bp, Homo sapiens
ttgtgtaagagaatgttgaata

SEQ ID NO: 3744533 - DNA, 14 bp, Homo sapiens
ttgtgtaataaagt

SEQ ID NO: 3744534 - DNA, 17 bp, Homo sapiens
ttgtgtaataaagtgtt

SEQ ID NO: 3744535 - DNA, 19 bp, Homo sapiens
ttgtgtaataaagtgtttt

SEQ ID NO: 3744536 - DNA, 21 bp, Homo sapiens
ttgtgtaataaagtgttttca

SEQ ID NO: 3744537 - DNA, 15 bp, Homo sapiens
ttgtgtgttatttaa

SEQ ID NO: 3744538 - DNA, 20 bp, Homo sapiens
ttgtgtgttatttaaatgag

SEQ ID NO: 3744539 - DNA, 13 bp, Homo sapiens
ttgtgttctaata

SEQ ID NO: 3744540 - DNA, 20 bp, Homo sapiens
ttgtgttctgtttgttaaaa

SEQ ID NO: 3744541 - DNA, 22 bp, Homo sapiens
ttgtgttctgtttgttaaaact

SEQ ID NO: 3744542 - DNA, 21 bp, Homo sapiens
ttgtgttgtttgaaaatatta

SEQ ID NO: 3744543 - DNA, 18 bp, Homo sapiens
ttgtgtttttaatttatt

SEQ ID NO: 3744544 - DNA, 14 bp, Homo sapiens
ttgttaaatattta

SEQ ID NO: 3744545 - DNA, 22 bp, Homo sapiens
ttgttaagtctaaatatttcct

SEQ ID NO: 3744546 - DNA, 17 bp, Homo sapiens
ttgttaatggtgcaaat

SEQ ID NO: 3744547 - DNA, 21 bp, Homo sapiens
ttgttacaggcaccgagaatg

SEQ ID NO: 3744548 - DNA, 23 bp, Homo sapiens
ttgttattatataattacatatt

SEQ ID NO: 3744549 - DNA, 22 bp, Homo sapiens
ttgttccaagacattgtcaata

SEQ ID NO: 3744550 - DNA, 12 bp, Homo sapiens
ttgttccagctc

SEQ ID NO: 3744551 - DNA, 14 bp, Homo sapiens
ttgttcttatgaac

SEQ ID NO: 3744552 - DNA, 14 bp, Homo sapiens
ttgttctttaaagt

SEQ ID NO: 3744553 - DNA, 12 bp, Homo sapiens
ttgttcttttcc

SEQ ID NO: 3744554 - DNA, 22 bp, Homo sapiens
ttgttgaggtggtctgaatgtt

SEQ ID NO: 3744555 - DNA, 20 bp, Homo sapiens
ttgtttatttatcagtgaca

SEQ ID NO: 3744556 - DNA, 20 bp, Homo sapiens
ttgtttcattgactatcaaa

SEQ ID NO: 3744557 - DNA, 21 bp, Homo sapiens
ttgtttctgaaaattccagaa

SEQ ID NO: 3744558 - DNA, 14 bp, Homo sapiens
ttgtttctgaccca

SEQ ID NO: 3744559 - DNA, 21 bp, Homo sapiens
ttgtttctgacccactgatct

SEQ ID NO: 3744560 - DNA, 19 bp, Homo sapiens
ttgtttcttccaaagcaca

SEQ ID NO: 3744561 - DNA, 19 bp, Homo sapiens
ttgtttgctcacctggggt

SEQ ID NO: 3744562 - DNA, 22 bp, Homo sapiens
ttgtttgtaaataagagatttg

SEQ ID NO: 3744563 - DNA, 21 bp, Homo sapiens
ttgtttgtttctccccctggg

SEQ ID NO: 3744564 - DNA, 12 bp, Homo sapiens
ttgtttgttttg

SEQ ID NO: 3744565 - DNA, 23 bp, Homo sapiens
ttgtttgttttgttttttagttc

SEQ ID NO: 3744566 - DNA, 20 bp, Homo sapiens
ttgttttaaaattaaagcta

SEQ ID NO: 3744567 - DNA, 16 bp, Homo sapiens
ttgttttaaggaagaa

SEQ ID NO: 3744568 - DNA, 20 bp, Homo sapiens
ttgttttcttctgtatgtta

SEQ ID NO: 3744569 - DNA, 16 bp, Homo sapiens
ttgttttgtgcagaga

SEQ ID NO: 3744570 - DNA, 12 bp, Homo sapiens
ttgttttttatc

SEQ ID NO: 3744571 - DNA, 18 bp, Homo sapiens
ttgttttttttttccact

SEQ ID NO: 3744572 - DNA, 22 bp, Homo sapiens
tttaaaaaaaatccttctaatc

SEQ ID NO: 3744573 - DNA, 19 bp, Homo sapiens
tttaaaaatcataaactgt

SEQ ID NO: 3744574 - DNA, 22 bp, Homo sapiens
tttaaaacaagaaagtttcccc

SEQ ID NO: 3744575 - DNA, 19 bp, Homo sapiens
tttaaaagttattaatatt

SEQ ID NO: 3744576 - DNA, 14 bp, Homo sapiens
tttaaaatcactaa

SEQ ID NO: 3744577 - DNA, 18 bp, Homo sapiens
tttaaaatgtataagttg

SEQ ID NO: 3744578 - DNA, 18 bp, Homo sapiens
tttaaagaatcattattt

SEQ ID NO: 3744579 - DNA, 22 bp, Homo sapiens
tttaaaggggcagaaaaactct

SEQ ID NO: 3744580 - DNA, 12 bp, Homo sapiens
tttaaagttctg

SEQ ID NO: 3744581 - DNA, 15 bp, Homo sapiens
tttaaagttctgtgt

SEQ ID NO: 3744582 - DNA, 21 bp, Homo sapiens
tttaaagttctgtgtatttaa

SEQ ID NO: 3744583 - DNA, 19 bp, Homo sapiens
tttaaataaaagtgatcaa

SEQ ID NO: 3744584 - DNA, 16 bp, Homo sapiens
tttaaatgtaaaacat

SEQ ID NO: 3744585 - DNA, 19 bp, Homo sapiens
tttaaattataaggactgc

SEQ ID NO: 3744586 - DNA, 11 bp, Homo sapiens
tttaacaatgc

SEQ ID NO: 3744587 - DNA, 20 bp, Homo sapiens
tttaacaatgcgaatggtag

SEQ ID NO: 3744588 - DNA, 14 bp, Homo sapiens
tttaacataaaggt

SEQ ID NO: 3744589 - DNA, 20 bp, Homo sapiens
tttaacataaattgtactgt

SEQ ID NO: 3744590 - DNA, 22 bp, Homo sapiens
tttaacgaatgaagatgtctaa

SEQ ID NO: 3744591 - DNA, 18 bp, Homo sapiens
tttaactcaggactccag

SEQ ID NO: 3744592 - DNA, 19 bp, Homo sapiens
tttaactcaggactccagc

SEQ ID NO: 3744593 - DNA, 13 bp, Homo sapiens
tttaagaaaatac

SEQ ID NO: 3744594 - DNA, 14 bp, Homo sapiens
tttaagataattat

SEQ ID NO: 3744595 - DNA, 22 bp, Homo sapiens
tttaagatgtgtcttcaatttg

SEQ ID NO: 3744596 - DNA, 18 bp, Homo sapiens
tttaagattccttttctt

SEQ ID NO: 3744597 - DNA, 21 bp, Homo sapiens
tgtcaggaaacatatttaaga

SEQ ID NO: 3744598 - DNA, 16 bp, Homo sapiens
tgtcaggaacagaagg

SEQ ID NO: 3744599 - DNA, 18 bp, Homo sapiens
tgtcaggaacagaaggat

SEQ ID NO: 3744600 - DNA, 18 bp, Homo sapiens
tgtcaggtggggcagctt

SEQ ID NO: 3744601 - DNA, 20 bp, Homo sapiens
tgtcaggtggggcagcttga

SEQ ID NO: 3744602 - DNA, 17 bp, Homo sapiens
tgtcataagaatgaata

SEQ ID NO: 3744603 - DNA, 20 bp, Homo sapiens
tgtcatatatggggggccaa

SEQ ID NO: 3744604 - DNA, 22 bp, Homo sapiens
tgtcatatatggggggccaaca

SEQ ID NO: 3744605 - DNA, 16 bp, Homo sapiens
tgtcatcccattgtct

SEQ ID NO: 3744606 - DNA, 13 bp, Homo sapiens
tgtcattaaaata

SEQ ID NO: 3744607 - DNA, 19 bp, Homo sapiens
tgtcattaccagacggttc

SEQ ID NO: 3744608 - DNA, 14 bp, Homo sapiens
tgtcattgctttac

SEQ ID NO: 3744609 - DNA, 19 bp, Homo sapiens
tgtccaaaggaggctggca

SEQ ID NO: 3744610 - DNA, 22 bp, Homo sapiens
tgtccaacctaacccctttcct

SEQ ID NO: 3744611 - DNA, 14 bp, Homo sapiens
tgtccaactccagt

SEQ ID NO: 3744612 - DNA, 17 bp, Homo sapiens
tgtccaagtgtgtgtgc

SEQ ID NO: 3744613 - DNA, 18 bp, Homo sapiens
tgtccaagtgtgtgtgcg

SEQ ID NO: 3744614 - DNA, 11 bp, Homo sapiens
tgtccacctgg

SEQ ID NO: 3744615 - DNA, 12 bp, Homo sapiens
tgtccacctggc

SEQ ID NO: 3744616 - DNA, 20 bp, Homo sapiens
tgtccagccccgtagacgtg

SEQ ID NO: 3744617 - DNA, 21 bp, Homo sapiens
tgtccaggcactgctgcccag

SEQ ID NO: 3744618 - DNA, 16 bp, Homo sapiens
tgtcccaacttgtaaa

SEQ ID NO: 3744619 - DNA, 13 bp, Homo sapiens
tgtcccaccagct

SEQ ID NO: 3744620 - DNA, 12 bp, Homo sapiens
tgtcccacctca

SEQ ID NO: 3744621 - DNA, 17 bp, Homo sapiens
tgtcccactcaagccaa

SEQ ID NO: 3744622 - DNA, 16 bp, Homo sapiens
tgtcccaggtcctcac

SEQ ID NO: 3744623 - DNA, 21 bp, Homo sapiens
tgtcccattttcagactgctt

SEQ ID NO: 3744624 - DNA, 15 bp, Homo sapiens
tgtccccagcccact

SEQ ID NO: 3744625 - DNA, 22 bp, Homo sapiens
tgtccctaatttaacccagctc

SEQ ID NO: 3744626 - DNA, 21 bp, Homo sapiens
tgtccctaccgagtctcttct

SEQ ID NO: 3744627 - DNA, 14 bp, Homo sapiens
tgtccctaggtcag

SEQ ID NO: 3744628 - DNA, 15 bp, Homo sapiens
tgtccctctcaggca

SEQ ID NO: 3744629 - DNA, 22 bp, Homo sapiens
tgtccctgcacttgcagactct

SEQ ID NO: 3744630 - DNA, 18 bp, Homo sapiens
tgtccctttcttggccag

SEQ ID NO: 3744631 - DNA, 13 bp, Homo sapiens
tgtccgagctttg

SEQ ID NO: 3744632 - DNA, 14 bp, Homo sapiens
tgtccgagctttga

SEQ ID NO: 3744633 - DNA, 17 bp, Homo sapiens
tgtccgccctcttcccc

SEQ ID NO: 3744634 - DNA, 14 bp, Homo sapiens
tgtcctcagcttct

SEQ ID NO: 3744635 - DNA, 22 bp, Homo sapiens
tgtcctccagaagcctctggct

SEQ ID NO: 3744636 - DNA, 18 bp, Homo sapiens
tgtcctcccctcaaggac

SEQ ID NO: 3744637 - DNA, 21 bp, Homo sapiens
tgtcctcctcggatcaccgag

SEQ ID NO: 3744638 - DNA, 23 bp, Homo sapiens
tgtcctctttcagaaaacagaaa

SEQ ID NO: 3744639 - DNA, 17 bp, Homo sapiens
tgtcctggttagcagag

SEQ ID NO: 3744640 - DNA, 17 bp, Homo sapiens
tgtcctttccctccact

SEQ ID NO: 3744641 - DNA, 18 bp, Homo sapiens
tgtcctttccctccactc

SEQ ID NO: 3744642 - DNA, 15 bp, Homo sapiens
tgtcgcccagtctgg

SEQ ID NO: 3744643 - DNA, 23 bp, Homo sapiens
tgtcgtagccaaggtgggctgag

SEQ ID NO: 3744644 - DNA, 23 bp, Homo sapiens
tgtctacacagatgttcacccaa

SEQ ID NO: 3744645 - DNA, 16 bp, Homo sapiens
tgtctaccatctccct

SEQ ID NO: 3744646 - DNA, 18 bp, Homo sapiens
tgtctaggtcagtaccca

SEQ ID NO: 3744647 - DNA, 14 bp, Homo sapiens
tgtctatgggactc

SEQ ID NO: 3744648 - DNA, 17 bp, Homo sapiens
tgtctcaagagggcact

SEQ ID NO: 3744649 - DNA, 18 bp, Homo sapiens
tgtctcaagagggcactg

SEQ ID NO: 3744650 - DNA, 13 bp, Homo sapiens
tgtctcagcctcc

SEQ ID NO: 3744651 - DNA, 17 bp, Homo sapiens
tgtctcaggtccctgca

SEQ ID NO: 3744652 - DNA, 23 bp, Homo sapiens
tgtctcatccccaggggtcccag

SEQ ID NO: 3744653 - DNA, 15 bp, Homo sapiens
tgtctcctctctctg

SEQ ID NO: 3744654 - DNA, 11 bp, Homo sapiens
tgtctcctgca

SEQ ID NO: 3744655 - DNA, 23 bp, Homo sapiens
tgtctctgggcttggggcttcct

SEQ ID NO: 3744656 - DNA, 20 bp, Homo sapiens
tgtctcttaaaaaaataaaa

SEQ ID NO: 3744657 - DNA, 21 bp, Homo sapiens
tgtctctttaatgtcacaggc

SEQ ID NO: 3744658 - DNA, 22 bp, Homo sapiens
tgtctctttaatgtcacaggca

SEQ ID NO: 3744659 - DNA, 19 bp, Homo sapiens
tgtctggacattcagaaca

SEQ ID NO: 3744660 - DNA, 14 bp, Homo sapiens
tgtctggagaataa

SEQ ID NO: 3744661 - DNA, 19 bp, Homo sapiens
tgtctggctgaggatttca

SEQ ID NO: 3744662 - DNA, 23 bp, Homo sapiens
tgtctgtagctcctcaactcacc

SEQ ID NO: 3744663 - DNA, 19 bp, Homo sapiens
tgtcttaaataaaagaaat

SEQ ID NO: 3744664 - DNA, 20 bp, Homo sapiens
tgtcttaaataaaagaaatg

SEQ ID NO: 3744665 - DNA, 21 bp, Homo sapiens
tgtcttaattaagtaaactaa

SEQ ID NO: 3744666 - DNA, 15 bp, Homo sapiens
tgtcttatttttaga

SEQ ID NO: 3744667 - DNA, 17 bp, Homo sapiens
tgtcttatttttagatg

SEQ ID NO: 3744668 - DNA, 20 bp, Homo sapiens
tgtcttcaatttgtataaaa

SEQ ID NO: 3744669 - DNA, 19 bp, Homo sapiens
tgtcttcacagctctgtgt

SEQ ID NO: 3744670 - DNA, 13 bp, Homo sapiens
tgtcttccaagga

SEQ ID NO: 3744671 - DNA, 24 bp, Homo sapiens
tgtcttccaaggagaccaagtcct

SEQ ID NO: 3744672 - DNA, 14 bp, Homo sapiens
tgtcttccataatg

SEQ ID NO: 3744673 - DNA, 16 bp, Homo sapiens
tgtcttctcaggctct

SEQ ID NO: 3744674 - DNA, 21 bp, Homo sapiens
tgtcttctcaggctctgccct

SEQ ID NO: 3744675 - DNA, 23 bp, Homo sapiens
tgtcttgctatggggagaaaaga

SEQ ID NO: 3744676 - DNA, 21 bp, Homo sapiens
tgtcttgtgtttttgtcttat

SEQ ID NO: 3744677 - DNA, 18 bp, Homo sapiens
tgtcttgttaatattctt

SEQ ID NO: 3744678 - DNA, 21 bp, Homo sapiens
tgtctttaggcagcagctttt

SEQ ID NO: 3744679 - DNA, 20 bp, Homo sapiens
tgtctttctttggtgccttt

SEQ ID NO: 3744680 - DNA, 16 bp, Homo sapiens
tgtcttttttcactac

SEQ ID NO: 3744681 - DNA, 13 bp, Homo sapiens
tgtgaaaagaaaa

SEQ ID NO: 3744682 - DNA, 15 bp, Homo sapiens
tgtgaaaagaaaaat

SEQ ID NO: 3744683 - DNA, 17 bp, Homo sapiens
tgtgaaaagaaaaatga

SEQ ID NO: 3744684 - DNA, 21 bp, Homo sapiens
tgtgaaaagaaaaatgagcct

SEQ ID NO: 3744685 - DNA, 14 bp, Homo sapiens
tgtgaaatgctggc

SEQ ID NO: 3744686 - DNA, 15 bp, Homo sapiens
tgtgaaccaccacac

SEQ ID NO: 3744687 - DNA, 16 bp, Homo sapiens
tgtgaagatgtttgca

SEQ ID NO: 3744688 - DNA, 15 bp, Homo sapiens
tgtgaatcagaccct

SEQ ID NO: 3744689 - DNA, 17 bp, Homo sapiens
tgtgaattgataataaa

SEQ ID NO: 3744690 - DNA, 19 bp, Homo sapiens
tgtgacaattttgtacaaa

SEQ ID NO: 3744691 - DNA, 13 bp, Homo sapiens
tgtgaccaagtta

SEQ ID NO: 3744692 - DNA, 14 bp, Homo sapiens
tgtgactagtgctg

SEQ ID NO: 3744693 - DNA, 20 bp, Homo sapiens
tgtgactagtgctgaagctt

SEQ ID NO: 3744694 - DNA, 23 bp, Homo sapiens
tgtgactagtgctgaagcttatt

SEQ ID NO: 3744695 - DNA, 19 bp, Homo sapiens
tgtgacttcagctctgttt

SEQ ID NO: 3744696 - DNA, 18 bp, Homo sapiens
tgtgagaaacatctcaat

SEQ ID NO: 3744697 - DNA, 14 bp, Homo sapiens
tgtgagaatcaaaa

SEQ ID NO: 3744698 - DNA, 19 bp, Homo sapiens
tgtgagacccccacacctc

SEQ ID NO: 3744699 - DNA, 13 bp, Homo sapiens
tgtgagagaaagt

SEQ ID NO: 3744700 - DNA, 13 bp, Homo sapiens
tgtgaggcagggg

SEQ ID NO: 3744701 - DNA, 18 bp, Homo sapiens
tgtgaggcaggggcggag

SEQ ID NO: 3744702 - DNA, 15 bp, Homo sapiens
tgtgagtcaccaagc

SEQ ID NO: 3744703 - DNA, 17 bp, Homo sapiens
tgtgagtcaccaagccc

SEQ ID NO: 3744704 - DNA, 19 bp, Homo sapiens
tgtgagtcaccaagcccag

SEQ ID NO: 3744705 - DNA, 14 bp, Homo sapiens
tgtgagtgtgtgca

SEQ ID NO: 3744706 - DNA, 22 bp, Homo sapiens
tgtgagtgtgtgtttgtgctga

SEQ ID NO: 3744707 - DNA, 14 bp, Homo sapiens
tgtgattgtgccta

SEQ ID NO: 3744708 - DNA, 14 bp, Homo sapiens
tgtgcaaaaatttt

SEQ ID NO: 3744709 - DNA, 12 bp, Homo sapiens
tgtgcaaatcct

SEQ ID NO: 3744710 - DNA, 15 bp, Homo sapiens
tgtgcaataaaataa

SEQ ID NO: 3744711 - DNA, 19 bp, Homo sapiens
tgttcatcatcctaagcta

SEQ ID NO: 3744712 - DNA, 23 bp, Homo sapiens
tgttcattgtaatgttactgatc

SEQ ID NO: 3744713 - DNA, 18 bp, Homo sapiens
tgttccaagacattgtca

SEQ ID NO: 3744714 - DNA, 20 bp, Homo sapiens
tgttccaagacattgtcaat

SEQ ID NO: 3744715 - DNA, 21 bp, Homo sapiens
tgttccaagacattgtcaata

SEQ ID NO: 3744716 - DNA, 16 bp, Homo sapiens
tgttccacaaaacatt

SEQ ID NO: 3744717 - DNA, 19 bp, Homo sapiens
tgttccacaagttaaataa

SEQ ID NO: 3744718 - DNA, 20 bp, Homo sapiens
tgttccacaagttaaataaa

SEQ ID NO: 3744719 - DNA, 16 bp, Homo sapiens
tgttcccattcttgca

SEQ ID NO: 3744720 - DNA, 22 bp, Homo sapiens
tgttccccactgacagcctccc

SEQ ID NO: 3744721 - DNA, 18 bp, Homo sapiens
tgttcctaagttcttaga

SEQ ID NO: 3744722 - DNA, 21 bp, Homo sapiens
tgttcctggcaatagtgtgtt

SEQ ID NO: 3744723 - DNA, 15 bp, Homo sapiens
tgttctctcttctcc

SEQ ID NO: 3744724 - DNA, 18 bp, Homo sapiens
tgttctctgaggacacta

SEQ ID NO: 3744725 - DNA, 16 bp, Homo sapiens
tgttctgattagaaat

SEQ ID NO: 3744726 - DNA, 13 bp, Homo sapiens
tgttctgggacac

SEQ ID NO: 3744727 - DNA, 15 bp, Homo sapiens
tgttctgtttgttaa

SEQ ID NO: 3744728 - DNA, 17 bp, Homo sapiens
tgttcttacctgtatgt

SEQ ID NO: 3744729 - DNA, 20 bp, Homo sapiens
tgttgaaaagccatgtttaa

SEQ ID NO: 3744730 - DNA, 17 bp, Homo sapiens
tgttgacagttcatatg

SEQ ID NO: 3744731 - DNA, 19 bp, Homo sapiens
tgttgacatccaagcttcc

SEQ ID NO: 3744732 - DNA, 20 bp, Homo sapiens
tgttgaggtggtctgaatgt

SEQ ID NO: 3744733 - DNA, 23 bp, Homo sapiens
tgttgaggtggtctgaatgttct

SEQ ID NO: 3744734 - DNA, 20 bp, Homo sapiens
tgttgattgcaggaataagg

SEQ ID NO: 3744735 - DNA, 17 bp, Homo sapiens
tgttgcaagtactgctg

SEQ ID NO: 3744736 - DNA, 12 bp, Homo sapiens
tgttgcccaggc

SEQ ID NO: 3744737 - DNA, 13 bp, Homo sapiens
tgttgcccaggca

SEQ ID NO: 3744738 - DNA, 15 bp, Homo sapiens
tgttgcccaggcagg

SEQ ID NO: 3744739 - DNA, 16 bp, Homo sapiens
tgttgcccaggcaggt

SEQ ID NO: 3744740 - DNA, 17 bp, Homo sapiens
tgttgcccaggcaggtc

SEQ ID NO: 3744741 - DNA, 23 bp, Homo sapiens
tgttgcccaggctggcgtgcagt

SEQ ID NO: 3744742 - DNA, 21 bp, Homo sapiens
tgttgccctttctgtaccatt

SEQ ID NO: 3744743 - DNA, 19 bp, Homo sapiens
tgttgctcaaaaaatgagc

SEQ ID NO: 3744744 - DNA, 18 bp, Homo sapiens
tgttggcacatgcctgta

SEQ ID NO: 3744745 - DNA, 14 bp, Homo sapiens
tgttggccaggctg

SEQ ID NO: 3744746 - DNA, 15 bp, Homo sapiens
tgttggccaggctgg

SEQ ID NO: 3744747 - DNA, 15 bp, Homo sapiens
tgttggctaatgaag

SEQ ID NO: 3744748 - DNA, 19 bp, Homo sapiens
tgttggctgggggcctcag

SEQ ID NO: 3744749 - DNA, 14 bp, Homo sapiens
tgttgtaaatattt

SEQ ID NO: 3744750 - DNA, 15 bp, Homo sapiens
tgttgtcattgcttt

SEQ ID NO: 3744751 - DNA, 19 bp, Homo sapiens
tgttgtcattgctttactg

SEQ ID NO: 3744752 - DNA, 13 bp, Homo sapiens
tgttgtttgtaaa

SEQ ID NO: 3744753 - DNA, 16 bp, Homo sapiens
tgtttaaaaaagttta

SEQ ID NO: 3744754 - DNA, 18 bp, Homo sapiens
tgtttaagatttaatttg

SEQ ID NO: 3744755 - DNA, 21 bp, Homo sapiens
tgtttaagtgttgtaaatatt

SEQ ID NO: 3744756 - DNA, 15 bp, Homo sapiens
tgtttacaagaaaaa

SEQ ID NO: 3744757 - DNA, 16 bp, Homo sapiens
tgtttacactctttgt

SEQ ID NO: 3744758 - DNA, 19 bp, Homo sapiens
tgtttacactctttgtaag

SEQ ID NO: 3744759 - DNA, 15 bp, Homo sapiens
tgtttacactgtcaa

SEQ ID NO: 3744760 - DNA, 16 bp, Homo sapiens
tgtttacactgtcaaa

SEQ ID NO: 3744761 - DNA, 12 bp, Homo sapiens
tgtttactgaaa

SEQ ID NO: 3744762 - DNA, 14 bp, Homo sapiens
tgtttagttgcaga

SEQ ID NO: 3744763 - DNA, 21 bp, Homo sapiens
tgtttatgcaaggaaggaaag

SEQ ID NO: 3744764 - DNA, 15 bp, Homo sapiens
tgtttatggcctcag

SEQ ID NO: 3744765 - DNA, 24 bp, Homo sapiens
tgtttatggcctcagctgcctcac

SEQ ID NO: 3744766 - DNA, 22 bp, Homo sapiens
tgtttatttataagcagattta

SEQ ID NO: 3744767 - DNA, 15 bp, Homo sapiens
tgtttatttttatat

SEQ ID NO: 3744768 - DNA, 16 bp, Homo sapiens
tgtttccttcatttct

SEQ ID NO: 3744769 - DNA, 23 bp, Homo sapiens
tgtttctagagcctgctggatct

SEQ ID NO: 3744770 - DNA, 15 bp, Homo sapiens
tgtttctagggaaat

SEQ ID NO: 3744771 - DNA, 24 bp, Homo sapiens
tgtttctattctctcctcagactg

SEQ ID NO: 3744772 - DNA, 13 bp, Homo sapiens
tgtttctgaaaat

SEQ ID NO: 3744773 - DNA, 21 bp, Homo sapiens
tgtttctgaaaattccagaaa

SEQ ID NO: 3744774 - DNA, 17 bp, Homo sapiens
tgtttctgacccactga

SEQ ID NO: 3744775 - DNA, 21 bp, Homo sapiens
tgtttctttaaatttcaaatg

SEQ ID NO: 3744776 - DNA, 19 bp, Homo sapiens
tgtttgaaaatattatctt

SEQ ID NO: 3744777 - DNA, 13 bp, Homo sapiens
tgtttgagctcag

SEQ ID NO: 3744778 - DNA, 23 bp, Homo sapiens
tgtttgagctcagacccccactc

SEQ ID NO: 3744779 - DNA, 16 bp, Homo sapiens
tgtttgcaatatcgat

SEQ ID NO: 3744780 - DNA, 16 bp, Homo sapiens
tgtttgtaaataagag

SEQ ID NO: 3744781 - DNA, 19 bp, Homo sapiens
tgtttgtaaataagagatt

SEQ ID NO: 3744782 - DNA, 21 bp, Homo sapiens
tgtttgtaaataagagatttg

SEQ ID NO: 3744783 - DNA, 16 bp, Homo sapiens
tgtttgtcagatatga

SEQ ID NO: 3744784 - DNA, 13 bp, Homo sapiens
tgtttgtggcctc

SEQ ID NO: 3744785 - DNA, 17 bp, Homo sapiens
tgtttgttgtcagctga

SEQ ID NO: 3744786 - DNA, 18 bp, Homo sapiens
tgttttaaatatagaatt

SEQ ID NO: 3744787 - DNA, 19 bp, Homo sapiens
tgttttaaatatagaattt

SEQ ID NO: 3744788 - DNA, 22 bp, Homo sapiens
tgttttaaatttatttcaaaaa

SEQ ID NO: 3744789 - DNA, 22 bp, Homo sapiens
tgttttaagaggcagggtctca

SEQ ID NO: 3744790 - DNA, 17 bp, Homo sapiens
tgttttaaggaagaaaa

SEQ ID NO: 3744791 - DNA, 19 bp, Homo sapiens
tgttttagaatgatgcaca

SEQ ID NO: 3744792 - DNA, 24 bp, Homo sapiens
tgttttagaatgatgcacatttca

SEQ ID NO: 3744793 - DNA, 14 bp, Homo sapiens
tgttttaggagcat

SEQ ID NO: 3744794 - DNA, 23 bp, Homo sapiens
tgttttcaaaccagtatacaaga

SEQ ID NO: 3744795 - DNA, 15 bp, Homo sapiens
tgttttcagactcag

SEQ ID NO: 3744796 - DNA, 12 bp, Homo sapiens
tgttttccctga

SEQ ID NO: 3744797 - DNA, 15 bp, Homo sapiens
tgttttctcttgaga

SEQ ID NO: 3744798 - DNA, 14 bp, Homo sapiens
tgttttgctaaagg

SEQ ID NO: 3744799 - DNA, 14 bp, Homo sapiens
tgttttgtgttgtt

SEQ ID NO: 3744800 - DNA, 17 bp, Homo sapiens
tgtttttgggatgtctt

SEQ ID NO: 3744801 - DNA, 17 bp, Homo sapiens
tgttttttcctgagctt

SEQ ID NO: 3744802 - DNA, 16 bp, Homo sapiens
tgttttttgaaaacat

SEQ ID NO: 3744803 - DNA, 14 bp, Homo sapiens
ttaaaaaaaactca

SEQ ID NO: 3744804 - DNA, 14 bp, Homo sapiens
ttaaaaaaaataat

SEQ ID NO: 3744805 - DNA, 17 bp, Homo sapiens
ttaaaaaaaataataaa

SEQ ID NO: 3744806 - DNA, 18 bp, Homo sapiens
ttaaaaaaaataataaat

SEQ ID NO: 3744807 - DNA, 20 bp, Homo sapiens
ttaaaaaaaatccttctaat

SEQ ID NO: 3744808 - DNA, 14 bp, Homo sapiens
ttaaaaaaatgaca

SEQ ID NO: 3744809 - DNA, 13 bp, Homo sapiens
ttaaaaaacttgt

SEQ ID NO: 3744810 - DNA, 12 bp, Homo sapiens
ttaaaaaagttt

SEQ ID NO: 3744811 - DNA, 15 bp, Homo sapiens
ttaaaaaagtttaaa

SEQ ID NO: 3744812 - DNA, 18 bp, Homo sapiens
ttaaaaaagtttaaaatg

SEQ ID NO: 3744813 - DNA, 12 bp, Homo sapiens
ttaaaaaatgtc

SEQ ID NO: 3744814 - DNA, 23 bp, Homo sapiens
ttaaaaagggcagggcatctcct

SEQ ID NO: 3744815 - DNA, 16 bp, Homo sapiens
ttaaaaagtctgcatt

SEQ ID NO: 3744816 - DNA, 12 bp, Homo sapiens
ttaaaaatggta

SEQ ID NO: 3744817 - DNA, 11 bp, Homo sapiens
ttaaaacaaga

SEQ ID NO: 3744818 - DNA, 14 bp, Homo sapiens
ttaaaacccaagtg

SEQ ID NO: 3744819 - DNA, 12 bp, Homo sapiens
ttaaaactcctg

SEQ ID NO: 3744820 - DNA, 12 bp, Homo sapiens
ttaaaagccatc

SEQ ID NO: 3744821 - DNA, 15 bp, Homo sapiens
ttaaaataactagtg

SEQ ID NO: 3744822 - DNA, 20 bp, Homo sapiens
ttaaaatatatatgttgatt

SEQ ID NO: 3744823 - DNA, 12 bp, Homo sapiens
ttaaaatatttt

SEQ ID NO: 3744824 - DNA, 14 bp, Homo sapiens
ttaaaatattttat

SEQ ID NO: 3744825 - DNA, 23 bp, Homo sapiens
ttaaaatcactaacattatattg

SEQ ID NO: 3744826 - DNA, 20 bp, Homo sapiens
ttcccagctgcccctccctg

SEQ ID NO: 3744827 - DNA, 13 bp, Homo sapiens
ttcccagctgtct

SEQ ID NO: 3744828 - DNA, 18 bp, Homo sapiens
ttcccagcttctgccaca

SEQ ID NO: 3744829 - DNA, 23 bp, Homo sapiens
ttcccatcactggagcaccaggc

SEQ ID NO: 3744830 - DNA, 13 bp, Homo sapiens
ttcccatgttaaa

SEQ ID NO: 3744831 - DNA, 18 bp, Homo sapiens
ttcccattgaaaatgtaa

SEQ ID NO: 3744832 - DNA, 11 bp, Homo sapiens
ttccccatggg

SEQ ID NO: 3744833 - DNA, 13 bp, Homo sapiens
ttcccccagccct

SEQ ID NO: 3744834 - DNA, 14 bp, Homo sapiens
ttcccccagccctg

SEQ ID NO: 3744835 - DNA, 15 bp, Homo sapiens
ttcccccagccctgt

SEQ ID NO: 3744836 - DNA, 15 bp, Homo sapiens
ttcccccatagccac

SEQ ID NO: 3744837 - DNA, 19 bp, Homo sapiens
ttccccccactctccccac

SEQ ID NO: 3744838 - DNA, 18 bp, Homo sapiens
ttcccctccttctccctt

SEQ ID NO: 3744839 - DNA, 14 bp, Homo sapiens
ttcccctttcccca

SEQ ID NO: 3744840 - DNA, 17 bp, Homo sapiens
ttcccctttccccactc

SEQ ID NO: 3744841 - DNA, 12 bp, Homo sapiens
ttcccgctcagc

SEQ ID NO: 3744842 - DNA, 15 bp, Homo sapiens
ttcccgctcagccct

SEQ ID NO: 3744843 - DNA, 22 bp, Homo sapiens
ttcccgctcagccctccctgcc

SEQ ID NO: 3744844 - DNA, 15 bp, Homo sapiens
ttccctacctcaggc

SEQ ID NO: 3744845 - DNA, 11 bp, Homo sapiens
ttccctccctt

SEQ ID NO: 3744846 - DNA, 17 bp, Homo sapiens
ttccctcccttcctctt

SEQ ID NO: 3744847 - DNA, 17 bp, Homo sapiens
ttccctctgcctgtccc

SEQ ID NO: 3744848 - DNA, 19 bp, Homo sapiens
ttccctgagtcaccaggaa

SEQ ID NO: 3744849 - DNA, 11 bp, Homo sapiens
ttccctggacc

SEQ ID NO: 3744850 - DNA, 23 bp, Homo sapiens
ttccctggcttgtaactccacca

SEQ ID NO: 3744851 - DNA, 12 bp, Homo sapiens
ttcccttggcct

SEQ ID NO: 3744852 - DNA, 14 bp, Homo sapiens
ttcccttggcctca

SEQ ID NO: 3744853 - DNA, 23 bp, Homo sapiens
ttccctttagcacgtttaaagtt

SEQ ID NO: 3744854 - DNA, 16 bp, Homo sapiens
ttccctttgctccacc

SEQ ID NO: 3744855 - DNA, 17 bp, Homo sapiens
ttcccttttacatactg

SEQ ID NO: 3744856 - DNA, 18 bp, Homo sapiens
ttcccttttacatactgc

SEQ ID NO: 3744857 - DNA, 19 bp, Homo sapiens
ttcccttttacatactgct

SEQ ID NO: 3744858 - DNA, 21 bp, Homo sapiens
ttcccttttacatactgctgt

SEQ ID NO: 3744859 - DNA, 13 bp, Homo sapiens
ttcctaaatgcag

SEQ ID NO: 3744860 - DNA, 15 bp, Homo sapiens
ttcctaacaggatga

SEQ ID NO: 3744861 - DNA, 20 bp, Homo sapiens
ttcctaagactgctgctgaa

SEQ ID NO: 3744862 - DNA, 16 bp, Homo sapiens
ttcctacaaagatgtt

SEQ ID NO: 3744863 - DNA, 23 bp, Homo sapiens
ttcctacaagagcagcctgtggc

SEQ ID NO: 3744864 - DNA, 14 bp, Homo sapiens
ttcctacaatatat

SEQ ID NO: 3744865 - DNA, 19 bp, Homo sapiens
ttcctacttttccttccct

SEQ ID NO: 3744866 - DNA, 18 bp, Homo sapiens
ttcctagataaaaagatg

SEQ ID NO: 3744867 - DNA, 20 bp, Homo sapiens
ttcctataatataataaata

SEQ ID NO: 3744868 - DNA, 19 bp, Homo sapiens
ttcctatatagtttattga

SEQ ID NO: 3744869 - DNA, 14 bp, Homo sapiens
ttcctatcccatcc

SEQ ID NO: 3744870 - DNA, 14 bp, Homo sapiens
ttcctatgtaactg

SEQ ID NO: 3744871 - DNA, 13 bp, Homo sapiens
ttcctcattagca

SEQ ID NO: 3744872 - DNA, 13 bp, Homo sapiens
ttcctccccagca

SEQ ID NO: 3744873 - DNA, 21 bp, Homo sapiens
ttcctccccattagagtcagc

SEQ ID NO: 3744874 - DNA, 21 bp, Homo sapiens
ttcctccctccctctttccct

SEQ ID NO: 3744875 - DNA, 19 bp, Homo sapiens
ttcctctagtgccctccac

SEQ ID NO: 3744876 - DNA, 12 bp, Homo sapiens
ttcctctgggaa

SEQ ID NO: 3744877 - DNA, 17 bp, Homo sapiens
ttcctgaaagaaacagt

SEQ ID NO: 3744878 - DNA, 18 bp, Homo sapiens
ttcctgaaagaaacagtt

SEQ ID NO: 3744879 - DNA, 14 bp, Homo sapiens
ttcctgaaccgatg

SEQ ID NO: 3744880 - DNA, 14 bp, Homo sapiens
ttcctgaatgaaat

SEQ ID NO: 3744881 - DNA, 15 bp, Homo sapiens
ttcctgatgacccag

SEQ ID NO: 3744882 - DNA, 16 bp, Homo sapiens
ttcctgatgacccagg

SEQ ID NO: 3744883 - DNA, 18 bp, Homo sapiens
ttcctgcatttgtgaaat

SEQ ID NO: 3744884 - DNA, 17 bp, Homo sapiens
ttcctgcctggtctcct

SEQ ID NO: 3744885 - DNA, 22 bp, Homo sapiens
ttcctgcctggtctcctgcccc

SEQ ID NO: 3744886 - DNA, 16 bp, Homo sapiens
ttcctgcctgtctcct

SEQ ID NO: 3744887 - DNA, 18 bp, Homo sapiens
ttcctgcctgtctccttt

SEQ ID NO: 3744888 - DNA, 21 bp, Homo sapiens
ttcctgcgggcttttccccgg

SEQ ID NO: 3744889 - DNA, 18 bp, Homo sapiens
ttcctggcaatagtgtgt

SEQ ID NO: 3744890 - DNA, 15 bp, Homo sapiens
ttcctgtccagagag

SEQ ID NO: 3744891 - DNA, 24 bp, Homo sapiens
ttcctgtccttctctcacctccta

SEQ ID NO: 3744892 - DNA, 14 bp, Homo sapiens
ttcctgtcttcctg

SEQ ID NO: 3744893 - DNA, 15 bp, Homo sapiens
ttcctgttcagcatt

SEQ ID NO: 3744894 - DNA, 21 bp, Homo sapiens
ttcctgttcagcattcttagc

SEQ ID NO: 3744895 - DNA, 13 bp, Homo sapiens
ttccttaaactgt

SEQ ID NO: 3744896 - DNA, 23 bp, Homo sapiens
ttccttagcttagacctcagcct

SEQ ID NO: 3744897 - DNA, 22 bp, Homo sapiens
ttccttcagtgcatctgggaag

SEQ ID NO: 3744898 - DNA, 19 bp, Homo sapiens
ttccttcattcaacccacc

SEQ ID NO: 3744899 - DNA, 20 bp, Homo sapiens
ttccttccatccctaccccc

SEQ ID NO: 3744900 - DNA, 16 bp, Homo sapiens
ttccttccttccctgg

SEQ ID NO: 3744901 - DNA, 13 bp, Homo sapiens
ttccttgaccagc

SEQ ID NO: 3744902 - DNA, 15 bp, Homo sapiens
ttccttgaccagcag

SEQ ID NO: 3744903 - DNA, 20 bp, Homo sapiens
ttccttgagttgattcagct

SEQ ID NO: 3744904 - DNA, 21 bp, Homo sapiens
ttccttgagttgattcagctc

SEQ ID NO: 3744905 - DNA, 18 bp, Homo sapiens
ttccttgctgtcctaggc

SEQ ID NO: 3744906 - DNA, 18 bp, Homo sapiens
ttccttggcatgccttcc

SEQ ID NO: 3744907 - DNA, 17 bp, Homo sapiens
ttccttggggcaggcag

SEQ ID NO: 3744908 - DNA, 18 bp, Homo sapiens
ttccttgtatttaaatat

SEQ ID NO: 3744909 - DNA, 17 bp, Homo sapiens
ttccttttgtgtacagt

SEQ ID NO: 3744910 - DNA, 14 bp, Homo sapiens
ttcgaagctcagcc

SEQ ID NO: 3744911 - DNA, 22 bp, Homo sapiens
ttcgaagctcagcccacccccc

SEQ ID NO: 3744912 - DNA, 19 bp, Homo sapiens
ttcgactgtgacctgtggg

SEQ ID NO: 3744913 - DNA, 15 bp, Homo sapiens
ttcgagaccagcctg

SEQ ID NO: 3744914 - DNA, 17 bp, Homo sapiens
ttcgagaccagcctggc

SEQ ID NO: 3744915 - DNA, 20 bp, Homo sapiens
ttcgatacaccgggcctgga

SEQ ID NO: 3744916 - DNA, 18 bp, Homo sapiens
ttcgatctcattcagtat

SEQ ID NO: 3744917 - DNA, 15 bp, Homo sapiens
ttcgctcctgtgtct

SEQ ID NO: 3744918 - DNA, 12 bp, Homo sapiens
ttcgctgcaacc

SEQ ID NO: 3744919 - DNA, 21 bp, Homo sapiens
ttcggcattggttccctttgc

SEQ ID NO: 3744920 - DNA, 20 bp, Homo sapiens
ttcgggaggtcgaggcagga

SEQ ID NO: 3744921 - DNA, 21 bp, Homo sapiens
ttcgtgaagtatactgtattt

SEQ ID NO: 3744922 - DNA, 15 bp, Homo sapiens
ttcgttcttgttctg

SEQ ID NO: 3744923 - DNA, 20 bp, Homo sapiens
ttcgttcttgttctgttttg

SEQ ID NO: 3744924 - DNA, 15 bp, Homo sapiens
ttcgtttgtttgttt

SEQ ID NO: 3744925 - DNA, 14 bp, Homo sapiens
ttctaaatgaagtg

SEQ ID NO: 3744926 - DNA, 18 bp, Homo sapiens
ttctaaatgaatgtttac

SEQ ID NO: 3744927 - DNA, 21 bp, Homo sapiens
ttctaaatgaatgtttacact

SEQ ID NO: 3744928 - DNA, 18 bp, Homo sapiens
ttctaaccagagcaagct

SEQ ID NO: 3744929 - DNA, 15 bp, Homo sapiens
ttctaactccagtga

SEQ ID NO: 3744930 - DNA, 14 bp, Homo sapiens
ttctaaggaatatg

SEQ ID NO: 3744931 - DNA, 12 bp, Homo sapiens
ttctaatagaac

SEQ ID NO: 3744932 - DNA, 18 bp, Homo sapiens
ttctaatagaactcagtt

SEQ ID NO: 3744933 - DNA, 17 bp, Homo sapiens
ttctacaatctatttat

SEQ ID NO: 3744934 - DNA, 21 bp, Homo sapiens
ttctacagcaaatttataatt

SEQ ID NO: 3744935 - DNA, 14 bp, Homo sapiens
ttctaccatttcag

SEQ ID NO: 3744936 - DNA, 12 bp, Homo sapiens
ttctacccagcg

SEQ ID NO: 3744937 - DNA, 20 bp, Homo sapiens
ttctacccagcgagccctgg

SEQ ID NO: 3744938 - DNA, 18 bp, Homo sapiens
ttctaccttgaggtcttt

SEQ ID NO: 3744939 - DNA, 20 bp, Homo sapiens
ttctactaaaaatacaaaaa

SEQ ID NO: 3744940 - DNA, 18 bp, Homo sapiens
ttctactcatatatatct

SEQ ID NO: 3744941 - DNA, 21 bp, Homo sapiens
ttctagaacatccctgccagc

SEQ ID NO: 3744942 - DNA, 22 bp, Homo sapiens
ttctagaacatccctgccagct

SEQ ID NO: 3744943 - DNA, 15 bp, Homo sapiens
ttctagaatttatca

SEQ ID NO: 3744944 - DNA, 21 bp, Homo sapiens
ttctagaatttatcacacttc

SEQ ID NO: 3744945 - DNA, 20 bp, Homo sapiens
ttctagagcctgctggatct

SEQ ID NO: 3744946 - DNA, 21 bp, Homo sapiens
ttctagctgttgagctgtttt

SEQ ID NO: 3744947 - DNA, 15 bp, Homo sapiens
ttctagggaaatgaa

SEQ ID NO: 3744948 - DNA, 23 bp, Homo sapiens
ttctattaaaagtgggaattagg

SEQ ID NO: 3744949 - DNA, 15 bp, Homo sapiens
ttctatttatttact

SEQ ID NO: 3744950 - DNA, 12 bp, Homo sapiens
ttctcaaagcag

SEQ ID NO: 3744951 - DNA, 16 bp, Homo sapiens
ttctcactcctacctg

SEQ ID NO: 3744952 - DNA, 23 bp, Homo sapiens
ttctcagaatctcaaataactaa

SEQ ID NO: 3744953 - DNA, 13 bp, Homo sapiens
ttctcagatattt

SEQ ID NO: 3744954 - DNA, 14 bp, Homo sapiens
ttctcagatattta

SEQ ID NO: 3744955 - DNA, 13 bp, Homo sapiens
ttctcatagcatt

SEQ ID NO: 3744956 - DNA, 13 bp, Homo sapiens
ttctccaccctgc

SEQ ID NO: 3744957 - DNA, 23 bp, Homo sapiens
ttctcccaattcatcctcactca

SEQ ID NO: 3744958 - DNA, 23 bp, Homo sapiens
ttctcccaggccaggctccttcc

SEQ ID NO: 3744959 - DNA, 17 bp, Homo sapiens
ttctccccctgggctct

SEQ ID NO: 3744960 - DNA, 15 bp, Homo sapiens
ttctcctgcctgtgc

SEQ ID NO: 3744961 - DNA, 21 bp, Homo sapiens
ttctcctgcctgtgctgtgac

SEQ ID NO: 3744962 - DNA, 17 bp, Homo sapiens
ttctcctttcacaacct

SEQ ID NO: 3744963 - DNA, 18 bp, Homo sapiens
ttctcctttcacaacctt

SEQ ID NO: 3744964 - DNA, 22 bp, Homo sapiens
ttctcctttcacaaccttctgt

SEQ ID NO: 3744965 - DNA, 16 bp, Homo sapiens
ttctcctttttacccc

SEQ ID NO: 3744966 - DNA, 20 bp, Homo sapiens
ttctctaaaatagccactta

SEQ ID NO: 3744967 - DNA, 21 bp, Homo sapiens
ttctctaacttcaaggcccat

SEQ ID NO: 3744968 - DNA, 17 bp, Homo sapiens
ttctctactctagggaa

SEQ ID NO: 3744969 - DNA, 13 bp, Homo sapiens
ttctctcacctcc

SEQ ID NO: 3744970 - DNA, 16 bp, Homo sapiens
ttctctctcctgtcca

SEQ ID NO: 3744971 - DNA, 23 bp, Homo sapiens
ttctctgaagagtgggtttcaca

SEQ ID NO: 3744972 - DNA, 15 bp, Homo sapiens
ttctctgctccacca

SEQ ID NO: 3744973 - DNA, 14 bp, Homo sapiens
ttctctgtatagta

SEQ ID NO: 3744974 - DNA, 12 bp, Homo sapiens
ttctctgtgaac

SEQ ID NO: 3744975 - DNA, 16 bp, Homo sapiens
ttctcttcattttccc

SEQ ID NO: 3744976 - DNA, 15 bp, Homo sapiens
ttctctttaactcag

SEQ ID NO: 3744977 - DNA, 16 bp, Homo sapiens
ttctcttttcaaaaca

SEQ ID NO: 3744978 - DNA, 19 bp, Homo sapiens
ttctgaaaattaacactgc

SEQ ID NO: 3744979 - DNA, 17 bp, Homo sapiens
ttctgaaactaatgaaa

SEQ ID NO: 3744980 - DNA, 20 bp, Homo sapiens
ttctgacattaacagttttc

SEQ ID NO: 3744981 - DNA, 22 bp, Homo sapiens
ttctgacattaacagttttcca

SEQ ID NO: 3744982 - DNA, 14 bp, Homo sapiens
ttctgaccacactt

SEQ ID NO: 3744983 - DNA, 14 bp, Homo sapiens
ttctgaccatttca

SEQ ID NO: 3744984 - DNA, 14 bp, Homo sapiens
ttctgacctcagca

SEQ ID NO: 3744985 - DNA, 22 bp, Homo sapiens
ttctgacttcatagatttcctt

SEQ ID NO: 3744986 - DNA, 15 bp, Homo sapiens
ttctgatgaatcttg

SEQ ID NO: 3744987 - DNA, 14 bp, Homo sapiens
ttctgattagaaat

SEQ ID NO: 3744988 - DNA, 16 bp, Homo sapiens
ttctgattttatgtaa

SEQ ID NO: 3744989 - DNA, 17 bp, Homo sapiens
ttctgcaaatagaaaac

SEQ ID NO: 3744990 - DNA, 15 bp, Homo sapiens
ttctgccagggagct

SEQ ID NO: 3744991 - DNA, 18 bp, Homo sapiens
ttctgccggccctggggc

SEQ ID NO: 3744992 - DNA, 15 bp, Homo sapiens
ttctgcctgcccagg

SEQ ID NO: 3744993 - DNA, 9 bp, Homo sapiens
ttctgctcc

SEQ ID NO: 3744994 - DNA, 13 bp, Homo sapiens
ttctgctccaccc

SEQ ID NO: 3744995 - DNA, 15 bp, Homo sapiens
ttctgctccaccctt

SEQ ID NO: 3744996 - DNA, 14 bp, Homo sapiens
ttctgcttcagcct

SEQ ID NO: 3744997 - DNA, 15 bp, Homo sapiens
ttctgctttcatctt

SEQ ID NO: 3744998 - DNA, 17 bp, Homo sapiens
ttctgggaaatggcttg

SEQ ID NO: 3744999 - DNA, 10 bp, Homo sapiens
ttctgggaca

SEQ ID NO: 3745000 - DNA, 16 bp, Homo sapiens
ttctgggaggaagcag

SEQ ID NO: 3745001 - DNA, 18 bp, Homo sapiens
ttctgggtggttgccctt

SEQ ID NO: 3745002 - DNA, 18 bp, Homo sapiens
ttctggtagatagaaata

SEQ ID NO: 3745003 - DNA, 19 bp, Homo sapiens
ttctggtagatagaaataa

SEQ ID NO: 3745004 - DNA, 14 bp, Homo sapiens
ttctggtctctcta

SEQ ID NO: 3745005 - DNA, 15 bp, Homo sapiens
ttctggttagctcag

SEQ ID NO: 3745006 - DNA, 17 bp, Homo sapiens
ttctgtaaaatgtctgt

SEQ ID NO: 3745007 - DNA, 21 bp, Homo sapiens
ttctgtagtactccttaagaa

SEQ ID NO: 3745008 - DNA, 19 bp, Homo sapiens
ttctgtcctactctgtgtc

SEQ ID NO: 3745009 - DNA, 16 bp, Homo sapiens
ttctgtctcatatgat

SEQ ID NO: 3745010 - DNA, 19 bp, Homo sapiens
ttctgtgagacccccacac

SEQ ID NO: 3745011 - DNA, 14 bp, Homo sapiens
ttctgtgcccagct

SEQ ID NO: 3745012 - DNA, 12 bp, Homo sapiens
ttctgtggctca

SEQ ID NO: 3745013 - DNA, 16 bp, Homo sapiens
ttctgtgtatttaatt

SEQ ID NO: 3745014 - DNA, 13 bp, Homo sapiens
ttctgtgtgaaga

SEQ ID NO: 3745015 - DNA, 15 bp, Homo sapiens
ttctgttcatttgtt

SEQ ID NO: 3745016 - DNA, 15 bp, Homo sapiens
ttctgtttctagttg

SEQ ID NO: 3745017 - DNA, 16 bp, Homo sapiens
ttctgttttgcctgaa

SEQ ID NO: 3745018 - DNA, 15 bp, Homo sapiens
ttcttaaaatatatt

SEQ ID NO: 3745019 - DNA, 13 bp, Homo sapiens
ttcttactgcttg

SEQ ID NO: 3745020 - DNA, 21 bp, Homo sapiens
ttcttatgtatgtgaaagtta

SEQ ID NO: 3745021 - DNA, 19 bp, Homo sapiens
ttcttatttaatgaaagac

SEQ ID NO: 3745022 - DNA, 23 bp, Homo sapiens
ttcttatttaatgaaagactgta

SEQ ID NO: 3745023 - DNA, 21 bp, Homo sapiens
ttcttcaacatcaatgttcat

SEQ ID NO: 3745024 - DNA, 22 bp, Homo sapiens
ttcttcaacatcaatgttcatt

SEQ ID NO: 3745025 - DNA, 14 bp, Homo sapiens
ttcttcagccacct

SEQ ID NO: 3745026 - DNA, 11 bp, Homo sapiens
ttcttcagttg

SEQ ID NO: 3745027 - DNA, 21 bp, Homo sapiens
ttcttcccttttacatactgc

SEQ ID NO: 3745028 - DNA, 20 bp, Homo sapiens
ttcttcggggaactcctgga

SEQ ID NO: 3745029 - DNA, 15 bp, Homo sapiens
ttcttgaaagctgtg

SEQ ID NO: 3745030 - DNA, 21 bp, Homo sapiens
ttcttgatgactggaattttt

SEQ ID NO: 3745031 - DNA, 14 bp, Homo sapiens
ttcttgctggttgt

SEQ ID NO: 3745032 - DNA, 22 bp, Homo sapiens
ttcttgggcattcttttgctgt

SEQ ID NO: 3745033 - DNA, 14 bp, Homo sapiens
ttctttaaccagtc

SEQ ID NO: 3745034 - DNA, 18 bp, Homo sapiens
ttctttataattctactt

SEQ ID NO: 3745035 - DNA, 20 bp, Homo sapiens
ttctttcaagtgaatctaaa

SEQ ID NO: 3745036 - DNA, 14 bp, Homo sapiens
ttctttccattatg

SEQ ID NO: 3745037 - DNA, 15 bp, Homo sapiens
ttctttggtgccttt

SEQ ID NO: 3745038 - DNA, 19 bp, Homo sapiens
ttctttggtgcctttcctg

SEQ ID NO: 3745039 - DNA, 22 bp, Homo sapiens
ttctttggtgcctttcctgttc

SEQ ID NO: 3745040 - DNA, 18 bp, Homo sapiens
ttctttgtttttagagac

SEQ ID NO: 3745041 - DNA, 19 bp, Homo sapiens
ttcttttactcatgatctt

SEQ ID NO: 3745042 - DNA, 12 bp, Homo sapiens
ttcttttatcac

SEQ ID NO: 3745043 - DNA, 14 bp, Homo sapiens
ttcttttgccatga

SEQ ID NO: 3745044 - DNA, 12 bp, Homo sapiens
ttcttttgtaaa

SEQ ID NO: 3745045 - DNA, 15 bp, Homo sapiens
ttctttttattttct

SEQ ID NO: 3745046 - DNA, 15 bp, Homo sapiens
ttgaaaactacattt

SEQ ID NO: 3745047 - DNA, 13 bp, Homo sapiens
ttgaaaagccatg

SEQ ID NO: 3745048 - DNA, 14 bp, Homo sapiens
ttgaaaatattatc

SEQ ID NO: 3745049 - DNA, 19 bp, Homo sapiens
ttgaaaccaccttttatta

SEQ ID NO: 3745050 - DNA, 15 bp, Homo sapiens
ttgaaagaaaatatg

SEQ ID NO: 3745051 - DNA, 20 bp, Homo sapiens
ttgaaagagaaccagtttca

SEQ ID NO: 3745052 - DNA, 19 bp, Homo sapiens
ttgaaagagttaagaatgt

SEQ ID NO: 3745053 - DNA, 22 bp, Homo sapiens
ttgaaagctgtggccagcttgt

SEQ ID NO: 3745054 - DNA, 19 bp, Homo sapiens
ttgaaaggcattctctgaa

SEQ ID NO: 3745055 - DNA, 17 bp, Homo sapiens
ttgaaagttttcagaac

SEQ ID NO: 3745056 - DNA, 16 bp, Homo sapiens
ttgaaatataatgcaa

SEQ ID NO: 3745057 - DNA, 21 bp, Homo sapiens
ttgaaatgaaagtataactga

SEQ ID NO: 3745058 - DNA, 18 bp, Homo sapiens
ttgaaccaaaacattccg

SEQ ID NO: 3745059 - DNA, 15 bp, Homo sapiens
ttgaactcctggcct

SEQ ID NO: 3745060 - DNA, 18 bp, Homo sapiens
ttgaactgggtacttgtg

SEQ ID NO: 3745061 - DNA, 18 bp, Homo sapiens
ttgaacttaaataaatgt

SEQ ID NO: 3745062 - DNA, 17 bp, Homo sapiens
ttgaagacaaaaatact

SEQ ID NO: 3745063 - DNA, 22 bp, Homo sapiens
ttgaagacaaaaatactctaat

SEQ ID NO: 3745064 - DNA, 18 bp, Homo sapiens
ttgaagatgctgaaacag

SEQ ID NO: 3745065 - DNA, 17 bp, Homo sapiens
ttgaagccactgaagct

SEQ ID NO: 3745066 - DNA, 14 bp, Homo sapiens
ttgaagctaagatt

SEQ ID NO: 3745067 - DNA, 16 bp, Homo sapiens
ttgaagctaattattt

SEQ ID NO: 3745068 - DNA, 15 bp, Homo sapiens
ttgaaggatctgttt

SEQ ID NO: 3745069 - DNA, 16 bp, Homo sapiens
ttgaaggatgctgtct

SEQ ID NO: 3745070 - DNA, 23 bp, Homo sapiens
ttgaagtgaaatctgtgcaataa

SEQ ID NO: 3745071 - DNA, 19 bp, Homo sapiens
ttgaataaagttgaagcta

SEQ ID NO: 3745072 - DNA, 18 bp, Homo sapiens
ttgaatataaacactata

SEQ ID NO: 3745073 - DNA, 19 bp, Homo sapiens
ttgaatccatgcttgggtg

SEQ ID NO: 3745074 - DNA, 12 bp, Homo sapiens
ttgaatgaaaaa

SEQ ID NO: 3745075 - DNA, 15 bp, Homo sapiens
ttgaatgaaaaattt

SEQ ID NO: 3745076 - DNA, 20 bp, Homo sapiens
ttgaatgaaaaatttaagca

SEQ ID NO: 3745077 - DNA, 22 bp, Homo sapiens
ttgaatgaaaaatttaagcatt

SEQ ID NO: 3745078 - DNA, 23 bp, Homo sapiens
ttgaatgaaaaatttaagcattg

SEQ ID NO: 3745079 - DNA, 15 bp, Homo sapiens
ttgaattcatagaaa

SEQ ID NO: 3745080 - DNA, 15 bp, Homo sapiens
ttgaatttaacaatg

SEQ ID NO: 3745081 - DNA, 19 bp, Homo sapiens
ttgaatttaacaatgcgaa

SEQ ID NO: 3745082 - DNA, 19 bp, Homo sapiens
ttgaattttcaagcatctc

SEQ ID NO: 3745083 - DNA, 16 bp, Homo sapiens
ttgacaaccatgagac

SEQ ID NO: 3745084 - DNA, 18 bp, Homo sapiens
ttgacaataaatgtgctt

SEQ ID NO: 3745085 - DNA, 16 bp, Homo sapiens
ttgacagaacactgtc

SEQ ID NO: 3745086 - DNA, 20 bp, Homo sapiens
ttgacataacactataaagg

SEQ ID NO: 3745087 - DNA, 18 bp, Homo sapiens
ttgaccaagcaggaagct

SEQ ID NO: 3745088 - DNA, 22 bp, Homo sapiens
ttgaccaagcaggaagctcaga

SEQ ID NO: 3745089 - DNA, 21 bp, Homo sapiens
ttgaccagcagatcccagctc

SEQ ID NO: 3745090 - DNA, 18 bp, Homo sapiens
ttgacctaagatttattt

SEQ ID NO: 3745091 - DNA, 21 bp, Homo sapiens
ttgactagggattcaggctgc

SEQ ID NO: 3745092 - DNA, 17 bp, Homo sapiens
ttgactgggtttctctg

SEQ ID NO: 3745093 - DNA, 19 bp, Homo sapiens
ttgacttgacagaacactg

SEQ ID NO: 3745094 - DNA, 23 bp, Homo sapiens
ttgagaaaccttattgtacctct

SEQ ID NO: 3745095 - DNA, 22 bp, Homo sapiens
ttgagaaatgaataatttccca

SEQ ID NO: 3745096 - DNA, 11 bp, Homo sapiens
ttgagacagag

SEQ ID NO: 3745097 - DNA, 14 bp, Homo sapiens
ttgagactagtttt

SEQ ID NO: 3745098 - DNA, 12 bp, Homo sapiens
ttgagacttttt

SEQ ID NO: 3745099 - DNA, 23 bp, Homo sapiens
ttgagactttttggtggatgtaa

SEQ ID NO: 3745100 - DNA, 17 bp, Homo sapiens
ttgagagaagagacaaa

SEQ ID NO: 3745101 - DNA, 17 bp, Homo sapiens
ttgagatagaagaactg

SEQ ID NO: 3745102 - DNA, 16 bp, Homo sapiens
ttgagcagggctcagc

SEQ ID NO: 3745103 - DNA, 17 bp, Homo sapiens
ttgagccaggcctgggt

SEQ ID NO: 3745104 - DNA, 22 bp, Homo sapiens
ttgagccaggcctgggtctgtg

SEQ ID NO: 3745105 - DNA, 13 bp, Homo sapiens
ttgagcccaggag

SEQ ID NO: 3745106 - DNA, 23 bp, Homo sapiens
ttgagggacaaatttaaaacaaa

SEQ ID NO: 3745107 - DNA, 16 bp, Homo sapiens
ttgaggggctcctgga

SEQ ID NO: 3745108 - DNA, 16 bp, Homo sapiens
ttgagggttgggctgg

SEQ ID NO: 3745109 - DNA, 14 bp, Homo sapiens
ttgagtaatctgat

SEQ ID NO: 3745110 - DNA, 17 bp, Homo sapiens
ttgagtggatgatgttt

SEQ ID NO: 3745111 - DNA, 19 bp, Homo sapiens
ttgagtggatgatgtttcg

SEQ ID NO: 3745112 - DNA, 18 bp, Homo sapiens
ttgagttaacctttaaga

SEQ ID NO: 3745113 - DNA, 21 bp, Homo sapiens
ttgagttttgttttaaaatta

SEQ ID NO: 3745114 - DNA, 12 bp, Homo sapiens
ttgataaagtaa

SEQ ID NO: 3745115 - DNA, 21 bp, Homo sapiens
ttgataaattccactggactt

SEQ ID NO: 3745116 - DNA, 17 bp, Homo sapiens
ttgatacttgttcaaaa

SEQ ID NO: 3745117 - DNA, 21 bp, Homo sapiens
ttgatatgaaaaatatgatat

SEQ ID NO: 3745118 - DNA, 18 bp, Homo sapiens
ttgatgactggaattttt

SEQ ID NO: 3745119 - DNA, 21 bp, Homo sapiens
ttgatgagtgtaacaagaaag

SEQ ID NO: 3745120 - DNA, 21 bp, Homo sapiens
ttgatggtcagacacaaacaa

SEQ ID NO: 3745121 - DNA, 17 bp, Homo sapiens
ttgatgtttgtggcctc

SEQ ID NO: 3745122 - DNA, 18 bp, Homo sapiens
ttgatgtttgtggcctca

SEQ ID NO: 3745123 - DNA, 20 bp, Homo sapiens
ttgatgtttgtggcctcaga

SEQ ID NO: 3745124 - DNA, 16 bp, Homo sapiens
ttgattattagccagg

SEQ ID NO: 3745125 - DNA, 15 bp, Homo sapiens
ttgattgtcagctac

SEQ ID NO: 3745126 - DNA, 17 bp, Homo sapiens
ttgattgtcagctacta

SEQ ID NO: 3745127 - DNA, 21 bp, Homo sapiens
ttgattgtcagctactaatga

SEQ ID NO: 3745128 - DNA, 16 bp, Homo sapiens
ttgatttaataacata

SEQ ID NO: 3745129 - DNA, 18 bp, Homo sapiens
ttgatttcccttcttctg

SEQ ID NO: 3745130 - DNA, 20 bp, Homo sapiens
ttgatttgttttagaatgat

SEQ ID NO: 3745131 - DNA, 23 bp, Homo sapiens
ttgattttacaattgaaatgact

SEQ ID NO: 3745132 - DNA, 15 bp, Homo sapiens
ttgcaaaatttccag

SEQ ID NO: 3745133 - DNA, 13 bp, Homo sapiens
ttgcaacacacag

SEQ ID NO: 3745134 - DNA, 14 bp, Homo sapiens
ttgcaacaggctgg

SEQ ID NO: 3745135 - DNA, 14 bp, Homo sapiens
ttgcaagaatcagt

SEQ ID NO: 3745136 - DNA, 23 bp, Homo sapiens
ttgcaaggccgctgttcacccac

SEQ ID NO: 3745137 - DNA, 19 bp, Homo sapiens
ttgcaatatcgatcagatg

SEQ ID NO: 3745138 - DNA, 19 bp, Homo sapiens
ttgcaatggcagccttggc

SEQ ID NO: 3745139 - DNA, 13 bp, Homo sapiens
ttgcacacttgtg

SEQ ID NO: 3745140 - DNA, 14 bp, Homo sapiens
ttgcaccactgcac

SEQ ID NO: 3745141 - DNA, 15 bp, Homo sapiens
ttgcaccactgcact

SEQ ID NO: 3745142 - DNA, 16 bp, Homo sapiens
ttgcaccactgcactc

SEQ ID NO: 3745143 - DNA, 18 bp, Homo sapiens
ttgcaccactgcactcca

SEQ ID NO: 3745144 - DNA, 18 bp, Homo sapiens
ttgcacgcccatgtgtga

SEQ ID NO: 3745145 - DNA, 20 bp, Homo sapiens
ttgcacgcccatgtgtgagt

SEQ ID NO: 3745146 - DNA, 15 bp, Homo sapiens
ttgcactccagcctg

SEQ ID NO: 3745147 - DNA, 19 bp, Homo sapiens
ttgcagaaaagcacctgcc

SEQ ID NO: 3745148 - DNA, 21 bp, Homo sapiens
ttgcagaaaagcacctgccga

SEQ ID NO: 3745149 - DNA, 22 bp, Homo sapiens
ttgcagacaggcaagcacctcc

SEQ ID NO: 3745150 - DNA, 19 bp, Homo sapiens
ttgcagactcagtttgtca

SEQ ID NO: 3745151 - DNA, 23 bp, Homo sapiens
ttgcagcagtgagtctcttcaga

SEQ ID NO: 3745152 - DNA, 20 bp, Homo sapiens
ttgcagtagagtcatctcca

SEQ ID NO: 3745153 - DNA, 15 bp, Homo sapiens
ttgcagtgagctgag

SEQ ID NO: 3745154 - DNA, 14 bp, Homo sapiens
ttgcataaaattgg

SEQ ID NO: 3745155 - DNA, 20 bp, Homo sapiens
ttgcataataagctaaagag

SEQ ID NO: 3745156 - DNA, 21 bp, Homo sapiens
ttgcataataagctaaagagg

SEQ ID NO: 3745157 - DNA, 22 bp, Homo sapiens
ttgcatagtaccaatcatttta

SEQ ID NO: 3745158 - DNA, 20 bp, Homo sapiens
ttgcatgggttttgtaggta

SEQ ID NO: 3745159 - DNA, 17 bp, Homo sapiens
ttgcattgaatatatta

SEQ ID NO: 3745160 - DNA, 15 bp, Homo sapiens
ttgcatttatggtca

SEQ ID NO: 3745161 - DNA, 15 bp, Homo sapiens
ttgccaaaataatgt

SEQ ID NO: 3745162 - DNA, 19 bp, Homo sapiens
ttgccaaaataatgtcttg

SEQ ID NO: 3745163 - DNA, 20 bp, Homo sapiens
ttgccaagaactgaaaacat

SEQ ID NO: 3745164 - DNA, 21 bp, Homo sapiens
ttgccaatgaggtctgaaatg

SEQ ID NO: 3745165 - DNA, 13 bp, Homo sapiens
ttgccacagctct

SEQ ID NO: 3745166 - DNA, 16 bp, Homo sapiens
ttgccaccaggagaac

SEQ ID NO: 3745167 - DNA, 15 bp, Homo sapiens
ttgccactgcctctt

SEQ ID NO: 3745168 - DNA, 21 bp, Homo sapiens
ttgccagtgtctttctttggt

SEQ ID NO: 3745169 - DNA, 23 bp, Homo sapiens
ttgccatcccctatggaccagaa

SEQ ID NO: 3745170 - DNA, 16 bp, Homo sapiens
ttgcccaacctcagca

SEQ ID NO: 3745171 - DNA, 16 bp, Homo sapiens
ttgcccagagatgcct

SEQ ID NO: 3745172 - DNA, 13 bp, Homo sapiens
ttgcccaggcagg

SEQ ID NO: 3745173 - DNA, 16 bp, Homo sapiens
ttgcccaggcaggtct

SEQ ID NO: 3745174 - DNA, 14 bp, Homo sapiens
ttgcccaggctggc

SEQ ID NO: 3745175 - DNA, 17 bp, Homo sapiens
ttgcccagggctcagcc

SEQ ID NO: 3745176 - DNA, 18 bp, Homo sapiens
ttgcccagggctcagcct

SEQ ID NO: 3745177 - DNA, 12 bp, Homo sapiens
ttgccccccacc

SEQ ID NO: 3745178 - DNA, 13 bp, Homo sapiens
ttgccccccaccc

SEQ ID NO: 3745179 - DNA, 16 bp, Homo sapiens
ttgcccttcacagtgt

SEQ ID NO: 3745180 - DNA, 21 bp, Homo sapiens
ttgccgttgccaagaactgaa

SEQ ID NO: 3745181 - DNA, 19 bp, Homo sapiens
ttgcctaataaacatcctt

SEQ ID NO: 3745182 - DNA, 19 bp, Homo sapiens
ttgcctaatacattaaagc

SEQ ID NO: 3745183 - DNA, 17 bp, Homo sapiens
ttgcctactatgccaga

SEQ ID NO: 3745184 - DNA, 18 bp, Homo sapiens
ttgcctccatggtgcctc

SEQ ID NO: 3745185 - DNA, 16 bp, Homo sapiens
ttgcctctgcctctga

SEQ ID NO: 3745186 - DNA, 20 bp, Homo sapiens
ttgcctgaagttggagtgag

SEQ ID NO: 3745187 - DNA, 17 bp, Homo sapiens
ttgccttctacttttaa

SEQ ID NO: 3745188 - DNA, 20 bp, Homo sapiens
ttgccttgggctgctcctca

SEQ ID NO: 3745189 - DNA, 17 bp, Homo sapiens
ttgcgaatggttccatt

SEQ ID NO: 3745190 - DNA, 19 bp, Homo sapiens
ttgcgttagaatgaggagg

SEQ ID NO: 3745191 - DNA, 21 bp, Homo sapiens
ttgctaaaaatagtggccaga

SEQ ID NO: 3745192 - DNA, 19 bp, Homo sapiens
ttgctagctatgtgacctt

SEQ ID NO: 3745193 - DNA, 15 bp, Homo sapiens
ttgctcacctggggt

SEQ ID NO: 3745194 - DNA, 23 bp, Homo sapiens
ttgctcatgcatagtcccagcta

SEQ ID NO: 3745195 - DNA, 23 bp, Homo sapiens
ttgctctatctcacagcacactc

SEQ ID NO: 3745196 - DNA, 11 bp, Homo sapiens
ttgctgagagc

SEQ ID NO: 3745197 - DNA, 21 bp, Homo sapiens
ttgctgcctgaagaacagtaa

SEQ ID NO: 3745198 - DNA, 20 bp, Homo sapiens
ttgctgctattttactgtct

SEQ ID NO: 3745199 - DNA, 19 bp, Homo sapiens
ttgctgctccttagctgcc

SEQ ID NO: 3745200 - DNA, 18 bp, Homo sapiens
ttgctgcttttccttggg

SEQ ID NO: 3745201 - DNA, 16 bp, Homo sapiens
ttgctggcaaagacag

SEQ ID NO: 3745202 - DNA, 17 bp, Homo sapiens
ttgctggtcttgtaaga

SEQ ID NO: 3745203 - DNA, 13 bp, Homo sapiens
ttgctgttttgat

SEQ ID NO: 3745204 - DNA, 12 bp, Homo sapiens
ttgcttatgaat

SEQ ID NO: 3745205 - DNA, 15 bp, Homo sapiens
ttgcttattgttcca

SEQ ID NO: 3745206 - DNA, 18 bp, Homo sapiens
ttgcttattgttccaaga

SEQ ID NO: 3745207 - DNA, 20 bp, Homo sapiens
ttgcttattgttccaagaca

SEQ ID NO: 3745208 - DNA, 15 bp, Homo sapiens
ttgcttctgggaagg

SEQ ID NO: 3745209 - DNA, 19 bp, Homo sapiens
ttgcttctgggaaggggtt

SEQ ID NO: 3745210 - DNA, 21 bp, Homo sapiens
ttgcttcttcccttaaaattt

SEQ ID NO: 3745211 - DNA, 12 bp, Homo sapiens
ttgcttgaaaga

SEQ ID NO: 3745212 - DNA, 22 bp, Homo sapiens
ttgcttgaaagaaaatatgcat

SEQ ID NO: 3745213 - DNA, 15 bp, Homo sapiens
ttgcttgaacacagt

SEQ ID NO: 3745214 - DNA, 17 bp, Homo sapiens
ttgcttgaacacagtat

SEQ ID NO: 3745215 - DNA, 18 bp, Homo sapiens
ttgcttgaacacagtatt

SEQ ID NO: 3745216 - DNA, 16 bp, Homo sapiens
ttgcttgagcccagga

SEQ ID NO: 3745217 - DNA, 18 bp, Homo sapiens
ttgcttgagcccaggagt

SEQ ID NO: 3745218 - DNA, 13 bp, Homo sapiens
ttgctttgtatgc

SEQ ID NO: 3745219 - DNA, 22 bp, Homo sapiens
ttggaaagcatcacctcaggcc

SEQ ID NO: 3745220 - DNA, 22 bp, Homo sapiens
ttggaaccacggagatctcctt

SEQ ID NO: 3745221 - DNA, 17 bp, Homo sapiens
ttggaagctctgaagtc

SEQ ID NO: 3745222 - DNA, 19 bp, Homo sapiens
ttggaagtttgtgttctgt

SEQ ID NO: 3745223 - DNA, 21 bp, Homo sapiens
ttggaattctgttcatttgtt

SEQ ID NO: 3745224 - DNA, 23 bp, Homo sapiens
ttggacaatcatgaaatatgcat

SEQ ID NO: 3745225 - DNA, 15 bp, Homo sapiens
ttggacacacacagc

SEQ ID NO: 3745226 - DNA, 14 bp, Homo sapiens
ttggacagcaaaac

SEQ ID NO: 3745227 - DNA, 22 bp, Homo sapiens
ttggacagcaaaaccattgctt

SEQ ID NO: 3745228 - DNA, 13 bp, Homo sapiens
ttggacggcctga

SEQ ID NO: 3745229 - DNA, 13 bp, Homo sapiens
ttggactattata

SEQ ID NO: 3745230 - DNA, 19 bp, Homo sapiens
ttggagaacgccagtctcc

SEQ ID NO: 3745231 - DNA, 13 bp, Homo sapiens
ttggagactctgt

SEQ ID NO: 3745232 - DNA, 15 bp, Homo sapiens
ttggagactctgtgg

SEQ ID NO: 3745233 - DNA, 13 bp, Homo sapiens
ttggagagtaaaa

SEQ ID NO: 3745234 - DNA, 18 bp, Homo sapiens
ttggagagtaaaaactga

SEQ ID NO: 3745235 - DNA, 20 bp, Homo sapiens
ttggagagtaaaaactgaat

SEQ ID NO: 3745236 - DNA, 19 bp, Homo sapiens
ttggaggaccaaaaaaata

SEQ ID NO: 3745237 - DNA, 23 bp, Homo sapiens
ttggagggtgggagagcccagcc

SEQ ID NO: 3745238 - DNA, 17 bp, Homo sapiens
ttggcaaaaaggcagga

SEQ ID NO: 3745239 - DNA, 16 bp, Homo sapiens
ttggcacagaaacaca

SEQ ID NO: 3745240 - DNA, 21 bp, Homo sapiens
ttggcaggggtggaggagagc

SEQ ID NO: 3745241 - DNA, 14 bp, Homo sapiens
ttggcattaaaact

SEQ ID NO: 3745242 - DNA, 20 bp, Homo sapiens
ttggccaaacatcagacctg

SEQ ID NO: 3745243 - DNA, 16 bp, Homo sapiens
ttggcccccgagctgg

SEQ ID NO: 3745244 - DNA, 18 bp, Homo sapiens
ttggcccctgcccggctg

SEQ ID NO: 3745245 - DNA, 22 bp, Homo sapiens
ttggcctgtctcatccccaggg

SEQ ID NO: 3745246 - DNA, 14 bp, Homo sapiens
ttggcgggccaagg

SEQ ID NO: 3745247 - DNA, 22 bp, Homo sapiens
ttggctaggacccctccatgtg

SEQ ID NO: 3745248 - DNA, 23 bp, Homo sapiens
ttggctattagagatcaacccct

SEQ ID NO: 3745249 - DNA, 13 bp, Homo sapiens
ttggctgggccca

SEQ ID NO: 3745250 - DNA, 18 bp, Homo sapiens
ttggctgggcccagaagg

SEQ ID NO: 3745251 - DNA, 21 bp, Homo sapiens
ttggctgggggcctcagtgcc

SEQ ID NO: 3745252 - DNA, 22 bp, Homo sapiens
ttggctgggggcctcagtgcca

SEQ ID NO: 3745253 - DNA, 17 bp, Homo sapiens
ttgggaggccccactgg

SEQ ID NO: 3745254 - DNA, 15 bp, Homo sapiens
ttgggaggctgaggc

SEQ ID NO: 3745255 - DNA, 18 bp, Homo sapiens
ttgggatgtcttattttt

SEQ ID NO: 3745256 - DNA, 23 bp, Homo sapiens
ttgggatgtcttatttttagatg

SEQ ID NO: 3745257 - DNA, 12 bp, Homo sapiens
ttgggccctcct

SEQ ID NO: 3745258 - DNA, 14 bp, Homo sapiens
ttggggcttcttgg

SEQ ID NO: 3745259 - DNA, 16 bp, Homo sapiens
ttgggggctgtgggga

SEQ ID NO: 3745260 - DNA, 23 bp, Homo sapiens
ttggggggggcccgcctggcaga

SEQ ID NO: 3745261 - DNA, 23 bp, Homo sapiens
ttgggtagaaagagatacagagg

SEQ ID NO: 3745262 - DNA, 16 bp, Homo sapiens
ttgggtggatgcctgg

SEQ ID NO: 3745263 - DNA, 23 bp, Homo sapiens
ttgggtgtaacaggtctcctctt

SEQ ID NO: 3745264 - DNA, 22 bp, Homo sapiens
ttggtactactagatgtcttta

SEQ ID NO: 3745265 - DNA, 20 bp, Homo sapiens
ttggtctgacccactgcttt

SEQ ID NO: 3745266 - DNA, 13 bp, Homo sapiens
ttggtctgtgtga

SEQ ID NO: 3745267 - DNA, 19 bp, Homo sapiens
ttggtcttatttattattg

SEQ ID NO: 3745268 - DNA, 17 bp, Homo sapiens
ttggtgcctttcctgtt

SEQ ID NO: 3745269 - DNA, 14 bp, Homo sapiens
ttggtggatgtaaa

SEQ ID NO: 3745270 - DNA, 23 bp, Homo sapiens
ttggtgtgtttttgggatgtctt

SEQ ID NO: 3745271 - DNA, 13 bp, Homo sapiens
ttggttatacatg

SEQ ID NO: 3745272 - DNA, 16 bp, Homo sapiens
ttggttatacatgaca

SEQ ID NO: 3745273 - DNA, 18 bp, Homo sapiens
ttggttcatcagtgttaa

SEQ ID NO: 3745274 - DNA, 22 bp, Homo sapiens
ttggttttaattgaaggaaaga

SEQ ID NO: 3745275 - DNA, 19 bp, Homo sapiens
ttgtaaaaacagcattgct

SEQ ID NO: 3745276 - DNA, 23 bp, Homo sapiens
ttgtaaacaaactgtgtaactgc

SEQ ID NO: 3745277 - DNA, 22 bp, Homo sapiens
ttgtaaactcaaaatatttgta

SEQ ID NO: 3745278 - DNA, 14 bp, Homo sapiens
ttgtaaactgtact

SEQ ID NO: 3745279 - DNA, 13 bp, Homo sapiens
ttgtaaagagttg

SEQ ID NO: 3745280 - DNA, 23 bp, Homo sapiens
ttgtaacatccaataggaatgct

SEQ ID NO: 3745281 - DNA, 21 bp, Homo sapiens
ttgtaagagctatacagtttt

SEQ ID NO: 3745282 - DNA, 11 bp, Homo sapiens
ttgtaagattt

SEQ ID NO: 3745283 - DNA, 21 bp, Homo sapiens
ttgtaagtgagagagacaaga

SEQ ID NO: 3745284 - DNA, 15 bp, Homo sapiens
ttgtaatcgttatgt

SEQ ID NO: 3745285 - DNA, 17 bp, Homo sapiens
ttatatatgtatttata

SEQ ID NO: 3745286 - DNA, 13 bp, Homo sapiens
ttatatatttata

SEQ ID NO: 3745287 - DNA, 13 bp, Homo sapiens
ttatatgaacata

SEQ ID NO: 3745288 - DNA, 14 bp, Homo sapiens
ttatattccatata

SEQ ID NO: 3745289 - DNA, 16 bp, Homo sapiens
ttatattccatatatt

SEQ ID NO: 3745290 - DNA, 14 bp, Homo sapiens
ttatattgagacaa

SEQ ID NO: 3745291 - DNA, 13 bp, Homo sapiens
ttatattgcaatg

SEQ ID NO: 3745292 - DNA, 15 bp, Homo sapiens
ttatcaatttgtcat

SEQ ID NO: 3745293 - DNA, 18 bp, Homo sapiens
ttatcacattatttgcat

SEQ ID NO: 3745294 - DNA, 15 bp, Homo sapiens
ttatcacttttctgt

SEQ ID NO: 3745295 - DNA, 12 bp, Homo sapiens
ttatcattttca

SEQ ID NO: 3745296 - DNA, 22 bp, Homo sapiens
ttatcccacggaaaatgccaat

SEQ ID NO: 3745297 - DNA, 19 bp, Homo sapiens
ttatcctaaaacaaatagt

SEQ ID NO: 3745298 - DNA, 14 bp, Homo sapiens
ttatcgaaactcat

SEQ ID NO: 3745299 - DNA, 14 bp, Homo sapiens
ttatcgggaacagt

SEQ ID NO: 3745300 - DNA, 23 bp, Homo sapiens
ttatcgggaacagtgtttcccat

SEQ ID NO: 3745301 - DNA, 21 bp, Homo sapiens
ttatcgggagcagtgtcttcc

SEQ ID NO: 3745302 - DNA, 17 bp, Homo sapiens
ttatctattgtaagata

SEQ ID NO: 3745303 - DNA, 21 bp, Homo sapiens
ttatctatttgtatatataca

SEQ ID NO: 3745304 - DNA, 18 bp, Homo sapiens
ttatctgagtcaactcct

SEQ ID NO: 3745305 - DNA, 23 bp, Homo sapiens
ttatctgggattatggttttgtg

SEQ ID NO: 3745306 - DNA, 18 bp, Homo sapiens
ttatctgtgtttttgaaa

SEQ ID NO: 3745307 - DNA, 16 bp, Homo sapiens
ttatcttacaaagtgt

SEQ ID NO: 3745308 - DNA, 20 bp, Homo sapiens
ttatcttcaggacactcact

SEQ ID NO: 3745309 - DNA, 16 bp, Homo sapiens
ttatcttggactgaca

SEQ ID NO: 3745310 - DNA, 16 bp, Homo sapiens
ttatctttacttttaa

SEQ ID NO: 3745311 - DNA, 14 bp, Homo sapiens
ttatgacagttata

SEQ ID NO: 3745312 - DNA, 16 bp, Homo sapiens
ttatgacatcacttgt

SEQ ID NO: 3745313 - DNA, 23 bp, Homo sapiens
ttatgacatcacttgtacaaaat

SEQ ID NO: 3745314 - DNA, 13 bp, Homo sapiens
ttatgagtttttg

SEQ ID NO: 3745315 - DNA, 23 bp, Homo sapiens
ttatgcaggggcaaacacctgct

SEQ ID NO: 3745316 - DNA, 18 bp, Homo sapiens
ttatgccatttgtttatt

SEQ ID NO: 3745317 - DNA, 16 bp, Homo sapiens
ttatgctgtattttct

SEQ ID NO: 3745318 - DNA, 19 bp, Homo sapiens
ttatggaagattttaaatt

SEQ ID NO: 3745319 - DNA, 12 bp, Homo sapiens
ttatggcctcag

SEQ ID NO: 3745320 - DNA, 15 bp, Homo sapiens
ttatggcctcagctg

SEQ ID NO: 3745321 - DNA, 21 bp, Homo sapiens
ttatgtatatttaaaagaaag

SEQ ID NO: 3745322 - DNA, 18 bp, Homo sapiens
ttatgtctaaaatcctgc

SEQ ID NO: 3745323 - DNA, 13 bp, Homo sapiens
ttatgtgagagaa

SEQ ID NO: 3745324 - DNA, 18 bp, Homo sapiens
ttatgtgccgtgttattg

SEQ ID NO: 3745325 - DNA, 15 bp, Homo sapiens
ttatgttttgtttct

SEQ ID NO: 3745326 - DNA, 16 bp, Homo sapiens
ttattaaaatcttaaa

SEQ ID NO: 3745327 - DNA, 20 bp, Homo sapiens
ttattaagatggattctcag

SEQ ID NO: 3745328 - DNA, 23 bp, Homo sapiens
ttattacagggcattcaaatggg

SEQ ID NO: 3745329 - DNA, 15 bp, Homo sapiens
ttattacatccttgt

SEQ ID NO: 3745330 - DNA, 21 bp, Homo sapiens
ttattacatccttgtggcaca

SEQ ID NO: 3745331 - DNA, 20 bp, Homo sapiens
ttattagtaaatgcttatca

SEQ ID NO: 3745332 - DNA, 21 bp, Homo sapiens
ttattcactgaagttctcctg

SEQ ID NO: 3745333 - DNA, 18 bp, Homo sapiens
ttattcagttaagaaaaa

SEQ ID NO: 3745334 - DNA, 15 bp, Homo sapiens
ttattctcaaagcag

SEQ ID NO: 3745335 - DNA, 11 bp, Homo sapiens
ttattctgctc

SEQ ID NO: 3745336 - DNA, 14 bp, Homo sapiens
ttattcttgtgaat

SEQ ID NO: 3745337 - DNA, 19 bp, Homo sapiens
ttattgcagcgattaataa

SEQ ID NO: 3745338 - DNA, 23 bp, Homo sapiens
ttattgcttgatacttttgacaa

SEQ ID NO: 3745339 - DNA, 13 bp, Homo sapiens
ttattggaattaa

SEQ ID NO: 3745340 - DNA, 15 bp, Homo sapiens
ttattgtacctctct

SEQ ID NO: 3745341 - DNA, 17 bp, Homo sapiens
ttattgttccaagacat

SEQ ID NO: 3745342 - DNA, 19 bp, Homo sapiens
ttattgttccaagacattg

SEQ ID NO: 3745343 - DNA, 23 bp, Homo sapiens
ttattgttccaagacattgtcaa

SEQ ID NO: 3745344 - DNA, 12 bp, Homo sapiens
ttatttaaatga

SEQ ID NO: 3745345 - DNA, 22 bp, Homo sapiens
ttatttaatgaaagactgtaca

SEQ ID NO: 3745346 - DNA, 16 bp, Homo sapiens
ttatttaatgttatgt

SEQ ID NO: 3745347 - DNA, 15 bp, Homo sapiens
ttatttatttatgga

SEQ ID NO: 3745348 - DNA, 19 bp, Homo sapiens
ttatttcccagtaattatt

SEQ ID NO: 3745349 - DNA, 18 bp, Homo sapiens
ttatttgcagagacagga

SEQ ID NO: 3745350 - DNA, 19 bp, Homo sapiens
ttatttggggttgcatcag

SEQ ID NO: 3745351 - DNA, 12 bp, Homo sapiens
ttattttaaatt

SEQ ID NO: 3745352 - DNA, 14 bp, Homo sapiens
ttattttaaattat

SEQ ID NO: 3745353 - DNA, 23 bp, Homo sapiens
ttattttaaattataaggactgc

SEQ ID NO: 3745354 - DNA, 16 bp, Homo sapiens
ttattttagcagttct

SEQ ID NO: 3745355 - DNA, 18 bp, Homo sapiens
ttattttcaagaaactga

SEQ ID NO: 3745356 - DNA, 12 bp, Homo sapiens
ttattttcactg

SEQ ID NO: 3745357 - DNA, 14 bp, Homo sapiens
ttattttcctcccc

SEQ ID NO: 3745358 - DNA, 20 bp, Homo sapiens
ttatttttatacagtagtga

SEQ ID NO: 3745359 - DNA, 13 bp, Homo sapiens
ttattttttatac

SEQ ID NO: 3745360 - DNA, 14 bp, Homo sapiens
ttatttttttctac

SEQ ID NO: 3745361 - DNA, 21 bp, Homo sapiens
ttcaaaaatgtacaaaataaa

SEQ ID NO: 3745362 - DNA, 16 bp, Homo sapiens
ttcaaaatggagggaa

SEQ ID NO: 3745363 - DNA, 14 bp, Homo sapiens
ttcaaaatgtctgt

SEQ ID NO: 3745364 - DNA, 21 bp, Homo sapiens
ttcaacatcaatgttcattgt

SEQ ID NO: 3745365 - DNA, 19 bp, Homo sapiens
ttcaaccactgtaaaatga

SEQ ID NO: 3745366 - DNA, 13 bp, Homo sapiens
ttcaacgcagccc

SEQ ID NO: 3745367 - DNA, 19 bp, Homo sapiens
ttcaacgcagccctgcttt

SEQ ID NO: 3745368 - DNA, 22 bp, Homo sapiens
ttcaagaaagcttcaaactgca

SEQ ID NO: 3745369 - DNA, 18 bp, Homo sapiens
ttcaagaccttctcccca

SEQ ID NO: 3745370 - DNA, 21 bp, Homo sapiens
ttcaagcgattcttctgcttc

SEQ ID NO: 3745371 - DNA, 16 bp, Homo sapiens
ttcaagggctgcttca

SEQ ID NO: 3745372 - DNA, 16 bp, Homo sapiens
ttcaaggtaaaattct

SEQ ID NO: 3745373 - DNA, 19 bp, Homo sapiens
ttcaaggtaaaattctaaa

SEQ ID NO: 3745374 - DNA, 22 bp, Homo sapiens
ttcaagtgcatgctctctgcag

SEQ ID NO: 3745375 - DNA, 17 bp, Homo sapiens
ttcaagttagctcagga

SEQ ID NO: 3745376 - DNA, 12 bp, Homo sapiens
ttcaataaagta

SEQ ID NO: 3745377 - DNA, 13 bp, Homo sapiens
ttcaataaagtat

SEQ ID NO: 3745378 - DNA, 20 bp, Homo sapiens
ttcaataagcatcaaactct

SEQ ID NO: 3745379 - DNA, 20 bp, Homo sapiens
ttcaattcaaaaatgtacaa

SEQ ID NO: 3745380 - DNA, 19 bp, Homo sapiens
ttcaattcagtgctgtact

SEQ ID NO: 3745381 - DNA, 16 bp, Homo sapiens
ttcaattcctctggga

SEQ ID NO: 3745382 - DNA, 16 bp, Homo sapiens
ttcaatttattgcaca

SEQ ID NO: 3745383 - DNA, 18 bp, Homo sapiens
ttcaatttattgcacaaa

SEQ ID NO: 3745384 - DNA, 17 bp, Homo sapiens
ttcaatttccaagagct

SEQ ID NO: 3745385 - DNA, 13 bp, Homo sapiens
ttcacaagctgcc

SEQ ID NO: 3745386 - DNA, 16 bp, Homo sapiens
ttcacaagctgcctcc

SEQ ID NO: 3745387 - DNA, 13 bp, Homo sapiens
ttcacaatagaaa

SEQ ID NO: 3745388 - DNA, 22 bp, Homo sapiens
ttcacaatggtgctcatttcat

SEQ ID NO: 3745389 - DNA, 21 bp, Homo sapiens
ttcacacacaggcaactgagg

SEQ ID NO: 3745390 - DNA, 18 bp, Homo sapiens
ttcacacttccaccagcc

SEQ ID NO: 3745391 - DNA, 19 bp, Homo sapiens
ttcacacttccaccagcct

SEQ ID NO: 3745392 - DNA, 18 bp, Homo sapiens
ttcacagtaccatctgaa

SEQ ID NO: 3745393 - DNA, 13 bp, Homo sapiens
ttcacagtttttc

SEQ ID NO: 3745394 - DNA, 19 bp, Homo sapiens
ttcacataaaatagatttt

SEQ ID NO: 3745395 - DNA, 18 bp, Homo sapiens
ttcacatgcatcaagtta

SEQ ID NO: 3745396 - DNA, 22 bp, Homo sapiens
ttcacattaatatttgctgaca

SEQ ID NO: 3745397 - DNA, 16 bp, Homo sapiens
ttcaccatgtaaaaca

SEQ ID NO: 3745398 - DNA, 16 bp, Homo sapiens
ttcacccacagaaaga

SEQ ID NO: 3745399 - DNA, 15 bp, Homo sapiens
ttcacccagacagct

SEQ ID NO: 3745400 - DNA, 22 bp, Homo sapiens
ttcaccctgtccaaactgccta

SEQ ID NO: 3745401 - DNA, 11 bp, Homo sapiens
ttcacctgtaa

SEQ ID NO: 3745402 - DNA, 16 bp, Homo sapiens
ttcacctgtaaaactt

SEQ ID NO: 3745403 - DNA, 19 bp, Homo sapiens
ttcacctgtttttaagctg

SEQ ID NO: 3745404 - DNA, 14 bp, Homo sapiens
ttcaccttgaagaa

SEQ ID NO: 3745405 - DNA, 21 bp, Homo sapiens
ttcacgcctgtaatcccagca

SEQ ID NO: 3745406 - DNA, 23 bp, Homo sapiens
ttcacgcctgtaatcccagcact

SEQ ID NO: 3745407 - DNA, 20 bp, Homo sapiens
ttcactatttttatttatat

SEQ ID NO: 3745408 - DNA, 17 bp, Homo sapiens
ttcactgctggctgcct

SEQ ID NO: 3745409 - DNA, 18 bp, Homo sapiens
ttcactgctggctgcctt

SEQ ID NO: 3745410 - DNA, 19 bp, Homo sapiens
ttcactgctggctgcctta

SEQ ID NO: 3745411 - DNA, 13 bp, Homo sapiens
ttcactggcccaa

SEQ ID NO: 3745412 - DNA, 15 bp, Homo sapiens
ttcactgtagaatga

SEQ ID NO: 3745413 - DNA, 23 bp, Homo sapiens
ttcagaatctgaatgtaatttgt

SEQ ID NO: 3745414 - DNA, 15 bp, Homo sapiens
ttcagagaggccttt

SEQ ID NO: 3745415 - DNA, 19 bp, Homo sapiens
ttcagaggtggctctggaa

SEQ ID NO: 3745416 - DNA, 16 bp, Homo sapiens
ttcagatatatttttc

SEQ ID NO: 3745417 - DNA, 13 bp, Homo sapiens
ttcagatcctacc

SEQ ID NO: 3745418 - DNA, 14 bp, Homo sapiens
ttcagatcctaccc

SEQ ID NO: 3745419 - DNA, 19 bp, Homo sapiens
ttcagatgcttctgggaga

SEQ ID NO: 3745420 - DNA, 22 bp, Homo sapiens
ttcagattcccagagcaaaata

SEQ ID NO: 3745421 - DNA, 18 bp, Homo sapiens
ttcagcaatatttaagga

SEQ ID NO: 3745422 - DNA, 16 bp, Homo sapiens
ttcagcatatttatag

SEQ ID NO: 3745423 - DNA, 13 bp, Homo sapiens
ttcagccaggagc

SEQ ID NO: 3745424 - DNA, 17 bp, Homo sapiens
ttcagccaggagctggg

SEQ ID NO: 3745425 - DNA, 13 bp, Homo sapiens
ttcagcccctcct

SEQ ID NO: 3745426 - DNA, 18 bp, Homo sapiens
ttcagctcacacatgaga

SEQ ID NO: 3745427 - DNA, 12 bp, Homo sapiens
ttcagctccagc

SEQ ID NO: 3745428 - DNA, 23 bp, Homo sapiens
ttcagctccagctcaccagcccc

SEQ ID NO: 3745429 - DNA, 24 bp, Homo sapiens
ttcagctctgcaagaattgaagca

SEQ ID NO: 3745430 - DNA, 16 bp, Homo sapiens
ttcaggaacctggacc

SEQ ID NO: 3745431 - DNA, 16 bp, Homo sapiens
ttcaggctcttctcct

SEQ ID NO: 3745432 - DNA, 22 bp, Homo sapiens
ttcagggaatttcaggaactag

SEQ ID NO: 3745433 - DNA, 13 bp, Homo sapiens
ttcagggcctcca

SEQ ID NO: 3745434 - DNA, 21 bp, Homo sapiens
ttcaggggagtcccgtcagga

SEQ ID NO: 3745435 - DNA, 17 bp, Homo sapiens
ttcagggttggcccctg

SEQ ID NO: 3745436 - DNA, 17 bp, Homo sapiens
ttcaggtaacaggcaga

SEQ ID NO: 3745437 - DNA, 20 bp, Homo sapiens
ttcagtaataaactgtgttt

SEQ ID NO: 3745438 - DNA, 20 bp, Homo sapiens
ttcagtgagggtcttcttac

SEQ ID NO: 3745439 - DNA, 13 bp, Homo sapiens
ttcagtgctgtgg

SEQ ID NO: 3745440 - DNA, 21 bp, Homo sapiens
ttcagtgctgtggcctgggca

SEQ ID NO: 3745441 - DNA, 13 bp, Homo sapiens
ttcagtggcagct

SEQ ID NO: 3745442 - DNA, 15 bp, Homo sapiens
ttcagtggcagctgc

SEQ ID NO: 3745443 - DNA, 13 bp, Homo sapiens
ttcagtgtacatg

SEQ ID NO: 3745444 - DNA, 15 bp, Homo sapiens
ttcagttaagaaaaa

SEQ ID NO: 3745445 - DNA, 21 bp, Homo sapiens
ttcagttaagaaaaaaataat

SEQ ID NO: 3745446 - DNA, 18 bp, Homo sapiens
ttcagttgatcactggca

SEQ ID NO: 3745447 - DNA, 17 bp, Homo sapiens
ttcagttttatctttaa

SEQ ID NO: 3745448 - DNA, 17 bp, Homo sapiens
ttcataacagtgccatt

SEQ ID NO: 3745449 - DNA, 22 bp, Homo sapiens
ttcataacagtgccattgtctt

SEQ ID NO: 3745450 - DNA, 14 bp, Homo sapiens
ttcatagatttcct

SEQ ID NO: 3745451 - DNA, 19 bp, Homo sapiens
ttcatagggtctcttcagg

SEQ ID NO: 3745452 - DNA, 16 bp, Homo sapiens
ttcatatttacttctt

SEQ ID NO: 3745453 - DNA, 16 bp, Homo sapiens
ttcatccaatcctcac

SEQ ID NO: 3745454 - DNA, 20 bp, Homo sapiens
ttcatccaatcctcactggg

SEQ ID NO: 3745455 - DNA, 20 bp, Homo sapiens
ttcatctaccattttctggt

SEQ ID NO: 3745456 - DNA, 16 bp, Homo sapiens
ttcatctatttctgag

SEQ ID NO: 3745457 - DNA, 22 bp, Homo sapiens
ttcatcttggtcacatacaatt

SEQ ID NO: 3745458 - DNA, 18 bp, Homo sapiens
ttcatgaaaatcctacca

SEQ ID NO: 3745459 - DNA, 20 bp, Homo sapiens
ttcatgcaaggggaaaatct

SEQ ID NO: 3745460 - DNA, 19 bp, Homo sapiens
ttcatgccaccatggccag

SEQ ID NO: 3745461 - DNA, 17 bp, Homo sapiens
ttcatgctatctctgtg

SEQ ID NO: 3745462 - DNA, 18 bp, Homo sapiens
ttcatgctatctctgtgt

SEQ ID NO: 3745463 - DNA, 15 bp, Homo sapiens
ttcattaaagcattt

SEQ ID NO: 3745464 - DNA, 17 bp, Homo sapiens
ttcattattggaattaa

SEQ ID NO: 3745465 - DNA, 14 bp, Homo sapiens
ttcattctggtctc

SEQ ID NO: 3745466 - DNA, 15 bp, Homo sapiens
ttcattgccagtgtc

SEQ ID NO: 3745467 - DNA, 16 bp, Homo sapiens
ttcattgccagtgtct

SEQ ID NO: 3745468 - DNA, 17 bp, Homo sapiens
ttcattgccagtgtctt

SEQ ID NO: 3745469 - DNA, 19 bp, Homo sapiens
ttcattgccagtgtctttc

SEQ ID NO: 3745470 - DNA, 13 bp, Homo sapiens
ttcattgtataaa

SEQ ID NO: 3745471 - DNA, 17 bp, Homo sapiens
ttcattgtataaaaata

SEQ ID NO: 3745472 - DNA, 13 bp, Homo sapiens
ttcatttctgata

SEQ ID NO: 3745473 - DNA, 19 bp, Homo sapiens
ttcatttctgatatagaat

SEQ ID NO: 3745474 - DNA, 20 bp, Homo sapiens
ttccaaagcacattgaaaga

SEQ ID NO: 3745475 - DNA, 13 bp, Homo sapiens
ttccaactgctgc

SEQ ID NO: 3745476 - DNA, 22 bp, Homo sapiens
ttccaactgctgccccaaagga

SEQ ID NO: 3745477 - DNA, 12 bp, Homo sapiens
ttccaagacatt

SEQ ID NO: 3745478 - DNA, 17 bp, Homo sapiens
ttccaagacattgtcaa

SEQ ID NO: 3745479 - DNA, 12 bp, Homo sapiens
ttccaagagctg

SEQ ID NO: 3745480 - DNA, 16 bp, Homo sapiens
ttccaagcaaatgtta

SEQ ID NO: 3745481 - DNA, 13 bp, Homo sapiens
ttccaaggagacc

SEQ ID NO: 3745482 - DNA, 22 bp, Homo sapiens
ttccaagtagaattgatttccc

SEQ ID NO: 3745483 - DNA, 18 bp, Homo sapiens
ttccacaaaatctgtcca

SEQ ID NO: 3745484 - DNA, 20 bp, Homo sapiens
ttccacatccggaggagaag

SEQ ID NO: 3745485 - DNA, 12 bp, Homo sapiens
ttccaccccctc

SEQ ID NO: 3745486 - DNA, 18 bp, Homo sapiens
ttccactgatggaaacaa

SEQ ID NO: 3745487 - DNA, 21 bp, Homo sapiens
ttccagaaaaccccagcatcc

SEQ ID NO: 3745488 - DNA, 23 bp, Homo sapiens
ttccagactgcttccaattttct

SEQ ID NO: 3745489 - DNA, 21 bp, Homo sapiens
ttccagagagtggctcctccc

SEQ ID NO: 3745490 - DNA, 20 bp, Homo sapiens
ttccagaggctattattttc

SEQ ID NO: 3745491 - DNA, 17 bp, Homo sapiens
ttccaggtgtttatagt

SEQ ID NO: 3745492 - DNA, 18 bp, Homo sapiens
ttccagtacctttgtcac

SEQ ID NO: 3745493 - DNA, 19 bp, Homo sapiens
ttccagtacctttgtcaca

SEQ ID NO: 3745494 - DNA, 16 bp, Homo sapiens
ttccagtggcctggct

SEQ ID NO: 3745495 - DNA, 17 bp, Homo sapiens
ttccataaggaatgtag

SEQ ID NO: 3745496 - DNA, 22 bp, Homo sapiens
ttccataatctggactcctctg

SEQ ID NO: 3745497 - DNA, 23 bp, Homo sapiens
ttccataatctggactcctctgt

SEQ ID NO: 3745498 - DNA, 19 bp, Homo sapiens
ttccataatgtataaagaa

SEQ ID NO: 3745499 - DNA, 14 bp, Homo sapiens
ttccataattatga

SEQ ID NO: 3745500 - DNA, 16 bp, Homo sapiens
ttccataattatgaca

SEQ ID NO: 3745501 - DNA, 18 bp, Homo sapiens
ttccatatattagcattt

SEQ ID NO: 3745502 - DNA, 14 bp, Homo sapiens
ttccatatgctgtt

SEQ ID NO: 3745503 - DNA, 20 bp, Homo sapiens
ttccatcataattctaatct

SEQ ID NO: 3745504 - DNA, 16 bp, Homo sapiens
ttccatgaaggcagag

SEQ ID NO: 3745505 - DNA, 14 bp, Homo sapiens
ttccattatgattc

SEQ ID NO: 3745506 - DNA, 19 bp, Homo sapiens
ttcccaacacttcagactg

SEQ ID NO: 3745507 - DNA, 14 bp, Homo sapiens
ttcccaagctctgc

SEQ ID NO: 3745508 - DNA, 15 bp, Homo sapiens
ttcccaagctctgct

SEQ ID NO: 3745509 - DNA, 21 bp, Homo sapiens
ttcccaatagcactttcattg

SEQ ID NO: 3745510 - DNA, 18 bp, Homo sapiens
ttcccagagcaaaataat

SEQ ID NO: 3745511 - DNA, 14 bp, Homo sapiens
ttcccagatacttc

SEQ ID NO: 3745512 - DNA, 14 bp, Homo sapiens
ttcccagctctccc

SEQ ID NO: 3745513 - DNA, 20 bp, Homo sapiens
ttcccagctctccctctggc

SEQ ID NO: 3745514 - DNA, 23 bp, Homo sapiens
ttcccagctctccctctggccct

SEQ ID NO: 3745515 - DNA, 22 bp, Homo sapiens
ttaaaatgtataagttgaggca

SEQ ID NO: 3745516 - DNA, 13 bp, Homo sapiens
ttaaaatttatat

SEQ ID NO: 3745517 - DNA, 15 bp, Homo sapiens
ttaaaatttattgct

SEQ ID NO: 3745518 - DNA, 14 bp, Homo sapiens
ttaaacaaaggttg

SEQ ID NO: 3745519 - DNA, 16 bp, Homo sapiens
ttaaacaatttatttt

SEQ ID NO: 3745520 - DNA, 18 bp, Homo sapiens
ttaaacaatttattttat

SEQ ID NO: 3745521 - DNA, 20 bp, Homo sapiens
ttaaactgtgtggactgtga

SEQ ID NO: 3745522 - DNA, 20 bp, Homo sapiens
ttaaactttcaatatcttta

SEQ ID NO: 3745523 - DNA, 12 bp, Homo sapiens
ttaaagacagag

SEQ ID NO: 3745524 - DNA, 20 bp, Homo sapiens
ttaaagcatttactttgaat

SEQ ID NO: 3745525 - DNA, 20 bp, Homo sapiens
ttaaagtgtattataacagt

SEQ ID NO: 3745526 - DNA, 15 bp, Homo sapiens
ttaaagttctgtgta

SEQ ID NO: 3745527 - DNA, 19 bp, Homo sapiens
ttaaagttctgtgtattta

SEQ ID NO: 3745528 - DNA, 11 bp, Homo sapiens
ttaaataaaag

SEQ ID NO: 3745529 - DNA, 20 bp, Homo sapiens
ttaaataaaagaaatgcaca

SEQ ID NO: 3745530 - DNA, 15 bp, Homo sapiens
ttaaataaaataacc

SEQ ID NO: 3745531 - DNA, 17 bp, Homo sapiens
ttaaatatatgtatgta

SEQ ID NO: 3745532 - DNA, 23 bp, Homo sapiens
ttaaatatattttcaaagtacat

SEQ ID NO: 3745533 - DNA, 21 bp, Homo sapiens
ttaaatatgttagcaaagagt

SEQ ID NO: 3745534 - DNA, 17 bp, Homo sapiens
ttaaatatttacatatg

SEQ ID NO: 3745535 - DNA, 15 bp, Homo sapiens
ttaaatgaaagcatg

SEQ ID NO: 3745536 - DNA, 18 bp, Homo sapiens
ttaaatgtaaagacaaaa

SEQ ID NO: 3745537 - DNA, 19 bp, Homo sapiens
ttaaattaaacaatttatt

SEQ ID NO: 3745538 - DNA, 13 bp, Homo sapiens
ttaaattataagg

SEQ ID NO: 3745539 - DNA, 16 bp, Homo sapiens
ttaaattttaatttat

SEQ ID NO: 3745540 - DNA, 15 bp, Homo sapiens
ttaaattttcttcag

SEQ ID NO: 3745541 - DNA, 16 bp, Homo sapiens
ttaaattttcttcagt

SEQ ID NO: 3745542 - DNA, 12 bp, Homo sapiens
ttaaatttttcc

SEQ ID NO: 3745543 - DNA, 19 bp, Homo sapiens
ttaacaaaccctcgtttct

SEQ ID NO: 3745544 - DNA, 23 bp, Homo sapiens
ttaacaaaccctcgtttctgatt

SEQ ID NO: 3745545 - DNA, 12 bp, Homo sapiens
ttaacaaggaat

SEQ ID NO: 3745546 - DNA, 21 bp, Homo sapiens
ttaacaaggaatgcctgtgcc

SEQ ID NO: 3745547 - DNA, 16 bp, Homo sapiens
ttaacacacataaagg

SEQ ID NO: 3745548 - DNA, 14 bp, Homo sapiens
ttaacagagacaga

SEQ ID NO: 3745549 - DNA, 19 bp, Homo sapiens
ttaacagttttccatgaaa

SEQ ID NO: 3745550 - DNA, 20 bp, Homo sapiens
ttaacagttttccatgaaaa

SEQ ID NO: 3745551 - DNA, 11 bp, Homo sapiens
ttaacataaag

SEQ ID NO: 3745552 - DNA, 21 bp, Homo sapiens
ttaacataaaggttattttct

SEQ ID NO: 3745553 - DNA, 13 bp, Homo sapiens
ttaacatataata

SEQ ID NO: 3745554 - DNA, 18 bp, Homo sapiens
ttaacatataatatatgt

SEQ ID NO: 3745555 - DNA, 20 bp, Homo sapiens
ttaacattgaccaagaactg

SEQ ID NO: 3745556 - DNA, 16 bp, Homo sapiens
ttaaccagtctgaagt

SEQ ID NO: 3745557 - DNA, 21 bp, Homo sapiens
ttaaccagtctgaagtttcat

SEQ ID NO: 3745558 - DNA, 22 bp, Homo sapiens
ttaaccagtctgaagtttcatt

SEQ ID NO: 3745559 - DNA, 12 bp, Homo sapiens
ttaactagaatt

SEQ ID NO: 3745560 - DNA, 15 bp, Homo sapiens
ttaactatgtacaat

SEQ ID NO: 3745561 - DNA, 14 bp, Homo sapiens
ttaactcaggactc

SEQ ID NO: 3745562 - DNA, 17 bp, Homo sapiens
ttaactcaggactccag

SEQ ID NO: 3745563 - DNA, 22 bp, Homo sapiens
ttaactcaggactccagcccat

SEQ ID NO: 3745564 - DNA, 11 bp, Homo sapiens
ttaactctttg

SEQ ID NO: 3745565 - DNA, 12 bp, Homo sapiens
ttaactctttgc

SEQ ID NO: 3745566 - DNA, 19 bp, Homo sapiens
ttaactgtgtatgtacata

SEQ ID NO: 3745567 - DNA, 16 bp, Homo sapiens
ttaagaaaaaaataat

SEQ ID NO: 3745568 - DNA, 17 bp, Homo sapiens
ttaagaaaaaaataatt

SEQ ID NO: 3745569 - DNA, 20 bp, Homo sapiens
ttaagaaaaaataacacaca

SEQ ID NO: 3745570 - DNA, 14 bp, Homo sapiens
ttaagaccagcctg

SEQ ID NO: 3745571 - DNA, 15 bp, Homo sapiens
ttaagaggcagggtc

SEQ ID NO: 3745572 - DNA, 21 bp, Homo sapiens
ttaagatggattctcagatat

SEQ ID NO: 3745573 - DNA, 13 bp, Homo sapiens
ttaagatttaatt

SEQ ID NO: 3745574 - DNA, 14 bp, Homo sapiens
ttaagcattactct

SEQ ID NO: 3745575 - DNA, 21 bp, Homo sapiens
ttaagcattactcttgtaaga

SEQ ID NO: 3745576 - DNA, 12 bp, Homo sapiens
ttaagcattgtt

SEQ ID NO: 3745577 - DNA, 17 bp, Homo sapiens
ttaagctgttactgtct

SEQ ID NO: 3745578 - DNA, 14 bp, Homo sapiens
ttaagctgtttcca

SEQ ID NO: 3745579 - DNA, 13 bp, Homo sapiens
ttaaggaagaaaa

SEQ ID NO: 3745580 - DNA, 17 bp, Homo sapiens
ttaaggaagaaaaatca

SEQ ID NO: 3745581 - DNA, 13 bp, Homo sapiens
ttaagtaaactaa

SEQ ID NO: 3745582 - DNA, 19 bp, Homo sapiens
ttaagtaaactaatgagtt

SEQ ID NO: 3745583 - DNA, 17 bp, Homo sapiens
ttaagtactatgtatca

SEQ ID NO: 3745584 - DNA, 17 bp, Homo sapiens
ttaagtatttatatatt

SEQ ID NO: 3745585 - DNA, 16 bp, Homo sapiens
ttaagtgctttgtaat

SEQ ID NO: 3745586 - DNA, 19 bp, Homo sapiens
ttaagtgtactaattaaca

SEQ ID NO: 3745587 - DNA, 21 bp, Homo sapiens
ttaagtgttgtaaatatttat

SEQ ID NO: 3745588 - DNA, 21 bp, Homo sapiens
ttaagttggcttctgtttcta

SEQ ID NO: 3745589 - DNA, 22 bp, Homo sapiens
ttaagttggcttctgtttctag

SEQ ID NO: 3745590 - DNA, 16 bp, Homo sapiens
ttaagtttgtgaatgt

SEQ ID NO: 3745591 - DNA, 19 bp, Homo sapiens
ttaataacataacaaataa

SEQ ID NO: 3745592 - DNA, 15 bp, Homo sapiens
ttaataagtttcact

SEQ ID NO: 3745593 - DNA, 15 bp, Homo sapiens
ttaatataactgcct

SEQ ID NO: 3745594 - DNA, 15 bp, Homo sapiens
ttaatatagctattt

SEQ ID NO: 3745595 - DNA, 17 bp, Homo sapiens
ttaatatagctattttt

SEQ ID NO: 3745596 - DNA, 17 bp, Homo sapiens
ttaatatgtattttatg

SEQ ID NO: 3745597 - DNA, 18 bp, Homo sapiens
ttaatattgatatgctta

SEQ ID NO: 3745598 - DNA, 22 bp, Homo sapiens
ttaatattgatatgcttataca

SEQ ID NO: 3745599 - DNA, 20 bp, Homo sapiens
ttaatctgtttatttacaag

SEQ ID NO: 3745600 - DNA, 20 bp, Homo sapiens
ttaatgaaagactgtacaaa

SEQ ID NO: 3745601 - DNA, 23 bp, Homo sapiens
ttaatgaaagactgtacaaagta

SEQ ID NO: 3745602 - DNA, 21 bp, Homo sapiens
ttaatgctaagggcaggccca

SEQ ID NO: 3745603 - DNA, 17 bp, Homo sapiens
ttaatgtcacaggcagg

SEQ ID NO: 3745604 - DNA, 18 bp, Homo sapiens
ttaatgtcacaggcaggt

SEQ ID NO: 3745605 - DNA, 21 bp, Homo sapiens
ttaattaagtaaactaatgag

SEQ ID NO: 3745606 - DNA, 18 bp, Homo sapiens
ttaattgtaaactgtact

SEQ ID NO: 3745607 - DNA, 15 bp, Homo sapiens
ttaatttatgagttt

SEQ ID NO: 3745608 - DNA, 15 bp, Homo sapiens
ttacaaaaagacact

SEQ ID NO: 3745609 - DNA, 14 bp, Homo sapiens
ttacaaaagatgta

SEQ ID NO: 3745610 - DNA, 18 bp, Homo sapiens
ttacaaaagatgtatcct

SEQ ID NO: 3745611 - DNA, 15 bp, Homo sapiens
ttacaaacatgtggt

SEQ ID NO: 3745612 - DNA, 13 bp, Homo sapiens
ttacaaactgcaa

SEQ ID NO: 3745613 - DNA, 21 bp, Homo sapiens
ttacaaactgcaatagagact

SEQ ID NO: 3745614 - DNA, 22 bp, Homo sapiens
ttacaaactgcaatagagactg

SEQ ID NO: 3745615 - DNA, 21 bp, Homo sapiens
ttacaagcgtgagccactgca

SEQ ID NO: 3745616 - DNA, 12 bp, Homo sapiens
ttacaatcaaag

SEQ ID NO: 3745617 - DNA, 15 bp, Homo sapiens
ttacaattgaaatga

SEQ ID NO: 3745618 - DNA, 17 bp, Homo sapiens
ttacaattgaaatgact

SEQ ID NO: 3745619 - DNA, 13 bp, Homo sapiens
ttacactttatgc

SEQ ID NO: 3745620 - DNA, 23 bp, Homo sapiens
ttacagaattgcttgtttgcttc

SEQ ID NO: 3745621 - DNA, 22 bp, Homo sapiens
ttacagagaggagaaacacatc

SEQ ID NO: 3745622 - DNA, 17 bp, Homo sapiens
ttacagattgcctcctt

SEQ ID NO: 3745623 - DNA, 15 bp, Homo sapiens
ttacaggcaccgaga

SEQ ID NO: 3745624 - DNA, 17 bp, Homo sapiens
ttacaggcaccgagaat

SEQ ID NO: 3745625 - DNA, 24 bp, Homo sapiens
ttacaggcaccgagaatgttgtat

SEQ ID NO: 3745626 - DNA, 18 bp, Homo sapiens
ttacagggagctgggaca

SEQ ID NO: 3745627 - DNA, 14 bp, Homo sapiens
ttacaggtgtgaac

SEQ ID NO: 3745628 - DNA, 16 bp, Homo sapiens
ttacagtgcagacagg

SEQ ID NO: 3745629 - DNA, 14 bp, Homo sapiens
ttacatactgctgt

SEQ ID NO: 3745630 - DNA, 19 bp, Homo sapiens
tgtgcacacacaccacaca

SEQ ID NO: 3745631 - DNA, 12 bp, Homo sapiens
tgtgcagtgttg

SEQ ID NO: 3745632 - DNA, 16 bp, Homo sapiens
tgtgccatgtgccagg

SEQ ID NO: 3745633 - DNA, 13 bp, Homo sapiens
tgtgcccagctca

SEQ ID NO: 3745634 - DNA, 15 bp, Homo sapiens
tgtgcccagctcagt

SEQ ID NO: 3745635 - DNA, 12 bp, Homo sapiens
tgtgcccagtta

SEQ ID NO: 3745636 - DNA, 22 bp, Homo sapiens
tgtgcccagttaatcttgcttt

SEQ ID NO: 3745637 - DNA, 16 bp, Homo sapiens
tgtgcccccagacgca

SEQ ID NO: 3745638 - DNA, 14 bp, Homo sapiens
tgtgcctcctcacc

SEQ ID NO: 3745639 - DNA, 12 bp, Homo sapiens
tgtgcctctgcc

SEQ ID NO: 3745640 - DNA, 14 bp, Homo sapiens
tgtgcctctgcctg

SEQ ID NO: 3745641 - DNA, 15 bp, Homo sapiens
tgtgcctctgcctgt

SEQ ID NO: 3745642 - DNA, 15 bp, Homo sapiens
tgtgcctctgggact

SEQ ID NO: 3745643 - DNA, 19 bp, Homo sapiens
tgtgcctgcaccaggagac

SEQ ID NO: 3745644 - DNA, 13 bp, Homo sapiens
tgtgcctgcagcc

SEQ ID NO: 3745645 - DNA, 13 bp, Homo sapiens
tgtgcctggagct

SEQ ID NO: 3745646 - DNA, 19 bp, Homo sapiens
tgtgcgcctacaggagtga

SEQ ID NO: 3745647 - DNA, 14 bp, Homo sapiens
tgtgcgtcctgtcg

SEQ ID NO: 3745648 - DNA, 15 bp, Homo sapiens
tgtgcgtgaaacaca

SEQ ID NO: 3745649 - DNA, 20 bp, Homo sapiens
tgtgcgtgtgtccatgtgtg

SEQ ID NO: 3745650 - DNA, 21 bp, Homo sapiens
tgtgcgtgtgtccatgtgtgt

SEQ ID NO: 3745651 - DNA, 23 bp, Homo sapiens
tgtgctaaccacgtctgtcttca

SEQ ID NO: 3745652 - DNA, 14 bp, Homo sapiens
tgtgctatgaattt

SEQ ID NO: 3745653 - DNA, 15 bp, Homo sapiens
tgtgctatgaatttt

SEQ ID NO: 3745654 - DNA, 15 bp, Homo sapiens
tgtgctctggacagg

SEQ ID NO: 3745655 - DNA, 12 bp, Homo sapiens
tgtgctgtgact

SEQ ID NO: 3745656 - DNA, 17 bp, Homo sapiens
tgtgctttgcattccta

SEQ ID NO: 3745657 - DNA, 12 bp, Homo sapiens
tgtggaaagcct

SEQ ID NO: 3745658 - DNA, 22 bp, Homo sapiens
tgtggaaagtgaatttgaatga

SEQ ID NO: 3745659 - DNA, 15 bp, Homo sapiens
tgtggaagggactag

SEQ ID NO: 3745660 - DNA, 14 bp, Homo sapiens
tgtggacacagctc

SEQ ID NO: 3745661 - DNA, 21 bp, Homo sapiens
tgtggagaagcggctggcagc

SEQ ID NO: 3745662 - DNA, 16 bp, Homo sapiens
tgtggagcccgcaccc

SEQ ID NO: 3745663 - DNA, 18 bp, Homo sapiens
tgtggagcccgcaccccc

SEQ ID NO: 3745664 - DNA, 21 bp, Homo sapiens
tgtggaggtacactcttatag

SEQ ID NO: 3745665 - DNA, 14 bp, Homo sapiens
tgtggatgataaaa

SEQ ID NO: 3745666 - DNA, 22 bp, Homo sapiens
tgtggcaaagccttcattgcct

SEQ ID NO: 3745667 - DNA, 17 bp, Homo sapiens
tgtggcatctttgcctt

SEQ ID NO: 3745668 - DNA, 24 bp, Homo sapiens
tgtggccaaaggagggtcaggaag

SEQ ID NO: 3745669 - DNA, 22 bp, Homo sapiens
tgtggcccctgaacaagaattg

SEQ ID NO: 3745670 - DNA, 12 bp, Homo sapiens
tgtggccccttc

SEQ ID NO: 3745671 - DNA, 17 bp, Homo sapiens
tgtggccctggcctgct

SEQ ID NO: 3745672 - DNA, 10 bp, Homo sapiens
tgtggcctca

SEQ ID NO: 3745673 - DNA, 13 bp, Homo sapiens
tgtggcctcagaa

SEQ ID NO: 3745674 - DNA, 13 bp, Homo sapiens
tgtggcggtgcct

SEQ ID NO: 3745675 - DNA, 13 bp, Homo sapiens
tgtggctcccctc

SEQ ID NO: 3745676 - DNA, 17 bp, Homo sapiens
tgtggctttctttcttt

SEQ ID NO: 3745677 - DNA, 15 bp, Homo sapiens
tgtgggaagaaacaa

SEQ ID NO: 3745678 - DNA, 16 bp, Homo sapiens
tgtgggactgtacaca

SEQ ID NO: 3745679 - DNA, 14 bp, Homo sapiens
tgtgggctcccttc

SEQ ID NO: 3745680 - DNA, 20 bp, Homo sapiens
tgtggttttcttttgccatg

SEQ ID NO: 3745681 - DNA, 21 bp, Homo sapiens
tgtgtaactgcccaaagcagc

SEQ ID NO: 3745682 - DNA, 14 bp, Homo sapiens
tgtgtaataaagtg

SEQ ID NO: 3745683 - DNA, 17 bp, Homo sapiens
tgtgtaataaagtgttt

SEQ ID NO: 3745684 - DNA, 19 bp, Homo sapiens
tgtgtaataaagtgttttc

SEQ ID NO: 3745685 - DNA, 20 bp, Homo sapiens
tgtgtaataaagtgttttca

SEQ ID NO: 3745686 - DNA, 14 bp, Homo sapiens
tgtgtactctggcc

SEQ ID NO: 3745687 - DNA, 17 bp, Homo sapiens
tgtgtactgtaaagaat

SEQ ID NO: 3745688 - DNA, 23 bp, Homo sapiens
tgtgtagacgaagggggcatctg

SEQ ID NO: 3745689 - DNA, 14 bp, Homo sapiens
tgtgtagctttgct

SEQ ID NO: 3745690 - DNA, 17 bp, Homo sapiens
tgtgtagctttgctctt

SEQ ID NO: 3745691 - DNA, 12 bp, Homo sapiens
tgtgtattgttc

SEQ ID NO: 3745692 - DNA, 15 bp, Homo sapiens
tgtgtattgttccca

SEQ ID NO: 3745693 - DNA, 18 bp, Homo sapiens
tgtgtatttaattgtaaa

SEQ ID NO: 3745694 - DNA, 22 bp, Homo sapiens
tgtgtatttaattgtaaactgt

SEQ ID NO: 3745695 - DNA, 19 bp, Homo sapiens
tgtgtatttccagtgcaat

SEQ ID NO: 3745696 - DNA, 19 bp, Homo sapiens
tgtgtcagcatagaagtaa

SEQ ID NO: 3745697 - DNA, 19 bp, Homo sapiens
tgtgtcaggtggggcagct

SEQ ID NO: 3745698 - DNA, 15 bp, Homo sapiens
tgtgtccaactccag

SEQ ID NO: 3745699 - DNA, 19 bp, Homo sapiens
tgtgtccttgcacctgcat

SEQ ID NO: 3745700 - DNA, 16 bp, Homo sapiens
tgtgtctcttttctct

SEQ ID NO: 3745701 - DNA, 20 bp, Homo sapiens
tgtgtcttgcaatggcagcc

SEQ ID NO: 3745702 - DNA, 23 bp, Homo sapiens
tgtgtgaagatcacgttccttcc

SEQ ID NO: 3745703 - DNA, 20 bp, Homo sapiens
tgtgtgaggagctgctggct

SEQ ID NO: 3745704 - DNA, 19 bp, Homo sapiens
tgtgtgcacgtacacacac

SEQ ID NO: 3745705 - DNA, 18 bp, Homo sapiens
tgtgtgcgagtgtgtgca

SEQ ID NO: 3745706 - DNA, 22 bp, Homo sapiens
tgtgtgctcatgtatgtgcgaa

SEQ ID NO: 3745707 - DNA, 15 bp, Homo sapiens
tgtgtgggactgtac

SEQ ID NO: 3745708 - DNA, 16 bp, Homo sapiens
tgtgtgggactgtaca

SEQ ID NO: 3745709 - DNA, 18 bp, Homo sapiens
tgtgtgggactgtacaca

SEQ ID NO: 3745710 - DNA, 19 bp, Homo sapiens
tgtgtgtgggctgtgagtg

SEQ ID NO: 3745711 - DNA, 12 bp, Homo sapiens
tgtgtgtgtgtg

SEQ ID NO: 3745712 - DNA, 22 bp, Homo sapiens
tgtgtgttgatcccaagacaat

SEQ ID NO: 3745713 - DNA, 14 bp, Homo sapiens
tgtgttatttaaat

SEQ ID NO: 3745714 - DNA, 11 bp, Homo sapiens
tgtgttcctgg

SEQ ID NO: 3745715 - DNA, 16 bp, Homo sapiens
tgtgttcctggcaata

SEQ ID NO: 3745716 - DNA, 19 bp, Homo sapiens
tgtgttctgtttgttaaaa

SEQ ID NO: 3745717 - DNA, 18 bp, Homo sapiens
tgtgttgccatgtgtgct

SEQ ID NO: 3745718 - DNA, 11 bp, Homo sapiens
tgtgtttcctt

SEQ ID NO: 3745719 - DNA, 11 bp, Homo sapiens
tgtgtttgtgt

SEQ ID NO: 3745720 - DNA, 19 bp, Homo sapiens
tgtgttttgttttgattta

SEQ ID NO: 3745721 - DNA, 19 bp, Homo sapiens
tgttaaaaaatttttgaaa

SEQ ID NO: 3745722 - DNA, 21 bp, Homo sapiens
tgttaacatggacatgatctt

SEQ ID NO: 3745723 - DNA, 20 bp, Homo sapiens
tgttaagcgtgtctgtattt

SEQ ID NO: 3745724 - DNA, 15 bp, Homo sapiens
tgttaagtggtttca

SEQ ID NO: 3745725 - DNA, 22 bp, Homo sapiens
tgttaagttgatggtgatgaaa

SEQ ID NO: 3745726 - DNA, 19 bp, Homo sapiens
tgttaatgaaaatgtcaga

SEQ ID NO: 3745727 - DNA, 19 bp, Homo sapiens
tgttacataagataaatgt

SEQ ID NO: 3745728 - DNA, 20 bp, Homo sapiens
tgttacctaattagagcaga

SEQ ID NO: 3745729 - DNA, 15 bp, Homo sapiens
tgttactgtcttcag

SEQ ID NO: 3745730 - DNA, 16 bp, Homo sapiens
tgttactgtcttcagt

SEQ ID NO: 3745731 - DNA, 15 bp, Homo sapiens
tgttagaacactatt

SEQ ID NO: 3745732 - DNA, 23 bp, Homo sapiens
tgttagagtccaacgtggggcag

SEQ ID NO: 3745733 - DNA, 16 bp, Homo sapiens
tgttaggaaaatttca

SEQ ID NO: 3745734 - DNA, 18 bp, Homo sapiens
tgttataggttgttggat

SEQ ID NO: 3745735 - DNA, 14 bp, Homo sapiens
tgttattacatcct

SEQ ID NO: 3745736 - DNA, 13 bp, Homo sapiens
tgttattgaaaaa

SEQ ID NO: 3745737 - DNA, 23 bp, Homo sapiens
tgttattgaaaaaaattggcatt

SEQ ID NO: 3745738 - DNA, 22 bp, Homo sapiens
tgttatttctatttttgtagaa

SEQ ID NO: 3745739 - DNA, 18 bp, Homo sapiens
tgttattttctgttgaag

SEQ ID NO: 3745740 - DNA, 16 bp, Homo sapiens
tgttatttttgtttct

SEQ ID NO: 3745741 - DNA, 18 bp, Homo sapiens
tgttcagaaggttgctct

SEQ ID NO: 3745742 - DNA, 20 bp, Homo sapiens
tgttcagctccagctcacca

SEQ ID NO: 3745743 - DNA, 22 bp, Homo sapiens
tgttcagtaacagggccttgct

SEQ ID NO: 3745744 - DNA, 14 bp, Homo sapiens
tgttcagtctttca

SEQ ID NO: 3745745 - DNA, 17 bp, Homo sapiens
tgtaagattttgaaaac

SEQ ID NO: 3745746 - DNA, 17 bp, Homo sapiens
tgtaagtaaatgtctgt

SEQ ID NO: 3745747 - DNA, 21 bp, Homo sapiens
tgtaagtaaatgtctgtggcc

SEQ ID NO: 3745748 - DNA, 12 bp, Homo sapiens
tgtaagtgtgag

SEQ ID NO: 3745749 - DNA, 22 bp, Homo sapiens
tgtaagttatttcttgtttgtt

SEQ ID NO: 3745750 - DNA, 15 bp, Homo sapiens
tgtaataaagtatat

SEQ ID NO: 3745751 - DNA, 17 bp, Homo sapiens
tgtaataaagtgttttc

SEQ ID NO: 3745752 - DNA, 18 bp, Homo sapiens
tgtaataaagtgttttca

SEQ ID NO: 3745753 - DNA, 16 bp, Homo sapiens
tgtaatcccagctact

SEQ ID NO: 3745754 - DNA, 21 bp, Homo sapiens
tgtaatcccagctactcagga

SEQ ID NO: 3745755 - DNA, 22 bp, Homo sapiens
tgtaatcccagctacttgggag

SEQ ID NO: 3745756 - DNA, 21 bp, Homo sapiens
tgtaatcgttatgtgtgtata

SEQ ID NO: 3745757 - DNA, 20 bp, Homo sapiens
tgtaatggtatcttaaagtg

SEQ ID NO: 3745758 - DNA, 19 bp, Homo sapiens
tgtaatgtcaccaccttcc

SEQ ID NO: 3745759 - DNA, 17 bp, Homo sapiens
tgtaattaagtactatg

SEQ ID NO: 3745760 - DNA, 13 bp, Homo sapiens
tgtacaaaataaa

SEQ ID NO: 3745761 - DNA, 22 bp, Homo sapiens
tgtacaaaataaacaaataaca

SEQ ID NO: 3745762 - DNA, 19 bp, Homo sapiens
tgtacaaagtagaagtctt

SEQ ID NO: 3745763 - DNA, 20 bp, Homo sapiens
tgtacaatattttaagcatt

SEQ ID NO: 3745764 - DNA, 14 bp, Homo sapiens
tgtacactgaatat

SEQ ID NO: 3745765 - DNA, 17 bp, Homo sapiens
tgtacactgaatattta

SEQ ID NO: 3745766 - DNA, 19 bp, Homo sapiens
tgtacactgaatatttata

SEQ ID NO: 3745767 - DNA, 21 bp, Homo sapiens
tgtacactgaatatttatatt

SEQ ID NO: 3745768 - DNA, 17 bp, Homo sapiens
tgtacagaatcattgct

SEQ ID NO: 3745769 - DNA, 21 bp, Homo sapiens
tgtacagaattctgctacctc

SEQ ID NO: 3745770 - DNA, 17 bp, Homo sapiens
tgtacagacgtatgctt

SEQ ID NO: 3745771 - DNA, 20 bp, Homo sapiens
tgtacagattgctgcttctg

SEQ ID NO: 3745772 - DNA, 13 bp, Homo sapiens
tgtacatatgtaa

SEQ ID NO: 3745773 - DNA, 16 bp, Homo sapiens
tgtacatatgtaaaat

SEQ ID NO: 3745774 - DNA, 22 bp, Homo sapiens
tgtacatttccaaattcacaag

SEQ ID NO: 3745775 - DNA, 12 bp, Homo sapiens
tgtaccatgtac

SEQ ID NO: 3745776 - DNA, 17 bp, Homo sapiens
tgtaccatgtacatgaa

SEQ ID NO: 3745777 - DNA, 16 bp, Homo sapiens
tgtacgtctgacaggc

SEQ ID NO: 3745778 - DNA, 21 bp, Homo sapiens
tgtactaattaacatataata

SEQ ID NO: 3745779 - DNA, 18 bp, Homo sapiens
tgtactcaggaggctgag

SEQ ID NO: 3745780 - DNA, 22 bp, Homo sapiens
tgtactgagccttgtaattcta

SEQ ID NO: 3745781 - DNA, 16 bp, Homo sapiens
tgtacttaataaattc

SEQ ID NO: 3745782 - DNA, 17 bp, Homo sapiens
tgtagaaggagacagag

SEQ ID NO: 3745783 - DNA, 13 bp, Homo sapiens
tgtagaaggcaca

SEQ ID NO: 3745784 - DNA, 22 bp, Homo sapiens
tgtagaagtaggaagtgaaaat

SEQ ID NO: 3745785 - DNA, 13 bp, Homo sapiens
tgtagagtgggag

SEQ ID NO: 3745786 - DNA, 19 bp, Homo sapiens
tgtagatattgtgaagtac

SEQ ID NO: 3745787 - DNA, 22 bp, Homo sapiens
tgtagatattgtgaagtacata

SEQ ID NO: 3745788 - DNA, 20 bp, Homo sapiens
tgtagcaaaacgcatggagt

SEQ ID NO: 3745789 - DNA, 21 bp, Homo sapiens
tgtagccccaagaaggctggg

SEQ ID NO: 3745790 - DNA, 22 bp, Homo sapiens
tgtagcctcgccgtctgtgaat

SEQ ID NO: 3745791 - DNA, 16 bp, Homo sapiens
tgtagccttgcccgga

SEQ ID NO: 3745792 - DNA, 18 bp, Homo sapiens
tgtaggaaggttaatgtt

SEQ ID NO: 3745793 - DNA, 17 bp, Homo sapiens
tgtagggttataataat

SEQ ID NO: 3745794 - DNA, 15 bp, Homo sapiens
tgtagtaaagaaatt

SEQ ID NO: 3745795 - DNA, 15 bp, Homo sapiens
tgtagtataaagaaa

SEQ ID NO: 3745796 - DNA, 13 bp, Homo sapiens
tgtagttaggaaa

SEQ ID NO: 3745797 - DNA, 14 bp, Homo sapiens
tgtagttaggaaat

SEQ ID NO: 3745798 - DNA, 19 bp, Homo sapiens
tgtagtttttcttcaacat

SEQ ID NO: 3745799 - DNA, 19 bp, Homo sapiens
tgtataagtccttgcaaga

SEQ ID NO: 3745800 - DNA, 15 bp, Homo sapiens
tgtataatattttta

SEQ ID NO: 3745801 - DNA, 13 bp, Homo sapiens
tgtatacctgtaa

SEQ ID NO: 3745802 - DNA, 23 bp, Homo sapiens
tgtatagtaaagtgataatttct

SEQ ID NO: 3745803 - DNA, 15 bp, Homo sapiens
tgtatatacaataac

SEQ ID NO: 3745804 - DNA, 16 bp, Homo sapiens
tgtatatacaataaca

SEQ ID NO: 3745805 - DNA, 17 bp, Homo sapiens
tgtatatacaataacat

SEQ ID NO: 3745806 - DNA, 18 bp, Homo sapiens
tgtatatacaataacata

SEQ ID NO: 3745807 - DNA, 13 bp, Homo sapiens
tgtatatatacat

SEQ ID NO: 3745808 - DNA, 21 bp, Homo sapiens
tgtatattatggaagatttta

SEQ ID NO: 3745809 - DNA, 17 bp, Homo sapiens
tgtatcaatgagtaaca

SEQ ID NO: 3745810 - DNA, 21 bp, Homo sapiens
tgtatcaggaaatatatatgt

SEQ ID NO: 3745811 - DNA, 15 bp, Homo sapiens
tgtatcatagaaatg

SEQ ID NO: 3745812 - DNA, 17 bp, Homo sapiens
tgtatcatttgaacaac

SEQ ID NO: 3745813 - DNA, 16 bp, Homo sapiens
tgtatcccatgagcct

SEQ ID NO: 3745814 - DNA, 17 bp, Homo sapiens
tgtatcggagacagtga

SEQ ID NO: 3745815 - DNA, 17 bp, Homo sapiens
tgtatctagtgcagctg

SEQ ID NO: 3745816 - DNA, 22 bp, Homo sapiens
tgtatgaaagatggctgtgcct

SEQ ID NO: 3745817 - DNA, 15 bp, Homo sapiens
tgtatgactaaagag

SEQ ID NO: 3745818 - DNA, 16 bp, Homo sapiens
tgtatgatattccata

SEQ ID NO: 3745819 - DNA, 21 bp, Homo sapiens
tgtatgatattccatagtata

SEQ ID NO: 3745820 - DNA, 22 bp, Homo sapiens
tgtatgatattccatagtatat

SEQ ID NO: 3745821 - DNA, 12 bp, Homo sapiens
tgtatgctggac

SEQ ID NO: 3745822 - DNA, 17 bp, Homo sapiens
tgtatggaatacagtgt

SEQ ID NO: 3745823 - DNA, 17 bp, Homo sapiens
tgtatgtgcgtgtgtgc

SEQ ID NO: 3745824 - DNA, 14 bp, Homo sapiens
tgtatgtttacact

SEQ ID NO: 3745825 - DNA, 22 bp, Homo sapiens
tgtatgtttgcacacttgtgtg

SEQ ID NO: 3745826 - DNA, 15 bp, Homo sapiens
tgtattacataaata

SEQ ID NO: 3745827 - DNA, 23 bp, Homo sapiens
tgtattaggactggctttgtccc

SEQ ID NO: 3745828 - DNA, 15 bp, Homo sapiens
tgtattagtcacaga

SEQ ID NO: 3745829 - DNA, 14 bp, Homo sapiens
tgtattataacagt

SEQ ID NO: 3745830 - DNA, 19 bp, Homo sapiens
tgtattccagtttgtttat

SEQ ID NO: 3745831 - DNA, 12 bp, Homo sapiens
tgtattgttccc

SEQ ID NO: 3745832 - DNA, 14 bp, Homo sapiens
tgtattgttcccag

SEQ ID NO: 3745833 - DNA, 13 bp, Homo sapiens
tgtatttaaatat

SEQ ID NO: 3745834 - DNA, 13 bp, Homo sapiens
tgtatttaattgt

SEQ ID NO: 3745835 - DNA, 20 bp, Homo sapiens
tgtatttattttcctcccca

SEQ ID NO: 3745836 - DNA, 15 bp, Homo sapiens
tgtatttccagtgca

SEQ ID NO: 3745837 - DNA, 20 bp, Homo sapiens
tgtatttgttaatggtttga

SEQ ID NO: 3745838 - DNA, 14 bp, Homo sapiens
tgtattttatgtat

SEQ ID NO: 3745839 - DNA, 23 bp, Homo sapiens
tgtcaaaaatgtcttgggtaggc

SEQ ID NO: 3745840 - DNA, 22 bp, Homo sapiens
tgtcaaacaaagccagaagctg

SEQ ID NO: 3745841 - DNA, 21 bp, Homo sapiens
tgtcaagttaacaaggaatgc

SEQ ID NO: 3745842 - DNA, 21 bp, Homo sapiens
tgtcaataaacagcttcatgc

SEQ ID NO: 3745843 - DNA, 17 bp, Homo sapiens
tgtcacaacctctctga

SEQ ID NO: 3745844 - DNA, 16 bp, Homo sapiens
tgtcacaataaatgta

SEQ ID NO: 3745845 - DNA, 13 bp, Homo sapiens
tgtcacacacttt

SEQ ID NO: 3745846 - DNA, 17 bp, Homo sapiens
tgtcacacactttggct

SEQ ID NO: 3745847 - DNA, 15 bp, Homo sapiens
tgtcacaggcaggtc

SEQ ID NO: 3745848 - DNA, 16 bp, Homo sapiens
tgtcacaggcaggtcc

SEQ ID NO: 3745849 - DNA, 21 bp, Homo sapiens
tgtcacaggcaggtccagggt

SEQ ID NO: 3745850 - DNA, 16 bp, Homo sapiens
tgtcaccaccttccca

SEQ ID NO: 3745851 - DNA, 13 bp, Homo sapiens
tgtcacctgaaga

SEQ ID NO: 3745852 - DNA, 15 bp, Homo sapiens
tgtcactaaagcagg

SEQ ID NO: 3745853 - DNA, 16 bp, Homo sapiens
tgtcagaaaccagtta

SEQ ID NO: 3745854 - DNA, 20 bp, Homo sapiens
tgtcagacctatttgacata

SEQ ID NO: 3745855 - DNA, 14 bp, Homo sapiens
tgtcagactttaaa

SEQ ID NO: 3745856 - DNA, 15 bp, Homo sapiens
tgtcagagctgggag

SEQ ID NO: 3745857 - DNA, 20 bp, Homo sapiens
tgtcagatattttttcagaa

SEQ ID NO: 3745858 - DNA, 15 bp, Homo sapiens
tgtcagattcctttc

SEQ ID NO: 3745859 - DNA, 19 bp, Homo sapiens
tgtcagctactaatgatgt

SEQ ID NO: 3745860 - DNA, 17 bp, Homo sapiens
tggcatgggggcctcag

SEQ ID NO: 3745861 - DNA, 20 bp, Homo sapiens
tggcatgggggcctcagggc

SEQ ID NO: 3745862 - DNA, 20 bp, Homo sapiens
tggcatgtgctgtgaccatt

SEQ ID NO: 3745863 - DNA, 22 bp, Homo sapiens
tggcatgtgctgtgaccattta

SEQ ID NO: 3745864 - DNA, 20 bp, Homo sapiens
tggcattttgtagtcttaac

SEQ ID NO: 3745865 - DNA, 14 bp, Homo sapiens
tggccaaaaagaat

SEQ ID NO: 3745866 - DNA, 22 bp, Homo sapiens
tggccaaaaagaatctgcattt

SEQ ID NO: 3745867 - DNA, 20 bp, Homo sapiens
tggccactccagacccctgg

SEQ ID NO: 3745868 - DNA, 16 bp, Homo sapiens
tggccagaccagagct

SEQ ID NO: 3745869 - DNA, 17 bp, Homo sapiens
tggccagaccagagctc

SEQ ID NO: 3745870 - DNA, 21 bp, Homo sapiens
tggccagaccagagctctgga

SEQ ID NO: 3745871 - DNA, 23 bp, Homo sapiens
tggccagaccagagctctggagc

SEQ ID NO: 3745872 - DNA, 14 bp, Homo sapiens
tggccagaggcttg

SEQ ID NO: 3745873 - DNA, 18 bp, Homo sapiens
tggccagatgcaccagcc

SEQ ID NO: 3745874 - DNA, 21 bp, Homo sapiens
tggccagatgcaccagccctt

SEQ ID NO: 3745875 - DNA, 21 bp, Homo sapiens
tggccagccaacttttgcatg

SEQ ID NO: 3745876 - DNA, 16 bp, Homo sapiens
tggccaggagctcttc

SEQ ID NO: 3745877 - DNA, 23 bp, Homo sapiens
tggccaggagctcttcaggcctc

SEQ ID NO: 3745878 - DNA, 16 bp, Homo sapiens
tggccaggcagatctg

SEQ ID NO: 3745879 - DNA, 20 bp, Homo sapiens
tggccaggcagatctgtgcc

SEQ ID NO: 3745880 - DNA, 16 bp, Homo sapiens
tggccaggtggccact

SEQ ID NO: 3745881 - DNA, 17 bp, Homo sapiens
tggccaggtggccactc

SEQ ID NO: 3745882 - DNA, 15 bp, Homo sapiens
tggccatttgctttt

SEQ ID NO: 3745883 - DNA, 20 bp, Homo sapiens
tggcccacgcctgtaatccc

SEQ ID NO: 3745884 - DNA, 21 bp, Homo sapiens
tggcccccactggctgtgggc

SEQ ID NO: 3745885 - DNA, 16 bp, Homo sapiens
tggcccctcacctggg

SEQ ID NO: 3745886 - DNA, 14 bp, Homo sapiens
tggcccctgaacaa

SEQ ID NO: 3745887 - DNA, 16 bp, Homo sapiens
tggcccctgcccggct

SEQ ID NO: 3745888 - DNA, 17 bp, Homo sapiens
tggcccgacagcctggc

SEQ ID NO: 3745889 - DNA, 20 bp, Homo sapiens
tggccctcacccctgccctg

SEQ ID NO: 3745890 - DNA, 12 bp, Homo sapiens
tggccctgcctt

SEQ ID NO: 3745891 - DNA, 18 bp, Homo sapiens
tggccctggcctgctggg

SEQ ID NO: 3745892 - DNA, 16 bp, Homo sapiens
tggccctggggcctgt

SEQ ID NO: 3745893 - DNA, 15 bp, Homo sapiens
tggccgggcacagct

SEQ ID NO: 3745894 - DNA, 16 bp, Homo sapiens
tggccgggcacagctg

SEQ ID NO: 3745895 - DNA, 13 bp, Homo sapiens
tggcctcaaccct

SEQ ID NO: 3745896 - DNA, 14 bp, Homo sapiens
tggcctcaaccctc

SEQ ID NO: 3745897 - DNA, 16 bp, Homo sapiens
tggcctcaaccctccc

SEQ ID NO: 3745898 - DNA, 21 bp, Homo sapiens
tggcctcaaccctccctcagc

SEQ ID NO: 3745899 - DNA, 14 bp, Homo sapiens
tggcctcagctgcc

SEQ ID NO: 3745900 - DNA, 16 bp, Homo sapiens
tggcctcagctgcctc

SEQ ID NO: 3745901 - DNA, 15 bp, Homo sapiens
tggcctggccaggag

SEQ ID NO: 3745902 - DNA, 12 bp, Homo sapiens
tggcctggctcc

SEQ ID NO: 3745903 - DNA, 12 bp, Homo sapiens
tggcctgtctca

SEQ ID NO: 3745904 - DNA, 20 bp, Homo sapiens
tggcctgtctcatccccagg

SEQ ID NO: 3745905 - DNA, 18 bp, Homo sapiens
tggccttccatttatatg

SEQ ID NO: 3745906 - DNA, 18 bp, Homo sapiens
tggcctttgcttatgaat

SEQ ID NO: 3745907 - DNA, 18 bp, Homo sapiens
tggcgattcccattgaaa

SEQ ID NO: 3745908 - DNA, 16 bp, Homo sapiens
tggcggctactcagca

SEQ ID NO: 3745909 - DNA, 17 bp, Homo sapiens
tggcggctactcagcag

SEQ ID NO: 3745910 - DNA, 23 bp, Homo sapiens
tggcggctactcagcagccctcc

SEQ ID NO: 3745911 - DNA, 13 bp, Homo sapiens
tggcgggccaagg

SEQ ID NO: 3745912 - DNA, 19 bp, Homo sapiens
tggcgtagagggtgctgcc

SEQ ID NO: 3745913 - DNA, 23 bp, Homo sapiens
tggcgtagagggtgctgccccat

SEQ ID NO: 3745914 - DNA, 13 bp, Homo sapiens
tggcgtctgtctt

SEQ ID NO: 3745915 - DNA, 17 bp, Homo sapiens
tggcgtctgtcttcaag

SEQ ID NO: 3745916 - DNA, 20 bp, Homo sapiens
tggctaagcttaaaaaaaac

SEQ ID NO: 3745917 - DNA, 17 bp, Homo sapiens
tggctaaggcaccagcc

SEQ ID NO: 3745918 - DNA, 17 bp, Homo sapiens
tggctaatgtactgcat

SEQ ID NO: 3745919 - DNA, 18 bp, Homo sapiens
tggctacatcccagcctg

SEQ ID NO: 3745920 - DNA, 20 bp, Homo sapiens
tggctacatcccagcctgtg

SEQ ID NO: 3745921 - DNA, 18 bp, Homo sapiens
tggctagagtcctcactc

SEQ ID NO: 3745922 - DNA, 22 bp, Homo sapiens
tggctattagagatcaacccct

SEQ ID NO: 3745923 - DNA, 16 bp, Homo sapiens
tggctcactgcagcct

SEQ ID NO: 3745924 - DNA, 17 bp, Homo sapiens
tggctcactgcagcctc

SEQ ID NO: 3745925 - DNA, 17 bp, Homo sapiens
tggctcccagggccatg

SEQ ID NO: 3745926 - DNA, 13 bp, Homo sapiens
tggctcccctcta

SEQ ID NO: 3745927 - DNA, 19 bp, Homo sapiens
tggctccgaacaccctcga

SEQ ID NO: 3745928 - DNA, 16 bp, Homo sapiens
tggctccgctgtgtgg

SEQ ID NO: 3745929 - DNA, 14 bp, Homo sapiens
tggctcctcccggt

SEQ ID NO: 3745930 - DNA, 14 bp, Homo sapiens
tggctcctgagggg

SEQ ID NO: 3745931 - DNA, 15 bp, Homo sapiens
tggctctgagaaggg

SEQ ID NO: 3745932 - DNA, 18 bp, Homo sapiens
tggctctgtggcttgcta

SEQ ID NO: 3745933 - DNA, 21 bp, Homo sapiens
tggctgacccagtccctgggg

SEQ ID NO: 3745934 - DNA, 20 bp, Homo sapiens
tggctgaggatttcaagcct

SEQ ID NO: 3745935 - DNA, 23 bp, Homo sapiens
tggctgcccagacccctctggcc

SEQ ID NO: 3745936 - DNA, 14 bp, Homo sapiens
tggctgcctggagc

SEQ ID NO: 3745937 - DNA, 16 bp, Homo sapiens
tggctgcctggagccc

SEQ ID NO: 3745938 - DNA, 16 bp, Homo sapiens
tggctgcggcaccctt

SEQ ID NO: 3745939 - DNA, 15 bp, Homo sapiens
tggctgctagcactt

SEQ ID NO: 3745940 - DNA, 22 bp, Homo sapiens
tggctggctaactggaagcatg

SEQ ID NO: 3745941 - DNA, 15 bp, Homo sapiens
tggctgggggcctca

SEQ ID NO: 3745942 - DNA, 17 bp, Homo sapiens
tggctgggggcctcagt

SEQ ID NO: 3745943 - DNA, 22 bp, Homo sapiens
tggctggtaagggccaagtccc

SEQ ID NO: 3745944 - DNA, 22 bp, Homo sapiens
tggctggtcaacttgagcatgt

SEQ ID NO: 3745945 - DNA, 14 bp, Homo sapiens
tggctgtgcctctg

SEQ ID NO: 3745946 - DNA, 15 bp, Homo sapiens
tggctgtgcctctgc

SEQ ID NO: 3745947 - DNA, 17 bp, Homo sapiens
tggctgtgcctctgcct

SEQ ID NO: 3745948 - DNA, 19 bp, Homo sapiens
tggctgtgcctctgcctgt

SEQ ID NO: 3745949 - DNA, 14 bp, Homo sapiens
tggctgtgggctcc

SEQ ID NO: 3745950 - DNA, 13 bp, Homo sapiens
tggctgttggctg

SEQ ID NO: 3745951 - DNA, 16 bp, Homo sapiens
tggctgttggctgggg

SEQ ID NO: 3745952 - DNA, 18 bp, Homo sapiens
tggctgttggctgggggc

SEQ ID NO: 3745953 - DNA, 20 bp, Homo sapiens
tggcttactacatgtgggag

SEQ ID NO: 3745954 - DNA, 20 bp, Homo sapiens
tggcttcacggaagagcctt

SEQ ID NO: 3745955 - DNA, 23 bp, Homo sapiens
tggcttcacggaagagccttgcg

SEQ ID NO: 3745956 - DNA, 22 bp, Homo sapiens
tggcttccagaaaaccccagca

SEQ ID NO: 3745957 - DNA, 18 bp, Homo sapiens
tggcttcccgctcagccc

SEQ ID NO: 3745958 - DNA, 21 bp, Homo sapiens
tggcttcccgctcagccctcc

SEQ ID NO: 3745959 - DNA, 17 bp, Homo sapiens
tggcttctgatgaatct

SEQ ID NO: 3745960 - DNA, 20 bp, Homo sapiens
tggcttctgatgaatcttgc

SEQ ID NO: 3745961 - DNA, 15 bp, Homo sapiens
tggcttctgtttcta

SEQ ID NO: 3745962 - DNA, 17 bp, Homo sapiens
tggctttcagagcctcc

SEQ ID NO: 3745963 - DNA, 20 bp, Homo sapiens
tggctttgcccaacctcagc

SEQ ID NO: 3745964 - DNA, 14 bp, Homo sapiens
tggcttttcactgc

SEQ ID NO: 3745965 - DNA, 15 bp, Homo sapiens
tggcttttcactgct

SEQ ID NO: 3745966 - DNA, 18 bp, Homo sapiens
tggcttttcactgctggc

SEQ ID NO: 3745967 - DNA, 22 bp, Homo sapiens
tggcttttcactgctggctgcc

SEQ ID NO: 3745968 - DNA, 16 bp, Homo sapiens
tgggaaactttccctt

SEQ ID NO: 3745969 - DNA, 16 bp, Homo sapiens
tgggaaaggagtagaa

SEQ ID NO: 3745970 - DNA, 17 bp, Homo sapiens
tgggaaaggagtagaaa

SEQ ID NO: 3745971 - DNA, 17 bp, Homo sapiens
tgggaaataagagagaa

SEQ ID NO: 3745972 - DNA, 16 bp, Homo sapiens
tgggaacgtgactgcc

SEQ ID NO: 3745973 - DNA, 22 bp, Homo sapiens
tgggaactcccaagaacagcag

SEQ ID NO: 3745974 - DNA, 18 bp, Homo sapiens
tgcggacagccacggcca

SEQ ID NO: 3745975 - DNA, 20 bp, Homo sapiens
tgcggacagccacggccagg

SEQ ID NO: 3745976 - DNA, 19 bp, Homo sapiens
tgcggccgcattccctgag

SEQ ID NO: 3745977 - DNA, 21 bp, Homo sapiens
tgcgggaccggtacagaaagg

SEQ ID NO: 3745978 - DNA, 17 bp, Homo sapiens
tgcgggatggtcctggg

SEQ ID NO: 3745979 - DNA, 17 bp, Homo sapiens
tgcgggcttttccccgg

SEQ ID NO: 3745980 - DNA, 20 bp, Homo sapiens
tgcgtacgtttcctgagaag

SEQ ID NO: 3745981 - DNA, 23 bp, Homo sapiens
tgcgtacgtttcctgagaagtgt

SEQ ID NO: 3745982 - DNA, 14 bp, Homo sapiens
tgcgtgaaacacac

SEQ ID NO: 3745983 - DNA, 17 bp, Homo sapiens
tgcgtggctgacccccc

SEQ ID NO: 3745984 - DNA, 21 bp, Homo sapiens
tgcgtgggtggggagggaggt

SEQ ID NO: 3745985 - DNA, 13 bp, Homo sapiens
tgcgttactaatt

SEQ ID NO: 3745986 - DNA, 22 bp, Homo sapiens
tgctaaatggtcgcccaggaga

SEQ ID NO: 3745987 - DNA, 18 bp, Homo sapiens
tgctaaatgtaagaatca

SEQ ID NO: 3745988 - DNA, 17 bp, Homo sapiens
tgctaacttggagcccc

SEQ ID NO: 3745989 - DNA, 22 bp, Homo sapiens
tgctaatcatgtgggtgagcca

SEQ ID NO: 3745990 - DNA, 13 bp, Homo sapiens
tgctaatcttctt

SEQ ID NO: 3745991 - DNA, 23 bp, Homo sapiens
tgctacatgacgacaaagctgct

SEQ ID NO: 3745992 - DNA, 19 bp, Homo sapiens
tgctacctgatcccactcc

SEQ ID NO: 3745993 - DNA, 23 bp, Homo sapiens
tgctacctgatcccactcctagg

SEQ ID NO: 3745994 - DNA, 20 bp, Homo sapiens
tgctactgattgtttcattg

SEQ ID NO: 3745995 - DNA, 23 bp, Homo sapiens
tgctagatgagaattcagctgcc

SEQ ID NO: 3745996 - DNA, 15 bp, Homo sapiens
tgctaggtgggccag

SEQ ID NO: 3745997 - DNA, 23 bp, Homo sapiens
tgctaggtgggccagcccctccc

SEQ ID NO: 3745998 - DNA, 16 bp, Homo sapiens
tgctagttttacagat

SEQ ID NO: 3745999 - DNA, 21 bp, Homo sapiens
tgctataactatgttgataaa

SEQ ID NO: 3746000 - DNA, 23 bp, Homo sapiens
tgctatatttgtgatataggaat

SEQ ID NO: 3746001 - DNA, 19 bp, Homo sapiens
tgctatccagctattttta

SEQ ID NO: 3746002 - DNA, 21 bp, Homo sapiens
tgctatctctgtgtgcacaaa

SEQ ID NO: 3746003 - DNA, 16 bp, Homo sapiens
tgctatggatggcttc

SEQ ID NO: 3746004 - DNA, 22 bp, Homo sapiens
tgctatggggagaaaagacatg

SEQ ID NO: 3746005 - DNA, 13 bp, Homo sapiens
tgctcacagctgt

SEQ ID NO: 3746006 - DNA, 12 bp, Homo sapiens
tgctcacctggg

SEQ ID NO: 3746007 - DNA, 14 bp, Homo sapiens
tgctcacctggggt

SEQ ID NO: 3746008 - DNA, 13 bp, Homo sapiens
tgctcagaacaca

SEQ ID NO: 3746009 - DNA, 14 bp, Homo sapiens
tgctcagggctgac

SEQ ID NO: 3746010 - DNA, 20 bp, Homo sapiens
tgctcagggtcaatttcttt

SEQ ID NO: 3746011 - DNA, 18 bp, Homo sapiens
tgctcaggtacagagaag

SEQ ID NO: 3746012 - DNA, 16 bp, Homo sapiens
tgctcagtagtcagac

SEQ ID NO: 3746013 - DNA, 15 bp, Homo sapiens
tgctccaccccactc

SEQ ID NO: 3746014 - DNA, 17 bp, Homo sapiens
tgctccaccccactcac

SEQ ID NO: 3746015 - DNA, 17 bp, Homo sapiens
tgctccacccttggcct

SEQ ID NO: 3746016 - DNA, 17 bp, Homo sapiens
tgctccagccaacccct

SEQ ID NO: 3746017 - DNA, 16 bp, Homo sapiens
tgctcccccaccccct

SEQ ID NO: 3746018 - DNA, 23 bp, Homo sapiens
tgctcccccaccccctccccagg

SEQ ID NO: 3746019 - DNA, 20 bp, Homo sapiens
tgctcccccatcctcccctt

SEQ ID NO: 3746020 - DNA, 22 bp, Homo sapiens
tgctcccccatcctccccttcc

SEQ ID NO: 3746021 - DNA, 14 bp, Homo sapiens
tgctccctcccctg

SEQ ID NO: 3746022 - DNA, 22 bp, Homo sapiens
tgctcctccagggccacgtgcc

SEQ ID NO: 3746023 - DNA, 19 bp, Homo sapiens
tgctcctctccccagcaag

SEQ ID NO: 3746024 - DNA, 19 bp, Homo sapiens
tgctcctggcccactgcat

SEQ ID NO: 3746025 - DNA, 16 bp, Homo sapiens
tgctccttagctgcca

SEQ ID NO: 3746026 - DNA, 15 bp, Homo sapiens
tgctcggccgtcttc

SEQ ID NO: 3746027 - DNA, 23 bp, Homo sapiens
tgctctatctcacagcacactca

SEQ ID NO: 3746028 - DNA, 13 bp, Homo sapiens
tgctctcccctgc

SEQ ID NO: 3746029 - DNA, 12 bp, Homo sapiens
tgctctcctctt

SEQ ID NO: 3746030 - DNA, 16 bp, Homo sapiens
tgctctctacccagcc

SEQ ID NO: 3746031 - DNA, 19 bp, Homo sapiens
tgctctctacccagcccat

SEQ ID NO: 3746032 - DNA, 20 bp, Homo sapiens
tgctctctacccagcccatc

SEQ ID NO: 3746033 - DNA, 17 bp, Homo sapiens
tgctctctgcagccagc

SEQ ID NO: 3746034 - DNA, 12 bp, Homo sapiens
tgctctgcccag

SEQ ID NO: 3746035 - DNA, 17 bp, Homo sapiens
tgctctgcccagagctg

SEQ ID NO: 3746036 - DNA, 22 bp, Homo sapiens
tgctctgcccagagctgggtga

SEQ ID NO: 3746037 - DNA, 14 bp, Homo sapiens
tgctctgctgacag

SEQ ID NO: 3746038 - DNA, 18 bp, Homo sapiens
tgctctgctggtcttcaa

SEQ ID NO: 3746039 - DNA, 14 bp, Homo sapiens
tgctctggacaggc

SEQ ID NO: 3746040 - DNA, 16 bp, Homo sapiens
tgctctggacaggcat

SEQ ID NO: 3746041 - DNA, 22 bp, Homo sapiens
tgctctgtcttctttgcccaca

SEQ ID NO: 3746042 - DNA, 18 bp, Homo sapiens
tgctcttagctgtctgct

SEQ ID NO: 3746043 - DNA, 18 bp, Homo sapiens
tgctcttgtcctagcttg

SEQ ID NO: 3746044 - DNA, 22 bp, Homo sapiens
tgctgaaagagaaaagaggggt

SEQ ID NO: 3746045 - DNA, 23 bp, Homo sapiens
tgctgaagcttattaatgctaag

SEQ ID NO: 3746046 - DNA, 23 bp, Homo sapiens
tgctgaatacagaggcaactgca

SEQ ID NO: 3746047 - DNA, 19 bp, Homo sapiens
tgctgaatcggaatctctg

SEQ ID NO: 3746048 - DNA, 21 bp, Homo sapiens
tgctgactgtactcctcccag

SEQ ID NO: 3746049 - DNA, 15 bp, Homo sapiens
tgctgagagacccaa

SEQ ID NO: 3746050 - DNA, 20 bp, Homo sapiens
tgctgagggaccagccaaga

SEQ ID NO: 3746051 - DNA, 15 bp, Homo sapiens
tgctgagttggtgtt

SEQ ID NO: 3746052 - DNA, 17 bp, Homo sapiens
tgctgatgtggcaactg

SEQ ID NO: 3746053 - DNA, 17 bp, Homo sapiens
tgctgattctcccgttc

SEQ ID NO: 3746054 - DNA, 12 bp, Homo sapiens
tgctgccatcca

SEQ ID NO: 3746055 - DNA, 13 bp, Homo sapiens
tgctgccatccag

SEQ ID NO: 3746056 - DNA, 16 bp, Homo sapiens
tgctgcccagcctcca

SEQ ID NO: 3746057 - DNA, 15 bp, Homo sapiens
tgctgccccagctga

SEQ ID NO: 3746058 - DNA, 24 bp, Homo sapiens
tgctgccccatgaagccacagccc

SEQ ID NO: 3746059 - DNA, 17 bp, Homo sapiens
tgctgcccgtcttcagc

SEQ ID NO: 3746060 - DNA, 20 bp, Homo sapiens
tgctgcccgtcttcagccta

SEQ ID NO: 3746061 - DNA, 21 bp, Homo sapiens
tgctgcccgtcttcagcctag

SEQ ID NO: 3746062 - DNA, 22 bp, Homo sapiens
tgctgcccgtcttcagcctagc

SEQ ID NO: 3746063 - DNA, 20 bp, Homo sapiens
tgctgccgcctcccagcctg

SEQ ID NO: 3746064 - DNA, 21 bp, Homo sapiens
tgctgccgcctcccagcctgg

SEQ ID NO: 3746065 - DNA, 12 bp, Homo sapiens
tgctgcctcccc

SEQ ID NO: 3746066 - DNA, 14 bp, Homo sapiens
tgctgcgtctccca

SEQ ID NO: 3746067 - DNA, 17 bp, Homo sapiens
tgctgctaatcttcagg

SEQ ID NO: 3746068 - DNA, 22 bp, Homo sapiens
tgctgctaatcttcagggcact

SEQ ID NO: 3746069 - DNA, 19 bp, Homo sapiens
tgctgctatcctgccaaaa

SEQ ID NO: 3746070 - DNA, 21 bp, Homo sapiens
tgctgctgaatttataaaaat

SEQ ID NO: 3746071 - DNA, 16 bp, Homo sapiens
tgctggacaggtctgg

SEQ ID NO: 3746072 - DNA, 15 bp, Homo sapiens
tgctggataaaatga

SEQ ID NO: 3746073 - DNA, 22 bp, Homo sapiens
tgctggatattttcaaattgta

SEQ ID NO: 3746074 - DNA, 19 bp, Homo sapiens
tgctggatctcccagggct

SEQ ID NO: 3746075 - DNA, 20 bp, Homo sapiens
tgctggatctcccagggcta

SEQ ID NO: 3746076 - DNA, 20 bp, Homo sapiens
tgctggcacatttccccaga

SEQ ID NO: 3746077 - DNA, 13 bp, Homo sapiens
tgctggcccctca

SEQ ID NO: 3746078 - DNA, 15 bp, Homo sapiens
tgctggcccctcacc

SEQ ID NO: 3746079 - DNA, 18 bp, Homo sapiens
tgctggctcccagggcca

SEQ ID NO: 3746080 - DNA, 13 bp, Homo sapiens
tgctggctgccca

SEQ ID NO: 3746081 - DNA, 15 bp, Homo sapiens
tgctgggactggcca

SEQ ID NO: 3746082 - DNA, 17 bp, Homo sapiens
tgctgggctctccacct

SEQ ID NO: 3746083 - DNA, 17 bp, Homo sapiens
tgctgggcttgtctgta

SEQ ID NO: 3746084 - DNA, 18 bp, Homo sapiens
tgctggggcaagtccctg

SEQ ID NO: 3746085 - DNA, 16 bp, Homo sapiens
tgctggtcactgccat

SEQ ID NO: 3746086 - DNA, 20 bp, Homo sapiens
tgctgtaaataaatgcttta

SEQ ID NO: 3746087 - DNA, 18 bp, Homo sapiens
tgctgtgaacaagtgaac

SEQ ID NO: 3746088 - DNA, 19 bp, Homo sapiens
tgggtggaaccaggaacct

SEQ ID NO: 3746089 - DNA, 20 bp, Homo sapiens
tgggtggcaccagcagcctg

SEQ ID NO: 3746090 - DNA, 21 bp, Homo sapiens
tgggtggcaccagcagcctgg

SEQ ID NO: 3746091 - DNA, 14 bp, Homo sapiens
tgggtggggaggga

SEQ ID NO: 3746092 - DNA, 15 bp, Homo sapiens
tgggtggggtgagga

SEQ ID NO: 3746093 - DNA, 22 bp, Homo sapiens
tgggtgtatttattttcctccc

SEQ ID NO: 3746094 - DNA, 23 bp, Homo sapiens
tgggttcaagcgattcttctgct

SEQ ID NO: 3746095 - DNA, 16 bp, Homo sapiens
tgggttcactgcaacc

SEQ ID NO: 3746096 - DNA, 14 bp, Homo sapiens
tgggttctgggtgg

SEQ ID NO: 3746097 - DNA, 14 bp, Homo sapiens
tggtaaaacacttg

SEQ ID NO: 3746098 - DNA, 19 bp, Homo sapiens
tggtaaacgctgtccctag

SEQ ID NO: 3746099 - DNA, 19 bp, Homo sapiens
tggtaagcttccaggaaaa

SEQ ID NO: 3746100 - DNA, 16 bp, Homo sapiens
tggtacatggccagtg

SEQ ID NO: 3746101 - DNA, 17 bp, Homo sapiens
tggtacttgctgctatt

SEQ ID NO: 3746102 - DNA, 17 bp, Homo sapiens
tggtaggaatagcatgt

SEQ ID NO: 3746103 - DNA, 17 bp, Homo sapiens
tggtagggacttaaaaa

SEQ ID NO: 3746104 - DNA, 16 bp, Homo sapiens
tggtatcttaaagtgt

SEQ ID NO: 3746105 - DNA, 15 bp, Homo sapiens
tggtatgtgtgtgta

SEQ ID NO: 3746106 - DNA, 19 bp, Homo sapiens
tggtatttatctattgtaa

SEQ ID NO: 3746107 - DNA, 22 bp, Homo sapiens
tggtatttatctattgtaagat

SEQ ID NO: 3746108 - DNA, 18 bp, Homo sapiens
tggtcaacttgagcatgt

SEQ ID NO: 3746109 - DNA, 19 bp, Homo sapiens
tggtcacaggactctgcct

SEQ ID NO: 3746110 - DNA, 22 bp, Homo sapiens
tggtcagacacaaacaaacaag

SEQ ID NO: 3746111 - DNA, 21 bp, Homo sapiens
tggtcagagtaagctgctttt

SEQ ID NO: 3746112 - DNA, 22 bp, Homo sapiens
tggtcagatttgaactcttcaa

SEQ ID NO: 3746113 - DNA, 19 bp, Homo sapiens
tggtccagggaagctggcc

SEQ ID NO: 3746114 - DNA, 14 bp, Homo sapiens
tggtcctaagtccc

SEQ ID NO: 3746115 - DNA, 19 bp, Homo sapiens
tggtcctaagtccctgccc

SEQ ID NO: 3746116 - DNA, 22 bp, Homo sapiens
tggtcctgactcaacatgttac

SEQ ID NO: 3746117 - DNA, 15 bp, Homo sapiens
tggtcgcccaggaga

SEQ ID NO: 3746118 - DNA, 17 bp, Homo sapiens
tggtctcaaactcttga

SEQ ID NO: 3746119 - DNA, 20 bp, Homo sapiens
tggtctcctctttgttttgt

SEQ ID NO: 3746120 - DNA, 18 bp, Homo sapiens
tggtctcctgcccccaca

SEQ ID NO: 3746121 - DNA, 15 bp, Homo sapiens
tggtctgaatgttct

SEQ ID NO: 3746122 - DNA, 16 bp, Homo sapiens
tggtctgaatgttctg

SEQ ID NO: 3746123 - DNA, 21 bp, Homo sapiens
tggtctgaatgttctgacatt

SEQ ID NO: 3746124 - DNA, 18 bp, Homo sapiens
tggtctgacccactgctt

SEQ ID NO: 3746125 - DNA, 15 bp, Homo sapiens
tggtctgcaggcagg

SEQ ID NO: 3746126 - DNA, 12 bp, Homo sapiens
tggtctgtgtga

SEQ ID NO: 3746127 - DNA, 13 bp, Homo sapiens
tggtcttgtaaga

SEQ ID NO: 3746128 - DNA, 15 bp, Homo sapiens
tggtctttctggaga

SEQ ID NO: 3746129 - DNA, 16 bp, Homo sapiens
tggtgacaccagcctt

SEQ ID NO: 3746130 - DNA, 14 bp, Homo sapiens
tggtgaggaagctc

SEQ ID NO: 3746131 - DNA, 13 bp, Homo sapiens
tggtgaggagcac

SEQ ID NO: 3746132 - DNA, 17 bp, Homo sapiens
tggtgatcaattaaatg

SEQ ID NO: 3746133 - DNA, 18 bp, Homo sapiens
tggtgatcaattaaatgt

SEQ ID NO: 3746134 - DNA, 10 bp, Homo sapiens
tggtgcatta

SEQ ID NO: 3746135 - DNA, 13 bp, Homo sapiens
tggtgcctttcct

SEQ ID NO: 3746136 - DNA, 15 bp, Homo sapiens
tggtgcctttcctgt

SEQ ID NO: 3746137 - DNA, 19 bp, Homo sapiens
tggtgcctttcctgttcag

SEQ ID NO: 3746138 - DNA, 18 bp, Homo sapiens
tggtgcgggcacaataaa

SEQ ID NO: 3746139 - DNA, 13 bp, Homo sapiens
tggtgctgccaca

SEQ ID NO: 3746140 - DNA, 18 bp, Homo sapiens
tggtgctgccacacttca

SEQ ID NO: 3746141 - DNA, 12 bp, Homo sapiens
tggtgctggata

SEQ ID NO: 3746142 - DNA, 17 bp, Homo sapiens
tggtgctggatattttc

SEQ ID NO: 3746143 - DNA, 17 bp, Homo sapiens
tggtggacagtcctggg

SEQ ID NO: 3746144 - DNA, 14 bp, Homo sapiens
tggtggatgtaaat

SEQ ID NO: 3746145 - DNA, 20 bp, Homo sapiens
tggtggcagtgggagctgcc

SEQ ID NO: 3746146 - DNA, 19 bp, Homo sapiens
tggtggcccgacagcctgg

SEQ ID NO: 3746147 - DNA, 16 bp, Homo sapiens
tggtggcgcaagcctg

SEQ ID NO: 3746148 - DNA, 21 bp, Homo sapiens
tggtgggaagcgtctgtccgt

SEQ ID NO: 3746149 - DNA, 15 bp, Homo sapiens
tggtggtatctgagt

SEQ ID NO: 3746150 - DNA, 14 bp, Homo sapiens
tggtgtccacctgg

SEQ ID NO: 3746151 - DNA, 17 bp, Homo sapiens
tggtgtccagctgagtt

SEQ ID NO: 3746152 - DNA, 19 bp, Homo sapiens
tggtgtcctttccctccac

SEQ ID NO: 3746153 - DNA, 15 bp, Homo sapiens
tggtgtgaaagtcag

SEQ ID NO: 3746154 - DNA, 13 bp, Homo sapiens
tggttaatgccat

SEQ ID NO: 3746155 - DNA, 14 bp, Homo sapiens
tggttacactgtta

SEQ ID NO: 3746156 - DNA, 17 bp, Homo sapiens
tggttacagtgcagaca

SEQ ID NO: 3746157 - DNA, 18 bp, Homo sapiens
tggttagctcagccccag

SEQ ID NO: 3746158 - DNA, 20 bp, Homo sapiens
tggttagctcagccccagcc

SEQ ID NO: 3746159 - DNA, 22 bp, Homo sapiens
tggttagctcagccccagccca

SEQ ID NO: 3746160 - DNA, 19 bp, Homo sapiens
tggttatacatgacactga

SEQ ID NO: 3746161 - DNA, 18 bp, Homo sapiens
tggttatttttatacagt

SEQ ID NO: 3746162 - DNA, 23 bp, Homo sapiens
tggttcatcagtgttaaaaaatt

SEQ ID NO: 3746163 - DNA, 18 bp, Homo sapiens
tggttcccctgttcactc

SEQ ID NO: 3746164 - DNA, 20 bp, Homo sapiens
tggttcccctgttcactcta

SEQ ID NO: 3746165 - DNA, 12 bp, Homo sapiens
tggttcctgggg

SEQ ID NO: 3746166 - DNA, 17 bp, Homo sapiens
tggttcctttctcagcc

SEQ ID NO: 3746167 - DNA, 19 bp, Homo sapiens
tggttcttgtgttggctgt

SEQ ID NO: 3746168 - DNA, 18 bp, Homo sapiens
tggttgatgatctttgca

SEQ ID NO: 3746169 - DNA, 17 bp, Homo sapiens
tggttgccttaaaagaa

SEQ ID NO: 3746170 - DNA, 15 bp, Homo sapiens
tggttgggtcctcac

SEQ ID NO: 3746171 - DNA, 23 bp, Homo sapiens
tggttgtcatttttgcagtagag

SEQ ID NO: 3746172 - DNA, 20 bp, Homo sapiens
tggtttagtgtaaaaatgag

SEQ ID NO: 3746173 - DNA, 21 bp, Homo sapiens
tggtttagtgtaaaaatgaga

SEQ ID NO: 3746174 - DNA, 16 bp, Homo sapiens
tggtttctagacttgt

SEQ ID NO: 3746175 - DNA, 14 bp, Homo sapiens
tggttttcaaaata

SEQ ID NO: 3746176 - DNA, 19 bp, Homo sapiens
tggttttcttttgccatga

SEQ ID NO: 3746177 - DNA, 14 bp, Homo sapiens
tgtaaaaatgagaa

SEQ ID NO: 3746178 - DNA, 17 bp, Homo sapiens
tgtaaaaatgagaacat

SEQ ID NO: 3746179 - DNA, 18 bp, Homo sapiens
tgtaaaactttattttat

SEQ ID NO: 3746180 - DNA, 21 bp, Homo sapiens
tgtaaaatcttggcacagaaa

SEQ ID NO: 3746181 - DNA, 17 bp, Homo sapiens
tgtaaacagtgcctgct

SEQ ID NO: 3746182 - DNA, 23 bp, Homo sapiens
tgtaaactcaaaatatttgtaca

SEQ ID NO: 3746183 - DNA, 18 bp, Homo sapiens
tgtaaactgcattagaaa

SEQ ID NO: 3746184 - DNA, 22 bp, Homo sapiens
tgtaaactgtactagtctgtgt

SEQ ID NO: 3746185 - DNA, 17 bp, Homo sapiens
tgtaaagtgtaaatcct

SEQ ID NO: 3746186 - DNA, 15 bp, Homo sapiens
tgtaaataagagatt

SEQ ID NO: 3746187 - DNA, 16 bp, Homo sapiens
tgtaaatagctcaggt

SEQ ID NO: 3746188 - DNA, 12 bp, Homo sapiens
tgtaaatattta

SEQ ID NO: 3746189 - DNA, 13 bp, Homo sapiens
tgtaaatatttat

SEQ ID NO: 3746190 - DNA, 22 bp, Homo sapiens
tgtaaatgctgtcaactatgat

SEQ ID NO: 3746191 - DNA, 10 bp, Homo sapiens
tgtaaattat

SEQ ID NO: 3746192 - DNA, 15 bp, Homo sapiens
tgtaacaagaaagga

SEQ ID NO: 3746193 - DNA, 17 bp, Homo sapiens
tgtaacaagaaaggaga

SEQ ID NO: 3746194 - DNA, 14 bp, Homo sapiens
tgtaacagctgagg

SEQ ID NO: 3746195 - DNA, 20 bp, Homo sapiens
tgtaacaggtctcctcttaa

SEQ ID NO: 3746196 - DNA, 15 bp, Homo sapiens
tgtaacatatgcaaa

SEQ ID NO: 3746197 - DNA, 13 bp, Homo sapiens
tgtaacctgagat

SEQ ID NO: 3746198 - DNA, 18 bp, Homo sapiens
tgtaactgcccaaagcag

SEQ ID NO: 3746199 - DNA, 21 bp, Homo sapiens
tgtaactggcagttttccatt

SEQ ID NO: 3746200 - DNA, 15 bp, Homo sapiens
tgtaacttttgtaag

SEQ ID NO: 3746201 - DNA, 22 bp, Homo sapiens
tgtaagaaacacactgaggcag

SEQ ID NO: 3746202 - DNA, 14 bp, Homo sapiens
tgtaagattttgaa

SEQ ID NO: 3746203 - DNA, 17 bp, Homo sapiens
tgggaagataggctctg

SEQ ID NO: 3746204 - DNA, 13 bp, Homo sapiens
tgggaaggacttg

SEQ ID NO: 3746205 - DNA, 22 bp, Homo sapiens
tgggaaggacttggcgcgccct

SEQ ID NO: 3746206 - DNA, 12 bp, Homo sapiens
tgggaaggaggg

SEQ ID NO: 3746207 - DNA, 22 bp, Homo sapiens
tgggaatgtattattctgcagc

SEQ ID NO: 3746208 - DNA, 20 bp, Homo sapiens
tgggaatgttacattgtttg

SEQ ID NO: 3746209 - DNA, 15 bp, Homo sapiens
tgggactaaatgccc

SEQ ID NO: 3746210 - DNA, 18 bp, Homo sapiens
tgggactaaatgccctgc

SEQ ID NO: 3746211 - DNA, 16 bp, Homo sapiens
tgggactacaggtgtg

SEQ ID NO: 3746212 - DNA, 17 bp, Homo sapiens
tgggactagcctggctt

SEQ ID NO: 3746213 - DNA, 18 bp, Homo sapiens
tgggactcaatgcactga

SEQ ID NO: 3746214 - DNA, 20 bp, Homo sapiens
tgggactcaatgcactgaca

SEQ ID NO: 3746215 - DNA, 12 bp, Homo sapiens
tgggactggagt

SEQ ID NO: 3746216 - DNA, 18 bp, Homo sapiens
tgggactggagtccctgt

SEQ ID NO: 3746217 - DNA, 13 bp, Homo sapiens
tgggactgggagg

SEQ ID NO: 3746218 - DNA, 22 bp, Homo sapiens
tgggactgtacacactttattt

SEQ ID NO: 3746219 - DNA, 22 bp, Homo sapiens
tgggagaacctcaggcttcctt

SEQ ID NO: 3746220 - DNA, 14 bp, Homo sapiens
tgggagccccaggg

SEQ ID NO: 3746221 - DNA, 16 bp, Homo sapiens
tgggagccccagggtc

SEQ ID NO: 3746222 - DNA, 18 bp, Homo sapiens
tgggagcctcataaagat

SEQ ID NO: 3746223 - DNA, 14 bp, Homo sapiens
tgggagctgcctgt

SEQ ID NO: 3746224 - DNA, 17 bp, Homo sapiens
tgggagctgcctgttca

SEQ ID NO: 3746225 - DNA, 18 bp, Homo sapiens
tgggagctggttagaaat

SEQ ID NO: 3746226 - DNA, 13 bp, Homo sapiens
tgggaggaagcag

SEQ ID NO: 3746227 - DNA, 20 bp, Homo sapiens
tgggaggccaaggtgggagg

SEQ ID NO: 3746228 - DNA, 16 bp, Homo sapiens
tgggaggccccactgg

SEQ ID NO: 3746229 - DNA, 11 bp, Homo sapiens
tgggaggctga

SEQ ID NO: 3746230 - DNA, 15 bp, Homo sapiens
tgggaggctgaggcg

SEQ ID NO: 3746231 - DNA, 19 bp, Homo sapiens
tgggagttcagctgcttct

SEQ ID NO: 3746232 - DNA, 20 bp, Homo sapiens
tgggatgcttgcctagggcc

SEQ ID NO: 3746233 - DNA, 15 bp, Homo sapiens
tgggatgtcttattt

SEQ ID NO: 3746234 - DNA, 22 bp, Homo sapiens
tgggattacaagcgtgagccac

SEQ ID NO: 3746235 - DNA, 15 bp, Homo sapiens
tgggcaatatagcaa

SEQ ID NO: 3746236 - DNA, 20 bp, Homo sapiens
tgggcacctggggagtggga

SEQ ID NO: 3746237 - DNA, 16 bp, Homo sapiens
tgggcactggattagt

SEQ ID NO: 3746238 - DNA, 15 bp, Homo sapiens
tgggcagaaggccaa

SEQ ID NO: 3746239 - DNA, 16 bp, Homo sapiens
tgggcagaaggccaag

SEQ ID NO: 3746240 - DNA, 18 bp, Homo sapiens
tgggcagaaggccaagag

SEQ ID NO: 3746241 - DNA, 14 bp, Homo sapiens
tgggcagccaggct

SEQ ID NO: 3746242 - DNA, 23 bp, Homo sapiens
tgggcaggaagtgaagagatcct

SEQ ID NO: 3746243 - DNA, 13 bp, Homo sapiens
tgggcaggacctc

SEQ ID NO: 3746244 - DNA, 21 bp, Homo sapiens
tgggcagggaggcaccattca

SEQ ID NO: 3746245 - DNA, 15 bp, Homo sapiens
tgggcaggtgggagc

SEQ ID NO: 3746246 - DNA, 23 bp, Homo sapiens
tgggcattgatggggaaggaggc

SEQ ID NO: 3746247 - DNA, 14 bp, Homo sapiens
tgggccaggacagg

SEQ ID NO: 3746248 - DNA, 18 bp, Homo sapiens
tgggcccagaggcacagc

SEQ ID NO: 3746249 - DNA, 17 bp, Homo sapiens
tgggccccaccacctag

SEQ ID NO: 3746250 - DNA, 13 bp, Homo sapiens
tgggcccctccct

SEQ ID NO: 3746251 - DNA, 22 bp, Homo sapiens
tgggcctcctgtgtgtgcgcct

SEQ ID NO: 3746252 - DNA, 13 bp, Homo sapiens
tgggcggcagaga

SEQ ID NO: 3746253 - DNA, 15 bp, Homo sapiens
tgggcggcagagagg

SEQ ID NO: 3746254 - DNA, 19 bp, Homo sapiens
tgggcggcagagaggactg

SEQ ID NO: 3746255 - DNA, 21 bp, Homo sapiens
tgggctcaagcaatcctcctg

SEQ ID NO: 3746256 - DNA, 15 bp, Homo sapiens
tgggctcccttcctc

SEQ ID NO: 3746257 - DNA, 16 bp, Homo sapiens
tgggctctccacctca

SEQ ID NO: 3746258 - DNA, 23 bp, Homo sapiens
tgggctctccacctcagccttgg

SEQ ID NO: 3746259 - DNA, 21 bp, Homo sapiens
tgggctctgccccagctctgg

SEQ ID NO: 3746260 - DNA, 23 bp, Homo sapiens
tgggctctgccccagctctggct

SEQ ID NO: 3746261 - DNA, 17 bp, Homo sapiens
tgggctgccctggtgct

SEQ ID NO: 3746262 - DNA, 21 bp, Homo sapiens
tgggctgccctggtgctgcca

SEQ ID NO: 3746263 - DNA, 16 bp, Homo sapiens
tgggctgctcctcatg

SEQ ID NO: 3746264 - DNA, 17 bp, Homo sapiens
tgggcttgtctgtagat

SEQ ID NO: 3746265 - DNA, 17 bp, Homo sapiens
tgggctttgattccatc

SEQ ID NO: 3746266 - DNA, 14 bp, Homo sapiens
tggggaagactgtg

SEQ ID NO: 3746267 - DNA, 17 bp, Homo sapiens
tggggaagactgtggct

SEQ ID NO: 3746268 - DNA, 17 bp, Homo sapiens
tggggagacacctcaga

SEQ ID NO: 3746269 - DNA, 20 bp, Homo sapiens
tggggagacacctcagagcc

SEQ ID NO: 3746270 - DNA, 16 bp, Homo sapiens
tggggagccaacagaa

SEQ ID NO: 3746271 - DNA, 19 bp, Homo sapiens
tggggagtgggacagagtc

SEQ ID NO: 3746272 - DNA, 23 bp, Homo sapiens
tggggatgagaaaggttgaagca

SEQ ID NO: 3746273 - DNA, 19 bp, Homo sapiens
tggggcaagtccctgactc

SEQ ID NO: 3746274 - DNA, 22 bp, Homo sapiens
tggggcaggaggggagtgaggc

SEQ ID NO: 3746275 - DNA, 22 bp, Homo sapiens
tggggcagtcacctgcccagat

SEQ ID NO: 3746276 - DNA, 12 bp, Homo sapiens
tggggccacagc

SEQ ID NO: 3746277 - DNA, 14 bp, Homo sapiens
tggggccacagcca

SEQ ID NO: 3746278 - DNA, 15 bp, Homo sapiens
tggggccacagccag

SEQ ID NO: 3746279 - DNA, 21 bp, Homo sapiens
tggggcccctttttactcccc

SEQ ID NO: 3746280 - DNA, 12 bp, Homo sapiens
tggggccttggt

SEQ ID NO: 3746281 - DNA, 18 bp, Homo sapiens
tggggcggtgagagggga

SEQ ID NO: 3746282 - DNA, 13 bp, Homo sapiens
tggggctctggga

SEQ ID NO: 3746283 - DNA, 21 bp, Homo sapiens
tggggctgatctcagggaagc

SEQ ID NO: 3746284 - DNA, 17 bp, Homo sapiens
tggggctgctcctccag

SEQ ID NO: 3746285 - DNA, 15 bp, Homo sapiens
tgggggaagccctgg

SEQ ID NO: 3746286 - DNA, 16 bp, Homo sapiens
tgggggaagccctgga

SEQ ID NO: 3746287 - DNA, 20 bp, Homo sapiens
tgggggatgactagaggcag

SEQ ID NO: 3746288 - DNA, 13 bp, Homo sapiens
tgggggcagaggg

SEQ ID NO: 3746289 - DNA, 18 bp, Homo sapiens
tgggggcagagggcagag

SEQ ID NO: 3746290 - DNA, 17 bp, Homo sapiens
tgggggcagcctgcgtg

SEQ ID NO: 3746291 - DNA, 15 bp, Homo sapiens
tgggggttctttctt

SEQ ID NO: 3746292 - DNA, 15 bp, Homo sapiens
tgggggttggctggg

SEQ ID NO: 3746293 - DNA, 19 bp, Homo sapiens
tggggtacccactgctctg

SEQ ID NO: 3746294 - DNA, 13 bp, Homo sapiens
tggggtagggctg

SEQ ID NO: 3746295 - DNA, 16 bp, Homo sapiens
tggggtagggctgact

SEQ ID NO: 3746296 - DNA, 21 bp, Homo sapiens
tggggtctcacagtgttgccc

SEQ ID NO: 3746297 - DNA, 13 bp, Homo sapiens
tggggtctccctc

SEQ ID NO: 3746298 - DNA, 14 bp, Homo sapiens
tggggtgaggacca

SEQ ID NO: 3746299 - DNA, 13 bp, Homo sapiens
tggggtgggagag

SEQ ID NO: 3746300 - DNA, 14 bp, Homo sapiens
tggggttcgtggaa

SEQ ID NO: 3746301 - DNA, 20 bp, Homo sapiens
tggggttcgtggaaagggtg

SEQ ID NO: 3746302 - DNA, 21 bp, Homo sapiens
tggggttggctgggcccagaa

SEQ ID NO: 3746303 - DNA, 17 bp, Homo sapiens
tgggtacttgtggacac

SEQ ID NO: 3746304 - DNA, 18 bp, Homo sapiens
tgggtacttgtggacaca

SEQ ID NO: 3746305 - DNA, 20 bp, Homo sapiens
tgggtacttgtggacacagc

SEQ ID NO: 3746306 - DNA, 21 bp, Homo sapiens
tgggtagaaagagatacagag

SEQ ID NO: 3746307 - DNA, 15 bp, Homo sapiens
tgggtatattcattt

SEQ ID NO: 3746308 - DNA, 19 bp, Homo sapiens
tgggtatattcatttcaaa

SEQ ID NO: 3746309 - DNA, 20 bp, Homo sapiens
tgggtatcaaacagctcagg

SEQ ID NO: 3746310 - DNA, 19 bp, Homo sapiens
tgggtatcctgcccagtgt

SEQ ID NO: 3746311 - DNA, 23 bp, Homo sapiens
tgggtctaaggggttggttgagg

SEQ ID NO: 3746312 - DNA, 20 bp, Homo sapiens
tgggtctcgctttgttgccc

SEQ ID NO: 3746313 - DNA, 19 bp, Homo sapiens
tgggtctgtgtctcttttc

SEQ ID NO: 3746314 - DNA, 22 bp, Homo sapiens
tgggtcttcagggggccaggtg

SEQ ID NO: 3746315 - DNA, 15 bp, Homo sapiens
tgggtgaagggagag

SEQ ID NO: 3746316 - DNA, 15 bp, Homo sapiens
tgggtgcccacagcc

SEQ ID NO: 3746317 - DNA, 14 bp, Homo sapiens
tgggtgctggctgc

SEQ ID NO: 3746318 - DNA, 23 bp, Homo sapiens
tgctgtgaacaagtgaacacatt

SEQ ID NO: 3746319 - DNA, 19 bp, Homo sapiens
tgctgtgaccatttataat

SEQ ID NO: 3746320 - DNA, 17 bp, Homo sapiens
tgctgtggtctctttgt

SEQ ID NO: 3746321 - DNA, 17 bp, Homo sapiens
tgctgtggttcctgggg

SEQ ID NO: 3746322 - DNA, 15 bp, Homo sapiens
tgctgtgtccaactc

SEQ ID NO: 3746323 - DNA, 20 bp, Homo sapiens
tgctgtgtccaactccagta

SEQ ID NO: 3746324 - DNA, 14 bp, Homo sapiens
tgctgttgcctcat

SEQ ID NO: 3746325 - DNA, 18 bp, Homo sapiens
tgcttatgaatatttata

SEQ ID NO: 3746326 - DNA, 20 bp, Homo sapiens
tgcttatgaatatttataac

SEQ ID NO: 3746327 - DNA, 21 bp, Homo sapiens
tgcttattgttccaagacatt

SEQ ID NO: 3746328 - DNA, 17 bp, Homo sapiens
tgcttcacaacccatct

SEQ ID NO: 3746329 - DNA, 23 bp, Homo sapiens
tgcttcagcctgaggctgagact

SEQ ID NO: 3746330 - DNA, 18 bp, Homo sapiens
tgcttcatgaaaatccta

SEQ ID NO: 3746331 - DNA, 21 bp, Homo sapiens
tgcttccctctgcctgtccct

SEQ ID NO: 3746332 - DNA, 21 bp, Homo sapiens
tgcttctaccaactggaagca

SEQ ID NO: 3746333 - DNA, 23 bp, Homo sapiens
tgcttctaccaactggaagcaca

SEQ ID NO: 3746334 - DNA, 12 bp, Homo sapiens
tgcttctcactg

SEQ ID NO: 3746335 - DNA, 19 bp, Homo sapiens
tgcttctcatagccccggt

SEQ ID NO: 3746336 - DNA, 14 bp, Homo sapiens
tgcttctctacaga

SEQ ID NO: 3746337 - DNA, 13 bp, Homo sapiens
tgcttctgggaga

SEQ ID NO: 3746338 - DNA, 17 bp, Homo sapiens
tgcttctgtagtactcc

SEQ ID NO: 3746339 - DNA, 14 bp, Homo sapiens
tgcttgaaagaaaa

SEQ ID NO: 3746340 - DNA, 21 bp, Homo sapiens
tgcttgaaagaaaatatgcat

SEQ ID NO: 3746341 - DNA, 13 bp, Homo sapiens
tgcttgaacacag

SEQ ID NO: 3746342 - DNA, 16 bp, Homo sapiens
tgcttgaacacagtat

SEQ ID NO: 3746343 - DNA, 13 bp, Homo sapiens
tgcttgagcccag

SEQ ID NO: 3746344 - DNA, 16 bp, Homo sapiens
tgcttgagcccaggag

SEQ ID NO: 3746345 - DNA, 18 bp, Homo sapiens
tgcttgatggtttatgtt

SEQ ID NO: 3746346 - DNA, 18 bp, Homo sapiens
tgcttgccgaaactggaa

SEQ ID NO: 3746347 - DNA, 19 bp, Homo sapiens
tgcttgcctagggcctggt

SEQ ID NO: 3746348 - DNA, 22 bp, Homo sapiens
tgcttgcctagggcctggtcca

SEQ ID NO: 3746349 - DNA, 21 bp, Homo sapiens
tgcttggaatatctgctgtat

SEQ ID NO: 3746350 - DNA, 20 bp, Homo sapiens
tgcttggacctcgtgcttta

SEQ ID NO: 3746351 - DNA, 21 bp, Homo sapiens
tgcttggacctcgtgctttaa

SEQ ID NO: 3746352 - DNA, 18 bp, Homo sapiens
tgcttgtaacaagaaaac

SEQ ID NO: 3746353 - DNA, 19 bp, Homo sapiens
tgcttgtaacaagaaaaca

SEQ ID NO: 3746354 - DNA, 19 bp, Homo sapiens
tgcttgttccctctccctg

SEQ ID NO: 3746355 - DNA, 14 bp, Homo sapiens
tgctttctgaactc

SEQ ID NO: 3746356 - DNA, 15 bp, Homo sapiens
tgctttgcccctgag

SEQ ID NO: 3746357 - DNA, 20 bp, Homo sapiens
tgctttgggctgccctggtg

SEQ ID NO: 3746358 - DNA, 12 bp, Homo sapiens
tgcttttcaaac

SEQ ID NO: 3746359 - DNA, 16 bp, Homo sapiens
tgcttttcttcctagt

SEQ ID NO: 3746360 - DNA, 17 bp, Homo sapiens
tgcttttggtctgtgtg

SEQ ID NO: 3746361 - DNA, 18 bp, Homo sapiens
tgcttttggtctgtgtga

SEQ ID NO: 3746362 - DNA, 23 bp, Homo sapiens
tgcttttttatggcgattcccat

SEQ ID NO: 3746363 - DNA, 23 bp, Homo sapiens
tggaaaaacatctgaaagccacg

SEQ ID NO: 3746364 - DNA, 13 bp, Homo sapiens
tggaaaaatccag

SEQ ID NO: 3746365 - DNA, 18 bp, Homo sapiens
tggaaaaatccagaaaga

SEQ ID NO: 3746366 - DNA, 19 bp, Homo sapiens
tggaaaaatccagaaagaa

SEQ ID NO: 3746367 - DNA, 14 bp, Homo sapiens
tggaaaagaataca

SEQ ID NO: 3746368 - DNA, 19 bp, Homo sapiens
tggaaaagaatacagaaag

SEQ ID NO: 3746369 - DNA, 17 bp, Homo sapiens
tggaaaataaaaggtct

SEQ ID NO: 3746370 - DNA, 14 bp, Homo sapiens
tggaaacaaagtgg

SEQ ID NO: 3746371 - DNA, 22 bp, Homo sapiens
tggaaacaaagtggaaggaaag

SEQ ID NO: 3746372 - DNA, 14 bp, Homo sapiens
tggaaacaggacca

SEQ ID NO: 3746373 - DNA, 15 bp, Homo sapiens
tggaaactaaaactt

SEQ ID NO: 3746374 - DNA, 23 bp, Homo sapiens
tggaaagacagcttctcatcctg

SEQ ID NO: 3746375 - DNA, 14 bp, Homo sapiens
tggaaagcctctgc

SEQ ID NO: 3746376 - DNA, 16 bp, Homo sapiens
tggaaagcctctgctg

SEQ ID NO: 3746377 - DNA, 20 bp, Homo sapiens
tggaaaggctcagtctcagg

SEQ ID NO: 3746378 - DNA, 21 bp, Homo sapiens
tggaaaggctcagtctcagga

SEQ ID NO: 3746379 - DNA, 23 bp, Homo sapiens
tggaaaggctcagtctcaggagc

SEQ ID NO: 3746380 - DNA, 15 bp, Homo sapiens
tggaaagtgaatttg

SEQ ID NO: 3746381 - DNA, 15 bp, Homo sapiens
tggaaataaatgtat

SEQ ID NO: 3746382 - DNA, 23 bp, Homo sapiens
tggaaataaatgtatcatagaaa

SEQ ID NO: 3746383 - DNA, 22 bp, Homo sapiens
tggaaatatcagttactcagcc

SEQ ID NO: 3746384 - DNA, 17 bp, Homo sapiens
tggaaattggaagagca

SEQ ID NO: 3746385 - DNA, 21 bp, Homo sapiens
tggaaatttgttataatgaat

SEQ ID NO: 3746386 - DNA, 13 bp, Homo sapiens
tggaacagcggga

SEQ ID NO: 3746387 - DNA, 21 bp, Homo sapiens
tggaaccacggagatctcctt

SEQ ID NO: 3746388 - DNA, 16 bp, Homo sapiens
tggaaccgcaggaagc

SEQ ID NO: 3746389 - DNA, 17 bp, Homo sapiens
tggaaccgcaggaagct

SEQ ID NO: 3746390 - DNA, 20 bp, Homo sapiens
tggaaccgcaggaagctgct

SEQ ID NO: 3746391 - DNA, 18 bp, Homo sapiens
tggaactaggttttaata

SEQ ID NO: 3746392 - DNA, 21 bp, Homo sapiens
tggaactcattcctgcctgtc

SEQ ID NO: 3746393 - DNA, 16 bp, Homo sapiens
tggaagattttaaatt

SEQ ID NO: 3746394 - DNA, 11 bp, Homo sapiens
tggaagcacag

SEQ ID NO: 3746395 - DNA, 22 bp, Homo sapiens
tggaagcacagaaaactagaat

SEQ ID NO: 3746396 - DNA, 19 bp, Homo sapiens
tggaagcatattgttatta

SEQ ID NO: 3746397 - DNA, 12 bp, Homo sapiens
tggaagccctcc

SEQ ID NO: 3746398 - DNA, 17 bp, Homo sapiens
tggaagctgccctgccc

SEQ ID NO: 3746399 - DNA, 16 bp, Homo sapiens
tggaagctgtgtcctt

SEQ ID NO: 3746400 - DNA, 11 bp, Homo sapiens
tggaaggaaag

SEQ ID NO: 3746401 - DNA, 15 bp, Homo sapiens
tggaaggaaagatgc

SEQ ID NO: 3746402 - DNA, 17 bp, Homo sapiens
tggaagggtttgtggct

SEQ ID NO: 3746403 - DNA, 21 bp, Homo sapiens
tggaagtgagggtcagagagg

SEQ ID NO: 3746404 - DNA, 21 bp, Homo sapiens
tggaagtgtgtgatctgtggg

SEQ ID NO: 3746405 - DNA, 15 bp, Homo sapiens
tggaagttttcagga

SEQ ID NO: 3746406 - DNA, 20 bp, Homo sapiens
tggaatactaaaaatcatga

SEQ ID NO: 3746407 - DNA, 13 bp, Homo sapiens
tggaatataaaga

SEQ ID NO: 3746408 - DNA, 17 bp, Homo sapiens
tggaatctagaagaaat

SEQ ID NO: 3746409 - DNA, 22 bp, Homo sapiens
tggaatcttctctttgacaatt

SEQ ID NO: 3746410 - DNA, 18 bp, Homo sapiens
tggaatgaattaaataaa

SEQ ID NO: 3746411 - DNA, 20 bp, Homo sapiens
tggaattaacctggtgctgg

SEQ ID NO: 3746412 - DNA, 21 bp, Homo sapiens
tggaattaacctggtgctgga

SEQ ID NO: 3746413 - DNA, 18 bp, Homo sapiens
tggaattgcttaccaaag

SEQ ID NO: 3746414 - DNA, 17 bp, Homo sapiens
tggaattgggagcttgg

SEQ ID NO: 3746415 - DNA, 24 bp, Homo sapiens
tggaatttttattatgcataactg

SEQ ID NO: 3746416 - DNA, 23 bp, Homo sapiens
tggaatttttcattgatatgaaa

SEQ ID NO: 3746417 - DNA, 14 bp, Homo sapiens
tggaattttttatt

SEQ ID NO: 3746418 - DNA, 16 bp, Homo sapiens
tggaattttttattct

SEQ ID NO: 3746419 - DNA, 21 bp, Homo sapiens
tggaattttttattcttgtga

SEQ ID NO: 3746420 - DNA, 17 bp, Homo sapiens
tggacacacaaggtgca

SEQ ID NO: 3746421 - DNA, 15 bp, Homo sapiens
tggacacacacagct

SEQ ID NO: 3746422 - DNA, 16 bp, Homo sapiens
tggacacagctcttct

SEQ ID NO: 3746423 - DNA, 18 bp, Homo sapiens
tggacaccaggagtccct

SEQ ID NO: 3746424 - DNA, 21 bp, Homo sapiens
tggacaccaggagtccctggt

SEQ ID NO: 3746425 - DNA, 22 bp, Homo sapiens
tggacagcaaaaccattgcttc

SEQ ID NO: 3746426 - DNA, 12 bp, Homo sapiens
tggacaggcatg

SEQ ID NO: 3746427 - DNA, 23 bp, Homo sapiens
tggacaggcatgttctctgagga

SEQ ID NO: 3746428 - DNA, 17 bp, Homo sapiens
tggacaggtctgggaga

SEQ ID NO: 3746429 - DNA, 15 bp, Homo sapiens
tggacagtcctggga

SEQ ID NO: 3746430 - DNA, 15 bp, Homo sapiens
tggacctaacattcg

SEQ ID NO: 3746431 - DNA, 20 bp, Homo sapiens
tggaccttgaactgggtact

SEQ ID NO: 3746432 - DNA, 15 bp, Homo sapiens
tggacgcacacagct

SEQ ID NO: 3746433 - DNA, 17 bp, Homo sapiens
tggacgttcggggcatg

SEQ ID NO: 3746434 - DNA, 18 bp, Homo sapiens
tggactattataatttaa

SEQ ID NO: 3746435 - DNA, 18 bp, Homo sapiens
tggactcaggatgcccag

SEQ ID NO: 3746436 - DNA, 17 bp, Homo sapiens
tggactctacactgtga

SEQ ID NO: 3746437 - DNA, 15 bp, Homo sapiens
tggactctcccctct

SEQ ID NO: 3746438 - DNA, 21 bp, Homo sapiens
tggactctcccctcttatgta

SEQ ID NO: 3746439 - DNA, 17 bp, Homo sapiens
tggactgaagcctgcag

SEQ ID NO: 3746440 - DNA, 19 bp, Homo sapiens
tggactggctagagtcctc

SEQ ID NO: 3746441 - DNA, 21 bp, Homo sapiens
tggactgtcatagaaattaca

SEQ ID NO: 3746442 - DNA, 15 bp, Homo sapiens
tggactgtgatgcca

SEQ ID NO: 3746443 - DNA, 17 bp, Homo sapiens
tggacttgagcttggca

SEQ ID NO: 3746444 - DNA, 19 bp, Homo sapiens
tggactttccaccccctcc

SEQ ID NO: 3746445 - DNA, 20 bp, Homo sapiens
tggacttttcgttaacattg

SEQ ID NO: 3746446 - DNA, 21 bp, Homo sapiens
tggacttttcgttaacattga

SEQ ID NO: 3746447 - DNA, 17 bp, Homo sapiens
tggagaaactgtagtct

SEQ ID NO: 3746448 - DNA, 20 bp, Homo sapiens
tggagaacgccagtctccca

SEQ ID NO: 3746449 - DNA, 15 bp, Homo sapiens
tggagaactcctagg

SEQ ID NO: 3746450 - DNA, 13 bp, Homo sapiens
tggagaagcagtg

SEQ ID NO: 3746451 - DNA, 22 bp, Homo sapiens
tggagaagcggctggcagccca

SEQ ID NO: 3746452 - DNA, 13 bp, Homo sapiens
tggagacaatgca

SEQ ID NO: 3746453 - DNA, 18 bp, Homo sapiens
tggagacaatgcagatgc

SEQ ID NO: 3746454 - DNA, 19 bp, Homo sapiens
tggagactctgtggggcct

SEQ ID NO: 3746455 - DNA, 17 bp, Homo sapiens
tggagactgtctcaaga

SEQ ID NO: 3746456 - DNA, 15 bp, Homo sapiens
tggagagtaaaaact

SEQ ID NO: 3746457 - DNA, 20 bp, Homo sapiens
tggagagtgcaacagtagca

SEQ ID NO: 3746458 - DNA, 23 bp, Homo sapiens
tggagatatttatggggggagaa

SEQ ID NO: 3746459 - DNA, 13 bp, Homo sapiens
tggagatggggag

SEQ ID NO: 3746460 - DNA, 15 bp, Homo sapiens
tggagatggggagaa

SEQ ID NO: 3746461 - DNA, 17 bp, Homo sapiens
tggagatggggagaaac

SEQ ID NO: 3746462 - DNA, 19 bp, Homo sapiens
tggagcagggacagatcat

SEQ ID NO: 3746463 - DNA, 17 bp, Homo sapiens
tggagccaagggttcag

SEQ ID NO: 3746464 - DNA, 17 bp, Homo sapiens
tggagcccgaggcacca

SEQ ID NO: 3746465 - DNA, 19 bp, Homo sapiens
tggagcccgaggcaccagt

SEQ ID NO: 3746466 - DNA, 16 bp, Homo sapiens
tggagcccgcaccccc

SEQ ID NO: 3746467 - DNA, 18 bp, Homo sapiens
tggagcccgcacccccac

SEQ ID NO: 3746468 - DNA, 22 bp, Homo sapiens
tggagcccgcacccccaccctt

SEQ ID NO: 3746469 - DNA, 14 bp, Homo sapiens
tggagcgcacctgc

SEQ ID NO: 3746470 - DNA, 13 bp, Homo sapiens
tggagctcctggg

SEQ ID NO: 3746471 - DNA, 18 bp, Homo sapiens
tggagctcctgggaaggc

SEQ ID NO: 3746472 - DNA, 18 bp, Homo sapiens
tggagctggcgtctgtct

SEQ ID NO: 3746473 - DNA, 21 bp, Homo sapiens
tggaggaaaaccaagccgtgg

SEQ ID NO: 3746474 - DNA, 17 bp, Homo sapiens
tggaggaatgctccccc

SEQ ID NO: 3746475 - DNA, 22 bp, Homo sapiens
tggaggaatgctcccccatcct

SEQ ID NO: 3746476 - DNA, 16 bp, Homo sapiens
tggaggagagcctggt

SEQ ID NO: 3746477 - DNA, 20 bp, Homo sapiens
tggaggagctcaggacacta

SEQ ID NO: 3746478 - DNA, 16 bp, Homo sapiens
tggaggaggaggcaat

SEQ ID NO: 3746479 - DNA, 22 bp, Homo sapiens
tggaggcacacagctgcagaga

SEQ ID NO: 3746480 - DNA, 15 bp, Homo sapiens
tggaggccagccagt

SEQ ID NO: 3746481 - DNA, 15 bp, Homo sapiens
tggaggcctctgggc

SEQ ID NO: 3746482 - DNA, 13 bp, Homo sapiens
tggaggctgtctt

SEQ ID NO: 3746483 - DNA, 14 bp, Homo sapiens
tggaggctgtcttc

SEQ ID NO: 3746484 - DNA, 23 bp, Homo sapiens
tggaggctgtcttctcaggctct

SEQ ID NO: 3746485 - DNA, 20 bp, Homo sapiens
tggagggaaacaccaaactc

SEQ ID NO: 3746486 - DNA, 19 bp, Homo sapiens
tggaggggtggtcctgact

SEQ ID NO: 3746487 - DNA, 17 bp, Homo sapiens
tggaggttaaggctgag

SEQ ID NO: 3746488 - DNA, 19 bp, Homo sapiens
tggaggttaaggctgagga

SEQ ID NO: 3746489 - DNA, 22 bp, Homo sapiens
tggaggttaaggctgaggaaag

SEQ ID NO: 3746490 - DNA, 24 bp, Homo sapiens
tggaggttaaggctgaggaaaggc

SEQ ID NO: 3746491 - DNA, 18 bp, Homo sapiens
tggagtagacccctggct

SEQ ID NO: 3746492 - DNA, 14 bp, Homo sapiens
tggagtatatgtca

SEQ ID NO: 3746493 - DNA, 15 bp, Homo sapiens
tggagtccagtctct

SEQ ID NO: 3746494 - DNA, 17 bp, Homo sapiens
tggatagatgccctgct

SEQ ID NO: 3746495 - DNA, 15 bp, Homo sapiens
tggatattagtcata

SEQ ID NO: 3746496 - DNA, 22 bp, Homo sapiens
tggatattttcaaattgtatct

SEQ ID NO: 3746497 - DNA, 23 bp, Homo sapiens
tggatcaaaatctgtagagcagg

SEQ ID NO: 3746498 - DNA, 23 bp, Homo sapiens
tggatcacagaggcttcttcaga

SEQ ID NO: 3746499 - DNA, 16 bp, Homo sapiens
tggatcagtcctttga

SEQ ID NO: 3746500 - DNA, 20 bp, Homo sapiens
tggatccccagtgaaaacta

SEQ ID NO: 3746501 - DNA, 14 bp, Homo sapiens
tggatgatgtttcg

SEQ ID NO: 3746502 - DNA, 20 bp, Homo sapiens
tggatgcctggtggcagctg

SEQ ID NO: 3746503 - DNA, 17 bp, Homo sapiens
tggattaattaaatgca

SEQ ID NO: 3746504 - DNA, 13 bp, Homo sapiens
tggattctcagat

SEQ ID NO: 3746505 - DNA, 14 bp, Homo sapiens
tggattctcagata

SEQ ID NO: 3746506 - DNA, 21 bp, Homo sapiens
tggattgacagtaacttggtt

SEQ ID NO: 3746507 - DNA, 17 bp, Homo sapiens
tggcaaagatgtgggga

SEQ ID NO: 3746508 - DNA, 14 bp, Homo sapiens
tggcaattctttga

SEQ ID NO: 3746509 - DNA, 14 bp, Homo sapiens
tggcaattttgtaa

SEQ ID NO: 3746510 - DNA, 15 bp, Homo sapiens
tggcaattttgtaac

SEQ ID NO: 3746511 - DNA, 22 bp, Homo sapiens
tggcacacacctgtagtcccag

SEQ ID NO: 3746512 - DNA, 18 bp, Homo sapiens
tggcacagcccaaagaag

SEQ ID NO: 3746513 - DNA, 21 bp, Homo sapiens
tggcacatttccccagacctg

SEQ ID NO: 3746514 - DNA, 16 bp, Homo sapiens
tggcaccagcagcctg

SEQ ID NO: 3746515 - DNA, 17 bp, Homo sapiens
tggcaccagcagcctgg

SEQ ID NO: 3746516 - DNA, 18 bp, Homo sapiens
tggcacccggcccctgct

SEQ ID NO: 3746517 - DNA, 19 bp, Homo sapiens
tggcacggtggctcaggcc

SEQ ID NO: 3746518 - DNA, 15 bp, Homo sapiens
tggcactataatgta

SEQ ID NO: 3746519 - DNA, 16 bp, Homo sapiens
tggcagaagtgtttca

SEQ ID NO: 3746520 - DNA, 19 bp, Homo sapiens
tggcagataatcagcctct

SEQ ID NO: 3746521 - DNA, 22 bp, Homo sapiens
tggcagatttagtgaaagctag

SEQ ID NO: 3746522 - DNA, 13 bp, Homo sapiens
tggcagattttac

SEQ ID NO: 3746523 - DNA, 15 bp, Homo sapiens
tggcagattttacaa

SEQ ID NO: 3746524 - DNA, 20 bp, Homo sapiens
tggcagattttacaaaagat

SEQ ID NO: 3746525 - DNA, 20 bp, Homo sapiens
tggcagcagagtgtggcctt

SEQ ID NO: 3746526 - DNA, 19 bp, Homo sapiens
tggcagcaggcctgttgct

SEQ ID NO: 3746527 - DNA, 17 bp, Homo sapiens
tggcagccgtgccttca

SEQ ID NO: 3746528 - DNA, 14 bp, Homo sapiens
tggcagctgtctca

SEQ ID NO: 3746529 - DNA, 19 bp, Homo sapiens
tggcaggagttggaagtgt

SEQ ID NO: 3746530 - DNA, 22 bp, Homo sapiens
tggcaggatgaccctgcgaagg

SEQ ID NO: 3746531 - DNA, 15 bp, Homo sapiens
tggcaggccagctgt

SEQ ID NO: 3746532 - DNA, 16 bp, Homo sapiens
tggcagggtgggatgg

SEQ ID NO: 3746533 - DNA, 17 bp, Homo sapiens
tggcagggtgggatgga

SEQ ID NO: 3746534 - DNA, 14 bp, Homo sapiens
tggcagtaaagaga

SEQ ID NO: 3746535 - DNA, 22 bp, Homo sapiens
tggcagtgcagcaaccagagca

SEQ ID NO: 3746536 - DNA, 22 bp, Homo sapiens
tggcatacgcctgtagtcctag

SEQ ID NO: 3746537 - DNA, 20 bp, Homo sapiens
tggcatcacagggcagagcc

SEQ ID NO: 3746538 - DNA, 19 bp, Homo sapiens
tggcatcccagtggcctca

SEQ ID NO: 3746539 - DNA, 18 bp, Homo sapiens
tggcatctgacacaaaaa

SEQ ID NO: 3746540 - DNA, 16 bp, Homo sapiens
tggcatctttgccttg

SEQ ID NO: 3746541 - DNA, 21 bp, Homo sapiens
tggcatctttgccttgggctg

SEQ ID NO: 3746542 - DNA, 16 bp, Homo sapiens
tggcatggcacctgtc

SEQ ID NO: 3746543 - DNA, 15 bp, Homo sapiens
tggcatggctccagt

SEQ ID NO: 3746544 - DNA, 16 bp, Homo sapiens
tggcatggctccagtc

SEQ ID NO: 3746545 - DNA, 17 bp, Homo sapiens
tggcatggctccagtct

SEQ ID NO: 3746546 - DNA, 20 bp, Homo sapiens
tgcattagaaatagacagta

SEQ ID NO: 3746547 - DNA, 12 bp, Homo sapiens
tgcattctagta

SEQ ID NO: 3746548 - DNA, 14 bp, Homo sapiens
tgcattgaatatat

SEQ ID NO: 3746549 - DNA, 23 bp, Homo sapiens
tgcattgcctgcggtcaaggcca

SEQ ID NO: 3746550 - DNA, 18 bp, Homo sapiens
tgcatttaccggcagtgc

SEQ ID NO: 3746551 - DNA, 13 bp, Homo sapiens
tgcatttcctgac

SEQ ID NO: 3746552 - DNA, 13 bp, Homo sapiens
tgcatttgaggtc

SEQ ID NO: 3746553 - DNA, 19 bp, Homo sapiens
tgcattttctgaaactaat

SEQ ID NO: 3746554 - DNA, 19 bp, Homo sapiens
tgcatttttgtgaaatgaa

SEQ ID NO: 3746555 - DNA, 17 bp, Homo sapiens
tgccaaaataatgtctt

SEQ ID NO: 3746556 - DNA, 19 bp, Homo sapiens
tgccaaaatcattttaatg

SEQ ID NO: 3746557 - DNA, 20 bp, Homo sapiens
tgccaaagctagggtggccc

SEQ ID NO: 3746558 - DNA, 14 bp, Homo sapiens
tgccaaagggaaat

SEQ ID NO: 3746559 - DNA, 20 bp, Homo sapiens
tgccaagaactgaaaacata

SEQ ID NO: 3746560 - DNA, 19 bp, Homo sapiens
tgccaagcacagtgcctgc

SEQ ID NO: 3746561 - DNA, 22 bp, Homo sapiens
tgccaaggccagagtggcctgg

SEQ ID NO: 3746562 - DNA, 21 bp, Homo sapiens
tgccaatgaggtctgaaatgg

SEQ ID NO: 3746563 - DNA, 13 bp, Homo sapiens
tgccacacagagt

SEQ ID NO: 3746564 - DNA, 14 bp, Homo sapiens
tgccacacttcagg

SEQ ID NO: 3746565 - DNA, 15 bp, Homo sapiens
tgccacacttcaggc

SEQ ID NO: 3746566 - DNA, 19 bp, Homo sapiens
tgccaccaactggccctct

SEQ ID NO: 3746567 - DNA, 21 bp, Homo sapiens
tgccaccaactggccctcttc

SEQ ID NO: 3746568 - DNA, 12 bp, Homo sapiens
tgccaccaggag

SEQ ID NO: 3746569 - DNA, 13 bp, Homo sapiens
tgccacctcccct

SEQ ID NO: 3746570 - DNA, 17 bp, Homo sapiens
tgccacctggggcagtc

SEQ ID NO: 3746571 - DNA, 22 bp, Homo sapiens
tgccacgcggtacaaaggaaaa

SEQ ID NO: 3746572 - DNA, 16 bp, Homo sapiens
tgccactaggctgggt

SEQ ID NO: 3746573 - DNA, 21 bp, Homo sapiens
tgccactaggctgggtgccca

SEQ ID NO: 3746574 - DNA, 22 bp, Homo sapiens
tgccactaggctgggtgcccac

SEQ ID NO: 3746575 - DNA, 23 bp, Homo sapiens
tgccactaggctgggtgcccaca

SEQ ID NO: 3746576 - DNA, 13 bp, Homo sapiens
tgccactgcctct

SEQ ID NO: 3746577 - DNA, 18 bp, Homo sapiens
tgccagaacagtttgtac

SEQ ID NO: 3746578 - DNA, 19 bp, Homo sapiens
tgccagagcaaagggccag

SEQ ID NO: 3746579 - DNA, 20 bp, Homo sapiens
tgccagagcaaagggccagg

SEQ ID NO: 3746580 - DNA, 22 bp, Homo sapiens
tgccagcacagagcgtccttcc

SEQ ID NO: 3746581 - DNA, 17 bp, Homo sapiens
tgccagcacccccacgc

SEQ ID NO: 3746582 - DNA, 15 bp, Homo sapiens
tgccagccagcagcc

SEQ ID NO: 3746583 - DNA, 21 bp, Homo sapiens
tgccagcctggcttctggagc

SEQ ID NO: 3746584 - DNA, 23 bp, Homo sapiens
tgccagcctggcttctggagccc

SEQ ID NO: 3746585 - DNA, 17 bp, Homo sapiens
tgccagctcagtcccat

SEQ ID NO: 3746586 - DNA, 11 bp, Homo sapiens
tgccaggcccg

SEQ ID NO: 3746587 - DNA, 18 bp, Homo sapiens
tgccaggtttttggtctg

SEQ ID NO: 3746588 - DNA, 19 bp, Homo sapiens
tgccaggtttttggtctga

SEQ ID NO: 3746589 - DNA, 22 bp, Homo sapiens
tgccaggtttttggtctgaccc

SEQ ID NO: 3746590 - DNA, 13 bp, Homo sapiens
tgccagtcctggg

SEQ ID NO: 3746591 - DNA, 14 bp, Homo sapiens
tgccagtcctgggg

SEQ ID NO: 3746592 - DNA, 20 bp, Homo sapiens
tgccagtgccttacctcctg

SEQ ID NO: 3746593 - DNA, 16 bp, Homo sapiens
tgccatattctgttgg

SEQ ID NO: 3746594 - DNA, 21 bp, Homo sapiens
tgccatattctgttggccagt

SEQ ID NO: 3746595 - DNA, 16 bp, Homo sapiens
tgccatgaactggagg

SEQ ID NO: 3746596 - DNA, 19 bp, Homo sapiens
tgccatgaactggaggcca

SEQ ID NO: 3746597 - DNA, 20 bp, Homo sapiens
tgccatgacaacttctaatt

SEQ ID NO: 3746598 - DNA, 23 bp, Homo sapiens
tgccatggacagaagaaggcagc

SEQ ID NO: 3746599 - DNA, 17 bp, Homo sapiens
tgccatggcgtgtccct

SEQ ID NO: 3746600 - DNA, 15 bp, Homo sapiens
tgccatgtgaagagg

SEQ ID NO: 3746601 - DNA, 14 bp, Homo sapiens
tgccatgtgccagg

SEQ ID NO: 3746602 - DNA, 17 bp, Homo sapiens
tgccatgttggccaggc

SEQ ID NO: 3746603 - DNA, 20 bp, Homo sapiens
tgccatgttggccaggctgg

SEQ ID NO: 3746604 - DNA, 17 bp, Homo sapiens
tgccatttgcaccctcc

SEQ ID NO: 3746605 - DNA, 21 bp, Homo sapiens
tgccattttgggttaggagaa

SEQ ID NO: 3746606 - DNA, 15 bp, Homo sapiens
tgcccaaatctgcct

SEQ ID NO: 3746607 - DNA, 13 bp, Homo sapiens
tgcccaacctcag

SEQ ID NO: 3746608 - DNA, 19 bp, Homo sapiens
tgcccaacctcagcaacct

SEQ ID NO: 3746609 - DNA, 18 bp, Homo sapiens
tgcccaacctgctctcct

SEQ ID NO: 3746610 - DNA, 21 bp, Homo sapiens
tgcccaagaatagatgctgac

SEQ ID NO: 3746611 - DNA, 12 bp, Homo sapiens
tgcccacagccc

SEQ ID NO: 3746612 - DNA, 17 bp, Homo sapiens
tgcccaccaacatccca

SEQ ID NO: 3746613 - DNA, 20 bp, Homo sapiens
tgcccacccgtggagatggg

SEQ ID NO: 3746614 - DNA, 19 bp, Homo sapiens
tgcccacctgcccatcaca

SEQ ID NO: 3746615 - DNA, 18 bp, Homo sapiens
tgcccacgctggagtgca

SEQ ID NO: 3746616 - DNA, 19 bp, Homo sapiens
tgcccagacccctctggcc

SEQ ID NO: 3746617 - DNA, 12 bp, Homo sapiens
tgcccagagatg

SEQ ID NO: 3746618 - DNA, 21 bp, Homo sapiens
tgcccagagatgcctccaccg

SEQ ID NO: 3746619 - DNA, 17 bp, Homo sapiens
tgcccagagctgggtga

SEQ ID NO: 3746620 - DNA, 16 bp, Homo sapiens
tgcccagatcccagaa

SEQ ID NO: 3746621 - DNA, 21 bp, Homo sapiens
tgcccagctcagtcttcccta

SEQ ID NO: 3746622 - DNA, 21 bp, Homo sapiens
tgcccaggagagccagccctc

SEQ ID NO: 3746623 - DNA, 20 bp, Homo sapiens
tgcccaggcaggtcttgaac

SEQ ID NO: 3746624 - DNA, 11 bp, Homo sapiens
tgcccaggccc

SEQ ID NO: 3746625 - DNA, 12 bp, Homo sapiens
tgcccaggcccc

SEQ ID NO: 3746626 - DNA, 15 bp, Homo sapiens
tgcccaggcccctgc

SEQ ID NO: 3746627 - DNA, 18 bp, Homo sapiens
tgcccaggcccctgccac

SEQ ID NO: 3746628 - DNA, 17 bp, Homo sapiens
tgcccaggcctgcctgt

SEQ ID NO: 3746629 - DNA, 19 bp, Homo sapiens
tgcccagggccactctgcc

SEQ ID NO: 3746630 - DNA, 22 bp, Homo sapiens
tgcccagggccactctgcctct

SEQ ID NO: 3746631 - DNA, 14 bp, Homo sapiens
tgcccagggctcag

SEQ ID NO: 3746632 - DNA, 15 bp, Homo sapiens
tgcccagggctcagc

SEQ ID NO: 3746633 - DNA, 20 bp, Homo sapiens
tgcccagggctcagcctggt

SEQ ID NO: 3746634 - DNA, 23 bp, Homo sapiens
tgcccagggctcagcctggtggg

SEQ ID NO: 3746635 - DNA, 23 bp, Homo sapiens
tgcccatcacagggttgggccca

SEQ ID NO: 3746636 - DNA, 16 bp, Homo sapiens
tgcccatcctgtctgt

SEQ ID NO: 3746637 - DNA, 18 bp, Homo sapiens
tgcccattccccagcctc

SEQ ID NO: 3746638 - DNA, 15 bp, Homo sapiens
tgccccaactcctgg

SEQ ID NO: 3746639 - DNA, 12 bp, Homo sapiens
tgccccacctgc

SEQ ID NO: 3746640 - DNA, 19 bp, Homo sapiens
tgccccacctttattaaaa

SEQ ID NO: 3746641 - DNA, 19 bp, Homo sapiens
tgccccagctgactgtggc

SEQ ID NO: 3746642 - DNA, 20 bp, Homo sapiens
tgccccagctgactgtggcc

SEQ ID NO: 3746643 - DNA, 19 bp, Homo sapiens
tgcccccacacctggccct

SEQ ID NO: 3746644 - DNA, 15 bp, Homo sapiens
tgccccccaccccag

SEQ ID NO: 3746645 - DNA, 18 bp, Homo sapiens
tgccccccaccccagcct

SEQ ID NO: 3746646 - DNA, 20 bp, Homo sapiens
tgccccccaccccagcctaa

SEQ ID NO: 3746647 - DNA, 12 bp, Homo sapiens
tgccccctggtg

SEQ ID NO: 3746648 - DNA, 17 bp, Homo sapiens
tgcccccttctcccaca

SEQ ID NO: 3746649 - DNA, 19 bp, Homo sapiens
tgcccccttctcccacact

SEQ ID NO: 3746650 - DNA, 20 bp, Homo sapiens
tgcccccttctcccacactg

SEQ ID NO: 3746651 - DNA, 22 bp, Homo sapiens
tgcccccttctcccacactgct

SEQ ID NO: 3746652 - DNA, 17 bp, Homo sapiens
tgccccgctttgcggac

SEQ ID NO: 3746653 - DNA, 18 bp, Homo sapiens
tgccccgtcaccatctca

SEQ ID NO: 3746654 - DNA, 20 bp, Homo sapiens
tgccccgtcaccatctcagg

SEQ ID NO: 3746655 - DNA, 18 bp, Homo sapiens
tgccccgtgcagactgga

SEQ ID NO: 3746656 - DNA, 22 bp, Homo sapiens
tgcccctattagctcttttctt

SEQ ID NO: 3746657 - DNA, 15 bp, Homo sapiens
tgcccctcccttcaa

SEQ ID NO: 3746658 - DNA, 14 bp, Homo sapiens
tgcccctggctctg

SEQ ID NO: 3746659 - DNA, 14 bp, Homo sapiens
tgccccttctacac

SEQ ID NO: 3746660 - DNA, 16 bp, Homo sapiens
tgccccttctacactc

SEQ ID NO: 3746661 - DNA, 22 bp, Homo sapiens
tgccccttctacactctcctgg

SEQ ID NO: 3746662 - DNA, 14 bp, Homo sapiens
tgcccgagctggtg

SEQ ID NO: 3746663 - DNA, 19 bp, Homo sapiens
tgcccgagctggtgcatta

SEQ ID NO: 3746664 - DNA, 20 bp, Homo sapiens
tgcccgagctggtgcattac

SEQ ID NO: 3746665 - DNA, 15 bp, Homo sapiens
tgcccggattctggg

SEQ ID NO: 3746666 - DNA, 18 bp, Homo sapiens
tgcccggggcagctgcca

SEQ ID NO: 3746667 - DNA, 20 bp, Homo sapiens
tgcccggggcagctgccaga

SEQ ID NO: 3746668 - DNA, 15 bp, Homo sapiens
tgccctactcactct

SEQ ID NO: 3746669 - DNA, 23 bp, Homo sapiens
tgccctagagcacactgtagcat

SEQ ID NO: 3746670 - DNA, 18 bp, Homo sapiens
tgccctaggctccgtcag

SEQ ID NO: 3746671 - DNA, 14 bp, Homo sapiens
tgccctccactgcc

SEQ ID NO: 3746672 - DNA, 15 bp, Homo sapiens
tgccctccactgccc

SEQ ID NO: 3746673 - DNA, 18 bp, Homo sapiens
tgccctccactgccctct

SEQ ID NO: 3746674 - DNA, 16 bp, Homo sapiens
tgccctccctccttcc

SEQ ID NO: 3746675 - DNA, 20 bp, Homo sapiens
tgccctcgggcgagtcactg

SEQ ID NO: 3746676 - DNA, 23 bp, Homo sapiens
tgccctcgggcgagtcactgcct

SEQ ID NO: 3746677 - DNA, 23 bp, Homo sapiens
tgccctgctgccgcctcccagcc

SEQ ID NO: 3746678 - DNA, 18 bp, Homo sapiens
tgccctggtccagggaag

SEQ ID NO: 3746679 - DNA, 17 bp, Homo sapiens
tgccctggtgctgccac

SEQ ID NO: 3746680 - DNA, 21 bp, Homo sapiens
tgccctggtgctgccacactt

SEQ ID NO: 3746681 - DNA, 22 bp, Homo sapiens
tgccctggtttcactggcccaa

SEQ ID NO: 3746682 - DNA, 17 bp, Homo sapiens
tgcccttggaggccagc

SEQ ID NO: 3746683 - DNA, 15 bp, Homo sapiens
tgccgaaactggaag

SEQ ID NO: 3746684 - DNA, 14 bp, Homo sapiens
tgccgacacgctcc

SEQ ID NO: 3746685 - DNA, 15 bp, Homo sapiens
tgccgaccgaggctg

SEQ ID NO: 3746686 - DNA, 22 bp, Homo sapiens
tgccgaccgaggctggagctgg

SEQ ID NO: 3746687 - DNA, 15 bp, Homo sapiens
tgccgcaccccagag

SEQ ID NO: 3746688 - DNA, 20 bp, Homo sapiens
tgccgcccgaggtggctgcc

SEQ ID NO: 3746689 - DNA, 23 bp, Homo sapiens
tgccgtagggagtacctgctgcc

SEQ ID NO: 3746690 - DNA, 14 bp, Homo sapiens
tgcctaagtggctg

SEQ ID NO: 3746691 - DNA, 21 bp, Homo sapiens
tgcctaataaacatccttcaa

SEQ ID NO: 3746692 - DNA, 22 bp, Homo sapiens
tgcctagcactcacatgctgga

SEQ ID NO: 3746693 - DNA, 17 bp, Homo sapiens
tgcctagggcctggtcc

SEQ ID NO: 3746694 - DNA, 18 bp, Homo sapiens
tgcctagggcctggtcca

SEQ ID NO: 3746695 - DNA, 20 bp, Homo sapiens
tgcctcatctataacatgca

SEQ ID NO: 3746696 - DNA, 13 bp, Homo sapiens
tgcctccaccgct

SEQ ID NO: 3746697 - DNA, 18 bp, Homo sapiens
tgcctccaccgctgccta

SEQ ID NO: 3746698 - DNA, 20 bp, Homo sapiens
tgcctccaccgctgcctaag

SEQ ID NO: 3746699 - DNA, 16 bp, Homo sapiens
tgcctccatggtgcct

SEQ ID NO: 3746700 - DNA, 20 bp, Homo sapiens
tgcctccatggtgcctctgg

SEQ ID NO: 3746701 - DNA, 22 bp, Homo sapiens
tgcctccatggtgcctctggag

SEQ ID NO: 3746702 - DNA, 18 bp, Homo sapiens
tgcctccccaaccctgcc

SEQ ID NO: 3746703 - DNA, 19 bp, Homo sapiens
tgcctccccaaccctgccc

SEQ ID NO: 3746704 - DNA, 18 bp, Homo sapiens
tgcctccccggctcgagc

SEQ ID NO: 3746705 - DNA, 19 bp, Homo sapiens
tgcctccctgaccctgcag

SEQ ID NO: 3746706 - DNA, 13 bp, Homo sapiens
tgcctccctgtcc

SEQ ID NO: 3746707 - DNA, 16 bp, Homo sapiens
tgcctccctgtccacc

SEQ ID NO: 3746708 - DNA, 24 bp, Homo sapiens
tgcctcctcacccccagctttgct

SEQ ID NO: 3746709 - DNA, 14 bp, Homo sapiens
tgcctcctcttcaa

SEQ ID NO: 3746710 - DNA, 21 bp, Homo sapiens
tgcctctgacacacagctctg

SEQ ID NO: 3746711 - DNA, 17 bp, Homo sapiens
tgcctctgcctctgaca

SEQ ID NO: 3746712 - DNA, 12 bp, Homo sapiens
tgcctctgcctg

SEQ ID NO: 3746713 - DNA, 13 bp, Homo sapiens
tgcctctgcctgt

SEQ ID NO: 3746714 - DNA, 17 bp, Homo sapiens
tgcctctggaggcctct

SEQ ID NO: 3746715 - DNA, 13 bp, Homo sapiens
tgcctctgggact

SEQ ID NO: 3746716 - DNA, 18 bp, Homo sapiens
tgcctctttcctgttgtt

SEQ ID NO: 3746717 - DNA, 13 bp, Homo sapiens
tgcctgaagaaca

SEQ ID NO: 3746718 - DNA, 19 bp, Homo sapiens
tgcctgaagttggagtgag

SEQ ID NO: 3746719 - DNA, 19 bp, Homo sapiens
tgcctgagcacctcccagc

SEQ ID NO: 3746720 - DNA, 20 bp, Homo sapiens
tgcctgagcacctcccagcc

SEQ ID NO: 3746721 - DNA, 22 bp, Homo sapiens
tgcctgagcacctcccagcccc

SEQ ID NO: 3746722 - DNA, 15 bp, Homo sapiens
tgcctgcatgtattt

SEQ ID NO: 3746723 - DNA, 13 bp, Homo sapiens
tgcctgcccaccc

SEQ ID NO: 3746724 - DNA, 18 bp, Homo sapiens
tgcctgcccaggcccctg

SEQ ID NO: 3746725 - DNA, 24 bp, Homo sapiens
tgcctgcccaggcccctgccaccc

SEQ ID NO: 3746726 - DNA, 18 bp, Homo sapiens
tgcctgccccaaacaaat

SEQ ID NO: 3746727 - DNA, 20 bp, Homo sapiens
tgcctgccccaaacaaatat

SEQ ID NO: 3746728 - DNA, 18 bp, Homo sapiens
tgcctggaagagcagccc

SEQ ID NO: 3746729 - DNA, 15 bp, Homo sapiens
tgcctggacaaaccc

SEQ ID NO: 3746730 - DNA, 17 bp, Homo sapiens
tgcctggagctcctggg

SEQ ID NO: 3746731 - DNA, 12 bp, Homo sapiens
tgcctggccagg

SEQ ID NO: 3746732 - DNA, 14 bp, Homo sapiens
tgcctggccaggca

SEQ ID NO: 3746733 - DNA, 15 bp, Homo sapiens
tgcctgggaatgtat

SEQ ID NO: 3746734 - DNA, 22 bp, Homo sapiens
tgcctgggctcccttgtgcgtg

SEQ ID NO: 3746735 - DNA, 23 bp, Homo sapiens
tgcctgggtggggctgctcctcc

SEQ ID NO: 3746736 - DNA, 14 bp, Homo sapiens
tgcctggtggcagc

SEQ ID NO: 3746737 - DNA, 17 bp, Homo sapiens
tgcctggtggcagctgc

SEQ ID NO: 3746738 - DNA, 18 bp, Homo sapiens
tgcctggtggcagctgcg

SEQ ID NO: 3746739 - DNA, 15 bp, Homo sapiens
tgcctgtagttagga

SEQ ID NO: 3746740 - DNA, 16 bp, Homo sapiens
tgcctgtagttaggaa

SEQ ID NO: 3746741 - DNA, 17 bp, Homo sapiens
tgcctgtagttaggaaa

SEQ ID NO: 3746742 - DNA, 23 bp, Homo sapiens
tgcctgtagttaggaaataaaac

SEQ ID NO: 3746743 - DNA, 15 bp, Homo sapiens
tgcctgtgagccagt

SEQ ID NO: 3746744 - DNA, 14 bp, Homo sapiens
tgcctgtgaggcag

SEQ ID NO: 3746745 - DNA, 12 bp, Homo sapiens
tgcctgtgccaa

SEQ ID NO: 3746746 - DNA, 19 bp, Homo sapiens
tgcctgtgccacccaccag

SEQ ID NO: 3746747 - DNA, 17 bp, Homo sapiens
tgcctgttcagctccag

SEQ ID NO: 3746748 - DNA, 18 bp, Homo sapiens
tgcctgttcagctccagc

SEQ ID NO: 3746749 - DNA, 21 bp, Homo sapiens
tgcctgttcagctccagctca

SEQ ID NO: 3746750 - DNA, 18 bp, Homo sapiens
tgccttacctcctgccca

SEQ ID NO: 3746751 - DNA, 21 bp, Homo sapiens
tgccttagaacctttcttaca

SEQ ID NO: 3746752 - DNA, 13 bp, Homo sapiens
tgccttcagctct

SEQ ID NO: 3746753 - DNA, 14 bp, Homo sapiens
tgccttccacgctg

SEQ ID NO: 3746754 - DNA, 17 bp, Homo sapiens
tgccttccacgctgtct

SEQ ID NO: 3746755 - DNA, 19 bp, Homo sapiens
tgccttccacgctgtctcc

SEQ ID NO: 3746756 - DNA, 13 bp, Homo sapiens
tgccttccataat

SEQ ID NO: 3746757 - DNA, 21 bp, Homo sapiens
tgccttcttcggggaactcct

SEQ ID NO: 3746758 - DNA, 22 bp, Homo sapiens
tgccttcttcggggaactcctg

SEQ ID NO: 3746759 - DNA, 18 bp, Homo sapiens
tgcctttgagtttcctca

SEQ ID NO: 3746760 - DNA, 12 bp, Homo sapiens
tgcctttgtaag

SEQ ID NO: 3746761 - DNA, 16 bp, Homo sapiens
tgcctttgtaagttat

SEQ ID NO: 3746762 - DNA, 15 bp, Homo sapiens
tgcctttgttttgat

SEQ ID NO: 3746763 - DNA, 18 bp, Homo sapiens
tgcgaaggggccctggtc

SEQ ID NO: 3746764 - DNA, 15 bp, Homo sapiens
tgcgacggagagaaa

SEQ ID NO: 3746765 - DNA, 13 bp, Homo sapiens
tgcgagtgtgtgc

SEQ ID NO: 3746766 - DNA, 20 bp, Homo sapiens
tgcgatctgggttcactgca

SEQ ID NO: 3746767 - DNA, 22 bp, Homo sapiens
tgcgcacaaggctgaccaagag

SEQ ID NO: 3746768 - DNA, 13 bp, Homo sapiens
tgcgcctacagga

SEQ ID NO: 3746769 - DNA, 23 bp, Homo sapiens
tgcgcgtgcacgtggagagctgg

SEQ ID NO: 3746770 - DNA, 20 bp, Homo sapiens
tgcgctctagcctgggcaac

SEQ ID NO: 3746771 - DNA, 17 bp, Homo sapiens
tgcgctgacaaccaccg

SEQ ID NO: 3746772 - DNA, 15 bp, Homo sapiens
tgcggacaagtttta

SEQ ID NO: 3746773 - DNA, 17 bp, Homo sapiens
tgcggacagccacggcc

SEQ ID NO: 3746774 - DNA, 18 bp, Homo sapiens
tgagatggccctctggta

SEQ ID NO: 3746775 - DNA, 17 bp, Homo sapiens
tgagcaaacctgcccca

SEQ ID NO: 3746776 - DNA, 18 bp, Homo sapiens
tgagcaaacctgccccat

SEQ ID NO: 3746777 - DNA, 19 bp, Homo sapiens
tgagcaaacctgccccatc

SEQ ID NO: 3746778 - DNA, 14 bp, Homo sapiens
tgagcaccagggga

SEQ ID NO: 3746779 - DNA, 20 bp, Homo sapiens
tgagcacctcccagcccctg

SEQ ID NO: 3746780 - DNA, 20 bp, Homo sapiens
tgagcagggctcagcgggga

SEQ ID NO: 3746781 - DNA, 15 bp, Homo sapiens
tgagcagtgtgtctc

SEQ ID NO: 3746782 - DNA, 15 bp, Homo sapiens
tgagcatgttactga

SEQ ID NO: 3746783 - DNA, 21 bp, Homo sapiens
tgagcattgtggctgtcagca

SEQ ID NO: 3746784 - DNA, 12 bp, Homo sapiens
tgagccaccacg

SEQ ID NO: 3746785 - DNA, 14 bp, Homo sapiens
tgagccagacaaat

SEQ ID NO: 3746786 - DNA, 18 bp, Homo sapiens
tgagccaggcctgggtct

SEQ ID NO: 3746787 - DNA, 23 bp, Homo sapiens
tgagccgagatcacgccactgca

SEQ ID NO: 3746788 - DNA, 13 bp, Homo sapiens
tgagcctcagcat

SEQ ID NO: 3746789 - DNA, 15 bp, Homo sapiens
tgagcctcagcatcc

SEQ ID NO: 3746790 - DNA, 16 bp, Homo sapiens
tgagcctggcaagaat

SEQ ID NO: 3746791 - DNA, 19 bp, Homo sapiens
tgagcctgggaggtcaagg

SEQ ID NO: 3746792 - DNA, 22 bp, Homo sapiens
tgagctcagacccccactctca

SEQ ID NO: 3746793 - DNA, 11 bp, Homo sapiens
tgagctcagga

SEQ ID NO: 3746794 - DNA, 19 bp, Homo sapiens
tgagctcaggagtttgaga

SEQ ID NO: 3746795 - DNA, 18 bp, Homo sapiens
tgagctccagacccccag

SEQ ID NO: 3746796 - DNA, 19 bp, Homo sapiens
tgagctccagacccccagc

SEQ ID NO: 3746797 - DNA, 16 bp, Homo sapiens
tgagctccccaaaaac

SEQ ID NO: 3746798 - DNA, 15 bp, Homo sapiens
tgagctccccaccac

SEQ ID NO: 3746799 - DNA, 20 bp, Homo sapiens
tgagctccccaccaccccag

SEQ ID NO: 3746800 - DNA, 23 bp, Homo sapiens
tgagctccccaccaccccagctg

SEQ ID NO: 3746801 - DNA, 19 bp, Homo sapiens
tgagctcctctgggcagga

SEQ ID NO: 3746802 - DNA, 20 bp, Homo sapiens
tgagctcggtggacccaggg

SEQ ID NO: 3746803 - DNA, 17 bp, Homo sapiens
tgagctgagatcgtgcc

SEQ ID NO: 3746804 - DNA, 14 bp, Homo sapiens
tgagctgagcaggg

SEQ ID NO: 3746805 - DNA, 16 bp, Homo sapiens
tgagcttagtgaaatt

SEQ ID NO: 3746806 - DNA, 16 bp, Homo sapiens
tgagcttctctgtgaa

SEQ ID NO: 3746807 - DNA, 13 bp, Homo sapiens
tgagcttggccag

SEQ ID NO: 3746808 - DNA, 15 bp, Homo sapiens
tgagcttggccagaa

SEQ ID NO: 3746809 - DNA, 17 bp, Homo sapiens
tgagctttggacacaca

SEQ ID NO: 3746810 - DNA, 15 bp, Homo sapiens
tgaggaaaggccagc

SEQ ID NO: 3746811 - DNA, 17 bp, Homo sapiens
tgaggaagcgtgaaggc

SEQ ID NO: 3746812 - DNA, 16 bp, Homo sapiens
tgaggaagctccagtc

SEQ ID NO: 3746813 - DNA, 23 bp, Homo sapiens
tgaggaagctccagtcctgctct

SEQ ID NO: 3746814 - DNA, 21 bp, Homo sapiens
tgaggaatccagacccggctg

SEQ ID NO: 3746815 - DNA, 22 bp, Homo sapiens
tgaggaatccagacccggctgc

SEQ ID NO: 3746816 - DNA, 20 bp, Homo sapiens
tgaggacaaccattccagac

SEQ ID NO: 3746817 - DNA, 16 bp, Homo sapiens
tgaggagctgctggct

SEQ ID NO: 3746818 - DNA, 21 bp, Homo sapiens
tgaggaggaaggagagaaggg

SEQ ID NO: 3746819 - DNA, 24 bp, Homo sapiens
tgaggaggcagaaagcagaggctg

SEQ ID NO: 3746820 - DNA, 14 bp, Homo sapiens
tgaggagtttccta

SEQ ID NO: 3746821 - DNA, 17 bp, Homo sapiens
tgaggatcagaaagtaa

SEQ ID NO: 3746822 - DNA, 20 bp, Homo sapiens
tgaggatgggaaggagggag

SEQ ID NO: 3746823 - DNA, 17 bp, Homo sapiens
tgaggatgtcactcaga

SEQ ID NO: 3746824 - DNA, 13 bp, Homo sapiens
tgaggatttcaag

SEQ ID NO: 3746825 - DNA, 20 bp, Homo sapiens
tgaggcaaccacaggcagca

SEQ ID NO: 3746826 - DNA, 17 bp, Homo sapiens
tgaggcaatgtcaggaa

SEQ ID NO: 3746827 - DNA, 20 bp, Homo sapiens
tgaggcaatgtcaggaacag

SEQ ID NO: 3746828 - DNA, 18 bp, Homo sapiens
tgaggcagaagaattgaa

SEQ ID NO: 3746829 - DNA, 14 bp, Homo sapiens
tgaggcagacagca

SEQ ID NO: 3746830 - DNA, 17 bp, Homo sapiens
tgaggcagacagcagct

SEQ ID NO: 3746831 - DNA, 23 bp, Homo sapiens
tgaggcagacagcagctcaggca

SEQ ID NO: 3746832 - DNA, 15 bp, Homo sapiens
tgaggcaggagaatc

SEQ ID NO: 3746833 - DNA, 22 bp, Homo sapiens
tgaggccaaacgttttgaacta

SEQ ID NO: 3746834 - DNA, 23 bp, Homo sapiens
tgaggcccagggagaggccatga

SEQ ID NO: 3746835 - DNA, 23 bp, Homo sapiens
tgaggcgggtggatcacctgagg

SEQ ID NO: 3746836 - DNA, 18 bp, Homo sapiens
tgaggctctttctgggcc

SEQ ID NO: 3746837 - DNA, 16 bp, Homo sapiens
tgaggctggactccag

SEQ ID NO: 3746838 - DNA, 14 bp, Homo sapiens
tgagggagcttagc

SEQ ID NO: 3746839 - DNA, 17 bp, Homo sapiens
tgagggataagcaaaag

SEQ ID NO: 3746840 - DNA, 17 bp, Homo sapiens
tgaggggcaacgaagaa

SEQ ID NO: 3746841 - DNA, 22 bp, Homo sapiens
tgagggtcagagaggagtcaga

SEQ ID NO: 3746842 - DNA, 19 bp, Homo sapiens
tgagggtcttcttacatgc

SEQ ID NO: 3746843 - DNA, 13 bp, Homo sapiens
tgaggtcagagcc

SEQ ID NO: 3746844 - DNA, 17 bp, Homo sapiens
tgaggtcagagcctgca

SEQ ID NO: 3746845 - DNA, 19 bp, Homo sapiens
tgaggtcagagcctgcagt

SEQ ID NO: 3746846 - DNA, 15 bp, Homo sapiens
tgaggtcccaggcag

SEQ ID NO: 3746847 - DNA, 17 bp, Homo sapiens
tgaggtcccaggcagag

SEQ ID NO: 3746848 - DNA, 13 bp, Homo sapiens
tgaggtcctgggg

SEQ ID NO: 3746849 - DNA, 18 bp, Homo sapiens
tgaggtcctgggggcctg

SEQ ID NO: 3746850 - DNA, 21 bp, Homo sapiens
tgaggtcctgggggcctgacc

SEQ ID NO: 3746851 - DNA, 23 bp, Homo sapiens
tgaggtctaggaacatacttcag

SEQ ID NO: 3746852 - DNA, 18 bp, Homo sapiens
tgaggtctcttgagggag

SEQ ID NO: 3746853 - DNA, 15 bp, Homo sapiens
tgaggtctgctcggc

SEQ ID NO: 3746854 - DNA, 23 bp, Homo sapiens
tgaggtctgctcggccgtcttca

SEQ ID NO: 3746855 - DNA, 21 bp, Homo sapiens
tgaggtcttttgacatgtgga

SEQ ID NO: 3746856 - DNA, 15 bp, Homo sapiens
tgaggtgaaagggag

SEQ ID NO: 3746857 - DNA, 17 bp, Homo sapiens
tgaggtgcagagtgccc

SEQ ID NO: 3746858 - DNA, 20 bp, Homo sapiens
tgaggtgcagagtgcccaga

SEQ ID NO: 3746859 - DNA, 16 bp, Homo sapiens
tgaggtggaagccctc

SEQ ID NO: 3746860 - DNA, 14 bp, Homo sapiens
tgaggtggtctgaa

SEQ ID NO: 3746861 - DNA, 19 bp, Homo sapiens
tgaggtggtctgaatgttc

SEQ ID NO: 3746862 - DNA, 14 bp, Homo sapiens
tgagtaagagctgg

SEQ ID NO: 3746863 - DNA, 21 bp, Homo sapiens
tgagtaagagctggtgtctga

SEQ ID NO: 3746864 - DNA, 15 bp, Homo sapiens
tgagtatctcctcgc

SEQ ID NO: 3746865 - DNA, 17 bp, Homo sapiens
tgagtatgtggaaggca

SEQ ID NO: 3746866 - DNA, 14 bp, Homo sapiens
tgagtcaccaagcc

SEQ ID NO: 3746867 - DNA, 17 bp, Homo sapiens
tgagtcaccaagcccag

SEQ ID NO: 3746868 - DNA, 13 bp, Homo sapiens
tgagtcaccagga

SEQ ID NO: 3746869 - DNA, 16 bp, Homo sapiens
tgagtcacccatgaag

SEQ ID NO: 3746870 - DNA, 20 bp, Homo sapiens
tgagtcaccctacctgtgcc

SEQ ID NO: 3746871 - DNA, 19 bp, Homo sapiens
tgagtccagaagtttgaga

SEQ ID NO: 3746872 - DNA, 18 bp, Homo sapiens
tgagtcccttccaggcca

SEQ ID NO: 3746873 - DNA, 15 bp, Homo sapiens
tgagtcgaggacagg

SEQ ID NO: 3746874 - DNA, 18 bp, Homo sapiens
tgagtcgaggacagggag

SEQ ID NO: 3746875 - DNA, 14 bp, Homo sapiens
tgagtctcttcaga

SEQ ID NO: 3746876 - DNA, 20 bp, Homo sapiens
tgagtgatcctccaacttca

SEQ ID NO: 3746877 - DNA, 20 bp, Homo sapiens
tgagtggggagacacctcag

SEQ ID NO: 3746878 - DNA, 21 bp, Homo sapiens
tgagtggggagacacctcaga

SEQ ID NO: 3746879 - DNA, 21 bp, Homo sapiens
tgagtgggggatcacagcctc

SEQ ID NO: 3746880 - DNA, 19 bp, Homo sapiens
tgagtgtaacaagaaagga

SEQ ID NO: 3746881 - DNA, 14 bp, Homo sapiens
tgagtgtaagtgtg

SEQ ID NO: 3746882 - DNA, 11 bp, Homo sapiens
tgagtgtacca

SEQ ID NO: 3746883 - DNA, 14 bp, Homo sapiens
tgagtgtggctccc

SEQ ID NO: 3746884 - DNA, 20 bp, Homo sapiens
tgagttcaagggctgtaggt

SEQ ID NO: 3746885 - DNA, 15 bp, Homo sapiens
tgagttcaggtagct

SEQ ID NO: 3746886 - DNA, 16 bp, Homo sapiens
tgagttcaggtagctg

SEQ ID NO: 3746887 - DNA, 18 bp, Homo sapiens
tgagttcataccctgtta

SEQ ID NO: 3746888 - DNA, 19 bp, Homo sapiens
tgagttgattcagctctgc

SEQ ID NO: 3746889 - DNA, 15 bp, Homo sapiens
tgagtttaccatttg

SEQ ID NO: 3746890 - DNA, 19 bp, Homo sapiens
tgagtttcctcaggctgct

SEQ ID NO: 3746891 - DNA, 14 bp, Homo sapiens
tgagtttcttttat

SEQ ID NO: 3746892 - DNA, 22 bp, Homo sapiens
tgagtttgccctggtttcactg

SEQ ID NO: 3746893 - DNA, 19 bp, Homo sapiens
tgataaaaaattttgtaat

SEQ ID NO: 3746894 - DNA, 19 bp, Homo sapiens
tgataaattccactggact

SEQ ID NO: 3746895 - DNA, 12 bp, Homo sapiens
tgataacagcta

SEQ ID NO: 3746896 - DNA, 16 bp, Homo sapiens
tgataaggatcagaac

SEQ ID NO: 3746897 - DNA, 18 bp, Homo sapiens
tgataatgatgatgacga

SEQ ID NO: 3746898 - DNA, 23 bp, Homo sapiens
tgatacactatgaagatgtttca

SEQ ID NO: 3746899 - DNA, 18 bp, Homo sapiens
tgatacccatagcttcca

SEQ ID NO: 3746900 - DNA, 15 bp, Homo sapiens
tgatacttttaagag

SEQ ID NO: 3746901 - DNA, 15 bp, Homo sapiens
tgatagcgttggaat

SEQ ID NO: 3746902 - DNA, 20 bp, Homo sapiens
tgatagcgttggaattaaaa

SEQ ID NO: 3746903 - DNA, 11 bp, Homo sapiens
tgatagcttta

SEQ ID NO: 3746904 - DNA, 22 bp, Homo sapiens
tgatatacttttttcttattta

SEQ ID NO: 3746905 - DNA, 12 bp, Homo sapiens
tgatatgaaaaa

SEQ ID NO: 3746906 - DNA, 19 bp, Homo sapiens
tgatatgcatttcctgctg

SEQ ID NO: 3746907 - DNA, 16 bp, Homo sapiens
tgatattccatagtat

SEQ ID NO: 3746908 - DNA, 19 bp, Homo sapiens
tgatattccatgaatgtat

SEQ ID NO: 3746909 - DNA, 17 bp, Homo sapiens
tgatattgcatatgcat

SEQ ID NO: 3746910 - DNA, 19 bp, Homo sapiens
tgatattttcaacgcagcc

SEQ ID NO: 3746911 - DNA, 21 bp, Homo sapiens
tgatattttcaacgcagccct

SEQ ID NO: 3746912 - DNA, 16 bp, Homo sapiens
tgatatttttttaagt

SEQ ID NO: 3746913 - DNA, 13 bp, Homo sapiens
tgatcaataaaat

SEQ ID NO: 3746914 - DNA, 15 bp, Homo sapiens
tgatcaataaaatgt

SEQ ID NO: 3746915 - DNA, 18 bp, Homo sapiens
tgatcaataaaatgtgat

SEQ ID NO: 3746916 - DNA, 17 bp, Homo sapiens
tgatcaattaaatgtag

SEQ ID NO: 3746917 - DNA, 18 bp, Homo sapiens
tgatcactggcaatgaaa

SEQ ID NO: 3746918 - DNA, 18 bp, Homo sapiens
tgatcagaccataatgtt

SEQ ID NO: 3746919 - DNA, 13 bp, Homo sapiens
tgatcatccactg

SEQ ID NO: 3746920 - DNA, 14 bp, Homo sapiens
tgatcatgcattgt

SEQ ID NO: 3746921 - DNA, 18 bp, Homo sapiens
tgatcattttccccccac

SEQ ID NO: 3746922 - DNA, 15 bp, Homo sapiens
tgatcatttttataa

SEQ ID NO: 3746923 - DNA, 21 bp, Homo sapiens
tgatccacccacctcagcctc

SEQ ID NO: 3746924 - DNA, 12 bp, Homo sapiens
tgatcccagcac

SEQ ID NO: 3746925 - DNA, 17 bp, Homo sapiens
tgatcctccaacttcat

SEQ ID NO: 3746926 - DNA, 15 bp, Homo sapiens
tgatcctcccacctc

SEQ ID NO: 3746927 - DNA, 22 bp, Homo sapiens
tgatcctcccacctcagcctcc

SEQ ID NO: 3746928 - DNA, 19 bp, Homo sapiens
tgatctcagggaagcccag

SEQ ID NO: 3746929 - DNA, 13 bp, Homo sapiens
tgatctccctgcc

SEQ ID NO: 3746930 - DNA, 14 bp, Homo sapiens
tgatctccctgccg

SEQ ID NO: 3746931 - DNA, 15 bp, Homo sapiens
tgatctccgtggctt

SEQ ID NO: 3746932 - DNA, 14 bp, Homo sapiens
tgatctcggctcat

SEQ ID NO: 3746933 - DNA, 23 bp, Homo sapiens
tgatctctactaccacaaggaaa

SEQ ID NO: 3746934 - DNA, 20 bp, Homo sapiens
tgatctgatgcaagcaagaa

SEQ ID NO: 3746935 - DNA, 11 bp, Homo sapiens
tgatctgggaa

SEQ ID NO: 3746936 - DNA, 16 bp, Homo sapiens
tgatctgggaactccc

SEQ ID NO: 3746937 - DNA, 13 bp, Homo sapiens
tgatctgtatata

SEQ ID NO: 3746938 - DNA, 14 bp, Homo sapiens
tgatcttgtgacat

SEQ ID NO: 3746939 - DNA, 21 bp, Homo sapiens
tgatctttgcagacaggcaag

SEQ ID NO: 3746940 - DNA, 11 bp, Homo sapiens
tgatgaaagct

SEQ ID NO: 3746941 - DNA, 15 bp, Homo sapiens
tgatgaaagctgatt

SEQ ID NO: 3746942 - DNA, 18 bp, Homo sapiens
tgatgaaatgtaaatact

SEQ ID NO: 3746943 - DNA, 20 bp, Homo sapiens
tgatgaagaaaagtgggcca

SEQ ID NO: 3746944 - DNA, 15 bp, Homo sapiens
tgatgacccaggctg

SEQ ID NO: 3746945 - DNA, 18 bp, Homo sapiens
tgatgagtgtaacaagaa

SEQ ID NO: 3746946 - DNA, 21 bp, Homo sapiens
tgatgagtgtaacaagaaagg

SEQ ID NO: 3746947 - DNA, 14 bp, Homo sapiens
tgatgataatgatg

SEQ ID NO: 3746948 - DNA, 21 bp, Homo sapiens
tgatgatcagctgtttgtcat

SEQ ID NO: 3746949 - DNA, 20 bp, Homo sapiens
tgatgatgaaatgaggtcag

SEQ ID NO: 3746950 - DNA, 20 bp, Homo sapiens
tgatgatttagagtgctgtc

SEQ ID NO: 3746951 - DNA, 16 bp, Homo sapiens
tgatgctaaataggag

SEQ ID NO: 3746952 - DNA, 13 bp, Homo sapiens
tgatgctcatggt

SEQ ID NO: 3746953 - DNA, 16 bp, Homo sapiens
tgatgctccctcccct

SEQ ID NO: 3746954 - DNA, 17 bp, Homo sapiens
tgatgctccctcccctg

SEQ ID NO: 3746955 - DNA, 23 bp, Homo sapiens
tgatgctccctcccctgccctgg

SEQ ID NO: 3746956 - DNA, 21 bp, Homo sapiens
tgatgcttgtaacaagaaaac

SEQ ID NO: 3746957 - DNA, 23 bp, Homo sapiens
tgatgcttgtaacaagaaaacat

SEQ ID NO: 3746958 - DNA, 17 bp, Homo sapiens
tgatggaaacaaagtgg

SEQ ID NO: 3746959 - DNA, 14 bp, Homo sapiens
tgatggtcagaggg

SEQ ID NO: 3746960 - DNA, 15 bp, Homo sapiens
tgatggtcagagggc

SEQ ID NO: 3746961 - DNA, 14 bp, Homo sapiens
tgatggttcccctg

SEQ ID NO: 3746962 - DNA, 15 bp, Homo sapiens
tgatgtaaatgaagt

SEQ ID NO: 3746963 - DNA, 17 bp, Homo sapiens
tgatgtaaatgaagtaa

SEQ ID NO: 3746964 - DNA, 21 bp, Homo sapiens
tgatgtgcaaaaatttttgga

SEQ ID NO: 3746965 - DNA, 22 bp, Homo sapiens
tgatgtgcaaaaatttttggat

SEQ ID NO: 3746966 - DNA, 16 bp, Homo sapiens
tgatgttaaaattcca

SEQ ID NO: 3746967 - DNA, 17 bp, Homo sapiens
tgatgtttgtggcctca

SEQ ID NO: 3746968 - DNA, 19 bp, Homo sapiens
tgatgtttgtggcctcaga

SEQ ID NO: 3746969 - DNA, 19 bp, Homo sapiens
tgattaaccacttcagctg

SEQ ID NO: 3746970 - DNA, 14 bp, Homo sapiens
tgattaatgctaaa

SEQ ID NO: 3746971 - DNA, 21 bp, Homo sapiens
tgattaattcaccttccagtg

SEQ ID NO: 3746972 - DNA, 13 bp, Homo sapiens
tgattacacagtt

SEQ ID NO: 3746973 - DNA, 15 bp, Homo sapiens
tgattactgtcaata

SEQ ID NO: 3746974 - DNA, 14 bp, Homo sapiens
tgattcagctctgc

SEQ ID NO: 3746975 - DNA, 17 bp, Homo sapiens
tgattcataataaatat

SEQ ID NO: 3746976 - DNA, 22 bp, Homo sapiens
tgattcccaagctctgctcctc

SEQ ID NO: 3746977 - DNA, 23 bp, Homo sapiens
tgattcgagctatatttaagtat

SEQ ID NO: 3746978 - DNA, 21 bp, Homo sapiens
tgattctcctgcctcagcctc

SEQ ID NO: 3746979 - DNA, 23 bp, Homo sapiens
tgattgtacagaatcattgctta

SEQ ID NO: 3746980 - DNA, 20 bp, Homo sapiens
tgatttagcaggaagctgtg

SEQ ID NO: 3746981 - DNA, 11 bp, Homo sapiens
tgatttcagga

SEQ ID NO: 3746982 - DNA, 23 bp, Homo sapiens
tgatttcaggatactctgtcaga

SEQ ID NO: 3746983 - DNA, 13 bp, Homo sapiens
tgatttcatttca

SEQ ID NO: 3746984 - DNA, 21 bp, Homo sapiens
tgatttcccctccaaggtatg

SEQ ID NO: 3746985 - DNA, 12 bp, Homo sapiens
tgatttggaaaa

SEQ ID NO: 3746986 - DNA, 18 bp, Homo sapiens
tgatttgtactgaaaaat

SEQ ID NO: 3746987 - DNA, 13 bp, Homo sapiens
tgattttaacaat

SEQ ID NO: 3746988 - DNA, 18 bp, Homo sapiens
tgattttaacaataacta

SEQ ID NO: 3746989 - DNA, 19 bp, Homo sapiens
tgattttaagaatccaaac

SEQ ID NO: 3746990 - DNA, 23 bp, Homo sapiens
tgattttacatttatctgtacat

SEQ ID NO: 3746991 - DNA, 18 bp, Homo sapiens
tgattttagctgcagaac

SEQ ID NO: 3746992 - DNA, 20 bp, Homo sapiens
tgattttcaaagctttttcc

SEQ ID NO: 3746993 - DNA, 13 bp, Homo sapiens
tgatttttatcca

SEQ ID NO: 3746994 - DNA, 22 bp, Homo sapiens
tgatttttttttagaacagaaa

SEQ ID NO: 3746995 - DNA, 23 bp, Homo sapiens
tgatttttttttagaacagaaaa

SEQ ID NO: 3746996 - DNA, 20 bp, Homo sapiens
tgcaaaaatttttggattga

SEQ ID NO: 3746997 - DNA, 22 bp, Homo sapiens
tgcaaaaggttcactaaagcag

SEQ ID NO: 3746998 - DNA, 23 bp, Homo sapiens
tgcaaacacacaaaggtataatt

SEQ ID NO: 3746999 - DNA, 12 bp, Homo sapiens
tgcaaagaaaat

SEQ ID NO: 3747000 - DNA, 15 bp, Homo sapiens
tgcaaagaggcaaga

SEQ ID NO: 3747001 - DNA, 14 bp, Homo sapiens
tgcaaatagaaaac

SEQ ID NO: 3747002 - DNA, 15 bp, Homo sapiens
tgcaaatagaaaaca

SEQ ID NO: 3747003 - DNA, 15 bp, Homo sapiens
tgcaaatgctgtatt

SEQ ID NO: 3747004 - DNA, 13 bp, Homo sapiens
tgcaacctccgcc

SEQ ID NO: 3747005 - DNA, 14 bp, Homo sapiens
tgcaacctccgcct

SEQ ID NO: 3747006 - DNA, 21 bp, Homo sapiens
tgcaacttctttttattttct

SEQ ID NO: 3747007 - DNA, 23 bp, Homo sapiens
tgcaagagggagcacgtgactgt

SEQ ID NO: 3747008 - DNA, 20 bp, Homo sapiens
tgcaaggaagccacagctgg

SEQ ID NO: 3747009 - DNA, 17 bp, Homo sapiens
tgcaaggaccaggactc

SEQ ID NO: 3747010 - DNA, 13 bp, Homo sapiens
tgcaaggcaaaga

SEQ ID NO: 3747011 - DNA, 16 bp, Homo sapiens
tgcaagtgacatctct

SEQ ID NO: 3747012 - DNA, 21 bp, Homo sapiens
tgcaagtgtatgcacgtgtgc

SEQ ID NO: 3747013 - DNA, 16 bp, Homo sapiens
tgcaataaaataacag

SEQ ID NO: 3747014 - DNA, 19 bp, Homo sapiens
tgcaatagagactgtagat

SEQ ID NO: 3747015 - DNA, 14 bp, Homo sapiens
tgcaatatgtatta

SEQ ID NO: 3747016 - DNA, 17 bp, Homo sapiens
tgcaatggttaacatct

SEQ ID NO: 3747017 - DNA, 21 bp, Homo sapiens
tgcaatgtcacaacctctctg

SEQ ID NO: 3747018 - DNA, 15 bp, Homo sapiens
tgcacaagctgcacc

SEQ ID NO: 3747019 - DNA, 13 bp, Homo sapiens
tgcacaatgtctt

SEQ ID NO: 3747020 - DNA, 14 bp, Homo sapiens
tgcacaatgtcttg

SEQ ID NO: 3747021 - DNA, 17 bp, Homo sapiens
tgcacacaccagagccc

SEQ ID NO: 3747022 - DNA, 18 bp, Homo sapiens
tgcacactcccctgcact

SEQ ID NO: 3747023 - DNA, 21 bp, Homo sapiens
tgcacacttgtgtgtgggctg

SEQ ID NO: 3747024 - DNA, 19 bp, Homo sapiens
tgcacagctgtagtacccc

SEQ ID NO: 3747025 - DNA, 12 bp, Homo sapiens
tgcaccaggaga

SEQ ID NO: 3747026 - DNA, 13 bp, Homo sapiens
tgcaccaggagac

SEQ ID NO: 3747027 - DNA, 14 bp, Homo sapiens
tgcaccaggagaca

SEQ ID NO: 3747028 - DNA, 16 bp, Homo sapiens
tgcacccccctgggct

SEQ ID NO: 3747029 - DNA, 16 bp, Homo sapiens
tgcaccctcaggcagg

SEQ ID NO: 3747030 - DNA, 17 bp, Homo sapiens
tgcaccctcaggcaggt

SEQ ID NO: 3747031 - DNA, 14 bp, Homo sapiens
tgcaccctccgcct

SEQ ID NO: 3747032 - DNA, 16 bp, Homo sapiens
tgcaccctccgccttc

SEQ ID NO: 3747033 - DNA, 22 bp, Homo sapiens
tgcaccgggccacagagaaagt

SEQ ID NO: 3747034 - DNA, 14 bp, Homo sapiens
tgcacctcccccca

SEQ ID NO: 3747035 - DNA, 15 bp, Homo sapiens
tgcacctccccccac

SEQ ID NO: 3747036 - DNA, 11 bp, Homo sapiens
tgcacctgcat

SEQ ID NO: 3747037 - DNA, 15 bp, Homo sapiens
tgcacctgccagcct

SEQ ID NO: 3747038 - DNA, 16 bp, Homo sapiens
tgcacctgccagcctg

SEQ ID NO: 3747039 - DNA, 18 bp, Homo sapiens
tgcacctgccagcctggc

SEQ ID NO: 3747040 - DNA, 14 bp, Homo sapiens
tgcaccttatctta

SEQ ID NO: 3747041 - DNA, 15 bp, Homo sapiens
tgcacgcccatgtgt

SEQ ID NO: 3747042 - DNA, 22 bp, Homo sapiens
tgcacgtagtagggtcaggcca

SEQ ID NO: 3747043 - DNA, 18 bp, Homo sapiens
tgcacgtggagagctggt

SEQ ID NO: 3747044 - DNA, 18 bp, Homo sapiens
tgcacgtggcttctgatg

SEQ ID NO: 3747045 - DNA, 12 bp, Homo sapiens
tgcactccagcc

SEQ ID NO: 3747046 - DNA, 13 bp, Homo sapiens
tgcactccagcct

SEQ ID NO: 3747047 - DNA, 14 bp, Homo sapiens
tgcactccagcctg

SEQ ID NO: 3747048 - DNA, 15 bp, Homo sapiens
tgcactccagcctgg

SEQ ID NO: 3747049 - DNA, 18 bp, Homo sapiens
tgcactccagcctgggcg

SEQ ID NO: 3747050 - DNA, 15 bp, Homo sapiens
tgcactctagccgga

SEQ ID NO: 3747051 - DNA, 21 bp, Homo sapiens
tgcactggagtccagtctctt

SEQ ID NO: 3747052 - DNA, 15 bp, Homo sapiens
tgcactgtatgctgg

SEQ ID NO: 3747053 - DNA, 21 bp, Homo sapiens
tgcacttgcagactctacaga

SEQ ID NO: 3747054 - DNA, 17 bp, Homo sapiens
tgcacttggcctctgga

SEQ ID NO: 3747055 - DNA, 16 bp, Homo sapiens
tgcagaaaagcacctg

SEQ ID NO: 3747056 - DNA, 18 bp, Homo sapiens
tgcagaaaagcacctgcc

SEQ ID NO: 3747057 - DNA, 17 bp, Homo sapiens
tgcagaaacagatttgg

SEQ ID NO: 3747058 - DNA, 19 bp, Homo sapiens
tgcagactcaataaaatca

SEQ ID NO: 3747059 - DNA, 19 bp, Homo sapiens
tgcagactctacagaggcc

SEQ ID NO: 3747060 - DNA, 13 bp, Homo sapiens
tgcagagtcagca

SEQ ID NO: 3747061 - DNA, 14 bp, Homo sapiens
tgcagagtgcccag

SEQ ID NO: 3747062 - DNA, 14 bp, Homo sapiens
tgcagcaaccagag

SEQ ID NO: 3747063 - DNA, 17 bp, Homo sapiens
tgcagcaaccagagcac

SEQ ID NO: 3747064 - DNA, 19 bp, Homo sapiens
tgcagcagcttgctgcacc

SEQ ID NO: 3747065 - DNA, 18 bp, Homo sapiens
tgcagcagtgagtctctt

SEQ ID NO: 3747066 - DNA, 17 bp, Homo sapiens
tgcagcatatgaggatg

SEQ ID NO: 3747067 - DNA, 13 bp, Homo sapiens
tgcagcatgacct

SEQ ID NO: 3747068 - DNA, 22 bp, Homo sapiens
tgcagcatgacctgtgaccagc

SEQ ID NO: 3747069 - DNA, 13 bp, Homo sapiens
tgcagccagccca

SEQ ID NO: 3747070 - DNA, 15 bp, Homo sapiens
tgcagccagcccagc

SEQ ID NO: 3747071 - DNA, 23 bp, Homo sapiens
tgcagccagcccagcccagctgg

SEQ ID NO: 3747072 - DNA, 14 bp, Homo sapiens
tgcagcccatgccc

SEQ ID NO: 3747073 - DNA, 21 bp, Homo sapiens
tgcagcccatgcccacctgcc

SEQ ID NO: 3747074 - DNA, 18 bp, Homo sapiens
tgcagcctcaacctcctg

SEQ ID NO: 3747075 - DNA, 23 bp, Homo sapiens
tgcagcctcaacctcctgggcta

SEQ ID NO: 3747076 - DNA, 20 bp, Homo sapiens
tgcagcctcgaactcctggg

SEQ ID NO: 3747077 - DNA, 21 bp, Homo sapiens
tgcagcctcgaactcctgggc

SEQ ID NO: 3747078 - DNA, 14 bp, Homo sapiens
tgcagcctggaggc

SEQ ID NO: 3747079 - DNA, 15 bp, Homo sapiens
tgcagcctggaggcc

SEQ ID NO: 3747080 - DNA, 20 bp, Homo sapiens
tgcagctctccccttctctg

SEQ ID NO: 3747081 - DNA, 22 bp, Homo sapiens
tgcagctctccccttctctgta

SEQ ID NO: 3747082 - DNA, 16 bp, Homo sapiens
tgcagctgattttaac

SEQ ID NO: 3747083 - DNA, 18 bp, Homo sapiens
tgcagctgattttaacaa

SEQ ID NO: 3747084 - DNA, 19 bp, Homo sapiens
tgcagctgattttaacaat

SEQ ID NO: 3747085 - DNA, 14 bp, Homo sapiens
tgcaggacctcagg

SEQ ID NO: 3747086 - DNA, 16 bp, Homo sapiens
tgcaggacctcaggtg

SEQ ID NO: 3747087 - DNA, 18 bp, Homo sapiens
tgcaggacctcaggtgag

SEQ ID NO: 3747088 - DNA, 19 bp, Homo sapiens
tgcaggatgattgtacaga

SEQ ID NO: 3747089 - DNA, 19 bp, Homo sapiens
tgcaggccccgcttgtcca

SEQ ID NO: 3747090 - DNA, 13 bp, Homo sapiens
tgcagggagtccg

SEQ ID NO: 3747091 - DNA, 19 bp, Homo sapiens
tgcagggggtgtgtctgct

SEQ ID NO: 3747092 - DNA, 22 bp, Homo sapiens
tgcagggggtgtgtctgctcag

SEQ ID NO: 3747093 - DNA, 14 bp, Homo sapiens
tgcagtgagccgag

SEQ ID NO: 3747094 - DNA, 17 bp, Homo sapiens
tgcataagttaacttcc

SEQ ID NO: 3747095 - DNA, 19 bp, Homo sapiens
tgcataataagctaaagag

SEQ ID NO: 3747096 - DNA, 14 bp, Homo sapiens
tgcataccaacctg

SEQ ID NO: 3747097 - DNA, 21 bp, Homo sapiens
tgcatagtaccaatcatttta

SEQ ID NO: 3747098 - DNA, 21 bp, Homo sapiens
tgcatagtattccattgtgtg

SEQ ID NO: 3747099 - DNA, 16 bp, Homo sapiens
tgcatatcctgagcca

SEQ ID NO: 3747100 - DNA, 15 bp, Homo sapiens
tgcatcaatcctgtg

SEQ ID NO: 3747101 - DNA, 20 bp, Homo sapiens
tgcatcaatcctgtgtggtt

SEQ ID NO: 3747102 - DNA, 21 bp, Homo sapiens
tgcatcagaaatgtctggaga

SEQ ID NO: 3747103 - DNA, 14 bp, Homo sapiens
tgcatccattcctc

SEQ ID NO: 3747104 - DNA, 20 bp, Homo sapiens
tgcatccgtagttccctgaa

SEQ ID NO: 3747105 - DNA, 23 bp, Homo sapiens
tgcatccgtgagcagtgtgtctc

SEQ ID NO: 3747106 - DNA, 17 bp, Homo sapiens
tgcatcttactgaaggt

SEQ ID NO: 3747107 - DNA, 13 bp, Homo sapiens
tgcatgaaggttt

SEQ ID NO: 3747108 - DNA, 19 bp, Homo sapiens
tgcatgaaggtttctgaaa

SEQ ID NO: 3747109 - DNA, 16 bp, Homo sapiens
tgcatgctctctgcag

SEQ ID NO: 3747110 - DNA, 19 bp, Homo sapiens
tgcatgctctctgcagcca

SEQ ID NO: 3747111 - DNA, 21 bp, Homo sapiens
tgcatggacctaacattcgat

SEQ ID NO: 3747112 - DNA, 23 bp, Homo sapiens
tgcatggggtggggtagggctga

SEQ ID NO: 3747113 - DNA, 17 bp, Homo sapiens
tgcatgggtgaagggag

SEQ ID NO: 3747114 - DNA, 17 bp, Homo sapiens
tgcatgggttttgtagg

SEQ ID NO: 3747115 - DNA, 18 bp, Homo sapiens
tgcatgggttttgtaggt

SEQ ID NO: 3747116 - DNA, 18 bp, Homo sapiens
tgcattacagagaggaga

SEQ ID NO: 3747117 - DNA, 22 bp, Homo sapiens
tgcattacagagaggagaaaca

SEQ ID NO: 3747118 - DNA, 20 bp, Homo sapiens
tctgtgtcaggtggggcagc

SEQ ID NO: 3747119 - DNA, 14 bp, Homo sapiens
tctgtgtgctgtgg

SEQ ID NO: 3747120 - DNA, 20 bp, Homo sapiens
tctgttggccagtgtgacaa

SEQ ID NO: 3747121 - DNA, 12 bp, Homo sapiens
tctgttgttttt

SEQ ID NO: 3747122 - DNA, 17 bp, Homo sapiens
tctgtttaaagtagatt

SEQ ID NO: 3747123 - DNA, 12 bp, Homo sapiens
tctgtttctagt

SEQ ID NO: 3747124 - DNA, 13 bp, Homo sapiens
tctgttttactgc

SEQ ID NO: 3747125 - DNA, 18 bp, Homo sapiens
tcttaaaaaataaaaact

SEQ ID NO: 3747126 - DNA, 18 bp, Homo sapiens
tcttaaaaagtggaaaaa

SEQ ID NO: 3747127 - DNA, 17 bp, Homo sapiens
tcttaaacaaatgtatg

SEQ ID NO: 3747128 - DNA, 12 bp, Homo sapiens
tcttaactcttt

SEQ ID NO: 3747129 - DNA, 22 bp, Homo sapiens
tcttaagaccacctcaaattta

SEQ ID NO: 3747130 - DNA, 23 bp, Homo sapiens
tcttaagaccacctcaaatttaa

SEQ ID NO: 3747131 - DNA, 12 bp, Homo sapiens
tcttaagcttcc

SEQ ID NO: 3747132 - DNA, 18 bp, Homo sapiens
tcttaattaagtaaacta

SEQ ID NO: 3747133 - DNA, 20 bp, Homo sapiens
tcttacaaagtgtattttat

SEQ ID NO: 3747134 - DNA, 18 bp, Homo sapiens
tcttacccttctgtgccc

SEQ ID NO: 3747135 - DNA, 21 bp, Homo sapiens
tcttacctgtatgtctccagt

SEQ ID NO: 3747136 - DNA, 21 bp, Homo sapiens
tcttagatatctttttattga

SEQ ID NO: 3747137 - DNA, 24 bp, Homo sapiens
tcttagatatctttttattgatgt

SEQ ID NO: 3747138 - DNA, 22 bp, Homo sapiens
tcttagcctgtggcagtaaaga

SEQ ID NO: 3747139 - DNA, 19 bp, Homo sapiens
tcttaggaagagaaaccag

SEQ ID NO: 3747140 - DNA, 16 bp, Homo sapiens
tcttaggcaatcacat

SEQ ID NO: 3747141 - DNA, 17 bp, Homo sapiens
tcttaggggagagcttt

SEQ ID NO: 3747142 - DNA, 20 bp, Homo sapiens
tcttatagaatatttattac

SEQ ID NO: 3747143 - DNA, 17 bp, Homo sapiens
tcttatttaatgaaaga

SEQ ID NO: 3747144 - DNA, 21 bp, Homo sapiens
tcttcaacatcaatgttcatt

SEQ ID NO: 3747145 - DNA, 13 bp, Homo sapiens
tcttcaagggctg

SEQ ID NO: 3747146 - DNA, 18 bp, Homo sapiens
tcttcaagggctgcttca

SEQ ID NO: 3747147 - DNA, 18 bp, Homo sapiens
tcttcaatttgtataaaa

SEQ ID NO: 3747148 - DNA, 19 bp, Homo sapiens
tcttcagccacctctcttt

SEQ ID NO: 3747149 - DNA, 13 bp, Homo sapiens
tcttcaggcctcc

SEQ ID NO: 3747150 - DNA, 18 bp, Homo sapiens
tcttcaggcctccctctc

SEQ ID NO: 3747151 - DNA, 13 bp, Homo sapiens
tcttcagggcact

SEQ ID NO: 3747152 - DNA, 18 bp, Homo sapiens
tcttcagttggtgtgttt

SEQ ID NO: 3747153 - DNA, 18 bp, Homo sapiens
tcttcagttttatcttta

SEQ ID NO: 3747154 - DNA, 19 bp, Homo sapiens
tcttcagttttatctttaa

SEQ ID NO: 3747155 - DNA, 18 bp, Homo sapiens
tcttcatccggcagcctg

SEQ ID NO: 3747156 - DNA, 15 bp, Homo sapiens
tcttcatccttagca

SEQ ID NO: 3747157 - DNA, 16 bp, Homo sapiens
tcttcatccttagcaa

SEQ ID NO: 3747158 - DNA, 14 bp, Homo sapiens
tcttcatgcaatga

SEQ ID NO: 3747159 - DNA, 13 bp, Homo sapiens
tcttccacctgga

SEQ ID NO: 3747160 - DNA, 16 bp, Homo sapiens
tcttcccatcactgga

SEQ ID NO: 3747161 - DNA, 20 bp, Homo sapiens
tcttccctagagggttcctg

SEQ ID NO: 3747162 - DNA, 20 bp, Homo sapiens
tcttccctagggctgggtgt

SEQ ID NO: 3747163 - DNA, 16 bp, Homo sapiens
tcttccggagatgtag

SEQ ID NO: 3747164 - DNA, 21 bp, Homo sapiens
tcttccggagatgtagcaaaa

SEQ ID NO: 3747165 - DNA, 19 bp, Homo sapiens
tcttcctagttttctcctc

SEQ ID NO: 3747166 - DNA, 23 bp, Homo sapiens
tcttcctagttttctcctcccag

SEQ ID NO: 3747167 - DNA, 13 bp, Homo sapiens
tcttcctatccca

SEQ ID NO: 3747168 - DNA, 14 bp, Homo sapiens
tcttcctatcccat

SEQ ID NO: 3747169 - DNA, 15 bp, Homo sapiens
tcttcctatcccatc

SEQ ID NO: 3747170 - DNA, 12 bp, Homo sapiens
tcttcctctgct

SEQ ID NO: 3747171 - DNA, 14 bp, Homo sapiens
tcttcctttcagaa

SEQ ID NO: 3747172 - DNA, 13 bp, Homo sapiens
tcttcgaggtgga

SEQ ID NO: 3747173 - DNA, 15 bp, Homo sapiens
tcttctattttattc

SEQ ID NO: 3747174 - DNA, 16 bp, Homo sapiens
tcttctattttattcc

SEQ ID NO: 3747175 - DNA, 14 bp, Homo sapiens
tcttctccaggctg

SEQ ID NO: 3747176 - DNA, 15 bp, Homo sapiens
tcttctccaggctgt

SEQ ID NO: 3747177 - DNA, 12 bp, Homo sapiens
tcttctccatct

SEQ ID NO: 3747178 - DNA, 16 bp, Homo sapiens
tcttctcccaattcat

SEQ ID NO: 3747179 - DNA, 18 bp, Homo sapiens
tcttctgccggccctggg

SEQ ID NO: 3747180 - DNA, 11 bp, Homo sapiens
tcttctgctcc

SEQ ID NO: 3747181 - DNA, 19 bp, Homo sapiens
tcttctgctccacccttgg

SEQ ID NO: 3747182 - DNA, 12 bp, Homo sapiens
tcttctgcttca

SEQ ID NO: 3747183 - DNA, 22 bp, Homo sapiens
tcttctgtacgtctgacaggca

SEQ ID NO: 3747184 - DNA, 12 bp, Homo sapiens
tcttcttatgca

SEQ ID NO: 3747185 - DNA, 14 bp, Homo sapiens
tcttcttcttcaga

SEQ ID NO: 3747186 - DNA, 14 bp, Homo sapiens
tcttgaaagctgtg

SEQ ID NO: 3747187 - DNA, 12 bp, Homo sapiens
tcttgaaatgaa

SEQ ID NO: 3747188 - DNA, 18 bp, Homo sapiens
tcttgaactcctggcctc

SEQ ID NO: 3747189 - DNA, 16 bp, Homo sapiens
tcttgaagtgaaatct

SEQ ID NO: 3747190 - DNA, 16 bp, Homo sapiens
tcttgaggccaggagt

SEQ ID NO: 3747191 - DNA, 18 bp, Homo sapiens
tcttgatgactggaattt

SEQ ID NO: 3747192 - DNA, 23 bp, Homo sapiens
tcttgcaatggcagccttggcaa

SEQ ID NO: 3747193 - DNA, 17 bp, Homo sapiens
tcttgccactgcctctt

SEQ ID NO: 3747194 - DNA, 17 bp, Homo sapiens
tcttgcccgctcaggct

SEQ ID NO: 3747195 - DNA, 20 bp, Homo sapiens
tcttgcctaagtattccttt

SEQ ID NO: 3747196 - DNA, 20 bp, Homo sapiens
tcttgcctccatggtgcctc

SEQ ID NO: 3747197 - DNA, 18 bp, Homo sapiens
tcttgctctatctcacag

SEQ ID NO: 3747198 - DNA, 14 bp, Homo sapiens
tcttgctctgctga

SEQ ID NO: 3747199 - DNA, 23 bp, Homo sapiens
tcttgctctgctgacagacacag

SEQ ID NO: 3747200 - DNA, 16 bp, Homo sapiens
tcttggaaagaaacaa

SEQ ID NO: 3747201 - DNA, 18 bp, Homo sapiens
tcttggctttgttttgtt

SEQ ID NO: 3747202 - DNA, 11 bp, Homo sapiens
tcttgggccct

SEQ ID NO: 3747203 - DNA, 17 bp, Homo sapiens
tcttggtcagatttgaa

SEQ ID NO: 3747204 - DNA, 11 bp, Homo sapiens
tcttgtaagat

SEQ ID NO: 3747205 - DNA, 18 bp, Homo sapiens
tcttgtaagattttgaaa

SEQ ID NO: 3747206 - DNA, 15 bp, Homo sapiens
tcttgtcacaataaa

SEQ ID NO: 3747207 - DNA, 21 bp, Homo sapiens
tcttgtccccaacaccccaca

SEQ ID NO: 3747208 - DNA, 12 bp, Homo sapiens
tcttgtctctgg

SEQ ID NO: 3747209 - DNA, 14 bp, Homo sapiens
tcttgtgactagtg

SEQ ID NO: 3747210 - DNA, 19 bp, Homo sapiens
tcttgtgactagtgctgaa

SEQ ID NO: 3747211 - DNA, 22 bp, Homo sapiens
tcttgtgactagtgctgaagct

SEQ ID NO: 3747212 - DNA, 22 bp, Homo sapiens
tcttgtgctcagcatgattctt

SEQ ID NO: 3747213 - DNA, 21 bp, Homo sapiens
tcttgttaatattctttcaat

SEQ ID NO: 3747214 - DNA, 22 bp, Homo sapiens
tcttgttgctcaaaaaatgagc

SEQ ID NO: 3747215 - DNA, 14 bp, Homo sapiens
tcttgttttcagtt

SEQ ID NO: 3747216 - DNA, 21 bp, Homo sapiens
tcttgtttttccactactgct

SEQ ID NO: 3747217 - DNA, 16 bp, Homo sapiens
tctttaaatttcaaat

SEQ ID NO: 3747218 - DNA, 17 bp, Homo sapiens
tctttaaatttcaaatg

SEQ ID NO: 3747219 - DNA, 21 bp, Homo sapiens
tctttaactcaggactccagc

SEQ ID NO: 3747220 - DNA, 23 bp, Homo sapiens
tctttaactcaggactccagccc

SEQ ID NO: 3747221 - DNA, 14 bp, Homo sapiens
tctttaatcttcag

SEQ ID NO: 3747222 - DNA, 20 bp, Homo sapiens
tctttataattctactttga

SEQ ID NO: 3747223 - DNA, 15 bp, Homo sapiens
tctttatatgaacat

SEQ ID NO: 3747224 - DNA, 20 bp, Homo sapiens
tctttcaaaggtagccatca

SEQ ID NO: 3747225 - DNA, 22 bp, Homo sapiens
tctttcaaaggtagccatcatg

SEQ ID NO: 3747226 - DNA, 19 bp, Homo sapiens
tctttcaaattgagagaat

SEQ ID NO: 3747227 - DNA, 16 bp, Homo sapiens
tctttcaagtgaatct

SEQ ID NO: 3747228 - DNA, 19 bp, Homo sapiens
tctttcacccacagaaaga

SEQ ID NO: 3747229 - DNA, 14 bp, Homo sapiens
tctttcagaaaaca

SEQ ID NO: 3747230 - DNA, 14 bp, Homo sapiens
tctttcagaaagct

SEQ ID NO: 3747231 - DNA, 15 bp, Homo sapiens
tctttccatttctct

SEQ ID NO: 3747232 - DNA, 24 bp, Homo sapiens
tctttccatttctctctccagtct

SEQ ID NO: 3747233 - DNA, 23 bp, Homo sapiens
tctttccctcccttcctctttcc

SEQ ID NO: 3747234 - DNA, 18 bp, Homo sapiens
tctttcctgttgttgtta

SEQ ID NO: 3747235 - DNA, 16 bp, Homo sapiens
tctttccttcctctca

SEQ ID NO: 3747236 - DNA, 23 bp, Homo sapiens
tctttctggcctgccttcgttaa

SEQ ID NO: 3747237 - DNA, 18 bp, Homo sapiens
tctttctttggtgccttt

SEQ ID NO: 3747238 - DNA, 16 bp, Homo sapiens
tctttgaaacaacttt

SEQ ID NO: 3747239 - DNA, 20 bp, Homo sapiens
tctttgataaagaaaagaat

SEQ ID NO: 3747240 - DNA, 14 bp, Homo sapiens
tctttgcagacagg

SEQ ID NO: 3747241 - DNA, 17 bp, Homo sapiens
tctttgcagacaggcaa

SEQ ID NO: 3747242 - DNA, 15 bp, Homo sapiens
tctttgcttgaacac

SEQ ID NO: 3747243 - DNA, 17 bp, Homo sapiens
tctttgcttgaacacag

SEQ ID NO: 3747244 - DNA, 21 bp, Homo sapiens
tctttgcttgaacacagtatt

SEQ ID NO: 3747245 - DNA, 17 bp, Homo sapiens
tctttggtgcctttcct

SEQ ID NO: 3747246 - DNA, 22 bp, Homo sapiens
tctttgtaagtaaactgccctg

SEQ ID NO: 3747247 - DNA, 14 bp, Homo sapiens
tctttgtaattatt

SEQ ID NO: 3747248 - DNA, 13 bp, Homo sapiens
tctttgtgtagct

SEQ ID NO: 3747249 - DNA, 15 bp, Homo sapiens
tctttgttacaggca

SEQ ID NO: 3747250 - DNA, 12 bp, Homo sapiens
tctttgttttgt

SEQ ID NO: 3747251 - DNA, 16 bp, Homo sapiens
tcttttagttttagtt

SEQ ID NO: 3747252 - DNA, 18 bp, Homo sapiens
tcttttagttttagttgc

SEQ ID NO: 3747253 - DNA, 16 bp, Homo sapiens
tcttttcctacttttc

SEQ ID NO: 3747254 - DNA, 22 bp, Homo sapiens
tcttttcctgtttttgttaact

SEQ ID NO: 3747255 - DNA, 14 bp, Homo sapiens
tcttttgacatgtg

SEQ ID NO: 3747256 - DNA, 21 bp, Homo sapiens
tctttttaagcttatttaatt

SEQ ID NO: 3747257 - DNA, 15 bp, Homo sapiens
tctttttaataaaaa

SEQ ID NO: 3747258 - DNA, 12 bp, Homo sapiens
tctttttattga

SEQ ID NO: 3747259 - DNA, 13 bp, Homo sapiens
tcttttttatgtg

SEQ ID NO: 3747260 - DNA, 14 bp, Homo sapiens
tctttttttgtgat

SEQ ID NO: 3747261 - DNA, 16 bp, Homo sapiens
tctttttttgtgatgt

SEQ ID NO: 3747262 - DNA, 12 bp, Homo sapiens
tgaaaaaaattg

SEQ ID NO: 3747263 - DNA, 17 bp, Homo sapiens
tgaaaaaagcttttatg

SEQ ID NO: 3747264 - DNA, 19 bp, Homo sapiens
tgaaaacatggtagaattg

SEQ ID NO: 3747265 - DNA, 23 bp, Homo sapiens
tgaaaacccagagaggaatcaga

SEQ ID NO: 3747266 - DNA, 17 bp, Homo sapiens
tgaaaacgttttattgt

SEQ ID NO: 3747267 - DNA, 19 bp, Homo sapiens
tgaaaacgttttattgtgt

SEQ ID NO: 3747268 - DNA, 16 bp, Homo sapiens
tgaaaactacatttta

SEQ ID NO: 3747269 - DNA, 19 bp, Homo sapiens
tgaaaagaaaaatgagcct

SEQ ID NO: 3747270 - DNA, 20 bp, Homo sapiens
tgaaaagaaaaatgagcctg

SEQ ID NO: 3747271 - DNA, 17 bp, Homo sapiens
tgaaaagacatcaagca

SEQ ID NO: 3747272 - DNA, 18 bp, Homo sapiens
tgaaaagacatcaagcac

SEQ ID NO: 3747273 - DNA, 23 bp, Homo sapiens
tgaaaagaggggaccagaagcca

SEQ ID NO: 3747274 - DNA, 19 bp, Homo sapiens
tgaaaagccatgtttaaga

SEQ ID NO: 3747275 - DNA, 22 bp, Homo sapiens
tgaaaagccatgtttaagattt

SEQ ID NO: 3747276 - DNA, 23 bp, Homo sapiens
tgaaaagccatgtttaagattta

SEQ ID NO: 3747277 - DNA, 12 bp, Homo sapiens
tgaaaaggaaga

SEQ ID NO: 3747278 - DNA, 19 bp, Homo sapiens
tgaaaatacaacttaaata

SEQ ID NO: 3747279 - DNA, 20 bp, Homo sapiens
tgaaaatattatctttgtaa

SEQ ID NO: 3747280 - DNA, 18 bp, Homo sapiens
tgaaaatgcaacaacatg

SEQ ID NO: 3747281 - DNA, 20 bp, Homo sapiens
tgaaaatgcaacaacatgta

SEQ ID NO: 3747282 - DNA, 20 bp, Homo sapiens
tgaaaatggaagtggcaata

SEQ ID NO: 3747283 - DNA, 17 bp, Homo sapiens
tgaaaatgtatgtgtaa

SEQ ID NO: 3747284 - DNA, 14 bp, Homo sapiens
tgaaaatgtcagaa

SEQ ID NO: 3747285 - DNA, 21 bp, Homo sapiens
tgaaaatgtcagaaaccagtt

SEQ ID NO: 3747286 - DNA, 11 bp, Homo sapiens
tgaaaatgtta

SEQ ID NO: 3747287 - DNA, 13 bp, Homo sapiens
tgaaaatgttttt

SEQ ID NO: 3747288 - DNA, 15 bp, Homo sapiens
tgaaaattaacactg

SEQ ID NO: 3747289 - DNA, 14 bp, Homo sapiens
tgaaaattcagtgg

SEQ ID NO: 3747290 - DNA, 19 bp, Homo sapiens
tgaaacaactttctcttgt

SEQ ID NO: 3747291 - DNA, 16 bp, Homo sapiens
tgaaacacaccaggct

SEQ ID NO: 3747292 - DNA, 13 bp, Homo sapiens
tgaaacagaaaca

SEQ ID NO: 3747293 - DNA, 14 bp, Homo sapiens
tgaaacagaaacaa

SEQ ID NO: 3747294 - DNA, 20 bp, Homo sapiens
tgaaacaggagagaaagggg

SEQ ID NO: 3747295 - DNA, 14 bp, Homo sapiens
tgaaacattttgtc

SEQ ID NO: 3747296 - DNA, 14 bp, Homo sapiens
tgaaactaatgaaa

SEQ ID NO: 3747297 - DNA, 15 bp, Homo sapiens
tgaaactagacttga

SEQ ID NO: 3747298 - DNA, 18 bp, Homo sapiens
tgaaacttcaagcaccag

SEQ ID NO: 3747299 - DNA, 16 bp, Homo sapiens
tgaaagaaatcatgtt

SEQ ID NO: 3747300 - DNA, 17 bp, Homo sapiens
tgaaagaaatcatgtta

SEQ ID NO: 3747301 - DNA, 17 bp, Homo sapiens
tgaaagaccttctccaa

SEQ ID NO: 3747302 - DNA, 13 bp, Homo sapiens
tgaaagactgtac

SEQ ID NO: 3747303 - DNA, 15 bp, Homo sapiens
tgaaagactgtacaa

SEQ ID NO: 3747304 - DNA, 16 bp, Homo sapiens
tgaaagactgtacaaa

SEQ ID NO: 3747305 - DNA, 22 bp, Homo sapiens
tgaaagactgtacaaagtagaa

SEQ ID NO: 3747306 - DNA, 21 bp, Homo sapiens
tgaaagatggctgtgcctctg

SEQ ID NO: 3747307 - DNA, 21 bp, Homo sapiens
tgaaagctgattactgtcaat

SEQ ID NO: 3747308 - DNA, 19 bp, Homo sapiens
tgaaaggcattctctgaag

SEQ ID NO: 3747309 - DNA, 20 bp, Homo sapiens
tgaaagggagctatcaggaa

SEQ ID NO: 3747310 - DNA, 18 bp, Homo sapiens
tgaaagtcttgtgactag

SEQ ID NO: 3747311 - DNA, 14 bp, Homo sapiens
tgaaataataaatc

SEQ ID NO: 3747312 - DNA, 13 bp, Homo sapiens
tgaaatactactt

SEQ ID NO: 3747313 - DNA, 18 bp, Homo sapiens
tgaaatagtctgtgtgaa

SEQ ID NO: 3747314 - DNA, 21 bp, Homo sapiens
tgaaatagtggttcttggaaa

SEQ ID NO: 3747315 - DNA, 22 bp, Homo sapiens
tgaaatagtggttcttggaaaa

SEQ ID NO: 3747316 - DNA, 15 bp, Homo sapiens
tgaaatatacacaca

SEQ ID NO: 3747317 - DNA, 16 bp, Homo sapiens
tgaaatatacacacag

SEQ ID NO: 3747318 - DNA, 17 bp, Homo sapiens
tgaaatatacacacagc

SEQ ID NO: 3747319 - DNA, 13 bp, Homo sapiens
tgaaatgaaaaca

SEQ ID NO: 3747320 - DNA, 20 bp, Homo sapiens
tgaaatgaaaacatgtaata

SEQ ID NO: 3747321 - DNA, 22 bp, Homo sapiens
tgaaatgaggtcagagcctgca

SEQ ID NO: 3747322 - DNA, 20 bp, Homo sapiens
tgaaatgccttactttgtat

SEQ ID NO: 3747323 - DNA, 24 bp, Homo sapiens
tgaaatgccttactttgtatgata

SEQ ID NO: 3747324 - DNA, 22 bp, Homo sapiens
tgaaattaaccatagatgtaga

SEQ ID NO: 3747325 - DNA, 23 bp, Homo sapiens
tgaaattactacaaaatttgaaa

SEQ ID NO: 3747326 - DNA, 23 bp, Homo sapiens
tgaaattgtttaagtgttgtaaa

SEQ ID NO: 3747327 - DNA, 22 bp, Homo sapiens
tgaaatttaatatagctatttt

SEQ ID NO: 3747328 - DNA, 16 bp, Homo sapiens
tgaaattttaccaagt

SEQ ID NO: 3747329 - DNA, 11 bp, Homo sapiens
tgaacaagaat

SEQ ID NO: 3747330 - DNA, 18 bp, Homo sapiens
tgaacaagaattggaagc

SEQ ID NO: 3747331 - DNA, 12 bp, Homo sapiens
tgaacacagtat

SEQ ID NO: 3747332 - DNA, 14 bp, Homo sapiens
tgaacacatcagct

SEQ ID NO: 3747333 - DNA, 16 bp, Homo sapiens
tgaacactgggggagg

SEQ ID NO: 3747334 - DNA, 17 bp, Homo sapiens
tgaacactgggggaggg

SEQ ID NO: 3747335 - DNA, 17 bp, Homo sapiens
tgaacacttattgcttt

SEQ ID NO: 3747336 - DNA, 20 bp, Homo sapiens
tgaacatagactagagaaac

SEQ ID NO: 3747337 - DNA, 17 bp, Homo sapiens
tgaaccaaaacattccg

SEQ ID NO: 3747338 - DNA, 20 bp, Homo sapiens
tgaaccaccacacccagccc

SEQ ID NO: 3747339 - DNA, 22 bp, Homo sapiens
tgaaccaccacacccagcccac

SEQ ID NO: 3747340 - DNA, 13 bp, Homo sapiens
tgaacccaggagg

SEQ ID NO: 3747341 - DNA, 13 bp, Homo sapiens
tgaacccttgctt

SEQ ID NO: 3747342 - DNA, 22 bp, Homo sapiens
tgaaccgatgagaaataaagtt

SEQ ID NO: 3747343 - DNA, 14 bp, Homo sapiens
tgaacggccttgct

SEQ ID NO: 3747344 - DNA, 16 bp, Homo sapiens
tgaactaataaaagca

SEQ ID NO: 3747345 - DNA, 11 bp, Homo sapiens
tgaactcctgg

SEQ ID NO: 3747346 - DNA, 15 bp, Homo sapiens
tgaactcctggcctc

SEQ ID NO: 3747347 - DNA, 22 bp, Homo sapiens
tgaactctttctggcctgcctt

SEQ ID NO: 3747348 - DNA, 19 bp, Homo sapiens
tgaactgggtacttgtgga

SEQ ID NO: 3747349 - DNA, 15 bp, Homo sapiens
tgaagaaaaaataca

SEQ ID NO: 3747350 - DNA, 15 bp, Homo sapiens
tgaagaacagtaact

SEQ ID NO: 3747351 - DNA, 16 bp, Homo sapiens
tgaagacaaaaatact

SEQ ID NO: 3747352 - DNA, 20 bp, Homo sapiens
tgaagacaaaaatactctaa

SEQ ID NO: 3747353 - DNA, 20 bp, Homo sapiens
tgaagactcattcttctgta

SEQ ID NO: 3747354 - DNA, 16 bp, Homo sapiens
tgaagagatccttctg

SEQ ID NO: 3747355 - DNA, 21 bp, Homo sapiens
tgaagagggagaagcatgaaa

SEQ ID NO: 3747356 - DNA, 17 bp, Homo sapiens
tgaagagtgagagggca

SEQ ID NO: 3747357 - DNA, 18 bp, Homo sapiens
tgaagagtgagagggcat

SEQ ID NO: 3747358 - DNA, 15 bp, Homo sapiens
tgaagatacatgtct

SEQ ID NO: 3747359 - DNA, 18 bp, Homo sapiens
tgaagataccatcagcaa

SEQ ID NO: 3747360 - DNA, 14 bp, Homo sapiens
tgaagatagaagaa

SEQ ID NO: 3747361 - DNA, 20 bp, Homo sapiens
tgaagatgtcatcccattgt

SEQ ID NO: 3747362 - DNA, 19 bp, Homo sapiens
tgaagattattttttatga

SEQ ID NO: 3747363 - DNA, 23 bp, Homo sapiens
tgaagcagatgcaaagaggcaag

SEQ ID NO: 3747364 - DNA, 19 bp, Homo sapiens
tgaagccacagcccaggcc

SEQ ID NO: 3747365 - DNA, 16 bp, Homo sapiens
tgaagccactgaagct

SEQ ID NO: 3747366 - DNA, 20 bp, Homo sapiens
tgaagccactgaagctggga

SEQ ID NO: 3747367 - DNA, 19 bp, Homo sapiens
tgaagctaattattttaat

SEQ ID NO: 3747368 - DNA, 23 bp, Homo sapiens
tgaagctaattattttaattagg

SEQ ID NO: 3747369 - DNA, 14 bp, Homo sapiens
tgaagctgcagtga

SEQ ID NO: 3747370 - DNA, 21 bp, Homo sapiens
tgaaggaaataaaaaagtctc

SEQ ID NO: 3747371 - DNA, 20 bp, Homo sapiens
tgaaggacattgcggacagc

SEQ ID NO: 3747372 - DNA, 20 bp, Homo sapiens
tgaaggactggattggccaa

SEQ ID NO: 3747373 - DNA, 16 bp, Homo sapiens
tgaaggagagcccttc

SEQ ID NO: 3747374 - DNA, 19 bp, Homo sapiens
tgaaggctttcagggcctc

SEQ ID NO: 3747375 - DNA, 21 bp, Homo sapiens
tgaagggaaaggatattttct

SEQ ID NO: 3747376 - DNA, 17 bp, Homo sapiens
tgaagggagagccagct

SEQ ID NO: 3747377 - DNA, 19 bp, Homo sapiens
tgaagggagagccagctcc

SEQ ID NO: 3747378 - DNA, 19 bp, Homo sapiens
tgaaggtcttgatttgttt

SEQ ID NO: 3747379 - DNA, 13 bp, Homo sapiens
tgaaggtttctga

SEQ ID NO: 3747380 - DNA, 14 bp, Homo sapiens
tgaagtaaaactta

SEQ ID NO: 3747381 - DNA, 14 bp, Homo sapiens
tgaagtaagcaaag

SEQ ID NO: 3747382 - DNA, 15 bp, Homo sapiens
tgaagtaagcaaaga

SEQ ID NO: 3747383 - DNA, 15 bp, Homo sapiens
tgaagtatactgtat

SEQ ID NO: 3747384 - DNA, 19 bp, Homo sapiens
tgaagtcacccggccccca

SEQ ID NO: 3747385 - DNA, 14 bp, Homo sapiens
tgaagtcactgcac

SEQ ID NO: 3747386 - DNA, 16 bp, Homo sapiens
tgaagtcactgcacag

SEQ ID NO: 3747387 - DNA, 20 bp, Homo sapiens
tgaagtgatatggtgagcag

SEQ ID NO: 3747388 - DNA, 14 bp, Homo sapiens
tgaagttaacagag

SEQ ID NO: 3747389 - DNA, 17 bp, Homo sapiens
tgaagttatctggcttc

SEQ ID NO: 3747390 - DNA, 14 bp, Homo sapiens
tgaagttggacagc

SEQ ID NO: 3747391 - DNA, 17 bp, Homo sapiens
tgaagtttacaatcaaa

SEQ ID NO: 3747392 - DNA, 14 bp, Homo sapiens
tgaataaagacacc

SEQ ID NO: 3747393 - DNA, 18 bp, Homo sapiens
tgaataaagcctgctttt

SEQ ID NO: 3747394 - DNA, 20 bp, Homo sapiens
tgaataaagcctgcttttta

SEQ ID NO: 3747395 - DNA, 19 bp, Homo sapiens
tgaatacagggcatgcatt

SEQ ID NO: 3747396 - DNA, 15 bp, Homo sapiens
tgaatataaacacta

SEQ ID NO: 3747397 - DNA, 22 bp, Homo sapiens
tgaatataccccttagtgtttg

SEQ ID NO: 3747398 - DNA, 20 bp, Homo sapiens
tgaatatgaacggtgagcat

SEQ ID NO: 3747399 - DNA, 11 bp, Homo sapiens
tgaatatttat

SEQ ID NO: 3747400 - DNA, 17 bp, Homo sapiens
tgaatatttataacagc

SEQ ID NO: 3747401 - DNA, 18 bp, Homo sapiens
tgaatatttataacagca

SEQ ID NO: 3747402 - DNA, 20 bp, Homo sapiens
tgaatatttatatttcacta

SEQ ID NO: 3747403 - DNA, 23 bp, Homo sapiens
tgaatatttgtcgatatttccat

SEQ ID NO: 3747404 - DNA, 21 bp, Homo sapiens
tgaatcagaccctaccccacc

SEQ ID NO: 3747405 - DNA, 14 bp, Homo sapiens
tgaatctcaatttg

SEQ ID NO: 3747406 - DNA, 11 bp, Homo sapiens
tgaatgaaaaa

SEQ ID NO: 3747407 - DNA, 17 bp, Homo sapiens
tgaatgaaaaatttaag

SEQ ID NO: 3747408 - DNA, 21 bp, Homo sapiens
tgaatgaaaaatttaagcatt

SEQ ID NO: 3747409 - DNA, 20 bp, Homo sapiens
tgaatgaaagtcttgtgact

SEQ ID NO: 3747410 - DNA, 23 bp, Homo sapiens
tgaatgatgatcctaggcatttg

SEQ ID NO: 3747411 - DNA, 19 bp, Homo sapiens
tgaatgcacactagcctct

SEQ ID NO: 3747412 - DNA, 23 bp, Homo sapiens
tgaatgcccacaggcaaatgcat

SEQ ID NO: 3747413 - DNA, 12 bp, Homo sapiens
tgaatggcctgc

SEQ ID NO: 3747414 - DNA, 15 bp, Homo sapiens
tgaatggcctgcctt

SEQ ID NO: 3747415 - DNA, 13 bp, Homo sapiens
tgaatggtatgga

SEQ ID NO: 3747416 - DNA, 12 bp, Homo sapiens
tgaatgttctga

SEQ ID NO: 3747417 - DNA, 21 bp, Homo sapiens
tgaatgttctgacattaacag

SEQ ID NO: 3747418 - DNA, 19 bp, Homo sapiens
tgaatgtttacactctttg

SEQ ID NO: 3747419 - DNA, 20 bp, Homo sapiens
tgaattaatgacagagccag

SEQ ID NO: 3747420 - DNA, 21 bp, Homo sapiens
tgaattaatgacagagccagt

SEQ ID NO: 3747421 - DNA, 13 bp, Homo sapiens
tgaattcatagaa

SEQ ID NO: 3747422 - DNA, 15 bp, Homo sapiens
tgaattgtccccagt

SEQ ID NO: 3747423 - DNA, 14 bp, Homo sapiens
tgaatttaacaatg

SEQ ID NO: 3747424 - DNA, 23 bp, Homo sapiens
tgaatttaacaatgcgaatggta

SEQ ID NO: 3747425 - DNA, 17 bp, Homo sapiens
tgaatttgaatgaaaaa

SEQ ID NO: 3747426 - DNA, 14 bp, Homo sapiens
tgaatttggcttta

SEQ ID NO: 3747427 - DNA, 13 bp, Homo sapiens
tgaattttcaagc

SEQ ID NO: 3747428 - DNA, 18 bp, Homo sapiens
tgaattttgtttggactt

SEQ ID NO: 3747429 - DNA, 13 bp, Homo sapiens
tgacaaaattttg

SEQ ID NO: 3747430 - DNA, 19 bp, Homo sapiens
tgacaaagaaacccaagtg

SEQ ID NO: 3747431 - DNA, 15 bp, Homo sapiens
tgacaaatcaagttt

SEQ ID NO: 3747432 - DNA, 19 bp, Homo sapiens
tgacaaccaccgctcccca

SEQ ID NO: 3747433 - DNA, 20 bp, Homo sapiens
tgacaaccaccgctccccag

SEQ ID NO: 3747434 - DNA, 21 bp, Homo sapiens
tgacaaccaccgctccccagc

SEQ ID NO: 3747435 - DNA, 14 bp, Homo sapiens
tgacaacttctaat

SEQ ID NO: 3747436 - DNA, 15 bp, Homo sapiens
tgacaagccccaggc

SEQ ID NO: 3747437 - DNA, 22 bp, Homo sapiens
tgacaagctcctggtcttgaga

SEQ ID NO: 3747438 - DNA, 16 bp, Homo sapiens
tgacaaggccccagag

SEQ ID NO: 3747439 - DNA, 18 bp, Homo sapiens
tgacaaggccccagagac

SEQ ID NO: 3747440 - DNA, 14 bp, Homo sapiens
tgacaagtcatttt

SEQ ID NO: 3747441 - DNA, 15 bp, Homo sapiens
tgacaatcaactcta

SEQ ID NO: 3747442 - DNA, 16 bp, Homo sapiens
tgacaattttgtacaa

SEQ ID NO: 3747443 - DNA, 18 bp, Homo sapiens
tgacaattttgtacaaat

SEQ ID NO: 3747444 - DNA, 18 bp, Homo sapiens
tgacacacagctctgtcc

SEQ ID NO: 3747445 - DNA, 21 bp, Homo sapiens
tgacacacagctctgtcctgg

SEQ ID NO: 3747446 - DNA, 23 bp, Homo sapiens
tgacaccagcctttctcccaggc

SEQ ID NO: 3747447 - DNA, 17 bp, Homo sapiens
tgacacgtccaccccag

SEQ ID NO: 3747448 - DNA, 13 bp, Homo sapiens
tgacactgaaatg

SEQ ID NO: 3747449 - DNA, 16 bp, Homo sapiens
tgacactgaaatgcct

SEQ ID NO: 3747450 - DNA, 18 bp, Homo sapiens
tgacacttcagagagctg

SEQ ID NO: 3747451 - DNA, 20 bp, Homo sapiens
tgacacttcagagagctggt

SEQ ID NO: 3747452 - DNA, 16 bp, Homo sapiens
tgacagacacaggccc

SEQ ID NO: 3747453 - DNA, 22 bp, Homo sapiens
tgacagagcaagtgagaccctg

SEQ ID NO: 3747454 - DNA, 13 bp, Homo sapiens
tgacagaggcagc

SEQ ID NO: 3747455 - DNA, 18 bp, Homo sapiens
tgacagaggcagccccat

SEQ ID NO: 3747456 - DNA, 17 bp, Homo sapiens
tgacagagtgagactct

SEQ ID NO: 3747457 - DNA, 17 bp, Homo sapiens
tgacaggcaatgctggc

SEQ ID NO: 3747458 - DNA, 19 bp, Homo sapiens
tgacaggcaatgctggctg

SEQ ID NO: 3747459 - DNA, 20 bp, Homo sapiens
tgacagggcacaccgggcac

SEQ ID NO: 3747460 - DNA, 15 bp, Homo sapiens
tgacaggtaaactat

SEQ ID NO: 3747461 - DNA, 17 bp, Homo sapiens
tgacagtaacttggtta

SEQ ID NO: 3747462 - DNA, 12 bp, Homo sapiens
tgacagtgaggt

SEQ ID NO: 3747463 - DNA, 16 bp, Homo sapiens
tgacagtgttgaaaat

SEQ ID NO: 3747464 - DNA, 19 bp, Homo sapiens
tgacagtgttgaaaatgtt

SEQ ID NO: 3747465 - DNA, 16 bp, Homo sapiens
tgacatcacttgtaca

SEQ ID NO: 3747466 - DNA, 19 bp, Homo sapiens
tgacatcacttgtacaaaa

SEQ ID NO: 3747467 - DNA, 21 bp, Homo sapiens
tgacatcacttgtacaaaata

SEQ ID NO: 3747468 - DNA, 22 bp, Homo sapiens
tgacatcacttgtacaaaataa

SEQ ID NO: 3747469 - DNA, 23 bp, Homo sapiens
tgacatcagtggcatggctccag

SEQ ID NO: 3747470 - DNA, 15 bp, Homo sapiens
tgacatgatcgcttt

SEQ ID NO: 3747471 - DNA, 19 bp, Homo sapiens
tgacatgcgggctgggcag

SEQ ID NO: 3747472 - DNA, 17 bp, Homo sapiens
tgacatgtggaaagtga

SEQ ID NO: 3747473 - DNA, 17 bp, Homo sapiens
tgacattaacagttttc

SEQ ID NO: 3747474 - DNA, 18 bp, Homo sapiens
tgacattgtagagcttct

SEQ ID NO: 3747475 - DNA, 20 bp, Homo sapiens
tgacattgttggccaaagcc

SEQ ID NO: 3747476 - DNA, 17 bp, Homo sapiens
tgaccaacatggagaaa

SEQ ID NO: 3747477 - DNA, 18 bp, Homo sapiens
tgaccaacatggagaaac

SEQ ID NO: 3747478 - DNA, 16 bp, Homo sapiens
tgaccaagagagaaag

SEQ ID NO: 3747479 - DNA, 17 bp, Homo sapiens
tgaccaagcaggaagct

SEQ ID NO: 3747480 - DNA, 18 bp, Homo sapiens
tgaccaagcaggaagctc

SEQ ID NO: 3747481 - DNA, 19 bp, Homo sapiens
tgaccaagcaggaagctca

SEQ ID NO: 3747482 - DNA, 16 bp, Homo sapiens
tgaccaagttataaat

SEQ ID NO: 3747483 - DNA, 18 bp, Homo sapiens
tgaccaatgatggtcacc

SEQ ID NO: 3747484 - DNA, 18 bp, Homo sapiens
tgaccacacttcctgtcc

SEQ ID NO: 3747485 - DNA, 20 bp, Homo sapiens
tgaccacacttcctgtccag

SEQ ID NO: 3747486 - DNA, 23 bp, Homo sapiens
tgaccacacttcctgtccagaga

SEQ ID NO: 3747487 - DNA, 15 bp, Homo sapiens
tgaccagaagggaaa

SEQ ID NO: 3747488 - DNA, 20 bp, Homo sapiens
tgaccagcagatcccagctc

SEQ ID NO: 3747489 - DNA, 16 bp, Homo sapiens
tgaccaggcatcctcc

SEQ ID NO: 3747490 - DNA, 14 bp, Homo sapiens
tgaccatttataat

SEQ ID NO: 3747491 - DNA, 14 bp, Homo sapiens
tgacccaattaagt

SEQ ID NO: 3747492 - DNA, 14 bp, Homo sapiens
tgacccacagcctc

SEQ ID NO: 3747493 - DNA, 19 bp, Homo sapiens
tgacccacagcctctgcct

SEQ ID NO: 3747494 - DNA, 20 bp, Homo sapiens
tgacccactgatctctacta

SEQ ID NO: 3747495 - DNA, 21 bp, Homo sapiens
tgacccagccccttgagaaac

SEQ ID NO: 3747496 - DNA, 12 bp, Homo sapiens
tgacccagtccc

SEQ ID NO: 3747497 - DNA, 18 bp, Homo sapiens
tgaccctctccaccccat

SEQ ID NO: 3747498 - DNA, 21 bp, Homo sapiens
tgaccctgcgaaggggccctg

SEQ ID NO: 3747499 - DNA, 19 bp, Homo sapiens
tgaccgaaacagcgctggg

SEQ ID NO: 3747500 - DNA, 13 bp, Homo sapiens
tgacctactctca

SEQ ID NO: 3747501 - DNA, 14 bp, Homo sapiens
tgacctcactgtga

SEQ ID NO: 3747502 - DNA, 16 bp, Homo sapiens
tgacctccccctcctt

SEQ ID NO: 3747503 - DNA, 22 bp, Homo sapiens
tgacctccctctaatttatctt

SEQ ID NO: 3747504 - DNA, 20 bp, Homo sapiens
tgacctgccccgcccagctg

SEQ ID NO: 3747505 - DNA, 13 bp, Homo sapiens
tgacctgtgacca

SEQ ID NO: 3747506 - DNA, 15 bp, Homo sapiens
tgacctgtgaccagc

SEQ ID NO: 3747507 - DNA, 19 bp, Homo sapiens
tgacctgtggggatttctc

SEQ ID NO: 3747508 - DNA, 22 bp, Homo sapiens
tgacctgtggggatttctccca

SEQ ID NO: 3747509 - DNA, 15 bp, Homo sapiens
tgacctgtgtcacta

SEQ ID NO: 3747510 - DNA, 13 bp, Homo sapiens
tgaccttctggga

SEQ ID NO: 3747511 - DNA, 19 bp, Homo sapiens
tgaccttgaactcctgggc

SEQ ID NO: 3747512 - DNA, 14 bp, Homo sapiens
tgacgaggctgggc

SEQ ID NO: 3747513 - DNA, 21 bp, Homo sapiens
tgacggaaggacctatgtttg

SEQ ID NO: 3747514 - DNA, 23 bp, Homo sapiens
tgacggaaggacctatgtttgct

SEQ ID NO: 3747515 - DNA, 19 bp, Homo sapiens
tgacgtcaagtctccttcc

SEQ ID NO: 3747516 - DNA, 17 bp, Homo sapiens
tgactagggattcaggc

SEQ ID NO: 3747517 - DNA, 19 bp, Homo sapiens
tgactagggattcaggctg

SEQ ID NO: 3747518 - DNA, 20 bp, Homo sapiens
tgactagggattcaggctgc

SEQ ID NO: 3747519 - DNA, 17 bp, Homo sapiens
tgactagtgctgaagct

SEQ ID NO: 3747520 - DNA, 21 bp, Homo sapiens
tgactagtgctgaagcttatt

SEQ ID NO: 3747521 - DNA, 20 bp, Homo sapiens
tgactattgaagttgcagat

SEQ ID NO: 3747522 - DNA, 15 bp, Homo sapiens
tgactcaacatgtta

SEQ ID NO: 3747523 - DNA, 20 bp, Homo sapiens
tgactcaagtgtctcagtcc

SEQ ID NO: 3747524 - DNA, 13 bp, Homo sapiens
tgactcacccaag

SEQ ID NO: 3747525 - DNA, 14 bp, Homo sapiens
tgactcttggcaca

SEQ ID NO: 3747526 - DNA, 21 bp, Homo sapiens
tgactgcattttactgtacag

SEQ ID NO: 3747527 - DNA, 16 bp, Homo sapiens
tgactgccccaactcc

SEQ ID NO: 3747528 - DNA, 15 bp, Homo sapiens
tgactggcacagtct

SEQ ID NO: 3747529 - DNA, 16 bp, Homo sapiens
tgactgtactcctccc

SEQ ID NO: 3747530 - DNA, 17 bp, Homo sapiens
tgactgtactcctccca

SEQ ID NO: 3747531 - DNA, 18 bp, Homo sapiens
tgactgtactcctcccag

SEQ ID NO: 3747532 - DNA, 16 bp, Homo sapiens
tgactgtcactgttcc

SEQ ID NO: 3747533 - DNA, 17 bp, Homo sapiens
tgactgtggccatggtc

SEQ ID NO: 3747534 - DNA, 21 bp, Homo sapiens
tgactgttttctcttgagagg

SEQ ID NO: 3747535 - DNA, 21 bp, Homo sapiens
tgagaacagatctccaaagct

SEQ ID NO: 3747536 - DNA, 22 bp, Homo sapiens
tgagaacagatctccaaagctt

SEQ ID NO: 3747537 - DNA, 16 bp, Homo sapiens
tgagaacatgttggta

SEQ ID NO: 3747538 - DNA, 15 bp, Homo sapiens
tgagaacttgacaag

SEQ ID NO: 3747539 - DNA, 13 bp, Homo sapiens
tgagaagaatatt

SEQ ID NO: 3747540 - DNA, 22 bp, Homo sapiens
tgagaagaatattgttcctaag

SEQ ID NO: 3747541 - DNA, 20 bp, Homo sapiens
tgagaagcagaggaaggaga

SEQ ID NO: 3747542 - DNA, 16 bp, Homo sapiens
tgagaagccgtgggtg

SEQ ID NO: 3747543 - DNA, 17 bp, Homo sapiens
tgagaagccgtgggtgg

SEQ ID NO: 3747544 - DNA, 17 bp, Homo sapiens
tgagaatagaaggaaac

SEQ ID NO: 3747545 - DNA, 16 bp, Homo sapiens
tgagaatcaaaactct

SEQ ID NO: 3747546 - DNA, 18 bp, Homo sapiens
tgagaattcagctgcccc

SEQ ID NO: 3747547 - DNA, 15 bp, Homo sapiens
tgagaattttaaatt

SEQ ID NO: 3747548 - DNA, 12 bp, Homo sapiens
tgagacaaaaat

SEQ ID NO: 3747549 - DNA, 14 bp, Homo sapiens
tgagaccaacctgg

SEQ ID NO: 3747550 - DNA, 14 bp, Homo sapiens
tgagaccactgtta

SEQ ID NO: 3747551 - DNA, 17 bp, Homo sapiens
tgagaccagcctgggca

SEQ ID NO: 3747552 - DNA, 21 bp, Homo sapiens
tgagacccattcctatttctt

SEQ ID NO: 3747553 - DNA, 13 bp, Homo sapiens
tgagacccccaca

SEQ ID NO: 3747554 - DNA, 12 bp, Homo sapiens
tgagacctcagc

SEQ ID NO: 3747555 - DNA, 14 bp, Homo sapiens
tgagacctcagcca

SEQ ID NO: 3747556 - DNA, 12 bp, Homo sapiens
tgagactctgtc

SEQ ID NO: 3747557 - DNA, 20 bp, Homo sapiens
tgagactctgtctcaaaaaa

SEQ ID NO: 3747558 - DNA, 23 bp, Homo sapiens
tgagactgcgggatggtcctggg

SEQ ID NO: 3747559 - DNA, 21 bp, Homo sapiens
tgagactggatactgcccggg

SEQ ID NO: 3747560 - DNA, 15 bp, Homo sapiens
tgagactttttggtg

SEQ ID NO: 3747561 - DNA, 22 bp, Homo sapiens
tgagactttttggtggatgtaa

SEQ ID NO: 3747562 - DNA, 14 bp, Homo sapiens
tgagagaatggaaa

SEQ ID NO: 3747563 - DNA, 23 bp, Homo sapiens
tgagagaatggaaaacagactca

SEQ ID NO: 3747564 - DNA, 20 bp, Homo sapiens
tgagagacccaaggaggaaa

SEQ ID NO: 3747565 - DNA, 21 bp, Homo sapiens
tgagagacccaaggaggaaaa

SEQ ID NO: 3747566 - DNA, 15 bp, Homo sapiens
tgagagagacaagaa

SEQ ID NO: 3747567 - DNA, 14 bp, Homo sapiens
tgagagctgggtgt

SEQ ID NO: 3747568 - DNA, 18 bp, Homo sapiens
tgagaggcagacttccct

SEQ ID NO: 3747569 - DNA, 14 bp, Homo sapiens
tgagatagaagatg

SEQ ID NO: 3747570 - DNA, 18 bp, Homo sapiens
tgagatagaagatgtttg

SEQ ID NO: 3747571 - DNA, 19 bp, Homo sapiens
tgagatagtagcatacatt

SEQ ID NO: 3747572 - DNA, 15 bp, Homo sapiens
tgagatcagcctggg

SEQ ID NO: 3747573 - DNA, 16 bp, Homo sapiens
tgagatctaagccttt

SEQ ID NO: 3747574 - DNA, 23 bp, Homo sapiens
tgagatctaagcctttccataag

SEQ ID NO: 3747575 - DNA, 17 bp, Homo sapiens
tgagatggccctctggt

SEQ ID NO: 3747576 - DNA, 17 bp, Homo sapiens
tagtgcggacaagtttt

SEQ ID NO: 3747577 - DNA, 14 bp, Homo sapiens
tagtgctgaagctt

SEQ ID NO: 3747578 - DNA, 17 bp, Homo sapiens
tagtgctgaagcttatt

SEQ ID NO: 3747579 - DNA, 19 bp, Homo sapiens
tagtgctgaagcttattaa

SEQ ID NO: 3747580 - DNA, 21 bp, Homo sapiens
tagtgcttaaaaatcattgat

SEQ ID NO: 3747581 - DNA, 18 bp, Homo sapiens
tagtggttcttggaaaaa

SEQ ID NO: 3747582 - DNA, 14 bp, Homo sapiens
tagtgtaaaaatga

SEQ ID NO: 3747583 - DNA, 18 bp, Homo sapiens
tagtgtaaaaatgagaac

SEQ ID NO: 3747584 - DNA, 15 bp, Homo sapiens
tagtgtaggctttac

SEQ ID NO: 3747585 - DNA, 18 bp, Homo sapiens
tagtgtaggctttactta

SEQ ID NO: 3747586 - DNA, 14 bp, Homo sapiens
tagtgtcactgctt

SEQ ID NO: 3747587 - DNA, 15 bp, Homo sapiens
tagttactatatgcc

SEQ ID NO: 3747588 - DNA, 14 bp, Homo sapiens
tagttactcattca

SEQ ID NO: 3747589 - DNA, 23 bp, Homo sapiens
tagttaggaaataaaacctttca

SEQ ID NO: 3747590 - DNA, 14 bp, Homo sapiens
tagttcatccaatc

SEQ ID NO: 3747591 - DNA, 15 bp, Homo sapiens
tagttctatttctat

SEQ ID NO: 3747592 - DNA, 19 bp, Homo sapiens
tagttgcagaaacattttg

SEQ ID NO: 3747593 - DNA, 16 bp, Homo sapiens
tagttgctccgcctct

SEQ ID NO: 3747594 - DNA, 21 bp, Homo sapiens
tagtttatacagttttaaaga

SEQ ID NO: 3747595 - DNA, 14 bp, Homo sapiens
tagtttctttggga

SEQ ID NO: 3747596 - DNA, 20 bp, Homo sapiens
tagtttgtgattttacattt

SEQ ID NO: 3747597 - DNA, 16 bp, Homo sapiens
tagttttagttgcaga

SEQ ID NO: 3747598 - DNA, 18 bp, Homo sapiens
tagtttttacctaccaca

SEQ ID NO: 3747599 - DNA, 17 bp, Homo sapiens
tataaaaaaaatgaaat

SEQ ID NO: 3747600 - DNA, 22 bp, Homo sapiens
tataaaatggtgttttcatgta

SEQ ID NO: 3747601 - DNA, 14 bp, Homo sapiens
tataaacatcacac

SEQ ID NO: 3747602 - DNA, 18 bp, Homo sapiens
tataaacatcacacacac

SEQ ID NO: 3747603 - DNA, 13 bp, Homo sapiens
tataaactttaga

SEQ ID NO: 3747604 - DNA, 21 bp, Homo sapiens
tataaactttagagtagcatg

SEQ ID NO: 3747605 - DNA, 22 bp, Homo sapiens
tataaagaacaaggtagttttt

SEQ ID NO: 3747606 - DNA, 12 bp, Homo sapiens
tataaagaattc

SEQ ID NO: 3747607 - DNA, 16 bp, Homo sapiens
tataaagcatctaaac

SEQ ID NO: 3747608 - DNA, 19 bp, Homo sapiens
tataaagcatctaaacttt

SEQ ID NO: 3747609 - DNA, 16 bp, Homo sapiens
tataaaggttgacaat

SEQ ID NO: 3747610 - DNA, 16 bp, Homo sapiens
tataaatcaatgtcac

SEQ ID NO: 3747611 - DNA, 20 bp, Homo sapiens
tataaatcaatgtcacttaa

SEQ ID NO: 3747612 - DNA, 11 bp, Homo sapiens
tataaattaaa

SEQ ID NO: 3747613 - DNA, 14 bp, Homo sapiens
tataaattaaatat

SEQ ID NO: 3747614 - DNA, 20 bp, Homo sapiens
tataaattaaatatatgtat

SEQ ID NO: 3747615 - DNA, 21 bp, Homo sapiens
tataacagtgtggtagttaat

SEQ ID NO: 3747616 - DNA, 15 bp, Homo sapiens
tataaccaatgttta

SEQ ID NO: 3747617 - DNA, 18 bp, Homo sapiens
tataactagtcctttact

SEQ ID NO: 3747618 - DNA, 19 bp, Homo sapiens
tataactatgttgataaaa

SEQ ID NO: 3747619 - DNA, 19 bp, Homo sapiens
tataactcatcataaaata

SEQ ID NO: 3747620 - DNA, 16 bp, Homo sapiens
tataactgaaggagaa

SEQ ID NO: 3747621 - DNA, 19 bp, Homo sapiens
tataacttaaaaaaatgac

SEQ ID NO: 3747622 - DNA, 16 bp, Homo sapiens
tataaggaaagcaata

SEQ ID NO: 3747623 - DNA, 12 bp, Homo sapiens
tataaggactgc

SEQ ID NO: 3747624 - DNA, 13 bp, Homo sapiens
tataataaagtat

SEQ ID NO: 3747625 - DNA, 16 bp, Homo sapiens
tataataaatgtacat

SEQ ID NO: 3747626 - DNA, 19 bp, Homo sapiens
tataatgtaagctctactg

SEQ ID NO: 3747627 - DNA, 16 bp, Homo sapiens
tataatgttagtagaa

SEQ ID NO: 3747628 - DNA, 17 bp, Homo sapiens
tataatgttgttattta

SEQ ID NO: 3747629 - DNA, 15 bp, Homo sapiens
tataatgtttgctat

SEQ ID NO: 3747630 - DNA, 19 bp, Homo sapiens
tataattatcggaagcagt

SEQ ID NO: 3747631 - DNA, 13 bp, Homo sapiens
tataattccctat

SEQ ID NO: 3747632 - DNA, 20 bp, Homo sapiens
tataattgttttttatcttt

SEQ ID NO: 3747633 - DNA, 22 bp, Homo sapiens
tataattgttttttatcttttc

SEQ ID NO: 3747634 - DNA, 15 bp, Homo sapiens
tataatttaacttca

SEQ ID NO: 3747635 - DNA, 22 bp, Homo sapiens
tataatttaacttcagagggaa

SEQ ID NO: 3747636 - DNA, 18 bp, Homo sapiens
tataattttaagattcct

SEQ ID NO: 3747637 - DNA, 20 bp, Homo sapiens
tataattttaagattccttt

SEQ ID NO: 3747638 - DNA, 19 bp, Homo sapiens
tataatttttaaagtatat

SEQ ID NO: 3747639 - DNA, 15 bp, Homo sapiens
tataattttttaaag

SEQ ID NO: 3747640 - DNA, 19 bp, Homo sapiens
tataattttttagagagct

SEQ ID NO: 3747641 - DNA, 18 bp, Homo sapiens
tataatttttttcaatat

SEQ ID NO: 3747642 - DNA, 15 bp, Homo sapiens
tatacaggggaatat

SEQ ID NO: 3747643 - DNA, 23 bp, Homo sapiens
tatacaggggaatattttattca

SEQ ID NO: 3747644 - DNA, 22 bp, Homo sapiens
tatacagtagtgagaagaatat

SEQ ID NO: 3747645 - DNA, 19 bp, Homo sapiens
tatacagttttaaagaatc

SEQ ID NO: 3747646 - DNA, 22 bp, Homo sapiens
tatacataacagggtaaattat

SEQ ID NO: 3747647 - DNA, 17 bp, Homo sapiens
tatacatgacactgaaa

SEQ ID NO: 3747648 - DNA, 21 bp, Homo sapiens
tataccccgtgaagcatccag

SEQ ID NO: 3747649 - DNA, 22 bp, Homo sapiens
tataccccttacttagcatgca

SEQ ID NO: 3747650 - DNA, 21 bp, Homo sapiens
tatacttttttcttatttaac

SEQ ID NO: 3747651 - DNA, 13 bp, Homo sapiens
tatagaagtttag

SEQ ID NO: 3747652 - DNA, 18 bp, Homo sapiens
tatagcctaggtgacaga

SEQ ID NO: 3747653 - DNA, 16 bp, Homo sapiens
tatagctacaggaagc

SEQ ID NO: 3747654 - DNA, 12 bp, Homo sapiens
tatagcttgaaa

SEQ ID NO: 3747655 - DNA, 12 bp, Homo sapiens
tatataaagaga

SEQ ID NO: 3747656 - DNA, 20 bp, Homo sapiens
tatataaagagaaaattgaa

SEQ ID NO: 3747657 - DNA, 14 bp, Homo sapiens
tatataataaagta

SEQ ID NO: 3747658 - DNA, 22 bp, Homo sapiens
tatatacaataacataatttgt

SEQ ID NO: 3747659 - DNA, 13 bp, Homo sapiens
tatatatacataa

SEQ ID NO: 3747660 - DNA, 15 bp, Homo sapiens
tatatatctatctta

SEQ ID NO: 3747661 - DNA, 14 bp, Homo sapiens
tatatatttataac

SEQ ID NO: 3747662 - DNA, 14 bp, Homo sapiens
tatatccatgtact

SEQ ID NO: 3747663 - DNA, 17 bp, Homo sapiens
tatatccatgtactgta

SEQ ID NO: 3747664 - DNA, 18 bp, Homo sapiens
tatatccatgtactgtag

SEQ ID NO: 3747665 - DNA, 19 bp, Homo sapiens
tatatccatgtactgtagt

SEQ ID NO: 3747666 - DNA, 17 bp, Homo sapiens
tatatctgttttactgc

SEQ ID NO: 3747667 - DNA, 15 bp, Homo sapiens
tatatgaacatagac

SEQ ID NO: 3747668 - DNA, 19 bp, Homo sapiens
tatatgaggacttgtgtct

SEQ ID NO: 3747669 - DNA, 20 bp, Homo sapiens
tatatgctctgcatgttaca

SEQ ID NO: 3747670 - DNA, 21 bp, Homo sapiens
tatatgctctgcatgttacat

SEQ ID NO: 3747671 - DNA, 13 bp, Homo sapiens
tatattaaaaatg

SEQ ID NO: 3747672 - DNA, 15 bp, Homo sapiens
tatattaaaaatggt

SEQ ID NO: 3747673 - DNA, 20 bp, Homo sapiens
tatattatcatgcaaatgct

SEQ ID NO: 3747674 - DNA, 14 bp, Homo sapiens
tatattcatatatt

SEQ ID NO: 3747675 - DNA, 19 bp, Homo sapiens
tatattccatatattagca

SEQ ID NO: 3747676 - DNA, 19 bp, Homo sapiens
tatattgtcagatattttt

SEQ ID NO: 3747677 - DNA, 18 bp, Homo sapiens
tatatttaagtattcaag

SEQ ID NO: 3747678 - DNA, 16 bp, Homo sapiens
tatatttataactcat

SEQ ID NO: 3747679 - DNA, 23 bp, Homo sapiens
tatatttataactcatcataaaa

SEQ ID NO: 3747680 - DNA, 24 bp, Homo sapiens
tatatttataactcatcataaaat

SEQ ID NO: 3747681 - DNA, 16 bp, Homo sapiens
tatatttcactatttt

SEQ ID NO: 3747682 - DNA, 21 bp, Homo sapiens
tatattttatacattaacttc

SEQ ID NO: 3747683 - DNA, 18 bp, Homo sapiens
tatattttcaattcaaaa

SEQ ID NO: 3747684 - DNA, 18 bp, Homo sapiens
tatatttttaataaaagt

SEQ ID NO: 3747685 - DNA, 16 bp, Homo sapiens
tatatttttgtttgtt

SEQ ID NO: 3747686 - DNA, 19 bp, Homo sapiens
tatattttttaatttgatg

SEQ ID NO: 3747687 - DNA, 13 bp, Homo sapiens
tatcaaactgaag

SEQ ID NO: 3747688 - DNA, 23 bp, Homo sapiens
tatcaagccagtacgtgctaaca

SEQ ID NO: 3747689 - DNA, 12 bp, Homo sapiens
tatcaagctaat

SEQ ID NO: 3747690 - DNA, 21 bp, Homo sapiens
tatcaaggtcgtttttttcat

SEQ ID NO: 3747691 - DNA, 13 bp, Homo sapiens
tatcaatcatttt

SEQ ID NO: 3747692 - DNA, 19 bp, Homo sapiens
tatcaattaccacaccatc

SEQ ID NO: 3747693 - DNA, 20 bp, Homo sapiens
tatcaatttgtcattttgaa

SEQ ID NO: 3747694 - DNA, 14 bp, Homo sapiens
tatcacacaaagca

SEQ ID NO: 3747695 - DNA, 16 bp, Homo sapiens
tatcacacaaagcaga

SEQ ID NO: 3747696 - DNA, 13 bp, Homo sapiens
tatcacattattt

SEQ ID NO: 3747697 - DNA, 18 bp, Homo sapiens
tatcactgaagcttttta

SEQ ID NO: 3747698 - DNA, 18 bp, Homo sapiens
tatcactgacacaaaaag

SEQ ID NO: 3747699 - DNA, 22 bp, Homo sapiens
tatcagtcataactaaataaag

SEQ ID NO: 3747700 - DNA, 16 bp, Homo sapiens
tatcagttactcagcc

SEQ ID NO: 3747701 - DNA, 17 bp, Homo sapiens
tatcagttactcagccc

SEQ ID NO: 3747702 - DNA, 18 bp, Homo sapiens
tatcagttactcagccct

SEQ ID NO: 3747703 - DNA, 19 bp, Homo sapiens
tatcagttactcagccctg

SEQ ID NO: 3747704 - DNA, 20 bp, Homo sapiens
tatcagttactcagccctgg

SEQ ID NO: 3747705 - DNA, 21 bp, Homo sapiens
tatcagttgagcttcatatac

SEQ ID NO: 3747706 - DNA, 23 bp, Homo sapiens
tatcagtttgctagcagaaatct

SEQ ID NO: 3747707 - DNA, 14 bp, Homo sapiens
tatcatagaaatgt

SEQ ID NO: 3747708 - DNA, 21 bp, Homo sapiens
tatcatatatatacatacatg

SEQ ID NO: 3747709 - DNA, 19 bp, Homo sapiens
tatcatatatttaatctta

SEQ ID NO: 3747710 - DNA, 21 bp, Homo sapiens
tatcatgtcaaacgtgaaaat

SEQ ID NO: 3747711 - DNA, 14 bp, Homo sapiens
tatcattcagcaac

SEQ ID NO: 3747712 - DNA, 21 bp, Homo sapiens
tatcattttctgcatttaacc

SEQ ID NO: 3747713 - DNA, 13 bp, Homo sapiens
tatccacccagcc

SEQ ID NO: 3747714 - DNA, 16 bp, Homo sapiens
tatccatgtactgtag

SEQ ID NO: 3747715 - DNA, 22 bp, Homo sapiens
tatccatgtactgtagtttttc

SEQ ID NO: 3747716 - DNA, 16 bp, Homo sapiens
tatcccttttcttgac

SEQ ID NO: 3747717 - DNA, 18 bp, Homo sapiens
tatcctgccaaaatcatt

SEQ ID NO: 3747718 - DNA, 22 bp, Homo sapiens
tatcgagtttgcaatgtcacaa

SEQ ID NO: 3747719 - DNA, 15 bp, Homo sapiens
tatcgggagcagtgt

SEQ ID NO: 3747720 - DNA, 12 bp, Homo sapiens
tatcgggggctg

SEQ ID NO: 3747721 - DNA, 14 bp, Homo sapiens
tatctaaaccatat

SEQ ID NO: 3747722 - DNA, 12 bp, Homo sapiens
tatctaaccagt

SEQ ID NO: 3747723 - DNA, 23 bp, Homo sapiens
tatctagtgcagctgattttaac

SEQ ID NO: 3747724 - DNA, 13 bp, Homo sapiens
tatctatcttata

SEQ ID NO: 3747725 - DNA, 13 bp, Homo sapiens
tatctattgtaag

SEQ ID NO: 3747726 - DNA, 14 bp, Homo sapiens
tatctattgtaaga

SEQ ID NO: 3747727 - DNA, 19 bp, Homo sapiens
tatctattgtaagataaaa

SEQ ID NO: 3747728 - DNA, 19 bp, Homo sapiens
tatctatttgtatatatac

SEQ ID NO: 3747729 - DNA, 16 bp, Homo sapiens
tatctcacagcacact

SEQ ID NO: 3747730 - DNA, 20 bp, Homo sapiens
tatctctgtctaccatctcc

SEQ ID NO: 3747731 - DNA, 23 bp, Homo sapiens
tatctctgtgtgcacaaatattt

SEQ ID NO: 3747732 - DNA, 21 bp, Homo sapiens
tatctgagaccccaaactctc

SEQ ID NO: 3747733 - DNA, 15 bp, Homo sapiens
tatctgctgtatgtc

SEQ ID NO: 3747734 - DNA, 23 bp, Homo sapiens
tatctgggattatggttttgtga

SEQ ID NO: 3747735 - DNA, 23 bp, Homo sapiens
tatctgtacatactttttcaaga

SEQ ID NO: 3747736 - DNA, 20 bp, Homo sapiens
tatctgtcatttgagcaggg

SEQ ID NO: 3747737 - DNA, 21 bp, Homo sapiens
tatctgtcatttgagcagggc

SEQ ID NO: 3747738 - DNA, 17 bp, Homo sapiens
tatctgtgtttttgaaa

SEQ ID NO: 3747739 - DNA, 14 bp, Homo sapiens
tatctgttttactg

SEQ ID NO: 3747740 - DNA, 19 bp, Homo sapiens
tatctgttttactgctttt

SEQ ID NO: 3747741 - DNA, 15 bp, Homo sapiens
tatcttaaagcactt

SEQ ID NO: 3747742 - DNA, 12 bp, Homo sapiens
tatcttcacaat

SEQ ID NO: 3747743 - DNA, 21 bp, Homo sapiens
tatcttggtgtgttaagagtt

SEQ ID NO: 3747744 - DNA, 14 bp, Homo sapiens
tatcttgtttttcc

SEQ ID NO: 3747745 - DNA, 19 bp, Homo sapiens
tatcttttctacagcaaat

SEQ ID NO: 3747746 - DNA, 17 bp, Homo sapiens
tatctttttattgatgt

SEQ ID NO: 3747747 - DNA, 19 bp, Homo sapiens
tatctttttattgatgtgc

SEQ ID NO: 3747748 - DNA, 14 bp, Homo sapiens
tatgaaaaatatga

SEQ ID NO: 3747749 - DNA, 20 bp, Homo sapiens
tatgaaatttaatatagcta

SEQ ID NO: 3747750 - DNA, 21 bp, Homo sapiens
tatgaacatagactagagaaa

SEQ ID NO: 3747751 - DNA, 18 bp, Homo sapiens
tatgaacggtgagcattg

SEQ ID NO: 3747752 - DNA, 15 bp, Homo sapiens
tatgaactgcatgta

SEQ ID NO: 3747753 - DNA, 15 bp, Homo sapiens
tatgacagttatact

SEQ ID NO: 3747754 - DNA, 20 bp, Homo sapiens
tatgacatcacttgtacaaa

SEQ ID NO: 3747755 - DNA, 16 bp, Homo sapiens
tatgaccttctaggaa

SEQ ID NO: 3747756 - DNA, 13 bp, Homo sapiens
tatgactaaagag

SEQ ID NO: 3747757 - DNA, 14 bp, Homo sapiens
tatgactaaagaga

SEQ ID NO: 3747758 - DNA, 17 bp, Homo sapiens
tatgactaaagagagaa

SEQ ID NO: 3747759 - DNA, 20 bp, Homo sapiens
tatgactaaagagagaatgt

SEQ ID NO: 3747760 - DNA, 16 bp, Homo sapiens
tatgactcccaaattt

SEQ ID NO: 3747761 - DNA, 20 bp, Homo sapiens
tatgacttggacctcatttt

SEQ ID NO: 3747762 - DNA, 17 bp, Homo sapiens
tatgagccagacaaatg

SEQ ID NO: 3747763 - DNA, 18 bp, Homo sapiens
tatgaggagtgaacattt

SEQ ID NO: 3747764 - DNA, 18 bp, Homo sapiens
tatgagttgttttcagac

SEQ ID NO: 3747765 - DNA, 22 bp, Homo sapiens
tatgagttgttttcagactcag

SEQ ID NO: 3747766 - DNA, 22 bp, Homo sapiens
tatgagtttttgatagctttat

SEQ ID NO: 3747767 - DNA, 23 bp, Homo sapiens
tatgataaaaaattttgtaattt

SEQ ID NO: 3747768 - DNA, 18 bp, Homo sapiens
tatgatattccatagtat

SEQ ID NO: 3747769 - DNA, 19 bp, Homo sapiens
tatgatattccatagtata

SEQ ID NO: 3747770 - DNA, 14 bp, Homo sapiens
tatgatcacggctc

SEQ ID NO: 3747771 - DNA, 15 bp, Homo sapiens
tatgatcccagcact

SEQ ID NO: 3747772 - DNA, 18 bp, Homo sapiens
tatgatgtgggtcaagga

SEQ ID NO: 3747773 - DNA, 16 bp, Homo sapiens
tatgattagtaaagaa

SEQ ID NO: 3747774 - DNA, 15 bp, Homo sapiens
tatgatttggaaaat

SEQ ID NO: 3747775 - DNA, 17 bp, Homo sapiens
tatgatttggaaaataa

SEQ ID NO: 3747776 - DNA, 21 bp, Homo sapiens
tatgcaaacataacaaaatca

SEQ ID NO: 3747777 - DNA, 18 bp, Homo sapiens
tatgcaatcaaatctgct

SEQ ID NO: 3747778 - DNA, 21 bp, Homo sapiens
tatgcacacctcccaccccct

SEQ ID NO: 3747779 - DNA, 16 bp, Homo sapiens
tatgcatctaataaaa

SEQ ID NO: 3747780 - DNA, 14 bp, Homo sapiens
tatgccagctcagt

SEQ ID NO: 3747781 - DNA, 22 bp, Homo sapiens
tatgccatagcaagattgctta

SEQ ID NO: 3747782 - DNA, 18 bp, Homo sapiens
tatgctctacccttgtgt

SEQ ID NO: 3747783 - DNA, 16 bp, Homo sapiens
tatgctgtattttctt

SEQ ID NO: 3747784 - DNA, 14 bp, Homo sapiens
tatgcttattttaa

SEQ ID NO: 3747785 - DNA, 21 bp, Homo sapiens
tatggaaactgttgccagaga

SEQ ID NO: 3747786 - DNA, 22 bp, Homo sapiens
tatggaagggtttgtggctggg

SEQ ID NO: 3747787 - DNA, 14 bp, Homo sapiens
tatggaattacatg

SEQ ID NO: 3747788 - DNA, 15 bp, Homo sapiens
tatggaggatggaga

SEQ ID NO: 3747789 - DNA, 19 bp, Homo sapiens
tatggattttctaaggaag

SEQ ID NO: 3747790 - DNA, 13 bp, Homo sapiens
tatggcagtgtct

SEQ ID NO: 3747791 - DNA, 19 bp, Homo sapiens
tatggcctcagctgcctca

SEQ ID NO: 3747792 - DNA, 21 bp, Homo sapiens
tatgggtatcaaacagctcag

SEQ ID NO: 3747793 - DNA, 22 bp, Homo sapiens
tatgggtgtgtgtttgtgtgag

SEQ ID NO: 3747794 - DNA, 12 bp, Homo sapiens
tatgtaaaataa

SEQ ID NO: 3747795 - DNA, 14 bp, Homo sapiens
tatgtaaacataat

SEQ ID NO: 3747796 - DNA, 14 bp, Homo sapiens
tatgtaactgcatt

SEQ ID NO: 3747797 - DNA, 23 bp, Homo sapiens
tatgtacaatattttaagcatta

SEQ ID NO: 3747798 - DNA, 14 bp, Homo sapiens
tatgtacctctttt

SEQ ID NO: 3747799 - DNA, 16 bp, Homo sapiens
tatgtacctcttttag

SEQ ID NO: 3747800 - DNA, 16 bp, Homo sapiens
tatgtagatgtgcatt

SEQ ID NO: 3747801 - DNA, 17 bp, Homo sapiens
tatgtagatgtgcattt

SEQ ID NO: 3747802 - DNA, 20 bp, Homo sapiens
tatgtatggaatacagtgtt

SEQ ID NO: 3747803 - DNA, 14 bp, Homo sapiens
tatgtatgtaaaaa

SEQ ID NO: 3747804 - DNA, 22 bp, Homo sapiens
tatgtatgtttacactgtcaaa

SEQ ID NO: 3747805 - DNA, 19 bp, Homo sapiens
tatgtattaatattcattg

SEQ ID NO: 3747806 - DNA, 13 bp, Homo sapiens
tatgtccatatct

SEQ ID NO: 3747807 - DNA, 19 bp, Homo sapiens
tatgtggtttccacgatga

SEQ ID NO: 3747808 - DNA, 12 bp, Homo sapiens
tatgtgtgtatg

SEQ ID NO: 3747809 - DNA, 12 bp, Homo sapiens
tatgtgtgtgta

SEQ ID NO: 3747810 - DNA, 19 bp, Homo sapiens
tatgtgtgtgtatgctact

SEQ ID NO: 3747811 - DNA, 16 bp, Homo sapiens
tatgtgtttttcacat

SEQ ID NO: 3747812 - DNA, 22 bp, Homo sapiens
tatgttaacctcagtgtcattt

SEQ ID NO: 3747813 - DNA, 22 bp, Homo sapiens
tatgttacatctgttttaaatt

SEQ ID NO: 3747814 - DNA, 22 bp, Homo sapiens
tatgttcttagtggatgttctg

SEQ ID NO: 3747815 - DNA, 18 bp, Homo sapiens
tatgttgacctaagattt

SEQ ID NO: 3747816 - DNA, 15 bp, Homo sapiens
tatgttgatgaaaaa

SEQ ID NO: 3747817 - DNA, 15 bp, Homo sapiens
tatgttgtatagatt

SEQ ID NO: 3747818 - DNA, 16 bp, Homo sapiens
tatgttgtgttctaat

SEQ ID NO: 3747819 - DNA, 17 bp, Homo sapiens
tatgttttaagaggcag

SEQ ID NO: 3747820 - DNA, 15 bp, Homo sapiens
tatgttttgtttctg

SEQ ID NO: 3747821 - DNA, 18 bp, Homo sapiens
tatgttttgtttctgaaa

SEQ ID NO: 3747822 - DNA, 18 bp, Homo sapiens
tatgttttttattatgct

SEQ ID NO: 3747823 - DNA, 15 bp, Homo sapiens
tattaaaaatggtaa

SEQ ID NO: 3747824 - DNA, 23 bp, Homo sapiens
tattaaaaattggctagttgaat

SEQ ID NO: 3747825 - DNA, 12 bp, Homo sapiens
tattaaagacag

SEQ ID NO: 3747826 - DNA, 16 bp, Homo sapiens
tattaacaaattatgt

SEQ ID NO: 3747827 - DNA, 18 bp, Homo sapiens
tattaacaaattatgtta

SEQ ID NO: 3747828 - DNA, 24 bp, Homo sapiens
tattaagaaagactatctaaatgt

SEQ ID NO: 3747829 - DNA, 13 bp, Homo sapiens
tattaagatggat

SEQ ID NO: 3747830 - DNA, 15 bp, Homo sapiens
tattaagatggattc

SEQ ID NO: 3747831 - DNA, 18 bp, Homo sapiens
tattaagatggattctca

SEQ ID NO: 3747832 - DNA, 21 bp, Homo sapiens
tattaagatggattctcagat

SEQ ID NO: 3747833 - DNA, 14 bp, Homo sapiens
tattaagcagtaaa

SEQ ID NO: 3747834 - DNA, 19 bp, Homo sapiens
tattaagcagtaaaaactg

SEQ ID NO: 3747835 - DNA, 14 bp, Homo sapiens
tattaaggaagaca

SEQ ID NO: 3747836 - DNA, 17 bp, Homo sapiens
tattaatattcattgta

SEQ ID NO: 3747837 - DNA, 20 bp, Homo sapiens
tattaatattcattgtataa

SEQ ID NO: 3747838 - DNA, 15 bp, Homo sapiens
tattaatgctaaggg

SEQ ID NO: 3747839 - DNA, 13 bp, Homo sapiens
tattacataaata

SEQ ID NO: 3747840 - DNA, 13 bp, Homo sapiens
tattacctctgat

SEQ ID NO: 3747841 - DNA, 14 bp, Homo sapiens
tattacctctgata

SEQ ID NO: 3747842 - DNA, 14 bp, Homo sapiens
tattacttctgcta

SEQ ID NO: 3747843 - DNA, 12 bp, Homo sapiens
tattagagaaga

SEQ ID NO: 3747844 - DNA, 15 bp, Homo sapiens
tattagccacaaaat

SEQ ID NO: 3747845 - DNA, 21 bp, Homo sapiens
tattagccaggtaatgtgaat

SEQ ID NO: 3747846 - DNA, 15 bp, Homo sapiens
tattataacttaaaa

SEQ ID NO: 3747847 - DNA, 12 bp, Homo sapiens
tattataattta

SEQ ID NO: 3747848 - DNA, 15 bp, Homo sapiens
tattataatttaatg

SEQ ID NO: 3747849 - DNA, 15 bp, Homo sapiens
tattatcaacaatag

SEQ ID NO: 3747850 - DNA, 18 bp, Homo sapiens
tattatcatgcaaatgct

SEQ ID NO: 3747851 - DNA, 21 bp, Homo sapiens
tattatggaagattttaaatt

SEQ ID NO: 3747852 - DNA, 15 bp, Homo sapiens
tattattgtgtgtta

SEQ ID NO: 3747853 - DNA, 15 bp, Homo sapiens
tattattttcacctg

SEQ ID NO: 3747854 - DNA, 19 bp, Homo sapiens
tattcaagaaagccagtct

SEQ ID NO: 3747855 - DNA, 22 bp, Homo sapiens
tattcaagaaagccagtcttaa

SEQ ID NO: 3747856 - DNA, 10 bp, Homo sapiens
tattcaaggt

SEQ ID NO: 3747857 - DNA, 20 bp, Homo sapiens
tattcaaggtaaaattctaa

SEQ ID NO: 3747858 - DNA, 21 bp, Homo sapiens
tattcaaggtaaaattctaaa

SEQ ID NO: 3747859 - DNA, 21 bp, Homo sapiens
tattcactgaagttctcctga

SEQ ID NO: 3747860 - DNA, 22 bp, Homo sapiens
tattcagtgctgtggcctgggc

SEQ ID NO: 3747861 - DNA, 16 bp, Homo sapiens
tattcagttaagaaaa

SEQ ID NO: 3747862 - DNA, 17 bp, Homo sapiens
tattcagttaagaaaaa

SEQ ID NO: 3747863 - DNA, 18 bp, Homo sapiens
tattcagttaagaaaaaa

SEQ ID NO: 3747864 - DNA, 21 bp, Homo sapiens
tattcagttaagaaaaaaata

SEQ ID NO: 3747865 - DNA, 21 bp, Homo sapiens
tattcattgtggttattttta

SEQ ID NO: 3747866 - DNA, 20 bp, Homo sapiens
tattccaccttaaattaaac

SEQ ID NO: 3747867 - DNA, 21 bp, Homo sapiens
tattccagtttgtttattact

SEQ ID NO: 3747868 - DNA, 18 bp, Homo sapiens
tattccatagtatattaa

SEQ ID NO: 3747869 - DNA, 14 bp, Homo sapiens
tattccatatatta

SEQ ID NO: 3747870 - DNA, 16 bp, Homo sapiens
tattccatgaatgtat

SEQ ID NO: 3747871 - DNA, 20 bp, Homo sapiens
tattcctatatagtttattg

SEQ ID NO: 3747872 - DNA, 14 bp, Homo sapiens
tattctcaaagcag

SEQ ID NO: 3747873 - DNA, 19 bp, Homo sapiens
tattctcactccaccaccc

SEQ ID NO: 3747874 - DNA, 17 bp, Homo sapiens
tattctctcctcagact

SEQ ID NO: 3747875 - DNA, 12 bp, Homo sapiens
tattctctttgg

SEQ ID NO: 3747876 - DNA, 17 bp, Homo sapiens
tattctggctgataaaa

SEQ ID NO: 3747877 - DNA, 15 bp, Homo sapiens
tattcttatttaatg

SEQ ID NO: 3747878 - DNA, 14 bp, Homo sapiens
tattcttcataaca

SEQ ID NO: 3747879 - DNA, 14 bp, Homo sapiens
tattcttgtgaata

SEQ ID NO: 3747880 - DNA, 18 bp, Homo sapiens
tattgaacttggaaagaa

SEQ ID NO: 3747881 - DNA, 18 bp, Homo sapiens
tattgacaataatttcag

SEQ ID NO: 3747882 - DNA, 17 bp, Homo sapiens
tattgacatcagcatca

SEQ ID NO: 3747883 - DNA, 14 bp, Homo sapiens
tattgagacaaaaa

SEQ ID NO: 3747884 - DNA, 17 bp, Homo sapiens
tattgagacaaaaatta

SEQ ID NO: 3747885 - DNA, 14 bp, Homo sapiens
tattgcgtcttagc

SEQ ID NO: 3747886 - DNA, 15 bp, Homo sapiens
tattgcttgcacaaa

SEQ ID NO: 3747887 - DNA, 21 bp, Homo sapiens
tattgcttgcacaaaccaatt

SEQ ID NO: 3747888 - DNA, 15 bp, Homo sapiens
tattggaattaacct

SEQ ID NO: 3747889 - DNA, 14 bp, Homo sapiens
tattgggttcatta

SEQ ID NO: 3747890 - DNA, 13 bp, Homo sapiens
tattgtaaataca

SEQ ID NO: 3747891 - DNA, 11 bp, Homo sapiens
tattgtacctc

SEQ ID NO: 3747892 - DNA, 14 bp, Homo sapiens
tattgtacctctct

SEQ ID NO: 3747893 - DNA, 15 bp, Homo sapiens
tattgtgaagtacat

SEQ ID NO: 3747894 - DNA, 19 bp, Homo sapiens
tattgtgtgttatttaaat

SEQ ID NO: 3747895 - DNA, 13 bp, Homo sapiens
tattgttccaaga

SEQ ID NO: 3747896 - DNA, 20 bp, Homo sapiens
tattgttccaagacattgtc

SEQ ID NO: 3747897 - DNA, 12 bp, Homo sapiens
tattgttttcag

SEQ ID NO: 3747898 - DNA, 22 bp, Homo sapiens
tattgtttttccttgtatttaa

SEQ ID NO: 3747899 - DNA, 19 bp, Homo sapiens
tatttaaaatttattgctt

SEQ ID NO: 3747900 - DNA, 18 bp, Homo sapiens
tatttaaatgtaaagaca

SEQ ID NO: 3747901 - DNA, 13 bp, Homo sapiens
tatttaagaaaat

SEQ ID NO: 3747902 - DNA, 14 bp, Homo sapiens
tatttaagaaaata

SEQ ID NO: 3747903 - DNA, 19 bp, Homo sapiens
tatttaagaaaatacaata

SEQ ID NO: 3747904 - DNA, 20 bp, Homo sapiens
tatttaagataattataata

SEQ ID NO: 3747905 - DNA, 23 bp, Homo sapiens
tatttaaggagatgtaagagctt

SEQ ID NO: 3747906 - DNA, 21 bp, Homo sapiens
tatttaagtattcaagaaagc

SEQ ID NO: 3747907 - DNA, 13 bp, Homo sapiens
tatttaattgtaa

SEQ ID NO: 3747908 - DNA, 14 bp, Homo sapiens
tatttacatatgaa

SEQ ID NO: 3747909 - DNA, 16 bp, Homo sapiens
tatttacatatgaaat

SEQ ID NO: 3747910 - DNA, 16 bp, Homo sapiens
tatttactgagcttct

SEQ ID NO: 3747911 - DNA, 22 bp, Homo sapiens
tatttactgagcttctctgtga

SEQ ID NO: 3747912 - DNA, 19 bp, Homo sapiens
tatttacttcgttttggtt

SEQ ID NO: 3747913 - DNA, 17 bp, Homo sapiens
tatttagattgttaaaa

SEQ ID NO: 3747914 - DNA, 19 bp, Homo sapiens
tatttagattgttaaaata

SEQ ID NO: 3747915 - DNA, 22 bp, Homo sapiens
tatttagattgttaaaataact

SEQ ID NO: 3747916 - DNA, 21 bp, Homo sapiens
tatttagcatgacaagcccca

SEQ ID NO: 3747917 - DNA, 17 bp, Homo sapiens
tatttataaatatattt

SEQ ID NO: 3747918 - DNA, 19 bp, Homo sapiens
tatttataacaacctaaat

SEQ ID NO: 3747919 - DNA, 20 bp, Homo sapiens
tatttataactcatcataaa

SEQ ID NO: 3747920 - DNA, 13 bp, Homo sapiens
tatttatataatt

SEQ ID NO: 3747921 - DNA, 17 bp, Homo sapiens
tatttatataattatgt

SEQ ID NO: 3747922 - DNA, 23 bp, Homo sapiens
tatttatatatgtatttataaat

SEQ ID NO: 3747923 - DNA, 17 bp, Homo sapiens
tatttatctattgtaag

SEQ ID NO: 3747924 - DNA, 19 bp, Homo sapiens
tatttatctattgtaagat

SEQ ID NO: 3747925 - DNA, 14 bp, Homo sapiens
tatttattaaattt

SEQ ID NO: 3747926 - DNA, 21 bp, Homo sapiens
tatttattgctacttcctgcc

SEQ ID NO: 3747927 - DNA, 16 bp, Homo sapiens
tatttattgtttattt

SEQ ID NO: 3747928 - DNA, 22 bp, Homo sapiens
tatttattgtttatttatcagt

SEQ ID NO: 3747929 - DNA, 13 bp, Homo sapiens
tatttatttaaat

SEQ ID NO: 3747930 - DNA, 17 bp, Homo sapiens
tatttatttactgagct

SEQ ID NO: 3747931 - DNA, 20 bp, Homo sapiens
tatttattttttttaagtat

SEQ ID NO: 3747932 - DNA, 14 bp, Homo sapiens
tatttcaaaaattt

SEQ ID NO: 3747933 - DNA, 20 bp, Homo sapiens
tatttcaaaatatacattca

SEQ ID NO: 3747934 - DNA, 22 bp, Homo sapiens
tatttcaatttccaagagctga

SEQ ID NO: 3747935 - DNA, 14 bp, Homo sapiens
tatttcaggattct

SEQ ID NO: 3747936 - DNA, 19 bp, Homo sapiens
tatttccttaaactgtgtg

SEQ ID NO: 3747937 - DNA, 13 bp, Homo sapiens
tatttcttgtttg

SEQ ID NO: 3747938 - DNA, 16 bp, Homo sapiens
tatttgcatgttacct

SEQ ID NO: 3747939 - DNA, 21 bp, Homo sapiens
tatttggggttgcatcagaaa

SEQ ID NO: 3747940 - DNA, 17 bp, Homo sapiens
tatttgttaaatattta

SEQ ID NO: 3747941 - DNA, 12 bp, Homo sapiens
tattttaagcat

SEQ ID NO: 3747942 - DNA, 13 bp, Homo sapiens
tattttaagcatt

SEQ ID NO: 3747943 - DNA, 19 bp, Homo sapiens
tattttaagcattactctt

SEQ ID NO: 3747944 - DNA, 20 bp, Homo sapiens
tattttaagcattactcttg

SEQ ID NO: 3747945 - DNA, 22 bp, Homo sapiens
tattttaagcattactcttgta

SEQ ID NO: 3747946 - DNA, 21 bp, Homo sapiens
tattttataaaattaaagaaa

SEQ ID NO: 3747947 - DNA, 16 bp, Homo sapiens
tattttatacattaac

SEQ ID NO: 3747948 - DNA, 15 bp, Homo sapiens
tattttatataataa

SEQ ID NO: 3747949 - DNA, 15 bp, Homo sapiens
tattttattcaaggt

SEQ ID NO: 3747950 - DNA, 17 bp, Homo sapiens
tattttatttttttcta

SEQ ID NO: 3747951 - DNA, 19 bp, Homo sapiens
tattttcaacgcagccctg

SEQ ID NO: 3747952 - DNA, 13 bp, Homo sapiens
tattttcaagaaa

SEQ ID NO: 3747953 - DNA, 16 bp, Homo sapiens
tattttcaagaaactg

SEQ ID NO: 3747954 - DNA, 20 bp, Homo sapiens
tattttcagaatctgaatgt

SEQ ID NO: 3747955 - DNA, 12 bp, Homo sapiens
tattttcctccc

SEQ ID NO: 3747956 - DNA, 20 bp, Homo sapiens
tattttctggtagatagaaa

SEQ ID NO: 3747957 - DNA, 15 bp, Homo sapiens
tatttttatacagta

SEQ ID NO: 3747958 - DNA, 20 bp, Homo sapiens
tatttttgtttcttccaaag

SEQ ID NO: 3747959 - DNA, 12 bp, Homo sapiens
tattttttaatt

SEQ ID NO: 3747960 - DNA, 17 bp, Homo sapiens
tattttttttaagtatt

SEQ ID NO: 3747961 - DNA, 13 bp, Homo sapiens
tcaaaaaatgagc

SEQ ID NO: 3747962 - DNA, 22 bp, Homo sapiens
tcaaaaactgtcaaagaatcaa

SEQ ID NO: 3747963 - DNA, 15 bp, Homo sapiens
tcaaaacagagatgt

SEQ ID NO: 3747964 - DNA, 18 bp, Homo sapiens
tcaaaagcaaatgagatc

SEQ ID NO: 3747965 - DNA, 13 bp, Homo sapiens
tcaaaaggtgcct

SEQ ID NO: 3747966 - DNA, 15 bp, Homo sapiens
tcaaaatgacagcca

SEQ ID NO: 3747967 - DNA, 14 bp, Homo sapiens
tcaaaatgtctgta

SEQ ID NO: 3747968 - DNA, 15 bp, Homo sapiens
tcaaacaaagccaga

SEQ ID NO: 3747969 - DNA, 20 bp, Homo sapiens
tcaaactgccttggcttcag

SEQ ID NO: 3747970 - DNA, 14 bp, Homo sapiens
tcaaactgtagaaa

SEQ ID NO: 3747971 - DNA, 20 bp, Homo sapiens
tcaaactgtagaaatgatga

SEQ ID NO: 3747972 - DNA, 22 bp, Homo sapiens
tcaaacttccagtgcaacactg

SEQ ID NO: 3747973 - DNA, 17 bp, Homo sapiens
tcaaagacattctgaca

SEQ ID NO: 3747974 - DNA, 12 bp, Homo sapiens
tcaaagaggttt

SEQ ID NO: 3747975 - DNA, 18 bp, Homo sapiens
tcaaagccaagtttatat

SEQ ID NO: 3747976 - DNA, 17 bp, Homo sapiens
tcaaagcttccattcca

SEQ ID NO: 3747977 - DNA, 15 bp, Homo sapiens
tcaaagctttttcca

SEQ ID NO: 3747978 - DNA, 16 bp, Homo sapiens
tcaaagctttttccag

SEQ ID NO: 3747979 - DNA, 18 bp, Homo sapiens
tcaaatgggctgctgctt

SEQ ID NO: 3747980 - DNA, 16 bp, Homo sapiens
tcaaattgagagaatg

SEQ ID NO: 3747981 - DNA, 14 bp, Homo sapiens
tcaaattgtatcta

SEQ ID NO: 3747982 - DNA, 19 bp, Homo sapiens
tcaacatgttactgaccag

SEQ ID NO: 3747983 - DNA, 15 bp, Homo sapiens
tcaaccaatgtagaa

SEQ ID NO: 3747984 - DNA, 18 bp, Homo sapiens
tcaaccattccccatggg

SEQ ID NO: 3747985 - DNA, 18 bp, Homo sapiens
tcaaccccttcgctcctg

SEQ ID NO: 3747986 - DNA, 23 bp, Homo sapiens
tcaaccccttcgctcctgtgtct

SEQ ID NO: 3747987 - DNA, 14 bp, Homo sapiens
tcaaccctccctca

SEQ ID NO: 3747988 - DNA, 14 bp, Homo sapiens
tcaacctcctgggc

SEQ ID NO: 3747989 - DNA, 13 bp, Homo sapiens
tcaacctgtaaat

SEQ ID NO: 3747990 - DNA, 15 bp, Homo sapiens
tcaacctgtaaatta

SEQ ID NO: 3747991 - DNA, 19 bp, Homo sapiens
tcaacctgtaaattatttt

SEQ ID NO: 3747992 - DNA, 20 bp, Homo sapiens
tcaacctgtgatgaggggag

SEQ ID NO: 3747993 - DNA, 14 bp, Homo sapiens
tcaacgcagccctg

SEQ ID NO: 3747994 - DNA, 18 bp, Homo sapiens
tcaacgcagccctgcttt

SEQ ID NO: 3747995 - DNA, 16 bp, Homo sapiens
tcaactcacctaatgt

SEQ ID NO: 3747996 - DNA, 16 bp, Homo sapiens
tcaacttgagcatgtt

SEQ ID NO: 3747997 - DNA, 20 bp, Homo sapiens
tcaacttgagcatgttactg

SEQ ID NO: 3747998 - DNA, 12 bp, Homo sapiens
tcaagaaactga

SEQ ID NO: 3747999 - DNA, 13 bp, Homo sapiens
tcaagaaactgag

SEQ ID NO: 3748000 - DNA, 22 bp, Homo sapiens
tcaagaaactgaggaattttct

SEQ ID NO: 3748001 - DNA, 23 bp, Homo sapiens
tcaagaaactgaggaattttctt

SEQ ID NO: 3748002 - DNA, 17 bp, Homo sapiens
tcaagaaagccagtctt

SEQ ID NO: 3748003 - DNA, 17 bp, Homo sapiens
tcaagagggtctgagga

SEQ ID NO: 3748004 - DNA, 20 bp, Homo sapiens
tcaagatgtcctccttgttc

SEQ ID NO: 3748005 - DNA, 19 bp, Homo sapiens
tcaagattttgaatgcttc

SEQ ID NO: 3748006 - DNA, 17 bp, Homo sapiens
tcaagcaagatttcaga

SEQ ID NO: 3748007 - DNA, 14 bp, Homo sapiens
tcaagcaatcctcc

SEQ ID NO: 3748008 - DNA, 18 bp, Homo sapiens
tcaagcaatcctcctgag

SEQ ID NO: 3748009 - DNA, 16 bp, Homo sapiens
tcaagcagattggaga

SEQ ID NO: 3748010 - DNA, 17 bp, Homo sapiens
tcaagcagattggagaa

SEQ ID NO: 3748011 - DNA, 17 bp, Homo sapiens
tcaagcgattcttctgc

SEQ ID NO: 3748012 - DNA, 19 bp, Homo sapiens
tcaagcgattcttctgctt

SEQ ID NO: 3748013 - DNA, 20 bp, Homo sapiens
tcaagctaataaaatatcat

SEQ ID NO: 3748014 - DNA, 22 bp, Homo sapiens
tcaagctaataaaatatcattc

SEQ ID NO: 3748015 - DNA, 23 bp, Homo sapiens
tcaagctaataaaatatcattca

SEQ ID NO: 3748016 - DNA, 18 bp, Homo sapiens
tcaaggacaaagtctcca

SEQ ID NO: 3748017 - DNA, 21 bp, Homo sapiens
tcaaggacaaagtctccagcc

SEQ ID NO: 3748018 - DNA, 22 bp, Homo sapiens
tcaaggacaaagtctccagccc

SEQ ID NO: 3748019 - DNA, 22 bp, Homo sapiens
tcaaggaccaacaagggcagtg

SEQ ID NO: 3748020 - DNA, 19 bp, Homo sapiens
tcaaggacttgaaagcatc

SEQ ID NO: 3748021 - DNA, 21 bp, Homo sapiens
tcaagggaattaaataaataa

SEQ ID NO: 3748022 - DNA, 18 bp, Homo sapiens
tcaaggtaaaattctaaa

SEQ ID NO: 3748023 - DNA, 20 bp, Homo sapiens
tcaaggtaaaattctaaata

SEQ ID NO: 3748024 - DNA, 21 bp, Homo sapiens
tcaaggtcgtttttttcattc

SEQ ID NO: 3748025 - DNA, 18 bp, Homo sapiens
tcaagtaagaagacatga

SEQ ID NO: 3748026 - DNA, 15 bp, Homo sapiens
tcaagtatccttgtt

SEQ ID NO: 3748027 - DNA, 15 bp, Homo sapiens
tcaagtattggcaaa

SEQ ID NO: 3748028 - DNA, 14 bp, Homo sapiens
tcaagtcagctctt

SEQ ID NO: 3748029 - DNA, 16 bp, Homo sapiens
tcaagtctctgctggc

SEQ ID NO: 3748030 - DNA, 15 bp, Homo sapiens
tcaagtgaaaaagga

SEQ ID NO: 3748031 - DNA, 19 bp, Homo sapiens
tcaagtgaatctaaaagct

SEQ ID NO: 3748032 - DNA, 18 bp, Homo sapiens
tcaagtgattctcctgcc

SEQ ID NO: 3748033 - DNA, 20 bp, Homo sapiens
tcaagtgattctcctgcctc

SEQ ID NO: 3748034 - DNA, 20 bp, Homo sapiens
tcaagtgcatgctctctgca

SEQ ID NO: 3748035 - DNA, 13 bp, Homo sapiens
tcaagttcaagga

SEQ ID NO: 3748036 - DNA, 20 bp, Homo sapiens
tcaagttgcacactcactgg

SEQ ID NO: 3748037 - DNA, 23 bp, Homo sapiens
tcaagtttccaagcaaatgttac

SEQ ID NO: 3748038 - DNA, 14 bp, Homo sapiens
tcaataaaatcatg

SEQ ID NO: 3748039 - DNA, 16 bp, Homo sapiens
tcaataaaatcatgta

SEQ ID NO: 3748040 - DNA, 18 bp, Homo sapiens
tcaataaaatcatgtaca

SEQ ID NO: 3748041 - DNA, 14 bp, Homo sapiens
tcaataaaatgtga

SEQ ID NO: 3748042 - DNA, 16 bp, Homo sapiens
tcaataaaatgtgatt

SEQ ID NO: 3748043 - DNA, 19 bp, Homo sapiens
tcaataaaatgtgattttt

SEQ ID NO: 3748044 - DNA, 22 bp, Homo sapiens
tcaataaaatgtgatttttctg

SEQ ID NO: 3748045 - DNA, 23 bp, Homo sapiens
tcaataaaatgtgatttttctga

SEQ ID NO: 3748046 - DNA, 21 bp, Homo sapiens
tcaataaacagcttcatgcct

SEQ ID NO: 3748047 - DNA, 20 bp, Homo sapiens
tcaataagcatcaaactctt

SEQ ID NO: 3748048 - DNA, 19 bp, Homo sapiens
tcaatacagtacaggcagc

SEQ ID NO: 3748049 - DNA, 18 bp, Homo sapiens
tcaatattcctgaatgaa

SEQ ID NO: 3748050 - DNA, 22 bp, Homo sapiens
tcaatattcctgaatgaaatat

SEQ ID NO: 3748051 - DNA, 11 bp, Homo sapiens
tcaatatttat

SEQ ID NO: 3748052 - DNA, 12 bp, Homo sapiens
tcaatatttatt

SEQ ID NO: 3748053 - DNA, 21 bp, Homo sapiens
tcaatctgaagatacatgtct

SEQ ID NO: 3748054 - DNA, 14 bp, Homo sapiens
tcaatgcactgaca

SEQ ID NO: 3748055 - DNA, 11 bp, Homo sapiens
tcaatgtcact

SEQ ID NO: 3748056 - DNA, 13 bp, Homo sapiens
tcaatgttcattg

SEQ ID NO: 3748057 - DNA, 24 bp, Homo sapiens
tcaatgttcattgtaatgttactg

SEQ ID NO: 3748058 - DNA, 23 bp, Homo sapiens
tcaatgtttatgcaaggaaggaa

SEQ ID NO: 3748059 - DNA, 20 bp, Homo sapiens
tcaattagtaacattcatgt

SEQ ID NO: 3748060 - DNA, 17 bp, Homo sapiens
tcaattcaaaaatgtac

SEQ ID NO: 3748061 - DNA, 18 bp, Homo sapiens
tcaattcatatttatgaa

SEQ ID NO: 3748062 - DNA, 16 bp, Homo sapiens
tcaattcctctgggaa

SEQ ID NO: 3748063 - DNA, 16 bp, Homo sapiens
tcaatttgtataaaat

SEQ ID NO: 3748064 - DNA, 21 bp, Homo sapiens
tcaatttgttcagtctttcat

SEQ ID NO: 3748065 - DNA, 22 bp, Homo sapiens
tcacaaaattttattcctatat

SEQ ID NO: 3748066 - DNA, 20 bp, Homo sapiens
tcacaaatcctaaaagaagc

SEQ ID NO: 3748067 - DNA, 12 bp, Homo sapiens
tcacaacctctc

SEQ ID NO: 3748068 - DNA, 14 bp, Homo sapiens
tcacaaccttctgt

SEQ ID NO: 3748069 - DNA, 14 bp, Homo sapiens
tcacaagctgcctc

SEQ ID NO: 3748070 - DNA, 20 bp, Homo sapiens
tcacaagttgtgtttgatat

SEQ ID NO: 3748071 - DNA, 18 bp, Homo sapiens
tcacaataaatgtattca

SEQ ID NO: 3748072 - DNA, 22 bp, Homo sapiens
tcacaatgaaatgctctccttt

SEQ ID NO: 3748073 - DNA, 21 bp, Homo sapiens
tcacaatggtgctcatttcat

SEQ ID NO: 3748074 - DNA, 13 bp, Homo sapiens
tcacacaaagcag

SEQ ID NO: 3748075 - DNA, 22 bp, Homo sapiens
tcacacagtgagtcgaggacag

SEQ ID NO: 3748076 - DNA, 23 bp, Homo sapiens
tcacaccaggcttgcctgcaggc

SEQ ID NO: 3748077 - DNA, 21 bp, Homo sapiens
tcacactgcaagagccttggt

SEQ ID NO: 3748078 - DNA, 19 bp, Homo sapiens
tcacacttccaccagcctg

SEQ ID NO: 3748079 - DNA, 20 bp, Homo sapiens
tcacacttccaccagcctgc

SEQ ID NO: 3748080 - DNA, 23 bp, Homo sapiens
tcacacttctgtgagacccccac

SEQ ID NO: 3748081 - DNA, 21 bp, Homo sapiens
tcacagaacccttggagccaa

SEQ ID NO: 3748082 - DNA, 12 bp, Homo sapiens
tcacagaagaat

SEQ ID NO: 3748083 - DNA, 15 bp, Homo sapiens
tcacagagcagagtc

SEQ ID NO: 3748084 - DNA, 17 bp, Homo sapiens
tcacaggactctgcctc

SEQ ID NO: 3748085 - DNA, 19 bp, Homo sapiens
tcacaggactctgcctcct

SEQ ID NO: 3748086 - DNA, 12 bp, Homo sapiens
tcacaggcaggt

SEQ ID NO: 3748087 - DNA, 15 bp, Homo sapiens
tcacaggcaggtcca

SEQ ID NO: 3748088 - DNA, 18 bp, Homo sapiens
tcacaggcaggtccaggg

SEQ ID NO: 3748089 - DNA, 15 bp, Homo sapiens
tcacagggcagagcc

SEQ ID NO: 3748090 - DNA, 18 bp, Homo sapiens
tcacagggcagagccggg

SEQ ID NO: 3748091 - DNA, 16 bp, Homo sapiens
tcacagggccccagaa

SEQ ID NO: 3748092 - DNA, 17 bp, Homo sapiens
tcacagggttgggccca

SEQ ID NO: 3748093 - DNA, 23 bp, Homo sapiens
tcacaggtagacagtatataact

SEQ ID NO: 3748094 - DNA, 19 bp, Homo sapiens
tcacagtctctttaatctt

SEQ ID NO: 3748095 - DNA, 17 bp, Homo sapiens
tcacagtgggagccagg

SEQ ID NO: 3748096 - DNA, 14 bp, Homo sapiens
tcacagtgtttcga

SEQ ID NO: 3748097 - DNA, 18 bp, Homo sapiens
tcacagttcctcgccctg

SEQ ID NO: 3748098 - DNA, 20 bp, Homo sapiens
tcacagttcctcgccctggg

SEQ ID NO: 3748099 - DNA, 18 bp, Homo sapiens
tcacataaaatagatttt

SEQ ID NO: 3748100 - DNA, 18 bp, Homo sapiens
tcacatacaattattttt

SEQ ID NO: 3748101 - DNA, 16 bp, Homo sapiens
tcacatagatgtccct

SEQ ID NO: 3748102 - DNA, 17 bp, Homo sapiens
tcacatagatgtccctt

SEQ ID NO: 3748103 - DNA, 14 bp, Homo sapiens
tcacatagtgaaag

SEQ ID NO: 3748104 - DNA, 16 bp, Homo sapiens
tcacatagtgaaagtt

SEQ ID NO: 3748105 - DNA, 13 bp, Homo sapiens
tcacatcacagga

SEQ ID NO: 3748106 - DNA, 20 bp, Homo sapiens
tcacatctttcacacttcca

SEQ ID NO: 3748107 - DNA, 12 bp, Homo sapiens
tcacatgctgga

SEQ ID NO: 3748108 - DNA, 13 bp, Homo sapiens
tcacatgctggac

SEQ ID NO: 3748109 - DNA, 17 bp, Homo sapiens
tcacatttattctgctc

SEQ ID NO: 3748110 - DNA, 18 bp, Homo sapiens
tcacatttattctgctca

SEQ ID NO: 3748111 - DNA, 19 bp, Homo sapiens
tcaccaaatcagctgctac

SEQ ID NO: 3748112 - DNA, 14 bp, Homo sapiens
tcaccaccttccca

SEQ ID NO: 3748113 - DNA, 15 bp, Homo sapiens
tcaccaccttcccag

SEQ ID NO: 3748114 - DNA, 21 bp, Homo sapiens
tcaccagatttgctaatttat

SEQ ID NO: 3748115 - DNA, 16 bp, Homo sapiens
tcaccatctcaggcca

SEQ ID NO: 3748116 - DNA, 17 bp, Homo sapiens
tcaccatctcaggccac

SEQ ID NO: 3748117 - DNA, 16 bp, Homo sapiens
tcaccatgtaaaacaa

SEQ ID NO: 3748118 - DNA, 19 bp, Homo sapiens
tcaccatgtaaaacaaaaa

SEQ ID NO: 3748119 - DNA, 16 bp, Homo sapiens
tcacccacagaaagag

SEQ ID NO: 3748120 - DNA, 12 bp, Homo sapiens
tcacccacaggg

SEQ ID NO: 3748121 - DNA, 12 bp, Homo sapiens
tcaccccaccct

SEQ ID NO: 3748122 - DNA, 13 bp, Homo sapiens
tcaccccaccctt

SEQ ID NO: 3748123 - DNA, 13 bp, Homo sapiens
tcaccccatccca

SEQ ID NO: 3748124 - DNA, 12 bp, Homo sapiens
tcacccctccac

SEQ ID NO: 3748125 - DNA, 14 bp, Homo sapiens
tcacccctgccctg

SEQ ID NO: 3748126 - DNA, 17 bp, Homo sapiens
tcaccctacctgtgcct

SEQ ID NO: 3748127 - DNA, 14 bp, Homo sapiens
tcaccggagctttc

SEQ ID NO: 3748128 - DNA, 23 bp, Homo sapiens
tcaccggagctttcaaagaagga

SEQ ID NO: 3748129 - DNA, 15 bp, Homo sapiens
tcacctactttgtaa

SEQ ID NO: 3748130 - DNA, 14 bp, Homo sapiens
tcacctcccctcct

SEQ ID NO: 3748131 - DNA, 20 bp, Homo sapiens
tcacctctaaaacagtcctt

SEQ ID NO: 3748132 - DNA, 15 bp, Homo sapiens
tcacctctgcctcaa

SEQ ID NO: 3748133 - DNA, 23 bp, Homo sapiens
tcacctcttatgcacacctccca

SEQ ID NO: 3748134 - DNA, 19 bp, Homo sapiens
tcacctgaagactcattct

SEQ ID NO: 3748135 - DNA, 21 bp, Homo sapiens
tcacctgagcccggatgcttc

SEQ ID NO: 3748136 - DNA, 23 bp, Homo sapiens
tcacctgcccagatcccagaagg

SEQ ID NO: 3748137 - DNA, 15 bp, Homo sapiens
tcacctgctggcccc

SEQ ID NO: 3748138 - DNA, 16 bp, Homo sapiens
tcacctgctggcccct

SEQ ID NO: 3748139 - DNA, 13 bp, Homo sapiens
tcacctgtaaaac

SEQ ID NO: 3748140 - DNA, 20 bp, Homo sapiens
tcacctgtttttaagctgtt

SEQ ID NO: 3748141 - DNA, 18 bp, Homo sapiens
tcaccttaggcagggaag

SEQ ID NO: 3748142 - DNA, 16 bp, Homo sapiens
tcacgcacctcccatc

SEQ ID NO: 3748143 - DNA, 17 bp, Homo sapiens
tcacgcacctcccatcc

SEQ ID NO: 3748144 - DNA, 16 bp, Homo sapiens
tcacgccactgcacta

SEQ ID NO: 3748145 - DNA, 16 bp, Homo sapiens
tcacgccactgcactc

SEQ ID NO: 3748146 - DNA, 21 bp, Homo sapiens
tcacgcctatgatcccagcac

SEQ ID NO: 3748147 - DNA, 19 bp, Homo sapiens
tcacgcctgtaatcccagc

SEQ ID NO: 3748148 - DNA, 23 bp, Homo sapiens
tcacgctcccaacacaaggtggg

SEQ ID NO: 3748149 - DNA, 16 bp, Homo sapiens
tcacggaagagccttg

SEQ ID NO: 3748150 - DNA, 22 bp, Homo sapiens
tcacgtaagatacaagtttcag

SEQ ID NO: 3748151 - DNA, 22 bp, Homo sapiens
tcactacccatcggtgtccatt

SEQ ID NO: 3748152 - DNA, 13 bp, Homo sapiens
tcactataaatgg

SEQ ID NO: 3748153 - DNA, 17 bp, Homo sapiens
tcactatgttgcccagg

SEQ ID NO: 3748154 - DNA, 19 bp, Homo sapiens
tcactatgttgcccaggca

SEQ ID NO: 3748155 - DNA, 20 bp, Homo sapiens
tcactcaagttcaaggacca

SEQ ID NO: 3748156 - DNA, 21 bp, Homo sapiens
tcactcaagttcaaggaccaa

SEQ ID NO: 3748157 - DNA, 14 bp, Homo sapiens
tcactccagcctgg

SEQ ID NO: 3748158 - DNA, 21 bp, Homo sapiens
tcactccaggaaggggctgga

SEQ ID NO: 3748159 - DNA, 20 bp, Homo sapiens
tcactcctggggcctcttgg

SEQ ID NO: 3748160 - DNA, 13 bp, Homo sapiens
tcactctcagtgc

SEQ ID NO: 3748161 - DNA, 12 bp, Homo sapiens
tcactctgtcgc

SEQ ID NO: 3748162 - DNA, 16 bp, Homo sapiens
tcactctgtcgcccag

SEQ ID NO: 3748163 - DNA, 20 bp, Homo sapiens
tcactcttattgcccacgct

SEQ ID NO: 3748164 - DNA, 23 bp, Homo sapiens
tcactgaaacttcaagcaccagg

SEQ ID NO: 3748165 - DNA, 16 bp, Homo sapiens
tcactgaagcttttta

SEQ ID NO: 3748166 - DNA, 19 bp, Homo sapiens
tcactgacacaaaaagtag

SEQ ID NO: 3748167 - DNA, 22 bp, Homo sapiens
tcactgcacagtgcatctcagc

SEQ ID NO: 3748168 - DNA, 11 bp, Homo sapiens
tcactgcctct

SEQ ID NO: 3748169 - DNA, 14 bp, Homo sapiens
tcactgctcacact

SEQ ID NO: 3748170 - DNA, 18 bp, Homo sapiens
tcactgctggctgcctta

SEQ ID NO: 3748171 - DNA, 17 bp, Homo sapiens
tcactggagcaccaggc

SEQ ID NO: 3748172 - DNA, 17 bp, Homo sapiens
tcactggagcccaggag

SEQ ID NO: 3748173 - DNA, 17 bp, Homo sapiens
tcactggggtcctgggg

SEQ ID NO: 3748174 - DNA, 18 bp, Homo sapiens
tcactgggtggggtgagg

SEQ ID NO: 3748175 - DNA, 18 bp, Homo sapiens
tcactgttgcccaggctg

SEQ ID NO: 3748176 - DNA, 14 bp, Homo sapiens
tcactgtttctctg

SEQ ID NO: 3748177 - DNA, 18 bp, Homo sapiens
tcactgtttctctgctgt

SEQ ID NO: 3748178 - DNA, 20 bp, Homo sapiens
tcactgtttctctgctgttg

SEQ ID NO: 3748179 - DNA, 19 bp, Homo sapiens
tcacttatcccaagagaat

SEQ ID NO: 3748180 - DNA, 15 bp, Homo sapiens
tcacttcaccctgga

SEQ ID NO: 3748181 - DNA, 10 bp, Homo sapiens
tcacttgagt

SEQ ID NO: 3748182 - DNA, 14 bp, Homo sapiens
tcacttgtacaaaa

SEQ ID NO: 3748183 - DNA, 17 bp, Homo sapiens
tcacttgtacaaaataa

SEQ ID NO: 3748184 - DNA, 13 bp, Homo sapiens
tcacttgtgtttt

SEQ ID NO: 3748185 - DNA, 17 bp, Homo sapiens
tcactttcacatagatg

SEQ ID NO: 3748186 - DNA, 14 bp, Homo sapiens
tcactttgctctga

SEQ ID NO: 3748187 - DNA, 12 bp, Homo sapiens
tcacttttcctc

SEQ ID NO: 3748188 - DNA, 18 bp, Homo sapiens
tcacttttcctccctcag

SEQ ID NO: 3748189 - DNA, 21 bp, Homo sapiens
tcacttttctgtaacgcctgc

SEQ ID NO: 3748190 - DNA, 16 bp, Homo sapiens
tcagaaaaacaataag

SEQ ID NO: 3748191 - DNA, 16 bp, Homo sapiens
tcagaaaacagaaaaa

SEQ ID NO: 3748192 - DNA, 13 bp, Homo sapiens
tcagaaaccagtt

SEQ ID NO: 3748193 - DNA, 15 bp, Homo sapiens
tcagaacacattctt

SEQ ID NO: 3748194 - DNA, 20 bp, Homo sapiens
tcagaagcctgaggctggga

SEQ ID NO: 3748195 - DNA, 13 bp, Homo sapiens
tcagaaggagaag

SEQ ID NO: 3748196 - DNA, 19 bp, Homo sapiens
tcagaaggagaaggaagga

SEQ ID NO: 3748197 - DNA, 23 bp, Homo sapiens
tcagaaggagaaggaaggagact

SEQ ID NO: 3748198 - DNA, 18 bp, Homo sapiens
tcagaatctcaaataact

SEQ ID NO: 3748199 - DNA, 17 bp, Homo sapiens
tcagaatctctcttctt

SEQ ID NO: 3748200 - DNA, 14 bp, Homo sapiens
tcagaatctttcct

SEQ ID NO: 3748201 - DNA, 15 bp, Homo sapiens
tcagaatctttcctt

SEQ ID NO: 3748202 - DNA, 18 bp, Homo sapiens
tcagacagaacccctaca

SEQ ID NO: 3748203 - DNA, 22 bp, Homo sapiens
tcagacagggtctgaaggactg

SEQ ID NO: 3748204 - DNA, 23 bp, Homo sapiens
tcagaccataatgttacattatt

SEQ ID NO: 3748205 - DNA, 12 bp, Homo sapiens
tcagacccccac

SEQ ID NO: 3748206 - DNA, 13 bp, Homo sapiens
tcagacctgtctt

SEQ ID NO: 3748207 - DNA, 18 bp, Homo sapiens
tcagacctgtcttccaag

SEQ ID NO: 3748208 - DNA, 20 bp, Homo sapiens
tcagacctgtcttccaagga

SEQ ID NO: 3748209 - DNA, 19 bp, Homo sapiens
tcagactgaacatgtacac

SEQ ID NO: 3748210 - DNA, 15 bp, Homo sapiens
tcagactgctgggac

SEQ ID NO: 3748211 - DNA, 17 bp, Homo sapiens
tcagactgctgggactg

SEQ ID NO: 3748212 - DNA, 15 bp, Homo sapiens
tcagactgctttaaa

SEQ ID NO: 3748213 - DNA, 13 bp, Homo sapiens
tcagagaatttct

SEQ ID NO: 3748214 - DNA, 14 bp, Homo sapiens
tcagagactcaggg

SEQ ID NO: 3748215 - DNA, 20 bp, Homo sapiens
tcagagactcagggccccag

SEQ ID NO: 3748216 - DNA, 14 bp, Homo sapiens
tcagagagagtgtt

SEQ ID NO: 3748217 - DNA, 16 bp, Homo sapiens
tcagagaggccttttg

SEQ ID NO: 3748218 - DNA, 12 bp, Homo sapiens
tcagagcctgca

SEQ ID NO: 3748219 - DNA, 15 bp, Homo sapiens
tcagagcctgcagtt

SEQ ID NO: 3748220 - DNA, 14 bp, Homo sapiens
tcagagggcccaaa

SEQ ID NO: 3748221 - DNA, 20 bp, Homo sapiens
tcagagggcccaaatggcag

SEQ ID NO: 3748222 - DNA, 17 bp, Homo sapiens
tcagaggtggctctgga

SEQ ID NO: 3748223 - DNA, 14 bp, Homo sapiens
tcagagtccaggcc

SEQ ID NO: 3748224 - DNA, 16 bp, Homo sapiens
tcagatatatttttca

SEQ ID NO: 3748225 - DNA, 13 bp, Homo sapiens
tcagatatttata

SEQ ID NO: 3748226 - DNA, 21 bp, Homo sapiens
tcagatatttatatttttatt

SEQ ID NO: 3748227 - DNA, 13 bp, Homo sapiens
tcagatcagtgct

SEQ ID NO: 3748228 - DNA, 21 bp, Homo sapiens
tcagatgcccagagggcccag

SEQ ID NO: 3748229 - DNA, 14 bp, Homo sapiens
tcagatgcttctgg

SEQ ID NO: 3748230 - DNA, 23 bp, Homo sapiens
tcagatggaaccgcaggaagctg

SEQ ID NO: 3748231 - DNA, 21 bp, Homo sapiens
tcagattcccagagcaaaata

SEQ ID NO: 3748232 - DNA, 19 bp, Homo sapiens
tcagattcctttcccttta

SEQ ID NO: 3748233 - DNA, 15 bp, Homo sapiens
tcagattttcctgtg

SEQ ID NO: 3748234 - DNA, 16 bp, Homo sapiens
tcagattttcctgtgg

SEQ ID NO: 3748235 - DNA, 12 bp, Homo sapiens
tcagcaccaccc

SEQ ID NO: 3748236 - DNA, 23 bp, Homo sapiens
tcagcaccaccctagtcccttcc

SEQ ID NO: 3748237 - DNA, 17 bp, Homo sapiens
tcagcacccccttctct

SEQ ID NO: 3748238 - DNA, 12 bp, Homo sapiens
tcagcagccctc

SEQ ID NO: 3748239 - DNA, 16 bp, Homo sapiens
tcagcagccctcctca

SEQ ID NO: 3748240 - DNA, 17 bp, Homo sapiens
tcagcatcctggcaccc

SEQ ID NO: 3748241 - DNA, 15 bp, Homo sapiens
tcagcattattgaaa

SEQ ID NO: 3748242 - DNA, 20 bp, Homo sapiens
tcagcattctcactcctacc

SEQ ID NO: 3748243 - DNA, 23 bp, Homo sapiens
tcagcattctcactcctacctgg

SEQ ID NO: 3748244 - DNA, 18 bp, Homo sapiens
tcagcattcttagcctgt

SEQ ID NO: 3748245 - DNA, 20 bp, Homo sapiens
tcagcattcttagcctgtgg

SEQ ID NO: 3748246 - DNA, 14 bp, Homo sapiens
tcagccaaatgtaa

SEQ ID NO: 3748247 - DNA, 19 bp, Homo sapiens
tcagccaggagctgggcag

SEQ ID NO: 3748248 - DNA, 20 bp, Homo sapiens
tcagccagtgaccaaccttt

SEQ ID NO: 3748249 - DNA, 23 bp, Homo sapiens
tcagccatgaggagttgctgttt

SEQ ID NO: 3748250 - DNA, 12 bp, Homo sapiens
tcagcccacccc

SEQ ID NO: 3748251 - DNA, 14 bp, Homo sapiens
tcagccccagccca

SEQ ID NO: 3748252 - DNA, 15 bp, Homo sapiens
tcagcccctcctctg

SEQ ID NO: 3748253 - DNA, 17 bp, Homo sapiens
tcagcccctcctctgcc

SEQ ID NO: 3748254 - DNA, 20 bp, Homo sapiens
tcagcccctcctctgccacc

SEQ ID NO: 3748255 - DNA, 23 bp, Homo sapiens
tcagcccctcctctgccacctcc

SEQ ID NO: 3748256 - DNA, 20 bp, Homo sapiens
tcagcccctcttgcccccca

SEQ ID NO: 3748257 - DNA, 21 bp, Homo sapiens
tcagcccctcttgccccccac

SEQ ID NO: 3748258 - DNA, 22 bp, Homo sapiens
tcagcccctcttgccccccacc

SEQ ID NO: 3748259 - DNA, 23 bp, Homo sapiens
tcagcccctcttgccccccaccc

SEQ ID NO: 3748260 - DNA, 13 bp, Homo sapiens
tcagccctcagaa

SEQ ID NO: 3748261 - DNA, 13 bp, Homo sapiens
tcagccctccctg

SEQ ID NO: 3748262 - DNA, 23 bp, Homo sapiens
tcagccctgaggtgaaagggagc

SEQ ID NO: 3748263 - DNA, 23 bp, Homo sapiens
tcagccctgcccttcagcatcct

SEQ ID NO: 3748264 - DNA, 19 bp, Homo sapiens
tcagccctgggccccacca

SEQ ID NO: 3748265 - DNA, 21 bp, Homo sapiens
tcagccctgggccccaccacc

SEQ ID NO: 3748266 - DNA, 23 bp, Homo sapiens
tcagcctagccgacctcagcctt

SEQ ID NO: 3748267 - DNA, 13 bp, Homo sapiens
tcagcctcccaaa

SEQ ID NO: 3748268 - DNA, 12 bp, Homo sapiens
tcagcctcccga

SEQ ID NO: 3748269 - DNA, 22 bp, Homo sapiens
tcagcctcccgaatagctggga

SEQ ID NO: 3748270 - DNA, 18 bp, Homo sapiens
tcagcctcccgagtagct

SEQ ID NO: 3748271 - DNA, 22 bp, Homo sapiens
tcagcctcccgagtagctggga

SEQ ID NO: 3748272 - DNA, 20 bp, Homo sapiens
tcagcctcctgtgtagctgg

SEQ ID NO: 3748273 - DNA, 18 bp, Homo sapiens
tcagcctgaggctgagac

SEQ ID NO: 3748274 - DNA, 16 bp, Homo sapiens
tcagcctgtgctgccc

SEQ ID NO: 3748275 - DNA, 15 bp, Homo sapiens
tcagcctttaagata

SEQ ID NO: 3748276 - DNA, 17 bp, Homo sapiens
tcagcggggacagctcc

SEQ ID NO: 3748277 - DNA, 18 bp, Homo sapiens
tcagctaaagcccaacct

SEQ ID NO: 3748278 - DNA, 15 bp, Homo sapiens
tcagctccagctcac

SEQ ID NO: 3748279 - DNA, 18 bp, Homo sapiens
tcagctccagctcaccag

SEQ ID NO: 3748280 - DNA, 23 bp, Homo sapiens
tcagctccagctcaccagcccca

SEQ ID NO: 3748281 - DNA, 12 bp, Homo sapiens
tcagctgcctca

SEQ ID NO: 3748282 - DNA, 23 bp, Homo sapiens
tcagctgtaagaagagactggga

SEQ ID NO: 3748283 - DNA, 13 bp, Homo sapiens
tcagcttcttaat

SEQ ID NO: 3748284 - DNA, 16 bp, Homo sapiens
tcagctttgccttcca

SEQ ID NO: 3748285 - DNA, 20 bp, Homo sapiens
tcaggaaaactgacagagga

SEQ ID NO: 3748286 - DNA, 20 bp, Homo sapiens
tcaggaaacatatttaagaa

SEQ ID NO: 3748287 - DNA, 14 bp, Homo sapiens
tcaggaaagacgga

SEQ ID NO: 3748288 - DNA, 19 bp, Homo sapiens
tcaggaaatatatatgtgt

SEQ ID NO: 3748289 - DNA, 18 bp, Homo sapiens
tcaggaacagctatggga

SEQ ID NO: 3748290 - DNA, 22 bp, Homo sapiens
tcaggaacctggaccaaagctg

SEQ ID NO: 3748291 - DNA, 18 bp, Homo sapiens
tcaggaaggatgagcatt

SEQ ID NO: 3748292 - DNA, 18 bp, Homo sapiens
tcaggaccctcgctggcc

SEQ ID NO: 3748293 - DNA, 19 bp, Homo sapiens
tcaggacgagaatgagggt

SEQ ID NO: 3748294 - DNA, 13 bp, Homo sapiens
tcaggactccagc

SEQ ID NO: 3748295 - DNA, 15 bp, Homo sapiens
tcaggacttggtctg

SEQ ID NO: 3748296 - DNA, 20 bp, Homo sapiens
tcaggaggctgaggcagaag

SEQ ID NO: 3748297 - DNA, 14 bp, Homo sapiens
tcaggaggctggag

SEQ ID NO: 3748298 - DNA, 21 bp, Homo sapiens
tcaggaggctggaggaagggg

SEQ ID NO: 3748299 - DNA, 19 bp, Homo sapiens
tcaggagtcccaaggaaag

SEQ ID NO: 3748300 - DNA, 12 bp, Homo sapiens
tcaggagttcct

SEQ ID NO: 3748301 - DNA, 20 bp, Homo sapiens
tcaggatcaaaccccgacca

SEQ ID NO: 3748302 - DNA, 13 bp, Homo sapiens
tcaggatgcccag

SEQ ID NO: 3748303 - DNA, 22 bp, Homo sapiens
tcaggatgcccagggccactct

SEQ ID NO: 3748304 - DNA, 22 bp, Homo sapiens
tcaggcataggcctgggtgctg

SEQ ID NO: 3748305 - DNA, 16 bp, Homo sapiens
tcaggcatgcctgtgt

SEQ ID NO: 3748306 - DNA, 18 bp, Homo sapiens
tcaggccaaccccaaaga

SEQ ID NO: 3748307 - DNA, 19 bp, Homo sapiens
tcaggccacctgccccctt

SEQ ID NO: 3748308 - DNA, 21 bp, Homo sapiens
tcaggccacctgcccccttct

SEQ ID NO: 3748309 - DNA, 14 bp, Homo sapiens
tcaggccacggcag

SEQ ID NO: 3748310 - DNA, 13 bp, Homo sapiens
tcaggccacttga

SEQ ID NO: 3748311 - DNA, 16 bp, Homo sapiens
tcaggccaggtgcagt

SEQ ID NO: 3748312 - DNA, 17 bp, Homo sapiens
tcaggccaggtgcagtg

SEQ ID NO: 3748313 - DNA, 18 bp, Homo sapiens
tcaggccaggtgcagtgg

SEQ ID NO: 3748314 - DNA, 22 bp, Homo sapiens
tcaggcctataaccccagctcc

SEQ ID NO: 3748315 - DNA, 17 bp, Homo sapiens
tcaggcctccctctctc

SEQ ID NO: 3748316 - DNA, 14 bp, Homo sapiens
tcaggctctgccct

SEQ ID NO: 3748317 - DNA, 15 bp, Homo sapiens
tcaggctcttctcct

SEQ ID NO: 3748318 - DNA, 16 bp, Homo sapiens
tcaggctcttctcctt

SEQ ID NO: 3748319 - DNA, 15 bp, Homo sapiens
tcaggctgcttggga

SEQ ID NO: 3748320 - DNA, 17 bp, Homo sapiens
tcagggaacatatttaa

SEQ ID NO: 3748321 - DNA, 15 bp, Homo sapiens
tcagggaagcccagc

SEQ ID NO: 3748322 - DNA, 19 bp, Homo sapiens
tcagggaagcccagctcca

SEQ ID NO: 3748323 - DNA, 22 bp, Homo sapiens
tcagggaatttcaggaactaga

SEQ ID NO: 3748324 - DNA, 21 bp, Homo sapiens
tcagggacagagacacctgca

SEQ ID NO: 3748325 - DNA, 14 bp, Homo sapiens
tcagggaccaagga

SEQ ID NO: 3748326 - DNA, 16 bp, Homo sapiens
tcagggcagggctctg

SEQ ID NO: 3748327 - DNA, 14 bp, Homo sapiens
tcagggccccagca

SEQ ID NO: 3748328 - DNA, 23 bp, Homo sapiens
tcagggccccagcactaaagcag

SEQ ID NO: 3748329 - DNA, 12 bp, Homo sapiens
tcagggctgaca

SEQ ID NO: 3748330 - DNA, 16 bp, Homo sapiens
tcaggggagtcccgtc

SEQ ID NO: 3748331 - DNA, 20 bp, Homo sapiens
tcaggggagtcccgtcagga

SEQ ID NO: 3748332 - DNA, 13 bp, Homo sapiens
tcagggggccagg

SEQ ID NO: 3748333 - DNA, 23 bp, Homo sapiens
tcaggggtcgtcaccacctctcc

SEQ ID NO: 3748334 - DNA, 21 bp, Homo sapiens
tcagggttctcctctcccctc

SEQ ID NO: 3748335 - DNA, 16 bp, Homo sapiens
tcagggttggcccctg

SEQ ID NO: 3748336 - DNA, 19 bp, Homo sapiens
tcagggttggcccctgccc

SEQ ID NO: 3748337 - DNA, 23 bp, Homo sapiens
tcagggttggcccctgcccggct

SEQ ID NO: 3748338 - DNA, 13 bp, Homo sapiens
tcaggtaacaggc

SEQ ID NO: 3748339 - DNA, 23 bp, Homo sapiens
tcaggtaacaggcagatacagga

SEQ ID NO: 3748340 - DNA, 15 bp, Homo sapiens
tcaggtcagggtgag

SEQ ID NO: 3748341 - DNA, 15 bp, Homo sapiens
tcaggtgagaagcag

SEQ ID NO: 3748342 - DNA, 23 bp, Homo sapiens
tcaggtgatccacccacctcagc

SEQ ID NO: 3748343 - DNA, 13 bp, Homo sapiens
tcaggtgctgcca

SEQ ID NO: 3748344 - DNA, 14 bp, Homo sapiens
tcaggtgctgccat

SEQ ID NO: 3748345 - DNA, 18 bp, Homo sapiens
tcaggtgctgccatccag

SEQ ID NO: 3748346 - DNA, 14 bp, Homo sapiens
tcaggtggggcagc

SEQ ID NO: 3748347 - DNA, 15 bp, Homo sapiens
tcaggtggggcagct

SEQ ID NO: 3748348 - DNA, 19 bp, Homo sapiens
tcaggtggggcagcttgag

SEQ ID NO: 3748349 - DNA, 21 bp, Homo sapiens
tcaggtggggcagcttgaggg

SEQ ID NO: 3748350 - DNA, 15 bp, Homo sapiens
tcaggttatactcct

SEQ ID NO: 3748351 - DNA, 19 bp, Homo sapiens
tcaggttgtagtaaagaaa

SEQ ID NO: 3748352 - DNA, 22 bp, Homo sapiens
tcaggttgtctgaagtcactgc

SEQ ID NO: 3748353 - DNA, 13 bp, Homo sapiens
tcaggttttgtaa

SEQ ID NO: 3748354 - DNA, 14 bp, Homo sapiens
tcaggttttgtaaa

SEQ ID NO: 3748355 - DNA, 19 bp, Homo sapiens
tcagtaataaactgtgttt

SEQ ID NO: 3748356 - DNA, 18 bp, Homo sapiens
tcagtaatttgaggacaa

SEQ ID NO: 3748357 - DNA, 13 bp, Homo sapiens
tcagtacccacct

SEQ ID NO: 3748358 - DNA, 22 bp, Homo sapiens
tcagtacccacctgagctttgg

SEQ ID NO: 3748359 - DNA, 21 bp, Homo sapiens
tcagtattaaaggggggaggg

SEQ ID NO: 3748360 - DNA, 14 bp, Homo sapiens
tcagtctcaggagc

SEQ ID NO: 3748361 - DNA, 21 bp, Homo sapiens
tcagtctgattcccaagctct

SEQ ID NO: 3748362 - DNA, 23 bp, Homo sapiens
tcagtctgcacttaaatatcaat

SEQ ID NO: 3748363 - DNA, 15 bp, Homo sapiens
tcagtctggcccttc

SEQ ID NO: 3748364 - DNA, 17 bp, Homo sapiens
tcagtgaggcccaggga

SEQ ID NO: 3748365 - DNA, 19 bp, Homo sapiens
tcagtgatgtaccatgaaa

SEQ ID NO: 3748366 - DNA, 14 bp, Homo sapiens
tcagtgcaaagatt

SEQ ID NO: 3748367 - DNA, 12 bp, Homo sapiens
tcagtgccacta

SEQ ID NO: 3748368 - DNA, 13 bp, Homo sapiens
tcagtgcccacca

SEQ ID NO: 3748369 - DNA, 12 bp, Homo sapiens
tcagtgctgtgg

SEQ ID NO: 3748370 - DNA, 14 bp, Homo sapiens
tcagtgctgtggcc

SEQ ID NO: 3748371 - DNA, 17 bp, Homo sapiens
tcagtgctgtggcctgg

SEQ ID NO: 3748372 - DNA, 23 bp, Homo sapiens
tcagtggactttccaccccctcc

SEQ ID NO: 3748373 - DNA, 11 bp, Homo sapiens
tcagtggcagc

SEQ ID NO: 3748374 - DNA, 13 bp, Homo sapiens
tcagtggcagctg

SEQ ID NO: 3748375 - DNA, 14 bp, Homo sapiens
tcagtgggagaaaa

SEQ ID NO: 3748376 - DNA, 20 bp, Homo sapiens
tcagtggttatttagggaac

SEQ ID NO: 3748377 - DNA, 15 bp, Homo sapiens
tcagtgtagccccaa

SEQ ID NO: 3748378 - DNA, 19 bp, Homo sapiens
tcagtgtagccccaagaag

SEQ ID NO: 3748379 - DNA, 22 bp, Homo sapiens
tcagtgtatggaaataaatgta

SEQ ID NO: 3748380 - DNA, 15 bp, Homo sapiens
tcagtgttaaaaaat

SEQ ID NO: 3748381 - DNA, 16 bp, Homo sapiens
tcagtgttaaaaaatt

SEQ ID NO: 3748382 - DNA, 14 bp, Homo sapiens
tcagttaagaaaaa

SEQ ID NO: 3748383 - DNA, 20 bp, Homo sapiens
tcagttcccttggcctcaga

SEQ ID NO: 3748384 - DNA, 23 bp, Homo sapiens
tcagttgagcttcatataccagc

SEQ ID NO: 3748385 - DNA, 13 bp, Homo sapiens
tcagttttaacta

SEQ ID NO: 3748386 - DNA, 16 bp, Homo sapiens
tcagttttatcatttt

SEQ ID NO: 3748387 - DNA, 16 bp, Homo sapiens
tcataaaataaagtat

SEQ ID NO: 3748388 - DNA, 16 bp, Homo sapiens
tcataactgtgtcatt

SEQ ID NO: 3748389 - DNA, 17 bp, Homo sapiens
tcataactttcattaaa

SEQ ID NO: 3748390 - DNA, 23 bp, Homo sapiens
tcatacaatgacaagtatgatga

SEQ ID NO: 3748391 - DNA, 13 bp, Homo sapiens
tcatagaaatgta

SEQ ID NO: 3748392 - DNA, 12 bp, Homo sapiens
tcatagaagaac

SEQ ID NO: 3748393 - DNA, 14 bp, Homo sapiens
tcatagatttctga

SEQ ID NO: 3748394 - DNA, 23 bp, Homo sapiens
tcatagatttctgattttatgta

SEQ ID NO: 3748395 - DNA, 18 bp, Homo sapiens
tcatagcagattttaatt

SEQ ID NO: 3748396 - DNA, 12 bp, Homo sapiens
tcatagctgaga

SEQ ID NO: 3748397 - DNA, 17 bp, Homo sapiens
tcatagctgagattcct

SEQ ID NO: 3748398 - DNA, 22 bp, Homo sapiens
tcatagtactctttgtagcaaa

SEQ ID NO: 3748399 - DNA, 19 bp, Homo sapiens
tcatagtatggtggctggg

SEQ ID NO: 3748400 - DNA, 18 bp, Homo sapiens
tcatataagattcatatt

SEQ ID NO: 3748401 - DNA, 16 bp, Homo sapiens
tcatataataaatgta

SEQ ID NO: 3748402 - DNA, 17 bp, Homo sapiens
tcatataccagcaatat

SEQ ID NO: 3748403 - DNA, 18 bp, Homo sapiens
tcatatatggggggccaa

SEQ ID NO: 3748404 - DNA, 21 bp, Homo sapiens
tcatatgtaccatgtacatga

SEQ ID NO: 3748405 - DNA, 20 bp, Homo sapiens
tcatatttacttcttataca

SEQ ID NO: 3748406 - DNA, 22 bp, Homo sapiens
tcatatttacttcttatacatt

SEQ ID NO: 3748407 - DNA, 16 bp, Homo sapiens
tcatcagtgttaaaaa

SEQ ID NO: 3748408 - DNA, 17 bp, Homo sapiens
tcatcattccttgagaa

SEQ ID NO: 3748409 - DNA, 19 bp, Homo sapiens
tcatccactgtgccatgtg

SEQ ID NO: 3748410 - DNA, 23 bp, Homo sapiens
tcatccactgtgccatgtgccag

SEQ ID NO: 3748411 - DNA, 12 bp, Homo sapiens
tcatccccaggg

SEQ ID NO: 3748412 - DNA, 21 bp, Homo sapiens
tcatccccaggggtcccagcc

SEQ ID NO: 3748413 - DNA, 14 bp, Homo sapiens
tcatccgaggcagg

SEQ ID NO: 3748414 - DNA, 17 bp, Homo sapiens
tcatccggcagcctgga

SEQ ID NO: 3748415 - DNA, 12 bp, Homo sapiens
tcatcctgcagg

SEQ ID NO: 3748416 - DNA, 14 bp, Homo sapiens
tcatccttttctcc

SEQ ID NO: 3748417 - DNA, 22 bp, Homo sapiens
tcatctaccattttctggttct

SEQ ID NO: 3748418 - DNA, 16 bp, Homo sapiens
tcatctaccttttctc

SEQ ID NO: 3748419 - DNA, 11 bp, Homo sapiens
tcatctatttc

SEQ ID NO: 3748420 - DNA, 14 bp, Homo sapiens
tcatctatttctga

SEQ ID NO: 3748421 - DNA, 18 bp, Homo sapiens
tcatctatttctgagaag

SEQ ID NO: 3748422 - DNA, 20 bp, Homo sapiens
tcatctcaggcctccctcaa

SEQ ID NO: 3748423 - DNA, 22 bp, Homo sapiens
tcatcttgaccaagcaggaagc

SEQ ID NO: 3748424 - DNA, 12 bp, Homo sapiens
tcatgaacacat

SEQ ID NO: 3748425 - DNA, 12 bp, Homo sapiens
tcatgaagccca

SEQ ID NO: 3748426 - DNA, 19 bp, Homo sapiens
tcatgatctccctgccgcc

SEQ ID NO: 3748427 - DNA, 14 bp, Homo sapiens
tcatgattagcaag

SEQ ID NO: 3748428 - DNA, 17 bp, Homo sapiens
tcatgcatagtcccagc

SEQ ID NO: 3748429 - DNA, 22 bp, Homo sapiens
tcatgccaccatggccagccaa

SEQ ID NO: 3748430 - DNA, 13 bp, Homo sapiens
tcatgcctttgta

SEQ ID NO: 3748431 - DNA, 14 bp, Homo sapiens
tcatgcctttgtaa

SEQ ID NO: 3748432 - DNA, 17 bp, Homo sapiens
tcatgcctttgtaagtt

SEQ ID NO: 3748433 - DNA, 16 bp, Homo sapiens
tcatggctcactgcag

SEQ ID NO: 3748434 - DNA, 18 bp, Homo sapiens
tcatggctcactgcagcc

SEQ ID NO: 3748435 - DNA, 19 bp, Homo sapiens
tcatggctcactgcagcct

SEQ ID NO: 3748436 - DNA, 17 bp, Homo sapiens
tcatgggcccctctgac

SEQ ID NO: 3748437 - DNA, 13 bp, Homo sapiens
tcatgtaaattac

SEQ ID NO: 3748438 - DNA, 18 bp, Homo sapiens
tcatgtggaatataaaga

SEQ ID NO: 3748439 - DNA, 21 bp, Homo sapiens
tcatgttaatcctagctgtgt

SEQ ID NO: 3748440 - DNA, 15 bp, Homo sapiens
tcattaaagcattta

SEQ ID NO: 3748441 - DNA, 23 bp, Homo sapiens
tcattataaacgtgatgatcagc

SEQ ID NO: 3748442 - DNA, 14 bp, Homo sapiens
tcattattggaatt

SEQ ID NO: 3748443 - DNA, 14 bp, Homo sapiens
tcattatttattaa

SEQ ID NO: 3748444 - DNA, 18 bp, Homo sapiens
tcattcaaaagttgaaat

SEQ ID NO: 3748445 - DNA, 23 bp, Homo sapiens
tcattccaccttcccatgccctg

SEQ ID NO: 3748446 - DNA, 12 bp, Homo sapiens
tcattccccagg

SEQ ID NO: 3748447 - DNA, 13 bp, Homo sapiens
tcattcctgcctg

SEQ ID NO: 3748448 - DNA, 17 bp, Homo sapiens
tcattcctgcctgtctc

SEQ ID NO: 3748449 - DNA, 14 bp, Homo sapiens
tcattgaagtattt

SEQ ID NO: 3748450 - DNA, 15 bp, Homo sapiens
tcattgatatgaaaa

SEQ ID NO: 3748451 - DNA, 19 bp, Homo sapiens
tcattgatatgaaaaatat

SEQ ID NO: 3748452 - DNA, 18 bp, Homo sapiens
tcattgattgtcagctac

SEQ ID NO: 3748453 - DNA, 16 bp, Homo sapiens
tcattgccagtgtctt

SEQ ID NO: 3748454 - DNA, 16 bp, Homo sapiens
tcattgcttatgacat

SEQ ID NO: 3748455 - DNA, 21 bp, Homo sapiens
tcattgcttcacaacccatct

SEQ ID NO: 3748456 - DNA, 15 bp, Homo sapiens
tcattgctttactgg

SEQ ID NO: 3748457 - DNA, 17 bp, Homo sapiens
tcattgtaatgttactg

SEQ ID NO: 3748458 - DNA, 19 bp, Homo sapiens
tcattgtaatgttactgat

SEQ ID NO: 3748459 - DNA, 20 bp, Homo sapiens
tcattgtaatgttactgatc

SEQ ID NO: 3748460 - DNA, 22 bp, Homo sapiens
tcattgtggttatttttataca

SEQ ID NO: 3748461 - DNA, 22 bp, Homo sapiens
tcatttacttgtacgagacaga

SEQ ID NO: 3748462 - DNA, 14 bp, Homo sapiens
tcatttatgaaaag

SEQ ID NO: 3748463 - DNA, 16 bp, Homo sapiens
tcatttcattcctaac

SEQ ID NO: 3748464 - DNA, 21 bp, Homo sapiens
tcatttgagcagggctcagcg

SEQ ID NO: 3748465 - DNA, 19 bp, Homo sapiens
tcatttgttattcttaaga

SEQ ID NO: 3748466 - DNA, 15 bp, Homo sapiens
tcatttgttggaatg

SEQ ID NO: 3748467 - DNA, 14 bp, Homo sapiens
tcattttaattatt

SEQ ID NO: 3748468 - DNA, 19 bp, Homo sapiens
tcattttccccccactctc

SEQ ID NO: 3748469 - DNA, 16 bp, Homo sapiens
tcattttgaagctaat

SEQ ID NO: 3748470 - DNA, 14 bp, Homo sapiens
tcatttttgaatac

SEQ ID NO: 3748471 - DNA, 20 bp, Homo sapiens
tccaaactgcctaagccctc

SEQ ID NO: 3748472 - DNA, 19 bp, Homo sapiens
tccaaagcacattgaaaga

SEQ ID NO: 3748473 - DNA, 19 bp, Homo sapiens
tccaaagctttcctggaga

SEQ ID NO: 3748474 - DNA, 23 bp, Homo sapiens
tccaaaggaagtctaggagctgg

SEQ ID NO: 3748475 - DNA, 17 bp, Homo sapiens
tccaaatgtcctccaga

SEQ ID NO: 3748476 - DNA, 20 bp, Homo sapiens
tccaaatgtcctccagaagc

SEQ ID NO: 3748477 - DNA, 22 bp, Homo sapiens
tccaacccatgatgagctcctc

SEQ ID NO: 3748478 - DNA, 21 bp, Homo sapiens
tccaacctaacccctttcctg

SEQ ID NO: 3748479 - DNA, 23 bp, Homo sapiens
tccaacctaacccctttcctgcg

SEQ ID NO: 3748480 - DNA, 16 bp, Homo sapiens
tccaacgtggcccaga

SEQ ID NO: 3748481 - DNA, 19 bp, Homo sapiens
tccaacgtggggcagcaca

SEQ ID NO: 3748482 - DNA, 15 bp, Homo sapiens
tccaacttcatttga

SEQ ID NO: 3748483 - DNA, 18 bp, Homo sapiens
tccaagacagaataatga

SEQ ID NO: 3748484 - DNA, 12 bp, Homo sapiens
tccaagagctga

SEQ ID NO: 3748485 - DNA, 11 bp, Homo sapiens
tccaagcaaag

SEQ ID NO: 3748486 - DNA, 17 bp, Homo sapiens
tccaagcaaatgttaca

SEQ ID NO: 3748487 - DNA, 22 bp, Homo sapiens
tccaagcgaggtcaacagagaa

SEQ ID NO: 3748488 - DNA, 16 bp, Homo sapiens
tccaaggagaaacaga

SEQ ID NO: 3748489 - DNA, 14 bp, Homo sapiens
tccaaggagaccaa

SEQ ID NO: 3748490 - DNA, 23 bp, Homo sapiens
tccaaggagaccaagtcctggct

SEQ ID NO: 3748491 - DNA, 16 bp, Homo sapiens
tccaataggaatgcta

SEQ ID NO: 3748492 - DNA, 15 bp, Homo sapiens
tccaatcctcactgg

SEQ ID NO: 3748493 - DNA, 22 bp, Homo sapiens
tccaatcctggctctgtggctt

SEQ ID NO: 3748494 - DNA, 17 bp, Homo sapiens
tccaatcttgtttccaa

SEQ ID NO: 3748495 - DNA, 21 bp, Homo sapiens
tccaatgtctttttaagctta

SEQ ID NO: 3748496 - DNA, 18 bp, Homo sapiens
tccaatttacatactctg

SEQ ID NO: 3748497 - DNA, 18 bp, Homo sapiens
tccaattttctggaatac

SEQ ID NO: 3748498 - DNA, 19 bp, Homo sapiens
tccacaagattcccagaga

SEQ ID NO: 3748499 - DNA, 21 bp, Homo sapiens
tccacaagattcccagagaca

SEQ ID NO: 3748500 - DNA, 17 bp, Homo sapiens
tccacaagttaaataaa

SEQ ID NO: 3748501 - DNA, 22 bp, Homo sapiens
tccacacacagaggaagagcag

SEQ ID NO: 3748502 - DNA, 18 bp, Homo sapiens
tccacaccctctcccagg

SEQ ID NO: 3748503 - DNA, 21 bp, Homo sapiens
tccacaccctctcccaggacc

SEQ ID NO: 3748504 - DNA, 14 bp, Homo sapiens
tccacagccgcagc

SEQ ID NO: 3748505 - DNA, 16 bp, Homo sapiens
tccacatttgtcacag

SEQ ID NO: 3748506 - DNA, 18 bp, Homo sapiens
tccacatttgtcacagaa

SEQ ID NO: 3748507 - DNA, 17 bp, Homo sapiens
tccaccacccaaaagtc

SEQ ID NO: 3748508 - DNA, 15 bp, Homo sapiens
tccacccagcccatt

SEQ ID NO: 3748509 - DNA, 12 bp, Homo sapiens
tccacccaggag

SEQ ID NO: 3748510 - DNA, 23 bp, Homo sapiens
tccaccccagtgcacccactctg

SEQ ID NO: 3748511 - DNA, 22 bp, Homo sapiens
tccaccccccagaacctgtcct

SEQ ID NO: 3748512 - DNA, 12 bp, Homo sapiens
tccaccccctcc

SEQ ID NO: 3748513 - DNA, 13 bp, Homo sapiens
tccaccctgctct

SEQ ID NO: 3748514 - DNA, 14 bp, Homo sapiens
tccaccctgctctc

SEQ ID NO: 3748515 - DNA, 13 bp, Homo sapiens
tccacccttggcc

SEQ ID NO: 3748516 - DNA, 16 bp, Homo sapiens
tccacccttggcctgt

SEQ ID NO: 3748517 - DNA, 17 bp, Homo sapiens
tccacccttggcctgtc

SEQ ID NO: 3748518 - DNA, 14 bp, Homo sapiens
tccaccgctgccta

SEQ ID NO: 3748519 - DNA, 19 bp, Homo sapiens
tccaccgctgcctaagtgg

SEQ ID NO: 3748520 - DNA, 11 bp, Homo sapiens
tccacctcagc

SEQ ID NO: 3748521 - DNA, 14 bp, Homo sapiens
tccacctcagcctt

SEQ ID NO: 3748522 - DNA, 16 bp, Homo sapiens
tccacctcagccttgg

SEQ ID NO: 3748523 - DNA, 14 bp, Homo sapiens
tccacctgagctgc

SEQ ID NO: 3748524 - DNA, 17 bp, Homo sapiens
tccacctgagctgccat

SEQ ID NO: 3748525 - DNA, 20 bp, Homo sapiens
tccacctgtctcagcctccc

SEQ ID NO: 3748526 - DNA, 15 bp, Homo sapiens
tccaccttcccatgc

SEQ ID NO: 3748527 - DNA, 22 bp, Homo sapiens
tccacgctgtctccagaccccc

SEQ ID NO: 3748528 - DNA, 23 bp, Homo sapiens
tccacgctgtctccagaccccca

SEQ ID NO: 3748529 - DNA, 13 bp, Homo sapiens
tccacggactcaa

SEQ ID NO: 3748530 - DNA, 15 bp, Homo sapiens
tccacgtactgcagc

SEQ ID NO: 3748531 - DNA, 13 bp, Homo sapiens
tccactactgcta

SEQ ID NO: 3748532 - DNA, 21 bp, Homo sapiens
tccactccttcctgccacctg

SEQ ID NO: 3748533 - DNA, 15 bp, Homo sapiens
tccactgccctctgt

SEQ ID NO: 3748534 - DNA, 22 bp, Homo sapiens
tccactgccttcgatacaccgg

SEQ ID NO: 3748535 - DNA, 16 bp, Homo sapiens
tccactggacttgagc

SEQ ID NO: 3748536 - DNA, 21 bp, Homo sapiens
tccactgtgccatgtgccagg

SEQ ID NO: 3748537 - DNA, 18 bp, Homo sapiens
tccagaaaaccccagcat

SEQ ID NO: 3748538 - DNA, 18 bp, Homo sapiens
tccagaaaggatatttaa

SEQ ID NO: 3748539 - DNA, 17 bp, Homo sapiens
tccagaagcctctggct

SEQ ID NO: 3748540 - DNA, 19 bp, Homo sapiens
tccagaagcctctggctag

SEQ ID NO: 3748541 - DNA, 19 bp, Homo sapiens
tccagacaaaccagaagca

SEQ ID NO: 3748542 - DNA, 12 bp, Homo sapiens
tccagaccccca

SEQ ID NO: 3748543 - DNA, 14 bp, Homo sapiens
tccagacccccagc

SEQ ID NO: 3748544 - DNA, 15 bp, Homo sapiens
tccagacccctggct

SEQ ID NO: 3748545 - DNA, 22 bp, Homo sapiens
tccagactgcttccaattttct

SEQ ID NO: 3748546 - DNA, 23 bp, Homo sapiens
tccagagagagaagtgcccctgc

SEQ ID NO: 3748547 - DNA, 22 bp, Homo sapiens
tccagagagtggctcctcccgg

SEQ ID NO: 3748548 - DNA, 21 bp, Homo sapiens
tccagatgccttctccagaca

SEQ ID NO: 3748549 - DNA, 15 bp, Homo sapiens
tccagcaattgtgtg

SEQ ID NO: 3748550 - DNA, 16 bp, Homo sapiens
tccagccgccattgcc

SEQ ID NO: 3748551 - DNA, 12 bp, Homo sapiens
tccagcctgggc

SEQ ID NO: 3748552 - DNA, 20 bp, Homo sapiens
tccagcctgggcaacagagc

SEQ ID NO: 3748553 - DNA, 21 bp, Homo sapiens
tccagctatttttatttgttt

SEQ ID NO: 3748554 - DNA, 17 bp, Homo sapiens
tccagctcaccagcccc

SEQ ID NO: 3748555 - DNA, 18 bp, Homo sapiens
tccagctcaccagcccca

SEQ ID NO: 3748556 - DNA, 19 bp, Homo sapiens
tccagctgggttggaaaac

SEQ ID NO: 3748557 - DNA, 17 bp, Homo sapiens
tccagctgttcagctgg

SEQ ID NO: 3748558 - DNA, 14 bp, Homo sapiens
tccaggagcctggc

SEQ ID NO: 3748559 - DNA, 23 bp, Homo sapiens
tccaggagcctggctccgtccag

SEQ ID NO: 3748560 - DNA, 15 bp, Homo sapiens
tccaggagcctgtgc

SEQ ID NO: 3748561 - DNA, 19 bp, Homo sapiens
tccaggcgatgtgcaagtg

SEQ ID NO: 3748562 - DNA, 19 bp, Homo sapiens
tccaggctgcatagaagga

SEQ ID NO: 3748563 - DNA, 20 bp, Homo sapiens
tccagggatgccatctgtgg

SEQ ID NO: 3748564 - DNA, 14 bp, Homo sapiens
tccagggccagatg

SEQ ID NO: 3748565 - DNA, 16 bp, Homo sapiens
tccagggccctgagct

SEQ ID NO: 3748566 - DNA, 20 bp, Homo sapiens
tccagggccctgagctcggt

SEQ ID NO: 3748567 - DNA, 16 bp, Homo sapiens
tccaggtcgggctcag

SEQ ID NO: 3748568 - DNA, 15 bp, Homo sapiens
tccaggttcagcttg

SEQ ID NO: 3748569 - DNA, 16 bp, Homo sapiens
tccaggttcagcttgt

SEQ ID NO: 3748570 - DNA, 17 bp, Homo sapiens
tccaggtttaagctgtt

SEQ ID NO: 3748571 - DNA, 18 bp, Homo sapiens
tccaggtttaagctgtta

SEQ ID NO: 3748572 - DNA, 15 bp, Homo sapiens
tccagtactggagct

SEQ ID NO: 3748573 - DNA, 16 bp, Homo sapiens
tccagtcctgctctct

SEQ ID NO: 3748574 - DNA, 19 bp, Homo sapiens
tccagtctgctgccctcca

SEQ ID NO: 3748575 - DNA, 20 bp, Homo sapiens
tccagtctgctgccctccat

SEQ ID NO: 3748576 - DNA, 18 bp, Homo sapiens
tccagtgagcttatcatg

SEQ ID NO: 3748577 - DNA, 17 bp, Homo sapiens
tccagtggcctggctcc

SEQ ID NO: 3748578 - DNA, 20 bp, Homo sapiens
tccagtggcctggctccgct

SEQ ID NO: 3748579 - DNA, 16 bp, Homo sapiens
tccagtgtctcggagg

SEQ ID NO: 3748580 - DNA, 13 bp, Homo sapiens
tccagttcccact

SEQ ID NO: 3748581 - DNA, 12 bp, Homo sapiens
tccataatgtat

SEQ ID NO: 3748582 - DNA, 20 bp, Homo sapiens
tccataatgtataaagaaca

SEQ ID NO: 3748583 - DNA, 13 bp, Homo sapiens
tccatactcagga

SEQ ID NO: 3748584 - DNA, 17 bp, Homo sapiens
tccatatattagcattt

SEQ ID NO: 3748585 - DNA, 17 bp, Homo sapiens
tccatatctaaccagtg

SEQ ID NO: 3748586 - DNA, 14 bp, Homo sapiens
tccatcaggccact

SEQ ID NO: 3748587 - DNA, 14 bp, Homo sapiens
tccatcccatcatc

SEQ ID NO: 3748588 - DNA, 18 bp, Homo sapiens
tccatccctaccccctaa

SEQ ID NO: 3748589 - DNA, 12 bp, Homo sapiens
tccatctccttg

SEQ ID NO: 3748590 - DNA, 16 bp, Homo sapiens
tccatctcgccacccc

SEQ ID NO: 3748591 - DNA, 23 bp, Homo sapiens
tccatctcgccacccctccttcc

SEQ ID NO: 3748592 - DNA, 21 bp, Homo sapiens
tccatgaaaacgttttattgt

SEQ ID NO: 3748593 - DNA, 12 bp, Homo sapiens
tccatgaaaatg

SEQ ID NO: 3748594 - DNA, 15 bp, Homo sapiens
tccatgaaaatgcaa

SEQ ID NO: 3748595 - DNA, 14 bp, Homo sapiens
tccatgaatgtatc

SEQ ID NO: 3748596 - DNA, 15 bp, Homo sapiens
tccatgaatgtatca

SEQ ID NO: 3748597 - DNA, 14 bp, Homo sapiens
tccatgctgcctcc

SEQ ID NO: 3748598 - DNA, 19 bp, Homo sapiens
tccatgggaaactttccct

SEQ ID NO: 3748599 - DNA, 17 bp, Homo sapiens
tccatggtgcctctgga

SEQ ID NO: 3748600 - DNA, 13 bp, Homo sapiens
tccatgtactgta

SEQ ID NO: 3748601 - DNA, 14 bp, Homo sapiens
tccatgtactgtag

SEQ ID NO: 3748602 - DNA, 17 bp, Homo sapiens
tccatgtcgcctctgca

SEQ ID NO: 3748603 - DNA, 18 bp, Homo sapiens
tccatgtcgcctctgcat

SEQ ID NO: 3748604 - DNA, 19 bp, Homo sapiens
tccatgtcgcctctgcatt

SEQ ID NO: 3748605 - DNA, 13 bp, Homo sapiens
tccatgtgtgtgc

SEQ ID NO: 3748606 - DNA, 12 bp, Homo sapiens
tccattatttat

SEQ ID NO: 3748607 - DNA, 14 bp, Homo sapiens
tccattccacatcc

SEQ ID NO: 3748608 - DNA, 12 bp, Homo sapiens
tccattcctcag

SEQ ID NO: 3748609 - DNA, 13 bp, Homo sapiens
tccattcctcagg

SEQ ID NO: 3748610 - DNA, 20 bp, Homo sapiens
tccatttagttctttgttat

SEQ ID NO: 3748611 - DNA, 21 bp, Homo sapiens
tccatttcatctatttctgag

SEQ ID NO: 3748612 - DNA, 23 bp, Homo sapiens
tccatttcatctatttctgagaa

SEQ ID NO: 3748613 - DNA, 18 bp, Homo sapiens
tccatttctctctccagt

SEQ ID NO: 3748614 - DNA, 23 bp, Homo sapiens
tcccaaaagtatcgggggctggg

SEQ ID NO: 3748615 - DNA, 13 bp, Homo sapiens
tcccaaagagctg

SEQ ID NO: 3748616 - DNA, 18 bp, Homo sapiens
tcccaacacttcagactg

SEQ ID NO: 3748617 - DNA, 17 bp, Homo sapiens
tcccaactcctataatt

SEQ ID NO: 3748618 - DNA, 14 bp, Homo sapiens
tcccaacttgtaaa

SEQ ID NO: 3748619 - DNA, 17 bp, Homo sapiens
tcccaagaacagcaggc

SEQ ID NO: 3748620 - DNA, 19 bp, Homo sapiens
tcccaagaacagcaggccc

SEQ ID NO: 3748621 - DNA, 12 bp, Homo sapiens
tcccaagctctg

SEQ ID NO: 3748622 - DNA, 13 bp, Homo sapiens
tcccaagctctgc

SEQ ID NO: 3748623 - DNA, 12 bp, Homo sapiens
tcccaagctgga

SEQ ID NO: 3748624 - DNA, 13 bp, Homo sapiens
tcccaaggaaagc

SEQ ID NO: 3748625 - DNA, 22 bp, Homo sapiens
tcccaaggctctgagcaaatgt

SEQ ID NO: 3748626 - DNA, 20 bp, Homo sapiens
tcccaatagcactttcattg

SEQ ID NO: 3748627 - DNA, 19 bp, Homo sapiens
tcccaattaggaagtgtaa

SEQ ID NO: 3748628 - DNA, 12 bp, Homo sapiens
tcccaccccacc

SEQ ID NO: 3748629 - DNA, 20 bp, Homo sapiens
tcccacccccatctctccct

SEQ ID NO: 3748630 - DNA, 20 bp, Homo sapiens
tcccacccccttctctgctc

SEQ ID NO: 3748631 - DNA, 13 bp, Homo sapiens
tcccacctcagcc

SEQ ID NO: 3748632 - DNA, 18 bp, Homo sapiens
tcccacctcagcctcccg

SEQ ID NO: 3748633 - DNA, 19 bp, Homo sapiens
tcccaccttggctgcaggg

SEQ ID NO: 3748634 - DNA, 23 bp, Homo sapiens
tcccacggaaaatgccaatctct

SEQ ID NO: 3748635 - DNA, 17 bp, Homo sapiens
tcccactcacaacagct

SEQ ID NO: 3748636 - DNA, 13 bp, Homo sapiens
tcccagacttgct

SEQ ID NO: 3748637 - DNA, 16 bp, Homo sapiens
tcccagagcaaaataa

SEQ ID NO: 3748638 - DNA, 23 bp, Homo sapiens
tcccagcactttgggaggccaag

SEQ ID NO: 3748639 - DNA, 10 bp, Homo sapiens
tcccagcctg

SEQ ID NO: 3748640 - DNA, 21 bp, Homo sapiens
tcccagcggctggtgcagggc

SEQ ID NO: 3748641 - DNA, 22 bp, Homo sapiens
tcccagctactcaagaggctga

SEQ ID NO: 3748642 - DNA, 23 bp, Homo sapiens
tcccagctactcagaagcctgag

SEQ ID NO: 3748643 - DNA, 17 bp, Homo sapiens
tcccagctacttgggag

SEQ ID NO: 3748644 - DNA, 19 bp, Homo sapiens
tcccagctacttgggaggc

SEQ ID NO: 3748645 - DNA, 14 bp, Homo sapiens
tcccagctctccct

SEQ ID NO: 3748646 - DNA, 14 bp, Homo sapiens
tcccagctgcccct

SEQ ID NO: 3748647 - DNA, 14 bp, Homo sapiens
tcccagctgtctgt

SEQ ID NO: 3748648 - DNA, 16 bp, Homo sapiens
tcccaggagacagttc

SEQ ID NO: 3748649 - DNA, 22 bp, Homo sapiens
tcccaggagacagttcaagaaa

SEQ ID NO: 3748650 - DNA, 20 bp, Homo sapiens
tcccaggccccctgcatcta

SEQ ID NO: 3748651 - DNA, 22 bp, Homo sapiens
tcccagggctactcactcaagt

SEQ ID NO: 3748652 - DNA, 12 bp, Homo sapiens
tcccaggggacc

SEQ ID NO: 3748653 - DNA, 18 bp, Homo sapiens
tcccaggggaccacacct

SEQ ID NO: 3748654 - DNA, 20 bp, Homo sapiens
tcccagtccaaatgtcctcc

SEQ ID NO: 3748655 - DNA, 22 bp, Homo sapiens
tcccagtgacacttcagagagc

SEQ ID NO: 3748656 - DNA, 14 bp, Homo sapiens
tcccagtggcctca

SEQ ID NO: 3748657 - DNA, 17 bp, Homo sapiens
tcccatagccaggaaac

SEQ ID NO: 3748658 - DNA, 14 bp, Homo sapiens
tcccatcactggag

SEQ ID NO: 3748659 - DNA, 14 bp, Homo sapiens
tcccatcccatccc

SEQ ID NO: 3748660 - DNA, 19 bp, Homo sapiens
tcccatcccatcccatccc

SEQ ID NO: 3748661 - DNA, 18 bp, Homo sapiens
tcccatcccgctcttttc

SEQ ID NO: 3748662 - DNA, 19 bp, Homo sapiens
tcccatcttaactctttgc

SEQ ID NO: 3748663 - DNA, 15 bp, Homo sapiens
tcccatcttccaagg

SEQ ID NO: 3748664 - DNA, 17 bp, Homo sapiens
tcccatgagcctcagca

SEQ ID NO: 3748665 - DNA, 20 bp, Homo sapiens
tcccatgagcctcagcatcc

SEQ ID NO: 3748666 - DNA, 15 bp, Homo sapiens
tcccattgtcttctg

SEQ ID NO: 3748667 - DNA, 22 bp, Homo sapiens
tcccattgtcttctgacctcta

SEQ ID NO: 3748668 - DNA, 22 bp, Homo sapiens
tccccaaaaacctcacccgagg

SEQ ID NO: 3748669 - DNA, 20 bp, Homo sapiens
tccccaaccctgcccctgcc

SEQ ID NO: 3748670 - DNA, 10 bp, Homo sapiens
tccccacact

SEQ ID NO: 3748671 - DNA, 13 bp, Homo sapiens
tccccaccagtga

SEQ ID NO: 3748672 - DNA, 22 bp, Homo sapiens
tccccaccttcaattcctgggc

SEQ ID NO: 3748673 - DNA, 23 bp, Homo sapiens
tccccaccttcaattcctgggcc

SEQ ID NO: 3748674 - DNA, 20 bp, Homo sapiens
tccccaccttcttcagccac

SEQ ID NO: 3748675 - DNA, 19 bp, Homo sapiens
tccccactgacagcctccc

SEQ ID NO: 3748676 - DNA, 18 bp, Homo sapiens
tccccactgcctgcccac

SEQ ID NO: 3748677 - DNA, 20 bp, Homo sapiens
tccccactgcctgcccaccc

SEQ ID NO: 3748678 - DNA, 22 bp, Homo sapiens
tccccactgcctgcccacccgt

SEQ ID NO: 3748679 - DNA, 13 bp, Homo sapiens
tccccagattgca

SEQ ID NO: 3748680 - DNA, 19 bp, Homo sapiens
tccccagattgcaacaggc

SEQ ID NO: 3748681 - DNA, 20 bp, Homo sapiens
tccccagattgcaacaggct

SEQ ID NO: 3748682 - DNA, 20 bp, Homo sapiens
tccccagcaagtgagagctg

SEQ ID NO: 3748683 - DNA, 15 bp, Homo sapiens
tccccagcaggtggg

SEQ ID NO: 3748684 - DNA, 13 bp, Homo sapiens
tccccagcccact

SEQ ID NO: 3748685 - DNA, 19 bp, Homo sapiens
tccccagcccactggatca

SEQ ID NO: 3748686 - DNA, 14 bp, Homo sapiens
tccccagcccaggg

SEQ ID NO: 3748687 - DNA, 15 bp, Homo sapiens
tccccagcccagggt

SEQ ID NO: 3748688 - DNA, 23 bp, Homo sapiens
tccccagcccagggttcccccag

SEQ ID NO: 3748689 - DNA, 15 bp, Homo sapiens
tccccagccctaaga

SEQ ID NO: 3748690 - DNA, 18 bp, Homo sapiens
tccccagcctctcttcct

SEQ ID NO: 3748691 - DNA, 23 bp, Homo sapiens
tccccagcctttgatcaggtggg

SEQ ID NO: 3748692 - DNA, 19 bp, Homo sapiens
tccccaggccccaggaagc

SEQ ID NO: 3748693 - DNA, 21 bp, Homo sapiens
tccccaggccccaggaagccg

SEQ ID NO: 3748694 - DNA, 23 bp, Homo sapiens
tccccaggggagagggtctggag

SEQ ID NO: 3748695 - DNA, 17 bp, Homo sapiens
tccccaggggtcccagc

SEQ ID NO: 3748696 - DNA, 14 bp, Homo sapiens
tccccagtgaaaac

SEQ ID NO: 3748697 - DNA, 17 bp, Homo sapiens
tccccagtttgcagaaa

SEQ ID NO: 3748698 - DNA, 17 bp, Homo sapiens
tccccatactctgtctc

SEQ ID NO: 3748699 - DNA, 19 bp, Homo sapiens
tccccatactctgtctccc

SEQ ID NO: 3748700 - DNA, 20 bp, Homo sapiens
tccccatgtgcctgcaccag

SEQ ID NO: 3748701 - DNA, 21 bp, Homo sapiens
tccccattagagtcagccttc

SEQ ID NO: 3748702 - DNA, 14 bp, Homo sapiens
tccccattcttcct

SEQ ID NO: 3748703 - DNA, 14 bp, Homo sapiens
tcccccaaccccca

SEQ ID NO: 3748704 - DNA, 17 bp, Homo sapiens
tcccccaacccccaccc

SEQ ID NO: 3748705 - DNA, 19 bp, Homo sapiens
tcccccaacccccacccca

SEQ ID NO: 3748706 - DNA, 21 bp, Homo sapiens
tcccccaacccccaccccaca

SEQ ID NO: 3748707 - DNA, 22 bp, Homo sapiens
tcccccaacccccaccccacac

SEQ ID NO: 3748708 - DNA, 18 bp, Homo sapiens
tcccccaccccctcccca

SEQ ID NO: 3748709 - DNA, 13 bp, Homo sapiens
tcccccagccctg

SEQ ID NO: 3748710 - DNA, 14 bp, Homo sapiens
tcccccagccctgt

SEQ ID NO: 3748711 - DNA, 15 bp, Homo sapiens
tcccccagccctgtg

SEQ ID NO: 3748712 - DNA, 14 bp, Homo sapiens
tcccccagtacctc

SEQ ID NO: 3748713 - DNA, 15 bp, Homo sapiens
tcccccatagccacc

SEQ ID NO: 3748714 - DNA, 19 bp, Homo sapiens
tcccccatcctccccttcc

SEQ ID NO: 3748715 - DNA, 12 bp, Homo sapiens
tccccccactct

SEQ ID NO: 3748716 - DNA, 21 bp, Homo sapiens
tccccccactctccccacact

SEQ ID NO: 3748717 - DNA, 13 bp, Homo sapiens
tccccccactgca

SEQ ID NO: 3748718 - DNA, 21 bp, Homo sapiens
tcccccgtagaaatccccctt

SEQ ID NO: 3748719 - DNA, 11 bp, Homo sapiens
tccccctcctt

SEQ ID NO: 3748720 - DNA, 20 bp, Homo sapiens
tccccctccttcccagctgc

SEQ ID NO: 3748721 - DNA, 21 bp, Homo sapiens
tccccctccttcccagctgcc

SEQ ID NO: 3748722 - DNA, 16 bp, Homo sapiens
tccccctgccagtgcc

SEQ ID NO: 3748723 - DNA, 17 bp, Homo sapiens
tccccctgccagtgcct

SEQ ID NO: 3748724 - DNA, 14 bp, Homo sapiens
tccccctgggctct

SEQ ID NO: 3748725 - DNA, 14 bp, Homo sapiens
tccccgcacccccc

SEQ ID NO: 3748726 - DNA, 21 bp, Homo sapiens
tccccgcaccccccaagctgt

SEQ ID NO: 3748727 - DNA, 19 bp, Homo sapiens
tccccgcattccaggctcc

SEQ ID NO: 3748728 - DNA, 16 bp, Homo sapiens
tccccgctggctgggg

SEQ ID NO: 3748729 - DNA, 17 bp, Homo sapiens
tccccgtgggccatggc

SEQ ID NO: 3748730 - DNA, 15 bp, Homo sapiens
tcccctatccaccca

SEQ ID NO: 3748731 - DNA, 18 bp, Homo sapiens
tcccctatccacccagcc

SEQ ID NO: 3748732 - DNA, 22 bp, Homo sapiens
tcccctcaaggacaaagtctcc

SEQ ID NO: 3748733 - DNA, 16 bp, Homo sapiens
tcccctccaaggtatg

SEQ ID NO: 3748734 - DNA, 13 bp, Homo sapiens
tcccctccctggc

SEQ ID NO: 3748735 - DNA, 16 bp, Homo sapiens
tcccctccctggctcc

SEQ ID NO: 3748736 - DNA, 20 bp, Homo sapiens
tcccctccgccaggcgagat

SEQ ID NO: 3748737 - DNA, 14 bp, Homo sapiens
tcccctccttctcc

SEQ ID NO: 3748738 - DNA, 22 bp, Homo sapiens
tcccctccttgcctcctgtgta

SEQ ID NO: 3748739 - DNA, 23 bp, Homo sapiens
tcccctccttgcctcctgtgtaa

SEQ ID NO: 3748740 - DNA, 13 bp, Homo sapiens
tcccctctgctgg

SEQ ID NO: 3748741 - DNA, 15 bp, Homo sapiens
tcccctctgctggcc

SEQ ID NO: 3748742 - DNA, 15 bp, Homo sapiens
tcccctgccctgctg

SEQ ID NO: 3748743 - DNA, 13 bp, Homo sapiens
tccccttccctgc

SEQ ID NO: 3748744 - DNA, 16 bp, Homo sapiens
tccccttgagctgaga

SEQ ID NO: 3748745 - DNA, 16 bp, Homo sapiens
tccccttgcccagggc

SEQ ID NO: 3748746 - DNA, 22 bp, Homo sapiens
tccccttgcccagggctcagcc

SEQ ID NO: 3748747 - DNA, 19 bp, Homo sapiens
tcccctttcgcccacagtc

SEQ ID NO: 3748748 - DNA, 17 bp, Homo sapiens
tccccttttattgctgc

SEQ ID NO: 3748749 - DNA, 15 bp, Homo sapiens
tcccgaatagctggg

SEQ ID NO: 3748750 - DNA, 17 bp, Homo sapiens
tcccgagtagctgggac

SEQ ID NO: 3748751 - DNA, 18 bp, Homo sapiens
tcccgagtagctgggact

SEQ ID NO: 3748752 - DNA, 19 bp, Homo sapiens
tcccgcctcttcttcttca

SEQ ID NO: 3748753 - DNA, 13 bp, Homo sapiens
tcccgctcagccc

SEQ ID NO: 3748754 - DNA, 22 bp, Homo sapiens
tccctaccgagtctcttctcca

SEQ ID NO: 3748755 - DNA, 15 bp, Homo sapiens
tccctacctcaacct

SEQ ID NO: 3748756 - DNA, 20 bp, Homo sapiens
tccctacctcaacctgtaaa

SEQ ID NO: 3748757 - DNA, 15 bp, Homo sapiens
tccctacttcctgtg

SEQ ID NO: 3748758 - DNA, 20 bp, Homo sapiens
tccctcaaagcttccattcc

SEQ ID NO: 3748759 - DNA, 22 bp, Homo sapiens
tccctcaaagcttccattccac

SEQ ID NO: 3748760 - DNA, 16 bp, Homo sapiens
tccctcaaccccacca

SEQ ID NO: 3748761 - DNA, 14 bp, Homo sapiens
tccctcagcccctc

SEQ ID NO: 3748762 - DNA, 18 bp, Homo sapiens
tccctcagtctggccctt

SEQ ID NO: 3748763 - DNA, 21 bp, Homo sapiens
tccctcagtctggcccttcct

SEQ ID NO: 3748764 - DNA, 19 bp, Homo sapiens
tccctccacgttcacccct

SEQ ID NO: 3748765 - DNA, 17 bp, Homo sapiens
tccctcccctgccctgg

SEQ ID NO: 3748766 - DNA, 15 bp, Homo sapiens
tccctccctttgaaa

SEQ ID NO: 3748767 - DNA, 12 bp, Homo sapiens
tccctcctcacc

SEQ ID NO: 3748768 - DNA, 13 bp, Homo sapiens
tccctcctcacct

SEQ ID NO: 3748769 - DNA, 18 bp, Homo sapiens
tccctcctcacctctgga

SEQ ID NO: 3748770 - DNA, 17 bp, Homo sapiens
tccctcgaacccacact

SEQ ID NO: 3748771 - DNA, 12 bp, Homo sapiens
tccctctcggaa

SEQ ID NO: 3748772 - DNA, 14 bp, Homo sapiens
tccctctctctgga

SEQ ID NO: 3748773 - DNA, 12 bp, Homo sapiens
tccctctctctt

SEQ ID NO: 3748774 - DNA, 16 bp, Homo sapiens
tccctctctcttctgc

SEQ ID NO: 3748775 - DNA, 21 bp, Homo sapiens
tccctctctcttctgctccac

SEQ ID NO: 3748776 - DNA, 23 bp, Homo sapiens
tccctctctcttctgctccaccc

SEQ ID NO: 3748777 - DNA, 21 bp, Homo sapiens
tccctctgcctgaaccttcca

SEQ ID NO: 3748778 - DNA, 16 bp, Homo sapiens
tccctctgcctgtccc

SEQ ID NO: 3748779 - DNA, 17 bp, Homo sapiens
tccctctggccctgcct

SEQ ID NO: 3748780 - DNA, 21 bp, Homo sapiens
tccctctttccctcccttcct

SEQ ID NO: 3748781 - DNA, 17 bp, Homo sapiens
tccctgaaaatgttttt

SEQ ID NO: 3748782 - DNA, 16 bp, Homo sapiens
tccctgacctccctct

SEQ ID NO: 3748783 - DNA, 14 bp, Homo sapiens
tccctgagtcacca

SEQ ID NO: 3748784 - DNA, 16 bp, Homo sapiens
tccctgagtcaccagg

SEQ ID NO: 3748785 - DNA, 21 bp, Homo sapiens
tccctgagtcaccaggaatgt

SEQ ID NO: 3748786 - DNA, 13 bp, Homo sapiens
tccctgcacttgc

SEQ ID NO: 3748787 - DNA, 14 bp, Homo sapiens
tccctgcacttgca

SEQ ID NO: 3748788 - DNA, 20 bp, Homo sapiens
tccctgcccctcccttcaac

SEQ ID NO: 3748789 - DNA, 16 bp, Homo sapiens
tccctggctctcagaa

SEQ ID NO: 3748790 - DNA, 18 bp, Homo sapiens
tccctggctctcagaagg

SEQ ID NO: 3748791 - DNA, 20 bp, Homo sapiens
tccctggctctcagaaggta

SEQ ID NO: 3748792 - DNA, 16 bp, Homo sapiens
tccctgggcagaaagt

SEQ ID NO: 3748793 - DNA, 18 bp, Homo sapiens
tccctgggcattgctttc

SEQ ID NO: 3748794 - DNA, 20 bp, Homo sapiens
tccctgggggaagccctgga

SEQ ID NO: 3748795 - DNA, 15 bp, Homo sapiens
tccctgtcaccaagc

SEQ ID NO: 3748796 - DNA, 13 bp, Homo sapiens
tccctgtccaccc

SEQ ID NO: 3748797 - DNA, 12 bp, Homo sapiens
tccctgttcatt

SEQ ID NO: 3748798 - DNA, 18 bp, Homo sapiens
tccctgttggtcggtggg

SEQ ID NO: 3748799 - DNA, 11 bp, Homo sapiens
tcccttcaacc

SEQ ID NO: 3748800 - DNA, 20 bp, Homo sapiens
tcccttcacaaacccagtgt

SEQ ID NO: 3748801 - DNA, 13 bp, Homo sapiens
tcccttctccttc

SEQ ID NO: 3748802 - DNA, 14 bp, Homo sapiens
tcccttgagccctc

SEQ ID NO: 3748803 - DNA, 13 bp, Homo sapiens
tcccttggcctca

SEQ ID NO: 3748804 - DNA, 14 bp, Homo sapiens
tccctttccttcca

SEQ ID NO: 3748805 - DNA, 18 bp, Homo sapiens
tccctttccttccatccc

SEQ ID NO: 3748806 - DNA, 16 bp, Homo sapiens
tccctttcttggccag

SEQ ID NO: 3748807 - DNA, 15 bp, Homo sapiens
tccctttgaaatgaa

SEQ ID NO: 3748808 - DNA, 20 bp, Homo sapiens
tccctttgctccaccccact

SEQ ID NO: 3748809 - DNA, 22 bp, Homo sapiens
tccctttgctccaccccactca

SEQ ID NO: 3748810 - DNA, 13 bp, Homo sapiens
tcccttttacata

SEQ ID NO: 3748811 - DNA, 17 bp, Homo sapiens
tcccttttacatactgc

SEQ ID NO: 3748812 - DNA, 20 bp, Homo sapiens
tcccttttacatactgctgt

SEQ ID NO: 3748813 - DNA, 20 bp, Homo sapiens
tccctttttatatcccattt

SEQ ID NO: 3748814 - DNA, 21 bp, Homo sapiens
tccgaaagggacttggaagct

SEQ ID NO: 3748815 - DNA, 19 bp, Homo sapiens
tccgaacaccctcgaagcg

SEQ ID NO: 3748816 - DNA, 20 bp, Homo sapiens
tccgacaaccgatgctccag

SEQ ID NO: 3748817 - DNA, 21 bp, Homo sapiens
tccgacaaccgatgctccagc

SEQ ID NO: 3748818 - DNA, 22 bp, Homo sapiens
tccgacaaccgatgctccagcc

SEQ ID NO: 3748819 - DNA, 20 bp, Homo sapiens
tccgaccactaattgccaag

SEQ ID NO: 3748820 - DNA, 13 bp, Homo sapiens
tccgaccagacac

SEQ ID NO: 3748821 - DNA, 17 bp, Homo sapiens
tccgaccagacaccttg

SEQ ID NO: 3748822 - DNA, 22 bp, Homo sapiens
tccgccctcaaaatgacagcca

SEQ ID NO: 3748823 - DNA, 17 bp, Homo sapiens
tccgcctctgctggcac

SEQ ID NO: 3748824 - DNA, 20 bp, Homo sapiens
tccgctttctacccagcgag

SEQ ID NO: 3748825 - DNA, 21 bp, Homo sapiens
tccgctttctacccagcgagc

SEQ ID NO: 3748826 - DNA, 22 bp, Homo sapiens
tccggaatcctgtcctcagctt

SEQ ID NO: 3748827 - DNA, 15 bp, Homo sapiens
tccggagtagctggg

SEQ ID NO: 3748828 - DNA, 13 bp, Homo sapiens
tccgtatttcaga

SEQ ID NO: 3748829 - DNA, 20 bp, Homo sapiens
tccgtctaagtcatgagctg

SEQ ID NO: 3748830 - DNA, 18 bp, Homo sapiens
tccgtgatccatccatct

SEQ ID NO: 3748831 - DNA, 20 bp, Homo sapiens
tccgtgatccatccatctcc

SEQ ID NO: 3748832 - DNA, 19 bp, Homo sapiens
tcctaaatgcagtgaattg

SEQ ID NO: 3748833 - DNA, 12 bp, Homo sapiens
tcctaaatgtat

SEQ ID NO: 3748834 - DNA, 16 bp, Homo sapiens
tcctaacaggatgaaa

SEQ ID NO: 3748835 - DNA, 22 bp, Homo sapiens
tcctaagttcttagatatcttt

SEQ ID NO: 3748836 - DNA, 15 bp, Homo sapiens
tcctaatcatccaat

SEQ ID NO: 3748837 - DNA, 19 bp, Homo sapiens
tcctacaagagcagcctgt

SEQ ID NO: 3748838 - DNA, 14 bp, Homo sapiens
tcctaccaacctct

SEQ ID NO: 3748839 - DNA, 13 bp, Homo sapiens
tcctacctcagcc

SEQ ID NO: 3748840 - DNA, 17 bp, Homo sapiens
tcctacctcagcctaga

SEQ ID NO: 3748841 - DNA, 20 bp, Homo sapiens
tcctacgtcaaacatgaagt

SEQ ID NO: 3748842 - DNA, 14 bp, Homo sapiens
tcctactctgtgtc

SEQ ID NO: 3748843 - DNA, 21 bp, Homo sapiens
tcctagaaattccccaccctg

SEQ ID NO: 3748844 - DNA, 20 bp, Homo sapiens
tcctagcactttgggaggcc

SEQ ID NO: 3748845 - DNA, 21 bp, Homo sapiens
tcctagcctgtgcctctggga

SEQ ID NO: 3748846 - DNA, 21 bp, Homo sapiens
tcctagcttgggaggcttccc

SEQ ID NO: 3748847 - DNA, 13 bp, Homo sapiens
tcctaggcatttg

SEQ ID NO: 3748848 - DNA, 20 bp, Homo sapiens
tcctagggaaaagttcatag

SEQ ID NO: 3748849 - DNA, 18 bp, Homo sapiens
tcctatatagtttattga

SEQ ID NO: 3748850 - DNA, 18 bp, Homo sapiens
tcctatattgttttcagt

SEQ ID NO: 3748851 - DNA, 20 bp, Homo sapiens
tcctatcaagccagtacgtg

SEQ ID NO: 3748852 - DNA, 17 bp, Homo sapiens
tcctatcagaagtttct

SEQ ID NO: 3748853 - DNA, 12 bp, Homo sapiens
tcctatcccatc

SEQ ID NO: 3748854 - DNA, 15 bp, Homo sapiens
tcctatcccatccca

SEQ ID NO: 3748855 - DNA, 18 bp, Homo sapiens
tcctatcccatcccatcc

SEQ ID NO: 3748856 - DNA, 16 bp, Homo sapiens
tcctcacccccagctt

SEQ ID NO: 3748857 - DNA, 21 bp, Homo sapiens
tcctcacctctggactggcta

SEQ ID NO: 3748858 - DNA, 22 bp, Homo sapiens
tcctcacctctggactggctag

SEQ ID NO: 3748859 - DNA, 23 bp, Homo sapiens
tcctcacctctggactggctaga

SEQ ID NO: 3748860 - DNA, 19 bp, Homo sapiens
tcctcactcccttcccata

SEQ ID NO: 3748861 - DNA, 14 bp, Homo sapiens
tcctcactgggtgg

SEQ ID NO: 3748862 - DNA, 15 bp, Homo sapiens
tcctcagactgctca

SEQ ID NO: 3748863 - DNA, 13 bp, Homo sapiens
tcctcaggctgct

SEQ ID NO: 3748864 - DNA, 22 bp, Homo sapiens
tcctcagggacagagacacctg

SEQ ID NO: 3748865 - DNA, 24 bp, Homo sapiens
tcctcagggacagagacacctgca

SEQ ID NO: 3748866 - DNA, 19 bp, Homo sapiens
tcctccagggccacgtgcc

SEQ ID NO: 3748867 - DNA, 12 bp, Homo sapiens
tcctcccacctc

SEQ ID NO: 3748868 - DNA, 10 bp, Homo sapiens
tcctccccag

SEQ ID NO: 3748869 - DNA, 22 bp, Homo sapiens
tcctccccattagagtcagcct

SEQ ID NO: 3748870 - DNA, 23 bp, Homo sapiens
tcctccccctgccagtgccttac

SEQ ID NO: 3748871 - DNA, 24 bp, Homo sapiens
tcctccccctgccagtgccttacc

SEQ ID NO: 3748872 - DNA, 13 bp, Homo sapiens
tcctccccttccc

SEQ ID NO: 3748873 - DNA, 14 bp, Homo sapiens
tcctccccttccct

SEQ ID NO: 3748874 - DNA, 15 bp, Homo sapiens
tcctccccttccctg

SEQ ID NO: 3748875 - DNA, 17 bp, Homo sapiens
tcctccctccctctttc

SEQ ID NO: 3748876 - DNA, 15 bp, Homo sapiens
tcctcctcccccaga

SEQ ID NO: 3748877 - DNA, 13 bp, Homo sapiens
tcctcgcaagctg

SEQ ID NO: 3748878 - DNA, 15 bp, Homo sapiens
tcctcgcaagctggg

SEQ ID NO: 3748879 - DNA, 14 bp, Homo sapiens
tcctcgccctgggt

SEQ ID NO: 3748880 - DNA, 19 bp, Homo sapiens
tcctctacttaatgagata

SEQ ID NO: 3748881 - DNA, 13 bp, Homo sapiens
tcctctccactgc

SEQ ID NO: 3748882 - DNA, 15 bp, Homo sapiens
tcctctccactgcct

SEQ ID NO: 3748883 - DNA, 17 bp, Homo sapiens
tcctctcccctctaagg

SEQ ID NO: 3748884 - DNA, 19 bp, Homo sapiens
tcctctctaacctccttta

SEQ ID NO: 3748885 - DNA, 12 bp, Homo sapiens
tcctctgccacc

SEQ ID NO: 3748886 - DNA, 22 bp, Homo sapiens
tcctctgccacctcccctatcc

SEQ ID NO: 3748887 - DNA, 13 bp, Homo sapiens
tcctctgccaggc

SEQ ID NO: 3748888 - DNA, 17 bp, Homo sapiens
tcctctgtccaggcact

SEQ ID NO: 3748889 - DNA, 16 bp, Homo sapiens
tcctctgtccagggcc

SEQ ID NO: 3748890 - DNA, 23 bp, Homo sapiens
tcctctgtccagggccctgagct

SEQ ID NO: 3748891 - DNA, 20 bp, Homo sapiens
tcctcttaaaaaataaaaac

SEQ ID NO: 3748892 - DNA, 17 bp, Homo sapiens
tcctctttcagaaaaca

SEQ ID NO: 3748893 - DNA, 15 bp, Homo sapiens
tcctctttgttttgt

SEQ ID NO: 3748894 - DNA, 14 bp, Homo sapiens
tcctgaaatttcag

SEQ ID NO: 3748895 - DNA, 22 bp, Homo sapiens
tcctgacggcgcccccagtgtg

SEQ ID NO: 3748896 - DNA, 19 bp, Homo sapiens
tcctgaggatcagaaagta

SEQ ID NO: 3748897 - DNA, 20 bp, Homo sapiens
tcctgaggggcatctgcccc

SEQ ID NO: 3748898 - DNA, 21 bp, Homo sapiens
tcctgaggggcatctgcccct

SEQ ID NO: 3748899 - DNA, 14 bp, Homo sapiens
tcctgatgacccag

SEQ ID NO: 3748900 - DNA, 17 bp, Homo sapiens
tcctgcaaaattttata

SEQ ID NO: 3748901 - DNA, 15 bp, Homo sapiens
tcctgcagcagagcc

SEQ ID NO: 3748902 - DNA, 11 bp, Homo sapiens
tcctgcatgca

SEQ ID NO: 3748903 - DNA, 11 bp, Homo sapiens
tcctgccaaaa

SEQ ID NO: 3748904 - DNA, 13 bp, Homo sapiens
tcctgccacctgc

SEQ ID NO: 3748905 - DNA, 12 bp, Homo sapiens
tcctgcccagga

SEQ ID NO: 3748906 - DNA, 18 bp, Homo sapiens
tcctgcccaggagagcca

SEQ ID NO: 3748907 - DNA, 22 bp, Homo sapiens
tcctgcccaggagagccagccc

SEQ ID NO: 3748908 - DNA, 23 bp, Homo sapiens
tcctgcccaggagagccagccct

SEQ ID NO: 3748909 - DNA, 13 bp, Homo sapiens
tcctgcccagtgt

SEQ ID NO: 3748910 - DNA, 17 bp, Homo sapiens
tcctgcccagtgttgtt

SEQ ID NO: 3748911 - DNA, 22 bp, Homo sapiens
tcctgcccccacacctggccct

SEQ ID NO: 3748912 - DNA, 23 bp, Homo sapiens
tcctgccgcccgaggtggctgcc

SEQ ID NO: 3748913 - DNA, 11 bp, Homo sapiens
tcctgcctact

SEQ ID NO: 3748914 - DNA, 14 bp, Homo sapiens
tcctgcctcagcct

SEQ ID NO: 3748915 - DNA, 15 bp, Homo sapiens
tcctgcctcagcctc

SEQ ID NO: 3748916 - DNA, 14 bp, Homo sapiens
tcctgcctggtctc

SEQ ID NO: 3748917 - DNA, 18 bp, Homo sapiens
tcctgcctggtctcctgc

SEQ ID NO: 3748918 - DNA, 20 bp, Homo sapiens
tcctgcctgtctcctttgca

SEQ ID NO: 3748919 - DNA, 12 bp, Homo sapiens
tcctgcgggctt

SEQ ID NO: 3748920 - DNA, 14 bp, Homo sapiens
tcctgctactctgt

SEQ ID NO: 3748921 - DNA, 14 bp, Homo sapiens
tcctgctagaaatg

SEQ ID NO: 3748922 - DNA, 15 bp, Homo sapiens
tcctgctctctaccc

SEQ ID NO: 3748923 - DNA, 17 bp, Homo sapiens
tcctgctctctacccag

SEQ ID NO: 3748924 - DNA, 20 bp, Homo sapiens
tcctggcaatagtgtgttct

SEQ ID NO: 3748925 - DNA, 21 bp, Homo sapiens
tcctggcaatagtgtgttctg

SEQ ID NO: 3748926 - DNA, 14 bp, Homo sapiens
tcctggctacatcc

SEQ ID NO: 3748927 - DNA, 17 bp, Homo sapiens
tcctggctacatcccag

SEQ ID NO: 3748928 - DNA, 18 bp, Homo sapiens
tcctggctacatcccagc

SEQ ID NO: 3748929 - DNA, 21 bp, Homo sapiens
tcctggctacatcccagcctg

SEQ ID NO: 3748930 - DNA, 16 bp, Homo sapiens
tcctggctttgcccaa

SEQ ID NO: 3748931 - DNA, 18 bp, Homo sapiens
tcctgggagaacctcagg

SEQ ID NO: 3748932 - DNA, 14 bp, Homo sapiens
tcctgggcccctcc

SEQ ID NO: 3748933 - DNA, 18 bp, Homo sapiens
tcctgggcccctccctac

SEQ ID NO: 3748934 - DNA, 22 bp, Homo sapiens
tcctgggcccctccctacctca

SEQ ID NO: 3748935 - DNA, 23 bp, Homo sapiens
tcctgggcccctccctacctcaa

SEQ ID NO: 3748936 - DNA, 16 bp, Homo sapiens
tcctgggctcaagcaa

SEQ ID NO: 3748937 - DNA, 13 bp, Homo sapiens
tcctgggctcagg

SEQ ID NO: 3748938 - DNA, 18 bp, Homo sapiens
tcctggggctctgtgcag

SEQ ID NO: 3748939 - DNA, 11 bp, Homo sapiens
tcctgggggcc

SEQ ID NO: 3748940 - DNA, 18 bp, Homo sapiens
tcctgggggcctgacctc

SEQ ID NO: 3748941 - DNA, 23 bp, Homo sapiens
tcctgggggttctttcttcctct

SEQ ID NO: 3748942 - DNA, 15 bp, Homo sapiens
tcctgggtggtctgc

SEQ ID NO: 3748943 - DNA, 17 bp, Homo sapiens
tcctgtacactgaatat

SEQ ID NO: 3748944 - DNA, 18 bp, Homo sapiens
tcctgtccaacctaaccc

SEQ ID NO: 3748945 - DNA, 14 bp, Homo sapiens
tcctgtccagagag

SEQ ID NO: 3748946 - DNA, 13 bp, Homo sapiens
tcctgtccgccct

SEQ ID NO: 3748947 - DNA, 22 bp, Homo sapiens
tcctgtccttctctcacctcct

SEQ ID NO: 3748948 - DNA, 11 bp, Homo sapiens
tcctgtctccc

SEQ ID NO: 3748949 - DNA, 12 bp, Homo sapiens
tcctgtctcccc

SEQ ID NO: 3748950 - DNA, 14 bp, Homo sapiens
tcctgtctcccctc

SEQ ID NO: 3748951 - DNA, 15 bp, Homo sapiens
tcctgtcttcctgca

SEQ ID NO: 3748952 - DNA, 23 bp, Homo sapiens
tcctgtgtcttgcaatggcagcc

SEQ ID NO: 3748953 - DNA, 24 bp, Homo sapiens
tcctgtgtcttgcaatggcagcct

SEQ ID NO: 3748954 - DNA, 18 bp, Homo sapiens
tcctgttgaaaagccatg

SEQ ID NO: 3748955 - DNA, 22 bp, Homo sapiens
tcctgttgaaaagccatgttta

SEQ ID NO: 3748956 - DNA, 17 bp, Homo sapiens
tccttaaactgtgtgga

SEQ ID NO: 3748957 - DNA, 13 bp, Homo sapiens
tccttaagaacac

SEQ ID NO: 3748958 - DNA, 16 bp, Homo sapiens
tccttaagaacacaaa

SEQ ID NO: 3748959 - DNA, 22 bp, Homo sapiens
tccttaccgtgggcactgaagg

SEQ ID NO: 3748960 - DNA, 19 bp, Homo sapiens
tccttagagacatcaaaat

SEQ ID NO: 3748961 - DNA, 16 bp, Homo sapiens
tccttagcaacagccg

SEQ ID NO: 3748962 - DNA, 14 bp, Homo sapiens
tccttagctgccaa

SEQ ID NO: 3748963 - DNA, 20 bp, Homo sapiens
tccttagcttagacctcagc

SEQ ID NO: 3748964 - DNA, 23 bp, Homo sapiens
tccttagcttagacctcagcctg

SEQ ID NO: 3748965 - DNA, 19 bp, Homo sapiens
tccttcaagaactctgggc

SEQ ID NO: 3748966 - DNA, 20 bp, Homo sapiens
tccttcaagaactctgggct

SEQ ID NO: 3748967 - DNA, 23 bp, Homo sapiens
tccttcaagaactctgggctgct

SEQ ID NO: 3748968 - DNA, 19 bp, Homo sapiens
tccttcaagttagctcagg

SEQ ID NO: 3748969 - DNA, 20 bp, Homo sapiens
tccttcaagttagctcagga

SEQ ID NO: 3748970 - DNA, 23 bp, Homo sapiens
tccttcaagttagctcaggaggc

SEQ ID NO: 3748971 - DNA, 14 bp, Homo sapiens
tccttccaacagga

SEQ ID NO: 3748972 - DNA, 21 bp, Homo sapiens
tccttccaacaggagctggga

SEQ ID NO: 3748973 - DNA, 20 bp, Homo sapiens
tccttccaactgctgcccca

SEQ ID NO: 3748974 - DNA, 15 bp, Homo sapiens
tccttccaccaagtt

SEQ ID NO: 3748975 - DNA, 16 bp, Homo sapiens
tccttccatccctacc

SEQ ID NO: 3748976 - DNA, 17 bp, Homo sapiens
tccttccatccctaccc

SEQ ID NO: 3748977 - DNA, 17 bp, Homo sapiens
tccttcccctttcccca

SEQ ID NO: 3748978 - DNA, 23 bp, Homo sapiens
tccttctaatctgctatgcttga

SEQ ID NO: 3748979 - DNA, 14 bp, Homo sapiens
tccttctacttaca

SEQ ID NO: 3748980 - DNA, 12 bp, Homo sapiens
tccttctccctt

SEQ ID NO: 3748981 - DNA, 12 bp, Homo sapiens
tccttgataatg

SEQ ID NO: 3748982 - DNA, 22 bp, Homo sapiens
tccttgcacactcccctgcact

SEQ ID NO: 3748983 - DNA, 17 bp, Homo sapiens
tccttgcacctgcatcc

SEQ ID NO: 3748984 - DNA, 17 bp, Homo sapiens
tccttgctgtcctaggc

SEQ ID NO: 3748985 - DNA, 22 bp, Homo sapiens
tccttgcttatgacatcacttg

SEQ ID NO: 3748986 - DNA, 20 bp, Homo sapiens
tccttggcatcacagggcag

SEQ ID NO: 3748987 - DNA, 15 bp, Homo sapiens
tccttggcatgcctt

SEQ ID NO: 3748988 - DNA, 21 bp, Homo sapiens
tccttgggaggccccactggg

SEQ ID NO: 3748989 - DNA, 15 bp, Homo sapiens
tccttgtatttaaat

SEQ ID NO: 3748990 - DNA, 16 bp, Homo sapiens
tccttgtcttggcagc

SEQ ID NO: 3748991 - DNA, 19 bp, Homo sapiens
tcctttagcgcccagttgg

SEQ ID NO: 3748992 - DNA, 22 bp, Homo sapiens
tcctttagcgcccagttgggtg

SEQ ID NO: 3748993 - DNA, 23 bp, Homo sapiens
tcctttagcgcccagttgggtgg

SEQ ID NO: 3748994 - DNA, 19 bp, Homo sapiens
tcctttcaatggtttgcaa

SEQ ID NO: 3748995 - DNA, 16 bp, Homo sapiens
tcctttcacaaccttc

SEQ ID NO: 3748996 - DNA, 19 bp, Homo sapiens
tcctttcacaaccttctgt

SEQ ID NO: 3748997 - DNA, 20 bp, Homo sapiens
tcctttcacaaccttctgtg

SEQ ID NO: 3748998 - DNA, 18 bp, Homo sapiens
tcctttcatccccacctt

SEQ ID NO: 3748999 - DNA, 13 bp, Homo sapiens
tcctttccctcca

SEQ ID NO: 3749000 - DNA, 12 bp, Homo sapiens
tcctttcccttt

SEQ ID NO: 3749001 - DNA, 13 bp, Homo sapiens
tcctttctggctt

SEQ ID NO: 3749002 - DNA, 15 bp, Homo sapiens
tcctttctttctaac

SEQ ID NO: 3749003 - DNA, 22 bp, Homo sapiens
tcctttgatcagtataattttt

SEQ ID NO: 3749004 - DNA, 16 bp, Homo sapiens
tcctttgttcttacct

SEQ ID NO: 3749005 - DNA, 19 bp, Homo sapiens
tcctttgtttttttttcct

SEQ ID NO: 3749006 - DNA, 19 bp, Homo sapiens
tccttttaaaacacttcca

SEQ ID NO: 3749007 - DNA, 22 bp, Homo sapiens
tccttttcgcaggattcttcct

SEQ ID NO: 3749008 - DNA, 16 bp, Homo sapiens
tccttttctcctatct

SEQ ID NO: 3749009 - DNA, 18 bp, Homo sapiens
tcctttttcccaataaat

SEQ ID NO: 3749010 - DNA, 19 bp, Homo sapiens
tcgaacccacactgcaaca

SEQ ID NO: 3749011 - DNA, 13 bp, Homo sapiens
tcgaactggctgc

SEQ ID NO: 3749012 - DNA, 14 bp, Homo sapiens
tcgaccccaaagcc

SEQ ID NO: 3749013 - DNA, 17 bp, Homo sapiens
tcgactgtgacctgtgg

SEQ ID NO: 3749014 - DNA, 18 bp, Homo sapiens
tcgagaccaacctgacca

SEQ ID NO: 3749015 - DNA, 13 bp, Homo sapiens
tcgagaccagcct

SEQ ID NO: 3749016 - DNA, 14 bp, Homo sapiens
tcgagaccagcctg

SEQ ID NO: 3749017 - DNA, 22 bp, Homo sapiens
tcgagcagtcctgcctcagcct

SEQ ID NO: 3749018 - DNA, 17 bp, Homo sapiens
tcgaggacagggaggtg

SEQ ID NO: 3749019 - DNA, 14 bp, Homo sapiens
tcgatatttccatc

SEQ ID NO: 3749020 - DNA, 19 bp, Homo sapiens
tcgatatttccatcattaa

SEQ ID NO: 3749021 - DNA, 20 bp, Homo sapiens
tcgatctcattcagtattaa

SEQ ID NO: 3749022 - DNA, 13 bp, Homo sapiens
tcgcaagctgggt

SEQ ID NO: 3749023 - DNA, 17 bp, Homo sapiens
tcgcccaaagccagaca

SEQ ID NO: 3749024 - DNA, 23 bp, Homo sapiens
tcgcccagtctggaatgcagtgg

SEQ ID NO: 3749025 - DNA, 19 bp, Homo sapiens
tcgcccagtgccctggggc

SEQ ID NO: 3749026 - DNA, 15 bp, Homo sapiens
tcgccgtctgtgaat

SEQ ID NO: 3749027 - DNA, 18 bp, Homo sapiens
tcgctcaatcaagaaaat

SEQ ID NO: 3749028 - DNA, 18 bp, Homo sapiens
tcgctccaccttgcagct

SEQ ID NO: 3749029 - DNA, 12 bp, Homo sapiens
tcgctcctgtgt

SEQ ID NO: 3749030 - DNA, 19 bp, Homo sapiens
tcgctgatatatgtgtttt

SEQ ID NO: 3749031 - DNA, 14 bp, Homo sapiens
tcgctggcccccac

SEQ ID NO: 3749032 - DNA, 18 bp, Homo sapiens
tcgctggcccccactggc

SEQ ID NO: 3749033 - DNA, 20 bp, Homo sapiens
tcgctggcccccactggctg

SEQ ID NO: 3749034 - DNA, 21 bp, Homo sapiens
tcgctggcccccactggctgt

SEQ ID NO: 3749035 - DNA, 16 bp, Homo sapiens
tcggaagcagtgcctt

SEQ ID NO: 3749036 - DNA, 23 bp, Homo sapiens
tcggaagcagtgccttccataat

SEQ ID NO: 3749037 - DNA, 19 bp, Homo sapiens
tcggaaggctggctgggca

SEQ ID NO: 3749038 - DNA, 21 bp, Homo sapiens
tcggagacagtgatctccata

SEQ ID NO: 3749039 - DNA, 23 bp, Homo sapiens
tcggagacagtgatctccatatg

SEQ ID NO: 3749040 - DNA, 20 bp, Homo sapiens
tcggatctggggctctggga

SEQ ID NO: 3749041 - DNA, 22 bp, Homo sapiens
tcggcattggttccctttgctc

SEQ ID NO: 3749042 - DNA, 21 bp, Homo sapiens
tcggctcctggactcattgct

SEQ ID NO: 3749043 - DNA, 15 bp, Homo sapiens
tcgggaacagtgttt

SEQ ID NO: 3749044 - DNA, 14 bp, Homo sapiens
tcgggagcagtgtc

SEQ ID NO: 3749045 - DNA, 19 bp, Homo sapiens
tcgggagcagtgtcttcca

SEQ ID NO: 3749046 - DNA, 21 bp, Homo sapiens
tcgtataacacaatatgaata

SEQ ID NO: 3749047 - DNA, 19 bp, Homo sapiens
tcgtcggggggacagctcc

SEQ ID NO: 3749048 - DNA, 13 bp, Homo sapiens
tcgtgacaacact

SEQ ID NO: 3749049 - DNA, 18 bp, Homo sapiens
tcgtgctaaattttcagt

SEQ ID NO: 3749050 - DNA, 14 bp, Homo sapiens
tcgtgctttaagtg

SEQ ID NO: 3749051 - DNA, 23 bp, Homo sapiens
tcgtggaaagggtgctgcttccc

SEQ ID NO: 3749052 - DNA, 21 bp, Homo sapiens
tcgtggcagataatcagcctc

SEQ ID NO: 3749053 - DNA, 20 bp, Homo sapiens
tcgtggccttccccagcctc

SEQ ID NO: 3749054 - DNA, 17 bp, Homo sapiens
tcgttaacattgaccaa

SEQ ID NO: 3749055 - DNA, 14 bp, Homo sapiens
tcgttaactgtgta

SEQ ID NO: 3749056 - DNA, 17 bp, Homo sapiens
tcgttagggaagagaaa

SEQ ID NO: 3749057 - DNA, 17 bp, Homo sapiens
tcgtttttttcattcca

SEQ ID NO: 3749058 - DNA, 15 bp, Homo sapiens
tctaaaatcctgctt

SEQ ID NO: 3749059 - DNA, 19 bp, Homo sapiens
tctaaactttaatatgtat

SEQ ID NO: 3749060 - DNA, 15 bp, Homo sapiens
tctaaagccaaaggt

SEQ ID NO: 3749061 - DNA, 15 bp, Homo sapiens
tctaaataaaatata

SEQ ID NO: 3749062 - DNA, 13 bp, Homo sapiens
tctaaatatttcc

SEQ ID NO: 3749063 - DNA, 23 bp, Homo sapiens
tctaacatttgagtcccttccag

SEQ ID NO: 3749064 - DNA, 16 bp, Homo sapiens
tctaaccacacagcct

SEQ ID NO: 3749065 - DNA, 18 bp, Homo sapiens
tctaaccacacagcctac

SEQ ID NO: 3749066 - DNA, 18 bp, Homo sapiens
tctaaccagagcaagctt

SEQ ID NO: 3749067 - DNA, 13 bp, Homo sapiens
tctaaccagtgat

SEQ ID NO: 3749068 - DNA, 20 bp, Homo sapiens
tctaactctgatgtaaatga

SEQ ID NO: 3749069 - DNA, 21 bp, Homo sapiens
tctaagattcatccatttatt

SEQ ID NO: 3749070 - DNA, 22 bp, Homo sapiens
tctaatagcgaggctctaacca

SEQ ID NO: 3749071 - DNA, 13 bp, Homo sapiens
tctaatagtgctt

SEQ ID NO: 3749072 - DNA, 20 bp, Homo sapiens
tctaatctgctatgcttgaa

SEQ ID NO: 3749073 - DNA, 15 bp, Homo sapiens
tctaatgctcacgct

SEQ ID NO: 3749074 - DNA, 20 bp, Homo sapiens
tctaatgggtatttaaacaa

SEQ ID NO: 3749075 - DNA, 19 bp, Homo sapiens
tctaattcccattttgcaa

SEQ ID NO: 3749076 - DNA, 21 bp, Homo sapiens
tctaattgaattttcaagcat

SEQ ID NO: 3749077 - DNA, 14 bp, Homo sapiens
tctaattgccatgt

SEQ ID NO: 3749078 - DNA, 15 bp, Homo sapiens
tctacaatctattta

SEQ ID NO: 3749079 - DNA, 15 bp, Homo sapiens
tctacactctcctgg

SEQ ID NO: 3749080 - DNA, 13 bp, Homo sapiens
tctacactgtgaa

SEQ ID NO: 3749081 - DNA, 17 bp, Homo sapiens
tctacagacttctccag

SEQ ID NO: 3749082 - DNA, 14 bp, Homo sapiens
tctacagcaaattt

SEQ ID NO: 3749083 - DNA, 16 bp, Homo sapiens
tctaccaactggaagc

SEQ ID NO: 3749084 - DNA, 13 bp, Homo sapiens
tctacccagccca

SEQ ID NO: 3749085 - DNA, 14 bp, Homo sapiens
tctacccagcccat

SEQ ID NO: 3749086 - DNA, 21 bp, Homo sapiens
tctacccagcccatcttgcct

SEQ ID NO: 3749087 - DNA, 13 bp, Homo sapiens
tctacccctggat

SEQ ID NO: 3749088 - DNA, 14 bp, Homo sapiens
tctaccctggcact

SEQ ID NO: 3749089 - DNA, 14 bp, Homo sapiens
tctactcatatata

SEQ ID NO: 3749090 - DNA, 22 bp, Homo sapiens
tctactcctacctcagcctaga

SEQ ID NO: 3749091 - DNA, 19 bp, Homo sapiens
tctactccttgtaaagact

SEQ ID NO: 3749092 - DNA, 19 bp, Homo sapiens
tctacttacacatcttcca

SEQ ID NO: 3749093 - DNA, 20 bp, Homo sapiens
tctacttacacatcttccac

SEQ ID NO: 3749094 - DNA, 19 bp, Homo sapiens
tctacttctgcccttgcca

SEQ ID NO: 3749095 - DNA, 15 bp, Homo sapiens
tctagaacacaggca

SEQ ID NO: 3749096 - DNA, 16 bp, Homo sapiens
tctagaacacaggcaa

SEQ ID NO: 3749097 - DNA, 23 bp, Homo sapiens
tctagattaccccctcattgttt

SEQ ID NO: 3749098 - DNA, 15 bp, Homo sapiens
tctagattgagagaa

SEQ ID NO: 3749099 - DNA, 11 bp, Homo sapiens
tctagctgttg

SEQ ID NO: 3749100 - DNA, 19 bp, Homo sapiens
tctagctgttgagctgttt

SEQ ID NO: 3749101 - DNA, 18 bp, Homo sapiens
tctaggagctgggaggaa

SEQ ID NO: 3749102 - DNA, 21 bp, Homo sapiens
tctaggagctgggaggaaaag

SEQ ID NO: 3749103 - DNA, 18 bp, Homo sapiens
tctaggcatcccagggga

SEQ ID NO: 3749104 - DNA, 20 bp, Homo sapiens
tctagggaaggccacctgca

SEQ ID NO: 3749105 - DNA, 20 bp, Homo sapiens
tctaggtaggggcccacttc

SEQ ID NO: 3749106 - DNA, 17 bp, Homo sapiens
tctaggtagtgccctat

SEQ ID NO: 3749107 - DNA, 16 bp, Homo sapiens
tctaggtcaaggcctg

SEQ ID NO: 3749108 - DNA, 20 bp, Homo sapiens
tctaggtcagtacccacctg

SEQ ID NO: 3749109 - DNA, 16 bp, Homo sapiens
tctagtgcagctgatt

SEQ ID NO: 3749110 - DNA, 15 bp, Homo sapiens
tctatgctcataact

SEQ ID NO: 3749111 - DNA, 13 bp, Homo sapiens
tctatgggactca

SEQ ID NO: 3749112 - DNA, 19 bp, Homo sapiens
tctatgggactcaatgcac

SEQ ID NO: 3749113 - DNA, 22 bp, Homo sapiens
tctatgggtatcaaacagctca

SEQ ID NO: 3749114 - DNA, 18 bp, Homo sapiens
tctattagactttagaaa

SEQ ID NO: 3749115 - DNA, 19 bp, Homo sapiens
tctattctctcctcagact

SEQ ID NO: 3749116 - DNA, 17 bp, Homo sapiens
tctattgctggcaaaga

SEQ ID NO: 3749117 - DNA, 16 bp, Homo sapiens
tctattgggttcatta

SEQ ID NO: 3749118 - DNA, 14 bp, Homo sapiens
tctatttaagtgta

SEQ ID NO: 3749119 - DNA, 22 bp, Homo sapiens
tctatttatttactgagcttct

SEQ ID NO: 3749120 - DNA, 15 bp, Homo sapiens
tctatttctgagaag

SEQ ID NO: 3749121 - DNA, 12 bp, Homo sapiens
tctattttaatt

SEQ ID NO: 3749122 - DNA, 17 bp, Homo sapiens
tctattttgtaaactca

SEQ ID NO: 3749123 - DNA, 13 bp, Homo sapiens
tctcaaacctcca

SEQ ID NO: 3749124 - DNA, 18 bp, Homo sapiens
tctcaaacctccaaaagc

SEQ ID NO: 3749125 - DNA, 20 bp, Homo sapiens
tctcaaacggtacacagact

SEQ ID NO: 3749126 - DNA, 21 bp, Homo sapiens
tctcaaactcttgacctcagg

SEQ ID NO: 3749127 - DNA, 18 bp, Homo sapiens
tctcaaagggtacttcca

SEQ ID NO: 3749128 - DNA, 21 bp, Homo sapiens
tctcaagccgcatcccagact

SEQ ID NO: 3749129 - DNA, 20 bp, Homo sapiens
tctcacagcacactcagcac

SEQ ID NO: 3749130 - DNA, 17 bp, Homo sapiens
tctcaccccatcccaca

SEQ ID NO: 3749131 - DNA, 20 bp, Homo sapiens
tctcacgggcagtagctgtg

SEQ ID NO: 3749132 - DNA, 20 bp, Homo sapiens
tctcactatgttgcccaggc

SEQ ID NO: 3749133 - DNA, 12 bp, Homo sapiens
tctcactccacc

SEQ ID NO: 3749134 - DNA, 14 bp, Homo sapiens
tctcactccaccac

SEQ ID NO: 3749135 - DNA, 18 bp, Homo sapiens
tctcactcctacctggta

SEQ ID NO: 3749136 - DNA, 16 bp, Homo sapiens
tctcactctgtcgccc

SEQ ID NO: 3749137 - DNA, 17 bp, Homo sapiens
tctcactctgtcgccca

SEQ ID NO: 3749138 - DNA, 14 bp, Homo sapiens
tctcactgtgtccc

SEQ ID NO: 3749139 - DNA, 15 bp, Homo sapiens
tctcactgttgccca

SEQ ID NO: 3749140 - DNA, 19 bp, Homo sapiens
tctcagaaggtattccttt

SEQ ID NO: 3749141 - DNA, 21 bp, Homo sapiens
tctcagcaatgattactcttt

SEQ ID NO: 3749142 - DNA, 15 bp, Homo sapiens
tctcagccaacgagt

SEQ ID NO: 3749143 - DNA, 16 bp, Homo sapiens
tctcaggacctaggga

SEQ ID NO: 3749144 - DNA, 13 bp, Homo sapiens
tctcaggccacct

SEQ ID NO: 3749145 - DNA, 18 bp, Homo sapiens
tctcaggccacctgcccc

SEQ ID NO: 3749146 - DNA, 20 bp, Homo sapiens
tctcaggctctgccctgccc

SEQ ID NO: 3749147 - DNA, 18 bp, Homo sapiens
tctcagggaagcccagct

SEQ ID NO: 3749148 - DNA, 23 bp, Homo sapiens
tctcagggaagcccagctccagg

SEQ ID NO: 3749149 - DNA, 23 bp, Homo sapiens
tctcagtgcttcttactattaag

SEQ ID NO: 3749150 - DNA, 15 bp, Homo sapiens
tctcatccccagggg

SEQ ID NO: 3749151 - DNA, 13 bp, Homo sapiens
tctcatcctgcag

SEQ ID NO: 3749152 - DNA, 15 bp, Homo sapiens
tctcatcctgcaggc

SEQ ID NO: 3749153 - DNA, 16 bp, Homo sapiens
tctcatccttttctcc

SEQ ID NO: 3749154 - DNA, 18 bp, Homo sapiens
tctcatccttttctccta

SEQ ID NO: 3749155 - DNA, 13 bp, Homo sapiens
tctcattccccag

SEQ ID NO: 3749156 - DNA, 16 bp, Homo sapiens
tctcattccccaggtg

SEQ ID NO: 3749157 - DNA, 12 bp, Homo sapiens
tctccaaatgag

SEQ ID NO: 3749158 - DNA, 16 bp, Homo sapiens
tctccacctcagcctt

SEQ ID NO: 3749159 - DNA, 13 bp, Homo sapiens
tctccactccaga

SEQ ID NO: 3749160 - DNA, 14 bp, Homo sapiens
tctccactgccttc

SEQ ID NO: 3749161 - DNA, 20 bp, Homo sapiens
tctccagacccccacccctt

SEQ ID NO: 3749162 - DNA, 17 bp, Homo sapiens
tctccagtcttccacct

SEQ ID NO: 3749163 - DNA, 17 bp, Homo sapiens
tctccatctggcagggt

SEQ ID NO: 3749164 - DNA, 17 bp, Homo sapiens
tctcccagctctagaca

SEQ ID NO: 3749165 - DNA, 14 bp, Homo sapiens
tctcccaggccagg

SEQ ID NO: 3749166 - DNA, 23 bp, Homo sapiens
tctcccaggccaggctccttcct

SEQ ID NO: 3749167 - DNA, 15 bp, Homo sapiens
tctcccaggccccct

SEQ ID NO: 3749168 - DNA, 16 bp, Homo sapiens
tctcccaggccccctg

SEQ ID NO: 3749169 - DNA, 11 bp, Homo sapiens
tctcccagttg

SEQ ID NO: 3749170 - DNA, 15 bp, Homo sapiens
tctcccatcttaact

SEQ ID NO: 3749171 - DNA, 22 bp, Homo sapiens
tctccccacactaacctgggtt

SEQ ID NO: 3749172 - DNA, 22 bp, Homo sapiens
tctccccatgtgcctgcaccag

SEQ ID NO: 3749173 - DNA, 14 bp, Homo sapiens
tctccccctgggct

SEQ ID NO: 3749174 - DNA, 20 bp, Homo sapiens
tctccccctgggctctgccc

SEQ ID NO: 3749175 - DNA, 13 bp, Homo sapiens
tctcccctctgct

SEQ ID NO: 3749176 - DNA, 14 bp, Homo sapiens
tctcccctgccctg

SEQ ID NO: 3749177 - DNA, 18 bp, Homo sapiens
tctccctcagtctggccc

SEQ ID NO: 3749178 - DNA, 12 bp, Homo sapiens
tctccctcccct

SEQ ID NO: 3749179 - DNA, 19 bp, Homo sapiens
tctccctcgaacccacact

SEQ ID NO: 3749180 - DNA, 14 bp, Homo sapiens
tctccctctcctgc

SEQ ID NO: 3749181 - DNA, 18 bp, Homo sapiens
tctccctctcctgcctac

SEQ ID NO: 3749182 - DNA, 12 bp, Homo sapiens
tctccctgccgc

SEQ ID NO: 3749183 - DNA, 20 bp, Homo sapiens
tctcctatttttttaaaatc

SEQ ID NO: 3749184 - DNA, 12 bp, Homo sapiens
tctcctcactga

SEQ ID NO: 3749185 - DNA, 14 bp, Homo sapiens
tctcctcagactgc

SEQ ID NO: 3749186 - DNA, 12 bp, Homo sapiens
tctcctcccagg

SEQ ID NO: 3749187 - DNA, 16 bp, Homo sapiens
tctcctcgcaagctgg

SEQ ID NO: 3749188 - DNA, 15 bp, Homo sapiens
tctcctctctctgta

SEQ ID NO: 3749189 - DNA, 12 bp, Homo sapiens
tctcctcttaaa

SEQ ID NO: 3749190 - DNA, 14 bp, Homo sapiens
tctcctcttaaaaa

SEQ ID NO: 3749191 - DNA, 13 bp, Homo sapiens
tctcctcttgcca

SEQ ID NO: 3749192 - DNA, 17 bp, Homo sapiens
tctcctcttgccactgc

SEQ ID NO: 3749193 - DNA, 16 bp, Homo sapiens
tctcctcttttatctt

SEQ ID NO: 3749194 - DNA, 20 bp, Homo sapiens
tctcctgaggatcagaaagt

SEQ ID NO: 3749195 - DNA, 15 bp, Homo sapiens
tctcctgattattta

SEQ ID NO: 3749196 - DNA, 16 bp, Homo sapiens
tctcctgattatttat

SEQ ID NO: 3749197 - DNA, 20 bp, Homo sapiens
tctcctgcctgtgctgtgac

SEQ ID NO: 3749198 - DNA, 13 bp, Homo sapiens
tctcctgggcccc

SEQ ID NO: 3749199 - DNA, 15 bp, Homo sapiens
tctcctgggcccctc

SEQ ID NO: 3749200 - DNA, 20 bp, Homo sapiens
tctcctgggcccctccctac

SEQ ID NO: 3749201 - DNA, 23 bp, Homo sapiens
tctcctgggcccctccctacctc

SEQ ID NO: 3749202 - DNA, 14 bp, Homo sapiens
tctccttagtcttc

SEQ ID NO: 3749203 - DNA, 11 bp, Homo sapiens
tctccttccaa

SEQ ID NO: 3749204 - DNA, 16 bp, Homo sapiens
tctccttccaactgct

SEQ ID NO: 3749205 - DNA, 21 bp, Homo sapiens
tctccttccaactgctgcccc

SEQ ID NO: 3749206 - DNA, 19 bp, Homo sapiens
tctccttcccctttcccca

SEQ ID NO: 3749207 - DNA, 23 bp, Homo sapiens
tctcgaactcctggactcaaagt

SEQ ID NO: 3749208 - DNA, 23 bp, Homo sapiens
tctctaaatgaggggcctcaggt

SEQ ID NO: 3749209 - DNA, 15 bp, Homo sapiens
tctctaacctccttt

SEQ ID NO: 3749210 - DNA, 18 bp, Homo sapiens
tctctaactcagaaacat

SEQ ID NO: 3749211 - DNA, 22 bp, Homo sapiens
tctctaacttcaaggcccatat

SEQ ID NO: 3749212 - DNA, 20 bp, Homo sapiens
tctctacagacttctccaga

SEQ ID NO: 3749213 - DNA, 12 bp, Homo sapiens
tctctacccagc

SEQ ID NO: 3749214 - DNA, 20 bp, Homo sapiens
tctctacccagcccatcttg

SEQ ID NO: 3749215 - DNA, 22 bp, Homo sapiens
tctctagaattttaagtgcttt

SEQ ID NO: 3749216 - DNA, 20 bp, Homo sapiens
tctctagggaaggccacctg

SEQ ID NO: 3749217 - DNA, 22 bp, Homo sapiens
tctctagggaaggccacctgca

SEQ ID NO: 3749218 - DNA, 15 bp, Homo sapiens
tctctatttaaattc

SEQ ID NO: 3749219 - DNA, 23 bp, Homo sapiens
tctctatttaaattcttttttaa

SEQ ID NO: 3749220 - DNA, 18 bp, Homo sapiens
tctctatttgtattgtta

SEQ ID NO: 3749221 - DNA, 13 bp, Homo sapiens
tctctccagtgca

SEQ ID NO: 3749222 - DNA, 14 bp, Homo sapiens
tctctcctcagact

SEQ ID NO: 3749223 - DNA, 13 bp, Homo sapiens
tctctcctgtcca

SEQ ID NO: 3749224 - DNA, 23 bp, Homo sapiens
tctctcggagtatctgggaactg

SEQ ID NO: 3749225 - DNA, 16 bp, Homo sapiens
tctctctattaccact

SEQ ID NO: 3749226 - DNA, 13 bp, Homo sapiens
tctctctgcctgt

SEQ ID NO: 3749227 - DNA, 17 bp, Homo sapiens
tctctctgcctgtgagc

SEQ ID NO: 3749228 - DNA, 11 bp, Homo sapiens
tctctcttctg

SEQ ID NO: 3749229 - DNA, 14 bp, Homo sapiens
tctctcttctgctc

SEQ ID NO: 3749230 - DNA, 16 bp, Homo sapiens
tctctctttggactct

SEQ ID NO: 3749231 - DNA, 15 bp, Homo sapiens
tctctgaacttcagc

SEQ ID NO: 3749232 - DNA, 16 bp, Homo sapiens
tctctgaacttcagct

SEQ ID NO: 3749233 - DNA, 22 bp, Homo sapiens
tctctgaagagtgggtttcaca

SEQ ID NO: 3749234 - DNA, 23 bp, Homo sapiens
tctctgaagagtgggtttcacaa

SEQ ID NO: 3749235 - DNA, 19 bp, Homo sapiens
tctctgagctccagtggaa

SEQ ID NO: 3749236 - DNA, 13 bp, Homo sapiens
tctctgaggacac

SEQ ID NO: 3749237 - DNA, 22 bp, Homo sapiens
tctctgatcttgtgctcagcat

SEQ ID NO: 3749238 - DNA, 11 bp, Homo sapiens
tctctgcagcc

SEQ ID NO: 3749239 - DNA, 16 bp, Homo sapiens
tctctgcagccagccc

SEQ ID NO: 3749240 - DNA, 10 bp, Homo sapiens
tctctgccat

SEQ ID NO: 3749241 - DNA, 12 bp, Homo sapiens
tctctgcccatt

SEQ ID NO: 3749242 - DNA, 14 bp, Homo sapiens
tctctgcccattcc

SEQ ID NO: 3749243 - DNA, 15 bp, Homo sapiens
tctctgcccattccc

SEQ ID NO: 3749244 - DNA, 11 bp, Homo sapiens
tctctgctcca

SEQ ID NO: 3749245 - DNA, 17 bp, Homo sapiens
tctctgctccaccacat

SEQ ID NO: 3749246 - DNA, 19 bp, Homo sapiens
tctctgctccaccacatcc

SEQ ID NO: 3749247 - DNA, 16 bp, Homo sapiens
tctctgctggcccagc

SEQ ID NO: 3749248 - DNA, 11 bp, Homo sapiens
tctctgcttca

SEQ ID NO: 3749249 - DNA, 19 bp, Homo sapiens
tctctggcccttcttgcct

SEQ ID NO: 3749250 - DNA, 17 bp, Homo sapiens
tctctggcgacagtttt

SEQ ID NO: 3749251 - DNA, 17 bp, Homo sapiens
tctctggctaaggacag

SEQ ID NO: 3749252 - DNA, 17 bp, Homo sapiens
tctctgtctaccatctc

SEQ ID NO: 3749253 - DNA, 18 bp, Homo sapiens
tctctgtgtgcacaaata

SEQ ID NO: 3749254 - DNA, 20 bp, Homo sapiens
tctcttatagaatatttatt

SEQ ID NO: 3749255 - DNA, 13 bp, Homo sapiens
tctcttcctatcc

SEQ ID NO: 3749256 - DNA, 16 bp, Homo sapiens
tctcttcctatcccat

SEQ ID NO: 3749257 - DNA, 20 bp, Homo sapiens
tctcttcctatcccatccca

SEQ ID NO: 3749258 - DNA, 14 bp, Homo sapiens
tctcttctccactg

SEQ ID NO: 3749259 - DNA, 13 bp, Homo sapiens
tctcttctgctcc

SEQ ID NO: 3749260 - DNA, 15 bp, Homo sapiens
tctcttgagcctggg

SEQ ID NO: 3749261 - DNA, 18 bp, Homo sapiens
tctcttgagcctgggagg

SEQ ID NO: 3749262 - DNA, 22 bp, Homo sapiens
tctcttgagggagcttagccaa

SEQ ID NO: 3749263 - DNA, 18 bp, Homo sapiens
tctcttggctggcttcct

SEQ ID NO: 3749264 - DNA, 18 bp, Homo sapiens
tctcttggtttccttcct

SEQ ID NO: 3749265 - DNA, 16 bp, Homo sapiens
tctcttttctctttct

SEQ ID NO: 3749266 - DNA, 20 bp, Homo sapiens
tctcttttgaatccatgctt

SEQ ID NO: 3749267 - DNA, 23 bp, Homo sapiens
tctcttttgaatccatgcttggg

SEQ ID NO: 3749268 - DNA, 14 bp, Homo sapiens
tctgaaaatgtatg

SEQ ID NO: 3749269 - DNA, 14 bp, Homo sapiens
tctgaaagccacgt

SEQ ID NO: 3749270 - DNA, 14 bp, Homo sapiens
tctgaacttcagct

SEQ ID NO: 3749271 - DNA, 12 bp, Homo sapiens
tctgaagcagat

SEQ ID NO: 3749272 - DNA, 22 bp, Homo sapiens
tctgaaggacattgcggacagc

SEQ ID NO: 3749273 - DNA, 17 bp, Homo sapiens
tctgaagtcacatcaca

SEQ ID NO: 3749274 - DNA, 20 bp, Homo sapiens
tctgaagtcacatcacagga

SEQ ID NO: 3749275 - DNA, 16 bp, Homo sapiens
tctgaagttggacagc

SEQ ID NO: 3749276 - DNA, 17 bp, Homo sapiens
tctgaagtttcatttat

SEQ ID NO: 3749277 - DNA, 21 bp, Homo sapiens
tctgaatgtaatttgtgtaat

SEQ ID NO: 3749278 - DNA, 14 bp, Homo sapiens
tctgaattccaagt

SEQ ID NO: 3749279 - DNA, 17 bp, Homo sapiens
tctgacacacagctctg

SEQ ID NO: 3749280 - DNA, 18 bp, Homo sapiens
tctgacacacagctctgt

SEQ ID NO: 3749281 - DNA, 16 bp, Homo sapiens
tctgacattaacagtt

SEQ ID NO: 3749282 - DNA, 19 bp, Homo sapiens
tctgacattaacagttttc

SEQ ID NO: 3749283 - DNA, 21 bp, Homo sapiens
tctgacattaacagttttcca

SEQ ID NO: 3749284 - DNA, 12 bp, Homo sapiens
tctgaccacact

SEQ ID NO: 3749285 - DNA, 13 bp, Homo sapiens
tctgaccacactt

SEQ ID NO: 3749286 - DNA, 22 bp, Homo sapiens
tctgaccacacttcctgtccag

SEQ ID NO: 3749287 - DNA, 12 bp, Homo sapiens
tctgacctcagc

SEQ ID NO: 3749288 - DNA, 13 bp, Homo sapiens
tctgacctcagca

SEQ ID NO: 3749289 - DNA, 14 bp, Homo sapiens
tctgacctcagcat

SEQ ID NO: 3749290 - DNA, 15 bp, Homo sapiens
tctgacctgcaggcc

SEQ ID NO: 3749291 - DNA, 19 bp, Homo sapiens
tctgacctgcaggccaaga

SEQ ID NO: 3749292 - DNA, 14 bp, Homo sapiens
tctgactgcacgtg

SEQ ID NO: 3749293 - DNA, 20 bp, Homo sapiens
tctgactgcacgtggcttct

SEQ ID NO: 3749294 - DNA, 23 bp, Homo sapiens
tctgagaaggggaggacctctgg

SEQ ID NO: 3749295 - DNA, 20 bp, Homo sapiens
tctgagaaggtccttaatga

SEQ ID NO: 3749296 - DNA, 20 bp, Homo sapiens
tctgaggacactaaccacgc

SEQ ID NO: 3749297 - DNA, 16 bp, Homo sapiens
tctgagtcaactcctt

SEQ ID NO: 3749298 - DNA, 17 bp, Homo sapiens
tctgatattccatgaat

SEQ ID NO: 3749299 - DNA, 20 bp, Homo sapiens
tctgatattccatgaatgta

SEQ ID NO: 3749300 - DNA, 17 bp, Homo sapiens
tctgatcatccactgtg

SEQ ID NO: 3749301 - DNA, 17 bp, Homo sapiens
tctgatcgttctttcta

SEQ ID NO: 3749302 - DNA, 15 bp, Homo sapiens
tctgatcttgtgctc

SEQ ID NO: 3749303 - DNA, 13 bp, Homo sapiens
tctgatgaatctt

SEQ ID NO: 3749304 - DNA, 14 bp, Homo sapiens
tctgatgaatcttg

SEQ ID NO: 3749305 - DNA, 14 bp, Homo sapiens
tctgatgtaaatga

SEQ ID NO: 3749306 - DNA, 18 bp, Homo sapiens
tctgatgtaaatgaagta

SEQ ID NO: 3749307 - DNA, 18 bp, Homo sapiens
tctgattcccaagctctg

SEQ ID NO: 3749308 - DNA, 19 bp, Homo sapiens
tctgattcccaagctctgc

SEQ ID NO: 3749309 - DNA, 23 bp, Homo sapiens
tctgattcccaagctctgctcct

SEQ ID NO: 3749310 - DNA, 13 bp, Homo sapiens
tctgatttcagga

SEQ ID NO: 3749311 - DNA, 21 bp, Homo sapiens
tctgattttatgtaaaatttt

SEQ ID NO: 3749312 - DNA, 21 bp, Homo sapiens
tctgcaaatagaaaacaggaa

SEQ ID NO: 3749313 - DNA, 17 bp, Homo sapiens
tctgcaaggtctttggt

SEQ ID NO: 3749314 - DNA, 13 bp, Homo sapiens
tctgcacagatgg

SEQ ID NO: 3749315 - DNA, 15 bp, Homo sapiens
tctgcacagatggat

SEQ ID NO: 3749316 - DNA, 15 bp, Homo sapiens
tctgcacccccctgg

SEQ ID NO: 3749317 - DNA, 16 bp, Homo sapiens
tctgcacccccctggg

SEQ ID NO: 3749318 - DNA, 14 bp, Homo sapiens
tctgcagccagccc

SEQ ID NO: 3749319 - DNA, 15 bp, Homo sapiens
tctgcagccagccca

SEQ ID NO: 3749320 - DNA, 13 bp, Homo sapiens
tctgcaggcaggg

SEQ ID NO: 3749321 - DNA, 17 bp, Homo sapiens
tctgcattcaggatcaa

SEQ ID NO: 3749322 - DNA, 23 bp, Homo sapiens
tctgccaggcccccaagcctgca

SEQ ID NO: 3749323 - DNA, 22 bp, Homo sapiens
tctgccatattctgttggccag

SEQ ID NO: 3749324 - DNA, 19 bp, Homo sapiens
tctgccatgaactggaggc

SEQ ID NO: 3749325 - DNA, 13 bp, Homo sapiens
tctgcccagagct

SEQ ID NO: 3749326 - DNA, 14 bp, Homo sapiens
tctgcccattcccc

SEQ ID NO: 3749327 - DNA, 16 bp, Homo sapiens
tctgcccattccccag

SEQ ID NO: 3749328 - DNA, 14 bp, Homo sapiens
tctgccccagctct

SEQ ID NO: 3749329 - DNA, 15 bp, Homo sapiens
tctgcccctccccca

SEQ ID NO: 3749330 - DNA, 18 bp, Homo sapiens
tctgcccctcccccaacc

SEQ ID NO: 3749331 - DNA, 18 bp, Homo sapiens
tctgccctgccctagctc

SEQ ID NO: 3749332 - DNA, 21 bp, Homo sapiens
tctgcctctgacacacagctc

SEQ ID NO: 3749333 - DNA, 20 bp, Homo sapiens
tctgcctgcccaggcccctg

SEQ ID NO: 3749334 - DNA, 13 bp, Homo sapiens
tctgcctgtccct

SEQ ID NO: 3749335 - DNA, 11 bp, Homo sapiens
tctgcctgtga

SEQ ID NO: 3749336 - DNA, 20 bp, Homo sapiens
tctgcctttgcagaaacaga

SEQ ID NO: 3749337 - DNA, 15 bp, Homo sapiens
tctgcgtctgtgttg

SEQ ID NO: 3749338 - DNA, 17 bp, Homo sapiens
tctgctacctcactggg

SEQ ID NO: 3749339 - DNA, 14 bp, Homo sapiens
tctgctccaccaca

SEQ ID NO: 3749340 - DNA, 14 bp, Homo sapiens
tctgctccaccctt

SEQ ID NO: 3749341 - DNA, 15 bp, Homo sapiens
tctgctccacccttg

SEQ ID NO: 3749342 - DNA, 17 bp, Homo sapiens
tctgctccacccttggc

SEQ ID NO: 3749343 - DNA, 19 bp, Homo sapiens
tctgctccacccttggcct

SEQ ID NO: 3749344 - DNA, 18 bp, Homo sapiens
tctgctcctctccccagc

SEQ ID NO: 3749345 - DNA, 13 bp, Homo sapiens
tctgctgaaggaa

SEQ ID NO: 3749346 - DNA, 17 bp, Homo sapiens
tctgctgacagacacag

SEQ ID NO: 3749347 - DNA, 19 bp, Homo sapiens
tctgctgacagacacaggc

SEQ ID NO: 3749348 - DNA, 22 bp, Homo sapiens
tctgctgacagacacaggcccg

SEQ ID NO: 3749349 - DNA, 13 bp, Homo sapiens
tctgctgccctcc

SEQ ID NO: 3749350 - DNA, 14 bp, Homo sapiens
tctgctgccctcca

SEQ ID NO: 3749351 - DNA, 12 bp, Homo sapiens
tctgctggccca

SEQ ID NO: 3749352 - DNA, 21 bp, Homo sapiens
tctgctggccgggcacagctg

SEQ ID NO: 3749353 - DNA, 18 bp, Homo sapiens
tctgctgtcagtctgctt

SEQ ID NO: 3749354 - DNA, 13 bp, Homo sapiens
tctgcttcagcct

SEQ ID NO: 3749355 - DNA, 15 bp, Homo sapiens
tctgcttcagcctcc

SEQ ID NO: 3749356 - DNA, 20 bp, Homo sapiens
tctgcttgccgaaactggaa

SEQ ID NO: 3749357 - DNA, 18 bp, Homo sapiens
tctgcttgctcttgtcct

SEQ ID NO: 3749358 - DNA, 18 bp, Homo sapiens
tctgctttgactgagcag

SEQ ID NO: 3749359 - DNA, 14 bp, Homo sapiens
tctggacaggcatg

SEQ ID NO: 3749360 - DNA, 15 bp, Homo sapiens
tctggactcctctgt

SEQ ID NO: 3749361 - DNA, 19 bp, Homo sapiens
tctggactgaagcctgcag

SEQ ID NO: 3749362 - DNA, 19 bp, Homo sapiens
tctggactgccccagaaaa

SEQ ID NO: 3749363 - DNA, 15 bp, Homo sapiens
tctggactggctaga

SEQ ID NO: 3749364 - DNA, 22 bp, Homo sapiens
tctggagaagcagtgagccgca

SEQ ID NO: 3749365 - DNA, 20 bp, Homo sapiens
tctggagaggttataggtca

SEQ ID NO: 3749366 - DNA, 12 bp, Homo sapiens
tctggagccctt

SEQ ID NO: 3749367 - DNA, 22 bp, Homo sapiens
tctggaggggagctctgtctgt

SEQ ID NO: 3749368 - DNA, 23 bp, Homo sapiens
tctggataattttgcataaaatt

SEQ ID NO: 3749369 - DNA, 19 bp, Homo sapiens
tctggcagggtgggatgga

SEQ ID NO: 3749370 - DNA, 13 bp, Homo sapiens
tctggccctgcct

SEQ ID NO: 3749371 - DNA, 16 bp, Homo sapiens
tctggctagaggccag

SEQ ID NO: 3749372 - DNA, 15 bp, Homo sapiens
tctggctctccccaa

SEQ ID NO: 3749373 - DNA, 22 bp, Homo sapiens
tctgggaaatggcttgaagcca

SEQ ID NO: 3749374 - DNA, 14 bp, Homo sapiens
tctgggacacagtt

SEQ ID NO: 3749375 - DNA, 15 bp, Homo sapiens
tctgggaccctttcc

SEQ ID NO: 3749376 - DNA, 16 bp, Homo sapiens
tctgggaccctttcct

SEQ ID NO: 3749377 - DNA, 18 bp, Homo sapiens
tctgggataagtaagttt

SEQ ID NO: 3749378 - DNA, 19 bp, Homo sapiens
tctgggcaggacctcagag

SEQ ID NO: 3749379 - DNA, 23 bp, Homo sapiens
tctgggccaagttcctctagtgc

SEQ ID NO: 3749380 - DNA, 22 bp, Homo sapiens
tctgggctgctacccagaaatc

SEQ ID NO: 3749381 - DNA, 13 bp, Homo sapiens
tctggggcccctt

SEQ ID NO: 3749382 - DNA, 21 bp, Homo sapiens
tctggggttcagcccctcctc

SEQ ID NO: 3749383 - DNA, 16 bp, Homo sapiens
tctgggtggttgccct

SEQ ID NO: 3749384 - DNA, 20 bp, Homo sapiens
tctggtagatttttaacgaa

SEQ ID NO: 3749385 - DNA, 17 bp, Homo sapiens
tctggtctcctctttgt

SEQ ID NO: 3749386 - DNA, 16 bp, Homo sapiens
tctggtgacaccagcc

SEQ ID NO: 3749387 - DNA, 17 bp, Homo sapiens
tctggtgacaccagcct

SEQ ID NO: 3749388 - DNA, 15 bp, Homo sapiens
tctggttagctcagc

SEQ ID NO: 3749389 - DNA, 22 bp, Homo sapiens
tctggttagctcagccccagcc

SEQ ID NO: 3749390 - DNA, 21 bp, Homo sapiens
tctgtaagctctttgaaacaa

SEQ ID NO: 3749391 - DNA, 19 bp, Homo sapiens
tctgtaataaactcatttc

SEQ ID NO: 3749392 - DNA, 24 bp, Homo sapiens
tctgtaataaactcatttctagca

SEQ ID NO: 3749393 - DNA, 22 bp, Homo sapiens
tctgtaccatagcgctgctctt

SEQ ID NO: 3749394 - DNA, 14 bp, Homo sapiens
tctgtagctcctca

SEQ ID NO: 3749395 - DNA, 18 bp, Homo sapiens
tctgtatcggagacagtg

SEQ ID NO: 3749396 - DNA, 23 bp, Homo sapiens
tctgtatttgaatcagcctacag

SEQ ID NO: 3749397 - DNA, 18 bp, Homo sapiens
tctgtcagatgggaagac

SEQ ID NO: 3749398 - DNA, 19 bp, Homo sapiens
tctgtcagatgggaagaca

SEQ ID NO: 3749399 - DNA, 22 bp, Homo sapiens
tctgtccaaaggaggctggcag

SEQ ID NO: 3749400 - DNA, 17 bp, Homo sapiens
tctgtccagggccctga

SEQ ID NO: 3749401 - DNA, 20 bp, Homo sapiens
tctgtccagggccctgagct

SEQ ID NO: 3749402 - DNA, 20 bp, Homo sapiens
tctgtccgtttactccaagg

SEQ ID NO: 3749403 - DNA, 14 bp, Homo sapiens
tctgtctaccatct

SEQ ID NO: 3749404 - DNA, 21 bp, Homo sapiens
tctgtctcaaaaaataaaaat

SEQ ID NO: 3749405 - DNA, 15 bp, Homo sapiens
tctgtctcatatgat

SEQ ID NO: 3749406 - DNA, 17 bp, Homo sapiens
tctgtcttcaagggctt

SEQ ID NO: 3749407 - DNA, 22 bp, Homo sapiens
tctgtcttcacagctctgtgtt

SEQ ID NO: 3749408 - DNA, 17 bp, Homo sapiens
tctgtgaaatgctggca

SEQ ID NO: 3749409 - DNA, 21 bp, Homo sapiens
tctgtgaacgatttagaaaga

SEQ ID NO: 3749410 - DNA, 19 bp, Homo sapiens
tctgtgcccagctcagtct

SEQ ID NO: 3749411 - DNA, 17 bp, Homo sapiens
tctgtgccccatgcctg

SEQ ID NO: 3749412 - DNA, 21 bp, Homo sapiens
tctgtgcctggagctcctggg

SEQ ID NO: 3749413 - DNA, 22 bp, Homo sapiens
tctgtgcgtgaaacacaccagg

SEQ ID NO: 3749414 - DNA, 15 bp, Homo sapiens
tctgtgtcagcctgt

SEQ ID NO: 3749415 - DNA, 12 bp, Homo sapiens
ggatgagaaagg

SEQ ID NO: 3749416 - DNA, 17 bp, Homo sapiens
ggatgaggtgctgggag

SEQ ID NO: 3749417 - DNA, 16 bp, Homo sapiens
ggatgcagagtcagca

SEQ ID NO: 3749418 - DNA, 18 bp, Homo sapiens
ggatgcagagtcagcaga

SEQ ID NO: 3749419 - DNA, 13 bp, Homo sapiens
ggatgcagcatta

SEQ ID NO: 3749420 - DNA, 23 bp, Homo sapiens
ggatgcccagggccactctgcct

SEQ ID NO: 3749421 - DNA, 18 bp, Homo sapiens
ggatgcctggtggcagct

SEQ ID NO: 3749422 - DNA, 20 bp, Homo sapiens
ggatgcctggtggcagctgc

SEQ ID NO: 3749423 - DNA, 14 bp, Homo sapiens
ggatgctgcctgag

SEQ ID NO: 3749424 - DNA, 11 bp, Homo sapiens
ggatgcttcat

SEQ ID NO: 3749425 - DNA, 21 bp, Homo sapiens
ggatggaggggtggtcctgac

SEQ ID NO: 3749426 - DNA, 12 bp, Homo sapiens
ggatgggaagga

SEQ ID NO: 3749427 - DNA, 20 bp, Homo sapiens
ggatggtcctggggctctgt

SEQ ID NO: 3749428 - DNA, 17 bp, Homo sapiens
ggatgtaaacagtgcct

SEQ ID NO: 3749429 - DNA, 21 bp, Homo sapiens
ggatgtaaacagtgcctgctg

SEQ ID NO: 3749430 - DNA, 23 bp, Homo sapiens
ggatgtatccatgggggcagggc

SEQ ID NO: 3749431 - DNA, 17 bp, Homo sapiens
ggatgtccacagatgcc

SEQ ID NO: 3749432 - DNA, 15 bp, Homo sapiens
ggatgttctgggaca

SEQ ID NO: 3749433 - DNA, 23 bp, Homo sapiens
ggatgtttctgtcacatcagctc

SEQ ID NO: 3749434 - DNA, 19 bp, Homo sapiens
ggattacaagcgtgagcca

SEQ ID NO: 3749435 - DNA, 19 bp, Homo sapiens
ggattcctaagactgctgc

SEQ ID NO: 3749436 - DNA, 13 bp, Homo sapiens
ggattctgggagg

SEQ ID NO: 3749437 - DNA, 19 bp, Homo sapiens
ggattgaaggatgctgtct

SEQ ID NO: 3749438 - DNA, 17 bp, Homo sapiens
ggattgcttgagcccag

SEQ ID NO: 3749439 - DNA, 19 bp, Homo sapiens
ggattggggaagactgtgg

SEQ ID NO: 3749440 - DNA, 13 bp, Homo sapiens
ggatttctcccag

SEQ ID NO: 3749441 - DNA, 15 bp, Homo sapiens
ggcaaaaaggcagga

SEQ ID NO: 3749442 - DNA, 21 bp, Homo sapiens
ggcaacacagcgagactccgt

SEQ ID NO: 3749443 - DNA, 21 bp, Homo sapiens
ggcaaccacaggcagcattta

SEQ ID NO: 3749444 - DNA, 19 bp, Homo sapiens
ggcaaccttgtctctatgc

SEQ ID NO: 3749445 - DNA, 20 bp, Homo sapiens
ggcaacgaagaaaaaaaata

SEQ ID NO: 3749446 - DNA, 13 bp, Homo sapiens
ggcaactgaggca

SEQ ID NO: 3749447 - DNA, 20 bp, Homo sapiens
ggcaactgaggcagacagca

SEQ ID NO: 3749448 - DNA, 23 bp, Homo sapiens
ggcaacttgggaactagactccc

SEQ ID NO: 3749449 - DNA, 18 bp, Homo sapiens
ggcaagaaggaattgact

SEQ ID NO: 3749450 - DNA, 15 bp, Homo sapiens
ggcaaggggtgcctg

SEQ ID NO: 3749451 - DNA, 23 bp, Homo sapiens
ggcaagtccctgactctctgtga

SEQ ID NO: 3749452 - DNA, 18 bp, Homo sapiens
ggcaatagtgtgttctga

SEQ ID NO: 3749453 - DNA, 16 bp, Homo sapiens
ggcaatataaccaatg

SEQ ID NO: 3749454 - DNA, 21 bp, Homo sapiens
ggcaatatagcaagatcccat

SEQ ID NO: 3749455 - DNA, 15 bp, Homo sapiens
ggcaatgatggcaat

SEQ ID NO: 3749456 - DNA, 23 bp, Homo sapiens
ggcaatgctggctgttggctggg

SEQ ID NO: 3749457 - DNA, 18 bp, Homo sapiens
ggcaatgtcaggaacaga

SEQ ID NO: 3749458 - DNA, 21 bp, Homo sapiens
ggcacacacctgtagtcccag

SEQ ID NO: 3749459 - DNA, 17 bp, Homo sapiens
ggcacagccggggcctg

SEQ ID NO: 3749460 - DNA, 16 bp, Homo sapiens
ggcacagggcagtggg

SEQ ID NO: 3749461 - DNA, 16 bp, Homo sapiens
ggcacatttccccaga

SEQ ID NO: 3749462 - DNA, 13 bp, Homo sapiens
ggcacattttttt

SEQ ID NO: 3749463 - DNA, 23 bp, Homo sapiens
ggcacatttttttttttaatttt

SEQ ID NO: 3749464 - DNA, 16 bp, Homo sapiens
ggcaccaagcccacag

SEQ ID NO: 3749465 - DNA, 19 bp, Homo sapiens
ggcaccattcaggaacctg

SEQ ID NO: 3749466 - DNA, 20 bp, Homo sapiens
ggcacccaccatcatgtctg

SEQ ID NO: 3749467 - DNA, 16 bp, Homo sapiens
ggcacccatcctagag

SEQ ID NO: 3749468 - DNA, 19 bp, Homo sapiens
ggcacccggcccctgctgg

SEQ ID NO: 3749469 - DNA, 18 bp, Homo sapiens
ggcacctatagtcccagc

SEQ ID NO: 3749470 - DNA, 19 bp, Homo sapiens
ggcacgaacccacctgctg

SEQ ID NO: 3749471 - DNA, 20 bp, Homo sapiens
ggcacgagcaaagtgaagac

SEQ ID NO: 3749472 - DNA, 13 bp, Homo sapiens
ggcacgctgtggg

SEQ ID NO: 3749473 - DNA, 15 bp, Homo sapiens
ggcactggtggcccg

SEQ ID NO: 3749474 - DNA, 16 bp, Homo sapiens
ggcagaaagtggccat

SEQ ID NO: 3749475 - DNA, 14 bp, Homo sapiens
ggcagaaccctggt

SEQ ID NO: 3749476 - DNA, 15 bp, Homo sapiens
ggcagaactgagctc

SEQ ID NO: 3749477 - DNA, 17 bp, Homo sapiens
ggcagaagaattgaacc

SEQ ID NO: 3749478 - DNA, 19 bp, Homo sapiens
ggcagaataatctttgggt

SEQ ID NO: 3749479 - DNA, 16 bp, Homo sapiens
ggcagacagcagctca

SEQ ID NO: 3749480 - DNA, 17 bp, Homo sapiens
ggcagacagcagctcag

SEQ ID NO: 3749481 - DNA, 16 bp, Homo sapiens
ggcagagccgggaagc

SEQ ID NO: 3749482 - DNA, 13 bp, Homo sapiens
ggcagaggctgga

SEQ ID NO: 3749483 - DNA, 21 bp, Homo sapiens
ggcagaggctggaggcagggc

SEQ ID NO: 3749484 - DNA, 22 bp, Homo sapiens
ggcagaggctggaggcagggcc

SEQ ID NO: 3749485 - DNA, 19 bp, Homo sapiens
ggcagagggcagaggctgg

SEQ ID NO: 3749486 - DNA, 20 bp, Homo sapiens
ggcagagggcagaggctgga

SEQ ID NO: 3749487 - DNA, 20 bp, Homo sapiens
ggcagaggttgcagtgagct

SEQ ID NO: 3749488 - DNA, 22 bp, Homo sapiens
ggcagagtgccccacctgccac

SEQ ID NO: 3749489 - DNA, 20 bp, Homo sapiens
ggcagataatcagcctctta

SEQ ID NO: 3749490 - DNA, 17 bp, Homo sapiens
ggcagatctgtgcccca

SEQ ID NO: 3749491 - DNA, 13 bp, Homo sapiens
ggcagattgaaaa

SEQ ID NO: 3749492 - DNA, 17 bp, Homo sapiens
ggcagcatagcaagaca

SEQ ID NO: 3749493 - DNA, 19 bp, Homo sapiens
ggcagcatagcaagacaca

SEQ ID NO: 3749494 - DNA, 18 bp, Homo sapiens
ggcagccaaacccatgag

SEQ ID NO: 3749495 - DNA, 23 bp, Homo sapiens
ggcagccccagcaccaccaggtc

SEQ ID NO: 3749496 - DNA, 21 bp, Homo sapiens
ggcagccccattctgcctgcc

SEQ ID NO: 3749497 - DNA, 22 bp, Homo sapiens
ggcagccccattctgcctgccc

SEQ ID NO: 3749498 - DNA, 23 bp, Homo sapiens
ggcagccccattctgcctgccca

SEQ ID NO: 3749499 - DNA, 13 bp, Homo sapiens
ggcagccctgtag

SEQ ID NO: 3749500 - DNA, 15 bp, Homo sapiens
ggcagccctgtaggg

SEQ ID NO: 3749501 - DNA, 22 bp, Homo sapiens
ggcagcctgcgtggctgacccc

SEQ ID NO: 3749502 - DNA, 21 bp, Homo sapiens
ggcagcgtactcatcatcaac

SEQ ID NO: 3749503 - DNA, 16 bp, Homo sapiens
ggcagctgccagagaa

SEQ ID NO: 3749504 - DNA, 21 bp, Homo sapiens
ggcagctgcggtccacccagg

SEQ ID NO: 3749505 - DNA, 22 bp, Homo sapiens
ggcagctgcttttgtctatggg

SEQ ID NO: 3749506 - DNA, 21 bp, Homo sapiens
ggcagcttgagggttgggctg

SEQ ID NO: 3749507 - DNA, 19 bp, Homo sapiens
ggcaggacaacgaggaagc

SEQ ID NO: 3749508 - DNA, 15 bp, Homo sapiens
ggcaggacctcagag

SEQ ID NO: 3749509 - DNA, 21 bp, Homo sapiens
ggcaggacctcagagtccagg

SEQ ID NO: 3749510 - DNA, 15 bp, Homo sapiens
ggcaggagctcagat

SEQ ID NO: 3749511 - DNA, 24 bp, Homo sapiens
ggcaggaggattgcttgagcccag

SEQ ID NO: 3749512 - DNA, 16 bp, Homo sapiens
ggcaggctggctggcc

SEQ ID NO: 3749513 - DNA, 18 bp, Homo sapiens
ggcagggaaaggctctga

SEQ ID NO: 3749514 - DNA, 13 bp, Homo sapiens
ggcagggagggga

SEQ ID NO: 3749515 - DNA, 15 bp, Homo sapiens
ggcagggcatctcct

SEQ ID NO: 3749516 - DNA, 16 bp, Homo sapiens
ggcagggccttgccca

SEQ ID NO: 3749517 - DNA, 20 bp, Homo sapiens
ggcagggccttgcccagaga

SEQ ID NO: 3749518 - DNA, 14 bp, Homo sapiens
ggcagggctctgat

SEQ ID NO: 3749519 - DNA, 15 bp, Homo sapiens
ggcagggctgactct

SEQ ID NO: 3749520 - DNA, 18 bp, Homo sapiens
ggcagggtctcactctgt

SEQ ID NO: 3749521 - DNA, 16 bp, Homo sapiens
ggcagggtgggatgga

SEQ ID NO: 3749522 - DNA, 17 bp, Homo sapiens
ggcaggtgggagcttga

SEQ ID NO: 3749523 - DNA, 15 bp, Homo sapiens
ggcaggttggtgggg

SEQ ID NO: 3749524 - DNA, 15 bp, Homo sapiens
ggcagtaaagagaaa

SEQ ID NO: 3749525 - DNA, 13 bp, Homo sapiens
ggcagtctggagg

SEQ ID NO: 3749526 - DNA, 14 bp, Homo sapiens
ggcagtctggaggg

SEQ ID NO: 3749527 - DNA, 21 bp, Homo sapiens
ggcagtctggaggggcatggc

SEQ ID NO: 3749528 - DNA, 18 bp, Homo sapiens
ggcagtgatgctggatgc

SEQ ID NO: 3749529 - DNA, 14 bp, Homo sapiens
ggcagtgggagctg

SEQ ID NO: 3749530 - DNA, 16 bp, Homo sapiens
ggcagtgggagctgcc

SEQ ID NO: 3749531 - DNA, 17 bp, Homo sapiens
ggcagtgggagctgcct

SEQ ID NO: 3749532 - DNA, 18 bp, Homo sapiens
ggcagtgggagctgcctg

SEQ ID NO: 3749533 - DNA, 19 bp, Homo sapiens
ggcagtgggagctgcctgt

SEQ ID NO: 3749534 - DNA, 13 bp, Homo sapiens
ggcagtggggctg

SEQ ID NO: 3749535 - DNA, 17 bp, Homo sapiens
ggcagttagagatgcct

SEQ ID NO: 3749536 - DNA, 15 bp, Homo sapiens
ggcagttctgggtgc

SEQ ID NO: 3749537 - DNA, 21 bp, Homo sapiens
ggcatacgcctgtagtcctag

SEQ ID NO: 3749538 - DNA, 15 bp, Homo sapiens
ggcatcccaggggac

SEQ ID NO: 3749539 - DNA, 16 bp, Homo sapiens
ggcatctcctgtgcat

SEQ ID NO: 3749540 - DNA, 17 bp, Homo sapiens
ggcatctcctgtgcatg

SEQ ID NO: 3749541 - DNA, 16 bp, Homo sapiens
ggcatctgacacaaaa

SEQ ID NO: 3749542 - DNA, 20 bp, Homo sapiens
ggcatctgacacaaaaaaag

SEQ ID NO: 3749543 - DNA, 15 bp, Homo sapiens
ggcatctgcaccctc

SEQ ID NO: 3749544 - DNA, 22 bp, Homo sapiens
ggcatctgcaccctcgatgaag

SEQ ID NO: 3749545 - DNA, 18 bp, Homo sapiens
ggcatctgcccctccccc

SEQ ID NO: 3749546 - DNA, 17 bp, Homo sapiens
ggcatctttgccttggg

SEQ ID NO: 3749547 - DNA, 21 bp, Homo sapiens
ggcatctttgccttgggctgc

SEQ ID NO: 3749548 - DNA, 23 bp, Homo sapiens
ggcatctttgccttgggctgctc

SEQ ID NO: 3749549 - DNA, 14 bp, Homo sapiens
ggcatgagggatca

SEQ ID NO: 3749550 - DNA, 19 bp, Homo sapiens
ggcatgagggatcacaggg

SEQ ID NO: 3749551 - DNA, 16 bp, Homo sapiens
ggcatgctggggcaag

SEQ ID NO: 3749552 - DNA, 18 bp, Homo sapiens
ggcatggccaggtggcca

SEQ ID NO: 3749553 - DNA, 16 bp, Homo sapiens
ggcatggctccagtct

SEQ ID NO: 3749554 - DNA, 21 bp, Homo sapiens
ggcatggtggcgcaagcctgt

SEQ ID NO: 3749555 - DNA, 15 bp, Homo sapiens
ggcattcctgcttat

SEQ ID NO: 3749556 - DNA, 12 bp, Homo sapiens
ggcattctctga

SEQ ID NO: 3749557 - DNA, 23 bp, Homo sapiens
ggcattgatggggaaggaggctg

SEQ ID NO: 3749558 - DNA, 13 bp, Homo sapiens
ggcattgctttcc

SEQ ID NO: 3749559 - DNA, 14 bp, Homo sapiens
ggcatttgctgaat

SEQ ID NO: 3749560 - DNA, 15 bp, Homo sapiens
ggccaaagccaaagc

SEQ ID NO: 3749561 - DNA, 22 bp, Homo sapiens
ggccaaatatattctctttggt

SEQ ID NO: 3749562 - DNA, 16 bp, Homo sapiens
ggccaagtgcaggctg

SEQ ID NO: 3749563 - DNA, 13 bp, Homo sapiens
ggccacagccaga

SEQ ID NO: 3749564 - DNA, 17 bp, Homo sapiens
ggccacagccagaaccc

SEQ ID NO: 3749565 - DNA, 14 bp, Homo sapiens
ggccacctgcaggt

SEQ ID NO: 3749566 - DNA, 13 bp, Homo sapiens
ggccacctgcccc

SEQ ID NO: 3749567 - DNA, 14 bp, Homo sapiens
ggccacctgccccc

SEQ ID NO: 3749568 - DNA, 23 bp, Homo sapiens
ggccacctgcccccttctcccac

SEQ ID NO: 3749569 - DNA, 11 bp, Homo sapiens
ggccacgtgcc

SEQ ID NO: 3749570 - DNA, 16 bp, Homo sapiens
ggccacgtgccaggcc

SEQ ID NO: 3749571 - DNA, 16 bp, Homo sapiens
ggccactctgcctctg

SEQ ID NO: 3749572 - DNA, 11 bp, Homo sapiens
ggccactgtga

SEQ ID NO: 3749573 - DNA, 15 bp, Homo sapiens
ggccacttttgacta

SEQ ID NO: 3749574 - DNA, 18 bp, Homo sapiens
ggccagagagcctggtgc

SEQ ID NO: 3749575 - DNA, 23 bp, Homo sapiens
ggccagagagcctggtgctgctg

SEQ ID NO: 3749576 - DNA, 17 bp, Homo sapiens
ggccagaggcagaaccc

SEQ ID NO: 3749577 - DNA, 22 bp, Homo sapiens
ggccagagggagtgacagaggc

SEQ ID NO: 3749578 - DNA, 14 bp, Homo sapiens
ggccagagtggcct

SEQ ID NO: 3749579 - DNA, 19 bp, Homo sapiens
ggccagagtggcctggcca

SEQ ID NO: 3749580 - DNA, 20 bp, Homo sapiens
ggccagatgcacatccctgg

SEQ ID NO: 3749581 - DNA, 19 bp, Homo sapiens
ggccagatgcaccagccct

SEQ ID NO: 3749582 - DNA, 18 bp, Homo sapiens
ggccagcaaggtggagtg

SEQ ID NO: 3749583 - DNA, 23 bp, Homo sapiens
ggccagcaaggtggagtggatgc

SEQ ID NO: 3749584 - DNA, 15 bp, Homo sapiens
ggccagccccaccca

SEQ ID NO: 3749585 - DNA, 21 bp, Homo sapiens
ggccagccccacccaggaggg

SEQ ID NO: 3749586 - DNA, 12 bp, Homo sapiens
ggccagcccctc

SEQ ID NO: 3749587 - DNA, 20 bp, Homo sapiens
ggccagctgcatctactcag

SEQ ID NO: 3749588 - DNA, 23 bp, Homo sapiens
ggccagctgcatctactcaggcc

SEQ ID NO: 3749589 - DNA, 16 bp, Homo sapiens
ggccagctggcagcag

SEQ ID NO: 3749590 - DNA, 18 bp, Homo sapiens
ggccagctgtggttttct

SEQ ID NO: 3749591 - DNA, 15 bp, Homo sapiens
ggccaggagctcttc

SEQ ID NO: 3749592 - DNA, 16 bp, Homo sapiens
ggccaggccagaggga

SEQ ID NO: 3749593 - DNA, 11 bp, Homo sapiens
ggccaggctcc

SEQ ID NO: 3749594 - DNA, 14 bp, Homo sapiens
ggccaggctggtct

SEQ ID NO: 3749595 - DNA, 18 bp, Homo sapiens
ggccaggctggtctcaaa

SEQ ID NO: 3749596 - DNA, 20 bp, Homo sapiens
ggccagtcctgcctggccag

SEQ ID NO: 3749597 - DNA, 14 bp, Homo sapiens
ggccatcggtcctg

SEQ ID NO: 3749598 - DNA, 18 bp, Homo sapiens
ggccatgagctccagacc

SEQ ID NO: 3749599 - DNA, 22 bp, Homo sapiens
ggccatgagctccagaccccca

SEQ ID NO: 3749600 - DNA, 13 bp, Homo sapiens
ggccatgggcctc

SEQ ID NO: 3749601 - DNA, 14 bp, Homo sapiens
ggcccaacattaaa

SEQ ID NO: 3749602 - DNA, 18 bp, Homo sapiens
ggcccacagctcccaccc

SEQ ID NO: 3749603 - DNA, 20 bp, Homo sapiens
ggcccacagctcccacccca

SEQ ID NO: 3749604 - DNA, 22 bp, Homo sapiens
ggcccacgcctgtaatcccagc

SEQ ID NO: 3749605 - DNA, 11 bp, Homo sapiens
ggcccagagag

SEQ ID NO: 3749606 - DNA, 22 bp, Homo sapiens
ggcccagatctggtcccttgca

SEQ ID NO: 3749607 - DNA, 15 bp, Homo sapiens
ggcccaggcaggcca

SEQ ID NO: 3749608 - DNA, 20 bp, Homo sapiens
ggccccaaaaccacagccct

SEQ ID NO: 3749609 - DNA, 15 bp, Homo sapiens
ggccccaggaagccg

SEQ ID NO: 3749610 - DNA, 12 bp, Homo sapiens
ggcccccactgg

SEQ ID NO: 3749611 - DNA, 17 bp, Homo sapiens
ggcccccactggctgtg

SEQ ID NO: 3749612 - DNA, 14 bp, Homo sapiens
ggcccctccctacc

SEQ ID NO: 3749613 - DNA, 16 bp, Homo sapiens
ggcccctccctacctc

SEQ ID NO: 3749614 - DNA, 20 bp, Homo sapiens
ggcccctccctacctcaacc

SEQ ID NO: 3749615 - DNA, 21 bp, Homo sapiens
ggcccctccctacctcaacct

SEQ ID NO: 3749616 - DNA, 17 bp, Homo sapiens
ggcccctgccaccctgg

SEQ ID NO: 3749617 - DNA, 17 bp, Homo sapiens
ggcccctgcccggctgc

SEQ ID NO: 3749618 - DNA, 20 bp, Homo sapiens
ggcccctgcccggctgcgga

SEQ ID NO: 3749619 - DNA, 13 bp, Homo sapiens
ggcccctgctggt

SEQ ID NO: 3749620 - DNA, 21 bp, Homo sapiens
ggccccttcacttctgaccac

SEQ ID NO: 3749621 - DNA, 17 bp, Homo sapiens
ggcccgacagcctggca

SEQ ID NO: 3749622 - DNA, 15 bp, Homo sapiens
ggccctcacccctgc

SEQ ID NO: 3749623 - DNA, 18 bp, Homo sapiens
ggccctcacccctgccct

SEQ ID NO: 3749624 - DNA, 22 bp, Homo sapiens
ggccctcacccctgccctggga

SEQ ID NO: 3749625 - DNA, 12 bp, Homo sapiens
ggccctggcctg

SEQ ID NO: 3749626 - DNA, 16 bp, Homo sapiens
ggccctggcctgctgg

SEQ ID NO: 3749627 - DNA, 22 bp, Homo sapiens
ggccctggcctgctgggctctc

SEQ ID NO: 3749628 - DNA, 12 bp, Homo sapiens
ggccctggggcc

SEQ ID NO: 3749629 - DNA, 12 bp, Homo sapiens
ggccctggtcct

SEQ ID NO: 3749630 - DNA, 15 bp, Homo sapiens
ggccgagaagcaaga

SEQ ID NO: 3749631 - DNA, 16 bp, Homo sapiens
ggccgcattccctgag

SEQ ID NO: 3749632 - DNA, 12 bp, Homo sapiens
ggccgggcacag

SEQ ID NO: 3749633 - DNA, 12 bp, Homo sapiens
ggccgtcaggac

SEQ ID NO: 3749634 - DNA, 13 bp, Homo sapiens
ggccgtggctgcc

SEQ ID NO: 3749635 - DNA, 14 bp, Homo sapiens
ggcctaaacttcag

SEQ ID NO: 3749636 - DNA, 23 bp, Homo sapiens
ggcctagatccacacacagagga

SEQ ID NO: 3749637 - DNA, 15 bp, Homo sapiens
ggcctagtcagccac

SEQ ID NO: 3749638 - DNA, 17 bp, Homo sapiens
ggcctcaaccctccctc

SEQ ID NO: 3749639 - DNA, 15 bp, Homo sapiens
ggcctcaaggacttg

SEQ ID NO: 3749640 - DNA, 23 bp, Homo sapiens
ggcctcaagtgattctcctgcct

SEQ ID NO: 3749641 - DNA, 18 bp, Homo sapiens
ggcctcactccaggaagg

SEQ ID NO: 3749642 - DNA, 10 bp, Homo sapiens
ggcctcagaa

SEQ ID NO: 3749643 - DNA, 16 bp, Homo sapiens
ggcctcagctgcctca

SEQ ID NO: 3749644 - DNA, 17 bp, Homo sapiens
ggcctcaggtttgcctg

SEQ ID NO: 3749645 - DNA, 22 bp, Homo sapiens
ggcctccagccctctcactgtg

SEQ ID NO: 3749646 - DNA, 12 bp, Homo sapiens
ggcctccagctc

SEQ ID NO: 3749647 - DNA, 13 bp, Homo sapiens
ggcctccagctca

SEQ ID NO: 3749648 - DNA, 14 bp, Homo sapiens
ggcctccagctcag

SEQ ID NO: 3749649 - DNA, 16 bp, Homo sapiens
ggcctccagctcagca

SEQ ID NO: 3749650 - DNA, 21 bp, Homo sapiens
ggcctccgtccaggagcctgg

SEQ ID NO: 3749651 - DNA, 21 bp, Homo sapiens
ggcctcctctaacaggggctg

SEQ ID NO: 3749652 - DNA, 18 bp, Homo sapiens
ggcctcctctgtccaggg

SEQ ID NO: 3749653 - DNA, 20 bp, Homo sapiens
ggcctgatgctccctcccct

SEQ ID NO: 3749654 - DNA, 23 bp, Homo sapiens
ggcctgatgctccctcccctgcc

SEQ ID NO: 3749655 - DNA, 18 bp, Homo sapiens
ggcctgccttgaagccac

SEQ ID NO: 3749656 - DNA, 17 bp, Homo sapiens
ggcctgctgggctctcc

SEQ ID NO: 3749657 - DNA, 15 bp, Homo sapiens
ggcctggcagccgtg

SEQ ID NO: 3749658 - DNA, 14 bp, Homo sapiens
ggcctggccaggag

SEQ ID NO: 3749659 - DNA, 15 bp, Homo sapiens
ggcctggccaggagc

SEQ ID NO: 3749660 - DNA, 23 bp, Homo sapiens
ggcctggccaggagctcttcagg

SEQ ID NO: 3749661 - DNA, 17 bp, Homo sapiens
ggcctgtccctggccat

SEQ ID NO: 3749662 - DNA, 23 bp, Homo sapiens
ggcctgtctcatccccaggggtc

SEQ ID NO: 3749663 - DNA, 18 bp, Homo sapiens
ggccttacacctcgttag

SEQ ID NO: 3749664 - DNA, 16 bp, Homo sapiens
ggccttccccagcctc

SEQ ID NO: 3749665 - DNA, 16 bp, Homo sapiens
ggccttgcccagagat

SEQ ID NO: 3749666 - DNA, 13 bp, Homo sapiens
ggcctttggcttc

SEQ ID NO: 3749667 - DNA, 20 bp, Homo sapiens
ggcgacagagcgagactccg

SEQ ID NO: 3749668 - DNA, 23 bp, Homo sapiens
ggcgacagagcgagagtctgtct

SEQ ID NO: 3749669 - DNA, 15 bp, Homo sapiens
ggcgagtcactgcct

SEQ ID NO: 3749670 - DNA, 18 bp, Homo sapiens
ggcgatccacctgtctca

SEQ ID NO: 3749671 - DNA, 14 bp, Homo sapiens
ggcgcccccagtgt

SEQ ID NO: 3749672 - DNA, 22 bp, Homo sapiens
ggcgcgcacctgtaatcccagc

SEQ ID NO: 3749673 - DNA, 21 bp, Homo sapiens
ggcggagcttgcagtgagccg

SEQ ID NO: 3749674 - DNA, 21 bp, Homo sapiens
ggcggctactcagcagccctc

SEQ ID NO: 3749675 - DNA, 22 bp, Homo sapiens
ggcgggcacctatagtcccagc

SEQ ID NO: 3749676 - DNA, 20 bp, Homo sapiens
ggcgggcgaatcacgaggtc

SEQ ID NO: 3749677 - DNA, 19 bp, Homo sapiens
ggcgtagagggtgctgccc

SEQ ID NO: 3749678 - DNA, 14 bp, Homo sapiens
ggcgtgcagtggtg

SEQ ID NO: 3749679 - DNA, 20 bp, Homo sapiens
ggctaagagctagcgctgcc

SEQ ID NO: 3749680 - DNA, 16 bp, Homo sapiens
ggctaatgtactgcat

SEQ ID NO: 3749681 - DNA, 13 bp, Homo sapiens
ggctacatcccag

SEQ ID NO: 3749682 - DNA, 15 bp, Homo sapiens
ggctactcagcagcc

SEQ ID NO: 3749683 - DNA, 16 bp, Homo sapiens
ggctactcagcagccc

SEQ ID NO: 3749684 - DNA, 13 bp, Homo sapiens
ggctagagtcctc

SEQ ID NO: 3749685 - DNA, 19 bp, Homo sapiens
ggctagagtcctcactccc

SEQ ID NO: 3749686 - DNA, 16 bp, Homo sapiens
ggctaggacccctcca

SEQ ID NO: 3749687 - DNA, 14 bp, Homo sapiens
ggctagtcagagag

SEQ ID NO: 3749688 - DNA, 15 bp, Homo sapiens
ggctagtcagagaga

SEQ ID NO: 3749689 - DNA, 19 bp, Homo sapiens
ggctatgggggcactgagg

SEQ ID NO: 3749690 - DNA, 14 bp, Homo sapiens
ggctcacagactgg

SEQ ID NO: 3749691 - DNA, 21 bp, Homo sapiens
ggctcacgcctatgatcccag

SEQ ID NO: 3749692 - DNA, 13 bp, Homo sapiens
ggctcacgtgtgt

SEQ ID NO: 3749693 - DNA, 14 bp, Homo sapiens
ggctcactgcagcc

SEQ ID NO: 3749694 - DNA, 15 bp, Homo sapiens
ggctcactgcagcct

SEQ ID NO: 3749695 - DNA, 16 bp, Homo sapiens
ggctcactgcagcctc

SEQ ID NO: 3749696 - DNA, 11 bp, Homo sapiens
ggctcagcctg

SEQ ID NO: 3749697 - DNA, 20 bp, Homo sapiens
ggctcagcctggtgggcctc

SEQ ID NO: 3749698 - DNA, 19 bp, Homo sapiens
ggctcagcggggacagctc

SEQ ID NO: 3749699 - DNA, 22 bp, Homo sapiens
ggctcagcggggacagctcctt

SEQ ID NO: 3749700 - DNA, 20 bp, Homo sapiens
ggctcatagggaagacctgc

SEQ ID NO: 3749701 - DNA, 21 bp, Homo sapiens
ggctcatattcctgcagcctg

SEQ ID NO: 3749702 - DNA, 14 bp, Homo sapiens
ggctccaggctcct

SEQ ID NO: 3749703 - DNA, 15 bp, Homo sapiens
ggctccagtctgctg

SEQ ID NO: 3749704 - DNA, 21 bp, Homo sapiens
ggctcccacaggcccttcctc

SEQ ID NO: 3749705 - DNA, 19 bp, Homo sapiens
ggctcccatgaccatactg

SEQ ID NO: 3749706 - DNA, 11 bp, Homo sapiens
ggctcccctct

SEQ ID NO: 3749707 - DNA, 16 bp, Homo sapiens
ggctcccttcctccca

SEQ ID NO: 3749708 - DNA, 17 bp, Homo sapiens
ggctcctcccggtgccc

SEQ ID NO: 3749709 - DNA, 16 bp, Homo sapiens
ggctcctccctccctc

SEQ ID NO: 3749710 - DNA, 12 bp, Homo sapiens
ggctcctgaggg

SEQ ID NO: 3749711 - DNA, 13 bp, Homo sapiens
ggctcctggaaag

SEQ ID NO: 3749712 - DNA, 12 bp, Homo sapiens
ggctctccacct

SEQ ID NO: 3749713 - DNA, 13 bp, Homo sapiens
ggctctccacctc

SEQ ID NO: 3749714 - DNA, 17 bp, Homo sapiens
ggctctccacctcagcc

SEQ ID NO: 3749715 - DNA, 21 bp, Homo sapiens
ggctctccacctcagccttgg

SEQ ID NO: 3749716 - DNA, 13 bp, Homo sapiens
ggctctgagaagg

SEQ ID NO: 3749717 - DNA, 20 bp, Homo sapiens
ggctctgccccagctctggc

SEQ ID NO: 3749718 - DNA, 13 bp, Homo sapiens
ggctctgccctgc

SEQ ID NO: 3749719 - DNA, 23 bp, Homo sapiens
ggctctgggatagctgacccagc

SEQ ID NO: 3749720 - DNA, 16 bp, Homo sapiens
ggctcttctcctttca

SEQ ID NO: 3749721 - DNA, 23 bp, Homo sapiens
ggctcttctcctttcacaacctt

SEQ ID NO: 3749722 - DNA, 13 bp, Homo sapiens
ggctgaaagacag

SEQ ID NO: 3749723 - DNA, 15 bp, Homo sapiens
ggctgaacggggaga

SEQ ID NO: 3749724 - DNA, 24 bp, Homo sapiens
ggctgacacgtccaccccagtgca

SEQ ID NO: 3749725 - DNA, 21 bp, Homo sapiens
ggctgaccttgaactcctggg

SEQ ID NO: 3749726 - DNA, 19 bp, Homo sapiens
ggctgactagaagggccag

SEQ ID NO: 3749727 - DNA, 13 bp, Homo sapiens
ggctgaggcagaa

SEQ ID NO: 3749728 - DNA, 15 bp, Homo sapiens
ggctgaggtgggagg

SEQ ID NO: 3749729 - DNA, 14 bp, Homo sapiens
ggctgatctcaggg

SEQ ID NO: 3749730 - DNA, 15 bp, Homo sapiens
ggctgatctcaggga

SEQ ID NO: 3749731 - DNA, 22 bp, Homo sapiens
ggctgatctcagggaagcccag

SEQ ID NO: 3749732 - DNA, 15 bp, Homo sapiens
ggctgatggagtaaa

SEQ ID NO: 3749733 - DNA, 23 bp, Homo sapiens
ggctgcaaagggtatcaggtgct

SEQ ID NO: 3749734 - DNA, 13 bp, Homo sapiens
ggctgcatagaag

SEQ ID NO: 3749735 - DNA, 19 bp, Homo sapiens
ggctgcatagaaggaggag

SEQ ID NO: 3749736 - DNA, 19 bp, Homo sapiens
ggctgcccacacaccccaa

SEQ ID NO: 3749737 - DNA, 20 bp, Homo sapiens
ggctgcccacacaccccaat

SEQ ID NO: 3749738 - DNA, 13 bp, Homo sapiens
ggctgccctgcca

SEQ ID NO: 3749739 - DNA, 13 bp, Homo sapiens
ggctgccctggtg

SEQ ID NO: 3749740 - DNA, 16 bp, Homo sapiens
ggctgccctggtgctg

SEQ ID NO: 3749741 - DNA, 22 bp, Homo sapiens
ggctgccctggtgctgccacac

SEQ ID NO: 3749742 - DNA, 14 bp, Homo sapiens
ggctgcctggagcc

SEQ ID NO: 3749743 - DNA, 18 bp, Homo sapiens
ggctgcctggagccccac

SEQ ID NO: 3749744 - DNA, 15 bp, Homo sapiens
ggctgctcagggctg

SEQ ID NO: 3749745 - DNA, 13 bp, Homo sapiens
ggctgctcctcca

SEQ ID NO: 3749746 - DNA, 19 bp, Homo sapiens
ggctgctcctccagggcca

SEQ ID NO: 3749747 - DNA, 15 bp, Homo sapiens
ggctgctctgcctgt

SEQ ID NO: 3749748 - DNA, 14 bp, Homo sapiens
ggctgctggaggaa

SEQ ID NO: 3749749 - DNA, 16 bp, Homo sapiens
ggctgctggaggaaaa

SEQ ID NO: 3749750 - DNA, 15 bp, Homo sapiens
ggctggacgtggtgg

SEQ ID NO: 3749751 - DNA, 19 bp, Homo sapiens
ggctggactccagatctgc

SEQ ID NO: 3749752 - DNA, 15 bp, Homo sapiens
ggctggaggcagggc

SEQ ID NO: 3749753 - DNA, 19 bp, Homo sapiens
ggctggcaccgccttctct

SEQ ID NO: 3749754 - DNA, 20 bp, Homo sapiens
ggctggcggctactcagcag

SEQ ID NO: 3749755 - DNA, 14 bp, Homo sapiens
ggctgggcagctgt

SEQ ID NO: 3749756 - DNA, 18 bp, Homo sapiens
ggctgggccaagccaggg

SEQ ID NO: 3749757 - DNA, 17 bp, Homo sapiens
ggctgggcttcagtggc

SEQ ID NO: 3749758 - DNA, 16 bp, Homo sapiens
ggctggggcaggaggg

SEQ ID NO: 3749759 - DNA, 14 bp, Homo sapiens
ggctgggggcagga

SEQ ID NO: 3749760 - DNA, 18 bp, Homo sapiens
ggctgggggcaggagggc

SEQ ID NO: 3749761 - DNA, 14 bp, Homo sapiens
ggctgggggcctca

SEQ ID NO: 3749762 - DNA, 15 bp, Homo sapiens
ggctgggggcctcag

SEQ ID NO: 3749763 - DNA, 16 bp, Homo sapiens
ggctgggggcctcagt

SEQ ID NO: 3749764 - DNA, 14 bp, Homo sapiens
ggctgggtgcccac

SEQ ID NO: 3749765 - DNA, 15 bp, Homo sapiens
ggctgggtgcccaca

SEQ ID NO: 3749766 - DNA, 16 bp, Homo sapiens
ggctgggtgcccacag

SEQ ID NO: 3749767 - DNA, 13 bp, Homo sapiens
ggctggtgcaggg

SEQ ID NO: 3749768 - DNA, 23 bp, Homo sapiens
ggctgtatcccatgagcctcagc

SEQ ID NO: 3749769 - DNA, 18 bp, Homo sapiens
ggctgtcagcaggaagca

SEQ ID NO: 3749770 - DNA, 22 bp, Homo sapiens
ggctgtcctttccagtggcctg

SEQ ID NO: 3749771 - DNA, 22 bp, Homo sapiens
ggctgtcttctcaggctctgcc

SEQ ID NO: 3749772 - DNA, 13 bp, Homo sapiens
ggctgtgcctctg

SEQ ID NO: 3749773 - DNA, 16 bp, Homo sapiens
ggctgtgggctccctt

SEQ ID NO: 3749774 - DNA, 15 bp, Homo sapiens
ggctgttggctgggg

SEQ ID NO: 3749775 - DNA, 16 bp, Homo sapiens
ggctgtttttgggtgc

SEQ ID NO: 3749776 - DNA, 15 bp, Homo sapiens
ggcttaaaacaacac

SEQ ID NO: 3749777 - DNA, 21 bp, Homo sapiens
ggcttcaatttattgcacaaa

SEQ ID NO: 3749778 - DNA, 20 bp, Homo sapiens
ggcttcacggaagagccttg

SEQ ID NO: 3749779 - DNA, 17 bp, Homo sapiens
ggcttcagtggcagctg

SEQ ID NO: 3749780 - DNA, 18 bp, Homo sapiens
ggcttcagtggcagctgc

SEQ ID NO: 3749781 - DNA, 19 bp, Homo sapiens
ggcttcagtggcagctgct

SEQ ID NO: 3749782 - DNA, 20 bp, Homo sapiens
ggcttcagtggcagctgctt

SEQ ID NO: 3749783 - DNA, 21 bp, Homo sapiens
ggcttccagaaaaccccagca

SEQ ID NO: 3749784 - DNA, 17 bp, Homo sapiens
ggcttccatttgtgtgt

SEQ ID NO: 3749785 - DNA, 15 bp, Homo sapiens
ggcttcccgctcagc

SEQ ID NO: 3749786 - DNA, 17 bp, Homo sapiens
ggcttcccgctcagccc

SEQ ID NO: 3749787 - DNA, 19 bp, Homo sapiens
ggcttcccgctcagccctc

SEQ ID NO: 3749788 - DNA, 16 bp, Homo sapiens
ggcttctgatgaatct

SEQ ID NO: 3749789 - DNA, 16 bp, Homo sapiens
ggcttctggagccctt

SEQ ID NO: 3749790 - DNA, 15 bp, Homo sapiens
ggcttctgtttctag

SEQ ID NO: 3749791 - DNA, 23 bp, Homo sapiens
ggcttgcaagtatgttttagcat

SEQ ID NO: 3749792 - DNA, 13 bp, Homo sapiens
ggcttgcctgcag

SEQ ID NO: 3749793 - DNA, 15 bp, Homo sapiens
ggcttgcctgcaggc

SEQ ID NO: 3749794 - DNA, 11 bp, Homo sapiens
ggcttgctgcc

SEQ ID NO: 3749795 - DNA, 23 bp, Homo sapiens
ggcttgggcttccatttgtgtgt

SEQ ID NO: 3749796 - DNA, 14 bp, Homo sapiens
ggctttctggagag

SEQ ID NO: 3749797 - DNA, 20 bp, Homo sapiens
ggctttgcccaacctcagca

SEQ ID NO: 3749798 - DNA, 18 bp, Homo sapiens
ggctttgtcccacagctt

SEQ ID NO: 3749799 - DNA, 20 bp, Homo sapiens
gggaacagtgtttcccataa

SEQ ID NO: 3749800 - DNA, 16 bp, Homo sapiens
gggaacatatttaagg

SEQ ID NO: 3749801 - DNA, 18 bp, Homo sapiens
gggaagaagctctctcct

SEQ ID NO: 3749802 - DNA, 22 bp, Homo sapiens
gggaagataggctctgcacaga

SEQ ID NO: 3749803 - DNA, 23 bp, Homo sapiens
gggaagcggaggttgcagggagc

SEQ ID NO: 3749804 - DNA, 18 bp, Homo sapiens
gggaaggccacctgcagg

SEQ ID NO: 3749805 - DNA, 19 bp, Homo sapiens
gggaaggccccacagacaa

SEQ ID NO: 3749806 - DNA, 14 bp, Homo sapiens
gggaatattttatt

SEQ ID NO: 3749807 - DNA, 22 bp, Homo sapiens
gggaatggcacagcccaaagaa

SEQ ID NO: 3749808 - DNA, 21 bp, Homo sapiens
gggaatgtttgcctctgcctc

SEQ ID NO: 3749809 - DNA, 14 bp, Homo sapiens
gggaattctcttgg

SEQ ID NO: 3749810 - DNA, 17 bp, Homo sapiens
gggacagagacacctgc

SEQ ID NO: 3749811 - DNA, 13 bp, Homo sapiens
gggacagagcaga

SEQ ID NO: 3749812 - DNA, 22 bp, Homo sapiens
gggacatgaaataaatgcccca

SEQ ID NO: 3749813 - DNA, 18 bp, Homo sapiens
gggactagcctggcttgg

SEQ ID NO: 3749814 - DNA, 23 bp, Homo sapiens
gggactcactggcagccccagca

SEQ ID NO: 3749815 - DNA, 16 bp, Homo sapiens
gggactcagccctgag

SEQ ID NO: 3749816 - DNA, 21 bp, Homo sapiens
gggactgtctttcagatacat

SEQ ID NO: 3749817 - DNA, 16 bp, Homo sapiens
gggagaagggggtcaa

SEQ ID NO: 3749818 - DNA, 17 bp, Homo sapiens
gggagacacctcagagc

SEQ ID NO: 3749819 - DNA, 12 bp, Homo sapiens
gggagagcccag

SEQ ID NO: 3749820 - DNA, 22 bp, Homo sapiens
gggagaggccatgattcgccca

SEQ ID NO: 3749821 - DNA, 15 bp, Homo sapiens
gggagagggtctgga

SEQ ID NO: 3749822 - DNA, 19 bp, Homo sapiens
gggagatggatcaatcaaa

SEQ ID NO: 3749823 - DNA, 19 bp, Homo sapiens
gggagcagtgtcttccata

SEQ ID NO: 3749824 - DNA, 12 bp, Homo sapiens
gggagccagggc

SEQ ID NO: 3749825 - DNA, 12 bp, Homo sapiens
gggagccccagg

SEQ ID NO: 3749826 - DNA, 14 bp, Homo sapiens
gggagccccagggt

SEQ ID NO: 3749827 - DNA, 16 bp, Homo sapiens
gggaggaaaagaaaag

SEQ ID NO: 3749828 - DNA, 15 bp, Homo sapiens
gggaggacctctggg

SEQ ID NO: 3749829 - DNA, 19 bp, Homo sapiens
gggaggatcactggagccc

SEQ ID NO: 3749830 - DNA, 22 bp, Homo sapiens
gggaggatcactggagcccagg

SEQ ID NO: 3749831 - DNA, 23 bp, Homo sapiens
gggaggattgcttgagctcagga

SEQ ID NO: 3749832 - DNA, 20 bp, Homo sapiens
gggaggcagaggttgcagtg

SEQ ID NO: 3749833 - DNA, 13 bp, Homo sapiens
gggaggcagccgg

SEQ ID NO: 3749834 - DNA, 11 bp, Homo sapiens
gggaggcccca

SEQ ID NO: 3749835 - DNA, 13 bp, Homo sapiens
gggagggggaggg

SEQ ID NO: 3749836 - DNA, 17 bp, Homo sapiens
gggagggttggggaggg

SEQ ID NO: 3749837 - DNA, 17 bp, Homo sapiens
gggaggtcgaggcagga

SEQ ID NO: 3749838 - DNA, 19 bp, Homo sapiens
gggaggtcgaggcaggagg

SEQ ID NO: 3749839 - DNA, 16 bp, Homo sapiens
gggaggtgaccccagg

SEQ ID NO: 3749840 - DNA, 23 bp, Homo sapiens
gggagtctgaagcagatgcaaag

SEQ ID NO: 3749841 - DNA, 18 bp, Homo sapiens
gggagtgggacagagtct

SEQ ID NO: 3749842 - DNA, 20 bp, Homo sapiens
gggatgactaaaatatttat

SEQ ID NO: 3749843 - DNA, 14 bp, Homo sapiens
gggatggaggagaa

SEQ ID NO: 3749844 - DNA, 17 bp, Homo sapiens
gggatggggccacagcc

SEQ ID NO: 3749845 - DNA, 15 bp, Homo sapiens
gggatggtcctgggg

SEQ ID NO: 3749846 - DNA, 23 bp, Homo sapiens
gggatgtatccatgggggcaggg

SEQ ID NO: 3749847 - DNA, 14 bp, Homo sapiens
gggattcaggctgc

SEQ ID NO: 3749848 - DNA, 17 bp, Homo sapiens
gggattgaaggatgctg

SEQ ID NO: 3749849 - DNA, 15 bp, Homo sapiens
gggatttctcccagc

SEQ ID NO: 3749850 - DNA, 19 bp, Homo sapiens
gggatttgtccttggggac

SEQ ID NO: 3749851 - DNA, 21 bp, Homo sapiens
gggattttcagccctcagaat

SEQ ID NO: 3749852 - DNA, 14 bp, Homo sapiens
gggcaaacaggcag

SEQ ID NO: 3749853 - DNA, 15 bp, Homo sapiens
gggcaaacaggcagt

SEQ ID NO: 3749854 - DNA, 15 bp, Homo sapiens
gggcaacgaagaaaa

SEQ ID NO: 3749855 - DNA, 17 bp, Homo sapiens
gggcaccaagcccacag

SEQ ID NO: 3749856 - DNA, 19 bp, Homo sapiens
gggcacctatagtcccagc

SEQ ID NO: 3749857 - DNA, 18 bp, Homo sapiens
gggcacctggggagtggg

SEQ ID NO: 3749858 - DNA, 16 bp, Homo sapiens
gggcactcagaagaca

SEQ ID NO: 3749859 - DNA, 13 bp, Homo sapiens
gggcagagccggg

SEQ ID NO: 3749860 - DNA, 23 bp, Homo sapiens
gggcagaggctggaggcagggcc

SEQ ID NO: 3749861 - DNA, 15 bp, Homo sapiens
gggcagagggcagag

SEQ ID NO: 3749862 - DNA, 16 bp, Homo sapiens
gggcagccaggctgcc

SEQ ID NO: 3749863 - DNA, 19 bp, Homo sapiens
gggcagcctgcgtggctga

SEQ ID NO: 3749864 - DNA, 18 bp, Homo sapiens
gggcaggaaggagagcct

SEQ ID NO: 3749865 - DNA, 21 bp, Homo sapiens
gggcaggaaggagagcctgct

SEQ ID NO: 3749866 - DNA, 20 bp, Homo sapiens
gggcagggcatctcctgtgc

SEQ ID NO: 3749867 - DNA, 14 bp, Homo sapiens
gggcagggcatgac

SEQ ID NO: 3749868 - DNA, 14 bp, Homo sapiens
gggcagtctggagg

SEQ ID NO: 3749869 - DNA, 13 bp, Homo sapiens
gggcatcatgcat

SEQ ID NO: 3749870 - DNA, 17 bp, Homo sapiens
gggcatctgcccctccc

SEQ ID NO: 3749871 - DNA, 13 bp, Homo sapiens
gggcatctggcct

SEQ ID NO: 3749872 - DNA, 17 bp, Homo sapiens
gggcatggccaggtggc

SEQ ID NO: 3749873 - DNA, 23 bp, Homo sapiens
gggcattgatggggaaggaggct

SEQ ID NO: 3749874 - DNA, 13 bp, Homo sapiens
gggccaagaaaga

SEQ ID NO: 3749875 - DNA, 18 bp, Homo sapiens
gggccaagccagggatgg

SEQ ID NO: 3749876 - DNA, 13 bp, Homo sapiens
gggccaaggactg

SEQ ID NO: 3749877 - DNA, 16 bp, Homo sapiens
gggccacagagaaagt

SEQ ID NO: 3749878 - DNA, 23 bp, Homo sapiens
gggccacagagaaagtacttctc

SEQ ID NO: 3749879 - DNA, 14 bp, Homo sapiens
gggccacagccaga

SEQ ID NO: 3749880 - DNA, 15 bp, Homo sapiens
gggccacctccccag

SEQ ID NO: 3749881 - DNA, 19 bp, Homo sapiens
gggccacgtgccaggcccg

SEQ ID NO: 3749882 - DNA, 12 bp, Homo sapiens
gggccagaggca

SEQ ID NO: 3749883 - DNA, 12 bp, Homo sapiens
gggccagcccct

SEQ ID NO: 3749884 - DNA, 17 bp, Homo sapiens
gggccagcccctcccac

SEQ ID NO: 3749885 - DNA, 13 bp, Homo sapiens
gggccagggccct

SEQ ID NO: 3749886 - DNA, 18 bp, Homo sapiens
gggccagtcctgcctggc

SEQ ID NO: 3749887 - DNA, 18 bp, Homo sapiens
gggccatgaactttgtcc

SEQ ID NO: 3749888 - DNA, 19 bp, Homo sapiens
gggccatgagctccagacc

SEQ ID NO: 3749889 - DNA, 23 bp, Homo sapiens
gggcccaagacagatgccccaga

SEQ ID NO: 3749890 - DNA, 13 bp, Homo sapiens
gggcccagatctg

SEQ ID NO: 3749891 - DNA, 19 bp, Homo sapiens
gggcccctccctacctcaa

SEQ ID NO: 3749892 - DNA, 22 bp, Homo sapiens
gggccctgagctcggtggaccc

SEQ ID NO: 3749893 - DNA, 20 bp, Homo sapiens
gggcctagatccacacacag

SEQ ID NO: 3749894 - DNA, 23 bp, Homo sapiens
gggcctagatccacacacagagg

SEQ ID NO: 3749895 - DNA, 19 bp, Homo sapiens
gggcctccattcctggagc

SEQ ID NO: 3749896 - DNA, 15 bp, Homo sapiens
gggcctcctgtgtgt

SEQ ID NO: 3749897 - DNA, 15 bp, Homo sapiens
gggcctcggagcctc

SEQ ID NO: 3749898 - DNA, 22 bp, Homo sapiens
gggcctcggtgtggagaagcgg

SEQ ID NO: 3749899 - DNA, 19 bp, Homo sapiens
gggcctgacctccccctcc

SEQ ID NO: 3749900 - DNA, 23 bp, Homo sapiens
gggcctgcctagcactcacatgc

SEQ ID NO: 3749901 - DNA, 16 bp, Homo sapiens
gggcctggtccctggg

SEQ ID NO: 3749902 - DNA, 20 bp, Homo sapiens
gggcctgtcgtgccagtcct

SEQ ID NO: 3749903 - DNA, 14 bp, Homo sapiens
gggcctgttgccct

SEQ ID NO: 3749904 - DNA, 12 bp, Homo sapiens
gggccttgccca

SEQ ID NO: 3749905 - DNA, 14 bp, Homo sapiens
gggccttgcccaga

SEQ ID NO: 3749906 - DNA, 20 bp, Homo sapiens
gggcgagactctgtctcaaa

SEQ ID NO: 3749907 - DNA, 18 bp, Homo sapiens
gggcgagtcactgcctct

SEQ ID NO: 3749908 - DNA, 16 bp, Homo sapiens
gggcgcggtggctcac

SEQ ID NO: 3749909 - DNA, 14 bp, Homo sapiens
gggcggcagagagg

SEQ ID NO: 3749910 - DNA, 21 bp, Homo sapiens
gggcggtgagaggggaacaga

SEQ ID NO: 3749911 - DNA, 16 bp, Homo sapiens
gggctcaagcagtcta

SEQ ID NO: 3749912 - DNA, 22 bp, Homo sapiens
gggctcagctctggctcacaga

SEQ ID NO: 3749913 - DNA, 23 bp, Homo sapiens
gggctcagctctggctcacagac

SEQ ID NO: 3749914 - DNA, 18 bp, Homo sapiens
gggctcccctttcgccca

SEQ ID NO: 3749915 - DNA, 18 bp, Homo sapiens
gggctctccacctcagcc

SEQ ID NO: 3749916 - DNA, 21 bp, Homo sapiens
gggctctccacctcagccttg

SEQ ID NO: 3749917 - DNA, 12 bp, Homo sapiens
gggctctgcccc

SEQ ID NO: 3749918 - DNA, 18 bp, Homo sapiens
gggctgaacggggagaaa

SEQ ID NO: 3749919 - DNA, 15 bp, Homo sapiens
gggctgagccctggc

SEQ ID NO: 3749920 - DNA, 16 bp, Homo sapiens
gggctgagctgcctgt

SEQ ID NO: 3749921 - DNA, 11 bp, Homo sapiens
gggctgagggg

SEQ ID NO: 3749922 - DNA, 13 bp, Homo sapiens
gggctgccctgcc

SEQ ID NO: 3749923 - DNA, 11 bp, Homo sapiens
gggctgctcct

SEQ ID NO: 3749924 - DNA, 15 bp, Homo sapiens
gggctgctcctccag

SEQ ID NO: 3749925 - DNA, 19 bp, Homo sapiens
gggctggcggctactcagc

SEQ ID NO: 3749926 - DNA, 18 bp, Homo sapiens
gggcttcagtggcagctg

SEQ ID NO: 3749927 - DNA, 19 bp, Homo sapiens
gggcttcagtggcagctgc

SEQ ID NO: 3749928 - DNA, 20 bp, Homo sapiens
gggcttcagtggcagctgct

SEQ ID NO: 3749929 - DNA, 17 bp, Homo sapiens
ggggaaaatcagcctgc

SEQ ID NO: 3749930 - DNA, 21 bp, Homo sapiens
ggggaaaatcagcctgctcca

SEQ ID NO: 3749931 - DNA, 13 bp, Homo sapiens
ggggaagccctgg

SEQ ID NO: 3749932 - DNA, 14 bp, Homo sapiens
ggggaagccctgga

SEQ ID NO: 3749933 - DNA, 18 bp, Homo sapiens
ggggaatgtttgcctctg

SEQ ID NO: 3749934 - DNA, 20 bp, Homo sapiens
ggggacagctccttctgtcc

SEQ ID NO: 3749935 - DNA, 21 bp, Homo sapiens
ggggacgctggtagagatgga

SEQ ID NO: 3749936 - DNA, 19 bp, Homo sapiens
ggggagaacttacattgtg

SEQ ID NO: 3749937 - DNA, 21 bp, Homo sapiens
ggggatgactagaggcaggga

SEQ ID NO: 3749938 - DNA, 15 bp, Homo sapiens
ggggcaaacacctgc

SEQ ID NO: 3749939 - DNA, 17 bp, Homo sapiens
ggggcagaacagccgct

SEQ ID NO: 3749940 - DNA, 19 bp, Homo sapiens
ggggcagctgccagagaag

SEQ ID NO: 3749941 - DNA, 16 bp, Homo sapiens
ggggcaggagggccct

SEQ ID NO: 3749942 - DNA, 11 bp, Homo sapiens
ggggcaggcag

SEQ ID NO: 3749943 - DNA, 17 bp, Homo sapiens
ggggcagtctggagggg

SEQ ID NO: 3749944 - DNA, 21 bp, Homo sapiens
ggggccacagccagaaccccg

SEQ ID NO: 3749945 - DNA, 21 bp, Homo sapiens
ggggccatgagctccagaccc

SEQ ID NO: 3749946 - DNA, 16 bp, Homo sapiens
ggggccatgaggcctc

SEQ ID NO: 3749947 - DNA, 21 bp, Homo sapiens
ggggcccgcctggcagaactg

SEQ ID NO: 3749948 - DNA, 22 bp, Homo sapiens
ggggcctgtacaaaagggacat

SEQ ID NO: 3749949 - DNA, 11 bp, Homo sapiens
ggggctcctgg

SEQ ID NO: 3749950 - DNA, 13 bp, Homo sapiens
ggggctcctggaa

SEQ ID NO: 3749951 - DNA, 18 bp, Homo sapiens
ggggctgaacggggagaa

SEQ ID NO: 3749952 - DNA, 20 bp, Homo sapiens
ggggctgatctcagggaagc

SEQ ID NO: 3749953 - DNA, 19 bp, Homo sapiens
ggggctggcggctactcag

SEQ ID NO: 3749954 - DNA, 18 bp, Homo sapiens
ggggctggggcaggaggg

SEQ ID NO: 3749955 - DNA, 11 bp, Homo sapiens
gggggcagagg

SEQ ID NO: 3749956 - DNA, 14 bp, Homo sapiens
gggggcagggcatg

SEQ ID NO: 3749957 - DNA, 15 bp, Homo sapiens
gggggccaacaccag

SEQ ID NO: 3749958 - DNA, 12 bp, Homo sapiens
gggggcctcagt

SEQ ID NO: 3749959 - DNA, 19 bp, Homo sapiens
ggggtagctagaggaacca

SEQ ID NO: 3749960 - DNA, 19 bp, Homo sapiens
ggggtctccctctcctgcc

SEQ ID NO: 3749961 - DNA, 22 bp, Homo sapiens
ggggtctttgtgagagtgagct

SEQ ID NO: 3749962 - DNA, 21 bp, Homo sapiens
ggggtgccctccactgccctc

SEQ ID NO: 3749963 - DNA, 23 bp, Homo sapiens
ggggttcagcccctcctctgcca

SEQ ID NO: 3749964 - DNA, 13 bp, Homo sapiens
gggtaaattattc

SEQ ID NO: 3749965 - DNA, 13 bp, Homo sapiens
gggtacccactgc

SEQ ID NO: 3749966 - DNA, 19 bp, Homo sapiens
gggtacttgtggacacagc

SEQ ID NO: 3749967 - DNA, 16 bp, Homo sapiens
gggtagctagaggaac

SEQ ID NO: 3749968 - DNA, 19 bp, Homo sapiens
gggtagcttctgacctcag

SEQ ID NO: 3749969 - DNA, 12 bp, Homo sapiens
gggtaggcggga

SEQ ID NO: 3749970 - DNA, 16 bp, Homo sapiens
gggtaggcgggaagga

SEQ ID NO: 3749971 - DNA, 20 bp, Homo sapiens
gggtatcaggtgctgccatc

SEQ ID NO: 3749972 - DNA, 23 bp, Homo sapiens
gggtcaagttattaatttcttca

SEQ ID NO: 3749973 - DNA, 15 bp, Homo sapiens
gggtcaggccacggc

SEQ ID NO: 3749974 - DNA, 17 bp, Homo sapiens
gggtcaggccacggcag

SEQ ID NO: 3749975 - DNA, 16 bp, Homo sapiens
gggtccttccctctcc

SEQ ID NO: 3749976 - DNA, 14 bp, Homo sapiens
gggtctagggagag

SEQ ID NO: 3749977 - DNA, 22 bp, Homo sapiens
gggtctcactatgttgcccagg

SEQ ID NO: 3749978 - DNA, 12 bp, Homo sapiens
gggtctcactct

SEQ ID NO: 3749979 - DNA, 19 bp, Homo sapiens
gggtctccaggaggagact

SEQ ID NO: 3749980 - DNA, 16 bp, Homo sapiens
gggtctccctctcctg

SEQ ID NO: 3749981 - DNA, 19 bp, Homo sapiens
gggtctccctctcctgcct

SEQ ID NO: 3749982 - DNA, 12 bp, Homo sapiens
gggtctgaggaa

SEQ ID NO: 3749983 - DNA, 15 bp, Homo sapiens
gggtctgtgtctctt

SEQ ID NO: 3749984 - DNA, 13 bp, Homo sapiens
gggtgaagggaga

SEQ ID NO: 3749985 - DNA, 19 bp, Homo sapiens
gggtgacagagcaagtgag

SEQ ID NO: 3749986 - DNA, 11 bp, Homo sapiens
gggtgagccag

SEQ ID NO: 3749987 - DNA, 21 bp, Homo sapiens
gggtgctgccccatgaagcca

SEQ ID NO: 3749988 - DNA, 21 bp, Homo sapiens
gggtgctgcttccctctgcct

SEQ ID NO: 3749989 - DNA, 20 bp, Homo sapiens
gggtggagaactcctagggt

SEQ ID NO: 3749990 - DNA, 13 bp, Homo sapiens
gggtggatgcctg

SEQ ID NO: 3749991 - DNA, 17 bp, Homo sapiens
gggtggatgcctggtgg

SEQ ID NO: 3749992 - DNA, 19 bp, Homo sapiens
gggtggcaccagcagcctg

SEQ ID NO: 3749993 - DNA, 18 bp, Homo sapiens
gggtggctagtcagagag

SEQ ID NO: 3749994 - DNA, 19 bp, Homo sapiens
gggtgggagagcccagcca

SEQ ID NO: 3749995 - DNA, 17 bp, Homo sapiens
gggtgggatggaggaga

SEQ ID NO: 3749996 - DNA, 23 bp, Homo sapiens
gggtggggacgtcctgccacctg

SEQ ID NO: 3749997 - DNA, 16 bp, Homo sapiens
gggtggtctgcaggca

SEQ ID NO: 3749998 - DNA, 12 bp, Homo sapiens
gggtggtgacct

SEQ ID NO: 3749999 - DNA, 16 bp, Homo sapiens
gggttacaaactgcaa

SEQ ID NO: 3750000 - DNA, 19 bp, Homo sapiens
gggttcagcccctcctctg

SEQ ID NO: 3750001 - DNA, 20 bp, Homo sapiens
gggttcagcccctcctctgc

SEQ ID NO: 3750002 - DNA, 13 bp, Homo sapiens
gggttcaggggac

SEQ ID NO: 3750003 - DNA, 15 bp, Homo sapiens
gggttcccccagccc

SEQ ID NO: 3750004 - DNA, 14 bp, Homo sapiens
gggttcctcttccc

SEQ ID NO: 3750005 - DNA, 16 bp, Homo sapiens
gggttctcctctcccc

SEQ ID NO: 3750006 - DNA, 18 bp, Homo sapiens
gggttgcatcagaaatgt

SEQ ID NO: 3750007 - DNA, 14 bp, Homo sapiens
gggttggctgggta

SEQ ID NO: 3750008 - DNA, 12 bp, Homo sapiens
gggttgggccca

SEQ ID NO: 3750009 - DNA, 15 bp, Homo sapiens
gggttgggctggtgt

SEQ ID NO: 3750010 - DNA, 22 bp, Homo sapiens
gggtttggcgggccaaggactg

SEQ ID NO: 3750011 - DNA, 17 bp, Homo sapiens
gggttttccaccctgga

SEQ ID NO: 3750012 - DNA, 23 bp, Homo sapiens
gggttttgccatgttggccaggc

SEQ ID NO: 3750013 - DNA, 13 bp, Homo sapiens
ggtaaaattctaa

SEQ ID NO: 3750014 - DNA, 11 bp, Homo sapiens
ggtaaattatt

SEQ ID NO: 3750015 - DNA, 18 bp, Homo sapiens
ggtaactagggaagataa

SEQ ID NO: 3750016 - DNA, 19 bp, Homo sapiens
ggtaataagtactgtgtac

SEQ ID NO: 3750017 - DNA, 12 bp, Homo sapiens
ggtacagagaag

SEQ ID NO: 3750018 - DNA, 15 bp, Homo sapiens
ggtacagagaaggaa

SEQ ID NO: 3750019 - DNA, 13 bp, Homo sapiens
ggtacccactgct

SEQ ID NO: 3750020 - DNA, 16 bp, Homo sapiens
ggtacccactgctctg

SEQ ID NO: 3750021 - DNA, 18 bp, Homo sapiens
ggtaccttgaacactggg

SEQ ID NO: 3750022 - DNA, 16 bp, Homo sapiens
ggtacttgtggacaca

SEQ ID NO: 3750023 - DNA, 21 bp, Homo sapiens
ggtacttgtggacacagctct

SEQ ID NO: 3750024 - DNA, 22 bp, Homo sapiens
ggtacttgtggacacagctctt

SEQ ID NO: 3750025 - DNA, 19 bp, Homo sapiens
ggtagcttctgacctcagc

SEQ ID NO: 3750026 - DNA, 20 bp, Homo sapiens
ggtagcttctgacctcagca

SEQ ID NO: 3750027 - DNA, 22 bp, Homo sapiens
ggtagtactcctgcaaaatttt

SEQ ID NO: 3750028 - DNA, 16 bp, Homo sapiens
ggtagttagtagcatg

SEQ ID NO: 3750029 - DNA, 19 bp, Homo sapiens
ggtagttagtagcatgttg

SEQ ID NO: 3750030 - DNA, 23 bp, Homo sapiens
ggtagttttccatggtcacagag

SEQ ID NO: 3750031 - DNA, 15 bp, Homo sapiens
ggtatatctgggctg

SEQ ID NO: 3750032 - DNA, 23 bp, Homo sapiens
ggtatatctgggctggccagttg

SEQ ID NO: 3750033 - DNA, 19 bp, Homo sapiens
ggtatcattttctgcattt

SEQ ID NO: 3750034 - DNA, 21 bp, Homo sapiens
ggtatggaagggtttgtggct

SEQ ID NO: 3750035 - DNA, 14 bp, Homo sapiens
ggtcaacagagaag

SEQ ID NO: 3750036 - DNA, 22 bp, Homo sapiens
ggtcaacttgagcatgttactg

SEQ ID NO: 3750037 - DNA, 20 bp, Homo sapiens
ggtcaagattttgaatgctt

SEQ ID NO: 3750038 - DNA, 15 bp, Homo sapiens
ggtcaagcccaggag

SEQ ID NO: 3750039 - DNA, 19 bp, Homo sapiens
ggtcaagcccaggaggact

SEQ ID NO: 3750040 - DNA, 18 bp, Homo sapiens
ggtcaagttattaatttc

SEQ ID NO: 3750041 - DNA, 18 bp, Homo sapiens
ggtcacaggactctgcct

SEQ ID NO: 3750042 - DNA, 22 bp, Homo sapiens
ggtcagcttgctgccctaggct

SEQ ID NO: 3750043 - DNA, 22 bp, Homo sapiens
ggtcaggagaggggcagaacag

SEQ ID NO: 3750044 - DNA, 16 bp, Homo sapiens
ggtcaggccacggcag

SEQ ID NO: 3750045 - DNA, 17 bp, Homo sapiens
ggtcagggaccaaggac

SEQ ID NO: 3750046 - DNA, 19 bp, Homo sapiens
ggtcaggtgttcaagacca

SEQ ID NO: 3750047 - DNA, 12 bp, Homo sapiens
ggtcagtaccca

SEQ ID NO: 3750048 - DNA, 14 bp, Homo sapiens
ggtcagtggctctt

SEQ ID NO: 3750049 - DNA, 16 bp, Homo sapiens
ggtcatagcagtgctt

SEQ ID NO: 3750050 - DNA, 12 bp, Homo sapiens
ggtccacccagg

SEQ ID NO: 3750051 - DNA, 15 bp, Homo sapiens
ggtccacccaggagc

SEQ ID NO: 3750052 - DNA, 15 bp, Homo sapiens
ggtcccagccacccc

SEQ ID NO: 3750053 - DNA, 13 bp, Homo sapiens
ggtccctgggagg

SEQ ID NO: 3750054 - DNA, 21 bp, Homo sapiens
ggtcccttcttactcacacac

SEQ ID NO: 3750055 - DNA, 19 bp, Homo sapiens
ggtcccttgagacctcagc

SEQ ID NO: 3750056 - DNA, 20 bp, Homo sapiens
ggtcccttgagacctcagcc

SEQ ID NO: 3750057 - DNA, 19 bp, Homo sapiens
ggtcctaagtccctgcccc

SEQ ID NO: 3750058 - DNA, 14 bp, Homo sapiens
ggtcctcagagaat

SEQ ID NO: 3750059 - DNA, 14 bp, Homo sapiens
ggtcctggggcctc

SEQ ID NO: 3750060 - DNA, 15 bp, Homo sapiens
ggtcctggggctctg

SEQ ID NO: 3750061 - DNA, 22 bp, Homo sapiens
ggtcctggggctctgtgcaggg

SEQ ID NO: 3750062 - DNA, 23 bp, Homo sapiens
ggtcctggggctctgtgcaggga

SEQ ID NO: 3750063 - DNA, 17 bp, Homo sapiens
ggtcctgtctcccctct

SEQ ID NO: 3750064 - DNA, 23 bp, Homo sapiens
ggtcctgtctcccctctgctggc

SEQ ID NO: 3750065 - DNA, 13 bp, Homo sapiens
ggtcgcccaggag

SEQ ID NO: 3750066 - DNA, 13 bp, Homo sapiens
ggtctaacttttg

SEQ ID NO: 3750067 - DNA, 21 bp, Homo sapiens
ggtctcaaactcctgggctca

SEQ ID NO: 3750068 - DNA, 21 bp, Homo sapiens
ggtctcactatgttgcccagg

SEQ ID NO: 3750069 - DNA, 18 bp, Homo sapiens
ggtctcagaatctttcct

SEQ ID NO: 3750070 - DNA, 14 bp, Homo sapiens
ggtctccctctcct

SEQ ID NO: 3750071 - DNA, 15 bp, Homo sapiens
ggtctccctctcctg

SEQ ID NO: 3750072 - DNA, 18 bp, Homo sapiens
ggtctccctctcctgcct

SEQ ID NO: 3750073 - DNA, 19 bp, Homo sapiens
ggtctccctctcctgccta

SEQ ID NO: 3750074 - DNA, 22 bp, Homo sapiens
ggtctccctctcctgcctactc

SEQ ID NO: 3750075 - DNA, 15 bp, Homo sapiens
ggtctcttgagggag

SEQ ID NO: 3750076 - DNA, 21 bp, Homo sapiens
ggtctcttgagggagcttagc

SEQ ID NO: 3750077 - DNA, 11 bp, Homo sapiens
ggtctgaatgt

SEQ ID NO: 3750078 - DNA, 14 bp, Homo sapiens
ggtctgcaggcagg

SEQ ID NO: 3750079 - DNA, 22 bp, Homo sapiens
ggtctgggggtcaggaggcagg

SEQ ID NO: 3750080 - DNA, 14 bp, Homo sapiens
ggtctgtcccacca

SEQ ID NO: 3750081 - DNA, 19 bp, Homo sapiens
ggtctgtgtctcttttctc

SEQ ID NO: 3750082 - DNA, 21 bp, Homo sapiens
ggtcttttgacatgtggaaag

SEQ ID NO: 3750083 - DNA, 14 bp, Homo sapiens
ggtgaaagggagct

SEQ ID NO: 3750084 - DNA, 17 bp, Homo sapiens
ggtgaagctatttatct

SEQ ID NO: 3750085 - DNA, 18 bp, Homo sapiens
ggtgaagctatttatctg

SEQ ID NO: 3750086 - DNA, 16 bp, Homo sapiens
ggtgacaccagccttt

SEQ ID NO: 3750087 - DNA, 21 bp, Homo sapiens
ggtgacagagtgagactctgt

SEQ ID NO: 3750088 - DNA, 23 bp, Homo sapiens
ggtgacagtgaggtcctgggggc

SEQ ID NO: 3750089 - DNA, 15 bp, Homo sapiens
ggtgaccttctggga

SEQ ID NO: 3750090 - DNA, 15 bp, Homo sapiens
ggtgagaagcagagg

SEQ ID NO: 3750091 - DNA, 15 bp, Homo sapiens
ggtgaggcaataaaa

SEQ ID NO: 3750092 - DNA, 17 bp, Homo sapiens
ggtgaggggctggcact

SEQ ID NO: 3750093 - DNA, 23 bp, Homo sapiens
ggtgatccacccacctcagcctc

SEQ ID NO: 3750094 - DNA, 17 bp, Homo sapiens
ggtgatctgggattagg

SEQ ID NO: 3750095 - DNA, 18 bp, Homo sapiens
ggtgcaaagttccctact

SEQ ID NO: 3750096 - DNA, 16 bp, Homo sapiens
ggtgcagagtgcccag

SEQ ID NO: 3750097 - DNA, 17 bp, Homo sapiens
ggtgcagagtgcccaga

SEQ ID NO: 3750098 - DNA, 18 bp, Homo sapiens
ggtgcatgccgctgcatc

SEQ ID NO: 3750099 - DNA, 22 bp, Homo sapiens
ggtgcctgggtggggctgctcc

SEQ ID NO: 3750100 - DNA, 21 bp, Homo sapiens
ggtgcctgtgaggcaggggcg

SEQ ID NO: 3750101 - DNA, 16 bp, Homo sapiens
ggtgcctttcctgttc

SEQ ID NO: 3750102 - DNA, 20 bp, Homo sapiens
ggtgctaaatggtcgcccag

SEQ ID NO: 3750103 - DNA, 21 bp, Homo sapiens
ggtgctaaatggtcgcccagg

SEQ ID NO: 3750104 - DNA, 15 bp, Homo sapiens
ggtgctcagggctga

SEQ ID NO: 3750105 - DNA, 15 bp, Homo sapiens
ggtgctgccatccag

SEQ ID NO: 3750106 - DNA, 20 bp, Homo sapiens
ggtggaagccctccttccac

SEQ ID NO: 3750107 - DNA, 13 bp, Homo sapiens
ggtggacacacaa

SEQ ID NO: 3750108 - DNA, 14 bp, Homo sapiens
ggtggacagtcctg

SEQ ID NO: 3750109 - DNA, 18 bp, Homo sapiens
ggtggacagtcctgggag

SEQ ID NO: 3750110 - DNA, 12 bp, Homo sapiens
ggtggacccagg

SEQ ID NO: 3750111 - DNA, 17 bp, Homo sapiens
ggtggatcacagaggct

SEQ ID NO: 3750112 - DNA, 20 bp, Homo sapiens
ggtggcaccagcagcctgga

SEQ ID NO: 3750113 - DNA, 15 bp, Homo sapiens
ggtggcagctgcggt

SEQ ID NO: 3750114 - DNA, 23 bp, Homo sapiens
ggtggcagctgcggtccacccag

SEQ ID NO: 3750115 - DNA, 23 bp, Homo sapiens
ggtggcatgtgcctatagtccca

SEQ ID NO: 3750116 - DNA, 23 bp, Homo sapiens
ggtggccactccagacccctggc

SEQ ID NO: 3750117 - DNA, 20 bp, Homo sapiens
ggtggcccgacagcctggca

SEQ ID NO: 3750118 - DNA, 19 bp, Homo sapiens
ggtggctcacgcctgtaat

SEQ ID NO: 3750119 - DNA, 13 bp, Homo sapiens
ggtggctctgaga

SEQ ID NO: 3750120 - DNA, 13 bp, Homo sapiens
ggtggctgaccca

SEQ ID NO: 3750121 - DNA, 21 bp, Homo sapiens
ggtggctgacccagtccctgg

SEQ ID NO: 3750122 - DNA, 20 bp, Homo sapiens
ggtgggaggatctcttgagc

SEQ ID NO: 3750123 - DNA, 16 bp, Homo sapiens
ggtgggatggaggaga

SEQ ID NO: 3750124 - DNA, 18 bp, Homo sapiens
ggtgggcaccaagagcca

SEQ ID NO: 3750125 - DNA, 16 bp, Homo sapiens
ggtgggcacctataat

SEQ ID NO: 3750126 - DNA, 16 bp, Homo sapiens
ggtgggccagcccctc

SEQ ID NO: 3750127 - DNA, 13 bp, Homo sapiens
ggtgggctgagcc

SEQ ID NO: 3750128 - DNA, 17 bp, Homo sapiens
ggtggggcagcttgagg

SEQ ID NO: 3750129 - DNA, 13 bp, Homo sapiens
ggtggggctgctc

SEQ ID NO: 3750130 - DNA, 12 bp, Homo sapiens
ggtgggtgaaag

SEQ ID NO: 3750131 - DNA, 19 bp, Homo sapiens
ggtggtcctgactcaacat

SEQ ID NO: 3750132 - DNA, 17 bp, Homo sapiens
ggtggtctgcaggcagg

SEQ ID NO: 3750133 - DNA, 13 bp, Homo sapiens
ggtggtgttttta

SEQ ID NO: 3750134 - DNA, 17 bp, Homo sapiens
ggtgtcaagagggtctg

SEQ ID NO: 3750135 - DNA, 16 bp, Homo sapiens
ggtgtccccagcccac

SEQ ID NO: 3750136 - DNA, 13 bp, Homo sapiens
ggtgtgcctgcag

SEQ ID NO: 3750137 - DNA, 12 bp, Homo sapiens
ggtgtggagaag

SEQ ID NO: 3750138 - DNA, 22 bp, Homo sapiens
ggtgtgtttttgggatgtctta

SEQ ID NO: 3750139 - DNA, 14 bp, Homo sapiens
ggtgttgggagccc

SEQ ID NO: 3750140 - DNA, 15 bp, Homo sapiens
ggttaaggctgagga

SEQ ID NO: 3750141 - DNA, 15 bp, Homo sapiens
ggttacaaactgcaa

SEQ ID NO: 3750142 - DNA, 13 bp, Homo sapiens
ggttacactgtta

SEQ ID NO: 3750143 - DNA, 15 bp, Homo sapiens
ggttacactgttaga

SEQ ID NO: 3750144 - DNA, 18 bp, Homo sapiens
ggttacagtgcagacagg

SEQ ID NO: 3750145 - DNA, 13 bp, Homo sapiens
ggttagggagggg

SEQ ID NO: 3750146 - DNA, 12 bp, Homo sapiens
ggttatacatga

SEQ ID NO: 3750147 - DNA, 21 bp, Homo sapiens
ggttatattttactactgtgg

SEQ ID NO: 3750148 - DNA, 23 bp, Homo sapiens
ggttcaagcgattcttctgcttc

SEQ ID NO: 3750149 - DNA, 14 bp, Homo sapiens
ggttcaccagcctc

SEQ ID NO: 3750150 - DNA, 21 bp, Homo sapiens
ggttcacgcctgtaatcccag

SEQ ID NO: 3750151 - DNA, 14 bp, Homo sapiens
ggttcagcccctcc

SEQ ID NO: 3750152 - DNA, 18 bp, Homo sapiens
ggttcagcccctcctctg

SEQ ID NO: 3750153 - DNA, 20 bp, Homo sapiens
ggttcagcccctcctctgcc

SEQ ID NO: 3750154 - DNA, 21 bp, Homo sapiens
ggttcagcccctcctctgcca

SEQ ID NO: 3750155 - DNA, 21 bp, Homo sapiens
ggttcagggttggcccctgcc

SEQ ID NO: 3750156 - DNA, 22 bp, Homo sapiens
ggttcagggttggcccctgccc

SEQ ID NO: 3750157 - DNA, 14 bp, Homo sapiens
ggttcatcagtgtt

SEQ ID NO: 3750158 - DNA, 15 bp, Homo sapiens
ggttcatcagtgtta

SEQ ID NO: 3750159 - DNA, 19 bp, Homo sapiens
ggttcatcagtgttaaaaa

SEQ ID NO: 3750160 - DNA, 16 bp, Homo sapiens
ggttcattattggaat

SEQ ID NO: 3750161 - DNA, 18 bp, Homo sapiens
ggttcattattggaatta

SEQ ID NO: 3750162 - DNA, 23 bp, Homo sapiens
ggttcatttcaaatacatctttg

SEQ ID NO: 3750163 - DNA, 16 bp, Homo sapiens
ggttccaatcctggct

SEQ ID NO: 3750164 - DNA, 18 bp, Homo sapiens
ggttccaatcctggctct

SEQ ID NO: 3750165 - DNA, 13 bp, Homo sapiens
ggttcccccagcc

SEQ ID NO: 3750166 - DNA, 16 bp, Homo sapiens
ggttcccccagccctg

SEQ ID NO: 3750167 - DNA, 21 bp, Homo sapiens
ggttcccccagccctgtggaa

SEQ ID NO: 3750168 - DNA, 15 bp, Homo sapiens
ggttcccctgttcac

SEQ ID NO: 3750169 - DNA, 17 bp, Homo sapiens
ggttccctttccttcca

SEQ ID NO: 3750170 - DNA, 21 bp, Homo sapiens
ggttccggaatcctgtcctca

SEQ ID NO: 3750171 - DNA, 18 bp, Homo sapiens
ggttctacaatctattta

SEQ ID NO: 3750172 - DNA, 18 bp, Homo sapiens
ggttgaggggctcctgga

SEQ ID NO: 3750173 - DNA, 19 bp, Homo sapiens
ggttgaggggctcctggaa

SEQ ID NO: 3750174 - DNA, 19 bp, Homo sapiens
ggttgaggtggaagccctc

SEQ ID NO: 3750175 - DNA, 17 bp, Homo sapiens
ggttgcagtgagctgag

SEQ ID NO: 3750176 - DNA, 20 bp, Homo sapiens
ggttgccttaaaagaaatct

SEQ ID NO: 3750177 - DNA, 15 bp, Homo sapiens
ggttgcttctgggaa

SEQ ID NO: 3750178 - DNA, 21 bp, Homo sapiens
ggttggcccctgcccggctgc

SEQ ID NO: 3750179 - DNA, 19 bp, Homo sapiens
ggttggctgggcccagaag

SEQ ID NO: 3750180 - DNA, 19 bp, Homo sapiens
ggtttacattcatctcatt

SEQ ID NO: 3750181 - DNA, 23 bp, Homo sapiens
ggtttactctgtggccaaaggag

SEQ ID NO: 3750182 - DNA, 19 bp, Homo sapiens
ggtttccttaaaattttta

SEQ ID NO: 3750183 - DNA, 12 bp, Homo sapiens
ggtttctagcat

SEQ ID NO: 3750184 - DNA, 14 bp, Homo sapiens
ggtttctgccctgc

SEQ ID NO: 3750185 - DNA, 14 bp, Homo sapiens
ggtttgcaaggaag

SEQ ID NO: 3750186 - DNA, 17 bp, Homo sapiens
ggtttggcgggccaagg

SEQ ID NO: 3750187 - DNA, 18 bp, Homo sapiens
ggttttaattgaaggaaa

SEQ ID NO: 3750188 - DNA, 19 bp, Homo sapiens
ggttttcgaagctcagccc

SEQ ID NO: 3750189 - DNA, 14 bp, Homo sapiens
ggttttcttcccat

SEQ ID NO: 3750190 - DNA, 23 bp, Homo sapiens
ggtttttgtttgtttcctttgtt

SEQ ID NO: 3750191 - DNA, 19 bp, Homo sapiens
gtaaaaacagcattgcttt

SEQ ID NO: 3750192 - DNA, 13 bp, Homo sapiens
gtaaaaatgagaa

SEQ ID NO: 3750193 - DNA, 12 bp, Homo sapiens
gtaaaacaaaaa

SEQ ID NO: 3750194 - DNA, 18 bp, Homo sapiens
gtaaaactttattttata

SEQ ID NO: 3750195 - DNA, 17 bp, Homo sapiens
gtaaaagataacaagat

SEQ ID NO: 3750196 - DNA, 13 bp, Homo sapiens
gtaaaattgcatg

SEQ ID NO: 3750197 - DNA, 14 bp, Homo sapiens
gtaaaattgcatgg

SEQ ID NO: 3750198 - DNA, 18 bp, Homo sapiens
gtaaacagtgcctgctga

SEQ ID NO: 3750199 - DNA, 21 bp, Homo sapiens
gtaaacgtttcagtaataaaa

SEQ ID NO: 3750200 - DNA, 23 bp, Homo sapiens
gtaaacgtttcagtaataaaaca

SEQ ID NO: 3750201 - DNA, 22 bp, Homo sapiens
gtaaactatcttggtgaatttt

SEQ ID NO: 3750202 - DNA, 16 bp, Homo sapiens
gtaaactatttatctg

SEQ ID NO: 3750203 - DNA, 14 bp, Homo sapiens
gtaaactgccctgt

SEQ ID NO: 3750204 - DNA, 19 bp, Homo sapiens
gtaaactgtactagtctgt

SEQ ID NO: 3750205 - DNA, 22 bp, Homo sapiens
gtaaagaaatttaaaagacact

SEQ ID NO: 3750206 - DNA, 19 bp, Homo sapiens
gtaaagagaaactttgtgc

SEQ ID NO: 3750207 - DNA, 20 bp, Homo sapiens
gtaaagtgtaacatatgcaa

SEQ ID NO: 3750208 - DNA, 18 bp, Homo sapiens
gtaaatagcaacatgctt

SEQ ID NO: 3750209 - DNA, 22 bp, Homo sapiens
gtaaatcctttttctttataaa

SEQ ID NO: 3750210 - DNA, 14 bp, Homo sapiens
gtaaattattcagt

SEQ ID NO: 3750211 - DNA, 22 bp, Homo sapiens
gtaaattattcagttaagaaaa

SEQ ID NO: 3750212 - DNA, 21 bp, Homo sapiens
gtaaattattttaaattataa

SEQ ID NO: 3750213 - DNA, 21 bp, Homo sapiens
gtaacaagagtgattcttgct

SEQ ID NO: 3750214 - DNA, 16 bp, Homo sapiens
gtaacaggtctcctct

SEQ ID NO: 3750215 - DNA, 20 bp, Homo sapiens
gtaacaggtctcctcttaaa

SEQ ID NO: 3750216 - DNA, 13 bp, Homo sapiens
gtaacattcatgt

SEQ ID NO: 3750217 - DNA, 21 bp, Homo sapiens
gtaacctgagatggccctctg

SEQ ID NO: 3750218 - DNA, 12 bp, Homo sapiens
gtaactccacca

SEQ ID NO: 3750219 - DNA, 12 bp, Homo sapiens
gcagaggcagcg

SEQ ID NO: 3750220 - DNA, 19 bp, Homo sapiens
gcagaggctggaggcaggg

SEQ ID NO: 3750221 - DNA, 21 bp, Homo sapiens
gcagaggctggaggcagggcc

SEQ ID NO: 3750222 - DNA, 22 bp, Homo sapiens
gcagaggctggaggcagggcct

SEQ ID NO: 3750223 - DNA, 19 bp, Homo sapiens
gcagagggcagaggctgga

SEQ ID NO: 3750224 - DNA, 16 bp, Homo sapiens
gcagaggggctttctg

SEQ ID NO: 3750225 - DNA, 19 bp, Homo sapiens
gcagaggggctttctggag

SEQ ID NO: 3750226 - DNA, 20 bp, Homo sapiens
gcagaggggctttctggaga

SEQ ID NO: 3750227 - DNA, 13 bp, Homo sapiens
gcagagtcagcag

SEQ ID NO: 3750228 - DNA, 16 bp, Homo sapiens
gcagataatcagcctc

SEQ ID NO: 3750229 - DNA, 17 bp, Homo sapiens
gcagataatcagcctct

SEQ ID NO: 3750230 - DNA, 22 bp, Homo sapiens
gcagatacaggaaaagctgctg

SEQ ID NO: 3750231 - DNA, 12 bp, Homo sapiens
gcagatcccagc

SEQ ID NO: 3750232 - DNA, 14 bp, Homo sapiens
gcagatcccagctc

SEQ ID NO: 3750233 - DNA, 13 bp, Homo sapiens
gcagatctgtgcc

SEQ ID NO: 3750234 - DNA, 14 bp, Homo sapiens
gcagatctgtgccc

SEQ ID NO: 3750235 - DNA, 22 bp, Homo sapiens
gcagatctgtgccccatgcctg

SEQ ID NO: 3750236 - DNA, 17 bp, Homo sapiens
gcagatgcaaagaggca

SEQ ID NO: 3750237 - DNA, 18 bp, Homo sapiens
gcagatgcaaagaggcaa

SEQ ID NO: 3750238 - DNA, 22 bp, Homo sapiens
gcagatgcaaagaggcaagagg

SEQ ID NO: 3750239 - DNA, 13 bp, Homo sapiens
gcagatgccagag

SEQ ID NO: 3750240 - DNA, 19 bp, Homo sapiens
gcagattggagaaaccctt

SEQ ID NO: 3750241 - DNA, 16 bp, Homo sapiens
gcagattttacaaaag

SEQ ID NO: 3750242 - DNA, 20 bp, Homo sapiens
gcagattttacaaaagatgt

SEQ ID NO: 3750243 - DNA, 19 bp, Homo sapiens
gcagcaacacaatgttatt

SEQ ID NO: 3750244 - DNA, 17 bp, Homo sapiens
gcagcaaccagagcact

SEQ ID NO: 3750245 - DNA, 13 bp, Homo sapiens
gcagcagagcctg

SEQ ID NO: 3750246 - DNA, 13 bp, Homo sapiens
gcagcagcttgct

SEQ ID NO: 3750247 - DNA, 20 bp, Homo sapiens
gcagcaggcctgttgctttt

SEQ ID NO: 3750248 - DNA, 17 bp, Homo sapiens
gcagcagtgagtctctt

SEQ ID NO: 3750249 - DNA, 14 bp, Homo sapiens
gcagcatatgagga

SEQ ID NO: 3750250 - DNA, 19 bp, Homo sapiens
gcagcatcttcacttctaa

SEQ ID NO: 3750251 - DNA, 13 bp, Homo sapiens
gcagccaagctcc

SEQ ID NO: 3750252 - DNA, 20 bp, Homo sapiens
gcagccaagctccttgggag

SEQ ID NO: 3750253 - DNA, 16 bp, Homo sapiens
gcagccagcccagccc

SEQ ID NO: 3750254 - DNA, 23 bp, Homo sapiens
gcagccagcccagcccagctggt

SEQ ID NO: 3750255 - DNA, 17 bp, Homo sapiens
gcagccagctctcagcc

SEQ ID NO: 3750256 - DNA, 12 bp, Homo sapiens
gcagccaggctg

SEQ ID NO: 3750257 - DNA, 13 bp, Homo sapiens
gcagcccatgccc

SEQ ID NO: 3750258 - DNA, 17 bp, Homo sapiens
gcagcccatgcccacct

SEQ ID NO: 3750259 - DNA, 18 bp, Homo sapiens
gcagcccatgcccacctg

SEQ ID NO: 3750260 - DNA, 20 bp, Homo sapiens
gcagcccatgcccacctgcc

SEQ ID NO: 3750261 - DNA, 22 bp, Homo sapiens
gcagcccatgcccacctgccca

SEQ ID NO: 3750262 - DNA, 17 bp, Homo sapiens
gcagccccattctgcct

SEQ ID NO: 3750263 - DNA, 18 bp, Homo sapiens
gcagccccattctgcctg

SEQ ID NO: 3750264 - DNA, 19 bp, Homo sapiens
gcagccccattctgcctgc

SEQ ID NO: 3750265 - DNA, 23 bp, Homo sapiens
gcagccccgcgcctccttccttg

SEQ ID NO: 3750266 - DNA, 15 bp, Homo sapiens
gcagcccgtgtggcc

SEQ ID NO: 3750267 - DNA, 15 bp, Homo sapiens
gcagccctcctcacc

SEQ ID NO: 3750268 - DNA, 13 bp, Homo sapiens
gcagccctgcttt

SEQ ID NO: 3750269 - DNA, 14 bp, Homo sapiens
gcagccctgctttg

SEQ ID NO: 3750270 - DNA, 24 bp, Homo sapiens
gcagccctgctttgggctgccctg

SEQ ID NO: 3750271 - DNA, 19 bp, Homo sapiens
gcagcctcgaactcctggg

SEQ ID NO: 3750272 - DNA, 14 bp, Homo sapiens
gcagcctctgaagt

SEQ ID NO: 3750273 - DNA, 14 bp, Homo sapiens
gcagcctgcctgga

SEQ ID NO: 3750274 - DNA, 15 bp, Homo sapiens
gcagcctgcctggag

SEQ ID NO: 3750275 - DNA, 13 bp, Homo sapiens
gcagcctgcgtgg

SEQ ID NO: 3750276 - DNA, 12 bp, Homo sapiens
gcagcctggagg

SEQ ID NO: 3750277 - DNA, 13 bp, Homo sapiens
gcagcctggaggc

SEQ ID NO: 3750278 - DNA, 14 bp, Homo sapiens
gcagcctgtggcat

SEQ ID NO: 3750279 - DNA, 16 bp, Homo sapiens
gcagcctgtggcatct

SEQ ID NO: 3750280 - DNA, 22 bp, Homo sapiens
gcagcctgtggcatctttgcct

SEQ ID NO: 3750281 - DNA, 24 bp, Homo sapiens
gcagcgagttgtggaaagcctctg

SEQ ID NO: 3750282 - DNA, 18 bp, Homo sapiens
gcagctgattttaacaat

SEQ ID NO: 3750283 - DNA, 15 bp, Homo sapiens
gcagctgccagagaa

SEQ ID NO: 3750284 - DNA, 17 bp, Homo sapiens
gcagctgcggtccaccc

SEQ ID NO: 3750285 - DNA, 22 bp, Homo sapiens
gcagctgcggtccacccaggag

SEQ ID NO: 3750286 - DNA, 23 bp, Homo sapiens
gcagctgcggtccacccaggagc

SEQ ID NO: 3750287 - DNA, 21 bp, Homo sapiens
gcagcttgcgttagaatgagg

SEQ ID NO: 3750288 - DNA, 15 bp, Homo sapiens
gcagcttgctgcacc

SEQ ID NO: 3750289 - DNA, 18 bp, Homo sapiens
gcaggaagcaacgaaggg

SEQ ID NO: 3750290 - DNA, 13 bp, Homo sapiens
gcaggaagctgct

SEQ ID NO: 3750291 - DNA, 15 bp, Homo sapiens
gcaggaagctgctcc

SEQ ID NO: 3750292 - DNA, 16 bp, Homo sapiens
gcaggaagctgtgaga

SEQ ID NO: 3750293 - DNA, 12 bp, Homo sapiens
gcaggaaggaga

SEQ ID NO: 3750294 - DNA, 22 bp, Homo sapiens
gcaggagaatcacttgcactcc

SEQ ID NO: 3750295 - DNA, 16 bp, Homo sapiens
gcaggagctcagatga

SEQ ID NO: 3750296 - DNA, 23 bp, Homo sapiens
gcaggaggattgcttgagcccag

SEQ ID NO: 3750297 - DNA, 22 bp, Homo sapiens
gcaggagggccctacctgattg

SEQ ID NO: 3750298 - DNA, 18 bp, Homo sapiens
gcaggatgattgtacaga

SEQ ID NO: 3750299 - DNA, 22 bp, Homo sapiens
gcaggcccaaattatcaagcta

SEQ ID NO: 3750300 - DNA, 19 bp, Homo sapiens
gcaggctggcaccgccttc

SEQ ID NO: 3750301 - DNA, 21 bp, Homo sapiens
gcagggaaggggaggcagccg

SEQ ID NO: 3750302 - DNA, 21 bp, Homo sapiens
gcagggaagtgtaagaaacac

SEQ ID NO: 3750303 - DNA, 14 bp, Homo sapiens
gcagggcatctcct

SEQ ID NO: 3750304 - DNA, 12 bp, Homo sapiens
gcagggctcagc

SEQ ID NO: 3750305 - DNA, 14 bp, Homo sapiens
gcagggctcagcgg

SEQ ID NO: 3750306 - DNA, 14 bp, Homo sapiens
gcagggtcaggaga

SEQ ID NO: 3750307 - DNA, 17 bp, Homo sapiens
gcagggtcaggagaggg

SEQ ID NO: 3750308 - DNA, 19 bp, Homo sapiens
gcagggtcctagaaattcc

SEQ ID NO: 3750309 - DNA, 18 bp, Homo sapiens
gcagggtctcactctgtc

SEQ ID NO: 3750310 - DNA, 14 bp, Homo sapiens
gcaggtaccactga

SEQ ID NO: 3750311 - DNA, 22 bp, Homo sapiens
gcaggtccagggtttgagttca

SEQ ID NO: 3750312 - DNA, 19 bp, Homo sapiens
gcaggtcttgaactcctgg

SEQ ID NO: 3750313 - DNA, 19 bp, Homo sapiens
gcaggtgaccttctgggaa

SEQ ID NO: 3750314 - DNA, 16 bp, Homo sapiens
gcaggtgggagcttga

SEQ ID NO: 3750315 - DNA, 16 bp, Homo sapiens
gcaggttgaggggctc

SEQ ID NO: 3750316 - DNA, 21 bp, Homo sapiens
gcaggttgaggggctcctgga

SEQ ID NO: 3750317 - DNA, 17 bp, Homo sapiens
gcagtaaagagaaactt

SEQ ID NO: 3750318 - DNA, 18 bp, Homo sapiens
gcagtaaagagaaacttt

SEQ ID NO: 3750319 - DNA, 21 bp, Homo sapiens
gcagtagaaataatatgcatt

SEQ ID NO: 3750320 - DNA, 20 bp, Homo sapiens
gcagtagagtcatctccatc

SEQ ID NO: 3750321 - DNA, 18 bp, Homo sapiens
gcagtcctgcctcagcct

SEQ ID NO: 3750322 - DNA, 22 bp, Homo sapiens
gcagtctctcttacccttctgt

SEQ ID NO: 3750323 - DNA, 15 bp, Homo sapiens
gcagtctggaggggc

SEQ ID NO: 3750324 - DNA, 14 bp, Homo sapiens
gcagtgaattgtga

SEQ ID NO: 3750325 - DNA, 18 bp, Homo sapiens
gcagtgacgtgcacctgt

SEQ ID NO: 3750326 - DNA, 14 bp, Homo sapiens
gcagtgagctgaga

SEQ ID NO: 3750327 - DNA, 22 bp, Homo sapiens
gcagtgaggggtatatctgggc

SEQ ID NO: 3750328 - DNA, 21 bp, Homo sapiens
gcagtgatgctggatgctcct

SEQ ID NO: 3750329 - DNA, 13 bp, Homo sapiens
gcagtgattttta

SEQ ID NO: 3750330 - DNA, 23 bp, Homo sapiens
gcagtgcagcaaccagagcactg

SEQ ID NO: 3750331 - DNA, 15 bp, Homo sapiens
gcagtgccttccata

SEQ ID NO: 3750332 - DNA, 16 bp, Homo sapiens
gcagtgccttccataa

SEQ ID NO: 3750333 - DNA, 21 bp, Homo sapiens
gcagtgggacagggcatggcc

SEQ ID NO: 3750334 - DNA, 17 bp, Homo sapiens
gccatcggtcctgtctc

SEQ ID NO: 3750335 - DNA, 13 bp, Homo sapiens
gccatgaactttg

SEQ ID NO: 3750336 - DNA, 14 bp, Homo sapiens
gccatgagctccag

SEQ ID NO: 3750337 - DNA, 15 bp, Homo sapiens
gccatgagctccaga

SEQ ID NO: 3750338 - DNA, 16 bp, Homo sapiens
gccatgagctccagac

SEQ ID NO: 3750339 - DNA, 24 bp, Homo sapiens
gccatgctcctggcccactgcatc

SEQ ID NO: 3750340 - DNA, 18 bp, Homo sapiens
gccatggactctacactg

SEQ ID NO: 3750341 - DNA, 23 bp, Homo sapiens
gccatggactctacactgtgaac

SEQ ID NO: 3750342 - DNA, 15 bp, Homo sapiens
gccatggaggcacac

SEQ ID NO: 3750343 - DNA, 21 bp, Homo sapiens
gccatggaggcacacagctgc

SEQ ID NO: 3750344 - DNA, 16 bp, Homo sapiens
gccatggcgtgtccct

SEQ ID NO: 3750345 - DNA, 15 bp, Homo sapiens
gccatgggcctcctg

SEQ ID NO: 3750346 - DNA, 15 bp, Homo sapiens
gccatgtgaagaggg

SEQ ID NO: 3750347 - DNA, 15 bp, Homo sapiens
gccatgttggccagg

SEQ ID NO: 3750348 - DNA, 16 bp, Homo sapiens
gccatgttggccaggc

SEQ ID NO: 3750349 - DNA, 20 bp, Homo sapiens
gccatgttggccaggctggt

SEQ ID NO: 3750350 - DNA, 24 bp, Homo sapiens
gccatgttggccaggctggtctca

SEQ ID NO: 3750351 - DNA, 21 bp, Homo sapiens
gccatgtttaagatttaattt

SEQ ID NO: 3750352 - DNA, 19 bp, Homo sapiens
gccattgcactccagcctg

SEQ ID NO: 3750353 - DNA, 18 bp, Homo sapiens
gccattgccaccaggaga

SEQ ID NO: 3750354 - DNA, 15 bp, Homo sapiens
gccattgtctttata

SEQ ID NO: 3750355 - DNA, 23 bp, Homo sapiens
gccatttgcaccctccgccttca

SEQ ID NO: 3750356 - DNA, 15 bp, Homo sapiens
gccatttgctttttc

SEQ ID NO: 3750357 - DNA, 17 bp, Homo sapiens
gcccaaagccagacagc

SEQ ID NO: 3750358 - DNA, 14 bp, Homo sapiens
gcccaacctcagca

SEQ ID NO: 3750359 - DNA, 22 bp, Homo sapiens
gcccaagaatagatgctgactg

SEQ ID NO: 3750360 - DNA, 19 bp, Homo sapiens
gcccaagacagatgcccca

SEQ ID NO: 3750361 - DNA, 20 bp, Homo sapiens
gcccaagacagatgccccag

SEQ ID NO: 3750362 - DNA, 21 bp, Homo sapiens
gcccaagacagatgccccaga

SEQ ID NO: 3750363 - DNA, 23 bp, Homo sapiens
gcccaagacagatgccccagagc

SEQ ID NO: 3750364 - DNA, 13 bp, Homo sapiens
gcccaagccctga

SEQ ID NO: 3750365 - DNA, 18 bp, Homo sapiens
gcccaatattataatttt

SEQ ID NO: 3750366 - DNA, 13 bp, Homo sapiens
gcccacagctccc

SEQ ID NO: 3750367 - DNA, 14 bp, Homo sapiens
gcccacagctccca

SEQ ID NO: 3750368 - DNA, 18 bp, Homo sapiens
gcccacaggatcagtctg

SEQ ID NO: 3750369 - DNA, 19 bp, Homo sapiens
gcccacaggatcagtctga

SEQ ID NO: 3750370 - DNA, 23 bp, Homo sapiens
gcccacaggtgtccccagcccac

SEQ ID NO: 3750371 - DNA, 20 bp, Homo sapiens
gcccacatagtgatggttcc

SEQ ID NO: 3750372 - DNA, 22 bp, Homo sapiens
gcccacatgtgtccatcccagc

SEQ ID NO: 3750373 - DNA, 16 bp, Homo sapiens
gcccacattggaccca

SEQ ID NO: 3750374 - DNA, 21 bp, Homo sapiens
gcccaccaacatcccattgcc

SEQ ID NO: 3750375 - DNA, 15 bp, Homo sapiens
gcccacctgcccatc

SEQ ID NO: 3750376 - DNA, 22 bp, Homo sapiens
gcccacctgtcaaacaaagcca

SEQ ID NO: 3750377 - DNA, 13 bp, Homo sapiens
gcccaccttggct

SEQ ID NO: 3750378 - DNA, 16 bp, Homo sapiens
gcccaccttggctcaa

SEQ ID NO: 3750379 - DNA, 21 bp, Homo sapiens
gcccacgctggagtgcagtga

SEQ ID NO: 3750380 - DNA, 23 bp, Homo sapiens
gcccacgctggagtgcagtgagc

SEQ ID NO: 3750381 - DNA, 23 bp, Homo sapiens
gcccacttcagggttctcctctc

SEQ ID NO: 3750382 - DNA, 21 bp, Homo sapiens
gcccagaattcccagctgtct

SEQ ID NO: 3750383 - DNA, 16 bp, Homo sapiens
gcccagagatgcctcc

SEQ ID NO: 3750384 - DNA, 19 bp, Homo sapiens
gcccagagatgcctccacc

SEQ ID NO: 3750385 - DNA, 20 bp, Homo sapiens
gcccagagatgcctccaccg

SEQ ID NO: 3750386 - DNA, 16 bp, Homo sapiens
gcccagagctgggtga

SEQ ID NO: 3750387 - DNA, 16 bp, Homo sapiens
gcccagagggcccagg

SEQ ID NO: 3750388 - DNA, 20 bp, Homo sapiens
gcccagccattaccatggag

SEQ ID NO: 3750389 - DNA, 13 bp, Homo sapiens
gcccagcccagct

SEQ ID NO: 3750390 - DNA, 14 bp, Homo sapiens
gcccagcccagctg

SEQ ID NO: 3750391 - DNA, 16 bp, Homo sapiens
gcccagcccagctggt

SEQ ID NO: 3750392 - DNA, 15 bp, Homo sapiens
gcccagctcagaggg

SEQ ID NO: 3750393 - DNA, 12 bp, Homo sapiens
gcccagctccag

SEQ ID NO: 3750394 - DNA, 13 bp, Homo sapiens
gcccagctgcacc

SEQ ID NO: 3750395 - DNA, 18 bp, Homo sapiens
gcccagctgcacctgcca

SEQ ID NO: 3750396 - DNA, 24 bp, Homo sapiens
gcccagctgcacctgccagcctgg

SEQ ID NO: 3750397 - DNA, 16 bp, Homo sapiens
gcccagctgctctgcc

SEQ ID NO: 3750398 - DNA, 19 bp, Homo sapiens
gcccagctgctctgcccag

SEQ ID NO: 3750399 - DNA, 20 bp, Homo sapiens
gcccagctgctctgcccaga

SEQ ID NO: 3750400 - DNA, 21 bp, Homo sapiens
gcccagctgctctgcccagag

SEQ ID NO: 3750401 - DNA, 17 bp, Homo sapiens
gcccagctggtgggaag

SEQ ID NO: 3750402 - DNA, 20 bp, Homo sapiens
gcccaggaatttgaagctgc

SEQ ID NO: 3750403 - DNA, 15 bp, Homo sapiens
gcccaggagagccag

SEQ ID NO: 3750404 - DNA, 11 bp, Homo sapiens
gcccaggcagg

SEQ ID NO: 3750405 - DNA, 14 bp, Homo sapiens
gcccaggcaggtct

SEQ ID NO: 3750406 - DNA, 12 bp, Homo sapiens
gcccaggcccct

SEQ ID NO: 3750407 - DNA, 18 bp, Homo sapiens
gcccaggcccctgccacc

SEQ ID NO: 3750408 - DNA, 18 bp, Homo sapiens
gcccaggcctccagctca

SEQ ID NO: 3750409 - DNA, 14 bp, Homo sapiens
gcccaggctggcgt

SEQ ID NO: 3750410 - DNA, 19 bp, Homo sapiens
gcccaggctggcgtgcagt

SEQ ID NO: 3750411 - DNA, 21 bp, Homo sapiens
gcccagggagcggaaagcagc

SEQ ID NO: 3750412 - DNA, 18 bp, Homo sapiens
gcccagggccactctgcc

SEQ ID NO: 3750413 - DNA, 22 bp, Homo sapiens
gcccagggccactctgcctctg

SEQ ID NO: 3750414 - DNA, 13 bp, Homo sapiens
gcccagggctcag

SEQ ID NO: 3750415 - DNA, 14 bp, Homo sapiens
gcccagggctcagc

SEQ ID NO: 3750416 - DNA, 19 bp, Homo sapiens
gcccagtctggaatgcagt

SEQ ID NO: 3750417 - DNA, 22 bp, Homo sapiens
gcccagtctggaatgcagtggt

SEQ ID NO: 3750418 - DNA, 19 bp, Homo sapiens
gcccagtgttgtttgtaaa

SEQ ID NO: 3750419 - DNA, 14 bp, Homo sapiens
gcccagttaatctt

SEQ ID NO: 3750420 - DNA, 19 bp, Homo sapiens
gcccagttgggtggatgcc

SEQ ID NO: 3750421 - DNA, 22 bp, Homo sapiens
gcccagttgggtggatgcctgg

SEQ ID NO: 3750422 - DNA, 21 bp, Homo sapiens
gcccatcacagggttgggccc

SEQ ID NO: 3750423 - DNA, 13 bp, Homo sapiens
gcccatgcccacc

SEQ ID NO: 3750424 - DNA, 21 bp, Homo sapiens
gcccatggttgagaaatgaat

SEQ ID NO: 3750425 - DNA, 17 bp, Homo sapiens
gcccattctctctcctg

SEQ ID NO: 3750426 - DNA, 19 bp, Homo sapiens
gcccattctctctcctgtc

SEQ ID NO: 3750427 - DNA, 20 bp, Homo sapiens
gcccattctctctcctgtcc

SEQ ID NO: 3750428 - DNA, 21 bp, Homo sapiens
gcccattctctctcctgtcca

SEQ ID NO: 3750429 - DNA, 17 bp, Homo sapiens
gccccaaacaaatatgc

SEQ ID NO: 3750430 - DNA, 18 bp, Homo sapiens
gccccaaacaaatatgca

SEQ ID NO: 3750431 - DNA, 20 bp, Homo sapiens
gccccaacccaaacctggag

SEQ ID NO: 3750432 - DNA, 14 bp, Homo sapiens
gccccaactcctgg

SEQ ID NO: 3750433 - DNA, 16 bp, Homo sapiens
gccccaactcctggaa

SEQ ID NO: 3750434 - DNA, 19 bp, Homo sapiens
gccccaaggggtttctgtt

SEQ ID NO: 3750435 - DNA, 21 bp, Homo sapiens
gccccaaggggtttctgtttc

SEQ ID NO: 3750436 - DNA, 20 bp, Homo sapiens
gccccaccacctaggccact

SEQ ID NO: 3750437 - DNA, 23 bp, Homo sapiens
gccccaccacctaggccactcct

SEQ ID NO: 3750438 - DNA, 11 bp, Homo sapiens
gccccacccag

SEQ ID NO: 3750439 - DNA, 11 bp, Homo sapiens
gccccacctgc

SEQ ID NO: 3750440 - DNA, 20 bp, Homo sapiens
gccccacctgccactaggct

SEQ ID NO: 3750441 - DNA, 23 bp, Homo sapiens
gccccacctgccactaggctggg

SEQ ID NO: 3750442 - DNA, 13 bp, Homo sapiens
gccccactgggga

SEQ ID NO: 3750443 - DNA, 14 bp, Homo sapiens
gccccactggggaa

SEQ ID NO: 3750444 - DNA, 15 bp, Homo sapiens
gccccactggggaaa

SEQ ID NO: 3750445 - DNA, 18 bp, Homo sapiens
gccccagaaggcagggaa

SEQ ID NO: 3750446 - DNA, 11 bp, Homo sapiens
gccccagagac

SEQ ID NO: 3750447 - DNA, 23 bp, Homo sapiens
gccccagagctgtttatggcctc

SEQ ID NO: 3750448 - DNA, 12 bp, Homo sapiens
gccccagcacta

SEQ ID NO: 3750449 - DNA, 23 bp, Homo sapiens
gccccagcactaaagcagtggac

SEQ ID NO: 3750450 - DNA, 13 bp, Homo sapiens
gccccagctctgg

SEQ ID NO: 3750451 - DNA, 20 bp, Homo sapiens
gccccaggcaggctgtgcgc

SEQ ID NO: 3750452 - DNA, 16 bp, Homo sapiens
gccccagggtcttccc

SEQ ID NO: 3750453 - DNA, 12 bp, Homo sapiens
gccccagtgccc

SEQ ID NO: 3750454 - DNA, 13 bp, Homo sapiens
gccccagtgccca

SEQ ID NO: 3750455 - DNA, 17 bp, Homo sapiens
gccccatcagctccagc

SEQ ID NO: 3750456 - DNA, 22 bp, Homo sapiens
gccccattctgcctgcccaggc

SEQ ID NO: 3750457 - DNA, 18 bp, Homo sapiens
gcccccacacctggccct

SEQ ID NO: 3750458 - DNA, 23 bp, Homo sapiens
gcccccacacctggccctggggc

SEQ ID NO: 3750459 - DNA, 21 bp, Homo sapiens
gcccccaccactaggactctg

SEQ ID NO: 3750460 - DNA, 19 bp, Homo sapiens
gcccccactggctgtgggc

SEQ ID NO: 3750461 - DNA, 17 bp, Homo sapiens
gcccccaggctgctgga

SEQ ID NO: 3750462 - DNA, 13 bp, Homo sapiens
gccccccacccca

SEQ ID NO: 3750463 - DNA, 14 bp, Homo sapiens
gccccccaccccag

SEQ ID NO: 3750464 - DNA, 11 bp, Homo sapiens
gcccccgcccc

SEQ ID NO: 3750465 - DNA, 15 bp, Homo sapiens
gcccccttctcccac

SEQ ID NO: 3750466 - DNA, 16 bp, Homo sapiens
gcccccttctcccaca

SEQ ID NO: 3750467 - DNA, 19 bp, Homo sapiens
gcccccttctcccacactg

SEQ ID NO: 3750468 - DNA, 20 bp, Homo sapiens
gccccgcaaaacccactgac

SEQ ID NO: 3750469 - DNA, 15 bp, Homo sapiens
gccccgccccacatt

SEQ ID NO: 3750470 - DNA, 17 bp, Homo sapiens
gccccgcgcctccttcc

SEQ ID NO: 3750471 - DNA, 20 bp, Homo sapiens
gccccgcttgtccagcgcct

SEQ ID NO: 3750472 - DNA, 17 bp, Homo sapiens
gccccgtcaccatctca

SEQ ID NO: 3750473 - DNA, 20 bp, Homo sapiens
gccccgtcaccatctcaggc

SEQ ID NO: 3750474 - DNA, 12 bp, Homo sapiens
gcccctcccacc

SEQ ID NO: 3750475 - DNA, 15 bp, Homo sapiens
gcccctcccccaacc

SEQ ID NO: 3750476 - DNA, 15 bp, Homo sapiens
gcccctccctacctc

SEQ ID NO: 3750477 - DNA, 17 bp, Homo sapiens
gcccctccctacctcaa

SEQ ID NO: 3750478 - DNA, 21 bp, Homo sapiens
gcccctccctacctcaacctg

SEQ ID NO: 3750479 - DNA, 12 bp, Homo sapiens
gcccctcccttc

SEQ ID NO: 3750480 - DNA, 20 bp, Homo sapiens
gcccctcctctgccacctcc

SEQ ID NO: 3750481 - DNA, 13 bp, Homo sapiens
gcccctcttgccc

SEQ ID NO: 3750482 - DNA, 22 bp, Homo sapiens
gcccctgagacaaatggaggcc

SEQ ID NO: 3750483 - DNA, 13 bp, Homo sapiens
gcccctgcacaaa

SEQ ID NO: 3750484 - DNA, 14 bp, Homo sapiens
gcccctgccaccct

SEQ ID NO: 3750485 - DNA, 16 bp, Homo sapiens
gcccctgccccgtcac

SEQ ID NO: 3750486 - DNA, 13 bp, Homo sapiens
gcccctgcccggc

SEQ ID NO: 3750487 - DNA, 14 bp, Homo sapiens
gcccctgcccggct

SEQ ID NO: 3750488 - DNA, 15 bp, Homo sapiens
gcccctgctgcctcc

SEQ ID NO: 3750489 - DNA, 20 bp, Homo sapiens
gcccctgctgcctccccaac

SEQ ID NO: 3750490 - DNA, 21 bp, Homo sapiens
gccccttcacttctgaccaca

SEQ ID NO: 3750491 - DNA, 17 bp, Homo sapiens
gccccttccccctccaa

SEQ ID NO: 3750492 - DNA, 16 bp, Homo sapiens
gcccgacagcctggca

SEQ ID NO: 3750493 - DNA, 12 bp, Homo sapiens
gcccgagctggt

SEQ ID NO: 3750494 - DNA, 14 bp, Homo sapiens
gcccgagctggtgc

SEQ ID NO: 3750495 - DNA, 15 bp, Homo sapiens
gcccgagctggtgca

SEQ ID NO: 3750496 - DNA, 16 bp, Homo sapiens
gcccgaggtggctgcc

SEQ ID NO: 3750497 - DNA, 15 bp, Homo sapiens
gcccgcacccccacc

SEQ ID NO: 3750498 - DNA, 17 bp, Homo sapiens
gcccgcatgcagcagct

SEQ ID NO: 3750499 - DNA, 22 bp, Homo sapiens
gcccgcatgcagcagcttgctg

SEQ ID NO: 3750500 - DNA, 19 bp, Homo sapiens
gcccgcatgcggcccagga

SEQ ID NO: 3750501 - DNA, 14 bp, Homo sapiens
gcccgcctggcaga

SEQ ID NO: 3750502 - DNA, 18 bp, Homo sapiens
gcccgcctggcagaactg

SEQ ID NO: 3750503 - DNA, 19 bp, Homo sapiens
gcccggagattggacggcc

SEQ ID NO: 3750504 - DNA, 22 bp, Homo sapiens
gcccggagattggacggcctga

SEQ ID NO: 3750505 - DNA, 14 bp, Homo sapiens
gcccggggcagctg

SEQ ID NO: 3750506 - DNA, 13 bp, Homo sapiens
gccctagctccac

SEQ ID NO: 3750507 - DNA, 14 bp, Homo sapiens
gccctaggcctggc

SEQ ID NO: 3750508 - DNA, 12 bp, Homo sapiens
gccctaggctcc

SEQ ID NO: 3750509 - DNA, 23 bp, Homo sapiens
gccctcaagacccttttgggttt

SEQ ID NO: 3750510 - DNA, 15 bp, Homo sapiens
gccctcaatcccagc

SEQ ID NO: 3750511 - DNA, 13 bp, Homo sapiens
gccctcacccctg

SEQ ID NO: 3750512 - DNA, 20 bp, Homo sapiens
gccctcacccctgccctggg

SEQ ID NO: 3750513 - DNA, 21 bp, Homo sapiens
gccctcattacggctcctctc

SEQ ID NO: 3750514 - DNA, 13 bp, Homo sapiens
gccctccactgcc

SEQ ID NO: 3750515 - DNA, 23 bp, Homo sapiens
gccctccactgccctctgttcag

SEQ ID NO: 3750516 - DNA, 16 bp, Homo sapiens
gccctccatcccgaca

SEQ ID NO: 3750517 - DNA, 21 bp, Homo sapiens
gccctcctcaccccgtctggg

SEQ ID NO: 3750518 - DNA, 23 bp, Homo sapiens
gccctcctgaaacttacacacaa

SEQ ID NO: 3750519 - DNA, 17 bp, Homo sapiens
gccctcgtggtggaaac

SEQ ID NO: 3750520 - DNA, 23 bp, Homo sapiens
gccctcgtggtggaaacttttct

SEQ ID NO: 3750521 - DNA, 13 bp, Homo sapiens
gccctcttcttac

SEQ ID NO: 3750522 - DNA, 21 bp, Homo sapiens
gccctgaggtgaaagggagct

SEQ ID NO: 3750523 - DNA, 21 bp, Homo sapiens
gccctgcagaggggaaaccag

SEQ ID NO: 3750524 - DNA, 17 bp, Homo sapiens
gccctgccctagctcca

SEQ ID NO: 3750525 - DNA, 18 bp, Homo sapiens
gccctgccctagctccac

SEQ ID NO: 3750526 - DNA, 23 bp, Homo sapiens
gccctgctgccgcctcccagcct

SEQ ID NO: 3750527 - DNA, 18 bp, Homo sapiens
gccctgctttgggctgcc

SEQ ID NO: 3750528 - DNA, 12 bp, Homo sapiens
gccctggcagga

SEQ ID NO: 3750529 - DNA, 14 bp, Homo sapiens
gccctggccagagg

SEQ ID NO: 3750530 - DNA, 15 bp, Homo sapiens
gccctggggcctgta

SEQ ID NO: 3750531 - DNA, 19 bp, Homo sapiens
gccctggggctgatctcag

SEQ ID NO: 3750532 - DNA, 18 bp, Homo sapiens
gccctggtccagggaagc

SEQ ID NO: 3750533 - DNA, 23 bp, Homo sapiens
gccctggtccagggaagctggcc

SEQ ID NO: 3750534 - DNA, 15 bp, Homo sapiens
gccctggtccttcca

SEQ ID NO: 3750535 - DNA, 16 bp, Homo sapiens
gccctggtgctgccac

SEQ ID NO: 3750536 - DNA, 22 bp, Homo sapiens
gccctggtttcactggcccaag

SEQ ID NO: 3750537 - DNA, 22 bp, Homo sapiens
gccctgtatcaacccagaaaca

SEQ ID NO: 3750538 - DNA, 15 bp, Homo sapiens
gccctgtcagtgcag

SEQ ID NO: 3750539 - DNA, 16 bp, Homo sapiens
gccctgtggaagggac

SEQ ID NO: 3750540 - DNA, 21 bp, Homo sapiens
gcccttcagcatcctcagttc

SEQ ID NO: 3750541 - DNA, 21 bp, Homo sapiens
gcccttccatgtcgcctctgc

SEQ ID NO: 3750542 - DNA, 22 bp, Homo sapiens
gcccttccatgtcgcctctgca

SEQ ID NO: 3750543 - DNA, 17 bp, Homo sapiens
gcccttcctctccactg

SEQ ID NO: 3750544 - DNA, 21 bp, Homo sapiens
gcccttcctctccactgcctt

SEQ ID NO: 3750545 - DNA, 18 bp, Homo sapiens
gcccttgagctccccaaa

SEQ ID NO: 3750546 - DNA, 19 bp, Homo sapiens
gcccttgcagttcagcacc

SEQ ID NO: 3750547 - DNA, 17 bp, Homo sapiens
gccgaccagagccccac

SEQ ID NO: 3750548 - DNA, 13 bp, Homo sapiens
gccgacctcagcc

SEQ ID NO: 3750549 - DNA, 13 bp, Homo sapiens
gccgacctcgtcc

SEQ ID NO: 3750550 - DNA, 19 bp, Homo sapiens
gccgacctcgtcctccccc

SEQ ID NO: 3750551 - DNA, 19 bp, Homo sapiens
gccgagagcctgctccccc

SEQ ID NO: 3750552 - DNA, 19 bp, Homo sapiens
gccgagatcacgccactgc

SEQ ID NO: 3750553 - DNA, 21 bp, Homo sapiens
gccgagatcacgccactgcac

SEQ ID NO: 3750554 - DNA, 18 bp, Homo sapiens
gccgagattgcaccactg

SEQ ID NO: 3750555 - DNA, 18 bp, Homo sapiens
gccgagggtcctggctcc

SEQ ID NO: 3750556 - DNA, 15 bp, Homo sapiens
gccgcaccccagagt

SEQ ID NO: 3750557 - DNA, 16 bp, Homo sapiens
gccgcaccccagagtg

SEQ ID NO: 3750558 - DNA, 17 bp, Homo sapiens
gccgcagcctccctctg

SEQ ID NO: 3750559 - DNA, 18 bp, Homo sapiens
gccgcatcttctccatct

SEQ ID NO: 3750560 - DNA, 16 bp, Homo sapiens
gccgccatgctcctgg

SEQ ID NO: 3750561 - DNA, 16 bp, Homo sapiens
gccgccattgccacca

SEQ ID NO: 3750562 - DNA, 17 bp, Homo sapiens
gccgccctgtaccctct

SEQ ID NO: 3750563 - DNA, 14 bp, Homo sapiens
gccgcctcccagcc

SEQ ID NO: 3750564 - DNA, 17 bp, Homo sapiens
gccgcctcccagcctgg

SEQ ID NO: 3750565 - DNA, 19 bp, Homo sapiens
gccgctcctgtctgccagc

SEQ ID NO: 3750566 - DNA, 20 bp, Homo sapiens
gccgctcctgtctgccagcc

SEQ ID NO: 3750567 - DNA, 16 bp, Homo sapiens
gccgctgttcacccac

SEQ ID NO: 3750568 - DNA, 22 bp, Homo sapiens
gccggcacccacaagtgccact

SEQ ID NO: 3750569 - DNA, 14 bp, Homo sapiens
gccggccctggggc

SEQ ID NO: 3750570 - DNA, 16 bp, Homo sapiens
gccgggcacagctgtg

SEQ ID NO: 3750571 - DNA, 21 bp, Homo sapiens
gccgggcgcggtggctcacgc

SEQ ID NO: 3750572 - DNA, 23 bp, Homo sapiens
gccggggaagacttgaaagaaag

SEQ ID NO: 3750573 - DNA, 17 bp, Homo sapiens
gccgggtgctcagggct

SEQ ID NO: 3750574 - DNA, 20 bp, Homo sapiens
gccgtagggagtacctgctg

SEQ ID NO: 3750575 - DNA, 19 bp, Homo sapiens
gccgtcttcactcgccccc

SEQ ID NO: 3750576 - DNA, 21 bp, Homo sapiens
gccgtcttcactcgcccccgg

SEQ ID NO: 3750577 - DNA, 22 bp, Homo sapiens
gccgtcttcactcgcccccggg

SEQ ID NO: 3750578 - DNA, 14 bp, Homo sapiens
gccgtggctgcggc

SEQ ID NO: 3750579 - DNA, 18 bp, Homo sapiens
gccgtggctgcggcaccc

SEQ ID NO: 3750580 - DNA, 22 bp, Homo sapiens
gccgtggcttcccgctcagccc

SEQ ID NO: 3750581 - DNA, 15 bp, Homo sapiens
gccgttactctccaa

SEQ ID NO: 3750582 - DNA, 23 bp, Homo sapiens
gccgttgccaagaactgaaaaca

SEQ ID NO: 3750583 - DNA, 16 bp, Homo sapiens
gcctaatacattaaag

SEQ ID NO: 3750584 - DNA, 17 bp, Homo sapiens
gcctaatacattaaagc

SEQ ID NO: 3750585 - DNA, 20 bp, Homo sapiens
gcctaatacattaaagcagt

SEQ ID NO: 3750586 - DNA, 16 bp, Homo sapiens
gcctaatccctgggca

SEQ ID NO: 3750587 - DNA, 22 bp, Homo sapiens
gcctaatccctgggcattgctt

SEQ ID NO: 3750588 - DNA, 14 bp, Homo sapiens
gcctacattatcta

SEQ ID NO: 3750589 - DNA, 22 bp, Homo sapiens
gcctaccggcaatttccggcca

SEQ ID NO: 3750590 - DNA, 20 bp, Homo sapiens
gcctactagggacctgggga

SEQ ID NO: 3750591 - DNA, 17 bp, Homo sapiens
gcctagcactcacatgc

SEQ ID NO: 3750592 - DNA, 18 bp, Homo sapiens
gcctagcactcacatgct

SEQ ID NO: 3750593 - DNA, 14 bp, Homo sapiens
gcctaggtgacaga

SEQ ID NO: 3750594 - DNA, 15 bp, Homo sapiens
gcctaggtgacagag

SEQ ID NO: 3750595 - DNA, 23 bp, Homo sapiens
gcctagtggggtctccctctcct

SEQ ID NO: 3750596 - DNA, 18 bp, Homo sapiens
gcctatgatcccagcact

SEQ ID NO: 3750597 - DNA, 13 bp, Homo sapiens
gcctcaaatgcag

SEQ ID NO: 3750598 - DNA, 18 bp, Homo sapiens
gcctcaaccctccctcag

SEQ ID NO: 3750599 - DNA, 14 bp, Homo sapiens
gcctcaacctcctg

SEQ ID NO: 3750600 - DNA, 18 bp, Homo sapiens
gcctcaacctcctgggct

SEQ ID NO: 3750601 - DNA, 19 bp, Homo sapiens
gcctcaagtgattctcctg

SEQ ID NO: 3750602 - DNA, 21 bp, Homo sapiens
gcctcaatgtgaatcagaccc

SEQ ID NO: 3750603 - DNA, 21 bp, Homo sapiens
gcctcaatgtggttgcaaggc

SEQ ID NO: 3750604 - DNA, 13 bp, Homo sapiens
gcctcacagaaga

SEQ ID NO: 3750605 - DNA, 20 bp, Homo sapiens
gcctcactctgttgctcagg

SEQ ID NO: 3750606 - DNA, 15 bp, Homo sapiens
gcctcagcatcctgg

SEQ ID NO: 3750607 - DNA, 16 bp, Homo sapiens
gcctcagcatcctggc

SEQ ID NO: 3750608 - DNA, 21 bp, Homo sapiens
gcctcagcatcctggcacccg

SEQ ID NO: 3750609 - DNA, 14 bp, Homo sapiens
gcctcagcctccca

SEQ ID NO: 3750610 - DNA, 18 bp, Homo sapiens
gcctcagggcagcctgcc

SEQ ID NO: 3750611 - DNA, 23 bp, Homo sapiens
gcctcagggcagcctgcctggag

SEQ ID NO: 3750612 - DNA, 21 bp, Homo sapiens
gcctcagtggactttccaccc

SEQ ID NO: 3750613 - DNA, 16 bp, Homo sapiens
gcctcatccgaggcag

SEQ ID NO: 3750614 - DNA, 19 bp, Homo sapiens
gcctcatccgaggcagggt

SEQ ID NO: 3750615 - DNA, 22 bp, Homo sapiens
gcctcatctataacatgcattt

SEQ ID NO: 3750616 - DNA, 22 bp, Homo sapiens
gcctccaaatgccaacttgtcc

SEQ ID NO: 3750617 - DNA, 14 bp, Homo sapiens
gcctccagccctct

SEQ ID NO: 3750618 - DNA, 18 bp, Homo sapiens
gcctccatggtgcctctg

SEQ ID NO: 3750619 - DNA, 17 bp, Homo sapiens
gcctcccaaagtgctgg

SEQ ID NO: 3750620 - DNA, 21 bp, Homo sapiens
gcctcccacgactgcccggca

SEQ ID NO: 3750621 - DNA, 21 bp, Homo sapiens
gcctccccaaccctgcccctg

SEQ ID NO: 3750622 - DNA, 19 bp, Homo sapiens
gcctcccgagtagctggga

SEQ ID NO: 3750623 - DNA, 13 bp, Homo sapiens
gcctccctcaacc

SEQ ID NO: 3750624 - DNA, 14 bp, Homo sapiens
gcctccctcaaccc

SEQ ID NO: 3750625 - DNA, 19 bp, Homo sapiens
gcctccctcccctgccctc

SEQ ID NO: 3750626 - DNA, 22 bp, Homo sapiens
gcctccctgaaaatgtttttct

SEQ ID NO: 3750627 - DNA, 19 bp, Homo sapiens
gcctccctgaccctgcaga

SEQ ID NO: 3750628 - DNA, 13 bp, Homo sapiens
gcctccctgtcca

SEQ ID NO: 3750629 - DNA, 14 bp, Homo sapiens
gcctccctgtccac

SEQ ID NO: 3750630 - DNA, 21 bp, Homo sapiens
gcctccctgttgaagctctgg

SEQ ID NO: 3750631 - DNA, 14 bp, Homo sapiens
gcctcctcaccccc

SEQ ID NO: 3750632 - DNA, 16 bp, Homo sapiens
gcctcctcacccccag

SEQ ID NO: 3750633 - DNA, 13 bp, Homo sapiens
gcctcctccagcc

SEQ ID NO: 3750634 - DNA, 23 bp, Homo sapiens
gcctcctgtgtgtgcgcctacag

SEQ ID NO: 3750635 - DNA, 15 bp, Homo sapiens
gcctcgaactcctgg

SEQ ID NO: 3750636 - DNA, 20 bp, Homo sapiens
gcctcgaactcctgggctca

SEQ ID NO: 3750637 - DNA, 13 bp, Homo sapiens
gcctcgaactggc

SEQ ID NO: 3750638 - DNA, 16 bp, Homo sapiens
gcctcgaactggctgc

SEQ ID NO: 3750639 - DNA, 12 bp, Homo sapiens
gcctctcatccc

SEQ ID NO: 3750640 - DNA, 17 bp, Homo sapiens
gcctctcatcccccatt

SEQ ID NO: 3750641 - DNA, 15 bp, Homo sapiens
gcctctcccatcact

SEQ ID NO: 3750642 - DNA, 15 bp, Homo sapiens
gcctctccctggccc

SEQ ID NO: 3750643 - DNA, 18 bp, Homo sapiens
gcctctcttcctatccca

SEQ ID NO: 3750644 - DNA, 21 bp, Homo sapiens
gcctctcttcctatcccatcc

SEQ ID NO: 3750645 - DNA, 15 bp, Homo sapiens
gcctctgacacacag

SEQ ID NO: 3750646 - DNA, 16 bp, Homo sapiens
gcctctgacacacagc

SEQ ID NO: 3750647 - DNA, 17 bp, Homo sapiens
gcctctgacacacagct

SEQ ID NO: 3750648 - DNA, 20 bp, Homo sapiens
gcctctgacacacagctctg

SEQ ID NO: 3750649 - DNA, 21 bp, Homo sapiens
gcctctgacacacagctctgt

SEQ ID NO: 3750650 - DNA, 16 bp, Homo sapiens
gcctctgccccgtctc

SEQ ID NO: 3750651 - DNA, 18 bp, Homo sapiens
gcctctgcctctgacaca

SEQ ID NO: 3750652 - DNA, 11 bp, Homo sapiens
gcctctgctgc

SEQ ID NO: 3750653 - DNA, 17 bp, Homo sapiens
gcctctggaggcctctg

SEQ ID NO: 3750654 - DNA, 17 bp, Homo sapiens
gcctctggattgtggga

SEQ ID NO: 3750655 - DNA, 12 bp, Homo sapiens
gcctctggctag

SEQ ID NO: 3750656 - DNA, 18 bp, Homo sapiens
gcctctggctagaggcca

SEQ ID NO: 3750657 - DNA, 18 bp, Homo sapiens
gcctcttaaagctgcctg

SEQ ID NO: 3750658 - DNA, 12 bp, Homo sapiens
gcctcttcctcc

SEQ ID NO: 3750659 - DNA, 12 bp, Homo sapiens
gcctcttctcta

SEQ ID NO: 3750660 - DNA, 23 bp, Homo sapiens
gcctcttctctactctagggaaa

SEQ ID NO: 3750661 - DNA, 14 bp, Homo sapiens
gcctcttgggttca

SEQ ID NO: 3750662 - DNA, 14 bp, Homo sapiens
gcctgacctccccc

SEQ ID NO: 3750663 - DNA, 22 bp, Homo sapiens
gcctgacctccccctccttccc

SEQ ID NO: 3750664 - DNA, 13 bp, Homo sapiens
gcctgaggagcag

SEQ ID NO: 3750665 - DNA, 17 bp, Homo sapiens
gcctgaggctgagactg

SEQ ID NO: 3750666 - DNA, 18 bp, Homo sapiens
gcctgaggctgagactgc

SEQ ID NO: 3750667 - DNA, 13 bp, Homo sapiens
gcctgaggctggg

SEQ ID NO: 3750668 - DNA, 16 bp, Homo sapiens
gcctgatgctccctcc

SEQ ID NO: 3750669 - DNA, 19 bp, Homo sapiens
gcctgatgctccctcccct

SEQ ID NO: 3750670 - DNA, 14 bp, Homo sapiens
gcctgcaccaggag

SEQ ID NO: 3750671 - DNA, 13 bp, Homo sapiens
gcctgcattctgc

SEQ ID NO: 3750672 - DNA, 14 bp, Homo sapiens
gcctgcccacccgt

SEQ ID NO: 3750673 - DNA, 15 bp, Homo sapiens
gcctgcccaggcccc

SEQ ID NO: 3750674 - DNA, 17 bp, Homo sapiens
gcctgcccaggcccctg

SEQ ID NO: 3750675 - DNA, 19 bp, Homo sapiens
gcctgcccaggcccctgcc

SEQ ID NO: 3750676 - DNA, 18 bp, Homo sapiens
gcctgcccctcccagaac

SEQ ID NO: 3750677 - DNA, 16 bp, Homo sapiens
gcctgccttgaagcca

SEQ ID NO: 3750678 - DNA, 23 bp, Homo sapiens
gcctgccttgaagccactgaagc

SEQ ID NO: 3750679 - DNA, 15 bp, Homo sapiens
gcctgctccagctgt

SEQ ID NO: 3750680 - DNA, 16 bp, Homo sapiens
gcctgctccagctgtt

SEQ ID NO: 3750681 - DNA, 16 bp, Homo sapiens
gcctgctcccccaccc

SEQ ID NO: 3750682 - DNA, 18 bp, Homo sapiens
gcctgctgcatggggtgg

SEQ ID NO: 3750683 - DNA, 22 bp, Homo sapiens
gcctgctggatctcccagggct

SEQ ID NO: 3750684 - DNA, 13 bp, Homo sapiens
gcctgctgggctc

SEQ ID NO: 3750685 - DNA, 17 bp, Homo sapiens
gcctgctgggctctcca

SEQ ID NO: 3750686 - DNA, 19 bp, Homo sapiens
gcctgctgggctctccacc

SEQ ID NO: 3750687 - DNA, 22 bp, Homo sapiens
gcctgctgggctctccacctca

SEQ ID NO: 3750688 - DNA, 14 bp, Homo sapiens
gcctggacaaaccc

SEQ ID NO: 3750689 - DNA, 16 bp, Homo sapiens
gcctggacaaaccctt

SEQ ID NO: 3750690 - DNA, 19 bp, Homo sapiens
gcctggagccccactgccc

SEQ ID NO: 3750691 - DNA, 14 bp, Homo sapiens
gcctggagctcctg

SEQ ID NO: 3750692 - DNA, 16 bp, Homo sapiens
gcctggagctcctggg

SEQ ID NO: 3750693 - DNA, 20 bp, Homo sapiens
gcctggcagccgtgccttca

SEQ ID NO: 3750694 - DNA, 21 bp, Homo sapiens
gcctggcagccgtgccttcag

SEQ ID NO: 3750695 - DNA, 20 bp, Homo sapiens
gcctggccagatgcaccagc

SEQ ID NO: 3750696 - DNA, 15 bp, Homo sapiens
gcctggccaggagct

SEQ ID NO: 3750697 - DNA, 19 bp, Homo sapiens
gcctggccaggagctcttc

SEQ ID NO: 3750698 - DNA, 14 bp, Homo sapiens
gcctggccaggcag

SEQ ID NO: 3750699 - DNA, 21 bp, Homo sapiens
gcctggcgaaaccccatctct

SEQ ID NO: 3750700 - DNA, 15 bp, Homo sapiens
gcctggcttctggag

SEQ ID NO: 3750701 - DNA, 17 bp, Homo sapiens
gcctggcttctggagcc

SEQ ID NO: 3750702 - DNA, 21 bp, Homo sapiens
gcctgggaaccttcctgtctt

SEQ ID NO: 3750703 - DNA, 15 bp, Homo sapiens
gcctgggaatgtatt

SEQ ID NO: 3750704 - DNA, 13 bp, Homo sapiens
gcctgggcagcat

SEQ ID NO: 3750705 - DNA, 17 bp, Homo sapiens
gcctgggcagccaggct

SEQ ID NO: 3750706 - DNA, 20 bp, Homo sapiens
gcctgggcagccaggctgcc

SEQ ID NO: 3750707 - DNA, 23 bp, Homo sapiens
gcctgggcagccaggctgccaag

SEQ ID NO: 3750708 - DNA, 23 bp, Homo sapiens
gcctgggctcccttgtgcgtggg

SEQ ID NO: 3750709 - DNA, 23 bp, Homo sapiens
gcctgggtctgtgtctcttttct

SEQ ID NO: 3750710 - DNA, 20 bp, Homo sapiens
gcctgggtgctggctgccca

SEQ ID NO: 3750711 - DNA, 18 bp, Homo sapiens
gcctgggtggggctgctc

SEQ ID NO: 3750712 - DNA, 22 bp, Homo sapiens
gcctgggtggggctgctcctcc

SEQ ID NO: 3750713 - DNA, 23 bp, Homo sapiens
gcctgggtggggctgctcctcca

SEQ ID NO: 3750714 - DNA, 24 bp, Homo sapiens
gcctgggtggggctgctcctccag

SEQ ID NO: 3750715 - DNA, 16 bp, Homo sapiens
gcctggtccctgggag

SEQ ID NO: 3750716 - DNA, 17 bp, Homo sapiens
gcctgtaatcccagcac

SEQ ID NO: 3750717 - DNA, 19 bp, Homo sapiens
gcctgtaatcccagcactt

SEQ ID NO: 3750718 - DNA, 16 bp, Homo sapiens
gcctgtaatcccagct

SEQ ID NO: 3750719 - DNA, 17 bp, Homo sapiens
gcctgtaatcccagcta

SEQ ID NO: 3750720 - DNA, 14 bp, Homo sapiens
gcctgtagttagga

SEQ ID NO: 3750721 - DNA, 18 bp, Homo sapiens
gcctgtagttaggaaata

SEQ ID NO: 3750722 - DNA, 14 bp, Homo sapiens
gcctgtccctctca

SEQ ID NO: 3750723 - DNA, 16 bp, Homo sapiens
gcctgtcgtgccagtc

SEQ ID NO: 3750724 - DNA, 17 bp, Homo sapiens
gcctgtctcatccccag

SEQ ID NO: 3750725 - DNA, 13 bp, Homo sapiens
gcctgtctccttt

SEQ ID NO: 3750726 - DNA, 16 bp, Homo sapiens
gcctgtgagccagtct

SEQ ID NO: 3750727 - DNA, 14 bp, Homo sapiens
gcctgtgaggcagg

SEQ ID NO: 3750728 - DNA, 18 bp, Homo sapiens
gcctgtgaggcaggggcg

SEQ ID NO: 3750729 - DNA, 23 bp, Homo sapiens
gcctgtgaggtgcagagtgccca

SEQ ID NO: 3750730 - DNA, 15 bp, Homo sapiens
gcctgtgctgcccgt

SEQ ID NO: 3750731 - DNA, 16 bp, Homo sapiens
gcctgtgctgcccgtc

SEQ ID NO: 3750732 - DNA, 18 bp, Homo sapiens
gcctgtggcagtaaagag

SEQ ID NO: 3750733 - DNA, 22 bp, Homo sapiens
gcctgtggcatctttgccttgg

SEQ ID NO: 3750734 - DNA, 16 bp, Homo sapiens
gcctgtggcggtgcct

SEQ ID NO: 3750735 - DNA, 18 bp, Homo sapiens
gcctgtggcggtgcctgg

SEQ ID NO: 3750736 - DNA, 19 bp, Homo sapiens
gcctgtggcggtgcctggg

SEQ ID NO: 3750737 - DNA, 14 bp, Homo sapiens
gcctgttcagctcc

SEQ ID NO: 3750738 - DNA, 19 bp, Homo sapiens
gcctgttcagctccagctc

SEQ ID NO: 3750739 - DNA, 20 bp, Homo sapiens
gcctgttcagctccagctca

SEQ ID NO: 3750740 - DNA, 19 bp, Homo sapiens
gcctgttcccattcttgca

SEQ ID NO: 3750741 - DNA, 12 bp, Homo sapiens
gccttaaaactt

SEQ ID NO: 3750742 - DNA, 17 bp, Homo sapiens
gccttaattttcagtat

SEQ ID NO: 3750743 - DNA, 13 bp, Homo sapiens
gccttacctcctg

SEQ ID NO: 3750744 - DNA, 16 bp, Homo sapiens
gccttacctcctgccc

SEQ ID NO: 3750745 - DNA, 18 bp, Homo sapiens
gccttacctcctgcccag

SEQ ID NO: 3750746 - DNA, 22 bp, Homo sapiens
gccttacctcctgcccaggaga

SEQ ID NO: 3750747 - DNA, 20 bp, Homo sapiens
gccttactttgtatgatatt

SEQ ID NO: 3750748 - DNA, 19 bp, Homo sapiens
gccttagaagtcacacagt

SEQ ID NO: 3750749 - DNA, 20 bp, Homo sapiens
gccttagaagtcacacagta

SEQ ID NO: 3750750 - DNA, 13 bp, Homo sapiens
gccttccataatt

SEQ ID NO: 3750751 - DNA, 16 bp, Homo sapiens
gccttccataattatg

SEQ ID NO: 3750752 - DNA, 15 bp, Homo sapiens
gccttccccagcctc

SEQ ID NO: 3750753 - DNA, 18 bp, Homo sapiens
gccttccccctcccaggg

SEQ ID NO: 3750754 - DNA, 19 bp, Homo sapiens
gccttcggacaactcagtc

SEQ ID NO: 3750755 - DNA, 19 bp, Homo sapiens
gccttcttattctcactcc

SEQ ID NO: 3750756 - DNA, 20 bp, Homo sapiens
gccttcttattctcactcca

SEQ ID NO: 3750757 - DNA, 21 bp, Homo sapiens
gccttcttattctcactccac

SEQ ID NO: 3750758 - DNA, 14 bp, Homo sapiens
gccttgaagccact

SEQ ID NO: 3750759 - DNA, 22 bp, Homo sapiens
gccttgcccggattctgggagg

SEQ ID NO: 3750760 - DNA, 15 bp, Homo sapiens
gccttgggctgctcc

SEQ ID NO: 3750761 - DNA, 21 bp, Homo sapiens
gccttggtgtccacctggccc

SEQ ID NO: 3750762 - DNA, 20 bp, Homo sapiens
gccttgtaattctaaatgaa

SEQ ID NO: 3750763 - DNA, 19 bp, Homo sapiens
gcctttagcttaagaggcc

SEQ ID NO: 3750764 - DNA, 15 bp, Homo sapiens
gcctttcctgttcag

SEQ ID NO: 3750765 - DNA, 16 bp, Homo sapiens
gcctttcctgttcagc

SEQ ID NO: 3750766 - DNA, 20 bp, Homo sapiens
gcctttcctgttcagcattc

SEQ ID NO: 3750767 - DNA, 17 bp, Homo sapiens
gcctttcttctctccag

SEQ ID NO: 3750768 - DNA, 16 bp, Homo sapiens
gcctttgcagaaacag

SEQ ID NO: 3750769 - DNA, 15 bp, Homo sapiens
gcgaaccaatatttg

SEQ ID NO: 3750770 - DNA, 21 bp, Homo sapiens
gcgaacggaacgttggacttt

SEQ ID NO: 3750771 - DNA, 19 bp, Homo sapiens
gcgacagagcgagagtctg

SEQ ID NO: 3750772 - DNA, 16 bp, Homo sapiens
gcgacggagagaaaaa

SEQ ID NO: 3750773 - DNA, 21 bp, Homo sapiens
gcgagctatgatcgcgccact

SEQ ID NO: 3750774 - DNA, 16 bp, Homo sapiens
gcgaggtcaacagaga

SEQ ID NO: 3750775 - DNA, 17 bp, Homo sapiens
gcgagttgtggaaagcc

SEQ ID NO: 3750776 - DNA, 17 bp, Homo sapiens
gcgatcatggctcactg

SEQ ID NO: 3750777 - DNA, 16 bp, Homo sapiens
gcgattcccattgaaa

SEQ ID NO: 3750778 - DNA, 13 bp, Homo sapiens
gcgcaagcctgta

SEQ ID NO: 3750779 - DNA, 18 bp, Homo sapiens
gcgcacaaggctgaccaa

SEQ ID NO: 3750780 - DNA, 18 bp, Homo sapiens
gcgcacctgccccctggt

SEQ ID NO: 3750781 - DNA, 22 bp, Homo sapiens
gcgcagtgcttctctacagact

SEQ ID NO: 3750782 - DNA, 20 bp, Homo sapiens
gcgccattgcactccagcct

SEQ ID NO: 3750783 - DNA, 13 bp, Homo sapiens
gcgccccttcccc

SEQ ID NO: 3750784 - DNA, 18 bp, Homo sapiens
gcgcctacaggagtgagc

SEQ ID NO: 3750785 - DNA, 20 bp, Homo sapiens
gcgcctacaggagtgagcac

SEQ ID NO: 3750786 - DNA, 22 bp, Homo sapiens
gcgcctccttccttgctgtcct

SEQ ID NO: 3750787 - DNA, 13 bp, Homo sapiens
gcgctacccactt

SEQ ID NO: 3750788 - DNA, 23 bp, Homo sapiens
gcgctgacaaccaccgctcccca

SEQ ID NO: 3750789 - DNA, 16 bp, Homo sapiens
gcggacagccacggcc

SEQ ID NO: 3750790 - DNA, 16 bp, Homo sapiens
gcggccgcattccctg

SEQ ID NO: 3750791 - DNA, 22 bp, Homo sapiens
gcggctactcagcagccctcct

SEQ ID NO: 3750792 - DNA, 16 bp, Homo sapiens
gcttcccccatagcca

SEQ ID NO: 3750793 - DNA, 23 bp, Homo sapiens
gcttcccgctcagccctccctgc

SEQ ID NO: 3750794 - DNA, 12 bp, Homo sapiens
gcttccctctgc

SEQ ID NO: 3750795 - DNA, 18 bp, Homo sapiens
gcttcctgacaatcaact

SEQ ID NO: 3750796 - DNA, 19 bp, Homo sapiens
gcttcgaggcccagcgacc

SEQ ID NO: 3750797 - DNA, 19 bp, Homo sapiens
gcttctaccaactggaagc

SEQ ID NO: 3750798 - DNA, 20 bp, Homo sapiens
gcttctaccaactggaagca

SEQ ID NO: 3750799 - DNA, 17 bp, Homo sapiens
gcttctcatcctgcagg

SEQ ID NO: 3750800 - DNA, 18 bp, Homo sapiens
gcttctcatcctgcaggc

SEQ ID NO: 3750801 - DNA, 19 bp, Homo sapiens
gcttctctgtgactgatgt

SEQ ID NO: 3750802 - DNA, 17 bp, Homo sapiens
gcttctctttaactcag

SEQ ID NO: 3750803 - DNA, 21 bp, Homo sapiens
gcttctctttaactcaggact

SEQ ID NO: 3750804 - DNA, 15 bp, Homo sapiens
gcttctgacctcagc

SEQ ID NO: 3750805 - DNA, 13 bp, Homo sapiens
gcttctggagccc

SEQ ID NO: 3750806 - DNA, 20 bp, Homo sapiens
gcttctgtagtactccttaa

SEQ ID NO: 3750807 - DNA, 22 bp, Homo sapiens
gcttcttaatataactgcctta

SEQ ID NO: 3750808 - DNA, 20 bp, Homo sapiens
gcttcttactattaagcagt

SEQ ID NO: 3750809 - DNA, 13 bp, Homo sapiens
gcttgaaagaaaa

SEQ ID NO: 3750810 - DNA, 17 bp, Homo sapiens
gcttgaacacagtattt

SEQ ID NO: 3750811 - DNA, 23 bp, Homo sapiens
gcttgaacacagtattttcccaa

SEQ ID NO: 3750812 - DNA, 23 bp, Homo sapiens
gcttgaacctgggaggcagaggt

SEQ ID NO: 3750813 - DNA, 22 bp, Homo sapiens
gcttgaagatcgttagtatcta

SEQ ID NO: 3750814 - DNA, 16 bp, Homo sapiens
gcttgagggttgggct

SEQ ID NO: 3750815 - DNA, 19 bp, Homo sapiens
gcttgatatttattatatt

SEQ ID NO: 3750816 - DNA, 20 bp, Homo sapiens
gcttgccgaaactggaagtt

SEQ ID NO: 3750817 - DNA, 12 bp, Homo sapiens
gcttgctgcacc

SEQ ID NO: 3750818 - DNA, 21 bp, Homo sapiens
gcttgctgcaccccaagtcca

SEQ ID NO: 3750819 - DNA, 18 bp, Homo sapiens
gcttggaaactggatgag

SEQ ID NO: 3750820 - DNA, 19 bp, Homo sapiens
gcttggaaagcatcacctc

SEQ ID NO: 3750821 - DNA, 23 bp, Homo sapiens
gcttggacctcgtgctttaagtg

SEQ ID NO: 3750822 - DNA, 18 bp, Homo sapiens
gcttggccagaagggggc

SEQ ID NO: 3750823 - DNA, 24 bp, Homo sapiens
gcttgggggatgactagaggcagg

SEQ ID NO: 3750824 - DNA, 21 bp, Homo sapiens
gcttgggtgtaacaggtctcc

SEQ ID NO: 3750825 - DNA, 20 bp, Homo sapiens
gcttgtaaatagctcaggtg

SEQ ID NO: 3750826 - DNA, 14 bp, Homo sapiens
gcttgtaacaagaa

SEQ ID NO: 3750827 - DNA, 18 bp, Homo sapiens
gcttgtaacaagaaaaca

SEQ ID NO: 3750828 - DNA, 16 bp, Homo sapiens
gcttgtaactccacca

SEQ ID NO: 3750829 - DNA, 22 bp, Homo sapiens
gcttgtaactccaccaacccat

SEQ ID NO: 3750830 - DNA, 13 bp, Homo sapiens
gcttgtcagagct

SEQ ID NO: 3750831 - DNA, 17 bp, Homo sapiens
gcttgtcagagctggga

SEQ ID NO: 3750832 - DNA, 15 bp, Homo sapiens
gcttgtccctgccca

SEQ ID NO: 3750833 - DNA, 18 bp, Homo sapiens
gcttgttccctctccctg

SEQ ID NO: 3750834 - DNA, 19 bp, Homo sapiens
gcttgtttgctcacctggg

SEQ ID NO: 3750835 - DNA, 23 bp, Homo sapiens
gcttgttttcttgccaatgaggt

SEQ ID NO: 3750836 - DNA, 16 bp, Homo sapiens
gctttaattgtgaatt

SEQ ID NO: 3750837 - DNA, 14 bp, Homo sapiens
gctttacaaaaaga

SEQ ID NO: 3750838 - DNA, 15 bp, Homo sapiens
gctttacttagctta

SEQ ID NO: 3750839 - DNA, 16 bp, Homo sapiens
gctttacttagcttat

SEQ ID NO: 3750840 - DNA, 21 bp, Homo sapiens
gctttacttagcttatcaatt

SEQ ID NO: 3750841 - DNA, 18 bp, Homo sapiens
gctttagaatgttttcct

SEQ ID NO: 3750842 - DNA, 20 bp, Homo sapiens
gctttagaatgttttccttc

SEQ ID NO: 3750843 - DNA, 15 bp, Homo sapiens
gctttatgtaataat

SEQ ID NO: 3750844 - DNA, 17 bp, Homo sapiens
gctttattttttaagta

SEQ ID NO: 3750845 - DNA, 19 bp, Homo sapiens
gctttattttttaagtatt

SEQ ID NO: 3750846 - DNA, 12 bp, Homo sapiens
gctttcatgatt

SEQ ID NO: 3750847 - DNA, 23 bp, Homo sapiens
gctttctacccagcgagccctgg

SEQ ID NO: 3750848 - DNA, 12 bp, Homo sapiens
gctttcttgctg

SEQ ID NO: 3750849 - DNA, 14 bp, Homo sapiens
gctttcttgctggt

SEQ ID NO: 3750850 - DNA, 16 bp, Homo sapiens
gctttgattccatctc

SEQ ID NO: 3750851 - DNA, 19 bp, Homo sapiens
gctttgcccaacctcagca

SEQ ID NO: 3750852 - DNA, 24 bp, Homo sapiens
gctttgccttccacgctgtctcca

SEQ ID NO: 3750853 - DNA, 16 bp, Homo sapiens
gctttgctaccaaagc

SEQ ID NO: 3750854 - DNA, 22 bp, Homo sapiens
gctttggacacacacagcttct

SEQ ID NO: 3750855 - DNA, 18 bp, Homo sapiens
gctttggacgcacacagc

SEQ ID NO: 3750856 - DNA, 19 bp, Homo sapiens
gctttggacgcacacagct

SEQ ID NO: 3750857 - DNA, 18 bp, Homo sapiens
gctttgggctgccctggt

SEQ ID NO: 3750858 - DNA, 17 bp, Homo sapiens
gcttttaacttctgata

SEQ ID NO: 3750859 - DNA, 14 bp, Homo sapiens
gcttttacttaaac

SEQ ID NO: 3750860 - DNA, 14 bp, Homo sapiens
gcttttagtaccca

SEQ ID NO: 3750861 - DNA, 19 bp, Homo sapiens
gcttttagtacccacctga

SEQ ID NO: 3750862 - DNA, 22 bp, Homo sapiens
gcttttcactgctggctgcctt

SEQ ID NO: 3750863 - DNA, 23 bp, Homo sapiens
gcttttcactgctggctgcctta

SEQ ID NO: 3750864 - DNA, 22 bp, Homo sapiens
gcttttccccggtcccttgaga

SEQ ID NO: 3750865 - DNA, 21 bp, Homo sapiens
gcttttccttggggcaggcag

SEQ ID NO: 3750866 - DNA, 22 bp, Homo sapiens
gcttttcctttgtttttatgaa

SEQ ID NO: 3750867 - DNA, 14 bp, Homo sapiens
gcttttcttcctag

SEQ ID NO: 3750868 - DNA, 19 bp, Homo sapiens
gcttttgctggtcactgcc

SEQ ID NO: 3750869 - DNA, 18 bp, Homo sapiens
gcttttgtctatgggact

SEQ ID NO: 3750870 - DNA, 12 bp, Homo sapiens
gcttttgtttct

SEQ ID NO: 3750871 - DNA, 13 bp, Homo sapiens
gctttttccagag

SEQ ID NO: 3750872 - DNA, 16 bp, Homo sapiens
gctttttgtcttttct

SEQ ID NO: 3750873 - DNA, 20 bp, Homo sapiens
gcttttttattttttataca

SEQ ID NO: 3750874 - DNA, 23 bp, Homo sapiens
ggaaaaaaacttttataaattaa

SEQ ID NO: 3750875 - DNA, 15 bp, Homo sapiens
ggaaaaatatttaag

SEQ ID NO: 3750876 - DNA, 18 bp, Homo sapiens
ggaaaacagactcaggtt

SEQ ID NO: 3750877 - DNA, 12 bp, Homo sapiens
ggaaaaccagac

SEQ ID NO: 3750878 - DNA, 22 bp, Homo sapiens
ggaaaaccagactacttgggag

SEQ ID NO: 3750879 - DNA, 16 bp, Homo sapiens
ggaaaactgacagagg

SEQ ID NO: 3750880 - DNA, 21 bp, Homo sapiens
ggaaaactgagactcagacag

SEQ ID NO: 3750881 - DNA, 14 bp, Homo sapiens
ggaaaagctgctga

SEQ ID NO: 3750882 - DNA, 20 bp, Homo sapiens
ggaaaaggcagggagcgagg

SEQ ID NO: 3750883 - DNA, 23 bp, Homo sapiens
ggaaaatcagcctgctccagctg

SEQ ID NO: 3750884 - DNA, 15 bp, Homo sapiens
ggaaaatgccaatct

SEQ ID NO: 3750885 - DNA, 21 bp, Homo sapiens
ggaaaatgttttgtaagaaac

SEQ ID NO: 3750886 - DNA, 13 bp, Homo sapiens
ggaaacaaagtgg

SEQ ID NO: 3750887 - DNA, 15 bp, Homo sapiens
ggaaagcagctcaaa

SEQ ID NO: 3750888 - DNA, 18 bp, Homo sapiens
ggaaagcatcacctcagg

SEQ ID NO: 3750889 - DNA, 19 bp, Homo sapiens
ggaaagcatcacctcaggc

SEQ ID NO: 3750890 - DNA, 16 bp, Homo sapiens
ggaaagcctctgctgc

SEQ ID NO: 3750891 - DNA, 15 bp, Homo sapiens
ggaaaggccagctgg

SEQ ID NO: 3750892 - DNA, 20 bp, Homo sapiens
ggaaaggctcagtctcagga

SEQ ID NO: 3750893 - DNA, 15 bp, Homo sapiens
ggaaagggtgctgct

SEQ ID NO: 3750894 - DNA, 19 bp, Homo sapiens
ggaaagtgaatttgaatga

SEQ ID NO: 3750895 - DNA, 22 bp, Homo sapiens
ggaaagtgaatttgaatgaaaa

SEQ ID NO: 3750896 - DNA, 16 bp, Homo sapiens
ggaaataaaacctttc

SEQ ID NO: 3750897 - DNA, 18 bp, Homo sapiens
ggaaataaaacctttcaa

SEQ ID NO: 3750898 - DNA, 20 bp, Homo sapiens
ggaaataataaagatgctct

SEQ ID NO: 3750899 - DNA, 22 bp, Homo sapiens
ggaaatattatgcaaattccca

SEQ ID NO: 3750900 - DNA, 17 bp, Homo sapiens
ggaaatgaatttctcta

SEQ ID NO: 3750901 - DNA, 12 bp, Homo sapiens
ggaacagaagga

SEQ ID NO: 3750902 - DNA, 21 bp, Homo sapiens
ggaacagacaacagaagtcat

SEQ ID NO: 3750903 - DNA, 15 bp, Homo sapiens
ggaacagacaggaga

SEQ ID NO: 3750904 - DNA, 20 bp, Homo sapiens
ggaacagactggaagcacag

SEQ ID NO: 3750905 - DNA, 20 bp, Homo sapiens
ggaacagctatgggagcccc

SEQ ID NO: 3750906 - DNA, 23 bp, Homo sapiens
ggaacagctatgggagccccagg

SEQ ID NO: 3750907 - DNA, 18 bp, Homo sapiens
ggaacagtgtttcccata

SEQ ID NO: 3750908 - DNA, 13 bp, Homo sapiens
ggaaccagagcca

SEQ ID NO: 3750909 - DNA, 15 bp, Homo sapiens
ggaaccgaaaggcca

SEQ ID NO: 3750910 - DNA, 17 bp, Homo sapiens
ggaaccgcaggaagctg

SEQ ID NO: 3750911 - DNA, 18 bp, Homo sapiens
ggaaccgcaggaagctgc

SEQ ID NO: 3750912 - DNA, 13 bp, Homo sapiens
ggaacgcagatga

SEQ ID NO: 3750913 - DNA, 20 bp, Homo sapiens
ggaacggtaaatttctgtgg

SEQ ID NO: 3750914 - DNA, 16 bp, Homo sapiens
ggaacgtgactgcccc

SEQ ID NO: 3750915 - DNA, 14 bp, Homo sapiens
ggaagaaaagagct

SEQ ID NO: 3750916 - DNA, 12 bp, Homo sapiens
ggaagaaacaaa

SEQ ID NO: 3750917 - DNA, 13 bp, Homo sapiens
ggaagaacataga

SEQ ID NO: 3750918 - DNA, 22 bp, Homo sapiens
ggaagacatggggaggaaggac

SEQ ID NO: 3750919 - DNA, 13 bp, Homo sapiens
ggaagagaaacca

SEQ ID NO: 3750920 - DNA, 13 bp, Homo sapiens
ggaagagaaatac

SEQ ID NO: 3750921 - DNA, 13 bp, Homo sapiens
ggaagagccttgc

SEQ ID NO: 3750922 - DNA, 20 bp, Homo sapiens
ggaagatttgcccatttaca

SEQ ID NO: 3750923 - DNA, 15 bp, Homo sapiens
ggaagcaccccatgc

SEQ ID NO: 3750924 - DNA, 22 bp, Homo sapiens
ggaagcaccccatgccaaagct

SEQ ID NO: 3750925 - DNA, 11 bp, Homo sapiens
ggaagcagtgc

SEQ ID NO: 3750926 - DNA, 19 bp, Homo sapiens
ggaagcagtgccttccata

SEQ ID NO: 3750927 - DNA, 11 bp, Homo sapiens
ggaagccctcc

SEQ ID NO: 3750928 - DNA, 22 bp, Homo sapiens
ggaagcggaggttgcagggagc

SEQ ID NO: 3750929 - DNA, 20 bp, Homo sapiens
ggaagctccagtcctgctct

SEQ ID NO: 3750930 - DNA, 23 bp, Homo sapiens
ggaagctgtgtccttgcacctgc

SEQ ID NO: 3750931 - DNA, 22 bp, Homo sapiens
ggaagctttctctgcttcagct

SEQ ID NO: 3750932 - DNA, 15 bp, Homo sapiens
ggaaggagactcacc

SEQ ID NO: 3750933 - DNA, 13 bp, Homo sapiens
ggaaggagagcct

SEQ ID NO: 3750934 - DNA, 19 bp, Homo sapiens
ggaaggcatgcctggacaa

SEQ ID NO: 3750935 - DNA, 17 bp, Homo sapiens
ggaaggctggctgggca

SEQ ID NO: 3750936 - DNA, 18 bp, Homo sapiens
ggaaggtttgtatattgt

SEQ ID NO: 3750937 - DNA, 21 bp, Homo sapiens
ggaagtccccaggccccagga

SEQ ID NO: 3750938 - DNA, 17 bp, Homo sapiens
ggaagtgacaaggcccc

SEQ ID NO: 3750939 - DNA, 21 bp, Homo sapiens
ggaagtgtaacagctgaggtc

SEQ ID NO: 3750940 - DNA, 17 bp, Homo sapiens
ggaagtttgtgttctgt

SEQ ID NO: 3750941 - DNA, 11 bp, Homo sapiens
ggaagttttca

SEQ ID NO: 3750942 - DNA, 18 bp, Homo sapiens
ggaagttttgcatttatg

SEQ ID NO: 3750943 - DNA, 18 bp, Homo sapiens
ggaataacatgtaattaa

SEQ ID NO: 3750944 - DNA, 13 bp, Homo sapiens
ggaataataccta

SEQ ID NO: 3750945 - DNA, 15 bp, Homo sapiens
ggaataatagaagaa

SEQ ID NO: 3750946 - DNA, 12 bp, Homo sapiens
ggaatacagtgt

SEQ ID NO: 3750947 - DNA, 13 bp, Homo sapiens
ggaatatgagctt

SEQ ID NO: 3750948 - DNA, 18 bp, Homo sapiens
ggaatcaacagggcagca

SEQ ID NO: 3750949 - DNA, 21 bp, Homo sapiens
ggaatcagacttcacactgca

SEQ ID NO: 3750950 - DNA, 14 bp, Homo sapiens
ggaatcctgtcctc

SEQ ID NO: 3750951 - DNA, 19 bp, Homo sapiens
ggaatcctgtcctcagctt

SEQ ID NO: 3750952 - DNA, 15 bp, Homo sapiens
ggaatctagaagaaa

SEQ ID NO: 3750953 - DNA, 16 bp, Homo sapiens
ggaatctagaagaaat

SEQ ID NO: 3750954 - DNA, 18 bp, Homo sapiens
ggaatgaagataccatca

SEQ ID NO: 3750955 - DNA, 23 bp, Homo sapiens
ggaatgcggccgcattccctgag

SEQ ID NO: 3750956 - DNA, 20 bp, Homo sapiens
ggaattaacctggtgctgga

SEQ ID NO: 3750957 - DNA, 19 bp, Homo sapiens
ggaattacatgtaaaacat

SEQ ID NO: 3750958 - DNA, 13 bp, Homo sapiens
ggaattctcttgg

SEQ ID NO: 3750959 - DNA, 20 bp, Homo sapiens
ggaattgcttaccaaaggat

SEQ ID NO: 3750960 - DNA, 21 bp, Homo sapiens
ggaattggtggcagattttac

SEQ ID NO: 3750961 - DNA, 17 bp, Homo sapiens
ggaattttttattcttg

SEQ ID NO: 3750962 - DNA, 20 bp, Homo sapiens
ggaattttttattcttgtga

SEQ ID NO: 3750963 - DNA, 16 bp, Homo sapiens
ggacaaagtctccagc

SEQ ID NO: 3750964 - DNA, 19 bp, Homo sapiens
ggacaaagtctccagccca

SEQ ID NO: 3750965 - DNA, 12 bp, Homo sapiens
ggacacagctct

SEQ ID NO: 3750966 - DNA, 21 bp, Homo sapiens
ggacacagctcttctccaggc

SEQ ID NO: 3750967 - DNA, 18 bp, Homo sapiens
ggacacttaacagatgca

SEQ ID NO: 3750968 - DNA, 19 bp, Homo sapiens
ggacagagacacctgcacc

SEQ ID NO: 3750969 - DNA, 22 bp, Homo sapiens
ggacagccacggccaggccaga

SEQ ID NO: 3750970 - DNA, 21 bp, Homo sapiens
ggacagcctgtggcggtgcct

SEQ ID NO: 3750971 - DNA, 23 bp, Homo sapiens
ggacagcctgtggcggtgcctgg

SEQ ID NO: 3750972 - DNA, 20 bp, Homo sapiens
ggacagctccttctgtccta

SEQ ID NO: 3750973 - DNA, 15 bp, Homo sapiens
ggacaggcagaaaga

SEQ ID NO: 3750974 - DNA, 23 bp, Homo sapiens
ggacaggcatgttctctgaggac

SEQ ID NO: 3750975 - DNA, 15 bp, Homo sapiens
ggacaggtctgggag

SEQ ID NO: 3750976 - DNA, 19 bp, Homo sapiens
ggacagtcctgggagaacc

SEQ ID NO: 3750977 - DNA, 19 bp, Homo sapiens
ggacagtgcttcagcctga

SEQ ID NO: 3750978 - DNA, 22 bp, Homo sapiens
ggacagtgcttcagcctgaggc

SEQ ID NO: 3750979 - DNA, 14 bp, Homo sapiens
ggacatattcattt

SEQ ID NO: 3750980 - DNA, 21 bp, Homo sapiens
ggacatgttcccttctccttc

SEQ ID NO: 3750981 - DNA, 20 bp, Homo sapiens
ggacattccaatttgcactt

SEQ ID NO: 3750982 - DNA, 16 bp, Homo sapiens
ggaccaaaaaaataag

SEQ ID NO: 3750983 - DNA, 13 bp, Homo sapiens
ggaccacacctcc

SEQ ID NO: 3750984 - DNA, 21 bp, Homo sapiens
ggaccacacctccctgaacca

SEQ ID NO: 3750985 - DNA, 19 bp, Homo sapiens
ggaccagaagccaaagact

SEQ ID NO: 3750986 - DNA, 15 bp, Homo sapiens
ggaccaggactccct

SEQ ID NO: 3750987 - DNA, 14 bp, Homo sapiens
ggacccagggatga

SEQ ID NO: 3750988 - DNA, 21 bp, Homo sapiens
ggacccggaggggcctggcag

SEQ ID NO: 3750989 - DNA, 17 bp, Homo sapiens
ggaccctcgctggcccc

SEQ ID NO: 3750990 - DNA, 18 bp, Homo sapiens
ggaccctcgctggccccc

SEQ ID NO: 3750991 - DNA, 12 bp, Homo sapiens
ggaccctttcct

SEQ ID NO: 3750992 - DNA, 21 bp, Homo sapiens
ggaccctttccttccttccct

SEQ ID NO: 3750993 - DNA, 16 bp, Homo sapiens
ggaccgagtagaggca

SEQ ID NO: 3750994 - DNA, 13 bp, Homo sapiens
ggacctcaccaag

SEQ ID NO: 3750995 - DNA, 23 bp, Homo sapiens
ggacctcaggtgagaagcagagg

SEQ ID NO: 3750996 - DNA, 14 bp, Homo sapiens
ggacctcctgagcg

SEQ ID NO: 3750997 - DNA, 18 bp, Homo sapiens
ggacgtcctgccacctgg

SEQ ID NO: 3750998 - DNA, 20 bp, Homo sapiens
ggactacaggtgtgagtcac

SEQ ID NO: 3750999 - DNA, 18 bp, Homo sapiens
ggactcaatgcactgaca

SEQ ID NO: 3751000 - DNA, 10 bp, Homo sapiens
ggactccagc

SEQ ID NO: 3751001 - DNA, 14 bp, Homo sapiens
ggactcctctgtcc

SEQ ID NO: 3751002 - DNA, 15 bp, Homo sapiens
ggactcctctgtcca

SEQ ID NO: 3751003 - DNA, 19 bp, Homo sapiens
ggactggctagagtcctca

SEQ ID NO: 3751004 - DNA, 15 bp, Homo sapiens
ggactgtcatagaaa

SEQ ID NO: 3751005 - DNA, 23 bp, Homo sapiens
ggacttgaaagcatccatgtgtg

SEQ ID NO: 3751006 - DNA, 16 bp, Homo sapiens
ggactttccaccccct

SEQ ID NO: 3751007 - DNA, 11 bp, Homo sapiens
ggagaaacaca

SEQ ID NO: 3751008 - DNA, 12 bp, Homo sapiens
ggagaaaccagc

SEQ ID NO: 3751009 - DNA, 20 bp, Homo sapiens
ggagaaatgcatccattcct

SEQ ID NO: 3751010 - DNA, 15 bp, Homo sapiens
ggagaacctcaggct

SEQ ID NO: 3751011 - DNA, 21 bp, Homo sapiens
ggagaactcctagggtggctg

SEQ ID NO: 3751012 - DNA, 18 bp, Homo sapiens
ggagaagcggctggcagc

SEQ ID NO: 3751013 - DNA, 22 bp, Homo sapiens
ggagaaggaaggagactcacct

SEQ ID NO: 3751014 - DNA, 17 bp, Homo sapiens
ggagaataattctttga

SEQ ID NO: 3751015 - DNA, 20 bp, Homo sapiens
ggagaatcgcttgaacccag

SEQ ID NO: 3751016 - DNA, 23 bp, Homo sapiens
ggagacaatgcagatgccagagc

SEQ ID NO: 3751017 - DNA, 21 bp, Homo sapiens
ggagacacatccagcaattgt

SEQ ID NO: 3751018 - DNA, 22 bp, Homo sapiens
ggagacataaccactgcttcca

SEQ ID NO: 3751019 - DNA, 17 bp, Homo sapiens
ggagaccaaggcgggag

SEQ ID NO: 3751020 - DNA, 9 bp, Homo sapiens
ggagactca

SEQ ID NO: 3751021 - DNA, 17 bp, Homo sapiens
ggagactcacctctgcc

SEQ ID NO: 3751022 - DNA, 13 bp, Homo sapiens
ggagactctgtgg

SEQ ID NO: 3751023 - DNA, 20 bp, Homo sapiens
ggagactctgtggggccttg

SEQ ID NO: 3751024 - DNA, 22 bp, Homo sapiens
ggagactgctgagtcaacccaa

SEQ ID NO: 3751025 - DNA, 14 bp, Homo sapiens
ggagagaggggaat

SEQ ID NO: 3751026 - DNA, 11 bp, Homo sapiens
ggagagccagc

SEQ ID NO: 3751027 - DNA, 15 bp, Homo sapiens
ggagagccagccctc

SEQ ID NO: 3751028 - DNA, 21 bp, Homo sapiens
ggagagccagccctccctgtc

SEQ ID NO: 3751029 - DNA, 23 bp, Homo sapiens
ggagagccagccctccctgtcct

SEQ ID NO: 3751030 - DNA, 16 bp, Homo sapiens
ggagagcgcctgcccc

SEQ ID NO: 3751031 - DNA, 18 bp, Homo sapiens
ggagagcgcctgcccctc

SEQ ID NO: 3751032 - DNA, 18 bp, Homo sapiens
ggagagctggtgcccgga

SEQ ID NO: 3751033 - DNA, 13 bp, Homo sapiens
ggagaggccatga

SEQ ID NO: 3751034 - DNA, 21 bp, Homo sapiens
ggagagggtctggagaagcag

SEQ ID NO: 3751035 - DNA, 23 bp, Homo sapiens
ggagagggtctggagaagcagtg

SEQ ID NO: 3751036 - DNA, 11 bp, Homo sapiens
ggagaggtctt

SEQ ID NO: 3751037 - DNA, 18 bp, Homo sapiens
ggagaggtcttttttaaa

SEQ ID NO: 3751038 - DNA, 23 bp, Homo sapiens
ggagaggtcttttttaaaaggaa

SEQ ID NO: 3751039 - DNA, 16 bp, Homo sapiens
ggagaggttgtctgtg

SEQ ID NO: 3751040 - DNA, 21 bp, Homo sapiens
ggagagtcccctgaaggtctg

SEQ ID NO: 3751041 - DNA, 19 bp, Homo sapiens
ggagatcggggccagaggc

SEQ ID NO: 3751042 - DNA, 20 bp, Homo sapiens
ggagatggaagttgcagtga

SEQ ID NO: 3751043 - DNA, 17 bp, Homo sapiens
ggagattggacggcctg

SEQ ID NO: 3751044 - DNA, 18 bp, Homo sapiens
ggagcacaaaagcctctc

SEQ ID NO: 3751045 - DNA, 17 bp, Homo sapiens
ggagcaccaggcacgaa

SEQ ID NO: 3751046 - DNA, 17 bp, Homo sapiens
ggagcagtgtcttccat

SEQ ID NO: 3751047 - DNA, 20 bp, Homo sapiens
ggagccaacagaagcttcca

SEQ ID NO: 3751048 - DNA, 23 bp, Homo sapiens
ggagccaagggttcagagactca

SEQ ID NO: 3751049 - DNA, 15 bp, Homo sapiens
ggagccccactgccc

SEQ ID NO: 3751050 - DNA, 14 bp, Homo sapiens
ggagccccagggtc

SEQ ID NO: 3751051 - DNA, 18 bp, Homo sapiens
ggagccctgtctcctctc

SEQ ID NO: 3751052 - DNA, 23 bp, Homo sapiens
ggagccctgtctcctctctctgt

SEQ ID NO: 3751053 - DNA, 21 bp, Homo sapiens
ggagcctcatccgaggcaggg

SEQ ID NO: 3751054 - DNA, 15 bp, Homo sapiens
ggagcgcacctgccc

SEQ ID NO: 3751055 - DNA, 23 bp, Homo sapiens
ggagcgcacctgccccctggtgg

SEQ ID NO: 3751056 - DNA, 19 bp, Homo sapiens
ggagcggccgcctgcgggc

SEQ ID NO: 3751057 - DNA, 17 bp, Homo sapiens
ggagctaacactggccc

SEQ ID NO: 3751058 - DNA, 14 bp, Homo sapiens
ggagctcctgggaa

SEQ ID NO: 3751059 - DNA, 17 bp, Homo sapiens
ggagctcttcaggcctc

SEQ ID NO: 3751060 - DNA, 12 bp, Homo sapiens
ggagctgagaat

SEQ ID NO: 3751061 - DNA, 16 bp, Homo sapiens
ggagctgagtggggga

SEQ ID NO: 3751062 - DNA, 15 bp, Homo sapiens
ggagctgctggcttg

SEQ ID NO: 3751063 - DNA, 17 bp, Homo sapiens
ggagctggcgtctgtct

SEQ ID NO: 3751064 - DNA, 15 bp, Homo sapiens
ggagcttgggaatgg

SEQ ID NO: 3751065 - DNA, 20 bp, Homo sapiens
ggaggaaaaccaagccgtgg

SEQ ID NO: 3751066 - DNA, 21 bp, Homo sapiens
ggaggaaaaccaagccgtggc

SEQ ID NO: 3751067 - DNA, 15 bp, Homo sapiens
ggaggaatgctcccc

SEQ ID NO: 3751068 - DNA, 18 bp, Homo sapiens
ggaggaatgctcccccat

SEQ ID NO: 3751069 - DNA, 21 bp, Homo sapiens
ggaggactgccccgtgcagac

SEQ ID NO: 3751070 - DNA, 13 bp, Homo sapiens
ggaggagaatgag

SEQ ID NO: 3751071 - DNA, 17 bp, Homo sapiens
ggaggatctcttgagcc

SEQ ID NO: 3751072 - DNA, 13 bp, Homo sapiens
ggaggatggagag

SEQ ID NO: 3751073 - DNA, 15 bp, Homo sapiens
ggaggatgttctggg

SEQ ID NO: 3751074 - DNA, 16 bp, Homo sapiens
ggaggcacacagctgc

SEQ ID NO: 3751075 - DNA, 15 bp, Homo sapiens
ggaggcctctgggcc

SEQ ID NO: 3751076 - DNA, 20 bp, Homo sapiens
ggaggcggagcttgcagtga

SEQ ID NO: 3751077 - DNA, 15 bp, Homo sapiens
ggaggctgaggcaga

SEQ ID NO: 3751078 - DNA, 16 bp, Homo sapiens
ggaggctgaggcagaa

SEQ ID NO: 3751079 - DNA, 18 bp, Homo sapiens
ggaggctgaggcagaaga

SEQ ID NO: 3751080 - DNA, 13 bp, Homo sapiens
ggaggctgaggcg

SEQ ID NO: 3751081 - DNA, 18 bp, Homo sapiens
ggaggcttgtcagagctg

SEQ ID NO: 3751082 - DNA, 21 bp, Homo sapiens
ggaggggactatttatgaagg

SEQ ID NO: 3751083 - DNA, 20 bp, Homo sapiens
ggaggggcatggccagcagc

SEQ ID NO: 3751084 - DNA, 13 bp, Homo sapiens
ggaggggcctggc

SEQ ID NO: 3751085 - DNA, 14 bp, Homo sapiens
ggaggggcctggca

SEQ ID NO: 3751086 - DNA, 18 bp, Homo sapiens
ggagggggtttgggggct

SEQ ID NO: 3751087 - DNA, 14 bp, Homo sapiens
ggagggtcaggaag

SEQ ID NO: 3751088 - DNA, 19 bp, Homo sapiens
ggagggttggggaggggcg

SEQ ID NO: 3751089 - DNA, 20 bp, Homo sapiens
ggaggtcaaggctgcagtga

SEQ ID NO: 3751090 - DNA, 16 bp, Homo sapiens
ggaggtcgaggcagga

SEQ ID NO: 3751091 - DNA, 18 bp, Homo sapiens
ggaggtcgaggcaggagg

SEQ ID NO: 3751092 - DNA, 20 bp, Homo sapiens
ggaggtggaggttgcagtga

SEQ ID NO: 3751093 - DNA, 17 bp, Homo sapiens
ggaggtggcagccctgt

SEQ ID NO: 3751094 - DNA, 19 bp, Homo sapiens
ggaggttaaggctgaggaa

SEQ ID NO: 3751095 - DNA, 21 bp, Homo sapiens
ggaggttaaggctgaggaaag

SEQ ID NO: 3751096 - DNA, 16 bp, Homo sapiens
ggaggttctctcggag

SEQ ID NO: 3751097 - DNA, 12 bp, Homo sapiens
ggagtacaaggc

SEQ ID NO: 3751098 - DNA, 17 bp, Homo sapiens
ggagtaccatgtggcaa

SEQ ID NO: 3751099 - DNA, 22 bp, Homo sapiens
ggagtagagatggggaaagaat

SEQ ID NO: 3751100 - DNA, 14 bp, Homo sapiens
ggagtcagagagaa

SEQ ID NO: 3751101 - DNA, 23 bp, Homo sapiens
ggagtcccaccttggctgcaggg

SEQ ID NO: 3751102 - DNA, 16 bp, Homo sapiens
ggagtcccgtcaggac

SEQ ID NO: 3751103 - DNA, 15 bp, Homo sapiens
ggagtctgaagcaga

SEQ ID NO: 3751104 - DNA, 19 bp, Homo sapiens
ggagtgacagaggcagccc

SEQ ID NO: 3751105 - DNA, 17 bp, Homo sapiens
ggagtgggacagagtct

SEQ ID NO: 3751106 - DNA, 18 bp, Homo sapiens
ggagtgtgtattgttccc

SEQ ID NO: 3751107 - DNA, 19 bp, Homo sapiens
ggagtgtgtattgttccca

SEQ ID NO: 3751108 - DNA, 19 bp, Homo sapiens
ggagttagaggccagcctg

SEQ ID NO: 3751109 - DNA, 19 bp, Homo sapiens
ggagttcctaacaggatga

SEQ ID NO: 3751110 - DNA, 20 bp, Homo sapiens
ggagttcgaggctgcagtca

SEQ ID NO: 3751111 - DNA, 22 bp, Homo sapiens
ggagttgtcaagtctctgctgg

SEQ ID NO: 3751112 - DNA, 20 bp, Homo sapiens
ggagtttaagaccagcctgg

SEQ ID NO: 3751113 - DNA, 13 bp, Homo sapiens
ggagtttgaggct

SEQ ID NO: 3751114 - DNA, 19 bp, Homo sapiens
ggagtttgaggctgcagcg

SEQ ID NO: 3751115 - DNA, 20 bp, Homo sapiens
ggagtttgaggctgcagcga

SEQ ID NO: 3751116 - DNA, 20 bp, Homo sapiens
ggataaacttttagaaactt

SEQ ID NO: 3751117 - DNA, 15 bp, Homo sapiens
ggataagccagctgc

SEQ ID NO: 3751118 - DNA, 16 bp, Homo sapiens
ggatactgcccggggc

SEQ ID NO: 3751119 - DNA, 12 bp, Homo sapiens
ggatagaggggt

SEQ ID NO: 3751120 - DNA, 14 bp, Homo sapiens
ggatatgagtagcc

SEQ ID NO: 3751121 - DNA, 16 bp, Homo sapiens
ggatatttaagaaaat

SEQ ID NO: 3751122 - DNA, 22 bp, Homo sapiens
ggatatttaagaaaatacaata

SEQ ID NO: 3751123 - DNA, 13 bp, Homo sapiens
ggatattttcaaa

SEQ ID NO: 3751124 - DNA, 16 bp, Homo sapiens
ggatcacagcctctga

SEQ ID NO: 3751125 - DNA, 14 bp, Homo sapiens
ggatcacagggccc

SEQ ID NO: 3751126 - DNA, 17 bp, Homo sapiens
ggatcactggagcccag

SEQ ID NO: 3751127 - DNA, 19 bp, Homo sapiens
ggatcactggagcccagga

SEQ ID NO: 3751128 - DNA, 16 bp, Homo sapiens
ggatcagaacagcaga

SEQ ID NO: 3751129 - DNA, 17 bp, Homo sapiens
ggatcagaacagcagag

SEQ ID NO: 3751130 - DNA, 19 bp, Homo sapiens
ggatcggaggcttgtcaga

SEQ ID NO: 3751131 - DNA, 12 bp, Homo sapiens
ggatctaccagc

SEQ ID NO: 3751132 - DNA, 13 bp, Homo sapiens
ggatctaccagca

SEQ ID NO: 3751133 - DNA, 18 bp, Homo sapiens
ggatctggggctctggga

SEQ ID NO: 3751134 - DNA, 21 bp, Homo sapiens
ggatgaaagttcccccatcag

SEQ ID NO: 3751135 - DNA, 22 bp, Homo sapiens
ggatgaatgaggtcccaggcag

SEQ ID NO: 3751136 - DNA, 18 bp, Homo sapiens
ggatgactagaggcaggg

SEQ ID NO: 3751137 - DNA, 19 bp, Homo sapiens
ggatgactagaggcaggga

SEQ ID NO: 3751138 - DNA, 17 bp, Homo sapiens
gtaactccaccaaccca

SEQ ID NO: 3751139 - DNA, 23 bp, Homo sapiens
gtaactctaattcccattttgca

SEQ ID NO: 3751140 - DNA, 18 bp, Homo sapiens
gtaactgcattgagaact

SEQ ID NO: 3751141 - DNA, 17 bp, Homo sapiens
gtaacttggttatacat

SEQ ID NO: 3751142 - DNA, 20 bp, Homo sapiens
gtaagaaagtgaagcaaatc

SEQ ID NO: 3751143 - DNA, 15 bp, Homo sapiens
gtaagacaaaggttt

SEQ ID NO: 3751144 - DNA, 19 bp, Homo sapiens
gtaagaccggaagctcctg

SEQ ID NO: 3751145 - DNA, 21 bp, Homo sapiens
gtaagaccggaagctcctggt

SEQ ID NO: 3751146 - DNA, 23 bp, Homo sapiens
gtaagatacaagtttcagacagg

SEQ ID NO: 3751147 - DNA, 13 bp, Homo sapiens
gtaagattttgaa

SEQ ID NO: 3751148 - DNA, 16 bp, Homo sapiens
gtaagattttgaaaac

SEQ ID NO: 3751149 - DNA, 17 bp, Homo sapiens
gtaagattttgaaaact

SEQ ID NO: 3751150 - DNA, 12 bp, Homo sapiens
gtaaggtgcctt

SEQ ID NO: 3751151 - DNA, 13 bp, Homo sapiens
gtaagtaattatc

SEQ ID NO: 3751152 - DNA, 16 bp, Homo sapiens
gtaagtgagagagaca

SEQ ID NO: 3751153 - DNA, 21 bp, Homo sapiens
gtaagtgtgagtaagagctgg

SEQ ID NO: 3751154 - DNA, 16 bp, Homo sapiens
gtaataaagtgttttc

SEQ ID NO: 3751155 - DNA, 17 bp, Homo sapiens
gtaataatgtgaatcat

SEQ ID NO: 3751156 - DNA, 15 bp, Homo sapiens
gtaatcccagcactt

SEQ ID NO: 3751157 - DNA, 21 bp, Homo sapiens
gtaatcccagctactcaggag

SEQ ID NO: 3751158 - DNA, 21 bp, Homo sapiens
gtaatctgatcgttctttcta

SEQ ID NO: 3751159 - DNA, 24 bp, Homo sapiens
gtaatctgatcgttctttctagct

SEQ ID NO: 3751160 - DNA, 14 bp, Homo sapiens
gtaatgtgaataaa

SEQ ID NO: 3751161 - DNA, 21 bp, Homo sapiens
gtaattaagtactatgtatca

SEQ ID NO: 3751162 - DNA, 20 bp, Homo sapiens
gtaattatcgggaacagtgt

SEQ ID NO: 3751163 - DNA, 22 bp, Homo sapiens
gtaattctaaatgaatgtttac

SEQ ID NO: 3751164 - DNA, 21 bp, Homo sapiens
gtaattgttgctaatcttctt

SEQ ID NO: 3751165 - DNA, 23 bp, Homo sapiens
gtaatttatagtttatacagttt

SEQ ID NO: 3751166 - DNA, 15 bp, Homo sapiens
gtaatttgtgtaata

SEQ ID NO: 3751167 - DNA, 20 bp, Homo sapiens
gtaatttgtgtaataaagtg

SEQ ID NO: 3751168 - DNA, 22 bp, Homo sapiens
gtaatttgtgtaataaagtgtt

SEQ ID NO: 3751169 - DNA, 14 bp, Homo sapiens
gtacaaaataaaca

SEQ ID NO: 3751170 - DNA, 16 bp, Homo sapiens
gtacaaaataaacaaa

SEQ ID NO: 3751171 - DNA, 14 bp, Homo sapiens
gtacaaaataaagt

SEQ ID NO: 3751172 - DNA, 16 bp, Homo sapiens
gtacaatattttaagc

SEQ ID NO: 3751173 - DNA, 16 bp, Homo sapiens
gtacacacacatacac

SEQ ID NO: 3751174 - DNA, 14 bp, Homo sapiens
gtacacactttatt

SEQ ID NO: 3751175 - DNA, 15 bp, Homo sapiens
gtacacactttattt

SEQ ID NO: 3751176 - DNA, 20 bp, Homo sapiens
gtacacagctctagacactg

SEQ ID NO: 3751177 - DNA, 14 bp, Homo sapiens
gtacactgaatatt

SEQ ID NO: 3751178 - DNA, 20 bp, Homo sapiens
gtacagaattctgctacctc

SEQ ID NO: 3751179 - DNA, 13 bp, Homo sapiens
gtacagagaagga

SEQ ID NO: 3751180 - DNA, 15 bp, Homo sapiens
gtacaggtaaggtga

SEQ ID NO: 3751181 - DNA, 21 bp, Homo sapiens
gtacagtggttctacaatcta

SEQ ID NO: 3751182 - DNA, 20 bp, Homo sapiens
gtacagttgggaaaatatgt

SEQ ID NO: 3751183 - DNA, 18 bp, Homo sapiens
gtacatatgtaaaataaa

SEQ ID NO: 3751184 - DNA, 14 bp, Homo sapiens
gtacatctggcctt

SEQ ID NO: 3751185 - DNA, 19 bp, Homo sapiens
gtacatggaataacatgta

SEQ ID NO: 3751186 - DNA, 18 bp, Homo sapiens
gtacattttcatatgctt

SEQ ID NO: 3751187 - DNA, 15 bp, Homo sapiens
gtaccaatcatttta

SEQ ID NO: 3751188 - DNA, 17 bp, Homo sapiens
gtaccccagctctgctt

SEQ ID NO: 3751189 - DNA, 19 bp, Homo sapiens
gtaccttcagatcctaccc

SEQ ID NO: 3751190 - DNA, 14 bp, Homo sapiens
gtacgtctgacagg

SEQ ID NO: 3751191 - DNA, 15 bp, Homo sapiens
gtacgtctgacaggc

SEQ ID NO: 3751192 - DNA, 15 bp, Homo sapiens
gtactaaggaatctt

SEQ ID NO: 3751193 - DNA, 16 bp, Homo sapiens
gtactagttacacatc

SEQ ID NO: 3751194 - DNA, 17 bp, Homo sapiens
gtactatatctgtttta

SEQ ID NO: 3751195 - DNA, 21 bp, Homo sapiens
gtactatatctgttttactgc

SEQ ID NO: 3751196 - DNA, 15 bp, Homo sapiens
gtactatgtatcaat

SEQ ID NO: 3751197 - DNA, 14 bp, Homo sapiens
gtactcctcccagg

SEQ ID NO: 3751198 - DNA, 12 bp, Homo sapiens
gtactctggcct

SEQ ID NO: 3751199 - DNA, 14 bp, Homo sapiens
gtactggcatggta

SEQ ID NO: 3751200 - DNA, 14 bp, Homo sapiens
gtactgtagttttt

SEQ ID NO: 3751201 - DNA, 19 bp, Homo sapiens
gtactgttgaatttggctt

SEQ ID NO: 3751202 - DNA, 17 bp, Homo sapiens
gtacttaaatgaaagca

SEQ ID NO: 3751203 - DNA, 14 bp, Homo sapiens
gtacttctccaccc

SEQ ID NO: 3751204 - DNA, 21 bp, Homo sapiens
gtacttctccaccctgctctc

SEQ ID NO: 3751205 - DNA, 21 bp, Homo sapiens
gtacttgctgctattttactg

SEQ ID NO: 3751206 - DNA, 18 bp, Homo sapiens
gtagaaaagaactggaaa

SEQ ID NO: 3751207 - DNA, 20 bp, Homo sapiens
gtagaaatatctgaaaatgt

SEQ ID NO: 3751208 - DNA, 21 bp, Homo sapiens
gtagaaatatctgaaaatgta

SEQ ID NO: 3751209 - DNA, 19 bp, Homo sapiens
gtagaagggttatatttta

SEQ ID NO: 3751210 - DNA, 18 bp, Homo sapiens
gtagacagtatataacta

SEQ ID NO: 3751211 - DNA, 16 bp, Homo sapiens
gtagaccaaaataaaa

SEQ ID NO: 3751212 - DNA, 15 bp, Homo sapiens
gtagacccctggctg

SEQ ID NO: 3751213 - DNA, 20 bp, Homo sapiens
gtagacctagggaggacctt

SEQ ID NO: 3751214 - DNA, 10 bp, Homo sapiens
gtagactagt

SEQ ID NO: 3751215 - DNA, 10 bp, Homo sapiens
gtagagccag

SEQ ID NO: 3751216 - DNA, 23 bp, Homo sapiens
gtagagccctgtatcaacccaga

SEQ ID NO: 3751217 - DNA, 15 bp, Homo sapiens
gtagagtgtgcctga

SEQ ID NO: 3751218 - DNA, 21 bp, Homo sapiens
gtagatgtgcatttttgtgaa

SEQ ID NO: 3751219 - DNA, 16 bp, Homo sapiens
gtagatttgttttgtg

SEQ ID NO: 3751220 - DNA, 18 bp, Homo sapiens
gtagcaggtaccactgat

SEQ ID NO: 3751221 - DNA, 14 bp, Homo sapiens
gtagccccaagaag

SEQ ID NO: 3751222 - DNA, 19 bp, Homo sapiens
gtagccgagagcctgctcc

SEQ ID NO: 3751223 - DNA, 16 bp, Homo sapiens
gtagctgcccctggct

SEQ ID NO: 3751224 - DNA, 19 bp, Homo sapiens
gtagcttctgacctcagca

SEQ ID NO: 3751225 - DNA, 22 bp, Homo sapiens
gtaggcatgagggatcacaggg

SEQ ID NO: 3751226 - DNA, 23 bp, Homo sapiens
gtagggcgggaggatgttctggg

SEQ ID NO: 3751227 - DNA, 13 bp, Homo sapiens
gtaggtacttttg

SEQ ID NO: 3751228 - DNA, 23 bp, Homo sapiens
gtaggtatcattttctgcattta

SEQ ID NO: 3751229 - DNA, 19 bp, Homo sapiens
gtagtactccttaagaaca

SEQ ID NO: 3751230 - DNA, 17 bp, Homo sapiens
gtagtcaagattgtgtt

SEQ ID NO: 3751231 - DNA, 13 bp, Homo sapiens
gtagtcccagcta

SEQ ID NO: 3751232 - DNA, 16 bp, Homo sapiens
gtagtctaaccaaatg

SEQ ID NO: 3751233 - DNA, 14 bp, Homo sapiens
gtagtgagaagaat

SEQ ID NO: 3751234 - DNA, 14 bp, Homo sapiens
gtagttaggaaata

SEQ ID NO: 3751235 - DNA, 13 bp, Homo sapiens
gtagttagtagca

SEQ ID NO: 3751236 - DNA, 13 bp, Homo sapiens
gtagttccctgaa

SEQ ID NO: 3751237 - DNA, 17 bp, Homo sapiens
gtagttccctgaaaacc

SEQ ID NO: 3751238 - DNA, 19 bp, Homo sapiens
gtataaaatggtgttttca

SEQ ID NO: 3751239 - DNA, 13 bp, Homo sapiens
gtataaagaaaag

SEQ ID NO: 3751240 - DNA, 15 bp, Homo sapiens
gtataatatttttaa

SEQ ID NO: 3751241 - DNA, 21 bp, Homo sapiens
gtataatggttgactgggttt

SEQ ID NO: 3751242 - DNA, 23 bp, Homo sapiens
gtataatggttgactgggtttct

SEQ ID NO: 3751243 - DNA, 21 bp, Homo sapiens
gtatacagtggattaattaaa

SEQ ID NO: 3751244 - DNA, 19 bp, Homo sapiens
gtatagtactggcatggta

SEQ ID NO: 3751245 - DNA, 21 bp, Homo sapiens
gtatatctgggctggccagtt

SEQ ID NO: 3751246 - DNA, 16 bp, Homo sapiens
gtatatgttgggtgca

SEQ ID NO: 3751247 - DNA, 22 bp, Homo sapiens
gtatattaaaaatggtaaaatt

SEQ ID NO: 3751248 - DNA, 15 bp, Homo sapiens
gtatattcatatatt

SEQ ID NO: 3751249 - DNA, 17 bp, Homo sapiens
gtatatttaaaagaaag

SEQ ID NO: 3751250 - DNA, 15 bp, Homo sapiens
gtatatttatataat

SEQ ID NO: 3751251 - DNA, 20 bp, Homo sapiens
gtatcaaacagctcaggctg

SEQ ID NO: 3751252 - DNA, 17 bp, Homo sapiens
gtatcaggacgagaatg

SEQ ID NO: 3751253 - DNA, 16 bp, Homo sapiens
gtatcaggtgctgcca

SEQ ID NO: 3751254 - DNA, 16 bp, Homo sapiens
gtatcatggaaatatt

SEQ ID NO: 3751255 - DNA, 14 bp, Homo sapiens
gtatccactttgca

SEQ ID NO: 3751256 - DNA, 16 bp, Homo sapiens
gtatccatgggggcag

SEQ ID NO: 3751257 - DNA, 18 bp, Homo sapiens
gtatccatgggggcaggg

SEQ ID NO: 3751258 - DNA, 20 bp, Homo sapiens
gtatccatgggggcagggca

SEQ ID NO: 3751259 - DNA, 19 bp, Homo sapiens
gtatcccaactcctataat

SEQ ID NO: 3751260 - DNA, 18 bp, Homo sapiens
gtatcctgcccagtgttg

SEQ ID NO: 3751261 - DNA, 17 bp, Homo sapiens
gtatcggagacagtgat

SEQ ID NO: 3751262 - DNA, 13 bp, Homo sapiens
gtatctagtgcag

SEQ ID NO: 3751263 - DNA, 17 bp, Homo sapiens
gtatctagtgcagctga

SEQ ID NO: 3751264 - DNA, 12 bp, Homo sapiens
gtatctgagcag

SEQ ID NO: 3751265 - DNA, 19 bp, Homo sapiens
gtatgaataaagacaccta

SEQ ID NO: 3751266 - DNA, 20 bp, Homo sapiens
gtatgactaaagagagaatg

SEQ ID NO: 3751267 - DNA, 16 bp, Homo sapiens
gtatgcttattttaaa

SEQ ID NO: 3751268 - DNA, 13 bp, Homo sapiens
gtatggaaataaa

SEQ ID NO: 3751269 - DNA, 18 bp, Homo sapiens
gtatggaatacagtgtta

SEQ ID NO: 3751270 - DNA, 17 bp, Homo sapiens
gtatgggtttctcccag

SEQ ID NO: 3751271 - DNA, 11 bp, Homo sapiens
gtatgtaaaaa

SEQ ID NO: 3751272 - DNA, 12 bp, Homo sapiens
gtatgtggaagg

SEQ ID NO: 3751273 - DNA, 18 bp, Homo sapiens
gtatgtgtgtgtatgcta

SEQ ID NO: 3751274 - DNA, 21 bp, Homo sapiens
gtatgtttgcacacttgtgtg

SEQ ID NO: 3751275 - DNA, 14 bp, Homo sapiens
gtatgttttagcat

SEQ ID NO: 3751276 - DNA, 16 bp, Homo sapiens
gtatgttttagcatgt

SEQ ID NO: 3751277 - DNA, 19 bp, Homo sapiens
gtatgtttttgtgtatttg

SEQ ID NO: 3751278 - DNA, 13 bp, Homo sapiens
gtattcaagaaag

SEQ ID NO: 3751279 - DNA, 22 bp, Homo sapiens
gtattcagtgagggtcttctta

SEQ ID NO: 3751280 - DNA, 14 bp, Homo sapiens
gtattccaccttaa

SEQ ID NO: 3751281 - DNA, 19 bp, Homo sapiens
gtattctgcctttgcagaa

SEQ ID NO: 3751282 - DNA, 23 bp, Homo sapiens
gtattctgcctttgcagaaacag

SEQ ID NO: 3751283 - DNA, 20 bp, Homo sapiens
gtattggggttattttctgg

SEQ ID NO: 3751284 - DNA, 18 bp, Homo sapiens
gtattgttcccagtgaca

SEQ ID NO: 3751285 - DNA, 22 bp, Homo sapiens
gtatttaattgtaaactgtact

SEQ ID NO: 3751286 - DNA, 12 bp, Homo sapiens
gtatttatatat

SEQ ID NO: 3751287 - DNA, 22 bp, Homo sapiens
gtatttattttcctccccagca

SEQ ID NO: 3751288 - DNA, 16 bp, Homo sapiens
gtatttcagatgcttt

SEQ ID NO: 3751289 - DNA, 16 bp, Homo sapiens
gtatttccagtgcaat

SEQ ID NO: 3751290 - DNA, 21 bp, Homo sapiens
gtattttagtaagagattcct

SEQ ID NO: 3751291 - DNA, 13 bp, Homo sapiens
gtattttatgtat

SEQ ID NO: 3751292 - DNA, 15 bp, Homo sapiens
gtattttatgtatgt

SEQ ID NO: 3751293 - DNA, 14 bp, Homo sapiens
gtcaaaacacttgt

SEQ ID NO: 3751294 - DNA, 16 bp, Homo sapiens
gtcaaaaggtgcctgt

SEQ ID NO: 3751295 - DNA, 15 bp, Homo sapiens
gtcaaacaaagccag

SEQ ID NO: 3751296 - DNA, 16 bp, Homo sapiens
gtcaaacaaagccaga

SEQ ID NO: 3751297 - DNA, 14 bp, Homo sapiens
gtcaaacgtgaaaa

SEQ ID NO: 3751298 - DNA, 15 bp, Homo sapiens
gtcaaacgtgaaaat

SEQ ID NO: 3751299 - DNA, 16 bp, Homo sapiens
gtcaaagcaaggatct

SEQ ID NO: 3751300 - DNA, 19 bp, Homo sapiens
gtcaacacttaagggtttt

SEQ ID NO: 3751301 - DNA, 18 bp, Homo sapiens
gtcaacagagaaggcagg

SEQ ID NO: 3751302 - DNA, 22 bp, Homo sapiens
gtcaacagagaaggcaggaatg

SEQ ID NO: 3751303 - DNA, 12 bp, Homo sapiens
gtcaacagtgaa

SEQ ID NO: 3751304 - DNA, 17 bp, Homo sapiens
gtcaagaagaagatgga

SEQ ID NO: 3751305 - DNA, 18 bp, Homo sapiens
gtcaagagggtctgagga

SEQ ID NO: 3751306 - DNA, 14 bp, Homo sapiens
gtcaagattttgaa

SEQ ID NO: 3751307 - DNA, 14 bp, Homo sapiens
gtcaagctgcttgg

SEQ ID NO: 3751308 - DNA, 15 bp, Homo sapiens
gtcaaggtgctgttg

SEQ ID NO: 3751309 - DNA, 14 bp, Homo sapiens
gtcaagtaagaaga

SEQ ID NO: 3751310 - DNA, 14 bp, Homo sapiens
gtcaagtctctgct

SEQ ID NO: 3751311 - DNA, 17 bp, Homo sapiens
gtcaagtctctgctggc

SEQ ID NO: 3751312 - DNA, 15 bp, Homo sapiens
gtcaagtgaaaaagg

SEQ ID NO: 3751313 - DNA, 16 bp, Homo sapiens
gtcaagtgaaaaagga

SEQ ID NO: 3751314 - DNA, 20 bp, Homo sapiens
gtcaagttattaatttcttc

SEQ ID NO: 3751315 - DNA, 20 bp, Homo sapiens
gtcaatacagtacaggcagc

SEQ ID NO: 3751316 - DNA, 22 bp, Homo sapiens
gtcaatcccctcattcaggaaa

SEQ ID NO: 3751317 - DNA, 15 bp, Homo sapiens
gtcaatcctgtgggt

SEQ ID NO: 3751318 - DNA, 12 bp, Homo sapiens
gtcacaataaat

SEQ ID NO: 3751319 - DNA, 22 bp, Homo sapiens
gtcacacagtattacttctgct

SEQ ID NO: 3751320 - DNA, 19 bp, Homo sapiens
gtcacagaaatcagaggag

SEQ ID NO: 3751321 - DNA, 12 bp, Homo sapiens
gtcacagagaac

SEQ ID NO: 3751322 - DNA, 19 bp, Homo sapiens
gtcacagagaactagtggt

SEQ ID NO: 3751323 - DNA, 11 bp, Homo sapiens
gtcaccacctt

SEQ ID NO: 3751324 - DNA, 17 bp, Homo sapiens
gtcaccaccttcccagc

SEQ ID NO: 3751325 - DNA, 18 bp, Homo sapiens
gtcaccaggaatgttaaa

SEQ ID NO: 3751326 - DNA, 23 bp, Homo sapiens
gtcaccaggaatgttaaagtcag

SEQ ID NO: 3751327 - DNA, 20 bp, Homo sapiens
gtcaccatctcaggccacct

SEQ ID NO: 3751328 - DNA, 16 bp, Homo sapiens
gtcaccggatcctggg

SEQ ID NO: 3751329 - DNA, 14 bp, Homo sapiens
gtcactactcacag

SEQ ID NO: 3751330 - DNA, 20 bp, Homo sapiens
gtcactgcacagtgcatctc

SEQ ID NO: 3751331 - DNA, 23 bp, Homo sapiens
gtcactgcacagtgcatctcagc

SEQ ID NO: 3751332 - DNA, 13 bp, Homo sapiens
gtcactgtttctc

SEQ ID NO: 3751333 - DNA, 15 bp, Homo sapiens
gtcagacacaaacaa

SEQ ID NO: 3751334 - DNA, 16 bp, Homo sapiens
gtcagactgctgggac

SEQ ID NO: 3751335 - DNA, 18 bp, Homo sapiens
gtcagactggctggctgc

SEQ ID NO: 3751336 - DNA, 22 bp, Homo sapiens
gtcagactggctggctgcagtg

SEQ ID NO: 3751337 - DNA, 21 bp, Homo sapiens
gtcagagaggagtcagagaga

SEQ ID NO: 3751338 - DNA, 22 bp, Homo sapiens
gtcagccttccccctcccaggg

SEQ ID NO: 3751339 - DNA, 19 bp, Homo sapiens
gtcagctactaatgatgtt

SEQ ID NO: 3751340 - DNA, 17 bp, Homo sapiens
gtcaggaaggatgagca

SEQ ID NO: 3751341 - DNA, 19 bp, Homo sapiens
gtcaggagttagaggccag

SEQ ID NO: 3751342 - DNA, 12 bp, Homo sapiens
gtcaggccacgg

SEQ ID NO: 3751343 - DNA, 21 bp, Homo sapiens
gtcaggcccttattttcaaga

SEQ ID NO: 3751344 - DNA, 13 bp, Homo sapiens
gtcagggaccaag

SEQ ID NO: 3751345 - DNA, 17 bp, Homo sapiens
gtcaggtggggcagctt

SEQ ID NO: 3751346 - DNA, 13 bp, Homo sapiens
gtcagtacccacc

SEQ ID NO: 3751347 - DNA, 23 bp, Homo sapiens
gtcagtgaggcccagggagaggc

SEQ ID NO: 3751348 - DNA, 18 bp, Homo sapiens
gtcataactaaataaagc

SEQ ID NO: 3751349 - DNA, 13 bp, Homo sapiens
gtcatagaaatta

SEQ ID NO: 3751350 - DNA, 22 bp, Homo sapiens
gtcatagaaattacacccaaag

SEQ ID NO: 3751351 - DNA, 14 bp, Homo sapiens
gtcatcccattgtc

SEQ ID NO: 3751352 - DNA, 18 bp, Homo sapiens
gtcatgagctgagcaggg

SEQ ID NO: 3751353 - DNA, 18 bp, Homo sapiens
gtcatgatctccctgccg

SEQ ID NO: 3751354 - DNA, 15 bp, Homo sapiens
gtcatgatggcacca

SEQ ID NO: 3751355 - DNA, 15 bp, Homo sapiens
gtcatgtgacaggta

SEQ ID NO: 3751356 - DNA, 22 bp, Homo sapiens
gtcattaaaataaataaatgca

SEQ ID NO: 3751357 - DNA, 21 bp, Homo sapiens
gtcatttgctgagcatgtact

SEQ ID NO: 3751358 - DNA, 17 bp, Homo sapiens
gtcattttgaagctaat

SEQ ID NO: 3751359 - DNA, 14 bp, Homo sapiens
gtccaaactgccta

SEQ ID NO: 3751360 - DNA, 16 bp, Homo sapiens
gtccaaaggaggctgg

SEQ ID NO: 3751361 - DNA, 20 bp, Homo sapiens
gtccaacccgaggcccgcat

SEQ ID NO: 3751362 - DNA, 14 bp, Homo sapiens
gtccaacctaaccc

SEQ ID NO: 3751363 - DNA, 20 bp, Homo sapiens
gtccaacctaacccctttcc

SEQ ID NO: 3751364 - DNA, 16 bp, Homo sapiens
gtccaagtgtgtgtgc

SEQ ID NO: 3751365 - DNA, 16 bp, Homo sapiens
gtccacagatgcctcc

SEQ ID NO: 3751366 - DNA, 23 bp, Homo sapiens
gtccagagagagaagtgcccctg

SEQ ID NO: 3751367 - DNA, 20 bp, Homo sapiens
gtccagccgccattgccacc

SEQ ID NO: 3751368 - DNA, 11 bp, Homo sapiens
gtccagcctgg

SEQ ID NO: 3751369 - DNA, 13 bp, Homo sapiens
gtccagggaagct

SEQ ID NO: 3751370 - DNA, 14 bp, Homo sapiens
gtccagggccctga

SEQ ID NO: 3751371 - DNA, 16 bp, Homo sapiens
gtccagggccctgagc

SEQ ID NO: 3751372 - DNA, 17 bp, Homo sapiens
gtccagggccctgagct

SEQ ID NO: 3751373 - DNA, 11 bp, Homo sapiens
gtccaggggat

SEQ ID NO: 3751374 - DNA, 17 bp, Homo sapiens
gtccaggtcgggctcag

SEQ ID NO: 3751375 - DNA, 12 bp, Homo sapiens
gtccatcccagc

SEQ ID NO: 3751376 - DNA, 21 bp, Homo sapiens
gtcccaccggttgcttctggg

SEQ ID NO: 3751377 - DNA, 14 bp, Homo sapiens
gtcccaccttggct

SEQ ID NO: 3751378 - DNA, 16 bp, Homo sapiens
gtcccaccttggctgc

SEQ ID NO: 3751379 - DNA, 17 bp, Homo sapiens
gtcccaccttggctgca

SEQ ID NO: 3751380 - DNA, 15 bp, Homo sapiens
gtcccagccaccccg

SEQ ID NO: 3751381 - DNA, 16 bp, Homo sapiens
gtcccagccaccccgg

SEQ ID NO: 3751382 - DNA, 18 bp, Homo sapiens
gtcccagccaccccgggc

SEQ ID NO: 3751383 - DNA, 12 bp, Homo sapiens
gtcccaggcaga

SEQ ID NO: 3751384 - DNA, 21 bp, Homo sapiens
gtccccaggccccaggaagcc

SEQ ID NO: 3751385 - DNA, 15 bp, Homo sapiens
gtcccggggctccac

SEQ ID NO: 3751386 - DNA, 22 bp, Homo sapiens
gtccctaccgagtctcttctcc

SEQ ID NO: 3751387 - DNA, 23 bp, Homo sapiens
gtccctaccgagtctcttctcca

SEQ ID NO: 3751388 - DNA, 20 bp, Homo sapiens
gtccctccacgttcacccct

SEQ ID NO: 3751389 - DNA, 21 bp, Homo sapiens
gtccctccacgttcacccctc

SEQ ID NO: 3751390 - DNA, 21 bp, Homo sapiens
gtccctctcggaaggctggct

SEQ ID NO: 3751391 - DNA, 13 bp, Homo sapiens
gtccctctctctg

SEQ ID NO: 3751392 - DNA, 14 bp, Homo sapiens
gtccctctctctgg

SEQ ID NO: 3751393 - DNA, 17 bp, Homo sapiens
gtccctgactctctgtg

SEQ ID NO: 3751394 - DNA, 17 bp, Homo sapiens
gtccctgccccctcccc

SEQ ID NO: 3751395 - DNA, 20 bp, Homo sapiens
gtccctgggggaagccctgg

SEQ ID NO: 3751396 - DNA, 22 bp, Homo sapiens
gtccctgggggaagccctggat

SEQ ID NO: 3751397 - DNA, 15 bp, Homo sapiens
gtccctggtaataag

SEQ ID NO: 3751398 - DNA, 12 bp, Homo sapiens
gtcccttcccct

SEQ ID NO: 3751399 - DNA, 13 bp, Homo sapiens
gtcccttcccctc

SEQ ID NO: 3751400 - DNA, 14 bp, Homo sapiens
gtcccttcccctcc

SEQ ID NO: 3751401 - DNA, 17 bp, Homo sapiens
gtcccttcccctccctg

SEQ ID NO: 3751402 - DNA, 18 bp, Homo sapiens
gtcccttcccctccctgg

SEQ ID NO: 3751403 - DNA, 20 bp, Homo sapiens
gtcccttcccctccctggct

SEQ ID NO: 3751404 - DNA, 19 bp, Homo sapiens
gtcccttgagacctcagcc

SEQ ID NO: 3751405 - DNA, 21 bp, Homo sapiens
gtcccttgagacctcagccat

SEQ ID NO: 3751406 - DNA, 22 bp, Homo sapiens
gtcccttgagacctcagccatg

SEQ ID NO: 3751407 - DNA, 13 bp, Homo sapiens
gtcccttgcagct

SEQ ID NO: 3751408 - DNA, 17 bp, Homo sapiens
gtccctttcttggccag

SEQ ID NO: 3751409 - DNA, 22 bp, Homo sapiens
gtccctttcttggccagttatc

SEQ ID NO: 3751410 - DNA, 22 bp, Homo sapiens
gtccgaaagggacttggaagct

SEQ ID NO: 3751411 - DNA, 13 bp, Homo sapiens
gtccgagctttga

SEQ ID NO: 3751412 - DNA, 12 bp, Homo sapiens
gtccgccctctt

SEQ ID NO: 3751413 - DNA, 21 bp, Homo sapiens
gtccggtggaaggccttcttt

SEQ ID NO: 3751414 - DNA, 17 bp, Homo sapiens
gtcctacagtggctgtc

SEQ ID NO: 3751415 - DNA, 12 bp, Homo sapiens
gtcctactctgt

SEQ ID NO: 3751416 - DNA, 19 bp, Homo sapiens
gtcctagccactcaggagg

SEQ ID NO: 3751417 - DNA, 12 bp, Homo sapiens
gtcctaggagta

SEQ ID NO: 3751418 - DNA, 19 bp, Homo sapiens
gtcctaggagtatcctcat

SEQ ID NO: 3751419 - DNA, 20 bp, Homo sapiens
gtcctcagagaatttctacc

SEQ ID NO: 3751420 - DNA, 13 bp, Homo sapiens
gtcctcagcttct

SEQ ID NO: 3751421 - DNA, 19 bp, Homo sapiens
gtcctccccctgccagtgc

SEQ ID NO: 3751422 - DNA, 15 bp, Homo sapiens
gtcctcccctcaagg

SEQ ID NO: 3751423 - DNA, 21 bp, Homo sapiens
gtcctcctcggatcaccgaga

SEQ ID NO: 3751424 - DNA, 22 bp, Homo sapiens
gtcctcctcggatcaccgagag

SEQ ID NO: 3751425 - DNA, 17 bp, Homo sapiens
gtcctcgtagccatctc

SEQ ID NO: 3751426 - DNA, 15 bp, Homo sapiens
gtcctctttcaaagg

SEQ ID NO: 3751427 - DNA, 18 bp, Homo sapiens
gtcctctttcagaaaaca

SEQ ID NO: 3751428 - DNA, 14 bp, Homo sapiens
gtcctcttttctga

SEQ ID NO: 3751429 - DNA, 13 bp, Homo sapiens
gtcctgactcaac

SEQ ID NO: 3751430 - DNA, 14 bp, Homo sapiens
gtcctgccacctgg

SEQ ID NO: 3751431 - DNA, 16 bp, Homo sapiens
gtcctgccacctgggg

SEQ ID NO: 3751432 - DNA, 17 bp, Homo sapiens
gtcctgccacctggggc

SEQ ID NO: 3751433 - DNA, 18 bp, Homo sapiens
gtcctgccacctggggca

SEQ ID NO: 3751434 - DNA, 14 bp, Homo sapiens
gtcctgcctggcca

SEQ ID NO: 3751435 - DNA, 15 bp, Homo sapiens
gtcctgcctggccag

SEQ ID NO: 3751436 - DNA, 23 bp, Homo sapiens
gtcctgctctctacccagcccat

SEQ ID NO: 3751437 - DNA, 21 bp, Homo sapiens
gtcctggctacatcccagcct

SEQ ID NO: 3751438 - DNA, 19 bp, Homo sapiens
gtcctggctcctgaggggc

SEQ ID NO: 3751439 - DNA, 19 bp, Homo sapiens
gtcctgggagaacctcagg

SEQ ID NO: 3751440 - DNA, 21 bp, Homo sapiens
gtcctgggagaacctcaggct

SEQ ID NO: 3751441 - DNA, 17 bp, Homo sapiens
gtcctgggagtgagctg

SEQ ID NO: 3751442 - DNA, 16 bp, Homo sapiens
gtcctggggctctgtg

SEQ ID NO: 3751443 - DNA, 11 bp, Homo sapiens
gtcctgggggc

SEQ ID NO: 3751444 - DNA, 15 bp, Homo sapiens
gtcctgggggcctga

SEQ ID NO: 3751445 - DNA, 13 bp, Homo sapiens
gtccttcaaaggc

SEQ ID NO: 3751446 - DNA, 14 bp, Homo sapiens
gtccttccaggccc

SEQ ID NO: 3751447 - DNA, 15 bp, Homo sapiens
gtcctttccctccac

SEQ ID NO: 3751448 - DNA, 12 bp, Homo sapiens
gtcgaggcagga

SEQ ID NO: 3751449 - DNA, 14 bp, Homo sapiens
gtcgatatttccat

SEQ ID NO: 3751450 - DNA, 14 bp, Homo sapiens
gtcgcccagtctgg

SEQ ID NO: 3751451 - DNA, 12 bp, Homo sapiens
gtctaaaaacac

SEQ ID NO: 3751452 - DNA, 16 bp, Homo sapiens
gtctaaatatttcctt

SEQ ID NO: 3751453 - DNA, 23 bp, Homo sapiens
gtctaaatatttccttaaactgt

SEQ ID NO: 3751454 - DNA, 17 bp, Homo sapiens
gtctaaccaaatgcatc

SEQ ID NO: 3751455 - DNA, 13 bp, Homo sapiens
gtctaggagctgg

SEQ ID NO: 3751456 - DNA, 22 bp, Homo sapiens
gtctaggtcagtacccacctga

SEQ ID NO: 3751457 - DNA, 15 bp, Homo sapiens
gtctatgggactcaa

SEQ ID NO: 3751458 - DNA, 22 bp, Homo sapiens
gtctatgggactcaatgcactg

SEQ ID NO: 3751459 - DNA, 20 bp, Homo sapiens
gtctcaaacctccaaaagcc

SEQ ID NO: 3751460 - DNA, 15 bp, Homo sapiens
gtctcaagagggcac

SEQ ID NO: 3751461 - DNA, 17 bp, Homo sapiens
gtctcaagagggcactg

SEQ ID NO: 3751462 - DNA, 22 bp, Homo sapiens
gtctcaagagggcactggtggc

SEQ ID NO: 3751463 - DNA, 15 bp, Homo sapiens
gtctcactctgtcgc

SEQ ID NO: 3751464 - DNA, 19 bp, Homo sapiens
gtctcactctgtcgcccag

SEQ ID NO: 3751465 - DNA, 17 bp, Homo sapiens
gtctcactgttgcccag

SEQ ID NO: 3751466 - DNA, 18 bp, Homo sapiens
gtctcactgttgcccagg

SEQ ID NO: 3751467 - DNA, 20 bp, Homo sapiens
gtctcactgttgcccaggct

SEQ ID NO: 3751468 - DNA, 22 bp, Homo sapiens
gtctcacttgtgcagtgttgac

SEQ ID NO: 3751469 - DNA, 17 bp, Homo sapiens
gtctcagaatctttcct

SEQ ID NO: 3751470 - DNA, 20 bp, Homo sapiens
gtctcagaatctttccttcc

SEQ ID NO: 3751471 - DNA, 12 bp, Homo sapiens
gtctcaggagca

SEQ ID NO: 3751472 - DNA, 15 bp, Homo sapiens
gtctcagtttcactt

SEQ ID NO: 3751473 - DNA, 11 bp, Homo sapiens
gtctccagccc

SEQ ID NO: 3751474 - DNA, 19 bp, Homo sapiens
gtctcccaggccccctgca

SEQ ID NO: 3751475 - DNA, 22 bp, Homo sapiens
gtctccctataatgctggagcg

SEQ ID NO: 3751476 - DNA, 19 bp, Homo sapiens
gtctccctctcctgcctac

SEQ ID NO: 3751477 - DNA, 19 bp, Homo sapiens
gtctcctctttgttttgtt

SEQ ID NO: 3751478 - DNA, 22 bp, Homo sapiens
gtctcctgcccccacacctggc

SEQ ID NO: 3751479 - DNA, 16 bp, Homo sapiens
gtctcgctttgttgcc

SEQ ID NO: 3751480 - DNA, 19 bp, Homo sapiens
gtctcgctttgttgcccag

SEQ ID NO: 3751481 - DNA, 14 bp, Homo sapiens
gtctctatttaaat

SEQ ID NO: 3751482 - DNA, 20 bp, Homo sapiens
gtctctctttggactctccc

SEQ ID NO: 3751483 - DNA, 17 bp, Homo sapiens
gtctctgctggcccagc

SEQ ID NO: 3751484 - DNA, 20 bp, Homo sapiens
gtctctgctggcccagccaa

SEQ ID NO: 3751485 - DNA, 11 bp, Homo sapiens
gtctgaaatgg

SEQ ID NO: 3751486 - DNA, 19 bp, Homo sapiens
gtctgaagtcactgcacag

SEQ ID NO: 3751487 - DNA, 20 bp, Homo sapiens
gtctgacaggcaatgctggc

SEQ ID NO: 3751488 - DNA, 23 bp, Homo sapiens
gtctgacaggcaatgctggctgt

SEQ ID NO: 3751489 - DNA, 14 bp, Homo sapiens
gtctgacccactgc

SEQ ID NO: 3751490 - DNA, 17 bp, Homo sapiens
gtctgagccaaagagaa

SEQ ID NO: 3751491 - DNA, 21 bp, Homo sapiens
gtctgaggaatccagacccgg

SEQ ID NO: 3751492 - DNA, 19 bp, Homo sapiens
gtctgattcccaagctctg

SEQ ID NO: 3751493 - DNA, 20 bp, Homo sapiens
gtctgattcccaagctctgc

SEQ ID NO: 3751494 - DNA, 21 bp, Homo sapiens
gtctgattcccaagctctgct

SEQ ID NO: 3751495 - DNA, 12 bp, Homo sapiens
gtctgcaggcag

SEQ ID NO: 3751496 - DNA, 13 bp, Homo sapiens
gtctgcaggcagg

SEQ ID NO: 3751497 - DNA, 20 bp, Homo sapiens
gtctgcattttctgaaacta

SEQ ID NO: 3751498 - DNA, 18 bp, Homo sapiens
gtctgccagccagcagcc

SEQ ID NO: 3751499 - DNA, 21 bp, Homo sapiens
gtctgcttctgcaccttatct

SEQ ID NO: 3751500 - DNA, 14 bp, Homo sapiens
gtctggagaagcag

SEQ ID NO: 3751501 - DNA, 19 bp, Homo sapiens
gtctggagaagcagtgagc

SEQ ID NO: 3751502 - DNA, 20 bp, Homo sapiens
gtctggggttcagcccctcc

SEQ ID NO: 3751503 - DNA, 14 bp, Homo sapiens
gtctggtttctaga

SEQ ID NO: 3751504 - DNA, 23 bp, Homo sapiens
gtctgtatttatgtgtgaggagc

SEQ ID NO: 3751505 - DNA, 17 bp, Homo sapiens
gtctgtccgtgttattt

SEQ ID NO: 3751506 - DNA, 16 bp, Homo sapiens
gtctgtcttcacagct

SEQ ID NO: 3751507 - DNA, 17 bp, Homo sapiens
gtctgtgtgcaagtgtg

SEQ ID NO: 3751508 - DNA, 15 bp, Homo sapiens
gtctgtgtgctgtgg

SEQ ID NO: 3751509 - DNA, 21 bp, Homo sapiens
gtcttaaaaagtggaaaaata

SEQ ID NO: 3751510 - DNA, 16 bp, Homo sapiens
gtcttaaataaaagaa

SEQ ID NO: 3751511 - DNA, 13 bp, Homo sapiens
gtcttaattaagt

SEQ ID NO: 3751512 - DNA, 14 bp, Homo sapiens
gtcttcaagggctg

SEQ ID NO: 3751513 - DNA, 21 bp, Homo sapiens
gtcttcaatttgtataaaatg

SEQ ID NO: 3751514 - DNA, 16 bp, Homo sapiens
gtcttcacagctctgt

SEQ ID NO: 3751515 - DNA, 23 bp, Homo sapiens
gtcttcagcctagccgacctcag

SEQ ID NO: 3751516 - DNA, 21 bp, Homo sapiens
gtcttcatccttagcaacagc

SEQ ID NO: 3751517 - DNA, 16 bp, Homo sapiens
gtcttccctagggctg

SEQ ID NO: 3751518 - DNA, 20 bp, Homo sapiens
gtcttcctgcattcacccag

SEQ ID NO: 3751519 - DNA, 19 bp, Homo sapiens
gtcttctcatagcattaac

SEQ ID NO: 3751520 - DNA, 20 bp, Homo sapiens
gtcttctcatagcattaact

SEQ ID NO: 3751521 - DNA, 23 bp, Homo sapiens
gtcttctcatagcattaactaat

SEQ ID NO: 3751522 - DNA, 17 bp, Homo sapiens
gtcttgaactcctggcc

SEQ ID NO: 3751523 - DNA, 21 bp, Homo sapiens
gtcttgaactcctggcctcaa

SEQ ID NO: 3751524 - DNA, 18 bp, Homo sapiens
gtcttgatttgttttaga

SEQ ID NO: 3751525 - DNA, 16 bp, Homo sapiens
gtcttgcaatggcagc

SEQ ID NO: 3751526 - DNA, 23 bp, Homo sapiens
gtcttgcaatggcagccttggca

SEQ ID NO: 3751527 - DNA, 22 bp, Homo sapiens
gtcttgctatggggagaaaaga

SEQ ID NO: 3751528 - DNA, 12 bp, Homo sapiens
gtcttgctgtgg

SEQ ID NO: 3751529 - DNA, 19 bp, Homo sapiens
gtcttgtgactagtgctga

SEQ ID NO: 3751530 - DNA, 21 bp, Homo sapiens
gtcttgttaatattctttcaa

SEQ ID NO: 3751531 - DNA, 22 bp, Homo sapiens
gtcttgttttttttttccactt

SEQ ID NO: 3751532 - DNA, 19 bp, Homo sapiens
gtctttctttggtgccttt

SEQ ID NO: 3751533 - DNA, 20 bp, Homo sapiens
gtctttgtaatgtcaccacc

SEQ ID NO: 3751534 - DNA, 21 bp, Homo sapiens
gtctttgtaatgtcaccacct

SEQ ID NO: 3751535 - DNA, 19 bp, Homo sapiens
gtctttgttaagactgctg

SEQ ID NO: 3751536 - DNA, 24 bp, Homo sapiens
gtcttttaggacccttcccttgag

SEQ ID NO: 3751537 - DNA, 14 bp, Homo sapiens
gtcttttgacatgt

SEQ ID NO: 3751538 - DNA, 16 bp, Homo sapiens
gtcttttttcactaca

SEQ ID NO: 3751539 - DNA, 16 bp, Homo sapiens
gtgaaagaaatcatgt

SEQ ID NO: 3751540 - DNA, 21 bp, Homo sapiens
gtgaaagtcagatgcccagag

SEQ ID NO: 3751541 - DNA, 17 bp, Homo sapiens
gtgaaatcaaaggtgct

SEQ ID NO: 3751542 - DNA, 17 bp, Homo sapiens
gtgaaatctgtgcaata

SEQ ID NO: 3751543 - DNA, 24 bp, Homo sapiens
gtgaacgtgggagttcagctgctt

SEQ ID NO: 3751544 - DNA, 21 bp, Homo sapiens
gtgaactgtgagggtaaaggc

SEQ ID NO: 3751545 - DNA, 20 bp, Homo sapiens
gtgaacttggggaacaaggg

SEQ ID NO: 3751546 - DNA, 18 bp, Homo sapiens
gtgaagatgtttgcaata

SEQ ID NO: 3751547 - DNA, 19 bp, Homo sapiens
gtgaagtatactgtatttt

SEQ ID NO: 3751548 - DNA, 21 bp, Homo sapiens
gtgaattatcccttttcttga

SEQ ID NO: 3751549 - DNA, 15 bp, Homo sapiens
gtgaatttgaatctc

SEQ ID NO: 3751550 - DNA, 18 bp, Homo sapiens
gtgaatttgaatgaaaaa

SEQ ID NO: 3751551 - DNA, 23 bp, Homo sapiens
gtgacaagctcctggtcttgaga

SEQ ID NO: 3751552 - DNA, 14 bp, Homo sapiens
gtgacaaggcccca

SEQ ID NO: 3751553 - DNA, 23 bp, Homo sapiens
gtgacaccagcctttctcccagg

SEQ ID NO: 3751554 - DNA, 22 bp, Homo sapiens
gtgacacttcagagagctggta

SEQ ID NO: 3751555 - DNA, 14 bp, Homo sapiens
gtgacagaggcagc

SEQ ID NO: 3751556 - DNA, 16 bp, Homo sapiens
gtgacagaggcagccc

SEQ ID NO: 3751557 - DNA, 19 bp, Homo sapiens
gtgacagaggcagccccat

SEQ ID NO: 3751558 - DNA, 22 bp, Homo sapiens
gtgacagagtgagactctgtct

SEQ ID NO: 3751559 - DNA, 17 bp, Homo sapiens
gtgacagagttcactat

SEQ ID NO: 3751560 - DNA, 21 bp, Homo sapiens
gtgacagtgaggtcctggggg

SEQ ID NO: 3751561 - DNA, 23 bp, Homo sapiens
gtgacagtgcctgggaatgtatt

SEQ ID NO: 3751562 - DNA, 15 bp, Homo sapiens
gtgacatcagtggca

SEQ ID NO: 3751563 - DNA, 16 bp, Homo sapiens
gtgacatgcgggctgg

SEQ ID NO: 3751564 - DNA, 22 bp, Homo sapiens
gtgacatgcgggctgggcagct

SEQ ID NO: 3751565 - DNA, 14 bp, Homo sapiens
gtgaccaaggagga

SEQ ID NO: 3751566 - DNA, 15 bp, Homo sapiens
gtgacccagtcagag

SEQ ID NO: 3751567 - DNA, 18 bp, Homo sapiens
gtgacctccacagctacc

SEQ ID NO: 3751568 - DNA, 23 bp, Homo sapiens
gtgacctgtggggatttctccca

SEQ ID NO: 3751569 - DNA, 15 bp, Homo sapiens
gtgaccttctgggaa

SEQ ID NO: 3751570 - DNA, 21 bp, Homo sapiens
gtgactgatgttaggctgggc

SEQ ID NO: 3751571 - DNA, 20 bp, Homo sapiens
gtgactgccccaactcctgg

SEQ ID NO: 3751572 - DNA, 21 bp, Homo sapiens
gtgactgccccaactcctgga

SEQ ID NO: 3751573 - DNA, 16 bp, Homo sapiens
gtgacttcagctctgt

SEQ ID NO: 3751574 - DNA, 19 bp, Homo sapiens
gtgagaaacatctcaataa

SEQ ID NO: 3751575 - DNA, 15 bp, Homo sapiens
gtgagaactactcag

SEQ ID NO: 3751576 - DNA, 15 bp, Homo sapiens
gtgagacccccacac

SEQ ID NO: 3751577 - DNA, 18 bp, Homo sapiens
gtgagcaaacctgcccca

SEQ ID NO: 3751578 - DNA, 20 bp, Homo sapiens
gtgagccaccgctgccagca

SEQ ID NO: 3751579 - DNA, 24 bp, Homo sapiens
gtgagccaccgctgccagcacaga

SEQ ID NO: 3751580 - DNA, 13 bp, Homo sapiens
gtgagccactgca

SEQ ID NO: 3751581 - DNA, 14 bp, Homo sapiens
gtgagccactgcac

SEQ ID NO: 3751582 - DNA, 19 bp, Homo sapiens
gtgagccgagatcacgcca

SEQ ID NO: 3751583 - DNA, 16 bp, Homo sapiens
gtgaggaagctccagt

SEQ ID NO: 3751584 - DNA, 17 bp, Homo sapiens
gtgaggagctgctggct

SEQ ID NO: 3751585 - DNA, 21 bp, Homo sapiens
gtgaggatggcctctgctaag

SEQ ID NO: 3751586 - DNA, 17 bp, Homo sapiens
gtgaggatgggaaggag

SEQ ID NO: 3751587 - DNA, 19 bp, Homo sapiens
gtgaggatgggaaggaggg

SEQ ID NO: 3751588 - DNA, 15 bp, Homo sapiens
gtgaggcccagggag

SEQ ID NO: 3751589 - DNA, 17 bp, Homo sapiens
gtgaggtcctgggggcc

SEQ ID NO: 3751590 - DNA, 19 bp, Homo sapiens
gtgaggtcctgggggcctg

SEQ ID NO: 3751591 - DNA, 21 bp, Homo sapiens
gtgaggtgcagagtgcccaga

SEQ ID NO: 3751592 - DNA, 20 bp, Homo sapiens
gtgaggtgggttttcttccc

SEQ ID NO: 3751593 - DNA, 15 bp, Homo sapiens
gtgagtgtggctccc

SEQ ID NO: 3751594 - DNA, 20 bp, Homo sapiens
gtgagttcagcctttaagat

SEQ ID NO: 3751595 - DNA, 20 bp, Homo sapiens
gtgatacaacttcaagtgca

SEQ ID NO: 3751596 - DNA, 20 bp, Homo sapiens
gtgatacccatagcttccat

SEQ ID NO: 3751597 - DNA, 15 bp, Homo sapiens
gtgatgccacacaga

SEQ ID NO: 3751598 - DNA, 19 bp, Homo sapiens
gtgatgccacacagagtgg

SEQ ID NO: 3751599 - DNA, 14 bp, Homo sapiens
gtgatgtttgtcct

SEQ ID NO: 3751600 - DNA, 16 bp, Homo sapiens
gtgattctcctgcctc

SEQ ID NO: 3751601 - DNA, 23 bp, Homo sapiens
gtgattctcctgcctcagcctcc

SEQ ID NO: 3751602 - DNA, 22 bp, Homo sapiens
gtgcaaagttccctacttcctg

SEQ ID NO: 3751603 - DNA, 14 bp, Homo sapiens
gtgcaacagacaag

SEQ ID NO: 3751604 - DNA, 15 bp, Homo sapiens
gtgcacaaatattta

SEQ ID NO: 3751605 - DNA, 17 bp, Homo sapiens
gtgcacacaccagagcc

SEQ ID NO: 3751606 - DNA, 21 bp, Homo sapiens
gtgcacacaccagagcccacc

SEQ ID NO: 3751607 - DNA, 18 bp, Homo sapiens
gtgcacgtacacacacat

SEQ ID NO: 3751608 - DNA, 14 bp, Homo sapiens
gtgcagactggagg

SEQ ID NO: 3751609 - DNA, 18 bp, Homo sapiens
gtgcagcaaccagagcac

SEQ ID NO: 3751610 - DNA, 16 bp, Homo sapiens
gtgcagctgattttaa

SEQ ID NO: 3751611 - DNA, 23 bp, Homo sapiens
gtgcagctgattttaacaataac

SEQ ID NO: 3751612 - DNA, 15 bp, Homo sapiens
gtgcaggctggcacc

SEQ ID NO: 3751613 - DNA, 19 bp, Homo sapiens
gtgcataagttaacttcca

SEQ ID NO: 3751614 - DNA, 15 bp, Homo sapiens
gtgcatctcagccca

SEQ ID NO: 3751615 - DNA, 18 bp, Homo sapiens
gtgcatctcagcccacat

SEQ ID NO: 3751616 - DNA, 18 bp, Homo sapiens
gtgcatgcagcatctaag

SEQ ID NO: 3751617 - DNA, 21 bp, Homo sapiens
gtgcatgctctctgcagccag

SEQ ID NO: 3751618 - DNA, 13 bp, Homo sapiens
gtgcatgtgtgtg

SEQ ID NO: 3751619 - DNA, 14 bp, Homo sapiens
gtgcattacagaga

SEQ ID NO: 3751620 - DNA, 17 bp, Homo sapiens
gtgcattttcccagata

SEQ ID NO: 3751621 - DNA, 18 bp, Homo sapiens
gtgccaagcacagtgcct

SEQ ID NO: 3751622 - DNA, 20 bp, Homo sapiens
gtgccaggcccggggctggc

SEQ ID NO: 3751623 - DNA, 20 bp, Homo sapiens
gtgccaggtttttggtctga

SEQ ID NO: 3751624 - DNA, 18 bp, Homo sapiens
gtgccagtcttgtgtctg

SEQ ID NO: 3751625 - DNA, 20 bp, Homo sapiens
gtgccccccttgccagacat

SEQ ID NO: 3751626 - DNA, 13 bp, Homo sapiens
gtgcccctgctgc

SEQ ID NO: 3751627 - DNA, 14 bp, Homo sapiens
gtgccctccactgc

SEQ ID NO: 3751628 - DNA, 18 bp, Homo sapiens
gtgccctccactgccctc

SEQ ID NO: 3751629 - DNA, 20 bp, Homo sapiens
gtgccctccactgccctctg

SEQ ID NO: 3751630 - DNA, 13 bp, Homo sapiens
gtgcctctgggac

SEQ ID NO: 3751631 - DNA, 11 bp, Homo sapiens
gtgcctgcagc

SEQ ID NO: 3751632 - DNA, 17 bp, Homo sapiens
gtgcctgggaatgtatt

SEQ ID NO: 3751633 - DNA, 18 bp, Homo sapiens
gtgcctgggtggggctgc

SEQ ID NO: 3751634 - DNA, 22 bp, Homo sapiens
gtgcctgggtggggctgctcct

SEQ ID NO: 3751635 - DNA, 15 bp, Homo sapiens
gtgcctgtgaggcag

SEQ ID NO: 3751636 - DNA, 16 bp, Homo sapiens
gtgcctgtgaggcagg

SEQ ID NO: 3751637 - DNA, 14 bp, Homo sapiens
gtgccttacctcct

SEQ ID NO: 3751638 - DNA, 17 bp, Homo sapiens
gtgccttacctcctgcc

SEQ ID NO: 3751639 - DNA, 20 bp, Homo sapiens
gtgccttacctcctgcccag

SEQ ID NO: 3751640 - DNA, 17 bp, Homo sapiens
gtgccttccataattat

SEQ ID NO: 3751641 - DNA, 11 bp, Homo sapiens
gtgcctttcct

SEQ ID NO: 3751642 - DNA, 13 bp, Homo sapiens
gtgcgtcctgtcg

SEQ ID NO: 3751643 - DNA, 14 bp, Homo sapiens
gtgcgtgggtgaag

SEQ ID NO: 3751644 - DNA, 13 bp, Homo sapiens
gtgcgtgtgtgca

SEQ ID NO: 3751645 - DNA, 13 bp, Homo sapiens
gtgctaaattttc

SEQ ID NO: 3751646 - DNA, 16 bp, Homo sapiens
gtgctaattaataaag

SEQ ID NO: 3751647 - DNA, 13 bp, Homo sapiens
gtgctatgaattt

SEQ ID NO: 3751648 - DNA, 19 bp, Homo sapiens
gtgctatggatggcttcta

SEQ ID NO: 3751649 - DNA, 14 bp, Homo sapiens
gtgctctggacagg

SEQ ID NO: 3751650 - DNA, 16 bp, Homo sapiens
gtgctctggacaggca

SEQ ID NO: 3751651 - DNA, 21 bp, Homo sapiens
gtgctgccacacttcaggctc

SEQ ID NO: 3751652 - DNA, 22 bp, Homo sapiens
gtgctgggattacaagcgtgag

SEQ ID NO: 3751653 - DNA, 15 bp, Homo sapiens
gtgctgtggttcctg

SEQ ID NO: 3751654 - DNA, 15 bp, Homo sapiens
gtgcttcagcctgag

SEQ ID NO: 3751655 - DNA, 20 bp, Homo sapiens
gtgcttgttccctctccctg

SEQ ID NO: 3751656 - DNA, 21 bp, Homo sapiens
gtgcttgtttgctcacctggg

SEQ ID NO: 3751657 - DNA, 23 bp, Homo sapiens
gtgcttgtttgctcacctggggt

SEQ ID NO: 3751658 - DNA, 12 bp, Homo sapiens
gtggaaaaatat

SEQ ID NO: 3751659 - DNA, 14 bp, Homo sapiens
gtggaaagcctctg

SEQ ID NO: 3751660 - DNA, 20 bp, Homo sapiens
gtggaaagggtgctgcttcc

SEQ ID NO: 3751661 - DNA, 14 bp, Homo sapiens
gtggaagccctcct

SEQ ID NO: 3751662 - DNA, 11 bp, Homo sapiens
gtggaaggaaa

SEQ ID NO: 3751663 - DNA, 23 bp, Homo sapiens
gtggacacagctcttctccaggc

SEQ ID NO: 3751664 - DNA, 21 bp, Homo sapiens
gtggacaccaggagtccctgg

SEQ ID NO: 3751665 - DNA, 16 bp, Homo sapiens
gtggacagtcctggga

SEQ ID NO: 3751666 - DNA, 14 bp, Homo sapiens
gtggaccaggacag

SEQ ID NO: 3751667 - DNA, 13 bp, Homo sapiens
gtggactggaagg

SEQ ID NO: 3751668 - DNA, 17 bp, Homo sapiens
gtggactttccaccccc

SEQ ID NO: 3751669 - DNA, 20 bp, Homo sapiens
gtggactttccaccccctcc

SEQ ID NO: 3751670 - DNA, 22 bp, Homo sapiens
gtggactttccaccccctccct

SEQ ID NO: 3751671 - DNA, 21 bp, Homo sapiens
gtggagaaactgtagtctcag

SEQ ID NO: 3751672 - DNA, 22 bp, Homo sapiens
gtggagaaattccttgattcac

SEQ ID NO: 3751673 - DNA, 16 bp, Homo sapiens
gtggagaactcctagg

SEQ ID NO: 3751674 - DNA, 14 bp, Homo sapiens
gtggagagctggtg

SEQ ID NO: 3751675 - DNA, 16 bp, Homo sapiens
gtggagagctggtgcc

SEQ ID NO: 3751676 - DNA, 17 bp, Homo sapiens
gtggagagctggtgccc

SEQ ID NO: 3751677 - DNA, 23 bp, Homo sapiens
gtggagcagccaacaagcagggg

SEQ ID NO: 3751678 - DNA, 17 bp, Homo sapiens
gtggaggagagcctggt

SEQ ID NO: 3751679 - DNA, 16 bp, Homo sapiens
gtggaggagctcagga

SEQ ID NO: 3751680 - DNA, 16 bp, Homo sapiens
gtggaggctgcagtga

SEQ ID NO: 3751681 - DNA, 13 bp, Homo sapiens
gtggagtggatgc

SEQ ID NO: 3751682 - DNA, 19 bp, Homo sapiens
gtggagttggcattgcatt

SEQ ID NO: 3751683 - DNA, 21 bp, Homo sapiens
gtggatagatgccctgctaga

SEQ ID NO: 3751684 - DNA, 13 bp, Homo sapiens
gtggatcacagag

SEQ ID NO: 3751685 - DNA, 13 bp, Homo sapiens
gtggatcacctga

SEQ ID NO: 3751686 - DNA, 14 bp, Homo sapiens
gtggatgcctcaga

SEQ ID NO: 3751687 - DNA, 18 bp, Homo sapiens
gtggatgcctggtggcag

SEQ ID NO: 3751688 - DNA, 22 bp, Homo sapiens
gtggcaaagccttcattgcctt

SEQ ID NO: 3751689 - DNA, 15 bp, Homo sapiens
gtggcaagaccaaaa

SEQ ID NO: 3751690 - DNA, 18 bp, Homo sapiens
gtggcaccagcagcctgg

SEQ ID NO: 3751691 - DNA, 23 bp, Homo sapiens
gtggcagataatcagcctcttaa

SEQ ID NO: 3751692 - DNA, 22 bp, Homo sapiens
gtggcagattttacaaaagatg

SEQ ID NO: 3751693 - DNA, 13 bp, Homo sapiens
gtggcagccctgt

SEQ ID NO: 3751694 - DNA, 12 bp, Homo sapiens
gtggcagctgct

SEQ ID NO: 3751695 - DNA, 13 bp, Homo sapiens
gtggcagctgctt

SEQ ID NO: 3751696 - DNA, 20 bp, Homo sapiens
gtggcagtaaagagaaactt

SEQ ID NO: 3751697 - DNA, 16 bp, Homo sapiens
gtggcagtgggagctg

SEQ ID NO: 3751698 - DNA, 20 bp, Homo sapiens
gtggcatctttgccttgggc

SEQ ID NO: 3751699 - DNA, 22 bp, Homo sapiens
gtggcatgttcatcgtataaca

SEQ ID NO: 3751700 - DNA, 21 bp, Homo sapiens
gtggccagaccagagctctgg

SEQ ID NO: 3751701 - DNA, 13 bp, Homo sapiens
gtggccctggcct

SEQ ID NO: 3751702 - DNA, 19 bp, Homo sapiens
gtggccctggcctgctggg

SEQ ID NO: 3751703 - DNA, 9 bp, Homo sapiens
gtggcctca

SEQ ID NO: 3751704 - DNA, 20 bp, Homo sapiens
gtggcctctgccccgtctca

SEQ ID NO: 3751705 - DNA, 24 bp, Homo sapiens
gtggcctctgccccgtctcatgag

SEQ ID NO: 3751706 - DNA, 12 bp, Homo sapiens
gtggcctggcca

SEQ ID NO: 3751707 - DNA, 18 bp, Homo sapiens
gtggcctggccaggagct

SEQ ID NO: 3751708 - DNA, 19 bp, Homo sapiens
gtggcctggctccgctgtg

SEQ ID NO: 3751709 - DNA, 14 bp, Homo sapiens
gtggcctgggcaag

SEQ ID NO: 3751710 - DNA, 12 bp, Homo sapiens
gtggccttcccc

SEQ ID NO: 3751711 - DNA, 16 bp, Homo sapiens
gtggctctgagaaggg

SEQ ID NO: 3751712 - DNA, 19 bp, Homo sapiens
gtggctgacccagtccctg

SEQ ID NO: 3751713 - DNA, 15 bp, Homo sapiens
gtggctgacccccct

SEQ ID NO: 3751714 - DNA, 16 bp, Homo sapiens
gtggctgacccccctc

SEQ ID NO: 3751715 - DNA, 16 bp, Homo sapiens
gtggctgcccacacac

SEQ ID NO: 3751716 - DNA, 16 bp, Homo sapiens
gtggctgggggcagga

SEQ ID NO: 3751717 - DNA, 21 bp, Homo sapiens
gtggctgggtccaggggatgg

SEQ ID NO: 3751718 - DNA, 15 bp, Homo sapiens
gtggctgtcagcagg

SEQ ID NO: 3751719 - DNA, 22 bp, Homo sapiens
gtggcttaaaacaacactcaca

SEQ ID NO: 3751720 - DNA, 21 bp, Homo sapiens
gtggcttcccgctcagccctc

SEQ ID NO: 3751721 - DNA, 20 bp, Homo sapiens
gtgggaaggacttggcgcgc

SEQ ID NO: 3751722 - DNA, 14 bp, Homo sapiens
gtgggaagggagag

SEQ ID NO: 3751723 - DNA, 13 bp, Homo sapiens
gtgggagagccca

SEQ ID NO: 3751724 - DNA, 18 bp, Homo sapiens
gtgggagctgcctgttca

SEQ ID NO: 3751725 - DNA, 16 bp, Homo sapiens
gtgggatggaggagaa

SEQ ID NO: 3751726 - DNA, 17 bp, Homo sapiens
gtgggatggaggagaag

SEQ ID NO: 3751727 - DNA, 17 bp, Homo sapiens
gtgggcaaacaggcagt

SEQ ID NO: 3751728 - DNA, 15 bp, Homo sapiens
gtgggccagcccctc

SEQ ID NO: 3751729 - DNA, 14 bp, Homo sapiens
gtgggccaggacag

SEQ ID NO: 3751730 - DNA, 15 bp, Homo sapiens
gtgggccatggcaat

SEQ ID NO: 3751731 - DNA, 22 bp, Homo sapiens
gtgggcctgtcgtgccagtcct

SEQ ID NO: 3751732 - DNA, 13 bp, Homo sapiens
gtgggcggcagag

SEQ ID NO: 3751733 - DNA, 13 bp, Homo sapiens
gtgggctcccttc

SEQ ID NO: 3751734 - DNA, 13 bp, Homo sapiens
gtgggctgagccc

SEQ ID NO: 3751735 - DNA, 19 bp, Homo sapiens
gtggggcagcacagagagg

SEQ ID NO: 3751736 - DNA, 17 bp, Homo sapiens
gtggggcagcttgaggg

SEQ ID NO: 3751737 - DNA, 14 bp, Homo sapiens
gtggggctgctcct

SEQ ID NO: 3751738 - DNA, 17 bp, Homo sapiens
gtggggctgctcctcca

SEQ ID NO: 3751739 - DNA, 18 bp, Homo sapiens
gtggggctgctcctccag

SEQ ID NO: 3751740 - DNA, 11 bp, Homo sapiens
gtggggctggg

SEQ ID NO: 3751741 - DNA, 12 bp, Homo sapiens
gtggggctgggg

SEQ ID NO: 3751742 - DNA, 22 bp, Homo sapiens
gtgggggcagagggcagaggct

SEQ ID NO: 3751743 - DNA, 16 bp, Homo sapiens
gtgggggttggctggg

SEQ ID NO: 3751744 - DNA, 22 bp, Homo sapiens
gtggggtctccctctcctgcct

SEQ ID NO: 3751745 - DNA, 15 bp, Homo sapiens
gtgggtacagagagg

SEQ ID NO: 3751746 - DNA, 20 bp, Homo sapiens
gtgggtagatcacgagatca

SEQ ID NO: 3751747 - DNA, 12 bp, Homo sapiens
gtgggtgagcca

SEQ ID NO: 3751748 - DNA, 19 bp, Homo sapiens
gtgggtggaaccaggaacc

SEQ ID NO: 3751749 - DNA, 18 bp, Homo sapiens
gtggtaagagaatgttat

SEQ ID NO: 3751750 - DNA, 19 bp, Homo sapiens
gtggtaagagaatgttata

SEQ ID NO: 3751751 - DNA, 19 bp, Homo sapiens
gtggtatgatcacggctca

SEQ ID NO: 3751752 - DNA, 15 bp, Homo sapiens
gtggtatgtgtgtgt

SEQ ID NO: 3751753 - DNA, 16 bp, Homo sapiens
gtggtcattaagcatt

SEQ ID NO: 3751754 - DNA, 23 bp, Homo sapiens
gtggtctgaatgttctgacatta

SEQ ID NO: 3751755 - DNA, 14 bp, Homo sapiens
gtggtctgcaggca

SEQ ID NO: 3751756 - DNA, 16 bp, Homo sapiens
gtggtctttctggaga

SEQ ID NO: 3751757 - DNA, 14 bp, Homo sapiens
gtggtgacctctgc

SEQ ID NO: 3751758 - DNA, 13 bp, Homo sapiens
gtggtgagatcat

SEQ ID NO: 3751759 - DNA, 22 bp, Homo sapiens
gtggtggcagtgcagcaaccag

SEQ ID NO: 3751760 - DNA, 23 bp, Homo sapiens
gtggtggcatacgcctgtagtcc

SEQ ID NO: 3751761 - DNA, 18 bp, Homo sapiens
gtggttatggagagggtg

SEQ ID NO: 3751762 - DNA, 14 bp, Homo sapiens
gtggttatttttat

SEQ ID NO: 3751763 - DNA, 16 bp, Homo sapiens
gtggtttttgagccat

SEQ ID NO: 3751764 - DNA, 20 bp, Homo sapiens
gtgtaaaaatgagaacatgt

SEQ ID NO: 3751765 - DNA, 22 bp, Homo sapiens
gtgtaagtgtgagtaagagctg

SEQ ID NO: 3751766 - DNA, 18 bp, Homo sapiens
gtgtaataaagtgttttc

SEQ ID NO: 3751767 - DNA, 21 bp, Homo sapiens
gtgtaatcatttcttgggccc

SEQ ID NO: 3751768 - DNA, 18 bp, Homo sapiens
gtgtacagaattctgcta

SEQ ID NO: 3751769 - DNA, 12 bp, Homo sapiens
gtgtacagtgtg

SEQ ID NO: 3751770 - DNA, 22 bp, Homo sapiens
gtgtacatggaataacatgtaa

SEQ ID NO: 3751771 - DNA, 20 bp, Homo sapiens
gtgtacgtggagagggatga

SEQ ID NO: 3751772 - DNA, 17 bp, Homo sapiens
gtgtactctggcctctg

SEQ ID NO: 3751773 - DNA, 19 bp, Homo sapiens
gtgtactctggcctctgtc

SEQ ID NO: 3751774 - DNA, 20 bp, Homo sapiens
gtgtaggctttacttagctt

SEQ ID NO: 3751775 - DNA, 14 bp, Homo sapiens
gtgtatatgtatgt

SEQ ID NO: 3751776 - DNA, 16 bp, Homo sapiens
gtgtatgactaaagag

SEQ ID NO: 3751777 - DNA, 18 bp, Homo sapiens
gtgtatgtgcgtgtgtgc

SEQ ID NO: 3751778 - DNA, 19 bp, Homo sapiens
gtgtattctagttttgtca

SEQ ID NO: 3751779 - DNA, 12 bp, Homo sapiens
gtgtattgttcc

SEQ ID NO: 3751780 - DNA, 17 bp, Homo sapiens
gtgtatttaattgtaaa

SEQ ID NO: 3751781 - DNA, 19 bp, Homo sapiens
gtgtatttaattgtaaact

SEQ ID NO: 3751782 - DNA, 22 bp, Homo sapiens
gtgtatttaattgtaaactgta

SEQ ID NO: 3751783 - DNA, 19 bp, Homo sapiens
gtgtatttattttcctccc

SEQ ID NO: 3751784 - DNA, 23 bp, Homo sapiens
gtgtcaggaaacatatttaagaa

SEQ ID NO: 3751785 - DNA, 19 bp, Homo sapiens
gtgtcaggtggggcagctt

SEQ ID NO: 3751786 - DNA, 23 bp, Homo sapiens
gtgtcatttggctttccagtcat

SEQ ID NO: 3751787 - DNA, 15 bp, Homo sapiens
gtgtccaactccagt

SEQ ID NO: 3751788 - DNA, 16 bp, Homo sapiens
gtgtccaactccagta

SEQ ID NO: 3751789 - DNA, 15 bp, Homo sapiens
gtgtccatgtgtgtg

SEQ ID NO: 3751790 - DNA, 12 bp, Homo sapiens
gtgtccccagcc

SEQ ID NO: 3751791 - DNA, 15 bp, Homo sapiens
gtgtcgtagccaagg

SEQ ID NO: 3751792 - DNA, 14 bp, Homo sapiens
gtgtctcctgcatg

SEQ ID NO: 3751793 - DNA, 16 bp, Homo sapiens
gtgtctcctgcatgca

SEQ ID NO: 3751794 - DNA, 13 bp, Homo sapiens
gtgtctgtattta

SEQ ID NO: 3751795 - DNA, 13 bp, Homo sapiens
gtgtcttccataa

SEQ ID NO: 3751796 - DNA, 15 bp, Homo sapiens
gtgtcttccataatg

SEQ ID NO: 3751797 - DNA, 17 bp, Homo sapiens
gtgtcttgcaatggcag

SEQ ID NO: 3751798 - DNA, 18 bp, Homo sapiens
gtgtcttgcaatggcagc

SEQ ID NO: 3751799 - DNA, 21 bp, Homo sapiens
gtgtcttgcaatggcagcctt

SEQ ID NO: 3751800 - DNA, 15 bp, Homo sapiens
gtgtcttgtgttttt

SEQ ID NO: 3751801 - DNA, 15 bp, Homo sapiens
gtgtgacatcagtgg

SEQ ID NO: 3751802 - DNA, 13 bp, Homo sapiens
gtgtgagtcacca

SEQ ID NO: 3751803 - DNA, 14 bp, Homo sapiens
gtgtgagtgtgtgc

SEQ ID NO: 3751804 - DNA, 17 bp, Homo sapiens
gtgtgatcccaagtgcc

SEQ ID NO: 3751805 - DNA, 12 bp, Homo sapiens
gtgtgcatgtgt

SEQ ID NO: 3751806 - DNA, 16 bp, Homo sapiens
gtgtgcgtcctgtcgg

SEQ ID NO: 3751807 - DNA, 12 bp, Homo sapiens
gtgtgctctgat

SEQ ID NO: 3751808 - DNA, 22 bp, Homo sapiens
gtgtgctctgatcatccactgt

SEQ ID NO: 3751809 - DNA, 19 bp, Homo sapiens
gtgtggctttcagagcctc

SEQ ID NO: 3751810 - DNA, 18 bp, Homo sapiens
gtgtggttgctcacagct

SEQ ID NO: 3751811 - DNA, 18 bp, Homo sapiens
gtgtgttctgattagaaa

SEQ ID NO: 3751812 - DNA, 14 bp, Homo sapiens
gtgtgtttgtgtga

SEQ ID NO: 3751813 - DNA, 17 bp, Homo sapiens
gtgtgttttcataataa

SEQ ID NO: 3751814 - DNA, 21 bp, Homo sapiens
gtgtgtttttgggatgtctta

SEQ ID NO: 3751815 - DNA, 21 bp, Homo sapiens
gtgttatttattgctacttcc

SEQ ID NO: 3751816 - DNA, 10 bp, Homo sapiens
gtgttcctgg

SEQ ID NO: 3751817 - DNA, 18 bp, Homo sapiens
gtgttgcgtgtcgtgggt

SEQ ID NO: 3751818 - DNA, 21 bp, Homo sapiens
gtgttggcttgtgatctggga

SEQ ID NO: 3751819 - DNA, 23 bp, Homo sapiens
gtgtttaacggcactgtggcctt

SEQ ID NO: 3751820 - DNA, 12 bp, Homo sapiens
gtgtttcccata

SEQ ID NO: 3751821 - DNA, 11 bp, Homo sapiens
gtgtttctagg

SEQ ID NO: 3751822 - DNA, 15 bp, Homo sapiens
gtgtttctagggaaa

SEQ ID NO: 3751823 - DNA, 14 bp, Homo sapiens
gtgttttcataata

SEQ ID NO: 3751824 - DNA, 15 bp, Homo sapiens
gtgttttcataataa

SEQ ID NO: 3751825 - DNA, 13 bp, Homo sapiens
gtgttttgttttg

SEQ ID NO: 3751826 - DNA, 14 bp, Homo sapiens
gttaaaaaaaataa

SEQ ID NO: 3751827 - DNA, 18 bp, Homo sapiens
gttaaaaaaaataataaa

SEQ ID NO: 3751828 - DNA, 19 bp, Homo sapiens
gttaaaaaaaataataaat

SEQ ID NO: 3751829 - DNA, 12 bp, Homo sapiens
gttaaaactgtc

SEQ ID NO: 3751830 - DNA, 21 bp, Homo sapiens
gttaaaataactagtgttgct

SEQ ID NO: 3751831 - DNA, 14 bp, Homo sapiens
gttaaacattgaag

SEQ ID NO: 3751832 - DNA, 20 bp, Homo sapiens
gttaaagtcagtgggaacgt

SEQ ID NO: 3751833 - DNA, 15 bp, Homo sapiens
gttaaatatttacat

SEQ ID NO: 3751834 - DNA, 16 bp, Homo sapiens
gttaaatatttacata

SEQ ID NO: 3751835 - DNA, 15 bp, Homo sapiens
gttaacaaggaatgc

SEQ ID NO: 3751836 - DNA, 23 bp, Homo sapiens
gttaacagagacagataactctc

SEQ ID NO: 3751837 - DNA, 16 bp, Homo sapiens
gttaactatgtacaat

SEQ ID NO: 3751838 - DNA, 18 bp, Homo sapiens
gttaactatgtacaatat

SEQ ID NO: 3751839 - DNA, 20 bp, Homo sapiens
gttaactatgtacaatattt

SEQ ID NO: 3751840 - DNA, 23 bp, Homo sapiens
gttaactatgtacaatattttaa

SEQ ID NO: 3751841 - DNA, 21 bp, Homo sapiens
gttaactattttattttctaa

SEQ ID NO: 3751842 - DNA, 13 bp, Homo sapiens
gttaactttgggt

SEQ ID NO: 3751843 - DNA, 15 bp, Homo sapiens
gttaagatatgatgt

SEQ ID NO: 3751844 - DNA, 14 bp, Homo sapiens
gttaagtggtttca

SEQ ID NO: 3751845 - DNA, 22 bp, Homo sapiens
gttaagttgatggtgatgaaat

SEQ ID NO: 3751846 - DNA, 17 bp, Homo sapiens
gttaatcaactgaaagt

SEQ ID NO: 3751847 - DNA, 13 bp, Homo sapiens
gttacaaactgca

SEQ ID NO: 3751848 - DNA, 21 bp, Homo sapiens
gttacaaactgcaatagagac

SEQ ID NO: 3751849 - DNA, 23 bp, Homo sapiens
gttacaaactgcaatagagactg

SEQ ID NO: 3751850 - DNA, 22 bp, Homo sapiens
gttacaggcaccgagaatgttg

SEQ ID NO: 3751851 - DNA, 17 bp, Homo sapiens
gttacagtgcagacagg

SEQ ID NO: 3751852 - DNA, 18 bp, Homo sapiens
gttacataagataaatgt

SEQ ID NO: 3751853 - DNA, 23 bp, Homo sapiens
gttacctttctaggtcaaggcct

SEQ ID NO: 3751854 - DNA, 15 bp, Homo sapiens
gttactatcctggct

SEQ ID NO: 3751855 - DNA, 17 bp, Homo sapiens
gttactgatcatgcatt

SEQ ID NO: 3751856 - DNA, 13 bp, Homo sapiens
gttacttcctatc

SEQ ID NO: 3751857 - DNA, 14 bp, Homo sapiens
gttagaatgaggag

SEQ ID NO: 3751858 - DNA, 18 bp, Homo sapiens
gttagagatgcctccctg

SEQ ID NO: 3751859 - DNA, 21 bp, Homo sapiens
gttagctcagccccagcccag

SEQ ID NO: 3751860 - DNA, 14 bp, Homo sapiens
gttaggaaataaaa

SEQ ID NO: 3751861 - DNA, 16 bp, Homo sapiens
gttaggaaataaaacc

SEQ ID NO: 3751862 - DNA, 22 bp, Homo sapiens
gttaggaaataaaacctttcaa

SEQ ID NO: 3751863 - DNA, 23 bp, Homo sapiens
gttaggaaataaaacctttcaaa

SEQ ID NO: 3751864 - DNA, 15 bp, Homo sapiens
gttaggagttcgaga

SEQ ID NO: 3751865 - DNA, 16 bp, Homo sapiens
gttaggctgggcccag

SEQ ID NO: 3751866 - DNA, 13 bp, Homo sapiens
gttagggaatggc

SEQ ID NO: 3751867 - DNA, 13 bp, Homo sapiens
gttagggaggggt

SEQ ID NO: 3751868 - DNA, 16 bp, Homo sapiens
gttagtagcatgttga

SEQ ID NO: 3751869 - DNA, 16 bp, Homo sapiens
gttagtatctaacatg

SEQ ID NO: 3751870 - DNA, 12 bp, Homo sapiens
gttagtcatttg

SEQ ID NO: 3751871 - DNA, 14 bp, Homo sapiens
gttagtttttactt

SEQ ID NO: 3751872 - DNA, 17 bp, Homo sapiens
gttataaatcaatgtca

SEQ ID NO: 3751873 - DNA, 17 bp, Homo sapiens
gttatacatgacactga

SEQ ID NO: 3751874 - DNA, 19 bp, Homo sapiens
gttatacatgacactgaaa

SEQ ID NO: 3751875 - DNA, 20 bp, Homo sapiens
gttatacatgacactgaaat

SEQ ID NO: 3751876 - DNA, 23 bp, Homo sapiens
gttatacatgacactgaaatgcc

SEQ ID NO: 3751877 - DNA, 17 bp, Homo sapiens
gttataggtcactcctg

SEQ ID NO: 3751878 - DNA, 13 bp, Homo sapiens
gttatagtgaatt

SEQ ID NO: 3751879 - DNA, 14 bp, Homo sapiens
gttatataaagaga

SEQ ID NO: 3751880 - DNA, 20 bp, Homo sapiens
gttatataaagagaaaattg

SEQ ID NO: 3751881 - DNA, 23 bp, Homo sapiens
gttatataaagagaaaattgaat

SEQ ID NO: 3751882 - DNA, 16 bp, Homo sapiens
gttatgataaaaaatt

SEQ ID NO: 3751883 - DNA, 18 bp, Homo sapiens
gttatgataaaaaatttt

SEQ ID NO: 3751884 - DNA, 23 bp, Homo sapiens
gttatggaaactgttgccagaga

SEQ ID NO: 3751885 - DNA, 22 bp, Homo sapiens
gttatgtgaatgatctctctga

SEQ ID NO: 3751886 - DNA, 18 bp, Homo sapiens
gttatgtgtatgtgccat

SEQ ID NO: 3751887 - DNA, 20 bp, Homo sapiens
gttatgtgtatgtgccattt

SEQ ID NO: 3751888 - DNA, 13 bp, Homo sapiens
gttattacatcct

SEQ ID NO: 3751889 - DNA, 15 bp, Homo sapiens
gttattacatccttg

SEQ ID NO: 3751890 - DNA, 15 bp, Homo sapiens
gttatttaaatgagt

SEQ ID NO: 3751891 - DNA, 20 bp, Homo sapiens
gttatttttatacagtagtg

SEQ ID NO: 3751892 - DNA, 21 bp, Homo sapiens
gttattttttaattattattt

SEQ ID NO: 3751893 - DNA, 18 bp, Homo sapiens
gttcaagcgattcttctg

SEQ ID NO: 3751894 - DNA, 12 bp, Homo sapiens
gttcaccagcct

SEQ ID NO: 3751895 - DNA, 16 bp, Homo sapiens
gttcacccacagggct

SEQ ID NO: 3751896 - DNA, 22 bp, Homo sapiens
gttcacctatttcaaaaatttg

SEQ ID NO: 3751897 - DNA, 21 bp, Homo sapiens
gttcacgtaagatacaagttt

SEQ ID NO: 3751898 - DNA, 22 bp, Homo sapiens
gttcagagactcagggccccag

SEQ ID NO: 3751899 - DNA, 16 bp, Homo sapiens
gttcagcaccacccta

SEQ ID NO: 3751900 - DNA, 21 bp, Homo sapiens
gttcagcccctcctctgccac

SEQ ID NO: 3751901 - DNA, 19 bp, Homo sapiens
gttcagctaagctaggaat

SEQ ID NO: 3751902 - DNA, 22 bp, Homo sapiens
gttcagctaagctaggaatgaa

SEQ ID NO: 3751903 - DNA, 15 bp, Homo sapiens
gttcagctccagctc

SEQ ID NO: 3751904 - DNA, 15 bp, Homo sapiens
gttcagctgcttctc

SEQ ID NO: 3751905 - DNA, 20 bp, Homo sapiens
gttcaggagtcccaaggaaa

SEQ ID NO: 3751906 - DNA, 15 bp, Homo sapiens
gttcaggggactcag

SEQ ID NO: 3751907 - DNA, 17 bp, Homo sapiens
gttcagggttggcccct

SEQ ID NO: 3751908 - DNA, 18 bp, Homo sapiens
gttcagggttggcccctg

SEQ ID NO: 3751909 - DNA, 17 bp, Homo sapiens
gttcaggtaacaggcag

SEQ ID NO: 3751910 - DNA, 13 bp, Homo sapiens
gttcaggtagctg

SEQ ID NO: 3751911 - DNA, 23 bp, Homo sapiens
gttcataacagtgccattgtctt

SEQ ID NO: 3751912 - DNA, 20 bp, Homo sapiens
gttcatagggtctcttcagg

SEQ ID NO: 3751913 - DNA, 22 bp, Homo sapiens
gttcatatgtaccatgtacatg

SEQ ID NO: 3751914 - DNA, 12 bp, Homo sapiens
gttcatcagtgt

SEQ ID NO: 3751915 - DNA, 14 bp, Homo sapiens
gttcatcagtgtta

SEQ ID NO: 3751916 - DNA, 16 bp, Homo sapiens
gttcatcagtgttaaa

SEQ ID NO: 3751917 - DNA, 17 bp, Homo sapiens
gttcatcatcctaagct

SEQ ID NO: 3751918 - DNA, 15 bp, Homo sapiens
gttcatccaatcctc

SEQ ID NO: 3751919 - DNA, 19 bp, Homo sapiens
gttcatccaatcctcactg

SEQ ID NO: 3751920 - DNA, 21 bp, Homo sapiens
gttcatccaatcctcactggg

SEQ ID NO: 3751921 - DNA, 17 bp, Homo sapiens
gttcatcgtataacaca

SEQ ID NO: 3751922 - DNA, 12 bp, Homo sapiens
gttcatgagaat

SEQ ID NO: 3751923 - DNA, 15 bp, Homo sapiens
gttcattattggaat

SEQ ID NO: 3751924 - DNA, 22 bp, Homo sapiens
gttcattattggaattaacctg

SEQ ID NO: 3751925 - DNA, 14 bp, Homo sapiens
gttcattgtaatgt

SEQ ID NO: 3751926 - DNA, 21 bp, Homo sapiens
gttcattgtaatgttactgat

SEQ ID NO: 3751927 - DNA, 18 bp, Homo sapiens
gttcatttgtgtgctcat

SEQ ID NO: 3751928 - DNA, 15 bp, Homo sapiens
gttccaatcctggct

SEQ ID NO: 3751929 - DNA, 16 bp, Homo sapiens
gttccagctctttgaa

SEQ ID NO: 3751930 - DNA, 22 bp, Homo sapiens
gttcccagtgacacttcagaga

SEQ ID NO: 3751931 - DNA, 15 bp, Homo sapiens
gttcccccagccctg

SEQ ID NO: 3751932 - DNA, 15 bp, Homo sapiens
gttccctctccctgt

SEQ ID NO: 3751933 - DNA, 20 bp, Homo sapiens
gttccctgaaaacccagaga

SEQ ID NO: 3751934 - DNA, 21 bp, Homo sapiens
gttccctgaaaacccagagag

SEQ ID NO: 3751935 - DNA, 13 bp, Homo sapiens
gttcccttctcct

SEQ ID NO: 3751936 - DNA, 15 bp, Homo sapiens
gttcccttggcctca

SEQ ID NO: 3751937 - DNA, 16 bp, Homo sapiens
gttcccttggcctcag

SEQ ID NO: 3751938 - DNA, 22 bp, Homo sapiens
gttccggaatcctgtcctcagc

SEQ ID NO: 3751939 - DNA, 17 bp, Homo sapiens
gttcctaacaggatgaa

SEQ ID NO: 3751940 - DNA, 22 bp, Homo sapiens
gttcctcattagcattttgcta

SEQ ID NO: 3751941 - DNA, 13 bp, Homo sapiens
gttcctcgccctg

SEQ ID NO: 3751942 - DNA, 20 bp, Homo sapiens
gttcctgatgacccaggctg

SEQ ID NO: 3751943 - DNA, 12 bp, Homo sapiens
gttcctgcagca

SEQ ID NO: 3751944 - DNA, 17 bp, Homo sapiens
gttcctgctagaaatgg

SEQ ID NO: 3751945 - DNA, 19 bp, Homo sapiens
gttcgagaccaacctgacc

SEQ ID NO: 3751946 - DNA, 19 bp, Homo sapiens
gttcgagaccagcctggcc

SEQ ID NO: 3751947 - DNA, 22 bp, Homo sapiens
gttctcaaacggtacacagact

SEQ ID NO: 3751948 - DNA, 15 bp, Homo sapiens
gttctctctatggta

SEQ ID NO: 3751949 - DNA, 18 bp, Homo sapiens
gttctctctatggtaaag

SEQ ID NO: 3751950 - DNA, 22 bp, Homo sapiens
gttctctctgcctgtgagccag

SEQ ID NO: 3751951 - DNA, 12 bp, Homo sapiens
gttctctgagga

SEQ ID NO: 3751952 - DNA, 16 bp, Homo sapiens
gttctctgaggacact

SEQ ID NO: 3751953 - DNA, 16 bp, Homo sapiens
gttctgacattaacag

SEQ ID NO: 3751954 - DNA, 13 bp, Homo sapiens
gttctgattagaa

SEQ ID NO: 3751955 - DNA, 18 bp, Homo sapiens
gttctgcaaatagaaaac

SEQ ID NO: 3751956 - DNA, 19 bp, Homo sapiens
gttctgcaaatagaaaaca

SEQ ID NO: 3751957 - DNA, 23 bp, Homo sapiens
gttctggccctcacccctgccct

SEQ ID NO: 3751958 - DNA, 11 bp, Homo sapiens
gttctgggaca

SEQ ID NO: 3751959 - DNA, 13 bp, Homo sapiens
gttctgtgtattt

SEQ ID NO: 3751960 - DNA, 18 bp, Homo sapiens
gttcttagatatcttttt

SEQ ID NO: 3751961 - DNA, 14 bp, Homo sapiens
gttcttcgaggtgg

SEQ ID NO: 3751962 - DNA, 16 bp, Homo sapiens
gttcttgttctgtttt

SEQ ID NO: 3751963 - DNA, 12 bp, Homo sapiens
gttctttcagaa

SEQ ID NO: 3751964 - DNA, 16 bp, Homo sapiens
gttctttcttcctctg

SEQ ID NO: 3751965 - DNA, 17 bp, Homo sapiens
gttctttcttcctctgc

SEQ ID NO: 3751966 - DNA, 13 bp, Homo sapiens
gttcttttaaagg

SEQ ID NO: 3751967 - DNA, 17 bp, Homo sapiens
gttgaaaaacagctgag

SEQ ID NO: 3751968 - DNA, 14 bp, Homo sapiens
gttgaaaagccatg

SEQ ID NO: 3751969 - DNA, 15 bp, Homo sapiens
gttgaaagagtccta

SEQ ID NO: 3751970 - DNA, 15 bp, Homo sapiens
gttgaagaggaaggg

SEQ ID NO: 3751971 - DNA, 15 bp, Homo sapiens
gttgacacggccatg

SEQ ID NO: 3751972 - DNA, 20 bp, Homo sapiens
gttgacttgacagaacactg

SEQ ID NO: 3751973 - DNA, 17 bp, Homo sapiens
gttgagggaacagacag

SEQ ID NO: 3751974 - DNA, 22 bp, Homo sapiens
gttgagggaacagacaggagaa

SEQ ID NO: 3751975 - DNA, 17 bp, Homo sapiens
gttgaggggctcctgga

SEQ ID NO: 3751976 - DNA, 18 bp, Homo sapiens
gttgaggggctcctggaa

SEQ ID NO: 3751977 - DNA, 18 bp, Homo sapiens
gttgataaattccactgg

SEQ ID NO: 3751978 - DNA, 20 bp, Homo sapiens
gttgatcactggcaatgaaa

SEQ ID NO: 3751979 - DNA, 23 bp, Homo sapiens
gttgcaaggccgctgttcaccca

SEQ ID NO: 3751980 - DNA, 17 bp, Homo sapiens
gttgccaaacagccaca

SEQ ID NO: 3751981 - DNA, 12 bp, Homo sapiens
gttgcccaggct

SEQ ID NO: 3751982 - DNA, 13 bp, Homo sapiens
gttgcccaggctg

SEQ ID NO: 3751983 - DNA, 14 bp, Homo sapiens
gttgcccaggctgg

SEQ ID NO: 3751984 - DNA, 17 bp, Homo sapiens
gttgcccaggctggcgt

SEQ ID NO: 3751985 - DNA, 21 bp, Homo sapiens
gttgcccaggctggcgtgcag

SEQ ID NO: 3751986 - DNA, 17 bp, Homo sapiens
gttgcgacggagagaaa

SEQ ID NO: 3751987 - DNA, 20 bp, Homo sapiens
gttgcgacggagagaaaaaa

SEQ ID NO: 3751988 - DNA, 15 bp, Homo sapiens
gttggaaaagaatac

SEQ ID NO: 3751989 - DNA, 19 bp, Homo sapiens
gttggacagcaaaaccatt

SEQ ID NO: 3751990 - DNA, 17 bp, Homo sapiens
gttggacttttcgttaa

SEQ ID NO: 3751991 - DNA, 14 bp, Homo sapiens
gttggccaggctgg

SEQ ID NO: 3751992 - DNA, 15 bp, Homo sapiens
gttggccaggctggt

SEQ ID NO: 3751993 - DNA, 13 bp, Homo sapiens
gttggcctgcact

SEQ ID NO: 3751994 - DNA, 13 bp, Homo sapiens
gttggctgggccc

SEQ ID NO: 3751995 - DNA, 16 bp, Homo sapiens
gttggctgggcccaga

SEQ ID NO: 3751996 - DNA, 23 bp, Homo sapiens
gttggctgggggcctcagtgcca

SEQ ID NO: 3751997 - DNA, 11 bp, Homo sapiens
gttggctgggt

SEQ ID NO: 3751998 - DNA, 13 bp, Homo sapiens
gttggcttctgtt

SEQ ID NO: 3751999 - DNA, 14 bp, Homo sapiens
gttgggaggattct

SEQ ID NO: 3752000 - DNA, 15 bp, Homo sapiens
gttgggcccagatct

SEQ ID NO: 3752001 - DNA, 13 bp, Homo sapiens
gttgggctggtgt

SEQ ID NO: 3752002 - DNA, 15 bp, Homo sapiens
gttgggctggtgtca

SEQ ID NO: 3752003 - DNA, 13 bp, Homo sapiens
gttgggtggatgc

SEQ ID NO: 3752004 - DNA, 15 bp, Homo sapiens
gttggtgttgcagaa

SEQ ID NO: 3752005 - DNA, 17 bp, Homo sapiens
gttgtcaagtctctgct

SEQ ID NO: 3752006 - DNA, 19 bp, Homo sapiens
gttgtggaaagcctctgct

SEQ ID NO: 3752007 - DNA, 21 bp, Homo sapiens
gttgtgtaagagaatgttgaa

SEQ ID NO: 3752008 - DNA, 16 bp, Homo sapiens
gttgtgtacgtggaga

SEQ ID NO: 3752009 - DNA, 16 bp, Homo sapiens
gttgttaatgaaaatg

SEQ ID NO: 3752010 - DNA, 16 bp, Homo sapiens
gttgtttaacataaat

SEQ ID NO: 3752011 - DNA, 13 bp, Homo sapiens
gttgtttcttcca

SEQ ID NO: 3752012 - DNA, 13 bp, Homo sapiens
gttgtttgaaaat

SEQ ID NO: 3752013 - DNA, 15 bp, Homo sapiens
gttgtttgtaaataa

SEQ ID NO: 3752014 - DNA, 12 bp, Homo sapiens
gtttaaactgat

SEQ ID NO: 3752015 - DNA, 21 bp, Homo sapiens
gtttaaagttctgtgtattta

SEQ ID NO: 3752016 - DNA, 12 bp, Homo sapiens
gtttaacataaa

SEQ ID NO: 3752017 - DNA, 23 bp, Homo sapiens
gtttaagatttaatttgccaaaa

SEQ ID NO: 3752018 - DNA, 17 bp, Homo sapiens
gtttacaggtggacaca

SEQ ID NO: 3752019 - DNA, 13 bp, Homo sapiens
gtttaccatttgt

SEQ ID NO: 3752020 - DNA, 16 bp, Homo sapiens
gtttaccatttgtaat

SEQ ID NO: 3752021 - DNA, 16 bp, Homo sapiens
gtttacttgtttcaga

SEQ ID NO: 3752022 - DNA, 16 bp, Homo sapiens
gtttagtgtaaaaatg

SEQ ID NO: 3752023 - DNA, 14 bp, Homo sapiens
gtttatggcctcag

SEQ ID NO: 3752024 - DNA, 22 bp, Homo sapiens
gtttatggcctcagctgcctca

SEQ ID NO: 3752025 - DNA, 16 bp, Homo sapiens
gtttattacttatttg

SEQ ID NO: 3752026 - DNA, 19 bp, Homo sapiens
gtttatttatcagtgacag

SEQ ID NO: 3752027 - DNA, 13 bp, Homo sapiens
gtttcagacaggg

SEQ ID NO: 3752028 - DNA, 22 bp, Homo sapiens
gtttcagacagggtctgaagga

SEQ ID NO: 3752029 - DNA, 17 bp, Homo sapiens
gtttcagtaataaaaca

SEQ ID NO: 3752030 - DNA, 18 bp, Homo sapiens
gtttcatttatgatacaa

SEQ ID NO: 3752031 - DNA, 15 bp, Homo sapiens
gtttccaaggagctg

SEQ ID NO: 3752032 - DNA, 18 bp, Homo sapiens
gtttccattttttgttcc

SEQ ID NO: 3752033 - DNA, 17 bp, Homo sapiens
gtttccccaccagtgaa

SEQ ID NO: 3752034 - DNA, 16 bp, Homo sapiens
gtttcctaaaagttca

SEQ ID NO: 3752035 - DNA, 19 bp, Homo sapiens
gtttcctcaggctgctgga

SEQ ID NO: 3752036 - DNA, 20 bp, Homo sapiens
gtttcctcattcctgaaaga

SEQ ID NO: 3752037 - DNA, 21 bp, Homo sapiens
gtttctagcatgaagacagag

SEQ ID NO: 3752038 - DNA, 15 bp, Homo sapiens
gtttctagggaaatg

SEQ ID NO: 3752039 - DNA, 14 bp, Homo sapiens
gtttctcccagttc

SEQ ID NO: 3752040 - DNA, 22 bp, Homo sapiens
gtttctccccctgggctctgcc

SEQ ID NO: 3752041 - DNA, 21 bp, Homo sapiens
gtttctgaaaattaacactgc

SEQ ID NO: 3752042 - DNA, 19 bp, Homo sapiens
gtttctgattaatgctaaa

SEQ ID NO: 3752043 - DNA, 11 bp, Homo sapiens
gtttcttccaa

SEQ ID NO: 3752044 - DNA, 17 bp, Homo sapiens
gtttgagatcagcctgg

SEQ ID NO: 3752045 - DNA, 18 bp, Homo sapiens
gtttgagatcagcctggg

SEQ ID NO: 3752046 - DNA, 17 bp, Homo sapiens
gtttgcaaggaagccac

SEQ ID NO: 3752047 - DNA, 16 bp, Homo sapiens
gtttgcctctgcctct

SEQ ID NO: 3752048 - DNA, 17 bp, Homo sapiens
gtttgcctctgcctctg

SEQ ID NO: 3752049 - DNA, 20 bp, Homo sapiens
gtttgctttgtatgcacttt

SEQ ID NO: 3752050 - DNA, 21 bp, Homo sapiens
gtttggcgggccaaggactgc

SEQ ID NO: 3752051 - DNA, 20 bp, Homo sapiens
gtttggggagcagagacact

SEQ ID NO: 3752052 - DNA, 18 bp, Homo sapiens
gtttggggatgagaaagg

SEQ ID NO: 3752053 - DNA, 18 bp, Homo sapiens
gtttgtctgtcttcatag

SEQ ID NO: 3752054 - DNA, 13 bp, Homo sapiens
gtttgtggctggg

SEQ ID NO: 3752055 - DNA, 18 bp, Homo sapiens
gtttgtttctccccctgg

SEQ ID NO: 3752056 - DNA, 14 bp, Homo sapiens
gtttgtttgtattt

SEQ ID NO: 3752057 - DNA, 15 bp, Homo sapiens
gtttgtttgttttgt

SEQ ID NO: 3752058 - DNA, 14 bp, Homo sapiens
gttttaaaattaaa

SEQ ID NO: 3752059 - DNA, 19 bp, Homo sapiens
gttttaaggaagaaaaatc

SEQ ID NO: 3752060 - DNA, 15 bp, Homo sapiens
gttttactgcagctt

SEQ ID NO: 3752061 - DNA, 16 bp, Homo sapiens
gttttactgcagcttt

SEQ ID NO: 3752062 - DNA, 13 bp, Homo sapiens
gttttagaatgat

SEQ ID NO: 3752063 - DNA, 11 bp, Homo sapiens
gttttatgata

SEQ ID NO: 3752064 - DNA, 17 bp, Homo sapiens
gttttcaaaataaaaat

SEQ ID NO: 3752065 - DNA, 20 bp, Homo sapiens
gttttcagaacctcttcccc

SEQ ID NO: 3752066 - DNA, 14 bp, Homo sapiens
gttttcagactcag

SEQ ID NO: 3752067 - DNA, 16 bp, Homo sapiens
gttttcagtgtacatg

SEQ ID NO: 3752068 - DNA, 22 bp, Homo sapiens
gttttcataataaaactttaaa

SEQ ID NO: 3752069 - DNA, 16 bp, Homo sapiens
gttttccaccctggaa

SEQ ID NO: 3752070 - DNA, 13 bp, Homo sapiens
gttttccatgaaa

SEQ ID NO: 3752071 - DNA, 17 bp, Homo sapiens
gttttcgaagctcagcc

SEQ ID NO: 3752072 - DNA, 19 bp, Homo sapiens
gttttcgaagctcagccca

SEQ ID NO: 3752073 - DNA, 16 bp, Homo sapiens
gttttctcctcccagg

SEQ ID NO: 3752074 - DNA, 18 bp, Homo sapiens
gttttctcctcccaggaa

SEQ ID NO: 3752075 - DNA, 21 bp, Homo sapiens
gttttctcctcccaggaactg

SEQ ID NO: 3752076 - DNA, 19 bp, Homo sapiens
gttttctcctgcctgtgct

SEQ ID NO: 3752077 - DNA, 15 bp, Homo sapiens
gttttcttcccatca

SEQ ID NO: 3752078 - DNA, 12 bp, Homo sapiens
gttttcttcctt

SEQ ID NO: 3752079 - DNA, 23 bp, Homo sapiens
gttttgaactaataaaagcataa

SEQ ID NO: 3752080 - DNA, 22 bp, Homo sapiens
gttttgatgtttgtggcctcag

SEQ ID NO: 3752081 - DNA, 16 bp, Homo sapiens
gttttggaagctctga

SEQ ID NO: 3752082 - DNA, 18 bp, Homo sapiens
gttttgtaggtacttttg

SEQ ID NO: 3752083 - DNA, 15 bp, Homo sapiens
gttttgtgttttttt

SEQ ID NO: 3752084 - DNA, 15 bp, Homo sapiens
gtttttaaatatatt

SEQ ID NO: 3752085 - DNA, 15 bp, Homo sapiens
gtttttaactcaata

SEQ ID NO: 3752086 - DNA, 18 bp, Homo sapiens
gtttttatggggctgaac

SEQ ID NO: 3752087 - DNA, 15 bp, Homo sapiens
gtttttccactactg

SEQ ID NO: 3752088 - DNA, 18 bp, Homo sapiens
gtttttctaggcctgggg

SEQ ID NO: 3752089 - DNA, 12 bp, Homo sapiens
gtttttcttcaa

SEQ ID NO: 3752090 - DNA, 22 bp, Homo sapiens
gtttttcttcaacatcaatgtt

SEQ ID NO: 3752091 - DNA, 13 bp, Homo sapiens
gtttttgggatgt

SEQ ID NO: 3752092 - DNA, 15 bp, Homo sapiens
gtttttgttaacttt

SEQ ID NO: 3752093 - DNA, 20 bp, Homo sapiens
gtttttttttcctgtccttc

SEQ ID NO: 3752094 - DNA, 19 bp, Homo sapiens
taaaaaaaatccttctaat

SEQ ID NO: 3752095 - DNA, 18 bp, Homo sapiens
taaaaaagtctctattta

SEQ ID NO: 3752096 - DNA, 19 bp, Homo sapiens
taaaaaagtctctatttaa

SEQ ID NO: 3752097 - DNA, 20 bp, Homo sapiens
taaaaaagtttaaaatgtat

SEQ ID NO: 3752098 - DNA, 16 bp, Homo sapiens
taaaaacagcattgct

SEQ ID NO: 3752099 - DNA, 19 bp, Homo sapiens
taaaaacagcattgctttc

SEQ ID NO: 3752100 - DNA, 20 bp, Homo sapiens
taaaaacagcattgctttct

SEQ ID NO: 3752101 - DNA, 17 bp, Homo sapiens
taaaaactgactcctta

SEQ ID NO: 3752102 - DNA, 15 bp, Homo sapiens
taaaaagtggaaaaa

SEQ ID NO: 3752103 - DNA, 17 bp, Homo sapiens
taaaaatcataaactgt

SEQ ID NO: 3752104 - DNA, 13 bp, Homo sapiens
taaaaatgagaac

SEQ ID NO: 3752105 - DNA, 22 bp, Homo sapiens
taaaaatgaggtactctcctgg

SEQ ID NO: 3752106 - DNA, 15 bp, Homo sapiens
taaaaatggacaaaa

SEQ ID NO: 3752107 - DNA, 23 bp, Homo sapiens
taaaaattgtttcaaaataaaaa

SEQ ID NO: 3752108 - DNA, 12 bp, Homo sapiens
taaaacaaaaaa

SEQ ID NO: 3752109 - DNA, 18 bp, Homo sapiens
taaaacaagaaagtttcc

SEQ ID NO: 3752110 - DNA, 16 bp, Homo sapiens
taaaacaatgtcaagg

SEQ ID NO: 3752111 - DNA, 18 bp, Homo sapiens
taaaacattttcacacaa

SEQ ID NO: 3752112 - DNA, 11 bp, Homo sapiens
taaaacctttc

SEQ ID NO: 3752113 - DNA, 16 bp, Homo sapiens
taaaactggcatctga

SEQ ID NO: 3752114 - DNA, 22 bp, Homo sapiens
taaaagaaatctctagctcaga

SEQ ID NO: 3752115 - DNA, 21 bp, Homo sapiens
taaaagaaatgcacaatgtct

SEQ ID NO: 3752116 - DNA, 23 bp, Homo sapiens
taaaagaaatgcacaatgtcttg

SEQ ID NO: 3752117 - DNA, 21 bp, Homo sapiens
taaaagatacatttgtatgtt

SEQ ID NO: 3752118 - DNA, 18 bp, Homo sapiens
taaaagcataaatgcaaa

SEQ ID NO: 3752119 - DNA, 13 bp, Homo sapiens
taaaataaagtat

SEQ ID NO: 3752120 - DNA, 16 bp, Homo sapiens
taaaatataattgttt

SEQ ID NO: 3752121 - DNA, 19 bp, Homo sapiens
taaaatatatatgttgatt

SEQ ID NO: 3752122 - DNA, 17 bp, Homo sapiens
taaaatatcattcagca

SEQ ID NO: 3752123 - DNA, 13 bp, Homo sapiens
taaaatattcctg

SEQ ID NO: 3752124 - DNA, 23 bp, Homo sapiens
taaaatattgttgaacacttgaa

SEQ ID NO: 3752125 - DNA, 18 bp, Homo sapiens
taaaatcatgtacatttc

SEQ ID NO: 3752126 - DNA, 19 bp, Homo sapiens
taaaatcatgtacatttct

SEQ ID NO: 3752127 - DNA, 20 bp, Homo sapiens
taaaatcttggcacagaaac

SEQ ID NO: 3752128 - DNA, 16 bp, Homo sapiens
taaaatgtataagttg

SEQ ID NO: 3752129 - DNA, 13 bp, Homo sapiens
taaaattaaagaa

SEQ ID NO: 3752130 - DNA, 14 bp, Homo sapiens
taaaattaaagaaa

SEQ ID NO: 3752131 - DNA, 14 bp, Homo sapiens
taaaattaagaatg

SEQ ID NO: 3752132 - DNA, 21 bp, Homo sapiens
taaaattgcatgggttttgta

SEQ ID NO: 3752133 - DNA, 23 bp, Homo sapiens
taaaatttattgcttgatacttt

SEQ ID NO: 3752134 - DNA, 19 bp, Homo sapiens
taaaattttgcctaataca

SEQ ID NO: 3752135 - DNA, 22 bp, Homo sapiens
taaacaaactgtgtaactgccc

SEQ ID NO: 3752136 - DNA, 13 bp, Homo sapiens
taaacaaaggttg

SEQ ID NO: 3752137 - DNA, 16 bp, Homo sapiens
taaacacatagattca

SEQ ID NO: 3752138 - DNA, 18 bp, Homo sapiens
taaacagcttcatgcctt

SEQ ID NO: 3752139 - DNA, 15 bp, Homo sapiens
taaacataattcttg

SEQ ID NO: 3752140 - DNA, 15 bp, Homo sapiens
taaacatcacacaca

SEQ ID NO: 3752141 - DNA, 13 bp, Homo sapiens
taaacattagttc

SEQ ID NO: 3752142 - DNA, 23 bp, Homo sapiens
taaacattagttctatttctatc

SEQ ID NO: 3752143 - DNA, 23 bp, Homo sapiens
taaactaatgagtttcttttata

SEQ ID NO: 3752144 - DNA, 17 bp, Homo sapiens
taaactattggaaagta

SEQ ID NO: 3752145 - DNA, 19 bp, Homo sapiens
taaactcaaaatatttgta

SEQ ID NO: 3752146 - DNA, 16 bp, Homo sapiens
taaactgcattagaaa

SEQ ID NO: 3752147 - DNA, 16 bp, Homo sapiens
taaactgccctgtcta

SEQ ID NO: 3752148 - DNA, 20 bp, Homo sapiens
taaactgtactagtctgtgt

SEQ ID NO: 3752149 - DNA, 16 bp, Homo sapiens
taaactttaatatgta

SEQ ID NO: 3752150 - DNA, 17 bp, Homo sapiens
taaactttaatatgtat

SEQ ID NO: 3752151 - DNA, 21 bp, Homo sapiens
taaactttcaatatctttatt

SEQ ID NO: 3752152 - DNA, 14 bp, Homo sapiens
taaacttttagaaa

SEQ ID NO: 3752153 - DNA, 13 bp, Homo sapiens
taaagaaaataaa

SEQ ID NO: 3752154 - DNA, 16 bp, Homo sapiens
taaagaaaataaaatt

SEQ ID NO: 3752155 - DNA, 19 bp, Homo sapiens
taaagaacaccctatattt

SEQ ID NO: 3752156 - DNA, 14 bp, Homo sapiens
taaagacaaaaaac

SEQ ID NO: 3752157 - DNA, 11 bp, Homo sapiens
taaagacaaag

SEQ ID NO: 3752158 - DNA, 19 bp, Homo sapiens
taaagacaaagacaaattc

SEQ ID NO: 3752159 - DNA, 22 bp, Homo sapiens
taaagacaaagacaaattctgt

SEQ ID NO: 3752160 - DNA, 15 bp, Homo sapiens
taaagagaaaattga

SEQ ID NO: 3752161 - DNA, 19 bp, Homo sapiens
taaagagaaaattgaattt

SEQ ID NO: 3752162 - DNA, 20 bp, Homo sapiens
taaagagaaaattgaattta

SEQ ID NO: 3752163 - DNA, 13 bp, Homo sapiens
taaagagaaactt

SEQ ID NO: 3752164 - DNA, 18 bp, Homo sapiens
taaagagttagtttgagt

SEQ ID NO: 3752165 - DNA, 12 bp, Homo sapiens
taaagagttctt

SEQ ID NO: 3752166 - DNA, 16 bp, Homo sapiens
taaagatattattcac

SEQ ID NO: 3752167 - DNA, 20 bp, Homo sapiens
taaagcagagggactttgta

SEQ ID NO: 3752168 - DNA, 19 bp, Homo sapiens
taaagcaggccttttgata

SEQ ID NO: 3752169 - DNA, 20 bp, Homo sapiens
taaagcaggccttttgatat

SEQ ID NO: 3752170 - DNA, 14 bp, Homo sapiens
taaagcatctaaac

SEQ ID NO: 3752171 - DNA, 20 bp, Homo sapiens
taaaggcctcttccttgctg

SEQ ID NO: 3752172 - DNA, 15 bp, Homo sapiens
taaaggggggagggg

SEQ ID NO: 3752173 - DNA, 17 bp, Homo sapiens
taaaggtggtatgtgtg

SEQ ID NO: 3752174 - DNA, 15 bp, Homo sapiens
taaagtattccacct

SEQ ID NO: 3752175 - DNA, 20 bp, Homo sapiens
taaagtattccaccttaaat

SEQ ID NO: 3752176 - DNA, 21 bp, Homo sapiens
taaagtattccaccttaaatt

SEQ ID NO: 3752177 - DNA, 23 bp, Homo sapiens
taaagtattccaccttaaattaa

SEQ ID NO: 3752178 - DNA, 15 bp, Homo sapiens
taaagtcttgctgtg

SEQ ID NO: 3752179 - DNA, 16 bp, Homo sapiens
taaagtgataatttct

SEQ ID NO: 3752180 - DNA, 22 bp, Homo sapiens
taaagtgtaaatcctttttctt

SEQ ID NO: 3752181 - DNA, 16 bp, Homo sapiens
taaagtgtaacatatg

SEQ ID NO: 3752182 - DNA, 13 bp, Homo sapiens
taaagtgttttca

SEQ ID NO: 3752183 - DNA, 14 bp, Homo sapiens
taaagtgttttcag

SEQ ID NO: 3752184 - DNA, 16 bp, Homo sapiens
taaagtgttttcagag

SEQ ID NO: 3752185 - DNA, 18 bp, Homo sapiens
taaagttaaacattttta

SEQ ID NO: 3752186 - DNA, 13 bp, Homo sapiens
taaagttacattg

SEQ ID NO: 3752187 - DNA, 23 bp, Homo sapiens
taaagttctgtgtatttaattgt

SEQ ID NO: 3752188 - DNA, 13 bp, Homo sapiens
taaagtttctgtt

SEQ ID NO: 3752189 - DNA, 22 bp, Homo sapiens
taaataaaaaataataatacaa

SEQ ID NO: 3752190 - DNA, 22 bp, Homo sapiens
taaataaaacattttcacacaa

SEQ ID NO: 3752191 - DNA, 19 bp, Homo sapiens
taaataaaagtgatcaata

SEQ ID NO: 3752192 - DNA, 12 bp, Homo sapiens
taaataaaataa

SEQ ID NO: 3752193 - DNA, 22 bp, Homo sapiens
taaataaatgtatcttattcac

SEQ ID NO: 3752194 - DNA, 11 bp, Homo sapiens
taaataagaga

SEQ ID NO: 3752195 - DNA, 15 bp, Homo sapiens
taaataagagatttg

SEQ ID NO: 3752196 - DNA, 15 bp, Homo sapiens
taaatagctatatcc

SEQ ID NO: 3752197 - DNA, 17 bp, Homo sapiens
taaatagctatatccat

SEQ ID NO: 3752198 - DNA, 19 bp, Homo sapiens
taaatatatgtatgtaaaa

SEQ ID NO: 3752199 - DNA, 15 bp, Homo sapiens
taaatatattttcaa

SEQ ID NO: 3752200 - DNA, 14 bp, Homo sapiens
taaatatcaatcat

SEQ ID NO: 3752201 - DNA, 10 bp, Homo sapiens
taaatattta

SEQ ID NO: 3752202 - DNA, 16 bp, Homo sapiens
taaatatttatgtaga

SEQ ID NO: 3752203 - DNA, 17 bp, Homo sapiens
taaatatttatgtagat

SEQ ID NO: 3752204 - DNA, 12 bp, Homo sapiens
taaatatttcct

SEQ ID NO: 3752205 - DNA, 14 bp, Homo sapiens
taaatatttcctta

SEQ ID NO: 3752206 - DNA, 15 bp, Homo sapiens
taaatcacacatgct

SEQ ID NO: 3752207 - DNA, 16 bp, Homo sapiens
taaatcctgttgaaaa

SEQ ID NO: 3752208 - DNA, 17 bp, Homo sapiens
taaatcctttttcttta

SEQ ID NO: 3752209 - DNA, 16 bp, Homo sapiens
taaatctgtaagctct

SEQ ID NO: 3752210 - DNA, 18 bp, Homo sapiens
taaatctgtaagctcttt

SEQ ID NO: 3752211 - DNA, 21 bp, Homo sapiens
taaatgaagtaacttgtctta

SEQ ID NO: 3752212 - DNA, 22 bp, Homo sapiens
taaatgaagtaacttgtcttaa

SEQ ID NO: 3752213 - DNA, 18 bp, Homo sapiens
taaatgaagtttatacag

SEQ ID NO: 3752214 - DNA, 20 bp, Homo sapiens
taaatgaagtttatacagta

SEQ ID NO: 3752215 - DNA, 14 bp, Homo sapiens
taaatgatgttgaa

SEQ ID NO: 3752216 - DNA, 14 bp, Homo sapiens
taaatgcaatatgt

SEQ ID NO: 3752217 - DNA, 16 bp, Homo sapiens
taaatgcataaatgca

SEQ ID NO: 3752218 - DNA, 21 bp, Homo sapiens
taaatgcatatcctgagccat

SEQ ID NO: 3752219 - DNA, 12 bp, Homo sapiens
taaatgccctgc

SEQ ID NO: 3752220 - DNA, 22 bp, Homo sapiens
taaatgggactggagtccctgt

SEQ ID NO: 3752221 - DNA, 14 bp, Homo sapiens
taaatgtccctaat

SEQ ID NO: 3752222 - DNA, 22 bp, Homo sapiens
taaatgtctctttaatgtcaca

SEQ ID NO: 3752223 - DNA, 12 bp, Homo sapiens
taaattaaacaa

SEQ ID NO: 3752224 - DNA, 16 bp, Homo sapiens
taaattaaacaattta

SEQ ID NO: 3752225 - DNA, 22 bp, Homo sapiens
taaattaccagtaaagtgtaac

SEQ ID NO: 3752226 - DNA, 18 bp, Homo sapiens
taaattagtatttattta

SEQ ID NO: 3752227 - DNA, 15 bp, Homo sapiens
taaattataaggact

SEQ ID NO: 3752228 - DNA, 20 bp, Homo sapiens
taaattataaggactgcatg

SEQ ID NO: 3752229 - DNA, 12 bp, Homo sapiens
taaattattcag

SEQ ID NO: 3752230 - DNA, 20 bp, Homo sapiens
taaattcaaccactgtaaaa

SEQ ID NO: 3752231 - DNA, 18 bp, Homo sapiens
taaattcagatatatttt

SEQ ID NO: 3752232 - DNA, 16 bp, Homo sapiens
taaattccactggact

SEQ ID NO: 3752233 - DNA, 15 bp, Homo sapiens
taaattcttttttaa

SEQ ID NO: 3752234 - DNA, 17 bp, Homo sapiens
taaatttatttcaaaaa

SEQ ID NO: 3752235 - DNA, 16 bp, Homo sapiens
taaattttcttcagtt

SEQ ID NO: 3752236 - DNA, 18 bp, Homo sapiens
taacaaaaactacacata

SEQ ID NO: 3752237 - DNA, 20 bp, Homo sapiens
taacaaaatcacttccatag

SEQ ID NO: 3752238 - DNA, 20 bp, Homo sapiens
taacaaaccctcgtttctga

SEQ ID NO: 3752239 - DNA, 21 bp, Homo sapiens
taacaaaccctcgtttctgat

SEQ ID NO: 3752240 - DNA, 15 bp, Homo sapiens
taacaagaaaacata

SEQ ID NO: 3752241 - DNA, 14 bp, Homo sapiens
taacaagagtgatt

SEQ ID NO: 3752242 - DNA, 18 bp, Homo sapiens
taacaagatctttcagga

SEQ ID NO: 3752243 - DNA, 13 bp, Homo sapiens
taacaagccaccc

SEQ ID NO: 3752244 - DNA, 18 bp, Homo sapiens
taacaaggaatgcctgtg

SEQ ID NO: 3752245 - DNA, 20 bp, Homo sapiens
taacaaggaatgcctgtgcc

SEQ ID NO: 3752246 - DNA, 21 bp, Homo sapiens
taacaaggaatgcctgtgcca

SEQ ID NO: 3752247 - DNA, 17 bp, Homo sapiens
taacaataactactgtg

SEQ ID NO: 3752248 - DNA, 17 bp, Homo sapiens
taacaatgcgaatggta

SEQ ID NO: 3752249 - DNA, 17 bp, Homo sapiens
taacacagcatgtgtat

SEQ ID NO: 3752250 - DNA, 17 bp, Homo sapiens
taacacatttgattctg

SEQ ID NO: 3752251 - DNA, 18 bp, Homo sapiens
taacagataagcaagaga

SEQ ID NO: 3752252 - DNA, 12 bp, Homo sapiens
taacagatgcaa

SEQ ID NO: 3752253 - DNA, 22 bp, Homo sapiens
taacaggctcaatattcctgaa

SEQ ID NO: 3752254 - DNA, 23 bp, Homo sapiens
taacaggctcaatattcctgaat

SEQ ID NO: 3752255 - DNA, 14 bp, Homo sapiens
taacaggggctggt

SEQ ID NO: 3752256 - DNA, 18 bp, Homo sapiens
taacagggtaaattattc

SEQ ID NO: 3752257 - DNA, 19 bp, Homo sapiens
taacagggtaaattattca

SEQ ID NO: 3752258 - DNA, 14 bp, Homo sapiens
taacaggtctcctc

SEQ ID NO: 3752259 - DNA, 15 bp, Homo sapiens
taacaggtctcctct

SEQ ID NO: 3752260 - DNA, 19 bp, Homo sapiens
taacagtcttactgcaggc

SEQ ID NO: 3752261 - DNA, 17 bp, Homo sapiens
taacagtgccattgtct

SEQ ID NO: 3752262 - DNA, 18 bp, Homo sapiens
taacagtgccattgtctt

SEQ ID NO: 3752263 - DNA, 21 bp, Homo sapiens
taacagtgccattgtctttat

SEQ ID NO: 3752264 - DNA, 21 bp, Homo sapiens
taacagttcacttgcagtgga

SEQ ID NO: 3752265 - DNA, 21 bp, Homo sapiens
taacagttttccatgaaaacg

SEQ ID NO: 3752266 - DNA, 16 bp, Homo sapiens
taacataatttgtaca

SEQ ID NO: 3752267 - DNA, 18 bp, Homo sapiens
taacatggaagggaagaa

SEQ ID NO: 3752268 - DNA, 23 bp, Homo sapiens
taacatggacatgatcttcttta

SEQ ID NO: 3752269 - DNA, 18 bp, Homo sapiens
taacatggtgtgcttctt

SEQ ID NO: 3752270 - DNA, 17 bp, Homo sapiens
taacatgtaattaagta

SEQ ID NO: 3752271 - DNA, 20 bp, Homo sapiens
taacattgaccaagaactgc

SEQ ID NO: 3752272 - DNA, 23 bp, Homo sapiens
taacattgaccaagaactgcatg

SEQ ID NO: 3752273 - DNA, 22 bp, Homo sapiens
taaccaaatgcatcaatcctgt

SEQ ID NO: 3752274 - DNA, 12 bp, Homo sapiens
taaccaatgttt

SEQ ID NO: 3752275 - DNA, 17 bp, Homo sapiens
taaccaatgtttaaaaa

SEQ ID NO: 3752276 - DNA, 22 bp, Homo sapiens
taaccaatgtttaaaaaagttt

SEQ ID NO: 3752277 - DNA, 13 bp, Homo sapiens
taaccactgcttc

SEQ ID NO: 3752278 - DNA, 21 bp, Homo sapiens
taaccagtctgaagtttcatt

SEQ ID NO: 3752279 - DNA, 17 bp, Homo sapiens
taaccccattctttgct

SEQ ID NO: 3752280 - DNA, 13 bp, Homo sapiens
taacccctttcct

SEQ ID NO: 3752281 - DNA, 17 bp, Homo sapiens
taacctcttttctgcat

SEQ ID NO: 3752282 - DNA, 18 bp, Homo sapiens
taacctgagatggccctc

SEQ ID NO: 3752283 - DNA, 22 bp, Homo sapiens
taacctgagatggccctctggt

SEQ ID NO: 3752284 - DNA, 15 bp, Homo sapiens
taacctggtgctgga

SEQ ID NO: 3752285 - DNA, 14 bp, Homo sapiens
taacgacttcaggg

SEQ ID NO: 3752286 - DNA, 14 bp, Homo sapiens
taactaaaaggtat

SEQ ID NO: 3752287 - DNA, 15 bp, Homo sapiens
taactaaaaggtatg

SEQ ID NO: 3752288 - DNA, 16 bp, Homo sapiens
taactaaattaacatt

SEQ ID NO: 3752289 - DNA, 14 bp, Homo sapiens
taactactgtgttc

SEQ ID NO: 3752290 - DNA, 17 bp, Homo sapiens
taactactgtgttcctg

SEQ ID NO: 3752291 - DNA, 17 bp, Homo sapiens
taactagaatttattca

SEQ ID NO: 3752292 - DNA, 18 bp, Homo sapiens
taactagaatttattcaa

SEQ ID NO: 3752293 - DNA, 16 bp, Homo sapiens
taactatgttgataaa

SEQ ID NO: 3752294 - DNA, 19 bp, Homo sapiens
taactattttattttctaa

SEQ ID NO: 3752295 - DNA, 14 bp, Homo sapiens
taactcaatatttt

SEQ ID NO: 3752296 - DNA, 17 bp, Homo sapiens
taactcaggactccagc

SEQ ID NO: 3752297 - DNA, 18 bp, Homo sapiens
taactcaggactccagcc

SEQ ID NO: 3752298 - DNA, 16 bp, Homo sapiens
taactcatcataaaat

SEQ ID NO: 3752299 - DNA, 16 bp, Homo sapiens
taactccaccaaccca

SEQ ID NO: 3752300 - DNA, 14 bp, Homo sapiens
taactccagtgaag

SEQ ID NO: 3752301 - DNA, 13 bp, Homo sapiens
taactctttggat

SEQ ID NO: 3752302 - DNA, 14 bp, Homo sapiens
taactgaaggagaa

SEQ ID NO: 3752303 - DNA, 16 bp, Homo sapiens
taactgacaaatcaag

SEQ ID NO: 3752304 - DNA, 17 bp, Homo sapiens
taactgacaaatcaagt

SEQ ID NO: 3752305 - DNA, 19 bp, Homo sapiens
taactgacaaatcaagttt

SEQ ID NO: 3752306 - DNA, 17 bp, Homo sapiens
taactgcattgagaact

SEQ ID NO: 3752307 - DNA, 22 bp, Homo sapiens
taactggaagcatgtaggagaa

SEQ ID NO: 3752308 - DNA, 13 bp, Homo sapiens
taactgtgtatgt

SEQ ID NO: 3752309 - DNA, 18 bp, Homo sapiens
taactgtgtatgtacata

SEQ ID NO: 3752310 - DNA, 20 bp, Homo sapiens
taactgtgtatgtacatata

SEQ ID NO: 3752311 - DNA, 15 bp, Homo sapiens
taactgtgtcatttg

SEQ ID NO: 3752312 - DNA, 16 bp, Homo sapiens
taacttaaaatatttt

SEQ ID NO: 3752313 - DNA, 16 bp, Homo sapiens
taacttaatagtattt

SEQ ID NO: 3752314 - DNA, 15 bp, Homo sapiens
taacttagcatgtgt

SEQ ID NO: 3752315 - DNA, 17 bp, Homo sapiens
taacttccaatttacat

SEQ ID NO: 3752316 - DNA, 20 bp, Homo sapiens
taacttccctgaaaaatcta

SEQ ID NO: 3752317 - DNA, 21 bp, Homo sapiens
taacttccctgaaaaatctaa

SEQ ID NO: 3752318 - DNA, 22 bp, Homo sapiens
taacttgagagtagatggtttg

SEQ ID NO: 3752319 - DNA, 16 bp, Homo sapiens
taacttggttatacat

SEQ ID NO: 3752320 - DNA, 14 bp, Homo sapiens
taacttgtcttaaa

SEQ ID NO: 3752321 - DNA, 21 bp, Homo sapiens
taactttatcacattatttgc

SEQ ID NO: 3752322 - DNA, 23 bp, Homo sapiens
taactttcagaagagatgggctt

SEQ ID NO: 3752323 - DNA, 23 bp, Homo sapiens
taactttcattaaagcatttact

SEQ ID NO: 3752324 - DNA, 20 bp, Homo sapiens
taacttttgtaaatacacat

SEQ ID NO: 3752325 - DNA, 18 bp, Homo sapiens
taacttttgtaagacaaa

SEQ ID NO: 3752326 - DNA, 18 bp, Homo sapiens
taagaaaatacaataaac

SEQ ID NO: 3752327 - DNA, 22 bp, Homo sapiens
taagaaagtgaagcaaatcaga

SEQ ID NO: 3752328 - DNA, 15 bp, Homo sapiens
taagaagacatgaac

SEQ ID NO: 3752329 - DNA, 23 bp, Homo sapiens
taagaagcacgtggtaaaacact

SEQ ID NO: 3752330 - DNA, 23 bp, Homo sapiens
taagaatgctggttttcctaaat

SEQ ID NO: 3752331 - DNA, 19 bp, Homo sapiens
taagaattttaaatatttt

SEQ ID NO: 3752332 - DNA, 19 bp, Homo sapiens
taagacagtcccatcaaaa

SEQ ID NO: 3752333 - DNA, 14 bp, Homo sapiens
taagaccagcctgg

SEQ ID NO: 3752334 - DNA, 17 bp, Homo sapiens
taagactaaatctgtaa

SEQ ID NO: 3752335 - DNA, 17 bp, Homo sapiens
taagagaaaatgtaaat

SEQ ID NO: 3752336 - DNA, 22 bp, Homo sapiens
taagagccatttaggggccact

SEQ ID NO: 3752337 - DNA, 13 bp, Homo sapiens
taagataaaaaag

SEQ ID NO: 3752338 - DNA, 16 bp, Homo sapiens
taagataaaaaagctg

SEQ ID NO: 3752339 - DNA, 16 bp, Homo sapiens
taagataaatgtgctg

SEQ ID NO: 3752340 - DNA, 13 bp, Homo sapiens
taagataattata

SEQ ID NO: 3752341 - DNA, 17 bp, Homo sapiens
taagatggattctcaga

SEQ ID NO: 3752342 - DNA, 20 bp, Homo sapiens
taagatggattctcagatat

SEQ ID NO: 3752343 - DNA, 21 bp, Homo sapiens
taagattccagagagtggctc

SEQ ID NO: 3752344 - DNA, 17 bp, Homo sapiens
taagatttaatttgcca

SEQ ID NO: 3752345 - DNA, 18 bp, Homo sapiens
taagatttaatttgccaa

SEQ ID NO: 3752346 - DNA, 19 bp, Homo sapiens
taagatttagagatgaatt

SEQ ID NO: 3752347 - DNA, 16 bp, Homo sapiens
taagcatcaaactctt

SEQ ID NO: 3752348 - DNA, 16 bp, Homo sapiens
taagcattactcttgt

SEQ ID NO: 3752349 - DNA, 20 bp, Homo sapiens
taagcattactcttgtaaga

SEQ ID NO: 3752350 - DNA, 18 bp, Homo sapiens
taagcattgggtgggtaa

SEQ ID NO: 3752351 - DNA, 18 bp, Homo sapiens
taagcattgtttgcttat

SEQ ID NO: 3752352 - DNA, 21 bp, Homo sapiens
taagcattgtttgcttattgt

SEQ ID NO: 3752353 - DNA, 15 bp, Homo sapiens
taagccatgggagac

SEQ ID NO: 3752354 - DNA, 17 bp, Homo sapiens
taagcctccatttagtt

SEQ ID NO: 3752355 - DNA, 20 bp, Homo sapiens
taagcctccatttagttctt

SEQ ID NO: 3752356 - DNA, 21 bp, Homo sapiens
taagctaaagaggctgaaaga

SEQ ID NO: 3752357 - DNA, 16 bp, Homo sapiens
taagctaacccccttc

SEQ ID NO: 3752358 - DNA, 14 bp, Homo sapiens
taagctattcagta

SEQ ID NO: 3752359 - DNA, 20 bp, Homo sapiens
taagctcaaggcgtgaggat

SEQ ID NO: 3752360 - DNA, 11 bp, Homo sapiens
taagctgtttc

SEQ ID NO: 3752361 - DNA, 16 bp, Homo sapiens
taagcttaaaaaaaac

SEQ ID NO: 3752362 - DNA, 14 bp, Homo sapiens
taagcttatttaat

SEQ ID NO: 3752363 - DNA, 17 bp, Homo sapiens
taagcttccaggaaaaa

SEQ ID NO: 3752364 - DNA, 22 bp, Homo sapiens
taagcttccaggaaaaaggaca

SEQ ID NO: 3752365 - DNA, 22 bp, Homo sapiens
taagcttccaggctgcatagaa

SEQ ID NO: 3752366 - DNA, 21 bp, Homo sapiens
taaggaaagcaataaatgaat

SEQ ID NO: 3752367 - DNA, 15 bp, Homo sapiens
taaggaacatgtact

SEQ ID NO: 3752368 - DNA, 14 bp, Homo sapiens
taaggaagaaaaat

SEQ ID NO: 3752369 - DNA, 20 bp, Homo sapiens
taaggaagatcactttgctc

SEQ ID NO: 3752370 - DNA, 19 bp, Homo sapiens
taaggaatgtagctggttt

SEQ ID NO: 3752371 - DNA, 18 bp, Homo sapiens
taaggacatttcccaggg

SEQ ID NO: 3752372 - DNA, 13 bp, Homo sapiens
taaggactgcatg

SEQ ID NO: 3752373 - DNA, 21 bp, Homo sapiens
taaggactgcatggtaattta

SEQ ID NO: 3752374 - DNA, 16 bp, Homo sapiens
taaggagatgggcctt

SEQ ID NO: 3752375 - DNA, 20 bp, Homo sapiens
taaggccgaagaagggtcct

SEQ ID NO: 3752376 - DNA, 23 bp, Homo sapiens
taaggcttcaatttattgcacaa

SEQ ID NO: 3752377 - DNA, 17 bp, Homo sapiens
taagggaaaagggaaca

SEQ ID NO: 3752378 - DNA, 15 bp, Homo sapiens
taaggtgtgctctga

SEQ ID NO: 3752379 - DNA, 21 bp, Homo sapiens
taagtaattatcgggaacagt

SEQ ID NO: 3752380 - DNA, 17 bp, Homo sapiens
taagtaccactcaggcc

SEQ ID NO: 3752381 - DNA, 13 bp, Homo sapiens
taagtactatgta

SEQ ID NO: 3752382 - DNA, 16 bp, Homo sapiens
taagtactatgtatca

SEQ ID NO: 3752383 - DNA, 14 bp, Homo sapiens
taagtactgtgtac

SEQ ID NO: 3752384 - DNA, 14 bp, Homo sapiens
taagtatcagaaag

SEQ ID NO: 3752385 - DNA, 21 bp, Homo sapiens
taagtattcttatttaatgaa

SEQ ID NO: 3752386 - DNA, 12 bp, Homo sapiens
taagtatttagg

SEQ ID NO: 3752387 - DNA, 14 bp, Homo sapiens
taagtatttatata

SEQ ID NO: 3752388 - DNA, 18 bp, Homo sapiens
taagtatttatatattta

SEQ ID NO: 3752389 - DNA, 23 bp, Homo sapiens
taagtcctactttacatatgctt

SEQ ID NO: 3752390 - DNA, 20 bp, Homo sapiens
taagtccttgcaagaatcag

SEQ ID NO: 3752391 - DNA, 17 bp, Homo sapiens
taagtgaagtaaaactt

SEQ ID NO: 3752392 - DNA, 20 bp, Homo sapiens
taagtggtactaactttcct

SEQ ID NO: 3752393 - DNA, 19 bp, Homo sapiens
taagtgtgagtaagagctg

SEQ ID NO: 3752394 - DNA, 21 bp, Homo sapiens
taagtgtgagtaagagctggt

SEQ ID NO: 3752395 - DNA, 14 bp, Homo sapiens
taagtgttgtaaat

SEQ ID NO: 3752396 - DNA, 19 bp, Homo sapiens
taagttactatcctggctt

SEQ ID NO: 3752397 - DNA, 17 bp, Homo sapiens
taagttatttcttgttt

SEQ ID NO: 3752398 - DNA, 16 bp, Homo sapiens
taagttggcttctgtt

SEQ ID NO: 3752399 - DNA, 22 bp, Homo sapiens
taagttggcttctgtttctagt

SEQ ID NO: 3752400 - DNA, 14 bp, Homo sapiens
taataaaaaggcac

SEQ ID NO: 3752401 - DNA, 16 bp, Homo sapiens
taataaaatatcattc

SEQ ID NO: 3752402 - DNA, 22 bp, Homo sapiens
taataaacatccttcaagaact

SEQ ID NO: 3752403 - DNA, 20 bp, Homo sapiens
taataaactgtcctctttca

SEQ ID NO: 3752404 - DNA, 17 bp, Homo sapiens
taataaagatgctcttt

SEQ ID NO: 3752405 - DNA, 15 bp, Homo sapiens
taataaatctggtag

SEQ ID NO: 3752406 - DNA, 17 bp, Homo sapiens
taataaatgtacattaa

SEQ ID NO: 3752407 - DNA, 13 bp, Homo sapiens
taataaattcaga

SEQ ID NO: 3752408 - DNA, 23 bp, Homo sapiens
taataaattgcatgctgctttaa

SEQ ID NO: 3752409 - DNA, 15 bp, Homo sapiens
taataatcttgtttc

SEQ ID NO: 3752410 - DNA, 20 bp, Homo sapiens
taataatcttgtttctgaaa

SEQ ID NO: 3752411 - DNA, 20 bp, Homo sapiens
taatacagccaaagataatc

SEQ ID NO: 3752412 - DNA, 13 bp, Homo sapiens
taatacattaaag

SEQ ID NO: 3752413 - DNA, 17 bp, Homo sapiens
taatacattaaagcagt

SEQ ID NO: 3752414 - DNA, 21 bp, Homo sapiens
taatagaagaacatccaagga

SEQ ID NO: 3752415 - DNA, 21 bp, Homo sapiens
taatagtgcttaaaaatcatt

SEQ ID NO: 3752416 - DNA, 21 bp, Homo sapiens
taatagttcaggtaacaggca

SEQ ID NO: 3752417 - DNA, 19 bp, Homo sapiens
taatataaagttggatgcg

SEQ ID NO: 3752418 - DNA, 16 bp, Homo sapiens
taatataactgcctta

SEQ ID NO: 3752419 - DNA, 22 bp, Homo sapiens
taatataactgccttaaaactt

SEQ ID NO: 3752420 - DNA, 10 bp, Homo sapiens
taatatgcat

SEQ ID NO: 3752421 - DNA, 20 bp, Homo sapiens
taatattaaggaagacaatg

SEQ ID NO: 3752422 - DNA, 19 bp, Homo sapiens
taatattgagaaagaaact

SEQ ID NO: 3752423 - DNA, 23 bp, Homo sapiens
taatcaaatttgtagggtttcta

SEQ ID NO: 3752424 - DNA, 17 bp, Homo sapiens
taatcaactgaaagtgt

SEQ ID NO: 3752425 - DNA, 11 bp, Homo sapiens
taatcagcctc

SEQ ID NO: 3752426 - DNA, 19 bp, Homo sapiens
taatcagggaggtcatttt

SEQ ID NO: 3752427 - DNA, 19 bp, Homo sapiens
taatcaggtcctcagagaa

SEQ ID NO: 3752428 - DNA, 22 bp, Homo sapiens
taatcaggtcctcagagaattt

SEQ ID NO: 3752429 - DNA, 18 bp, Homo sapiens
taatcagtgtagccccaa

SEQ ID NO: 3752430 - DNA, 20 bp, Homo sapiens
taatcatataataaatgtac

SEQ ID NO: 3752431 - DNA, 17 bp, Homo sapiens
taatcatccaatgctca

SEQ ID NO: 3752432 - DNA, 19 bp, Homo sapiens
taatcatgtgggtgagcca

SEQ ID NO: 3752433 - DNA, 17 bp, Homo sapiens
taatcctagctgtgtgc

SEQ ID NO: 3752434 - DNA, 16 bp, Homo sapiens
taatcggcccacagct

SEQ ID NO: 3752435 - DNA, 15 bp, Homo sapiens
taatcgttatgtgtg

SEQ ID NO: 3752436 - DNA, 16 bp, Homo sapiens
taatcgttatgtgtgt

SEQ ID NO: 3752437 - DNA, 22 bp, Homo sapiens
taatctattgggttcattattg

SEQ ID NO: 3752438 - DNA, 19 bp, Homo sapiens
taatctggactcctctgtc

SEQ ID NO: 3752439 - DNA, 19 bp, Homo sapiens
taatcttaggggagagctt

SEQ ID NO: 3752440 - DNA, 13 bp, Homo sapiens
taatcttcagttt

SEQ ID NO: 3752441 - DNA, 20 bp, Homo sapiens
taatcttcagttttatcttt

SEQ ID NO: 3752442 - DNA, 22 bp, Homo sapiens
taatctttgggtaacttcaaaa

SEQ ID NO: 3752443 - DNA, 13 bp, Homo sapiens
taatgaaaatgtc

SEQ ID NO: 3752444 - DNA, 14 bp, Homo sapiens
taatgaaaatgtca

SEQ ID NO: 3752445 - DNA, 17 bp, Homo sapiens
taatgaaagactgtaca

SEQ ID NO: 3752446 - DNA, 23 bp, Homo sapiens
taatgaaataaatcatgttaatc

SEQ ID NO: 3752447 - DNA, 22 bp, Homo sapiens
taatgaagggaaaggatatttt

SEQ ID NO: 3752448 - DNA, 15 bp, Homo sapiens
taatgaatgcataaa

SEQ ID NO: 3752449 - DNA, 15 bp, Homo sapiens
taatgaatggactca

SEQ ID NO: 3752450 - DNA, 16 bp, Homo sapiens
taatgagtttctttta

SEQ ID NO: 3752451 - DNA, 23 bp, Homo sapiens
taatgatgtcgtttgaatcacag

SEQ ID NO: 3752452 - DNA, 21 bp, Homo sapiens
taatgcatgttaggaaaattt

SEQ ID NO: 3752453 - DNA, 14 bp, Homo sapiens
taatgctaaatgta

SEQ ID NO: 3752454 - DNA, 16 bp, Homo sapiens
taatgctgttgcctca

SEQ ID NO: 3752455 - DNA, 15 bp, Homo sapiens
taatgtacatctggc

SEQ ID NO: 3752456 - DNA, 17 bp, Homo sapiens
taatgtcacaggcaggt

SEQ ID NO: 3752457 - DNA, 10 bp, Homo sapiens
taatgtgaac

SEQ ID NO: 3752458 - DNA, 12 bp, Homo sapiens
taatgttactga

SEQ ID NO: 3752459 - DNA, 18 bp, Homo sapiens
taatgtttatgagccaga

SEQ ID NO: 3752460 - DNA, 12 bp, Homo sapiens
taatgtttgcta

SEQ ID NO: 3752461 - DNA, 14 bp, Homo sapiens
taattaacatataa

SEQ ID NO: 3752462 - DNA, 17 bp, Homo sapiens
taattaagtaaactaat

SEQ ID NO: 3752463 - DNA, 22 bp, Homo sapiens
taattagagcagatgacccctc

SEQ ID NO: 3752464 - DNA, 18 bp, Homo sapiens
taattaggggttgctaag

SEQ ID NO: 3752465 - DNA, 13 bp, Homo sapiens
taattaggttaac

SEQ ID NO: 3752466 - DNA, 23 bp, Homo sapiens
taattagttcctcattagcattt

SEQ ID NO: 3752467 - DNA, 18 bp, Homo sapiens
taattatcggaagcagtg

SEQ ID NO: 3752468 - DNA, 19 bp, Homo sapiens
taattatcggaagcagtgc

SEQ ID NO: 3752469 - DNA, 21 bp, Homo sapiens
taattatcggaagcagtgcct

SEQ ID NO: 3752470 - DNA, 21 bp, Homo sapiens
taattatcgggaacagtgttt

SEQ ID NO: 3752471 - DNA, 13 bp, Homo sapiens
taattatgacagt

SEQ ID NO: 3752472 - DNA, 12 bp, Homo sapiens
taattattattc

SEQ ID NO: 3752473 - DNA, 14 bp, Homo sapiens
taattattattctt

SEQ ID NO: 3752474 - DNA, 13 bp, Homo sapiens
taattattattta

SEQ ID NO: 3752475 - DNA, 14 bp, Homo sapiens
taattattatttat

SEQ ID NO: 3752476 - DNA, 17 bp, Homo sapiens
taattattatttatata

SEQ ID NO: 3752477 - DNA, 15 bp, Homo sapiens
taattattgtttata

SEQ ID NO: 3752478 - DNA, 22 bp, Homo sapiens
taattattgtttatattttcaa

SEQ ID NO: 3752479 - DNA, 14 bp, Homo sapiens
taattattttaatt

SEQ ID NO: 3752480 - DNA, 15 bp, Homo sapiens
taattattttaatta

SEQ ID NO: 3752481 - DNA, 18 bp, Homo sapiens
taattattttaattaggt

SEQ ID NO: 3752482 - DNA, 17 bp, Homo sapiens
taattattttcttcctt

SEQ ID NO: 3752483 - DNA, 14 bp, Homo sapiens
taattcatgtttct

SEQ ID NO: 3752484 - DNA, 18 bp, Homo sapiens
taattcccattttgcaaa

SEQ ID NO: 3752485 - DNA, 21 bp, Homo sapiens
taattcccattttgcaaaatt

SEQ ID NO: 3752486 - DNA, 20 bp, Homo sapiens
taattccctatcttttagtt

SEQ ID NO: 3752487 - DNA, 18 bp, Homo sapiens
taattctaaatgaatgtt

SEQ ID NO: 3752488 - DNA, 13 bp, Homo sapiens
taattctaaccag

SEQ ID NO: 3752489 - DNA, 13 bp, Homo sapiens
taattgaaggaaa

SEQ ID NO: 3752490 - DNA, 22 bp, Homo sapiens
taattgaattttcaagcatctc

SEQ ID NO: 3752491 - DNA, 22 bp, Homo sapiens
taattgacaggattattggaaa

SEQ ID NO: 3752492 - DNA, 14 bp, Homo sapiens
taattgtaaactgt

SEQ ID NO: 3752493 - DNA, 16 bp, Homo sapiens
taattgtaaactgtac

SEQ ID NO: 3752494 - DNA, 21 bp, Homo sapiens
taattgtgaaaaagttaaaca

SEQ ID NO: 3752495 - DNA, 14 bp, Homo sapiens
taattgtgaattga

SEQ ID NO: 3752496 - DNA, 20 bp, Homo sapiens
taattgttaagatatgatgt

SEQ ID NO: 3752497 - DNA, 23 bp, Homo sapiens
taatttatcttgtctctgggctt

SEQ ID NO: 3752498 - DNA, 20 bp, Homo sapiens
taatttatgagtttttgata

SEQ ID NO: 3752499 - DNA, 17 bp, Homo sapiens
taatttatttattaaga

SEQ ID NO: 3752500 - DNA, 19 bp, Homo sapiens
taatttatttattaagatg

SEQ ID NO: 3752501 - DNA, 20 bp, Homo sapiens
taatttgatgaaagctgatt

SEQ ID NO: 3752502 - DNA, 24 bp, Homo sapiens
taatttgatgaaagctgattactg

SEQ ID NO: 3752503 - DNA, 19 bp, Homo sapiens
taatttgccaaaataatgt

SEQ ID NO: 3752504 - DNA, 22 bp, Homo sapiens
taatttgccaaaataatgtctt

SEQ ID NO: 3752505 - DNA, 23 bp, Homo sapiens
taatttgccaaaataatgtcttg

SEQ ID NO: 3752506 - DNA, 21 bp, Homo sapiens
taatttgtacatatgtaaaat

SEQ ID NO: 3752507 - DNA, 13 bp, Homo sapiens
taattttaaataa

SEQ ID NO: 3752508 - DNA, 14 bp, Homo sapiens
taattttcttcatg

SEQ ID NO: 3752509 - DNA, 23 bp, Homo sapiens
taattttcttcatgcaatgacat

SEQ ID NO: 3752510 - DNA, 17 bp, Homo sapiens
taattttcttgatgact

SEQ ID NO: 3752511 - DNA, 15 bp, Homo sapiens
taattttgaataaat

SEQ ID NO: 3752512 - DNA, 16 bp, Homo sapiens
taattttgtaaaggtg

SEQ ID NO: 3752513 - DNA, 14 bp, Homo sapiens
taattttgtatctt

SEQ ID NO: 3752514 - DNA, 16 bp, Homo sapiens
taatttttttcaatat

SEQ ID NO: 3752515 - DNA, 13 bp, Homo sapiens
tacaaaagatgta

SEQ ID NO: 3752516 - DNA, 19 bp, Homo sapiens
tacaaaataaacaaataac

SEQ ID NO: 3752517 - DNA, 20 bp, Homo sapiens
tacaaaataaagttacattg

SEQ ID NO: 3752518 - DNA, 19 bp, Homo sapiens
tacaaactcccacttgtca

SEQ ID NO: 3752519 - DNA, 14 bp, Homo sapiens
tacaaactgcaata

SEQ ID NO: 3752520 - DNA, 17 bp, Homo sapiens
tacaaactgcaatagag

SEQ ID NO: 3752521 - DNA, 14 bp, Homo sapiens
tacaaagtagaagt

SEQ ID NO: 3752522 - DNA, 18 bp, Homo sapiens
tacaaagtagaagtctta

SEQ ID NO: 3752523 - DNA, 20 bp, Homo sapiens
tacaaagtgtattttataaa

SEQ ID NO: 3752524 - DNA, 17 bp, Homo sapiens
tacaaatactcttagga

SEQ ID NO: 3752525 - DNA, 19 bp, Homo sapiens
tacaaattgcttgaaagaa

SEQ ID NO: 3752526 - DNA, 16 bp, Homo sapiens
tacaaatttgttattt

SEQ ID NO: 3752527 - DNA, 17 bp, Homo sapiens
tacaagaaaaaatgaat

SEQ ID NO: 3752528 - DNA, 16 bp, Homo sapiens
tacaagagcagcctgt

SEQ ID NO: 3752529 - DNA, 20 bp, Homo sapiens
tacaagagcagcctgtggca

SEQ ID NO: 3752530 - DNA, 23 bp, Homo sapiens
tacaagagcagcctgtggcatct

SEQ ID NO: 3752531 - DNA, 16 bp, Homo sapiens
tacaagcgtgagccac

SEQ ID NO: 3752532 - DNA, 19 bp, Homo sapiens
tacaagcgtgagccactgc

SEQ ID NO: 3752533 - DNA, 20 bp, Homo sapiens
tacaagcgtgagccactgca

SEQ ID NO: 3752534 - DNA, 20 bp, Homo sapiens
tacaagtaggggttgtgggt

SEQ ID NO: 3752535 - DNA, 13 bp, Homo sapiens
tacaagtttcaga

SEQ ID NO: 3752536 - DNA, 17 bp, Homo sapiens
tacaagtttcagacagg

SEQ ID NO: 3752537 - DNA, 12 bp, Homo sapiens
tacaataaacta

SEQ ID NO: 3752538 - DNA, 13 bp, Homo sapiens
tacaataacataa

SEQ ID NO: 3752539 - DNA, 20 bp, Homo sapiens
tacaatcaaaggaaaatagt

SEQ ID NO: 3752540 - DNA, 22 bp, Homo sapiens
tacaattatttttacagttctc

SEQ ID NO: 3752541 - DNA, 14 bp, Homo sapiens
tacaattgaaatga

SEQ ID NO: 3752542 - DNA, 16 bp, Homo sapiens
tacaattgaaatgact

SEQ ID NO: 3752543 - DNA, 14 bp, Homo sapiens
tacaattgaactta

SEQ ID NO: 3752544 - DNA, 19 bp, Homo sapiens
tacacaaatacttattcat

SEQ ID NO: 3752545 - DNA, 19 bp, Homo sapiens
tacacacacaaagagagtt

SEQ ID NO: 3752546 - DNA, 11 bp, Homo sapiens
tacacacacac

SEQ ID NO: 3752547 - DNA, 17 bp, Homo sapiens
tacacagactattgaca

SEQ ID NO: 3752548 - DNA, 15 bp, Homo sapiens
tacacagctctagac

SEQ ID NO: 3752549 - DNA, 23 bp, Homo sapiens
tacacatagcatgtaatggtatc

SEQ ID NO: 3752550 - DNA, 14 bp, Homo sapiens
tacacatcttccac

SEQ ID NO: 3752551 - DNA, 22 bp, Homo sapiens
tacacctcgttagggaagagaa

SEQ ID NO: 3752552 - DNA, 21 bp, Homo sapiens
tacactggtttgagcttagtg

SEQ ID NO: 3752553 - DNA, 16 bp, Homo sapiens
tacacttacactttat

SEQ ID NO: 3752554 - DNA, 21 bp, Homo sapiens
tacagaaagatggatgtgctt

SEQ ID NO: 3752555 - DNA, 18 bp, Homo sapiens
tacagaaattagccgggc

SEQ ID NO: 3752556 - DNA, 18 bp, Homo sapiens
tacagaattctgctacct

SEQ ID NO: 3752557 - DNA, 21 bp, Homo sapiens
tacagaattctgctacctcac

SEQ ID NO: 3752558 - DNA, 13 bp, Homo sapiens
tacagacgtatgc

SEQ ID NO: 3752559 - DNA, 18 bp, Homo sapiens
tacagacgtatgcttatt

SEQ ID NO: 3752560 - DNA, 14 bp, Homo sapiens
tacagacttctcca

SEQ ID NO: 3752561 - DNA, 22 bp, Homo sapiens
tacagagaggagaaacacatct

SEQ ID NO: 3752562 - DNA, 22 bp, Homo sapiens
tacagagaggtcaagcccagga

SEQ ID NO: 3752563 - DNA, 12 bp, Homo sapiens
tacagcaaattt

SEQ ID NO: 3752564 - DNA, 18 bp, Homo sapiens
tacagccaaagataatct

SEQ ID NO: 3752565 - DNA, 16 bp, Homo sapiens
tacagctaatcagcat

SEQ ID NO: 3752566 - DNA, 13 bp, Homo sapiens
tacagctgcctgc

SEQ ID NO: 3752567 - DNA, 17 bp, Homo sapiens
tacaggaaaagctgctg

SEQ ID NO: 3752568 - DNA, 15 bp, Homo sapiens
tacaggcatagagtt

SEQ ID NO: 3752569 - DNA, 22 bp, Homo sapiens
tacagggcgagactctgtctca

SEQ ID NO: 3752570 - DNA, 14 bp, Homo sapiens
tacaggggaatatt

SEQ ID NO: 3752571 - DNA, 16 bp, Homo sapiens
tacaggggaatatttt

SEQ ID NO: 3752572 - DNA, 18 bp, Homo sapiens
tacagggtagcaggtacc

SEQ ID NO: 3752573 - DNA, 15 bp, Homo sapiens
tacagtacaggcagc

SEQ ID NO: 3752574 - DNA, 14 bp, Homo sapiens
tacagtgcagacag

SEQ ID NO: 3752575 - DNA, 20 bp, Homo sapiens
tacagtgcagacaggccatg

SEQ ID NO: 3752576 - DNA, 21 bp, Homo sapiens
tacagttgggaaaatatgtcc

SEQ ID NO: 3752577 - DNA, 16 bp, Homo sapiens
tacagttttaaagaat

SEQ ID NO: 3752578 - DNA, 22 bp, Homo sapiens
tacagttttcctaaatgtatac

SEQ ID NO: 3752579 - DNA, 22 bp, Homo sapiens
tacataagataaatgtgctgaa

SEQ ID NO: 3752580 - DNA, 12 bp, Homo sapiens
tacatactgctg

SEQ ID NO: 3752581 - DNA, 13 bp, Homo sapiens
tacatactgctgt

SEQ ID NO: 3752582 - DNA, 15 bp, Homo sapiens
tacataggcagcact

SEQ ID NO: 3752583 - DNA, 13 bp, Homo sapiens
tacatatgaaatt

SEQ ID NO: 3752584 - DNA, 13 bp, Homo sapiens
tacatatgcttta

SEQ ID NO: 3752585 - DNA, 14 bp, Homo sapiens
tacatatgctttaa

SEQ ID NO: 3752586 - DNA, 17 bp, Homo sapiens
tacatatgctttaagaa

SEQ ID NO: 3752587 - DNA, 21 bp, Homo sapiens
tacatatgctttaagaatcga

SEQ ID NO: 3752588 - DNA, 15 bp, Homo sapiens
tacatatgtaaaata

SEQ ID NO: 3752589 - DNA, 17 bp, Homo sapiens
tacatatgtaaaataaa

SEQ ID NO: 3752590 - DNA, 18 bp, Homo sapiens
tacatattaggaaaatat

SEQ ID NO: 3752591 - DNA, 21 bp, Homo sapiens
tacatatttgcatatgtatga

SEQ ID NO: 3752592 - DNA, 14 bp, Homo sapiens
tacatcccagcctg

SEQ ID NO: 3752593 - DNA, 20 bp, Homo sapiens
tacatccttgtggcacattt

SEQ ID NO: 3752594 - DNA, 13 bp, Homo sapiens
tacatctgtcatg

SEQ ID NO: 3752595 - DNA, 14 bp, Homo sapiens
tacatgaaacagaa

SEQ ID NO: 3752596 - DNA, 20 bp, Homo sapiens
tacatgacactgaaatgcct

SEQ ID NO: 3752597 - DNA, 22 bp, Homo sapiens
tacatgagaacagactggcctg

SEQ ID NO: 3752598 - DNA, 20 bp, Homo sapiens
tacatgcatacactctcaaa

SEQ ID NO: 3752599 - DNA, 21 bp, Homo sapiens
tacatgcatacactctcaaag

SEQ ID NO: 3752600 - DNA, 18 bp, Homo sapiens
tacatggaataacatgta

SEQ ID NO: 3752601 - DNA, 17 bp, Homo sapiens
tacatgggtagcttctg

SEQ ID NO: 3752602 - DNA, 15 bp, Homo sapiens
tacattcaatgttta

SEQ ID NO: 3752603 - DNA, 16 bp, Homo sapiens
tacattgtgaaacttc

SEQ ID NO: 3752604 - DNA, 19 bp, Homo sapiens
tacatttataatgtttgct

SEQ ID NO: 3752605 - DNA, 21 bp, Homo sapiens
tacatttccaaattcacaagt

SEQ ID NO: 3752606 - DNA, 12 bp, Homo sapiens
tacattttaaca

SEQ ID NO: 3752607 - DNA, 14 bp, Homo sapiens
tacattttaacatg

SEQ ID NO: 3752608 - DNA, 17 bp, Homo sapiens
taccaaaattatttcag

SEQ ID NO: 3752609 - DNA, 18 bp, Homo sapiens
taccaaaattatttcaga

SEQ ID NO: 3752610 - DNA, 23 bp, Homo sapiens
taccaaaattatttcagaaatgt

SEQ ID NO: 3752611 - DNA, 13 bp, Homo sapiens
taccaaaggatag

SEQ ID NO: 3752612 - DNA, 14 bp, Homo sapiens
taccaactggaagc

SEQ ID NO: 3752613 - DNA, 19 bp, Homo sapiens
taccaatcattttaattat

SEQ ID NO: 3752614 - DNA, 13 bp, Homo sapiens
taccacaaggaaa

SEQ ID NO: 3752615 - DNA, 21 bp, Homo sapiens
taccactgaagatagaagaaa

SEQ ID NO: 3752616 - DNA, 21 bp, Homo sapiens
taccagacggttcaccagcct

SEQ ID NO: 3752617 - DNA, 20 bp, Homo sapiens
taccaggccgccccagcctc

SEQ ID NO: 3752618 - DNA, 14 bp, Homo sapiens
taccaggttgaaag

SEQ ID NO: 3752619 - DNA, 15 bp, Homo sapiens
taccaggttgaaaga

SEQ ID NO: 3752620 - DNA, 19 bp, Homo sapiens
taccagtaaagtgtaacat

SEQ ID NO: 3752621 - DNA, 15 bp, Homo sapiens
taccatgaaacaaag

SEQ ID NO: 3752622 - DNA, 22 bp, Homo sapiens
taccatttgtaataaagtatat

SEQ ID NO: 3752623 - DNA, 16 bp, Homo sapiens
taccattttctggttc

SEQ ID NO: 3752624 - DNA, 11 bp, Homo sapiens
tacccacctga

SEQ ID NO: 3752625 - DNA, 15 bp, Homo sapiens
tacccactgctctgg

SEQ ID NO: 3752626 - DNA, 21 bp, Homo sapiens
tacccacttctaaatagcaat

SEQ ID NO: 3752627 - DNA, 18 bp, Homo sapiens
tacccagaatgtcagatt

SEQ ID NO: 3752628 - DNA, 16 bp, Homo sapiens
taccccagctctgctt

SEQ ID NO: 3752629 - DNA, 17 bp, Homo sapiens
taccccttacttagcat

SEQ ID NO: 3752630 - DNA, 21 bp, Homo sapiens
taccctcaggcataggcctgg

SEQ ID NO: 3752631 - DNA, 14 bp, Homo sapiens
taccctcccacccc

SEQ ID NO: 3752632 - DNA, 18 bp, Homo sapiens
taccctcctttttttccc

SEQ ID NO: 3752633 - DNA, 20 bp, Homo sapiens
tacccttctgtgcccagctc

SEQ ID NO: 3752634 - DNA, 21 bp, Homo sapiens
taccgagtctcttctccactg

SEQ ID NO: 3752635 - DNA, 19 bp, Homo sapiens
tacctaaaaggaaatctca

SEQ ID NO: 3752636 - DNA, 15 bp, Homo sapiens
tacctacatacaatt

SEQ ID NO: 3752637 - DNA, 16 bp, Homo sapiens
tacctaccacagtgtc

SEQ ID NO: 3752638 - DNA, 17 bp, Homo sapiens
tacctaccacagtgtct

SEQ ID NO: 3752639 - DNA, 22 bp, Homo sapiens
tacctcaacccccatttctatt

SEQ ID NO: 3752640 - DNA, 17 bp, Homo sapiens
tacctcaacctgtaaat

SEQ ID NO: 3752641 - DNA, 19 bp, Homo sapiens
tacctcaacctgtaaatta

SEQ ID NO: 3752642 - DNA, 16 bp, Homo sapiens
tacctcagcctagacc

SEQ ID NO: 3752643 - DNA, 16 bp, Homo sapiens
tacctcccacctttgg

SEQ ID NO: 3752644 - DNA, 14 bp, Homo sapiens
tacctctgatacct

SEQ ID NO: 3752645 - DNA, 16 bp, Homo sapiens
tacctctttgaaagaa

SEQ ID NO: 3752646 - DNA, 15 bp, Homo sapiens
tacctgatcccactc

SEQ ID NO: 3752647 - DNA, 19 bp, Homo sapiens
tacctgctgccccagctga

SEQ ID NO: 3752648 - DNA, 13 bp, Homo sapiens
tacctgtgaaata

SEQ ID NO: 3752649 - DNA, 12 bp, Homo sapiens
tacctgtgcctg

SEQ ID NO: 3752650 - DNA, 20 bp, Homo sapiens
taccttcaataaagtatcta

SEQ ID NO: 3752651 - DNA, 17 bp, Homo sapiens
taccttcagatcctacc

SEQ ID NO: 3752652 - DNA, 18 bp, Homo sapiens
taccttcagatcctaccc

SEQ ID NO: 3752653 - DNA, 18 bp, Homo sapiens
taccttgaacactggggg

SEQ ID NO: 3752654 - DNA, 22 bp, Homo sapiens
taccttgtgttttgttttgatt

SEQ ID NO: 3752655 - DNA, 12 bp, Homo sapiens
tacctttgtcac

SEQ ID NO: 3752656 - DNA, 22 bp, Homo sapiens
tacgccaggggaaaatcagcct

SEQ ID NO: 3752657 - DNA, 14 bp, Homo sapiens
tacgtctgacaggc

SEQ ID NO: 3752658 - DNA, 18 bp, Homo sapiens
tactaaaaatacaaacaa

SEQ ID NO: 3752659 - DNA, 15 bp, Homo sapiens
tactaatgatgtttt

SEQ ID NO: 3752660 - DNA, 19 bp, Homo sapiens
tactaattaacatataata

SEQ ID NO: 3752661 - DNA, 18 bp, Homo sapiens
tactacacattcaataag

SEQ ID NO: 3752662 - DNA, 21 bp, Homo sapiens
tactacagttgttttttgaaa

SEQ ID NO: 3752663 - DNA, 18 bp, Homo sapiens
tactacatgtgggagctt

SEQ ID NO: 3752664 - DNA, 16 bp, Homo sapiens
tactaccacaaggaaa

SEQ ID NO: 3752665 - DNA, 17 bp, Homo sapiens
tactactagatgtcttt

SEQ ID NO: 3752666 - DNA, 20 bp, Homo sapiens
tactactgtggaaaaatatt

SEQ ID NO: 3752667 - DNA, 23 bp, Homo sapiens
tactagtctgtgtgggactgtac

SEQ ID NO: 3752668 - DNA, 19 bp, Homo sapiens
tactagttacacatcttca

SEQ ID NO: 3752669 - DNA, 16 bp, Homo sapiens
tactatatctgtttta

SEQ ID NO: 3752670 - DNA, 14 bp, Homo sapiens
tactatatttatgg

SEQ ID NO: 3752671 - DNA, 17 bp, Homo sapiens
tactattaagcagtaaa

SEQ ID NO: 3752672 - DNA, 12 bp, Homo sapiens
tactcacctcac

SEQ ID NO: 3752673 - DNA, 23 bp, Homo sapiens
tactcactcaagttcaaggacca

SEQ ID NO: 3752674 - DNA, 23 bp, Homo sapiens
tactcagcagccctcctcacccc

SEQ ID NO: 3752675 - DNA, 12 bp, Homo sapiens
tactcagccctg

SEQ ID NO: 3752676 - DNA, 23 bp, Homo sapiens
tactcagccctgggccccaccac

SEQ ID NO: 3752677 - DNA, 16 bp, Homo sapiens
tactcatgatcttgtg

SEQ ID NO: 3752678 - DNA, 17 bp, Homo sapiens
tactcatgatcttgtga

SEQ ID NO: 3752679 - DNA, 16 bp, Homo sapiens
tactcctacctcagcc

SEQ ID NO: 3752680 - DNA, 17 bp, Homo sapiens
tactcctctttacactg

SEQ ID NO: 3752681 - DNA, 14 bp, Homo sapiens
tactccttaagaac

SEQ ID NO: 3752682 - DNA, 16 bp, Homo sapiens
tactctccaacctgga

SEQ ID NO: 3752683 - DNA, 18 bp, Homo sapiens
tactctccaacctggaca

SEQ ID NO: 3752684 - DNA, 22 bp, Homo sapiens
tactctcctggaaatattaaga

SEQ ID NO: 3752685 - DNA, 23 bp, Homo sapiens
tactctcctggaaatattaagaa

SEQ ID NO: 3752686 - DNA, 12 bp, Homo sapiens
tactctgaaggg

SEQ ID NO: 3752687 - DNA, 19 bp, Homo sapiens
tactctgaagggcatcatg

SEQ ID NO: 3752688 - DNA, 15 bp, Homo sapiens
tactctgtcagatgg

SEQ ID NO: 3752689 - DNA, 12 bp, Homo sapiens
tactctgtctcc

SEQ ID NO: 3752690 - DNA, 14 bp, Homo sapiens
tactctgttccttc

SEQ ID NO: 3752691 - DNA, 18 bp, Homo sapiens
tactcttaggaagagaaa

SEQ ID NO: 3752692 - DNA, 21 bp, Homo sapiens
tactcttgtaagattttgaaa

SEQ ID NO: 3752693 - DNA, 23 bp, Homo sapiens
tactcttgtaagattttgaaaac

SEQ ID NO: 3752694 - DNA, 20 bp, Homo sapiens
tactgaaaggttaccctgta

SEQ ID NO: 3752695 - DNA, 17 bp, Homo sapiens
tactgaaggtaaaattg

SEQ ID NO: 3752696 - DNA, 14 bp, Homo sapiens
tactgactttctca

SEQ ID NO: 3752697 - DNA, 23 bp, Homo sapiens
tactgagccttgtaattctaaat

SEQ ID NO: 3752698 - DNA, 20 bp, Homo sapiens
tactgagtatgtggaaggca

SEQ ID NO: 3752699 - DNA, 17 bp, Homo sapiens
tactgatcatgcattgt

SEQ ID NO: 3752700 - DNA, 15 bp, Homo sapiens
tactgattgtttcat

SEQ ID NO: 3752701 - DNA, 12 bp, Homo sapiens
tactgcagcctc

SEQ ID NO: 3752702 - DNA, 19 bp, Homo sapiens
tactgcccaggcctgcctg

SEQ ID NO: 3752703 - DNA, 23 bp, Homo sapiens
tactggaagttttgcatttatgg

SEQ ID NO: 3752704 - DNA, 18 bp, Homo sapiens
tactggtcttgtggaatt

SEQ ID NO: 3752705 - DNA, 19 bp, Homo sapiens
tactggtgcagtcattatg

SEQ ID NO: 3752706 - DNA, 18 bp, Homo sapiens
tactgtacagattgctgc

SEQ ID NO: 3752707 - DNA, 19 bp, Homo sapiens
tactgtacagattgctgct

SEQ ID NO: 3752708 - DNA, 12 bp, Homo sapiens
tactgtagtttt

SEQ ID NO: 3752709 - DNA, 13 bp, Homo sapiens
tactgtagttttt

SEQ ID NO: 3752710 - DNA, 16 bp, Homo sapiens
tactgtcctacccacc

SEQ ID NO: 3752711 - DNA, 12 bp, Homo sapiens
tactgtcttaat

SEQ ID NO: 3752712 - DNA, 15 bp, Homo sapiens
tactgtcttaattaa

SEQ ID NO: 3752713 - DNA, 13 bp, Homo sapiens
tactgtgttcctg

SEQ ID NO: 3752714 - DNA, 16 bp, Homo sapiens
tactgtgttcctggca

SEQ ID NO: 3752715 - DNA, 17 bp, Homo sapiens
tacttaaatgaaagcat

SEQ ID NO: 3752716 - DNA, 17 bp, Homo sapiens
tacttaataaattcaga

SEQ ID NO: 3752717 - DNA, 17 bp, Homo sapiens
tacttaccatatgtgct

SEQ ID NO: 3752718 - DNA, 18 bp, Homo sapiens
tacttagcaatgttatct

SEQ ID NO: 3752719 - DNA, 15 bp, Homo sapiens
tacttagcttatcaa

SEQ ID NO: 3752720 - DNA, 21 bp, Homo sapiens
tacttatatttttaataaaag

SEQ ID NO: 3752721 - DNA, 13 bp, Homo sapiens
tacttattcattg

SEQ ID NO: 3752722 - DNA, 19 bp, Homo sapiens
tacttatttttgacagtgt

SEQ ID NO: 3752723 - DNA, 22 bp, Homo sapiens
tacttcctgcctggtctcctgc

SEQ ID NO: 3752724 - DNA, 23 bp, Homo sapiens
tacttcctgtgacttcagctctg

SEQ ID NO: 3752725 - DNA, 21 bp, Homo sapiens
tacttctagagatagtacata

SEQ ID NO: 3752726 - DNA, 13 bp, Homo sapiens
tacttctccaccc

SEQ ID NO: 3752727 - DNA, 15 bp, Homo sapiens
tacttctgctacata

SEQ ID NO: 3752728 - DNA, 22 bp, Homo sapiens
tacttgatgagtgtaacaagaa

SEQ ID NO: 3752729 - DNA, 23 bp, Homo sapiens
tacttgggagacctgtaatcata

SEQ ID NO: 3752730 - DNA, 14 bp, Homo sapiens
tacttgtggacaca

SEQ ID NO: 3752731 - DNA, 23 bp, Homo sapiens
tactttacatatgctttaagaat

SEQ ID NO: 3752732 - DNA, 20 bp, Homo sapiens
tactttgtatgatattccat

SEQ ID NO: 3752733 - DNA, 11 bp, Homo sapiens
tactttgtcag

SEQ ID NO: 3752734 - DNA, 17 bp, Homo sapiens
tacttttccttccctca

SEQ ID NO: 3752735 - DNA, 14 bp, Homo sapiens
tacttttggaatct

SEQ ID NO: 3752736 - DNA, 16 bp, Homo sapiens
tactttttcattcttt

SEQ ID NO: 3752737 - DNA, 23 bp, Homo sapiens
tagaaaaaggagcttacctccca

SEQ ID NO: 3752738 - DNA, 15 bp, Homo sapiens
tagaaagaagatgaa

SEQ ID NO: 3752739 - DNA, 21 bp, Homo sapiens
tagaaagaagcccaatattat

SEQ ID NO: 3752740 - DNA, 23 bp, Homo sapiens
tagaaagaagcccaatattataa

SEQ ID NO: 3752741 - DNA, 17 bp, Homo sapiens
tagaaagagatacagag

SEQ ID NO: 3752742 - DNA, 22 bp, Homo sapiens
tagaaagccaaatcaaaatatg

SEQ ID NO: 3752743 - DNA, 17 bp, Homo sapiens
tagaaagtgaataaaaa

SEQ ID NO: 3752744 - DNA, 16 bp, Homo sapiens
tagaaataaagcatct

SEQ ID NO: 3752745 - DNA, 15 bp, Homo sapiens
tagaaataatatgca

SEQ ID NO: 3752746 - DNA, 15 bp, Homo sapiens
tagaacacaggcaaa

SEQ ID NO: 3752747 - DNA, 22 bp, Homo sapiens
tagaacactattttcagaatct

SEQ ID NO: 3752748 - DNA, 16 bp, Homo sapiens
tagaacagaaaacaac

SEQ ID NO: 3752749 - DNA, 22 bp, Homo sapiens
tagaacagaaaacaacaaaaaa

SEQ ID NO: 3752750 - DNA, 18 bp, Homo sapiens
tagaacatccctgccagc

SEQ ID NO: 3752751 - DNA, 18 bp, Homo sapiens
tagaacattgattgctgt

SEQ ID NO: 3752752 - DNA, 15 bp, Homo sapiens
tagaaccactatgaa

SEQ ID NO: 3752753 - DNA, 12 bp, Homo sapiens
tagaaccaggca

SEQ ID NO: 3752754 - DNA, 23 bp, Homo sapiens
tagaaccaggcaacttgggaact

SEQ ID NO: 3752755 - DNA, 16 bp, Homo sapiens
tagaagaaatgaaatt

SEQ ID NO: 3752756 - DNA, 17 bp, Homo sapiens
tagaagaaatgaaattt

SEQ ID NO: 3752757 - DNA, 23 bp, Homo sapiens
tagaagaaatgaaattttaccaa

SEQ ID NO: 3752758 - DNA, 13 bp, Homo sapiens
tagaaggaaacta

SEQ ID NO: 3752759 - DNA, 23 bp, Homo sapiens
tagaaggagacagagctggttgg

SEQ ID NO: 3752760 - DNA, 16 bp, Homo sapiens
tagaagggttatattt

SEQ ID NO: 3752761 - DNA, 16 bp, Homo sapiens
tagaagtcacacagta

SEQ ID NO: 3752762 - DNA, 18 bp, Homo sapiens
tagaagtcttagatgtat

SEQ ID NO: 3752763 - DNA, 19 bp, Homo sapiens
tagaagtcttagatgtata

SEQ ID NO: 3752764 - DNA, 18 bp, Homo sapiens
tagaagtggaccaggaca

SEQ ID NO: 3752765 - DNA, 19 bp, Homo sapiens
tagaagtggaccaggacag

SEQ ID NO: 3752766 - DNA, 20 bp, Homo sapiens
tagaagtggaccaggacagg

SEQ ID NO: 3752767 - DNA, 16 bp, Homo sapiens
tagaagtgggccagga

SEQ ID NO: 3752768 - DNA, 21 bp, Homo sapiens
tagaataatgtgggaagaaac

SEQ ID NO: 3752769 - DNA, 23 bp, Homo sapiens
tagaataatgtgggaagaaacaa

SEQ ID NO: 3752770 - DNA, 15 bp, Homo sapiens
tagaatataattatc

SEQ ID NO: 3752771 - DNA, 15 bp, Homo sapiens
tagaatatttattac

SEQ ID NO: 3752772 - DNA, 21 bp, Homo sapiens
tagaatcagcctaggggtcag

SEQ ID NO: 3752773 - DNA, 16 bp, Homo sapiens
tagaatgatttcatgc

SEQ ID NO: 3752774 - DNA, 22 bp, Homo sapiens
tagaatttattcaattcctctg

SEQ ID NO: 3752775 - DNA, 18 bp, Homo sapiens
tagaatttttaatgtttt

SEQ ID NO: 3752776 - DNA, 15 bp, Homo sapiens
tagacaaccctgcaa

SEQ ID NO: 3752777 - DNA, 10 bp, Homo sapiens
tagacagagt

SEQ ID NO: 3752778 - DNA, 21 bp, Homo sapiens
tagacagagtctcactgttgc

SEQ ID NO: 3752779 - DNA, 14 bp, Homo sapiens
tagaccaaaataaa

SEQ ID NO: 3752780 - DNA, 23 bp, Homo sapiens
tagaccatttatctgggattatg

SEQ ID NO: 3752781 - DNA, 13 bp, Homo sapiens
tagacctcagcct

SEQ ID NO: 3752782 - DNA, 15 bp, Homo sapiens
tagacctcagcctgt

SEQ ID NO: 3752783 - DNA, 13 bp, Homo sapiens
tagactagagaaa

SEQ ID NO: 3752784 - DNA, 17 bp, Homo sapiens
tagactgcctgggttcc

SEQ ID NO: 3752785 - DNA, 16 bp, Homo sapiens
tagacttgaggaaacc

SEQ ID NO: 3752786 - DNA, 18 bp, Homo sapiens
tagacttgtgctgatcgt

SEQ ID NO: 3752787 - DNA, 17 bp, Homo sapiens
tagactttagaaataaa

SEQ ID NO: 3752788 - DNA, 19 bp, Homo sapiens
tagactttagaaataaatg

SEQ ID NO: 3752789 - DNA, 18 bp, Homo sapiens
tagactttatgcaataaa

SEQ ID NO: 3752790 - DNA, 19 bp, Homo sapiens
tagactttatgcaataaat

SEQ ID NO: 3752791 - DNA, 11 bp, Homo sapiens
tagagacaggg

SEQ ID NO: 3752792 - DNA, 15 bp, Homo sapiens
tagagactgtagatt

SEQ ID NO: 3752793 - DNA, 19 bp, Homo sapiens
tagagactgtagattgctt

SEQ ID NO: 3752794 - DNA, 17 bp, Homo sapiens
tagagatgactgagtcc

SEQ ID NO: 3752795 - DNA, 13 bp, Homo sapiens
tagagatgcctcc

SEQ ID NO: 3752796 - DNA, 16 bp, Homo sapiens
tagagatgcctccctg

SEQ ID NO: 3752797 - DNA, 19 bp, Homo sapiens
tagagatggaggaggaggc

SEQ ID NO: 3752798 - DNA, 17 bp, Homo sapiens
tagagcctgctggatct

SEQ ID NO: 3752799 - DNA, 16 bp, Homo sapiens
tagagctagtctttca

SEQ ID NO: 3752800 - DNA, 22 bp, Homo sapiens
tagaggaaaaaaatgactaaaa

SEQ ID NO: 3752801 - DNA, 15 bp, Homo sapiens
tagaggaagcagcca

SEQ ID NO: 3752802 - DNA, 18 bp, Homo sapiens
tagaggccagccccaccc

SEQ ID NO: 3752803 - DNA, 17 bp, Homo sapiens
tagagggttcctgtaga

SEQ ID NO: 3752804 - DNA, 16 bp, Homo sapiens
tagaggtgagggaagc

SEQ ID NO: 3752805 - DNA, 14 bp, Homo sapiens
tagagtcagccttc

SEQ ID NO: 3752806 - DNA, 23 bp, Homo sapiens
tagagtcatctccatcagctgta

SEQ ID NO: 3752807 - DNA, 20 bp, Homo sapiens
tagagtcctcactcccagtc

SEQ ID NO: 3752808 - DNA, 12 bp, Homo sapiens
tagagtgggagc

SEQ ID NO: 3752809 - DNA, 15 bp, Homo sapiens
tagataaactcagaa

SEQ ID NO: 3752810 - DNA, 13 bp, Homo sapiens
tagataactcttt

SEQ ID NO: 3752811 - DNA, 11 bp, Homo sapiens
tagatagaaat

SEQ ID NO: 3752812 - DNA, 21 bp, Homo sapiens
tagatagaaataaatagctat

SEQ ID NO: 3752813 - DNA, 15 bp, Homo sapiens
tagatatatgctctg

SEQ ID NO: 3752814 - DNA, 20 bp, Homo sapiens
tagatatctttttattgatg

SEQ ID NO: 3752815 - DNA, 20 bp, Homo sapiens
tagatcacataacagaatgc

SEQ ID NO: 3752816 - DNA, 17 bp, Homo sapiens
tagatcacgagatcaag

SEQ ID NO: 3752817 - DNA, 14 bp, Homo sapiens
tagatcatgaagaa

SEQ ID NO: 3752818 - DNA, 22 bp, Homo sapiens
tagatcgatgatatgaccagaa

SEQ ID NO: 3752819 - DNA, 23 bp, Homo sapiens
tagatgagcccagccctgttctg

SEQ ID NO: 3752820 - DNA, 15 bp, Homo sapiens
tagatgccctgctag

SEQ ID NO: 3752821 - DNA, 23 bp, Homo sapiens
tagatgctgactgtactcctccc

SEQ ID NO: 3752822 - DNA, 14 bp, Homo sapiens
tagatggttacact

SEQ ID NO: 3752823 - DNA, 17 bp, Homo sapiens
tagatggttacactgtt

SEQ ID NO: 3752824 - DNA, 20 bp, Homo sapiens
tagatggttacactgttaga

SEQ ID NO: 3752825 - DNA, 21 bp, Homo sapiens
tagatgtccctttcttggcca

SEQ ID NO: 3752826 - DNA, 22 bp, Homo sapiens
tagatgtccctttcttggccag

SEQ ID NO: 3752827 - DNA, 18 bp, Homo sapiens
tagattaagagatgggtt

SEQ ID NO: 3752828 - DNA, 21 bp, Homo sapiens
tagattatattgagacaaaaa

SEQ ID NO: 3752829 - DNA, 15 bp, Homo sapiens
tagattcacctgtaa

SEQ ID NO: 3752830 - DNA, 20 bp, Homo sapiens
tagattcacctgtaaaactt

SEQ ID NO: 3752831 - DNA, 21 bp, Homo sapiens
tagattcacctgtaaaacttt

SEQ ID NO: 3752832 - DNA, 22 bp, Homo sapiens
tagattcacctgtaaaacttta

SEQ ID NO: 3752833 - DNA, 20 bp, Homo sapiens
tagattctacatattcttta

SEQ ID NO: 3752834 - DNA, 17 bp, Homo sapiens
tagatttctgattttat

SEQ ID NO: 3752835 - DNA, 19 bp, Homo sapiens
tagatttgttttgtgttgt

SEQ ID NO: 3752836 - DNA, 22 bp, Homo sapiens
tagattttagaccctattgctg

SEQ ID NO: 3752837 - DNA, 20 bp, Homo sapiens
tagcaagattgcttaaaata

SEQ ID NO: 3752838 - DNA, 21 bp, Homo sapiens
tagcaatccatgttagttttt

SEQ ID NO: 3752839 - DNA, 20 bp, Homo sapiens
tagcacgtttaaagttctgt

SEQ ID NO: 3752840 - DNA, 20 bp, Homo sapiens
tagcagaatcaaaatgacct

SEQ ID NO: 3752841 - DNA, 14 bp, Homo sapiens
tagcagctatctct

SEQ ID NO: 3752842 - DNA, 11 bp, Homo sapiens
tagcagggaaa

SEQ ID NO: 3752843 - DNA, 13 bp, Homo sapiens
tagcagtgatttt

SEQ ID NO: 3752844 - DNA, 15 bp, Homo sapiens
tagcagtgattttta

SEQ ID NO: 3752845 - DNA, 14 bp, Homo sapiens
tagcagttctgcaa

SEQ ID NO: 3752846 - DNA, 15 bp, Homo sapiens
tagcatacatttata

SEQ ID NO: 3752847 - DNA, 18 bp, Homo sapiens
tagcatgacaagccccag

SEQ ID NO: 3752848 - DNA, 22 bp, Homo sapiens
tagcatgacaagccccaggcag

SEQ ID NO: 3752849 - DNA, 14 bp, Homo sapiens
tagcatgcacaaag

SEQ ID NO: 3752850 - DNA, 17 bp, Homo sapiens
tagcatgcacaaagtgt

SEQ ID NO: 3752851 - DNA, 17 bp, Homo sapiens
tagcatgtcactaaagc

SEQ ID NO: 3752852 - DNA, 14 bp, Homo sapiens
tagcattggggaca

SEQ ID NO: 3752853 - DNA, 16 bp, Homo sapiens
tagcattttgctaaat

SEQ ID NO: 3752854 - DNA, 22 bp, Homo sapiens
tagcattttgctaaatgtgaat

SEQ ID NO: 3752855 - DNA, 20 bp, Homo sapiens
tagccaaaaatgtctaaaag

SEQ ID NO: 3752856 - DNA, 20 bp, Homo sapiens
tagccaaggtgggctgagcc

SEQ ID NO: 3752857 - DNA, 19 bp, Homo sapiens
tagccaccccagaaatggt

SEQ ID NO: 3752858 - DNA, 16 bp, Homo sapiens
tagccacttaccttca

SEQ ID NO: 3752859 - DNA, 17 bp, Homo sapiens
tagccacttaccttcaa

SEQ ID NO: 3752860 - DNA, 19 bp, Homo sapiens
tagccccaagaaggctggg

SEQ ID NO: 3752861 - DNA, 22 bp, Homo sapiens
tagccccaagaaggctggggct

SEQ ID NO: 3752862 - DNA, 18 bp, Homo sapiens
tagccctggccagaggct

SEQ ID NO: 3752863 - DNA, 13 bp, Homo sapiens
tagccgacctcag

SEQ ID NO: 3752864 - DNA, 14 bp, Homo sapiens
tagccgacctcagc

SEQ ID NO: 3752865 - DNA, 18 bp, Homo sapiens
tagccgagagcctgctcc

SEQ ID NO: 3752866 - DNA, 16 bp, Homo sapiens
tagcctaggtgacaga

SEQ ID NO: 3752867 - DNA, 18 bp, Homo sapiens
tagcctgtgcctctggga

SEQ ID NO: 3752868 - DNA, 20 bp, Homo sapiens
tagcctgtgcctctgggact

SEQ ID NO: 3752869 - DNA, 14 bp, Homo sapiens
tagcctgtggcagt

SEQ ID NO: 3752870 - DNA, 20 bp, Homo sapiens
tagccttagaagtcacacag

SEQ ID NO: 3752871 - DNA, 22 bp, Homo sapiens
tagccttgcccggattctggga

SEQ ID NO: 3752872 - DNA, 23 bp, Homo sapiens
tagcgacattgcagtctgcttct

SEQ ID NO: 3752873 - DNA, 22 bp, Homo sapiens
tagcgctgccgcaccccagagt

SEQ ID NO: 3752874 - DNA, 20 bp, Homo sapiens
tagctacaggaagcacccca

SEQ ID NO: 3752875 - DNA, 23 bp, Homo sapiens
tagctacaggaagcaccccatgc

SEQ ID NO: 3752876 - DNA, 14 bp, Homo sapiens
tagctatatccatg

SEQ ID NO: 3752877 - DNA, 15 bp, Homo sapiens
tagctatatccatgt

SEQ ID NO: 3752878 - DNA, 19 bp, Homo sapiens
tagctatatccatgtactg

SEQ ID NO: 3752879 - DNA, 22 bp, Homo sapiens
tagctatatccatgtactgtag

SEQ ID NO: 3752880 - DNA, 16 bp, Homo sapiens
tagctatgtgaccttg

SEQ ID NO: 3752881 - DNA, 17 bp, Homo sapiens
tagctcagccccagccc

SEQ ID NO: 3752882 - DNA, 18 bp, Homo sapiens
tagctcagccccagccca

SEQ ID NO: 3752883 - DNA, 16 bp, Homo sapiens
tagctcaggtgtccct

SEQ ID NO: 3752884 - DNA, 12 bp, Homo sapiens
tagctgcagaac

SEQ ID NO: 3752885 - DNA, 12 bp, Homo sapiens
tagctgggacta

SEQ ID NO: 3752886 - DNA, 18 bp, Homo sapiens
tagctggttcctgctaga

SEQ ID NO: 3752887 - DNA, 23 bp, Homo sapiens
tagctggttcctgctagaaatgg

SEQ ID NO: 3752888 - DNA, 14 bp, Homo sapiens
tagctgtgtgaaat

SEQ ID NO: 3752889 - DNA, 13 bp, Homo sapiens
tagctgttgagct

SEQ ID NO: 3752890 - DNA, 15 bp, Homo sapiens
tagcttagacctcag

SEQ ID NO: 3752891 - DNA, 16 bp, Homo sapiens
tagcttagacctcagc

SEQ ID NO: 3752892 - DNA, 17 bp, Homo sapiens
tagcttagacctcagcc

SEQ ID NO: 3752893 - DNA, 20 bp, Homo sapiens
tagctttattttttaagtat

SEQ ID NO: 3752894 - DNA, 13 bp, Homo sapiens
tagctttccacat

SEQ ID NO: 3752895 - DNA, 18 bp, Homo sapiens
tagctttccacatttgtc

SEQ ID NO: 3752896 - DNA, 20 bp, Homo sapiens
taggaaataaaacctttcaa

SEQ ID NO: 3752897 - DNA, 20 bp, Homo sapiens
taggaacggtaaatttctgt

SEQ ID NO: 3752898 - DNA, 15 bp, Homo sapiens
taggaagagaaacca

SEQ ID NO: 3752899 - DNA, 12 bp, Homo sapiens
taggaataaata

SEQ ID NO: 3752900 - DNA, 21 bp, Homo sapiens
taggaattcccagcccaaagc

SEQ ID NO: 3752901 - DNA, 23 bp, Homo sapiens
taggacatgttcccttctccttc

SEQ ID NO: 3752902 - DNA, 18 bp, Homo sapiens
taggactctgaggctctt

SEQ ID NO: 3752903 - DNA, 14 bp, Homo sapiens
taggagaccaaggc

SEQ ID NO: 3752904 - DNA, 18 bp, Homo sapiens
taggagctgggaggaaaa

SEQ ID NO: 3752905 - DNA, 17 bp, Homo sapiens
taggagttcgagaccag

SEQ ID NO: 3752906 - DNA, 20 bp, Homo sapiens
taggatcatttgttggaatg

SEQ ID NO: 3752907 - DNA, 18 bp, Homo sapiens
taggcagttagagatgcc

SEQ ID NO: 3752908 - DNA, 22 bp, Homo sapiens
taggcagttagagatgcctccc

SEQ ID NO: 3752909 - DNA, 16 bp, Homo sapiens
taggcatttgctgaat

SEQ ID NO: 3752910 - DNA, 14 bp, Homo sapiens
taggccactcctcc

SEQ ID NO: 3752911 - DNA, 15 bp, Homo sapiens
taggccactcctcca

SEQ ID NO: 3752912 - DNA, 15 bp, Homo sapiens
taggctattcacaac

SEQ ID NO: 3752913 - DNA, 12 bp, Homo sapiens
taggctgggtgc

SEQ ID NO: 3752914 - DNA, 17 bp, Homo sapiens
taggctgggtgcccaca

SEQ ID NO: 3752915 - DNA, 19 bp, Homo sapiens
tagggaaaaaccagcgtgt

SEQ ID NO: 3752916 - DNA, 20 bp, Homo sapiens
tagggaaaaaccagcgtgtg

SEQ ID NO: 3752917 - DNA, 13 bp, Homo sapiens
tagggaagagaaa

SEQ ID NO: 3752918 - DNA, 13 bp, Homo sapiens
tagggaagataat

SEQ ID NO: 3752919 - DNA, 17 bp, Homo sapiens
tagggatagtcaccttt

SEQ ID NO: 3752920 - DNA, 20 bp, Homo sapiens
tagggatagtcaccttttaa

SEQ ID NO: 3752921 - DNA, 18 bp, Homo sapiens
tagggatgttctggccct

SEQ ID NO: 3752922 - DNA, 15 bp, Homo sapiens
tagggtaaggtgcct

SEQ ID NO: 3752923 - DNA, 15 bp, Homo sapiens
tagggtctcttcagg

SEQ ID NO: 3752924 - DNA, 12 bp, Homo sapiens
tagggtggccct

SEQ ID NO: 3752925 - DNA, 16 bp, Homo sapiens
taggtcaagaagaaga

SEQ ID NO: 3752926 - DNA, 21 bp, Homo sapiens
taggtcaaggcctgtccctgg

SEQ ID NO: 3752927 - DNA, 15 bp, Homo sapiens
taggtcactcctggg

SEQ ID NO: 3752928 - DNA, 18 bp, Homo sapiens
taggtcagtacccacctg

SEQ ID NO: 3752929 - DNA, 23 bp, Homo sapiens
taggtcagtacccacctgagctt

SEQ ID NO: 3752930 - DNA, 11 bp, Homo sapiens
taggtgacaga

SEQ ID NO: 3752931 - DNA, 23 bp, Homo sapiens
taggtgacagagtgagactctgt

SEQ ID NO: 3752932 - DNA, 14 bp, Homo sapiens
taggtgatttgaag

SEQ ID NO: 3752933 - DNA, 16 bp, Homo sapiens
taggtgctaattaata

SEQ ID NO: 3752934 - DNA, 16 bp, Homo sapiens
taggtgggccagcccc

SEQ ID NO: 3752935 - DNA, 19 bp, Homo sapiens
taggtgggccagcccctcc

SEQ ID NO: 3752936 - DNA, 23 bp, Homo sapiens
taggtgggccagcccctcccacc

SEQ ID NO: 3752937 - DNA, 16 bp, Homo sapiens
taggtgtcatttccat

SEQ ID NO: 3752938 - DNA, 13 bp, Homo sapiens
taggtgtggggga

SEQ ID NO: 3752939 - DNA, 17 bp, Homo sapiens
taggtgttcaggccagt

SEQ ID NO: 3752940 - DNA, 19 bp, Homo sapiens
taggttaactatgtacaat

SEQ ID NO: 3752941 - DNA, 21 bp, Homo sapiens
taggttggcaaaaaggcagga

SEQ ID NO: 3752942 - DNA, 17 bp, Homo sapiens
taggtttaacataaagg

SEQ ID NO: 3752943 - DNA, 13 bp, Homo sapiens
tagtaaaaataaa

SEQ ID NO: 3752944 - DNA, 16 bp, Homo sapiens
tagtaaaaataaaatt

SEQ ID NO: 3752945 - DNA, 14 bp, Homo sapiens
tagtacccacctga

SEQ ID NO: 3752946 - DNA, 16 bp, Homo sapiens
tagtactatatctgtt

SEQ ID NO: 3752947 - DNA, 21 bp, Homo sapiens
tagtactcctgcaaaatttta

SEQ ID NO: 3752948 - DNA, 19 bp, Homo sapiens
tagtactccttaagaacac

SEQ ID NO: 3752949 - DNA, 17 bp, Homo sapiens
tagtatattaaaaatgg

SEQ ID NO: 3752950 - DNA, 14 bp, Homo sapiens
tagtatctaacatg

SEQ ID NO: 3752951 - DNA, 15 bp, Homo sapiens
tagtatctaacatgt

SEQ ID NO: 3752952 - DNA, 16 bp, Homo sapiens
tagtatggtggctggg

SEQ ID NO: 3752953 - DNA, 14 bp, Homo sapiens
tagtcccagctact

SEQ ID NO: 3752954 - DNA, 20 bp, Homo sapiens
tagtcccttcccctccctgg

SEQ ID NO: 3752955 - DNA, 22 bp, Homo sapiens
tagtcccttcccctccctggct

SEQ ID NO: 3752956 - DNA, 19 bp, Homo sapiens
tagtctaaccaaatgcatc

SEQ ID NO: 3752957 - DNA, 12 bp, Homo sapiens
tagtctcaggac

SEQ ID NO: 3752958 - DNA, 17 bp, Homo sapiens
tagtctgtgtgctgtgg

SEQ ID NO: 3752959 - DNA, 19 bp, Homo sapiens
tagtcttctcatagcatta

SEQ ID NO: 3752960 - DNA, 23 bp, Homo sapiens
tagtgaattatcccttttcttga

SEQ ID NO: 3752961 - DNA, 15 bp, Homo sapiens
tagtgagaagaatat

SEQ ID NO: 3752962 - DNA, 18 bp, Homo sapiens
tagtgagacccctgtctc

SEQ ID NO: 3752963 - DNA, 18 bp, Homo sapiens
tagtgatctgaacagaaa

SEQ ID NO: 3752964 - DNA, 18 bp, Homo sapiens
tagtgatggttcccctgt

SEQ ID NO: 3752965 - DNA, 12 bp, Homo sapiens
tagtgcagctga

SEQ ID NO: 3752966 - DNA, 14 bp, Homo sapiens
tagtgcagctgatt

SEQ ID NO: 3752967 - DNA, 15 bp, Homo sapiens
tagtgcagctgattt

SEQ ID NO: 3752968 - DNA, 18 bp, Homo sapiens
tagtgcagctgattttaa

SEQ ID NO: 3752969 - DNA, 19 bp, Homo sapiens
tagtgcagctgattttaac

SEQ ID NO: 3752970 - DNA, 23 bp, Homo sapiens
tagtgccctccacagccgcagcc

SEQ ID NO: 3752971 - DNA, 23 bp, Homo sapiens
tagtgccgtagggagtacctgct

SEQ ID NO: 3752972 - DNA, 21 bp, Homo sapiens
tagtgcgatgtttcaggaggc

SEQ ID NO: 3752973 - DNA, 12 bp, Homo sapiens
gacacagctctt

SEQ ID NO: 3752974 - DNA, 16 bp, Homo sapiens
gacacagctcttctcc

SEQ ID NO: 3752975 - DNA, 19 bp, Homo sapiens
gacacaggcccggctccag

SEQ ID NO: 3752976 - DNA, 20 bp, Homo sapiens
gacaccagcctttctcccag

SEQ ID NO: 3752977 - DNA, 20 bp, Homo sapiens
gacaccaggagtccctggta

SEQ ID NO: 3752978 - DNA, 15 bp, Homo sapiens
gacacctgcacctcc

SEQ ID NO: 3752979 - DNA, 17 bp, Homo sapiens
gacacctgtactggaga

SEQ ID NO: 3752980 - DNA, 20 bp, Homo sapiens
gacacctgtactggagagca

SEQ ID NO: 3752981 - DNA, 18 bp, Homo sapiens
gacaccttgacagggcac

SEQ ID NO: 3752982 - DNA, 15 bp, Homo sapiens
gacacgtccacccca

SEQ ID NO: 3752983 - DNA, 15 bp, Homo sapiens
gacactaaccacgct

SEQ ID NO: 3752984 - DNA, 20 bp, Homo sapiens
gacactaaccacgctggacc

SEQ ID NO: 3752985 - DNA, 22 bp, Homo sapiens
gacactgaaatgccttactttg

SEQ ID NO: 3752986 - DNA, 15 bp, Homo sapiens
gacactgatgggcaa

SEQ ID NO: 3752987 - DNA, 16 bp, Homo sapiens
gacactgccacacagg

SEQ ID NO: 3752988 - DNA, 17 bp, Homo sapiens
gacacttcagagagctg

SEQ ID NO: 3752989 - DNA, 18 bp, Homo sapiens
gacacttcagagagctgg

SEQ ID NO: 3752990 - DNA, 23 bp, Homo sapiens
gacacttcagagagctggtagtt

SEQ ID NO: 3752991 - DNA, 21 bp, Homo sapiens
gacacttttcatgtgtgattt

SEQ ID NO: 3752992 - DNA, 19 bp, Homo sapiens
gacacttttttgagtggat

SEQ ID NO: 3752993 - DNA, 15 bp, Homo sapiens
gacagaacactgtct

SEQ ID NO: 3752994 - DNA, 13 bp, Homo sapiens
gacagacacacac

SEQ ID NO: 3752995 - DNA, 12 bp, Homo sapiens
gacagacacagg

SEQ ID NO: 3752996 - DNA, 15 bp, Homo sapiens
gacagagacacctgc

SEQ ID NO: 3752997 - DNA, 18 bp, Homo sapiens
gacagagacacctgcacc

SEQ ID NO: 3752998 - DNA, 18 bp, Homo sapiens
gacagagacgcaggaatg

SEQ ID NO: 3752999 - DNA, 19 bp, Homo sapiens
gacagagaggacgtgggcg

SEQ ID NO: 3753000 - DNA, 23 bp, Homo sapiens
gacagaggcagccccattctgcc

SEQ ID NO: 3753001 - DNA, 15 bp, Homo sapiens
gacagagtctgggtg

SEQ ID NO: 3753002 - DNA, 16 bp, Homo sapiens
gacagcaaaaccattg

SEQ ID NO: 3753003 - DNA, 22 bp, Homo sapiens
gacagcaacggggaggccaagt

SEQ ID NO: 3753004 - DNA, 16 bp, Homo sapiens
gacagcagctcaggca

SEQ ID NO: 3753005 - DNA, 20 bp, Homo sapiens
gacagcagctcaggcacact

SEQ ID NO: 3753006 - DNA, 13 bp, Homo sapiens
gacagcatggtgc

SEQ ID NO: 3753007 - DNA, 13 bp, Homo sapiens
gacagccacggcc

SEQ ID NO: 3753008 - DNA, 17 bp, Homo sapiens
gacagccacggccaggc

SEQ ID NO: 3753009 - DNA, 20 bp, Homo sapiens
gacagccacggccaggccag

SEQ ID NO: 3753010 - DNA, 13 bp, Homo sapiens
gacagcctggcac

SEQ ID NO: 3753011 - DNA, 16 bp, Homo sapiens
gacagctccctctgcc

SEQ ID NO: 3753012 - DNA, 17 bp, Homo sapiens
gacagctccctctgcct

SEQ ID NO: 3753013 - DNA, 18 bp, Homo sapiens
gacagctccctctgcctg

SEQ ID NO: 3753014 - DNA, 14 bp, Homo sapiens
gacagctgtccctg

SEQ ID NO: 3753015 - DNA, 15 bp, Homo sapiens
gacagctgtccctgt

SEQ ID NO: 3753016 - DNA, 17 bp, Homo sapiens
gacagctgtccctgtca

SEQ ID NO: 3753017 - DNA, 19 bp, Homo sapiens
gacaggaaaatcctctggc

SEQ ID NO: 3753018 - DNA, 22 bp, Homo sapiens
gacaggacagtgcttcagcctg

SEQ ID NO: 3753019 - DNA, 23 bp, Homo sapiens
gacaggacagtgcttcagcctga

SEQ ID NO: 3753020 - DNA, 12 bp, Homo sapiens
gacaggagaaat

SEQ ID NO: 3753021 - DNA, 24 bp, Homo sapiens
gacaggagaaatgcatccattcct

SEQ ID NO: 3753022 - DNA, 21 bp, Homo sapiens
gacaggagacctggcactgga

SEQ ID NO: 3753023 - DNA, 16 bp, Homo sapiens
gacaggcaatgctggc

SEQ ID NO: 3753024 - DNA, 17 bp, Homo sapiens
gacaggcaatgctggct

SEQ ID NO: 3753025 - DNA, 19 bp, Homo sapiens
gacaggcaatgctggctgt

SEQ ID NO: 3753026 - DNA, 24 bp, Homo sapiens
gacaggcaatgctggctgttggct

SEQ ID NO: 3753027 - DNA, 14 bp, Homo sapiens
gacaggcagaaaga

SEQ ID NO: 3753028 - DNA, 15 bp, Homo sapiens
gacaggcagaaagag

SEQ ID NO: 3753029 - DNA, 20 bp, Homo sapiens
gacaggcatgttctctgagg

SEQ ID NO: 3753030 - DNA, 21 bp, Homo sapiens
gacaggcatgttctctgagga

SEQ ID NO: 3753031 - DNA, 20 bp, Homo sapiens
gacaggccatgtgagccacc

SEQ ID NO: 3753032 - DNA, 11 bp, Homo sapiens
gacaggcccaa

SEQ ID NO: 3753033 - DNA, 15 bp, Homo sapiens
gacaggcccaagaga

SEQ ID NO: 3753034 - DNA, 18 bp, Homo sapiens
gacaggcccaagagatga

SEQ ID NO: 3753035 - DNA, 22 bp, Homo sapiens
gacaggcccaagagatgaagag

SEQ ID NO: 3753036 - DNA, 15 bp, Homo sapiens
gacagggtcctgcta

SEQ ID NO: 3753037 - DNA, 22 bp, Homo sapiens
gacagggttttgccatgttggc

SEQ ID NO: 3753038 - DNA, 14 bp, Homo sapiens
gacagtatataact

SEQ ID NO: 3753039 - DNA, 22 bp, Homo sapiens
gacagtcaaggagtggcttact

SEQ ID NO: 3753040 - DNA, 15 bp, Homo sapiens
gacagtcctgggaga

SEQ ID NO: 3753041 - DNA, 18 bp, Homo sapiens
gacagtcctgggagaacc

SEQ ID NO: 3753042 - DNA, 17 bp, Homo sapiens
gacagtgaggtcctggg

SEQ ID NO: 3753043 - DNA, 19 bp, Homo sapiens
gacagtgaggtcctggggg

SEQ ID NO: 3753044 - DNA, 20 bp, Homo sapiens
gacagtgaggtcctgggggc

SEQ ID NO: 3753045 - DNA, 16 bp, Homo sapiens
gacagtgatctccata

SEQ ID NO: 3753046 - DNA, 22 bp, Homo sapiens
gacagtgcctgggaatgtatta

SEQ ID NO: 3753047 - DNA, 17 bp, Homo sapiens
gacagtgcttcagcctg

SEQ ID NO: 3753048 - DNA, 18 bp, Homo sapiens
gacagtgcttcagcctga

SEQ ID NO: 3753049 - DNA, 21 bp, Homo sapiens
gacagttatactgtcggtttt

SEQ ID NO: 3753050 - DNA, 22 bp, Homo sapiens
gacatactccttccatcaaata

SEQ ID NO: 3753051 - DNA, 20 bp, Homo sapiens
gacatattcatttggaaata

SEQ ID NO: 3753052 - DNA, 19 bp, Homo sapiens
gacatcaagcacagaagga

SEQ ID NO: 3753053 - DNA, 22 bp, Homo sapiens
gacatcacttgtacaaaataaa

SEQ ID NO: 3753054 - DNA, 20 bp, Homo sapiens
gacatcagtggcatggctcc

SEQ ID NO: 3753055 - DNA, 15 bp, Homo sapiens
gacatccaagcttcc

SEQ ID NO: 3753056 - DNA, 16 bp, Homo sapiens
gacatgaatgcacact

SEQ ID NO: 3753057 - DNA, 18 bp, Homo sapiens
gacatgcgggctgggcag

SEQ ID NO: 3753058 - DNA, 22 bp, Homo sapiens
gacatgcgggctgggcagctgt

SEQ ID NO: 3753059 - DNA, 15 bp, Homo sapiens
gacatggggaggaag

SEQ ID NO: 3753060 - DNA, 16 bp, Homo sapiens
gacatggggaggaagg

SEQ ID NO: 3753061 - DNA, 18 bp, Homo sapiens
gacatgtggaaagtgaat

SEQ ID NO: 3753062 - DNA, 23 bp, Homo sapiens
gacatgtggaaagtgaatttgaa

SEQ ID NO: 3753063 - DNA, 14 bp, Homo sapiens
gacatgtggtggga

SEQ ID NO: 3753064 - DNA, 16 bp, Homo sapiens
gacatgtggtgggaca

SEQ ID NO: 3753065 - DNA, 12 bp, Homo sapiens
gacattaacagt

SEQ ID NO: 3753066 - DNA, 14 bp, Homo sapiens
gacattaacagttt

SEQ ID NO: 3753067 - DNA, 21 bp, Homo sapiens
gacattaagcatcacaaatga

SEQ ID NO: 3753068 - DNA, 14 bp, Homo sapiens
gacattgcggacag

SEQ ID NO: 3753069 - DNA, 11 bp, Homo sapiens
gacatttccca

SEQ ID NO: 3753070 - DNA, 17 bp, Homo sapiens
gacatttttttcccttg

SEQ ID NO: 3753071 - DNA, 17 bp, Homo sapiens
gaccaacaagggcagtg

SEQ ID NO: 3753072 - DNA, 18 bp, Homo sapiens
gaccaacaagggcagtgg

SEQ ID NO: 3753073 - DNA, 21 bp, Homo sapiens
gaccaacatggagaaaccctg

SEQ ID NO: 3753074 - DNA, 13 bp, Homo sapiens
gaccaactgggcc

SEQ ID NO: 3753075 - DNA, 15 bp, Homo sapiens
gaccaagaactgcat

SEQ ID NO: 3753076 - DNA, 16 bp, Homo sapiens
gaccaagcaggaagct

SEQ ID NO: 3753077 - DNA, 17 bp, Homo sapiens
gaccaagcaggaagctc

SEQ ID NO: 3753078 - DNA, 20 bp, Homo sapiens
gaccaagcaggaagctcaga

SEQ ID NO: 3753079 - DNA, 13 bp, Homo sapiens
gaccaaggacccc

SEQ ID NO: 3753080 - DNA, 13 bp, Homo sapiens
gaccaattcaacc

SEQ ID NO: 3753081 - DNA, 23 bp, Homo sapiens
gaccacacttcctgtccagagag

SEQ ID NO: 3753082 - DNA, 23 bp, Homo sapiens
gaccacagggttcaaaatgtctg

SEQ ID NO: 3753083 - DNA, 18 bp, Homo sapiens
gaccacctcaaatttaaa

SEQ ID NO: 3753084 - DNA, 14 bp, Homo sapiens
gaccacctgcccaa

SEQ ID NO: 3753085 - DNA, 14 bp, Homo sapiens
gaccactgttatca

SEQ ID NO: 3753086 - DNA, 16 bp, Homo sapiens
gaccagaaatcaaaaa

SEQ ID NO: 3753087 - DNA, 23 bp, Homo sapiens
gaccagacaccttgacagggcac

SEQ ID NO: 3753088 - DNA, 21 bp, Homo sapiens
gaccagagccccacacggagg

SEQ ID NO: 3753089 - DNA, 11 bp, Homo sapiens
gaccagagctc

SEQ ID NO: 3753090 - DNA, 17 bp, Homo sapiens
gaccagagctctggagc

SEQ ID NO: 3753091 - DNA, 17 bp, Homo sapiens
gaccagcagatcccagc

SEQ ID NO: 3753092 - DNA, 20 bp, Homo sapiens
gaccagcagatcccagctca

SEQ ID NO: 3753093 - DNA, 19 bp, Homo sapiens
gaccagcatccttaagtat

SEQ ID NO: 3753094 - DNA, 20 bp, Homo sapiens
gaccagcctccatgctgcct

SEQ ID NO: 3753095 - DNA, 11 bp, Homo sapiens
gaccagcctgg

SEQ ID NO: 3753096 - DNA, 20 bp, Homo sapiens
gaccagcctggccaacatgg

SEQ ID NO: 3753097 - DNA, 12 bp, Homo sapiens
gaccagcctggg

SEQ ID NO: 3753098 - DNA, 14 bp, Homo sapiens
gaccaggactccct

SEQ ID NO: 3753099 - DNA, 23 bp, Homo sapiens
gaccaggactccctcctcacctc

SEQ ID NO: 3753100 - DNA, 23 bp, Homo sapiens
gaccaggcatcctccacaatagc

SEQ ID NO: 3753101 - DNA, 15 bp, Homo sapiens
gaccagttgcacttg

SEQ ID NO: 3753102 - DNA, 13 bp, Homo sapiens
gaccatttataat

SEQ ID NO: 3753103 - DNA, 16 bp, Homo sapiens
gacccactgatctcta

SEQ ID NO: 3753104 - DNA, 23 bp, Homo sapiens
gacccagccccttgagaaacctt

SEQ ID NO: 3753105 - DNA, 16 bp, Homo sapiens
gacccagtccctgggg

SEQ ID NO: 3753106 - DNA, 18 bp, Homo sapiens
gaccccagcggctgagtc

SEQ ID NO: 3753107 - DNA, 19 bp, Homo sapiens
gaccccagcggctgagtca

SEQ ID NO: 3753108 - DNA, 13 bp, Homo sapiens
gacccccacacct

SEQ ID NO: 3753109 - DNA, 14 bp, Homo sapiens
gacccccacccctt

SEQ ID NO: 3753110 - DNA, 16 bp, Homo sapiens
gacccccctcaggacc

SEQ ID NO: 3753111 - DNA, 13 bp, Homo sapiens
gacccctcacctt

SEQ ID NO: 3753112 - DNA, 13 bp, Homo sapiens
gacccctccatgt

SEQ ID NO: 3753113 - DNA, 13 bp, Homo sapiens
gacccctggcttt

SEQ ID NO: 3753114 - DNA, 21 bp, Homo sapiens
gacccctggcttttcactgct

SEQ ID NO: 3753115 - DNA, 22 bp, Homo sapiens
gacccctggcttttcactgctg

SEQ ID NO: 3753116 - DNA, 12 bp, Homo sapiens
gacccggctgcg

SEQ ID NO: 3753117 - DNA, 15 bp, Homo sapiens
gaccctaaatctgag

SEQ ID NO: 3753118 - DNA, 15 bp, Homo sapiens
gaccctacaggagag

SEQ ID NO: 3753119 - DNA, 17 bp, Homo sapiens
gaccctacttcctgcac

SEQ ID NO: 3753120 - DNA, 16 bp, Homo sapiens
gaccctattgctgctt

SEQ ID NO: 3753121 - DNA, 15 bp, Homo sapiens
gaccctccccgcacc

SEQ ID NO: 3753122 - DNA, 17 bp, Homo sapiens
gaccctccccgcacccc

SEQ ID NO: 3753123 - DNA, 22 bp, Homo sapiens
gaccctcctcctcccccagagg

SEQ ID NO: 3753124 - DNA, 14 bp, Homo sapiens
gaccctcgctggcc

SEQ ID NO: 3753125 - DNA, 15 bp, Homo sapiens
gaccctcgctggccc

SEQ ID NO: 3753126 - DNA, 19 bp, Homo sapiens
gaccctcgctggcccccac

SEQ ID NO: 3753127 - DNA, 20 bp, Homo sapiens
gaccctcgctggcccccact

SEQ ID NO: 3753128 - DNA, 21 bp, Homo sapiens
gaccctcgctggcccccactg

SEQ ID NO: 3753129 - DNA, 15 bp, Homo sapiens
gaccctcgtggcctt

SEQ ID NO: 3753130 - DNA, 16 bp, Homo sapiens
gaccctctccacccca

SEQ ID NO: 3753131 - DNA, 17 bp, Homo sapiens
gaccctctccaccccat

SEQ ID NO: 3753132 - DNA, 20 bp, Homo sapiens
gaccctctgaccctagctct

SEQ ID NO: 3753133 - DNA, 15 bp, Homo sapiens
gaccctgcagagatg

SEQ ID NO: 3753134 - DNA, 22 bp, Homo sapiens
gaccctgcgaaggggccctggt

SEQ ID NO: 3753135 - DNA, 17 bp, Homo sapiens
gaccgaggctggagctg

SEQ ID NO: 3753136 - DNA, 16 bp, Homo sapiens
gaccggaagctcctgg

SEQ ID NO: 3753137 - DNA, 15 bp, Homo sapiens
gaccggtacagaaag

SEQ ID NO: 3753138 - DNA, 21 bp, Homo sapiens
gacctagggatgttctggccc

SEQ ID NO: 3753139 - DNA, 23 bp, Homo sapiens
gacctataaatcattaagacaac

SEQ ID NO: 3753140 - DNA, 22 bp, Homo sapiens
gacctatgtttgctcagaacac

SEQ ID NO: 3753141 - DNA, 18 bp, Homo sapiens
gacctcagagtccaggcc

SEQ ID NO: 3753142 - DNA, 12 bp, Homo sapiens
gacctcagcctg

SEQ ID NO: 3753143 - DNA, 13 bp, Homo sapiens
gacctcagcctgt

SEQ ID NO: 3753144 - DNA, 16 bp, Homo sapiens
gacctcagcctgtgct

SEQ ID NO: 3753145 - DNA, 14 bp, Homo sapiens
gacctcagccttcc

SEQ ID NO: 3753146 - DNA, 21 bp, Homo sapiens
gacctcaggtgagaagcagag

SEQ ID NO: 3753147 - DNA, 19 bp, Homo sapiens
gacctcaggtgatccaccc

SEQ ID NO: 3753148 - DNA, 14 bp, Homo sapiens
gacctccagctgtt

SEQ ID NO: 3753149 - DNA, 12 bp, Homo sapiens
gacctccccctc

SEQ ID NO: 3753150 - DNA, 17 bp, Homo sapiens
gacctccccctccttcc

SEQ ID NO: 3753151 - DNA, 19 bp, Homo sapiens
gacctcgtcctccccctgc

SEQ ID NO: 3753152 - DNA, 21 bp, Homo sapiens
gacctcgtcctccccctgcca

SEQ ID NO: 3753153 - DNA, 23 bp, Homo sapiens
gacctctataattgccactgaga

SEQ ID NO: 3753154 - DNA, 13 bp, Homo sapiens
gacctctgcctga

SEQ ID NO: 3753155 - DNA, 13 bp, Homo sapiens
gacctctgggctt

SEQ ID NO: 3753156 - DNA, 22 bp, Homo sapiens
gacctggcactggatgcagaaa

SEQ ID NO: 3753157 - DNA, 20 bp, Homo sapiens
gacctgtcttccaaggagac

SEQ ID NO: 3753158 - DNA, 15 bp, Homo sapiens
gacctgtgaccagca

SEQ ID NO: 3753159 - DNA, 12 bp, Homo sapiens
gaccttatctgt

SEQ ID NO: 3753160 - DNA, 14 bp, Homo sapiens
gaccttatctgtgc

SEQ ID NO: 3753161 - DNA, 21 bp, Homo sapiens
gaccttatctgtgcgtgaaac

SEQ ID NO: 3753162 - DNA, 22 bp, Homo sapiens
gaccttatctgtgcgtgaaaca

SEQ ID NO: 3753163 - DNA, 13 bp, Homo sapiens
gacgcacacagct

SEQ ID NO: 3753164 - DNA, 21 bp, Homo sapiens
gacgctggtagagatggagga

SEQ ID NO: 3753165 - DNA, 14 bp, Homo sapiens
gacggagtcccacc

SEQ ID NO: 3753166 - DNA, 15 bp, Homo sapiens
gacggcctgatgctc

SEQ ID NO: 3753167 - DNA, 22 bp, Homo sapiens
gacggcctgatgctccctcccc

SEQ ID NO: 3753168 - DNA, 22 bp, Homo sapiens
gacgtccctccacgttcacccc

SEQ ID NO: 3753169 - DNA, 20 bp, Homo sapiens
gacgttcatttgtgtgctca

SEQ ID NO: 3753170 - DNA, 17 bp, Homo sapiens
gactaaagagagaatgt

SEQ ID NO: 3753171 - DNA, 18 bp, Homo sapiens
gactaaagagagaatgta

SEQ ID NO: 3753172 - DNA, 12 bp, Homo sapiens
gactacaggcac

SEQ ID NO: 3753173 - DNA, 15 bp, Homo sapiens
gactacaggcaccca

SEQ ID NO: 3753174 - DNA, 21 bp, Homo sapiens
gactacaggtgtgagtcacca

SEQ ID NO: 3753175 - DNA, 17 bp, Homo sapiens
gactactcccccaggtg

SEQ ID NO: 3753176 - DNA, 16 bp, Homo sapiens
gactagaggcttgcat

SEQ ID NO: 3753177 - DNA, 17 bp, Homo sapiens
gactagcctggcttggg

SEQ ID NO: 3753178 - DNA, 18 bp, Homo sapiens
gactagggattcaggctg

SEQ ID NO: 3753179 - DNA, 21 bp, Homo sapiens
gactagggattcaggctgctt

SEQ ID NO: 3753180 - DNA, 13 bp, Homo sapiens
gactagtgctgaa

SEQ ID NO: 3753181 - DNA, 16 bp, Homo sapiens
gactagtgctgaagct

SEQ ID NO: 3753182 - DNA, 17 bp, Homo sapiens
gactagtgctgaagctt

SEQ ID NO: 3753183 - DNA, 18 bp, Homo sapiens
gactagtgctgaagctta

SEQ ID NO: 3753184 - DNA, 19 bp, Homo sapiens
gactagtgctgaagcttat

SEQ ID NO: 3753185 - DNA, 14 bp, Homo sapiens
gactattcagtttt

SEQ ID NO: 3753186 - DNA, 22 bp, Homo sapiens
gactcaacatgttactgaccag

SEQ ID NO: 3753187 - DNA, 13 bp, Homo sapiens
gactcacctctgc

SEQ ID NO: 3753188 - DNA, 17 bp, Homo sapiens
gactcacctctgcctca

SEQ ID NO: 3753189 - DNA, 18 bp, Homo sapiens
gactcacctctgcctcaa

SEQ ID NO: 3753190 - DNA, 21 bp, Homo sapiens
gactcactggcagccccagca

SEQ ID NO: 3753191 - DNA, 23 bp, Homo sapiens
gactcacttatcccaagagaatg

SEQ ID NO: 3753192 - DNA, 17 bp, Homo sapiens
gactcagacaggaaagg

SEQ ID NO: 3753193 - DNA, 16 bp, Homo sapiens
gactcagccctgaggt

SEQ ID NO: 3753194 - DNA, 23 bp, Homo sapiens
gactcaggatgcccagggccact

SEQ ID NO: 3753195 - DNA, 14 bp, Homo sapiens
gactcagggcccca

SEQ ID NO: 3753196 - DNA, 15 bp, Homo sapiens
gactcagggccccag

SEQ ID NO: 3753197 - DNA, 14 bp, Homo sapiens
gactcattcttctg

SEQ ID NO: 3753198 - DNA, 18 bp, Homo sapiens
gactccagatctgcaccg

SEQ ID NO: 3753199 - DNA, 18 bp, Homo sapiens
gactcccaaagagctgcc

SEQ ID NO: 3753200 - DNA, 24 bp, Homo sapiens
gactccctcctcacctctggactg

SEQ ID NO: 3753201 - DNA, 14 bp, Homo sapiens
gactcctgtggaga

SEQ ID NO: 3753202 - DNA, 19 bp, Homo sapiens
gactctacctcatatcagt

SEQ ID NO: 3753203 - DNA, 19 bp, Homo sapiens
gactctaggtgcccttgga

SEQ ID NO: 3753204 - DNA, 12 bp, Homo sapiens
gactctgcctcc

SEQ ID NO: 3753205 - DNA, 16 bp, Homo sapiens
gactctgtctcaaaaa

SEQ ID NO: 3753206 - DNA, 19 bp, Homo sapiens
gactctgtctcaaaaaaac

SEQ ID NO: 3753207 - DNA, 17 bp, Homo sapiens
gactctgtggggccttg

SEQ ID NO: 3753208 - DNA, 17 bp, Homo sapiens
gactcttttgccattaa

SEQ ID NO: 3753209 - DNA, 16 bp, Homo sapiens
gactgaagcctgcagg

SEQ ID NO: 3753210 - DNA, 20 bp, Homo sapiens
gactgatgttaggctgggcc

SEQ ID NO: 3753211 - DNA, 17 bp, Homo sapiens
gactgcatggtaattta

SEQ ID NO: 3753212 - DNA, 18 bp, Homo sapiens
gactgcatggtaatttat

SEQ ID NO: 3753213 - DNA, 20 bp, Homo sapiens
gactgccccgtgcagactgg

SEQ ID NO: 3753214 - DNA, 16 bp, Homo sapiens
gactgccgaccgaggc

SEQ ID NO: 3753215 - DNA, 20 bp, Homo sapiens
gactgccgaccgaggctgga

SEQ ID NO: 3753216 - DNA, 14 bp, Homo sapiens
gactggaagcacag

SEQ ID NO: 3753217 - DNA, 16 bp, Homo sapiens
gactggaagcacagct

SEQ ID NO: 3753218 - DNA, 18 bp, Homo sapiens
gactggaagcacagcttc

SEQ ID NO: 3753219 - DNA, 20 bp, Homo sapiens
gactggaggaccacactcaa

SEQ ID NO: 3753220 - DNA, 18 bp, Homo sapiens
gactggcctgaggagcag

SEQ ID NO: 3753221 - DNA, 23 bp, Homo sapiens
gactggctagagtcctcactccc

SEQ ID NO: 3753222 - DNA, 14 bp, Homo sapiens
gactggctggctgc

SEQ ID NO: 3753223 - DNA, 19 bp, Homo sapiens
gactggctttgtcccacag

SEQ ID NO: 3753224 - DNA, 20 bp, Homo sapiens
gactggctttgtcccacagc

SEQ ID NO: 3753225 - DNA, 22 bp, Homo sapiens
gactgggaagataggctctgca

SEQ ID NO: 3753226 - DNA, 23 bp, Homo sapiens
gactgggtctcgctttgttgccc

SEQ ID NO: 3753227 - DNA, 16 bp, Homo sapiens
gactgtacacacttta

SEQ ID NO: 3753228 - DNA, 18 bp, Homo sapiens
gactgtattatacatggg

SEQ ID NO: 3753229 - DNA, 21 bp, Homo sapiens
gactgtctcaagagggcactg

SEQ ID NO: 3753230 - DNA, 23 bp, Homo sapiens
gactgtctcaagagggcactggt

SEQ ID NO: 3753231 - DNA, 13 bp, Homo sapiens
gactgtgatgcca

SEQ ID NO: 3753232 - DNA, 12 bp, Homo sapiens
gactgtggctgc

SEQ ID NO: 3753233 - DNA, 15 bp, Homo sapiens
gactgtggctgctag

SEQ ID NO: 3753234 - DNA, 21 bp, Homo sapiens
gactgttttttcctgagcttg

SEQ ID NO: 3753235 - DNA, 13 bp, Homo sapiens
gacttaaagcaga

SEQ ID NO: 3753236 - DNA, 14 bp, Homo sapiens
gacttcacactgca

SEQ ID NO: 3753237 - DNA, 22 bp, Homo sapiens
gacttcacactgcaagagcctt

SEQ ID NO: 3753238 - DNA, 15 bp, Homo sapiens
gacttcccaactgca

SEQ ID NO: 3753239 - DNA, 22 bp, Homo sapiens
gacttccccgcattccaggctc

SEQ ID NO: 3753240 - DNA, 16 bp, Homo sapiens
gacttgaaagaaaggg

SEQ ID NO: 3753241 - DNA, 21 bp, Homo sapiens
gacttgaaagcatccatgtgt

SEQ ID NO: 3753242 - DNA, 18 bp, Homo sapiens
gacttgacagaacactgt

SEQ ID NO: 3753243 - DNA, 13 bp, Homo sapiens
gacttggaagctc

SEQ ID NO: 3753244 - DNA, 16 bp, Homo sapiens
gacttggaagctccgc

SEQ ID NO: 3753245 - DNA, 17 bp, Homo sapiens
gactttagaaataaatg

SEQ ID NO: 3753246 - DNA, 18 bp, Homo sapiens
gactttagaaataaatgt

SEQ ID NO: 3753247 - DNA, 16 bp, Homo sapiens
gactttatgcaataaa

SEQ ID NO: 3753248 - DNA, 17 bp, Homo sapiens
gactttatgcaataaat

SEQ ID NO: 3753249 - DNA, 19 bp, Homo sapiens
gactttccaccccctccct

SEQ ID NO: 3753250 - DNA, 17 bp, Homo sapiens
gacttttcgttaacatt

SEQ ID NO: 3753251 - DNA, 15 bp, Homo sapiens
gagaaaattgaattt

SEQ ID NO: 3753252 - DNA, 18 bp, Homo sapiens
gagaaaattgaatttaac

SEQ ID NO: 3753253 - DNA, 19 bp, Homo sapiens
gagaaaattgaatttaaca

SEQ ID NO: 3753254 - DNA, 13 bp, Homo sapiens
gagaaacagagac

SEQ ID NO: 3753255 - DNA, 12 bp, Homo sapiens
gagaaaccctgt

SEQ ID NO: 3753256 - DNA, 23 bp, Homo sapiens
gagaaaccttattgtacctctct

SEQ ID NO: 3753257 - DNA, 19 bp, Homo sapiens
gagaaccactacatgcagc

SEQ ID NO: 3753258 - DNA, 15 bp, Homo sapiens
gagaacgccagtctc

SEQ ID NO: 3753259 - DNA, 18 bp, Homo sapiens
gagaactgcatatgtttc

SEQ ID NO: 3753260 - DNA, 19 bp, Homo sapiens
gagaagaatattgttccta

SEQ ID NO: 3753261 - DNA, 18 bp, Homo sapiens
gagaagcatatagaggca

SEQ ID NO: 3753262 - DNA, 18 bp, Homo sapiens
gagaagccaaaagattgg

SEQ ID NO: 3753263 - DNA, 16 bp, Homo sapiens
gagaagcggctggcag

SEQ ID NO: 3753264 - DNA, 17 bp, Homo sapiens
gagaagcggctggcagc

SEQ ID NO: 3753265 - DNA, 13 bp, Homo sapiens
gagaaggcaggaa

SEQ ID NO: 3753266 - DNA, 15 bp, Homo sapiens
gagaaggggaggagg

SEQ ID NO: 3753267 - DNA, 14 bp, Homo sapiens
gagaagtcaaacat

SEQ ID NO: 3753268 - DNA, 23 bp, Homo sapiens
gagaagtcttagacttgaaatac

SEQ ID NO: 3753269 - DNA, 15 bp, Homo sapiens
gagaagtgcccctgc

SEQ ID NO: 3753270 - DNA, 15 bp, Homo sapiens
gagaatctatattta

SEQ ID NO: 3753271 - DNA, 13 bp, Homo sapiens
gagaatgagggtc

SEQ ID NO: 3753272 - DNA, 15 bp, Homo sapiens
gagaattcagctgcc

SEQ ID NO: 3753273 - DNA, 15 bp, Homo sapiens
gagaattgtatcatt

SEQ ID NO: 3753274 - DNA, 21 bp, Homo sapiens
gagaattgtatcatttgaaca

SEQ ID NO: 3753275 - DNA, 17 bp, Homo sapiens
gagacaatgcagatgcc

SEQ ID NO: 3753276 - DNA, 21 bp, Homo sapiens
gagacaatgcagatgccagag

SEQ ID NO: 3753277 - DNA, 17 bp, Homo sapiens
gagacacagggcatcca

SEQ ID NO: 3753278 - DNA, 16 bp, Homo sapiens
gagacacctcagagcc

SEQ ID NO: 3753279 - DNA, 19 bp, Homo sapiens
gagacacctcagagccccg

SEQ ID NO: 3753280 - DNA, 15 bp, Homo sapiens
gagacacctgcacct

SEQ ID NO: 3753281 - DNA, 20 bp, Homo sapiens
gagacaggaaaatcctctgg

SEQ ID NO: 3753282 - DNA, 21 bp, Homo sapiens
gagacaggaaaatcctctggc

SEQ ID NO: 3753283 - DNA, 19 bp, Homo sapiens
gagacataaccactgcttc

SEQ ID NO: 3753284 - DNA, 14 bp, Homo sapiens
gagaccaacctgac

SEQ ID NO: 3753285 - DNA, 15 bp, Homo sapiens
gagaccaacctgacc

SEQ ID NO: 3753286 - DNA, 18 bp, Homo sapiens
gagaccaaggcgggagca

SEQ ID NO: 3753287 - DNA, 19 bp, Homo sapiens
gagaccagcctgggcagca

SEQ ID NO: 3753288 - DNA, 14 bp, Homo sapiens
gagacccctgtctc

SEQ ID NO: 3753289 - DNA, 15 bp, Homo sapiens
gagacccctgtctcc

SEQ ID NO: 3753290 - DNA, 19 bp, Homo sapiens
gagaccctcgtggccttcc

SEQ ID NO: 3753291 - DNA, 13 bp, Homo sapiens
gagacctcagcca

SEQ ID NO: 3753292 - DNA, 14 bp, Homo sapiens
gagacctcagccat

SEQ ID NO: 3753293 - DNA, 12 bp, Homo sapiens
gagacctgtgct

SEQ ID NO: 3753294 - DNA, 16 bp, Homo sapiens
gagactagattgcctt

SEQ ID NO: 3753295 - DNA, 18 bp, Homo sapiens
gagactcacctctgcctc

SEQ ID NO: 3753296 - DNA, 20 bp, Homo sapiens
gagactcacctctgcctcaa

SEQ ID NO: 3753297 - DNA, 13 bp, Homo sapiens
gagactcagacag

SEQ ID NO: 3753298 - DNA, 16 bp, Homo sapiens
gagactccatgagaag

SEQ ID NO: 3753299 - DNA, 21 bp, Homo sapiens
gagactgggaagataggctct

SEQ ID NO: 3753300 - DNA, 23 bp, Homo sapiens
gagactgtctcaagagggcactg

SEQ ID NO: 3753301 - DNA, 19 bp, Homo sapiens
gagactttttggtggatgt

SEQ ID NO: 3753302 - DNA, 15 bp, Homo sapiens
gagagaaggggagga

SEQ ID NO: 3753303 - DNA, 13 bp, Homo sapiens
gagagacaagaag

SEQ ID NO: 3753304 - DNA, 14 bp, Homo sapiens
gagagacccaagga

SEQ ID NO: 3753305 - DNA, 20 bp, Homo sapiens
gagagacccaaggaggaaaa

SEQ ID NO: 3753306 - DNA, 20 bp, Homo sapiens
gagagagctgagtgagctga

SEQ ID NO: 3753307 - DNA, 11 bp, Homo sapiens
gagagccagcc

SEQ ID NO: 3753308 - DNA, 14 bp, Homo sapiens
gagagccagccctc

SEQ ID NO: 3753309 - DNA, 17 bp, Homo sapiens
gagagcctgctccccca

SEQ ID NO: 3753310 - DNA, 23 bp, Homo sapiens
gagagcctgctcccccaccccct

SEQ ID NO: 3753311 - DNA, 14 bp, Homo sapiens
gagagcctgctgca

SEQ ID NO: 3753312 - DNA, 14 bp, Homo sapiens
gagagctggggaag

SEQ ID NO: 3753313 - DNA, 13 bp, Homo sapiens
gagagctggtgcc

SEQ ID NO: 3753314 - DNA, 18 bp, Homo sapiens
gagagctgttcccaaatt

SEQ ID NO: 3753315 - DNA, 19 bp, Homo sapiens
gagaggaatgcctgtgtga

SEQ ID NO: 3753316 - DNA, 16 bp, Homo sapiens
gagaggacgtgggcgg

SEQ ID NO: 3753317 - DNA, 17 bp, Homo sapiens
cttttggttgccttaaa

SEQ ID NO: 3753318 - DNA, 13 bp, Homo sapiens
cttttgtaaatgt

SEQ ID NO: 3753319 - DNA, 16 bp, Homo sapiens
cttttgtttcttccct

SEQ ID NO: 3753320 - DNA, 19 bp, Homo sapiens
ctttttaagcttatttaat

SEQ ID NO: 3753321 - DNA, 14 bp, Homo sapiens
ctttttaataaaaa

SEQ ID NO: 3753322 - DNA, 22 bp, Homo sapiens
ctttttaatattgatatgctta

SEQ ID NO: 3753323 - DNA, 16 bp, Homo sapiens
ctttttcccaataaat

SEQ ID NO: 3753324 - DNA, 17 bp, Homo sapiens
ctttttcccaataaatt

SEQ ID NO: 3753325 - DNA, 12 bp, Homo sapiens
ctttttctttat

SEQ ID NO: 3753326 - DNA, 15 bp, Homo sapiens
ctttttggtggatgt

SEQ ID NO: 3753327 - DNA, 18 bp, Homo sapiens
cttttttaaattttcttc

SEQ ID NO: 3753328 - DNA, 15 bp, Homo sapiens
cttttttacacaaat

SEQ ID NO: 3753329 - DNA, 21 bp, Homo sapiens
cttttttatggcgattcccat

SEQ ID NO: 3753330 - DNA, 13 bp, Homo sapiens
gaaaaaaactttt

SEQ ID NO: 3753331 - DNA, 23 bp, Homo sapiens
gaaaaaaacttttataaattaaa

SEQ ID NO: 3753332 - DNA, 19 bp, Homo sapiens
gaaaaaaataattttatga

SEQ ID NO: 3753333 - DNA, 13 bp, Homo sapiens
gaaaaaaatgact

SEQ ID NO: 3753334 - DNA, 23 bp, Homo sapiens
gaaaaaagaaattccctggacca

SEQ ID NO: 3753335 - DNA, 21 bp, Homo sapiens
gaaaaaataattgatttcaag

SEQ ID NO: 3753336 - DNA, 14 bp, Homo sapiens
gaaaaaatacattt

SEQ ID NO: 3753337 - DNA, 22 bp, Homo sapiens
gaaaaagcagtaactgacaact

SEQ ID NO: 3753338 - DNA, 15 bp, Homo sapiens
gaaaaaggacaggca

SEQ ID NO: 3753339 - DNA, 21 bp, Homo sapiens
gaaaaaggacaggcagaaaga

SEQ ID NO: 3753340 - DNA, 21 bp, Homo sapiens
gaaaaaggagcttacctccca

SEQ ID NO: 3753341 - DNA, 17 bp, Homo sapiens
gaaaaatttaagcattg

SEQ ID NO: 3753342 - DNA, 19 bp, Homo sapiens
gaaaaatttaagcattgtt

SEQ ID NO: 3753343 - DNA, 22 bp, Homo sapiens
gaaaaatttaagcattgtttgc

SEQ ID NO: 3753344 - DNA, 15 bp, Homo sapiens
gaaaacaacaaaaaa

SEQ ID NO: 3753345 - DNA, 17 bp, Homo sapiens
gaaaacagactcaggtt

SEQ ID NO: 3753346 - DNA, 21 bp, Homo sapiens
gaaaacaggaaaaaaactttt

SEQ ID NO: 3753347 - DNA, 19 bp, Homo sapiens
gaaaacatcactgaaatgc

SEQ ID NO: 3753348 - DNA, 15 bp, Homo sapiens
gaaaacatgtaataa

SEQ ID NO: 3753349 - DNA, 18 bp, Homo sapiens
gaaaaccaagccgtggct

SEQ ID NO: 3753350 - DNA, 14 bp, Homo sapiens
gaaaacccagagag

SEQ ID NO: 3753351 - DNA, 15 bp, Homo sapiens
gaaaacccagagagg

SEQ ID NO: 3753352 - DNA, 17 bp, Homo sapiens
gaaaacggttaaaactg

SEQ ID NO: 3753353 - DNA, 18 bp, Homo sapiens
gaaaacgttttattgtgt

SEQ ID NO: 3753354 - DNA, 16 bp, Homo sapiens
gaaaactgacagagga

SEQ ID NO: 3753355 - DNA, 19 bp, Homo sapiens
gaaaactgcaacttgtaaa

SEQ ID NO: 3753356 - DNA, 18 bp, Homo sapiens
gaaaagaaaaatgagcct

SEQ ID NO: 3753357 - DNA, 21 bp, Homo sapiens
gaaaagatggtatcatatatt

SEQ ID NO: 3753358 - DNA, 14 bp, Homo sapiens
gaaaagcacctgcc

SEQ ID NO: 3753359 - DNA, 16 bp, Homo sapiens
gaaaagcacctgccga

SEQ ID NO: 3753360 - DNA, 17 bp, Homo sapiens
gaaaagcacctgccgac

SEQ ID NO: 3753361 - DNA, 21 bp, Homo sapiens
gaaaagccatgtttaagattt

SEQ ID NO: 3753362 - DNA, 13 bp, Homo sapiens
gaaaagctgctga

SEQ ID NO: 3753363 - DNA, 19 bp, Homo sapiens
gaaaagctgctgacagtgt

SEQ ID NO: 3753364 - DNA, 21 bp, Homo sapiens
gaaaagggagattcagactgt

SEQ ID NO: 3753365 - DNA, 14 bp, Homo sapiens
gaaaataaaattaa

SEQ ID NO: 3753366 - DNA, 17 bp, Homo sapiens
gaaaataaaattaagaa

SEQ ID NO: 3753367 - DNA, 13 bp, Homo sapiens
gaaaatacaataa

SEQ ID NO: 3753368 - DNA, 21 bp, Homo sapiens
gaaaatattatctttgtaatt

SEQ ID NO: 3753369 - DNA, 16 bp, Homo sapiens
gaaaatcagcctgctc

SEQ ID NO: 3753370 - DNA, 20 bp, Homo sapiens
gaaaatcagcctgctccagc

SEQ ID NO: 3753371 - DNA, 13 bp, Homo sapiens
gaaaatcctacca

SEQ ID NO: 3753372 - DNA, 13 bp, Homo sapiens
gaaaatcctctgg

SEQ ID NO: 3753373 - DNA, 14 bp, Homo sapiens
gaaaatcctctggc

SEQ ID NO: 3753374 - DNA, 21 bp, Homo sapiens
gaaaatgtcagaaaccagtta

SEQ ID NO: 3753375 - DNA, 23 bp, Homo sapiens
gaaaatgtcagaaaccagttatg

SEQ ID NO: 3753376 - DNA, 18 bp, Homo sapiens
gaaaatgttttgtaagaa

SEQ ID NO: 3753377 - DNA, 20 bp, Homo sapiens
gaaaatgtttttctgccagg

SEQ ID NO: 3753378 - DNA, 20 bp, Homo sapiens
gaaaattgaatttaacaatg

SEQ ID NO: 3753379 - DNA, 15 bp, Homo sapiens
gaaaattggacatta

SEQ ID NO: 3753380 - DNA, 14 bp, Homo sapiens
gaaacaaaaacact

SEQ ID NO: 3753381 - DNA, 18 bp, Homo sapiens
gaaacaaagtggaaggaa

SEQ ID NO: 3753382 - DNA, 15 bp, Homo sapiens
gaaacacaatatttt

SEQ ID NO: 3753383 - DNA, 16 bp, Homo sapiens
gaaacacaccaggctg

SEQ ID NO: 3753384 - DNA, 20 bp, Homo sapiens
gaaacacactgaggcaggga

SEQ ID NO: 3753385 - DNA, 21 bp, Homo sapiens
gaaacacactgaggcagggaa

SEQ ID NO: 3753386 - DNA, 23 bp, Homo sapiens
gaaacacactgaggcagggaagt

SEQ ID NO: 3753387 - DNA, 22 bp, Homo sapiens
gaaacactgggcttctagaacc

SEQ ID NO: 3753388 - DNA, 19 bp, Homo sapiens
gaaacatcagttactctga

SEQ ID NO: 3753389 - DNA, 20 bp, Homo sapiens
gaaacatcagttactctgaa

SEQ ID NO: 3753390 - DNA, 16 bp, Homo sapiens
gaaacatctcaataaa

SEQ ID NO: 3753391 - DNA, 18 bp, Homo sapiens
gaaaccaatcaagataaa

SEQ ID NO: 3753392 - DNA, 21 bp, Homo sapiens
gaaaccaatcaagataaagga

SEQ ID NO: 3753393 - DNA, 21 bp, Homo sapiens
gaaaccattatgaagaagaga

SEQ ID NO: 3753394 - DNA, 17 bp, Homo sapiens
gaaaccttattgtacct

SEQ ID NO: 3753395 - DNA, 15 bp, Homo sapiens
gaaactaacagataa

SEQ ID NO: 3753396 - DNA, 21 bp, Homo sapiens
gaaactcacctgctggcccct

SEQ ID NO: 3753397 - DNA, 22 bp, Homo sapiens
gaaactcagagtcggaacggag

SEQ ID NO: 3753398 - DNA, 22 bp, Homo sapiens
gaaactgaggaattttctttgt

SEQ ID NO: 3753399 - DNA, 15 bp, Homo sapiens
gaaactgttgccaga

SEQ ID NO: 3753400 - DNA, 21 bp, Homo sapiens
gaaactgttgccagagatgga

SEQ ID NO: 3753401 - DNA, 17 bp, Homo sapiens
gaaacttcaagcaccag

SEQ ID NO: 3753402 - DNA, 17 bp, Homo sapiens
gaaacttgttagaaatg

SEQ ID NO: 3753403 - DNA, 13 bp, Homo sapiens
gaaactttgtgct

SEQ ID NO: 3753404 - DNA, 16 bp, Homo sapiens
gaaagaaaatatgcat

SEQ ID NO: 3753405 - DNA, 13 bp, Homo sapiens
gaaagaaggaaga

SEQ ID NO: 3753406 - DNA, 18 bp, Homo sapiens
gaaagaagtggggacaga

SEQ ID NO: 3753407 - DNA, 16 bp, Homo sapiens
gaaagagatacagagg

SEQ ID NO: 3753408 - DNA, 17 bp, Homo sapiens
gaaagagttaagaatgt

SEQ ID NO: 3753409 - DNA, 21 bp, Homo sapiens
gaaagatgctcaggtacagag

SEQ ID NO: 3753410 - DNA, 12 bp, Homo sapiens
gaaagatttgta

SEQ ID NO: 3753411 - DNA, 14 bp, Homo sapiens
gaaagcaataaatg

SEQ ID NO: 3753412 - DNA, 18 bp, Homo sapiens
gaaagcagaggctggcct

SEQ ID NO: 3753413 - DNA, 19 bp, Homo sapiens
gaaagcagctcaaaggcac

SEQ ID NO: 3753414 - DNA, 16 bp, Homo sapiens
gaaagcatcacctcag

SEQ ID NO: 3753415 - DNA, 17 bp, Homo sapiens
gaaagcatcacctcagg

SEQ ID NO: 3753416 - DNA, 19 bp, Homo sapiens
gaaagccagtcttaacatt

SEQ ID NO: 3753417 - DNA, 18 bp, Homo sapiens
gaaagccccagcactaac

SEQ ID NO: 3753418 - DNA, 22 bp, Homo sapiens
gaaagccctgagctttctgcta

SEQ ID NO: 3753419 - DNA, 23 bp, Homo sapiens
gaaagctttgaatactaaattat

SEQ ID NO: 3753420 - DNA, 11 bp, Homo sapiens
gaaaggagact

SEQ ID NO: 3753421 - DNA, 22 bp, Homo sapiens
gaaaggatgtaaacagtgcctg

SEQ ID NO: 3753422 - DNA, 14 bp, Homo sapiens
gaaaggattcatgt

SEQ ID NO: 3753423 - DNA, 17 bp, Homo sapiens
gaaaggcattctctgaa

SEQ ID NO: 3753424 - DNA, 14 bp, Homo sapiens
gaaaggccagctgg

SEQ ID NO: 3753425 - DNA, 22 bp, Homo sapiens
gaaaggccagctggcagcagag

SEQ ID NO: 3753426 - DNA, 19 bp, Homo sapiens
gaaagggacttggaagctc

SEQ ID NO: 3753427 - DNA, 17 bp, Homo sapiens
gaaagggagcagagaag

SEQ ID NO: 3753428 - DNA, 15 bp, Homo sapiens
gaaagggcccagaga

SEQ ID NO: 3753429 - DNA, 16 bp, Homo sapiens
gaaagggcccagagag

SEQ ID NO: 3753430 - DNA, 16 bp, Homo sapiens
gaaagggtgctgcttc

SEQ ID NO: 3753431 - DNA, 14 bp, Homo sapiens
gaaaggtttacatt

SEQ ID NO: 3753432 - DNA, 16 bp, Homo sapiens
gaaagtaatttcttct

SEQ ID NO: 3753433 - DNA, 19 bp, Homo sapiens
gaaagtaatttcttctcaa

SEQ ID NO: 3753434 - DNA, 19 bp, Homo sapiens
gaaagtcatgaacacatca

SEQ ID NO: 3753435 - DNA, 19 bp, Homo sapiens
gaaagtcttgtgactagtg

SEQ ID NO: 3753436 - DNA, 19 bp, Homo sapiens
gaaagtgaagcaaatcaga

SEQ ID NO: 3753437 - DNA, 16 bp, Homo sapiens
gaaagtgaataaaaat

SEQ ID NO: 3753438 - DNA, 17 bp, Homo sapiens
gaaagtgaataaaaatt

SEQ ID NO: 3753439 - DNA, 14 bp, Homo sapiens
gaaagtgtttcctt

SEQ ID NO: 3753440 - DNA, 14 bp, Homo sapiens
gaaataaaaaagtc

SEQ ID NO: 3753441 - DNA, 15 bp, Homo sapiens
gaaataaaaaagtct

SEQ ID NO: 3753442 - DNA, 17 bp, Homo sapiens
gaaataaaaaagtctct

SEQ ID NO: 3753443 - DNA, 18 bp, Homo sapiens
gaaataaaaaagtctcta

SEQ ID NO: 3753444 - DNA, 22 bp, Homo sapiens
gaaataaaaaagtctctattta

SEQ ID NO: 3753445 - DNA, 14 bp, Homo sapiens
gaaataaaaccttt

SEQ ID NO: 3753446 - DNA, 15 bp, Homo sapiens
gaaataaaacctttc

SEQ ID NO: 3753447 - DNA, 16 bp, Homo sapiens
gaaataaaacctttca

SEQ ID NO: 3753448 - DNA, 17 bp, Homo sapiens
gaaataaaacctttcaa

SEQ ID NO: 3753449 - DNA, 18 bp, Homo sapiens
gaaataaaacctttcaaa

SEQ ID NO: 3753450 - DNA, 11 bp, Homo sapiens
gaaataataaa

SEQ ID NO: 3753451 - DNA, 14 bp, Homo sapiens
gaaataataaatct

SEQ ID NO: 3753452 - DNA, 13 bp, Homo sapiens
gaaataatatgca

SEQ ID NO: 3753453 - DNA, 14 bp, Homo sapiens
gaaataatatgcat

SEQ ID NO: 3753454 - DNA, 19 bp, Homo sapiens
gaaatacgccagaactgct

SEQ ID NO: 3753455 - DNA, 21 bp, Homo sapiens
gaaatactacttaccatatgt

SEQ ID NO: 3753456 - DNA, 19 bp, Homo sapiens
gaaatagacagtatattta

SEQ ID NO: 3753457 - DNA, 17 bp, Homo sapiens
gaaatagtctgtgtgaa

SEQ ID NO: 3753458 - DNA, 15 bp, Homo sapiens
gaaatataatgcaaa

SEQ ID NO: 3753459 - DNA, 15 bp, Homo sapiens
gaaatatacacacag

SEQ ID NO: 3753460 - DNA, 13 bp, Homo sapiens
gaaatatcattta

SEQ ID NO: 3753461 - DNA, 19 bp, Homo sapiens
gaaatatctgaaaatgtat

SEQ ID NO: 3753462 - DNA, 13 bp, Homo sapiens
gaaatattatgca

SEQ ID NO: 3753463 - DNA, 15 bp, Homo sapiens
gaaatattatgcaaa

SEQ ID NO: 3753464 - DNA, 16 bp, Homo sapiens
gaaatctgtgcaataa

SEQ ID NO: 3753465 - DNA, 13 bp, Homo sapiens
gaaatgaaagaaa

SEQ ID NO: 3753466 - DNA, 19 bp, Homo sapiens
gaaatgaaattttaccaag

SEQ ID NO: 3753467 - DNA, 18 bp, Homo sapiens
gaaatgaataatttccca

SEQ ID NO: 3753468 - DNA, 23 bp, Homo sapiens
gaaatgcctaagaagatgacttc

SEQ ID NO: 3753469 - DNA, 23 bp, Homo sapiens
gaaatgccttactttgtatgata

SEQ ID NO: 3753470 - DNA, 17 bp, Homo sapiens
gaaatggcttgaagcca

SEQ ID NO: 3753471 - DNA, 15 bp, Homo sapiens
gaaatgttttaaggc

SEQ ID NO: 3753472 - DNA, 17 bp, Homo sapiens
gaaattacacccaaaga

SEQ ID NO: 3753473 - DNA, 18 bp, Homo sapiens
gaaattactacaaaattt

SEQ ID NO: 3753474 - DNA, 15 bp, Homo sapiens
gaaattggctggatg

SEQ ID NO: 3753475 - DNA, 19 bp, Homo sapiens
gaaatttaaaagacactgt

SEQ ID NO: 3753476 - DNA, 11 bp, Homo sapiens
gaaatttcaga

SEQ ID NO: 3753477 - DNA, 11 bp, Homo sapiens
gaaatttgaat

SEQ ID NO: 3753478 - DNA, 15 bp, Homo sapiens
gaaattttacaatag

SEQ ID NO: 3753479 - DNA, 16 bp, Homo sapiens
gaaattttaccaagtt

SEQ ID NO: 3753480 - DNA, 18 bp, Homo sapiens
gaaatttttattaaatta

SEQ ID NO: 3753481 - DNA, 20 bp, Homo sapiens
gaacaacctcggctcctgga

SEQ ID NO: 3753482 - DNA, 17 bp, Homo sapiens
gaacaagtgaacacatt

SEQ ID NO: 3753483 - DNA, 21 bp, Homo sapiens
gaacaagttgtttcattgact

SEQ ID NO: 3753484 - DNA, 21 bp, Homo sapiens
gaacacccgactcctcaaaag

SEQ ID NO: 3753485 - DNA, 16 bp, Homo sapiens
gaacaccctatatttt

SEQ ID NO: 3753486 - DNA, 16 bp, Homo sapiens
gaacactattttcaga

SEQ ID NO: 3753487 - DNA, 17 bp, Homo sapiens
gaacactgggggagggg

SEQ ID NO: 3753488 - DNA, 16 bp, Homo sapiens
gaacacttattgcttt

SEQ ID NO: 3753489 - DNA, 11 bp, Homo sapiens
gaacagaaaac

SEQ ID NO: 3753490 - DNA, 12 bp, Homo sapiens
gaacagaaaaca

SEQ ID NO: 3753491 - DNA, 19 bp, Homo sapiens
gaacagaaaacaacaaaaa

SEQ ID NO: 3753492 - DNA, 12 bp, Homo sapiens
gaacagaaggat

SEQ ID NO: 3753493 - DNA, 14 bp, Homo sapiens
gaacagaaggatga

SEQ ID NO: 3753494 - DNA, 18 bp, Homo sapiens
gaacagacaacagaagtc

SEQ ID NO: 3753495 - DNA, 19 bp, Homo sapiens
gaacagacaacagaagtca

SEQ ID NO: 3753496 - DNA, 15 bp, Homo sapiens
gaacagacaggagaa

SEQ ID NO: 3753497 - DNA, 16 bp, Homo sapiens
gaacagacaggagaaa

SEQ ID NO: 3753498 - DNA, 19 bp, Homo sapiens
gaacagactggaagcacag

SEQ ID NO: 3753499 - DNA, 15 bp, Homo sapiens
gaacagactggcctg

SEQ ID NO: 3753500 - DNA, 13 bp, Homo sapiens
gaacagcaggccc

SEQ ID NO: 3753501 - DNA, 15 bp, Homo sapiens
gaacagcaggcccac

SEQ ID NO: 3753502 - DNA, 18 bp, Homo sapiens
gaacagccgctcctgtct

SEQ ID NO: 3753503 - DNA, 22 bp, Homo sapiens
gaacagcgggagacctgtgcta

SEQ ID NO: 3753504 - DNA, 16 bp, Homo sapiens
gaacagtgtttcccat

SEQ ID NO: 3753505 - DNA, 18 bp, Homo sapiens
gaacagtgtttcccataa

SEQ ID NO: 3753506 - DNA, 13 bp, Homo sapiens
gaacatacttcag

SEQ ID NO: 3753507 - DNA, 18 bp, Homo sapiens
gaacatagactagagaaa

SEQ ID NO: 3753508 - DNA, 21 bp, Homo sapiens
gaacatagactagagaaaccg

SEQ ID NO: 3753509 - DNA, 23 bp, Homo sapiens
gaacatccaaggagaaacagaga

SEQ ID NO: 3753510 - DNA, 15 bp, Homo sapiens
gaacatccctgccag

SEQ ID NO: 3753511 - DNA, 16 bp, Homo sapiens
gaacatgtacactggt

SEQ ID NO: 3753512 - DNA, 20 bp, Homo sapiens
gaacatgttggtatttatct

SEQ ID NO: 3753513 - DNA, 20 bp, Homo sapiens
gaaccaaaacattccgttta

SEQ ID NO: 3753514 - DNA, 20 bp, Homo sapiens
gaaccacatcttgctctgct

SEQ ID NO: 3753515 - DNA, 17 bp, Homo sapiens
gaaccaccacacccagc

SEQ ID NO: 3753516 - DNA, 18 bp, Homo sapiens
gaaccaccacacccagcc

SEQ ID NO: 3753517 - DNA, 21 bp, Homo sapiens
gaaccaccacacccagcccac

SEQ ID NO: 3753518 - DNA, 19 bp, Homo sapiens
gaaccactacatgcagccc

SEQ ID NO: 3753519 - DNA, 14 bp, Homo sapiens
gaacccacctgctg

SEQ ID NO: 3753520 - DNA, 19 bp, Homo sapiens
gaacccacctgctgagaga

SEQ ID NO: 3753521 - DNA, 21 bp, Homo sapiens
gaacccctacatgaaacagaa

SEQ ID NO: 3753522 - DNA, 22 bp, Homo sapiens
gaaccctggtgaggaagctcca

SEQ ID NO: 3753523 - DNA, 14 bp, Homo sapiens
gaaccgaaaggcca

SEQ ID NO: 3753524 - DNA, 15 bp, Homo sapiens
gaaccgcaggaagct

SEQ ID NO: 3753525 - DNA, 18 bp, Homo sapiens
gaacctcacgcacctccc

SEQ ID NO: 3753526 - DNA, 20 bp, Homo sapiens
gaacctcacgcacctcccat

SEQ ID NO: 3753527 - DNA, 21 bp, Homo sapiens
gaacctcacgcacctcccatc

SEQ ID NO: 3753528 - DNA, 18 bp, Homo sapiens
gaacctcaggcttccttg

SEQ ID NO: 3753529 - DNA, 23 bp, Homo sapiens
gaacggacgagataatgtgaact

SEQ ID NO: 3753530 - DNA, 14 bp, Homo sapiens
gaacggggagaaaa

SEQ ID NO: 3753531 - DNA, 16 bp, Homo sapiens
gaacggggtccttcaa

SEQ ID NO: 3753532 - DNA, 14 bp, Homo sapiens
gaacgtgactgccc

SEQ ID NO: 3753533 - DNA, 22 bp, Homo sapiens
gaacgtgactgccccaactcct

SEQ ID NO: 3753534 - DNA, 19 bp, Homo sapiens
gaactagactgcctgggtt

SEQ ID NO: 3753535 - DNA, 13 bp, Homo sapiens
gaactagctggaa

SEQ ID NO: 3753536 - DNA, 19 bp, Homo sapiens
gaactagctggaatttttt

SEQ ID NO: 3753537 - DNA, 15 bp, Homo sapiens
gaactataaagaagt

SEQ ID NO: 3753538 - DNA, 22 bp, Homo sapiens
gaactattggagggtgggagag

SEQ ID NO: 3753539 - DNA, 14 bp, Homo sapiens
gaactcattcctgc

SEQ ID NO: 3753540 - DNA, 22 bp, Homo sapiens
gaactcattcctgcctgtctcc

SEQ ID NO: 3753541 - DNA, 20 bp, Homo sapiens
gaactcctgggctcaagcag

SEQ ID NO: 3753542 - DNA, 20 bp, Homo sapiens
gaactcgcttctctgtgact

SEQ ID NO: 3753543 - DNA, 22 bp, Homo sapiens
gaactctttctggcctgccttc

SEQ ID NO: 3753544 - DNA, 16 bp, Homo sapiens
gaactgaaaacataaa

SEQ ID NO: 3753545 - DNA, 21 bp, Homo sapiens
gaactgcatatgtttcgctga

SEQ ID NO: 3753546 - DNA, 15 bp, Homo sapiens
gaactgcatggacct

SEQ ID NO: 3753547 - DNA, 17 bp, Homo sapiens
gaactgcctctttcctg

SEQ ID NO: 3753548 - DNA, 21 bp, Homo sapiens
gaactgctttatcccacggaa

SEQ ID NO: 3753549 - DNA, 15 bp, Homo sapiens
gaactggactcagga

SEQ ID NO: 3753550 - DNA, 15 bp, Homo sapiens
gaactggaggccagg

SEQ ID NO: 3753551 - DNA, 11 bp, Homo sapiens
gaactggctgc

SEQ ID NO: 3753552 - DNA, 15 bp, Homo sapiens
gaacttaaataaatg

SEQ ID NO: 3753553 - DNA, 24 bp, Homo sapiens
gaactttccacattcagagcttac

SEQ ID NO: 3753554 - DNA, 18 bp, Homo sapiens
gaagaaaaaatacatttt

SEQ ID NO: 3753555 - DNA, 16 bp, Homo sapiens
gaagaacatccaagga

SEQ ID NO: 3753556 - DNA, 17 bp, Homo sapiens
gaagaacatccaaggag

SEQ ID NO: 3753557 - DNA, 20 bp, Homo sapiens
gaagaacatccaaggagaaa

SEQ ID NO: 3753558 - DNA, 13 bp, Homo sapiens
gaagaagaaaaca

SEQ ID NO: 3753559 - DNA, 19 bp, Homo sapiens
gaagaatattgttcctaag

SEQ ID NO: 3753560 - DNA, 22 bp, Homo sapiens
gaagaatattgttcctaagttc

SEQ ID NO: 3753561 - DNA, 20 bp, Homo sapiens
gaagaattgaacccaggagg

SEQ ID NO: 3753562 - DNA, 16 bp, Homo sapiens
gaagacaaaaatactc

SEQ ID NO: 3753563 - DNA, 23 bp, Homo sapiens
gaagacaatgtgaaaagaaaaat

SEQ ID NO: 3753564 - DNA, 18 bp, Homo sapiens
gaagacatgaaccaagtg

SEQ ID NO: 3753565 - DNA, 14 bp, Homo sapiens
gaagaccctccccg

SEQ ID NO: 3753566 - DNA, 22 bp, Homo sapiens
gaagacctgctgagggaccagc

SEQ ID NO: 3753567 - DNA, 20 bp, Homo sapiens
gaagactgtcagcttccaaa

SEQ ID NO: 3753568 - DNA, 21 bp, Homo sapiens
gaagagagtccatatttcaat

SEQ ID NO: 3753569 - DNA, 12 bp, Homo sapiens
gaagagcagccc

SEQ ID NO: 3753570 - DNA, 17 bp, Homo sapiens
gaagagctattatataa

SEQ ID NO: 3753571 - DNA, 17 bp, Homo sapiens
gaagaggaactgggcct

SEQ ID NO: 3753572 - DNA, 18 bp, Homo sapiens
gaagagtgggtttcacaa

SEQ ID NO: 3753573 - DNA, 16 bp, Homo sapiens
gaagataccatcagca

SEQ ID NO: 3753574 - DNA, 13 bp, Homo sapiens
gaagatagaagaa

SEQ ID NO: 3753575 - DNA, 19 bp, Homo sapiens
gaagatgtcatcccattgt

SEQ ID NO: 3753576 - DNA, 15 bp, Homo sapiens
gaagattatttttta

SEQ ID NO: 3753577 - DNA, 16 bp, Homo sapiens
gaagcaacagaaaaaa

SEQ ID NO: 3753578 - DNA, 13 bp, Homo sapiens
gaagcacagcttc

SEQ ID NO: 3753579 - DNA, 15 bp, Homo sapiens
gaagcagaggaagga

SEQ ID NO: 3753580 - DNA, 19 bp, Homo sapiens
gaagcagatgcaaagaggc

SEQ ID NO: 3753581 - DNA, 18 bp, Homo sapiens
gaagcaggttgaggggct

SEQ ID NO: 3753582 - DNA, 16 bp, Homo sapiens
gaagcagtgagccgca

SEQ ID NO: 3753583 - DNA, 17 bp, Homo sapiens
gaagcagtgccttccat

SEQ ID NO: 3753584 - DNA, 18 bp, Homo sapiens
gaagcatttactttgtgt

SEQ ID NO: 3753585 - DNA, 15 bp, Homo sapiens
gaagccacagcccag

SEQ ID NO: 3753586 - DNA, 18 bp, Homo sapiens
gaagccacagcccaggcc

SEQ ID NO: 3753587 - DNA, 14 bp, Homo sapiens
gaagcccagctcca

SEQ ID NO: 3753588 - DNA, 17 bp, Homo sapiens
gaagcccagctccaggg

SEQ ID NO: 3753589 - DNA, 21 bp, Homo sapiens
gaagcccattcctctgccagg

SEQ ID NO: 3753590 - DNA, 16 bp, Homo sapiens
gaagccctccttccac

SEQ ID NO: 3753591 - DNA, 21 bp, Homo sapiens
gaagccctggatttcagaaag

SEQ ID NO: 3753592 - DNA, 14 bp, Homo sapiens
gaagccgctgctgg

SEQ ID NO: 3753593 - DNA, 13 bp, Homo sapiens
gaagcctctggct

SEQ ID NO: 3753594 - DNA, 17 bp, Homo sapiens
gaagctcagcccacccc

SEQ ID NO: 3753595 - DNA, 18 bp, Homo sapiens
gaagctcagcccaccccc

SEQ ID NO: 3753596 - DNA, 19 bp, Homo sapiens
gaagctccagtcctgctct

SEQ ID NO: 3753597 - DNA, 20 bp, Homo sapiens
gaagctccagtcctgctctc

SEQ ID NO: 3753598 - DNA, 12 bp, Homo sapiens
gaagctcctggt

SEQ ID NO: 3753599 - DNA, 13 bp, Homo sapiens
gaagctctgaagt

SEQ ID NO: 3753600 - DNA, 17 bp, Homo sapiens
gaagctgtgtccttgca

SEQ ID NO: 3753601 - DNA, 20 bp, Homo sapiens
gaagctgtgtccttgcacct

SEQ ID NO: 3753602 - DNA, 22 bp, Homo sapiens
gaagctgtgtccttgcacctgc

SEQ ID NO: 3753603 - DNA, 20 bp, Homo sapiens
gaagcttattaatgctaagg

SEQ ID NO: 3753604 - DNA, 21 bp, Homo sapiens
gaagcttattaatgctaaggg

SEQ ID NO: 3753605 - DNA, 20 bp, Homo sapiens
gaagctttctctgcttcagc

SEQ ID NO: 3753606 - DNA, 15 bp, Homo sapiens
gaaggaaatgaacca

SEQ ID NO: 3753607 - DNA, 15 bp, Homo sapiens
gaaggaaatgaattt

SEQ ID NO: 3753608 - DNA, 23 bp, Homo sapiens
gaaggaaggagactcacctctgc

SEQ ID NO: 3753609 - DNA, 22 bp, Homo sapiens
gaaggaataaattgctccttga

SEQ ID NO: 3753610 - DNA, 15 bp, Homo sapiens
gaaggaattgacttc

SEQ ID NO: 3753611 - DNA, 21 bp, Homo sapiens
gaaggacattgcggacagcca

SEQ ID NO: 3753612 - DNA, 23 bp, Homo sapiens
gaaggacccggaggggcctggca

SEQ ID NO: 3753613 - DNA, 21 bp, Homo sapiens
gaaggacccttcagaggtggc

SEQ ID NO: 3753614 - DNA, 17 bp, Homo sapiens
gaaggacctatgtttgc

SEQ ID NO: 3753615 - DNA, 16 bp, Homo sapiens
gaaggagaaggaagga

SEQ ID NO: 3753616 - DNA, 17 bp, Homo sapiens
gaaggagaaggaaggag

SEQ ID NO: 3753617 - DNA, 15 bp, Homo sapiens
gaaggagacagagct

SEQ ID NO: 3753618 - DNA, 20 bp, Homo sapiens
gaaggagagaaggggaggag

SEQ ID NO: 3753619 - DNA, 16 bp, Homo sapiens
gaaggatgagcattta

SEQ ID NO: 3753620 - DNA, 17 bp, Homo sapiens
gaaggatgtacatttcc

SEQ ID NO: 3753621 - DNA, 12 bp, Homo sapiens
gaaggcaaaaaa

SEQ ID NO: 3753622 - DNA, 12 bp, Homo sapiens
gaaggctgtcct

SEQ ID NO: 3753623 - DNA, 21 bp, Homo sapiens
gaagggactaggagcactgta

SEQ ID NO: 3753624 - DNA, 16 bp, Homo sapiens
gaagggagagccagct

SEQ ID NO: 3753625 - DNA, 21 bp, Homo sapiens
gaagggcttggactcaagcaa

SEQ ID NO: 3753626 - DNA, 22 bp, Homo sapiens
gaaggggaggacctctgggctt

SEQ ID NO: 3753627 - DNA, 23 bp, Homo sapiens
gaaggggaggcagccggcaccca

SEQ ID NO: 3753628 - DNA, 19 bp, Homo sapiens
gaagggggcatctggcctt

SEQ ID NO: 3753629 - DNA, 14 bp, Homo sapiens
gaagggggccatga

SEQ ID NO: 3753630 - DNA, 21 bp, Homo sapiens
gaagggtccttccctctcccc

SEQ ID NO: 3753631 - DNA, 23 bp, Homo sapiens
gaaggtcttgatttgttttagaa

SEQ ID NO: 3753632 - DNA, 22 bp, Homo sapiens
gaaggtgccccaaaatgcaaga

SEQ ID NO: 3753633 - DNA, 23 bp, Homo sapiens
gaaggtgggggttggctgggtac

SEQ ID NO: 3753634 - DNA, 15 bp, Homo sapiens
gaaggttgtgatgaa

SEQ ID NO: 3753635 - DNA, 23 bp, Homo sapiens
gaagtaggaagtgaaaataggta

SEQ ID NO: 3753636 - DNA, 20 bp, Homo sapiens
gaagtcactcaattgttttt

SEQ ID NO: 3753637 - DNA, 20 bp, Homo sapiens
gaagtctaggagctgggagg

SEQ ID NO: 3753638 - DNA, 16 bp, Homo sapiens
gaagtgaccaaggagg

SEQ ID NO: 3753639 - DNA, 13 bp, Homo sapiens
gaagtgcccctgc

SEQ ID NO: 3753640 - DNA, 16 bp, Homo sapiens
gaagtggaccaggaca

SEQ ID NO: 3753641 - DNA, 20 bp, Homo sapiens
gaagtgtccgagaactaaag

SEQ ID NO: 3753642 - DNA, 17 bp, Homo sapiens
gaagttgcagtgagctg

SEQ ID NO: 3753643 - DNA, 13 bp, Homo sapiens
gaagttggacagc

SEQ ID NO: 3753644 - DNA, 18 bp, Homo sapiens
gaagttgggcaatataac

SEQ ID NO: 3753645 - DNA, 23 bp, Homo sapiens
gaagttttcaggacttggtctga

SEQ ID NO: 3753646 - DNA, 12 bp, Homo sapiens
gaagttttgcat

SEQ ID NO: 3753647 - DNA, 17 bp, Homo sapiens
gaataaagcctgctttt

SEQ ID NO: 3753648 - DNA, 19 bp, Homo sapiens
gaataacatgtaattaagt

SEQ ID NO: 3753649 - DNA, 22 bp, Homo sapiens
gaataaccacttaaaaaatgtc

SEQ ID NO: 3753650 - DNA, 17 bp, Homo sapiens
gaataatacagtatctc

SEQ ID NO: 3753651 - DNA, 22 bp, Homo sapiens
gaataatctttgggtaacttca

SEQ ID NO: 3753652 - DNA, 21 bp, Homo sapiens
gaataatgtgggaagaaacaa

SEQ ID NO: 3753653 - DNA, 21 bp, Homo sapiens
gaataatttcccaattaggaa

SEQ ID NO: 3753654 - DNA, 14 bp, Homo sapiens
gaatacagaaagat

SEQ ID NO: 3753655 - DNA, 23 bp, Homo sapiens
gaatacagggcatgcattttgca

SEQ ID NO: 3753656 - DNA, 20 bp, Homo sapiens
gaatacagtgttattttctt

SEQ ID NO: 3753657 - DNA, 13 bp, Homo sapiens
gaatagaaggaaa

SEQ ID NO: 3753658 - DNA, 15 bp, Homo sapiens
gaatagatgctgact

SEQ ID NO: 3753659 - DNA, 23 bp, Homo sapiens
gaatagctgggactacaggtgtg

SEQ ID NO: 3753660 - DNA, 14 bp, Homo sapiens
gaatataaacacta

SEQ ID NO: 3753661 - DNA, 21 bp, Homo sapiens
gaatataaacactatatggca

SEQ ID NO: 3753662 - DNA, 21 bp, Homo sapiens
gaatataccccttagtgtttg

SEQ ID NO: 3753663 - DNA, 22 bp, Homo sapiens
gaatatgaacggtgagcattgt

SEQ ID NO: 3753664 - DNA, 12 bp, Homo sapiens
gaatattagctt

SEQ ID NO: 3753665 - DNA, 10 bp, Homo sapiens
gaatatttat

SEQ ID NO: 3753666 - DNA, 18 bp, Homo sapiens
gaatatttatatttcact

SEQ ID NO: 3753667 - DNA, 13 bp, Homo sapiens
gaatatttattac

SEQ ID NO: 3753668 - DNA, 15 bp, Homo sapiens
gaatatttattacct

SEQ ID NO: 3753669 - DNA, 19 bp, Homo sapiens
gaatatttattacctctga

SEQ ID NO: 3753670 - DNA, 18 bp, Homo sapiens
gaatattttattcaaggt

SEQ ID NO: 3753671 - DNA, 17 bp, Homo sapiens
gaatcaacagggcagca

SEQ ID NO: 3753672 - DNA, 13 bp, Homo sapiens
gaatcagaaacag

SEQ ID NO: 3753673 - DNA, 19 bp, Homo sapiens
gaatcagatcatttcaaaa

SEQ ID NO: 3753674 - DNA, 19 bp, Homo sapiens
gaatcatacttagcaaagt

SEQ ID NO: 3753675 - DNA, 13 bp, Homo sapiens
gaatcattattta

SEQ ID NO: 3753676 - DNA, 16 bp, Homo sapiens
gaatcattatttatta

SEQ ID NO: 3753677 - DNA, 14 bp, Homo sapiens
gaatcattgcttat

SEQ ID NO: 3753678 - DNA, 16 bp, Homo sapiens
gaatccaagcgaggtc

SEQ ID NO: 3753679 - DNA, 17 bp, Homo sapiens
gaatctagaagaaatga

SEQ ID NO: 3753680 - DNA, 20 bp, Homo sapiens
gaatctagaagaaatgaaat

SEQ ID NO: 3753681 - DNA, 21 bp, Homo sapiens
gaatctagaagaaatgaaatt

SEQ ID NO: 3753682 - DNA, 13 bp, Homo sapiens
gaatctatattta

SEQ ID NO: 3753683 - DNA, 13 bp, Homo sapiens
gaatctgaatgta

SEQ ID NO: 3753684 - DNA, 20 bp, Homo sapiens
gaatgaaaaatttaagcatt

SEQ ID NO: 3753685 - DNA, 23 bp, Homo sapiens
gaatgaaaaatttaagcattgtt

SEQ ID NO: 3753686 - DNA, 21 bp, Homo sapiens
gaatgaaagggcccagagagg

SEQ ID NO: 3753687 - DNA, 23 bp, Homo sapiens
gaatgaaatcctgcttcagtgta

SEQ ID NO: 3753688 - DNA, 21 bp, Homo sapiens
gaatgaagataccatcagcaa

SEQ ID NO: 3753689 - DNA, 20 bp, Homo sapiens
gaatgaggaggaaggagaga

SEQ ID NO: 3753690 - DNA, 14 bp, Homo sapiens
gaatgaggtcccag

SEQ ID NO: 3753691 - DNA, 16 bp, Homo sapiens
gaatgaggtcccaggc

SEQ ID NO: 3753692 - DNA, 22 bp, Homo sapiens
gaatgaggtcccaggcagagaa

SEQ ID NO: 3753693 - DNA, 13 bp, Homo sapiens
gaatgatgaagct

SEQ ID NO: 3753694 - DNA, 23 bp, Homo sapiens
gaatgattctaatttttaagcaa

SEQ ID NO: 3753695 - DNA, 20 bp, Homo sapiens
gaatgatttccaaagagaaa

SEQ ID NO: 3753696 - DNA, 22 bp, Homo sapiens
gaatgcacactagcctctccag

SEQ ID NO: 3753697 - DNA, 14 bp, Homo sapiens
gaatgcataaaatg

SEQ ID NO: 3753698 - DNA, 13 bp, Homo sapiens
gaatgcctcctcc

SEQ ID NO: 3753699 - DNA, 23 bp, Homo sapiens
gaatgcggcaagaaggaattgac

SEQ ID NO: 3753700 - DNA, 16 bp, Homo sapiens
gaatgctaacagttca

SEQ ID NO: 3753701 - DNA, 11 bp, Homo sapiens
gaatgctcccc

SEQ ID NO: 3753702 - DNA, 20 bp, Homo sapiens
gaatgctcccccatcctccc

SEQ ID NO: 3753703 - DNA, 19 bp, Homo sapiens
gaatgcttggaatatctgc

SEQ ID NO: 3753704 - DNA, 19 bp, Homo sapiens
gaatggtagtctaaccaaa

SEQ ID NO: 3753705 - DNA, 11 bp, Homo sapiens
gaatgtaatca

SEQ ID NO: 3753706 - DNA, 23 bp, Homo sapiens
gaatgtaatttgtgtaataaagt

SEQ ID NO: 3753707 - DNA, 15 bp, Homo sapiens
gaatgtatcaggaaa

SEQ ID NO: 3753708 - DNA, 16 bp, Homo sapiens
gaatgtattattctgc

SEQ ID NO: 3753709 - DNA, 18 bp, Homo sapiens
gaatgtattattctgcag

SEQ ID NO: 3753710 - DNA, 19 bp, Homo sapiens
gaatgtattattctgcagc

SEQ ID NO: 3753711 - DNA, 15 bp, Homo sapiens
gaatgtcagattcct

SEQ ID NO: 3753712 - DNA, 19 bp, Homo sapiens
gaatgtcagattcctttcc

SEQ ID NO: 3753713 - DNA, 22 bp, Homo sapiens
gaatgtctttgttggaaaagaa

SEQ ID NO: 3753714 - DNA, 17 bp, Homo sapiens
gaatgttacattgtttg

SEQ ID NO: 3753715 - DNA, 11 bp, Homo sapiens
gaatgttctga

SEQ ID NO: 3753716 - DNA, 17 bp, Homo sapiens
gaatgttctgacattaa

SEQ ID NO: 3753717 - DNA, 20 bp, Homo sapiens
gaatgttctgacattaacag

SEQ ID NO: 3753718 - DNA, 20 bp, Homo sapiens
gaatgtttacactctttgta

SEQ ID NO: 3753719 - DNA, 17 bp, Homo sapiens
gaatgtttgcctctgcc

SEQ ID NO: 3753720 - DNA, 12 bp, Homo sapiens
gaattaaaacaa

SEQ ID NO: 3753721 - DNA, 16 bp, Homo sapiens
gaattaacctggtgct

SEQ ID NO: 3753722 - DNA, 14 bp, Homo sapiens
gaattcagctgccc

SEQ ID NO: 3753723 - DNA, 17 bp, Homo sapiens
gaattctcagaatctca

SEQ ID NO: 3753724 - DNA, 19 bp, Homo sapiens
gaattctgctacctcactg

SEQ ID NO: 3753725 - DNA, 18 bp, Homo sapiens
gaattcttacatgttttc

SEQ ID NO: 3753726 - DNA, 16 bp, Homo sapiens
gaattgaacccaggag

SEQ ID NO: 3753727 - DNA, 18 bp, Homo sapiens
gaattgacttcgactgtg

SEQ ID NO: 3753728 - DNA, 20 bp, Homo sapiens
gaattgatttcccttcttct

SEQ ID NO: 3753729 - DNA, 23 bp, Homo sapiens
gaattgcattttttaaaacaaga

SEQ ID NO: 3753730 - DNA, 14 bp, Homo sapiens
gaattgtatcattt

SEQ ID NO: 3753731 - DNA, 14 bp, Homo sapiens
gaattgtccccagt

SEQ ID NO: 3753732 - DNA, 23 bp, Homo sapiens
gaattgtccccagtttgcagaaa

SEQ ID NO: 3753733 - DNA, 18 bp, Homo sapiens
gaattgtgaccaagttat

SEQ ID NO: 3753734 - DNA, 16 bp, Homo sapiens
gaatttaacaatgcga

SEQ ID NO: 3753735 - DNA, 13 bp, Homo sapiens
gaatttataaccc

SEQ ID NO: 3753736 - DNA, 22 bp, Homo sapiens
gaatttatcacacttctgtgag

SEQ ID NO: 3753737 - DNA, 17 bp, Homo sapiens
gaatttcccacataccc

SEQ ID NO: 3753738 - DNA, 17 bp, Homo sapiens
gaatttctaaaaaacag

SEQ ID NO: 3753739 - DNA, 21 bp, Homo sapiens
gaatttcttggtaagaagccg

SEQ ID NO: 3753740 - DNA, 19 bp, Homo sapiens
gaatttgaagctgcagtga

SEQ ID NO: 3753741 - DNA, 16 bp, Homo sapiens
gaatttgaatctcaat

SEQ ID NO: 3753742 - DNA, 19 bp, Homo sapiens
gaatttggcctgcactaat

SEQ ID NO: 3753743 - DNA, 15 bp, Homo sapiens
gaattttgttgctgt

SEQ ID NO: 3753744 - DNA, 16 bp, Homo sapiens
gaatttttattatgca

SEQ ID NO: 3753745 - DNA, 17 bp, Homo sapiens
gaatttttattatgcat

SEQ ID NO: 3753746 - DNA, 16 bp, Homo sapiens
gaatttttcattgata

SEQ ID NO: 3753747 - DNA, 14 bp, Homo sapiens
gaatttttctctaa

SEQ ID NO: 3753748 - DNA, 17 bp, Homo sapiens
gaattttttattcttgt

SEQ ID NO: 3753749 - DNA, 19 bp, Homo sapiens
gaattttttattcttgtga

SEQ ID NO: 3753750 - DNA, 20 bp, Homo sapiens
gaatttttttcatcttctct

SEQ ID NO: 3753751 - DNA, 22 bp, Homo sapiens
gaatttttttcatcttctctgg

SEQ ID NO: 3753752 - DNA, 21 bp, Homo sapiens
gacaaagacaaattctgtttc

SEQ ID NO: 3753753 - DNA, 20 bp, Homo sapiens
gacaaagctgctaaatctcc

SEQ ID NO: 3753754 - DNA, 17 bp, Homo sapiens
gacaaaggacatttgtt

SEQ ID NO: 3753755 - DNA, 17 bp, Homo sapiens
gacaaagtctccagccc

SEQ ID NO: 3753756 - DNA, 12 bp, Homo sapiens
gacaaattctgt

SEQ ID NO: 3753757 - DNA, 20 bp, Homo sapiens
gacaaattctgtttcttgag

SEQ ID NO: 3753758 - DNA, 17 bp, Homo sapiens
gacaaatttaaaacaaa

SEQ ID NO: 3753759 - DNA, 21 bp, Homo sapiens
gacaacaaattaggttttgta

SEQ ID NO: 3753760 - DNA, 23 bp, Homo sapiens
gacaacaaattaggttttgtaca

SEQ ID NO: 3753761 - DNA, 12 bp, Homo sapiens
gacaacattaaa

SEQ ID NO: 3753762 - DNA, 15 bp, Homo sapiens
gacaacgaggaagcc

SEQ ID NO: 3753763 - DNA, 19 bp, Homo sapiens
gacaagaagcaaatttttt

SEQ ID NO: 3753764 - DNA, 12 bp, Homo sapiens
gacaagccccag

SEQ ID NO: 3753765 - DNA, 17 bp, Homo sapiens
gacaagccccaggcagg

SEQ ID NO: 3753766 - DNA, 19 bp, Homo sapiens
gacaaggattgctactgtc

SEQ ID NO: 3753767 - DNA, 16 bp, Homo sapiens
gacaaggccccagaga

SEQ ID NO: 3753768 - DNA, 21 bp, Homo sapiens
gacaaggtagccctggccaga

SEQ ID NO: 3753769 - DNA, 16 bp, Homo sapiens
gacaatgcagatgcca

SEQ ID NO: 3753770 - DNA, 20 bp, Homo sapiens
gacaatgcagatgccagagc

SEQ ID NO: 3753771 - DNA, 19 bp, Homo sapiens
gacaatgtgaaaagaaaaa

SEQ ID NO: 3753772 - DNA, 13 bp, Homo sapiens
gacacaaaaaaag

SEQ ID NO: 3753773 - DNA, 21 bp, Homo sapiens
gacacacagctctgtcctggg

SEQ ID NO: 3753774 - DNA, 15 bp, Homo sapiens
gagaggcaatggcca

SEQ ID NO: 3753775 - DNA, 22 bp, Homo sapiens
gagaggcagacttccctgaatg

SEQ ID NO: 3753776 - DNA, 15 bp, Homo sapiens
gagaggccttttgga

SEQ ID NO: 3753777 - DNA, 19 bp, Homo sapiens
gagagggacagcccactga

SEQ ID NO: 3753778 - DNA, 13 bp, Homo sapiens
gagaggggcacag

SEQ ID NO: 3753779 - DNA, 24 bp, Homo sapiens
gagaggtcaagcccaggaggactg

SEQ ID NO: 3753780 - DNA, 16 bp, Homo sapiens
gagagtggctcctccc

SEQ ID NO: 3753781 - DNA, 20 bp, Homo sapiens
gagatcacgccactgcactc

SEQ ID NO: 3753782 - DNA, 13 bp, Homo sapiens
gagatcagcctgg

SEQ ID NO: 3753783 - DNA, 18 bp, Homo sapiens
gagatccagggcaaggcc

SEQ ID NO: 3753784 - DNA, 21 bp, Homo sapiens
gagatgaagagtgagagggca

SEQ ID NO: 3753785 - DNA, 15 bp, Homo sapiens
gagatgaagcaaaca

SEQ ID NO: 3753786 - DNA, 21 bp, Homo sapiens
gagatgactgagtcctcgtag

SEQ ID NO: 3753787 - DNA, 12 bp, Homo sapiens
gagatgcctccc

SEQ ID NO: 3753788 - DNA, 13 bp, Homo sapiens
gagatggaggagg

SEQ ID NO: 3753789 - DNA, 14 bp, Homo sapiens
gagatggaggagga

SEQ ID NO: 3753790 - DNA, 15 bp, Homo sapiens
gagatggaggaggag

SEQ ID NO: 3753791 - DNA, 23 bp, Homo sapiens
gagatggatcaatcaaacccggc

SEQ ID NO: 3753792 - DNA, 15 bp, Homo sapiens
gagatggccctctgg

SEQ ID NO: 3753793 - DNA, 16 bp, Homo sapiens
gagatggccctctggt

SEQ ID NO: 3753794 - DNA, 17 bp, Homo sapiens
gagatgggactgggagg

SEQ ID NO: 3753795 - DNA, 18 bp, Homo sapiens
gagatgggcttgttttct

SEQ ID NO: 3753796 - DNA, 18 bp, Homo sapiens
gagatggggagaaaccta

SEQ ID NO: 3753797 - DNA, 17 bp, Homo sapiens
gagatgtaaaaggtatt

SEQ ID NO: 3753798 - DNA, 18 bp, Homo sapiens
gagatttcttgttgctca

SEQ ID NO: 3753799 - DNA, 15 bp, Homo sapiens
gagcaagacagagac

SEQ ID NO: 3753800 - DNA, 13 bp, Homo sapiens
gagcaagcttttt

SEQ ID NO: 3753801 - DNA, 13 bp, Homo sapiens
gagcacactgtag

SEQ ID NO: 3753802 - DNA, 13 bp, Homo sapiens
gagcaccaggcac

SEQ ID NO: 3753803 - DNA, 13 bp, Homo sapiens
gagcaccagggga

SEQ ID NO: 3753804 - DNA, 22 bp, Homo sapiens
gagcaccgcctgtgaaatacca

SEQ ID NO: 3753805 - DNA, 21 bp, Homo sapiens
gagcactctgagtttaccatt

SEQ ID NO: 3753806 - DNA, 15 bp, Homo sapiens
gagcactgtataccc

SEQ ID NO: 3753807 - DNA, 18 bp, Homo sapiens
gagcagactggtgagcag

SEQ ID NO: 3753808 - DNA, 15 bp, Homo sapiens
gagcagactggtggg

SEQ ID NO: 3753809 - DNA, 13 bp, Homo sapiens
gagcagaggcagc

SEQ ID NO: 3753810 - DNA, 18 bp, Homo sapiens
gagcagcggacttcaaaa

SEQ ID NO: 3753811 - DNA, 19 bp, Homo sapiens
gagcaggcacatggaggag

SEQ ID NO: 3753812 - DNA, 11 bp, Homo sapiens
gagcagtgtct

SEQ ID NO: 3753813 - DNA, 18 bp, Homo sapiens
gagcagtgtgtctcctgc

SEQ ID NO: 3753814 - DNA, 20 bp, Homo sapiens
gagcatctcttgaggccagg

SEQ ID NO: 3753815 - DNA, 16 bp, Homo sapiens
gagccaccgctgccag

SEQ ID NO: 3753816 - DNA, 13 bp, Homo sapiens
gagccacctgtcc

SEQ ID NO: 3753817 - DNA, 13 bp, Homo sapiens
gagccactgcacc

SEQ ID NO: 3753818 - DNA, 13 bp, Homo sapiens
gagccagccctcc

SEQ ID NO: 3753819 - DNA, 15 bp, Homo sapiens
gagccagccctccct

SEQ ID NO: 3753820 - DNA, 22 bp, Homo sapiens
gagccaggcctgggtctgtgtc

SEQ ID NO: 3753821 - DNA, 19 bp, Homo sapiens
gagccagggtctcactatg

SEQ ID NO: 3753822 - DNA, 17 bp, Homo sapiens
gagcccaccttggctca

SEQ ID NO: 3753823 - DNA, 18 bp, Homo sapiens
gagcccagccctgttctg

SEQ ID NO: 3753824 - DNA, 20 bp, Homo sapiens
gagcccagccctgttctggg

SEQ ID NO: 3753825 - DNA, 12 bp, Homo sapiens
gagcccaggagt

SEQ ID NO: 3753826 - DNA, 14 bp, Homo sapiens
gagccccactgccc

SEQ ID NO: 3753827 - DNA, 15 bp, Homo sapiens
gagccccactgccct

SEQ ID NO: 3753828 - DNA, 12 bp, Homo sapiens
gagccccagggt

SEQ ID NO: 3753829 - DNA, 19 bp, Homo sapiens
gagccccagggtcttccct

SEQ ID NO: 3753830 - DNA, 12 bp, Homo sapiens
gagccccagtgc

SEQ ID NO: 3753831 - DNA, 13 bp, Homo sapiens
gagccccgaggcc

SEQ ID NO: 3753832 - DNA, 17 bp, Homo sapiens
gagccccgaggccttct

SEQ ID NO: 3753833 - DNA, 23 bp, Homo sapiens
gagccctggcaggatgaccctgc

SEQ ID NO: 3753834 - DNA, 16 bp, Homo sapiens
gagccctggtggcagt

SEQ ID NO: 3753835 - DNA, 17 bp, Homo sapiens
gagccctggtggcagtg

SEQ ID NO: 3753836 - DNA, 20 bp, Homo sapiens
gagccgagatcacgccactg

SEQ ID NO: 3753837 - DNA, 21 bp, Homo sapiens
gagccgagatcacgccactgc

SEQ ID NO: 3753838 - DNA, 13 bp, Homo sapiens
gagcctcagcatc

SEQ ID NO: 3753839 - DNA, 14 bp, Homo sapiens
gagcctcagcatcc

SEQ ID NO: 3753840 - DNA, 15 bp, Homo sapiens
gagcctcagcatcct

SEQ ID NO: 3753841 - DNA, 18 bp, Homo sapiens
gagcctcatccgaggcag

SEQ ID NO: 3753842 - DNA, 19 bp, Homo sapiens
gagcctgaattttgttgct

SEQ ID NO: 3753843 - DNA, 12 bp, Homo sapiens
gagcctgcagtt

SEQ ID NO: 3753844 - DNA, 10 bp, Homo sapiens
gagcctggca

SEQ ID NO: 3753845 - DNA, 15 bp, Homo sapiens
gagcctggcaagaat

SEQ ID NO: 3753846 - DNA, 13 bp, Homo sapiens
gagcgaaactccg

SEQ ID NO: 3753847 - DNA, 16 bp, Homo sapiens
gagcgagcgctaccca

SEQ ID NO: 3753848 - DNA, 18 bp, Homo sapiens
gagcgcacctgccccctg

SEQ ID NO: 3753849 - DNA, 20 bp, Homo sapiens
gagcgcacctgccccctggt

SEQ ID NO: 3753850 - DNA, 15 bp, Homo sapiens
gagcgcctgcccctc

SEQ ID NO: 3753851 - DNA, 16 bp, Homo sapiens
gagcgcctgcccctcc

SEQ ID NO: 3753852 - DNA, 20 bp, Homo sapiens
gagcgcctgcccctcccaga

SEQ ID NO: 3753853 - DNA, 14 bp, Homo sapiens
gagcggaaagcagc

SEQ ID NO: 3753854 - DNA, 15 bp, Homo sapiens
gagcggaaagcagct

SEQ ID NO: 3753855 - DNA, 16 bp, Homo sapiens
gagcgtgaatctgtat

SEQ ID NO: 3753856 - DNA, 15 bp, Homo sapiens
gagctagcagcaggg

SEQ ID NO: 3753857 - DNA, 17 bp, Homo sapiens
gagctagcagcagggag

SEQ ID NO: 3753858 - DNA, 18 bp, Homo sapiens
gagctagcgctgccgcac

SEQ ID NO: 3753859 - DNA, 23 bp, Homo sapiens
gagctagcgctgccgcaccccag

SEQ ID NO: 3753860 - DNA, 15 bp, Homo sapiens
gagctcagaccccca

SEQ ID NO: 3753861 - DNA, 21 bp, Homo sapiens
gagctcagacccccactctca

SEQ ID NO: 3753862 - DNA, 14 bp, Homo sapiens
gagctccagtggaa

SEQ ID NO: 3753863 - DNA, 19 bp, Homo sapiens
gagctccccaccaccccag

SEQ ID NO: 3753864 - DNA, 21 bp, Homo sapiens
gagctcctccttgtcttggca

SEQ ID NO: 3753865 - DNA, 15 bp, Homo sapiens
gagctcctctgggca

SEQ ID NO: 3753866 - DNA, 16 bp, Homo sapiens
gagctcctctgggcag

SEQ ID NO: 3753867 - DNA, 13 bp, Homo sapiens
gagctcctgggaa

SEQ ID NO: 3753868 - DNA, 16 bp, Homo sapiens
gagctcttcaggcctc

SEQ ID NO: 3753869 - DNA, 17 bp, Homo sapiens
gagctcttcaggcctcc

SEQ ID NO: 3753870 - DNA, 20 bp, Homo sapiens
gagctgagaatagaaggaaa

SEQ ID NO: 3753871 - DNA, 20 bp, Homo sapiens
gagctgagatcgcgccactg

SEQ ID NO: 3753872 - DNA, 19 bp, Homo sapiens
gagctgcctgttcagctcc

SEQ ID NO: 3753873 - DNA, 20 bp, Homo sapiens
gagctgcctgttcagctcca

SEQ ID NO: 3753874 - DNA, 21 bp, Homo sapiens
gagctgcctgttcagctccag

SEQ ID NO: 3753875 - DNA, 12 bp, Homo sapiens
gagctgctggct

SEQ ID NO: 3753876 - DNA, 17 bp, Homo sapiens
gagctggacctcaccaa

SEQ ID NO: 3753877 - DNA, 16 bp, Homo sapiens
gagctggcgtctgtct

SEQ ID NO: 3753878 - DNA, 17 bp, Homo sapiens
gagctgggaggaaaaga

SEQ ID NO: 3753879 - DNA, 17 bp, Homo sapiens
gagctgggcagaaggcc

SEQ ID NO: 3753880 - DNA, 11 bp, Homo sapiens
gagctggtgca

SEQ ID NO: 3753881 - DNA, 17 bp, Homo sapiens
gagctggtgcattacag

SEQ ID NO: 3753882 - DNA, 15 bp, Homo sapiens
gagctggtgcccgga

SEQ ID NO: 3753883 - DNA, 16 bp, Homo sapiens
gagctgtttatggcct

SEQ ID NO: 3753884 - DNA, 17 bp, Homo sapiens
gagctgtttatggcctc

SEQ ID NO: 3753885 - DNA, 18 bp, Homo sapiens
gagctgtttatggcctca

SEQ ID NO: 3753886 - DNA, 20 bp, Homo sapiens
gagcttcaagtctgtgcctg

SEQ ID NO: 3753887 - DNA, 14 bp, Homo sapiens
gagcttctctgtga

SEQ ID NO: 3753888 - DNA, 17 bp, Homo sapiens
gagcttctctttaactc

SEQ ID NO: 3753889 - DNA, 19 bp, Homo sapiens
gagcttctctttaactcag

SEQ ID NO: 3753890 - DNA, 14 bp, Homo sapiens
gagcttggccagaa

SEQ ID NO: 3753891 - DNA, 16 bp, Homo sapiens
gagctttacaaaaaga

SEQ ID NO: 3753892 - DNA, 18 bp, Homo sapiens
gagctttcaaagaaggaa

SEQ ID NO: 3753893 - DNA, 23 bp, Homo sapiens
gagctttctgtccttttggcact

SEQ ID NO: 3753894 - DNA, 20 bp, Homo sapiens
gaggaaactcacctgctggc

SEQ ID NO: 3753895 - DNA, 14 bp, Homo sapiens
gaggaaggagagaa

SEQ ID NO: 3753896 - DNA, 21 bp, Homo sapiens
gaggaaggcatgcctggacaa

SEQ ID NO: 3753897 - DNA, 23 bp, Homo sapiens
gaggaatatgacggaagaacata

SEQ ID NO: 3753898 - DNA, 20 bp, Homo sapiens
gaggaatcgaggaaccagag

SEQ ID NO: 3753899 - DNA, 13 bp, Homo sapiens
gaggaatttctga

SEQ ID NO: 3753900 - DNA, 22 bp, Homo sapiens
gaggaattttctttgtgtagct

SEQ ID NO: 3753901 - DNA, 21 bp, Homo sapiens
gaggacacctgtactggagag

SEQ ID NO: 3753902 - DNA, 22 bp, Homo sapiens
gaggacagggaggtgaccccag

SEQ ID NO: 3753903 - DNA, 16 bp, Homo sapiens
gaggacgtgggcggca

SEQ ID NO: 3753904 - DNA, 20 bp, Homo sapiens
gaggacgtgggcggcagaga

SEQ ID NO: 3753905 - DNA, 16 bp, Homo sapiens
gaggacttgtgtctct

SEQ ID NO: 3753906 - DNA, 13 bp, Homo sapiens
gaggagaaacaca

SEQ ID NO: 3753907 - DNA, 12 bp, Homo sapiens
gaggagaagaat

SEQ ID NO: 3753908 - DNA, 14 bp, Homo sapiens
gaggagagcctggt

SEQ ID NO: 3753909 - DNA, 12 bp, Homo sapiens
gaggagctgctg

SEQ ID NO: 3753910 - DNA, 15 bp, Homo sapiens
gaggagctgctggct

SEQ ID NO: 3753911 - DNA, 20 bp, Homo sapiens
gaggagggcgtgactcaccc

SEQ ID NO: 3753912 - DNA, 15 bp, Homo sapiens
gaggaggtggcagcc

SEQ ID NO: 3753913 - DNA, 22 bp, Homo sapiens
gaggaggtggcagccctgtagg

SEQ ID NO: 3753914 - DNA, 18 bp, Homo sapiens
gaggagtttcctaaaagt

SEQ ID NO: 3753915 - DNA, 17 bp, Homo sapiens
gaggatcactggagccc

SEQ ID NO: 3753916 - DNA, 13 bp, Homo sapiens
gaggatctcttga

SEQ ID NO: 3753917 - DNA, 16 bp, Homo sapiens
gaggatctcttgagcc

SEQ ID NO: 3753918 - DNA, 13 bp, Homo sapiens
gaggatggagaga

SEQ ID NO: 3753919 - DNA, 20 bp, Homo sapiens
gaggatggcctctgctaagc

SEQ ID NO: 3753920 - DNA, 17 bp, Homo sapiens
gaggattctatgaggca

SEQ ID NO: 3753921 - DNA, 19 bp, Homo sapiens
gaggattgcttgagcccag

SEQ ID NO: 3753922 - DNA, 22 bp, Homo sapiens
gaggattgcttgagcccaggag

SEQ ID NO: 3753923 - DNA, 15 bp, Homo sapiens
gaggatttcaagcct

SEQ ID NO: 3753924 - DNA, 23 bp, Homo sapiens
gaggcaaaaggcagtggggctgg

SEQ ID NO: 3753925 - DNA, 19 bp, Homo sapiens
gaggcaatgtcaggaacag

SEQ ID NO: 3753926 - DNA, 21 bp, Homo sapiens
gaggcaatgtcaggaacagaa

SEQ ID NO: 3753927 - DNA, 12 bp, Homo sapiens
gaggcagacagc

SEQ ID NO: 3753928 - DNA, 16 bp, Homo sapiens
gaggcagacagcagct

SEQ ID NO: 3753929 - DNA, 18 bp, Homo sapiens
gaggcagccccattctgc

SEQ ID NO: 3753930 - DNA, 20 bp, Homo sapiens
gaggcagccccattctgcct

SEQ ID NO: 3753931 - DNA, 22 bp, Homo sapiens
gaggcagccccattctgcctgc

SEQ ID NO: 3753932 - DNA, 15 bp, Homo sapiens
gaggcagggagggga

SEQ ID NO: 3753933 - DNA, 15 bp, Homo sapiens
gaggcagggccttgc

SEQ ID NO: 3753934 - DNA, 22 bp, Homo sapiens
gaggcagggccttgcccagaga

SEQ ID NO: 3753935 - DNA, 23 bp, Homo sapiens
gaggcagggccttgcccagagat

SEQ ID NO: 3753936 - DNA, 14 bp, Homo sapiens
gaggcaggggcgga

SEQ ID NO: 3753937 - DNA, 15 bp, Homo sapiens
gaggcagggtctcac

SEQ ID NO: 3753938 - DNA, 22 bp, Homo sapiens
gaggccaaggtgggaggattgc

SEQ ID NO: 3753939 - DNA, 15 bp, Homo sapiens
gaggccaagtgcagg

SEQ ID NO: 3753940 - DNA, 22 bp, Homo sapiens
gaggccagccccacccaggagg

SEQ ID NO: 3753941 - DNA, 21 bp, Homo sapiens
gaggccatgggcctcctgtgt

SEQ ID NO: 3753942 - DNA, 12 bp, Homo sapiens
gaggcccaggga

SEQ ID NO: 3753943 - DNA, 13 bp, Homo sapiens
gaggcccagggag

SEQ ID NO: 3753944 - DNA, 21 bp, Homo sapiens
gaggcctagtcagccacatgg

SEQ ID NO: 3753945 - DNA, 21 bp, Homo sapiens
gaggcctcagtggactttcca

SEQ ID NO: 3753946 - DNA, 19 bp, Homo sapiens
gaggcgggtggatcacctg

SEQ ID NO: 3753947 - DNA, 16 bp, Homo sapiens
gaggctctttctgggc

SEQ ID NO: 3753948 - DNA, 16 bp, Homo sapiens
gaggctgaggcaagag

SEQ ID NO: 3753949 - DNA, 13 bp, Homo sapiens
gaggctgaggcag

SEQ ID NO: 3753950 - DNA, 14 bp, Homo sapiens
gaggctgaggcaga

SEQ ID NO: 3753951 - DNA, 17 bp, Homo sapiens
gaggctgaggcaggagg

SEQ ID NO: 3753952 - DNA, 16 bp, Homo sapiens
gaggctgcagcgagct

SEQ ID NO: 3753953 - DNA, 14 bp, Homo sapiens
gaggctggaggcag

SEQ ID NO: 3753954 - DNA, 15 bp, Homo sapiens
gaggctggaggcagg

SEQ ID NO: 3753955 - DNA, 17 bp, Homo sapiens
gaggctggaggcagggc

SEQ ID NO: 3753956 - DNA, 18 bp, Homo sapiens
gaggctggaggcagggcc

SEQ ID NO: 3753957 - DNA, 21 bp, Homo sapiens
gaggctgtcttctcaggctct

SEQ ID NO: 3753958 - DNA, 22 bp, Homo sapiens
gaggctgtcttctcaggctctg

SEQ ID NO: 3753959 - DNA, 17 bp, Homo sapiens
gaggctgttcccaccag

SEQ ID NO: 3753960 - DNA, 22 bp, Homo sapiens
gaggcttcttcagatcagtgct

SEQ ID NO: 3753961 - DNA, 15 bp, Homo sapiens
gaggcttggaaagca

SEQ ID NO: 3753962 - DNA, 18 bp, Homo sapiens
gaggcttgtcagagctgg

SEQ ID NO: 3753963 - DNA, 18 bp, Homo sapiens
gagggaattgaggtctgc

SEQ ID NO: 3753964 - DNA, 21 bp, Homo sapiens
gagggacaaatttaaaacaaa

SEQ ID NO: 3753965 - DNA, 15 bp, Homo sapiens
gagggatcacagggc

SEQ ID NO: 3753966 - DNA, 18 bp, Homo sapiens
gagggatgaggtgctggg

SEQ ID NO: 3753967 - DNA, 15 bp, Homo sapiens
gagggatgctgcctg

SEQ ID NO: 3753968 - DNA, 16 bp, Homo sapiens
gagggcagaggctgga

SEQ ID NO: 3753969 - DNA, 12 bp, Homo sapiens
gaggggaacaga

SEQ ID NO: 3753970 - DNA, 18 bp, Homo sapiens
gaggggaataatagaaga

SEQ ID NO: 3753971 - DNA, 21 bp, Homo sapiens
gaggggacgctggtagagatg

SEQ ID NO: 3753972 - DNA, 18 bp, Homo sapiens
gaggggcaacgaagaaaa

SEQ ID NO: 3753973 - DNA, 19 bp, Homo sapiens
gaggggcatggccagcagc

SEQ ID NO: 3753974 - DNA, 20 bp, Homo sapiens
gaggggcctggcagccgtgc

SEQ ID NO: 3753975 - DNA, 13 bp, Homo sapiens
gaggggctcctgg

SEQ ID NO: 3753976 - DNA, 14 bp, Homo sapiens
gaggggctcctgga

SEQ ID NO: 3753977 - DNA, 19 bp, Homo sapiens
gagggggttacaaactgca

SEQ ID NO: 3753978 - DNA, 13 bp, Homo sapiens
gagggtctgagga

SEQ ID NO: 3753979 - DNA, 15 bp, Homo sapiens
gagggtctggagaag

SEQ ID NO: 3753980 - DNA, 22 bp, Homo sapiens
gagggtgtcccaaaaagaaagg

SEQ ID NO: 3753981 - DNA, 15 bp, Homo sapiens
gagggttgggctggt

SEQ ID NO: 3753982 - DNA, 23 bp, Homo sapiens
gaggtcaacagagaaggcaggaa

SEQ ID NO: 3753983 - DNA, 16 bp, Homo sapiens
gaggtcaagcccagga

SEQ ID NO: 3753984 - DNA, 17 bp, Homo sapiens
gaggtcaaggctgcagt

SEQ ID NO: 3753985 - DNA, 13 bp, Homo sapiens
gaggtcagagcct

SEQ ID NO: 3753986 - DNA, 20 bp, Homo sapiens
gaggtcagagcctgcagtta

SEQ ID NO: 3753987 - DNA, 15 bp, Homo sapiens
gaggtctcttgaggg

SEQ ID NO: 3753988 - DNA, 17 bp, Homo sapiens
gaggtctcttgagggag

SEQ ID NO: 3753989 - DNA, 18 bp, Homo sapiens
gaggtcttttgacatgtg

SEQ ID NO: 3753990 - DNA, 23 bp, Homo sapiens
gaggtgaactgtttccacattca

SEQ ID NO: 3753991 - DNA, 21 bp, Homo sapiens
gaggtgcagagtgcccagaac

SEQ ID NO: 3753992 - DNA, 23 bp, Homo sapiens
gaggtgctactgactttctcagc

SEQ ID NO: 3753993 - DNA, 20 bp, Homo sapiens
gaggtgctgcattgcctgcg

SEQ ID NO: 3753994 - DNA, 16 bp, Homo sapiens
gaggtggcagccctgt

SEQ ID NO: 3753995 - DNA, 14 bp, Homo sapiens
gaggtggctgggtt

SEQ ID NO: 3753996 - DNA, 19 bp, Homo sapiens
gaggtggtctgaatgttct

SEQ ID NO: 3753997 - DNA, 13 bp, Homo sapiens
gaggttataggtc

SEQ ID NO: 3753998 - DNA, 13 bp, Homo sapiens
gaggttgcaggga

SEQ ID NO: 3753999 - DNA, 16 bp, Homo sapiens
gaggttttatgatatt

SEQ ID NO: 3754000 - DNA, 14 bp, Homo sapiens
gagtaatttattgt

SEQ ID NO: 3754001 - DNA, 16 bp, Homo sapiens
gagtacctgctgcccc

SEQ ID NO: 3754002 - DNA, 22 bp, Homo sapiens
gagtagaaagacagagctggga

SEQ ID NO: 3754003 - DNA, 23 bp, Homo sapiens
gagtagccccaacccaaacctgg

SEQ ID NO: 3754004 - DNA, 18 bp, Homo sapiens
gagtagccgagagcctgc

SEQ ID NO: 3754005 - DNA, 21 bp, Homo sapiens
gagtagttgatgttgcatttt

SEQ ID NO: 3754006 - DNA, 14 bp, Homo sapiens
gagtatatgcactt

SEQ ID NO: 3754007 - DNA, 16 bp, Homo sapiens
gagtatctgggaactg

SEQ ID NO: 3754008 - DNA, 20 bp, Homo sapiens
gagtatttaggcagattgaa

SEQ ID NO: 3754009 - DNA, 20 bp, Homo sapiens
gagtcaaaacacttgtaatt

SEQ ID NO: 3754010 - DNA, 13 bp, Homo sapiens
gagtcaccaagcc

SEQ ID NO: 3754011 - DNA, 14 bp, Homo sapiens
gagtcaccaagccc

SEQ ID NO: 3754012 - DNA, 17 bp, Homo sapiens
gagtcaccaagcccagt

SEQ ID NO: 3754013 - DNA, 23 bp, Homo sapiens
gagtcactgcctctccctggccc

SEQ ID NO: 3754014 - DNA, 11 bp, Homo sapiens
gagtcagcctt

SEQ ID NO: 3754015 - DNA, 18 bp, Homo sapiens
gagtcagggacccctgcc

SEQ ID NO: 3754016 - DNA, 20 bp, Homo sapiens
gagtccaacgtggggcagca

SEQ ID NO: 3754017 - DNA, 22 bp, Homo sapiens
gagtccaacgtggggcagcaca

SEQ ID NO: 3754018 - DNA, 13 bp, Homo sapiens
gagtccaggcccc

SEQ ID NO: 3754019 - DNA, 13 bp, Homo sapiens
gagtccagtctct

SEQ ID NO: 3754020 - DNA, 14 bp, Homo sapiens
gagtcccaaggaaa

SEQ ID NO: 3754021 - DNA, 16 bp, Homo sapiens
gagtcccaaggaaagc

SEQ ID NO: 3754022 - DNA, 13 bp, Homo sapiens
gagtcccaccttg

SEQ ID NO: 3754023 - DNA, 20 bp, Homo sapiens
gagtcccaccttggctgcag

SEQ ID NO: 3754024 - DNA, 21 bp, Homo sapiens
gagtcctacagtggctgtcac

SEQ ID NO: 3754025 - DNA, 16 bp, Homo sapiens
gagtcgaggacaggga

SEQ ID NO: 3754026 - DNA, 14 bp, Homo sapiens
gagtctcttctcca

SEQ ID NO: 3754027 - DNA, 15 bp, Homo sapiens
gagtctcttctccac

SEQ ID NO: 3754028 - DNA, 14 bp, Homo sapiens
gagtctgaagcaga

SEQ ID NO: 3754029 - DNA, 15 bp, Homo sapiens
gagtctgaagcagat

SEQ ID NO: 3754030 - DNA, 14 bp, Homo sapiens
gagtgacagagtaa

SEQ ID NO: 3754031 - DNA, 19 bp, Homo sapiens
gagtgacagtggattgcat

SEQ ID NO: 3754032 - DNA, 14 bp, Homo sapiens
gagtgagactctgt

SEQ ID NO: 3754033 - DNA, 12 bp, Homo sapiens
gagtgagctggt

SEQ ID NO: 3754034 - DNA, 17 bp, Homo sapiens
gagtgaggcaggtgaca

SEQ ID NO: 3754035 - DNA, 19 bp, Homo sapiens
gagtgagtgtggctcccct

SEQ ID NO: 3754036 - DNA, 10 bp, Homo sapiens
gagtgatctt

SEQ ID NO: 3754037 - DNA, 13 bp, Homo sapiens
gagtgcagtgagc

SEQ ID NO: 3754038 - DNA, 14 bp, Homo sapiens
gagtgcccagaact

SEQ ID NO: 3754039 - DNA, 15 bp, Homo sapiens
gagtgccccacctgc

SEQ ID NO: 3754040 - DNA, 15 bp, Homo sapiens
gagtgcggtggtgtg

SEQ ID NO: 3754041 - DNA, 16 bp, Homo sapiens
gagtggatagatgccc

SEQ ID NO: 3754042 - DNA, 18 bp, Homo sapiens
gagtggatgatgtttcgt

SEQ ID NO: 3754043 - DNA, 12 bp, Homo sapiens
gagtggcctggc

SEQ ID NO: 3754044 - DNA, 15 bp, Homo sapiens
gagtggcctggccag

SEQ ID NO: 3754045 - DNA, 19 bp, Homo sapiens
gagtggcctggccaggagc

SEQ ID NO: 3754046 - DNA, 15 bp, Homo sapiens
gagtggctcctcccg

SEQ ID NO: 3754047 - DNA, 17 bp, Homo sapiens
gagtgggacagagtctg

SEQ ID NO: 3754048 - DNA, 11 bp, Homo sapiens
gagtgtagtga

SEQ ID NO: 3754049 - DNA, 16 bp, Homo sapiens
gagtgtggctcccctc

SEQ ID NO: 3754050 - DNA, 18 bp, Homo sapiens
gagtgtgggaagggagag

SEQ ID NO: 3754051 - DNA, 21 bp, Homo sapiens
gagtgtgtccaagtgtgtgtg

SEQ ID NO: 3754052 - DNA, 19 bp, Homo sapiens
gagttcaagaccagcctgg

SEQ ID NO: 3754053 - DNA, 20 bp, Homo sapiens
gagttcaagaccagcctggc

SEQ ID NO: 3754054 - DNA, 22 bp, Homo sapiens
gagttgaaagagttaagaatgt

SEQ ID NO: 3754055 - DNA, 16 bp, Homo sapiens
gagttggcattgcatt

SEQ ID NO: 3754056 - DNA, 16 bp, Homo sapiens
gagttgtggaaagcct

SEQ ID NO: 3754057 - DNA, 13 bp, Homo sapiens
gagtttaaagcaa

SEQ ID NO: 3754058 - DNA, 19 bp, Homo sapiens
gagtttaagaccagcctgg

SEQ ID NO: 3754059 - DNA, 17 bp, Homo sapiens
gagtttaccatttgtaa

SEQ ID NO: 3754060 - DNA, 21 bp, Homo sapiens
gagtttagtgatctgaacaga

SEQ ID NO: 3754061 - DNA, 18 bp, Homo sapiens
gataaaaaattttgtaat

SEQ ID NO: 3754062 - DNA, 23 bp, Homo sapiens
gataaaagatacatttgtatgtt

SEQ ID NO: 3754063 - DNA, 15 bp, Homo sapiens
gataaacttttagaa

SEQ ID NO: 3754064 - DNA, 22 bp, Homo sapiens
gataaagatgcaaggaccagga

SEQ ID NO: 3754065 - DNA, 13 bp, Homo sapiens
gataaagatttct

SEQ ID NO: 3754066 - DNA, 11 bp, Homo sapiens
gataacagcta

SEQ ID NO: 3754067 - DNA, 22 bp, Homo sapiens
gataacctgtacttcaagttaa

SEQ ID NO: 3754068 - DNA, 13 bp, Homo sapiens
gataactctttgg

SEQ ID NO: 3754069 - DNA, 14 bp, Homo sapiens
gataactctttgga

SEQ ID NO: 3754070 - DNA, 17 bp, Homo sapiens
gataatatgagaatcag

SEQ ID NO: 3754071 - DNA, 13 bp, Homo sapiens
gataatcagcctc

SEQ ID NO: 3754072 - DNA, 21 bp, Homo sapiens
gataatgttgtggtttgttgc

SEQ ID NO: 3754073 - DNA, 17 bp, Homo sapiens
gataattttgcataaaa

SEQ ID NO: 3754074 - DNA, 19 bp, Homo sapiens
gatacaccgggcctggaga

SEQ ID NO: 3754075 - DNA, 20 bp, Homo sapiens
gatacactgaagttaacaga

SEQ ID NO: 3754076 - DNA, 21 bp, Homo sapiens
gatacatttgtatgttgtgaa

SEQ ID NO: 3754077 - DNA, 22 bp, Homo sapiens
gatacgagttttggccgggtgc

SEQ ID NO: 3754078 - DNA, 16 bp, Homo sapiens
gatactggaagttttg

SEQ ID NO: 3754079 - DNA, 19 bp, Homo sapiens
gatactggaagttttgcat

SEQ ID NO: 3754080 - DNA, 13 bp, Homo sapiens
gatactttacatg

SEQ ID NO: 3754081 - DNA, 16 bp, Homo sapiens
gatagaagaactgcaa

SEQ ID NO: 3754082 - DNA, 14 bp, Homo sapiens
gatagaagatgttt

SEQ ID NO: 3754083 - DNA, 18 bp, Homo sapiens
gatagataactctttgga

SEQ ID NO: 3754084 - DNA, 15 bp, Homo sapiens
gatagcgttggaatt

SEQ ID NO: 3754085 - DNA, 23 bp, Homo sapiens
gatagcgttggaattaaaacaat

SEQ ID NO: 3754086 - DNA, 14 bp, Homo sapiens
gataggctctgcac

SEQ ID NO: 3754087 - DNA, 16 bp, Homo sapiens
gatagtattgtgcata

SEQ ID NO: 3754088 - DNA, 15 bp, Homo sapiens
gatatagaattgcaa

SEQ ID NO: 3754089 - DNA, 18 bp, Homo sapiens
gatatagatcacataaca

SEQ ID NO: 3754090 - DNA, 18 bp, Homo sapiens
gatatatgctctgcatgt

SEQ ID NO: 3754091 - DNA, 23 bp, Homo sapiens
gatatatgctctgcatgttacat

SEQ ID NO: 3754092 - DNA, 22 bp, Homo sapiens
gatatccctatgctgcctaggc

SEQ ID NO: 3754093 - DNA, 21 bp, Homo sapiens
gatatgagttgttttcagact

SEQ ID NO: 3754094 - DNA, 19 bp, Homo sapiens
gatattaaattttttaaaa

SEQ ID NO: 3754095 - DNA, 20 bp, Homo sapiens
gatattccccccacttaaga

SEQ ID NO: 3754096 - DNA, 19 bp, Homo sapiens
gatatttatggggggagaa

SEQ ID NO: 3754097 - DNA, 17 bp, Homo sapiens
gatatttccatcattaa

SEQ ID NO: 3754098 - DNA, 19 bp, Homo sapiens
gatattttcaaattgtatc

SEQ ID NO: 3754099 - DNA, 16 bp, Homo sapiens
gatcaaattctacaac

SEQ ID NO: 3754100 - DNA, 23 bp, Homo sapiens
gatcaaccccttcgctcctgtgt

SEQ ID NO: 3754101 - DNA, 19 bp, Homo sapiens
gatcaataaaatgtgattt

SEQ ID NO: 3754102 - DNA, 21 bp, Homo sapiens
gatcaataaaatgtgattttt

SEQ ID NO: 3754103 - DNA, 16 bp, Homo sapiens
gatcaattaaatgtag

SEQ ID NO: 3754104 - DNA, 20 bp, Homo sapiens
gatcacagggccccagaagg

SEQ ID NO: 3754105 - DNA, 13 bp, Homo sapiens
gatcacgccactg

SEQ ID NO: 3754106 - DNA, 16 bp, Homo sapiens
gatcacgccactgcac

SEQ ID NO: 3754107 - DNA, 18 bp, Homo sapiens
gatcacgccactgcacta

SEQ ID NO: 3754108 - DNA, 12 bp, Homo sapiens
gatcacggctca

SEQ ID NO: 3754109 - DNA, 15 bp, Homo sapiens
gatcacggctcactg

SEQ ID NO: 3754110 - DNA, 18 bp, Homo sapiens
gatcacggctcactgcag

SEQ ID NO: 3754111 - DNA, 17 bp, Homo sapiens
gatcactggagcccagg

SEQ ID NO: 3754112 - DNA, 12 bp, Homo sapiens
gatcagaaagta

SEQ ID NO: 3754113 - DNA, 16 bp, Homo sapiens
gatcagctgtttgtca

SEQ ID NO: 3754114 - DNA, 18 bp, Homo sapiens
gatcagctgtttgtcata

SEQ ID NO: 3754115 - DNA, 13 bp, Homo sapiens
gatcaggtgggga

SEQ ID NO: 3754116 - DNA, 20 bp, Homo sapiens
gatcagtataattttttaaa

SEQ ID NO: 3754117 - DNA, 23 bp, Homo sapiens
gatcagtcctttgatcagtataa

SEQ ID NO: 3754118 - DNA, 18 bp, Homo sapiens
gatcatagatttctgatt

SEQ ID NO: 3754119 - DNA, 23 bp, Homo sapiens
gatcatagatttctgattttatg

SEQ ID NO: 3754120 - DNA, 19 bp, Homo sapiens
gatcatccactgtgccatg

SEQ ID NO: 3754121 - DNA, 12 bp, Homo sapiens
gatcatgcattg

SEQ ID NO: 3754122 - DNA, 14 bp, Homo sapiens
gatcatgcattgtt

SEQ ID NO: 3754123 - DNA, 16 bp, Homo sapiens
gatcatggctcactgc

SEQ ID NO: 3754124 - DNA, 20 bp, Homo sapiens
gatcatggctcactgcagcc

SEQ ID NO: 3754125 - DNA, 14 bp, Homo sapiens
gatcattttccccc

SEQ ID NO: 3754126 - DNA, 15 bp, Homo sapiens
gatcattttcccccc

SEQ ID NO: 3754127 - DNA, 16 bp, Homo sapiens
gatccaagctggtccc

SEQ ID NO: 3754128 - DNA, 15 bp, Homo sapiens
gatccacacacagag

SEQ ID NO: 3754129 - DNA, 16 bp, Homo sapiens
gatccacacacagagg

SEQ ID NO: 3754130 - DNA, 19 bp, Homo sapiens
gatccacctgtctcagcct

SEQ ID NO: 3754131 - DNA, 17 bp, Homo sapiens
gatccatccatctccag

SEQ ID NO: 3754132 - DNA, 22 bp, Homo sapiens
gatccatgagtttgccctggtt

SEQ ID NO: 3754133 - DNA, 14 bp, Homo sapiens
gatcctacccctga

SEQ ID NO: 3754134 - DNA, 18 bp, Homo sapiens
gatcctaggcatttgctg

SEQ ID NO: 3754135 - DNA, 18 bp, Homo sapiens
gatcgtgctaaattttca

SEQ ID NO: 3754136 - DNA, 17 bp, Homo sapiens
gatctaagcctttccat

SEQ ID NO: 3754137 - DNA, 18 bp, Homo sapiens
gatctaagcctttccata

SEQ ID NO: 3754138 - DNA, 19 bp, Homo sapiens
gatctcagggaagcccagc

SEQ ID NO: 3754139 - DNA, 15 bp, Homo sapiens
gatctcattcagtat

SEQ ID NO: 3754140 - DNA, 20 bp, Homo sapiens
gatctcattcagtattaaag

SEQ ID NO: 3754141 - DNA, 13 bp, Homo sapiens
gatctccctgccg

SEQ ID NO: 3754142 - DNA, 14 bp, Homo sapiens
gatctccttgccct

SEQ ID NO: 3754143 - DNA, 21 bp, Homo sapiens
gatctctactaccacaaggaa

SEQ ID NO: 3754144 - DNA, 12 bp, Homo sapiens
gatctgaacaga

SEQ ID NO: 3754145 - DNA, 13 bp, Homo sapiens
gatctgactgcac

SEQ ID NO: 3754146 - DNA, 20 bp, Homo sapiens
gatctgcagggggtgtgtct

SEQ ID NO: 3754147 - DNA, 17 bp, Homo sapiens
gatctgggaactcccaa

SEQ ID NO: 3754148 - DNA, 23 bp, Homo sapiens
gatctgggaccctttccttcctt

SEQ ID NO: 3754149 - DNA, 17 bp, Homo sapiens
gatctggggctctggga

SEQ ID NO: 3754150 - DNA, 18 bp, Homo sapiens
gatctgggttcactgcaa

SEQ ID NO: 3754151 - DNA, 20 bp, Homo sapiens
gatctgtatatacaataaca

SEQ ID NO: 3754152 - DNA, 16 bp, Homo sapiens
gatctgtgcccagaga

SEQ ID NO: 3754153 - DNA, 19 bp, Homo sapiens
gatctgtgcccagagatgg

SEQ ID NO: 3754154 - DNA, 13 bp, Homo sapiens
gatctgtgcccca

SEQ ID NO: 3754155 - DNA, 14 bp, Homo sapiens
gatctgtgccccat

SEQ ID NO: 3754156 - DNA, 20 bp, Homo sapiens
gatctgttgtgtacgtggag

SEQ ID NO: 3754157 - DNA, 19 bp, Homo sapiens
gatctgtttttaaaaatca

SEQ ID NO: 3754158 - DNA, 21 bp, Homo sapiens
gatctgtttttaaaaatcata

SEQ ID NO: 3754159 - DNA, 19 bp, Homo sapiens
gatcttctttataattcta

SEQ ID NO: 3754160 - DNA, 20 bp, Homo sapiens
gatctttcacccacagaaag

SEQ ID NO: 3754161 - DNA, 21 bp, Homo sapiens
gatctttcacccacagaaaga

SEQ ID NO: 3754162 - DNA, 11 bp, Homo sapiens
gatctttcagg

SEQ ID NO: 3754163 - DNA, 15 bp, Homo sapiens
gatctttcaggaaag

SEQ ID NO: 3754164 - DNA, 18 bp, Homo sapiens
gatctttgcagacaggca

SEQ ID NO: 3754165 - DNA, 16 bp, Homo sapiens
gatcttttcaagttaa

SEQ ID NO: 3754166 - DNA, 14 bp, Homo sapiens
gatgaagagtgaga

SEQ ID NO: 3754167 - DNA, 19 bp, Homo sapiens
gatgaagcaaacacattaa

SEQ ID NO: 3754168 - DNA, 17 bp, Homo sapiens
gatgaagttatctggct

SEQ ID NO: 3754169 - DNA, 23 bp, Homo sapiens
gatgaccctgcgaaggggccctg

SEQ ID NO: 3754170 - DNA, 13 bp, Homo sapiens
gatgactggaatt

SEQ ID NO: 3754171 - DNA, 17 bp, Homo sapiens
gatgactggaattttta

SEQ ID NO: 3754172 - DNA, 21 bp, Homo sapiens
gatgacttcccaactgcaagt

SEQ ID NO: 3754173 - DNA, 22 bp, Homo sapiens
gatgagaaaggttgaagcacca

SEQ ID NO: 3754174 - DNA, 20 bp, Homo sapiens
gatgagaattcagctgcccc

SEQ ID NO: 3754175 - DNA, 20 bp, Homo sapiens
gatgagtgtaacaagaaagg

SEQ ID NO: 3754176 - DNA, 21 bp, Homo sapiens
gatgatgaaatgaggtcagag

SEQ ID NO: 3754177 - DNA, 23 bp, Homo sapiens
gatgatgataatgatgatgacga

SEQ ID NO: 3754178 - DNA, 20 bp, Homo sapiens
gatgatttgctatcaaaata

SEQ ID NO: 3754179 - DNA, 15 bp, Homo sapiens
gatgcaaagaggcaa

SEQ ID NO: 3754180 - DNA, 15 bp, Homo sapiens
gatgcacatccctgg

SEQ ID NO: 3754181 - DNA, 16 bp, Homo sapiens
gatgcagcattatgat

SEQ ID NO: 3754182 - DNA, 16 bp, Homo sapiens
gatgccatctgtgtcc

SEQ ID NO: 3754183 - DNA, 20 bp, Homo sapiens
gatgcccagggccactctgc

SEQ ID NO: 3754184 - DNA, 12 bp, Homo sapiens
gatgccccagag

SEQ ID NO: 3754185 - DNA, 12 bp, Homo sapiens
gatgccctgcta

SEQ ID NO: 3754186 - DNA, 15 bp, Homo sapiens
gatgcctggtggcag

SEQ ID NO: 3754187 - DNA, 17 bp, Homo sapiens
gatgcctggtggcagct

SEQ ID NO: 3754188 - DNA, 19 bp, Homo sapiens
gatgcctggtggcagctgc

SEQ ID NO: 3754189 - DNA, 19 bp, Homo sapiens
gatgctcaggtacagagaa

SEQ ID NO: 3754190 - DNA, 20 bp, Homo sapiens
gatgctcaggtacagagaag

SEQ ID NO: 3754191 - DNA, 12 bp, Homo sapiens
gatgctccagcc

SEQ ID NO: 3754192 - DNA, 15 bp, Homo sapiens
gatgctccctcccct

SEQ ID NO: 3754193 - DNA, 21 bp, Homo sapiens
gatgctgaaacaggagagaaa

SEQ ID NO: 3754194 - DNA, 19 bp, Homo sapiens
gatgctgaaagagaaaaga

SEQ ID NO: 3754195 - DNA, 14 bp, Homo sapiens
gatgctgcctgagt

SEQ ID NO: 3754196 - DNA, 21 bp, Homo sapiens
gatgctgtcttcgtactggga

SEQ ID NO: 3754197 - DNA, 20 bp, Homo sapiens
gatgcttgtaacaagaaaac

SEQ ID NO: 3754198 - DNA, 14 bp, Homo sapiens
gatggagagagggg

SEQ ID NO: 3754199 - DNA, 13 bp, Homo sapiens
gatggaggagaag

SEQ ID NO: 3754200 - DNA, 14 bp, Homo sapiens
gatggaggagaaga

SEQ ID NO: 3754201 - DNA, 14 bp, Homo sapiens
gatggattctcaga

SEQ ID NO: 3754202 - DNA, 16 bp, Homo sapiens
gatggattctcagata

SEQ ID NO: 3754203 - DNA, 19 bp, Homo sapiens
gatggattctcagatattt

SEQ ID NO: 3754204 - DNA, 19 bp, Homo sapiens
gatggatttgcctgtgcca

SEQ ID NO: 3754205 - DNA, 14 bp, Homo sapiens
gatggccctctggt

SEQ ID NO: 3754206 - DNA, 13 bp, Homo sapiens
gatggctgtgcct

SEQ ID NO: 3754207 - DNA, 18 bp, Homo sapiens
gatgggaaggagggaggt

SEQ ID NO: 3754208 - DNA, 18 bp, Homo sapiens
gatgggcttgttttcttg

SEQ ID NO: 3754209 - DNA, 13 bp, Homo sapiens
gatggggaaggag

SEQ ID NO: 3754210 - DNA, 13 bp, Homo sapiens
gatggggccacag

SEQ ID NO: 3754211 - DNA, 14 bp, Homo sapiens
gatggggccacagc

SEQ ID NO: 3754212 - DNA, 21 bp, Homo sapiens
gatgggggagtctgaagcaga

SEQ ID NO: 3754213 - DNA, 15 bp, Homo sapiens
gatgggggatgcttc

SEQ ID NO: 3754214 - DNA, 22 bp, Homo sapiens
gatgggtctggtttgcagagct

SEQ ID NO: 3754215 - DNA, 23 bp, Homo sapiens
gatgggtctggtttgcagagctt

SEQ ID NO: 3754216 - DNA, 15 bp, Homo sapiens
gatggtatcatatat

SEQ ID NO: 3754217 - DNA, 15 bp, Homo sapiens
gatggtcctggggct

SEQ ID NO: 3754218 - DNA, 24 bp, Homo sapiens
gatggtcctggggctctgtgcagg

SEQ ID NO: 3754219 - DNA, 17 bp, Homo sapiens
gatggttacactgttag

SEQ ID NO: 3754220 - DNA, 16 bp, Homo sapiens
gatgtaaacagtgcct

SEQ ID NO: 3754221 - DNA, 19 bp, Homo sapiens
gatgtaaacagtgcctgct

SEQ ID NO: 3754222 - DNA, 13 bp, Homo sapiens
gatgtaagagctt

SEQ ID NO: 3754223 - DNA, 18 bp, Homo sapiens
gatgtatccatgggggca

SEQ ID NO: 3754224 - DNA, 21 bp, Homo sapiens
gatgtccctttcttggccagt

SEQ ID NO: 3754225 - DNA, 21 bp, Homo sapiens
gatgtgctttgcattcctaca

SEQ ID NO: 3754226 - DNA, 24 bp, Homo sapiens
gatgtggagcacaaaagcctctca

SEQ ID NO: 3754227 - DNA, 12 bp, Homo sapiens
gatgtggccctg

SEQ ID NO: 3754228 - DNA, 20 bp, Homo sapiens
gatgttgtttaacataaatt

SEQ ID NO: 3754229 - DNA, 17 bp, Homo sapiens
gatgtttgtggcctcag

SEQ ID NO: 3754230 - DNA, 15 bp, Homo sapiens
gattaaactgagtga

SEQ ID NO: 3754231 - DNA, 19 bp, Homo sapiens
gattaaccacttcagctga

SEQ ID NO: 3754232 - DNA, 19 bp, Homo sapiens
gattaaggtctctctttgg

SEQ ID NO: 3754233 - DNA, 20 bp, Homo sapiens
gattaaggtctctctttgga

SEQ ID NO: 3754234 - DNA, 15 bp, Homo sapiens
gattaattaaatgca

SEQ ID NO: 3754235 - DNA, 13 bp, Homo sapiens
gattacaagcgtg

SEQ ID NO: 3754236 - DNA, 22 bp, Homo sapiens
gattacaagcgtgagccactgc

SEQ ID NO: 3754237 - DNA, 12 bp, Homo sapiens
gattactctttg

SEQ ID NO: 3754238 - DNA, 18 bp, Homo sapiens
gattactgtcaataaaca

SEQ ID NO: 3754239 - DNA, 15 bp, Homo sapiens
gattagatcttttaa

SEQ ID NO: 3754240 - DNA, 16 bp, Homo sapiens
gattatggttttgtga

SEQ ID NO: 3754241 - DNA, 17 bp, Homo sapiens
gattatggttttgtgat

SEQ ID NO: 3754242 - DNA, 15 bp, Homo sapiens
gattattttttatga

SEQ ID NO: 3754243 - DNA, 20 bp, Homo sapiens
gattcacctgtaaaacttta

SEQ ID NO: 3754244 - DNA, 15 bp, Homo sapiens
gattcagctctgcaa

SEQ ID NO: 3754245 - DNA, 12 bp, Homo sapiens
gattcaggctgc

SEQ ID NO: 3754246 - DNA, 13 bp, Homo sapiens
gattcaggctgct

SEQ ID NO: 3754247 - DNA, 16 bp, Homo sapiens
gattcaggctgcttgg

SEQ ID NO: 3754248 - DNA, 22 bp, Homo sapiens
gattcatctaccctgctgacct

SEQ ID NO: 3754249 - DNA, 21 bp, Homo sapiens
gattcatgccaattagcaatt

SEQ ID NO: 3754250 - DNA, 20 bp, Homo sapiens
gattccagagagtggctcct

SEQ ID NO: 3754251 - DNA, 22 bp, Homo sapiens
gattccagagagtggctcctcc

SEQ ID NO: 3754252 - DNA, 18 bp, Homo sapiens
gattcccaagctctgctc

SEQ ID NO: 3754253 - DNA, 21 bp, Homo sapiens
gattcccaagctctgctcctc

SEQ ID NO: 3754254 - DNA, 13 bp, Homo sapiens
gattcccagagac

SEQ ID NO: 3754255 - DNA, 19 bp, Homo sapiens
gattcccagagacaggaaa

SEQ ID NO: 3754256 - DNA, 13 bp, Homo sapiens
gattcccattgaa

SEQ ID NO: 3754257 - DNA, 23 bp, Homo sapiens
gattcccattgaaaatgtaagta

SEQ ID NO: 3754258 - DNA, 21 bp, Homo sapiens
gattcccctaacctcattccc

SEQ ID NO: 3754259 - DNA, 13 bp, Homo sapiens
gattcctttccct

SEQ ID NO: 3754260 - DNA, 18 bp, Homo sapiens
gattcgcccaaagccaga

SEQ ID NO: 3754261 - DNA, 15 bp, Homo sapiens
gattctcctgcctca

SEQ ID NO: 3754262 - DNA, 17 bp, Homo sapiens
gattctcctgcctcagc

SEQ ID NO: 3754263 - DNA, 20 bp, Homo sapiens
gattctcctgcctcagcctc

SEQ ID NO: 3754264 - DNA, 21 bp, Homo sapiens
gattctcctgcctcagcctcc

SEQ ID NO: 3754265 - DNA, 22 bp, Homo sapiens
gattctgggaggaagcaggttg

SEQ ID NO: 3754266 - DNA, 16 bp, Homo sapiens
gattcttcaaaagcat

SEQ ID NO: 3754267 - DNA, 21 bp, Homo sapiens
gattcttctgcttcagcctcc

SEQ ID NO: 3754268 - DNA, 14 bp, Homo sapiens
gattgaaaaggaag

SEQ ID NO: 3754269 - DNA, 18 bp, Homo sapiens
gattgacagtaacttggt

SEQ ID NO: 3754270 - DNA, 19 bp, Homo sapiens
gattgacagtaacttggtt

SEQ ID NO: 3754271 - DNA, 20 bp, Homo sapiens
gattgacagtaacttggtta

SEQ ID NO: 3754272 - DNA, 23 bp, Homo sapiens
gattgcaccactgcactccagcc

SEQ ID NO: 3754273 - DNA, 21 bp, Homo sapiens
gattgctgtgtccaactccag

SEQ ID NO: 3754274 - DNA, 14 bp, Homo sapiens
gattgcttaaaata

SEQ ID NO: 3754275 - DNA, 16 bp, Homo sapiens
gattgcttgagcccag

SEQ ID NO: 3754276 - DNA, 19 bp, Homo sapiens
gattgcttgagcccaggag

SEQ ID NO: 3754277 - DNA, 22 bp, Homo sapiens
gattggatacgcatcagacaga

SEQ ID NO: 3754278 - DNA, 11 bp, Homo sapiens
gattgtaactc

SEQ ID NO: 3754279 - DNA, 16 bp, Homo sapiens
gatttaatttgccaaa

SEQ ID NO: 3754280 - DNA, 20 bp, Homo sapiens
gatttacccagaatgtcaga

SEQ ID NO: 3754281 - DNA, 20 bp, Homo sapiens
gatttatcacacaaagcaga

SEQ ID NO: 3754282 - DNA, 14 bp, Homo sapiens
gatttattttgtta

SEQ ID NO: 3754283 - DNA, 21 bp, Homo sapiens
gatttcagaaagagcaagtct

SEQ ID NO: 3754284 - DNA, 20 bp, Homo sapiens
gatttcaggatactctgtca

SEQ ID NO: 3754285 - DNA, 16 bp, Homo sapiens
gatttcagtcttttcc

SEQ ID NO: 3754286 - DNA, 13 bp, Homo sapiens
gatttcatgattt

SEQ ID NO: 3754287 - DNA, 18 bp, Homo sapiens
gatttcatgctatctctg

SEQ ID NO: 3754288 - DNA, 20 bp, Homo sapiens
gatttcatttcaactgtttg

SEQ ID NO: 3754289 - DNA, 15 bp, Homo sapiens
gatttgcctgtgcca

SEQ ID NO: 3754290 - DNA, 17 bp, Homo sapiens
gatttggtgaatttgaa

SEQ ID NO: 3754291 - DNA, 18 bp, Homo sapiens
gatttggtgaatttgaat

SEQ ID NO: 3754292 - DNA, 19 bp, Homo sapiens
gatttgtactacagttctt

SEQ ID NO: 3754293 - DNA, 19 bp, Homo sapiens
gatttgttaatgatagcta

SEQ ID NO: 3754294 - DNA, 21 bp, Homo sapiens
gatttgttgttctttcagaaa

SEQ ID NO: 3754295 - DNA, 14 bp, Homo sapiens
gattttaacaataa

SEQ ID NO: 3754296 - DNA, 15 bp, Homo sapiens
gattttaacaataac

SEQ ID NO: 3754297 - DNA, 17 bp, Homo sapiens
gattttaacaataacta

SEQ ID NO: 3754298 - DNA, 18 bp, Homo sapiens
gattttacaattgaaatg

SEQ ID NO: 3754299 - DNA, 19 bp, Homo sapiens
gattttcaaagctttttcc

SEQ ID NO: 3754300 - DNA, 19 bp, Homo sapiens
gattttcagccctcagaat

SEQ ID NO: 3754301 - DNA, 23 bp, Homo sapiens
gattttctacaagtattctgcct

SEQ ID NO: 3754302 - DNA, 12 bp, Homo sapiens
gattttgaaaac

SEQ ID NO: 3754303 - DNA, 16 bp, Homo sapiens
gattttgaaaactaca

SEQ ID NO: 3754304 - DNA, 13 bp, Homo sapiens
gatttttatccaa

SEQ ID NO: 3754305 - DNA, 11 bp, Homo sapiens
gcaaaaatttt

SEQ ID NO: 3754306 - DNA, 21 bp, Homo sapiens
gcaaaaccactagaactctcc

SEQ ID NO: 3754307 - DNA, 16 bp, Homo sapiens
gcaaaacccacagaag

SEQ ID NO: 3754308 - DNA, 17 bp, Homo sapiens
gcaaaagatgcttctca

SEQ ID NO: 3754309 - DNA, 13 bp, Homo sapiens
gcaaaataatttt

SEQ ID NO: 3754310 - DNA, 18 bp, Homo sapiens
gcaaaattatagaagttt

SEQ ID NO: 3754311 - DNA, 23 bp, Homo sapiens
gcaaaattatagaagtttagatt

SEQ ID NO: 3754312 - DNA, 15 bp, Homo sapiens
gcaaacacctgctga

SEQ ID NO: 3754313 - DNA, 18 bp, Homo sapiens
gcaaagggagcactgggt

SEQ ID NO: 3754314 - DNA, 15 bp, Homo sapiens
gcaaatcagaaactt

SEQ ID NO: 3754315 - DNA, 20 bp, Homo sapiens
gcaaatcagaaacttgtgaa

SEQ ID NO: 3754316 - DNA, 21 bp, Homo sapiens
gcaaatgttacatagtgtagg

SEQ ID NO: 3754317 - DNA, 12 bp, Homo sapiens
gcaacacacaga

SEQ ID NO: 3754318 - DNA, 13 bp, Homo sapiens
gcaacagaaaaaa

SEQ ID NO: 3754319 - DNA, 13 bp, Homo sapiens
gcaacagacaagt

SEQ ID NO: 3754320 - DNA, 13 bp, Homo sapiens
gcaacaggctggg

SEQ ID NO: 3754321 - DNA, 15 bp, Homo sapiens
gcaaccagagcactg

SEQ ID NO: 3754322 - DNA, 17 bp, Homo sapiens
gcaaccagagcactgta

SEQ ID NO: 3754323 - DNA, 19 bp, Homo sapiens
gcaaccagagcactgtata

SEQ ID NO: 3754324 - DNA, 17 bp, Homo sapiens
gcaacctgtaagactga

SEQ ID NO: 3754325 - DNA, 14 bp, Homo sapiens
gcaacgaagaaaaa

SEQ ID NO: 3754326 - DNA, 18 bp, Homo sapiens
gcaacggggaggccaagt

SEQ ID NO: 3754327 - DNA, 14 bp, Homo sapiens
gcaactcatcttag

SEQ ID NO: 3754328 - DNA, 15 bp, Homo sapiens
gcaactgaacaaaaa

SEQ ID NO: 3754329 - DNA, 13 bp, Homo sapiens
gcaactgaggcag

SEQ ID NO: 3754330 - DNA, 15 bp, Homo sapiens
gcaactgaggcagac

SEQ ID NO: 3754331 - DNA, 19 bp, Homo sapiens
gcaactgaggcagacagca

SEQ ID NO: 3754332 - DNA, 22 bp, Homo sapiens
gcaactgaggcagacagcagct

SEQ ID NO: 3754333 - DNA, 20 bp, Homo sapiens
gcaactgctgatgctcatgg

SEQ ID NO: 3754334 - DNA, 21 bp, Homo sapiens
gcaactgctgatgctcatggt

SEQ ID NO: 3754335 - DNA, 23 bp, Homo sapiens
gcaacttgtctttttctggactg

SEQ ID NO: 3754336 - DNA, 17 bp, Homo sapiens
gcaagaattgaagcagg

SEQ ID NO: 3754337 - DNA, 15 bp, Homo sapiens
gcaagcacctcctgc

SEQ ID NO: 3754338 - DNA, 20 bp, Homo sapiens
gcaagcatttatgtttattt

SEQ ID NO: 3754339 - DNA, 20 bp, Homo sapiens
gcaagcctgtaatcccagct

SEQ ID NO: 3754340 - DNA, 21 bp, Homo sapiens
gcaagcttggctgtagaagga

SEQ ID NO: 3754341 - DNA, 14 bp, Homo sapiens
gcaaggaaggaaag

SEQ ID NO: 3754342 - DNA, 21 bp, Homo sapiens
gcaaggccgctgttcacccac

SEQ ID NO: 3754343 - DNA, 14 bp, Homo sapiens
gcaaggggctctgc

SEQ ID NO: 3754344 - DNA, 18 bp, Homo sapiens
gcaaggggtgcctgggaa

SEQ ID NO: 3754345 - DNA, 19 bp, Homo sapiens
gcaaggggtgcctgggaac

SEQ ID NO: 3754346 - DNA, 14 bp, Homo sapiens
gcaagtatgtgagt

SEQ ID NO: 3754347 - DNA, 18 bp, Homo sapiens
gcaagtatgtgagtgtgt

SEQ ID NO: 3754348 - DNA, 22 bp, Homo sapiens
gcaagtccctgactctctgtga

SEQ ID NO: 3754349 - DNA, 21 bp, Homo sapiens
gcaagtcctaagcctgttagc

SEQ ID NO: 3754350 - DNA, 22 bp, Homo sapiens
gcaagtgagcaaacctgcccca

SEQ ID NO: 3754351 - DNA, 23 bp, Homo sapiens
gcaagtgtgtatgtgcgtgtgtg

SEQ ID NO: 3754352 - DNA, 13 bp, Homo sapiens
gcaagtgtgtgca

SEQ ID NO: 3754353 - DNA, 19 bp, Homo sapiens
gcaagtgtgtgcatgtgtg

SEQ ID NO: 3754354 - DNA, 22 bp, Homo sapiens
gcaagtgtgtgcatgtgtgcga

SEQ ID NO: 3754355 - DNA, 20 bp, Homo sapiens
gcaataacctcaaagtgact

SEQ ID NO: 3754356 - DNA, 14 bp, Homo sapiens
gcaatagagactgt

SEQ ID NO: 3754357 - DNA, 17 bp, Homo sapiens
gcaatataaccaatgtt

SEQ ID NO: 3754358 - DNA, 17 bp, Homo sapiens
gcaatatttaaggagat

SEQ ID NO: 3754359 - DNA, 22 bp, Homo sapiens
gcaatatttaaggagatgtaag

SEQ ID NO: 3754360 - DNA, 20 bp, Homo sapiens
gcaatcagattttcctgtgg

SEQ ID NO: 3754361 - DNA, 22 bp, Homo sapiens
gcaatccatgttagtttttact

SEQ ID NO: 3754362 - DNA, 14 bp, Homo sapiens
gcaatgattactct

SEQ ID NO: 3754363 - DNA, 13 bp, Homo sapiens
gcaatgctggctg

SEQ ID NO: 3754364 - DNA, 12 bp, Homo sapiens
gcaatggcagcc

SEQ ID NO: 3754365 - DNA, 15 bp, Homo sapiens
gcaatggcagccttg

SEQ ID NO: 3754366 - DNA, 21 bp, Homo sapiens
gcaatgtcacaacctctctga

SEQ ID NO: 3754367 - DNA, 20 bp, Homo sapiens
gcaatgtcaggaacagaagg

SEQ ID NO: 3754368 - DNA, 14 bp, Homo sapiens
gcaatgtgctactg

SEQ ID NO: 3754369 - DNA, 15 bp, Homo sapiens
gcaattccgcattta

SEQ ID NO: 3754370 - DNA, 18 bp, Homo sapiens
gcaattgaattaaattag

SEQ ID NO: 3754371 - DNA, 14 bp, Homo sapiens
gcaattttgtaacg

SEQ ID NO: 3754372 - DNA, 11 bp, Homo sapiens
gcacaataaat

SEQ ID NO: 3754373 - DNA, 17 bp, Homo sapiens
gcacacaccagagccca

SEQ ID NO: 3754374 - DNA, 19 bp, Homo sapiens
gcacacagctgcagagaca

SEQ ID NO: 3754375 - DNA, 15 bp, Homo sapiens
gcacagaaaactaga

SEQ ID NO: 3754376 - DNA, 20 bp, Homo sapiens
gcacagaaacacaatatttt

SEQ ID NO: 3754377 - DNA, 19 bp, Homo sapiens
gcacagagagggggccacc

SEQ ID NO: 3754378 - DNA, 23 bp, Homo sapiens
gcacagagagggggccacctccc

SEQ ID NO: 3754379 - DNA, 13 bp, Homo sapiens
gcacagatggatt

SEQ ID NO: 3754380 - DNA, 18 bp, Homo sapiens
gcacagatggatttgcct

SEQ ID NO: 3754381 - DNA, 23 bp, Homo sapiens
gcacagccggggcctgcctagca

SEQ ID NO: 3754382 - DNA, 14 bp, Homo sapiens
gcacagctgtggtg

SEQ ID NO: 3754383 - DNA, 18 bp, Homo sapiens
gcacagtgcatctcagcc

SEQ ID NO: 3754384 - DNA, 19 bp, Homo sapiens
gcacagtgcatctcagccc

SEQ ID NO: 3754385 - DNA, 20 bp, Homo sapiens
gcacagtgcatctcagccca

SEQ ID NO: 3754386 - DNA, 21 bp, Homo sapiens
gcacatctgcattttcacccc

SEQ ID NO: 3754387 - DNA, 21 bp, Homo sapiens
gcacatgagctggcgggattg

SEQ ID NO: 3754388 - DNA, 15 bp, Homo sapiens
gcaccagcagcctgg

SEQ ID NO: 3754389 - DNA, 13 bp, Homo sapiens
gcaccaggagaca

SEQ ID NO: 3754390 - DNA, 19 bp, Homo sapiens
gcaccagtgtcctcccctc

SEQ ID NO: 3754391 - DNA, 22 bp, Homo sapiens
gcacccacaaataaatgacaag

SEQ ID NO: 3754392 - DNA, 22 bp, Homo sapiens
gcacccaccatcatgtctggct

SEQ ID NO: 3754393 - DNA, 15 bp, Homo sapiens
gcaccccaagtccag

SEQ ID NO: 3754394 - DNA, 15 bp, Homo sapiens
gcacccccacccttt

SEQ ID NO: 3754395 - DNA, 15 bp, Homo sapiens
gcacccccacgccct

SEQ ID NO: 3754396 - DNA, 13 bp, Homo sapiens
gcacccccctggg

SEQ ID NO: 3754397 - DNA, 14 bp, Homo sapiens
gcacccggcccctg

SEQ ID NO: 3754398 - DNA, 15 bp, Homo sapiens
gcacccggcccctgc

SEQ ID NO: 3754399 - DNA, 16 bp, Homo sapiens
gcaccctcaggcaggt

SEQ ID NO: 3754400 - DNA, 19 bp, Homo sapiens
gcaccctcaggcaggtggg

SEQ ID NO: 3754401 - DNA, 20 bp, Homo sapiens
gcaccctcatacacagaaac

SEQ ID NO: 3754402 - DNA, 20 bp, Homo sapiens
gcaccgccggccagctggga

SEQ ID NO: 3754403 - DNA, 17 bp, Homo sapiens
gcacctatagtcccagc

SEQ ID NO: 3754404 - DNA, 17 bp, Homo sapiens
gcacctcccagcccctg

SEQ ID NO: 3754405 - DNA, 14 bp, Homo sapiens
gcacctgccagcct

SEQ ID NO: 3754406 - DNA, 16 bp, Homo sapiens
gcacctgccccctggt

SEQ ID NO: 3754407 - DNA, 22 bp, Homo sapiens
gcacctgccccctggtggacag

SEQ ID NO: 3754408 - DNA, 21 bp, Homo sapiens
gcacctgccgacctcgtcctc

SEQ ID NO: 3754409 - DNA, 15 bp, Homo sapiens
gcacctggggagtgg

SEQ ID NO: 3754410 - DNA, 21 bp, Homo sapiens
gcacctgtaatcccagctact

SEQ ID NO: 3754411 - DNA, 21 bp, Homo sapiens
gcacctgtactcaggaggctg

SEQ ID NO: 3754412 - DNA, 20 bp, Homo sapiens
gcacgagtgggaaggacttg

SEQ ID NO: 3754413 - DNA, 18 bp, Homo sapiens
gcacgcccatgtgtgagt

SEQ ID NO: 3754414 - DNA, 22 bp, Homo sapiens
gcacgcccatgtgtgagtgtgt

SEQ ID NO: 3754415 - DNA, 20 bp, Homo sapiens
gcacgtagtagggtcaggcc

SEQ ID NO: 3754416 - DNA, 16 bp, Homo sapiens
gcacgtggagagctgg

SEQ ID NO: 3754417 - DNA, 17 bp, Homo sapiens
gcacgtttaaagttctg

SEQ ID NO: 3754418 - DNA, 14 bp, Homo sapiens
gcactaaagcagtg

SEQ ID NO: 3754419 - DNA, 20 bp, Homo sapiens
gcactaaagcagtggacacc

SEQ ID NO: 3754420 - DNA, 13 bp, Homo sapiens
gcactcagaagac

SEQ ID NO: 3754421 - DNA, 13 bp, Homo sapiens
gcactccagcctg

SEQ ID NO: 3754422 - DNA, 16 bp, Homo sapiens
gcactccagcctgggc

SEQ ID NO: 3754423 - DNA, 21 bp, Homo sapiens
gcactccagcctgggcgacag

SEQ ID NO: 3754424 - DNA, 14 bp, Homo sapiens
gcactctagccgga

SEQ ID NO: 3754425 - DNA, 17 bp, Homo sapiens
gcactgactgggcatag

SEQ ID NO: 3754426 - DNA, 12 bp, Homo sapiens
gcactgctgccc

SEQ ID NO: 3754427 - DNA, 17 bp, Homo sapiens
gcactggagtccagtct

SEQ ID NO: 3754428 - DNA, 18 bp, Homo sapiens
gcactggagtccagtctc

SEQ ID NO: 3754429 - DNA, 22 bp, Homo sapiens
gcactggtggcccgacagcctg

SEQ ID NO: 3754430 - DNA, 24 bp, Homo sapiens
gcactggtggcccgacagcctggc

SEQ ID NO: 3754431 - DNA, 16 bp, Homo sapiens
gcactgtatgctggac

SEQ ID NO: 3754432 - DNA, 16 bp, Homo sapiens
gcacttgcagactcta

SEQ ID NO: 3754433 - DNA, 22 bp, Homo sapiens
gcactttcattgccagtgtctt

SEQ ID NO: 3754434 - DNA, 16 bp, Homo sapiens
gcactttgggaggctg

SEQ ID NO: 3754435 - DNA, 21 bp, Homo sapiens
gcactttgggaggctgaggtg

SEQ ID NO: 3754436 - DNA, 16 bp, Homo sapiens
gcagaaaagcacctgc

SEQ ID NO: 3754437 - DNA, 17 bp, Homo sapiens
gcagaaaagcacctgcc

SEQ ID NO: 3754438 - DNA, 21 bp, Homo sapiens
gcagaaaagcacctgccgacc

SEQ ID NO: 3754439 - DNA, 10 bp, Homo sapiens
gcagaaacag

SEQ ID NO: 3754440 - DNA, 11 bp, Homo sapiens
gcagaaacaga

SEQ ID NO: 3754441 - DNA, 17 bp, Homo sapiens
gcagaaagcagaggctg

SEQ ID NO: 3754442 - DNA, 17 bp, Homo sapiens
gcagaaagggagcagag

SEQ ID NO: 3754443 - DNA, 15 bp, Homo sapiens
gcagaaatctagaag

SEQ ID NO: 3754444 - DNA, 18 bp, Homo sapiens
gcagaacagccgctcctg

SEQ ID NO: 3754445 - DNA, 21 bp, Homo sapiens
gcagaacagccgctcctgtct

SEQ ID NO: 3754446 - DNA, 23 bp, Homo sapiens
gcagaacagccgctcctgtctgc

SEQ ID NO: 3754447 - DNA, 23 bp, Homo sapiens
gcagaagggggtctcttcttcca

SEQ ID NO: 3754448 - DNA, 14 bp, Homo sapiens
gcagaagtgtttca

SEQ ID NO: 3754449 - DNA, 18 bp, Homo sapiens
gcagaataatctttgggt

SEQ ID NO: 3754450 - DNA, 16 bp, Homo sapiens
gcagacagcagctcag

SEQ ID NO: 3754451 - DNA, 19 bp, Homo sapiens
gcagacagcagctcaggca

SEQ ID NO: 3754452 - DNA, 20 bp, Homo sapiens
gcagacaggccatgtgagcc

SEQ ID NO: 3754453 - DNA, 20 bp, Homo sapiens
gcagactcaataaaatcatg

SEQ ID NO: 3754454 - DNA, 17 bp, Homo sapiens
gcagactcagtttgtca

SEQ ID NO: 3754455 - DNA, 18 bp, Homo sapiens
gcagactcagtttgtcag

SEQ ID NO: 3754456 - DNA, 19 bp, Homo sapiens
gcagactctacagaggcca

SEQ ID NO: 3754457 - DNA, 22 bp, Homo sapiens
gcagactctacagaggccatgg

SEQ ID NO: 3754458 - DNA, 17 bp, Homo sapiens
gcagactggtgagcaga

SEQ ID NO: 3754459 - DNA, 19 bp, Homo sapiens
gcagagaatgaaagggccc

SEQ ID NO: 3754460 - DNA, 21 bp, Homo sapiens
gcagagaattctcttatccaa

SEQ ID NO: 3754461 - DNA, 14 bp, Homo sapiens
gcagagcaggggca

SEQ ID NO: 3754462 - DNA, 20 bp, Homo sapiens
gcagagcaggggcagggtga

SEQ ID NO: 3754463 - DNA, 17 bp, Homo sapiens
gcagtgggagctgcctg

SEQ ID NO: 3754464 - DNA, 18 bp, Homo sapiens
gcagtggtgcgatctggg

SEQ ID NO: 3754465 - DNA, 21 bp, Homo sapiens
gcagtggtgcgatctgggttc

SEQ ID NO: 3754466 - DNA, 16 bp, Homo sapiens
gcagtgtcttccataa

SEQ ID NO: 3754467 - DNA, 18 bp, Homo sapiens
gcagtgtgtctcctgcat

SEQ ID NO: 3754468 - DNA, 20 bp, Homo sapiens
gcagtgtgtctcctgcatgc

SEQ ID NO: 3754469 - DNA, 19 bp, Homo sapiens
gcagttagagatgcctccc

SEQ ID NO: 3754470 - DNA, 17 bp, Homo sapiens
gcagttattaacactaa

SEQ ID NO: 3754471 - DNA, 21 bp, Homo sapiens
gcagtttgcctggtgcagtgg

SEQ ID NO: 3754472 - DNA, 15 bp, Homo sapiens
gcataaaaattagcc

SEQ ID NO: 3754473 - DNA, 15 bp, Homo sapiens
gcataactgacaaat

SEQ ID NO: 3754474 - DNA, 17 bp, Homo sapiens
gcataactgacaaatca

SEQ ID NO: 3754475 - DNA, 22 bp, Homo sapiens
gcataactgacaaatcaagttt

SEQ ID NO: 3754476 - DNA, 14 bp, Homo sapiens
gcataataagctaa

SEQ ID NO: 3754477 - DNA, 18 bp, Homo sapiens
gcataataagctaaagag

SEQ ID NO: 3754478 - DNA, 21 bp, Homo sapiens
gcatacacccccacctcctgc

SEQ ID NO: 3754479 - DNA, 23 bp, Homo sapiens
gcatagaaggaggagagggaaaa

SEQ ID NO: 3754480 - DNA, 16 bp, Homo sapiens
gcatagcaagacacat

SEQ ID NO: 3754481 - DNA, 23 bp, Homo sapiens
gcataggcctgggtgctggctgc

SEQ ID NO: 3754482 - DNA, 20 bp, Homo sapiens
gcatagtattccattgtgtg

SEQ ID NO: 3754483 - DNA, 22 bp, Homo sapiens
gcatagtattccattgtgtgag

SEQ ID NO: 3754484 - DNA, 16 bp, Homo sapiens
gcatattcttatgtat

SEQ ID NO: 3754485 - DNA, 14 bp, Homo sapiens
gcatcacagggcag

SEQ ID NO: 3754486 - DNA, 21 bp, Homo sapiens
gcatcacctagaaacttgtta

SEQ ID NO: 3754487 - DNA, 10 bp, Homo sapiens
gcatcagaaa

SEQ ID NO: 3754488 - DNA, 11 bp, Homo sapiens
gcatcagaaat

SEQ ID NO: 3754489 - DNA, 12 bp, Homo sapiens
gcatccaactga

SEQ ID NO: 3754490 - DNA, 12 bp, Homo sapiens
gcatccaggcac

SEQ ID NO: 3754491 - DNA, 17 bp, Homo sapiens
gcatccatgtgtggact

SEQ ID NO: 3754492 - DNA, 14 bp, Homo sapiens
gcatccattcctca

SEQ ID NO: 3754493 - DNA, 15 bp, Homo sapiens
gcatccattcctcag

SEQ ID NO: 3754494 - DNA, 18 bp, Homo sapiens
gcatccattcctcaggga

SEQ ID NO: 3754495 - DNA, 14 bp, Homo sapiens
gcatcccaggggac

SEQ ID NO: 3754496 - DNA, 19 bp, Homo sapiens
gcatcccaggggaccacac

SEQ ID NO: 3754497 - DNA, 16 bp, Homo sapiens
gcatcccagtggcctc

SEQ ID NO: 3754498 - DNA, 17 bp, Homo sapiens
gcatcccagtggcctca

SEQ ID NO: 3754499 - DNA, 18 bp, Homo sapiens
gcatccgtagttccctga

SEQ ID NO: 3754500 - DNA, 15 bp, Homo sapiens
gcatcctcagttcct

SEQ ID NO: 3754501 - DNA, 13 bp, Homo sapiens
gcatcctggcacc

SEQ ID NO: 3754502 - DNA, 22 bp, Homo sapiens
gcatcctggcacccggcccctg

SEQ ID NO: 3754503 - DNA, 12 bp, Homo sapiens
gcatctaaactt

SEQ ID NO: 3754504 - DNA, 15 bp, Homo sapiens
gcatctaaactttaa

SEQ ID NO: 3754505 - DNA, 19 bp, Homo sapiens
gcatctaaactttaatatg

SEQ ID NO: 3754506 - DNA, 20 bp, Homo sapiens
gcatctaaactttaatatgt

SEQ ID NO: 3754507 - DNA, 21 bp, Homo sapiens
gcatctaaactttaatatgta

SEQ ID NO: 3754508 - DNA, 14 bp, Homo sapiens
gcatctcagcccac

SEQ ID NO: 3754509 - DNA, 14 bp, Homo sapiens
gcatctcttgaggc

SEQ ID NO: 3754510 - DNA, 18 bp, Homo sapiens
gcatctcttgaggccagg

SEQ ID NO: 3754511 - DNA, 19 bp, Homo sapiens
gcatctgacacaaaaaaag

SEQ ID NO: 3754512 - DNA, 14 bp, Homo sapiens
gcatctgcccctcc

SEQ ID NO: 3754513 - DNA, 17 bp, Homo sapiens
gcatctgcccctccccc

SEQ ID NO: 3754514 - DNA, 18 bp, Homo sapiens
gcatctgctaataaaacc

SEQ ID NO: 3754515 - DNA, 12 bp, Homo sapiens
gcatctggcctt

SEQ ID NO: 3754516 - DNA, 16 bp, Homo sapiens
gcatcttactgaaggt

SEQ ID NO: 3754517 - DNA, 23 bp, Homo sapiens
gcatcttactgaaggtaaaattg

SEQ ID NO: 3754518 - DNA, 19 bp, Homo sapiens
gcatcttctcactcccttc

SEQ ID NO: 3754519 - DNA, 13 bp, Homo sapiens
gcatctttgcctt

SEQ ID NO: 3754520 - DNA, 22 bp, Homo sapiens
gcatctttgccttgggctgctc

SEQ ID NO: 3754521 - DNA, 13 bp, Homo sapiens
gcatgaaggtttc

SEQ ID NO: 3754522 - DNA, 16 bp, Homo sapiens
gcatgacaagccccag

SEQ ID NO: 3754523 - DNA, 21 bp, Homo sapiens
gcatgacaagccccaggcagg

SEQ ID NO: 3754524 - DNA, 19 bp, Homo sapiens
gcatgagggatcacagggc

SEQ ID NO: 3754525 - DNA, 13 bp, Homo sapiens
gcatgcagcagct

SEQ ID NO: 3754526 - DNA, 22 bp, Homo sapiens
gcatgcagcagcttgctgcacc

SEQ ID NO: 3754527 - DNA, 21 bp, Homo sapiens
gcatgcattttgcagcagtga

SEQ ID NO: 3754528 - DNA, 16 bp, Homo sapiens
gcatgccttccagcac

SEQ ID NO: 3754529 - DNA, 21 bp, Homo sapiens
gcatgccttccagcaccctgc

SEQ ID NO: 3754530 - DNA, 15 bp, Homo sapiens
gcatgcggcccagga

SEQ ID NO: 3754531 - DNA, 13 bp, Homo sapiens
gcatgctctctgc

SEQ ID NO: 3754532 - DNA, 13 bp, Homo sapiens
gcatgctggggca

SEQ ID NO: 3754533 - DNA, 14 bp, Homo sapiens
gcatggagaacagt

SEQ ID NO: 3754534 - DNA, 23 bp, Homo sapiens
gcatggagtgtgtattgttccca

SEQ ID NO: 3754535 - DNA, 22 bp, Homo sapiens
gcatggcacctgtcgcccagtg

SEQ ID NO: 3754536 - DNA, 13 bp, Homo sapiens
gcatggccaggtg

SEQ ID NO: 3754537 - DNA, 17 bp, Homo sapiens
gcatggccaggtggcca

SEQ ID NO: 3754538 - DNA, 14 bp, Homo sapiens
gcatggctccagtc

SEQ ID NO: 3754539 - DNA, 22 bp, Homo sapiens
gcatggggataaaggagaaggc

SEQ ID NO: 3754540 - DNA, 15 bp, Homo sapiens
gcatgggttttgtag

SEQ ID NO: 3754541 - DNA, 23 bp, Homo sapiens
gcatgtccctaccgagtctcttc

SEQ ID NO: 3754542 - DNA, 19 bp, Homo sapiens
gcatgtctttttttctgtt

SEQ ID NO: 3754543 - DNA, 11 bp, Homo sapiens
gcatgtgtgtg

SEQ ID NO: 3754544 - DNA, 14 bp, Homo sapiens
gcatgtgtgtgctc

SEQ ID NO: 3754545 - DNA, 22 bp, Homo sapiens
gcatgtgtttggttctggggcc

SEQ ID NO: 3754546 - DNA, 15 bp, Homo sapiens
gcatgttctctgagg

SEQ ID NO: 3754547 - DNA, 22 bp, Homo sapiens
gcatgttctctgaggacactaa

SEQ ID NO: 3754548 - DNA, 13 bp, Homo sapiens
gcattaaaactta

SEQ ID NO: 3754549 - DNA, 13 bp, Homo sapiens
gcattacattcct

SEQ ID NO: 3754550 - DNA, 21 bp, Homo sapiens
gcattagaaatagacagtata

SEQ ID NO: 3754551 - DNA, 15 bp, Homo sapiens
gcattattgcattat

SEQ ID NO: 3754552 - DNA, 12 bp, Homo sapiens
gcattcacccag

SEQ ID NO: 3754553 - DNA, 19 bp, Homo sapiens
gcattcacccagacagctc

SEQ ID NO: 3754554 - DNA, 20 bp, Homo sapiens
gcattcacccagacagctcc

SEQ ID NO: 3754555 - DNA, 14 bp, Homo sapiens
gcattccaggctcc

SEQ ID NO: 3754556 - DNA, 14 bp, Homo sapiens
gcattccctgagtc

SEQ ID NO: 3754557 - DNA, 19 bp, Homo sapiens
gcattcttgtcacaataaa

SEQ ID NO: 3754558 - DNA, 21 bp, Homo sapiens
gcattcttgtcacaataaatg

SEQ ID NO: 3754559 - DNA, 22 bp, Homo sapiens
gcattcttgtcacaataaatgt

SEQ ID NO: 3754560 - DNA, 17 bp, Homo sapiens
gcattcttttgctgttt

SEQ ID NO: 3754561 - DNA, 16 bp, Homo sapiens
gcattgatggggaagg

SEQ ID NO: 3754562 - DNA, 15 bp, Homo sapiens
gcattgctttccact

SEQ ID NO: 3754563 - DNA, 12 bp, Homo sapiens
gcattgctttct

SEQ ID NO: 3754564 - DNA, 13 bp, Homo sapiens
gcattgctttctg

SEQ ID NO: 3754565 - DNA, 23 bp, Homo sapiens
gcattgttgaggtggtctgaatg

SEQ ID NO: 3754566 - DNA, 15 bp, Homo sapiens
gcatttactttgtgt

SEQ ID NO: 3754567 - DNA, 18 bp, Homo sapiens
gcatttactttgtgttca

SEQ ID NO: 3754568 - DNA, 18 bp, Homo sapiens
gcatttcctgctggtcaa

SEQ ID NO: 3754569 - DNA, 12 bp, Homo sapiens
gcatttgtgaaa

SEQ ID NO: 3754570 - DNA, 11 bp, Homo sapiens
gccaaaataat

SEQ ID NO: 3754571 - DNA, 19 bp, Homo sapiens
gccaaaataatgtcttgtt

SEQ ID NO: 3754572 - DNA, 20 bp, Homo sapiens
gccaaacatcagacctgtct

SEQ ID NO: 3754573 - DNA, 15 bp, Homo sapiens
gccaaaccctgtctg

SEQ ID NO: 3754574 - DNA, 13 bp, Homo sapiens
gccaaagccaaag

SEQ ID NO: 3754575 - DNA, 19 bp, Homo sapiens
gccaaagcctcctccagcc

SEQ ID NO: 3754576 - DNA, 16 bp, Homo sapiens
gccaaagctaggcctg

SEQ ID NO: 3754577 - DNA, 16 bp, Homo sapiens
gccaaagctagggtgg

SEQ ID NO: 3754578 - DNA, 20 bp, Homo sapiens
gccaaagctagggtggccct

SEQ ID NO: 3754579 - DNA, 23 bp, Homo sapiens
gccaaaggagggtcaggaaggat

SEQ ID NO: 3754580 - DNA, 16 bp, Homo sapiens
gccaaaggtctagaaa

SEQ ID NO: 3754581 - DNA, 12 bp, Homo sapiens
gccaaagtgtta

SEQ ID NO: 3754582 - DNA, 15 bp, Homo sapiens
gccaaatatattctc

SEQ ID NO: 3754583 - DNA, 16 bp, Homo sapiens
gccaaatgtaattgaa

SEQ ID NO: 3754584 - DNA, 17 bp, Homo sapiens
gccaacagaagcttcca

SEQ ID NO: 3754585 - DNA, 19 bp, Homo sapiens
gccaacagaagcttccatt

SEQ ID NO: 3754586 - DNA, 13 bp, Homo sapiens
gccaagaactgaa

SEQ ID NO: 3754587 - DNA, 16 bp, Homo sapiens
gccaagatgcttttca

SEQ ID NO: 3754588 - DNA, 20 bp, Homo sapiens
gccaagcacagtgcctgcat

SEQ ID NO: 3754589 - DNA, 22 bp, Homo sapiens
gccaagcacctagcctcgctct

SEQ ID NO: 3754590 - DNA, 12 bp, Homo sapiens
gccaagcagcca

SEQ ID NO: 3754591 - DNA, 14 bp, Homo sapiens
gccaagcagccaag

SEQ ID NO: 3754592 - DNA, 13 bp, Homo sapiens
gccaagccaggga

SEQ ID NO: 3754593 - DNA, 14 bp, Homo sapiens
gccaaggactgccg

SEQ ID NO: 3754594 - DNA, 23 bp, Homo sapiens
gccaaggagggtggatcacctga

SEQ ID NO: 3754595 - DNA, 15 bp, Homo sapiens
gccaaggtgggagga

SEQ ID NO: 3754596 - DNA, 23 bp, Homo sapiens
gccaaggtgggaggattgcttga

SEQ ID NO: 3754597 - DNA, 21 bp, Homo sapiens
gccaaggtgggctgagccctg

SEQ ID NO: 3754598 - DNA, 22 bp, Homo sapiens
gccaaggtgggctgagccctgg

SEQ ID NO: 3754599 - DNA, 23 bp, Homo sapiens
gccaagtcccaccggttgcttct

SEQ ID NO: 3754600 - DNA, 16 bp, Homo sapiens
gccaagtgcaggctgg

SEQ ID NO: 3754601 - DNA, 15 bp, Homo sapiens
gccaagttcctctag

SEQ ID NO: 3754602 - DNA, 14 bp, Homo sapiens
gccacagagaaagt

SEQ ID NO: 3754603 - DNA, 16 bp, Homo sapiens
gccacagccagaaccc

SEQ ID NO: 3754604 - DNA, 22 bp, Homo sapiens
gccacagcccaggcctccagct

SEQ ID NO: 3754605 - DNA, 17 bp, Homo sapiens
gccacatccccgctggc

SEQ ID NO: 3754606 - DNA, 20 bp, Homo sapiens
gccacatccccgctggctgg

SEQ ID NO: 3754607 - DNA, 15 bp, Homo sapiens
gccaccacgtccagc

SEQ ID NO: 3754608 - DNA, 16 bp, Homo sapiens
gccaccacgtccagct

SEQ ID NO: 3754609 - DNA, 16 bp, Homo sapiens
gccaccaggtcatctc

SEQ ID NO: 3754610 - DNA, 22 bp, Homo sapiens
gccaccatattcagtgctgtgg

SEQ ID NO: 3754611 - DNA, 16 bp, Homo sapiens
gccaccatgcccagct

SEQ ID NO: 3754612 - DNA, 22 bp, Homo sapiens
gccaccatgcccagctcagagg

SEQ ID NO: 3754613 - DNA, 17 bp, Homo sapiens
gccacctccccaggccg

SEQ ID NO: 3754614 - DNA, 12 bp, Homo sapiens
gccacctgcagg

SEQ ID NO: 3754615 - DNA, 21 bp, Homo sapiens
gccacctgcccccttctccca

SEQ ID NO: 3754616 - DNA, 18 bp, Homo sapiens
gccacctgtcccacctca

SEQ ID NO: 3754617 - DNA, 17 bp, Homo sapiens
gccacgtgccaggcccg

SEQ ID NO: 3754618 - DNA, 22 bp, Homo sapiens
gccactacactccagcctgagc

SEQ ID NO: 3754619 - DNA, 22 bp, Homo sapiens
gccactccagacccctggcttt

SEQ ID NO: 3754620 - DNA, 14 bp, Homo sapiens
gccactctgcctct

SEQ ID NO: 3754621 - DNA, 14 bp, Homo sapiens
gccactgaagctgg

SEQ ID NO: 3754622 - DNA, 15 bp, Homo sapiens
gccactgaagctggg

SEQ ID NO: 3754623 - DNA, 18 bp, Homo sapiens
gccactgcaccgggccac

SEQ ID NO: 3754624 - DNA, 19 bp, Homo sapiens
gccactgcaccgggccaca

SEQ ID NO: 3754625 - DNA, 21 bp, Homo sapiens
gccactgcactccagcctggg

SEQ ID NO: 3754626 - DNA, 19 bp, Homo sapiens
gccacttaccttcaataaa

SEQ ID NO: 3754627 - DNA, 22 bp, Homo sapiens
gccacttaccttcaataaagta

SEQ ID NO: 3754628 - DNA, 23 bp, Homo sapiens
gccacttaccttcaataaagtat

SEQ ID NO: 3754629 - DNA, 22 bp, Homo sapiens
gccactttggtacatggccagt

SEQ ID NO: 3754630 - DNA, 14 bp, Homo sapiens
gccagaaccccgag

SEQ ID NO: 3754631 - DNA, 15 bp, Homo sapiens
gccagaaccccgagc

SEQ ID NO: 3754632 - DNA, 12 bp, Homo sapiens
gccagaagctga

SEQ ID NO: 3754633 - DNA, 21 bp, Homo sapiens
gccagaagctgagcaccaggg

SEQ ID NO: 3754634 - DNA, 15 bp, Homo sapiens
gccagaccagagctc

SEQ ID NO: 3754635 - DNA, 22 bp, Homo sapiens
gccagacggcacccacccagca

SEQ ID NO: 3754636 - DNA, 21 bp, Homo sapiens
gccagagagcctggtgctgct

SEQ ID NO: 3754637 - DNA, 18 bp, Homo sapiens
gccagagcaaagggccag

SEQ ID NO: 3754638 - DNA, 20 bp, Homo sapiens
gccagagggagtgacagagg

SEQ ID NO: 3754639 - DNA, 13 bp, Homo sapiens
gccagagtggcct

SEQ ID NO: 3754640 - DNA, 18 bp, Homo sapiens
gccagagtggcctggcca

SEQ ID NO: 3754641 - DNA, 19 bp, Homo sapiens
gccagagtggcctggccag

SEQ ID NO: 3754642 - DNA, 23 bp, Homo sapiens
gccagagtggcctggccaggagc

SEQ ID NO: 3754643 - DNA, 21 bp, Homo sapiens
gccagatgcacatccctggaa

SEQ ID NO: 3754644 - DNA, 21 bp, Homo sapiens
gccagcacccccacgccctca

SEQ ID NO: 3754645 - DNA, 16 bp, Homo sapiens
gccagcagccagctct

SEQ ID NO: 3754646 - DNA, 21 bp, Homo sapiens
gccagcagccagctctcagcc

SEQ ID NO: 3754647 - DNA, 22 bp, Homo sapiens
gccagcagccagctctcagcca

SEQ ID NO: 3754648 - DNA, 23 bp, Homo sapiens
gccagcagccagctctcagccaa

SEQ ID NO: 3754649 - DNA, 12 bp, Homo sapiens
gccagccagcag

SEQ ID NO: 3754650 - DNA, 14 bp, Homo sapiens
gccagccagcagcc

SEQ ID NO: 3754651 - DNA, 22 bp, Homo sapiens
gccagccagtgacctgaggaag

SEQ ID NO: 3754652 - DNA, 13 bp, Homo sapiens
gccagcccagccc

SEQ ID NO: 3754653 - DNA, 14 bp, Homo sapiens
gccagcccagccca

SEQ ID NO: 3754654 - DNA, 13 bp, Homo sapiens
gccagccccaccc

SEQ ID NO: 3754655 - DNA, 19 bp, Homo sapiens
gccagccccacccaggagg

SEQ ID NO: 3754656 - DNA, 20 bp, Homo sapiens
gccagcccctcccaccacag

SEQ ID NO: 3754657 - DNA, 21 bp, Homo sapiens
gccagccctccctgtcctcct

SEQ ID NO: 3754658 - DNA, 16 bp, Homo sapiens
gccagctcagtcccat

SEQ ID NO: 3754659 - DNA, 15 bp, Homo sapiens
gccagctctcagcca

SEQ ID NO: 3754660 - DNA, 14 bp, Homo sapiens
gccagctgcatcta

SEQ ID NO: 3754661 - DNA, 14 bp, Homo sapiens
gccagctggcagca

SEQ ID NO: 3754662 - DNA, 16 bp, Homo sapiens
gccagctgggatctga

SEQ ID NO: 3754663 - DNA, 13 bp, Homo sapiens
gccaggagctggg

SEQ ID NO: 3754664 - DNA, 19 bp, Homo sapiens
gccaggagtttgagaccag

SEQ ID NO: 3754665 - DNA, 15 bp, Homo sapiens
gccaggccagaggga

SEQ ID NO: 3754666 - DNA, 22 bp, Homo sapiens
gccaggccagagggagtgacag

SEQ ID NO: 3754667 - DNA, 18 bp, Homo sapiens
gccaggcccccaagcctg

SEQ ID NO: 3754668 - DNA, 19 bp, Homo sapiens
gccaggcccccaagcctgc

SEQ ID NO: 3754669 - DNA, 23 bp, Homo sapiens
gccaggcccccaagcctgcagtc

SEQ ID NO: 3754670 - DNA, 16 bp, Homo sapiens
gccaggcgagatgggg

SEQ ID NO: 3754671 - DNA, 17 bp, Homo sapiens
gccaggctcaggccatg

SEQ ID NO: 3754672 - DNA, 13 bp, Homo sapiens
gccaggctggtct

SEQ ID NO: 3754673 - DNA, 15 bp, Homo sapiens
gccaggctggtctca

SEQ ID NO: 3754674 - DNA, 11 bp, Homo sapiens
gccagggagct

SEQ ID NO: 3754675 - DNA, 19 bp, Homo sapiens
gccagggccctgcagaggg

SEQ ID NO: 3754676 - DNA, 21 bp, Homo sapiens
gccaggggaaaatcagcctgc

SEQ ID NO: 3754677 - DNA, 21 bp, Homo sapiens
gccaggtaatgtgaataaatt

SEQ ID NO: 3754678 - DNA, 13 bp, Homo sapiens
gccaggtgcagtg

SEQ ID NO: 3754679 - DNA, 18 bp, Homo sapiens
gccaggtggccactccag

SEQ ID NO: 3754680 - DNA, 16 bp, Homo sapiens
gccagtcctgcctggc

SEQ ID NO: 3754681 - DNA, 19 bp, Homo sapiens
gccagtcctgcctggccag

SEQ ID NO: 3754682 - DNA, 20 bp, Homo sapiens
gccagtcctgcctggccagg

SEQ ID NO: 3754683 - DNA, 17 bp, Homo sapiens
gccagtgacctgaggaa

SEQ ID NO: 3754684 - DNA, 18 bp, Homo sapiens
gccagtgacctgaggaag

SEQ ID NO: 3754685 - DNA, 20 bp, Homo sapiens
gccagtgacctgaggaagcg

SEQ ID NO: 3754686 - DNA, 20 bp, Homo sapiens
gccagtgatgctaaaggttg

SEQ ID NO: 3754687 - DNA, 22 bp, Homo sapiens
gccagtgccttacctcctgccc

SEQ ID NO: 3754688 - DNA, 14 bp, Homo sapiens
gccagttggaacca

SEQ ID NO: 3754689 - DNA, 19 bp, Homo sapiens
gccatattctgttggccag

SEQ ID NO: 3754690 - DNA, 21 bp, Homo sapiens
gccatcatgtaaattaccagt

SEQ ID NO: 3754691 - DNA, 20 bp, Homo sapiens
gccatccaggttcagcttgt

SEQ ID NO: 3754692 - DNA, 22 bp, Homo sapiens
ctgttttaaatttatttcaaaa

SEQ ID NO: 3754693 - DNA, 22 bp, Homo sapiens
ctgttttacaaaaaagaaaaga

SEQ ID NO: 3754694 - DNA, 12 bp, Homo sapiens
ctgttttgaatt

SEQ ID NO: 3754695 - DNA, 22 bp, Homo sapiens
ctgttttgcctgaagttggagt

SEQ ID NO: 3754696 - DNA, 22 bp, Homo sapiens
ctgttttgttttgttttttaaa

SEQ ID NO: 3754697 - DNA, 17 bp, Homo sapiens
ctgtttttaaaaatcat

SEQ ID NO: 3754698 - DNA, 15 bp, Homo sapiens
ctgtttttaagctgt

SEQ ID NO: 3754699 - DNA, 21 bp, Homo sapiens
ctgtttttcagggaggtggct

SEQ ID NO: 3754700 - DNA, 17 bp, Homo sapiens
ctgttttttcctgagct

SEQ ID NO: 3754701 - DNA, 22 bp, Homo sapiens
cttaaaaagtctgcattacatt

SEQ ID NO: 3754702 - DNA, 12 bp, Homo sapiens
cttaaaaagtta

SEQ ID NO: 3754703 - DNA, 12 bp, Homo sapiens
cttaaaactcct

SEQ ID NO: 3754704 - DNA, 21 bp, Homo sapiens
cttaaaagccatcatgtaaat

SEQ ID NO: 3754705 - DNA, 20 bp, Homo sapiens
cttaaaatattcctgcattt

SEQ ID NO: 3754706 - DNA, 21 bp, Homo sapiens
cttaaaggctgtggtagtact

SEQ ID NO: 3754707 - DNA, 18 bp, Homo sapiens
cttaaatatcaatcattt

SEQ ID NO: 3754708 - DNA, 21 bp, Homo sapiens
cttaaatgaaagcatgtggca

SEQ ID NO: 3754709 - DNA, 16 bp, Homo sapiens
cttaaatgagaaggaa

SEQ ID NO: 3754710 - DNA, 22 bp, Homo sapiens
cttaaattaaacaatttatttt

SEQ ID NO: 3754711 - DNA, 19 bp, Homo sapiens
cttaacaaaccctcgtttc

SEQ ID NO: 3754712 - DNA, 14 bp, Homo sapiens
cttaacattctgta

SEQ ID NO: 3754713 - DNA, 16 bp, Homo sapiens
cttaaccgcatcagaa

SEQ ID NO: 3754714 - DNA, 11 bp, Homo sapiens
cttaactcttt

SEQ ID NO: 3754715 - DNA, 13 bp, Homo sapiens
cttaactctttgc

SEQ ID NO: 3754716 - DNA, 17 bp, Homo sapiens
cttaagaacacaaagcg

SEQ ID NO: 3754717 - DNA, 16 bp, Homo sapiens
cttaatagtatttatg

SEQ ID NO: 3754718 - DNA, 14 bp, Homo sapiens
cttaatatgttaac

SEQ ID NO: 3754719 - DNA, 21 bp, Homo sapiens
cttaatctgtttatttacaag

SEQ ID NO: 3754720 - DNA, 12 bp, Homo sapiens
cttaatgagata

SEQ ID NO: 3754721 - DNA, 18 bp, Homo sapiens
cttaattttcagtataat

SEQ ID NO: 3754722 - DNA, 20 bp, Homo sapiens
cttacaaagtgtattttata

SEQ ID NO: 3754723 - DNA, 20 bp, Homo sapiens
cttacacctcgttagggaag

SEQ ID NO: 3754724 - DNA, 23 bp, Homo sapiens
cttacacctcgttagggaagaga

SEQ ID NO: 3754725 - DNA, 15 bp, Homo sapiens
cttacatgagaacag

SEQ ID NO: 3754726 - DNA, 14 bp, Homo sapiens
cttacatgcatttg

SEQ ID NO: 3754727 - DNA, 21 bp, Homo sapiens
cttacattagcagtttgcttt

SEQ ID NO: 3754728 - DNA, 22 bp, Homo sapiens
cttacattagcagtttgctttg

SEQ ID NO: 3754729 - DNA, 17 bp, Homo sapiens
cttacccttctgtgccc

SEQ ID NO: 3754730 - DNA, 16 bp, Homo sapiens
cttacctcctgcccag

SEQ ID NO: 3754731 - DNA, 19 bp, Homo sapiens
cttacctcctgcccaggag

SEQ ID NO: 3754732 - DNA, 19 bp, Homo sapiens
cttacctgggcattcttgt

SEQ ID NO: 3754733 - DNA, 20 bp, Homo sapiens
cttacctgtatgtctccagt

SEQ ID NO: 3754734 - DNA, 20 bp, Homo sapiens
cttactacatgtgggagctt

SEQ ID NO: 3754735 - DNA, 12 bp, Homo sapiens
cttactgaaggt

SEQ ID NO: 3754736 - DNA, 18 bp, Homo sapiens
cttacttagcatgcacaa

SEQ ID NO: 3754737 - DNA, 14 bp, Homo sapiens
cttactttgtatga

SEQ ID NO: 3754738 - DNA, 18 bp, Homo sapiens
cttactttgtatgatatt

SEQ ID NO: 3754739 - DNA, 15 bp, Homo sapiens
cttagaagtcacaca

SEQ ID NO: 3754740 - DNA, 17 bp, Homo sapiens
cttagaagtggaccagg

SEQ ID NO: 3754741 - DNA, 18 bp, Homo sapiens
cttagaagtggaccagga

SEQ ID NO: 3754742 - DNA, 22 bp, Homo sapiens
cttagaagtggaccaggacagg

SEQ ID NO: 3754743 - DNA, 12 bp, Homo sapiens
cttagacctcag

SEQ ID NO: 3754744 - DNA, 16 bp, Homo sapiens
cttagacctcagcctg

SEQ ID NO: 3754745 - DNA, 17 bp, Homo sapiens
cttagacctcagcctgt

SEQ ID NO: 3754746 - DNA, 20 bp, Homo sapiens
cttagatatctttttattga

SEQ ID NO: 3754747 - DNA, 22 bp, Homo sapiens
cttagcagctatctctcagtga

SEQ ID NO: 3754748 - DNA, 14 bp, Homo sapiens
cttagctgccaagt

SEQ ID NO: 3754749 - DNA, 22 bp, Homo sapiens
cttaggaagagaaaccagggag

SEQ ID NO: 3754750 - DNA, 17 bp, Homo sapiens
cttagtgaaattacttc

SEQ ID NO: 3754751 - DNA, 23 bp, Homo sapiens
cttagttcaagtcctgcctctta

SEQ ID NO: 3754752 - DNA, 15 bp, Homo sapiens
cttatacatttgata

SEQ ID NO: 3754753 - DNA, 14 bp, Homo sapiens
cttatagaatattt

SEQ ID NO: 3754754 - DNA, 20 bp, Homo sapiens
cttatagaatatttattacc

SEQ ID NO: 3754755 - DNA, 20 bp, Homo sapiens
cttatatagtttactatttt

SEQ ID NO: 3754756 - DNA, 16 bp, Homo sapiens
cttatcaatttgtcat

SEQ ID NO: 3754757 - DNA, 21 bp, Homo sapiens
cttatcaatttgtcattttga

SEQ ID NO: 3754758 - DNA, 18 bp, Homo sapiens
cttatcactgacacaaaa

SEQ ID NO: 3754759 - DNA, 23 bp, Homo sapiens
cttatctaatcatgaaactccct

SEQ ID NO: 3754760 - DNA, 21 bp, Homo sapiens
cttatctgtgcgtgaaacaca

SEQ ID NO: 3754761 - DNA, 19 bp, Homo sapiens
cttattcattgtggttatt

SEQ ID NO: 3754762 - DNA, 19 bp, Homo sapiens
cttattgttccaagacatt

SEQ ID NO: 3754763 - DNA, 21 bp, Homo sapiens
cttattgttccaagacattgt

SEQ ID NO: 3754764 - DNA, 13 bp, Homo sapiens
cttatttattatt

SEQ ID NO: 3754765 - DNA, 18 bp, Homo sapiens
cttattttcaagaaactg

SEQ ID NO: 3754766 - DNA, 16 bp, Homo sapiens
cttatttttagatggt

SEQ ID NO: 3754767 - DNA, 22 bp, Homo sapiens
cttatttttagatggttacact

SEQ ID NO: 3754768 - DNA, 23 bp, Homo sapiens
cttatttttagatggttacactg

SEQ ID NO: 3754769 - DNA, 17 bp, Homo sapiens
cttatttttgacagtgt

SEQ ID NO: 3754770 - DNA, 16 bp, Homo sapiens
cttcaaagcttgaaga

SEQ ID NO: 3754771 - DNA, 20 bp, Homo sapiens
cttcaactgaccagcctcca

SEQ ID NO: 3754772 - DNA, 16 bp, Homo sapiens
cttcaagggctgcttc

SEQ ID NO: 3754773 - DNA, 14 bp, Homo sapiens
cttcaagtctgtgc

SEQ ID NO: 3754774 - DNA, 15 bp, Homo sapiens
cttcaagtctgtgcc

SEQ ID NO: 3754775 - DNA, 17 bp, Homo sapiens
cttcaagtctgtgcctg

SEQ ID NO: 3754776 - DNA, 18 bp, Homo sapiens
cttcaagtctgtgcctgg

SEQ ID NO: 3754777 - DNA, 17 bp, Homo sapiens
cttcaagttagctcagg

SEQ ID NO: 3754778 - DNA, 18 bp, Homo sapiens
cttcaagttagctcagga

SEQ ID NO: 3754779 - DNA, 20 bp, Homo sapiens
cttcaagttagctcaggagg

SEQ ID NO: 3754780 - DNA, 14 bp, Homo sapiens
cttcaataaagtat

SEQ ID NO: 3754781 - DNA, 10 bp, Homo sapiens
cttcaatttg

SEQ ID NO: 3754782 - DNA, 19 bp, Homo sapiens
cttcaatttgtataaaatg

SEQ ID NO: 3754783 - DNA, 16 bp, Homo sapiens
cttcacacacaggcaa

SEQ ID NO: 3754784 - DNA, 22 bp, Homo sapiens
cttcacacacaggcaactgagg

SEQ ID NO: 3754785 - DNA, 21 bp, Homo sapiens
cttcacactgcaagagccttg

SEQ ID NO: 3754786 - DNA, 14 bp, Homo sapiens
cttcacagtgtttc

SEQ ID NO: 3754787 - DNA, 21 bp, Homo sapiens
cttcaccctgtcaagttaaca

SEQ ID NO: 3754788 - DNA, 19 bp, Homo sapiens
cttcacggaagagccttgc

SEQ ID NO: 3754789 - DNA, 17 bp, Homo sapiens
cttcacttctgaccaca

SEQ ID NO: 3754790 - DNA, 21 bp, Homo sapiens
cttcacttctgaccacacttc

SEQ ID NO: 3754791 - DNA, 11 bp, Homo sapiens
cttcagagagc

SEQ ID NO: 3754792 - DNA, 16 bp, Homo sapiens
cttcagaggctgaggt

SEQ ID NO: 3754793 - DNA, 15 bp, Homo sapiens
cttcagatcagtgct

SEQ ID NO: 3754794 - DNA, 16 bp, Homo sapiens
cttcagatcctacccc

SEQ ID NO: 3754795 - DNA, 15 bp, Homo sapiens
cttcagcatcctcag

SEQ ID NO: 3754796 - DNA, 17 bp, Homo sapiens
cttcagccacctctctt

SEQ ID NO: 3754797 - DNA, 13 bp, Homo sapiens
cttcagcctagcc

SEQ ID NO: 3754798 - DNA, 23 bp, Homo sapiens
cttcagcctagccgacctcagcc

SEQ ID NO: 3754799 - DNA, 11 bp, Homo sapiens
cttcagctgac

SEQ ID NO: 3754800 - DNA, 19 bp, Homo sapiens
cttcaggacactcactaca

SEQ ID NO: 3754801 - DNA, 15 bp, Homo sapiens
cttcaggctcttctc

SEQ ID NO: 3754802 - DNA, 18 bp, Homo sapiens
cttcaggctcttctcctt

SEQ ID NO: 3754803 - DNA, 16 bp, Homo sapiens
cttcaggtggaaaaac

SEQ ID NO: 3754804 - DNA, 15 bp, Homo sapiens
cttcaggttcttagt

SEQ ID NO: 3754805 - DNA, 23 bp, Homo sapiens
cttcagtaagccgtgattttcat

SEQ ID NO: 3754806 - DNA, 14 bp, Homo sapiens
cttcagtggcagct

SEQ ID NO: 3754807 - DNA, 16 bp, Homo sapiens
cttcagtggcagctgc

SEQ ID NO: 3754808 - DNA, 13 bp, Homo sapiens
cttcagtgggaga

SEQ ID NO: 3754809 - DNA, 15 bp, Homo sapiens
cttcagtgggagaaa

SEQ ID NO: 3754810 - DNA, 19 bp, Homo sapiens
cttcagttggtgtgttttt

SEQ ID NO: 3754811 - DNA, 22 bp, Homo sapiens
cttcagttggtgtgtttttggg

SEQ ID NO: 3754812 - DNA, 11 bp, Homo sapiens
cttcatcctct

SEQ ID NO: 3754813 - DNA, 19 bp, Homo sapiens
cttcatccttagcaacagc

SEQ ID NO: 3754814 - DNA, 20 bp, Homo sapiens
cttcatccttagcaacagcc

SEQ ID NO: 3754815 - DNA, 19 bp, Homo sapiens
cttcattgccttaactgga

SEQ ID NO: 3754816 - DNA, 19 bp, Homo sapiens
cttcatttctgatatagaa

SEQ ID NO: 3754817 - DNA, 14 bp, Homo sapiens
cttcatttggagat

SEQ ID NO: 3754818 - DNA, 13 bp, Homo sapiens
cttcatttttcct

SEQ ID NO: 3754819 - DNA, 17 bp, Homo sapiens
cttcatttttcctaaca

SEQ ID NO: 3754820 - DNA, 15 bp, Homo sapiens
cttccaactgctgcc

SEQ ID NO: 3754821 - DNA, 18 bp, Homo sapiens
cttccaactgctgcccca

SEQ ID NO: 3754822 - DNA, 17 bp, Homo sapiens
cttccaagacctgactc

SEQ ID NO: 3754823 - DNA, 18 bp, Homo sapiens
cttccaagacctgactca

SEQ ID NO: 3754824 - DNA, 12 bp, Homo sapiens
cttccaaggaga

SEQ ID NO: 3754825 - DNA, 14 bp, Homo sapiens
cttccaaggagacc

SEQ ID NO: 3754826 - DNA, 21 bp, Homo sapiens
cttccaaggagaccaagtcct

SEQ ID NO: 3754827 - DNA, 17 bp, Homo sapiens
cttccacgctgtctcca

SEQ ID NO: 3754828 - DNA, 18 bp, Homo sapiens
cttccacgctgtctccag

SEQ ID NO: 3754829 - DNA, 19 bp, Homo sapiens
cttccacggactcaagttt

SEQ ID NO: 3754830 - DNA, 20 bp, Homo sapiens
cttccaggccatcagaggcc

SEQ ID NO: 3754831 - DNA, 21 bp, Homo sapiens
cttccaggggaggttcagtga

SEQ ID NO: 3754832 - DNA, 11 bp, Homo sapiens
cttccataatc

SEQ ID NO: 3754833 - DNA, 14 bp, Homo sapiens
cttccatagcctaa

SEQ ID NO: 3754834 - DNA, 17 bp, Homo sapiens
cttccatccctaccccc

SEQ ID NO: 3754835 - DNA, 19 bp, Homo sapiens
cttccatccctacccccta

SEQ ID NO: 3754836 - DNA, 15 bp, Homo sapiens
cttccatgtcgcctc

SEQ ID NO: 3754837 - DNA, 17 bp, Homo sapiens
cttccatgtcgcctctg

SEQ ID NO: 3754838 - DNA, 19 bp, Homo sapiens
cttccatgtcgcctctgca

SEQ ID NO: 3754839 - DNA, 12 bp, Homo sapiens
cttccatttata

SEQ ID NO: 3754840 - DNA, 21 bp, Homo sapiens
cttcccagctctccctctggc

SEQ ID NO: 3754841 - DNA, 21 bp, Homo sapiens
cttcccagctgcccctccctg

SEQ ID NO: 3754842 - DNA, 11 bp, Homo sapiens
cttcccatcac

SEQ ID NO: 3754843 - DNA, 18 bp, Homo sapiens
cttcccatcactggagca

SEQ ID NO: 3754844 - DNA, 19 bp, Homo sapiens
cttccccactgcctgccca

SEQ ID NO: 3754845 - DNA, 15 bp, Homo sapiens
cttcccccatagcca

SEQ ID NO: 3754846 - DNA, 16 bp, Homo sapiens
cttcccccatagccac

SEQ ID NO: 3754847 - DNA, 18 bp, Homo sapiens
cttccccgcattccaggc

SEQ ID NO: 3754848 - DNA, 18 bp, Homo sapiens
cttcccctccctggctcc

SEQ ID NO: 3754849 - DNA, 21 bp, Homo sapiens
cttcccctctaatgctcacgc

SEQ ID NO: 3754850 - DNA, 23 bp, Homo sapiens
cttccccttgcccagggctcagc

SEQ ID NO: 3754851 - DNA, 16 bp, Homo sapiens
cttcccgctcagccct

SEQ ID NO: 3754852 - DNA, 17 bp, Homo sapiens
cttcccgctcagccctc

SEQ ID NO: 3754853 - DNA, 17 bp, Homo sapiens
cttccctacagttgaaa

SEQ ID NO: 3754854 - DNA, 13 bp, Homo sapiens
cttccctacctca

SEQ ID NO: 3754855 - DNA, 16 bp, Homo sapiens
cttccctacctcaggc

SEQ ID NO: 3754856 - DNA, 17 bp, Homo sapiens
cttccctacctcaggca

SEQ ID NO: 3754857 - DNA, 20 bp, Homo sapiens
cttccctacctcaggcagga

SEQ ID NO: 3754858 - DNA, 20 bp, Homo sapiens
cttccctagagggttcctgt

SEQ ID NO: 3754859 - DNA, 11 bp, Homo sapiens
cttccctctgc

SEQ ID NO: 3754860 - DNA, 17 bp, Homo sapiens
cttccctctgcctgtcc

SEQ ID NO: 3754861 - DNA, 14 bp, Homo sapiens
cttcccttttacat

SEQ ID NO: 3754862 - DNA, 22 bp, Homo sapiens
cttcctacaagagcagcctgtg

SEQ ID NO: 3754863 - DNA, 24 bp, Homo sapiens
cttcctacaagagcagcctgtggc

SEQ ID NO: 3754864 - DNA, 15 bp, Homo sapiens
cttcctagttttctc

SEQ ID NO: 3754865 - DNA, 12 bp, Homo sapiens
cttcctatccca

SEQ ID NO: 3754866 - DNA, 16 bp, Homo sapiens
cttcctatcccatccc

SEQ ID NO: 3754867 - DNA, 13 bp, Homo sapiens
cttcctccctcat

SEQ ID NO: 3754868 - DNA, 13 bp, Homo sapiens
cttcctccctccc

SEQ ID NO: 3754869 - DNA, 21 bp, Homo sapiens
cttcctctcatccttttctcc

SEQ ID NO: 3754870 - DNA, 19 bp, Homo sapiens
cttcctctccactgccttc

SEQ ID NO: 3754871 - DNA, 22 bp, Homo sapiens
cttcctctttccatctaccctc

SEQ ID NO: 3754872 - DNA, 17 bp, Homo sapiens
cttcctgcattcaccca

SEQ ID NO: 3754873 - DNA, 20 bp, Homo sapiens
cttcctgcattcacccagac

SEQ ID NO: 3754874 - DNA, 22 bp, Homo sapiens
cttcctgcattcacccagacag

SEQ ID NO: 3754875 - DNA, 16 bp, Homo sapiens
cttcctgtccagagag

SEQ ID NO: 3754876 - DNA, 17 bp, Homo sapiens
cttcctgtccagagaga

SEQ ID NO: 3754877 - DNA, 19 bp, Homo sapiens
cttcctgtccagagagaga

SEQ ID NO: 3754878 - DNA, 15 bp, Homo sapiens
cttcctgtccgccct

SEQ ID NO: 3754879 - DNA, 13 bp, Homo sapiens
cttcctgtgactt

SEQ ID NO: 3754880 - DNA, 16 bp, Homo sapiens
cttcctgtgacttcag

SEQ ID NO: 3754881 - DNA, 16 bp, Homo sapiens
cttccttaccgtgggc

SEQ ID NO: 3754882 - DNA, 15 bp, Homo sapiens
cttccttccctggct

SEQ ID NO: 3754883 - DNA, 15 bp, Homo sapiens
cttccttgaccagca

SEQ ID NO: 3754884 - DNA, 16 bp, Homo sapiens
cttccttgaccagcag

SEQ ID NO: 3754885 - DNA, 13 bp, Homo sapiens
cttcgactgtgac

SEQ ID NO: 3754886 - DNA, 16 bp, Homo sapiens
cttcgatacaccgggc

SEQ ID NO: 3754887 - DNA, 21 bp, Homo sapiens
cttcgatacaccgggcctgga

SEQ ID NO: 3754888 - DNA, 14 bp, Homo sapiens
cttcgctcctgtgt

SEQ ID NO: 3754889 - DNA, 19 bp, Homo sapiens
cttcgggaggtcgaggcag

SEQ ID NO: 3754890 - DNA, 21 bp, Homo sapiens
cttcgggaggtcgaggcagga

SEQ ID NO: 3754891 - DNA, 19 bp, Homo sapiens
cttcggggaactcctggaa

SEQ ID NO: 3754892 - DNA, 20 bp, Homo sapiens
cttcgttaactgtgtatgta

SEQ ID NO: 3754893 - DNA, 19 bp, Homo sapiens
cttctaaaaaaaaacaaaa

SEQ ID NO: 3754894 - DNA, 15 bp, Homo sapiens
cttctaattgccatg

SEQ ID NO: 3754895 - DNA, 18 bp, Homo sapiens
cttctaccaactggaagc

SEQ ID NO: 3754896 - DNA, 18 bp, Homo sapiens
cttctactgagccttcag

SEQ ID NO: 3754897 - DNA, 13 bp, Homo sapiens
cttctacttttaa

SEQ ID NO: 3754898 - DNA, 21 bp, Homo sapiens
cttctacttttaagttgctga

SEQ ID NO: 3754899 - DNA, 13 bp, Homo sapiens
cttctagaaccag

SEQ ID NO: 3754900 - DNA, 13 bp, Homo sapiens
cttctaggaagct

SEQ ID NO: 3754901 - DNA, 16 bp, Homo sapiens
cttctaggttctaaaa

SEQ ID NO: 3754902 - DNA, 17 bp, Homo sapiens
cttctattttgtaaact

SEQ ID NO: 3754903 - DNA, 21 bp, Homo sapiens
cttctcaaagggtacttccac

SEQ ID NO: 3754904 - DNA, 20 bp, Homo sapiens
cttctcactcccttctcctt

SEQ ID NO: 3754905 - DNA, 16 bp, Homo sapiens
cttctcactgccatgc

SEQ ID NO: 3754906 - DNA, 17 bp, Homo sapiens
cttctcatcctgcaggc

SEQ ID NO: 3754907 - DNA, 15 bp, Homo sapiens
cttctccaccctgct

SEQ ID NO: 3754908 - DNA, 18 bp, Homo sapiens
cttctccaccctgctctc

SEQ ID NO: 3754909 - DNA, 12 bp, Homo sapiens
cttctccaggct

SEQ ID NO: 3754910 - DNA, 13 bp, Homo sapiens
cttctccaggctg

SEQ ID NO: 3754911 - DNA, 17 bp, Homo sapiens
cttctccaggctgtatc

SEQ ID NO: 3754912 - DNA, 18 bp, Homo sapiens
cttctccttccaactgct

SEQ ID NO: 3754913 - DNA, 16 bp, Homo sapiens
cttctccttgataaca

SEQ ID NO: 3754914 - DNA, 13 bp, Homo sapiens
cttctctacagac

SEQ ID NO: 3754915 - DNA, 16 bp, Homo sapiens
cttctctcacctccta

SEQ ID NO: 3754916 - DNA, 14 bp, Homo sapiens
cttctctccagtgc

SEQ ID NO: 3754917 - DNA, 18 bp, Homo sapiens
cttctctctctaaaatga

SEQ ID NO: 3754918 - DNA, 13 bp, Homo sapiens
cttctctgaagga

SEQ ID NO: 3754919 - DNA, 15 bp, Homo sapiens
cttctctgcccattc

SEQ ID NO: 3754920 - DNA, 21 bp, Homo sapiens
cttctctgcccattccccagc

SEQ ID NO: 3754921 - DNA, 23 bp, Homo sapiens
cttctctgcccattccccagcct

SEQ ID NO: 3754922 - DNA, 15 bp, Homo sapiens
cttctctgctccacc

SEQ ID NO: 3754923 - DNA, 21 bp, Homo sapiens
cttctctgctccaccacatcc

SEQ ID NO: 3754924 - DNA, 14 bp, Homo sapiens
cttctcttaattta

SEQ ID NO: 3754925 - DNA, 19 bp, Homo sapiens
cttctgaccacacttcctg

SEQ ID NO: 3754926 - DNA, 23 bp, Homo sapiens
cttctgaccacacttcctgtcca

SEQ ID NO: 3754927 - DNA, 14 bp, Homo sapiens
cttctgacctcagc

SEQ ID NO: 3754928 - DNA, 18 bp, Homo sapiens
cttctgatgaatcttgcg

SEQ ID NO: 3754929 - DNA, 17 bp, Homo sapiens
cttctgcaccttatctt

SEQ ID NO: 3754930 - DNA, 18 bp, Homo sapiens
cttctgcaccttatctta

SEQ ID NO: 3754931 - DNA, 20 bp, Homo sapiens
cttctgccatttctgagatc

SEQ ID NO: 3754932 - DNA, 19 bp, Homo sapiens
cttctgctccacccttggc

SEQ ID NO: 3754933 - DNA, 17 bp, Homo sapiens
cttctgctggataaaat

SEQ ID NO: 3754934 - DNA, 17 bp, Homo sapiens
cttctgcttcagcctcc

SEQ ID NO: 3754935 - DNA, 11 bp, Homo sapiens
cttctggagcc

SEQ ID NO: 3754936 - DNA, 14 bp, Homo sapiens
cttctggagccctt

SEQ ID NO: 3754937 - DNA, 21 bp, Homo sapiens
cttctgggaagacaactagga

SEQ ID NO: 3754938 - DNA, 18 bp, Homo sapiens
cttctgtacgtctgacag

SEQ ID NO: 3754939 - DNA, 21 bp, Homo sapiens
cttctgtacgtctgacaggca

SEQ ID NO: 3754940 - DNA, 18 bp, Homo sapiens
cttctgtatactgtggag

SEQ ID NO: 3754941 - DNA, 16 bp, Homo sapiens
cttctgtcctactctg

SEQ ID NO: 3754942 - DNA, 21 bp, Homo sapiens
cttctgtcctactctgtgtca

SEQ ID NO: 3754943 - DNA, 16 bp, Homo sapiens
cttctgtgcccagctc

SEQ ID NO: 3754944 - DNA, 13 bp, Homo sapiens
cttctgtttctag

SEQ ID NO: 3754945 - DNA, 16 bp, Homo sapiens
cttctgtttctagttg

SEQ ID NO: 3754946 - DNA, 13 bp, Homo sapiens
cttcttaaagagt

SEQ ID NO: 3754947 - DNA, 21 bp, Homo sapiens
cttcttaaatgagaaggaatt

SEQ ID NO: 3754948 - DNA, 16 bp, Homo sapiens
cttcttatacatttga

SEQ ID NO: 3754949 - DNA, 14 bp, Homo sapiens
cttcttattctcac

SEQ ID NO: 3754950 - DNA, 17 bp, Homo sapiens
cttcttattctcactcc

SEQ ID NO: 3754951 - DNA, 21 bp, Homo sapiens
cttcttcagccacctctcttt

SEQ ID NO: 3754952 - DNA, 19 bp, Homo sapiens
cttcttctcctaggattcc

SEQ ID NO: 3754953 - DNA, 13 bp, Homo sapiens
cttcttcttcaga

SEQ ID NO: 3754954 - DNA, 13 bp, Homo sapiens
cttcttgcttctc

SEQ ID NO: 3754955 - DNA, 20 bp, Homo sapiens
cttcttggtcttatttatta

SEQ ID NO: 3754956 - DNA, 15 bp, Homo sapiens
cttcttgtgatcttg

SEQ ID NO: 3754957 - DNA, 23 bp, Homo sapiens
cttcttgtgatcttgctctatct

SEQ ID NO: 3754958 - DNA, 12 bp, Homo sapiens
cttctttccatt

SEQ ID NO: 3754959 - DNA, 13 bp, Homo sapiens
cttcttttgctct

SEQ ID NO: 3754960 - DNA, 15 bp, Homo sapiens
cttctttttattttc

SEQ ID NO: 3754961 - DNA, 20 bp, Homo sapiens
cttctttttattttcttttg

SEQ ID NO: 3754962 - DNA, 17 bp, Homo sapiens
cttctttttttgtgatg

SEQ ID NO: 3754963 - DNA, 13 bp, Homo sapiens
cttgaaagaaaat

SEQ ID NO: 3754964 - DNA, 23 bp, Homo sapiens
cttgaaagaaaggggcaggagct

SEQ ID NO: 3754965 - DNA, 13 bp, Homo sapiens
cttgaaagctgtg

SEQ ID NO: 3754966 - DNA, 20 bp, Homo sapiens
cttgaaagtcatgaacacat

SEQ ID NO: 3754967 - DNA, 16 bp, Homo sapiens
cttgaactgggtactt

SEQ ID NO: 3754968 - DNA, 20 bp, Homo sapiens
cttgaactgggtacttgtgg

SEQ ID NO: 3754969 - DNA, 17 bp, Homo sapiens
cttgaagccactgaagc

SEQ ID NO: 3754970 - DNA, 18 bp, Homo sapiens
cttgaagccactgaagct

SEQ ID NO: 3754971 - DNA, 19 bp, Homo sapiens
cttgaagccactgaagctg

SEQ ID NO: 3754972 - DNA, 17 bp, Homo sapiens
cttgaagtcacccggcc

SEQ ID NO: 3754973 - DNA, 22 bp, Homo sapiens
cttgacaagttgcgacggagag

SEQ ID NO: 3754974 - DNA, 15 bp, Homo sapiens
cttgacagggcacac

SEQ ID NO: 3754975 - DNA, 23 bp, Homo sapiens
cttgaccaagcaggaagctcaga

SEQ ID NO: 3754976 - DNA, 21 bp, Homo sapiens
cttgaccagcagatcccagct

SEQ ID NO: 3754977 - DNA, 13 bp, Homo sapiens
cttgacctcaggt

SEQ ID NO: 3754978 - DNA, 16 bp, Homo sapiens
cttgactattggagga

SEQ ID NO: 3754979 - DNA, 17 bp, Homo sapiens
cttgacttgattagtgc

SEQ ID NO: 3754980 - DNA, 14 bp, Homo sapiens
cttgagacctcagc

SEQ ID NO: 3754981 - DNA, 15 bp, Homo sapiens
cttgagacctcagcc

SEQ ID NO: 3754982 - DNA, 20 bp, Homo sapiens
cttgagagtagatggtttga

SEQ ID NO: 3754983 - DNA, 15 bp, Homo sapiens
cttgagatgtcttct

SEQ ID NO: 3754984 - DNA, 22 bp, Homo sapiens
cttgagcatgttactgacagag

SEQ ID NO: 3754985 - DNA, 16 bp, Homo sapiens
cttgagccagtaattg

SEQ ID NO: 3754986 - DNA, 12 bp, Homo sapiens
cttgagcccagg

SEQ ID NO: 3754987 - DNA, 14 bp, Homo sapiens
cttgagcccaggag

SEQ ID NO: 3754988 - DNA, 13 bp, Homo sapiens
cttgagctgagat

SEQ ID NO: 3754989 - DNA, 14 bp, Homo sapiens
cttgaggagtgtga

SEQ ID NO: 3754990 - DNA, 22 bp, Homo sapiens
cttgaggagtgtgagaatcaaa

SEQ ID NO: 3754991 - DNA, 16 bp, Homo sapiens
cttgagggagcttagc

SEQ ID NO: 3754992 - DNA, 17 bp, Homo sapiens
cttgaggtcttttgaca

SEQ ID NO: 3754993 - DNA, 18 bp, Homo sapiens
cttgaggtcttttgacat

SEQ ID NO: 3754994 - DNA, 23 bp, Homo sapiens
cttgaggtcttttgacatgtgga

SEQ ID NO: 3754995 - DNA, 18 bp, Homo sapiens
cttgagttgattcagctc

SEQ ID NO: 3754996 - DNA, 19 bp, Homo sapiens
cttgagttgattcagctct

SEQ ID NO: 3754997 - DNA, 14 bp, Homo sapiens
cttgataacagcta

SEQ ID NO: 3754998 - DNA, 22 bp, Homo sapiens
cttgatctgtatatacaataac

SEQ ID NO: 3754999 - DNA, 13 bp, Homo sapiens
cttgatgagtgta

SEQ ID NO: 3755000 - DNA, 19 bp, Homo sapiens
cttgatgagtgtaacaaga

SEQ ID NO: 3755001 - DNA, 21 bp, Homo sapiens
cttgatgagtgtaacaagaaa

SEQ ID NO: 3755002 - DNA, 23 bp, Homo sapiens
cttgatgagtgtaacaagaaagg

SEQ ID NO: 3755003 - DNA, 21 bp, Homo sapiens
cttgatggctccgaacaccct

SEQ ID NO: 3755004 - DNA, 22 bp, Homo sapiens
cttgatggtcagacacaaacaa

SEQ ID NO: 3755005 - DNA, 15 bp, Homo sapiens
cttgatgtgttatct

SEQ ID NO: 3755006 - DNA, 21 bp, Homo sapiens
cttgatttgttttagaatgat

SEQ ID NO: 3755007 - DNA, 14 bp, Homo sapiens
cttgcaagaatcag

SEQ ID NO: 3755008 - DNA, 18 bp, Homo sapiens
cttgcaagaatcagtgca

SEQ ID NO: 3755009 - DNA, 16 bp, Homo sapiens
cttgcaatggcagcct

SEQ ID NO: 3755010 - DNA, 18 bp, Homo sapiens
cttgcaatggcagccttg

SEQ ID NO: 3755011 - DNA, 13 bp, Homo sapiens
cttgcacctgcat

SEQ ID NO: 3755012 - DNA, 14 bp, Homo sapiens
cttgcacctgcatc

SEQ ID NO: 3755013 - DNA, 18 bp, Homo sapiens
cttgcagactctacagag

SEQ ID NO: 3755014 - DNA, 20 bp, Homo sapiens
cttgcagagaagccttggta

SEQ ID NO: 3755015 - DNA, 13 bp, Homo sapiens
cttgcagagcttg

SEQ ID NO: 3755016 - DNA, 22 bp, Homo sapiens
cttgcataataagctaaagagg

SEQ ID NO: 3755017 - DNA, 20 bp, Homo sapiens
cttgccacagctcttgagga

SEQ ID NO: 3755018 - DNA, 14 bp, Homo sapiens
cttgccactgcctc

SEQ ID NO: 3755019 - DNA, 15 bp, Homo sapiens
cttgccactgcctct

SEQ ID NO: 3755020 - DNA, 19 bp, Homo sapiens
cttgcccagagatgcctcc

SEQ ID NO: 3755021 - DNA, 23 bp, Homo sapiens
cttgcccagagatgcctccaccg

SEQ ID NO: 3755022 - DNA, 15 bp, Homo sapiens
cttgcccagggctca

SEQ ID NO: 3755023 - DNA, 20 bp, Homo sapiens
cttgcccagggctcagcctg

SEQ ID NO: 3755024 - DNA, 23 bp, Homo sapiens
cttgcccagggctcagcctggtg

SEQ ID NO: 3755025 - DNA, 14 bp, Homo sapiens
cttgccccccaccc

SEQ ID NO: 3755026 - DNA, 17 bp, Homo sapiens
cttgcccggattctggg

SEQ ID NO: 3755027 - DNA, 20 bp, Homo sapiens
cttgcccggattctgggagg

SEQ ID NO: 3755028 - DNA, 17 bp, Homo sapiens
cttgcctccatggtgcc

SEQ ID NO: 3755029 - DNA, 21 bp, Homo sapiens
cttgcctccatggtgcctctg

SEQ ID NO: 3755030 - DNA, 22 bp, Homo sapiens
cttgcctccatggtgcctctgg

SEQ ID NO: 3755031 - DNA, 12 bp, Homo sapiens
cttgcctgcagg

SEQ ID NO: 3755032 - DNA, 19 bp, Homo sapiens
cttgcgcttttgctggtca

SEQ ID NO: 3755033 - DNA, 14 bp, Homo sapiens
cttgctctatctca

SEQ ID NO: 3755034 - DNA, 18 bp, Homo sapiens
cttgctctatctcacagc

SEQ ID NO: 3755035 - DNA, 14 bp, Homo sapiens
cttgctctgctgac

SEQ ID NO: 3755036 - DNA, 16 bp, Homo sapiens
cttgctctgctgacag

SEQ ID NO: 3755037 - DNA, 12 bp, Homo sapiens
cttgctgcaccc

SEQ ID NO: 3755038 - DNA, 14 bp, Homo sapiens
cttgctgctatttt

SEQ ID NO: 3755039 - DNA, 18 bp, Homo sapiens
cttgctgtggtctctttg

SEQ ID NO: 3755040 - DNA, 13 bp, Homo sapiens
cttgcttgctttt

SEQ ID NO: 3755041 - DNA, 21 bp, Homo sapiens
cttggaaactggatgaggtca

SEQ ID NO: 3755042 - DNA, 21 bp, Homo sapiens
cttggaaagaaacaaccgttg

SEQ ID NO: 3755043 - DNA, 20 bp, Homo sapiens
cttggaaagcatcacctcag

SEQ ID NO: 3755044 - DNA, 21 bp, Homo sapiens
cttggaaagcatcacctcagg

SEQ ID NO: 3755045 - DNA, 13 bp, Homo sapiens
cttggaagctccg

SEQ ID NO: 3755046 - DNA, 20 bp, Homo sapiens
cttggaagctccgctttcta

SEQ ID NO: 3755047 - DNA, 18 bp, Homo sapiens
cttggaatatctgctgta

SEQ ID NO: 3755048 - DNA, 18 bp, Homo sapiens
cttggacctcgtgcttta

SEQ ID NO: 3755049 - DNA, 14 bp, Homo sapiens
cttggactattata

SEQ ID NO: 3755050 - DNA, 22 bp, Homo sapiens
cttggactattataatttaatg

SEQ ID NO: 3755051 - DNA, 18 bp, Homo sapiens
cttggagccccagtgcca

SEQ ID NO: 3755052 - DNA, 21 bp, Homo sapiens
cttggagccccagtgccaagc

SEQ ID NO: 3755053 - DNA, 19 bp, Homo sapiens
cttggagggcccacttgta

SEQ ID NO: 3755054 - DNA, 14 bp, Homo sapiens
cttggcagcctact

SEQ ID NO: 3755055 - DNA, 15 bp, Homo sapiens
cttggcagctgaact

SEQ ID NO: 3755056 - DNA, 19 bp, Homo sapiens
cttggcatcacagggcaga

SEQ ID NO: 3755057 - DNA, 22 bp, Homo sapiens
cttggcatcacagggcagagcc

SEQ ID NO: 3755058 - DNA, 16 bp, Homo sapiens
cttggcatgccttcca

SEQ ID NO: 3755059 - DNA, 22 bp, Homo sapiens
cttggccagaagggggccatga

SEQ ID NO: 3755060 - DNA, 18 bp, Homo sapiens
cttggccagttatccctt

SEQ ID NO: 3755061 - DNA, 23 bp, Homo sapiens
cttggcctgtctcatccccaggg

SEQ ID NO: 3755062 - DNA, 14 bp, Homo sapiens
cttggcgtggagcc

SEQ ID NO: 3755063 - DNA, 16 bp, Homo sapiens
cttggctgcagggagt

SEQ ID NO: 3755064 - DNA, 10 bp, Homo sapiens
cttgggaatg

SEQ ID NO: 3755065 - DNA, 14 bp, Homo sapiens
cttgggaggcccca

SEQ ID NO: 3755066 - DNA, 14 bp, Homo sapiens
cttgggccactgtg

SEQ ID NO: 3755067 - DNA, 18 bp, Homo sapiens
cttgggccactgtgaaga

SEQ ID NO: 3755068 - DNA, 19 bp, Homo sapiens
cttgggcttccatttgtgt

SEQ ID NO: 3755069 - DNA, 18 bp, Homo sapiens
cttggggaacaagggtgg

SEQ ID NO: 3755070 - DNA, 23 bp, Homo sapiens
cttggggggctgaggtgggagga

SEQ ID NO: 3755071 - DNA, 17 bp, Homo sapiens
cttgggtcccagggaag

SEQ ID NO: 3755072 - DNA, 15 bp, Homo sapiens
cttggtaagaagccg

SEQ ID NO: 3755073 - DNA, 18 bp, Homo sapiens
cttggtacttgctgctat

SEQ ID NO: 3755074 - DNA, 20 bp, Homo sapiens
cttggtacttgctgctattt

SEQ ID NO: 3755075 - DNA, 16 bp, Homo sapiens
cttggtgtccacctgg

SEQ ID NO: 3755076 - DNA, 17 bp, Homo sapiens
cttggtgtccacctggc

SEQ ID NO: 3755077 - DNA, 21 bp, Homo sapiens
cttgtaaatagctcaggtgtc

SEQ ID NO: 3755078 - DNA, 21 bp, Homo sapiens
cttgtaactccaccaacccat

SEQ ID NO: 3755079 - DNA, 20 bp, Homo sapiens
cttgtaagagctatacagtt

SEQ ID NO: 3755080 - DNA, 13 bp, Homo sapiens
cttgtaattctaa

SEQ ID NO: 3755081 - DNA, 23 bp, Homo sapiens
cttgtaattctaaatgaatgttt

SEQ ID NO: 3755082 - DNA, 18 bp, Homo sapiens
cttgtatcctctggttct

SEQ ID NO: 3755083 - DNA, 21 bp, Homo sapiens
cttgtatgaaagatggctgtg

SEQ ID NO: 3755084 - DNA, 14 bp, Homo sapiens
cttgtcacaataaa

SEQ ID NO: 3755085 - DNA, 15 bp, Homo sapiens
cttgtcacaataaat

SEQ ID NO: 3755086 - DNA, 14 bp, Homo sapiens
cttgtcagagctgg

SEQ ID NO: 3755087 - DNA, 21 bp, Homo sapiens
cttgtcagagctgggaggggt

SEQ ID NO: 3755088 - DNA, 16 bp, Homo sapiens
cttgtcccactcaagc

SEQ ID NO: 3755089 - DNA, 18 bp, Homo sapiens
cttgtcccactcaagcca

SEQ ID NO: 3755090 - DNA, 17 bp, Homo sapiens
cttgtgaatatgtacat

SEQ ID NO: 3755091 - DNA, 20 bp, Homo sapiens
cttgtgactagtgctgaagc

SEQ ID NO: 3755092 - DNA, 22 bp, Homo sapiens
cttgtgactagtgctgaagctt

SEQ ID NO: 3755093 - DNA, 20 bp, Homo sapiens
cttgtgctgatcgtgctaaa

SEQ ID NO: 3755094 - DNA, 21 bp, Homo sapiens
cttgtggacacagctcttctc

SEQ ID NO: 3755095 - DNA, 13 bp, Homo sapiens
cttgtgttggctg

SEQ ID NO: 3755096 - DNA, 15 bp, Homo sapiens
cttgtgttttaaaat

SEQ ID NO: 3755097 - DNA, 16 bp, Homo sapiens
cttgttaagatagtta

SEQ ID NO: 3755098 - DNA, 13 bp, Homo sapiens
cttgttaatattc

SEQ ID NO: 3755099 - DNA, 13 bp, Homo sapiens
cttgttatttata

SEQ ID NO: 3755100 - DNA, 13 bp, Homo sapiens
cttgttccagctc

SEQ ID NO: 3755101 - DNA, 21 bp, Homo sapiens
cttgttccccactgacagcct

SEQ ID NO: 3755102 - DNA, 13 bp, Homo sapiens
cttgttctactca

SEQ ID NO: 3755103 - DNA, 12 bp, Homo sapiens
cttgttctgttt

SEQ ID NO: 3755104 - DNA, 13 bp, Homo sapiens
cttgttctgtttt

SEQ ID NO: 3755105 - DNA, 14 bp, Homo sapiens
cttgttctgttttg

SEQ ID NO: 3755106 - DNA, 23 bp, Homo sapiens
cttgttgctgagtctgcagatga

SEQ ID NO: 3755107 - DNA, 12 bp, Homo sapiens
cttgtttctgaa

SEQ ID NO: 3755108 - DNA, 14 bp, Homo sapiens
cttgttttcttgcc

SEQ ID NO: 3755109 - DNA, 18 bp, Homo sapiens
cttgtttttccactactg

SEQ ID NO: 3755110 - DNA, 20 bp, Homo sapiens
cttgttttttttttccactt

SEQ ID NO: 3755111 - DNA, 16 bp, Homo sapiens
ctttaaaaaaaatcct

SEQ ID NO: 3755112 - DNA, 14 bp, Homo sapiens
ctttaaaatattgt

SEQ ID NO: 3755113 - DNA, 18 bp, Homo sapiens
ctttaaccagtctgaagt

SEQ ID NO: 3755114 - DNA, 21 bp, Homo sapiens
ctttaactcaggactccagcc

SEQ ID NO: 3755115 - DNA, 14 bp, Homo sapiens
ctttaagacatact

SEQ ID NO: 3755116 - DNA, 20 bp, Homo sapiens
ctttaagtgcctacattatc

SEQ ID NO: 3755117 - DNA, 15 bp, Homo sapiens
ctttaatatgtattt

SEQ ID NO: 3755118 - DNA, 14 bp, Homo sapiens
ctttaatcttcagt

SEQ ID NO: 3755119 - DNA, 17 bp, Homo sapiens
ctttaatcttcagtttt

SEQ ID NO: 3755120 - DNA, 18 bp, Homo sapiens
ctttaatgtcacaggcag

SEQ ID NO: 3755121 - DNA, 23 bp, Homo sapiens
ctttaattgttaagatatgatgt

SEQ ID NO: 3755122 - DNA, 14 bp, Homo sapiens
ctttaccctcatct

SEQ ID NO: 3755123 - DNA, 15 bp, Homo sapiens
ctttaccctcatctg

SEQ ID NO: 3755124 - DNA, 17 bp, Homo sapiens
ctttaccctcatctgtc

SEQ ID NO: 3755125 - DNA, 15 bp, Homo sapiens
ctttagaaataaatg

SEQ ID NO: 3755126 - DNA, 17 bp, Homo sapiens
ctttagaatgttttcct

SEQ ID NO: 3755127 - DNA, 23 bp, Homo sapiens
ctttagaatgttttccttctact

SEQ ID NO: 3755128 - DNA, 21 bp, Homo sapiens
ctttagcacgtttaaagttct

SEQ ID NO: 3755129 - DNA, 14 bp, Homo sapiens
ctttagcgcccagt

SEQ ID NO: 3755130 - DNA, 13 bp, Homo sapiens
ctttataattcta

SEQ ID NO: 3755131 - DNA, 15 bp, Homo sapiens
ctttatagatcagcc

SEQ ID NO: 3755132 - DNA, 19 bp, Homo sapiens
ctttatcacattatttgca

SEQ ID NO: 3755133 - DNA, 18 bp, Homo sapiens
ctttatgcagcttccttt

SEQ ID NO: 3755134 - DNA, 16 bp, Homo sapiens
ctttattttatataat

SEQ ID NO: 3755135 - DNA, 23 bp, Homo sapiens
ctttattttatataataaagtat

SEQ ID NO: 3755136 - DNA, 13 bp, Homo sapiens
ctttattttctgg

SEQ ID NO: 3755137 - DNA, 18 bp, Homo sapiens
ctttattttctggtagat

SEQ ID NO: 3755138 - DNA, 22 bp, Homo sapiens
ctttattttttaagtatttata

SEQ ID NO: 3755139 - DNA, 17 bp, Homo sapiens
ctttcacaaaattttat

SEQ ID NO: 3755140 - DNA, 14 bp, Homo sapiens
ctttcacaaccttc

SEQ ID NO: 3755141 - DNA, 16 bp, Homo sapiens
ctttcacaaccttctg

SEQ ID NO: 3755142 - DNA, 19 bp, Homo sapiens
ctttcacacttccaccagc

SEQ ID NO: 3755143 - DNA, 20 bp, Homo sapiens
ctttcacacttccaccagcc

SEQ ID NO: 3755144 - DNA, 21 bp, Homo sapiens
ctttcacacttccaccagcct

SEQ ID NO: 3755145 - DNA, 18 bp, Homo sapiens
ctttcacccacagaaaga

SEQ ID NO: 3755146 - DNA, 19 bp, Homo sapiens
ctttcacccacagaaagag

SEQ ID NO: 3755147 - DNA, 18 bp, Homo sapiens
ctttcagaaaacagaaaa

SEQ ID NO: 3755148 - DNA, 23 bp, Homo sapiens
ctttcagaaaacagaaaaaaaac

SEQ ID NO: 3755149 - DNA, 14 bp, Homo sapiens
ctttcagaaagctt

SEQ ID NO: 3755150 - DNA, 11 bp, Homo sapiens
ctttcagagcc

SEQ ID NO: 3755151 - DNA, 14 bp, Homo sapiens
ctttcagagcctcc

SEQ ID NO: 3755152 - DNA, 15 bp, Homo sapiens
ctttcagtgaaagca

SEQ ID NO: 3755153 - DNA, 20 bp, Homo sapiens
ctttcattaaagcatttact

SEQ ID NO: 3755154 - DNA, 15 bp, Homo sapiens
ctttcattgccagtg

SEQ ID NO: 3755155 - DNA, 18 bp, Homo sapiens
ctttcattgccagtgtct

SEQ ID NO: 3755156 - DNA, 16 bp, Homo sapiens
ctttccaaatgcccag

SEQ ID NO: 3755157 - DNA, 14 bp, Homo sapiens
ctttccaccccctc

SEQ ID NO: 3755158 - DNA, 19 bp, Homo sapiens
ctttcccaacacttcagac

SEQ ID NO: 3755159 - DNA, 17 bp, Homo sapiens
ctttccccatactctgt

SEQ ID NO: 3755160 - DNA, 13 bp, Homo sapiens
ctttccctccctt

SEQ ID NO: 3755161 - DNA, 14 bp, Homo sapiens
ctttccctcccttc

SEQ ID NO: 3755162 - DNA, 19 bp, Homo sapiens
ctttccctgcttaatgaaa

SEQ ID NO: 3755163 - DNA, 21 bp, Homo sapiens
ctttcctggagagtctcactc

SEQ ID NO: 3755164 - DNA, 17 bp, Homo sapiens
ctttcctgttcagcatt

SEQ ID NO: 3755165 - DNA, 11 bp, Homo sapiens
ctttccttcct

SEQ ID NO: 3755166 - DNA, 13 bp, Homo sapiens
ctttcctttttcc

SEQ ID NO: 3755167 - DNA, 21 bp, Homo sapiens
ctttcctttttcccaataaat

SEQ ID NO: 3755168 - DNA, 17 bp, Homo sapiens
ctttctacccagcgagc

SEQ ID NO: 3755169 - DNA, 17 bp, Homo sapiens
ctttctagctaatggaa

SEQ ID NO: 3755170 - DNA, 23 bp, Homo sapiens
ctttctagctgttgagctgtttt

SEQ ID NO: 3755171 - DNA, 21 bp, Homo sapiens
ctttctcagccgcttctgact

SEQ ID NO: 3755172 - DNA, 20 bp, Homo sapiens
ctttctcccaggccaggctc

SEQ ID NO: 3755173 - DNA, 15 bp, Homo sapiens
ctttctccttagtct

SEQ ID NO: 3755174 - DNA, 16 bp, Homo sapiens
ctttctctgcttcagc

SEQ ID NO: 3755175 - DNA, 15 bp, Homo sapiens
ctttcttcctctgct

SEQ ID NO: 3755176 - DNA, 16 bp, Homo sapiens
ctttcttctattttat

SEQ ID NO: 3755177 - DNA, 21 bp, Homo sapiens
ctttcttgctggttgtcattt

SEQ ID NO: 3755178 - DNA, 14 bp, Homo sapiens
ctttcttggccagt

SEQ ID NO: 3755179 - DNA, 15 bp, Homo sapiens
ctttctttggtgcct

SEQ ID NO: 3755180 - DNA, 21 bp, Homo sapiens
ctttctttggtgcctttcctg

SEQ ID NO: 3755181 - DNA, 22 bp, Homo sapiens
ctttcttttctggaatgtaatc

SEQ ID NO: 3755182 - DNA, 16 bp, Homo sapiens
ctttgaatgcggccca

SEQ ID NO: 3755183 - DNA, 16 bp, Homo sapiens
ctttgagcttaagaat

SEQ ID NO: 3755184 - DNA, 22 bp, Homo sapiens
ctttgagtttcctcaggctgct

SEQ ID NO: 3755185 - DNA, 15 bp, Homo sapiens
ctttgattccatctc

SEQ ID NO: 3755186 - DNA, 16 bp, Homo sapiens
ctttgattccatctcc

SEQ ID NO: 3755187 - DNA, 23 bp, Homo sapiens
ctttgcagaaacagatttggtga

SEQ ID NO: 3755188 - DNA, 18 bp, Homo sapiens
ctttgcccaacctcagca

SEQ ID NO: 3755189 - DNA, 21 bp, Homo sapiens
ctttgcccaacctcagcaacc

SEQ ID NO: 3755190 - DNA, 22 bp, Homo sapiens
ctttgccttccacgctgtctcc

SEQ ID NO: 3755191 - DNA, 13 bp, Homo sapiens
ctttgccttgggc

SEQ ID NO: 3755192 - DNA, 12 bp, Homo sapiens
ctttgcctttgc

SEQ ID NO: 3755193 - DNA, 19 bp, Homo sapiens
ctttgctccaccccactca

SEQ ID NO: 3755194 - DNA, 14 bp, Homo sapiens
ctttgctgagagct

SEQ ID NO: 3755195 - DNA, 20 bp, Homo sapiens
ctttgcttatgaatatttat

SEQ ID NO: 3755196 - DNA, 23 bp, Homo sapiens
ctttgcttatgaatatttataac

SEQ ID NO: 3755197 - DNA, 15 bp, Homo sapiens
ctttgcttgaacaca

SEQ ID NO: 3755198 - DNA, 16 bp, Homo sapiens
ctttgcttgaacacag

SEQ ID NO: 3755199 - DNA, 17 bp, Homo sapiens
ctttgcttgaacacagt

SEQ ID NO: 3755200 - DNA, 19 bp, Homo sapiens
ctttgcttgaacacagtat

SEQ ID NO: 3755201 - DNA, 21 bp, Homo sapiens
ctttgcttgaacacagtattt

SEQ ID NO: 3755202 - DNA, 17 bp, Homo sapiens
ctttggaaacaggacca

SEQ ID NO: 3755203 - DNA, 17 bp, Homo sapiens
ctttggacacacacagc

SEQ ID NO: 3755204 - DNA, 19 bp, Homo sapiens
ctttggacacacacagctt

SEQ ID NO: 3755205 - DNA, 19 bp, Homo sapiens
ctttggacgcacacagctt

SEQ ID NO: 3755206 - DNA, 13 bp, Homo sapiens
ctttggatagcat

SEQ ID NO: 3755207 - DNA, 13 bp, Homo sapiens
ctttgggaggcca

SEQ ID NO: 3755208 - DNA, 18 bp, Homo sapiens
ctttgggaggctgaggcg

SEQ ID NO: 3755209 - DNA, 21 bp, Homo sapiens
ctttggggcttttacaccagt

SEQ ID NO: 3755210 - DNA, 16 bp, Homo sapiens
ctttggtactaataat

SEQ ID NO: 3755211 - DNA, 21 bp, Homo sapiens
ctttggtactaataatcttgt

SEQ ID NO: 3755212 - DNA, 23 bp, Homo sapiens
ctttggtcctaagtccctgcccc

SEQ ID NO: 3755213 - DNA, 15 bp, Homo sapiens
ctttggtctcttgct

SEQ ID NO: 3755214 - DNA, 16 bp, Homo sapiens
ctttggtgcctttcct

SEQ ID NO: 3755215 - DNA, 18 bp, Homo sapiens
ctttggtgcctttcctgt

SEQ ID NO: 3755216 - DNA, 21 bp, Homo sapiens
ctttggtgcgggcacaataaa

SEQ ID NO: 3755217 - DNA, 17 bp, Homo sapiens
ctttggtggagataaag

SEQ ID NO: 3755218 - DNA, 22 bp, Homo sapiens
ctttgtaagtaaactgccctgt

SEQ ID NO: 3755219 - DNA, 19 bp, Homo sapiens
ctttgtaatcgttatgtgt

SEQ ID NO: 3755220 - DNA, 21 bp, Homo sapiens
ctttgtaatcgttatgtgtgt

SEQ ID NO: 3755221 - DNA, 21 bp, Homo sapiens
ctttgtaatgtcaccaccttc

SEQ ID NO: 3755222 - DNA, 15 bp, Homo sapiens
ctttgtatgatattc

SEQ ID NO: 3755223 - DNA, 18 bp, Homo sapiens
ctttgtcatctttcttct

SEQ ID NO: 3755224 - DNA, 16 bp, Homo sapiens
ctttgtcccacagctt

SEQ ID NO: 3755225 - DNA, 16 bp, Homo sapiens
ctttgtgtagctttgc

SEQ ID NO: 3755226 - DNA, 18 bp, Homo sapiens
ctttgttaagactgctga

SEQ ID NO: 3755227 - DNA, 18 bp, Homo sapiens
ctttgtttgttgtcagct

SEQ ID NO: 3755228 - DNA, 19 bp, Homo sapiens
ctttgttttgatgtttgtg

SEQ ID NO: 3755229 - DNA, 18 bp, Homo sapiens
ctttgtttttatgaagaa

SEQ ID NO: 3755230 - DNA, 16 bp, Homo sapiens
ctttgtttttttttcc

SEQ ID NO: 3755231 - DNA, 14 bp, Homo sapiens
cttttaaatcctgt

SEQ ID NO: 3755232 - DNA, 18 bp, Homo sapiens
cttttaaatcctgttgaa

SEQ ID NO: 3755233 - DNA, 20 bp, Homo sapiens
cttttaaatcctgttgaaaa

SEQ ID NO: 3755234 - DNA, 17 bp, Homo sapiens
cttttaggacccttccc

SEQ ID NO: 3755235 - DNA, 20 bp, Homo sapiens
cttttagtacccacctgagc

SEQ ID NO: 3755236 - DNA, 18 bp, Homo sapiens
cttttagttgtatctctt

SEQ ID NO: 3755237 - DNA, 20 bp, Homo sapiens
cttttagttgtatctctttt

SEQ ID NO: 3755238 - DNA, 21 bp, Homo sapiens
cttttagttgtatctcttttg

SEQ ID NO: 3755239 - DNA, 22 bp, Homo sapiens
cttttagttttagttgcagaaa

SEQ ID NO: 3755240 - DNA, 20 bp, Homo sapiens
cttttataaaaaaaatgaaa

SEQ ID NO: 3755241 - DNA, 11 bp, Homo sapiens
cttttataaat

SEQ ID NO: 3755242 - DNA, 16 bp, Homo sapiens
cttttataaattaaat

SEQ ID NO: 3755243 - DNA, 24 bp, Homo sapiens
cttttataaattaaatatatgtat

SEQ ID NO: 3755244 - DNA, 19 bp, Homo sapiens
cttttatcacgatattatt

SEQ ID NO: 3755245 - DNA, 14 bp, Homo sapiens
cttttatgagctca

SEQ ID NO: 3755246 - DNA, 22 bp, Homo sapiens
cttttatgagctcatgtagcaa

SEQ ID NO: 3755247 - DNA, 15 bp, Homo sapiens
cttttcaaaacattt

SEQ ID NO: 3755248 - DNA, 16 bp, Homo sapiens
cttttcactgctggct

SEQ ID NO: 3755249 - DNA, 17 bp, Homo sapiens
cttttcactgctggctg

SEQ ID NO: 3755250 - DNA, 18 bp, Homo sapiens
cttttcactgctggctgc

SEQ ID NO: 3755251 - DNA, 22 bp, Homo sapiens
cttttcataacctagccttaga

SEQ ID NO: 3755252 - DNA, 18 bp, Homo sapiens
cttttcatgcgtgtgtgt

SEQ ID NO: 3755253 - DNA, 14 bp, Homo sapiens
cttttcccaaccat

SEQ ID NO: 3755254 - DNA, 18 bp, Homo sapiens
cttttcctgtttttgtta

SEQ ID NO: 3755255 - DNA, 16 bp, Homo sapiens
cttttcgccgtggctg

SEQ ID NO: 3755256 - DNA, 11 bp, Homo sapiens
cttttcgttaa

SEQ ID NO: 3755257 - DNA, 15 bp, Homo sapiens
cttttctacagcaaa

SEQ ID NO: 3755258 - DNA, 17 bp, Homo sapiens
cttttctacagcaaatt

SEQ ID NO: 3755259 - DNA, 20 bp, Homo sapiens
cttttctacagcaaatttat

SEQ ID NO: 3755260 - DNA, 23 bp, Homo sapiens
cttttctacagcaaatttataat

SEQ ID NO: 3755261 - DNA, 23 bp, Homo sapiens
cttttctgcatcatctgtagata

SEQ ID NO: 3755262 - DNA, 14 bp, Homo sapiens
cttttgaacccagg

SEQ ID NO: 3755263 - DNA, 19 bp, Homo sapiens
cttttgaatccatgcttgg

SEQ ID NO: 3755264 - DNA, 18 bp, Homo sapiens
cttttgacttaaagcaga

SEQ ID NO: 3755265 - DNA, 20 bp, Homo sapiens
cttttggcccccgagctggg

SEQ ID NO: 3755266 - DNA, 16 bp, Homo sapiens
ctgaggcaggagaatc

SEQ ID NO: 3755267 - DNA, 15 bp, Homo sapiens
ctgaggcaggaggat

SEQ ID NO: 3755268 - DNA, 22 bp, Homo sapiens
ctgaggcagggaagtccccagg

SEQ ID NO: 3755269 - DNA, 18 bp, Homo sapiens
ctgaggcgggtggatcac

SEQ ID NO: 3755270 - DNA, 16 bp, Homo sapiens
ctgaggctctttctgg

SEQ ID NO: 3755271 - DNA, 24 bp, Homo sapiens
ctgaggctggactccagatctgca

SEQ ID NO: 3755272 - DNA, 16 bp, Homo sapiens
ctgagggaccaactgg

SEQ ID NO: 3755273 - DNA, 21 bp, Homo sapiens
ctgagggaccaactgggccca

SEQ ID NO: 3755274 - DNA, 16 bp, Homo sapiens
ctgagggcgaggggag

SEQ ID NO: 3755275 - DNA, 22 bp, Homo sapiens
ctgaggggcaacgaagaaaaaa

SEQ ID NO: 3755276 - DNA, 18 bp, Homo sapiens
ctgaggggcatctgcccc

SEQ ID NO: 3755277 - DNA, 20 bp, Homo sapiens
ctgaggggcatctgcccctc

SEQ ID NO: 3755278 - DNA, 17 bp, Homo sapiens
ctgaggtgaaagggagc

SEQ ID NO: 3755279 - DNA, 19 bp, Homo sapiens
ctgaggtgaaagggagcta

SEQ ID NO: 3755280 - DNA, 22 bp, Homo sapiens
ctgaggtgggaggatctcttga

SEQ ID NO: 3755281 - DNA, 21 bp, Homo sapiens
ctgagtatctcctcgcaagct

SEQ ID NO: 3755282 - DNA, 15 bp, Homo sapiens
ctgagtcaccaggaa

SEQ ID NO: 3755283 - DNA, 17 bp, Homo sapiens
ctgagtcaccaggaatg

SEQ ID NO: 3755284 - DNA, 23 bp, Homo sapiens
ctgagtcaccctacctgtgcctg

SEQ ID NO: 3755285 - DNA, 20 bp, Homo sapiens
ctgagttgacttgacagaac

SEQ ID NO: 3755286 - DNA, 17 bp, Homo sapiens
ctgagtttaccatttgt

SEQ ID NO: 3755287 - DNA, 20 bp, Homo sapiens
ctgagtttaccatttgtaat

SEQ ID NO: 3755288 - DNA, 22 bp, Homo sapiens
ctgagtttaccatttgtaataa

SEQ ID NO: 3755289 - DNA, 23 bp, Homo sapiens
ctgatagcgttggaattaaaaca

SEQ ID NO: 3755290 - DNA, 12 bp, Homo sapiens
ctgatatagaat

SEQ ID NO: 3755291 - DNA, 15 bp, Homo sapiens
ctgatatatgtgttt

SEQ ID NO: 3755292 - DNA, 18 bp, Homo sapiens
ctgatcaagtcaccggag

SEQ ID NO: 3755293 - DNA, 12 bp, Homo sapiens
ctgatcatgcat

SEQ ID NO: 3755294 - DNA, 17 bp, Homo sapiens
ctgatcatgcattgttg

SEQ ID NO: 3755295 - DNA, 20 bp, Homo sapiens
ctgatcgccaacctttcccc

SEQ ID NO: 3755296 - DNA, 17 bp, Homo sapiens
ctgatcgtgctaaattt

SEQ ID NO: 3755297 - DNA, 22 bp, Homo sapiens
ctgatctcagggaagcccagct

SEQ ID NO: 3755298 - DNA, 23 bp, Homo sapiens
ctgatctctactaccacaaggaa

SEQ ID NO: 3755299 - DNA, 14 bp, Homo sapiens
ctgatgacccaggc

SEQ ID NO: 3755300 - DNA, 23 bp, Homo sapiens
ctgatgacccaggctgcctgagc

SEQ ID NO: 3755301 - DNA, 19 bp, Homo sapiens
ctgatgacctaacctaagc

SEQ ID NO: 3755302 - DNA, 16 bp, Homo sapiens
ctgatgagaatttata

SEQ ID NO: 3755303 - DNA, 18 bp, Homo sapiens
ctgatgctccctcccctg

SEQ ID NO: 3755304 - DNA, 24 bp, Homo sapiens
ctgatgctccctcccctgccctgg

SEQ ID NO: 3755305 - DNA, 14 bp, Homo sapiens
ctgatggaaacaaa

SEQ ID NO: 3755306 - DNA, 24 bp, Homo sapiens
ctgatgggcaacccccagcctgct

SEQ ID NO: 3755307 - DNA, 15 bp, Homo sapiens
ctgatgtaaatgaag

SEQ ID NO: 3755308 - DNA, 16 bp, Homo sapiens
ctgatgtaaatgaagt

SEQ ID NO: 3755309 - DNA, 17 bp, Homo sapiens
ctgatgtaaatgaagta

SEQ ID NO: 3755310 - DNA, 17 bp, Homo sapiens
ctgatgttaggctgggc

SEQ ID NO: 3755311 - DNA, 22 bp, Homo sapiens
ctgatgttgagggaacagacag

SEQ ID NO: 3755312 - DNA, 16 bp, Homo sapiens
ctgattactgtcaata

SEQ ID NO: 3755313 - DNA, 17 bp, Homo sapiens
ctgattactgtcaataa

SEQ ID NO: 3755314 - DNA, 23 bp, Homo sapiens
ctgattactgtcaataaacagct

SEQ ID NO: 3755315 - DNA, 19 bp, Homo sapiens
ctgattagaaatgaccaat

SEQ ID NO: 3755316 - DNA, 17 bp, Homo sapiens
ctgattcccaagctctg

SEQ ID NO: 3755317 - DNA, 20 bp, Homo sapiens
ctgattcccaagctctgctc

SEQ ID NO: 3755318 - DNA, 14 bp, Homo sapiens
ctgattttaacaat

SEQ ID NO: 3755319 - DNA, 22 bp, Homo sapiens
ctgattttaacaataactactg

SEQ ID NO: 3755320 - DNA, 18 bp, Homo sapiens
ctgattttcaaagctttt

SEQ ID NO: 3755321 - DNA, 21 bp, Homo sapiens
ctgattttcaaagctttttcc

SEQ ID NO: 3755322 - DNA, 19 bp, Homo sapiens
ctgcaaatagaaaacagga

SEQ ID NO: 3755323 - DNA, 15 bp, Homo sapiens
ctgcaacctgttgat

SEQ ID NO: 3755324 - DNA, 19 bp, Homo sapiens
ctgcaacttgtaaatgtgg

SEQ ID NO: 3755325 - DNA, 17 bp, Homo sapiens
ctgcaagagccttggtg

SEQ ID NO: 3755326 - DNA, 19 bp, Homo sapiens
ctgcaagagccttggtgtc

SEQ ID NO: 3755327 - DNA, 23 bp, Homo sapiens
ctgcaagagccttggtgtccacc

SEQ ID NO: 3755328 - DNA, 21 bp, Homo sapiens
ctgcaatagagactgtagatt

SEQ ID NO: 3755329 - DNA, 13 bp, Homo sapiens
ctgcacaaagccc

SEQ ID NO: 3755330 - DNA, 18 bp, Homo sapiens
ctgcacaaagcccttcca

SEQ ID NO: 3755331 - DNA, 15 bp, Homo sapiens
ctgcacaagctgcac

SEQ ID NO: 3755332 - DNA, 16 bp, Homo sapiens
ctgcacaagctgcacc

SEQ ID NO: 3755333 - DNA, 20 bp, Homo sapiens
ctgcacagatggatttgcct

SEQ ID NO: 3755334 - DNA, 11 bp, Homo sapiens
ctgcaccagga

SEQ ID NO: 3755335 - DNA, 13 bp, Homo sapiens
ctgcaccaggaga

SEQ ID NO: 3755336 - DNA, 12 bp, Homo sapiens
ctgcaccgggcc

SEQ ID NO: 3755337 - DNA, 14 bp, Homo sapiens
ctgcaccgggccac

SEQ ID NO: 3755338 - DNA, 15 bp, Homo sapiens
ctgcaccgggccaca

SEQ ID NO: 3755339 - DNA, 14 bp, Homo sapiens
ctgcacctcccccc

SEQ ID NO: 3755340 - DNA, 21 bp, Homo sapiens
ctgcacctccccccactgcag

SEQ ID NO: 3755341 - DNA, 13 bp, Homo sapiens
ctgcacctgccag

SEQ ID NO: 3755342 - DNA, 16 bp, Homo sapiens
ctgcacctgccagcct

SEQ ID NO: 3755343 - DNA, 20 bp, Homo sapiens
ctgcactatagcctaggtga

SEQ ID NO: 3755344 - DNA, 16 bp, Homo sapiens
ctgcactccagcctgg

SEQ ID NO: 3755345 - DNA, 18 bp, Homo sapiens
ctgcactccagcctgggc

SEQ ID NO: 3755346 - DNA, 20 bp, Homo sapiens
ctgcactccagcctgggcga

SEQ ID NO: 3755347 - DNA, 16 bp, Homo sapiens
ctgcactctagccgga

SEQ ID NO: 3755348 - DNA, 19 bp, Homo sapiens
ctgcactgacccacagcct

SEQ ID NO: 3755349 - DNA, 14 bp, Homo sapiens
ctgcacttgcagac

SEQ ID NO: 3755350 - DNA, 16 bp, Homo sapiens
ctgcacttgcagactc

SEQ ID NO: 3755351 - DNA, 18 bp, Homo sapiens
ctgcacttgcagactcta

SEQ ID NO: 3755352 - DNA, 23 bp, Homo sapiens
ctgcacttgcagactctacagag

SEQ ID NO: 3755353 - DNA, 19 bp, Homo sapiens
ctgcagaggggctttctgg

SEQ ID NO: 3755354 - DNA, 20 bp, Homo sapiens
ctgcagaggggctttctgga

SEQ ID NO: 3755355 - DNA, 15 bp, Homo sapiens
ctgcagcagagcctg

SEQ ID NO: 3755356 - DNA, 16 bp, Homo sapiens
ctgcagccagcccagc

SEQ ID NO: 3755357 - DNA, 18 bp, Homo sapiens
ctgcagccagcccagccc

SEQ ID NO: 3755358 - DNA, 22 bp, Homo sapiens
ctgcagccagcccagcccagct

SEQ ID NO: 3755359 - DNA, 22 bp, Homo sapiens
ctgcagcctcaacctcctgggc

SEQ ID NO: 3755360 - DNA, 23 bp, Homo sapiens
ctgcagcctcaacctcctgggct

SEQ ID NO: 3755361 - DNA, 24 bp, Homo sapiens
ctgcagcctcaacctcctgggcta

SEQ ID NO: 3755362 - DNA, 19 bp, Homo sapiens
ctgcagcctcgaactcctg

SEQ ID NO: 3755363 - DNA, 21 bp, Homo sapiens
ctgcagcctcgaactcctggg

SEQ ID NO: 3755364 - DNA, 20 bp, Homo sapiens
ctgcagcctttgcctccccg

SEQ ID NO: 3755365 - DNA, 13 bp, Homo sapiens
ctgcagctgggct

SEQ ID NO: 3755366 - DNA, 22 bp, Homo sapiens
ctgcaggccaagagcagaggca

SEQ ID NO: 3755367 - DNA, 22 bp, Homo sapiens
ctgcaggccccgcttgtccagc

SEQ ID NO: 3755368 - DNA, 16 bp, Homo sapiens
ctgcagggccaagcac

SEQ ID NO: 3755369 - DNA, 13 bp, Homo sapiens
ctgcagtcacagc

SEQ ID NO: 3755370 - DNA, 21 bp, Homo sapiens
ctgcagtttgagacaggagac

SEQ ID NO: 3755371 - DNA, 16 bp, Homo sapiens
ctgcataccaacctgg

SEQ ID NO: 3755372 - DNA, 22 bp, Homo sapiens
ctgcatcgtttcatcttccaac

SEQ ID NO: 3755373 - DNA, 13 bp, Homo sapiens
ctgcatggaccta

SEQ ID NO: 3755374 - DNA, 17 bp, Homo sapiens
ctgcatggtaatttata

SEQ ID NO: 3755375 - DNA, 20 bp, Homo sapiens
ctgcatggtaatttatagtt

SEQ ID NO: 3755376 - DNA, 22 bp, Homo sapiens
ctgcattcacccagacagctcc

SEQ ID NO: 3755377 - DNA, 22 bp, Homo sapiens
ctgcattgcctgcggtcaaggc

SEQ ID NO: 3755378 - DNA, 14 bp, Homo sapiens
ctgcatttgtgaaa

SEQ ID NO: 3755379 - DNA, 17 bp, Homo sapiens
ctgcattttcaccccac

SEQ ID NO: 3755380 - DNA, 21 bp, Homo sapiens
ctgccaaagggaaatatcatt

SEQ ID NO: 3755381 - DNA, 22 bp, Homo sapiens
ctgccacacgtctgaccctctc

SEQ ID NO: 3755382 - DNA, 17 bp, Homo sapiens
ctgccacacttcaggct

SEQ ID NO: 3755383 - DNA, 16 bp, Homo sapiens
ctgccaccctggggag

SEQ ID NO: 3755384 - DNA, 11 bp, Homo sapiens
ctgccacctcc

SEQ ID NO: 3755385 - DNA, 12 bp, Homo sapiens
ctgccacctccc

SEQ ID NO: 3755386 - DNA, 15 bp, Homo sapiens
ctgccactaggctgg

SEQ ID NO: 3755387 - DNA, 18 bp, Homo sapiens
ctgccactaggctgggtg

SEQ ID NO: 3755388 - DNA, 11 bp, Homo sapiens
ctgccagagaa

SEQ ID NO: 3755389 - DNA, 14 bp, Homo sapiens
ctgccagcacagag

SEQ ID NO: 3755390 - DNA, 12 bp, Homo sapiens
ctgccagccagc

SEQ ID NO: 3755391 - DNA, 13 bp, Homo sapiens
ctgccagccagca

SEQ ID NO: 3755392 - DNA, 16 bp, Homo sapiens
ctgccagccagcagcc

SEQ ID NO: 3755393 - DNA, 13 bp, Homo sapiens
ctgccagcctggc

SEQ ID NO: 3755394 - DNA, 14 bp, Homo sapiens
ctgccagcctggct

SEQ ID NO: 3755395 - DNA, 20 bp, Homo sapiens
ctgccagcctggcttctgga

SEQ ID NO: 3755396 - DNA, 13 bp, Homo sapiens
ctgccaggcatgg

SEQ ID NO: 3755397 - DNA, 13 bp, Homo sapiens
ctgccagggagct

SEQ ID NO: 3755398 - DNA, 20 bp, Homo sapiens
ctgccagtccccctgcccca

SEQ ID NO: 3755399 - DNA, 14 bp, Homo sapiens
ctgccagtgcctta

SEQ ID NO: 3755400 - DNA, 14 bp, Homo sapiens
ctgccatgccagct

SEQ ID NO: 3755401 - DNA, 22 bp, Homo sapiens
ctgccatggcgtgtccctctcg

SEQ ID NO: 3755402 - DNA, 19 bp, Homo sapiens
ctgccatttgcaccctccg

SEQ ID NO: 3755403 - DNA, 20 bp, Homo sapiens
ctgccatttgcaccctccgc

SEQ ID NO: 3755404 - DNA, 13 bp, Homo sapiens
ctgcccaaagcag

SEQ ID NO: 3755405 - DNA, 17 bp, Homo sapiens
ctgcccacattggaccc

SEQ ID NO: 3755406 - DNA, 18 bp, Homo sapiens
ctgcccagacccctctgg

SEQ ID NO: 3755407 - DNA, 23 bp, Homo sapiens
ctgcccagacccctctggccagg

SEQ ID NO: 3755408 - DNA, 18 bp, Homo sapiens
ctgcccagatcccagaag

SEQ ID NO: 3755409 - DNA, 11 bp, Homo sapiens
ctgcccaggag

SEQ ID NO: 3755410 - DNA, 18 bp, Homo sapiens
ctgcccaggagagccagc

SEQ ID NO: 3755411 - DNA, 19 bp, Homo sapiens
ctgcccaggagagccagcc

SEQ ID NO: 3755412 - DNA, 16 bp, Homo sapiens
ctgcccaggcccctgc

SEQ ID NO: 3755413 - DNA, 17 bp, Homo sapiens
ctgcccaggcctgcctg

SEQ ID NO: 3755414 - DNA, 21 bp, Homo sapiens
ctgcccagtgttgtttgtaaa

SEQ ID NO: 3755415 - DNA, 23 bp, Homo sapiens
ctgcccagtgttgtttgtaaata

SEQ ID NO: 3755416 - DNA, 18 bp, Homo sapiens
ctgcccatcacagggttg

SEQ ID NO: 3755417 - DNA, 22 bp, Homo sapiens
ctgcccatcacagggttgggcc

SEQ ID NO: 3755418 - DNA, 16 bp, Homo sapiens
ctgccccaactcctgg

SEQ ID NO: 3755419 - DNA, 18 bp, Homo sapiens
ctgccccaactcctggaa

SEQ ID NO: 3755420 - DNA, 13 bp, Homo sapiens
ctgccccagctct

SEQ ID NO: 3755421 - DNA, 14 bp, Homo sapiens
ctgccccagctctg

SEQ ID NO: 3755422 - DNA, 16 bp, Homo sapiens
ctgccccagctgactg

SEQ ID NO: 3755423 - DNA, 16 bp, Homo sapiens
ctgccccatgaagcca

SEQ ID NO: 3755424 - DNA, 18 bp, Homo sapiens
ctgccccctccccttcac

SEQ ID NO: 3755425 - DNA, 13 bp, Homo sapiens
ctgccccctggtg

SEQ ID NO: 3755426 - DNA, 15 bp, Homo sapiens
ctgccccgcccagct

SEQ ID NO: 3755427 - DNA, 17 bp, Homo sapiens
ctgccccgcccagctgc

SEQ ID NO: 3755428 - DNA, 18 bp, Homo sapiens
ctgccccgtcaccatctc

SEQ ID NO: 3755429 - DNA, 19 bp, Homo sapiens
ctgccccgtcaccatctca

SEQ ID NO: 3755430 - DNA, 23 bp, Homo sapiens
ctgccccgtcaccatctcaggcc

SEQ ID NO: 3755431 - DNA, 18 bp, Homo sapiens
ctgccccgtgcagactgg

SEQ ID NO: 3755432 - DNA, 14 bp, Homo sapiens
ctgcccctcccaga

SEQ ID NO: 3755433 - DNA, 22 bp, Homo sapiens
ctgcccctcccccaacccccac

SEQ ID NO: 3755434 - DNA, 13 bp, Homo sapiens
ctgcccctccctg

SEQ ID NO: 3755435 - DNA, 16 bp, Homo sapiens
ctgcccctgccccgtc

SEQ ID NO: 3755436 - DNA, 13 bp, Homo sapiens
ctgcccgagctgg

SEQ ID NO: 3755437 - DNA, 14 bp, Homo sapiens
ctgcccgagctggt

SEQ ID NO: 3755438 - DNA, 15 bp, Homo sapiens
ctgcccggctgcgga

SEQ ID NO: 3755439 - DNA, 15 bp, Homo sapiens
ctgcccggggcagct

SEQ ID NO: 3755440 - DNA, 16 bp, Homo sapiens
ctgcccggggcagctg

SEQ ID NO: 3755441 - DNA, 22 bp, Homo sapiens
ctgcccggggcagctgccagag

SEQ ID NO: 3755442 - DNA, 16 bp, Homo sapiens
ctgcccgtcttcagcc

SEQ ID NO: 3755443 - DNA, 19 bp, Homo sapiens
ctgccctagagcacactgt

SEQ ID NO: 3755444 - DNA, 16 bp, Homo sapiens
ctgccctccctggagc

SEQ ID NO: 3755445 - DNA, 12 bp, Homo sapiens
ctgccctggtgc

SEQ ID NO: 3755446 - DNA, 13 bp, Homo sapiens
ctgccctggtgct

SEQ ID NO: 3755447 - DNA, 18 bp, Homo sapiens
ctgccctggtgctgccac

SEQ ID NO: 3755448 - DNA, 13 bp, Homo sapiens
ctgccgaccagag

SEQ ID NO: 3755449 - DNA, 16 bp, Homo sapiens
ctgccgaccgaggctg

SEQ ID NO: 3755450 - DNA, 21 bp, Homo sapiens
ctgccgaccgaggctggagct

SEQ ID NO: 3755451 - DNA, 17 bp, Homo sapiens
ctgccgacctcgtcctc

SEQ ID NO: 3755452 - DNA, 16 bp, Homo sapiens
ctgccgcaccccagag

SEQ ID NO: 3755453 - DNA, 22 bp, Homo sapiens
ctgccgcccgaggtggctgcct

SEQ ID NO: 3755454 - DNA, 14 bp, Homo sapiens
ctgccgcctcccag

SEQ ID NO: 3755455 - DNA, 15 bp, Homo sapiens
ctgccgcctcccagc

SEQ ID NO: 3755456 - DNA, 16 bp, Homo sapiens
ctgccgcctcccagcc

SEQ ID NO: 3755457 - DNA, 19 bp, Homo sapiens
ctgccgcctcccagcctgg

SEQ ID NO: 3755458 - DNA, 15 bp, Homo sapiens
ctgccggccctgggg

SEQ ID NO: 3755459 - DNA, 17 bp, Homo sapiens
ctgccggctctggctct

SEQ ID NO: 3755460 - DNA, 15 bp, Homo sapiens
ctgcctaagtggctg

SEQ ID NO: 3755461 - DNA, 19 bp, Homo sapiens
ctgcctaagtggctgctga

SEQ ID NO: 3755462 - DNA, 20 bp, Homo sapiens
ctgcctaagtggctgctgac

SEQ ID NO: 3755463 - DNA, 13 bp, Homo sapiens
ctgcctactcacg

SEQ ID NO: 3755464 - DNA, 14 bp, Homo sapiens
ctgcctactcacga

SEQ ID NO: 3755465 - DNA, 23 bp, Homo sapiens
ctgcctcacttcctacaagagca

SEQ ID NO: 3755466 - DNA, 15 bp, Homo sapiens
ctgcctcagcctccc

SEQ ID NO: 3755467 - DNA, 18 bp, Homo sapiens
ctgcctccattctgacca

SEQ ID NO: 3755468 - DNA, 24 bp, Homo sapiens
ctgcctcctcttcaactgaccagc

SEQ ID NO: 3755469 - DNA, 19 bp, Homo sapiens
ctgcctcgaactggctgca

SEQ ID NO: 3755470 - DNA, 15 bp, Homo sapiens
ctgcctctcccatca

SEQ ID NO: 3755471 - DNA, 17 bp, Homo sapiens
ctgcctctccctggccc

SEQ ID NO: 3755472 - DNA, 19 bp, Homo sapiens
ctgcctctccctggccctc

SEQ ID NO: 3755473 - DNA, 22 bp, Homo sapiens
ctgcctctgacacacagctctg

SEQ ID NO: 3755474 - DNA, 14 bp, Homo sapiens
ctgcctctgcctgc

SEQ ID NO: 3755475 - DNA, 20 bp, Homo sapiens
ctgcctctgcctgcattctg

SEQ ID NO: 3755476 - DNA, 12 bp, Homo sapiens
ctgcctcttcct

SEQ ID NO: 3755477 - DNA, 14 bp, Homo sapiens
ctgcctcttctcta

SEQ ID NO: 3755478 - DNA, 13 bp, Homo sapiens
ctgcctgagcacc

SEQ ID NO: 3755479 - DNA, 21 bp, Homo sapiens
ctgcctgagcacctcccagcc

SEQ ID NO: 3755480 - DNA, 20 bp, Homo sapiens
ctgcctgcagtactttacct

SEQ ID NO: 3755481 - DNA, 12 bp, Homo sapiens
ctgcctgcccac

SEQ ID NO: 3755482 - DNA, 14 bp, Homo sapiens
ctgcctgcccaccc

SEQ ID NO: 3755483 - DNA, 15 bp, Homo sapiens
ctgcctgcccacccg

SEQ ID NO: 3755484 - DNA, 21 bp, Homo sapiens
ctgcctgcccaggcccctgcc

SEQ ID NO: 3755485 - DNA, 16 bp, Homo sapiens
ctgcctggagccccac

SEQ ID NO: 3755486 - DNA, 19 bp, Homo sapiens
ctgcctggagccccactgc

SEQ ID NO: 3755487 - DNA, 18 bp, Homo sapiens
ctgcctgtagttaggaaa

SEQ ID NO: 3755488 - DNA, 19 bp, Homo sapiens
ctgcctgtccctctcaggc

SEQ ID NO: 3755489 - DNA, 23 bp, Homo sapiens
ctgcctgtccctctcaggcatgc

SEQ ID NO: 3755490 - DNA, 12 bp, Homo sapiens
ctgcctgtctcc

SEQ ID NO: 3755491 - DNA, 21 bp, Homo sapiens
ctgcctgtgcacggccagctg

SEQ ID NO: 3755492 - DNA, 14 bp, Homo sapiens
ctgcctgttcagct

SEQ ID NO: 3755493 - DNA, 23 bp, Homo sapiens
ctgcctgttcagctccagctcac

SEQ ID NO: 3755494 - DNA, 20 bp, Homo sapiens
ctgcctttagtcgctgagga

SEQ ID NO: 3755495 - DNA, 19 bp, Homo sapiens
ctgcctttgcagaaacaga

SEQ ID NO: 3755496 - DNA, 17 bp, Homo sapiens
ctgcgaaggggccctgg

SEQ ID NO: 3755497 - DNA, 18 bp, Homo sapiens
ctgcgaaggggccctggt

SEQ ID NO: 3755498 - DNA, 20 bp, Homo sapiens
ctgcgggatggtcctggggc

SEQ ID NO: 3755499 - DNA, 15 bp, Homo sapiens
ctgcggtccacccag

SEQ ID NO: 3755500 - DNA, 17 bp, Homo sapiens
ctgcggtccacccagga

SEQ ID NO: 3755501 - DNA, 19 bp, Homo sapiens
ctgcggtccacccaggagc

SEQ ID NO: 3755502 - DNA, 13 bp, Homo sapiens
ctgcgtggctgac

SEQ ID NO: 3755503 - DNA, 16 bp, Homo sapiens
ctgctaataaaaccca

SEQ ID NO: 3755504 - DNA, 18 bp, Homo sapiens
ctgctacctcactggggt

SEQ ID NO: 3755505 - DNA, 22 bp, Homo sapiens
ctgctagcacttggagccaagg

SEQ ID NO: 3755506 - DNA, 16 bp, Homo sapiens
ctgctaggtgggccag

SEQ ID NO: 3755507 - DNA, 22 bp, Homo sapiens
ctgctaggtgggccagcccctc

SEQ ID NO: 3755508 - DNA, 23 bp, Homo sapiens
ctgctaggtgggccagcccctcc

SEQ ID NO: 3755509 - DNA, 18 bp, Homo sapiens
ctgctatttcccaagctg

SEQ ID NO: 3755510 - DNA, 19 bp, Homo sapiens
ctgctatttcccaagctgg

SEQ ID NO: 3755511 - DNA, 23 bp, Homo sapiens
ctgctatttcccaagctggagtg

SEQ ID NO: 3755512 - DNA, 13 bp, Homo sapiens
ctgctattttact

SEQ ID NO: 3755513 - DNA, 20 bp, Homo sapiens
ctgctattttactgtcttaa

SEQ ID NO: 3755514 - DNA, 21 bp, Homo sapiens
ctgctattttactgtcttaat

SEQ ID NO: 3755515 - DNA, 16 bp, Homo sapiens
ctgctccaccacatcc

SEQ ID NO: 3755516 - DNA, 14 bp, Homo sapiens
ctgctccacccttg

SEQ ID NO: 3755517 - DNA, 17 bp, Homo sapiens
ctgctccacccttggcc

SEQ ID NO: 3755518 - DNA, 19 bp, Homo sapiens
ctgctccagctgttcagct

SEQ ID NO: 3755519 - DNA, 13 bp, Homo sapiens
ctgctcccctccc

SEQ ID NO: 3755520 - DNA, 14 bp, Homo sapiens
ctgctcctcatggt

SEQ ID NO: 3755521 - DNA, 14 bp, Homo sapiens
ctgctcctccaggg

SEQ ID NO: 3755522 - DNA, 24 bp, Homo sapiens
ctgctcctccagggccacgtgcca

SEQ ID NO: 3755523 - DNA, 16 bp, Homo sapiens
ctgctcctctccccag

SEQ ID NO: 3755524 - DNA, 17 bp, Homo sapiens
ctgctcctctccccagc

SEQ ID NO: 3755525 - DNA, 18 bp, Homo sapiens
ctgctcctctccccagca

SEQ ID NO: 3755526 - DNA, 19 bp, Homo sapiens
ctgctcctctccccagcaa

SEQ ID NO: 3755527 - DNA, 20 bp, Homo sapiens
ctgctccttagctgccaagc

SEQ ID NO: 3755528 - DNA, 15 bp, Homo sapiens
ctgctctccgaccag

SEQ ID NO: 3755529 - DNA, 19 bp, Homo sapiens
ctgctctccgaccagacac

SEQ ID NO: 3755530 - DNA, 14 bp, Homo sapiens
ctgctctcctcttg

SEQ ID NO: 3755531 - DNA, 21 bp, Homo sapiens
ctgctctcctcttgccactgc

SEQ ID NO: 3755532 - DNA, 14 bp, Homo sapiens
ctgctctctaccca

SEQ ID NO: 3755533 - DNA, 19 bp, Homo sapiens
ctgctctgaacacgaagct

SEQ ID NO: 3755534 - DNA, 11 bp, Homo sapiens
ctgctctgccc

SEQ ID NO: 3755535 - DNA, 12 bp, Homo sapiens
ctgctctgccca

SEQ ID NO: 3755536 - DNA, 14 bp, Homo sapiens
ctgctctgcccaga

SEQ ID NO: 3755537 - DNA, 23 bp, Homo sapiens
ctgctctgcccagagctgggtga

SEQ ID NO: 3755538 - DNA, 16 bp, Homo sapiens
ctgctgaataataaac

SEQ ID NO: 3755539 - DNA, 19 bp, Homo sapiens
ctgctgacagacacaggcc

SEQ ID NO: 3755540 - DNA, 23 bp, Homo sapiens
ctgctgacagacacaggcccggc

SEQ ID NO: 3755541 - DNA, 18 bp, Homo sapiens
ctgctgactgttttctct

SEQ ID NO: 3755542 - DNA, 16 bp, Homo sapiens
ctgctgagagacccaa

SEQ ID NO: 3755543 - DNA, 17 bp, Homo sapiens
ctgctgagggaccagcc

SEQ ID NO: 3755544 - DNA, 14 bp, Homo sapiens
ctgctgatgctcat

SEQ ID NO: 3755545 - DNA, 15 bp, Homo sapiens
ctgctgatgctcatg

SEQ ID NO: 3755546 - DNA, 12 bp, Homo sapiens
ctgctgcccagc

SEQ ID NO: 3755547 - DNA, 22 bp, Homo sapiens
ctgctgcccagcctccaagctc

SEQ ID NO: 3755548 - DNA, 13 bp, Homo sapiens
ctgctgccccagc

SEQ ID NO: 3755549 - DNA, 16 bp, Homo sapiens
ctgctgccccagctga

SEQ ID NO: 3755550 - DNA, 13 bp, Homo sapiens
ctgctgccctcca

SEQ ID NO: 3755551 - DNA, 14 bp, Homo sapiens
ctgctgccgcctcc

SEQ ID NO: 3755552 - DNA, 21 bp, Homo sapiens
ctgctgccgcctcccagcctg

SEQ ID NO: 3755553 - DNA, 14 bp, Homo sapiens
ctgctgcctcccca

SEQ ID NO: 3755554 - DNA, 19 bp, Homo sapiens
ctgctgcctccccaaccct

SEQ ID NO: 3755555 - DNA, 15 bp, Homo sapiens
ctgctgctgctgctg

SEQ ID NO: 3755556 - DNA, 11 bp, Homo sapiens
ctgctggagga

SEQ ID NO: 3755557 - DNA, 21 bp, Homo sapiens
ctgctggcacatttccccaga

SEQ ID NO: 3755558 - DNA, 14 bp, Homo sapiens
ctgctggcccctca

SEQ ID NO: 3755559 - DNA, 15 bp, Homo sapiens
ctgctggcccctcac

SEQ ID NO: 3755560 - DNA, 16 bp, Homo sapiens
ctgctggcccctcacc

SEQ ID NO: 3755561 - DNA, 18 bp, Homo sapiens
ctgctggccgggcacagc

SEQ ID NO: 3755562 - DNA, 20 bp, Homo sapiens
ctgctggccgggcacagctg

SEQ ID NO: 3755563 - DNA, 12 bp, Homo sapiens
ctgctggctgcc

SEQ ID NO: 3755564 - DNA, 14 bp, Homo sapiens
ctgctggctgcctt

SEQ ID NO: 3755565 - DNA, 16 bp, Homo sapiens
ctgctggcttgcagtg

SEQ ID NO: 3755566 - DNA, 17 bp, Homo sapiens
ctgctgggactggccag

SEQ ID NO: 3755567 - DNA, 19 bp, Homo sapiens
ctgctgggactggccaggt

SEQ ID NO: 3755568 - DNA, 15 bp, Homo sapiens
ctgctgggctctcca

SEQ ID NO: 3755569 - DNA, 18 bp, Homo sapiens
ctgctgggctctccacct

SEQ ID NO: 3755570 - DNA, 22 bp, Homo sapiens
ctgctgggctctccacctcagc

SEQ ID NO: 3755571 - DNA, 23 bp, Homo sapiens
ctgctgggctctccacctcagcc

SEQ ID NO: 3755572 - DNA, 19 bp, Homo sapiens
ctgctgggttttcctccgg

SEQ ID NO: 3755573 - DNA, 23 bp, Homo sapiens
ctgctggttcagggttggcccct

SEQ ID NO: 3755574 - DNA, 15 bp, Homo sapiens
ctgctgtcagtctgc

SEQ ID NO: 3755575 - DNA, 16 bp, Homo sapiens
ctgctgtcagtctgct

SEQ ID NO: 3755576 - DNA, 22 bp, Homo sapiens
ctgctgtgaacaagtgaacaca

SEQ ID NO: 3755577 - DNA, 19 bp, Homo sapiens
ctgcttagcttgcaccttg

SEQ ID NO: 3755578 - DNA, 20 bp, Homo sapiens
ctgcttatccgttagccgtg

SEQ ID NO: 3755579 - DNA, 14 bp, Homo sapiens
ctgcttcagcctcc

SEQ ID NO: 3755580 - DNA, 21 bp, Homo sapiens
ctgcttcagtgtatggaaata

SEQ ID NO: 3755581 - DNA, 24 bp, Homo sapiens
ctgcttccaattttctggaataca

SEQ ID NO: 3755582 - DNA, 18 bp, Homo sapiens
ctgcttccctctgcctgt

SEQ ID NO: 3755583 - DNA, 20 bp, Homo sapiens
ctgcttccctctgcctgtcc

SEQ ID NO: 3755584 - DNA, 19 bp, Homo sapiens
ctgcttctaccaactggaa

SEQ ID NO: 3755585 - DNA, 21 bp, Homo sapiens
ctgcttctaccaactggaagc

SEQ ID NO: 3755586 - DNA, 20 bp, Homo sapiens
ctgcttgcttgctttttaat

SEQ ID NO: 3755587 - DNA, 17 bp, Homo sapiens
ctgcttgtccctgccca

SEQ ID NO: 3755588 - DNA, 21 bp, Homo sapiens
ctgctttaattgtgaattgat

SEQ ID NO: 3755589 - DNA, 23 bp, Homo sapiens
ctgctttagaatgttttccttct

SEQ ID NO: 3755590 - DNA, 20 bp, Homo sapiens
ctgctttgactgagcagact

SEQ ID NO: 3755591 - DNA, 19 bp, Homo sapiens
ctgctttgggctgccctgg

SEQ ID NO: 3755592 - DNA, 20 bp, Homo sapiens
ctgctttgggctgccctggt

SEQ ID NO: 3755593 - DNA, 21 bp, Homo sapiens
ctgctttgggctgccctggtg

SEQ ID NO: 3755594 - DNA, 15 bp, Homo sapiens
ctgcttttccctaag

SEQ ID NO: 3755595 - DNA, 21 bp, Homo sapiens
ctgcttttccctaagccaagg

SEQ ID NO: 3755596 - DNA, 23 bp, Homo sapiens
ctgcttttccttggggcaggcag

SEQ ID NO: 3755597 - DNA, 15 bp, Homo sapiens
ctgcttttggtctgt

SEQ ID NO: 3755598 - DNA, 19 bp, Homo sapiens
ctgctttttaaagaatgct

SEQ ID NO: 3755599 - DNA, 21 bp, Homo sapiens
ctggaaaggctcagtctcagg

SEQ ID NO: 3755600 - DNA, 23 bp, Homo sapiens
ctggaaatatcagttactcagcc

SEQ ID NO: 3755601 - DNA, 22 bp, Homo sapiens
ctggaagctgtgtccttgcacc

SEQ ID NO: 3755602 - DNA, 15 bp, Homo sapiens
ctggaatacatgaaa

SEQ ID NO: 3755603 - DNA, 15 bp, Homo sapiens
ctggaatgtaatcaa

SEQ ID NO: 3755604 - DNA, 21 bp, Homo sapiens
ctggaatgtaatcaatgtttc

SEQ ID NO: 3755605 - DNA, 14 bp, Homo sapiens
ctggacaggcatgt

SEQ ID NO: 3755606 - DNA, 15 bp, Homo sapiens
ctggacaggtctggg

SEQ ID NO: 3755607 - DNA, 18 bp, Homo sapiens
ctggacattcagaacacc

SEQ ID NO: 3755608 - DNA, 14 bp, Homo sapiens
ctggaccactgggc

SEQ ID NO: 3755609 - DNA, 16 bp, Homo sapiens
ctggaccttgaactgg

SEQ ID NO: 3755610 - DNA, 15 bp, Homo sapiens
ctggacggcattcct

SEQ ID NO: 3755611 - DNA, 19 bp, Homo sapiens
ctggacggcattcctgctt

SEQ ID NO: 3755612 - DNA, 19 bp, Homo sapiens
ctggactccagatctgcac

SEQ ID NO: 3755613 - DNA, 21 bp, Homo sapiens
ctggactccagatctgcaccg

SEQ ID NO: 3755614 - DNA, 14 bp, Homo sapiens
ctggactcctctgt

SEQ ID NO: 3755615 - DNA, 20 bp, Homo sapiens
ctggactcctctgtccaggc

SEQ ID NO: 3755616 - DNA, 21 bp, Homo sapiens
ctggactggtggcccctgcct

SEQ ID NO: 3755617 - DNA, 18 bp, Homo sapiens
ctggactgtcatagaaat

SEQ ID NO: 3755618 - DNA, 20 bp, Homo sapiens
ctggactgtcatagaaatta

SEQ ID NO: 3755619 - DNA, 13 bp, Homo sapiens
ctggacttgagct

SEQ ID NO: 3755620 - DNA, 15 bp, Homo sapiens
ctggacttgagcttg

SEQ ID NO: 3755621 - DNA, 15 bp, Homo sapiens
ctggagaactagaga

SEQ ID NO: 3755622 - DNA, 17 bp, Homo sapiens
ctggagaataattcttt

SEQ ID NO: 3755623 - DNA, 13 bp, Homo sapiens
ctggagagcaaca

SEQ ID NO: 3755624 - DNA, 23 bp, Homo sapiens
ctggagaggagggatgctgcctg

SEQ ID NO: 3755625 - DNA, 15 bp, Homo sapiens
ctggagcaccaggca

SEQ ID NO: 3755626 - DNA, 14 bp, Homo sapiens
ctggagccacctgt

SEQ ID NO: 3755627 - DNA, 13 bp, Homo sapiens
ctggagcccagga

SEQ ID NO: 3755628 - DNA, 15 bp, Homo sapiens
ctggagcccaggagt

SEQ ID NO: 3755629 - DNA, 23 bp, Homo sapiens
ctggagccccactgcccttctca

SEQ ID NO: 3755630 - DNA, 17 bp, Homo sapiens
ctggagcccgaggcacc

SEQ ID NO: 3755631 - DNA, 15 bp, Homo sapiens
ctggagcccttgggt

SEQ ID NO: 3755632 - DNA, 23 bp, Homo sapiens
ctggagcctccactgcctctgga

SEQ ID NO: 3755633 - DNA, 13 bp, Homo sapiens
ctggagcttctct

SEQ ID NO: 3755634 - DNA, 12 bp, Homo sapiens
ctggaggcaggg

SEQ ID NO: 3755635 - DNA, 14 bp, Homo sapiens
ctggaggcagggcc

SEQ ID NO: 3755636 - DNA, 15 bp, Homo sapiens
ctggaggcagggcct

SEQ ID NO: 3755637 - DNA, 16 bp, Homo sapiens
ctggaggcagggcctt

SEQ ID NO: 3755638 - DNA, 15 bp, Homo sapiens
ctggaggcctctggg

SEQ ID NO: 3755639 - DNA, 16 bp, Homo sapiens
ctggaggcctctgggc

SEQ ID NO: 3755640 - DNA, 22 bp, Homo sapiens
ctggaggcctctgggcctcctc

SEQ ID NO: 3755641 - DNA, 15 bp, Homo sapiens
ctggaggggacgctg

SEQ ID NO: 3755642 - DNA, 16 bp, Homo sapiens
ctggaggggacgctgg

SEQ ID NO: 3755643 - DNA, 16 bp, Homo sapiens
ctggagtccagtctct

SEQ ID NO: 3755644 - DNA, 16 bp, Homo sapiens
ctggagtgcagtgagc

SEQ ID NO: 3755645 - DNA, 17 bp, Homo sapiens
ctggagtgcagtgagcc

SEQ ID NO: 3755646 - DNA, 20 bp, Homo sapiens
ctggagtgcagtgagccgag

SEQ ID NO: 3755647 - DNA, 13 bp, Homo sapiens
ctggataaaatga

SEQ ID NO: 3755648 - DNA, 15 bp, Homo sapiens
ctggataattttgca

SEQ ID NO: 3755649 - DNA, 18 bp, Homo sapiens
ctggatagtccgtctctg

SEQ ID NO: 3755650 - DNA, 13 bp, Homo sapiens
ctggatcagtcct

SEQ ID NO: 3755651 - DNA, 20 bp, Homo sapiens
ctggatcagtcctttgatca

SEQ ID NO: 3755652 - DNA, 19 bp, Homo sapiens
ctggatccatcaggccact

SEQ ID NO: 3755653 - DNA, 13 bp, Homo sapiens
ctggatctcccag

SEQ ID NO: 3755654 - DNA, 22 bp, Homo sapiens
ctggcaaacatgaaaaatcggc

SEQ ID NO: 3755655 - DNA, 15 bp, Homo sapiens
ctggcaatagtgtgt

SEQ ID NO: 3755656 - DNA, 19 bp, Homo sapiens
ctggcaatagtgtgttctg

SEQ ID NO: 3755657 - DNA, 15 bp, Homo sapiens
ctggcacagggcagt

SEQ ID NO: 3755658 - DNA, 17 bp, Homo sapiens
ctggcacagggcagtgg

SEQ ID NO: 3755659 - DNA, 19 bp, Homo sapiens
ctggcacatttccccagac

SEQ ID NO: 3755660 - DNA, 16 bp, Homo sapiens
ctggcactataatgta

SEQ ID NO: 3755661 - DNA, 23 bp, Homo sapiens
ctggcactataatgtaagctcta

SEQ ID NO: 3755662 - DNA, 17 bp, Homo sapiens
ctggcagccgtgccttc

SEQ ID NO: 3755663 - DNA, 22 bp, Homo sapiens
ctggcagccgtgccttcagctc

SEQ ID NO: 3755664 - DNA, 15 bp, Homo sapiens
ctggcagttttccat

SEQ ID NO: 3755665 - DNA, 14 bp, Homo sapiens
ctggcatctttgct

SEQ ID NO: 3755666 - DNA, 19 bp, Homo sapiens
ctggcatggcacctgtcgc

SEQ ID NO: 3755667 - DNA, 15 bp, Homo sapiens
ctggcattacagctg

SEQ ID NO: 3755668 - DNA, 17 bp, Homo sapiens
ctggccaacatggtaaa

SEQ ID NO: 3755669 - DNA, 19 bp, Homo sapiens
ctggccagatgcaccagcc

SEQ ID NO: 3755670 - DNA, 20 bp, Homo sapiens
ctggccagatgcaccagccc

SEQ ID NO: 3755671 - DNA, 21 bp, Homo sapiens
ctggccagatgcaccagccct

SEQ ID NO: 3755672 - DNA, 12 bp, Homo sapiens
ctggccaggagc

SEQ ID NO: 3755673 - DNA, 15 bp, Homo sapiens
ctggccaggagctct

SEQ ID NO: 3755674 - DNA, 11 bp, Homo sapiens
ctggccaggca

SEQ ID NO: 3755675 - DNA, 13 bp, Homo sapiens
ctggccaggcaga

SEQ ID NO: 3755676 - DNA, 14 bp, Homo sapiens
ctggccaggcagat

SEQ ID NO: 3755677 - DNA, 21 bp, Homo sapiens
ctggccaggcagatctgtgcc

SEQ ID NO: 3755678 - DNA, 22 bp, Homo sapiens
ctggccaggcagatctgtgccc

SEQ ID NO: 3755679 - DNA, 17 bp, Homo sapiens
ctggccagttggaacca

SEQ ID NO: 3755680 - DNA, 13 bp, Homo sapiens
ctggcccagccaa

SEQ ID NO: 3755681 - DNA, 20 bp, Homo sapiens
ctggcccagccaaaccctgt

SEQ ID NO: 3755682 - DNA, 23 bp, Homo sapiens
ctggcccagccaaaccctgtctg

SEQ ID NO: 3755683 - DNA, 15 bp, Homo sapiens
ctggcccccactggc

SEQ ID NO: 3755684 - DNA, 23 bp, Homo sapiens
ctggcccccactggctgtgggct

SEQ ID NO: 3755685 - DNA, 12 bp, Homo sapiens
ctggcccctcac

SEQ ID NO: 3755686 - DNA, 15 bp, Homo sapiens
ctggcccctcacctg

SEQ ID NO: 3755687 - DNA, 22 bp, Homo sapiens
ctggcccgtcatgttcctcaaa

SEQ ID NO: 3755688 - DNA, 21 bp, Homo sapiens
ctggccctcacccctgccctg

SEQ ID NO: 3755689 - DNA, 22 bp, Homo sapiens
ctggccctcacccctgccctgg

SEQ ID NO: 3755690 - DNA, 16 bp, Homo sapiens
ctggccctcagtttcc

SEQ ID NO: 3755691 - DNA, 13 bp, Homo sapiens
ctggccctcttct

SEQ ID NO: 3755692 - DNA, 12 bp, Homo sapiens
ctggccctgcct

SEQ ID NO: 3755693 - DNA, 14 bp, Homo sapiens
ctggccctgccttc

SEQ ID NO: 3755694 - DNA, 14 bp, Homo sapiens
ctggccctggggcc

SEQ ID NO: 3755695 - DNA, 12 bp, Homo sapiens
ctggcccttcct

SEQ ID NO: 3755696 - DNA, 17 bp, Homo sapiens
ctggccgagggtcctgg

SEQ ID NO: 3755697 - DNA, 14 bp, Homo sapiens
ctggccgggcacag

SEQ ID NO: 3755698 - DNA, 20 bp, Homo sapiens
ctggccgggcacagctgtgg

SEQ ID NO: 3755699 - DNA, 21 bp, Homo sapiens
ctggcctcagactcatacaga

SEQ ID NO: 3755700 - DNA, 17 bp, Homo sapiens
ctggcctctgtcatatc

SEQ ID NO: 3755701 - DNA, 12 bp, Homo sapiens
ctggcctgagga

SEQ ID NO: 3755702 - DNA, 12 bp, Homo sapiens
ctggcctgttct

SEQ ID NO: 3755703 - DNA, 13 bp, Homo sapiens
ctggccttacacc

SEQ ID NO: 3755704 - DNA, 19 bp, Homo sapiens
ctggccttgaaaccacctt

SEQ ID NO: 3755705 - DNA, 19 bp, Homo sapiens
ctggcgacagttttccttc

SEQ ID NO: 3755706 - DNA, 18 bp, Homo sapiens
ctggcggctactcagcag

SEQ ID NO: 3755707 - DNA, 23 bp, Homo sapiens
ctggcggctactcagcagccctc

SEQ ID NO: 3755708 - DNA, 22 bp, Homo sapiens
ctggcgtctgtcttcaagggct

SEQ ID NO: 3755709 - DNA, 16 bp, Homo sapiens
ctggctcacagactgg

SEQ ID NO: 3755710 - DNA, 23 bp, Homo sapiens
ctggctcatattcctgcagcctg

SEQ ID NO: 3755711 - DNA, 18 bp, Homo sapiens
ctggctcccacaggccct

SEQ ID NO: 3755712 - DNA, 22 bp, Homo sapiens
ctggctcccacaggcccttcct

SEQ ID NO: 3755713 - DNA, 16 bp, Homo sapiens
ctggctccgctgtgtg

SEQ ID NO: 3755714 - DNA, 17 bp, Homo sapiens
ctggctcctgaggggca

SEQ ID NO: 3755715 - DNA, 15 bp, Homo sapiens
ctggctctgtggctt

SEQ ID NO: 3755716 - DNA, 21 bp, Homo sapiens
ctggctgaggatttcaagcct

SEQ ID NO: 3755717 - DNA, 22 bp, Homo sapiens
ctggctgaggatttcaagcctg

SEQ ID NO: 3755718 - DNA, 13 bp, Homo sapiens
ctggctgcagtga

SEQ ID NO: 3755719 - DNA, 12 bp, Homo sapiens
ctggctgcccag

SEQ ID NO: 3755720 - DNA, 18 bp, Homo sapiens
ctggctgcccagacccct

SEQ ID NO: 3755721 - DNA, 15 bp, Homo sapiens
ctggctggctgcagt

SEQ ID NO: 3755722 - DNA, 14 bp, Homo sapiens
ctggctgggcatgg

SEQ ID NO: 3755723 - DNA, 16 bp, Homo sapiens
ctggctgggggcctca

SEQ ID NO: 3755724 - DNA, 19 bp, Homo sapiens
ctggctgggggcctcactc

SEQ ID NO: 3755725 - DNA, 19 bp, Homo sapiens
ctggctgtcagtatgacat

SEQ ID NO: 3755726 - DNA, 14 bp, Homo sapiens
ctggctgtgggctc

SEQ ID NO: 3755727 - DNA, 16 bp, Homo sapiens
ctggctgtgggctccc

SEQ ID NO: 3755728 - DNA, 14 bp, Homo sapiens
ctggcttctggagc

SEQ ID NO: 3755729 - DNA, 15 bp, Homo sapiens
ctggcttctggagcc

SEQ ID NO: 3755730 - DNA, 16 bp, Homo sapiens
ctggcttctggagccc

SEQ ID NO: 3755731 - DNA, 20 bp, Homo sapiens
ctggcttctggagcccttgg

SEQ ID NO: 3755732 - DNA, 23 bp, Homo sapiens
ctggcttgggactaaatgccctg

SEQ ID NO: 3755733 - DNA, 19 bp, Homo sapiens
ctggcttgtaactccacca

SEQ ID NO: 3755734 - DNA, 17 bp, Homo sapiens
ctggctttgcccaacct

SEQ ID NO: 3755735 - DNA, 19 bp, Homo sapiens
ctggctttgcccaacctca

SEQ ID NO: 3755736 - DNA, 20 bp, Homo sapiens
ctggctttgtcccacagctt

SEQ ID NO: 3755737 - DNA, 21 bp, Homo sapiens
ctggctttgtcccacagcttg

SEQ ID NO: 3755738 - DNA, 16 bp, Homo sapiens
ctggcttttcactgct

SEQ ID NO: 3755739 - DNA, 17 bp, Homo sapiens
ctggcttttcactgctg

SEQ ID NO: 3755740 - DNA, 23 bp, Homo sapiens
ctggcttttcactgctggctgcc

SEQ ID NO: 3755741 - DNA, 19 bp, Homo sapiens
ctgggaaccttcctgtctt

SEQ ID NO: 3755742 - DNA, 23 bp, Homo sapiens
ctgggaactcccaagaacagcag

SEQ ID NO: 3755743 - DNA, 21 bp, Homo sapiens
ctgggaagataggctctgcac

SEQ ID NO: 3755744 - DNA, 12 bp, Homo sapiens
ctgggaaggggt

SEQ ID NO: 3755745 - DNA, 13 bp, Homo sapiens
ctgggaatgtatt

SEQ ID NO: 3755746 - DNA, 18 bp, Homo sapiens
ctgggaatgtattattct

SEQ ID NO: 3755747 - DNA, 11 bp, Homo sapiens
ctgggacacag

SEQ ID NO: 3755748 - DNA, 23 bp, Homo sapiens
ctgggacacttaacagatgcaat

SEQ ID NO: 3755749 - DNA, 22 bp, Homo sapiens
ctgggaccacaggttcatgcca

SEQ ID NO: 3755750 - DNA, 14 bp, Homo sapiens
ctgggaccctttcc

SEQ ID NO: 3755751 - DNA, 20 bp, Homo sapiens
ctgggaccctttccttcctt

SEQ ID NO: 3755752 - DNA, 23 bp, Homo sapiens
ctgggaccctttccttccttccc

SEQ ID NO: 3755753 - DNA, 21 bp, Homo sapiens
ctgggactacaggcacccacc

SEQ ID NO: 3755754 - DNA, 13 bp, Homo sapiens
ctgggactggcca

SEQ ID NO: 3755755 - DNA, 14 bp, Homo sapiens
ctgggagaacctca

SEQ ID NO: 3755756 - DNA, 14 bp, Homo sapiens
ctgggagctctgca

SEQ ID NO: 3755757 - DNA, 13 bp, Homo sapiens
ctgggaggaagca

SEQ ID NO: 3755758 - DNA, 21 bp, Homo sapiens
ctgggaggtcaaggctgcagt

SEQ ID NO: 3755759 - DNA, 16 bp, Homo sapiens
ctgggatctgactgca

SEQ ID NO: 3755760 - DNA, 21 bp, Homo sapiens
ctgggatgtccacagatgcct

SEQ ID NO: 3755761 - DNA, 17 bp, Homo sapiens
ctgggattacaggtgtg

SEQ ID NO: 3755762 - DNA, 17 bp, Homo sapiens
ctgggcacctggggagt

SEQ ID NO: 3755763 - DNA, 16 bp, Homo sapiens
ctgggcagaaggccaa

SEQ ID NO: 3755764 - DNA, 17 bp, Homo sapiens
ctgggcagcatagcaag

SEQ ID NO: 3755765 - DNA, 16 bp, Homo sapiens
ctgggcagccaggctg

SEQ ID NO: 3755766 - DNA, 18 bp, Homo sapiens
ctgggcagccaggctgcc

SEQ ID NO: 3755767 - DNA, 21 bp, Homo sapiens
ctgggcagctgttagagtcca

SEQ ID NO: 3755768 - DNA, 20 bp, Homo sapiens
ctgggcaggttggtgggggc

SEQ ID NO: 3755769 - DNA, 19 bp, Homo sapiens
ctgggccaactcacctgag

SEQ ID NO: 3755770 - DNA, 19 bp, Homo sapiens
ctgggccaagccagggatg

SEQ ID NO: 3755771 - DNA, 14 bp, Homo sapiens
ctgggcccagaagg

SEQ ID NO: 3755772 - DNA, 19 bp, Homo sapiens
ctgggcccagaggcacagc

SEQ ID NO: 3755773 - DNA, 20 bp, Homo sapiens
ctgggcccagaggcacagcc

SEQ ID NO: 3755774 - DNA, 14 bp, Homo sapiens
ctgggccccaccac

SEQ ID NO: 3755775 - DNA, 18 bp, Homo sapiens
ctgggccccaccacctag

SEQ ID NO: 3755776 - DNA, 19 bp, Homo sapiens
ctgggcccctccctacctc

SEQ ID NO: 3755777 - DNA, 20 bp, Homo sapiens
ctgggcccctccctacctca

SEQ ID NO: 3755778 - DNA, 23 bp, Homo sapiens
ctgggcctcctctaacaggggct

SEQ ID NO: 3755779 - DNA, 24 bp, Homo sapiens
ctgggcctcctctaacaggggctg

SEQ ID NO: 3755780 - DNA, 13 bp, Homo sapiens
ctgggctctccac

SEQ ID NO: 3755781 - DNA, 18 bp, Homo sapiens
ctgggctctccacctcag

SEQ ID NO: 3755782 - DNA, 19 bp, Homo sapiens
ctgggctctccacctcagc

SEQ ID NO: 3755783 - DNA, 19 bp, Homo sapiens
ctgggctgctacccagaaa

SEQ ID NO: 3755784 - DNA, 12 bp, Homo sapiens
ctgggctgtgtg

SEQ ID NO: 3755785 - DNA, 21 bp, Homo sapiens
ctgggcttcagtggcagctgc

SEQ ID NO: 3755786 - DNA, 22 bp, Homo sapiens
ctgggcttcagtggcagctgct

SEQ ID NO: 3755787 - DNA, 23 bp, Homo sapiens
ctgggcttcagtggcagctgctt

SEQ ID NO: 3755788 - DNA, 19 bp, Homo sapiens
ctgggcttggggcttccta

SEQ ID NO: 3755789 - DNA, 18 bp, Homo sapiens
ctgggcttgtctgtagat

SEQ ID NO: 3755790 - DNA, 20 bp, Homo sapiens
ctgggctttgattccatctc

SEQ ID NO: 3755791 - DNA, 17 bp, Homo sapiens
ctggggaaataacagct

SEQ ID NO: 3755792 - DNA, 22 bp, Homo sapiens
ctggggaaataacagctgtggc

SEQ ID NO: 3755793 - DNA, 18 bp, Homo sapiens
ctggggatactggcaaag

SEQ ID NO: 3755794 - DNA, 20 bp, Homo sapiens
ctggggcctcggagcctcat

SEQ ID NO: 3755795 - DNA, 23 bp, Homo sapiens
ctggggcctcggagcctcatccg

SEQ ID NO: 3755796 - DNA, 12 bp, Homo sapiens
ctggggcctctt

SEQ ID NO: 3755797 - DNA, 19 bp, Homo sapiens
ctggggctaggctggagcc

SEQ ID NO: 3755798 - DNA, 14 bp, Homo sapiens
ctggggctctgtgc

SEQ ID NO: 3755799 - DNA, 19 bp, Homo sapiens
ctggggctctgtgcaggga

SEQ ID NO: 3755800 - DNA, 16 bp, Homo sapiens
ctggggctgatctcag

SEQ ID NO: 3755801 - DNA, 14 bp, Homo sapiens
ctgggggaagccct

SEQ ID NO: 3755802 - DNA, 16 bp, Homo sapiens
ctgggggaagccctgg

SEQ ID NO: 3755803 - DNA, 12 bp, Homo sapiens
ctgggggcctca

SEQ ID NO: 3755804 - DNA, 13 bp, Homo sapiens
ctgggggcctcag

SEQ ID NO: 3755805 - DNA, 17 bp, Homo sapiens
ctgggggcctcagtgcc

SEQ ID NO: 3755806 - DNA, 15 bp, Homo sapiens
ctgggggcctgacct

SEQ ID NO: 3755807 - DNA, 20 bp, Homo sapiens
ctgggggttctttcttcctc

SEQ ID NO: 3755808 - DNA, 23 bp, Homo sapiens
ctggggtgccctccactgccctc

SEQ ID NO: 3755809 - DNA, 19 bp, Homo sapiens
ctggggtgtgggaggcccg

SEQ ID NO: 3755810 - DNA, 20 bp, Homo sapiens
ctggggttcagcccctcctc

SEQ ID NO: 3755811 - DNA, 16 bp, Homo sapiens
ctgggtacttgtggac

SEQ ID NO: 3755812 - DNA, 20 bp, Homo sapiens
ctgggtacttgtggacacag

SEQ ID NO: 3755813 - DNA, 15 bp, Homo sapiens
ctgggtctgtgtctc

SEQ ID NO: 3755814 - DNA, 14 bp, Homo sapiens
ctgggtgcagctga

SEQ ID NO: 3755815 - DNA, 16 bp, Homo sapiens
ctgggtgcccacagcc

SEQ ID NO: 3755816 - DNA, 19 bp, Homo sapiens
ctgggtgcccacagcccgc

SEQ ID NO: 3755817 - DNA, 21 bp, Homo sapiens
ctgggtggcaccagcagcctg

SEQ ID NO: 3755818 - DNA, 17 bp, Homo sapiens
ctgggtggggctgctcc

SEQ ID NO: 3755819 - DNA, 16 bp, Homo sapiens
ctgggtggttgccctt

SEQ ID NO: 3755820 - DNA, 19 bp, Homo sapiens
ctgggtgtattaggactgg

SEQ ID NO: 3755821 - DNA, 15 bp, Homo sapiens
ctgggttcactgcaa

SEQ ID NO: 3755822 - DNA, 18 bp, Homo sapiens
ctgggttcactgcaacct

SEQ ID NO: 3755823 - DNA, 16 bp, Homo sapiens
ctgggttccctttcct

SEQ ID NO: 3755824 - DNA, 21 bp, Homo sapiens
ctgggttccctttccttccat

SEQ ID NO: 3755825 - DNA, 16 bp, Homo sapiens
ctgggttctgggtggt

SEQ ID NO: 3755826 - DNA, 13 bp, Homo sapiens
ctgggttggaaaa

SEQ ID NO: 3755827 - DNA, 15 bp, Homo sapiens
ctggtaagggccaag

SEQ ID NO: 3755828 - DNA, 20 bp, Homo sapiens
ctggtagacacaggatagat

SEQ ID NO: 3755829 - DNA, 14 bp, Homo sapiens
ctggtagatagaaa

SEQ ID NO: 3755830 - DNA, 21 bp, Homo sapiens
ctggtagttagtagcatgttg

SEQ ID NO: 3755831 - DNA, 12 bp, Homo sapiens
ctggtatttcct

SEQ ID NO: 3755832 - DNA, 18 bp, Homo sapiens
ctggtcacaggactctgc

SEQ ID NO: 3755833 - DNA, 21 bp, Homo sapiens
ctggtcacaggactctgcctc

SEQ ID NO: 3755834 - DNA, 14 bp, Homo sapiens
ctggtcactgccat

SEQ ID NO: 3755835 - DNA, 21 bp, Homo sapiens
ctggtccagggaagctggccg

SEQ ID NO: 3755836 - DNA, 22 bp, Homo sapiens
ctggtccagggaagctggccga

SEQ ID NO: 3755837 - DNA, 16 bp, Homo sapiens
ctggtccatgatggag

SEQ ID NO: 3755838 - DNA, 15 bp, Homo sapiens
ctggtcccactcagt

SEQ ID NO: 3755839 - DNA, 21 bp, Homo sapiens
ctggtctcaaactcctgggct

SEQ ID NO: 3755840 - DNA, 23 bp, Homo sapiens
ctggtctcaaactcttgacctca

SEQ ID NO: 3755841 - DNA, 20 bp, Homo sapiens
ctggtctcctgcccccacac

SEQ ID NO: 3755842 - DNA, 22 bp, Homo sapiens
ctggtctcctgcccccacacct

SEQ ID NO: 3755843 - DNA, 14 bp, Homo sapiens
ctggtcttgagatg

SEQ ID NO: 3755844 - DNA, 15 bp, Homo sapiens
ctggtcttgagatgt

SEQ ID NO: 3755845 - DNA, 18 bp, Homo sapiens
ctggtcttgtggaattgg

SEQ ID NO: 3755846 - DNA, 15 bp, Homo sapiens
ctggtgacaccagcc

SEQ ID NO: 3755847 - DNA, 16 bp, Homo sapiens
ctggtgacaccagcct

SEQ ID NO: 3755848 - DNA, 13 bp, Homo sapiens
ctggtgaggaagc

SEQ ID NO: 3755849 - DNA, 18 bp, Homo sapiens
ctggtgaggaagctccag

SEQ ID NO: 3755850 - DNA, 14 bp, Homo sapiens
ctggtgaggagcac

SEQ ID NO: 3755851 - DNA, 19 bp, Homo sapiens
ctggtgcattacagagagg

SEQ ID NO: 3755852 - DNA, 20 bp, Homo sapiens
ctggtgctgccacacttcag

SEQ ID NO: 3755853 - DNA, 22 bp, Homo sapiens
ctggtgctgccacacttcaggc

SEQ ID NO: 3755854 - DNA, 14 bp, Homo sapiens
ctggtgctgctgct

SEQ ID NO: 3755855 - DNA, 20 bp, Homo sapiens
ctggtgctggatattttcaa

SEQ ID NO: 3755856 - DNA, 12 bp, Homo sapiens
ctggtggacagt

SEQ ID NO: 3755857 - DNA, 16 bp, Homo sapiens
ctggtggacagtcctg

SEQ ID NO: 3755858 - DNA, 17 bp, Homo sapiens
ctggtggacagtcctgg

SEQ ID NO: 3755859 - DNA, 18 bp, Homo sapiens
ctggtggcagtgggagct

SEQ ID NO: 3755860 - DNA, 16 bp, Homo sapiens
ctggtggcccctgcct

SEQ ID NO: 3755861 - DNA, 23 bp, Homo sapiens
ctggtgggatctgtgcccagaga

SEQ ID NO: 3755862 - DNA, 20 bp, Homo sapiens
ctggttagctcagccccagc

SEQ ID NO: 3755863 - DNA, 18 bp, Homo sapiens
ctggttcctgctagaaat

SEQ ID NO: 3755864 - DNA, 13 bp, Homo sapiens
ctggttgtcattt

SEQ ID NO: 3755865 - DNA, 14 bp, Homo sapiens
ctgtaaaactttat

SEQ ID NO: 3755866 - DNA, 15 bp, Homo sapiens
ctgtaaaatgaaatt

SEQ ID NO: 3755867 - DNA, 12 bp, Homo sapiens
ctgtaaagaatt

SEQ ID NO: 3755868 - DNA, 17 bp, Homo sapiens
ctgtaaattattttaaa

SEQ ID NO: 3755869 - DNA, 18 bp, Homo sapiens
ctgtaaattattttaaat

SEQ ID NO: 3755870 - DNA, 22 bp, Homo sapiens
ctgtaagaagagactgggaaga

SEQ ID NO: 3755871 - DNA, 23 bp, Homo sapiens
ctgtaagaagagactgggaagat

SEQ ID NO: 3755872 - DNA, 17 bp, Homo sapiens
ctgtaagctctttgaaa

SEQ ID NO: 3755873 - DNA, 15 bp, Homo sapiens
ctgtacaaagtagaa

SEQ ID NO: 3755874 - DNA, 14 bp, Homo sapiens
ctgtacaatattta

SEQ ID NO: 3755875 - DNA, 20 bp, Homo sapiens
ctgtacagattgctgcttct

SEQ ID NO: 3755876 - DNA, 22 bp, Homo sapiens
ctgtacagattgctgcttctgc

SEQ ID NO: 3755877 - DNA, 16 bp, Homo sapiens
ctgtacatactttttc

SEQ ID NO: 3755878 - DNA, 19 bp, Homo sapiens
ctgtacatactttttcaag

SEQ ID NO: 3755879 - DNA, 19 bp, Homo sapiens
ctgtactcctcccaggcgc

SEQ ID NO: 3755880 - DNA, 21 bp, Homo sapiens
ctgtactcctcccaggcgccc

SEQ ID NO: 3755881 - DNA, 13 bp, Homo sapiens
ctgtactggagag

SEQ ID NO: 3755882 - DNA, 18 bp, Homo sapiens
ctgtactggagagcaaca

SEQ ID NO: 3755883 - DNA, 15 bp, Homo sapiens
ctgtacttcaagtta

SEQ ID NO: 3755884 - DNA, 17 bp, Homo sapiens
ctgtacttgatgacaga

SEQ ID NO: 3755885 - DNA, 21 bp, Homo sapiens
ctgtagattgcttctgtagta

SEQ ID NO: 3755886 - DNA, 18 bp, Homo sapiens
ctgtagcattacagtggg

SEQ ID NO: 3755887 - DNA, 20 bp, Homo sapiens
ctgtaggttcatgcccaagc

SEQ ID NO: 3755888 - DNA, 20 bp, Homo sapiens
ctgtagtaaactatttatct

SEQ ID NO: 3755889 - DNA, 21 bp, Homo sapiens
ctgtagtactccttaagaaca

SEQ ID NO: 3755890 - DNA, 14 bp, Homo sapiens
ctgtagtcccagct

SEQ ID NO: 3755891 - DNA, 23 bp, Homo sapiens
ctgtagtcctagccactcaggag

SEQ ID NO: 3755892 - DNA, 13 bp, Homo sapiens
ctgtagttaggaa

SEQ ID NO: 3755893 - DNA, 14 bp, Homo sapiens
ctgtagttaggaaa

SEQ ID NO: 3755894 - DNA, 18 bp, Homo sapiens
ctgtagttaggaaataaa

SEQ ID NO: 3755895 - DNA, 15 bp, Homo sapiens
ctgtatatacaataa

SEQ ID NO: 3755896 - DNA, 14 bp, Homo sapiens
ctgtatcccatgag

SEQ ID NO: 3755897 - DNA, 18 bp, Homo sapiens
ctgtatcccatgagcctc

SEQ ID NO: 3755898 - DNA, 18 bp, Homo sapiens
ctgtcaaacaaagccaga

SEQ ID NO: 3755899 - DNA, 14 bp, Homo sapiens
ctgtcaagttaaca

SEQ ID NO: 3755900 - DNA, 19 bp, Homo sapiens
ctgtcaagttaacaaggaa

SEQ ID NO: 3755901 - DNA, 19 bp, Homo sapiens
ctgtcactgtttctctgct

SEQ ID NO: 3755902 - DNA, 21 bp, Homo sapiens
ctgtcagatgggaagacatga

SEQ ID NO: 3755903 - DNA, 15 bp, Homo sapiens
ctgtcagtgcagccc

SEQ ID NO: 3755904 - DNA, 16 bp, Homo sapiens
ctgtcatatcttcaca

SEQ ID NO: 3755905 - DNA, 21 bp, Homo sapiens
ctgtcatctaccttttctctt

SEQ ID NO: 3755906 - DNA, 14 bp, Homo sapiens
ctgtcatttgagca

SEQ ID NO: 3755907 - DNA, 16 bp, Homo sapiens
ctgtcatttgagcagg

SEQ ID NO: 3755908 - DNA, 21 bp, Homo sapiens
ctgtcatttgagcagggctca

SEQ ID NO: 3755909 - DNA, 16 bp, Homo sapiens
ctgtcattttttttct

SEQ ID NO: 3755910 - DNA, 20 bp, Homo sapiens
ctgtccaaactgcctaagcc

SEQ ID NO: 3755911 - DNA, 17 bp, Homo sapiens
ctgtccaaaggaggctg

SEQ ID NO: 3755912 - DNA, 15 bp, Homo sapiens
ctgtccagcctgggc

SEQ ID NO: 3755913 - DNA, 18 bp, Homo sapiens
ctgtccaggcactgctgc

SEQ ID NO: 3755914 - DNA, 20 bp, Homo sapiens
ctgtccagggccctgagctc

SEQ ID NO: 3755915 - DNA, 23 bp, Homo sapiens
ctgtccagggccctgagctcggt

SEQ ID NO: 3755916 - DNA, 13 bp, Homo sapiens
ctgtcccacctca

SEQ ID NO: 3755917 - DNA, 22 bp, Homo sapiens
ctgtccccctgagatcagagtc

SEQ ID NO: 3755918 - DNA, 19 bp, Homo sapiens
ctgtccctagtaaaaatac

SEQ ID NO: 3755919 - DNA, 12 bp, Homo sapiens
ctgtccctcact

SEQ ID NO: 3755920 - DNA, 16 bp, Homo sapiens
ctgtccctctcaggca

SEQ ID NO: 3755921 - DNA, 14 bp, Homo sapiens
ctgtccctggccat

SEQ ID NO: 3755922 - DNA, 17 bp, Homo sapiens
ctgtccctgtcaccaag

SEQ ID NO: 3755923 - DNA, 17 bp, Homo sapiens
ctgtccgccctcttccc

SEQ ID NO: 3755924 - DNA, 18 bp, Homo sapiens
ctgtccgtttactccaag

SEQ ID NO: 3755925 - DNA, 16 bp, Homo sapiens
ctgtcctactctgtgt

SEQ ID NO: 3755926 - DNA, 18 bp, Homo sapiens
ctgtcctactctgtgtca

SEQ ID NO: 3755927 - DNA, 17 bp, Homo sapiens
ctgtcctcagcttctta

SEQ ID NO: 3755928 - DNA, 23 bp, Homo sapiens
ctgtcctcctcggatcaccgaga

SEQ ID NO: 3755929 - DNA, 20 bp, Homo sapiens
ctgtcctctttcagaaaaca

SEQ ID NO: 3755930 - DNA, 19 bp, Homo sapiens
ctgtccttacccatctgca

SEQ ID NO: 3755931 - DNA, 23 bp, Homo sapiens
ctgtccttctctcacctcctaaa

SEQ ID NO: 3755932 - DNA, 22 bp, Homo sapiens
ctgtcctttccagtggcctggc

SEQ ID NO: 3755933 - DNA, 13 bp, Homo sapiens
ctgtcgcccagtc

SEQ ID NO: 3755934 - DNA, 15 bp, Homo sapiens
ctgtcgcccagtctg

SEQ ID NO: 3755935 - DNA, 16 bp, Homo sapiens
ctgtcgcccagtctgg

SEQ ID NO: 3755936 - DNA, 17 bp, Homo sapiens
ctgtcggagccctgtct

SEQ ID NO: 3755937 - DNA, 23 bp, Homo sapiens
ctgtcggagccctgtctcctctc

SEQ ID NO: 3755938 - DNA, 15 bp, Homo sapiens
ctgtcgtgccagtcc

SEQ ID NO: 3755939 - DNA, 13 bp, Homo sapiens
ctgtctaccatct

SEQ ID NO: 3755940 - DNA, 15 bp, Homo sapiens
ctgtctaccatctcc

SEQ ID NO: 3755941 - DNA, 23 bp, Homo sapiens
ctgtctaggtcagtacccacctg

SEQ ID NO: 3755942 - DNA, 16 bp, Homo sapiens
ctgtctcaaaaaaaga

SEQ ID NO: 3755943 - DNA, 18 bp, Homo sapiens
ctgtctcaaaaaaagaaa

SEQ ID NO: 3755944 - DNA, 20 bp, Homo sapiens
ctgtctcaagagggcactgg

SEQ ID NO: 3755945 - DNA, 23 bp, Homo sapiens
ctgtctcaagagggcactggtgg

SEQ ID NO: 3755946 - DNA, 19 bp, Homo sapiens
ctgtctcatccccaggggt

SEQ ID NO: 3755947 - DNA, 20 bp, Homo sapiens
ctgtctcatccccaggggtc

SEQ ID NO: 3755948 - DNA, 12 bp, Homo sapiens
ctgtctccagac

SEQ ID NO: 3755949 - DNA, 20 bp, Homo sapiens
ctgtctccctataatgctgg

SEQ ID NO: 3755950 - DNA, 17 bp, Homo sapiens
ctgtctcctctctctgt

SEQ ID NO: 3755951 - DNA, 17 bp, Homo sapiens
ctgtctgccagccagca

SEQ ID NO: 3755952 - DNA, 15 bp, Homo sapiens
ctgtcttaattaagt

SEQ ID NO: 3755953 - DNA, 23 bp, Homo sapiens
ctgtcttaattaagtaaactaat

SEQ ID NO: 3755954 - DNA, 23 bp, Homo sapiens
ctgtcttcacagctctgtgttgc

SEQ ID NO: 3755955 - DNA, 15 bp, Homo sapiens
ctgtcttccaaggag

SEQ ID NO: 3755956 - DNA, 16 bp, Homo sapiens
ctgtctttcagataca

SEQ ID NO: 3755957 - DNA, 12 bp, Homo sapiens
ctgtgaaatagt

SEQ ID NO: 3755958 - DNA, 16 bp, Homo sapiens
ctgtgaacgatttaga

SEQ ID NO: 3755959 - DNA, 15 bp, Homo sapiens
ctgtgaacttgggga

SEQ ID NO: 3755960 - DNA, 14 bp, Homo sapiens
ctgtgaccagcact

SEQ ID NO: 3755961 - DNA, 18 bp, Homo sapiens
ctgtgaccaggaaggaag

SEQ ID NO: 3755962 - DNA, 14 bp, Homo sapiens
ctgtgaccatttat

SEQ ID NO: 3755963 - DNA, 17 bp, Homo sapiens
ctgtgaccatttataat

SEQ ID NO: 3755964 - DNA, 16 bp, Homo sapiens
ctgtgacctgccccgc

SEQ ID NO: 3755965 - DNA, 13 bp, Homo sapiens
ctgtgacctgtgg

SEQ ID NO: 3755966 - DNA, 14 bp, Homo sapiens
ctgtgagaccccca

SEQ ID NO: 3755967 - DNA, 18 bp, Homo sapiens
ctgtgagacccccacacc

SEQ ID NO: 3755968 - DNA, 13 bp, Homo sapiens
ctgtgaggcaggg

SEQ ID NO: 3755969 - DNA, 18 bp, Homo sapiens
ctgtgaggcaggggcgga

SEQ ID NO: 3755970 - DNA, 14 bp, Homo sapiens
ctgtgagtgtaagt

SEQ ID NO: 3755971 - DNA, 19 bp, Homo sapiens
ctgtgagtgtaagtgtgag

SEQ ID NO: 3755972 - DNA, 20 bp, Homo sapiens
ctgtgagtgtaagtgtgagt

SEQ ID NO: 3755973 - DNA, 14 bp, Homo sapiens
ctgtgatgccacac

SEQ ID NO: 3755974 - DNA, 16 bp, Homo sapiens
ctgtgattgtgcctac

SEQ ID NO: 3755975 - DNA, 16 bp, Homo sapiens
ctgtgcaaatccttga

SEQ ID NO: 3755976 - DNA, 11 bp, Homo sapiens
ctgtgcaataa

SEQ ID NO: 3755977 - DNA, 12 bp, Homo sapiens
ctgtgcaataaa

SEQ ID NO: 3755978 - DNA, 21 bp, Homo sapiens
ctgtgcacggccagctgcatc

SEQ ID NO: 3755979 - DNA, 13 bp, Homo sapiens
ctgtgcagggagg

SEQ ID NO: 3755980 - DNA, 23 bp, Homo sapiens
ctgtgcagtggcccccacagaaa

SEQ ID NO: 3755981 - DNA, 20 bp, Homo sapiens
ctgtgcatgggtgaagggag

SEQ ID NO: 3755982 - DNA, 18 bp, Homo sapiens
ctgtgccacccaccaggg

SEQ ID NO: 3755983 - DNA, 14 bp, Homo sapiens
ctgtgccatgtgcc

SEQ ID NO: 3755984 - DNA, 16 bp, Homo sapiens
ctgtgcccagctcagt

SEQ ID NO: 3755985 - DNA, 21 bp, Homo sapiens
ctgtgccccatgcctgtccag

SEQ ID NO: 3755986 - DNA, 13 bp, Homo sapiens
ctgtgcctctgcc

SEQ ID NO: 3755987 - DNA, 19 bp, Homo sapiens
ctgtgcctggagctcctgg

SEQ ID NO: 3755988 - DNA, 16 bp, Homo sapiens
ctgtgcgtgaaacaca

SEQ ID NO: 3755989 - DNA, 16 bp, Homo sapiens
ctgtgctatgaatttt

SEQ ID NO: 3755990 - DNA, 15 bp, Homo sapiens
ctgtgctctggacag

SEQ ID NO: 3755991 - DNA, 22 bp, Homo sapiens
ctgtgctgcccgtcttcagcct

SEQ ID NO: 3755992 - DNA, 13 bp, Homo sapiens
ctgtggaagggac

SEQ ID NO: 3755993 - DNA, 15 bp, Homo sapiens
ctgtggagcccgcac

SEQ ID NO: 3755994 - DNA, 17 bp, Homo sapiens
ctgtggatgataaaaca

SEQ ID NO: 3755995 - DNA, 19 bp, Homo sapiens
ctgtggcaggccagctgtg

SEQ ID NO: 3755996 - DNA, 23 bp, Homo sapiens
ctgtggcaggccagctgtggttt

SEQ ID NO: 3755997 - DNA, 15 bp, Homo sapiens
ctgtggcagtaaaga

SEQ ID NO: 3755998 - DNA, 20 bp, Homo sapiens
ctgtggcagtaaagagaaac

SEQ ID NO: 3755999 - DNA, 23 bp, Homo sapiens
ctgtggccagcttgttatttata

SEQ ID NO: 3756000 - DNA, 11 bp, Homo sapiens
ctgtggcctgg

SEQ ID NO: 3756001 - DNA, 16 bp, Homo sapiens
ctgtggcctgggcaag

SEQ ID NO: 3756002 - DNA, 13 bp, Homo sapiens
ctgtggccttgtt

SEQ ID NO: 3756003 - DNA, 18 bp, Homo sapiens
ctgtggcggtgcctgggt

SEQ ID NO: 3756004 - DNA, 22 bp, Homo sapiens
ctgtgggcacgctgtgggcagg

SEQ ID NO: 3756005 - DNA, 20 bp, Homo sapiens
ctgtgggcaggtgggagctt

SEQ ID NO: 3756006 - DNA, 19 bp, Homo sapiens
ctgtgggcctcaaggactt

SEQ ID NO: 3756007 - DNA, 23 bp, Homo sapiens
ctgtggttacagtgcagacaggc

SEQ ID NO: 3756008 - DNA, 15 bp, Homo sapiens
ctgtgtaacactgtt

SEQ ID NO: 3756009 - DNA, 15 bp, Homo sapiens
ctgtgtatgtacata

SEQ ID NO: 3756010 - DNA, 13 bp, Homo sapiens
ctgtgtatttaat

SEQ ID NO: 3756011 - DNA, 17 bp, Homo sapiens
ctgtgtatttaattgta

SEQ ID NO: 3756012 - DNA, 17 bp, Homo sapiens
ctgtgtcagcatagaag

SEQ ID NO: 3756013 - DNA, 23 bp, Homo sapiens
ctgtgtcaggaaacatatttaag

SEQ ID NO: 3756014 - DNA, 17 bp, Homo sapiens
ctgtgtccaactccagt

SEQ ID NO: 3756015 - DNA, 18 bp, Homo sapiens
ctgtgtccttgcacctgc

SEQ ID NO: 3756016 - DNA, 19 bp, Homo sapiens
ctgtgtccttgcacctgca

SEQ ID NO: 3756017 - DNA, 22 bp, Homo sapiens
ctgtgtccttgcacctgcatcc

SEQ ID NO: 3756018 - DNA, 16 bp, Homo sapiens
ctgtgtcgtagccaag

SEQ ID NO: 3756019 - DNA, 19 bp, Homo sapiens
ctgtgtcttgcaatggcag

SEQ ID NO: 3756020 - DNA, 22 bp, Homo sapiens
ctgtgtcttgcaatggcagcct

SEQ ID NO: 3756021 - DNA, 12 bp, Homo sapiens
ctgtgtgaaata

SEQ ID NO: 3756022 - DNA, 16 bp, Homo sapiens
ctgtgtgcacaaatat

SEQ ID NO: 3756023 - DNA, 22 bp, Homo sapiens
ctgtgtgggactgtacacactt

SEQ ID NO: 3756024 - DNA, 20 bp, Homo sapiens
ctgtgtggtttagtgtaaaa

SEQ ID NO: 3756025 - DNA, 20 bp, Homo sapiens
ctgtgtgtgcgcctacagga

SEQ ID NO: 3756026 - DNA, 18 bp, Homo sapiens
ctgtgtgttttcataata

SEQ ID NO: 3756027 - DNA, 19 bp, Homo sapiens
ctgtgtgttttcataataa

SEQ ID NO: 3756028 - DNA, 13 bp, Homo sapiens
ctgtgttcctggc

SEQ ID NO: 3756029 - DNA, 14 bp, Homo sapiens
ctgtgttgccatgt

SEQ ID NO: 3756030 - DNA, 16 bp, Homo sapiens
ctgttaagtggtttca

SEQ ID NO: 3756031 - DNA, 13 bp, Homo sapiens
ctgttactgtctt

SEQ ID NO: 3756032 - DNA, 15 bp, Homo sapiens
ctgttagaacactat

SEQ ID NO: 3756033 - DNA, 16 bp, Homo sapiens
ctgttagaacactatt

SEQ ID NO: 3756034 - DNA, 17 bp, Homo sapiens
ctgttagaacactattt

SEQ ID NO: 3756035 - DNA, 18 bp, Homo sapiens
ctgttagaacactatttt

SEQ ID NO: 3756036 - DNA, 21 bp, Homo sapiens
ctgttagaacactattttcag

SEQ ID NO: 3756037 - DNA, 23 bp, Homo sapiens
ctgttagaacactattttcagaa

SEQ ID NO: 3756038 - DNA, 15 bp, Homo sapiens
ctgttagctgttatt

SEQ ID NO: 3756039 - DNA, 16 bp, Homo sapiens
ctgttatttctatttt

SEQ ID NO: 3756040 - DNA, 17 bp, Homo sapiens
ctgttatttctattttt

SEQ ID NO: 3756041 - DNA, 12 bp, Homo sapiens
ctgttcaaggaa

SEQ ID NO: 3756042 - DNA, 14 bp, Homo sapiens
ctgttcacccacag

SEQ ID NO: 3756043 - DNA, 18 bp, Homo sapiens
ctgttcacccacagggct

SEQ ID NO: 3756044 - DNA, 16 bp, Homo sapiens
ctgttcacttttcctc

SEQ ID NO: 3756045 - DNA, 16 bp, Homo sapiens
ctgttcagctccagct

SEQ ID NO: 3756046 - DNA, 13 bp, Homo sapiens
ctgttcattgtaa

SEQ ID NO: 3756047 - DNA, 14 bp, Homo sapiens
ctgttcattgtaag

SEQ ID NO: 3756048 - DNA, 14 bp, Homo sapiens
ctgttcatttgtta

SEQ ID NO: 3756049 - DNA, 17 bp, Homo sapiens
ctgttgaatttcccaca

SEQ ID NO: 3756050 - DNA, 20 bp, Homo sapiens
ctgttgagctgttttccctg

SEQ ID NO: 3756051 - DNA, 16 bp, Homo sapiens
ctgttgcccaggctgg

SEQ ID NO: 3756052 - DNA, 20 bp, Homo sapiens
ctgttgccctttctgtacca

SEQ ID NO: 3756053 - DNA, 12 bp, Homo sapiens
ctgttgcttttt

SEQ ID NO: 3756054 - DNA, 14 bp, Homo sapiens
ctgttgtcattgct

SEQ ID NO: 3756055 - DNA, 16 bp, Homo sapiens
ctgttgtcattgcttt

SEQ ID NO: 3756056 - DNA, 18 bp, Homo sapiens
ctgttgtcattgctttac

SEQ ID NO: 3756057 - DNA, 17 bp, Homo sapiens
ctgttgttatggaaact

SEQ ID NO: 3756058 - DNA, 22 bp, Homo sapiens
ctgttgttgttaatgaaaatgt

SEQ ID NO: 3756059 - DNA, 23 bp, Homo sapiens
ctgttgttgttaatgaaaatgtc

SEQ ID NO: 3756060 - DNA, 14 bp, Homo sapiens
ctgtttacaagaaa

SEQ ID NO: 3756061 - DNA, 16 bp, Homo sapiens
ctgtttacaagaaaaa

SEQ ID NO: 3756062 - DNA, 17 bp, Homo sapiens
ctgtttacaagaaaaaa

SEQ ID NO: 3756063 - DNA, 18 bp, Homo sapiens
ctgtttacaagaaaaaat

SEQ ID NO: 3756064 - DNA, 15 bp, Homo sapiens
ctgtttatggcctca

SEQ ID NO: 3756065 - DNA, 21 bp, Homo sapiens
ctgtttatggcctcagctgcc

SEQ ID NO: 3756066 - DNA, 11 bp, Homo sapiens
ctgtttgtcat

SEQ ID NO: 3756067 - DNA, 20 bp, Homo sapiens
ctgtttgtttgacaaagaaa

SEQ ID NO: 3756068 - DNA, 21 bp, Homo sapiens
ctgaaagccacgttccttact

SEQ ID NO: 3756069 - DNA, 18 bp, Homo sapiens
ctgaaagccctgagcttt

SEQ ID NO: 3756070 - DNA, 19 bp, Homo sapiens
ctgaaagccctgagctttc

SEQ ID NO: 3756071 - DNA, 22 bp, Homo sapiens
ctgaaagtgtttccttcatttc

SEQ ID NO: 3756072 - DNA, 13 bp, Homo sapiens
ctgaaatttcaga

SEQ ID NO: 3756073 - DNA, 16 bp, Homo sapiens
ctgaacaaaaaataaa

SEQ ID NO: 3756074 - DNA, 14 bp, Homo sapiens
ctgaacaagaattg

SEQ ID NO: 3756075 - DNA, 19 bp, Homo sapiens
ctgaacacttttgttgtaa

SEQ ID NO: 3756076 - DNA, 14 bp, Homo sapiens
ctgaaccatccctg

SEQ ID NO: 3756077 - DNA, 21 bp, Homo sapiens
ctgaacctgggtaactaggga

SEQ ID NO: 3756078 - DNA, 13 bp, Homo sapiens
ctgaacggggaga

SEQ ID NO: 3756079 - DNA, 17 bp, Homo sapiens
ctgaactcgcttctctg

SEQ ID NO: 3756080 - DNA, 19 bp, Homo sapiens
ctgaagactcattcttctg

SEQ ID NO: 3756081 - DNA, 20 bp, Homo sapiens
ctgaagagctattatataaa

SEQ ID NO: 3756082 - DNA, 19 bp, Homo sapiens
ctgaagaggaactgggcct

SEQ ID NO: 3756083 - DNA, 19 bp, Homo sapiens
ctgaagatacatgtctttc

SEQ ID NO: 3756084 - DNA, 16 bp, Homo sapiens
ctgaagatagaagaaa

SEQ ID NO: 3756085 - DNA, 17 bp, Homo sapiens
ctgaagatagaagaaaa

SEQ ID NO: 3756086 - DNA, 22 bp, Homo sapiens
ctgaagcagatgcaaagaggca

SEQ ID NO: 3756087 - DNA, 18 bp, Homo sapiens
ctgaagccgccaggaccg

SEQ ID NO: 3756088 - DNA, 17 bp, Homo sapiens
ctgaagcttattaatgc

SEQ ID NO: 3756089 - DNA, 20 bp, Homo sapiens
ctgaagcttattaatgctaa

SEQ ID NO: 3756090 - DNA, 21 bp, Homo sapiens
ctgaagcttattaatgctaag

SEQ ID NO: 3756091 - DNA, 22 bp, Homo sapiens
ctgaaggaataaattgctcctt

SEQ ID NO: 3756092 - DNA, 20 bp, Homo sapiens
ctgaaggacattgcggacag

SEQ ID NO: 3756093 - DNA, 18 bp, Homo sapiens
ctgaaggctttcagggcc

SEQ ID NO: 3756094 - DNA, 15 bp, Homo sapiens
ctgaaggtaaaattg

SEQ ID NO: 3756095 - DNA, 14 bp, Homo sapiens
ctgaagtcacacag

SEQ ID NO: 3756096 - DNA, 19 bp, Homo sapiens
ctgaagtcacacagtgagt

SEQ ID NO: 3756097 - DNA, 21 bp, Homo sapiens
ctgaagtcacatcacaggaca

SEQ ID NO: 3756098 - DNA, 14 bp, Homo sapiens
ctgaagttggacag

SEQ ID NO: 3756099 - DNA, 15 bp, Homo sapiens
ctgaagttggacagc

SEQ ID NO: 3756100 - DNA, 17 bp, Homo sapiens
ctgaagtttcatttatg

SEQ ID NO: 3756101 - DNA, 11 bp, Homo sapiens
ctgaataataa

SEQ ID NO: 3756102 - DNA, 21 bp, Homo sapiens
ctgaatatttatatttcacta

SEQ ID NO: 3756103 - DNA, 17 bp, Homo sapiens
ctgaatgctctgtgcga

SEQ ID NO: 3756104 - DNA, 19 bp, Homo sapiens
ctgaatggttttcaaaata

SEQ ID NO: 3756105 - DNA, 20 bp, Homo sapiens
ctgaatggttttcaaaataa

SEQ ID NO: 3756106 - DNA, 19 bp, Homo sapiens
ctgaatgttctgacattaa

SEQ ID NO: 3756107 - DNA, 22 bp, Homo sapiens
ctgaatgttctgacattaacag

SEQ ID NO: 3756108 - DNA, 21 bp, Homo sapiens
ctgaattaatgacagagccag

SEQ ID NO: 3756109 - DNA, 16 bp, Homo sapiens
ctgaattgtccccagt

SEQ ID NO: 3756110 - DNA, 16 bp, Homo sapiens
ctgacaaatcaagttt

SEQ ID NO: 3756111 - DNA, 22 bp, Homo sapiens
ctgacaaccaccgctccccagc

SEQ ID NO: 3756112 - DNA, 20 bp, Homo sapiens
ctgacacacagctctgtcct

SEQ ID NO: 3756113 - DNA, 17 bp, Homo sapiens
ctgacacgtccacccca

SEQ ID NO: 3756114 - DNA, 12 bp, Homo sapiens
ctgacagacaca

SEQ ID NO: 3756115 - DNA, 14 bp, Homo sapiens
ctgacagacacagg

SEQ ID NO: 3756116 - DNA, 19 bp, Homo sapiens
ctgacagacacaggcccgg

SEQ ID NO: 3756117 - DNA, 12 bp, Homo sapiens
ctgacagaggag

SEQ ID NO: 3756118 - DNA, 11 bp, Homo sapiens
ctgacaggcaa

SEQ ID NO: 3756119 - DNA, 18 bp, Homo sapiens
ctgacaggcaatgctggc

SEQ ID NO: 3756120 - DNA, 19 bp, Homo sapiens
ctgacaggcaatgctggct

SEQ ID NO: 3756121 - DNA, 18 bp, Homo sapiens
ctgacattaacagttttc

SEQ ID NO: 3756122 - DNA, 20 bp, Homo sapiens
ctgacattaacagttttcca

SEQ ID NO: 3756123 - DNA, 23 bp, Homo sapiens
ctgacattaacagttttccatga

SEQ ID NO: 3756124 - DNA, 21 bp, Homo sapiens
ctgacattgttggccaaagcc

SEQ ID NO: 3756125 - DNA, 22 bp, Homo sapiens
ctgacattgttggccaaagcca

SEQ ID NO: 3756126 - DNA, 17 bp, Homo sapiens
ctgaccagcctccatgc

SEQ ID NO: 3756127 - DNA, 15 bp, Homo sapiens
ctgaccatccactct

SEQ ID NO: 3756128 - DNA, 12 bp, Homo sapiens
ctgacccactgc

SEQ ID NO: 3756129 - DNA, 21 bp, Homo sapiens
ctgacccagccccttgagaaa

SEQ ID NO: 3756130 - DNA, 13 bp, Homo sapiens
ctgacccagtccc

SEQ ID NO: 3756131 - DNA, 15 bp, Homo sapiens
ctgacccagtccctg

SEQ ID NO: 3756132 - DNA, 20 bp, Homo sapiens
ctgacctccctctaatttat

SEQ ID NO: 3756133 - DNA, 21 bp, Homo sapiens
ctgacctccctctaatttatc

SEQ ID NO: 3756134 - DNA, 18 bp, Homo sapiens
ctgacctttgtcatcttt

SEQ ID NO: 3756135 - DNA, 21 bp, Homo sapiens
ctgacctttgtcatctttctt

SEQ ID NO: 3756136 - DNA, 23 bp, Homo sapiens
ctgacctttgtcatctttcttct

SEQ ID NO: 3756137 - DNA, 17 bp, Homo sapiens
ctgacgaggctgggcca

SEQ ID NO: 3756138 - DNA, 19 bp, Homo sapiens
ctgacgaggctgggccaag

SEQ ID NO: 3756139 - DNA, 21 bp, Homo sapiens
ctgacgaggctgggccaagcc

SEQ ID NO: 3756140 - DNA, 19 bp, Homo sapiens
ctgacggcgcccccagtgt

SEQ ID NO: 3756141 - DNA, 20 bp, Homo sapiens
ctgacggcgcccccagtgtg

SEQ ID NO: 3756142 - DNA, 15 bp, Homo sapiens
ctgactcaggcatca

SEQ ID NO: 3756143 - DNA, 22 bp, Homo sapiens
ctgactcccaaagagctgccta

SEQ ID NO: 3756144 - DNA, 15 bp, Homo sapiens
ctgactccttagaga

SEQ ID NO: 3756145 - DNA, 13 bp, Homo sapiens
ctgactctctgtg

SEQ ID NO: 3756146 - DNA, 13 bp, Homo sapiens
ctgactgtggccc

SEQ ID NO: 3756147 - DNA, 16 bp, Homo sapiens
ctgactgttttctctt

SEQ ID NO: 3756148 - DNA, 21 bp, Homo sapiens
ctgacttccccgcattccagg

SEQ ID NO: 3756149 - DNA, 16 bp, Homo sapiens
ctgactttgctctttc

SEQ ID NO: 3756150 - DNA, 18 bp, Homo sapiens
ctgactttgctctttctt

SEQ ID NO: 3756151 - DNA, 22 bp, Homo sapiens
ctgagaaaacgaaactgctcta

SEQ ID NO: 3756152 - DNA, 23 bp, Homo sapiens
ctgagaaaatgagtgactagacg

SEQ ID NO: 3756153 - DNA, 23 bp, Homo sapiens
ctgagaaggtccttaatgatccg

SEQ ID NO: 3756154 - DNA, 23 bp, Homo sapiens
ctgagaatagaaggaaactagct

SEQ ID NO: 3756155 - DNA, 14 bp, Homo sapiens
ctgagactcagaca

SEQ ID NO: 3756156 - DNA, 20 bp, Homo sapiens
ctgagactcagacaggaaag

SEQ ID NO: 3756157 - DNA, 21 bp, Homo sapiens
ctgagactcagacaggaaagg

SEQ ID NO: 3756158 - DNA, 19 bp, Homo sapiens
ctgagagacccaaggagga

SEQ ID NO: 3756159 - DNA, 20 bp, Homo sapiens
ctgagagacccaaggaggaa

SEQ ID NO: 3756160 - DNA, 23 bp, Homo sapiens
ctgagatggaacccttttggccc

SEQ ID NO: 3756161 - DNA, 15 bp, Homo sapiens
ctgagatggccctct

SEQ ID NO: 3756162 - DNA, 15 bp, Homo sapiens
ctgagcaaatgtggc

SEQ ID NO: 3756163 - DNA, 17 bp, Homo sapiens
ctgagcaaatgtggctc

SEQ ID NO: 3756164 - DNA, 20 bp, Homo sapiens
ctgagcaagaccctgtctct

SEQ ID NO: 3756165 - DNA, 15 bp, Homo sapiens
ctgagcacctcccag

SEQ ID NO: 3756166 - DNA, 15 bp, Homo sapiens
ctgagccaaagagaa

SEQ ID NO: 3756167 - DNA, 18 bp, Homo sapiens
ctgagcctacagatgaac

SEQ ID NO: 3756168 - DNA, 12 bp, Homo sapiens
ctgagccttcag

SEQ ID NO: 3756169 - DNA, 15 bp, Homo sapiens
ctgagctcctctggg

SEQ ID NO: 3756170 - DNA, 15 bp, Homo sapiens
ctgagcttctctgtg

SEQ ID NO: 3756171 - DNA, 16 bp, Homo sapiens
ctgagcttggccagaa

SEQ ID NO: 3756172 - DNA, 17 bp, Homo sapiens
ctgagcttggccagaag

SEQ ID NO: 3756173 - DNA, 14 bp, Homo sapiens
ctgagctttctgct

SEQ ID NO: 3756174 - DNA, 17 bp, Homo sapiens
ctgaggaaaggccagct

SEQ ID NO: 3756175 - DNA, 21 bp, Homo sapiens
ctgaggaatcaacagggcagc

SEQ ID NO: 3756176 - DNA, 16 bp, Homo sapiens
ctgaggaattttcttt

SEQ ID NO: 3756177 - DNA, 17 bp, Homo sapiens
ctgaggatcagaaagta

SEQ ID NO: 3756178 - DNA, 22 bp, Homo sapiens
ctgaggatttaagggatggaaa

SEQ ID NO: 3756179 - DNA, 14 bp, Homo sapiens
ctgaggatttcaag

SEQ ID NO: 3756180 - DNA, 18 bp, Homo sapiens
ctgaggatttcaagcctg

SEQ ID NO: 3756181 - DNA, 12 bp, Homo sapiens
ctgaggcaagag

SEQ ID NO: 3756182 - DNA, 12 bp, Homo sapiens
ctcatgtagcaa

SEQ ID NO: 3756183 - DNA, 17 bp, Homo sapiens
ctcattacggctcctct

SEQ ID NO: 3756184 - DNA, 21 bp, Homo sapiens
ctcattagcattttgctaaat

SEQ ID NO: 3756185 - DNA, 15 bp, Homo sapiens
ctcattcaaaagttg

SEQ ID NO: 3756186 - DNA, 22 bp, Homo sapiens
ctcattcaggaaaactgacaga

SEQ ID NO: 3756187 - DNA, 14 bp, Homo sapiens
ctcattcagtatta

SEQ ID NO: 3756188 - DNA, 15 bp, Homo sapiens
ctcattcagtattaa

SEQ ID NO: 3756189 - DNA, 17 bp, Homo sapiens
ctcattcagtattaaag

SEQ ID NO: 3756190 - DNA, 14 bp, Homo sapiens
ctcattccccaggt

SEQ ID NO: 3756191 - DNA, 12 bp, Homo sapiens
ctcattcctgcc

SEQ ID NO: 3756192 - DNA, 16 bp, Homo sapiens
ctcattcctgcctgtc

SEQ ID NO: 3756193 - DNA, 17 bp, Homo sapiens
ctcatttggggtagcta

SEQ ID NO: 3756194 - DNA, 23 bp, Homo sapiens
ctcatttttataatgtcccttca

SEQ ID NO: 3756195 - DNA, 15 bp, Homo sapiens
ctccaaatgagatct

SEQ ID NO: 3756196 - DNA, 14 bp, Homo sapiens
ctccaacctggaca

SEQ ID NO: 3756197 - DNA, 15 bp, Homo sapiens
ctccacagctacctc

SEQ ID NO: 3756198 - DNA, 13 bp, Homo sapiens
ctccaccaaccca

SEQ ID NO: 3756199 - DNA, 14 bp, Homo sapiens
ctccaccacccaaa

SEQ ID NO: 3756200 - DNA, 15 bp, Homo sapiens
ctccaccccactcac

SEQ ID NO: 3756201 - DNA, 15 bp, Homo sapiens
ctccaccctgctctc

SEQ ID NO: 3756202 - DNA, 19 bp, Homo sapiens
ctccaccgctgcctaagtg

SEQ ID NO: 3756203 - DNA, 14 bp, Homo sapiens
ctccacctcagcct

SEQ ID NO: 3756204 - DNA, 18 bp, Homo sapiens
ctccacgttcacccctcc

SEQ ID NO: 3756205 - DNA, 12 bp, Homo sapiens
ctccactccttc

SEQ ID NO: 3756206 - DNA, 19 bp, Homo sapiens
ctccactccttcctgccac

SEQ ID NO: 3756207 - DNA, 22 bp, Homo sapiens
ctccactccttcctgccacctg

SEQ ID NO: 3756208 - DNA, 19 bp, Homo sapiens
ctccactctgactggcaca

SEQ ID NO: 3756209 - DNA, 13 bp, Homo sapiens
ctccactggatgg

SEQ ID NO: 3756210 - DNA, 16 bp, Homo sapiens
ctccagacccccaccc

SEQ ID NO: 3756211 - DNA, 19 bp, Homo sapiens
ctccagacccctggctttt

SEQ ID NO: 3756212 - DNA, 14 bp, Homo sapiens
ctccagccaacccc

SEQ ID NO: 3756213 - DNA, 17 bp, Homo sapiens
ctccagccaacccctgt

SEQ ID NO: 3756214 - DNA, 20 bp, Homo sapiens
ctccagccaacccctgtgga

SEQ ID NO: 3756215 - DNA, 13 bp, Homo sapiens
ctccagcctgagc

SEQ ID NO: 3756216 - DNA, 13 bp, Homo sapiens
ctccagcctgggc

SEQ ID NO: 3756217 - DNA, 14 bp, Homo sapiens
ctccagcctgggca

SEQ ID NO: 3756218 - DNA, 18 bp, Homo sapiens
ctccagctgttcagctgg

SEQ ID NO: 3756219 - DNA, 21 bp, Homo sapiens
ctccaggaaggggctggactg

SEQ ID NO: 3756220 - DNA, 11 bp, Homo sapiens
ctccaggctcc

SEQ ID NO: 3756221 - DNA, 23 bp, Homo sapiens
ctccaggctcctttagcgcccag

SEQ ID NO: 3756222 - DNA, 20 bp, Homo sapiens
ctccaggctgtatcccatga

SEQ ID NO: 3756223 - DNA, 19 bp, Homo sapiens
ctccagggagcaagacaga

SEQ ID NO: 3756224 - DNA, 22 bp, Homo sapiens
ctccagggagcaagacagagac

SEQ ID NO: 3756225 - DNA, 16 bp, Homo sapiens
ctccagggccacgtgc

SEQ ID NO: 3756226 - DNA, 16 bp, Homo sapiens
ctccagtactggagct

SEQ ID NO: 3756227 - DNA, 22 bp, Homo sapiens
ctccagtcctgctctctaccca

SEQ ID NO: 3756228 - DNA, 12 bp, Homo sapiens
ctccagtctgct

SEQ ID NO: 3756229 - DNA, 17 bp, Homo sapiens
ctccagtctgctgccct

SEQ ID NO: 3756230 - DNA, 16 bp, Homo sapiens
ctccagtcttccacct

SEQ ID NO: 3756231 - DNA, 19 bp, Homo sapiens
ctccagtcttccacctgga

SEQ ID NO: 3756232 - DNA, 20 bp, Homo sapiens
ctccagtcttccacctggaa

SEQ ID NO: 3756233 - DNA, 16 bp, Homo sapiens
ctccatcctaccacaa

SEQ ID NO: 3756234 - DNA, 20 bp, Homo sapiens
ctccatcgctgtcatctcag

SEQ ID NO: 3756235 - DNA, 13 bp, Homo sapiens
ctccatctccact

SEQ ID NO: 3756236 - DNA, 13 bp, Homo sapiens
ctccatgctgcct

SEQ ID NO: 3756237 - DNA, 15 bp, Homo sapiens
ctccatggtgcctct

SEQ ID NO: 3756238 - DNA, 19 bp, Homo sapiens
ctccattcctggagcccga

SEQ ID NO: 3756239 - DNA, 23 bp, Homo sapiens
ctcccaagaacagcaggcccacc

SEQ ID NO: 3756240 - DNA, 21 bp, Homo sapiens
ctcccaaggggcccaaattct

SEQ ID NO: 3756241 - DNA, 22 bp, Homo sapiens
ctcccaaggggcccaaattctt

SEQ ID NO: 3756242 - DNA, 14 bp, Homo sapiens
ctcccacaggccct

SEQ ID NO: 3756243 - DNA, 16 bp, Homo sapiens
ctcccacaggcccttc

SEQ ID NO: 3756244 - DNA, 14 bp, Homo sapiens
ctcccaccacagca

SEQ ID NO: 3756245 - DNA, 15 bp, Homo sapiens
ctcccacccccatct

SEQ ID NO: 3756246 - DNA, 19 bp, Homo sapiens
ctcccacccccatctctcc

SEQ ID NO: 3756247 - DNA, 22 bp, Homo sapiens
ctcccacccccttctctgctcc

SEQ ID NO: 3756248 - DNA, 13 bp, Homo sapiens
ctcccacctcagc

SEQ ID NO: 3756249 - DNA, 18 bp, Homo sapiens
ctcccagcccctgcccct

SEQ ID NO: 3756250 - DNA, 11 bp, Homo sapiens
ctcccagcctg

SEQ ID NO: 3756251 - DNA, 20 bp, Homo sapiens
ctcccagctctagacaaccc

SEQ ID NO: 3756252 - DNA, 18 bp, Homo sapiens
ctcccaggaactgggcca

SEQ ID NO: 3756253 - DNA, 17 bp, Homo sapiens
ctcccaggccaggctcc

SEQ ID NO: 3756254 - DNA, 17 bp, Homo sapiens
ctcccaggcgccccttc

SEQ ID NO: 3756255 - DNA, 19 bp, Homo sapiens
ctcccaggcgccccttccc

SEQ ID NO: 3756256 - DNA, 23 bp, Homo sapiens
ctcccagggccagggccctgcag

SEQ ID NO: 3756257 - DNA, 23 bp, Homo sapiens
ctcccagggccttaaaagccatc

SEQ ID NO: 3756258 - DNA, 20 bp, Homo sapiens
ctcccagtccaaatgtcctc

SEQ ID NO: 3756259 - DNA, 18 bp, Homo sapiens
ctcccagttctctaggga

SEQ ID NO: 3756260 - DNA, 21 bp, Homo sapiens
ctcccagttctctagggaagg

SEQ ID NO: 3756261 - DNA, 23 bp, Homo sapiens
ctcccatcttaactctttgcctt

SEQ ID NO: 3756262 - DNA, 21 bp, Homo sapiens
ctcccatgaccatactgaggg

SEQ ID NO: 3756263 - DNA, 19 bp, Homo sapiens
ctccccaaccctgcccctg

SEQ ID NO: 3756264 - DNA, 23 bp, Homo sapiens
ctccccaccttcaattcctgggc

SEQ ID NO: 3756265 - DNA, 20 bp, Homo sapiens
ctccccagcaagtgagagct

SEQ ID NO: 3756266 - DNA, 21 bp, Homo sapiens
ctccccagcaagtgagagctg

SEQ ID NO: 3756267 - DNA, 22 bp, Homo sapiens
ctccccagcaagtgagagctgg

SEQ ID NO: 3756268 - DNA, 23 bp, Homo sapiens
ctccccagcaagtgagagctggg

SEQ ID NO: 3756269 - DNA, 16 bp, Homo sapiens
ctccccagcaggtggg

SEQ ID NO: 3756270 - DNA, 16 bp, Homo sapiens
ctccccagcccagggt

SEQ ID NO: 3756271 - DNA, 21 bp, Homo sapiens
ctccccaggccgtggctgccc

SEQ ID NO: 3756272 - DNA, 11 bp, Homo sapiens
ctccccagggg

SEQ ID NO: 3756273 - DNA, 21 bp, Homo sapiens
ctccccaggggagagggtctg

SEQ ID NO: 3756274 - DNA, 20 bp, Homo sapiens
ctccccatgtgcctgcacca

SEQ ID NO: 3756275 - DNA, 23 bp, Homo sapiens
ctccccctgggctctgccccagc

SEQ ID NO: 3756276 - DNA, 14 bp, Homo sapiens
ctccccgcttctgc

SEQ ID NO: 3756277 - DNA, 20 bp, Homo sapiens
ctcccctaacctcttttctg

SEQ ID NO: 3756278 - DNA, 17 bp, Homo sapiens
ctcccctatccacccag

SEQ ID NO: 3756279 - DNA, 20 bp, Homo sapiens
ctcccctccttgcctcctgt

SEQ ID NO: 3756280 - DNA, 16 bp, Homo sapiens
ctcccctcctttccca

SEQ ID NO: 3756281 - DNA, 21 bp, Homo sapiens
ctcccctctatttagcatgac

SEQ ID NO: 3756282 - DNA, 15 bp, Homo sapiens
ctcccctctgctggc

SEQ ID NO: 3756283 - DNA, 16 bp, Homo sapiens
ctcccctctgctggcc

SEQ ID NO: 3756284 - DNA, 15 bp, Homo sapiens
ctcccctgcactgga

SEQ ID NO: 3756285 - DNA, 12 bp, Homo sapiens
ctcccctgccct

SEQ ID NO: 3756286 - DNA, 13 bp, Homo sapiens
ctcccctgccctg

SEQ ID NO: 3756287 - DNA, 16 bp, Homo sapiens
ctcccctgccctgctg

SEQ ID NO: 3756288 - DNA, 23 bp, Homo sapiens
ctccccttcgcgtatttcaggat

SEQ ID NO: 3756289 - DNA, 16 bp, Homo sapiens
ctccccttgagctgag

SEQ ID NO: 3756290 - DNA, 16 bp, Homo sapiens
ctcccgaatagctggg

SEQ ID NO: 3756291 - DNA, 18 bp, Homo sapiens
ctcccgagtagctgggac

SEQ ID NO: 3756292 - DNA, 22 bp, Homo sapiens
ctcccgggactcactggcagcc

SEQ ID NO: 3756293 - DNA, 23 bp, Homo sapiens
ctcccgggactcactggcagccc

SEQ ID NO: 3756294 - DNA, 15 bp, Homo sapiens
ctcccggtgcccaag

SEQ ID NO: 3756295 - DNA, 13 bp, Homo sapiens
ctccctaccacct

SEQ ID NO: 3756296 - DNA, 14 bp, Homo sapiens
ctccctaccacctc

SEQ ID NO: 3756297 - DNA, 11 bp, Homo sapiens
ctccctacctc

SEQ ID NO: 3756298 - DNA, 16 bp, Homo sapiens
ctccctacctcaacct

SEQ ID NO: 3756299 - DNA, 21 bp, Homo sapiens
ctccctacctcaacctgtaaa

SEQ ID NO: 3756300 - DNA, 22 bp, Homo sapiens
ctccctacctcaacctgtaaat

SEQ ID NO: 3756301 - DNA, 15 bp, Homo sapiens
ctccctcagcccctc

SEQ ID NO: 3756302 - DNA, 16 bp, Homo sapiens
ctccctcagcccctct

SEQ ID NO: 3756303 - DNA, 18 bp, Homo sapiens
ctccctcagcccctcttg

SEQ ID NO: 3756304 - DNA, 18 bp, Homo sapiens
ctccctcagtctggccct

SEQ ID NO: 3756305 - DNA, 23 bp, Homo sapiens
ctccctcagtgccctcattttat

SEQ ID NO: 3756306 - DNA, 14 bp, Homo sapiens
ctccctcccctgcc

SEQ ID NO: 3756307 - DNA, 18 bp, Homo sapiens
ctccctcccctgccctcg

SEQ ID NO: 3756308 - DNA, 21 bp, Homo sapiens
ctccctcccctgccctggtcc

SEQ ID NO: 3756309 - DNA, 23 bp, Homo sapiens
ctccctcccctgccctggtccag

SEQ ID NO: 3756310 - DNA, 18 bp, Homo sapiens
ctccctcgaacccacact

SEQ ID NO: 3756311 - DNA, 20 bp, Homo sapiens
ctccctcgaacccacactgc

SEQ ID NO: 3756312 - DNA, 22 bp, Homo sapiens
ctccctcgaacccacactgcaa

SEQ ID NO: 3756313 - DNA, 15 bp, Homo sapiens
ctccctctcctgcct

SEQ ID NO: 3756314 - DNA, 16 bp, Homo sapiens
ctccctctctcttctg

SEQ ID NO: 3756315 - DNA, 13 bp, Homo sapiens
ctccctctgacct

SEQ ID NO: 3756316 - DNA, 14 bp, Homo sapiens
ctccctctgacctg

SEQ ID NO: 3756317 - DNA, 21 bp, Homo sapiens
ctccctctgacctgcaggcca

SEQ ID NO: 3756318 - DNA, 14 bp, Homo sapiens
ctccctctggccct

SEQ ID NO: 3756319 - DNA, 15 bp, Homo sapiens
ctccctctggccctg

SEQ ID NO: 3756320 - DNA, 18 bp, Homo sapiens
ctccctctggccctgcct

SEQ ID NO: 3756321 - DNA, 15 bp, Homo sapiens
ctccctctttccctc

SEQ ID NO: 3756322 - DNA, 19 bp, Homo sapiens
ctccctctttccctccctt

SEQ ID NO: 3756323 - DNA, 15 bp, Homo sapiens
ctccctgaccctgca

SEQ ID NO: 3756324 - DNA, 16 bp, Homo sapiens
ctccctgaccctgcag

SEQ ID NO: 3756325 - DNA, 21 bp, Homo sapiens
ctccctgaccctgcagagatg

SEQ ID NO: 3756326 - DNA, 15 bp, Homo sapiens
ctccctgatgtacag

SEQ ID NO: 3756327 - DNA, 18 bp, Homo sapiens
ctccctgccagcaccccc

SEQ ID NO: 3756328 - DNA, 13 bp, Homo sapiens
ctccctggcctgt

SEQ ID NO: 3756329 - DNA, 15 bp, Homo sapiens
ctccctggcctgttc

SEQ ID NO: 3756330 - DNA, 19 bp, Homo sapiens
ctccctggcctgttctgtt

SEQ ID NO: 3756331 - DNA, 12 bp, Homo sapiens
ctccctggctcc

SEQ ID NO: 3756332 - DNA, 14 bp, Homo sapiens
ctccctggctccca

SEQ ID NO: 3756333 - DNA, 20 bp, Homo sapiens
ctccctggctctcagaaggt

SEQ ID NO: 3756334 - DNA, 15 bp, Homo sapiens
ctccctgtcctcctc

SEQ ID NO: 3756335 - DNA, 16 bp, Homo sapiens
ctccctgtcctcctcg

SEQ ID NO: 3756336 - DNA, 18 bp, Homo sapiens
ctcccttcaaccattccc

SEQ ID NO: 3756337 - DNA, 17 bp, Homo sapiens
ctccctttcttccctac

SEQ ID NO: 3756338 - DNA, 12 bp, Homo sapiens
ctccgctgtgtg

SEQ ID NO: 3756339 - DNA, 18 bp, Homo sapiens
ctccgctgtgtggatggg

SEQ ID NO: 3756340 - DNA, 19 bp, Homo sapiens
ctccgctttctacccagcg

SEQ ID NO: 3756341 - DNA, 20 bp, Homo sapiens
ctccgctttctacccagcga

SEQ ID NO: 3756342 - DNA, 21 bp, Homo sapiens
ctccgctttctacccagcgag

SEQ ID NO: 3756343 - DNA, 23 bp, Homo sapiens
ctccggaggctgaggcaggagaa

SEQ ID NO: 3756344 - DNA, 14 bp, Homo sapiens
ctccgggagagggg

SEQ ID NO: 3756345 - DNA, 23 bp, Homo sapiens
ctccggtgtgcctgcagccccgc

SEQ ID NO: 3756346 - DNA, 15 bp, Homo sapiens
ctccgtatttcagac

SEQ ID NO: 3756347 - DNA, 22 bp, Homo sapiens
ctccgtccagccgccattgcca

SEQ ID NO: 3756348 - DNA, 19 bp, Homo sapiens
ctccgtccaggagcctggc

SEQ ID NO: 3756349 - DNA, 22 bp, Homo sapiens
ctccgtccaggagcctgtgcct

SEQ ID NO: 3756350 - DNA, 18 bp, Homo sapiens
ctcctacctcagcctaga

SEQ ID NO: 3756351 - DNA, 19 bp, Homo sapiens
ctcctaggacatgttccct

SEQ ID NO: 3756352 - DNA, 20 bp, Homo sapiens
ctcctagggaaaagttcata

SEQ ID NO: 3756353 - DNA, 21 bp, Homo sapiens
ctcctagttcttcatcccact

SEQ ID NO: 3756354 - DNA, 17 bp, Homo sapiens
ctcctatcacctcccct

SEQ ID NO: 3756355 - DNA, 18 bp, Homo sapiens
ctcctatcacctcccctc

SEQ ID NO: 3756356 - DNA, 20 bp, Homo sapiens
ctcctcacccccagctttgc

SEQ ID NO: 3756357 - DNA, 18 bp, Homo sapiens
ctcctcacctctggactg

SEQ ID NO: 3756358 - DNA, 15 bp, Homo sapiens
ctcctccaaaggaag

SEQ ID NO: 3756359 - DNA, 14 bp, Homo sapiens
ctcctccagggcca

SEQ ID NO: 3756360 - DNA, 19 bp, Homo sapiens
ctcctccagggccacgtgc

SEQ ID NO: 3756361 - DNA, 23 bp, Homo sapiens
ctcctcccaggcgccccttcccc

SEQ ID NO: 3756362 - DNA, 15 bp, Homo sapiens
ctcctcccggtgccc

SEQ ID NO: 3756363 - DNA, 16 bp, Homo sapiens
ctcctcgcaagctggg

SEQ ID NO: 3756364 - DNA, 17 bp, Homo sapiens
ctcctcgcaagctgggt

SEQ ID NO: 3756365 - DNA, 21 bp, Homo sapiens
ctcctctaacaggggctggtg

SEQ ID NO: 3756366 - DNA, 14 bp, Homo sapiens
ctcctctcccctct

SEQ ID NO: 3756367 - DNA, 19 bp, Homo sapiens
ctcctctctaacctccttt

SEQ ID NO: 3756368 - DNA, 15 bp, Homo sapiens
ctcctctgccacctc

SEQ ID NO: 3756369 - DNA, 23 bp, Homo sapiens
ctcctctgggcaggacctcagag

SEQ ID NO: 3756370 - DNA, 18 bp, Homo sapiens
ctcctctgtccagggccc

SEQ ID NO: 3756371 - DNA, 16 bp, Homo sapiens
ctcctcttgccactgc

SEQ ID NO: 3756372 - DNA, 16 bp, Homo sapiens
ctcctctttgttttgt

SEQ ID NO: 3756373 - DNA, 21 bp, Homo sapiens
ctcctctttgttttgttttaa

SEQ ID NO: 3756374 - DNA, 23 bp, Homo sapiens
ctcctgaggatcagaaagtaatt

SEQ ID NO: 3756375 - DNA, 21 bp, Homo sapiens
ctcctgaggggcatctgcccc

SEQ ID NO: 3756376 - DNA, 16 bp, Homo sapiens
ctcctgagtgatccca

SEQ ID NO: 3756377 - DNA, 15 bp, Homo sapiens
ctcctgattatttat

SEQ ID NO: 3756378 - DNA, 14 bp, Homo sapiens
ctcctgcccacctg

SEQ ID NO: 3756379 - DNA, 15 bp, Homo sapiens
ctcctgcccaggaga

SEQ ID NO: 3756380 - DNA, 16 bp, Homo sapiens
ctcctgcccaggagag

SEQ ID NO: 3756381 - DNA, 20 bp, Homo sapiens
ctcctgcccaggagagccag

SEQ ID NO: 3756382 - DNA, 17 bp, Homo sapiens
ctcctgcccccacacct

SEQ ID NO: 3756383 - DNA, 20 bp, Homo sapiens
ctcctgcccccacacctggc

SEQ ID NO: 3756384 - DNA, 22 bp, Homo sapiens
ctcctgcccccacacctggccc

SEQ ID NO: 3756385 - DNA, 14 bp, Homo sapiens
ctcctgcctactca

SEQ ID NO: 3756386 - DNA, 12 bp, Homo sapiens
ctcctgcctcag

SEQ ID NO: 3756387 - DNA, 16 bp, Homo sapiens
ctcctgcctcagcctc

SEQ ID NO: 3756388 - DNA, 17 bp, Homo sapiens
ctcctgcctcagcctcc

SEQ ID NO: 3756389 - DNA, 18 bp, Homo sapiens
ctcctgcctcgaactggc

SEQ ID NO: 3756390 - DNA, 20 bp, Homo sapiens
ctcctgcctcgaactggctg

SEQ ID NO: 3756391 - DNA, 18 bp, Homo sapiens
ctcctgctactctgttcc

SEQ ID NO: 3756392 - DNA, 24 bp, Homo sapiens
ctcctggaaaggctcagtctcagg

SEQ ID NO: 3756393 - DNA, 20 bp, Homo sapiens
ctcctggaagctgtgtcctt

SEQ ID NO: 3756394 - DNA, 18 bp, Homo sapiens
ctcctggcccactgcatc

SEQ ID NO: 3756395 - DNA, 19 bp, Homo sapiens
ctcctggcccactgcatcg

SEQ ID NO: 3756396 - DNA, 22 bp, Homo sapiens
ctcctgggaaggctactcacct

SEQ ID NO: 3756397 - DNA, 18 bp, Homo sapiens
ctcctgggctaagtgatc

SEQ ID NO: 3756398 - DNA, 15 bp, Homo sapiens
ctcctgggctcaagc

SEQ ID NO: 3756399 - DNA, 13 bp, Homo sapiens
ctcctgggctcag

SEQ ID NO: 3756400 - DNA, 23 bp, Homo sapiens
ctcctgggggttctttcttcctc

SEQ ID NO: 3756401 - DNA, 14 bp, Homo sapiens
ctcctgtccaacct

SEQ ID NO: 3756402 - DNA, 17 bp, Homo sapiens
ctcctgtctgccagcca

SEQ ID NO: 3756403 - DNA, 23 bp, Homo sapiens
ctcctgtgtcttgcaatggcagc

SEQ ID NO: 3756404 - DNA, 19 bp, Homo sapiens
ctcctgtgtgtgcgcctac

SEQ ID NO: 3756405 - DNA, 14 bp, Homo sapiens
ctccttagctgcca

SEQ ID NO: 3756406 - DNA, 17 bp, Homo sapiens
ctccttagtcttctcat

SEQ ID NO: 3756407 - DNA, 18 bp, Homo sapiens
ctccttccaacaggagct

SEQ ID NO: 3756408 - DNA, 18 bp, Homo sapiens
ctccttccaactgctgcc

SEQ ID NO: 3756409 - DNA, 16 bp, Homo sapiens
ctccttcccagctgcc

SEQ ID NO: 3756410 - DNA, 17 bp, Homo sapiens
ctccttcccagctgccc

SEQ ID NO: 3756411 - DNA, 22 bp, Homo sapiens
ctccttcccagctgcccctccc

SEQ ID NO: 3756412 - DNA, 15 bp, Homo sapiens
ctccttcctgtcttc

SEQ ID NO: 3756413 - DNA, 17 bp, Homo sapiens
ctccttcctgtcttcct

SEQ ID NO: 3756414 - DNA, 22 bp, Homo sapiens
ctccttccttgctgtcctaggc

SEQ ID NO: 3756415 - DNA, 13 bp, Homo sapiens
ctccttctccctt

SEQ ID NO: 3756416 - DNA, 14 bp, Homo sapiens
ctccttctgtccta

SEQ ID NO: 3756417 - DNA, 17 bp, Homo sapiens
ctccttgggaggcccca

SEQ ID NO: 3756418 - DNA, 15 bp, Homo sapiens
ctcctttaccctcat

SEQ ID NO: 3756419 - DNA, 17 bp, Homo sapiens
ctcctttagcgcccagt

SEQ ID NO: 3756420 - DNA, 13 bp, Homo sapiens
ctcctttcacaac

SEQ ID NO: 3756421 - DNA, 16 bp, Homo sapiens
ctcctttgcaggctca

SEQ ID NO: 3756422 - DNA, 17 bp, Homo sapiens
ctcctttggccattcca

SEQ ID NO: 3756423 - DNA, 18 bp, Homo sapiens
ctcgaacccacactgcaa

SEQ ID NO: 3756424 - DNA, 15 bp, Homo sapiens
ctcgaactcctgggc

SEQ ID NO: 3756425 - DNA, 17 bp, Homo sapiens
ctcgaactcctgggctc

SEQ ID NO: 3756426 - DNA, 17 bp, Homo sapiens
ctcgaagcgcgccactc

SEQ ID NO: 3756427 - DNA, 13 bp, Homo sapiens
ctcgcaagctggg

SEQ ID NO: 3756428 - DNA, 13 bp, Homo sapiens
ctcgccctgggtc

SEQ ID NO: 3756429 - DNA, 15 bp, Homo sapiens
ctcgccgtctgtgaa

SEQ ID NO: 3756430 - DNA, 16 bp, Homo sapiens
ctcgccgtctgtgaat

SEQ ID NO: 3756431 - DNA, 20 bp, Homo sapiens
ctcgctggcccccactggct

SEQ ID NO: 3756432 - DNA, 21 bp, Homo sapiens
ctcgctggcccccactggctg

SEQ ID NO: 3756433 - DNA, 17 bp, Homo sapiens
ctcgctttgttgcccag

SEQ ID NO: 3756434 - DNA, 16 bp, Homo sapiens
ctcggaaggctggctg

SEQ ID NO: 3756435 - DNA, 12 bp, Homo sapiens
ctcggagcctca

SEQ ID NO: 3756436 - DNA, 16 bp, Homo sapiens
ctcggagcctcatccg

SEQ ID NO: 3756437 - DNA, 17 bp, Homo sapiens
ctcggagggattcccct

SEQ ID NO: 3756438 - DNA, 14 bp, Homo sapiens
ctcggtggacccag

SEQ ID NO: 3756439 - DNA, 17 bp, Homo sapiens
ctcggtgtggagaagcg

SEQ ID NO: 3756440 - DNA, 20 bp, Homo sapiens
ctcgtatatgtctcaggtcc

SEQ ID NO: 3756441 - DNA, 14 bp, Homo sapiens
ctcgtcctccccct

SEQ ID NO: 3756442 - DNA, 20 bp, Homo sapiens
ctcgtggccttccccagcct

SEQ ID NO: 3756443 - DNA, 21 bp, Homo sapiens
ctcgtggccttccccagcctc

SEQ ID NO: 3756444 - DNA, 17 bp, Homo sapiens
ctctaaaatagccactt

SEQ ID NO: 3756445 - DNA, 15 bp, Homo sapiens
ctctaaccacacagc

SEQ ID NO: 3756446 - DNA, 17 bp, Homo sapiens
ctctacaaactcccact

SEQ ID NO: 3756447 - DNA, 13 bp, Homo sapiens
ctctacagaggcc

SEQ ID NO: 3756448 - DNA, 14 bp, Homo sapiens
ctctacagaggcca

SEQ ID NO: 3756449 - DNA, 12 bp, Homo sapiens
ctctacccagcc

SEQ ID NO: 3756450 - DNA, 15 bp, Homo sapiens
ctctacccagcccat

SEQ ID NO: 3756451 - DNA, 16 bp, Homo sapiens
ctctaccctcccaccc

SEQ ID NO: 3756452 - DNA, 18 bp, Homo sapiens
ctctaccctcccaccccc

SEQ ID NO: 3756453 - DNA, 13 bp, Homo sapiens
ctctaccctggca

SEQ ID NO: 3756454 - DNA, 20 bp, Homo sapiens
ctctacctcatatcagtttg

SEQ ID NO: 3756455 - DNA, 18 bp, Homo sapiens
ctctactaccacaaggaa

SEQ ID NO: 3756456 - DNA, 20 bp, Homo sapiens
ctctactaccacaaggaaaa

SEQ ID NO: 3756457 - DNA, 19 bp, Homo sapiens
ctctactcctacctcagcc

SEQ ID NO: 3756458 - DNA, 16 bp, Homo sapiens
ctctacttagcatgtc

SEQ ID NO: 3756459 - DNA, 17 bp, Homo sapiens
ctctacttagcatgtcc

SEQ ID NO: 3756460 - DNA, 23 bp, Homo sapiens
ctctagaattttaagtgctttgt

SEQ ID NO: 3756461 - DNA, 18 bp, Homo sapiens
ctctagacaaccctgcaa

SEQ ID NO: 3756462 - DNA, 16 bp, Homo sapiens
ctctagacactgccac

SEQ ID NO: 3756463 - DNA, 13 bp, Homo sapiens
ctctagcctgggc

SEQ ID NO: 3756464 - DNA, 21 bp, Homo sapiens
ctctagggaaggccacctgca

SEQ ID NO: 3756465 - DNA, 18 bp, Homo sapiens
ctctagtgccctccacag

SEQ ID NO: 3756466 - DNA, 16 bp, Homo sapiens
ctctataattgccact

SEQ ID NO: 3756467 - DNA, 14 bp, Homo sapiens
ctctcactgtgtcc

SEQ ID NO: 3756468 - DNA, 15 bp, Homo sapiens
ctctcactgtgtccc

SEQ ID NO: 3756469 - DNA, 19 bp, Homo sapiens
ctctcaggcatgcctgtgt

SEQ ID NO: 3756470 - DNA, 18 bp, Homo sapiens
ctctcatccttttctcct

SEQ ID NO: 3756471 - DNA, 19 bp, Homo sapiens
ctctcatccttttctccta

SEQ ID NO: 3756472 - DNA, 15 bp, Homo sapiens
ctctcattccccagg

SEQ ID NO: 3756473 - DNA, 20 bp, Homo sapiens
ctctcattccccaggtggct

SEQ ID NO: 3756474 - DNA, 12 bp, Homo sapiens
ctctccacctca

SEQ ID NO: 3756475 - DNA, 15 bp, Homo sapiens
ctctccactgccttc

SEQ ID NO: 3756476 - DNA, 16 bp, Homo sapiens
ctctccactgccttcg

SEQ ID NO: 3756477 - DNA, 13 bp, Homo sapiens
ctctccccacact

SEQ ID NO: 3756478 - DNA, 20 bp, Homo sapiens
ctctcccctcttatgtacct

SEQ ID NO: 3756479 - DNA, 17 bp, Homo sapiens
ctctcccctgccctgct

SEQ ID NO: 3756480 - DNA, 18 bp, Homo sapiens
ctctcccctgccctgctg

SEQ ID NO: 3756481 - DNA, 16 bp, Homo sapiens
ctctccccttctctgt

SEQ ID NO: 3756482 - DNA, 13 bp, Homo sapiens
ctctccctcccct

SEQ ID NO: 3756483 - DNA, 12 bp, Homo sapiens
ctctccctctgg

SEQ ID NO: 3756484 - DNA, 13 bp, Homo sapiens
ctctcctcagact

SEQ ID NO: 3756485 - DNA, 15 bp, Homo sapiens
ctctcctcagactgc

SEQ ID NO: 3756486 - DNA, 12 bp, Homo sapiens
ctctcctgccta

SEQ ID NO: 3756487 - DNA, 23 bp, Homo sapiens
ctctcctgggcccctccctacct

SEQ ID NO: 3756488 - DNA, 18 bp, Homo sapiens
ctctcctgtactttttcc

SEQ ID NO: 3756489 - DNA, 21 bp, Homo sapiens
ctctcctgtccaacctaaccc

SEQ ID NO: 3756490 - DNA, 20 bp, Homo sapiens
ctctcggagtatctgggaac

SEQ ID NO: 3756491 - DNA, 16 bp, Homo sapiens
ctctctaacctccttt

SEQ ID NO: 3756492 - DNA, 19 bp, Homo sapiens
ctctctacaaactcccact

SEQ ID NO: 3756493 - DNA, 17 bp, Homo sapiens
ctctctacccagcccat

SEQ ID NO: 3756494 - DNA, 22 bp, Homo sapiens
ctctctactcctacctcagcct

SEQ ID NO: 3756495 - DNA, 20 bp, Homo sapiens
ctctctatggtaaagatatt

SEQ ID NO: 3756496 - DNA, 23 bp, Homo sapiens
ctctctatggtaaagatattatt

SEQ ID NO: 3756497 - DNA, 17 bp, Homo sapiens
ctctctccagtcttcca

SEQ ID NO: 3756498 - DNA, 21 bp, Homo sapiens
ctctctccatcagaggacacc

SEQ ID NO: 3756499 - DNA, 20 bp, Homo sapiens
ctctctcctcctgcccacct

SEQ ID NO: 3756500 - DNA, 15 bp, Homo sapiens
ctctctcctgtactt

SEQ ID NO: 3756501 - DNA, 15 bp, Homo sapiens
ctctctcctgtccaa

SEQ ID NO: 3756502 - DNA, 18 bp, Homo sapiens
ctctctcttctgctccac

SEQ ID NO: 3756503 - DNA, 18 bp, Homo sapiens
ctctctgcagccagccca

SEQ ID NO: 3756504 - DNA, 20 bp, Homo sapiens
ctctctgcctgtgagccagt

SEQ ID NO: 3756505 - DNA, 13 bp, Homo sapiens
ctctctgctgtac

SEQ ID NO: 3756506 - DNA, 14 bp, Homo sapiens
ctctcttcctatcc

SEQ ID NO: 3756507 - DNA, 16 bp, Homo sapiens
ctctcttctgctccac

SEQ ID NO: 3756508 - DNA, 17 bp, Homo sapiens
ctctcttctgctccacc

SEQ ID NO: 3756509 - DNA, 18 bp, Homo sapiens
ctctcttctgctccaccc

SEQ ID NO: 3756510 - DNA, 15 bp, Homo sapiens
ctctcttggtttcct

SEQ ID NO: 3756511 - DNA, 15 bp, Homo sapiens
ctctctttggactct

SEQ ID NO: 3756512 - DNA, 13 bp, Homo sapiens
ctctgaagagtgg

SEQ ID NO: 3756513 - DNA, 21 bp, Homo sapiens
ctctgaagagtgggtttcaca

SEQ ID NO: 3756514 - DNA, 15 bp, Homo sapiens
ctctgaaggacattg

SEQ ID NO: 3756515 - DNA, 17 bp, Homo sapiens
ctctgaagggcatcatg

SEQ ID NO: 3756516 - DNA, 23 bp, Homo sapiens
ctctgaagtcacatcacaggaca

SEQ ID NO: 3756517 - DNA, 17 bp, Homo sapiens
ctctgacacacagctct

SEQ ID NO: 3756518 - DNA, 23 bp, Homo sapiens
ctctgacagaagaaccccagggt

SEQ ID NO: 3756519 - DNA, 15 bp, Homo sapiens
ctctgacctgcaggc

SEQ ID NO: 3756520 - DNA, 16 bp, Homo sapiens
ctctgacctgcaggcc

SEQ ID NO: 3756521 - DNA, 18 bp, Homo sapiens
ctctgactcccaaagagc

SEQ ID NO: 3756522 - DNA, 18 bp, Homo sapiens
ctctgactggcacagtct

SEQ ID NO: 3756523 - DNA, 23 bp, Homo sapiens
ctctgagaaggggaggacctctg

SEQ ID NO: 3756524 - DNA, 14 bp, Homo sapiens
ctctgaggacacta

SEQ ID NO: 3756525 - DNA, 19 bp, Homo sapiens
ctctgaggctctttctggg

SEQ ID NO: 3756526 - DNA, 18 bp, Homo sapiens
ctctgagtttaccatttg

SEQ ID NO: 3756527 - DNA, 20 bp, Homo sapiens
ctctgagtttaccatttgta

SEQ ID NO: 3756528 - DNA, 23 bp, Homo sapiens
ctctgatattccatgaatgtatc

SEQ ID NO: 3756529 - DNA, 20 bp, Homo sapiens
ctctgatcttgtgctcagca

SEQ ID NO: 3756530 - DNA, 15 bp, Homo sapiens
ctctgatgtaaatga

SEQ ID NO: 3756531 - DNA, 15 bp, Homo sapiens
ctctgcacaagctgc

SEQ ID NO: 3756532 - DNA, 16 bp, Homo sapiens
ctctgcacaagctgca

SEQ ID NO: 3756533 - DNA, 18 bp, Homo sapiens
ctctgcacaagctgcacc

SEQ ID NO: 3756534 - DNA, 20 bp, Homo sapiens
ctctgcacaagctgcaccct

SEQ ID NO: 3756535 - DNA, 16 bp, Homo sapiens
ctctgcagccagccca

SEQ ID NO: 3756536 - DNA, 18 bp, Homo sapiens
ctctgcagccagcccagc

SEQ ID NO: 3756537 - DNA, 14 bp, Homo sapiens
ctctgcattctagt

SEQ ID NO: 3756538 - DNA, 14 bp, Homo sapiens
ctctgccacctccc

SEQ ID NO: 3756539 - DNA, 19 bp, Homo sapiens
ctctgccatgaactggagg

SEQ ID NO: 3756540 - DNA, 19 bp, Homo sapiens
ctctgcccagagctgggtg

SEQ ID NO: 3756541 - DNA, 12 bp, Homo sapiens
ctctgccccagc

SEQ ID NO: 3756542 - DNA, 16 bp, Homo sapiens
ctctgccccagctctg

SEQ ID NO: 3756543 - DNA, 15 bp, Homo sapiens
ctctgccctgcccta

SEQ ID NO: 3756544 - DNA, 17 bp, Homo sapiens
ctctgcctctgcctgca

SEQ ID NO: 3756545 - DNA, 10 bp, Homo sapiens
ctctgcctga

SEQ ID NO: 3756546 - DNA, 21 bp, Homo sapiens
ctctgcctgaagtcacacagt

SEQ ID NO: 3756547 - DNA, 22 bp, Homo sapiens
ctctgcctgaagtcacacagtg

SEQ ID NO: 3756548 - DNA, 18 bp, Homo sapiens
ctctgcctgtccctctca

SEQ ID NO: 3756549 - DNA, 16 bp, Homo sapiens
ctctgctaatcatgtg

SEQ ID NO: 3756550 - DNA, 12 bp, Homo sapiens
ctctgctccacc

SEQ ID NO: 3756551 - DNA, 14 bp, Homo sapiens
ctctgctccaccac

SEQ ID NO: 3756552 - DNA, 16 bp, Homo sapiens
ctctgctccaccacat

SEQ ID NO: 3756553 - DNA, 13 bp, Homo sapiens
ctctgctcctctc

SEQ ID NO: 3756554 - DNA, 18 bp, Homo sapiens
ctctgctcctctccccag

SEQ ID NO: 3756555 - DNA, 13 bp, Homo sapiens
ctctgctgacaga

SEQ ID NO: 3756556 - DNA, 18 bp, Homo sapiens
ctctgcttgccgaaactg

SEQ ID NO: 3756557 - DNA, 22 bp, Homo sapiens
ctctgcttgccgaaactggaag

SEQ ID NO: 3756558 - DNA, 16 bp, Homo sapiens
ctctggacaaagcgtt

SEQ ID NO: 3756559 - DNA, 15 bp, Homo sapiens
ctctggacaggcatg

SEQ ID NO: 3756560 - DNA, 16 bp, Homo sapiens
ctctggactggctaga

SEQ ID NO: 3756561 - DNA, 15 bp, Homo sapiens
ctctggagccacctg

SEQ ID NO: 3756562 - DNA, 22 bp, Homo sapiens
ctctggagccacctgtcccacc

SEQ ID NO: 3756563 - DNA, 18 bp, Homo sapiens
ctctggattgtgggaatt

SEQ ID NO: 3756564 - DNA, 10 bp, Homo sapiens
ctctggccag

SEQ ID NO: 3756565 - DNA, 13 bp, Homo sapiens
ctctggccctgcc

SEQ ID NO: 3756566 - DNA, 14 bp, Homo sapiens
ctctggcgtgtggg

SEQ ID NO: 3756567 - DNA, 22 bp, Homo sapiens
ctctggctagaggccagcccca

SEQ ID NO: 3756568 - DNA, 19 bp, Homo sapiens
ctctgggaaataagagaga

SEQ ID NO: 3756569 - DNA, 23 bp, Homo sapiens
ctctgggcaggacctcagagtcc

SEQ ID NO: 3756570 - DNA, 15 bp, Homo sapiens
ctctggtaacctctt

SEQ ID NO: 3756571 - DNA, 17 bp, Homo sapiens
ctctggtagacacagga

SEQ ID NO: 3756572 - DNA, 19 bp, Homo sapiens
ctctggtctcctctttgtt

SEQ ID NO: 3756573 - DNA, 22 bp, Homo sapiens
ctctggtctcctctttgttttg

SEQ ID NO: 3756574 - DNA, 15 bp, Homo sapiens
ctctggttatctaat

SEQ ID NO: 3756575 - DNA, 19 bp, Homo sapiens
ctctgtcgcccagtctgga

SEQ ID NO: 3756576 - DNA, 16 bp, Homo sapiens
ctctgtctaccatctc

SEQ ID NO: 3756577 - DNA, 17 bp, Homo sapiens
ctctgtctaccatctcc

SEQ ID NO: 3756578 - DNA, 22 bp, Homo sapiens
ctctgtctaccatctccctcga

SEQ ID NO: 3756579 - DNA, 18 bp, Homo sapiens
ctctgtgaacgatttaga

SEQ ID NO: 3756580 - DNA, 21 bp, Homo sapiens
ctctgtgaacgatttagaaag

SEQ ID NO: 3756581 - DNA, 23 bp, Homo sapiens
ctctgtgacctgccccgcccagc

SEQ ID NO: 3756582 - DNA, 19 bp, Homo sapiens
ctctgtgtcaggtggggca

SEQ ID NO: 3756583 - DNA, 21 bp, Homo sapiens
ctctgtgtcaggtggggcagc

SEQ ID NO: 3756584 - DNA, 21 bp, Homo sapiens
ctctgttcagtaacagggcct

SEQ ID NO: 3756585 - DNA, 22 bp, Homo sapiens
ctctgttcctggctcagcctca

SEQ ID NO: 3756586 - DNA, 16 bp, Homo sapiens
ctcttaaaaaataaaa

SEQ ID NO: 3756587 - DNA, 18 bp, Homo sapiens
ctcttaaaaaataaaaac

SEQ ID NO: 3756588 - DNA, 13 bp, Homo sapiens
ctcttaaaaccca

SEQ ID NO: 3756589 - DNA, 20 bp, Homo sapiens
ctcttaaagctgcctgtagt

SEQ ID NO: 3756590 - DNA, 18 bp, Homo sapiens
ctcttatagaatatttat

SEQ ID NO: 3756591 - DNA, 20 bp, Homo sapiens
ctcttatagaatatttatta

SEQ ID NO: 3756592 - DNA, 21 bp, Homo sapiens
ctcttatagaatatttattac

SEQ ID NO: 3756593 - DNA, 17 bp, Homo sapiens
ctcttatgcacacctcc

SEQ ID NO: 3756594 - DNA, 19 bp, Homo sapiens
ctcttatgtacctctttta

SEQ ID NO: 3756595 - DNA, 15 bp, Homo sapiens
ctcttattgcccacg

SEQ ID NO: 3756596 - DNA, 19 bp, Homo sapiens
ctcttattgcccacgctgg

SEQ ID NO: 3756597 - DNA, 20 bp, Homo sapiens
ctcttattgcccacgctgga

SEQ ID NO: 3756598 - DNA, 17 bp, Homo sapiens
ctcttcaactgaccagc

SEQ ID NO: 3756599 - DNA, 20 bp, Homo sapiens
ctcttcaactgaccagcctc

SEQ ID NO: 3756600 - DNA, 13 bp, Homo sapiens
ctcttcaggcctc

SEQ ID NO: 3756601 - DNA, 15 bp, Homo sapiens
ctcttcaggttctta

SEQ ID NO: 3756602 - DNA, 17 bp, Homo sapiens
ctcttccccctctccca

SEQ ID NO: 3756603 - DNA, 19 bp, Homo sapiens
ctcttccccctctcccagt

SEQ ID NO: 3756604 - DNA, 19 bp, Homo sapiens
ctcttccggagatgtagca

SEQ ID NO: 3756605 - DNA, 12 bp, Homo sapiens
ctcttcctatcc

SEQ ID NO: 3756606 - DNA, 16 bp, Homo sapiens
ctcttcctatcccatc

SEQ ID NO: 3756607 - DNA, 15 bp, Homo sapiens
ctcttctagagccgt

SEQ ID NO: 3756608 - DNA, 12 bp, Homo sapiens
ctcttctccact

SEQ ID NO: 3756609 - DNA, 19 bp, Homo sapiens
ctcttctccactggatgga

SEQ ID NO: 3756610 - DNA, 12 bp, Homo sapiens
ctcttctccagg

SEQ ID NO: 3756611 - DNA, 13 bp, Homo sapiens
ctcttctccaggc

SEQ ID NO: 3756612 - DNA, 16 bp, Homo sapiens
ctcttctccaggctgt

SEQ ID NO: 3756613 - DNA, 15 bp, Homo sapiens
ctcttctcctttcac

SEQ ID NO: 3756614 - DNA, 21 bp, Homo sapiens
ctcttctgccggccctggggc

SEQ ID NO: 3756615 - DNA, 14 bp, Homo sapiens
ctcttctgctccac

SEQ ID NO: 3756616 - DNA, 15 bp, Homo sapiens
ctcttctgctccacc

SEQ ID NO: 3756617 - DNA, 13 bp, Homo sapiens
ctcttgacctcag

SEQ ID NO: 3756618 - DNA, 14 bp, Homo sapiens
ctcttgaggccagg

SEQ ID NO: 3756619 - DNA, 15 bp, Homo sapiens
ctcttgagggagctt

SEQ ID NO: 3756620 - DNA, 17 bp, Homo sapiens
ctcttgcagagaagcct

SEQ ID NO: 3756621 - DNA, 16 bp, Homo sapiens
ctcttgccactgcctc

SEQ ID NO: 3756622 - DNA, 22 bp, Homo sapiens
ctcttgccactgcctcttcctc

SEQ ID NO: 3756623 - DNA, 16 bp, Homo sapiens
ctcttgccccccaccc

SEQ ID NO: 3756624 - DNA, 17 bp, Homo sapiens
ctcttgcggtcccttct

SEQ ID NO: 3756625 - DNA, 22 bp, Homo sapiens
ctcttgcttgtgggactagcct

SEQ ID NO: 3756626 - DNA, 15 bp, Homo sapiens
ctcttggctggcttc

SEQ ID NO: 3756627 - DNA, 15 bp, Homo sapiens
ctcttgtaagatttt

SEQ ID NO: 3756628 - DNA, 20 bp, Homo sapiens
ctcttgtaagattttgaaaa

SEQ ID NO: 3756629 - DNA, 22 bp, Homo sapiens
ctctttaactcaggactccagc

SEQ ID NO: 3756630 - DNA, 22 bp, Homo sapiens
ctctttaatgtcacaggcaggt

SEQ ID NO: 3756631 - DNA, 20 bp, Homo sapiens
ctctttgtggcagaagtgtt

SEQ ID NO: 3756632 - DNA, 19 bp, Homo sapiens
ctcttttacccaataagat

SEQ ID NO: 3756633 - DNA, 15 bp, Homo sapiens
ctcttttctgcatca

SEQ ID NO: 3756634 - DNA, 21 bp, Homo sapiens
ctgaaaaatggtaattgttgc

SEQ ID NO: 3756635 - DNA, 20 bp, Homo sapiens
ctgaaaacataaaaagttaa

SEQ ID NO: 3756636 - DNA, 22 bp, Homo sapiens
ctgaaaattccagaaaggatat

SEQ ID NO: 3756637 - DNA, 14 bp, Homo sapiens
ctgaaagaaacagt

SEQ ID NO: 3756638 - DNA, 15 bp, Homo sapiens
ctgaaagaaacagtt

SEQ ID NO: 3756639 - DNA, 19 bp, Homo sapiens
ctgaaagaaacagttaact

SEQ ID NO: 3756640 - DNA, 12 bp, Homo sapiens
ctgaaagccacg

SEQ ID NO: 3756641 - DNA, 15 bp, Homo sapiens
cgagccctggtggca

SEQ ID NO: 3756642 - DNA, 18 bp, Homo sapiens
cgagccctggtggcagtg

SEQ ID NO: 3756643 - DNA, 23 bp, Homo sapiens
cgagctgggggccatgagctcca

SEQ ID NO: 3756644 - DNA, 21 bp, Homo sapiens
cgagctggtgcattacagaga

SEQ ID NO: 3756645 - DNA, 14 bp, Homo sapiens
cgaggaaccagagc

SEQ ID NO: 3756646 - DNA, 15 bp, Homo sapiens
cgaggaaccagagcc

SEQ ID NO: 3756647 - DNA, 12 bp, Homo sapiens
cgaggacaggga

SEQ ID NO: 3756648 - DNA, 14 bp, Homo sapiens
cgaggacagggagg

SEQ ID NO: 3756649 - DNA, 22 bp, Homo sapiens
cgaggcagggtcaggagagggg

SEQ ID NO: 3756650 - DNA, 19 bp, Homo sapiens
cgaggccttctctgaagga

SEQ ID NO: 3756651 - DNA, 22 bp, Homo sapiens
cgaggctgcccactatggtcat

SEQ ID NO: 3756652 - DNA, 15 bp, Homo sapiens
cgaggctgggccaag

SEQ ID NO: 3756653 - DNA, 18 bp, Homo sapiens
cgaggctgggccaagcca

SEQ ID NO: 3756654 - DNA, 16 bp, Homo sapiens
cgaggtatgaggtcta

SEQ ID NO: 3756655 - DNA, 15 bp, Homo sapiens
cgaggtcaacagaga

SEQ ID NO: 3756656 - DNA, 17 bp, Homo sapiens
cgaggtcaacagagaag

SEQ ID NO: 3756657 - DNA, 22 bp, Homo sapiens
cgaggtggatcacagaggcttc

SEQ ID NO: 3756658 - DNA, 20 bp, Homo sapiens
cgaggtggctgcctggagcc

SEQ ID NO: 3756659 - DNA, 22 bp, Homo sapiens
cgagtcactgcctctccctggc

SEQ ID NO: 3756660 - DNA, 16 bp, Homo sapiens
cgagtctcttctccac

SEQ ID NO: 3756661 - DNA, 17 bp, Homo sapiens
cgagtctcttctccact

SEQ ID NO: 3756662 - DNA, 22 bp, Homo sapiens
cgagtggatagatgccctgcta

SEQ ID NO: 3756663 - DNA, 19 bp, Homo sapiens
cgagtgtgtgcatgtgtgt

SEQ ID NO: 3756664 - DNA, 18 bp, Homo sapiens
cgagtttgcaatgtcaca

SEQ ID NO: 3756665 - DNA, 18 bp, Homo sapiens
cgatacaccgggcctgga

SEQ ID NO: 3756666 - DNA, 16 bp, Homo sapiens
cgatctcattcagtat

SEQ ID NO: 3756667 - DNA, 21 bp, Homo sapiens
cgatgaatttggagactctgt

SEQ ID NO: 3756668 - DNA, 22 bp, Homo sapiens
cgatgatgcttgtaacaagaaa

SEQ ID NO: 3756669 - DNA, 14 bp, Homo sapiens
cgatgctccagcca

SEQ ID NO: 3756670 - DNA, 22 bp, Homo sapiens
cgatgctccagccaacccctgt

SEQ ID NO: 3756671 - DNA, 21 bp, Homo sapiens
cgatgggggatgcttcatgtg

SEQ ID NO: 3756672 - DNA, 15 bp, Homo sapiens
cgatgtggccctggc

SEQ ID NO: 3756673 - DNA, 16 bp, Homo sapiens
cgattcaccctgtcca

SEQ ID NO: 3756674 - DNA, 21 bp, Homo sapiens
cgattcaccctgtccaaactg

SEQ ID NO: 3756675 - DNA, 21 bp, Homo sapiens
cgcaagcctgtaatcccagct

SEQ ID NO: 3756676 - DNA, 20 bp, Homo sapiens
cgcaatgtgcccccagacgc

SEQ ID NO: 3756677 - DNA, 14 bp, Homo sapiens
cgcacccccaccct

SEQ ID NO: 3756678 - DNA, 19 bp, Homo sapiens
cgcacccccaccctttggg

SEQ ID NO: 3756679 - DNA, 18 bp, Homo sapiens
cgcacctcccatcctaat

SEQ ID NO: 3756680 - DNA, 14 bp, Homo sapiens
cgcagatgatccat

SEQ ID NO: 3756681 - DNA, 16 bp, Homo sapiens
cgcagcctccctctga

SEQ ID NO: 3756682 - DNA, 14 bp, Homo sapiens
cgcatcttctccat

SEQ ID NO: 3756683 - DNA, 23 bp, Homo sapiens
cgcatggagtgtgtattgttccc

SEQ ID NO: 3756684 - DNA, 18 bp, Homo sapiens
cgccaaagaatgccttga

SEQ ID NO: 3756685 - DNA, 16 bp, Homo sapiens
cgccaaggctggggga

SEQ ID NO: 3756686 - DNA, 21 bp, Homo sapiens
cgccactgcactccagcctgg

SEQ ID NO: 3756687 - DNA, 22 bp, Homo sapiens
cgccactgcactccagcctggg

SEQ ID NO: 3756688 - DNA, 23 bp, Homo sapiens
cgccactgcactccagcctgggc

SEQ ID NO: 3756689 - DNA, 23 bp, Homo sapiens
cgccagaactgctttatcccacg

SEQ ID NO: 3756690 - DNA, 23 bp, Homo sapiens
cgccaggggaaaatcagcctgct

SEQ ID NO: 3756691 - DNA, 19 bp, Homo sapiens
cgccattgcactccagcct

SEQ ID NO: 3756692 - DNA, 16 bp, Homo sapiens
cgccattgccaccagg

SEQ ID NO: 3756693 - DNA, 17 bp, Homo sapiens
cgcccaaagccagacag

SEQ ID NO: 3756694 - DNA, 20 bp, Homo sapiens
cgcccagctgcacctgccag

SEQ ID NO: 3756695 - DNA, 12 bp, Homo sapiens
cgcccagtctgg

SEQ ID NO: 3756696 - DNA, 19 bp, Homo sapiens
cgcccagtgccctggggct

SEQ ID NO: 3756697 - DNA, 21 bp, Homo sapiens
cgcccctcatttatccctcaa

SEQ ID NO: 3756698 - DNA, 13 bp, Homo sapiens
cgccgtggctgcg

SEQ ID NO: 3756699 - DNA, 17 bp, Homo sapiens
cgcctcaatgtggttgc

SEQ ID NO: 3756700 - DNA, 11 bp, Homo sapiens
cgcctcccagc

SEQ ID NO: 3756701 - DNA, 17 bp, Homo sapiens
cgcctgcttgtccctgc

SEQ ID NO: 3756702 - DNA, 16 bp, Homo sapiens
cgcctgtaatcccagc

SEQ ID NO: 3756703 - DNA, 17 bp, Homo sapiens
cgcctgtaatcccagca

SEQ ID NO: 3756704 - DNA, 22 bp, Homo sapiens
cgccttcactccggtgtgcctg

SEQ ID NO: 3756705 - DNA, 18 bp, Homo sapiens
cgcggctcaaaaggaaac

SEQ ID NO: 3756706 - DNA, 19 bp, Homo sapiens
cgcgtgcacacaccagagc

SEQ ID NO: 3756707 - DNA, 20 bp, Homo sapiens
cgcgtgcacacaccagagcc

SEQ ID NO: 3756708 - DNA, 11 bp, Homo sapiens
cgctacccact

SEQ ID NO: 3756709 - DNA, 18 bp, Homo sapiens
cgctcatgggcccctctg

SEQ ID NO: 3756710 - DNA, 20 bp, Homo sapiens
cgctcatgggcccctctgac

SEQ ID NO: 3756711 - DNA, 22 bp, Homo sapiens
cgctcatgggcccctctgactc

SEQ ID NO: 3756712 - DNA, 13 bp, Homo sapiens
cgctcccgggact

SEQ ID NO: 3756713 - DNA, 16 bp, Homo sapiens
cgctcctgtctgccag

SEQ ID NO: 3756714 - DNA, 20 bp, Homo sapiens
cgctcctgtctgccagccag

SEQ ID NO: 3756715 - DNA, 21 bp, Homo sapiens
cgctcctgtctgccagccagc

SEQ ID NO: 3756716 - DNA, 13 bp, Homo sapiens
cgctcctgtgtct

SEQ ID NO: 3756717 - DNA, 17 bp, Homo sapiens
cgctctcctttctttct

SEQ ID NO: 3756718 - DNA, 21 bp, Homo sapiens
cgctcttggcaggtactcagc

SEQ ID NO: 3756719 - DNA, 23 bp, Homo sapiens
cgctgacaaccaccgctccccag

SEQ ID NO: 3756720 - DNA, 21 bp, Homo sapiens
cgctgccgcaccccagagtgt

SEQ ID NO: 3756721 - DNA, 20 bp, Homo sapiens
cgctgctcttatgccatttg

SEQ ID NO: 3756722 - DNA, 23 bp, Homo sapiens
cgctggaccttgaactgggtact

SEQ ID NO: 3756723 - DNA, 13 bp, Homo sapiens
cgctggcccccac

SEQ ID NO: 3756724 - DNA, 20 bp, Homo sapiens
cgctggcccccactggctgt

SEQ ID NO: 3756725 - DNA, 21 bp, Homo sapiens
cgctggcccccactggctgtg

SEQ ID NO: 3756726 - DNA, 14 bp, Homo sapiens
cgctgtctccagac

SEQ ID NO: 3756727 - DNA, 20 bp, Homo sapiens
cgctgtctccagacccccac

SEQ ID NO: 3756728 - DNA, 16 bp, Homo sapiens
cgcttcccccatagcc

SEQ ID NO: 3756729 - DNA, 18 bp, Homo sapiens
cgcttcccccatagccac

SEQ ID NO: 3756730 - DNA, 14 bp, Homo sapiens
cgcttctgcctgca

SEQ ID NO: 3756731 - DNA, 22 bp, Homo sapiens
cgctttctagctgttgagctgt

SEQ ID NO: 3756732 - DNA, 18 bp, Homo sapiens
cggaaaatgccaatctct

SEQ ID NO: 3756733 - DNA, 14 bp, Homo sapiens
cggaagctcctggt

SEQ ID NO: 3756734 - DNA, 15 bp, Homo sapiens
cggaagctcctggta

SEQ ID NO: 3756735 - DNA, 15 bp, Homo sapiens
cggacagccacggcc

SEQ ID NO: 3756736 - DNA, 18 bp, Homo sapiens
cggacagccacggccagg

SEQ ID NO: 3756737 - DNA, 13 bp, Homo sapiens
cggagagaaaaaa

SEQ ID NO: 3756738 - DNA, 19 bp, Homo sapiens
cggagattggacggcctga

SEQ ID NO: 3756739 - DNA, 20 bp, Homo sapiens
cggagcctcatccgaggcag

SEQ ID NO: 3756740 - DNA, 19 bp, Homo sapiens
cggagctaacactggcccc

SEQ ID NO: 3756741 - DNA, 11 bp, Homo sapiens
cggaggagaag

SEQ ID NO: 3756742 - DNA, 19 bp, Homo sapiens
cggaggagaagaaggaaat

SEQ ID NO: 3756743 - DNA, 12 bp, Homo sapiens
cggaggcaaaag

SEQ ID NO: 3756744 - DNA, 20 bp, Homo sapiens
cggaggcttgtcagagctgg

SEQ ID NO: 3756745 - DNA, 19 bp, Homo sapiens
cggagggaattgaggtctg

SEQ ID NO: 3756746 - DNA, 18 bp, Homo sapiens
cggaggggcctggcagcc

SEQ ID NO: 3756747 - DNA, 14 bp, Homo sapiens
cggagtcccacctt

SEQ ID NO: 3756748 - DNA, 18 bp, Homo sapiens
cggagtcccaccttggct

SEQ ID NO: 3756749 - DNA, 21 bp, Homo sapiens
cggagtcccaccttggctgca

SEQ ID NO: 3756750 - DNA, 18 bp, Homo sapiens
cggatcaccgagagtagc

SEQ ID NO: 3756751 - DNA, 21 bp, Homo sapiens
cggcaggacaacgaggaagcc

SEQ ID NO: 3756752 - DNA, 16 bp, Homo sapiens
cggcagttctgggtgc

SEQ ID NO: 3756753 - DNA, 20 bp, Homo sapiens
cggccaagatgcttttcaaa

SEQ ID NO: 3756754 - DNA, 11 bp, Homo sapiens
cggccaggcca

SEQ ID NO: 3756755 - DNA, 15 bp, Homo sapiens
ctacccagcgagccc

SEQ ID NO: 3756756 - DNA, 17 bp, Homo sapiens
ctacccagcgagccctg

SEQ ID NO: 3756757 - DNA, 20 bp, Homo sapiens
ctacccagcgagccctggtg

SEQ ID NO: 3756758 - DNA, 19 bp, Homo sapiens
ctacccaggaggctgaggt

SEQ ID NO: 3756759 - DNA, 20 bp, Homo sapiens
ctacccaggaggctgaggtg

SEQ ID NO: 3756760 - DNA, 17 bp, Homo sapiens
ctaccccctaagagcca

SEQ ID NO: 3756761 - DNA, 14 bp, Homo sapiens
ctacccctggatga

SEQ ID NO: 3756762 - DNA, 12 bp, Homo sapiens
ctaccctcccac

SEQ ID NO: 3756763 - DNA, 14 bp, Homo sapiens
ctaccctcccccag

SEQ ID NO: 3756764 - DNA, 17 bp, Homo sapiens
ctaccgagtctcttctc

SEQ ID NO: 3756765 - DNA, 18 bp, Homo sapiens
ctacctcaacctgtaaat

SEQ ID NO: 3756766 - DNA, 11 bp, Homo sapiens
ctacctcagcc

SEQ ID NO: 3756767 - DNA, 14 bp, Homo sapiens
ctacctcaggcagg

SEQ ID NO: 3756768 - DNA, 20 bp, Homo sapiens
ctacctcaggcaggaagggc

SEQ ID NO: 3756769 - DNA, 17 bp, Homo sapiens
ctacctgaacacttatt

SEQ ID NO: 3756770 - DNA, 13 bp, Homo sapiens
ctacctgtgcctg

SEQ ID NO: 3756771 - DNA, 15 bp, Homo sapiens
ctaccttcaaagctg

SEQ ID NO: 3756772 - DNA, 22 bp, Homo sapiens
ctaccttgaggtcttttgacat

SEQ ID NO: 3756773 - DNA, 23 bp, Homo sapiens
ctaccttgaggtcttttgacatg

SEQ ID NO: 3756774 - DNA, 14 bp, Homo sapiens
ctacgctctccttt

SEQ ID NO: 3756775 - DNA, 17 bp, Homo sapiens
ctacgttaccaggcagg

SEQ ID NO: 3756776 - DNA, 15 bp, Homo sapiens
ctactagatgtcttt

SEQ ID NO: 3756777 - DNA, 16 bp, Homo sapiens
ctactcaagaggctga

SEQ ID NO: 3756778 - DNA, 20 bp, Homo sapiens
ctactcaagaggctgaggca

SEQ ID NO: 3756779 - DNA, 18 bp, Homo sapiens
ctactcacagtctcttta

SEQ ID NO: 3756780 - DNA, 17 bp, Homo sapiens
ctactcagaagcctgag

SEQ ID NO: 3756781 - DNA, 19 bp, Homo sapiens
ctactcagaagcctgaggc

SEQ ID NO: 3756782 - DNA, 21 bp, Homo sapiens
ctactcagaagcctgaggctg

SEQ ID NO: 3756783 - DNA, 13 bp, Homo sapiens
ctactcaggaggc

SEQ ID NO: 3756784 - DNA, 22 bp, Homo sapiens
ctactctcaggatcaagaaagt

SEQ ID NO: 3756785 - DNA, 17 bp, Homo sapiens
ctactgattgtttcatt

SEQ ID NO: 3756786 - DNA, 17 bp, Homo sapiens
ctactggtcttgtggaa

SEQ ID NO: 3756787 - DNA, 20 bp, Homo sapiens
ctactgtcctacccaccctc

SEQ ID NO: 3756788 - DNA, 15 bp, Homo sapiens
ctactgtggaaaaat

SEQ ID NO: 3756789 - DNA, 22 bp, Homo sapiens
ctactgtggaaaaatatttaag

SEQ ID NO: 3756790 - DNA, 12 bp, Homo sapiens
ctactgtgttcc

SEQ ID NO: 3756791 - DNA, 19 bp, Homo sapiens
ctactgtgttcctggcaat

SEQ ID NO: 3756792 - DNA, 17 bp, Homo sapiens
ctacttagcatgtccct

SEQ ID NO: 3756793 - DNA, 14 bp, Homo sapiens
ctacttcctgcctg

SEQ ID NO: 3756794 - DNA, 20 bp, Homo sapiens
ctacttcctgcctggtctcc

SEQ ID NO: 3756795 - DNA, 20 bp, Homo sapiens
ctacttcctgtgacttcagc

SEQ ID NO: 3756796 - DNA, 12 bp, Homo sapiens
ctacttgggagg

SEQ ID NO: 3756797 - DNA, 14 bp, Homo sapiens
ctactttgtccttt

SEQ ID NO: 3756798 - DNA, 14 bp, Homo sapiens
ctagaacacaggca

SEQ ID NO: 3756799 - DNA, 20 bp, Homo sapiens
ctagaagggccagtcctgcc

SEQ ID NO: 3756800 - DNA, 21 bp, Homo sapiens
ctagaagtgggccaggacagg

SEQ ID NO: 3756801 - DNA, 13 bp, Homo sapiens
ctagaatttattc

SEQ ID NO: 3756802 - DNA, 22 bp, Homo sapiens
ctagaatttattcaattcctct

SEQ ID NO: 3756803 - DNA, 16 bp, Homo sapiens
ctagacaaccctgcaa

SEQ ID NO: 3756804 - DNA, 17 bp, Homo sapiens
ctagacctccagctgtt

SEQ ID NO: 3756805 - DNA, 18 bp, Homo sapiens
ctagagcctgctggatct

SEQ ID NO: 3756806 - DNA, 16 bp, Homo sapiens
ctagaggaagcagcca

SEQ ID NO: 3756807 - DNA, 19 bp, Homo sapiens
ctagaggcagggaggggac

SEQ ID NO: 3756808 - DNA, 20 bp, Homo sapiens
ctagaggccagccccaccca

SEQ ID NO: 3756809 - DNA, 22 bp, Homo sapiens
ctagaggcttgcataataagct

SEQ ID NO: 3756810 - DNA, 16 bp, Homo sapiens
ctagagggttcctgta

SEQ ID NO: 3756811 - DNA, 23 bp, Homo sapiens
ctagataaaaagatggcctttgc

SEQ ID NO: 3756812 - DNA, 21 bp, Homo sapiens
ctagatccacacacagaggaa

SEQ ID NO: 3756813 - DNA, 20 bp, Homo sapiens
ctagattctacatattcttt

SEQ ID NO: 3756814 - DNA, 24 bp, Homo sapiens
ctagattgagagaagagacaaaca

SEQ ID NO: 3756815 - DNA, 17 bp, Homo sapiens
ctagcagaaatctagaa

SEQ ID NO: 3756816 - DNA, 22 bp, Homo sapiens
ctagcagcagggagggcttctg

SEQ ID NO: 3756817 - DNA, 16 bp, Homo sapiens
ctagcatgaagacaga

SEQ ID NO: 3756818 - DNA, 13 bp, Homo sapiens
ctagcctctccag

SEQ ID NO: 3756819 - DNA, 21 bp, Homo sapiens
ctagcctgtgcctctgggact

SEQ ID NO: 3756820 - DNA, 22 bp, Homo sapiens
ctagcctgtgcctctgggactg

SEQ ID NO: 3756821 - DNA, 22 bp, Homo sapiens
ctagccttaatcaggtcctcag

SEQ ID NO: 3756822 - DNA, 21 bp, Homo sapiens
ctagccttagaagtcacacag

SEQ ID NO: 3756823 - DNA, 22 bp, Homo sapiens
ctagccttagaagtcacacagt

SEQ ID NO: 3756824 - DNA, 16 bp, Homo sapiens
ctagcgctgccgcacc

SEQ ID NO: 3756825 - DNA, 15 bp, Homo sapiens
ctagctatgtgacct

SEQ ID NO: 3756826 - DNA, 20 bp, Homo sapiens
ctagcttacatgagaacaga

SEQ ID NO: 3756827 - DNA, 15 bp, Homo sapiens
ctaggaattcccagc

SEQ ID NO: 3756828 - DNA, 16 bp, Homo sapiens
ctaggacatgttccct

SEQ ID NO: 3756829 - DNA, 22 bp, Homo sapiens
ctaggacatgttcccttctcct

SEQ ID NO: 3756830 - DNA, 22 bp, Homo sapiens
ctaggacccctccatgtgggct

SEQ ID NO: 3756831 - DNA, 14 bp, Homo sapiens
ctaggcatcccagg

SEQ ID NO: 3756832 - DNA, 14 bp, Homo sapiens
ctaggccactcctc

SEQ ID NO: 3756833 - DNA, 16 bp, Homo sapiens
ctaggccactcctcca

SEQ ID NO: 3756834 - DNA, 19 bp, Homo sapiens
ctaggccactcctccaaag

SEQ ID NO: 3756835 - DNA, 12 bp, Homo sapiens
ctaggccgggcg

SEQ ID NO: 3756836 - DNA, 18 bp, Homo sapiens
ctaggcctggccagatgc

SEQ ID NO: 3756837 - DNA, 12 bp, Homo sapiens
ctaggcctgggg

SEQ ID NO: 3756838 - DNA, 13 bp, Homo sapiens
ctaggcctgggga

SEQ ID NO: 3756839 - DNA, 13 bp, Homo sapiens
ctaggctccaccc

SEQ ID NO: 3756840 - DNA, 18 bp, Homo sapiens
ctaggctgggtgcccaca

SEQ ID NO: 3756841 - DNA, 20 bp, Homo sapiens
ctaggctgggtgcccacagc

SEQ ID NO: 3756842 - DNA, 11 bp, Homo sapiens
ctagggaagaa

SEQ ID NO: 3756843 - DNA, 20 bp, Homo sapiens
ctagggaagaaagcagaaca

SEQ ID NO: 3756844 - DNA, 15 bp, Homo sapiens
ctagggagagaccct

SEQ ID NO: 3756845 - DNA, 14 bp, Homo sapiens
ctagggaggacctt

SEQ ID NO: 3756846 - DNA, 21 bp, Homo sapiens
ctaggggtcagggaccaagga

SEQ ID NO: 3756847 - DNA, 17 bp, Homo sapiens
ctagggtggcccttgca

SEQ ID NO: 3756848 - DNA, 20 bp, Homo sapiens
ctaggtaatttttacagaat

SEQ ID NO: 3756849 - DNA, 19 bp, Homo sapiens
ctaggtcaaggcctgtccc

SEQ ID NO: 3756850 - DNA, 22 bp, Homo sapiens
ctaggtcagtacccacctgagc

SEQ ID NO: 3756851 - DNA, 24 bp, Homo sapiens
ctaggtgacagagtgagactctgt

SEQ ID NO: 3756852 - DNA, 19 bp, Homo sapiens
ctaggtgggccagcccctc

SEQ ID NO: 3756853 - DNA, 16 bp, Homo sapiens
ctagtcagagagagtg

SEQ ID NO: 3756854 - DNA, 17 bp, Homo sapiens
ctagtcccttcccctcc

SEQ ID NO: 3756855 - DNA, 20 bp, Homo sapiens
ctagtcccttcccctccctg

SEQ ID NO: 3756856 - DNA, 21 bp, Homo sapiens
ctagtcccttcccctccctgg

SEQ ID NO: 3756857 - DNA, 23 bp, Homo sapiens
ctagtcccttcccctccctggct

SEQ ID NO: 3756858 - DNA, 18 bp, Homo sapiens
ctagtctgtgtgctgtgg

SEQ ID NO: 3756859 - DNA, 17 bp, Homo sapiens
ctagtgatttctggggc

SEQ ID NO: 3756860 - DNA, 13 bp, Homo sapiens
ctagtgcagctga

SEQ ID NO: 3756861 - DNA, 14 bp, Homo sapiens
ctagtgcagctgat

SEQ ID NO: 3756862 - DNA, 15 bp, Homo sapiens
ctagtgcagctgatt

SEQ ID NO: 3756863 - DNA, 19 bp, Homo sapiens
ctagtgccctccacagccg

SEQ ID NO: 3756864 - DNA, 12 bp, Homo sapiens
ctagtgctgaag

SEQ ID NO: 3756865 - DNA, 14 bp, Homo sapiens
ctagtgctgaagct

SEQ ID NO: 3756866 - DNA, 17 bp, Homo sapiens
ctagtgctgaagcttat

SEQ ID NO: 3756867 - DNA, 21 bp, Homo sapiens
ctagtgctgaagcttattaat

SEQ ID NO: 3756868 - DNA, 17 bp, Homo sapiens
ctagtggggtctccctc

SEQ ID NO: 3756869 - DNA, 24 bp, Homo sapiens
ctagttcatccaatcctcactggg

SEQ ID NO: 3756870 - DNA, 22 bp, Homo sapiens
ctagttcctgatgacccaggct

SEQ ID NO: 3756871 - DNA, 17 bp, Homo sapiens
ctagttttctcctccca

SEQ ID NO: 3756872 - DNA, 18 bp, Homo sapiens
ctataaatggtgtttttt

SEQ ID NO: 3756873 - DNA, 23 bp, Homo sapiens
ctataaatggtgtttttttaata

SEQ ID NO: 3756874 - DNA, 15 bp, Homo sapiens
ctatacaactggaca

SEQ ID NO: 3756875 - DNA, 12 bp, Homo sapiens
ctatagactcta

SEQ ID NO: 3756876 - DNA, 18 bp, Homo sapiens
ctatagcctaggtgacag

SEQ ID NO: 3756877 - DNA, 13 bp, Homo sapiens
ctatatccatgta

SEQ ID NO: 3756878 - DNA, 14 bp, Homo sapiens
ctatatccatgtac

SEQ ID NO: 3756879 - DNA, 18 bp, Homo sapiens
ctatatccatgtactgta

SEQ ID NO: 3756880 - DNA, 19 bp, Homo sapiens
ctatatccatgtactgtag

SEQ ID NO: 3756881 - DNA, 13 bp, Homo sapiens
ctatatctgtttt

SEQ ID NO: 3756882 - DNA, 18 bp, Homo sapiens
ctatatctgttttactgc

SEQ ID NO: 3756883 - DNA, 10 bp, Homo sapiens
ctatatgtat

SEQ ID NO: 3756884 - DNA, 13 bp, Homo sapiens
ctatattgtacac

SEQ ID NO: 3756885 - DNA, 15 bp, Homo sapiens
ctatattgtacacac

SEQ ID NO: 3756886 - DNA, 14 bp, Homo sapiens
ctatatttaagtat

SEQ ID NO: 3756887 - DNA, 22 bp, Homo sapiens
ctatatttaagtattcaagaaa

SEQ ID NO: 3756888 - DNA, 13 bp, Homo sapiens
ctatatttagatt

SEQ ID NO: 3756889 - DNA, 18 bp, Homo sapiens
ctatattttaacctgcat

SEQ ID NO: 3756890 - DNA, 15 bp, Homo sapiens
ctatcaaaataaatt

SEQ ID NO: 3756891 - DNA, 13 bp, Homo sapiens
ctatcaaactgaa

SEQ ID NO: 3756892 - DNA, 18 bp, Homo sapiens
ctatcatgtcaaacgtga

SEQ ID NO: 3756893 - DNA, 15 bp, Homo sapiens
ctatccacccagccc

SEQ ID NO: 3756894 - DNA, 16 bp, Homo sapiens
ctatcccatcccatcc

SEQ ID NO: 3756895 - DNA, 20 bp, Homo sapiens
ctatccggacagagcacgtt

SEQ ID NO: 3756896 - DNA, 14 bp, Homo sapiens
ctatcctggctttg

SEQ ID NO: 3756897 - DNA, 20 bp, Homo sapiens
ctatctaggtggagttgaaa

SEQ ID NO: 3756898 - DNA, 22 bp, Homo sapiens
ctatctaggtggagttgaaaga

SEQ ID NO: 3756899 - DNA, 18 bp, Homo sapiens
ctatctcacagcacactc

SEQ ID NO: 3756900 - DNA, 19 bp, Homo sapiens
ctatgatttggaaaataaa

SEQ ID NO: 3756901 - DNA, 19 bp, Homo sapiens
ctatgcattttaaagttaa

SEQ ID NO: 3756902 - DNA, 20 bp, Homo sapiens
ctatgctcataactgtgtca

SEQ ID NO: 3756903 - DNA, 22 bp, Homo sapiens
ctatgggactcaatgcactgac

SEQ ID NO: 3756904 - DNA, 23 bp, Homo sapiens
ctatgggactcaatgcactgaca

SEQ ID NO: 3756905 - DNA, 12 bp, Homo sapiens
ctatggtaaaga

SEQ ID NO: 3756906 - DNA, 13 bp, Homo sapiens
ctatggtaaagat

SEQ ID NO: 3756907 - DNA, 22 bp, Homo sapiens
ctatggtaaagatattattcac

SEQ ID NO: 3756908 - DNA, 12 bp, Homo sapiens
ctatggtcatct

SEQ ID NO: 3756909 - DNA, 21 bp, Homo sapiens
ctatgtaactgcattgagaac

SEQ ID NO: 3756910 - DNA, 16 bp, Homo sapiens
ctatgtatcaatgagt

SEQ ID NO: 3756911 - DNA, 17 bp, Homo sapiens
ctatgtggctgtatctt

SEQ ID NO: 3756912 - DNA, 16 bp, Homo sapiens
ctattaagcagtaaaa

SEQ ID NO: 3756913 - DNA, 16 bp, Homo sapiens
ctattagccacaaaat

SEQ ID NO: 3756914 - DNA, 15 bp, Homo sapiens
ctattataatttaat

SEQ ID NO: 3756915 - DNA, 21 bp, Homo sapiens
ctattgatataaataaaacat

SEQ ID NO: 3756916 - DNA, 11 bp, Homo sapiens
ctattggtaaa

SEQ ID NO: 3756917 - DNA, 12 bp, Homo sapiens
ctattgtaagat

SEQ ID NO: 3756918 - DNA, 13 bp, Homo sapiens
ctatttaaattct

SEQ ID NO: 3756919 - DNA, 18 bp, Homo sapiens
ctatttagcatgacaagc

SEQ ID NO: 3756920 - DNA, 23 bp, Homo sapiens
ctatttagtttttgtaatttatt

SEQ ID NO: 3756921 - DNA, 22 bp, Homo sapiens
ctatttatctgtgtttttgaaa

SEQ ID NO: 3756922 - DNA, 18 bp, Homo sapiens
ctatttcaaaaatttgga

SEQ ID NO: 3756923 - DNA, 13 bp, Homo sapiens
ctatttctgagaa

SEQ ID NO: 3756924 - DNA, 13 bp, Homo sapiens
ctatttgtattgt

SEQ ID NO: 3756925 - DNA, 23 bp, Homo sapiens
ctatttgttttcttctgtatgtt

SEQ ID NO: 3756926 - DNA, 14 bp, Homo sapiens
ctattttactgtct

SEQ ID NO: 3756927 - DNA, 17 bp, Homo sapiens
ctattttactgtcttaa

SEQ ID NO: 3756928 - DNA, 23 bp, Homo sapiens
ctattttactgtcttaattaagt

SEQ ID NO: 3756929 - DNA, 14 bp, Homo sapiens
ctattttcagaatc

SEQ ID NO: 3756930 - DNA, 15 bp, Homo sapiens
ctattttcagaatct

SEQ ID NO: 3756931 - DNA, 12 bp, Homo sapiens
ctatttttgtag

SEQ ID NO: 3756932 - DNA, 13 bp, Homo sapiens
ctatttttgtaga

SEQ ID NO: 3756933 - DNA, 19 bp, Homo sapiens
ctatttttttaaaatcact

SEQ ID NO: 3756934 - DNA, 20 bp, Homo sapiens
ctcaaaagcacccttgacgt

SEQ ID NO: 3756935 - DNA, 23 bp, Homo sapiens
ctcaaaaggaaaccaagtggtca

SEQ ID NO: 3756936 - DNA, 18 bp, Homo sapiens
ctcaaaatatttgtacat

SEQ ID NO: 3756937 - DNA, 16 bp, Homo sapiens
ctcaaaatgacagcca

SEQ ID NO: 3756938 - DNA, 20 bp, Homo sapiens
ctcaaactcttgacctcagg

SEQ ID NO: 3756939 - DNA, 23 bp, Homo sapiens
ctcaaagtgactattcagttttc

SEQ ID NO: 3756940 - DNA, 22 bp, Homo sapiens
ctcaaatgcagtatttttgttg

SEQ ID NO: 3756941 - DNA, 20 bp, Homo sapiens
ctcaacaaaagtgctttgga

SEQ ID NO: 3756942 - DNA, 19 bp, Homo sapiens
ctcaacccccatttctatt

SEQ ID NO: 3756943 - DNA, 22 bp, Homo sapiens
ctcaacccccatttctatttat

SEQ ID NO: 3756944 - DNA, 15 bp, Homo sapiens
ctcaacctgtaaatt

SEQ ID NO: 3756945 - DNA, 21 bp, Homo sapiens
ctcaacctgtaaattatttta

SEQ ID NO: 3756946 - DNA, 21 bp, Homo sapiens
ctcaacctgtgatgaggggag

SEQ ID NO: 3756947 - DNA, 23 bp, Homo sapiens
ctcaagacccttttgggtttctg

SEQ ID NO: 3756948 - DNA, 17 bp, Homo sapiens
ctcaagaggctgaggca

SEQ ID NO: 3756949 - DNA, 17 bp, Homo sapiens
ctcaagcaatcctcctg

SEQ ID NO: 3756950 - DNA, 22 bp, Homo sapiens
ctcaagccaagcagccaagctc

SEQ ID NO: 3756951 - DNA, 12 bp, Homo sapiens
ctcaagccctgc

SEQ ID NO: 3756952 - DNA, 13 bp, Homo sapiens
ctcaagccctgca

SEQ ID NO: 3756953 - DNA, 22 bp, Homo sapiens
ctcaaggacaaagtctccagcc

SEQ ID NO: 3756954 - DNA, 10 bp, Homo sapiens
ctcaaggact

SEQ ID NO: 3756955 - DNA, 15 bp, Homo sapiens
ctcaaggacttgaaa

SEQ ID NO: 3756956 - DNA, 16 bp, Homo sapiens
ctcaaggcgtgaggat

SEQ ID NO: 3756957 - DNA, 16 bp, Homo sapiens
ctcaagtcttccctga

SEQ ID NO: 3756958 - DNA, 15 bp, Homo sapiens
ctcaagttcaaggac

SEQ ID NO: 3756959 - DNA, 17 bp, Homo sapiens
ctcaagttcaaggacca

SEQ ID NO: 3756960 - DNA, 20 bp, Homo sapiens
ctcaataaagtgctttaaaa

SEQ ID NO: 3756961 - DNA, 15 bp, Homo sapiens
ctcaatgcactgaca

SEQ ID NO: 3756962 - DNA, 21 bp, Homo sapiens
ctcaatgtgaatcagacccta

SEQ ID NO: 3756963 - DNA, 13 bp, Homo sapiens
ctcaattgttttt

SEQ ID NO: 3756964 - DNA, 15 bp, Homo sapiens
ctcaattgtttttgt

SEQ ID NO: 3756965 - DNA, 22 bp, Homo sapiens
ctcacaaaccatgcaaatgcta

SEQ ID NO: 3756966 - DNA, 21 bp, Homo sapiens
ctcacaccgcgtctggtgaca

SEQ ID NO: 3756967 - DNA, 17 bp, Homo sapiens
ctcacagcacactcagc

SEQ ID NO: 3756968 - DNA, 19 bp, Homo sapiens
ctcacagtctctttaatct

SEQ ID NO: 3756969 - DNA, 22 bp, Homo sapiens
ctcacagtgggagccagggctg

SEQ ID NO: 3756970 - DNA, 17 bp, Homo sapiens
ctcacagttcctcgccc

SEQ ID NO: 3756971 - DNA, 20 bp, Homo sapiens
ctcacatctttcacacttcc

SEQ ID NO: 3756972 - DNA, 21 bp, Homo sapiens
ctcacatgctggacaggtctg

SEQ ID NO: 3756973 - DNA, 18 bp, Homo sapiens
ctcacccccagctttgct

SEQ ID NO: 3756974 - DNA, 19 bp, Homo sapiens
ctcacccccagctttgcta

SEQ ID NO: 3756975 - DNA, 16 bp, Homo sapiens
ctcaccccgtctgggg

SEQ ID NO: 3756976 - DNA, 15 bp, Homo sapiens
ctcacccctgccctg

SEQ ID NO: 3756977 - DNA, 16 bp, Homo sapiens
ctcacccctgccctgg

SEQ ID NO: 3756978 - DNA, 17 bp, Homo sapiens
ctcacccctgccctggg

SEQ ID NO: 3756979 - DNA, 18 bp, Homo sapiens
ctcacccctgccctggga

SEQ ID NO: 3756980 - DNA, 16 bp, Homo sapiens
ctcacctctgcctcaa

SEQ ID NO: 3756981 - DNA, 18 bp, Homo sapiens
ctcacctctgcctcaatg

SEQ ID NO: 3756982 - DNA, 15 bp, Homo sapiens
ctcacctgctggccc

SEQ ID NO: 3756983 - DNA, 16 bp, Homo sapiens
ctcacctgctggcccc

SEQ ID NO: 3756984 - DNA, 18 bp, Homo sapiens
ctcacctgctggcccctc

SEQ ID NO: 3756985 - DNA, 19 bp, Homo sapiens
ctcacctgctggcccctca

SEQ ID NO: 3756986 - DNA, 20 bp, Homo sapiens
ctcacctgggcacctgggga

SEQ ID NO: 3756987 - DNA, 21 bp, Homo sapiens
ctcacctggggtgtgggaggc

SEQ ID NO: 3756988 - DNA, 18 bp, Homo sapiens
ctcacgcctgtaatccca

SEQ ID NO: 3756989 - DNA, 19 bp, Homo sapiens
ctcacgcctgtaatcccag

SEQ ID NO: 3756990 - DNA, 20 bp, Homo sapiens
ctcacgctcccaacacaagg

SEQ ID NO: 3756991 - DNA, 19 bp, Homo sapiens
ctcacgggcagtagctgtg

SEQ ID NO: 3756992 - DNA, 16 bp, Homo sapiens
ctcacgtgagagtgtc

SEQ ID NO: 3756993 - DNA, 21 bp, Homo sapiens
ctcactatgttgcccaggcag

SEQ ID NO: 3756994 - DNA, 12 bp, Homo sapiens
ctcactccacca

SEQ ID NO: 3756995 - DNA, 20 bp, Homo sapiens
ctcactccaccacccaaaag

SEQ ID NO: 3756996 - DNA, 12 bp, Homo sapiens
ctcactcccctc

SEQ ID NO: 3756997 - DNA, 20 bp, Homo sapiens
ctcactcccctcctttccca

SEQ ID NO: 3756998 - DNA, 22 bp, Homo sapiens
ctcactcccctcctttcccaac

SEQ ID NO: 3756999 - DNA, 21 bp, Homo sapiens
ctcactcccttcccataagct

SEQ ID NO: 3757000 - DNA, 15 bp, Homo sapiens
ctcactcctacctgg

SEQ ID NO: 3757001 - DNA, 13 bp, Homo sapiens
ctcactctgtcgc

SEQ ID NO: 3757002 - DNA, 16 bp, Homo sapiens
ctcactgcagcctcaa

SEQ ID NO: 3757003 - DNA, 15 bp, Homo sapiens
ctcactgcagcctcg

SEQ ID NO: 3757004 - DNA, 19 bp, Homo sapiens
ctcactgccatgccagctt

SEQ ID NO: 3757005 - DNA, 18 bp, Homo sapiens
ctcactggcagccccagc

SEQ ID NO: 3757006 - DNA, 19 bp, Homo sapiens
ctcactggcagccccagca

SEQ ID NO: 3757007 - DNA, 12 bp, Homo sapiens
ctcactgggtgg

SEQ ID NO: 3757008 - DNA, 15 bp, Homo sapiens
ctcactgttgcccag

SEQ ID NO: 3757009 - DNA, 22 bp, Homo sapiens
ctcactgttgcccaggctggcg

SEQ ID NO: 3757010 - DNA, 15 bp, Homo sapiens
ctcagaacacattct

SEQ ID NO: 3757011 - DNA, 13 bp, Homo sapiens
ctcagaagacact

SEQ ID NO: 3757012 - DNA, 22 bp, Homo sapiens
ctcagaagacactgatgggcaa

SEQ ID NO: 3757013 - DNA, 13 bp, Homo sapiens
ctcagaagcctga

SEQ ID NO: 3757014 - DNA, 19 bp, Homo sapiens
ctcagaaggtattcctttt

SEQ ID NO: 3757015 - DNA, 14 bp, Homo sapiens
ctcagactgctcaa

SEQ ID NO: 3757016 - DNA, 14 bp, Homo sapiens
ctcagagtccaggc

SEQ ID NO: 3757017 - DNA, 22 bp, Homo sapiens
ctcagatggaaccgcaggaagc

SEQ ID NO: 3757018 - DNA, 20 bp, Homo sapiens
ctcagcaaaagatgcttctc

SEQ ID NO: 3757019 - DNA, 21 bp, Homo sapiens
ctcagcaaaagatgcttctca

SEQ ID NO: 3757020 - DNA, 20 bp, Homo sapiens
ctcagcacccccttctctgc

SEQ ID NO: 3757021 - DNA, 12 bp, Homo sapiens
ctcagcagccct

SEQ ID NO: 3757022 - DNA, 22 bp, Homo sapiens
ctcagccaaccttacttacagc

SEQ ID NO: 3757023 - DNA, 19 bp, Homo sapiens
ctcagcccacatagtgatg

SEQ ID NO: 3757024 - DNA, 16 bp, Homo sapiens
ctcagcccctcttgcc

SEQ ID NO: 3757025 - DNA, 11 bp, Homo sapiens
ctcagccctga

SEQ ID NO: 3757026 - DNA, 14 bp, Homo sapiens
ctcagccctgaggt

SEQ ID NO: 3757027 - DNA, 15 bp, Homo sapiens
ctcagccctgggccc

SEQ ID NO: 3757028 - DNA, 19 bp, Homo sapiens
ctcagccctgggccccacc

SEQ ID NO: 3757029 - DNA, 21 bp, Homo sapiens
ctcagccctgggccccaccac

SEQ ID NO: 3757030 - DNA, 16 bp, Homo sapiens
ctcagcctcccaaagt

SEQ ID NO: 3757031 - DNA, 13 bp, Homo sapiens
ctcagcctcccga

SEQ ID NO: 3757032 - DNA, 21 bp, Homo sapiens
ctcagcctcccgaatagctgg

SEQ ID NO: 3757033 - DNA, 20 bp, Homo sapiens
ctcagcctccggagtagctg

SEQ ID NO: 3757034 - DNA, 22 bp, Homo sapiens
ctcagcctcctgtgtagctggg

SEQ ID NO: 3757035 - DNA, 17 bp, Homo sapiens
ctcagcctctgaatatg

SEQ ID NO: 3757036 - DNA, 18 bp, Homo sapiens
ctcagcctggtgggcctc

SEQ ID NO: 3757037 - DNA, 20 bp, Homo sapiens
ctcagcctggtgggcctcct

SEQ ID NO: 3757038 - DNA, 14 bp, Homo sapiens
ctcagcctgtgctg

SEQ ID NO: 3757039 - DNA, 23 bp, Homo sapiens
ctcagccttccccttgcccaggg

SEQ ID NO: 3757040 - DNA, 19 bp, Homo sapiens
ctcagcggggacagctcct

SEQ ID NO: 3757041 - DNA, 20 bp, Homo sapiens
ctcagcggggacagctcctt

SEQ ID NO: 3757042 - DNA, 13 bp, Homo sapiens
ctcagctctggct

SEQ ID NO: 3757043 - DNA, 14 bp, Homo sapiens
ctcagctctggctc

SEQ ID NO: 3757044 - DNA, 17 bp, Homo sapiens
ctcagctctggctcaca

SEQ ID NO: 3757045 - DNA, 17 bp, Homo sapiens
ctcagctttttgtcttt

SEQ ID NO: 3757046 - DNA, 17 bp, Homo sapiens
ctcaggaccctcgctgg

SEQ ID NO: 3757047 - DNA, 23 bp, Homo sapiens
ctcaggaggctgaggcagaagaa

SEQ ID NO: 3757048 - DNA, 23 bp, Homo sapiens
ctcaggaggctgaggcaggagga

SEQ ID NO: 3757049 - DNA, 22 bp, Homo sapiens
ctcaggcataggcctgggtgct

SEQ ID NO: 3757050 - DNA, 18 bp, Homo sapiens
ctcaggccacctgccccc

SEQ ID NO: 3757051 - DNA, 14 bp, Homo sapiens
ctcaggctctgccc

SEQ ID NO: 3757052 - DNA, 17 bp, Homo sapiens
ctcaggctctgccctgc

SEQ ID NO: 3757053 - DNA, 19 bp, Homo sapiens
ctcaggctctgccctgccc

SEQ ID NO: 3757054 - DNA, 22 bp, Homo sapiens
ctcaggctctgccctgccctag

SEQ ID NO: 3757055 - DNA, 17 bp, Homo sapiens
ctcaggctgaccacttt

SEQ ID NO: 3757056 - DNA, 11 bp, Homo sapiens
ctcaggctgct

SEQ ID NO: 3757057 - DNA, 14 bp, Homo sapiens
ctcaggctgctgga

SEQ ID NO: 3757058 - DNA, 15 bp, Homo sapiens
ctcagggaagcccag

SEQ ID NO: 3757059 - DNA, 16 bp, Homo sapiens
ctcagggaagcccagc

SEQ ID NO: 3757060 - DNA, 20 bp, Homo sapiens
ctcagggacagagacacctg

SEQ ID NO: 3757061 - DNA, 21 bp, Homo sapiens
ctcagggacagagacacctgc

SEQ ID NO: 3757062 - DNA, 22 bp, Homo sapiens
ctcagggacagagacacctgca

SEQ ID NO: 3757063 - DNA, 15 bp, Homo sapiens
ctcagggcagcctgc

SEQ ID NO: 3757064 - DNA, 18 bp, Homo sapiens
ctcaggtacagagaagga

SEQ ID NO: 3757065 - DNA, 14 bp, Homo sapiens
ctcaggtgagaagc

SEQ ID NO: 3757066 - DNA, 16 bp, Homo sapiens
ctcaggtgagaagcag

SEQ ID NO: 3757067 - DNA, 18 bp, Homo sapiens
ctcaggtgatccacccac

SEQ ID NO: 3757068 - DNA, 19 bp, Homo sapiens
ctcaggtgatccacccacc

SEQ ID NO: 3757069 - DNA, 15 bp, Homo sapiens
ctcaggtgtccctgc

SEQ ID NO: 3757070 - DNA, 23 bp, Homo sapiens
ctcaggtgtccctgcacttgcag

SEQ ID NO: 3757071 - DNA, 14 bp, Homo sapiens
ctcaggttgtctga

SEQ ID NO: 3757072 - DNA, 15 bp, Homo sapiens
ctcagtccatagcag

SEQ ID NO: 3757073 - DNA, 16 bp, Homo sapiens
ctcagtctcaggagca

SEQ ID NO: 3757074 - DNA, 22 bp, Homo sapiens
ctcagtctggcccttccttttc

SEQ ID NO: 3757075 - DNA, 23 bp, Homo sapiens
ctcagtcttccctagggctgggt

SEQ ID NO: 3757076 - DNA, 16 bp, Homo sapiens
ctcagtggactttcca

SEQ ID NO: 3757077 - DNA, 19 bp, Homo sapiens
ctcagtggactttccaccc

SEQ ID NO: 3757078 - DNA, 18 bp, Homo sapiens
ctcagtgtcatttatgaa

SEQ ID NO: 3757079 - DNA, 18 bp, Homo sapiens
ctcagttcccttggcctc

SEQ ID NO: 3757080 - DNA, 19 bp, Homo sapiens
ctcagttcccttggcctca

SEQ ID NO: 3757081 - DNA, 21 bp, Homo sapiens
ctcagttcccttggcctcaga

SEQ ID NO: 3757082 - DNA, 22 bp, Homo sapiens
ctcagttcccttggcctcagaa

SEQ ID NO: 3757083 - DNA, 12 bp, Homo sapiens
ctcagtttccct

SEQ ID NO: 3757084 - DNA, 16 bp, Homo sapiens
ctcagtttccctatct

SEQ ID NO: 3757085 - DNA, 17 bp, Homo sapiens
ctcataaagatggcttt

SEQ ID NO: 3757086 - DNA, 14 bp, Homo sapiens
ctcatactcacctc

SEQ ID NO: 3757087 - DNA, 12 bp, Homo sapiens
ctcatagcatta

SEQ ID NO: 3757088 - DNA, 16 bp, Homo sapiens
ctcatagcattaacta

SEQ ID NO: 3757089 - DNA, 15 bp, Homo sapiens
ctcatcataaaataa

SEQ ID NO: 3757090 - DNA, 14 bp, Homo sapiens
ctcatccccagggg

SEQ ID NO: 3757091 - DNA, 22 bp, Homo sapiens
ctcatccccaggggtcccagcc

SEQ ID NO: 3757092 - DNA, 15 bp, Homo sapiens
ctcatccgaggcagg

SEQ ID NO: 3757093 - DNA, 13 bp, Homo sapiens
ctcatcctgcagg

SEQ ID NO: 3757094 - DNA, 17 bp, Homo sapiens
ctcatccttttctccta

SEQ ID NO: 3757095 - DNA, 19 bp, Homo sapiens
ctcatgatcttgtgacata

SEQ ID NO: 3757096 - DNA, 17 bp, Homo sapiens
ctcatgggcccctctga

SEQ ID NO: 3757097 - DNA, 20 bp, Homo sapiens
ctcatgggcccctctgactc

SEQ ID NO: 3757098 - DNA, 14 bp, Homo sapiens
cctgccccctggtg

SEQ ID NO: 3757099 - DNA, 16 bp, Homo sapiens
cctgccccctggtgga

SEQ ID NO: 3757100 - DNA, 12 bp, Homo sapiens
cctgcccccttc

SEQ ID NO: 3757101 - DNA, 17 bp, Homo sapiens
cctgcccccttctccca

SEQ ID NO: 3757102 - DNA, 22 bp, Homo sapiens
cctgcccccttctcccacactg

SEQ ID NO: 3757103 - DNA, 22 bp, Homo sapiens
cctgccccgcccagctgcacct

SEQ ID NO: 3757104 - DNA, 23 bp, Homo sapiens
cctgccccgtcaccatctcaggc

SEQ ID NO: 3757105 - DNA, 14 bp, Homo sapiens
cctgcccctcccag

SEQ ID NO: 3757106 - DNA, 14 bp, Homo sapiens
cctgcccctccctt

SEQ ID NO: 3757107 - DNA, 18 bp, Homo sapiens
cctgcccctcccttcaac

SEQ ID NO: 3757108 - DNA, 21 bp, Homo sapiens
cctgccccttctacactctcc

SEQ ID NO: 3757109 - DNA, 16 bp, Homo sapiens
cctgcccggctgcgga

SEQ ID NO: 3757110 - DNA, 19 bp, Homo sapiens
cctgccctagagcacactg

SEQ ID NO: 3757111 - DNA, 15 bp, Homo sapiens
cctgcccttgtccca

SEQ ID NO: 3757112 - DNA, 16 bp, Homo sapiens
cctgccgacacgctcc

SEQ ID NO: 3757113 - DNA, 20 bp, Homo sapiens
cctgccgacacgctccctcc

SEQ ID NO: 3757114 - DNA, 18 bp, Homo sapiens
cctgccgacctcgtcctc

SEQ ID NO: 3757115 - DNA, 14 bp, Homo sapiens
cctgccgcctcaat

SEQ ID NO: 3757116 - DNA, 20 bp, Homo sapiens
cctgcctagcactcacatgc

SEQ ID NO: 3757117 - DNA, 13 bp, Homo sapiens
cctgcctgtctcc

SEQ ID NO: 3757118 - DNA, 14 bp, Homo sapiens
cctgcctgtctcct

SEQ ID NO: 3757119 - DNA, 12 bp, Homo sapiens
cctgcctgtgct

SEQ ID NO: 3757120 - DNA, 14 bp, Homo sapiens
cctgccttcgttaa

SEQ ID NO: 3757121 - DNA, 17 bp, Homo sapiens
cctgccttgaagccact

SEQ ID NO: 3757122 - DNA, 21 bp, Homo sapiens
cctgccttgaagccactgaag

SEQ ID NO: 3757123 - DNA, 23 bp, Homo sapiens
cctgccttgaagccactgaagct

SEQ ID NO: 3757124 - DNA, 19 bp, Homo sapiens
cctgcgggcttttccccgg

SEQ ID NO: 3757125 - DNA, 14 bp, Homo sapiens
cctgcggtcaaggc

SEQ ID NO: 3757126 - DNA, 16 bp, Homo sapiens
cctgcggtcaaggcca

SEQ ID NO: 3757127 - DNA, 18 bp, Homo sapiens
cctgcggtcaaggccagc

SEQ ID NO: 3757128 - DNA, 14 bp, Homo sapiens
cctgctagaaatgg

SEQ ID NO: 3757129 - DNA, 23 bp, Homo sapiens
cctgctagatgagaattcagctg

SEQ ID NO: 3757130 - DNA, 23 bp, Homo sapiens
cctgctcccccaccccctcccca

SEQ ID NO: 3757131 - DNA, 21 bp, Homo sapiens
cctgctctccgaccagacacc

SEQ ID NO: 3757132 - DNA, 16 bp, Homo sapiens
cctgctctcctcttgc

SEQ ID NO: 3757133 - DNA, 16 bp, Homo sapiens
cctgctctctacccag

SEQ ID NO: 3757134 - DNA, 13 bp, Homo sapiens
cctgctgccccag

SEQ ID NO: 3757135 - DNA, 22 bp, Homo sapiens
cctgctgccccagctgactgtg

SEQ ID NO: 3757136 - DNA, 13 bp, Homo sapiens
cctgctgcctccc

SEQ ID NO: 3757137 - DNA, 17 bp, Homo sapiens
cctgctggatctcccag

SEQ ID NO: 3757138 - DNA, 11 bp, Homo sapiens
cctgctggccc

SEQ ID NO: 3757139 - DNA, 12 bp, Homo sapiens
cctgctggcccc

SEQ ID NO: 3757140 - DNA, 16 bp, Homo sapiens
cctgctggcccctcac

SEQ ID NO: 3757141 - DNA, 16 bp, Homo sapiens
cctgctgggctctcca

SEQ ID NO: 3757142 - DNA, 17 bp, Homo sapiens
cctgctgggctctccac

SEQ ID NO: 3757143 - DNA, 24 bp, Homo sapiens
cctgctgggctctccacctcagcc

SEQ ID NO: 3757144 - DNA, 13 bp, Homo sapiens
cctgctggttcag

SEQ ID NO: 3757145 - DNA, 19 bp, Homo sapiens
cctgctggttcagggttgg

SEQ ID NO: 3757146 - DNA, 17 bp, Homo sapiens
cctgctttgggctgccc

SEQ ID NO: 3757147 - DNA, 21 bp, Homo sapiens
cctgctttgggctgccctggt

SEQ ID NO: 3757148 - DNA, 20 bp, Homo sapiens
cctggaaaggctcagtctca

SEQ ID NO: 3757149 - DNA, 22 bp, Homo sapiens
cctggaaaggctcagtctcagg

SEQ ID NO: 3757150 - DNA, 17 bp, Homo sapiens
cctggaagagcagccct

SEQ ID NO: 3757151 - DNA, 20 bp, Homo sapiens
cctggaagccctctctggct

SEQ ID NO: 3757152 - DNA, 13 bp, Homo sapiens
cctggaagctgtg

SEQ ID NO: 3757153 - DNA, 18 bp, Homo sapiens
cctggaagctgtgtcctt

SEQ ID NO: 3757154 - DNA, 21 bp, Homo sapiens
cctggaagctgtgtccttgca

SEQ ID NO: 3757155 - DNA, 14 bp, Homo sapiens
cctggaccaaagct

SEQ ID NO: 3757156 - DNA, 17 bp, Homo sapiens
cctggagagtctcactc

SEQ ID NO: 3757157 - DNA, 18 bp, Homo sapiens
cctggagccccactgccc

SEQ ID NO: 3757158 - DNA, 14 bp, Homo sapiens
cctggagctcctgg

SEQ ID NO: 3757159 - DNA, 15 bp, Homo sapiens
cctggagctcctggg

SEQ ID NO: 3757160 - DNA, 18 bp, Homo sapiens
cctggagctcctgggaag

SEQ ID NO: 3757161 - DNA, 16 bp, Homo sapiens
cctggatctaccagca

SEQ ID NO: 3757162 - DNA, 12 bp, Homo sapiens
cctggcaatagt

SEQ ID NO: 3757163 - DNA, 16 bp, Homo sapiens
cctggcacagggcagt

SEQ ID NO: 3757164 - DNA, 19 bp, Homo sapiens
cctggcacccggcccctgc

SEQ ID NO: 3757165 - DNA, 18 bp, Homo sapiens
cctggcacggtggctcag

SEQ ID NO: 3757166 - DNA, 22 bp, Homo sapiens
cctggcacggtggctcaggcct

SEQ ID NO: 3757167 - DNA, 17 bp, Homo sapiens
cctggcagaactgagct

SEQ ID NO: 3757168 - DNA, 18 bp, Homo sapiens
cctggcagaactgagctc

SEQ ID NO: 3757169 - DNA, 19 bp, Homo sapiens
cctggcagccgtgccttca

SEQ ID NO: 3757170 - DNA, 13 bp, Homo sapiens
cctggccagaggc

SEQ ID NO: 3757171 - DNA, 14 bp, Homo sapiens
cctggccagaggct

SEQ ID NO: 3757172 - DNA, 13 bp, Homo sapiens
cctggccaggagc

SEQ ID NO: 3757173 - DNA, 15 bp, Homo sapiens
cctggccaggagctc

SEQ ID NO: 3757174 - DNA, 16 bp, Homo sapiens
cctggccaggagctct

SEQ ID NO: 3757175 - DNA, 22 bp, Homo sapiens
cctggccaggcagatctgtgcc

SEQ ID NO: 3757176 - DNA, 13 bp, Homo sapiens
cctggccatctct

SEQ ID NO: 3757177 - DNA, 20 bp, Homo sapiens
cctggccccatgtctctcag

SEQ ID NO: 3757178 - DNA, 20 bp, Homo sapiens
cctggccctggggcctgtac

SEQ ID NO: 3757179 - DNA, 12 bp, Homo sapiens
cctggcctgctg

SEQ ID NO: 3757180 - DNA, 13 bp, Homo sapiens
cctggcctgttct

SEQ ID NO: 3757181 - DNA, 12 bp, Homo sapiens
cctggctcagcc

SEQ ID NO: 3757182 - DNA, 14 bp, Homo sapiens
cctggctcccatga

SEQ ID NO: 3757183 - DNA, 12 bp, Homo sapiens
cctggctccgct

SEQ ID NO: 3757184 - DNA, 20 bp, Homo sapiens
cctggctctgtggcttgcta

SEQ ID NO: 3757185 - DNA, 13 bp, Homo sapiens
cctggcttctgga

SEQ ID NO: 3757186 - DNA, 16 bp, Homo sapiens
cctggcttctggagcc

SEQ ID NO: 3757187 - DNA, 21 bp, Homo sapiens
cctggcttctggagcccttgg

SEQ ID NO: 3757188 - DNA, 17 bp, Homo sapiens
cctgggactgctgcttc

SEQ ID NO: 3757189 - DNA, 17 bp, Homo sapiens
cctgggagaacctcagg

SEQ ID NO: 3757190 - DNA, 20 bp, Homo sapiens
cctgggaggtcaaggctgca

SEQ ID NO: 3757191 - DNA, 22 bp, Homo sapiens
cctgggatgtccacagatgcct

SEQ ID NO: 3757192 - DNA, 15 bp, Homo sapiens
cctgggcacctgggg

SEQ ID NO: 3757193 - DNA, 17 bp, Homo sapiens
cctgggcacctggggag

SEQ ID NO: 3757194 - DNA, 18 bp, Homo sapiens
cctgggcagccaggctgc

SEQ ID NO: 3757195 - DNA, 17 bp, Homo sapiens
cctgggcattgctttcc

SEQ ID NO: 3757196 - DNA, 23 bp, Homo sapiens
cctgggccccaccacctaggcca

SEQ ID NO: 3757197 - DNA, 13 bp, Homo sapiens
cctgggcccctcc

SEQ ID NO: 3757198 - DNA, 19 bp, Homo sapiens
cctgggcccctccctacct

SEQ ID NO: 3757199 - DNA, 24 bp, Homo sapiens
cctggggagtgggacagagtctgg

SEQ ID NO: 3757200 - DNA, 12 bp, Homo sapiens
cctggggcctcg

SEQ ID NO: 3757201 - DNA, 22 bp, Homo sapiens
cctggggctgatctcagggaag

SEQ ID NO: 3757202 - DNA, 11 bp, Homo sapiens
cctgggggcct

SEQ ID NO: 3757203 - DNA, 17 bp, Homo sapiens
cctgggggcctgacctc

SEQ ID NO: 3757204 - DNA, 22 bp, Homo sapiens
cctgggggcctgacctccccct

SEQ ID NO: 3757205 - DNA, 21 bp, Homo sapiens
cctgggggttctttcttcctc

SEQ ID NO: 3757206 - DNA, 16 bp, Homo sapiens
cctgggtctgtgtctc

SEQ ID NO: 3757207 - DNA, 21 bp, Homo sapiens
cctgggtctgtgtctcttttc

SEQ ID NO: 3757208 - DNA, 19 bp, Homo sapiens
cctgggtggggctgctcct

SEQ ID NO: 3757209 - DNA, 14 bp, Homo sapiens
cctgggtggtctgc

SEQ ID NO: 3757210 - DNA, 14 bp, Homo sapiens
cctggtccctggga

SEQ ID NO: 3757211 - DNA, 18 bp, Homo sapiens
cctggtccttccaggccc

SEQ ID NO: 3757212 - DNA, 18 bp, Homo sapiens
cctggtctcctgccccca

SEQ ID NO: 3757213 - DNA, 16 bp, Homo sapiens
cctctgacctgcaggc

SEQ ID NO: 3757214 - DNA, 19 bp, Homo sapiens
cctctgacctgcaggccaa

SEQ ID NO: 3757215 - DNA, 19 bp, Homo sapiens
cctctgagcccctgggact

SEQ ID NO: 3757216 - DNA, 14 bp, Homo sapiens
cctctgatacctca

SEQ ID NO: 3757217 - DNA, 15 bp, Homo sapiens
cctctgatacctcaa

SEQ ID NO: 3757218 - DNA, 19 bp, Homo sapiens
cctctgcacaagctgcacc

SEQ ID NO: 3757219 - DNA, 20 bp, Homo sapiens
cctctgccacctcccctatc

SEQ ID NO: 3757220 - DNA, 14 bp, Homo sapiens
cctctgccccgtct

SEQ ID NO: 3757221 - DNA, 19 bp, Homo sapiens
cctctgcctgaaccttcca

SEQ ID NO: 3757222 - DNA, 17 bp, Homo sapiens
cctctgcctgcattctg

SEQ ID NO: 3757223 - DNA, 18 bp, Homo sapiens
cctctgcctgtccctctc

SEQ ID NO: 3757224 - DNA, 22 bp, Homo sapiens
cctctgcctgtccctctcaggc

SEQ ID NO: 3757225 - DNA, 15 bp, Homo sapiens
cctctgcctgtctcc

SEQ ID NO: 3757226 - DNA, 19 bp, Homo sapiens
cctctgcctgtctccccca

SEQ ID NO: 3757227 - DNA, 21 bp, Homo sapiens
cctctgctggcacatttcccc

SEQ ID NO: 3757228 - DNA, 23 bp, Homo sapiens
cctctgctggccgggcacagctg

SEQ ID NO: 3757229 - DNA, 15 bp, Homo sapiens
cctctggaggcctct

SEQ ID NO: 3757230 - DNA, 18 bp, Homo sapiens
cctctggattgtgggaat

SEQ ID NO: 3757231 - DNA, 12 bp, Homo sapiens
cctctggccctg

SEQ ID NO: 3757232 - DNA, 22 bp, Homo sapiens
cctctggctagaggccagcccc

SEQ ID NO: 3757233 - DNA, 12 bp, Homo sapiens
cctctgggactg

SEQ ID NO: 3757234 - DNA, 15 bp, Homo sapiens
cctctgggcctcctc

SEQ ID NO: 3757235 - DNA, 17 bp, Homo sapiens
cctctgggcctcctcta

SEQ ID NO: 3757236 - DNA, 11 bp, Homo sapiens
cctctgggctt

SEQ ID NO: 3757237 - DNA, 16 bp, Homo sapiens
cctctggtagacacag

SEQ ID NO: 3757238 - DNA, 19 bp, Homo sapiens
cctctggttcttcatttat

SEQ ID NO: 3757239 - DNA, 19 bp, Homo sapiens
cctctgtcatatcttcaca

SEQ ID NO: 3757240 - DNA, 20 bp, Homo sapiens
cctctgtccagggccctgag

SEQ ID NO: 3757241 - DNA, 23 bp, Homo sapiens
cctctgtccagggccctgagctc

SEQ ID NO: 3757242 - DNA, 19 bp, Homo sapiens
cctcttaaagctgcctgta

SEQ ID NO: 3757243 - DNA, 20 bp, Homo sapiens
cctcttaaagctgcctgtag

SEQ ID NO: 3757244 - DNA, 21 bp, Homo sapiens
cctcttaaagctgcctgtagt

SEQ ID NO: 3757245 - DNA, 23 bp, Homo sapiens
cctcttaaagctgcctgtagtta

SEQ ID NO: 3757246 - DNA, 19 bp, Homo sapiens
cctcttccggagatgtagc

SEQ ID NO: 3757247 - DNA, 15 bp, Homo sapiens
cctcttcctccctca

SEQ ID NO: 3757248 - DNA, 16 bp, Homo sapiens
cctcttccttgctgtg

SEQ ID NO: 3757249 - DNA, 17 bp, Homo sapiens
cctcttcttacttgatg

SEQ ID NO: 3757250 - DNA, 16 bp, Homo sapiens
cctcttcttcttcaga

SEQ ID NO: 3757251 - DNA, 14 bp, Homo sapiens
cctcttgccactgc

SEQ ID NO: 3757252 - DNA, 23 bp, Homo sapiens
cctcttgccccccaccccagcct

SEQ ID NO: 3757253 - DNA, 22 bp, Homo sapiens
cctgaaaatgtttttctgccag

SEQ ID NO: 3757254 - DNA, 18 bp, Homo sapiens
cctgaaacttacacacaa

SEQ ID NO: 3757255 - DNA, 18 bp, Homo sapiens
cctgaaagccctgagctt

SEQ ID NO: 3757256 - DNA, 14 bp, Homo sapiens
cctgaaatttcaga

SEQ ID NO: 3757257 - DNA, 15 bp, Homo sapiens
cctgaaatttcagat

SEQ ID NO: 3757258 - DNA, 13 bp, Homo sapiens
cctgaacaagaat

SEQ ID NO: 3757259 - DNA, 17 bp, Homo sapiens
cctgaacaagaattgga

SEQ ID NO: 3757260 - DNA, 18 bp, Homo sapiens
cctgaacacttattgctt

SEQ ID NO: 3757261 - DNA, 19 bp, Homo sapiens
cctgaagtaagcaaagact

SEQ ID NO: 3757262 - DNA, 19 bp, Homo sapiens
cctgaagtcacacagtgag

SEQ ID NO: 3757263 - DNA, 16 bp, Homo sapiens
cctgacagaaggactc

SEQ ID NO: 3757264 - DNA, 20 bp, Homo sapiens
cctgaccaacagttccttca

SEQ ID NO: 3757265 - DNA, 20 bp, Homo sapiens
cctgaccacgctttctagct

SEQ ID NO: 3757266 - DNA, 16 bp, Homo sapiens
cctgacctccctctaa

SEQ ID NO: 3757267 - DNA, 14 bp, Homo sapiens
cctgacctgtctca

SEQ ID NO: 3757268 - DNA, 16 bp, Homo sapiens
cctgacctgtctcacc

SEQ ID NO: 3757269 - DNA, 21 bp, Homo sapiens
cctgacggcgcccccagtgtg

SEQ ID NO: 3757270 - DNA, 16 bp, Homo sapiens
cctgactcaggcatca

SEQ ID NO: 3757271 - DNA, 17 bp, Homo sapiens
cctgactctctgtgacc

SEQ ID NO: 3757272 - DNA, 18 bp, Homo sapiens
cctgactctctgtgacct

SEQ ID NO: 3757273 - DNA, 20 bp, Homo sapiens
cctgagacaaatggaggcct

SEQ ID NO: 3757274 - DNA, 16 bp, Homo sapiens
cctgagcacctcccag

SEQ ID NO: 3757275 - DNA, 17 bp, Homo sapiens
cctgagcacctcccagc

SEQ ID NO: 3757276 - DNA, 18 bp, Homo sapiens
cctgagcacctcccagcc

SEQ ID NO: 3757277 - DNA, 22 bp, Homo sapiens
cctgagcacctcccagcccctg

SEQ ID NO: 3757278 - DNA, 12 bp, Homo sapiens
cctgagctcccc

SEQ ID NO: 3757279 - DNA, 17 bp, Homo sapiens
cctgagctgccatccag

SEQ ID NO: 3757280 - DNA, 23 bp, Homo sapiens
cctgagctttggacacacacagc

SEQ ID NO: 3757281 - DNA, 15 bp, Homo sapiens
cctgagctttggacg

SEQ ID NO: 3757282 - DNA, 22 bp, Homo sapiens
cctgagctttggacgcacacag

SEQ ID NO: 3757283 - DNA, 12 bp, Homo sapiens
cctgaggaagcg

SEQ ID NO: 3757284 - DNA, 14 bp, Homo sapiens
cctgaggatcagaa

SEQ ID NO: 3757285 - DNA, 14 bp, Homo sapiens
cctgaggctgagac

SEQ ID NO: 3757286 - DNA, 15 bp, Homo sapiens
cctgaggctggactc

SEQ ID NO: 3757287 - DNA, 20 bp, Homo sapiens
cctgaggggcatctgcccct

SEQ ID NO: 3757288 - DNA, 14 bp, Homo sapiens
cctgagtcaccagg

SEQ ID NO: 3757289 - DNA, 14 bp, Homo sapiens
cctgatcccactcc

SEQ ID NO: 3757290 - DNA, 23 bp, Homo sapiens
cctgatcgccaacctttccccca

SEQ ID NO: 3757291 - DNA, 23 bp, Homo sapiens
cctgatgctccctcccctgccct

SEQ ID NO: 3757292 - DNA, 16 bp, Homo sapiens
cctgatgttaaaattc

SEQ ID NO: 3757293 - DNA, 18 bp, Homo sapiens
cctgcaaaatgagaccct

SEQ ID NO: 3757294 - DNA, 14 bp, Homo sapiens
cctgcacctccccc

SEQ ID NO: 3757295 - DNA, 18 bp, Homo sapiens
cctgcacctccccccact

SEQ ID NO: 3757296 - DNA, 20 bp, Homo sapiens
cctgcacctccccccactgc

SEQ ID NO: 3757297 - DNA, 21 bp, Homo sapiens
cctgcacctccccccactgca

SEQ ID NO: 3757298 - DNA, 22 bp, Homo sapiens
cctgcacctccccccactgcag

SEQ ID NO: 3757299 - DNA, 15 bp, Homo sapiens
cctgcactggagtcc

SEQ ID NO: 3757300 - DNA, 23 bp, Homo sapiens
cctgcactggagtccagtctctt

SEQ ID NO: 3757301 - DNA, 22 bp, Homo sapiens
cctgcacttgcagactctacag

SEQ ID NO: 3757302 - DNA, 19 bp, Homo sapiens
cctgcagaggggaaaccag

SEQ ID NO: 3757303 - DNA, 15 bp, Homo sapiens
cctgcagcagagcct

SEQ ID NO: 3757304 - DNA, 22 bp, Homo sapiens
cctgcagccccgcgcctccttc

SEQ ID NO: 3757305 - DNA, 21 bp, Homo sapiens
cctgcaggccaagagcagagg

SEQ ID NO: 3757306 - DNA, 22 bp, Homo sapiens
cctgcaggccaagagcagaggc

SEQ ID NO: 3757307 - DNA, 18 bp, Homo sapiens
cctgcagtactttacctc

SEQ ID NO: 3757308 - DNA, 22 bp, Homo sapiens
cctgcatctatcgagtttgcaa

SEQ ID NO: 3757309 - DNA, 15 bp, Homo sapiens
cctgcattcacccag

SEQ ID NO: 3757310 - DNA, 12 bp, Homo sapiens
cctgccaccctg

SEQ ID NO: 3757311 - DNA, 13 bp, Homo sapiens
cctgccaccctgg

SEQ ID NO: 3757312 - DNA, 22 bp, Homo sapiens
cctgccaccctggggagaaagt

SEQ ID NO: 3757313 - DNA, 13 bp, Homo sapiens
cctgccacctggg

SEQ ID NO: 3757314 - DNA, 16 bp, Homo sapiens
cctgccacctggggca

SEQ ID NO: 3757315 - DNA, 17 bp, Homo sapiens
cctgccactaggctggg

SEQ ID NO: 3757316 - DNA, 23 bp, Homo sapiens
cctgccactttggtacatggcca

SEQ ID NO: 3757317 - DNA, 16 bp, Homo sapiens
cctgccagcctggctt

SEQ ID NO: 3757318 - DNA, 17 bp, Homo sapiens
cctgccagcctggcttc

SEQ ID NO: 3757319 - DNA, 21 bp, Homo sapiens
cctgccagcctggcttctgga

SEQ ID NO: 3757320 - DNA, 14 bp, Homo sapiens
cctgcccacctgtc

SEQ ID NO: 3757321 - DNA, 14 bp, Homo sapiens
cctgcccaggcccc

SEQ ID NO: 3757322 - DNA, 11 bp, Homo sapiens
cctgcccagtg

SEQ ID NO: 3757323 - DNA, 16 bp, Homo sapiens
cctgcccatgggagct

SEQ ID NO: 3757324 - DNA, 15 bp, Homo sapiens
cctgcccccacacct

SEQ ID NO: 3757325 - DNA, 18 bp, Homo sapiens
cctgcccccacacctggc

SEQ ID NO: 3757326 - DNA, 22 bp, Homo sapiens
cctgcccccacacctggccctg

SEQ ID NO: 3757327 - DNA, 14 bp, Homo sapiens
ataactgaaggaga

SEQ ID NO: 3757328 - DNA, 17 bp, Homo sapiens
ataactgacaaatcaag

SEQ ID NO: 3757329 - DNA, 18 bp, Homo sapiens
ataactgacaaatcaagt

SEQ ID NO: 3757330 - DNA, 16 bp, Homo sapiens
ataacttaaaaaaatg

SEQ ID NO: 3757331 - DNA, 16 bp, Homo sapiens
ataacttcaagcaaac

SEQ ID NO: 3757332 - DNA, 13 bp, Homo sapiens
ataagataaatgt

SEQ ID NO: 3757333 - DNA, 17 bp, Homo sapiens
ataagataaatgtgctg

SEQ ID NO: 3757334 - DNA, 12 bp, Homo sapiens
ataagcaagaga

SEQ ID NO: 3757335 - DNA, 23 bp, Homo sapiens
ataagcatggagaacagtgattt

SEQ ID NO: 3757336 - DNA, 21 bp, Homo sapiens
ataagcctccatttagttctt

SEQ ID NO: 3757337 - DNA, 11 bp, Homo sapiens
ataaggactgc

SEQ ID NO: 3757338 - DNA, 12 bp, Homo sapiens
ataaggactgca

SEQ ID NO: 3757339 - DNA, 20 bp, Homo sapiens
ataagggagcgtagaatctg

SEQ ID NO: 3757340 - DNA, 13 bp, Homo sapiens
ataaggtgtattg

SEQ ID NO: 3757341 - DNA, 14 bp, Homo sapiens
ataaggtgtattgc

SEQ ID NO: 3757342 - DNA, 22 bp, Homo sapiens
ataataaagtattccaccttaa

SEQ ID NO: 3757343 - DNA, 13 bp, Homo sapiens
ataataatacaag

SEQ ID NO: 3757344 - DNA, 22 bp, Homo sapiens
ataatatatgttttaaatatag

SEQ ID NO: 3757345 - DNA, 15 bp, Homo sapiens
ataatatgagaatca

SEQ ID NO: 3757346 - DNA, 21 bp, Homo sapiens
ataatcagcaagaatttgatc

SEQ ID NO: 3757347 - DNA, 14 bp, Homo sapiens
ataatcagcctctt

SEQ ID NO: 3757348 - DNA, 17 bp, Homo sapiens
ataatcagcctcttaaa

SEQ ID NO: 3757349 - DNA, 12 bp, Homo sapiens
ataatctagaac

SEQ ID NO: 3757350 - DNA, 20 bp, Homo sapiens
ataatctggactcctctgtc

SEQ ID NO: 3757351 - DNA, 18 bp, Homo sapiens
ataatgctgttgcctcat

SEQ ID NO: 3757352 - DNA, 15 bp, Homo sapiens
ataatgtaagctcta

SEQ ID NO: 3757353 - DNA, 19 bp, Homo sapiens
ataatgtcttgttaatatt

SEQ ID NO: 3757354 - DNA, 21 bp, Homo sapiens
ataatgtgggaagaaacaaac

SEQ ID NO: 3757355 - DNA, 14 bp, Homo sapiens
ataatgttgttatt

SEQ ID NO: 3757356 - DNA, 19 bp, Homo sapiens
ataatgttgttatttaaag

SEQ ID NO: 3757357 - DNA, 13 bp, Homo sapiens
ataatgtttgcta

SEQ ID NO: 3757358 - DNA, 22 bp, Homo sapiens
ataattatcggaagcagtgcct

SEQ ID NO: 3757359 - DNA, 14 bp, Homo sapiens
ataattatgacagt

SEQ ID NO: 3757360 - DNA, 20 bp, Homo sapiens
ataattatgttattgaaaaa

SEQ ID NO: 3757361 - DNA, 17 bp, Homo sapiens
ataattccctatctttt

SEQ ID NO: 3757362 - DNA, 14 bp, Homo sapiens
ataattcttgtata

SEQ ID NO: 3757363 - DNA, 11 bp, Homo sapiens
ataatttccca

SEQ ID NO: 3757364 - DNA, 22 bp, Homo sapiens
ataatttcccaattaggaagtg

SEQ ID NO: 3757365 - DNA, 15 bp, Homo sapiens
ataattttatgaatg

SEQ ID NO: 3757366 - DNA, 19 bp, Homo sapiens
ataattttatgaatgtctt

SEQ ID NO: 3757367 - DNA, 13 bp, Homo sapiens
ataattttcttca

SEQ ID NO: 3757368 - DNA, 17 bp, Homo sapiens
ataattttcttcatgca

SEQ ID NO: 3757369 - DNA, 16 bp, Homo sapiens
ataattttgcataaaa

SEQ ID NO: 3757370 - DNA, 19 bp, Homo sapiens
atacaaaggcttattaatt

SEQ ID NO: 3757371 - DNA, 17 bp, Homo sapiens
atacaacatgattttat

SEQ ID NO: 3757372 - DNA, 19 bp, Homo sapiens
atacaagtttcagacaggg

SEQ ID NO: 3757373 - DNA, 12 bp, Homo sapiens
atacaataaact

SEQ ID NO: 3757374 - DNA, 21 bp, Homo sapiens
atacaataaactattggaaag

SEQ ID NO: 3757375 - DNA, 15 bp, Homo sapiens
atacacaacacacac

SEQ ID NO: 3757376 - DNA, 19 bp, Homo sapiens
atacacacacaaagagagt

SEQ ID NO: 3757377 - DNA, 21 bp, Homo sapiens
atacactatgaagatgtttca

SEQ ID NO: 3757378 - DNA, 22 bp, Homo sapiens
atacactatttgtgagcaaagg

SEQ ID NO: 3757379 - DNA, 22 bp, Homo sapiens
atacaggaaaagctgctgacag

SEQ ID NO: 3757380 - DNA, 21 bp, Homo sapiens
atacagggcatgcattttgca

SEQ ID NO: 3757381 - DNA, 18 bp, Homo sapiens
atacaggggaatatttta

SEQ ID NO: 3757382 - DNA, 16 bp, Homo sapiens
atacagtacaggcagc

SEQ ID NO: 3757383 - DNA, 19 bp, Homo sapiens
atacagtacaggcagcaca

SEQ ID NO: 3757384 - DNA, 17 bp, Homo sapiens
atacagttttaaagaat

SEQ ID NO: 3757385 - DNA, 23 bp, Homo sapiens
atacagttttaaagaatcattat

SEQ ID NO: 3757386 - DNA, 20 bp, Homo sapiens
atacagttttcctaaatgta

SEQ ID NO: 3757387 - DNA, 16 bp, Homo sapiens
atacatacacatatat

SEQ ID NO: 3757388 - DNA, 14 bp, Homo sapiens
atacatgacactga

SEQ ID NO: 3757389 - DNA, 15 bp, Homo sapiens
atacatgacactgaa

SEQ ID NO: 3757390 - DNA, 19 bp, Homo sapiens
atacatgacactgaaatgc

SEQ ID NO: 3757391 - DNA, 17 bp, Homo sapiens
atacatttgtatgttgt

SEQ ID NO: 3757392 - DNA, 18 bp, Homo sapiens
ataccaaaattatttcag

SEQ ID NO: 3757393 - DNA, 20 bp, Homo sapiens
ataccaaaattatttcagaa

SEQ ID NO: 3757394 - DNA, 23 bp, Homo sapiens
ataccagctactccggaggctga

SEQ ID NO: 3757395 - DNA, 14 bp, Homo sapiens
ataccaggttgaaa

SEQ ID NO: 3757396 - DNA, 18 bp, Homo sapiens
atactaaaaatcatgaga

SEQ ID NO: 3757397 - DNA, 14 bp, Homo sapiens
atactaagaaaaga

SEQ ID NO: 3757398 - DNA, 18 bp, Homo sapiens
atactagccagagctcct

SEQ ID NO: 3757399 - DNA, 14 bp, Homo sapiens
atactatatttatg

SEQ ID NO: 3757400 - DNA, 20 bp, Homo sapiens
atactatttagtttttgtaa

SEQ ID NO: 3757401 - DNA, 23 bp, Homo sapiens
atactatttagtttttgtaattt

SEQ ID NO: 3757402 - DNA, 16 bp, Homo sapiens
atactctaattctaac

SEQ ID NO: 3757403 - DNA, 12 bp, Homo sapiens
atactctgtcag

SEQ ID NO: 3757404 - DNA, 14 bp, Homo sapiens
atactctgtcagat

SEQ ID NO: 3757405 - DNA, 14 bp, Homo sapiens
atactctgtctccc

SEQ ID NO: 3757406 - DNA, 21 bp, Homo sapiens
atactcttaggaagagaaacc

SEQ ID NO: 3757407 - DNA, 14 bp, Homo sapiens
atactgagggacca

SEQ ID NO: 3757408 - DNA, 17 bp, Homo sapiens
atactgtacttaataaa

SEQ ID NO: 3757409 - DNA, 13 bp, Homo sapiens
atacttgagactg

SEQ ID NO: 3757410 - DNA, 23 bp, Homo sapiens
atagaaaacaggaaaaaaacttt

SEQ ID NO: 3757411 - DNA, 21 bp, Homo sapiens
atagaaactcaccatgtaaaa

SEQ ID NO: 3757412 - DNA, 20 bp, Homo sapiens
atagaaataaatagctatat

SEQ ID NO: 3757413 - DNA, 15 bp, Homo sapiens
atagaactctgggct

SEQ ID NO: 3757414 - DNA, 13 bp, Homo sapiens
atagaagaaaaaa

SEQ ID NO: 3757415 - DNA, 17 bp, Homo sapiens
atagaagaaaaaagaat

SEQ ID NO: 3757416 - DNA, 23 bp, Homo sapiens
atagaagaaaaaagaatgtcaga

SEQ ID NO: 3757417 - DNA, 15 bp, Homo sapiens
atagaagaactgcaa

SEQ ID NO: 3757418 - DNA, 20 bp, Homo sapiens
atagaagaatacaaacatat

SEQ ID NO: 3757419 - DNA, 14 bp, Homo sapiens
atagaaggaaacta

SEQ ID NO: 3757420 - DNA, 10 bp, Homo sapiens
atagaaggag

SEQ ID NO: 3757421 - DNA, 15 bp, Homo sapiens
atagaaggaggagag

SEQ ID NO: 3757422 - DNA, 13 bp, Homo sapiens
atagaagttttat

SEQ ID NO: 3757423 - DNA, 19 bp, Homo sapiens
atagaatatttattacctc

SEQ ID NO: 3757424 - DNA, 18 bp, Homo sapiens
atagaatggtatcaataa

SEQ ID NO: 3757425 - DNA, 16 bp, Homo sapiens
atagacatttgtaaat

SEQ ID NO: 3757426 - DNA, 17 bp, Homo sapiens
atagactagagaaaccg

SEQ ID NO: 3757427 - DNA, 20 bp, Homo sapiens
atagactttatgcaataaat

SEQ ID NO: 3757428 - DNA, 14 bp, Homo sapiens
atagagactgtaga

SEQ ID NO: 3757429 - DNA, 15 bp, Homo sapiens
atagaggtgagggaa

SEQ ID NO: 3757430 - DNA, 15 bp, Homo sapiens
atagatcacataaca

SEQ ID NO: 3757431 - DNA, 19 bp, Homo sapiens
atagatcacataacagaat

SEQ ID NO: 3757432 - DNA, 15 bp, Homo sapiens
atagattcacctgta

SEQ ID NO: 3757433 - DNA, 19 bp, Homo sapiens
atagattcacctgtaaaac

SEQ ID NO: 3757434 - DNA, 21 bp, Homo sapiens
atagattcacctgtaaaactt

SEQ ID NO: 3757435 - DNA, 15 bp, Homo sapiens
atagatttctgattt

SEQ ID NO: 3757436 - DNA, 16 bp, Homo sapiens
atagatttctgatttt

SEQ ID NO: 3757437 - DNA, 19 bp, Homo sapiens
atagatttctgattttatg

SEQ ID NO: 3757438 - DNA, 19 bp, Homo sapiens
atagcaagacacatcccta

SEQ ID NO: 3757439 - DNA, 22 bp, Homo sapiens
atagcaatccatgttagttttt

SEQ ID NO: 3757440 - DNA, 15 bp, Homo sapiens
atagcactgagcaaa

SEQ ID NO: 3757441 - DNA, 12 bp, Homo sapiens
atagccaaaaat

SEQ ID NO: 3757442 - DNA, 21 bp, Homo sapiens
cctcccagggccagggccctg

SEQ ID NO: 3757443 - DNA, 14 bp, Homo sapiens
cctccccaggggag

SEQ ID NO: 3757444 - DNA, 21 bp, Homo sapiens
cctccccattagagtcagcct

SEQ ID NO: 3757445 - DNA, 13 bp, Homo sapiens
cctccccccactg

SEQ ID NO: 3757446 - DNA, 14 bp, Homo sapiens
cctccccccactgc

SEQ ID NO: 3757447 - DNA, 17 bp, Homo sapiens
cctccccccactgcagg

SEQ ID NO: 3757448 - DNA, 18 bp, Homo sapiens
cctccccccactgcaggc

SEQ ID NO: 3757449 - DNA, 15 bp, Homo sapiens
cctccccctgccagt

SEQ ID NO: 3757450 - DNA, 17 bp, Homo sapiens
cctccccctgccagtgc

SEQ ID NO: 3757451 - DNA, 18 bp, Homo sapiens
cctccccctgccagtgcc

SEQ ID NO: 3757452 - DNA, 19 bp, Homo sapiens
cctccccctgccagtgcct

SEQ ID NO: 3757453 - DNA, 14 bp, Homo sapiens
cctccccctgtccc

SEQ ID NO: 3757454 - DNA, 20 bp, Homo sapiens
cctcccctccttgcctcctg

SEQ ID NO: 3757455 - DNA, 14 bp, Homo sapiens
cctcccctgccatt

SEQ ID NO: 3757456 - DNA, 13 bp, Homo sapiens
cctcccctgccct

SEQ ID NO: 3757457 - DNA, 14 bp, Homo sapiens
cctcccctgcccta

SEQ ID NO: 3757458 - DNA, 17 bp, Homo sapiens
cctccccttccctgcaa

SEQ ID NO: 3757459 - DNA, 18 bp, Homo sapiens
cctcccgaatagctggga

SEQ ID NO: 3757460 - DNA, 19 bp, Homo sapiens
cctcccgaatagctgggac

SEQ ID NO: 3757461 - DNA, 21 bp, Homo sapiens
cctcccgaatagctgggacta

SEQ ID NO: 3757462 - DNA, 18 bp, Homo sapiens
cctcccgagtagctggga

SEQ ID NO: 3757463 - DNA, 20 bp, Homo sapiens
cctcccgagtagctgggact

SEQ ID NO: 3757464 - DNA, 16 bp, Homo sapiens
cctcccggtgcccaag

SEQ ID NO: 3757465 - DNA, 11 bp, Homo sapiens
cctccctcagc

SEQ ID NO: 3757466 - DNA, 16 bp, Homo sapiens
cctccctcagcccctc

SEQ ID NO: 3757467 - DNA, 20 bp, Homo sapiens
cctccctcagcccctcttgc

SEQ ID NO: 3757468 - DNA, 17 bp, Homo sapiens
cctccctcccctgccct

SEQ ID NO: 3757469 - DNA, 18 bp, Homo sapiens
cctccctcccctgccctc

SEQ ID NO: 3757470 - DNA, 13 bp, Homo sapiens
cctccctccctct

SEQ ID NO: 3757471 - DNA, 13 bp, Homo sapiens
cctccctcctctg

SEQ ID NO: 3757472 - DNA, 12 bp, Homo sapiens
cctccctccttc

SEQ ID NO: 3757473 - DNA, 13 bp, Homo sapiens
cctccctctctct

SEQ ID NO: 3757474 - DNA, 22 bp, Homo sapiens
cctccctctctcttctgctcca

SEQ ID NO: 3757475 - DNA, 18 bp, Homo sapiens
cctccctctgacctgcag

SEQ ID NO: 3757476 - DNA, 15 bp, Homo sapiens
cctccctgaccctgc

SEQ ID NO: 3757477 - DNA, 22 bp, Homo sapiens
cctccctgaccctgcagagatg

SEQ ID NO: 3757478 - DNA, 14 bp, Homo sapiens
cctccctggcctgt

SEQ ID NO: 3757479 - DNA, 12 bp, Homo sapiens
cctccctggctc

SEQ ID NO: 3757480 - DNA, 14 bp, Homo sapiens
cctccctgtcctcc

SEQ ID NO: 3757481 - DNA, 16 bp, Homo sapiens
cctccctgtcctcctc

SEQ ID NO: 3757482 - DNA, 16 bp, Homo sapiens
cctcccttctactgct

SEQ ID NO: 3757483 - DNA, 19 bp, Homo sapiens
cctcccttctactgcttct

SEQ ID NO: 3757484 - DNA, 14 bp, Homo sapiens
cctccgccaggcga

SEQ ID NO: 3757485 - DNA, 16 bp, Homo sapiens
cctccgccaggcgaga

SEQ ID NO: 3757486 - DNA, 16 bp, Homo sapiens
cctccgtatttcagac

SEQ ID NO: 3757487 - DNA, 14 bp, Homo sapiens
cctcctcaccccca

SEQ ID NO: 3757488 - DNA, 13 bp, Homo sapiens
cctcctcaccccg

SEQ ID NO: 3757489 - DNA, 13 bp, Homo sapiens
cctcctcacctct

SEQ ID NO: 3757490 - DNA, 18 bp, Homo sapiens
cctcctctgtccagggcc

SEQ ID NO: 3757491 - DNA, 14 bp, Homo sapiens
cctcctgcccacct

SEQ ID NO: 3757492 - DNA, 12 bp, Homo sapiens
cctcctgcccag

SEQ ID NO: 3757493 - DNA, 13 bp, Homo sapiens
cctcctgcccagg

SEQ ID NO: 3757494 - DNA, 15 bp, Homo sapiens
cctcctgcccaggag

SEQ ID NO: 3757495 - DNA, 16 bp, Homo sapiens
cctcctgcccaggaga

SEQ ID NO: 3757496 - DNA, 19 bp, Homo sapiens
cctcctgcccaggagagcc

SEQ ID NO: 3757497 - DNA, 21 bp, Homo sapiens
cctcctgcccaggagagccag

SEQ ID NO: 3757498 - DNA, 13 bp, Homo sapiens
cctcctgggctaa

SEQ ID NO: 3757499 - DNA, 22 bp, Homo sapiens
cctcctgtgtgtgcgcctacag

SEQ ID NO: 3757500 - DNA, 23 bp, Homo sapiens
cctcctgtgtgtgcgcctacagg

SEQ ID NO: 3757501 - DNA, 18 bp, Homo sapiens
cctccttcccagctgccc

SEQ ID NO: 3757502 - DNA, 18 bp, Homo sapiens
cctccttccttgaccagc

SEQ ID NO: 3757503 - DNA, 17 bp, Homo sapiens
cctccttctcccttttt

SEQ ID NO: 3757504 - DNA, 20 bp, Homo sapiens
cctccttgcctcctgtgtaa

SEQ ID NO: 3757505 - DNA, 20 bp, Homo sapiens
cctccttgtcttggcagcct

SEQ ID NO: 3757506 - DNA, 16 bp, Homo sapiens
cctcctttaccctcat

SEQ ID NO: 3757507 - DNA, 17 bp, Homo sapiens
cctcctttaccctcatc

SEQ ID NO: 3757508 - DNA, 19 bp, Homo sapiens
cctcctttaccctcatctg

SEQ ID NO: 3757509 - DNA, 12 bp, Homo sapiens
cctcctttccca

SEQ ID NO: 3757510 - DNA, 15 bp, Homo sapiens
cctcctttctggctt

SEQ ID NO: 3757511 - DNA, 15 bp, Homo sapiens
cctcgaacccacact

SEQ ID NO: 3757512 - DNA, 21 bp, Homo sapiens
cctcgaacccacactgcaaca

SEQ ID NO: 3757513 - DNA, 14 bp, Homo sapiens
cctcgaactcctgg

SEQ ID NO: 3757514 - DNA, 16 bp, Homo sapiens
cctcgaactcctgggc

SEQ ID NO: 3757515 - DNA, 19 bp, Homo sapiens
cctcgaagcgcgccactcg

SEQ ID NO: 3757516 - DNA, 12 bp, Homo sapiens
cctcgccctggg

SEQ ID NO: 3757517 - DNA, 12 bp, Homo sapiens
cctcgctggccc

SEQ ID NO: 3757518 - DNA, 13 bp, Homo sapiens
cctcgctggcccc

SEQ ID NO: 3757519 - DNA, 19 bp, Homo sapiens
cctcggctcctggactcat

SEQ ID NO: 3757520 - DNA, 16 bp, Homo sapiens
cctcggtgccttcctc

SEQ ID NO: 3757521 - DNA, 14 bp, Homo sapiens
cctcggtgtggaga

SEQ ID NO: 3757522 - DNA, 15 bp, Homo sapiens
cctcgtcctccccct

SEQ ID NO: 3757523 - DNA, 22 bp, Homo sapiens
cctcgttagggaagagaaacag

SEQ ID NO: 3757524 - DNA, 23 bp, Homo sapiens
cctctaacaggggctggtgggca

SEQ ID NO: 3757525 - DNA, 15 bp, Homo sapiens
cctctaatgctcacg

SEQ ID NO: 3757526 - DNA, 22 bp, Homo sapiens
cctctaatgctcacgctcccaa

SEQ ID NO: 3757527 - DNA, 19 bp, Homo sapiens
cctctagaaatttttcaga

SEQ ID NO: 3757528 - DNA, 14 bp, Homo sapiens
cctctagaggcaag

SEQ ID NO: 3757529 - DNA, 16 bp, Homo sapiens
cctctatttagcatga

SEQ ID NO: 3757530 - DNA, 14 bp, Homo sapiens
cctctccactgcct

SEQ ID NO: 3757531 - DNA, 16 bp, Homo sapiens
cctctccactgccttc

SEQ ID NO: 3757532 - DNA, 19 bp, Homo sapiens
cctctccactgccttcgat

SEQ ID NO: 3757533 - DNA, 12 bp, Homo sapiens
cctctcccagga

SEQ ID NO: 3757534 - DNA, 15 bp, Homo sapiens
cctctcccagttgtc

SEQ ID NO: 3757535 - DNA, 15 bp, Homo sapiens
cctctccctggccct

SEQ ID NO: 3757536 - DNA, 11 bp, Homo sapiens
cctctcctgcc

SEQ ID NO: 3757537 - DNA, 12 bp, Homo sapiens
cctctcctgcct

SEQ ID NO: 3757538 - DNA, 13 bp, Homo sapiens
cctctcctgccta

SEQ ID NO: 3757539 - DNA, 14 bp, Homo sapiens
cctctcctgcctac

SEQ ID NO: 3757540 - DNA, 17 bp, Homo sapiens
cctctcctgcctactca

SEQ ID NO: 3757541 - DNA, 17 bp, Homo sapiens
cctctcggaaggctggc

SEQ ID NO: 3757542 - DNA, 21 bp, Homo sapiens
cctctcggaaggctggctggg

SEQ ID NO: 3757543 - DNA, 20 bp, Homo sapiens
cctctctaacctcctttacc

SEQ ID NO: 3757544 - DNA, 20 bp, Homo sapiens
cctctctcttctgctccacc

SEQ ID NO: 3757545 - DNA, 22 bp, Homo sapiens
cctctctcttctgctccaccct

SEQ ID NO: 3757546 - DNA, 14 bp, Homo sapiens
cctctcttcctatc

SEQ ID NO: 3757547 - DNA, 17 bp, Homo sapiens
cctctcttcctatccca

SEQ ID NO: 3757548 - DNA, 19 bp, Homo sapiens
cctctcttcctatcccatc

SEQ ID NO: 3757549 - DNA, 21 bp, Homo sapiens
cctctcttcctatcccatccc

SEQ ID NO: 3757550 - DNA, 21 bp, Homo sapiens
cctctcttggtttccttcctt

SEQ ID NO: 3757551 - DNA, 14 bp, Homo sapiens
cctctgacacacag

SEQ ID NO: 3757552 - DNA, 15 bp, Homo sapiens
cctctgacacacagc

SEQ ID NO: 3757553 - DNA, 17 bp, Homo sapiens
cctctgacacacagctc

SEQ ID NO: 3757554 - DNA, 18 bp, Homo sapiens
cctctgacacacagctct

SEQ ID NO: 3757555 - DNA, 19 bp, Homo sapiens
cctctgacacacagctctg

SEQ ID NO: 3757556 - DNA, 22 bp, Homo sapiens
cctctgaccctagctctttcct

SEQ ID NO: 3757557 - DNA, 15 bp, Homo sapiens
cctctgacctgcagg

SEQ ID NO: 3757558 - DNA, 16 bp, Homo sapiens
cctggtcttgagatgt

SEQ ID NO: 3757559 - DNA, 20 bp, Homo sapiens
cctggtgaggaagctccagt

SEQ ID NO: 3757560 - DNA, 13 bp, Homo sapiens
cctggtgctggat

SEQ ID NO: 3757561 - DNA, 14 bp, Homo sapiens
cctggtggacagtc

SEQ ID NO: 3757562 - DNA, 13 bp, Homo sapiens
cctggtggcagct

SEQ ID NO: 3757563 - DNA, 15 bp, Homo sapiens
cctggtggcagctgc

SEQ ID NO: 3757564 - DNA, 14 bp, Homo sapiens
cctggtgggcctcc

SEQ ID NO: 3757565 - DNA, 21 bp, Homo sapiens
cctggttccggaatcctgtcc

SEQ ID NO: 3757566 - DNA, 14 bp, Homo sapiens
cctgtaaaacttta

SEQ ID NO: 3757567 - DNA, 20 bp, Homo sapiens
cctgtaaaactttattttat

SEQ ID NO: 3757568 - DNA, 15 bp, Homo sapiens
cctgtaaattatttt

SEQ ID NO: 3757569 - DNA, 23 bp, Homo sapiens
cctgtaaattattttaaattata

SEQ ID NO: 3757570 - DNA, 16 bp, Homo sapiens
cctgtaatcccagcac

SEQ ID NO: 3757571 - DNA, 23 bp, Homo sapiens
cctgtaatcccagctactcagga

SEQ ID NO: 3757572 - DNA, 17 bp, Homo sapiens
cctgtaccccagcactt

SEQ ID NO: 3757573 - DNA, 21 bp, Homo sapiens
cctgtactcaggaggctgagg

SEQ ID NO: 3757574 - DNA, 23 bp, Homo sapiens
cctgtactcaggaggctgagggg

SEQ ID NO: 3757575 - DNA, 14 bp, Homo sapiens
cctgtagactagtg

SEQ ID NO: 3757576 - DNA, 23 bp, Homo sapiens
cctgtagagtgggagctgagtgg

SEQ ID NO: 3757577 - DNA, 13 bp, Homo sapiens
cctgtagccctaa

SEQ ID NO: 3757578 - DNA, 13 bp, Homo sapiens
cctgtagtcctag

SEQ ID NO: 3757579 - DNA, 14 bp, Homo sapiens
cctgtagttaggaa

SEQ ID NO: 3757580 - DNA, 23 bp, Homo sapiens
cctgtagttaggaaataaaacct

SEQ ID NO: 3757581 - DNA, 17 bp, Homo sapiens
cctgtatgtctccagta

SEQ ID NO: 3757582 - DNA, 18 bp, Homo sapiens
cctgtcaaacaaagccag

SEQ ID NO: 3757583 - DNA, 16 bp, Homo sapiens
cctgtcagtgcagccc

SEQ ID NO: 3757584 - DNA, 19 bp, Homo sapiens
cctgtcagtgcagcccgtg

SEQ ID NO: 3757585 - DNA, 22 bp, Homo sapiens
cctgtccacccccgcctccctc

SEQ ID NO: 3757586 - DNA, 15 bp, Homo sapiens
cctgtccctggccat

SEQ ID NO: 3757587 - DNA, 17 bp, Homo sapiens
cctgtccctggccatct

SEQ ID NO: 3757588 - DNA, 14 bp, Homo sapiens
cctgtcctcctcgg

SEQ ID NO: 3757589 - DNA, 16 bp, Homo sapiens
cctgtcggagccctgt

SEQ ID NO: 3757590 - DNA, 21 bp, Homo sapiens
cctgtcggagccctgtctcct

SEQ ID NO: 3757591 - DNA, 22 bp, Homo sapiens
cctgtcggagccctgtctcctc

SEQ ID NO: 3757592 - DNA, 14 bp, Homo sapiens
cctgtcgtgccagt

SEQ ID NO: 3757593 - DNA, 16 bp, Homo sapiens
cctgtcgtgccagtcc

SEQ ID NO: 3757594 - DNA, 17 bp, Homo sapiens
cctgtcgtgccagtcct

SEQ ID NO: 3757595 - DNA, 22 bp, Homo sapiens
cctgtctaggtcagtacccacc

SEQ ID NO: 3757596 - DNA, 13 bp, Homo sapiens
cctgtctcccctc

SEQ ID NO: 3757597 - DNA, 14 bp, Homo sapiens
cctgtctcccctct

SEQ ID NO: 3757598 - DNA, 18 bp, Homo sapiens
cctgtctcccctctgctg

SEQ ID NO: 3757599 - DNA, 20 bp, Homo sapiens
cctgtctcccctctgctggc

SEQ ID NO: 3757600 - DNA, 15 bp, Homo sapiens
cctgtctgccagcca

SEQ ID NO: 3757601 - DNA, 17 bp, Homo sapiens
cctgtctgccagccagc

SEQ ID NO: 3757602 - DNA, 21 bp, Homo sapiens
cctgtctgccagccagcagcc

SEQ ID NO: 3757603 - DNA, 14 bp, Homo sapiens
cctgtcttccaagg

SEQ ID NO: 3757604 - DNA, 15 bp, Homo sapiens
cctgtcttcctgcat

SEQ ID NO: 3757605 - DNA, 13 bp, Homo sapiens
cctgtgagccagt

SEQ ID NO: 3757606 - DNA, 15 bp, Homo sapiens
cctgtgagccagtct

SEQ ID NO: 3757607 - DNA, 14 bp, Homo sapiens
cctgtgaggcaggg

SEQ ID NO: 3757608 - DNA, 12 bp, Homo sapiens
cctgtgccaata

SEQ ID NO: 3757609 - DNA, 15 bp, Homo sapiens
cctgtgcctgaccct

SEQ ID NO: 3757610 - DNA, 19 bp, Homo sapiens
cctgtggaagggactagga

SEQ ID NO: 3757611 - DNA, 17 bp, Homo sapiens
cctgtggagcccgcacc

SEQ ID NO: 3757612 - DNA, 18 bp, Homo sapiens
cctgtggcagtaaagaga

SEQ ID NO: 3757613 - DNA, 23 bp, Homo sapiens
cctgtggcagtaaagagaaactt

SEQ ID NO: 3757614 - DNA, 23 bp, Homo sapiens
cctgtggcatctttgccttgggc

SEQ ID NO: 3757615 - DNA, 17 bp, Homo sapiens
cctgtggcggtgcctgg

SEQ ID NO: 3757616 - DNA, 22 bp, Homo sapiens
cctgtggttacagtgcagacag

SEQ ID NO: 3757617 - DNA, 17 bp, Homo sapiens
cctgtgtcttgcaatgg

SEQ ID NO: 3757618 - DNA, 19 bp, Homo sapiens
cctgtgtcttgcaatggca

SEQ ID NO: 3757619 - DNA, 21 bp, Homo sapiens
cctgtgtggtttagtgtaaaa

SEQ ID NO: 3757620 - DNA, 13 bp, Homo sapiens
cctgtgtttctag

SEQ ID NO: 3757621 - DNA, 22 bp, Homo sapiens
cctgttacctaattagagcaga

SEQ ID NO: 3757622 - DNA, 18 bp, Homo sapiens
cctgttagctgttatttc

SEQ ID NO: 3757623 - DNA, 15 bp, Homo sapiens
cctgttcagcattct

SEQ ID NO: 3757624 - DNA, 19 bp, Homo sapiens
cctgttcagctccagctca

SEQ ID NO: 3757625 - DNA, 19 bp, Homo sapiens
cctgttctgggtgcagctg

SEQ ID NO: 3757626 - DNA, 22 bp, Homo sapiens
cctgttgccctttctgtaccat

SEQ ID NO: 3757627 - DNA, 12 bp, Homo sapiens
cctgttgctttt

SEQ ID NO: 3757628 - DNA, 12 bp, Homo sapiens
cctgtttcttcc

SEQ ID NO: 3757629 - DNA, 19 bp, Homo sapiens
cctgttttatactgtactt

SEQ ID NO: 3757630 - DNA, 17 bp, Homo sapiens
cctgtttttaagctgtt

SEQ ID NO: 3757631 - DNA, 23 bp, Homo sapiens
ccttaaaactttaatcccacttg

SEQ ID NO: 3757632 - DNA, 14 bp, Homo sapiens
ccttaaaagccatc

SEQ ID NO: 3757633 - DNA, 17 bp, Homo sapiens
ccttaactggagcccca

SEQ ID NO: 3757634 - DNA, 19 bp, Homo sapiens
ccttaagaacacaaagcgg

SEQ ID NO: 3757635 - DNA, 18 bp, Homo sapiens
ccttacctcctgcccagg

SEQ ID NO: 3757636 - DNA, 20 bp, Homo sapiens
ccttacttacagcataaggg

SEQ ID NO: 3757637 - DNA, 20 bp, Homo sapiens
ccttactttgtatgatattc

SEQ ID NO: 3757638 - DNA, 17 bp, Homo sapiens
ccttagcttagacctca

SEQ ID NO: 3757639 - DNA, 18 bp, Homo sapiens
ccttagcttagacctcag

SEQ ID NO: 3757640 - DNA, 19 bp, Homo sapiens
ccttagcttagacctcagc

SEQ ID NO: 3757641 - DNA, 20 bp, Homo sapiens
ccttagcttagacctcagcc

SEQ ID NO: 3757642 - DNA, 20 bp, Homo sapiens
ccttatctgtgcgtgaaaca

SEQ ID NO: 3757643 - DNA, 15 bp, Homo sapiens
ccttattgtacctct

SEQ ID NO: 3757644 - DNA, 14 bp, Homo sapiens
ccttattttcaaga

SEQ ID NO: 3757645 - DNA, 13 bp, Homo sapiens
ccttcaaagctga

SEQ ID NO: 3757646 - DNA, 13 bp, Homo sapiens
ccttcaactgaaa

SEQ ID NO: 3757647 - DNA, 24 bp, Homo sapiens
ccttcaactgaaaagactcagtgt

SEQ ID NO: 3757648 - DNA, 12 bp, Homo sapiens
ccttcacagtgt

SEQ ID NO: 3757649 - DNA, 20 bp, Homo sapiens
ccttcacatcctgtgtttct

SEQ ID NO: 3757650 - DNA, 23 bp, Homo sapiens
ccttcactccggtgtgcctgcag

SEQ ID NO: 3757651 - DNA, 20 bp, Homo sapiens
ccttcacttctgaccacact

SEQ ID NO: 3757652 - DNA, 18 bp, Homo sapiens
ccttcagaggtggctctg

SEQ ID NO: 3757653 - DNA, 12 bp, Homo sapiens
ccttcagtgccc

SEQ ID NO: 3757654 - DNA, 14 bp, Homo sapiens
ccttcagtgcccac

SEQ ID NO: 3757655 - DNA, 15 bp, Homo sapiens
ccttcagtgcccacc

SEQ ID NO: 3757656 - DNA, 22 bp, Homo sapiens
ccttcatttggcattccccact

SEQ ID NO: 3757657 - DNA, 19 bp, Homo sapiens
ccttccaacaggagctggg

SEQ ID NO: 3757658 - DNA, 17 bp, Homo sapiens
ccttccaactgctgccc

SEQ ID NO: 3757659 - DNA, 18 bp, Homo sapiens
ccttccacgctgtctcca

SEQ ID NO: 3757660 - DNA, 21 bp, Homo sapiens
ccttccacggatccatgtagc

SEQ ID NO: 3757661 - DNA, 17 bp, Homo sapiens
ccttccagcaccctgca

SEQ ID NO: 3757662 - DNA, 15 bp, Homo sapiens
ccttccaggccatca

SEQ ID NO: 3757663 - DNA, 18 bp, Homo sapiens
ccttccatgtcgcctctg

SEQ ID NO: 3757664 - DNA, 19 bp, Homo sapiens
ccttccatgtcgcctctgc

SEQ ID NO: 3757665 - DNA, 21 bp, Homo sapiens
ccttccatgtcgcctctgcat

SEQ ID NO: 3757666 - DNA, 13 bp, Homo sapiens
ccttcccagctct

SEQ ID NO: 3757667 - DNA, 14 bp, Homo sapiens
ccttcccagctctc

SEQ ID NO: 3757668 - DNA, 18 bp, Homo sapiens
ccttcccagctctccctc

SEQ ID NO: 3757669 - DNA, 21 bp, Homo sapiens
ccttcccagctctccctctgg

SEQ ID NO: 3757670 - DNA, 16 bp, Homo sapiens
ccttcccagctgcccc

SEQ ID NO: 3757671 - DNA, 12 bp, Homo sapiens
ccttccccactg

SEQ ID NO: 3757672 - DNA, 13 bp, Homo sapiens
ccttccccagcct

SEQ ID NO: 3757673 - DNA, 15 bp, Homo sapiens
ccttccccagcctct

SEQ ID NO: 3757674 - DNA, 19 bp, Homo sapiens
ccttccccctgtagactag

SEQ ID NO: 3757675 - DNA, 17 bp, Homo sapiens
ccttcccctccctggct

SEQ ID NO: 3757676 - DNA, 19 bp, Homo sapiens
ccttcccctccctggctcc

SEQ ID NO: 3757677 - DNA, 14 bp, Homo sapiens
ccttcctctccact

SEQ ID NO: 3757678 - DNA, 21 bp, Homo sapiens
ccttcctctccactgccttcg

SEQ ID NO: 3757679 - DNA, 16 bp, Homo sapiens
ccttcctgtccgccct

SEQ ID NO: 3757680 - DNA, 12 bp, Homo sapiens
ccttcctgtctt

SEQ ID NO: 3757681 - DNA, 13 bp, Homo sapiens
ccttcctgtcttc

SEQ ID NO: 3757682 - DNA, 19 bp, Homo sapiens
ccttcctgtcttcctgcat

SEQ ID NO: 3757683 - DNA, 15 bp, Homo sapiens
ccttccttccctggc

SEQ ID NO: 3757684 - DNA, 16 bp, Homo sapiens
ccttccttgaccagca

SEQ ID NO: 3757685 - DNA, 20 bp, Homo sapiens
ccttccttgctgtcctaggc

SEQ ID NO: 3757686 - DNA, 22 bp, Homo sapiens
ccttcgatacaccgggcctgga

SEQ ID NO: 3757687 - DNA, 23 bp, Homo sapiens
ccttcgatacaccgggcctggag

SEQ ID NO: 3757688 - DNA, 14 bp, Homo sapiens
ccttcgctcctgtg

SEQ ID NO: 3757689 - DNA, 22 bp, Homo sapiens
ccttctaatctgctatgcttga

SEQ ID NO: 3757690 - DNA, 15 bp, Homo sapiens
ccttctacactctcc

SEQ ID NO: 3757691 - DNA, 21 bp, Homo sapiens
ccttctccttgataacagcta

SEQ ID NO: 3757692 - DNA, 14 bp, Homo sapiens
ccttctctgcccat

SEQ ID NO: 3757693 - DNA, 20 bp, Homo sapiens
ccttctgtcctactctgtgt

SEQ ID NO: 3757694 - DNA, 21 bp, Homo sapiens
ccttctgtcctactctgtgtc

SEQ ID NO: 3757695 - DNA, 19 bp, Homo sapiens
ccttctgtgcccagctcag

SEQ ID NO: 3757696 - DNA, 20 bp, Homo sapiens
ccttctgtgcccagctcagt

SEQ ID NO: 3757697 - DNA, 21 bp, Homo sapiens
ccttctgtggctcacagaacc

SEQ ID NO: 3757698 - DNA, 19 bp, Homo sapiens
ccttcttattctcactcca

SEQ ID NO: 3757699 - DNA, 20 bp, Homo sapiens
ccttctttctagagagggaa

SEQ ID NO: 3757700 - DNA, 14 bp, Homo sapiens
ccttctttttcttc

SEQ ID NO: 3757701 - DNA, 20 bp, Homo sapiens
ccttgaacactgggggaggg

SEQ ID NO: 3757702 - DNA, 14 bp, Homo sapiens
ccttgaactcctgg

SEQ ID NO: 3757703 - DNA, 16 bp, Homo sapiens
ccttgaactgggtact

SEQ ID NO: 3757704 - DNA, 22 bp, Homo sapiens
ccttgaagccactgaagctggg

SEQ ID NO: 3757705 - DNA, 17 bp, Homo sapiens
ccttgaagtcacccggc

SEQ ID NO: 3757706 - DNA, 18 bp, Homo sapiens
ccttgacagggcacaccg

SEQ ID NO: 3757707 - DNA, 12 bp, Homo sapiens
ccttgaccagca

SEQ ID NO: 3757708 - DNA, 11 bp, Homo sapiens
ccttgagacca

SEQ ID NO: 3757709 - DNA, 16 bp, Homo sapiens
ccttgagacctcagcc

SEQ ID NO: 3757710 - DNA, 19 bp, Homo sapiens
ccttgagacctcagccatg

SEQ ID NO: 3757711 - DNA, 13 bp, Homo sapiens
ccttgaggtcttt

SEQ ID NO: 3757712 - DNA, 17 bp, Homo sapiens
ccttgcaacacacagac

SEQ ID NO: 3757713 - DNA, 18 bp, Homo sapiens
ccttgcaacacacagaca

SEQ ID NO: 3757714 - DNA, 17 bp, Homo sapiens
ccttgcagttcagcacc

SEQ ID NO: 3757715 - DNA, 19 bp, Homo sapiens
ccttgcagttcagcaccac

SEQ ID NO: 3757716 - DNA, 11 bp, Homo sapiens
ccttgcccaga

SEQ ID NO: 3757717 - DNA, 14 bp, Homo sapiens
ccttgcccagagat

SEQ ID NO: 3757718 - DNA, 21 bp, Homo sapiens
ccttgcccagagatgcctcca

SEQ ID NO: 3757719 - DNA, 16 bp, Homo sapiens
ccttgcccagggctca

SEQ ID NO: 3757720 - DNA, 17 bp, Homo sapiens
ccttgcccagggctcag

SEQ ID NO: 3757721 - DNA, 18 bp, Homo sapiens
ccttgcccagggctcagc

SEQ ID NO: 3757722 - DNA, 20 bp, Homo sapiens
ccttgcccagggctcagcct

SEQ ID NO: 3757723 - DNA, 19 bp, Homo sapiens
ccttgcccggattctggga

SEQ ID NO: 3757724 - DNA, 12 bp, Homo sapiens
ccttgcctcctg

SEQ ID NO: 3757725 - DNA, 11 bp, Homo sapiens
ccttgctacct

SEQ ID NO: 3757726 - DNA, 20 bp, Homo sapiens
ccttgctctcccctgccctg

SEQ ID NO: 3757727 - DNA, 18 bp, Homo sapiens
ccttggaggctgtcttct

SEQ ID NO: 3757728 - DNA, 11 bp, Homo sapiens
ccttggcctca

SEQ ID NO: 3757729 - DNA, 14 bp, Homo sapiens
ccttggctgcaggg

SEQ ID NO: 3757730 - DNA, 20 bp, Homo sapiens
ccttggcttcaggggagtcc

SEQ ID NO: 3757731 - DNA, 20 bp, Homo sapiens
ccttgggaggccccactggg

SEQ ID NO: 3757732 - DNA, 15 bp, Homo sapiens
ccttgggctgctcct

SEQ ID NO: 3757733 - DNA, 15 bp, Homo sapiens
ccttggggcaggcag

SEQ ID NO: 3757734 - DNA, 20 bp, Homo sapiens
ccttggtgtccacctggccc

SEQ ID NO: 3757735 - DNA, 19 bp, Homo sapiens
ccttgtaattctaaatgaa

SEQ ID NO: 3757736 - DNA, 13 bp, Homo sapiens
ccttgtatttaaa

SEQ ID NO: 3757737 - DNA, 20 bp, Homo sapiens
cctttagcacgtttaaagtt

SEQ ID NO: 3757738 - DNA, 14 bp, Homo sapiens
cctttccctaaaga

SEQ ID NO: 3757739 - DNA, 20 bp, Homo sapiens
cctttcctgttcagcattct

SEQ ID NO: 3757740 - DNA, 15 bp, Homo sapiens
cctttggccattcca

SEQ ID NO: 3757741 - DNA, 22 bp, Homo sapiens
cctttggtcctaagtccctgcc

SEQ ID NO: 3757742 - DNA, 14 bp, Homo sapiens
cctttgtaagttat

SEQ ID NO: 3757743 - DNA, 15 bp, Homo sapiens
cctttgtaagttatt

SEQ ID NO: 3757744 - DNA, 18 bp, Homo sapiens
cctttgtcatctttcttc

SEQ ID NO: 3757745 - DNA, 23 bp, Homo sapiens
cctttgttttgatgtttgtggcc

SEQ ID NO: 3757746 - DNA, 19 bp, Homo sapiens
cctttgtttttttttcctg

SEQ ID NO: 3757747 - DNA, 21 bp, Homo sapiens
ccttttaaatcctgttgaaaa

SEQ ID NO: 3757748 - DNA, 18 bp, Homo sapiens
ccttttctcctatcttca

SEQ ID NO: 3757749 - DNA, 14 bp, Homo sapiens
cctttttactcccc

SEQ ID NO: 3757750 - DNA, 13 bp, Homo sapiens
cctttttccttcc

SEQ ID NO: 3757751 - DNA, 20 bp, Homo sapiens
cctttttctttataaacttt

SEQ ID NO: 3757752 - DNA, 13 bp, Homo sapiens
cgaaactgctcta

SEQ ID NO: 3757753 - DNA, 22 bp, Homo sapiens
cgaaaggatgtaaacagtgcct

SEQ ID NO: 3757754 - DNA, 23 bp, Homo sapiens
cgaaagggacttggaagctccgc

SEQ ID NO: 3757755 - DNA, 22 bp, Homo sapiens
cgaaatgttattttttaattat

SEQ ID NO: 3757756 - DNA, 18 bp, Homo sapiens
cgaacaccctcgaagcgc

SEQ ID NO: 3757757 - DNA, 21 bp, Homo sapiens
cgaacaccctcgaagcgcgcc

SEQ ID NO: 3757758 - DNA, 23 bp, Homo sapiens
cgaacccacctgctgagagaccc

SEQ ID NO: 3757759 - DNA, 16 bp, Homo sapiens
cgaacgacaatagctt

SEQ ID NO: 3757760 - DNA, 12 bp, Homo sapiens
cgaactcctggg

SEQ ID NO: 3757761 - DNA, 14 bp, Homo sapiens
cgaactggctgcaa

SEQ ID NO: 3757762 - DNA, 19 bp, Homo sapiens
cgaagaaaaaaaataacac

SEQ ID NO: 3757763 - DNA, 12 bp, Homo sapiens
cgaaggcctctg

SEQ ID NO: 3757764 - DNA, 19 bp, Homo sapiens
cgaagggggcatctggcct

SEQ ID NO: 3757765 - DNA, 15 bp, Homo sapiens
cgaatagctgggact

SEQ ID NO: 3757766 - DNA, 17 bp, Homo sapiens
cgacaaagctgctaaat

SEQ ID NO: 3757767 - DNA, 16 bp, Homo sapiens
cgacagagcgagactt

SEQ ID NO: 3757768 - DNA, 12 bp, Homo sapiens
cgacagcctggc

SEQ ID NO: 3757769 - DNA, 12 bp, Homo sapiens
cgaccacctgcc

SEQ ID NO: 3757770 - DNA, 14 bp, Homo sapiens
cgaccacctgccca

SEQ ID NO: 3757771 - DNA, 23 bp, Homo sapiens
cgaccagacaccttgacagggca

SEQ ID NO: 3757772 - DNA, 20 bp, Homo sapiens
cgaccgaggctggagctggc

SEQ ID NO: 3757773 - DNA, 12 bp, Homo sapiens
cgacctcagcct

SEQ ID NO: 3757774 - DNA, 14 bp, Homo sapiens
cgacctcagccttc

SEQ ID NO: 3757775 - DNA, 23 bp, Homo sapiens
cgacctcgtcctccccctgccag

SEQ ID NO: 3757776 - DNA, 22 bp, Homo sapiens
cgacggtgggcatttgtgaggc

SEQ ID NO: 3757777 - DNA, 18 bp, Homo sapiens
cgactctatagactctag

SEQ ID NO: 3757778 - DNA, 20 bp, Homo sapiens
cgactctatagactctagga

SEQ ID NO: 3757779 - DNA, 13 bp, Homo sapiens
cgactttattttc

SEQ ID NO: 3757780 - DNA, 14 bp, Homo sapiens
cgagaccagcctgg

SEQ ID NO: 3757781 - DNA, 15 bp, Homo sapiens
cgagagcctgctccc

SEQ ID NO: 3757782 - DNA, 19 bp, Homo sapiens
cgagagcctgctcccccac

SEQ ID NO: 3757783 - DNA, 17 bp, Homo sapiens
cgagatcacgccactgc

SEQ ID NO: 3757784 - DNA, 20 bp, Homo sapiens
cgagatcacgccactgcact

SEQ ID NO: 3757785 - DNA, 16 bp, Homo sapiens
cgagatcggggtagaa

SEQ ID NO: 3757786 - DNA, 15 bp, Homo sapiens
cgagcagtcctgcct

SEQ ID NO: 3757787 - DNA, 21 bp, Homo sapiens
cgagcagtcctgcctcagcct

SEQ ID NO: 3757788 - DNA, 20 bp, Homo sapiens
cggccaggccagagggagtg

SEQ ID NO: 3757789 - DNA, 22 bp, Homo sapiens
cggccatgaccactttccccgt

SEQ ID NO: 3757790 - DNA, 12 bp, Homo sapiens
cggcccacagct

SEQ ID NO: 3757791 - DNA, 15 bp, Homo sapiens
cggcccacagctccc

SEQ ID NO: 3757792 - DNA, 22 bp, Homo sapiens
cggcccacagctcccaccccac

SEQ ID NO: 3757793 - DNA, 13 bp, Homo sapiens
cggcccctgctgg

SEQ ID NO: 3757794 - DNA, 12 bp, Homo sapiens
cggccctggggc

SEQ ID NO: 3757795 - DNA, 15 bp, Homo sapiens
cggccgcattccctg

SEQ ID NO: 3757796 - DNA, 21 bp, Homo sapiens
cggcctccgtccaggagcctg

SEQ ID NO: 3757797 - DNA, 16 bp, Homo sapiens
cggccttgctgggggc

SEQ ID NO: 3757798 - DNA, 17 bp, Homo sapiens
cggcctttgttgctcag

SEQ ID NO: 3757799 - DNA, 12 bp, Homo sapiens
cggctactcagc

SEQ ID NO: 3757800 - DNA, 19 bp, Homo sapiens
cggctactcagcagccctc

SEQ ID NO: 3757801 - DNA, 14 bp, Homo sapiens
cggctcactgcagc

SEQ ID NO: 3757802 - DNA, 15 bp, Homo sapiens
cggctcactgcagcc

SEQ ID NO: 3757803 - DNA, 16 bp, Homo sapiens
cggctcactgcagcct

SEQ ID NO: 3757804 - DNA, 22 bp, Homo sapiens
cggctcctctctaacctccttt

SEQ ID NO: 3757805 - DNA, 17 bp, Homo sapiens
cggctcctggactcatt

SEQ ID NO: 3757806 - DNA, 22 bp, Homo sapiens
cggctgagtcatgatctccctg

SEQ ID NO: 3757807 - DNA, 20 bp, Homo sapiens
cgggaacagtgtttcccata

SEQ ID NO: 3757808 - DNA, 23 bp, Homo sapiens
cgggaagccaccctcccagctct

SEQ ID NO: 3757809 - DNA, 12 bp, Homo sapiens
cgggaaggaggg

SEQ ID NO: 3757810 - DNA, 23 bp, Homo sapiens
cgggaaggagggttagggagggg

SEQ ID NO: 3757811 - DNA, 20 bp, Homo sapiens
cgggaggcagaggttgcagt

SEQ ID NO: 3757812 - DNA, 17 bp, Homo sapiens
cgggaggtcgaggcagg

SEQ ID NO: 3757813 - DNA, 15 bp, Homo sapiens
cgggcacaataaatc

SEQ ID NO: 3757814 - DNA, 21 bp, Homo sapiens
cgggcatggtggcgcaagcct

SEQ ID NO: 3757815 - DNA, 11 bp, Homo sapiens
cgggctcagca

SEQ ID NO: 3757816 - DNA, 19 bp, Homo sapiens
cgggctcagcaaaagatgc

SEQ ID NO: 3757817 - DNA, 14 bp, Homo sapiens
cgggctgccctgcc

SEQ ID NO: 3757818 - DNA, 16 bp, Homo sapiens
cgggctggcctgtgcc

SEQ ID NO: 3757819 - DNA, 17 bp, Homo sapiens
cgggctggcctgtgcct

SEQ ID NO: 3757820 - DNA, 16 bp, Homo sapiens
cgggctgggagctctg

SEQ ID NO: 3757821 - DNA, 16 bp, Homo sapiens
cgggctgggcagctgt

SEQ ID NO: 3757822 - DNA, 14 bp, Homo sapiens
cggggaactcctgg

SEQ ID NO: 3757823 - DNA, 15 bp, Homo sapiens
cggggaactcctgga

SEQ ID NO: 3757824 - DNA, 14 bp, Homo sapiens
cggggacagctcct

SEQ ID NO: 3757825 - DNA, 19 bp, Homo sapiens
cggggaggccaagtgcagg

SEQ ID NO: 3757826 - DNA, 19 bp, Homo sapiens
cggggcatgctggggcaag

SEQ ID NO: 3757827 - DNA, 14 bp, Homo sapiens
cggggccccagggc

SEQ ID NO: 3757828 - DNA, 15 bp, Homo sapiens
cggggcctgcctagc

SEQ ID NO: 3757829 - DNA, 15 bp, Homo sapiens
cggggggacagctcc

SEQ ID NO: 3757830 - DNA, 19 bp, Homo sapiens
cgggtttggcgggccaagg

SEQ ID NO: 3757831 - DNA, 14 bp, Homo sapiens
cggtcaaggccagc

SEQ ID NO: 3757832 - DNA, 14 bp, Homo sapiens
cggtccacccagga

SEQ ID NO: 3757833 - DNA, 16 bp, Homo sapiens
cggtccacccaggagc

SEQ ID NO: 3757834 - DNA, 18 bp, Homo sapiens
cggtcccctccgccaggc

SEQ ID NO: 3757835 - DNA, 21 bp, Homo sapiens
cggtcccttgagacctcagcc

SEQ ID NO: 3757836 - DNA, 15 bp, Homo sapiens
cggtcctgtctcccc

SEQ ID NO: 3757837 - DNA, 23 bp, Homo sapiens
cggtgcatacacccccacctcct

SEQ ID NO: 3757838 - DNA, 20 bp, Homo sapiens
cggtggctcaggcctataac

SEQ ID NO: 3757839 - DNA, 20 bp, Homo sapiens
cggtgtgcctgcagccccgc

SEQ ID NO: 3757840 - DNA, 13 bp, Homo sapiens
cggtgtggagaag

SEQ ID NO: 3757841 - DNA, 13 bp, Homo sapiens
cggttcaccagcc

SEQ ID NO: 3757842 - DNA, 21 bp, Homo sapiens
cggtttggggagcagagacac

SEQ ID NO: 3757843 - DNA, 24 bp, Homo sapiens
cgtaagatacaagtttcagacagg

SEQ ID NO: 3757844 - DNA, 14 bp, Homo sapiens
cgtactgcagcctc

SEQ ID NO: 3757845 - DNA, 15 bp, Homo sapiens
cgtactgcagcctcc

SEQ ID NO: 3757846 - DNA, 17 bp, Homo sapiens
cgtagggagtacctgct

SEQ ID NO: 3757847 - DNA, 13 bp, Homo sapiens
cgtagttccctga

SEQ ID NO: 3757848 - DNA, 14 bp, Homo sapiens
cgtcaccacctctc

SEQ ID NO: 3757849 - DNA, 19 bp, Homo sapiens
cgtcagctggcactgtctc

SEQ ID NO: 3757850 - DNA, 19 bp, Homo sapiens
cgtccaggagcctgtgcct

SEQ ID NO: 3757851 - DNA, 17 bp, Homo sapiens
cgtcctccccctgccag

SEQ ID NO: 3757852 - DNA, 14 bp, Homo sapiens
cgtcctgccacctg

SEQ ID NO: 3757853 - DNA, 16 bp, Homo sapiens
cgtcctgccacctggg

SEQ ID NO: 3757854 - DNA, 18 bp, Homo sapiens
cgtctcccatcttaactc

SEQ ID NO: 3757855 - DNA, 21 bp, Homo sapiens
cgtctgacaggcaatgctggc

SEQ ID NO: 3757856 - DNA, 23 bp, Homo sapiens
cgtctgctaacttggagccccag

SEQ ID NO: 3757857 - DNA, 18 bp, Homo sapiens
cgtctggggttcagcccc

SEQ ID NO: 3757858 - DNA, 19 bp, Homo sapiens
cgtctggggttcagcccct

SEQ ID NO: 3757859 - DNA, 18 bp, Homo sapiens
cgtctgtcttcacagctc

SEQ ID NO: 3757860 - DNA, 14 bp, Homo sapiens
cgtcttcagcctag

SEQ ID NO: 3757861 - DNA, 16 bp, Homo sapiens
cgtgaaacacaccagg

SEQ ID NO: 3757862 - DNA, 13 bp, Homo sapiens
cgtgaagcatcca

SEQ ID NO: 3757863 - DNA, 19 bp, Homo sapiens
cgtgaaggccgagaagcaa

SEQ ID NO: 3757864 - DNA, 18 bp, Homo sapiens
cgtgacatccccaccctt

SEQ ID NO: 3757865 - DNA, 15 bp, Homo sapiens
cgtgactcacccaag

SEQ ID NO: 3757866 - DNA, 17 bp, Homo sapiens
cgtgactcacccaagca

SEQ ID NO: 3757867 - DNA, 13 bp, Homo sapiens
cgtgactgcccca

SEQ ID NO: 3757868 - DNA, 21 bp, Homo sapiens
cgtgactgccccaactcctgg

SEQ ID NO: 3757869 - DNA, 22 bp, Homo sapiens
cgtgagccactgcaccgggcca

SEQ ID NO: 3757870 - DNA, 13 bp, Homo sapiens
cgtgatcttggct

SEQ ID NO: 3757871 - DNA, 21 bp, Homo sapiens
cgtgcacacaccagagcccac

SEQ ID NO: 3757872 - DNA, 15 bp, Homo sapiens
cgtgcacctgtactc

SEQ ID NO: 3757873 - DNA, 17 bp, Homo sapiens
cgtgcactctgctaatc

SEQ ID NO: 3757874 - DNA, 17 bp, Homo sapiens
cgtgcagactggagggg

SEQ ID NO: 3757875 - DNA, 14 bp, Homo sapiens
cgtgcagcatatga

SEQ ID NO: 3757876 - DNA, 13 bp, Homo sapiens
cgtgccaggcccg

SEQ ID NO: 3757877 - DNA, 12 bp, Homo sapiens
cgtgccctctgt

SEQ ID NO: 3757878 - DNA, 22 bp, Homo sapiens
cgtgcttgtttgctcacctggg

SEQ ID NO: 3757879 - DNA, 21 bp, Homo sapiens
cgtggaaagggtgctgcttcc

SEQ ID NO: 3757880 - DNA, 20 bp, Homo sapiens
cgtggagagctggtgcccgg

SEQ ID NO: 3757881 - DNA, 18 bp, Homo sapiens
cgtggaggaatgctcccc

SEQ ID NO: 3757882 - DNA, 20 bp, Homo sapiens
cgtggcagataatcagcctc

SEQ ID NO: 3757883 - DNA, 22 bp, Homo sapiens
cgtggcagataatcagcctctt

SEQ ID NO: 3757884 - DNA, 16 bp, Homo sapiens
cgtggcccagagaagc

SEQ ID NO: 3757885 - DNA, 14 bp, Homo sapiens
cgtggctgaccccc

SEQ ID NO: 3757886 - DNA, 19 bp, Homo sapiens
cgtggctgcggcacccttg

SEQ ID NO: 3757887 - DNA, 19 bp, Homo sapiens
cgtggcttcccgctcagcc

SEQ ID NO: 3757888 - DNA, 13 bp, Homo sapiens
cgtgggccatggc

SEQ ID NO: 3757889 - DNA, 23 bp, Homo sapiens
cgtgggtgtgtgtagccaaggtc

SEQ ID NO: 3757890 - DNA, 20 bp, Homo sapiens
cgtgtggctcacgtgtgtga

SEQ ID NO: 3757891 - DNA, 17 bp, Homo sapiens
cgtgtgtccatgtgtgt

SEQ ID NO: 3757892 - DNA, 22 bp, Homo sapiens
cgttatgtgtgtatatgtatgt

SEQ ID NO: 3757893 - DNA, 13 bp, Homo sapiens
cgttccagttccc

SEQ ID NO: 3757894 - DNA, 13 bp, Homo sapiens
cgttcttgttctg

SEQ ID NO: 3757895 - DNA, 19 bp, Homo sapiens
cgttcttgttctgttttgt

SEQ ID NO: 3757896 - DNA, 23 bp, Homo sapiens
cgtttaaagtgtattataacagt

SEQ ID NO: 3757897 - DNA, 16 bp, Homo sapiens
cgtttacattttagac

SEQ ID NO: 3757898 - DNA, 17 bp, Homo sapiens
cgtttcagtaataaaac

SEQ ID NO: 3757899 - DNA, 20 bp, Homo sapiens
cgtttccaggtgtttatagt

SEQ ID NO: 3757900 - DNA, 15 bp, Homo sapiens
cgtttgtttgttttg

SEQ ID NO: 3757901 - DNA, 14 bp, Homo sapiens
cgttttattgtgtt

SEQ ID NO: 3757902 - DNA, 18 bp, Homo sapiens
ctaaaaatagtggccaga

SEQ ID NO: 3757903 - DNA, 22 bp, Homo sapiens
ctaaaaatattataacttaaaa

SEQ ID NO: 3757904 - DNA, 18 bp, Homo sapiens
ctaaaagttcataacagt

SEQ ID NO: 3757905 - DNA, 21 bp, Homo sapiens
ctaaagaaggtttcagaaaga

SEQ ID NO: 3757906 - DNA, 16 bp, Homo sapiens
ctaaagagagaatgta

SEQ ID NO: 3757907 - DNA, 18 bp, Homo sapiens
ctaaagaggctgaaagag

SEQ ID NO: 3757908 - DNA, 19 bp, Homo sapiens
ctaaaggaaaaaaccatcc

SEQ ID NO: 3757909 - DNA, 20 bp, Homo sapiens
ctaaaggtcccaaggcaagg

SEQ ID NO: 3757910 - DNA, 15 bp, Homo sapiens
ctaaataaaatataa

SEQ ID NO: 3757911 - DNA, 17 bp, Homo sapiens
ctaaataaaatataatt

SEQ ID NO: 3757912 - DNA, 20 bp, Homo sapiens
ctaaataaacacatagattc

SEQ ID NO: 3757913 - DNA, 17 bp, Homo sapiens
ctaaatcctttactgtt

SEQ ID NO: 3757914 - DNA, 22 bp, Homo sapiens
ctaaatctgtaagctctttgaa

SEQ ID NO: 3757915 - DNA, 22 bp, Homo sapiens
ctaaatgaaaatcgtgacaaca

SEQ ID NO: 3757916 - DNA, 16 bp, Homo sapiens
ctaaatgaatgtttac

SEQ ID NO: 3757917 - DNA, 22 bp, Homo sapiens
ctaaatgcatatcctgagccat

SEQ ID NO: 3757918 - DNA, 18 bp, Homo sapiens
ctaaatgtaagaatcatt

SEQ ID NO: 3757919 - DNA, 21 bp, Homo sapiens
ctaaatgtggagaaactgtag

SEQ ID NO: 3757920 - DNA, 14 bp, Homo sapiens
ctaacactggcccc

SEQ ID NO: 3757921 - DNA, 19 bp, Homo sapiens
ctaacaggggctggtgggc

SEQ ID NO: 3757922 - DNA, 20 bp, Homo sapiens
ctaacaggggctggtgggca

SEQ ID NO: 3757923 - DNA, 17 bp, Homo sapiens
ctaacagttcacttgca

SEQ ID NO: 3757924 - DNA, 19 bp, Homo sapiens
ctaacagttcacttgcagt

SEQ ID NO: 3757925 - DNA, 12 bp, Homo sapiens
ctaacatataat

SEQ ID NO: 3757926 - DNA, 20 bp, Homo sapiens
ctaacattatattgcaatga

SEQ ID NO: 3757927 - DNA, 15 bp, Homo sapiens
ctaaccacacagcct

SEQ ID NO: 3757928 - DNA, 16 bp, Homo sapiens
ctaacccctttcctgc

SEQ ID NO: 3757929 - DNA, 14 bp, Homo sapiens
ctaacctaagcaaa

SEQ ID NO: 3757930 - DNA, 17 bp, Homo sapiens
ctaacctgggttccctt

SEQ ID NO: 3757931 - DNA, 15 bp, Homo sapiens
ctaactctgatgtaa

SEQ ID NO: 3757932 - DNA, 20 bp, Homo sapiens
ctaactgtgctcaagaggtt

SEQ ID NO: 3757933 - DNA, 17 bp, Homo sapiens
ctaacttggagccccag

SEQ ID NO: 3757934 - DNA, 21 bp, Homo sapiens
ctaacttggagccccagtgcc

SEQ ID NO: 3757935 - DNA, 22 bp, Homo sapiens
ctaacttggagccccagtgcca

SEQ ID NO: 3757936 - DNA, 18 bp, Homo sapiens
ctaagactgctgctgaat

SEQ ID NO: 3757937 - DNA, 11 bp, Homo sapiens
ctaagagccat

SEQ ID NO: 3757938 - DNA, 20 bp, Homo sapiens
ctaagagccatttaggggcc

SEQ ID NO: 3757939 - DNA, 16 bp, Homo sapiens
ctaagagctagcgctg

SEQ ID NO: 3757940 - DNA, 23 bp, Homo sapiens
ctaagcacgggccatatgaataa

SEQ ID NO: 3757941 - DNA, 19 bp, Homo sapiens
ctaagctattcagtaataa

SEQ ID NO: 3757942 - DNA, 22 bp, Homo sapiens
ctaagctcaaggcgtgaggatg

SEQ ID NO: 3757943 - DNA, 15 bp, Homo sapiens
ctaagcttaaaaaaa

SEQ ID NO: 3757944 - DNA, 16 bp, Homo sapiens
ctaaggacatttccca

SEQ ID NO: 3757945 - DNA, 19 bp, Homo sapiens
ctaaggccgaagaagggtc

SEQ ID NO: 3757946 - DNA, 16 bp, Homo sapiens
ctaaggtgtgctctga

SEQ ID NO: 3757947 - DNA, 22 bp, Homo sapiens
ctaagtgatcctcccacctcag

SEQ ID NO: 3757948 - DNA, 23 bp, Homo sapiens
ctaagtgatcctcccacctcagc

SEQ ID NO: 3757949 - DNA, 21 bp, Homo sapiens
ctaagtggtactaactttcct

SEQ ID NO: 3757950 - DNA, 17 bp, Homo sapiens
ctaagttcttagatatc

SEQ ID NO: 3757951 - DNA, 18 bp, Homo sapiens
ctaagttcttagatatct

SEQ ID NO: 3757952 - DNA, 20 bp, Homo sapiens
ctaagttcttagatatcttt

SEQ ID NO: 3757953 - DNA, 10 bp, Homo sapiens
ctaataaaac

SEQ ID NO: 3757954 - DNA, 13 bp, Homo sapiens
ctaataaaagcat

SEQ ID NO: 3757955 - DNA, 15 bp, Homo sapiens
ctaataaaatatcat

SEQ ID NO: 3757956 - DNA, 18 bp, Homo sapiens
ctaataaaatatcattca

SEQ ID NO: 3757957 - DNA, 22 bp, Homo sapiens
ctaataaaatatcattcagcaa

SEQ ID NO: 3757958 - DNA, 19 bp, Homo sapiens
ctaataatcttgtttctga

SEQ ID NO: 3757959 - DNA, 13 bp, Homo sapiens
ctaatagaactca

SEQ ID NO: 3757960 - DNA, 17 bp, Homo sapiens
ctaatatacagggtagc

SEQ ID NO: 3757961 - DNA, 21 bp, Homo sapiens
ctaatcagcattctcactcct

SEQ ID NO: 3757962 - DNA, 16 bp, Homo sapiens
ctaatcatccaatgct

SEQ ID NO: 3757963 - DNA, 19 bp, Homo sapiens
ctaatccctgggcattgct

SEQ ID NO: 3757964 - DNA, 17 bp, Homo sapiens
ctaatctaacaatggaa

SEQ ID NO: 3757965 - DNA, 17 bp, Homo sapiens
ctaatctattgggttca

SEQ ID NO: 3757966 - DNA, 22 bp, Homo sapiens
ctaatctattgggttcattatt

SEQ ID NO: 3757967 - DNA, 16 bp, Homo sapiens
ctaatgagaagtcaac

SEQ ID NO: 3757968 - DNA, 19 bp, Homo sapiens
ctaatgagtttcttttata

SEQ ID NO: 3757969 - DNA, 12 bp, Homo sapiens
ctaatgatgttt

SEQ ID NO: 3757970 - DNA, 16 bp, Homo sapiens
ctaatgtactgcatat

SEQ ID NO: 3757971 - DNA, 17 bp, Homo sapiens
ctaatgtttatgagcca

SEQ ID NO: 3757972 - DNA, 13 bp, Homo sapiens
ctaattaataaag

SEQ ID NO: 3757973 - DNA, 16 bp, Homo sapiens
ctaattattttaatta

SEQ ID NO: 3757974 - DNA, 18 bp, Homo sapiens
ctaattcccattttgcaa

SEQ ID NO: 3757975 - DNA, 20 bp, Homo sapiens
ctaattcccattttgcaaaa

SEQ ID NO: 3757976 - DNA, 11 bp, Homo sapiens
ctaattctaac

SEQ ID NO: 3757977 - DNA, 13 bp, Homo sapiens
ctaattgccatgt

SEQ ID NO: 3757978 - DNA, 19 bp, Homo sapiens
ctaattggcctctttaaga

SEQ ID NO: 3757979 - DNA, 21 bp, Homo sapiens
ctaatttatcctgaaatttca

SEQ ID NO: 3757980 - DNA, 15 bp, Homo sapiens
ctaatttctgtgtct

SEQ ID NO: 3757981 - DNA, 15 bp, Homo sapiens
ctaatttgatgttta

SEQ ID NO: 3757982 - DNA, 23 bp, Homo sapiens
ctacaaaaaattagaaattggct

SEQ ID NO: 3757983 - DNA, 20 bp, Homo sapiens
ctacaaaacctgatgttaaa

SEQ ID NO: 3757984 - DNA, 21 bp, Homo sapiens
ctacaaaacctgatgttaaaa

SEQ ID NO: 3757985 - DNA, 18 bp, Homo sapiens
ctacaaaatttgaaattt

SEQ ID NO: 3757986 - DNA, 15 bp, Homo sapiens
ctacaagagcagcct

SEQ ID NO: 3757987 - DNA, 19 bp, Homo sapiens
ctacaagctaaaattagat

SEQ ID NO: 3757988 - DNA, 18 bp, Homo sapiens
ctacaagtattctgcctt

SEQ ID NO: 3757989 - DNA, 17 bp, Homo sapiens
ctacactccagcctgag

SEQ ID NO: 3757990 - DNA, 12 bp, Homo sapiens
ctacactctcct

SEQ ID NO: 3757991 - DNA, 21 bp, Homo sapiens
ctacactctcctgggcccctc

SEQ ID NO: 3757992 - DNA, 16 bp, Homo sapiens
ctacagacttctccag

SEQ ID NO: 3757993 - DNA, 15 bp, Homo sapiens
ctacagaggccatgg

SEQ ID NO: 3757994 - DNA, 17 bp, Homo sapiens
ctacagaggccatgggc

SEQ ID NO: 3757995 - DNA, 18 bp, Homo sapiens
ctacagctaatcagcatt

SEQ ID NO: 3757996 - DNA, 22 bp, Homo sapiens
ctacagctaatcagcattctca

SEQ ID NO: 3757997 - DNA, 20 bp, Homo sapiens
ctacaggaagcaccccatgc

SEQ ID NO: 3757998 - DNA, 20 bp, Homo sapiens
ctacaggcctcacacacaat

SEQ ID NO: 3757999 - DNA, 22 bp, Homo sapiens
ctacagggcgagactctgtctc

SEQ ID NO: 3758000 - DNA, 14 bp, Homo sapiens
ctacaggtgtgagt

SEQ ID NO: 3758001 - DNA, 16 bp, Homo sapiens
ctacaggtgtgagtca

SEQ ID NO: 3758002 - DNA, 22 bp, Homo sapiens
ctacagttgttttttgaaaaca

SEQ ID NO: 3758003 - DNA, 10 bp, Homo sapiens
ctacatgaaa

SEQ ID NO: 3758004 - DNA, 18 bp, Homo sapiens
ctacatgaaacagaaaca

SEQ ID NO: 3758005 - DNA, 19 bp, Homo sapiens
ctacatgacgacaaagctg

SEQ ID NO: 3758006 - DNA, 23 bp, Homo sapiens
ctacatgcagcccatgcccacct

SEQ ID NO: 3758007 - DNA, 16 bp, Homo sapiens
ctacatgtgggagctt

SEQ ID NO: 3758008 - DNA, 14 bp, Homo sapiens
ctaccaaagcacct

SEQ ID NO: 3758009 - DNA, 13 bp, Homo sapiens
ctaccacaaggaa

SEQ ID NO: 3758010 - DNA, 15 bp, Homo sapiens
ctaccacaaggaaaa

SEQ ID NO: 3758011 - DNA, 14 bp, Homo sapiens
ctaccacagtgtct

SEQ ID NO: 3758012 - DNA, 15 bp, Homo sapiens
ctaccacctccccag

SEQ ID NO: 3758013 - DNA, 18 bp, Homo sapiens
ctaccatcccctgtagag

SEQ ID NO: 3758014 - DNA, 13 bp, Homo sapiens
ctaccatctccct

SEQ ID NO: 3758015 - DNA, 12 bp, Homo sapiens
ctaccatttcag

SEQ ID NO: 3758016 - DNA, 13 bp, Homo sapiens
ctacccaccctcc

SEQ ID NO: 3758017 - DNA, 19 bp, Homo sapiens
catataaacatcacacaca

SEQ ID NO: 3758018 - DNA, 20 bp, Homo sapiens
catataatatatgttttaaa

SEQ ID NO: 3758019 - DNA, 18 bp, Homo sapiens
catataatgttgttattt

SEQ ID NO: 3758020 - DNA, 15 bp, Homo sapiens
catatcctgagccat

SEQ ID NO: 3758021 - DNA, 22 bp, Homo sapiens
catatgactcacatgatgcata

SEQ ID NO: 3758022 - DNA, 15 bp, Homo sapiens
catatgttacactaa

SEQ ID NO: 3758023 - DNA, 20 bp, Homo sapiens
catattaggaaaatatgggt

SEQ ID NO: 3758024 - DNA, 13 bp, Homo sapiens
catattatgtctt

SEQ ID NO: 3758025 - DNA, 22 bp, Homo sapiens
catattctgttggccagtgtga

SEQ ID NO: 3758026 - DNA, 11 bp, Homo sapiens
catatttaaga

SEQ ID NO: 3758027 - DNA, 17 bp, Homo sapiens
catatttacttcttata

SEQ ID NO: 3758028 - DNA, 12 bp, Homo sapiens
catatttcaatt

SEQ ID NO: 3758029 - DNA, 15 bp, Homo sapiens
catatttgagactag

SEQ ID NO: 3758030 - DNA, 21 bp, Homo sapiens
catcaagcacagaaggaggag

SEQ ID NO: 3758031 - DNA, 23 bp, Homo sapiens
catcaagttattgacaaactctc

SEQ ID NO: 3758032 - DNA, 18 bp, Homo sapiens
catcaatgttcattgtaa

SEQ ID NO: 3758033 - DNA, 15 bp, Homo sapiens
catcacagggcagag

SEQ ID NO: 3758034 - DNA, 12 bp, Homo sapiens
catcacctcagg

SEQ ID NO: 3758035 - DNA, 13 bp, Homo sapiens
catcacctcaggc

SEQ ID NO: 3758036 - DNA, 19 bp, Homo sapiens
catcaccttaggcagggaa

SEQ ID NO: 3758037 - DNA, 19 bp, Homo sapiens
catcactggagcaccaggc

SEQ ID NO: 3758038 - DNA, 14 bp, Homo sapiens
catcagaaggagaa

SEQ ID NO: 3758039 - DNA, 23 bp, Homo sapiens
catcagaaggagaaggaaggaga

SEQ ID NO: 3758040 - DNA, 12 bp, Homo sapiens
catcagacctgt

SEQ ID NO: 3758041 - DNA, 20 bp, Homo sapiens
catcagacctgtcttccaag

SEQ ID NO: 3758042 - DNA, 23 bp, Homo sapiens
catcagacctgtcttccaaggag

SEQ ID NO: 3758043 - DNA, 16 bp, Homo sapiens
catcagctattcagtt

SEQ ID NO: 3758044 - DNA, 18 bp, Homo sapiens
catcagtggcatggctcc

SEQ ID NO: 3758045 - DNA, 15 bp, Homo sapiens
catcagtgttaaaaa

SEQ ID NO: 3758046 - DNA, 16 bp, Homo sapiens
catcatgcatcttact

SEQ ID NO: 3758047 - DNA, 15 bp, Homo sapiens
catcatgtctggcta

SEQ ID NO: 3758048 - DNA, 17 bp, Homo sapiens
catcattataaacgtga

SEQ ID NO: 3758049 - DNA, 17 bp, Homo sapiens
catcattccttgagaaa

SEQ ID NO: 3758050 - DNA, 14 bp, Homo sapiens
catcatttcaggag

SEQ ID NO: 3758051 - DNA, 15 bp, Homo sapiens
catccaaccccccac

SEQ ID NO: 3758052 - DNA, 19 bp, Homo sapiens
catccaaccccccacctgc

SEQ ID NO: 3758053 - DNA, 23 bp, Homo sapiens
catccaaggagaaacagagacag

SEQ ID NO: 3758054 - DNA, 21 bp, Homo sapiens
catccaatcctcactgggtgg

SEQ ID NO: 3758055 - DNA, 19 bp, Homo sapiens
catccactctaccctccca

SEQ ID NO: 3758056 - DNA, 22 bp, Homo sapiens
catccactctaccctcccaccc

SEQ ID NO: 3758057 - DNA, 23 bp, Homo sapiens
catccactgtgccatgtgccagg

SEQ ID NO: 3758058 - DNA, 15 bp, Homo sapiens
catccaggttcagct

SEQ ID NO: 3758059 - DNA, 13 bp, Homo sapiens
catccagttcatg

SEQ ID NO: 3758060 - DNA, 14 bp, Homo sapiens
catccatctccagg

SEQ ID NO: 3758061 - DNA, 16 bp, Homo sapiens
catccatctccaggga

SEQ ID NO: 3758062 - DNA, 20 bp, Homo sapiens
catccatttcatctatttct

SEQ ID NO: 3758063 - DNA, 23 bp, Homo sapiens
catccatttcatctatttctgag

SEQ ID NO: 3758064 - DNA, 23 bp, Homo sapiens
catcccactcacaacagctgcct

SEQ ID NO: 3758065 - DNA, 17 bp, Homo sapiens
catcccagcctgtggtt

SEQ ID NO: 3758066 - DNA, 13 bp, Homo sapiens
catcccaggggac

SEQ ID NO: 3758067 - DNA, 13 bp, Homo sapiens
catcccagtggcc

SEQ ID NO: 3758068 - DNA, 20 bp, Homo sapiens
catcccagtggcctcaaccc

SEQ ID NO: 3758069 - DNA, 13 bp, Homo sapiens
catcccatcccat

SEQ ID NO: 3758070 - DNA, 15 bp, Homo sapiens
catcccattgccctg

SEQ ID NO: 3758071 - DNA, 16 bp, Homo sapiens
catccccacccttgga

SEQ ID NO: 3758072 - DNA, 14 bp, Homo sapiens
catcccctgtagag

SEQ ID NO: 3758073 - DNA, 21 bp, Homo sapiens
catcccctgtagagtgggagc

SEQ ID NO: 3758074 - DNA, 12 bp, Homo sapiens
catccctacccc

SEQ ID NO: 3758075 - DNA, 14 bp, Homo sapiens
catccctaccccct

SEQ ID NO: 3758076 - DNA, 22 bp, Homo sapiens
catccctaccccctaagagcca

SEQ ID NO: 3758077 - DNA, 19 bp, Homo sapiens
catccctgaggctggactc

SEQ ID NO: 3758078 - DNA, 19 bp, Homo sapiens
catccctgattcctgttgt

SEQ ID NO: 3758079 - DNA, 14 bp, Homo sapiens
catccgaggcaggg

SEQ ID NO: 3758080 - DNA, 21 bp, Homo sapiens
catcctaccacaatgcagtgc

SEQ ID NO: 3758081 - DNA, 12 bp, Homo sapiens
catcctcccctt

SEQ ID NO: 3758082 - DNA, 21 bp, Homo sapiens
catcctccccttccctgcaaa

SEQ ID NO: 3758083 - DNA, 16 bp, Homo sapiens
catcctccgtccagcc

SEQ ID NO: 3758084 - DNA, 12 bp, Homo sapiens
catcctgcaggc

SEQ ID NO: 3758085 - DNA, 15 bp, Homo sapiens
catcctggcacccgg

SEQ ID NO: 3758086 - DNA, 17 bp, Homo sapiens
catccttagcaacagcc

SEQ ID NO: 3758087 - DNA, 19 bp, Homo sapiens
catctatcgagtttgcaat

SEQ ID NO: 3758088 - DNA, 19 bp, Homo sapiens
catctatgtcccttgctgt

SEQ ID NO: 3758089 - DNA, 13 bp, Homo sapiens
catctatttctga

SEQ ID NO: 3758090 - DNA, 14 bp, Homo sapiens
catctatttctgag

SEQ ID NO: 3758091 - DNA, 18 bp, Homo sapiens
catctcaggcctccctca

SEQ ID NO: 3758092 - DNA, 20 bp, Homo sapiens
catctccagggagcaagaca

SEQ ID NO: 3758093 - DNA, 16 bp, Homo sapiens
catctccatcagctgt

SEQ ID NO: 3758094 - DNA, 19 bp, Homo sapiens
catctcctgtgcatgggtg

SEQ ID NO: 3758095 - DNA, 21 bp, Homo sapiens
catctcgccacccctccttcc

SEQ ID NO: 3758096 - DNA, 22 bp, Homo sapiens
catctcgccacccctccttcct

SEQ ID NO: 3758097 - DNA, 16 bp, Homo sapiens
catctctacaaaaagc

SEQ ID NO: 3758098 - DNA, 15 bp, Homo sapiens
catctctccctcccc

SEQ ID NO: 3758099 - DNA, 15 bp, Homo sapiens
catctcttgaggcca

SEQ ID NO: 3758100 - DNA, 13 bp, Homo sapiens
catctgaaagcca

SEQ ID NO: 3758101 - DNA, 14 bp, Homo sapiens
catctgaaagccac

SEQ ID NO: 3758102 - DNA, 14 bp, Homo sapiens
catctgacacaaaa

SEQ ID NO: 3758103 - DNA, 11 bp, Homo sapiens
catctgcccct

SEQ ID NO: 3758104 - DNA, 16 bp, Homo sapiens
catctggaaaataaaa

SEQ ID NO: 3758105 - DNA, 20 bp, Homo sapiens
catctggccttacacctcgt

SEQ ID NO: 3758106 - DNA, 21 bp, Homo sapiens
catctgggaagatttctacct

SEQ ID NO: 3758107 - DNA, 12 bp, Homo sapiens
catctgtagata

SEQ ID NO: 3758108 - DNA, 23 bp, Homo sapiens
catctgtctggaggggagctctg

SEQ ID NO: 3758109 - DNA, 13 bp, Homo sapiens
catcttactgaag

SEQ ID NO: 3758110 - DNA, 21 bp, Homo sapiens
catcttaggttggcaaaaagg

SEQ ID NO: 3758111 - DNA, 14 bp, Homo sapiens
catcttctccatct

SEQ ID NO: 3758112 - DNA, 15 bp, Homo sapiens
catcttgaccaagca

SEQ ID NO: 3758113 - DNA, 16 bp, Homo sapiens
catcttgaccaagcag

SEQ ID NO: 3758114 - DNA, 17 bp, Homo sapiens
catcttgaccaagcagg

SEQ ID NO: 3758115 - DNA, 20 bp, Homo sapiens
catcttgaccaagcaggaag

SEQ ID NO: 3758116 - DNA, 22 bp, Homo sapiens
catcttgaccaagcaggaagct

SEQ ID NO: 3758117 - DNA, 15 bp, Homo sapiens
catcttgctctgctg

SEQ ID NO: 3758118 - DNA, 17 bp, Homo sapiens
catcttgctctgctgac

SEQ ID NO: 3758119 - DNA, 19 bp, Homo sapiens
catcttgctctgctgacag

SEQ ID NO: 3758120 - DNA, 16 bp, Homo sapiens
catctttcttctattt

SEQ ID NO: 3758121 - DNA, 23 bp, Homo sapiens
catctttcttctattttattccc

SEQ ID NO: 3758122 - DNA, 13 bp, Homo sapiens
catcttttacatt

SEQ ID NO: 3758123 - DNA, 13 bp, Homo sapiens
catgaaaaagcag

SEQ ID NO: 3758124 - DNA, 13 bp, Homo sapiens
catgaaaacgttt

SEQ ID NO: 3758125 - DNA, 16 bp, Homo sapiens
catgaaaacgttttat

SEQ ID NO: 3758126 - DNA, 21 bp, Homo sapiens
catgaaaacgttttattgtgt

SEQ ID NO: 3758127 - DNA, 22 bp, Homo sapiens
catgaaaacgttttattgtgtt

SEQ ID NO: 3758128 - DNA, 13 bp, Homo sapiens
catgaaaatgcaa

SEQ ID NO: 3758129 - DNA, 15 bp, Homo sapiens
catgaaaatgcaaca

SEQ ID NO: 3758130 - DNA, 22 bp, Homo sapiens
catgaaaatgcaacaacatgta

SEQ ID NO: 3758131 - DNA, 19 bp, Homo sapiens
catgaaacagaaacaaaaa

SEQ ID NO: 3758132 - DNA, 13 bp, Homo sapiens
catgaaatatgca

SEQ ID NO: 3758133 - DNA, 14 bp, Homo sapiens
catgaaatatgcat

SEQ ID NO: 3758134 - DNA, 24 bp, Homo sapiens
catgaaattgtctagcagagcagg

SEQ ID NO: 3758135 - DNA, 21 bp, Homo sapiens
catgaagccacagcccaggcc

SEQ ID NO: 3758136 - DNA, 24 bp, Homo sapiens
catgaagccacagcccaggcctcc

SEQ ID NO: 3758137 - DNA, 16 bp, Homo sapiens
catgaagccaggtgtg

SEQ ID NO: 3758138 - DNA, 18 bp, Homo sapiens
catgaaggtttctgaaaa

SEQ ID NO: 3758139 - DNA, 16 bp, Homo sapiens
catgaatgcacactag

SEQ ID NO: 3758140 - DNA, 17 bp, Homo sapiens
catgaatgtatcaggaa

SEQ ID NO: 3758141 - DNA, 15 bp, Homo sapiens
catgacaagccccag

SEQ ID NO: 3758142 - DNA, 19 bp, Homo sapiens
catgacaagccccaggcag

SEQ ID NO: 3758143 - DNA, 20 bp, Homo sapiens
catgacaagccccaggcagg

SEQ ID NO: 3758144 - DNA, 15 bp, Homo sapiens
catgacactgaaatg

SEQ ID NO: 3758145 - DNA, 18 bp, Homo sapiens
catgacctgtgaccagca

SEQ ID NO: 3758146 - DNA, 16 bp, Homo sapiens
catgactgcattttac

SEQ ID NO: 3758147 - DNA, 15 bp, Homo sapiens
catgagaacagactg

SEQ ID NO: 3758148 - DNA, 14 bp, Homo sapiens
catgagacacatct

SEQ ID NO: 3758149 - DNA, 15 bp, Homo sapiens
catgagcctcagcat

SEQ ID NO: 3758150 - DNA, 18 bp, Homo sapiens
catgagcctcagcatcct

SEQ ID NO: 3758151 - DNA, 19 bp, Homo sapiens
catgagcctcagcatcctg

SEQ ID NO: 3758152 - DNA, 20 bp, Homo sapiens
catgagcctcagcatcctgg

SEQ ID NO: 3758153 - DNA, 23 bp, Homo sapiens
catgagcctcagcatcctggcac

SEQ ID NO: 3758154 - DNA, 19 bp, Homo sapiens
catgagctccagaccccca

SEQ ID NO: 3758155 - DNA, 23 bp, Homo sapiens
catgagctccagacccccagcaa

SEQ ID NO: 3758156 - DNA, 16 bp, Homo sapiens
catgaggagttgctgt

SEQ ID NO: 3758157 - DNA, 21 bp, Homo sapiens
catgaggcctcagtggacttt

SEQ ID NO: 3758158 - DNA, 18 bp, Homo sapiens
catgagggatcacagggc

SEQ ID NO: 3758159 - DNA, 19 bp, Homo sapiens
catgagggatcacagggcc

SEQ ID NO: 3758160 - DNA, 20 bp, Homo sapiens
catgaggggcccgagcagaa

SEQ ID NO: 3758161 - DNA, 22 bp, Homo sapiens
catgagtttgccctggtttcac

SEQ ID NO: 3758162 - DNA, 18 bp, Homo sapiens
catgatctccctgccgcc

SEQ ID NO: 3758163 - DNA, 19 bp, Homo sapiens
catgatggagtcaggtttg

SEQ ID NO: 3758164 - DNA, 21 bp, Homo sapiens
catgattctttaatagaagtt

SEQ ID NO: 3758165 - DNA, 19 bp, Homo sapiens
catgcaaggggaaaatctc

SEQ ID NO: 3758166 - DNA, 16 bp, Homo sapiens
catgcacgtgtgtgca

SEQ ID NO: 3758167 - DNA, 18 bp, Homo sapiens
catgcagaaagggagcag

SEQ ID NO: 3758168 - DNA, 17 bp, Homo sapiens
catgcagcagcttgctg

SEQ ID NO: 3758169 - DNA, 14 bp, Homo sapiens
catgcagcatctaa

SEQ ID NO: 3758170 - DNA, 15 bp, Homo sapiens
catgcatacactctc

SEQ ID NO: 3758171 - DNA, 14 bp, Homo sapiens
catgcatcaagtta

SEQ ID NO: 3758172 - DNA, 20 bp, Homo sapiens
catgcattgttgaggtggtc

SEQ ID NO: 3758173 - DNA, 19 bp, Homo sapiens
catgccagcttatctcagg

SEQ ID NO: 3758174 - DNA, 14 bp, Homo sapiens
catgcccacctgcc

SEQ ID NO: 3758175 - DNA, 17 bp, Homo sapiens
catgcccacctgcccat

SEQ ID NO: 3758176 - DNA, 15 bp, Homo sapiens
catgccttccagcac

SEQ ID NO: 3758177 - DNA, 21 bp, Homo sapiens
catgccttccagcaccctgca

SEQ ID NO: 3758178 - DNA, 13 bp, Homo sapiens
catgcctttgtaa

SEQ ID NO: 3758179 - DNA, 16 bp, Homo sapiens
catgcctttgtaagtt

SEQ ID NO: 3758180 - DNA, 13 bp, Homo sapiens
catgcgcacaagg

SEQ ID NO: 3758181 - DNA, 15 bp, Homo sapiens
catgcgggctgggca

SEQ ID NO: 3758182 - DNA, 19 bp, Homo sapiens
catgcgggctgggcagctg

SEQ ID NO: 3758183 - DNA, 16 bp, Homo sapiens
catgctatctctgtgt

SEQ ID NO: 3758184 - DNA, 23 bp, Homo sapiens
catgctatctctgtgtgcacaaa

SEQ ID NO: 3758185 - DNA, 14 bp, Homo sapiens
catgctctctgcag

SEQ ID NO: 3758186 - DNA, 21 bp, Homo sapiens
catgctctctgcagccagccc

SEQ ID NO: 3758187 - DNA, 19 bp, Homo sapiens
catgctgaaggctgaaaga

SEQ ID NO: 3758188 - DNA, 12 bp, Homo sapiens
catgctgcttta

SEQ ID NO: 3758189 - DNA, 19 bp, Homo sapiens
catgctggctcccagggcc

SEQ ID NO: 3758190 - DNA, 20 bp, Homo sapiens
catgctggggcaagtccctg

SEQ ID NO: 3758191 - DNA, 20 bp, Homo sapiens
catgcttttcttcctagtta

SEQ ID NO: 3758192 - DNA, 14 bp, Homo sapiens
catggaagggaaga

SEQ ID NO: 3758193 - DNA, 16 bp, Homo sapiens
catggaataacatgta

SEQ ID NO: 3758194 - DNA, 15 bp, Homo sapiens
catggacagaagaag

SEQ ID NO: 3758195 - DNA, 15 bp, Homo sapiens
catggacttccactg

SEQ ID NO: 3758196 - DNA, 11 bp, Homo sapiens
catggagaaac

SEQ ID NO: 3758197 - DNA, 15 bp, Homo sapiens
catggagaaaccctg

SEQ ID NO: 3758198 - DNA, 14 bp, Homo sapiens
catggaggagcttg

SEQ ID NO: 3758199 - DNA, 16 bp, Homo sapiens
catggaggcacacagc

SEQ ID NO: 3758200 - DNA, 20 bp, Homo sapiens
catggaggcacacagctgca

SEQ ID NO: 3758201 - DNA, 17 bp, Homo sapiens
catggagtgtgtattgt

SEQ ID NO: 3758202 - DNA, 21 bp, Homo sapiens
catggcacctgtcgcccagtg

SEQ ID NO: 3758203 - DNA, 23 bp, Homo sapiens
catggcacctgtcgcccagtgcc

SEQ ID NO: 3758204 - DNA, 21 bp, Homo sapiens
catggcagaataatctttggg

SEQ ID NO: 3758205 - DNA, 14 bp, Homo sapiens
catggccaggtggc

SEQ ID NO: 3758206 - DNA, 16 bp, Homo sapiens
catggctaactggcga

SEQ ID NO: 3758207 - DNA, 19 bp, Homo sapiens
catggctaaggcaccagcc

SEQ ID NO: 3758208 - DNA, 14 bp, Homo sapiens
catggctcactgca

SEQ ID NO: 3758209 - DNA, 16 bp, Homo sapiens
catggctcactgcagc

SEQ ID NO: 3758210 - DNA, 15 bp, Homo sapiens
catggctccagtctg

SEQ ID NO: 3758211 - DNA, 15 bp, Homo sapiens
catggcttgccacag

SEQ ID NO: 3758212 - DNA, 17 bp, Homo sapiens
catgggaaactttccct

SEQ ID NO: 3758213 - DNA, 21 bp, Homo sapiens
catgggagctggttagaaatg

SEQ ID NO: 3758214 - DNA, 18 bp, Homo sapiens
catgggcctcctgtgtgt

SEQ ID NO: 3758215 - DNA, 19 bp, Homo sapiens
catgggggcagggcatgac

SEQ ID NO: 3758216 - DNA, 22 bp, Homo sapiens
catgggtgaagggagagccagc

SEQ ID NO: 3758217 - DNA, 23 bp, Homo sapiens
catgggtgaagggagagccagct

SEQ ID NO: 3758218 - DNA, 13 bp, Homo sapiens
catggtaatttat

SEQ ID NO: 3758219 - DNA, 18 bp, Homo sapiens
catggtccccatggcatg

SEQ ID NO: 3758220 - DNA, 19 bp, Homo sapiens
catggtgggttcaggggac

SEQ ID NO: 3758221 - DNA, 16 bp, Homo sapiens
catggtgtttttataa

SEQ ID NO: 3758222 - DNA, 23 bp, Homo sapiens
catggtgtttttataaagaattc

SEQ ID NO: 3758223 - DNA, 14 bp, Homo sapiens
catggttgagaaat

SEQ ID NO: 3758224 - DNA, 12 bp, Homo sapiens
catgtaaaacaa

SEQ ID NO: 3758225 - DNA, 14 bp, Homo sapiens
catgtaaaacaaaa

SEQ ID NO: 3758226 - DNA, 15 bp, Homo sapiens
catgtaaaacaaaaa

SEQ ID NO: 3758227 - DNA, 19 bp, Homo sapiens
catgtaaaacaaaaaacaa

SEQ ID NO: 3758228 - DNA, 21 bp, Homo sapiens
catgtaataaaaagtatatgt

SEQ ID NO: 3758229 - DNA, 22 bp, Homo sapiens
catgtaataaaaagtatatgtt

SEQ ID NO: 3758230 - DNA, 15 bp, Homo sapiens
catgtacatgaagaa

SEQ ID NO: 3758231 - DNA, 22 bp, Homo sapiens
catgtactgagccttgtaattc

SEQ ID NO: 3758232 - DNA, 20 bp, Homo sapiens
catgtactgttactgtgtca

SEQ ID NO: 3758233 - DNA, 23 bp, Homo sapiens
catgtagcaatcagattttcctg

SEQ ID NO: 3758234 - DNA, 14 bp, Homo sapiens
catgtagcaggact

SEQ ID NO: 3758235 - DNA, 21 bp, Homo sapiens
catgtataaatgaagtttata

SEQ ID NO: 3758236 - DNA, 20 bp, Homo sapiens
catgtataatatttttaatt

SEQ ID NO: 3758237 - DNA, 14 bp, Homo sapiens
catgtcaaacgtga

SEQ ID NO: 3758238 - DNA, 19 bp, Homo sapiens
catgtcaaacgtgaaaatg

SEQ ID NO: 3758239 - DNA, 22 bp, Homo sapiens
catgtccctaccgagtctcttc

SEQ ID NO: 3758240 - DNA, 23 bp, Homo sapiens
catgtccctaccgagtctcttct

SEQ ID NO: 3758241 - DNA, 20 bp, Homo sapiens
catgtcgcctctgcattcag

SEQ ID NO: 3758242 - DNA, 18 bp, Homo sapiens
catgtgcctgcaccagga

SEQ ID NO: 3758243 - DNA, 23 bp, Homo sapiens
catgtgcctgcaccaggagacag

SEQ ID NO: 3758244 - DNA, 23 bp, Homo sapiens
catgtgctgtgaccatttataat

SEQ ID NO: 3758245 - DNA, 16 bp, Homo sapiens
catgtggaaagtgaat

SEQ ID NO: 3758246 - DNA, 21 bp, Homo sapiens
catgtggaaagtgaatttgaa

SEQ ID NO: 3758247 - DNA, 22 bp, Homo sapiens
catgtggaaagtgaatttgaat

SEQ ID NO: 3758248 - DNA, 17 bp, Homo sapiens
catgtggaatataaaga

SEQ ID NO: 3758249 - DNA, 16 bp, Homo sapiens
catgtgggtgagccag

SEQ ID NO: 3758250 - DNA, 17 bp, Homo sapiens
catgtgtgcgagtgtgt

SEQ ID NO: 3758251 - DNA, 16 bp, Homo sapiens
catgttacataagata

SEQ ID NO: 3758252 - DNA, 19 bp, Homo sapiens
catgttaggaaaatttcac

SEQ ID NO: 3758253 - DNA, 14 bp, Homo sapiens
catgttatgataaa

SEQ ID NO: 3758254 - DNA, 20 bp, Homo sapiens
catgttatgataaaaaattt

SEQ ID NO: 3758255 - DNA, 21 bp, Homo sapiens
catgttatgataaaaaatttt

SEQ ID NO: 3758256 - DNA, 15 bp, Homo sapiens
catgttggccaggct

SEQ ID NO: 3758257 - DNA, 19 bp, Homo sapiens
catgttggccaggctggtc

SEQ ID NO: 3758258 - DNA, 13 bp, Homo sapiens
catgtttaagatt

SEQ ID NO: 3758259 - DNA, 13 bp, Homo sapiens
catgtttcttcat

SEQ ID NO: 3758260 - DNA, 20 bp, Homo sapiens
catgtttgagctcagacccc

SEQ ID NO: 3758261 - DNA, 18 bp, Homo sapiens
catgtttttcttctccct

SEQ ID NO: 3758262 - DNA, 19 bp, Homo sapiens
catgtttttcttctccctc

SEQ ID NO: 3758263 - DNA, 12 bp, Homo sapiens
cattaaaacaat

SEQ ID NO: 3758264 - DNA, 22 bp, Homo sapiens
cattaaaacaatattgtttcta

SEQ ID NO: 3758265 - DNA, 22 bp, Homo sapiens
cattaaagcagtcacttttcct

SEQ ID NO: 3758266 - DNA, 16 bp, Homo sapiens
cattaacagttttcca

SEQ ID NO: 3758267 - DNA, 20 bp, Homo sapiens
cattaacagttttccatgaa

SEQ ID NO: 3758268 - DNA, 22 bp, Homo sapiens
cattaacagttttccatgaaaa

SEQ ID NO: 3758269 - DNA, 16 bp, Homo sapiens
cattaactaatctatt

SEQ ID NO: 3758270 - DNA, 17 bp, Homo sapiens
cattaatatttgctgac

SEQ ID NO: 3758271 - DNA, 18 bp, Homo sapiens
cattacagagaggagaaa

SEQ ID NO: 3758272 - DNA, 20 bp, Homo sapiens
cattacattccttgataatg

SEQ ID NO: 3758273 - DNA, 20 bp, Homo sapiens
cattaccagacggttcacca

SEQ ID NO: 3758274 - DNA, 23 bp, Homo sapiens
cattaccagacggttcaccagcc

SEQ ID NO: 3758275 - DNA, 15 bp, Homo sapiens
cattacggctcctct

SEQ ID NO: 3758276 - DNA, 18 bp, Homo sapiens
cattactcttgtaagatt

SEQ ID NO: 3758277 - DNA, 19 bp, Homo sapiens
cattactcttgtaagattt

SEQ ID NO: 3758278 - DNA, 18 bp, Homo sapiens
cattagaccaagcttgtc

SEQ ID NO: 3758279 - DNA, 22 bp, Homo sapiens
cattatcgccttttgacagctg

SEQ ID NO: 3758280 - DNA, 18 bp, Homo sapiens
cattatcgggagcagtgt

SEQ ID NO: 3758281 - DNA, 16 bp, Homo sapiens
cattatgagaggcaat

SEQ ID NO: 3758282 - DNA, 13 bp, Homo sapiens
cattattatcaac

SEQ ID NO: 3758283 - DNA, 12 bp, Homo sapiens
cattattggaat

SEQ ID NO: 3758284 - DNA, 14 bp, Homo sapiens
cattattggaatta

SEQ ID NO: 3758285 - DNA, 18 bp, Homo sapiens
cattattggaattaacct

SEQ ID NO: 3758286 - DNA, 22 bp, Homo sapiens
cattattggaattaacctggtg

SEQ ID NO: 3758287 - DNA, 13 bp, Homo sapiens
cattatttattaa

SEQ ID NO: 3758288 - DNA, 17 bp, Homo sapiens
cattatttattaaattt

SEQ ID NO: 3758289 - DNA, 18 bp, Homo sapiens
cattatttattaaatttt

SEQ ID NO: 3758290 - DNA, 14 bp, Homo sapiens
cattatttgcatgt

SEQ ID NO: 3758291 - DNA, 18 bp, Homo sapiens
cattcaaaagttgaaatt

SEQ ID NO: 3758292 - DNA, 17 bp, Homo sapiens
cattcaagtcagctctt

SEQ ID NO: 3758293 - DNA, 16 bp, Homo sapiens
cattcaatacaagtgt

SEQ ID NO: 3758294 - DNA, 13 bp, Homo sapiens
cattcaatgttta

SEQ ID NO: 3758295 - DNA, 13 bp, Homo sapiens
cattcagaacacc

SEQ ID NO: 3758296 - DNA, 20 bp, Homo sapiens
cattcaggaaaactgacaga

SEQ ID NO: 3758297 - DNA, 12 bp, Homo sapiens
cattcaggaacc

SEQ ID NO: 3758298 - DNA, 15 bp, Homo sapiens
cattcataactttca

SEQ ID NO: 3758299 - DNA, 12 bp, Homo sapiens
cattccaggctc

SEQ ID NO: 3758300 - DNA, 17 bp, Homo sapiens
cattccaggctcctccc

SEQ ID NO: 3758301 - DNA, 23 bp, Homo sapiens
cattccccaggtggctgacccag

SEQ ID NO: 3758302 - DNA, 22 bp, Homo sapiens
cattccgacaaccgatgctcca

SEQ ID NO: 3758303 - DNA, 13 bp, Homo sapiens
cattcctatttct

SEQ ID NO: 3758304 - DNA, 19 bp, Homo sapiens
cattcctgaaagaaacagt

SEQ ID NO: 3758305 - DNA, 14 bp, Homo sapiens
cattcctgcctgtc

SEQ ID NO: 3758306 - DNA, 20 bp, Homo sapiens
cattccttgataatgttgtg

SEQ ID NO: 3758307 - DNA, 14 bp, Homo sapiens
cattctcaagccct

SEQ ID NO: 3758308 - DNA, 16 bp, Homo sapiens
cattctcactcctacc

SEQ ID NO: 3758309 - DNA, 16 bp, Homo sapiens
cattctctctcctgtc

SEQ ID NO: 3758310 - DNA, 18 bp, Homo sapiens
cattctctctcctgtcca

SEQ ID NO: 3758311 - DNA, 17 bp, Homo sapiens
cattctgaccatttcag

SEQ ID NO: 3758312 - DNA, 22 bp, Homo sapiens
cattctgccaggcccccaagcc

SEQ ID NO: 3758313 - DNA, 20 bp, Homo sapiens
cattctgcctgcccaggccc

SEQ ID NO: 3758314 - DNA, 21 bp, Homo sapiens
cattcttagcctgtggcagta

SEQ ID NO: 3758315 - DNA, 13 bp, Homo sapiens
cattcttcctagt

SEQ ID NO: 3758316 - DNA, 18 bp, Homo sapiens
cattcttgtcacaataaa

SEQ ID NO: 3758317 - DNA, 19 bp, Homo sapiens
cattcttgtcacaataaat

SEQ ID NO: 3758318 - DNA, 20 bp, Homo sapiens
cattctttgcttgaacacag

SEQ ID NO: 3758319 - DNA, 16 bp, Homo sapiens
cattgaaagagaacca

SEQ ID NO: 3758320 - DNA, 15 bp, Homo sapiens
cattgaagagagagc

SEQ ID NO: 3758321 - DNA, 18 bp, Homo sapiens
cattgaagtaatgaattt

SEQ ID NO: 3758322 - DNA, 17 bp, Homo sapiens
cattgaccaagaactgc

SEQ ID NO: 3758323 - DNA, 19 bp, Homo sapiens
cattgactatcaaactgaa

SEQ ID NO: 3758324 - DNA, 16 bp, Homo sapiens
cattgattgctgtgtc

SEQ ID NO: 3758325 - DNA, 23 bp, Homo sapiens
cattgattgctgtgtccaactcc

SEQ ID NO: 3758326 - DNA, 18 bp, Homo sapiens
cattgcactccagcctgg

SEQ ID NO: 3758327 - DNA, 18 bp, Homo sapiens
cattgccagtgtctttct

SEQ ID NO: 3758328 - DNA, 13 bp, Homo sapiens
cattgctgctcct

SEQ ID NO: 3758329 - DNA, 17 bp, Homo sapiens
cattgctggtcttgtaa

SEQ ID NO: 3758330 - DNA, 11 bp, Homo sapiens
cattgctttac

SEQ ID NO: 3758331 - DNA, 18 bp, Homo sapiens
cattgggtgggtaaattc

SEQ ID NO: 3758332 - DNA, 18 bp, Homo sapiens
cattggttccctttgctc

SEQ ID NO: 3758333 - DNA, 22 bp, Homo sapiens
cattggttccctttgctccacc

SEQ ID NO: 3758334 - DNA, 15 bp, Homo sapiens
cattgtaaacaaact

SEQ ID NO: 3758335 - DNA, 19 bp, Homo sapiens
cattgtagagcttctggca

SEQ ID NO: 3758336 - DNA, 15 bp, Homo sapiens
cattgtctttatatg

SEQ ID NO: 3758337 - DNA, 17 bp, Homo sapiens
cattgtctttatatgaa

SEQ ID NO: 3758338 - DNA, 18 bp, Homo sapiens
cattgtggttatttttat

SEQ ID NO: 3758339 - DNA, 17 bp, Homo sapiens
cattgttggccaaagcc

SEQ ID NO: 3758340 - DNA, 17 bp, Homo sapiens
cattgtttattaacaaa

SEQ ID NO: 3758341 - DNA, 14 bp, Homo sapiens
cattgtttgcttat

SEQ ID NO: 3758342 - DNA, 20 bp, Homo sapiens
cattgtttgcttattgttcc

SEQ ID NO: 3758343 - DNA, 21 bp, Homo sapiens
cattgtttgcttattgttcca

SEQ ID NO: 3758344 - DNA, 14 bp, Homo sapiens
catttagttctttg

SEQ ID NO: 3758345 - DNA, 14 bp, Homo sapiens
catttataatgttt

SEQ ID NO: 3758346 - DNA, 22 bp, Homo sapiens
catttatctgtacatacttttt

SEQ ID NO: 3758347 - DNA, 14 bp, Homo sapiens
catttattctgctc

SEQ ID NO: 3758348 - DNA, 15 bp, Homo sapiens
catttcaactgtttg

SEQ ID NO: 3758349 - DNA, 21 bp, Homo sapiens
catttcatctaccattttctg

SEQ ID NO: 3758350 - DNA, 14 bp, Homo sapiens
catttcatctattt

SEQ ID NO: 3758351 - DNA, 17 bp, Homo sapiens
catttcatctatttctg

SEQ ID NO: 3758352 - DNA, 20 bp, Homo sapiens
catttcctgacagaaggact

SEQ ID NO: 3758353 - DNA, 12 bp, Homo sapiens
catttcctgtgt

SEQ ID NO: 3758354 - DNA, 13 bp, Homo sapiens
catttcctgtgtc

SEQ ID NO: 3758355 - DNA, 13 bp, Homo sapiens
catttctatttat

SEQ ID NO: 3758356 - DNA, 23 bp, Homo sapiens
catttctatttatttactgagct

SEQ ID NO: 3758357 - DNA, 11 bp, Homo sapiens
catttctctct

SEQ ID NO: 3758358 - DNA, 16 bp, Homo sapiens
catttctgatatagaa

SEQ ID NO: 3758359 - DNA, 21 bp, Homo sapiens
catttctgatatagaattgca

SEQ ID NO: 3758360 - DNA, 18 bp, Homo sapiens
catttcttgggccctcct

SEQ ID NO: 3758361 - DNA, 21 bp, Homo sapiens
catttgaataaagcctgcttt

SEQ ID NO: 3758362 - DNA, 16 bp, Homo sapiens
catttgagcagggctc

SEQ ID NO: 3758363 - DNA, 20 bp, Homo sapiens
catttgcgcacaacttaaaa

SEQ ID NO: 3758364 - DNA, 23 bp, Homo sapiens
catttgcgcacaacttaaaaagt

SEQ ID NO: 3758365 - DNA, 20 bp, Homo sapiens
catttgctaactagcttgga

SEQ ID NO: 3758366 - DNA, 22 bp, Homo sapiens
catttggggtagctagaggaac

SEQ ID NO: 3758367 - DNA, 17 bp, Homo sapiens
catttgggtggtaagag

SEQ ID NO: 3758368 - DNA, 14 bp, Homo sapiens
catttgtcacagaa

SEQ ID NO: 3758369 - DNA, 22 bp, Homo sapiens
catttgtgtgtgtgcaagtgtg

SEQ ID NO: 3758370 - DNA, 16 bp, Homo sapiens
catttgttggaatgaa

SEQ ID NO: 3758371 - DNA, 11 bp, Homo sapiens
cattttaacat

SEQ ID NO: 3758372 - DNA, 22 bp, Homo sapiens
cattttactgtacagattgctg

SEQ ID NO: 3758373 - DNA, 15 bp, Homo sapiens
cattttagacagtaa

SEQ ID NO: 3758374 - DNA, 17 bp, Homo sapiens
cattttagacagtaagt

SEQ ID NO: 3758375 - DNA, 19 bp, Homo sapiens
cattttagacagtaagtat

SEQ ID NO: 3758376 - DNA, 16 bp, Homo sapiens
cattttcaccccaccc

SEQ ID NO: 3758377 - DNA, 19 bp, Homo sapiens
cattttcagactgctttaa

SEQ ID NO: 3758378 - DNA, 17 bp, Homo sapiens
cattttccccccactct

SEQ ID NO: 3758379 - DNA, 20 bp, Homo sapiens
cattttccccccactctccc

SEQ ID NO: 3758380 - DNA, 15 bp, Homo sapiens
cattttctgaaacta

SEQ ID NO: 3758381 - DNA, 20 bp, Homo sapiens
cattttctgaaactaatgaa

SEQ ID NO: 3758382 - DNA, 10 bp, Homo sapiens
cattttctgg

SEQ ID NO: 3758383 - DNA, 12 bp, Homo sapiens
cattttgcaaaa

SEQ ID NO: 3758384 - DNA, 18 bp, Homo sapiens
cattttgcagcagtgagt

SEQ ID NO: 3758385 - DNA, 18 bp, Homo sapiens
cattttgctaaatgtgaa

SEQ ID NO: 3758386 - DNA, 15 bp, Homo sapiens
cattttgcttcatag

SEQ ID NO: 3758387 - DNA, 20 bp, Homo sapiens
catttttagtagagacaggg

SEQ ID NO: 3758388 - DNA, 22 bp, Homo sapiens
catttttattacccttctttcc

SEQ ID NO: 3758389 - DNA, 13 bp, Homo sapiens
catttttcctaac

SEQ ID NO: 3758390 - DNA, 18 bp, Homo sapiens
catttttcctaacaggat

SEQ ID NO: 3758391 - DNA, 20 bp, Homo sapiens
catttttgaatacaggcata

SEQ ID NO: 3758392 - DNA, 17 bp, Homo sapiens
catttttgatttcaggt

SEQ ID NO: 3758393 - DNA, 14 bp, Homo sapiens
cattttttaaaaca

SEQ ID NO: 3758394 - DNA, 17 bp, Homo sapiens
catttttttttttaatt

SEQ ID NO: 3758395 - DNA, 20 bp, Homo sapiens
ccaaaaaattctacaacaca

SEQ ID NO: 3758396 - DNA, 21 bp, Homo sapiens
ccaaaacatcgtctaaacttt

SEQ ID NO: 3758397 - DNA, 15 bp, Homo sapiens
ccaaaaccacagccc

SEQ ID NO: 3758398 - DNA, 21 bp, Homo sapiens
ccaaaagtcaaaaggtgcctg

SEQ ID NO: 3758399 - DNA, 16 bp, Homo sapiens
ccaaaattatttcaga

SEQ ID NO: 3758400 - DNA, 16 bp, Homo sapiens
ccaaacaaatatgcaa

SEQ ID NO: 3758401 - DNA, 20 bp, Homo sapiens
ccaaacatcagacctgtctt

SEQ ID NO: 3758402 - DNA, 21 bp, Homo sapiens
ccaaacatcagacctgtcttc

SEQ ID NO: 3758403 - DNA, 13 bp, Homo sapiens
ccaaacctggaga

SEQ ID NO: 3758404 - DNA, 14 bp, Homo sapiens
ccaaacctggagat

SEQ ID NO: 3758405 - DNA, 13 bp, Homo sapiens
ccaaactctgcca

SEQ ID NO: 3758406 - DNA, 14 bp, Homo sapiens
ccaaactgcctaag

SEQ ID NO: 3758407 - DNA, 19 bp, Homo sapiens
ccaaagccaaagctaggcc

SEQ ID NO: 3758408 - DNA, 23 bp, Homo sapiens
ccaaagccccttgctctcccctg

SEQ ID NO: 3758409 - DNA, 17 bp, Homo sapiens
ccaaagcctcctccagc

SEQ ID NO: 3758410 - DNA, 16 bp, Homo sapiens
ccaaagctaggcctgg

SEQ ID NO: 3758411 - DNA, 13 bp, Homo sapiens
ccaaaggtctaga

SEQ ID NO: 3758412 - DNA, 14 bp, Homo sapiens
ccaaagtgctggga

SEQ ID NO: 3758413 - DNA, 23 bp, Homo sapiens
ccaaatctgcctattgcagctgg

SEQ ID NO: 3758414 - DNA, 21 bp, Homo sapiens
ccaaattttggccaaagtgtt

SEQ ID NO: 3758415 - DNA, 14 bp, Homo sapiens
ccaacaagggcagt

SEQ ID NO: 3758416 - DNA, 15 bp, Homo sapiens
ccaacaagggcagtg

SEQ ID NO: 3758417 - DNA, 23 bp, Homo sapiens
ccaacaagggcagtggaggtgct

SEQ ID NO: 3758418 - DNA, 23 bp, Homo sapiens
ccaacaggagctgggatcctaag

SEQ ID NO: 3758419 - DNA, 19 bp, Homo sapiens
ccaacagtcaaaacagaga

SEQ ID NO: 3758420 - DNA, 13 bp, Homo sapiens
ccaacatcaacat

SEQ ID NO: 3758421 - DNA, 20 bp, Homo sapiens
ccaacatcccattgccctgg

SEQ ID NO: 3758422 - DNA, 15 bp, Homo sapiens
ccaacatggagaaac

SEQ ID NO: 3758423 - DNA, 23 bp, Homo sapiens
ccaacatggagaaaccctgtctc

SEQ ID NO: 3758424 - DNA, 20 bp, Homo sapiens
ccaaccaagtggctcccaca

SEQ ID NO: 3758425 - DNA, 12 bp, Homo sapiens
ccaacccatcag

SEQ ID NO: 3758426 - DNA, 14 bp, Homo sapiens
ccaacccatcagaa

SEQ ID NO: 3758427 - DNA, 17 bp, Homo sapiens
ccaacccccaccccaca

SEQ ID NO: 3758428 - DNA, 18 bp, Homo sapiens
ccaacccccaccccacac

SEQ ID NO: 3758429 - DNA, 15 bp, Homo sapiens
ccaacccgaggcccg

SEQ ID NO: 3758430 - DNA, 15 bp, Homo sapiens
ccaaccctcagagcc

SEQ ID NO: 3758431 - DNA, 15 bp, Homo sapiens
ccaaccctgcccctg

SEQ ID NO: 3758432 - DNA, 18 bp, Homo sapiens
ccaacctaacccctttcc

SEQ ID NO: 3758433 - DNA, 14 bp, Homo sapiens
ccaacctcctgacc

SEQ ID NO: 3758434 - DNA, 12 bp, Homo sapiens
ccaacctgacca

SEQ ID NO: 3758435 - DNA, 22 bp, Homo sapiens
ccaacggagagcgcctgcccct

SEQ ID NO: 3758436 - DNA, 16 bp, Homo sapiens
ccaacgtggggcagca

SEQ ID NO: 3758437 - DNA, 19 bp, Homo sapiens
ccaactaacaagaaactca

SEQ ID NO: 3758438 - DNA, 18 bp, Homo sapiens
ccaactggccctcttctt

SEQ ID NO: 3758439 - DNA, 16 bp, Homo sapiens
ccaactgggcccaaga

SEQ ID NO: 3758440 - DNA, 17 bp, Homo sapiens
ccaactgggcccaagac

SEQ ID NO: 3758441 - DNA, 18 bp, Homo sapiens
ccaagaacagcaggccca

SEQ ID NO: 3758442 - DNA, 13 bp, Homo sapiens
ccaagaactgaaa

SEQ ID NO: 3758443 - DNA, 13 bp, Homo sapiens
ccaagaaggctgg

SEQ ID NO: 3758444 - DNA, 19 bp, Homo sapiens
ccaagaatagatgctgact

SEQ ID NO: 3758445 - DNA, 22 bp, Homo sapiens
ccaagacagatgccccagagct

SEQ ID NO: 3758446 - DNA, 23 bp, Homo sapiens
ccaagacagatgccccagagctg

SEQ ID NO: 3758447 - DNA, 11 bp, Homo sapiens
ccaagacattg

SEQ ID NO: 3758448 - DNA, 17 bp, Homo sapiens
ccaagacattgtcaata

SEQ ID NO: 3758449 - DNA, 19 bp, Homo sapiens
ccaagacttggtgtccttt

SEQ ID NO: 3758450 - DNA, 20 bp, Homo sapiens
ccaagagaaggggaagcact

SEQ ID NO: 3758451 - DNA, 19 bp, Homo sapiens
ccaagagcagaggcagcga

SEQ ID NO: 3758452 - DNA, 21 bp, Homo sapiens
ccaagaggctgttcccaccag

SEQ ID NO: 3758453 - DNA, 18 bp, Homo sapiens
ccaagcagccaagctcct

SEQ ID NO: 3758454 - DNA, 22 bp, Homo sapiens
ccaagccagggatggggccaca

SEQ ID NO: 3758455 - DNA, 14 bp, Homo sapiens
ccaagccgtggctt

SEQ ID NO: 3758456 - DNA, 21 bp, Homo sapiens
ccaagccgtggcttcccgctc

SEQ ID NO: 3758457 - DNA, 23 bp, Homo sapiens
ccaagccgtggcttcccgctcag

SEQ ID NO: 3758458 - DNA, 13 bp, Homo sapiens
ccaagcctgacca

SEQ ID NO: 3758459 - DNA, 21 bp, Homo sapiens
ccaagcgaggtcaacagagaa

SEQ ID NO: 3758460 - DNA, 15 bp, Homo sapiens
ccaagctccttggga

SEQ ID NO: 3758461 - DNA, 22 bp, Homo sapiens
ccaagctccttgggaggcccca

SEQ ID NO: 3758462 - DNA, 13 bp, Homo sapiens
ccaagctctgctc

SEQ ID NO: 3758463 - DNA, 17 bp, Homo sapiens
ccaagctctgctcctct

SEQ ID NO: 3758464 - DNA, 14 bp, Homo sapiens
ccaagctgttttct

SEQ ID NO: 3758465 - DNA, 17 bp, Homo sapiens
ccaagcttcctttgttt

SEQ ID NO: 3758466 - DNA, 15 bp, Homo sapiens
ccaaggacccctcac

SEQ ID NO: 3758467 - DNA, 18 bp, Homo sapiens
ccaaggagaaacagagac

SEQ ID NO: 3758468 - DNA, 19 bp, Homo sapiens
ccaaggagaaacagagaca

SEQ ID NO: 3758469 - DNA, 21 bp, Homo sapiens
ccaaggagaccaagtcctggc

SEQ ID NO: 3758470 - DNA, 17 bp, Homo sapiens
ccaaggagctgagaata

SEQ ID NO: 3758471 - DNA, 21 bp, Homo sapiens
ccaaggcaaggggtgcctggg

SEQ ID NO: 3758472 - DNA, 19 bp, Homo sapiens
ccaaggccagagtggcctg

SEQ ID NO: 3758473 - DNA, 20 bp, Homo sapiens
ccaaggggcagtctggaggg

SEQ ID NO: 3758474 - DNA, 23 bp, Homo sapiens
ccaagggtatccaagttggactg

SEQ ID NO: 3758475 - DNA, 23 bp, Homo sapiens
ccaagggttcagagactcagggc

SEQ ID NO: 3758476 - DNA, 18 bp, Homo sapiens
ccaaggtgggaggattgc

SEQ ID NO: 3758477 - DNA, 20 bp, Homo sapiens
ccaaggtgggtagatcacga

SEQ ID NO: 3758478 - DNA, 20 bp, Homo sapiens
ccaagtcagctttgccttcc

SEQ ID NO: 3758479 - DNA, 23 bp, Homo sapiens
ccaagtcccaccggttgcttctg

SEQ ID NO: 3758480 - DNA, 22 bp, Homo sapiens
ccaagtcctggctacatcccag

SEQ ID NO: 3758481 - DNA, 16 bp, Homo sapiens
ccaagtgcaggctggc

SEQ ID NO: 3758482 - DNA, 20 bp, Homo sapiens
ccaagtggaccttgagacca

SEQ ID NO: 3758483 - DNA, 13 bp, Homo sapiens
ccaagtggctccc

SEQ ID NO: 3758484 - DNA, 18 bp, Homo sapiens
ccaagtgggggcagaggg

SEQ ID NO: 3758485 - DNA, 18 bp, Homo sapiens
ccaagtggtcaggagttg

SEQ ID NO: 3758486 - DNA, 13 bp, Homo sapiens
ccaagtgtgtgtg

SEQ ID NO: 3758487 - DNA, 15 bp, Homo sapiens
ccaagttataaatca

SEQ ID NO: 3758488 - DNA, 21 bp, Homo sapiens
ccaatagcactttcattgcca

SEQ ID NO: 3758489 - DNA, 16 bp, Homo sapiens
ccaataggaatgctaa

SEQ ID NO: 3758490 - DNA, 22 bp, Homo sapiens
ccaatagttgttgattggcagg

SEQ ID NO: 3758491 - DNA, 19 bp, Homo sapiens
ccaatatcctcgctcccgg

SEQ ID NO: 3758492 - DNA, 18 bp, Homo sapiens
ccaatatttctcagacat

SEQ ID NO: 3758493 - DNA, 14 bp, Homo sapiens
ccaatatttgtaga

SEQ ID NO: 3758494 - DNA, 22 bp, Homo sapiens
ccaatcattttaattattattc

SEQ ID NO: 3758495 - DNA, 18 bp, Homo sapiens
ccaatcctcactgggtgg

SEQ ID NO: 3758496 - DNA, 15 bp, Homo sapiens
ccaatgatggtcacc

SEQ ID NO: 3758497 - DNA, 23 bp, Homo sapiens
ccaatggagtagacccctggctg

SEQ ID NO: 3758498 - DNA, 19 bp, Homo sapiens
ccaattaagtcctacttta

SEQ ID NO: 3758499 - DNA, 23 bp, Homo sapiens
ccaattaggaagtgtaacagctg

SEQ ID NO: 3758500 - DNA, 21 bp, Homo sapiens
ccaattcaaccctttgcccca

SEQ ID NO: 3758501 - DNA, 11 bp, Homo sapiens
ccaattcttac

SEQ ID NO: 3758502 - DNA, 18 bp, Homo sapiens
ccaattcttacaaacatg

SEQ ID NO: 3758503 - DNA, 17 bp, Homo sapiens
ccacaaataaatgacaa

SEQ ID NO: 3758504 - DNA, 15 bp, Homo sapiens
ccacaagattcccag

SEQ ID NO: 3758505 - DNA, 18 bp, Homo sapiens
ccacaagattcccagaga

SEQ ID NO: 3758506 - DNA, 19 bp, Homo sapiens
ccacaagattcccagagac

SEQ ID NO: 3758507 - DNA, 24 bp, Homo sapiens
ccacaagattcccagagacaggaa

SEQ ID NO: 3758508 - DNA, 13 bp, Homo sapiens
ccacacagagtgg

SEQ ID NO: 3758509 - DNA, 12 bp, Homo sapiens
ccacacccagcc

SEQ ID NO: 3758510 - DNA, 13 bp, Homo sapiens
ccacacccagccc

SEQ ID NO: 3758511 - DNA, 18 bp, Homo sapiens
ccacacctcagttccctt

SEQ ID NO: 3758512 - DNA, 13 bp, Homo sapiens
ccacacctggccc

SEQ ID NO: 3758513 - DNA, 20 bp, Homo sapiens
ccacacttcaggctcttctc

SEQ ID NO: 3758514 - DNA, 21 bp, Homo sapiens
ccacacttcaggctcttctcc

SEQ ID NO: 3758515 - DNA, 21 bp, Homo sapiens
ccacacttcctgtccagagag

SEQ ID NO: 3758516 - DNA, 21 bp, Homo sapiens
ccacagaagacttcccagctt

SEQ ID NO: 3758517 - DNA, 16 bp, Homo sapiens
ccacagaagtgctttc

SEQ ID NO: 3758518 - DNA, 22 bp, Homo sapiens
ccacagagaaagtacttctcca

SEQ ID NO: 3758519 - DNA, 17 bp, Homo sapiens
ccacagcagcctctgaa

SEQ ID NO: 3758520 - DNA, 20 bp, Homo sapiens
ccacagcagcctctgaagtt

SEQ ID NO: 3758521 - DNA, 13 bp, Homo sapiens
ccacagcccaggc

SEQ ID NO: 3758522 - DNA, 19 bp, Homo sapiens
ccacagcccgcatgcagca

SEQ ID NO: 3758523 - DNA, 14 bp, Homo sapiens
ccacagccctgtca

SEQ ID NO: 3758524 - DNA, 15 bp, Homo sapiens
ccacagccctgtcag

SEQ ID NO: 3758525 - DNA, 20 bp, Homo sapiens
ccacagccctgtcagtgcag

SEQ ID NO: 3758526 - DNA, 23 bp, Homo sapiens
ccacagccctgtcagtgcagccc

SEQ ID NO: 3758527 - DNA, 12 bp, Homo sapiens
ccacagccgcag

SEQ ID NO: 3758528 - DNA, 15 bp, Homo sapiens
ccacagccgcagcct

SEQ ID NO: 3758529 - DNA, 23 bp, Homo sapiens
ccacaggcccttcctctccactg

SEQ ID NO: 3758530 - DNA, 17 bp, Homo sapiens
ccacagggctaagagct

SEQ ID NO: 3758531 - DNA, 20 bp, Homo sapiens
ccacatagactttatgcaat

SEQ ID NO: 3758532 - DNA, 21 bp, Homo sapiens
ccacatagtgatggttcccct

SEQ ID NO: 3758533 - DNA, 22 bp, Homo sapiens
ccacatcccactcacaacagct

SEQ ID NO: 3758534 - DNA, 14 bp, Homo sapiens
ccacatcttgctct

SEQ ID NO: 3758535 - DNA, 17 bp, Homo sapiens
ccacatgtgtccatccc

SEQ ID NO: 3758536 - DNA, 16 bp, Homo sapiens
ccacatttgtcacaga

SEQ ID NO: 3758537 - DNA, 15 bp, Homo sapiens
ccaccaacatcccat

SEQ ID NO: 3758538 - DNA, 15 bp, Homo sapiens
ccaccaaccctcaga

SEQ ID NO: 3758539 - DNA, 16 bp, Homo sapiens
ccaccaactggccctc

SEQ ID NO: 3758540 - DNA, 14 bp, Homo sapiens
ccaccacacccagc

SEQ ID NO: 3758541 - DNA, 23 bp, Homo sapiens
ccaccagactgacaaatgtgtat

SEQ ID NO: 3758542 - DNA, 19 bp, Homo sapiens
ccaccaggagaaccactac

SEQ ID NO: 3758543 - DNA, 22 bp, Homo sapiens
ccaccaggctgctcagggctgg

SEQ ID NO: 3758544 - DNA, 18 bp, Homo sapiens
ccaccatcatgtctggct

SEQ ID NO: 3758545 - DNA, 17 bp, Homo sapiens
ccaccatggccagccaa

SEQ ID NO: 3758546 - DNA, 22 bp, Homo sapiens
ccaccatggctaaggcaccagc

SEQ ID NO: 3758547 - DNA, 15 bp, Homo sapiens
ccacccaccagggcg

SEQ ID NO: 3758548 - DNA, 11 bp, Homo sapiens
ccacccagccc

SEQ ID NO: 3758549 - DNA, 12 bp, Homo sapiens
ccacccaggagg

SEQ ID NO: 3758550 - DNA, 18 bp, Homo sapiens
ccacccaggagggagggg

SEQ ID NO: 3758551 - DNA, 23 bp, Homo sapiens
ccacccaggagggagggggctat

SEQ ID NO: 3758552 - DNA, 14 bp, Homo sapiens
ccaccccaccccct

SEQ ID NO: 3758553 - DNA, 18 bp, Homo sapiens
ccaccccagctgctcccc

SEQ ID NO: 3758554 - DNA, 23 bp, Homo sapiens
ccaccccatgtcaccggatcctg

SEQ ID NO: 3758555 - DNA, 22 bp, Homo sapiens
ccaccccccagaacctgtcctt

SEQ ID NO: 3758556 - DNA, 13 bp, Homo sapiens
ccacccccctcat

SEQ ID NO: 3758557 - DNA, 18 bp, Homo sapiens
ccaccccctccccagggg

SEQ ID NO: 3758558 - DNA, 22 bp, Homo sapiens
ccacccccttcagtgcccacca

SEQ ID NO: 3758559 - DNA, 13 bp, Homo sapiens
ccacccccttctc

SEQ ID NO: 3758560 - DNA, 18 bp, Homo sapiens
ccacccccttctctgctc

SEQ ID NO: 3758561 - DNA, 20 bp, Homo sapiens
ccacccccttctctgctcca

SEQ ID NO: 3758562 - DNA, 20 bp, Homo sapiens
ccaccccgggctctctgctg

SEQ ID NO: 3758563 - DNA, 19 bp, Homo sapiens
ccacccctcaacacctctg

SEQ ID NO: 3758564 - DNA, 16 bp, Homo sapiens
ccaccccttccccact

SEQ ID NO: 3758565 - DNA, 11 bp, Homo sapiens
ccaccctgctc

SEQ ID NO: 3758566 - DNA, 11 bp, Homo sapiens
ccaccctggaa

SEQ ID NO: 3758567 - DNA, 14 bp, Homo sapiens
ccacccttcccctc

SEQ ID NO: 3758568 - DNA, 20 bp, Homo sapiens
ccacccttggaggctgtctt

SEQ ID NO: 3758569 - DNA, 13 bp, Homo sapiens
ccacccttggcct

SEQ ID NO: 3758570 - DNA, 14 bp, Homo sapiens
ccacccttggcctg

SEQ ID NO: 3758571 - DNA, 16 bp, Homo sapiens
ccacccttggcctgtc

SEQ ID NO: 3758572 - DNA, 16 bp, Homo sapiens
ccaccgctgccagcac

SEQ ID NO: 3758573 - DNA, 20 bp, Homo sapiens
ccaccgctgccagcacagag

SEQ ID NO: 3758574 - DNA, 21 bp, Homo sapiens
ccaccgctgcctaagtggctg

SEQ ID NO: 3758575 - DNA, 22 bp, Homo sapiens
ccaccgggctgggagctctgca

SEQ ID NO: 3758576 - DNA, 18 bp, Homo sapiens
ccaccggttgcttctggg

SEQ ID NO: 3758577 - DNA, 21 bp, Homo sapiens
ccaccggttgcttctgggaag

SEQ ID NO: 3758578 - DNA, 20 bp, Homo sapiens
ccacctaccttcaaagctga

SEQ ID NO: 3758579 - DNA, 20 bp, Homo sapiens
ccacctaggccactcctcca

SEQ ID NO: 3758580 - DNA, 14 bp, Homo sapiens
ccacctcaaattta

SEQ ID NO: 3758581 - DNA, 14 bp, Homo sapiens
ccacctcagcctcc

SEQ ID NO: 3758582 - DNA, 15 bp, Homo sapiens
ccacctcagcctccc

SEQ ID NO: 3758583 - DNA, 16 bp, Homo sapiens
ccacctcagccttgga

SEQ ID NO: 3758584 - DNA, 22 bp, Homo sapiens
ccacctcccctatccacccagc

SEQ ID NO: 3758585 - DNA, 14 bp, Homo sapiens
ccacctgccactag

SEQ ID NO: 3758586 - DNA, 20 bp, Homo sapiens
ccacctgccactaggctggg

SEQ ID NO: 3758587 - DNA, 14 bp, Homo sapiens
ccacctgcccatca

SEQ ID NO: 3758588 - DNA, 16 bp, Homo sapiens
ccacctgcccatcaca

SEQ ID NO: 3758589 - DNA, 21 bp, Homo sapiens
ccacctgcccccttctcccac

SEQ ID NO: 3758590 - DNA, 22 bp, Homo sapiens
ccacctgctgagagacccaagg

SEQ ID NO: 3758591 - DNA, 20 bp, Homo sapiens
ccacctggaagccctctctg

SEQ ID NO: 3758592 - DNA, 21 bp, Homo sapiens
ccacctggccccatgtctctc

SEQ ID NO: 3758593 - DNA, 14 bp, Homo sapiens
ccacctggggcagt

SEQ ID NO: 3758594 - DNA, 20 bp, Homo sapiens
ccacctggggcagtcacctg

SEQ ID NO: 3758595 - DNA, 17 bp, Homo sapiens
ccacctggtggcctctg

SEQ ID NO: 3758596 - DNA, 20 bp, Homo sapiens
ccacctgtcaaacaaagcca

SEQ ID NO: 3758597 - DNA, 14 bp, Homo sapiens
ccacctgtcccacc

SEQ ID NO: 3758598 - DNA, 17 bp, Homo sapiens
ccacctgtcccacctca

SEQ ID NO: 3758599 - DNA, 16 bp, Homo sapiens
ccacctgtctcagcct

SEQ ID NO: 3758600 - DNA, 18 bp, Homo sapiens
ccacctgtctcagcctcc

SEQ ID NO: 3758601 - DNA, 16 bp, Homo sapiens
ccaccttaaattaaac

SEQ ID NO: 3758602 - DNA, 20 bp, Homo sapiens
ccaccttaaattaaacaatt

SEQ ID NO: 3758603 - DNA, 20 bp, Homo sapiens
ccaccttcaattcctgggcc

SEQ ID NO: 3758604 - DNA, 12 bp, Homo sapiens
ccaccttcccag

SEQ ID NO: 3758605 - DNA, 13 bp, Homo sapiens
ccaccttcccagc

SEQ ID NO: 3758606 - DNA, 16 bp, Homo sapiens
ccaccttcccagctct

SEQ ID NO: 3758607 - DNA, 19 bp, Homo sapiens
ccaccttcccagctctccc

SEQ ID NO: 3758608 - DNA, 14 bp, Homo sapiens
ccaccttcccatgc

SEQ ID NO: 3758609 - DNA, 16 bp, Homo sapiens
ccaccttggctgcagg

SEQ ID NO: 3758610 - DNA, 18 bp, Homo sapiens
ccaccttggctgcaggga

SEQ ID NO: 3758611 - DNA, 13 bp, Homo sapiens
ccacgctggagtg

SEQ ID NO: 3758612 - DNA, 18 bp, Homo sapiens
ccacgctggagtgcagtg

SEQ ID NO: 3758613 - DNA, 19 bp, Homo sapiens
ccacgctgtctccagaccc

SEQ ID NO: 3758614 - DNA, 20 bp, Homo sapiens
ccacgctgtctccagacccc

SEQ ID NO: 3758615 - DNA, 20 bp, Homo sapiens
ccacggaaaatgccaatctc

SEQ ID NO: 3758616 - DNA, 12 bp, Homo sapiens
ccacggccaggc

SEQ ID NO: 3758617 - DNA, 18 bp, Homo sapiens
ccacggccaggccagagg

SEQ ID NO: 3758618 - DNA, 23 bp, Homo sapiens
ccacggccaggccagagggagtg

SEQ ID NO: 3758619 - DNA, 13 bp, Homo sapiens
ccacgtactgcag

SEQ ID NO: 3758620 - DNA, 17 bp, Homo sapiens
ccacgtctgtcttcaca

SEQ ID NO: 3758621 - DNA, 15 bp, Homo sapiens
ccacgttcacccctc

SEQ ID NO: 3758622 - DNA, 21 bp, Homo sapiens
ccactacactccagcctgagc

SEQ ID NO: 3758623 - DNA, 23 bp, Homo sapiens
ccactacggaatagttggctagg

SEQ ID NO: 3758624 - DNA, 19 bp, Homo sapiens
ccactaggactctgaggct

SEQ ID NO: 3758625 - DNA, 15 bp, Homo sapiens
ccactaggctgggtg

SEQ ID NO: 3758626 - DNA, 17 bp, Homo sapiens
ccactcaagccaagcag

SEQ ID NO: 3758627 - DNA, 18 bp, Homo sapiens
ccactcaagccaagcagc

SEQ ID NO: 3758628 - DNA, 14 bp, Homo sapiens
ccactcacaacagc

SEQ ID NO: 3758629 - DNA, 20 bp, Homo sapiens
ccactcaggaggctgaggca

SEQ ID NO: 3758630 - DNA, 18 bp, Homo sapiens
ccactcagtccatagcag

SEQ ID NO: 3758631 - DNA, 16 bp, Homo sapiens
ccactccccaccttca

SEQ ID NO: 3758632 - DNA, 14 bp, Homo sapiens
ccactcctgtacac

SEQ ID NO: 3758633 - DNA, 18 bp, Homo sapiens
ccactctaccctcccacc

SEQ ID NO: 3758634 - DNA, 19 bp, Homo sapiens
ccactctaccctcccaccc

SEQ ID NO: 3758635 - DNA, 17 bp, Homo sapiens
ccactctcattccccag

SEQ ID NO: 3758636 - DNA, 15 bp, Homo sapiens
ccactctccccacac

SEQ ID NO: 3758637 - DNA, 16 bp, Homo sapiens
ccactctccccacact

SEQ ID NO: 3758638 - DNA, 14 bp, Homo sapiens
ccactctgcctctg

SEQ ID NO: 3758639 - DNA, 16 bp, Homo sapiens
ccactctgcctctgcc

SEQ ID NO: 3758640 - DNA, 21 bp, Homo sapiens
ccactctgctttgactgagca

SEQ ID NO: 3758641 - DNA, 19 bp, Homo sapiens
ccactgaagatagaagaaa

SEQ ID NO: 3758642 - DNA, 16 bp, Homo sapiens
ccactgaagctgggat

SEQ ID NO: 3758643 - DNA, 17 bp, Homo sapiens
ccactgcaccgggccac

SEQ ID NO: 3758644 - DNA, 19 bp, Homo sapiens
ccactgcactatagcctag

SEQ ID NO: 3758645 - DNA, 18 bp, Homo sapiens
ccactgcactccagcctg

SEQ ID NO: 3758646 - DNA, 21 bp, Homo sapiens
ccactgcatcgtttcatcttc

SEQ ID NO: 3758647 - DNA, 15 bp, Homo sapiens
ccactgcccgagctg

SEQ ID NO: 3758648 - DNA, 18 bp, Homo sapiens
ccactgcccgagctggtg

SEQ ID NO: 3758649 - DNA, 23 bp, Homo sapiens
ccactgcccgagctggtgcatta

SEQ ID NO: 3758650 - DNA, 13 bp, Homo sapiens
ccactgccctctg

SEQ ID NO: 3758651 - DNA, 16 bp, Homo sapiens
ccactgcccttctcat

SEQ ID NO: 3758652 - DNA, 16 bp, Homo sapiens
ccactgcctcttcctc

SEQ ID NO: 3758653 - DNA, 13 bp, Homo sapiens
ccactgcctgccc

SEQ ID NO: 3758654 - DNA, 14 bp, Homo sapiens
ccactgcctgccca

SEQ ID NO: 3758655 - DNA, 23 bp, Homo sapiens
ccactgcctgcccacccgtggag

SEQ ID NO: 3758656 - DNA, 11 bp, Homo sapiens
ccactgctctg

SEQ ID NO: 3758657 - DNA, 13 bp, Homo sapiens
ccactgctctggt

SEQ ID NO: 3758658 - DNA, 15 bp, Homo sapiens
ccactgctctggtta

SEQ ID NO: 3758659 - DNA, 22 bp, Homo sapiens
ccactgcttttggtctgtgtga

SEQ ID NO: 3758660 - DNA, 20 bp, Homo sapiens
ccactggacttgagcttggc

SEQ ID NO: 3758661 - DNA, 11 bp, Homo sapiens
ccactggctgt

SEQ ID NO: 3758662 - DNA, 14 bp, Homo sapiens
ccactggctgtggg

SEQ ID NO: 3758663 - DNA, 14 bp, Homo sapiens
ccactgtttattca

SEQ ID NO: 3758664 - DNA, 22 bp, Homo sapiens
ccacttaccttcaataaagtat

SEQ ID NO: 3758665 - DNA, 22 bp, Homo sapiens
ccacttattccccattcttcct

SEQ ID NO: 3758666 - DNA, 21 bp, Homo sapiens
ccacttcattcttgaaagctg

SEQ ID NO: 3758667 - DNA, 20 bp, Homo sapiens
ccacttcttgttccccactg

SEQ ID NO: 3758668 - DNA, 16 bp, Homo sapiens
ccacttcttttataac

SEQ ID NO: 3758669 - DNA, 15 bp, Homo sapiens
ccagaaaaccccagc

SEQ ID NO: 3758670 - DNA, 20 bp, Homo sapiens
ccagaaacacctagatcaga

SEQ ID NO: 3758671 - DNA, 14 bp, Homo sapiens
ccagaaaggagact

SEQ ID NO: 3758672 - DNA, 16 bp, Homo sapiens
ccagaaaggagactag

SEQ ID NO: 3758673 - DNA, 16 bp, Homo sapiens
ccagaaatcattttac

SEQ ID NO: 3758674 - DNA, 14 bp, Homo sapiens
ccagaacctgtcct

SEQ ID NO: 3758675 - DNA, 15 bp, Homo sapiens
ccagaagcctctggc

SEQ ID NO: 3758676 - DNA, 16 bp, Homo sapiens
ccagaagcctctggct

SEQ ID NO: 3758677 - DNA, 12 bp, Homo sapiens
ccagaaggcagg

SEQ ID NO: 3758678 - DNA, 23 bp, Homo sapiens
ccagaagtttgagatcagcctgg

SEQ ID NO: 3758679 - DNA, 23 bp, Homo sapiens
ccagaatggtctttctaatgtgt

SEQ ID NO: 3758680 - DNA, 19 bp, Homo sapiens
ccagacaccttgacagggc

SEQ ID NO: 3758681 - DNA, 13 bp, Homo sapiens
ccagacagctccc

SEQ ID NO: 3758682 - DNA, 23 bp, Homo sapiens
ccagacatgtggtgggacaggga

SEQ ID NO: 3758683 - DNA, 14 bp, Homo sapiens
ccagaccagagctc

SEQ ID NO: 3758684 - DNA, 14 bp, Homo sapiens
ccagacccccaccc

SEQ ID NO: 3758685 - DNA, 24 bp, Homo sapiens
ccagacccctctggccaggatgga

SEQ ID NO: 3758686 - DNA, 14 bp, Homo sapiens
ccagacccctggct

SEQ ID NO: 3758687 - DNA, 15 bp, Homo sapiens
ccagacccctggctt

SEQ ID NO: 3758688 - DNA, 15 bp, Homo sapiens
ccagacggcacccac

SEQ ID NO: 3758689 - DNA, 17 bp, Homo sapiens
ccagacggttcaccagc

SEQ ID NO: 3758690 - DNA, 19 bp, Homo sapiens
ccagacggttcaccagcct

SEQ ID NO: 3758691 - DNA, 23 bp, Homo sapiens
ccagagaagcatcggagggaatt

SEQ ID NO: 3758692 - DNA, 14 bp, Homo sapiens
ccagagacaagact

SEQ ID NO: 3758693 - DNA, 13 bp, Homo sapiens
ccagagacaggaa

SEQ ID NO: 3758694 - DNA, 14 bp, Homo sapiens
ccagagacaggaaa

SEQ ID NO: 3758695 - DNA, 15 bp, Homo sapiens
ccagagacaggaaaa

SEQ ID NO: 3758696 - DNA, 18 bp, Homo sapiens
ccagagagagaagtgccc

SEQ ID NO: 3758697 - DNA, 21 bp, Homo sapiens
ccagagagcctggtgctgctg

SEQ ID NO: 3758698 - DNA, 23 bp, Homo sapiens
ccagagatgcctccaccgctgcc

SEQ ID NO: 3758699 - DNA, 16 bp, Homo sapiens
ccagagatgggactgg

SEQ ID NO: 3758700 - DNA, 16 bp, Homo sapiens
ccagagcactgtatac

SEQ ID NO: 3758701 - DNA, 14 bp, Homo sapiens
ccagagccccacac

SEQ ID NO: 3758702 - DNA, 22 bp, Homo sapiens
ccagagctctggagccacctgt

SEQ ID NO: 3758703 - DNA, 22 bp, Homo sapiens
ccagagctgtttatggcctcag

SEQ ID NO: 3758704 - DNA, 23 bp, Homo sapiens
ccagagctgtttatggcctcagc

SEQ ID NO: 3758705 - DNA, 15 bp, Homo sapiens
ccagaggcacagccg

SEQ ID NO: 3758706 - DNA, 16 bp, Homo sapiens
ccagagggagtgacag

SEQ ID NO: 3758707 - DNA, 19 bp, Homo sapiens
ccagagggagtgacagagg

SEQ ID NO: 3758708 - DNA, 22 bp, Homo sapiens
ccagagggagtgacagaggcag

SEQ ID NO: 3758709 - DNA, 23 bp, Homo sapiens
ccagagggagtgacagaggcagc

SEQ ID NO: 3758710 - DNA, 13 bp, Homo sapiens
ccagagggcccag

SEQ ID NO: 3758711 - DNA, 17 bp, Homo sapiens
ccagagtggcctggcca

SEQ ID NO: 3758712 - DNA, 21 bp, Homo sapiens
ccagagtggcctggccaggag

SEQ ID NO: 3758713 - DNA, 21 bp, Homo sapiens
ccagagtgtgggaagggagag

SEQ ID NO: 3758714 - DNA, 13 bp, Homo sapiens
ccagatctggtcc

SEQ ID NO: 3758715 - DNA, 21 bp, Homo sapiens
ccagatgagcagaagctctcg

SEQ ID NO: 3758716 - DNA, 14 bp, Homo sapiens
ccagatgcaccagc

SEQ ID NO: 3758717 - DNA, 16 bp, Homo sapiens
ccagattgcaacaggc

SEQ ID NO: 3758718 - DNA, 19 bp, Homo sapiens
ccagattgcaacaggctgg

SEQ ID NO: 3758719 - DNA, 20 bp, Homo sapiens
ccagattgcaacaggctggg

SEQ ID NO: 3758720 - DNA, 16 bp, Homo sapiens
ccagcaagtgagagct

SEQ ID NO: 3758721 - DNA, 17 bp, Homo sapiens
ccagcaagtgagagctg

SEQ ID NO: 3758722 - DNA, 18 bp, Homo sapiens
ccagcaagtgagagctgg

SEQ ID NO: 3758723 - DNA, 19 bp, Homo sapiens
ccagcaagtgagagctggg

SEQ ID NO: 3758724 - DNA, 14 bp, Homo sapiens
ccagcacagagcgt

SEQ ID NO: 3758725 - DNA, 18 bp, Homo sapiens
ccagcacagagcgtcctt

SEQ ID NO: 3758726 - DNA, 21 bp, Homo sapiens
ccagcacagagcgtccttccc

SEQ ID NO: 3758727 - DNA, 23 bp, Homo sapiens
ccagcaccaccaggtctcccggg

SEQ ID NO: 3758728 - DNA, 15 bp, Homo sapiens
ccagcacccccacgc

SEQ ID NO: 3758729 - DNA, 17 bp, Homo sapiens
ccagcactaaagcagtg

SEQ ID NO: 3758730 - DNA, 12 bp, Homo sapiens
ccagcactaacg

SEQ ID NO: 3758731 - DNA, 21 bp, Homo sapiens
ccagcactttgggaggctgag

SEQ ID NO: 3758732 - DNA, 17 bp, Homo sapiens
ccagcagatcccagctc

SEQ ID NO: 3758733 - DNA, 19 bp, Homo sapiens
ccagcagccagctctcagc

SEQ ID NO: 3758734 - DNA, 12 bp, Homo sapiens
ccagcagcctgg

SEQ ID NO: 3758735 - DNA, 20 bp, Homo sapiens
ccagcagcctggaccctgtg

SEQ ID NO: 3758736 - DNA, 15 bp, Homo sapiens
ccagcagtttgggag

SEQ ID NO: 3758737 - DNA, 19 bp, Homo sapiens
ccagcatccttttctgcag

SEQ ID NO: 3758738 - DNA, 18 bp, Homo sapiens
ccagccaaaccctgtctg

SEQ ID NO: 3758739 - DNA, 19 bp, Homo sapiens
ccagccaaagcctcctcca

SEQ ID NO: 3758740 - DNA, 15 bp, Homo sapiens
ccagccagcagccag

SEQ ID NO: 3758741 - DNA, 19 bp, Homo sapiens
ccagccattaccatggaga

SEQ ID NO: 3758742 - DNA, 21 bp, Homo sapiens
ccagccattaccatggagaca

SEQ ID NO: 3758743 - DNA, 12 bp, Homo sapiens
ccagcccactgg

SEQ ID NO: 3758744 - DNA, 16 bp, Homo sapiens
ccagcccagcccagct

SEQ ID NO: 3758745 - DNA, 18 bp, Homo sapiens
ccagcccagctgctctgc

SEQ ID NO: 3758746 - DNA, 22 bp, Homo sapiens
ccagcccatcttgcctccatgg

SEQ ID NO: 3758747 - DNA, 17 bp, Homo sapiens
ccagcccattctctctc

SEQ ID NO: 3758748 - DNA, 19 bp, Homo sapiens
ccagcccattctctctcct

SEQ ID NO: 3758749 - DNA, 14 bp, Homo sapiens
ccagccccacccag

SEQ ID NO: 3758750 - DNA, 16 bp, Homo sapiens
ccagccccacccagga

SEQ ID NO: 3758751 - DNA, 16 bp, Homo sapiens
ccagccccagtgccca

SEQ ID NO: 3758752 - DNA, 11 bp, Homo sapiens
ccagcccctcc

SEQ ID NO: 3758753 - DNA, 16 bp, Homo sapiens
ccagcccctgcccctc

SEQ ID NO: 3758754 - DNA, 17 bp, Homo sapiens
ccagccctccctgtcct

SEQ ID NO: 3758755 - DNA, 18 bp, Homo sapiens
ccagccctccctgtcctc

SEQ ID NO: 3758756 - DNA, 19 bp, Homo sapiens
ccagccctccctgtcctcc

SEQ ID NO: 3758757 - DNA, 20 bp, Homo sapiens
ccagccctctcactgtgtcc

SEQ ID NO: 3758758 - DNA, 17 bp, Homo sapiens
ccagcccttagcaggga

SEQ ID NO: 3758759 - DNA, 16 bp, Homo sapiens
ccagcccttgaagtca

SEQ ID NO: 3758760 - DNA, 20 bp, Homo sapiens
ccagcccttgagctccccaa

SEQ ID NO: 3758761 - DNA, 14 bp, Homo sapiens
ccagccgccatgct

SEQ ID NO: 3758762 - DNA, 20 bp, Homo sapiens
ccagccgccattgccaccag

SEQ ID NO: 3758763 - DNA, 23 bp, Homo sapiens
ccagccgccattgccaccaggag

SEQ ID NO: 3758764 - DNA, 21 bp, Homo sapiens
ccagcctctcttggtttcctt

SEQ ID NO: 3758765 - DNA, 24 bp, Homo sapiens
ccagcctctgagcccctgggactg

SEQ ID NO: 3758766 - DNA, 11 bp, Homo sapiens
ccagcctgagc

SEQ ID NO: 3758767 - DNA, 20 bp, Homo sapiens
ccagcctggcttctggagcc

SEQ ID NO: 3758768 - DNA, 16 bp, Homo sapiens
ccagcctgggcagcca

SEQ ID NO: 3758769 - DNA, 12 bp, Homo sapiens
ccagcctgtggt

SEQ ID NO: 3758770 - DNA, 19 bp, Homo sapiens
ccagcctgtggttacagtg

SEQ ID NO: 3758771 - DNA, 21 bp, Homo sapiens
ccagcctgtggttacagtgca

SEQ ID NO: 3758772 - DNA, 19 bp, Homo sapiens
ccagcctttctcccaggcc

SEQ ID NO: 3758773 - DNA, 21 bp, Homo sapiens
ccagcctttctcccaggccag

SEQ ID NO: 3758774 - DNA, 13 bp, Homo sapiens
ccagcgagccctg

SEQ ID NO: 3758775 - DNA, 16 bp, Homo sapiens
ccagcgagccctggtg

SEQ ID NO: 3758776 - DNA, 22 bp, Homo sapiens
ccagcgcctagtggggtctccc

SEQ ID NO: 3758777 - DNA, 21 bp, Homo sapiens
ccagcggctggtgcagggcct

SEQ ID NO: 3758778 - DNA, 20 bp, Homo sapiens
ccagctactcagaagcctga

SEQ ID NO: 3758779 - DNA, 13 bp, Homo sapiens
ccagctactcagg

SEQ ID NO: 3758780 - DNA, 14 bp, Homo sapiens
ccagctcacgtcac

SEQ ID NO: 3758781 - DNA, 15 bp, Homo sapiens
ccagctcacgtcaca

SEQ ID NO: 3758782 - DNA, 13 bp, Homo sapiens
ccagctcagaggg

SEQ ID NO: 3758783 - DNA, 18 bp, Homo sapiens
ccagctcagtcttcccta

SEQ ID NO: 3758784 - DNA, 18 bp, Homo sapiens
ccagctctagacaaccct

SEQ ID NO: 3758785 - DNA, 22 bp, Homo sapiens
ccagctctagacaaccctgcaa

SEQ ID NO: 3758786 - DNA, 16 bp, Homo sapiens
ccagctctccctctgg

SEQ ID NO: 3758787 - DNA, 21 bp, Homo sapiens
ccagctctccctctggccctg

SEQ ID NO: 3758788 - DNA, 22 bp, Homo sapiens
ccagctctccctctggccctgc

SEQ ID NO: 3758789 - DNA, 21 bp, Homo sapiens
ccagctgaaatactgaggggt

SEQ ID NO: 3758790 - DNA, 17 bp, Homo sapiens
ccagctgcacctgccag

SEQ ID NO: 3758791 - DNA, 20 bp, Homo sapiens
ccagctgcacctgccagcct

SEQ ID NO: 3758792 - DNA, 23 bp, Homo sapiens
ccagctgcacctgccagcctggc

SEQ ID NO: 3758793 - DNA, 16 bp, Homo sapiens
ccagctgcccctccct

SEQ ID NO: 3758794 - DNA, 19 bp, Homo sapiens
ccagctgcccctccctgcc

SEQ ID NO: 3758795 - DNA, 18 bp, Homo sapiens
ccagctgccgaccagagc

SEQ ID NO: 3758796 - DNA, 16 bp, Homo sapiens
ccagctgctcccctcc

SEQ ID NO: 3758797 - DNA, 19 bp, Homo sapiens
ccagctgctcccctccctc

SEQ ID NO: 3758798 - DNA, 16 bp, Homo sapiens
ccagctgctctgccca

SEQ ID NO: 3758799 - DNA, 22 bp, Homo sapiens
ccagctgtctgtgtcagcctgt

SEQ ID NO: 3758800 - DNA, 22 bp, Homo sapiens
ccagctgtgggtacagagaggt

SEQ ID NO: 3758801 - DNA, 23 bp, Homo sapiens
ccagctgtgggtacagagaggtc

SEQ ID NO: 3758802 - DNA, 14 bp, Homo sapiens
ccagctgtggtttt

SEQ ID NO: 3758803 - DNA, 23 bp, Homo sapiens
ccagctgtggttttcttttgcca

SEQ ID NO: 3758804 - DNA, 16 bp, Homo sapiens
ccagctgttcagctgg

SEQ ID NO: 3758805 - DNA, 17 bp, Homo sapiens
ccagcttgttatttata

SEQ ID NO: 3758806 - DNA, 20 bp, Homo sapiens
ccagctttgctaccaaagca

SEQ ID NO: 3758807 - DNA, 15 bp, Homo sapiens
ccaggaaaaaggaca

SEQ ID NO: 3758808 - DNA, 23 bp, Homo sapiens
ccaggaaactctgcattctagta

SEQ ID NO: 3758809 - DNA, 14 bp, Homo sapiens
ccaggaactgggcc

SEQ ID NO: 3758810 - DNA, 18 bp, Homo sapiens
ccaggaaggggctggact

SEQ ID NO: 3758811 - DNA, 15 bp, Homo sapiens
ccaggaatgaagata

SEQ ID NO: 3758812 - DNA, 19 bp, Homo sapiens
ccaggaatgcctcctccct

SEQ ID NO: 3758813 - DNA, 20 bp, Homo sapiens
ccaggaatgttaaagtcagt

SEQ ID NO: 3758814 - DNA, 13 bp, Homo sapiens
ccaggacaggacc

SEQ ID NO: 3758815 - DNA, 17 bp, Homo sapiens
ccaggacaggcccggcg

SEQ ID NO: 3758816 - DNA, 18 bp, Homo sapiens
ccaggactccctcctcac

SEQ ID NO: 3758817 - DNA, 16 bp, Homo sapiens
ccaggagacagacaga

SEQ ID NO: 3758818 - DNA, 16 bp, Homo sapiens
ccaggagagccagccc

SEQ ID NO: 3758819 - DNA, 17 bp, Homo sapiens
ccaggagagccagccct

SEQ ID NO: 3758820 - DNA, 23 bp, Homo sapiens
ccaggagagccagccctccctgt

SEQ ID NO: 3758821 - DNA, 20 bp, Homo sapiens
ccaggagccccgaggccttc

SEQ ID NO: 3758822 - DNA, 21 bp, Homo sapiens
ccaggagctcttcaggcctcc

SEQ ID NO: 3758823 - DNA, 23 bp, Homo sapiens
ccaggagctgggcagaaggccaa

SEQ ID NO: 3758824 - DNA, 15 bp, Homo sapiens
ccaggaggctgaggt

SEQ ID NO: 3758825 - DNA, 23 bp, Homo sapiens
ccaggagtttaagaccagcctgg

SEQ ID NO: 3758826 - DNA, 18 bp, Homo sapiens
ccaggagtttgagaccag

SEQ ID NO: 3758827 - DNA, 17 bp, Homo sapiens
ccaggagtttgaggctg

SEQ ID NO: 3758828 - DNA, 20 bp, Homo sapiens
ccaggagtttgaggctgcag

SEQ ID NO: 3758829 - DNA, 14 bp, Homo sapiens
ccaggatggagggg

SEQ ID NO: 3758830 - DNA, 22 bp, Homo sapiens
ccaggatggaggggtggtcctg

SEQ ID NO: 3758831 - DNA, 18 bp, Homo sapiens
ccaggcactgctgcccag

SEQ ID NO: 3758832 - DNA, 18 bp, Homo sapiens
ccaggcagatctgtgccc

SEQ ID NO: 3758833 - DNA, 23 bp, Homo sapiens
ccaggcagatctgtgccccatgc

SEQ ID NO: 3758834 - DNA, 14 bp, Homo sapiens
ccaggccagaggga

SEQ ID NO: 3758835 - DNA, 17 bp, Homo sapiens
ccaggccccctgcatct

SEQ ID NO: 3758836 - DNA, 20 bp, Homo sapiens
ccaggccccgctcattcttt

SEQ ID NO: 3758837 - DNA, 21 bp, Homo sapiens
ccaggcccctgccaccctggg

SEQ ID NO: 3758838 - DNA, 16 bp, Homo sapiens
ccaggccgccccagcc

SEQ ID NO: 3758839 - DNA, 22 bp, Homo sapiens
ccaggccggtgtgggctgtgtc

SEQ ID NO: 3758840 - DNA, 13 bp, Homo sapiens
ccaggcctccagc

SEQ ID NO: 3758841 - DNA, 14 bp, Homo sapiens
ccaggcctccagct

SEQ ID NO: 3758842 - DNA, 16 bp, Homo sapiens
ccaggcctccagctca

SEQ ID NO: 3758843 - DNA, 16 bp, Homo sapiens
ccaggcctgggtctgt

SEQ ID NO: 3758844 - DNA, 23 bp, Homo sapiens
ccaggctccttcctgtcttcctg

SEQ ID NO: 3758845 - DNA, 21 bp, Homo sapiens
ccaggctcctttagcgcccag

SEQ ID NO: 3758846 - DNA, 18 bp, Homo sapiens
ccaggctgcatagaagga

SEQ ID NO: 3758847 - DNA, 20 bp, Homo sapiens
ccaggctgccaaggccagag

SEQ ID NO: 3758848 - DNA, 17 bp, Homo sapiens
ccaggctgctcagggct

SEQ ID NO: 3758849 - DNA, 19 bp, Homo sapiens
ccaggctggcgtgcagtgg

SEQ ID NO: 3758850 - DNA, 14 bp, Homo sapiens
ccaggctggtctca

SEQ ID NO: 3758851 - DNA, 17 bp, Homo sapiens
ccaggcttgcctgcagg

SEQ ID NO: 3758852 - DNA, 17 bp, Homo sapiens
ccagggaagctggccga

SEQ ID NO: 3758853 - DNA, 18 bp, Homo sapiens
ccagggaagctggccgag

SEQ ID NO: 3758854 - DNA, 17 bp, Homo sapiens
ccagggaagctgtccct

SEQ ID NO: 3758855 - DNA, 17 bp, Homo sapiens
ccagggagcaagacaga

SEQ ID NO: 3758856 - DNA, 23 bp, Homo sapiens
ccagggatgccatctgtgggcac

SEQ ID NO: 3758857 - DNA, 19 bp, Homo sapiens
ccagggatggggccacagc

SEQ ID NO: 3758858 - DNA, 22 bp, Homo sapiens
ccagggatggggccacagccag

SEQ ID NO: 3758859 - DNA, 22 bp, Homo sapiens
ccagggcaccaagcccacaggt

SEQ ID NO: 3758860 - DNA, 19 bp, Homo sapiens
ccagggccacgtgccaggc

SEQ ID NO: 3758861 - DNA, 21 bp, Homo sapiens
ccagggccacgtgccaggccc

SEQ ID NO: 3758862 - DNA, 22 bp, Homo sapiens
ccagggccacgtgccaggcccg

SEQ ID NO: 3758863 - DNA, 16 bp, Homo sapiens
ccagggccagggccct

SEQ ID NO: 3758864 - DNA, 15 bp, Homo sapiens
ccagggctcagcctg

SEQ ID NO: 3758865 - DNA, 21 bp, Homo sapiens
ccaggggaaaatcagcctgct

SEQ ID NO: 3758866 - DNA, 14 bp, Homo sapiens
ccagggttccccca

SEQ ID NO: 3758867 - DNA, 21 bp, Homo sapiens
ccaggtcgggctcagctctgg

SEQ ID NO: 3758868 - DNA, 23 bp, Homo sapiens
ccaggtcgggctcagctctggct

SEQ ID NO: 3758869 - DNA, 19 bp, Homo sapiens
ccaggtgcacagacgtccc

SEQ ID NO: 3758870 - DNA, 22 bp, Homo sapiens
ccaggtgcagtggctcacgcct

SEQ ID NO: 3758871 - DNA, 23 bp, Homo sapiens
ccaggtggctgacccagtccctg

SEQ ID NO: 3758872 - DNA, 22 bp, Homo sapiens
ccaggtgtggttgctcacagct

SEQ ID NO: 3758873 - DNA, 16 bp, Homo sapiens
ccaggtttctatgtgt

SEQ ID NO: 3758874 - DNA, 17 bp, Homo sapiens
ccaggtttttggtctga

SEQ ID NO: 3758875 - DNA, 17 bp, Homo sapiens
ccagtatacaagataag

SEQ ID NO: 3758876 - DNA, 21 bp, Homo sapiens
ccagtcatcagctattcagtt

SEQ ID NO: 3758877 - DNA, 18 bp, Homo sapiens
ccagtccaaatgtcctcc

SEQ ID NO: 3758878 - DNA, 18 bp, Homo sapiens
ccagtccccctgccccag

SEQ ID NO: 3758879 - DNA, 19 bp, Homo sapiens
ccagtccctgggggaagcc

SEQ ID NO: 3758880 - DNA, 17 bp, Homo sapiens
ccagtcctgcctggcca

SEQ ID NO: 3758881 - DNA, 18 bp, Homo sapiens
ccagtcctgcctggccag

SEQ ID NO: 3758882 - DNA, 12 bp, Homo sapiens
ccagtcctgctc

SEQ ID NO: 3758883 - DNA, 13 bp, Homo sapiens
ccagtcctgctct

SEQ ID NO: 3758884 - DNA, 15 bp, Homo sapiens
ccagtcctgctctct

SEQ ID NO: 3758885 - DNA, 14 bp, Homo sapiens
ccagtctcccaggc

SEQ ID NO: 3758886 - DNA, 21 bp, Homo sapiens
ccagtctcccaggccccctgc

SEQ ID NO: 3758887 - DNA, 20 bp, Homo sapiens
ccagtctgaagtttcattta

SEQ ID NO: 3758888 - DNA, 16 bp, Homo sapiens
ccagtctgctgccctc

SEQ ID NO: 3758889 - DNA, 22 bp, Homo sapiens
ccagtctgctgccctccatccc

SEQ ID NO: 3758890 - DNA, 19 bp, Homo sapiens
ccagtctggaatgcagtgg

SEQ ID NO: 3758891 - DNA, 18 bp, Homo sapiens
ccagtcttccacctggaa

SEQ ID NO: 3758892 - DNA, 12 bp, Homo sapiens
ccagtcttgtgt

SEQ ID NO: 3758893 - DNA, 24 bp, Homo sapiens
ccagtgacacttcagagagctggt

SEQ ID NO: 3758894 - DNA, 15 bp, Homo sapiens
ccagtgacctgagga

SEQ ID NO: 3758895 - DNA, 17 bp, Homo sapiens
ccagtgacctgaggaag

SEQ ID NO: 3758896 - DNA, 19 bp, Homo sapiens
ccagtgacctgaggaagcg

SEQ ID NO: 3758897 - DNA, 19 bp, Homo sapiens
ccagtgattcgagctatat

SEQ ID NO: 3758898 - DNA, 20 bp, Homo sapiens
ccagtgccttacctcctgcc

SEQ ID NO: 3758899 - DNA, 18 bp, Homo sapiens
ccagtggaagaagaaaac

SEQ ID NO: 3758900 - DNA, 16 bp, Homo sapiens
ccagtggcctcaaccc

SEQ ID NO: 3758901 - DNA, 13 bp, Homo sapiens
ccagtgggaagat

SEQ ID NO: 3758902 - DNA, 14 bp, Homo sapiens
ccagtgtagccttg

SEQ ID NO: 3758903 - DNA, 12 bp, Homo sapiens
ccagtgtctttc

SEQ ID NO: 3758904 - DNA, 16 bp, Homo sapiens
ccagtgtctttctttg

SEQ ID NO: 3758905 - DNA, 23 bp, Homo sapiens
ccagtgtgacaaggattgctact

SEQ ID NO: 3758906 - DNA, 18 bp, Homo sapiens
ccagtgttgtttgtaaat

SEQ ID NO: 3758907 - DNA, 22 bp, Homo sapiens
ccagtgttgtttgtaaataaga

SEQ ID NO: 3758908 - DNA, 17 bp, Homo sapiens
ccagttaatcttgcttt

SEQ ID NO: 3758909 - DNA, 19 bp, Homo sapiens
ccagttaatcttgctttct

SEQ ID NO: 3758910 - DNA, 21 bp, Homo sapiens
ccagttgcacttggcctctgg

SEQ ID NO: 3758911 - DNA, 19 bp, Homo sapiens
ccagttgggtggatgcctg

SEQ ID NO: 3758912 - DNA, 18 bp, Homo sapiens
ccagttgtatattattct

SEQ ID NO: 3758913 - DNA, 21 bp, Homo sapiens
ccagttgtcccgattgtaact

SEQ ID NO: 3758914 - DNA, 14 bp, Homo sapiens
ccagtttgcagaaa

SEQ ID NO: 3758915 - DNA, 21 bp, Homo sapiens
ccataagcctccatttagttc

SEQ ID NO: 3758916 - DNA, 15 bp, Homo sapiens
ccatagtatattaaa

SEQ ID NO: 3758917 - DNA, 16 bp, Homo sapiens
ccatatctaaccagtg

SEQ ID NO: 3758918 - DNA, 15 bp, Homo sapiens
ccatattctgttggc

SEQ ID NO: 3758919 - DNA, 18 bp, Homo sapiens
ccatattctgttggccag

SEQ ID NO: 3758920 - DNA, 18 bp, Homo sapiens
ccatcaagttgcacactc

SEQ ID NO: 3758921 - DNA, 16 bp, Homo sapiens
ccatcacaaacttaaa

SEQ ID NO: 3758922 - DNA, 20 bp, Homo sapiens
ccatcacagggttgggccca

SEQ ID NO: 3758923 - DNA, 13 bp, Homo sapiens
ccatcaccagaca

SEQ ID NO: 3758924 - DNA, 19 bp, Homo sapiens
ccatcagctgtaagaagag

SEQ ID NO: 3758925 - DNA, 21 bp, Homo sapiens
ccatcagttcccccagtacct

SEQ ID NO: 3758926 - DNA, 16 bp, Homo sapiens
ccatcatgtctggcta

SEQ ID NO: 3758927 - DNA, 19 bp, Homo sapiens
ccatccaggttcagcttgt

SEQ ID NO: 3758928 - DNA, 14 bp, Homo sapiens
ccatccatctccag

SEQ ID NO: 3758929 - DNA, 16 bp, Homo sapiens
ccatccatctccaggg

SEQ ID NO: 3758930 - DNA, 13 bp, Homo sapiens
ccatcccacctct

SEQ ID NO: 3758931 - DNA, 12 bp, Homo sapiens
ccatcccatccc

SEQ ID NO: 3758932 - DNA, 13 bp, Homo sapiens
ccatcccatccca

SEQ ID NO: 3758933 - DNA, 14 bp, Homo sapiens
ccatcccatcccat

SEQ ID NO: 3758934 - DNA, 22 bp, Homo sapiens
ccatcccctgtagagtgggagc

SEQ ID NO: 3758935 - DNA, 17 bp, Homo sapiens
ccatcccgacatggacc

SEQ ID NO: 3758936 - DNA, 18 bp, Homo sapiens
ccatcccgctcttttcct

SEQ ID NO: 3758937 - DNA, 22 bp, Homo sapiens
ccatcctaatcatccaatgctc

SEQ ID NO: 3758938 - DNA, 23 bp, Homo sapiens
ccatcctaatcatccaatgctca

SEQ ID NO: 3758939 - DNA, 16 bp, Homo sapiens
ccatcggtcctgtctc

SEQ ID NO: 3758940 - DNA, 22 bp, Homo sapiens
ccatcggtgtccatttatagaa

SEQ ID NO: 3758941 - DNA, 17 bp, Homo sapiens
ccatctcaggccacctg

SEQ ID NO: 3758942 - DNA, 21 bp, Homo sapiens
ccatctcaggccacctgcccc

SEQ ID NO: 3758943 - DNA, 14 bp, Homo sapiens
ccatctccagggag

SEQ ID NO: 3758944 - DNA, 21 bp, Homo sapiens
ccatctccagggagcaagaca

SEQ ID NO: 3758945 - DNA, 17 bp, Homo sapiens
ccatctctccctcccct

SEQ ID NO: 3758946 - DNA, 20 bp, Homo sapiens
ccatctctctactcctacct

SEQ ID NO: 3758947 - DNA, 18 bp, Homo sapiens
ccatctctgaacttcagc

SEQ ID NO: 3758948 - DNA, 19 bp, Homo sapiens
ccatctctgaacttcagct

SEQ ID NO: 3758949 - DNA, 18 bp, Homo sapiens
ccatctctgattttcaaa

SEQ ID NO: 3758950 - DNA, 20 bp, Homo sapiens
ccatctgcacccccctgggc

SEQ ID NO: 3758951 - DNA, 22 bp, Homo sapiens
ccatctgtgggcacgctgtggg

SEQ ID NO: 3758952 - DNA, 21 bp, Homo sapiens
ccatgaaaacgttttattgtg

SEQ ID NO: 3758953 - DNA, 13 bp, Homo sapiens
ccatgaactggag

SEQ ID NO: 3758954 - DNA, 15 bp, Homo sapiens
ccatgaactttgtcc

SEQ ID NO: 3758955 - DNA, 18 bp, Homo sapiens
ccatgaagccacagccca

SEQ ID NO: 3758956 - DNA, 23 bp, Homo sapiens
ccatgaccagaagggaaacagtc

SEQ ID NO: 3758957 - DNA, 14 bp, Homo sapiens
ccatgaccatactg

SEQ ID NO: 3758958 - DNA, 18 bp, Homo sapiens
ccatgagcctcagcatcc

SEQ ID NO: 3758959 - DNA, 21 bp, Homo sapiens
ccatgagcctcagcatcctgg

SEQ ID NO: 3758960 - DNA, 19 bp, Homo sapiens
ccatgagctccagaccccc

SEQ ID NO: 3758961 - DNA, 15 bp, Homo sapiens
ccatgaggcctcagt

SEQ ID NO: 3758962 - DNA, 18 bp, Homo sapiens
ccatgagtttgccctggt

SEQ ID NO: 3758963 - DNA, 19 bp, Homo sapiens
ccatgattaaccacttcag

SEQ ID NO: 3758964 - DNA, 20 bp, Homo sapiens
ccatgccaaagctagggtgg

SEQ ID NO: 3758965 - DNA, 16 bp, Homo sapiens
ccatgcccacctgccc

SEQ ID NO: 3758966 - DNA, 18 bp, Homo sapiens
ccatgcctgtccagcctg

SEQ ID NO: 3758967 - DNA, 14 bp, Homo sapiens
ccatgctgcctcca

SEQ ID NO: 3758968 - DNA, 15 bp, Homo sapiens
ccatggactctacac

SEQ ID NO: 3758969 - DNA, 18 bp, Homo sapiens
ccatgggaaactttccct

SEQ ID NO: 3758970 - DNA, 22 bp, Homo sapiens
ccatgggagctggttagaaatg

SEQ ID NO: 3758971 - DNA, 15 bp, Homo sapiens
ccatgggcctcctgt

SEQ ID NO: 3758972 - DNA, 14 bp, Homo sapiens
ccatggtcacagag

SEQ ID NO: 3758973 - DNA, 16 bp, Homo sapiens
ccatgtaaaacaaaaa

SEQ ID NO: 3758974 - DNA, 16 bp, Homo sapiens
ccatgtacatgaagaa

SEQ ID NO: 3758975 - DNA, 22 bp, Homo sapiens
ccatgtactgtagtttttcttc

SEQ ID NO: 3758976 - DNA, 16 bp, Homo sapiens
ccatgtagcaggactg

SEQ ID NO: 3758977 - DNA, 22 bp, Homo sapiens
ccatgtcaccggatcctgggtg

SEQ ID NO: 3758978 - DNA, 15 bp, Homo sapiens
ccatgtcgcctctgc

SEQ ID NO: 3758979 - DNA, 19 bp, Homo sapiens
ccatgtcgcctctgcattc

SEQ ID NO: 3758980 - DNA, 17 bp, Homo sapiens
ccatgtgagccaccgct

SEQ ID NO: 3758981 - DNA, 13 bp, Homo sapiens
ccatgtgcccagt

SEQ ID NO: 3758982 - DNA, 17 bp, Homo sapiens
ccatgtgcctgcaccag

SEQ ID NO: 3758983 - DNA, 14 bp, Homo sapiens
ccatgttggccagg

SEQ ID NO: 3758984 - DNA, 15 bp, Homo sapiens
ccatgttggccaggc

SEQ ID NO: 3758985 - DNA, 16 bp, Homo sapiens
ccatgttggccaggct

SEQ ID NO: 3758986 - DNA, 14 bp, Homo sapiens
ccatgtttaagatt

SEQ ID NO: 3758987 - DNA, 15 bp, Homo sapiens
ccatgtttaagattt

SEQ ID NO: 3758988 - DNA, 15 bp, Homo sapiens
ccattaaagttctca

SEQ ID NO: 3758989 - DNA, 16 bp, Homo sapiens
ccattagagtcagcct

SEQ ID NO: 3758990 - DNA, 22 bp, Homo sapiens
ccattcagcccatttcacacct

SEQ ID NO: 3758991 - DNA, 15 bp, Homo sapiens
ccattcaggaacctg

SEQ ID NO: 3758992 - DNA, 11 bp, Homo sapiens
ccattcagtca

SEQ ID NO: 3758993 - DNA, 13 bp, Homo sapiens
ccattccacatcc

SEQ ID NO: 3758994 - DNA, 12 bp, Homo sapiens
ccattcctcagg

SEQ ID NO: 3758995 - DNA, 17 bp, Homo sapiens
ccattctgaccatttca

SEQ ID NO: 3758996 - DNA, 19 bp, Homo sapiens
ccattctgcctgcccaggc

SEQ ID NO: 3758997 - DNA, 21 bp, Homo sapiens
ccattctgcctgcccaggccc

SEQ ID NO: 3758998 - DNA, 22 bp, Homo sapiens
ccattctttgcttgaacacagt

SEQ ID NO: 3758999 - DNA, 21 bp, Homo sapiens
ccattgccaccaggagaacca

SEQ ID NO: 3759000 - DNA, 14 bp, Homo sapiens
ccattgccctggtt

SEQ ID NO: 3759001 - DNA, 23 bp, Homo sapiens
ccattgctgctccttagctgcca

SEQ ID NO: 3759002 - DNA, 15 bp, Homo sapiens
ccattgtctcagagc

SEQ ID NO: 3759003 - DNA, 18 bp, Homo sapiens
ccattgtctttatatgaa

SEQ ID NO: 3759004 - DNA, 12 bp, Homo sapiens
ccatttacactt

SEQ ID NO: 3759005 - DNA, 14 bp, Homo sapiens
ccatttatagaata

SEQ ID NO: 3759006 - DNA, 20 bp, Homo sapiens
ccatttatgtgagtgtgtgt

SEQ ID NO: 3759007 - DNA, 12 bp, Homo sapiens
ccatttgtaata

SEQ ID NO: 3759008 - DNA, 15 bp, Homo sapiens
ccatttgtaataaag

SEQ ID NO: 3759009 - DNA, 14 bp, Homo sapiens
ccatttgtgtgtgt

SEQ ID NO: 3759010 - DNA, 12 bp, Homo sapiens
ccatttgtttat

SEQ ID NO: 3759011 - DNA, 13 bp, Homo sapiens
ccatttgtttatt

SEQ ID NO: 3759012 - DNA, 14 bp, Homo sapiens
ccattttctggttc

SEQ ID NO: 3759013 - DNA, 14 bp, Homo sapiens
ccattttgcaaaat

SEQ ID NO: 3759014 - DNA, 17 bp, Homo sapiens
ccattttgcaaaatttc

SEQ ID NO: 3759015 - DNA, 16 bp, Homo sapiens
ccattttgcccttcca

SEQ ID NO: 3759016 - DNA, 20 bp, Homo sapiens
ccattttggggtacccactg

SEQ ID NO: 3759017 - DNA, 22 bp, Homo sapiens
cccaaaagtcaaaaggtgcctg

SEQ ID NO: 3759018 - DNA, 23 bp, Homo sapiens
cccaaactgttgattattagcca

SEQ ID NO: 3759019 - DNA, 13 bp, Homo sapiens
cccaaagtgctgg

SEQ ID NO: 3759020 - DNA, 19 bp, Homo sapiens
cccaaattatcaagctaat

SEQ ID NO: 3759021 - DNA, 18 bp, Homo sapiens
cccaacacaaggtgggca

SEQ ID NO: 3759022 - DNA, 16 bp, Homo sapiens
cccaaccctgcccctg

SEQ ID NO: 3759023 - DNA, 14 bp, Homo sapiens
cccaacctgctctc

SEQ ID NO: 3759024 - DNA, 15 bp, Homo sapiens
cccaacgaaaagcac

SEQ ID NO: 3759025 - DNA, 12 bp, Homo sapiens
cccaactcctgg

SEQ ID NO: 3759026 - DNA, 23 bp, Homo sapiens
cccaactcctggaagctgtgtcc

SEQ ID NO: 3759027 - DNA, 23 bp, Homo sapiens
cccaagaacagcaggcccaccta

SEQ ID NO: 3759028 - DNA, 19 bp, Homo sapiens
cccaagacagatgccccag

SEQ ID NO: 3759029 - DNA, 22 bp, Homo sapiens
cccaagacttggtgtcctttcc

SEQ ID NO: 3759030 - DNA, 19 bp, Homo sapiens
cccaagctggagtgcagtg

SEQ ID NO: 3759031 - DNA, 14 bp, Homo sapiens
cccaaggaaagccc

SEQ ID NO: 3759032 - DNA, 14 bp, Homo sapiens
cccaaggaggaaaa

SEQ ID NO: 3759033 - DNA, 15 bp, Homo sapiens
cccaaggggcagtct

SEQ ID NO: 3759034 - DNA, 21 bp, Homo sapiens
cccaattcttacaaacatgtg

SEQ ID NO: 3759035 - DNA, 22 bp, Homo sapiens
cccacacctcagttcccttggc

SEQ ID NO: 3759036 - DNA, 22 bp, Homo sapiens
cccacacggaggcatctgcacc

SEQ ID NO: 3759037 - DNA, 23 bp, Homo sapiens
cccacagaaagactgagctcaag

SEQ ID NO: 3759038 - DNA, 14 bp, Homo sapiens
cccacagcccgcat

SEQ ID NO: 3759039 - DNA, 17 bp, Homo sapiens
cccacagcctctgcctg

SEQ ID NO: 3759040 - DNA, 14 bp, Homo sapiens
cccacagctcccac

SEQ ID NO: 3759041 - DNA, 15 bp, Homo sapiens
cccacagctcccacc

SEQ ID NO: 3759042 - DNA, 20 bp, Homo sapiens
cccacagctcccaccccacc

SEQ ID NO: 3759043 - DNA, 22 bp, Homo sapiens
cccacaggtgtccccagcccac

SEQ ID NO: 3759044 - DNA, 19 bp, Homo sapiens
cccacatagtgatggttcc

SEQ ID NO: 3759045 - DNA, 14 bp, Homo sapiens
cccacattccgaca

SEQ ID NO: 3759046 - DNA, 13 bp, Homo sapiens
cccaccacctagg

SEQ ID NO: 3759047 - DNA, 16 bp, Homo sapiens
cccaccacctaggcca

SEQ ID NO: 3759048 - DNA, 19 bp, Homo sapiens
cccaccacgatgtggccct

SEQ ID NO: 3759049 - DNA, 17 bp, Homo sapiens
cccaccaggctgctcag

SEQ ID NO: 3759050 - DNA, 18 bp, Homo sapiens
cccaccatgtctgcccca

SEQ ID NO: 3759051 - DNA, 13 bp, Homo sapiens
cccacccaggagg

SEQ ID NO: 3759052 - DNA, 12 bp, Homo sapiens
cccaccccacac

SEQ ID NO: 3759053 - DNA, 14 bp, Homo sapiens
cccaccccacactt

SEQ ID NO: 3759054 - DNA, 14 bp, Homo sapiens
cccaccccagccta

SEQ ID NO: 3759055 - DNA, 14 bp, Homo sapiens
cccacccccctcat

SEQ ID NO: 3759056 - DNA, 17 bp, Homo sapiens
cccaccccctccccagg

SEQ ID NO: 3759057 - DNA, 19 bp, Homo sapiens
cccacccccttcagtgccc

SEQ ID NO: 3759058 - DNA, 16 bp, Homo sapiens
cccacccccttctctg

SEQ ID NO: 3759059 - DNA, 12 bp, Homo sapiens
cccaccccttcc

SEQ ID NO: 3759060 - DNA, 15 bp, Homo sapiens
cccaccccttcccca

SEQ ID NO: 3759061 - DNA, 19 bp, Homo sapiens
cccaccggttgcttctggg

SEQ ID NO: 3759062 - DNA, 20 bp, Homo sapiens
cccaccggttgcttctggga

SEQ ID NO: 3759063 - DNA, 20 bp, Homo sapiens
cccacctaccttcaaagctg

SEQ ID NO: 3759064 - DNA, 17 bp, Homo sapiens
cccacctcagcctcctg

SEQ ID NO: 3759065 - DNA, 20 bp, Homo sapiens
cccacctggtggcctctgcc

SEQ ID NO: 3759066 - DNA, 22 bp, Homo sapiens
cccacctgtcaaacaaagccag

SEQ ID NO: 3759067 - DNA, 19 bp, Homo sapiens
cccaccttcaattcctggg

SEQ ID NO: 3759068 - DNA, 20 bp, Homo sapiens
cccaccttcaattcctgggc

SEQ ID NO: 3759069 - DNA, 22 bp, Homo sapiens
cccaccttggctcaagtcctct

SEQ ID NO: 3759070 - DNA, 15 bp, Homo sapiens
cccaccttggctgca

SEQ ID NO: 3759071 - DNA, 20 bp, Homo sapiens
cccacgactgcccggcaggg

SEQ ID NO: 3759072 - DNA, 18 bp, Homo sapiens
cccacgttctctctgcct

SEQ ID NO: 3759073 - DNA, 14 bp, Homo sapiens
cccactcacagaga

SEQ ID NO: 3759074 - DNA, 13 bp, Homo sapiens
cccactctcattc

SEQ ID NO: 3759075 - DNA, 19 bp, Homo sapiens
cccactctcattccccagg

SEQ ID NO: 3759076 - DNA, 22 bp, Homo sapiens
cccactgatctctactaccaca

SEQ ID NO: 3759077 - DNA, 14 bp, Homo sapiens
cccactgcctgccc

SEQ ID NO: 3759078 - DNA, 22 bp, Homo sapiens
cccactggctgtgggctccctt

SEQ ID NO: 3759079 - DNA, 21 bp, Homo sapiens
cccactggggaaataacagct

SEQ ID NO: 3759080 - DNA, 14 bp, Homo sapiens
cccagaaaggagac

SEQ ID NO: 3759081 - DNA, 17 bp, Homo sapiens
cccagaacctgtccttg

SEQ ID NO: 3759082 - DNA, 19 bp, Homo sapiens
cccagaacctgtccttgca

SEQ ID NO: 3759083 - DNA, 20 bp, Homo sapiens
cccagaactggactcaggat

SEQ ID NO: 3759084 - DNA, 23 bp, Homo sapiens
cccagaaggcagggaaaggctct

SEQ ID NO: 3759085 - DNA, 13 bp, Homo sapiens
cccagacagctcc

SEQ ID NO: 3759086 - DNA, 21 bp, Homo sapiens
cccagacagctccctctgcct

SEQ ID NO: 3759087 - DNA, 20 bp, Homo sapiens
cccagacccctctggccagg

SEQ ID NO: 3759088 - DNA, 21 bp, Homo sapiens
cccagaccttttatccactta

SEQ ID NO: 3759089 - DNA, 23 bp, Homo sapiens
cccagacttgctgaatcggaatc

SEQ ID NO: 3759090 - DNA, 15 bp, Homo sapiens
cccagagacaggaaa

SEQ ID NO: 3759091 - DNA, 16 bp, Homo sapiens
cccagagacaggaaaa

SEQ ID NO: 3759092 - DNA, 19 bp, Homo sapiens
cccagagaggaatcagact

SEQ ID NO: 3759093 - DNA, 13 bp, Homo sapiens
cccagagctgttt

SEQ ID NO: 3759094 - DNA, 20 bp, Homo sapiens
cccagagctgtttatggcct

SEQ ID NO: 3759095 - DNA, 22 bp, Homo sapiens
cccagagctgtttatggcctca

SEQ ID NO: 3759096 - DNA, 21 bp, Homo sapiens
cccagattgcaacaggctggg

SEQ ID NO: 3759097 - DNA, 16 bp, Homo sapiens
cccagatttcagtctt

SEQ ID NO: 3759098 - DNA, 13 bp, Homo sapiens
cccagcaaccctc

SEQ ID NO: 3759099 - DNA, 17 bp, Homo sapiens
cccagcaaccctcctat

SEQ ID NO: 3759100 - DNA, 18 bp, Homo sapiens
cccagcaagtgagagctg

SEQ ID NO: 3759101 - DNA, 18 bp, Homo sapiens
cccagcaccaccaggtct

SEQ ID NO: 3759102 - DNA, 18 bp, Homo sapiens
cccagcacttgtgttgtc

SEQ ID NO: 3759103 - DNA, 19 bp, Homo sapiens
cccagcagggcctcaaagt

SEQ ID NO: 3759104 - DNA, 15 bp, Homo sapiens
cccagcaggtgggga

SEQ ID NO: 3759105 - DNA, 16 bp, Homo sapiens
cccagcagtttgggag

SEQ ID NO: 3759106 - DNA, 21 bp, Homo sapiens
cccagcatccttttctgcaga

SEQ ID NO: 3759107 - DNA, 12 bp, Homo sapiens
cccagccacccc

SEQ ID NO: 3759108 - DNA, 19 bp, Homo sapiens
cccagccattaccatggag

SEQ ID NO: 3759109 - DNA, 22 bp, Homo sapiens
cccagccattaccatggagaca

SEQ ID NO: 3759110 - DNA, 16 bp, Homo sapiens
cccagcccaaagctgt

SEQ ID NO: 3759111 - DNA, 20 bp, Homo sapiens
cccagcccagctgctctgcc

SEQ ID NO: 3759112 - DNA, 22 bp, Homo sapiens
cccagcccagctgctctgccca

SEQ ID NO: 3759113 - DNA, 16 bp, Homo sapiens
cccagcccagctggtg

SEQ ID NO: 3759114 - DNA, 18 bp, Homo sapiens
cccagcccctgcccctca

SEQ ID NO: 3759115 - DNA, 20 bp, Homo sapiens
cccagcccctgcccctcatg

SEQ ID NO: 3759116 - DNA, 18 bp, Homo sapiens
cccagcctccaagctcca

SEQ ID NO: 3759117 - DNA, 12 bp, Homo sapiens
cccagcctgcta

SEQ ID NO: 3759118 - DNA, 19 bp, Homo sapiens
cccagcctgtggttacagt

SEQ ID NO: 3759119 - DNA, 15 bp, Homo sapiens
cccagcggctggtgc

SEQ ID NO: 3759120 - DNA, 21 bp, Homo sapiens
cccagctactcagaagcctga

SEQ ID NO: 3759121 - DNA, 18 bp, Homo sapiens
cccagctcagtcttccct

SEQ ID NO: 3759122 - DNA, 11 bp, Homo sapiens
cccagctccag

SEQ ID NO: 3759123 - DNA, 15 bp, Homo sapiens
cccagctccagggcc

SEQ ID NO: 3759124 - DNA, 17 bp, Homo sapiens
cccagctccagggccag

SEQ ID NO: 3759125 - DNA, 15 bp, Homo sapiens
cccagctctccctct

SEQ ID NO: 3759126 - DNA, 17 bp, Homo sapiens
cccagctgactgtggcc

SEQ ID NO: 3759127 - DNA, 18 bp, Homo sapiens
cccagctgcacctgccag

SEQ ID NO: 3759128 - DNA, 21 bp, Homo sapiens
cccagctgcacctgccagcct

SEQ ID NO: 3759129 - DNA, 22 bp, Homo sapiens
cccagctgcacctgccagcctg

SEQ ID NO: 3759130 - DNA, 12 bp, Homo sapiens
cccagctgcccc

SEQ ID NO: 3759131 - DNA, 15 bp, Homo sapiens
cccagctgcccctcc

SEQ ID NO: 3759132 - DNA, 15 bp, Homo sapiens
cccagctgctcccct

SEQ ID NO: 3759133 - DNA, 21 bp, Homo sapiens
cccagctgctcccctccctcc

SEQ ID NO: 3759134 - DNA, 12 bp, Homo sapiens
cccagctgctct

SEQ ID NO: 3759135 - DNA, 19 bp, Homo sapiens
cccagctgctctgcccaga

SEQ ID NO: 3759136 - DNA, 15 bp, Homo sapiens
cccaggaactgggcc

SEQ ID NO: 3759137 - DNA, 12 bp, Homo sapiens
cccaggaagccg

SEQ ID NO: 3759138 - DNA, 22 bp, Homo sapiens
cccaggaatgaagataccatca

SEQ ID NO: 3759139 - DNA, 17 bp, Homo sapiens
cccaggagacagttcaa

SEQ ID NO: 3759140 - DNA, 23 bp, Homo sapiens
cccaggagagccagccctccctg

SEQ ID NO: 3759141 - DNA, 14 bp, Homo sapiens
cccaggagccccga

SEQ ID NO: 3759142 - DNA, 18 bp, Homo sapiens
cccaggagccccgaggcc

SEQ ID NO: 3759143 - DNA, 13 bp, Homo sapiens
cccaggaggctga

SEQ ID NO: 3759144 - DNA, 18 bp, Homo sapiens
cccaggagggagggggct

SEQ ID NO: 3759145 - DNA, 22 bp, Homo sapiens
cccaggagtttgaggctgcagc

SEQ ID NO: 3759146 - DNA, 11 bp, Homo sapiens
cccaggcaggt

SEQ ID NO: 3759147 - DNA, 17 bp, Homo sapiens
cccaggcaggtcttgaa

SEQ ID NO: 3759148 - DNA, 13 bp, Homo sapiens
cccaggccccagg

SEQ ID NO: 3759149 - DNA, 22 bp, Homo sapiens
cccaggcccctgccaccctggg

SEQ ID NO: 3759150 - DNA, 18 bp, Homo sapiens
cccaggctgcctgagcac

SEQ ID NO: 3759151 - DNA, 14 bp, Homo sapiens
cccagggagaggcc

SEQ ID NO: 3759152 - DNA, 15 bp, Homo sapiens
cccagggagcggaaa

SEQ ID NO: 3759153 - DNA, 21 bp, Homo sapiens
cccagggatttgtccttgggg

SEQ ID NO: 3759154 - DNA, 15 bp, Homo sapiens
cccagggccagggcc

SEQ ID NO: 3759155 - DNA, 22 bp, Homo sapiens
cccagggccagggccctgcaga

SEQ ID NO: 3759156 - DNA, 14 bp, Homo sapiens
cccagggctcagcc

SEQ ID NO: 3759157 - DNA, 16 bp, Homo sapiens
cccagggctcagcctg

SEQ ID NO: 3759158 - DNA, 21 bp, Homo sapiens
cccaggggagagggtctggag

SEQ ID NO: 3759159 - DNA, 19 bp, Homo sapiens
cccaggggtcccagccacc

SEQ ID NO: 3759160 - DNA, 18 bp, Homo sapiens
cccagggtcttccctacc

SEQ ID NO: 3759161 - DNA, 19 bp, Homo sapiens
cccaggtggctgacccagt

SEQ ID NO: 3759162 - DNA, 22 bp, Homo sapiens
cccaggtggctgacccagtccc

SEQ ID NO: 3759163 - DNA, 23 bp, Homo sapiens
cccaggtggctgacccagtccct

SEQ ID NO: 3759164 - DNA, 14 bp, Homo sapiens
cccagtaagccact

SEQ ID NO: 3759165 - DNA, 12 bp, Homo sapiens
cccagtccctgg

SEQ ID NO: 3759166 - DNA, 13 bp, Homo sapiens
cccagtccctggg

SEQ ID NO: 3759167 - DNA, 14 bp, Homo sapiens
cccagtccctgggg

SEQ ID NO: 3759168 - DNA, 23 bp, Homo sapiens
cccagtccctgggggaagccctg

SEQ ID NO: 3759169 - DNA, 10 bp, Homo sapiens
cccagtctgg

SEQ ID NO: 3759170 - DNA, 15 bp, Homo sapiens
cccagtgaaaactag

SEQ ID NO: 3759171 - DNA, 12 bp, Homo sapiens
cccagtgacact

SEQ ID NO: 3759172 - DNA, 15 bp, Homo sapiens
cccagtgccctgggg

SEQ ID NO: 3759173 - DNA, 17 bp, Homo sapiens
cccagtgccgagaagga

SEQ ID NO: 3759174 - DNA, 13 bp, Homo sapiens
cccagtggcctca

SEQ ID NO: 3759175 - DNA, 16 bp, Homo sapiens
cccagtgttttaggag

SEQ ID NO: 3759176 - DNA, 16 bp, Homo sapiens
cccagttctctaggga

SEQ ID NO: 3759177 - DNA, 15 bp, Homo sapiens
cccagtttgcagaaa

SEQ ID NO: 3759178 - DNA, 16 bp, Homo sapiens
cccagtttgcagaaaa

SEQ ID NO: 3759179 - DNA, 23 bp, Homo sapiens
cccataattttttttttcctttt

SEQ ID NO: 3759180 - DNA, 18 bp, Homo sapiens
cccatactctgtctccct

SEQ ID NO: 3759181 - DNA, 13 bp, Homo sapiens
cccatagcttcca

SEQ ID NO: 3759182 - DNA, 21 bp, Homo sapiens
cccatcacagggttgggccca

SEQ ID NO: 3759183 - DNA, 15 bp, Homo sapiens
cccatcactggagca

SEQ ID NO: 3759184 - DNA, 12 bp, Homo sapiens
cccatcccatcc

SEQ ID NO: 3759185 - DNA, 13 bp, Homo sapiens
cccatcccatccc

SEQ ID NO: 3759186 - DNA, 15 bp, Homo sapiens
cccatcccatcccat

SEQ ID NO: 3759187 - DNA, 13 bp, Homo sapiens
cccatcctcccct

SEQ ID NO: 3759188 - DNA, 20 bp, Homo sapiens
cccatcggtgtccatttata

SEQ ID NO: 3759189 - DNA, 21 bp, Homo sapiens
cccatctgcacccccctgggc

SEQ ID NO: 3759190 - DNA, 22 bp, Homo sapiens
cccatctgcacccccctgggct

SEQ ID NO: 3759191 - DNA, 24 bp, Homo sapiens
cccatcttgcctccatggtgcctc

SEQ ID NO: 3759192 - DNA, 12 bp, Homo sapiens
cccatgaagcca

SEQ ID NO: 3759193 - DNA, 19 bp, Homo sapiens
cccatgaccatactgaggg

SEQ ID NO: 3759194 - DNA, 22 bp, Homo sapiens
cccatgagcctcagcatcctgg

SEQ ID NO: 3759195 - DNA, 21 bp, Homo sapiens
cccatgccaaagctagggtgg

SEQ ID NO: 3759196 - DNA, 14 bp, Homo sapiens
cccatgcccacctg

SEQ ID NO: 3759197 - DNA, 20 bp, Homo sapiens
cccatgcctgtccagcctgg

SEQ ID NO: 3759198 - DNA, 20 bp, Homo sapiens
cccatggcatgggggcctca

SEQ ID NO: 3759199 - DNA, 18 bp, Homo sapiens
cccattagaccaagcttg

SEQ ID NO: 3759200 - DNA, 13 bp, Homo sapiens
cccattctgcctg

SEQ ID NO: 3759201 - DNA, 14 bp, Homo sapiens
cccattctgcctgc

SEQ ID NO: 3759202 - DNA, 19 bp, Homo sapiens
cccattctgcctgcccagg

SEQ ID NO: 3759203 - DNA, 21 bp, Homo sapiens
cccattctgcctgcccaggcc

SEQ ID NO: 3759204 - DNA, 12 bp, Homo sapiens
cccattcttcct

SEQ ID NO: 3759205 - DNA, 16 bp, Homo sapiens
cccatttacacttttg

SEQ ID NO: 3759206 - DNA, 19 bp, Homo sapiens
cccatttctatttatttac

SEQ ID NO: 3759207 - DNA, 19 bp, Homo sapiens
cccattttgcaaaatttcc

SEQ ID NO: 3759208 - DNA, 20 bp, Homo sapiens
cccatttttatatcgatctc

SEQ ID NO: 3759209 - DNA, 20 bp, Homo sapiens
ccccaaaaacctcacccgag

SEQ ID NO: 3759210 - DNA, 22 bp, Homo sapiens
ccccaaaaccacagccctgtca

SEQ ID NO: 3759211 - DNA, 23 bp, Homo sapiens
ccccaaaggaagctttctctgct

SEQ ID NO: 3759212 - DNA, 16 bp, Homo sapiens
ccccaacgaaaagcac

SEQ ID NO: 3759213 - DNA, 13 bp, Homo sapiens
ccccaactcctgg

SEQ ID NO: 3759214 - DNA, 18 bp, Homo sapiens
ccccaagaaggctggggc

SEQ ID NO: 3759215 - DNA, 16 bp, Homo sapiens
ccccaagctgttttct

SEQ ID NO: 3759216 - DNA, 15 bp, Homo sapiens
ccccaaggggcagtc

SEQ ID NO: 3759217 - DNA, 17 bp, Homo sapiens
ccccacacctggccctg

SEQ ID NO: 3759218 - DNA, 23 bp, Homo sapiens
ccccacacttgttccagctcttt

SEQ ID NO: 3759219 - DNA, 15 bp, Homo sapiens
ccccaccccttcccc

SEQ ID NO: 3759220 - DNA, 22 bp, Homo sapiens
ccccaccccttccccactgcct

SEQ ID NO: 3759221 - DNA, 21 bp, Homo sapiens
ccccaccttcaattcctgggc

SEQ ID NO: 3759222 - DNA, 23 bp, Homo sapiens
ccccactccctggctctcagaag

SEQ ID NO: 3759223 - DNA, 12 bp, Homo sapiens
ccccactctccc

SEQ ID NO: 3759224 - DNA, 14 bp, Homo sapiens
ccccactgcccttc
